United States Patent 11,926,839 (PLATFORM FOR T LYMPHOCYTE GENOME ENGINEERING AND IN VIVO HIGH-THROUGHPUT SCREENING THEREOF) - sequence listing, part 2

SEQ ID NO: 22373 - RNA, 20 nt, Artificial Sequence
  MKO10022373_A_Gosr2
  gRNA
ccaugccguggugaauguug

SEQ ID NO: 22374 - RNA, 20 nt, Artificial Sequence
  MKO10022374_A_Gosr2
  gRNA
uacugugcccgccuccaaug

SEQ ID NO: 22375 - RNA, 20 nt, Artificial Sequence
  MKO10022375_A_Got1l1
  gRNA
uuccugcagcauaucccggu

SEQ ID NO: 22376 - RNA, 20 nt, Artificial Sequence
  MKO10022376_A_Got1l1
  gRNA
cauucuuucgccacgucuug

SEQ ID NO: 22377 - RNA, 20 nt, Artificial Sequence
  MKO10022377_A_Got1l1
  gRNA
ggacuaugaguacuugcccc

SEQ ID NO: 22378 - RNA, 20 nt, Artificial Sequence
  MKO10022378_A_Got1
  gRNA
acauucggcccuauugcuac

SEQ ID NO: 22379 - RNA, 20 nt, Artificial Sequence
  MKO10022379_A_Got1
  gRNA
ccgaauguccuuaaaaccgg

SEQ ID NO: 22380 - RNA, 20 nt, Artificial Sequence
  MKO10022380_A_Got1
  gRNA
cccuguuggguugugcgcac

SEQ ID NO: 22381 - RNA, 20 nt, Artificial Sequence
  MKO10022381_A_Got2
  gRNA
caagcucaccuuccggacac

SEQ ID NO: 22382 - RNA, 20 nt, Artificial Sequence
  MKO10022382_A_Got2
  gRNA
gugauuuccccaggaugguu

SEQ ID NO: 22383 - RNA, 20 nt, Artificial Sequence
  MKO10022383_A_Got2
  gRNA
cugguggacccauguugaaa

SEQ ID NO: 22384 - RNA, 20 nt, Artificial Sequence
  MKO10022384_A_Gp1ba
  gRNA
caaguuggcacaucguacac

SEQ ID NO: 22385 - RNA, 20 nt, Artificial Sequence
  MKO10022385_A_Gp1ba
  gRNA
uacccaguugguucucgccc

SEQ ID NO: 22386 - RNA, 20 nt, Artificial Sequence
  MKO10022386_A_Gp1ba
  gRNA
ucguuggcaacaagagcccg

SEQ ID NO: 22387 - RNA, 20 nt, Artificial Sequence
  MKO10022387_A_Gp1bb
  gRNA
aacgcguccagaagcccggg

SEQ ID NO: 22388 - RNA, 20 nt, Artificial Sequence
  MKO10022388_A_Gp1bb
  gRNA
gcgcgacacagcgcaggucg

SEQ ID NO: 22389 - RNA, 20 nt, Artificial Sequence
  MKO10022389_A_Gp1bb
  gRNA
ccagaacucacgggagccca

SEQ ID NO: 22390 - RNA, 20 nt, Artificial Sequence
  MKO10022390_A_Gp2
  gRNA
guccaugaccagcccuguug

SEQ ID NO: 22391 - RNA, 20 nt, Artificial Sequence
  MKO10022391_A_Gp2
  gRNA
acaacgauucaucaguugca

SEQ ID NO: 22392 - RNA, 20 nt, Artificial Sequence
  MKO10022392_A_Gp2
  gRNA
gugaugauaaccugcacggc

SEQ ID NO: 22393 - RNA, 20 nt, Artificial Sequence
  MKO10022393_A_Gp49a
  gRNA
ggaggcccaguauuauuauc

SEQ ID NO: 22394 - RNA, 20 nt, Artificial Sequence
  MKO10022394_A_Gp49a
  gRNA
uuuaugacagccucauaugc

SEQ ID NO: 22395 - RNA, 20 nt, Artificial Sequence
  MKO10022395_A_Gp49a
  gRNA
ugcagcucauccacacuauu

SEQ ID NO: 22396 - RNA, 20 nt, Artificial Sequence
  MKO10022396_A_Gp5
  gRNA
acaccuggcgcaggugcccg

SEQ ID NO: 22397 - RNA, 20 nt, Artificial Sequence
  MKO10022397_A_Gp5
  gRNA
aggugucgcugcgccacaac

SEQ ID NO: 22398 - RNA, 20 nt, Artificial Sequence
  MKO10022398_A_Gp5
  gRNA
ucgucuuccacgugcgaucc

SEQ ID NO: 22399 - RNA, 20 nt, Artificial Sequence
  MKO10022399_A_Gp6
  gRNA
gagugacccucuagugcuug

SEQ ID NO: 22400 - RNA, 20 nt, Artificial Sequence
  MKO10022400_A_Gp6
  gRNA
aggcgauauaaauccacauc

SEQ ID NO: 22401 - RNA, 20 nt, Artificial Sequence
  MKO10022401_A_Gp6
  gRNA
cagcuugagcuaauugcuac

SEQ ID NO: 22402 - RNA, 20 nt, Artificial Sequence
  MKO10022402_A_Gp9
  gRNA
cacugaacgcaggcuauugu

SEQ ID NO: 22403 - RNA, 20 nt, Artificial Sequence
  MKO10022403_A_Gp9
  gRNA
gggcgccugguggccaaguc

SEQ ID NO: 22404 - RNA, 20 nt, Artificial Sequence
  MKO10022404_A_Gp9
  gRNA
gccucaccuaccugcgccuc

SEQ ID NO: 22405 - RNA, 20 nt, Artificial Sequence
  MKO10022405_A_Gpa33
  gRNA
guaguaacccgcugucuccg

SEQ ID NO: 22406 - RNA, 20 nt, Artificial Sequence
  MKO10022406_A_Gpa33
  gRNA
cagugacacggagcacucgu

SEQ ID NO: 22407 - RNA, 20 nt, Artificial Sequence
  MKO10022407_A_Gpa33
  gRNA
caagucucgaguccgccucu

SEQ ID NO: 22408 - RNA, 20 nt, Artificial Sequence
  MKO10022408_A_Gpaa1
  gRNA
cccucaauacauagcgcucg

SEQ ID NO: 22409 - RNA, 20 nt, Artificial Sequence
  MKO10022409_A_Gpaa1
  gRNA
gaucgccugguuucuggcgc

SEQ ID NO: 22410 - RNA, 20 nt, Artificial Sequence
  MKO10022410_A_Gpaa1
  gRNA
ucucagacauguaagugcgc

SEQ ID NO: 22411 - RNA, 20 nt, Artificial Sequence
  MKO10022411_A_Gpalpp1
  gRNA
gucgugacgcuauaguuaac

SEQ ID NO: 22412 - RNA, 20 nt, Artificial Sequence
  MKO10022412_A_Gpalpp1
  gRNA
gaacugcagcuucuguaauu

SEQ ID NO: 22413 - RNA, 20 nt, Artificial Sequence
  MKO10022413_A_Gpalpp1
  gRNA
guuggaccaaugccugcaaa

SEQ ID NO: 22414 - RNA, 20 nt, Artificial Sequence
  MKO10022414_A_Gpam
  gRNA
cgucucgcucuugaacaaaa

SEQ ID NO: 22415 - RNA, 20 nt, Artificial Sequence
  MKO10022415_A_Gpam
  gRNA
ucaagagcgagacguccaua

SEQ ID NO: 22416 - RNA, 20 nt, Artificial Sequence
  MKO10022416_A_Gpam
  gRNA
auagcagcaccuucccacga

SEQ ID NO: 22417 - RNA, 20 nt, Artificial Sequence
  MKO10022417_A_Gpank1
  gRNA
cgcugggguaaauucgauga

SEQ ID NO: 22418 - RNA, 20 nt, Artificial Sequence
  MKO10022418_A_Gpank1
  gRNA
uccauaucagucagaacucg

SEQ ID NO: 22419 - RNA, 20 nt, Artificial Sequence
  MKO10022419_A_Gpank1
  gRNA
cuggguuggagucugugacc

SEQ ID NO: 22420 - RNA, 20 nt, Artificial Sequence
  MKO10022420_A_Gpau2
  gRNA
cuggcagcagcggcccauaa

SEQ ID NO: 22421 - RNA, 20 nt, Artificial Sequence
  MKO10022421_A_Gpau2
  gRNA
gggaaaguaucgccccuuua

SEQ ID NO: 22422 - RNA, 20 nt, Artificial Sequence
  MKO10022422_A_Gpau2
  gRNA
cugcaacgugauccuuguga

SEQ ID NO: 22423 - RNA, 20 nt, Artificial Sequence
  MKO10022423_A_Gpauch11
  gRNA
ggcagauccgagaagcccgu

SEQ ID NO: 22424 - RNA, 20 nt, Artificial Sequence
  MKO10022424_A_Gpauch11
  gRNA
accgcuuuaccgaaacuccu

SEQ ID NO: 22425 - RNA, 20 nt, Artificial Sequence
  MKO10022425_A_Gpauch11
  gRNA
gaugcgacugaagaguaagc

SEQ ID NO: 22426 - RNA, 20 nt, Artificial Sequence
  MKO10022426_A_Gpauch1
  gRNA
aaggcgcgccgacagaaacc

SEQ ID NO: 22427 - RNA, 20 nt, Artificial Sequence
  MKO10022427_A_Gpauch1
  gRNA
ucaucaagcagcguggcgcc

SEQ ID NO: 22428 - RNA, 20 nt, Artificial Sequence
  MKO10022428_A_Gpauch1
  gRNA
cgcgccuuucucuucacccg

SEQ ID NO: 22429 - RNA, 20 nt, Artificial Sequence
  MKO10022429_A_Gpauch2l
  gRNA
gccauaccaucagugacccc

SEQ ID NO: 22430 - RNA, 20 nt, Artificial Sequence
  MKO10022430_A_Gpauch2l
  gRNA
accaaugaugaaggacgaca

SEQ ID NO: 22431 - RNA, 20 nt, Artificial Sequence
  MKO10022431_A_Gpauch2l
  gRNA
ggccgauccucuccgucccc

SEQ ID NO: 22432 - RNA, 20 nt, Artificial Sequence
  MKO10022432_A_Gpauch2
  gRNA
aaccuaagcagcagcguucg

SEQ ID NO: 22433 - RNA, 20 nt, Artificial Sequence
  MKO10022433_A_Gpauch2
  gRNA
uaggcauuucagucgaacaa

SEQ ID NO: 22434 - RNA, 20 nt, Artificial Sequence
  MKO10022434_A_Gpauch2
  gRNA
gcuagacucagucgccuuca

SEQ ID NO: 22435 - RNA, 20 nt, Artificial Sequence
  MKO10022435_A_Gpauch3
  gRNA
gcgacacgaagcucugcacg

SEQ ID NO: 22436 - RNA, 20 nt, Artificial Sequence
  MKO10022436_A_Gpauch3
  gRNA
cacguugccauagcgccggg

SEQ ID NO: 22437 - RNA, 20 nt, Artificial Sequence
  MKO10022437_A_Gpauch3
  gRNA
gucuccguuccaggcgcauu

SEQ ID NO: 22438 - RNA, 20 nt, Artificial Sequence
  MKO10022438_A_Gpauch4
  gRNA
cuccucacccgagguuagug

SEQ ID NO: 22439 - RNA, 20 nt, Artificial Sequence
  MKO10022439_A_Gpauch4
  gRNA
uuuggggugacugcgcuggg

SEQ ID NO: 22440 - RNA, 20 nt, Artificial Sequence
  MKO10022440_A_Gpauch4
  gRNA
caacaagacugccgccagcu

SEQ ID NO: 22441 - RNA, 20 nt, Artificial Sequence
  MKO10022441_A_Gpauch8
  gRNA
acaucauacuugacaacgau

SEQ ID NO: 22442 - RNA, 20 nt, Artificial Sequence
  MKO10022442_A_Gpauch8
  gRNA
ugucaagcuggauuaugccg

SEQ ID NO: 22443 - RNA, 20 nt, Artificial Sequence
  MKO10022443_A_Gpauch8
  gRNA
ggucaucuuaccgauucuau

SEQ ID NO: 22444 - RNA, 20 nt, Artificial Sequence
  MKO10022444_A_Gpbar1
  gRNA
uaguggugggcgacgcucau

SEQ ID NO: 22445 - RNA, 20 nt, Artificial Sequence
  MKO10022445_A_Gpbar1
  gRNA
gcugugugagauccgccgac

SEQ ID NO: 22446 - RNA, 20 nt, Artificial Sequence
  MKO10022446_A_Gpbar1
  gRNA
ggcugcgcaaguggcggucc

SEQ ID NO: 22447 - RNA, 20 nt, Artificial Sequence
  MKO10022447_A_Gpbp1l1
  gRNA
ucaccucccguaguccguag

SEQ ID NO: 22448 - RNA, 20 nt, Artificial Sequence
  MKO10022448_A_Gpbp1l1
  gRNA
gcaacucauaccuuagaggg

SEQ ID NO: 22449 - RNA, 20 nt, Artificial Sequence
  MKO10022449_A_Gpbp1l1
  gRNA
gccugcaccaccucccucua

SEQ ID NO: 22450 - RNA, 20 nt, Artificial Sequence
  MKO10022450_A_Gpbp1
  gRNA
ucugguauuggacguccuaa

SEQ ID NO: 22451 - RNA, 20 nt, Artificial Sequence
  MKO10022451_A_Gpbp1
  gRNA
cgacgacacaauucuucaga

SEQ ID NO: 22452 - RNA, 20 nt, Artificial Sequence
  MKO10022452_A_Gpbp1
  gRNA
aaaaauggauggcguacgca

SEQ ID NO: 22453 - RNA, 20 nt, Artificial Sequence
  MKO10022453_A_Gpc1
  gRNA
augacacucuccgcacccga

SEQ ID NO: 22454 - RNA, 20 nt, Artificial Sequence
  MKO10022454_A_Gpc1
  gRNA
cacgaguguucugcguauac

SEQ ID NO: 22455 - RNA, 20 nt, Artificial Sequence
  MKO10022455_A_Gpc1
  gRNA
gcccgcaggcgcaguucucg

SEQ ID NO: 22456 - RNA, 20 nt, Artificial Sequence
  MKO10022456_A_Gpc2
  gRNA
cggcggggugagucuccgaa

SEQ ID NO: 22457 - RNA, 20 nt, Artificial Sequence
  MKO10022457_A_Gpc2
  gRNA
gccugaauggggcggauauc

SEQ ID NO: 22458 - RNA, 20 nt, Artificial Sequence
  MKO10022458_A_Gpc2
  gRNA
acuucucauaguagucccgc

SEQ ID NO: 22459 - RNA, 20 nt, Artificial Sequence
  MKO10022459_A_Gpc3
  gRNA
gccguaugcucacccgaaug

SEQ ID NO: 22460 - RNA, 20 nt, Artificial Sequence
  MKO10022460_A_Gpc3
  gRNA
cagaucuauauuggcguugc

SEQ ID NO: 22461 - RNA, 20 nt, Artificial Sequence
  MKO10022461_A_Gpc3
  gRNA
gacaucaacgagugccuccg

SEQ ID NO: 22462 - RNA, 20 nt, Artificial Sequence
  MKO10022462_A_Gpc4
  gRNA
ggcgaaacaugcgcuccaga

SEQ ID NO: 22463 - RNA, 20 nt, Artificial Sequence
  MKO10022463_A_Gpc4
  gRNA
ucuggagcgcauguuucgcc

SEQ ID NO: 22464 - RNA, 20 nt, Artificial Sequence
  MKO10022464_A_Gpc4
  gRNA
uauugcucaaacaucaugcg

SEQ ID NO: 22465 - RNA, 20 nt, Artificial Sequence
  MKO10022465_A_Gpc5
  gRNA
aaucuugccgagcugcaauc

SEQ ID NO: 22466 - RNA, 20 nt, Artificial Sequence
  MKO10022466_A_Gpc5
  gRNA
gagcacguguucaacgucgu

SEQ ID NO: 22467 - RNA, 20 nt, Artificial Sequence
  MKO10022467_A_Gpc5
  gRNA
auucuugcaggcgcuuaauc

SEQ ID NO: 22468 - RNA, 20 nt, Artificial Sequence
  MKO10022468_A_Gpc6
  gRNA
ccgucaggcuuacggugcca

SEQ ID NO: 22469 - RNA, 20 nt, Artificial Sequence
  MKO10022469_A_Gpc6
  gRNA
ccgagccuucacguccgccg

SEQ ID NO: 22470 - RNA, 20 nt, Artificial Sequence
  MKO10022470_A_Gpc6
  gRNA
aaaggugcgagccgcgauga

SEQ ID NO: 22471 - RNA, 20 nt, Artificial Sequence
  MKO10022471_A_Gpcpd1
  gRNA
gugaaguaccgcuacuucag

SEQ ID NO: 22472 - RNA, 20 nt, Artificial Sequence
  MKO10022472_A_Gpcpd1
  gRNA
ccuaaagggguuauugaucg

SEQ ID NO: 22473 - RNA, 20 nt, Artificial Sequence
  MKO10022473_A_Gpcpd1
  gRNA
ccacgaucaauaaccccuuu

SEQ ID NO: 22474 - RNA, 20 nt, Artificial Sequence
  MKO10022474_A_Gpd1l
  gRNA
cguccugcacggcuucgcug

SEQ ID NO: 22475 - RNA, 20 nt, Artificial Sequence
  MKO10022475_A_Gpd1l
  gRNA
ugaucucaucgcagaucuug

SEQ ID NO: 22476 - RNA, 20 nt, Artificial Sequence
  MKO10022476_A_Gpd1l
  gRNA
ggagauuagcuucagcccgu

SEQ ID NO: 22477 - RNA, 20 nt, Artificial Sequence
  MKO10022477_A_Gpd1
  gRNA
ggcccccaucagcacgcuca

SEQ ID NO: 22478 - RNA, 20 nt, Artificial Sequence
  MKO10022478_A_Gpd1
  gRNA
ugcauugcuacccacgaucu

SEQ ID NO: 22479 - RNA, 20 nt, Artificial Sequence
  MKO10022479_A_Gpd1
  gRNA
gugguaccccaucaguucau

SEQ ID NO: 22480 - RNA, 20 nt, Artificial Sequence
  MKO10022480_A_Gpd2
  gRNA
cguaccgucauaguagacaa

SEQ ID NO: 22481 - RNA, 20 nt, Artificial Sequence
  MKO10022481_A_Gpd2
  gRNA
aggagcgauuucuaguaagu

SEQ ID NO: 22482 - RNA, 20 nt, Artificial Sequence
  MKO10022482_A_Gpd2
  gRNA
uggugugcgauaccuccaga

SEQ ID NO: 22483 - RNA, 20 nt, Artificial Sequence
  MKO10022483_A_Gper1
  gRNA
cgucacgccuaccccuugac

SEQ ID NO: 22484 - RNA, 20 nt, Artificial Sequence
  MKO10022484_A_Gper1
  gRNA
ugacggccuugagcguggca

SEQ ID NO: 22485 - RNA, 20 nt, Artificial Sequence
  MKO10022485_A_Gper1
  gRNA
ugucguaguacugcucgucc

SEQ ID NO: 22486 - RNA, 20 nt, Artificial Sequence
  MKO10022486_A_Gpha2
  gRNA
ugaucgccucggcacuugcc

SEQ ID NO: 22487 - RNA, 20 nt, Artificial Sequence
  MKO10022487_A_Gpha2
  gRNA
agaucucaagcuccccacgc

SEQ ID NO: 22488 - RNA, 20 nt, Artificial Sequence
  MKO10022488_A_Gpha2
  gRNA
acugcgcaccgucacauuga

SEQ ID NO: 22489 - RNA, 20 nt, Artificial Sequence
  MKO10022489_A_Gphb5
  gRNA
guauguacacacucgaugau

SEQ ID NO: 22490 - RNA, 20 nt, Artificial Sequence
  MKO10022490_A_Gphb5
  gRNA
aacacgccccacagucacau

SEQ ID NO: 22491 - RNA, 20 nt, Artificial Sequence
  MKO10022491_A_Gphb5
  gRNA
aaguugguauaccuuguccu

SEQ ID NO: 22492 - RNA, 20 nt, Artificial Sequence
  MKO10022492_A_Gphn
  gRNA
cacgaccaucaaauccgugu

SEQ ID NO: 22493 - RNA, 20 nt, Artificial Sequence
  MKO10022493_A_Gphn
  gRNA
cagguugggugggacuauau

SEQ ID NO: 22494 - RNA, 20 nt, Artificial Sequence
  MKO10022494_A_Gphn
  gRNA
gcugggaaacauggcgaccg

SEQ ID NO: 22495 - RNA, 20 nt, Artificial Sequence
  MKO10022495_A_Gpi1
  gRNA
cugugacagcggguccggag

SEQ ID NO: 22496 - RNA, 20 nt, Artificial Sequence
  MKO10022496_A_Gpi1
  gRNA
acccuuuccagucaccacuc

SEQ ID NO: 22497 - RNA, 20 nt, Artificial Sequence
  MKO10022497_A_Gpi1
  gRNA
uaccucgguguaguugaucu

SEQ ID NO: 22498 - RNA, 20 nt, Artificial Sequence
  MKO10022498_A_Gpihbp1
  gRNA
gaugcucaccgguuccgcug

SEQ ID NO: 22499 - RNA, 20 nt, Artificial Sequence
  MKO10022499_A_Gpihbp1
  gRNA
uggcaaguuuagccaccccc

SEQ ID NO: 22500 - RNA, 20 nt, Artificial Sequence
  MKO10022500_A_Gpihbp1
  gRNA
aaguuagccccaucgcucug

SEQ ID NO: 22501 - RNA, 20 nt, Artificial Sequence
  MKO10022501_A_Gpkow
  gRNA
cuaccggggccucuauggca

SEQ ID NO: 22502 - RNA, 20 nt, Artificial Sequence
  MKO10022502_A_Gpkow
  gRNA
agccccgagucaacucuaua

SEQ ID NO: 22503 - RNA, 20 nt, Artificial Sequence
  MKO10022503_A_Gpkow
  gRNA
gccggaggaagccgacuaug

SEQ ID NO: 22504 - RNA, 20 nt, Artificial Sequence
  MKO10022504_A_Gpld1
  gRNA
agcucacgucagcgaccaug

SEQ ID NO: 22505 - RNA, 20 nt, Artificial Sequence
  MKO10022505_A_Gpld1
  gRNA
ugacgugagcuggcauagcc

SEQ ID NO: 22506 - RNA, 20 nt, Artificial Sequence
  MKO10022506_A_Gpld1
  gRNA
ucccagccugauaugcgucc

SEQ ID NO: 22507 - RNA, 20 nt, Artificial Sequence
  MKO10022507_A_Gpm6a
  gRNA
cugccggaacaccacucuag

SEQ ID NO: 22508 - RNA, 20 nt, Artificial Sequence
  MKO10022508_A_Gpm6a
  gRNA
ugcuuggaucugcgucaguu

SEQ ID NO: 22509 - RNA, 20 nt, Artificial Sequence
  MKO10022509_A_Gpm6a
  gRNA
aagcauagggaauaccuccc

SEQ ID NO: 22510 - RNA, 20 nt, Artificial Sequence
  MKO10022510_A_Gpm6b
  gRNA
gaacaucugcaacacgaaug

SEQ ID NO: 22511 - RNA, 20 nt, Artificial Sequence
  MKO10022511_A_Gpm6b
  gRNA
acagaucugcuccacacccg

SEQ ID NO: 22512 - RNA, 20 nt, Artificial Sequence
  MKO10022512_A_Gpm6b
  gRNA
cugaugcaguauguuaucua

SEQ ID NO: 22513 - RNA, 20 nt, Artificial Sequence
  MKO10022513_A_Gpn1
  gRNA
uccagguugauuacauacgg

SEQ ID NO: 22514 - RNA, 20 nt, Artificial Sequence
  MKO10022514_A_Gpn1
  gRNA
gaggucacuauaccuccguu

SEQ ID NO: 22515 - RNA, 20 nt, Artificial Sequence
  MKO10022515_A_Gpn1
  gRNA
caggcacucaccaauauugg

SEQ ID NO: 22516 - RNA, 20 nt, Artificial Sequence
  MKO10022516_A_Gpn2
  gRNA
agccaugauguccgcugcaa

SEQ ID NO: 22517 - RNA, 20 nt, Artificial Sequence
  MKO10022517_A_Gpn2
  gRNA
ccacagccuguaagacucgc

SEQ ID NO: 22518 - RNA, 20 nt, Artificial Sequence
  MKO10022518_A_Gpn2
  gRNA
cguguaguaguccagguuga

SEQ ID NO: 22519 - RNA, 20 nt, Artificial Sequence
  MKO10022519_A_Gpn3
  gRNA
aaucguccucgacguggccc

SEQ ID NO: 22520 - RNA, 20 nt, Artificial Sequence
  MKO10022520_A_Gpn3
  gRNA
uaguugaaguguucugccgc

SEQ ID NO: 22521 - RNA, 20 nt, Artificial Sequence
  MKO10022521_A_Gpn3
  gRNA
agcccucaaccgaucugucc

SEQ ID NO: 22522 - RNA, 20 nt, Artificial Sequence
  MKO10022522_A_Gpnmb
  gRNA
ccgaagaccagccacguaau

SEQ ID NO: 22523 - RNA, 20 nt, Artificial Sequence
  MKO10022523_A_Gpnmb
  gRNA
ggcauacauucccaucucga

SEQ ID NO: 22524 - RNA, 20 nt, Artificial Sequence
  MKO10022524_A_Gpnmb
  gRNA
agagagcacaaccaauuacg

SEQ ID NO: 22525 - RNA, 20 nt, Artificial Sequence
  MKO10022525_A_Gpr101
  gRNA
gcuggugcuguuucgacgac

SEQ ID NO: 22526 - RNA, 20 nt, Artificial Sequence
  MKO10022526_A_Gpr101
  gRNA
uaccacacugacaaccguau

SEQ ID NO: 22527 - RNA, 20 nt, Artificial Sequence
  MKO10022527_A_Gpr101
  gRNA
uguggguggauaucgauacc

SEQ ID NO: 22528 - RNA, 20 nt, Artificial Sequence
  MKO10022528_A_Gpr107
  gRNA
cccucagaucggauucaguc

SEQ ID NO: 22529 - RNA, 20 nt, Artificial Sequence
  MKO10022529_A_Gpr107
  gRNA
ccucucugugaacgagccug

SEQ ID NO: 22530 - RNA, 20 nt, Artificial Sequence
  MKO10022530_A_Gpr107
  gRNA
guucuucaaggauggguaca

SEQ ID NO: 22531 - RNA, 20 nt, Artificial Sequence
  MKO10022531_A_Gpr108
  gRNA
uggcaguguccgcuccuacu

SEQ ID NO: 22532 - RNA, 20 nt, Artificial Sequence
  MKO10022532_A_Gpr108
  gRNA
aggguccaaguccgaaaaua

SEQ ID NO: 22533 - RNA, 20 nt, Artificial Sequence
  MKO10022533_A_Gpr108
  gRNA
cccccgaaaccagacccagc

SEQ ID NO: 22534 - RNA, 20 nt, Artificial Sequence
  MKO10022534_A_Gpr110
  gRNA
ucuccgucgccgaguuuacg

SEQ ID NO: 22535 - RNA, 20 nt, Artificial Sequence
  MKO10022535_A_Gpr110
  gRNA
accuccaguccacgaguaug

SEQ ID NO: 22536 - RNA, 20 nt, Artificial Sequence
  MKO10022536_A_Gpr110
  gRNA
ccacguauagcugucuucgc

SEQ ID NO: 22537 - RNA, 20 nt, Artificial Sequence
  MKO10022537_A_Gpr111
  gRNA
ccgcaauguuagcgaugcac

SEQ ID NO: 22538 - RNA, 20 nt, Artificial Sequence
  MKO10022538_A_Gpr111
  gRNA
aaaaggcuaccuccggcccg

SEQ ID NO: 22539 - RNA, 20 nt, Artificial Sequence
  MKO10022539_A_Gpr111
  gRNA
cgccaacguaccaugugguc

SEQ ID NO: 22540 - RNA, 20 nt, Artificial Sequence
  MKO10022540_A_Gpr113
  gRNA
ucgcccgcaugucccgucau

SEQ ID NO: 22541 - RNA, 20 nt, Artificial Sequence
  MKO10022541_A_Gpr113
  gRNA
gagugucgugcuaaccacag

SEQ ID NO: 22542 - RNA, 20 nt, Artificial Sequence
  MKO10022542_A_Gpr113
  gRNA
cuucccccgaaaacgcuuac

SEQ ID NO: 22543 - RNA, 20 nt, Artificial Sequence
  MKO10022543_A_Gpr114
  gRNA
caaguugugcccgccgaagc

SEQ ID NO: 22544 - RNA, 20 nt, Artificial Sequence
  MKO10022544_A_Gpr114
  gRNA
uagaagaaaagggcgccgug

SEQ ID NO: 22545 - RNA, 20 nt, Artificial Sequence
  MKO10022545_A_Gpr114
  gRNA
aagcgccuugagcagcccgu

SEQ ID NO: 22546 - RNA, 20 nt, Artificial Sequence
  MKO10022546_A_Gpr115
  gRNA
caauguucacgaugcacacg

SEQ ID NO: 22547 - RNA, 20 nt, Artificial Sequence
  MKO10022547_A_Gpr115
  gRNA
uggguguccccuugugaucg

SEQ ID NO: 22548 - RNA, 20 nt, Artificial Sequence
  MKO10022548_A_Gpr115
  gRNA
aauccaaaaguacugccccg

SEQ ID NO: 22549 - RNA, 20 nt, Artificial Sequence
  MKO10022549_A_Gpr116
  gRNA
agcugcagcgggugaucgcg

SEQ ID NO: 22550 - RNA, 20 nt, Artificial Sequence
  MKO10022550_A_Gpr116
  gRNA
agacaacugcaguagccgcc

SEQ ID NO: 22551 - RNA, 20 nt, Artificial Sequence
  MKO10022551_A_Gpr116
  gRNA
ccccggcuagcucauguucu

SEQ ID NO: 22552 - RNA, 20 nt, Artificial Sequence
  MKO10022552_A_Gpr119
  gRNA
gggccgauaagcuccggcca

SEQ ID NO: 22553 - RNA, 20 nt, Artificial Sequence
  MKO10022553_A_Gpr119
  gRNA
ccggagcuuaucggccccca

SEQ ID NO: 22554 - RNA, 20 nt, Artificial Sequence
  MKO10022554_A_Gpr119
  gRNA
ggcugauaccuugauuggcg

SEQ ID NO: 22555 - RNA, 20 nt, Artificial Sequence
  MKO10022555_A_Gpr123
  gRNA
gccggccuuuccggcuuauc

SEQ ID NO: 22556 - RNA, 20 nt, Artificial Sequence
  MKO10022556_A_Gpr123
  gRNA
acagugccauccggauaagc

SEQ ID NO: 22557 - RNA, 20 nt, Artificial Sequence
  MKO10022557_A_Gpr123
  gRNA
gcggugcaggcauacaccac

SEQ ID NO: 22558 - RNA, 20 nt, Artificial Sequence
  MKO10022558_A_Gpr124
  gRNA
gagacagccaauccgauugu

SEQ ID NO: 22559 - RNA, 20 nt, Artificial Sequence
  MKO10022559_A_Gpr124
  gRNA
gucccaagaaggauccauug

SEQ ID NO: 22560 - RNA, 20 nt, Artificial Sequence
  MKO10022560_A_Gpr124
  gRNA
aucuacucuagucugcaacc

SEQ ID NO: 22561 - RNA, 20 nt, Artificial Sequence
  MKO10022561_A_Gpr125
  gRNA
gaccugacgaacaaccgaau

SEQ ID NO: 22562 - RNA, 20 nt, Artificial Sequence
  MKO10022562_A_Gpr125
  gRNA
uccggaacaaccuuauuagu

SEQ ID NO: 22563 - RNA, 20 nt, Artificial Sequence
  MKO10022563_A_Gpr125
  gRNA
cuggggcuauccuacuaaua

SEQ ID NO: 22564 - RNA, 20 nt, Artificial Sequence
  MKO10022564_A_Gpr126
  gRNA
accaucagugcugucguacc

SEQ ID NO: 22565 - RNA, 20 nt, Artificial Sequence
  MKO10022565_A_Gpr126
  gRNA
cguaaagguaccggaaggau

SEQ ID NO: 22566 - RNA, 20 nt, Artificial Sequence
  MKO10022566_A_Gpr126
  gRNA
gaacaaugcguuaccuguga

SEQ ID NO: 22567 - RNA, 20 nt, Artificial Sequence
  MKO10022567_A_Gpr128
  gRNA
gccaaaggugaauucaccgu

SEQ ID NO: 22568 - RNA, 20 nt, Artificial Sequence
  MKO10022568_A_Gpr128
  gRNA
aaagggcugcguuguacaau

SEQ ID NO: 22569 - RNA, 20 nt, Artificial Sequence
  MKO10022569_A_Gpr128
  gRNA
uucugugaaaauaguaccga

SEQ ID NO: 22570 - RNA, 20 nt, Artificial Sequence
  MKO10022570_A_Gpr12
  gRNA
ucagggcguaauauagcgag

SEQ ID NO: 22571 - RNA, 20 nt, Artificial Sequence
  MKO10022571_A_Gpr12
  gRNA
guagguguaaucggcgauca

SEQ ID NO: 22572 - RNA, 20 nt, Artificial Sequence
  MKO10022572_A_Gpr12
  gRNA
cccugacguaccacuccgag

SEQ ID NO: 22573 - RNA, 20 nt, Artificial Sequence
  MKO10022573_A_Gpr132
  gRNA
gaccugccacgucuccuacg

SEQ ID NO: 22574 - RNA, 20 nt, Artificial Sequence
  MKO10022574_A_Gpr132
  gRNA
cauuuccugcgaccgcuaca

SEQ ID NO: 22575 - RNA, 20 nt, Artificial Sequence
  MKO10022575_A_Gpr132
  gRNA
gauucucucaccugcugcau

SEQ ID NO: 22576 - RNA, 20 nt, Artificial Sequence
  MKO10022576_A_Gpr133
  gRNA
ggcgugacguuucucuacua

SEQ ID NO: 22577 - RNA, 20 nt, Artificial Sequence
  MKO10022577_A_Gpr133
  gRNA
cuccgcaggcuuugcggucu

SEQ ID NO: 22578 - RNA, 20 nt, Artificial Sequence
  MKO10022578_A_Gpr133
  gRNA
uccaacuugucugcgacugu

SEQ ID NO: 22579 - RNA, 20 nt, Artificial Sequence
  MKO10022579_A_Gpr135
  gRNA
cucgaucuauucgcgccucc

SEQ ID NO: 22580 - RNA, 20 nt, Artificial Sequence
  MKO10022580_A_Gpr135
  gRNA
accgcuacugcgccaucgug

SEQ ID NO: 22581 - RNA, 20 nt, Artificial Sequence
  MKO10022581_A_Gpr135
  gRNA
gcgcagcacgcgcgcguaag

SEQ ID NO: 22582 - RNA, 20 nt, Artificial Sequence
  MKO10022582_A_Gpr137b
  gRNA
cuuugacuccaaguagaugu

SEQ ID NO: 22583 - RNA, 20 nt, Artificial Sequence
  MKO10022583_A_Gpr137b
  gRNA
gacgccggcuacguaguguu

SEQ ID NO: 22584 - RNA, 20 nt, Artificial Sequence
  MKO10022584_A_Gpr137b
  gRNA
ccgagucagaaaucccacga

SEQ ID NO: 22585 - RNA, 20 nt, Artificial Sequence
  MKO10022585_A_Gpr137c
  gRNA
uccguggacuagcauugcac

SEQ ID NO: 22586 - RNA, 20 nt, Artificial Sequence
  MKO10022586_A_Gpr137c
  gRNA
aaaugucuaccucgaaucaa

SEQ ID NO: 22587 - RNA, 20 nt, Artificial Sequence
  MKO10022587_A_Gpr137c
  gRNA
ucugugccagacugucaucg

SEQ ID NO: 22588 - RNA, 20 nt, Artificial Sequence
  MKO10022588_A_Gpr137
  gRNA
cagccgggccuguuacaacc

SEQ ID NO: 22589 - RNA, 20 nt, Artificial Sequence
  MKO10022589_A_Gpr137
  gRNA
guuguaccagucguaaucga

SEQ ID NO: 22590 - RNA, 20 nt, Artificial Sequence
  MKO10022590_A_Gpr137
  gRNA
gcagcaguucccaaacgaag

SEQ ID NO: 22591 - RNA, 20 nt, Artificial Sequence
  MKO10022591_A_Gpr139
  gRNA
cgguccccuuaacgguugac

SEQ ID NO: 22592 - RNA, 20 nt, Artificial Sequence
  MKO10022592_A_Gpr139
  gRNA
uugcggcuuaggcuucgugc

SEQ ID NO: 22593 - RNA, 20 nt, Artificial Sequence
  MKO10022593_A_Gpr139
  gRNA
aagccgagcuauucgcagcg

SEQ ID NO: 22594 - RNA, 20 nt, Artificial Sequence
  MKO10022594_A_Gpr141
  gRNA
guggcgaaacuuccgcacca

SEQ ID NO: 22595 - RNA, 20 nt, Artificial Sequence
  MKO10022595_A_Gpr141
  gRNA
cuaguaucaccacguagaag

SEQ ID NO: 22596 - RNA, 20 nt, Artificial Sequence
  MKO10022596_A_Gpr141
  gRNA
acugacggugccuuuccgcu

SEQ ID NO: 22597 - RNA, 20 nt, Artificial Sequence
  MKO10022597_A_Gpr142
  gRNA
cuacgaagacgaugaucacu

SEQ ID NO: 22598 - RNA, 20 nt, Artificial Sequence
  MKO10022598_A_Gpr142
  gRNA
uacagcaugacaauaauacg

SEQ ID NO: 22599 - RNA, 20 nt, Artificial Sequence
  MKO10022599_A_Gpr142
  gRNA
ccauccacaccaucguaucu

SEQ ID NO: 22600 - RNA, 20 nt, Artificial Sequence
  MKO10022600_A_Gpr143
  gRNA
ugaucaggagaucggcggga

SEQ ID NO: 22601 - RNA, 20 nt, Artificial Sequence
  MKO10022601_A_Gpr143
  gRNA
cauccugcuguaccacauca

SEQ ID NO: 22602 - RNA, 20 nt, Artificial Sequence
  MKO10022602_A_Gpr143
  gRNA
cucauacaggaaucguuauc

SEQ ID NO: 22603 - RNA, 20 nt, Artificial Sequence
  MKO10022603_A_Gpr146
  gRNA
cacgcucgauguaguaguca

SEQ ID NO: 22604 - RNA, 20 nt, Artificial Sequence
  MKO10022604_A_Gpr146
  gRNA
cauguucacgaaguacacgu

SEQ ID NO: 22605 - RNA, 20 nt, Artificial Sequence
  MKO10022605_A_Gpr146
  gRNA
uacaacacccggcacgugug

SEQ ID NO: 22606 - RNA, 20 nt, Artificial Sequence
  MKO10022606_A_Gpr149
  gRNA
gucugaacgaacgccucgcc

SEQ ID NO: 22607 - RNA, 20 nt, Artificial Sequence
  MKO10022607_A_Gpr149
  gRNA
cgcuuccgcuuucgggcucc

SEQ ID NO: 22608 - RNA, 20 nt, Artificial Sequence
  MKO10022608_A_Gpr149
  gRNA
agauucgucuccugcgacuu

SEQ ID NO: 22609 - RNA, 20 nt, Artificial Sequence
  MKO10022609_A_Gpr150
  gRNA
ggcggcgaugcgcguccuag

SEQ ID NO: 22610 - RNA, 20 nt, Artificial Sequence
  MKO10022610_A_Gpr150
  gRNA
gcggcgccggucgcucucuu

SEQ ID NO: 22611 - RNA, 20 nt, Artificial Sequence
  MKO10022611_A_Gpr150
  gRNA
cuccgaccuucguggugcgc

SEQ ID NO: 22612 - RNA, 20 nt, Artificial Sequence
  MKO10022612_A_Gpr151
  gRNA
uuccacaccugcgugacguc

SEQ ID NO: 22613 - RNA, 20 nt, Artificial Sequence
  MKO10022613_A_Gpr151
  gRNA
gccgagaucccaaacgcccu

SEQ ID NO: 22614 - RNA, 20 nt, Artificial Sequence
  MKO10022614_A_Gpr151
  gRNA
ucguacaucgugucuuacau

SEQ ID NO: 22615 - RNA, 20 nt, Artificial Sequence
  MKO10022615_A_Gpr152
  gRNA
cugacucguccccgaaggca

SEQ ID NO: 22616 - RNA, 20 nt, Artificial Sequence
  MKO10022616_A_Gpr152
  gRNA
uggaucagggagcccaccgu

SEQ ID NO: 22617 - RNA, 20 nt, Artificial Sequence
  MKO10022617_A_Gpr152
  gRNA
gcugucugcgaggaacgacc

SEQ ID NO: 22618 - RNA, 20 nt, Artificial Sequence
  MKO10022618_A_Gpr153
  gRNA
gucgggcaguagcgagaccg

SEQ ID NO: 22619 - RNA, 20 nt, Artificial Sequence
  MKO10022619_A_Gpr153
  gRNA
cacgcugcacucggacucgc

SEQ ID NO: 22620 - RNA, 20 nt, Artificial Sequence
  MKO10022620_A_Gpr153
  gRNA
auugucagaaucuucgucgu

SEQ ID NO: 22621 - RNA, 20 nt, Artificial Sequence
  MKO10022621_A_Gpr155
  gRNA
accauauagaaacgcauagu

SEQ ID NO: 22622 - RNA, 20 nt, Artificial Sequence
  MKO10022622_A_Gpr155
  gRNA
agcgaacuuacucaucgcuc

SEQ ID NO: 22623 - RNA, 20 nt, Artificial Sequence
  MKO10022623_A_Gpr155
  gRNA
cuuaugaugcuaaaccccau

SEQ ID NO: 22624 - RNA, 20 nt, Artificial Sequence
  MKO10022624_A_Gpr156
  gRNA
aggcggcuguacuacugugc

SEQ ID NO: 22625 - RNA, 20 nt, Artificial Sequence
  MKO10022625_A_Gpr156
  gRNA
cgacuguccuugcugugcau

SEQ ID NO: 22626 - RNA, 20 nt, Artificial Sequence
  MKO10022626_A_Gpr156
  gRNA
auguaauccugcuugugaca

SEQ ID NO: 22627 - RNA, 20 nt, Artificial Sequence
  MKO10022627_A_Gpr157
  gRNA
uggagggcccgcgcguaguu

SEQ ID NO: 22628 - RNA, 20 nt, Artificial Sequence
  MKO10022628_A_Gpr157
  gRNA
agcaucguccgaacuacgcg

SEQ ID NO: 22629 - RNA, 20 nt, Artificial Sequence
  MKO10022629_A_Gpr157
  gRNA
cuucagcuggggugucccgu

SEQ ID NO: 22630 - RNA, 20 nt, Artificial Sequence
  MKO10022630_A_Gpr158
  gRNA
auugaccaauguucgaguga

SEQ ID NO: 22631 - RNA, 20 nt, Artificial Sequence
  MKO10022631_A_Gpr158
  gRNA
aagagauaauagcgagccgc

SEQ ID NO: 22632 - RNA, 20 nt, Artificial Sequence
  MKO10022632_A_Gpr158
  gRNA
accagccaucacucgaacau

SEQ ID NO: 22633 - RNA, 20 nt, Artificial Sequence
  MKO10022633_A_Gpr15
  gRNA
ccuuagccaagagauuacga

SEQ ID NO: 22634 - RNA, 20 nt, Artificial Sequence
  MKO10022634_A_Gpr15
  gRNA
uguuaugcuuucccgacugc

SEQ ID NO: 22635 - RNA, 20 nt, Artificial Sequence
  MKO10022635_A_Gpr15
  gRNA
aucggacagucaccucacua

SEQ ID NO: 22636 - RNA, 20 nt, Artificial Sequence
  MKO10022636_A_Gpr160
  gRNA
acguucauuucuauguacgc

SEQ ID NO: 22637 - RNA, 20 nt, Artificial Sequence
  MKO10022637_A_Gpr160
  gRNA
ggucaaccaaaacguaagca

SEQ ID NO: 22638 - RNA, 20 nt, Artificial Sequence
  MKO10022638_A_Gpr160
  gRNA
acauagaaaugaacgucccc

SEQ ID NO: 22639 - RNA, 20 nt, Artificial Sequence
  MKO10022639_A_Gpr161
  gRNA
cgccgaaaauccauucccuc

SEQ ID NO: 22640 - RNA, 20 nt, Artificial Sequence
  MKO10022640_A_Gpr161
  gRNA
ugauggcucucgucuacauc

SEQ ID NO: 22641 - RNA, 20 nt, Artificial Sequence
  MKO10022641_A_Gpr161
  gRNA
aucuucaugggguacaccau

SEQ ID NO: 22642 - RNA, 20 nt, Artificial Sequence
  MKO10022642_A_Gpr162
  gRNA
aguccaacggcucggcuauc

SEQ ID NO: 22643 - RNA, 20 nt, Artificial Sequence
  MKO10022643_A_Gpr162
  gRNA
ucuccggauagccgagccgu

SEQ ID NO: 22644 - RNA, 20 nt, Artificial Sequence
  MKO10022644_A_Gpr162
  gRNA
guguguggcgaucauguccg

SEQ ID NO: 22645 - RNA, 20 nt, Artificial Sequence
  MKO10022645_A_Gpr165
  gRNA
ggucccccgaguuugacaug

SEQ ID NO: 22646 - RNA, 20 nt, Artificial Sequence
  MKO10022646_A_Gpr165
  gRNA
uagauaaaaucagccgccuc

SEQ ID NO: 22647 - RNA, 20 nt, Artificial Sequence
  MKO10022647_A_Gpr165
  gRNA
agcuucugguaaacggcaug

SEQ ID NO: 22648 - RNA, 20 nt, Artificial Sequence
  MKO10022648_A_Gpr171
  gRNA
uuuaggugaggcgaaagucu

SEQ ID NO: 22649 - RNA, 20 nt, Artificial Sequence
  MKO10022649_A_Gpr171
  gRNA
gcugaucauggugccgaaca

SEQ ID NO: 22650 - RNA, 20 nt, Artificial Sequence
  MKO10022650_A_Gpr171
  gRNA
uguaugggauccugacagcg

SEQ ID NO: 22651 - RNA, 20 nt, Artificial Sequence
  MKO10022651_A_Gpr173
  gRNA
cguccaugcccaguagccgc

SEQ ID NO: 22652 - RNA, 20 nt, Artificial Sequence
  MKO10022652_A_Gpr173
  gRNA
caccuacaaguuuauccgag

SEQ ID NO: 22653 - RNA, 20 nt, Artificial Sequence
  MKO10022653_A_Gpr173
  gRNA
caucagcgucacccgcuaca

SEQ ID NO: 22654 - RNA, 20 nt, Artificial Sequence
  MKO10022654_A_Gpr174
  gRNA
caccucuccgauaguuauca

SEQ ID NO: 22655 - RNA, 20 nt, Artificial Sequence
  MKO10022655_A_Gpr174
  gRNA
gccagauuaacauuccugau

SEQ ID NO: 22656 - RNA, 20 nt, Artificial Sequence
  MKO10022656_A_Gpr174
  gRNA
gcaucagugugcgaagauuu

SEQ ID NO: 22657 - RNA, 20 nt, Artificial Sequence
  MKO10022657_A_Gpr176
  gRNA
ggcgccaaccucagcgcguu

SEQ ID NO: 22658 - RNA, 20 nt, Artificial Sequence
  MKO10022658_A_Gpr176
  gRNA
ccgguacagucgccgcaaug

SEQ ID NO: 22659 - RNA, 20 nt, Artificial Sequence
  MKO10022659_A_Gpr176
  gRNA
cagccacccgcgcaacacgu

SEQ ID NO: 22660 - RNA, 20 nt, Artificial Sequence
  MKO10022660_A_Gpr179
  gRNA
cuaccguugccgagggagca

SEQ ID NO: 22661 - RNA, 20 nt, Artificial Sequence
  MKO10022661_A_Gpr179
  gRNA
uaacagaggauccgggcauc

SEQ ID NO: 22662 - RNA, 20 nt, Artificial Sequence
  MKO10022662_A_Gpr179
  gRNA
gguaggccaccagcauacuc

SEQ ID NO: 22663 - RNA, 20 nt, Artificial Sequence
  MKO10022663_A_Gpr17
  gRNA
gaucauucgcagccugcgcc

SEQ ID NO: 22664 - RNA, 20 nt, Artificial Sequence
  MKO10022664_A_Gpr17
  gRNA
gucuaugugcuucacuaccg

SEQ ID NO: 22665 - RNA, 20 nt, Artificial Sequence
  MKO10022665_A_Gpr17
  gRNA
agccguccgcaugauugcua

SEQ ID NO: 22666 - RNA, 20 nt, Artificial Sequence
  MKO10022666_A_Gpr180
  gRNA
augccgacaaguucaccugc

SEQ ID NO: 22667 - RNA, 20 nt, Artificial Sequence
  MKO10022667_A_Gpr180
  gRNA
gcuccucaacccggacgccg

SEQ ID NO: 22668 - RNA, 20 nt, Artificial Sequence
  MKO10022668_A_Gpr180
  gRNA
cagaaucaacaacguagcag

SEQ ID NO: 22669 - RNA, 20 nt, Artificial Sequence
  MKO10022669_A_Gpr182
  gRNA
acgccugaacguuucggaug

SEQ ID NO: 22670 - RNA, 20 nt, Artificial Sequence
  MKO10022670_A_Gpr182
  gRNA
ccaccccauccgaaacguuc

SEQ ID NO: 22671 - RNA, 20 nt, Artificial Sequence
  MKO10022671_A_Gpr182
  gRNA
ugacguagcggucaaugcug

SEQ ID NO: 22672 - RNA, 20 nt, Artificial Sequence
  MKO10022672_A_Gpr183
  gRNA
ugucgaucuccagcgcagug

SEQ ID NO: 22673 - RNA, 20 nt, Artificial Sequence
  MKO10022673_A_Gpr183
  gRNA
auuucccgcgaauucucuuc

SEQ ID NO: 22674 - RNA, 20 nt, Artificial Sequence
  MKO10022674_A_Gpr183
  gRNA
aagggacagcgucccugccg

SEQ ID NO: 22675 - RNA, 20 nt, Artificial Sequence
  MKO10022675_A_Gpr18
  gRNA
ucgcagaaaaaguguccgau

SEQ ID NO: 22676 - RNA, 20 nt, Artificial Sequence
  MKO10022676_A_Gpr18
  gRNA
gugaccguaaacugcccgau

SEQ ID NO: 22677 - RNA, 20 nt, Artificial Sequence
  MKO10022677_A_Gpr18
  gRNA
ugacgcugaugacucgagcc

SEQ ID NO: 22678 - RNA, 20 nt, Artificial Sequence
  MKO10022678_A_Gpr19
  gRNA
ggauaacgaccagccgccug

SEQ ID NO: 22679 - RNA, 20 nt, Artificial Sequence
  MKO10022679_A_Gpr19
  gRNA
gugaacugcagcacgacaaa

SEQ ID NO: 22680 - RNA, 20 nt, Artificial Sequence
  MKO10022680_A_Gpr19
  gRNA
gaaggccgcguccaagaucc

SEQ ID NO: 22681 - RNA, 20 nt, Artificial Sequence
  MKO10022681_A_Gpr1
  gRNA
agguacuaaagcguucgcug

SEQ ID NO: 22682 - RNA, 20 nt, Artificial Sequence
  MKO10022682_A_Gpr1
  gRNA
gcaaguggauguagcggucc

SEQ ID NO: 22683 - RNA, 20 nt, Artificial Sequence
  MKO10022683_A_Gpr1
  gRNA
agacguuccaagcccgcuuc

SEQ ID NO: 22684 - RNA, 20 nt, Artificial Sequence
  MKO10022684_A_Gpr20
  gRNA
gcuugaauucuucuccacgc

SEQ ID NO: 22685 - RNA, 20 nt, Artificial Sequence
  MKO10022685_A_Gpr20
  gRNA
cgaggccucuucuaccagcg

SEQ ID NO: 22686 - RNA, 20 nt, Artificial Sequence
  MKO10022686_A_Gpr20
  gRNA
aguacugccgccuacggcuc

SEQ ID NO: 22687 - RNA, 20 nt, Artificial Sequence
  MKO10022687_A_Gpr21
  gRNA
cuacuacccucuuccgauug

SEQ ID NO: 22688 - RNA, 20 nt, Artificial Sequence
  MKO10022688_A_Gpr21
  gRNA
ccuuacacaguuaggugcaa

SEQ ID NO: 22689 - RNA, 20 nt, Artificial Sequence
  MKO10022689_A_Gpr21
  gRNA
uccagauaagcgcuaugcca

SEQ ID NO: 22690 - RNA, 20 nt, Artificial Sequence
  MKO10022690_A_Gpr22
  gRNA
ggcguuucacggcucgccgg

SEQ ID NO: 22691 - RNA, 20 nt, Artificial Sequence
  MKO10022691_A_Gpr22
  gRNA
gccaccgggaacgacgagaa

SEQ ID NO: 22692 - RNA, 20 nt, Artificial Sequence
  MKO10022692_A_Gpr22
  gRNA
aacuaccauggugagcccaa

SEQ ID NO: 22693 - RNA, 20 nt, Artificial Sequence
  MKO10022693_A_Gpr25
  gRNA
cccuaccgacgcgcggcagg

SEQ ID NO: 22694 - RNA, 20 nt, Artificial Sequence
  MKO10022694_A_Gpr25
  gRNA
cgcggaaugagcgguccaac

SEQ ID NO: 22695 - RNA, 20 nt, Artificial Sequence
  MKO10022695_A_Gpr25
  gRNA
cgucaauagcagugcgaacc

SEQ ID NO: 22696 - RNA, 20 nt, Artificial Sequence
  MKO10022696_A_Gpr26
  gRNA
ugcugcgacaccaauaccgc

SEQ ID NO: 22697 - RNA, 20 nt, Artificial Sequence
  MKO10022697_A_Gpr26
  gRNA
ucgcagcaaggaauacacga

SEQ ID NO: 22698 - RNA, 20 nt, Artificial Sequence
  MKO10022698_A_Gpr26
  gRNA
cugccguugugccacgacgc

SEQ ID NO: 22699 - RNA, 20 nt, Artificial Sequence
  MKO10022699_A_Gpr27
  gRNA
cuggccgugcgccgcgaugc

SEQ ID NO: 22700 - RNA, 20 nt, Artificial Sequence
  MKO10022700_A_Gpr27
  gRNA
cacaccagcaucgcggcgca

SEQ ID NO: 22701 - RNA, 20 nt, Artificial Sequence
  MKO10022701_A_Gpr27
  gRNA
ggccaguuaccugcgcgucc

SEQ ID NO: 22702 - RNA, 20 nt, Artificial Sequence
  MKO10022702_A_Gpr31b
  gRNA
ucuucuggaggguccugaug

SEQ ID NO: 22703 - RNA, 20 nt, Artificial Sequence
  MKO10022703_A_Gpr31b
  gRNA
cugcucagcugccagcacug

SEQ ID NO: 22704 - RNA, 20 nt, Artificial Sequence
  MKO10022704_A_Gpr31b
  gRNA
aucaggaauaggagucccug

SEQ ID NO: 22705 - RNA, 20 nt, Artificial Sequence
  MKO10022705_A_Gpr33
  gRNA
cccggauugccuugcaaauc

SEQ ID NO: 22706 - RNA, 20 nt, Artificial Sequence
  MKO10022706_A_Gpr33
  gRNA
caccgacaaagugcuguuga

SEQ ID NO: 22707 - RNA, 20 nt, Artificial Sequence
  MKO10022707_A_Gpr33
  gRNA
caauccgggaagcccagugu

SEQ ID NO: 22708 - RNA, 20 nt, Artificial Sequence
  MKO10022708_A_Gpr34
  gRNA
augugauacauuaugcggaa

SEQ ID NO: 22709 - RNA, 20 nt, Artificial Sequence
  MKO10022709_A_Gpr34
  gRNA
ugucacggacagaucaugca

SEQ ID NO: 22710 - RNA, 20 nt, Artificial Sequence
  MKO10022710_A_Gpr34
  gRNA
aauuacccuuagugcuguac

SEQ ID NO: 22711 - RNA, 20 nt, Artificial Sequence
  MKO10022711_A_Gpr35
  gRNA
ccgcaucuauaugaccaacc

SEQ ID NO: 22712 - RNA, 20 nt, Artificial Sequence
  MKO10022712_A_Gpr35
  gRNA
caguggugcugaaauugcgc

SEQ ID NO: 22713 - RNA, 20 nt, Artificial Sequence
  MKO10022713_A_Gpr35
  gRNA
accgcagcucacgcgcacgc

SEQ ID NO: 22714 - RNA, 20 nt, Artificial Sequence
  MKO10022714_A_Gpr37l1
  gRNA
agcucucggucaccggauac

SEQ ID NO: 22715 - RNA, 20 nt, Artificial Sequence
  MKO10022715_A_Gpr37l1
  gRNA
gcccgaaucugucuauucgc

SEQ ID NO: 22716 - RNA, 20 nt, Artificial Sequence
  MKO10022716_A_Gpr37l1
  gRNA
cagcagagucgaccccgaag

SEQ ID NO: 22717 - RNA, 20 nt, Artificial Sequence
  MKO10022717_A_Gpr37
  gRNA
agccgcgaugugcgcgagag

SEQ ID NO: 22718 - RNA, 20 nt, Artificial Sequence
  MKO10022718_A_Gpr37
  gRNA
caagaucgugcccuauaucg

SEQ ID NO: 22719 - RNA, 20 nt, Artificial Sequence
  MKO10022719_A_Gpr37
  gRNA
gcggagaaggccaguacccg

SEQ ID NO: 22720 - RNA, 20 nt, Artificial Sequence
  MKO10022720_A_Gpr39
  gRNA
ggaugcccaaucagauccga

SEQ ID NO: 22721 - RNA, 20 nt, Artificial Sequence
  MKO10022721_A_Gpr39
  gRNA
gcacgaaccucuccaaccgu

SEQ ID NO: 22722 - RNA, 20 nt, Artificial Sequence
  MKO10022722_A_Gpr39
  gRNA
guucgugcagauggacauau

SEQ ID NO: 22723 - RNA, 20 nt, Artificial Sequence
  MKO10022723_A_Gpr3
  gRNA
caccaccagcgcguucucgc

SEQ ID NO: 22724 - RNA, 20 nt, Artificial Sequence
  MKO10022724_A_Gpr3
  gRNA
aacaugggggcgcggaaggc

SEQ ID NO: 22725 - RNA, 20 nt, Artificial Sequence
  MKO10022725_A_Gpr3
  gRNA
aagguagcggucaacgguaa

SEQ ID NO: 22726 - RNA, 20 nt, Artificial Sequence
  MKO10022726_A_Gpr44
  gRNA
ugacgcgagcugccguagcg

SEQ ID NO: 22727 - RNA, 20 nt, Artificial Sequence
  MKO10022727_A_Gpr44
  gRNA
cugcguccaacccgcuugau

SEQ ID NO: 22728 - RNA, 20 nt, Artificial Sequence
  MKO10022728_A_Gpr44
  gRNA
gguagucgcacguggugucg

SEQ ID NO: 22729 - RNA, 20 nt, Artificial Sequence
  MKO10022729_A_Gpr45
  gRNA
acgcgccuauguagugacac

SEQ ID NO: 22730 - RNA, 20 nt, Artificial Sequence
  MKO10022730_A_Gpr45
  gRNA
cgaaaaccaauccgcugucu

SEQ ID NO: 22731 - RNA, 20 nt, Artificial Sequence
  MKO10022731_A_Gpr45
  gRNA
gauccuccagcaguagacga

SEQ ID NO: 22732 - RNA, 20 nt, Artificial Sequence
  MKO10022732_A_Gpr4
  gRNA
gaaucuguaccgcgucuuug

SEQ ID NO: 22733 - RNA, 20 nt, Artificial Sequence
  MKO10022733_A_Gpr4
  gRNA
ugcgcuuugcacgccugcgc

SEQ ID NO: 22734 - RNA, 20 nt, Artificial Sequence
  MKO10022734_A_Gpr4
  gRNA
agacggcgcugcgagacagc

SEQ ID NO: 22735 - RNA, 20 nt, Artificial Sequence
  MKO10022735_A_Gpr50
  gRNA
agguucgagauagucaacag

SEQ ID NO: 22736 - RNA, 20 nt, Artificial Sequence
  MKO10022736_A_Gpr50
  gRNA
aaggcgguucccaccccauu

SEQ ID NO: 22737 - RNA, 20 nt, Artificial Sequence
  MKO10022737_A_Gpr50
  gRNA
acagucgucguagaccugau

SEQ ID NO: 22738 - RNA, 20 nt, Artificial Sequence
  MKO10022738_A_Gpr52
  gRNA
cccugaccgucgcuacgcca

SEQ ID NO: 22739 - RNA, 20 nt, Artificial Sequence
  MKO10022739_A_Gpr52
  gRNA
ggccagauucccuagucacg

SEQ ID NO: 22740 - RNA, 20 nt, Artificial Sequence
  MKO10022740_A_Gpr52
  gRNA
ccaagcagguaacuccaacg

SEQ ID NO: 22741 - RNA, 20 nt, Artificial Sequence
  MKO10022741_A_Gpr55
  gRNA
agaauuucgcaugcgcauca

SEQ ID NO: 22742 - RNA, 20 nt, Artificial Sequence
  MKO10022742_A_Gpr55
  gRNA
caacugcucauucgauuccg

SEQ ID NO: 22743 - RNA, 20 nt, Artificial Sequence
  MKO10022743_A_Gpr55
  gRNA
ggccauccaguacccgaucc

SEQ ID NO: 22744 - RNA, 20 nt, Artificial Sequence
  MKO10022744_A_Gpr56
  gRNA
gucgccgggaugacgccaag

SEQ ID NO: 22745 - RNA, 20 nt, Artificial Sequence
  MKO10022745_A_Gpr56
  gRNA
gucaucccggcgacggccuc

SEQ ID NO: 22746 - RNA, 20 nt, Artificial Sequence
  MKO10022746_A_Gpr56
  gRNA
caguguggcgacuccaguag

SEQ ID NO: 22747 - RNA, 20 nt, Artificial Sequence
  MKO10022747_A_Gpr61
  gRNA
gguccacccaaugcgcuacg

SEQ ID NO: 22748 - RNA, 20 nt, Artificial Sequence
  MKO10022748_A_Gpr61
  gRNA
augcgcaccucguagcgcau

SEQ ID NO: 22749 - RNA, 20 nt, Artificial Sequence
  MKO10022749_A_Gpr61
  gRNA
augucucaaccgucagaucc

SEQ ID NO: 22750 - RNA, 20 nt, Artificial Sequence
  MKO10022750_A_Gpr62
  gRNA
ggaccccucgucgugccgag

SEQ ID NO: 22751 - RNA, 20 nt, Artificial Sequence
  MKO10022751_A_Gpr62
  gRNA
uaccguaggcggccaacagc

SEQ ID NO: 22752 - RNA, 20 nt, Artificial Sequence
  MKO10022752_A_Gpr62
  gRNA
ugagcaccagcgcgggcgcc

SEQ ID NO: 22753 - RNA, 20 nt, Artificial Sequence
  MKO10022753_A_Gpr63
  gRNA
ccuagugccgucuacgugug

SEQ ID NO: 22754 - RNA, 20 nt, Artificial Sequence
  MKO10022754_A_Gpr63
  gRNA
aaagacuacaaacgucgugu

SEQ ID NO: 22755 - RNA, 20 nt, Artificial Sequence
  MKO10022755_A_Gpr63
  gRNA
ugcucauuauuaguaucgau

SEQ ID NO: 22756 - RNA, 20 nt, Artificial Sequence
  MKO10022756_A_Gpr64
  gRNA
agccuaccuggguaacauug

SEQ ID NO: 22757 - RNA, 20 nt, Artificial Sequence
  MKO10022757_A_Gpr64
  gRNA
auucucguuacaucccugaa

SEQ ID NO: 22758 - RNA, 20 nt, Artificial Sequence
  MKO10022758_A_Gpr64
  gRNA
cccuguuggcagaccugaag

SEQ ID NO: 22759 - RNA, 20 nt, Artificial Sequence
  MKO10022759_A_Gpr65
  gRNA
ugucgcgcucuaaaacgcag

SEQ ID NO: 22760 - RNA, 20 nt, Artificial Sequence
  MKO10022760_A_Gpr65
  gRNA
auaaagucuaccgagcugug

SEQ ID NO: 22761 - RNA, 20 nt, Artificial Sequence
  MKO10022761_A_Gpr65
  gRNA
acgcgaaucuucucguucuu

SEQ ID NO: 22762 - RNA, 20 nt, Artificial Sequence
  MKO10022762_A_Gpr68
  gRNA
ucugcaaguacccgaaguag

SEQ ID NO: 22763 - RNA, 20 nt, Artificial Sequence
  MKO10022763_A_Gpr68
  gRNA
guaguugaugcuacgcugcc

SEQ ID NO: 22764 - RNA, 20 nt, Artificial Sequence
  MKO10022764_A_Gpr68
  gRNA
caucaacuacuaccgcuucc

SEQ ID NO: 22765 - RNA, 20 nt, Artificial Sequence
  MKO10022765_A_Gpr6
  gRNA
gcaccggacaccggcgaaug

SEQ ID NO: 22766 - RNA, 20 nt, Artificial Sequence
  MKO10022766_A_Gpr6
  gRNA
ugccgaaagcaguagucccg

SEQ ID NO: 22767 - RNA, 20 nt, Artificial Sequence
  MKO10022767_A_Gpr6
  gRNA
gaggcggcggcggaccuaac

SEQ ID NO: 22768 - RNA, 20 nt, Artificial Sequence
  MKO10022768_A_Gpr75
  gRNA
guaauagugcauggcgaugu

SEQ ID NO: 22769 - RNA, 20 nt, Artificial Sequence
  MKO10022769_A_Gpr75
  gRNA
aagugcuauuucccccgugc

SEQ ID NO: 22770 - RNA, 20 nt, Artificial Sequence
  MKO10022770_A_Gpr75
  gRNA
caccaccaaugauuugaugc

SEQ ID NO: 22771 - RNA, 20 nt, Artificial Sequence
  MKO10022771_A_Gpr81
  gRNA
ggaacgauuugccccaucga

SEQ ID NO: 22772 - RNA, 20 nt, Artificial Sequence
  MKO10022772_A_Gpr81
  gRNA
cacuagugggcaccguccag

SEQ ID NO: 22773 - RNA, 20 nt, Artificial Sequence
  MKO10022773_A_Gpr81
  gRNA
cuccgcgucuucgugcgucc

SEQ ID NO: 22774 - RNA, 20 nt, Artificial Sequence
  MKO10022774_A_Gpr82
  gRNA
ccaucugccgauuguagcac

SEQ ID NO: 22775 - RNA, 20 nt, Artificial Sequence
  MKO10022775_A_Gpr82
  gRNA
ccuauacuacucaguagucg

SEQ ID NO: 22776 - RNA, 20 nt, Artificial Sequence
  MKO10022776_A_Gpr82
  gRNA
caaaucuuucucgguaaugg

SEQ ID NO: 22777 - RNA, 20 nt, Artificial Sequence
  MKO10022777_A_Gpr83
  gRNA
gacucugacagcuaucgcag

SEQ ID NO: 22778 - RNA, 20 nt, Artificial Sequence
  MKO10022778_A_Gpr83
  gRNA
cucuguggucacgucgccaa

SEQ ID NO: 22779 - RNA, 20 nt, Artificial Sequence
  MKO10022779_A_Gpr83
  gRNA
ccaacgccuccucgcacuuc

SEQ ID NO: 22780 - RNA, 20 nt, Artificial Sequence
  MKO10022780_A_Gpr84
  gRNA
agccauacgcguggcgaaac

SEQ ID NO: 22781 - RNA, 20 nt, Artificial Sequence
  MKO10022781_A_Gpr84
  gRNA
cgccaguuucgccacgcgua

SEQ ID NO: 22782 - RNA, 20 nt, Artificial Sequence
  MKO10022782_A_Gpr84
  gRNA
gagccgcacgcuucacuugc

SEQ ID NO: 22783 - RNA, 20 nt, Artificial Sequence
  MKO10022783_A_Gpr85
  gRNA
augggcgauggcuaaguauc

SEQ ID NO: 22784 - RNA, 20 nt, Artificial Sequence
  MKO10022784_A_Gpr85
  gRNA
ugcaaaaacucuccaauagc

SEQ ID NO: 22785 - RNA, 20 nt, Artificial Sequence
  MKO10022785_A_Gpr85
  gRNA
aggcaaaaugcgaauaccac

SEQ ID NO: 22786 - RNA, 20 nt, Artificial Sequence
  MKO10022786_A_Gpr87
  gRNA
gcacaaccagagcauccgcg

SEQ ID NO: 22787 - RNA, 20 nt, Artificial Sequence
  MKO10022787_A_Gpr87
  gRNA
aauucauaagccaaucgagc

SEQ ID NO: 22788 - RNA, 20 nt, Artificial Sequence
  MKO10022788_A_Gpr87
  gRNA
uuccgaauaguccgugaugc

SEQ ID NO: 22789 - RNA, 20 nt, Artificial Sequence
  MKO10022789_A_Gpr88
  gRNA
gcuugacgcugacgcgcacg

SEQ ID NO: 22790 - RNA, 20 nt, Artificial Sequence
  MKO10022790_A_Gpr88
  gRNA
auucacgaugaaggcguugc

SEQ ID NO: 22791 - RNA, 20 nt, Artificial Sequence
  MKO10022791_A_Gpr88
  gRNA
gguucagcgccacgaggcaa

SEQ ID NO: 22792 - RNA, 20 nt, Artificial Sequence
  MKO10022792_A_Gpr89
  gRNA
cuucaugcgccaguuguuua

SEQ ID NO: 22793 - RNA, 20 nt, Artificial Sequence
  MKO10022793_A_Gpr89
  gRNA
uuaacaggugcgucaguaug

SEQ ID NO: 22794 - RNA, 20 nt, Artificial Sequence
  MKO10022794_A_Gpr89
  gRNA
ucagcucccguuacuuccau

SEQ ID NO: 22795 - RNA, 20 nt, Artificial Sequence
  MKO10022795_A_Gpr97
  gRNA
gugggccagaugcacgccac

SEQ ID NO: 22796 - RNA, 20 nt, Artificial Sequence
  MKO10022796_A_Gpr97
  gRNA
cguggcccuccugaagccga

SEQ ID NO: 22797 - RNA, 20 nt, Artificial Sequence
  MKO10022797_A_Gpr97
  gRNA
agcagugucauucaagucga

SEQ ID NO: 22798 - RNA, 20 nt, Artificial Sequence
  MKO10022798_A_Gpr98
  gRNA
aguaugugacgacgaucuuc

SEQ ID NO: 22799 - RNA, 20 nt, Artificial Sequence
  MKO10022799_A_Gpr98
  gRNA
gcagcguuuaucccugccag

SEQ ID NO: 22800 - RNA, 20 nt, Artificial Sequence
  MKO10022800_A_Gpr98
  gRNA
cucaaucaccgagauugaug

SEQ ID NO: 22801 - RNA, 20 nt, Artificial Sequence
  MKO10022801_A_Gprasp1
  gRNA
acucgccacgaaacuuauuu

SEQ ID NO: 22802 - RNA, 20 nt, Artificial Sequence
  MKO10022802_A_Gprasp1
  gRNA
acgccuacuuguuacugauu

SEQ ID NO: 22803 - RNA, 20 nt, Artificial Sequence
  MKO10022803_A_Gprasp1
  gRNA
cugacccaguuucgacaguc

SEQ ID NO: 22804 - RNA, 20 nt, Artificial Sequence
  MKO10022804_A_Gprasp2
  gRNA
uucgaugguaaccucguccc

SEQ ID NO: 22805 - RNA, 20 nt, Artificial Sequence
  MKO10022805_A_Gprasp2
  gRNA
ugcaucgccugugguuaaua

SEQ ID NO: 22806 - RNA, 20 nt, Artificial Sequence
  MKO10022806_A_Gprasp2
  gRNA
uuuggaucugggcuucgacc

SEQ ID NO: 22807 - RNA, 20 nt, Artificial Sequence
  MKO10022807_A_Gprc5a
  gRNA
aguccguacaaugacuacga

SEQ ID NO: 22808 - RNA, 20 nt, Artificial Sequence
  MKO10022808_A_Gprc5a
  gRNA
acgaaauccucauugcgccg

SEQ ID NO: 22809 - RNA, 20 nt, Artificial Sequence
  MKO10022809_A_Gprc5a
  gRNA
ucaagacgagcacguaaaug

SEQ ID NO: 22810 - RNA, 20 nt, Artificial Sequence
  MKO10022810_A_Gprc5b
  gRNA
ucaauggaugaacauaacgc

SEQ ID NO: 22811 - RNA, 20 nt, Artificial Sequence
  MKO10022811_A_Gprc5b
  gRNA
uaauuaaugaguugccgaag

SEQ ID NO: 22812 - RNA, 20 nt, Artificial Sequence
  MKO10022812_A_Gprc5b
  gRNA
uguguaucagccgaccgaga

SEQ ID NO: 22813 - RNA, 20 nt, Artificial Sequence
  MKO10022813_A_Gprc5c
  gRNA
uguacaugucuucggcccgc

SEQ ID NO: 22814 - RNA, 20 nt, Artificial Sequence
  MKO10022814_A_Gprc5c
  gRNA
guuuccgccagcgcuugaag

SEQ ID NO: 22815 - RNA, 20 nt, Artificial Sequence
  MKO10022815_A_Gprc5c
  gRNA
gggacauguacccgacccga

SEQ ID NO: 22816 - RNA, 20 nt, Artificial Sequence
  MKO10022816_A_Gprc5d
  gRNA
gacaccguaucagcucaaug

SEQ ID NO: 22817 - RNA, 20 nt, Artificial Sequence
  MKO10022817_A_Gprc5d
  gRNA
cacauacucuaucgcaauga

SEQ ID NO: 22818 - RNA, 20 nt, Artificial Sequence
  MKO10022818_A_Gprc5d
  gRNA
gauguagcacuaacugcaua

SEQ ID NO: 22819 - RNA, 20 nt, Artificial Sequence
  MKO10022819_A_Gprc6a
  gRNA
accugauccgacaaucggga

SEQ ID NO: 22820 - RNA, 20 nt, Artificial Sequence
  MKO10022820_A_Gprc6a
  gRNA
cagcuugcaguguucgcccu

SEQ ID NO: 22821 - RNA, 20 nt, Artificial Sequence
  MKO10022821_A_Gprc6a
  gRNA
gucaaggcugucauaggugc

SEQ ID NO: 22822 - RNA, 20 nt, Artificial Sequence
  MKO10022822_A_Gprin1
  gRNA
gugaaguugucgcgaguccg

SEQ ID NO: 22823 - RNA, 20 nt, Artificial Sequence
  MKO10022823_A_Gprin1
  gRNA
agucgacccccccacgacug

SEQ ID NO: 22824 - RNA, 20 nt, Artificial Sequence
  MKO10022824_A_Gprin1
  gRNA
ucccagcucacgucgcgcac

SEQ ID NO: 22825 - RNA, 20 nt, Artificial Sequence
  MKO10022825_A_Gprin2
  gRNA
gcuagaguccggccuacgac

SEQ ID NO: 22826 - RNA, 20 nt, Artificial Sequence
  MKO10022826_A_Gprin2
  gRNA
gacugcaugaccgcccgcag

SEQ ID NO: 22827 - RNA, 20 nt, Artificial Sequence
  MKO10022827_A_Gprin2
  gRNA
uucuaaaucagccugcacgu

SEQ ID NO: 22828 - RNA, 20 nt, Artificial Sequence
  MKO10022828_A_Gprin3
  gRNA
gcauggucuuucacgauaag

SEQ ID NO: 22829 - RNA, 20 nt, Artificial Sequence
  MKO10022829_A_Gprin3
  gRNA
agcugcaaaccguccaacuc

SEQ ID NO: 22830 - RNA, 20 nt, Artificial Sequence
  MKO10022830_A_Gprin3
  gRNA
aagucaggauuaguaccuuc

SEQ ID NO: 22831 - RNA, 20 nt, Artificial Sequence
  MKO10022831_A_Gps1
  gRNA
aggccaccuugaugacguug

SEQ ID NO: 22832 - RNA, 20 nt, Artificial Sequence
  MKO10022832_A_Gps1
  gRNA
aaggcuuaaccugguagccu

SEQ ID NO: 22833 - RNA, 20 nt, Artificial Sequence
  MKO10022833_A_Gps1
  gRNA
gcguucugcggaucuuccug

SEQ ID NO: 22834 - RNA, 20 nt, Artificial Sequence
  MKO10022834_A_Gps2
  gRNA
ucccucaccguaagcacuug

SEQ ID NO: 22835 - RNA, 20 nt, Artificial Sequence
  MKO10022835_A_Gps2
  gRNA
ggguuccuguaugaaccguc

SEQ ID NO: 22836 - RNA, 20 nt, Artificial Sequence
  MKO10022836_A_Gps2
  gRNA
aaugucacuagaggagacca

SEQ ID NO: 22837 - RNA, 20 nt, Artificial Sequence
  MKO10022837_A_Gpsm1
  gRNA
gguccuaggccgauucgaug

SEQ ID NO: 22838 - RNA, 20 nt, Artificial Sequence
  MKO10022838_A_Gpsm1
  gRNA
ugcagugucucgcggacauc

SEQ ID NO: 22839 - RNA, 20 nt, Artificial Sequence
  MKO10022839_A_Gpsm1
  gRNA
gggcccgggcauacuccuuc

SEQ ID NO: 22840 - RNA, 20 nt, Artificial Sequence
  MKO10022840_A_Gpsm2
  gRNA
ugcccggguccgcaggauac

SEQ ID NO: 22841 - RNA, 20 nt, Artificial Sequence
  MKO10022841_A_Gpsm2
  gRNA
gcaagagcgcucuacaaucu

SEQ ID NO: 22842 - RNA, 20 nt, Artificial Sequence
  MKO10022842_A_Gpsm2
  gRNA
ugcaguuauagcucacgagc

SEQ ID NO: 22843 - RNA, 20 nt, Artificial Sequence
  MKO10022843_A_Gpsm3
  gRNA
agcccagucccgccgccuag

SEQ ID NO: 22844 - RNA, 20 nt, Artificial Sequence
  MKO10022844_A_Gpsm3
  gRNA
auagcccuagggccccguuc

SEQ ID NO: 22845 - RNA, 20 nt, Artificial Sequence
  MKO10022845_A_Gpsm3
  gRNA
gaaggggcgggucagaccgu

SEQ ID NO: 22846 - RNA, 20 nt, Artificial Sequence
  MKO10022846_A_Gpt2
  gRNA
cacggauacaguuaacgccu

SEQ ID NO: 22847 - RNA, 20 nt, Artificial Sequence
  MKO10022847_A_Gpt2
  gRNA
aagacgcuaagaaacgagcg

SEQ ID NO: 22848 - RNA, 20 nt, Artificial Sequence
  MKO10022848_A_Gpt2
  gRNA
cucugagcucgacgcggugc

SEQ ID NO: 22849 - RNA, 20 nt, Artificial Sequence
  MKO10022849_A_Gpt
  gRNA
guacuaugcgucaucaaccc

SEQ ID NO: 22850 - RNA, 20 nt, Artificial Sequence
  MKO10022850_A_Gpt
  gRNA
uugaugacgcauaguacucg

SEQ ID NO: 22851 - RNA, 20 nt, Artificial Sequence
  MKO10022851_A_Gpt
  gRNA
cccuaccacgauggcaucgc

SEQ ID NO: 22852 - RNA, 20 nt, Artificial Sequence
  MKO10022852_A_Gpx1
  gRNA
cgaugucgaugguacgaaag

SEQ ID NO: 22853 - RNA, 20 nt, Artificial Sequence
  MKO10022853_A_Gpx1
  gRNA
acaggcuccccgcccgucag

SEQ ID NO: 22854 - RNA, 20 nt, Artificial Sequence
  MKO10022854_A_Gpx1
  gRNA
gcucgaacccgccaccaggu

SEQ ID NO: 22855 - RNA, 20 nt, Artificial Sequence
  MKO10022855_A_Gpx2
  gRNA
agccucaaguauguccgacc

SEQ ID NO: 22856 - RNA, 20 nt, Artificial Sequence
  MKO10022856_A_Gpx2
  gRNA
uccucaccugauguccgaac

SEQ ID NO: 22857 - RNA, 20 nt, Artificial Sequence
  MKO10022857_A_Gpx2
  gRNA
uucuacgaucucagugccgu

SEQ ID NO: 22858 - RNA, 20 nt, Artificial Sequence
  MKO10022858_A_Gpx3
  gRNA
auggcauaccgguuaugcgc

SEQ ID NO: 22859 - RNA, 20 nt, Artificial Sequence
  MKO10022859_A_Gpx3
  gRNA
ccucccagguauguucgacc

SEQ ID NO: 22860 - RNA, 20 nt, Artificial Sequence
  MKO10022860_A_Gpx3
  gRNA
gcucaccuggccgccucuuu

SEQ ID NO: 22861 - RNA, 20 nt, Artificial Sequence
  MKO10022861_A_Gpx4
  gRNA
cgugugcaucgucaccaacg

SEQ ID NO: 22862 - RNA, 20 nt, Artificial Sequence
  MKO10022862_A_Gpx4
  gRNA
aaacccaccuguacuuaucc

SEQ ID NO: 22863 - RNA, 20 nt, Artificial Sequence
  MKO10022863_A_Gpx4
  gRNA
cacacaccugccucccaaac

SEQ ID NO: 22864 - RNA, 20 nt, Artificial Sequence
  MKO10022864_A_Gpx5
  gRNA
cuggauugucagaccgcaau

SEQ ID NO: 22865 - RNA, 20 nt, Artificial Sequence
  MKO10022865_A_Gpx5
  gRNA
uaaaaguccaugacauccgc

SEQ ID NO: 22866 - RNA, 20 nt, Artificial Sequence
  MKO10022866_A_Gpx5
  gRNA
cagagccucauagucguaga

SEQ ID NO: 22867 - RNA, 20 nt, Artificial Sequence
  MKO10022867_A_Gpx6
  gRNA
ggccugacagcuacguaccc

SEQ ID NO: 22868 - RNA, 20 nt, Artificial Sequence
  MKO10022868_A_Gpx6
  gRNA
uaccaggguacguagcuguc

SEQ ID NO: 22869 - RNA, 20 nt, Artificial Sequence
  MKO10022869_A_Gpx6
  gRNA
cgcaugacagggacuccauc

SEQ ID NO: 22870 - RNA, 20 nt, Artificial Sequence
  MKO10022870_A_Gpx7
  gRNA
ggccugcgcgcaauccgagc

SEQ ID NO: 22871 - RNA, 20 nt, Artificial Sequence
  MKO10022871_A_Gpx7
  gRNA
cgcuagcuacguucaccacc

SEQ ID NO: 22872 - RNA, 20 nt, Artificial Sequence
  MKO10022872_A_Gpx7
  gRNA
cucacggguuagguacuuga

SEQ ID NO: 22873 - RNA, 20 nt, Artificial Sequence
  MKO10022873_A_Gpx8
  gRNA
gcccuaucacuucaacgucc

SEQ ID NO: 22874 - RNA, 20 nt, Artificial Sequence
  MKO10022874_A_Gpx8
  gRNA
cacuagccacguuuacaacc

SEQ ID NO: 22875 - RNA, 20 nt, Artificial Sequence
  MKO10022875_A_Gpx8
  gRNA
gccuacccauuaaaauguuc

SEQ ID NO: 22876 - RNA, 20 nt, Artificial Sequence
  MKO10022876_A_Gramd1a
  gRNA
gcuccccgucucuucguaag

SEQ ID NO: 22877 - RNA, 20 nt, Artificial Sequence
  MKO10022877_A_Gramd1a
  gRNA
ugaagcagagcgccucaucg

SEQ ID NO: 22878 - RNA, 20 nt, Artificial Sequence
  MKO10022878_A_Gramd1a
  gRNA
ugaagccgcuuacgaagaga

SEQ ID NO: 22879 - RNA, 20 nt, Artificial Sequence
  MKO10022879_A_Gramd1b
  gRNA
caccuuucgucgcgcacucg

SEQ ID NO: 22880 - RNA, 20 nt, Artificial Sequence
  MKO10022880_A_Gramd1b
  gRNA
guccucgagugcgcgacgaa

SEQ ID NO: 22881 - RNA, 20 nt, Artificial Sequence
  MKO10022881_A_Gramd1b
  gRNA
gcgggaccgcuuccggagga

SEQ ID NO: 22882 - RNA, 20 nt, Artificial Sequence
  MKO10022882_A_Gramd1c
  gRNA
guccucagcaacccgcuaac

SEQ ID NO: 22883 - RNA, 20 nt, Artificial Sequence
  MKO10022883_A_Gramd1c
  gRNA
guugcugaggacuaugguau

SEQ ID NO: 22884 - RNA, 20 nt, Artificial Sequence
  MKO10022884_A_Gramd1c
  gRNA
auucccgagaaagaucuuca

SEQ ID NO: 22885 - RNA, 20 nt, Artificial Sequence
  MKO10022885_A_Gramd2
  gRNA
gagagauauagagccgacca

SEQ ID NO: 22886 - RNA, 20 nt, Artificial Sequence
  MKO10022886_A_Gramd2
  gRNA
gcuguuuaaagauaucccgu

SEQ ID NO: 22887 - RNA, 20 nt, Artificial Sequence
  MKO10022887_A_Gramd2
  gRNA
uaaacagcuugugguauugu

SEQ ID NO: 22888 - RNA, 20 nt, Artificial Sequence
  MKO10022888_A_Gramd3
  gRNA
agcucuuugugucggaaaac

SEQ ID NO: 22889 - RNA, 20 nt, Artificial Sequence
  MKO10022889_A_Gramd3
  gRNA
ccgaguccccggaccagaag

SEQ ID NO: 22890 - RNA, 20 nt, Artificial Sequence
  MKO10022890_A_Gramd3
  gRNA
ccucuucugguccggggacu

SEQ ID NO: 22891 - RNA, 20 nt, Artificial Sequence
  MKO10022891_A_Gramd4
  gRNA
cgaucgacugaacgagauca

SEQ ID NO: 22892 - RNA, 20 nt, Artificial Sequence
  MKO10022892_A_Gramd4
  gRNA
gcacgccugccgccaugaug

SEQ ID NO: 22893 - RNA, 20 nt, Artificial Sequence
  MKO10022893_A_Gramd4
  gRNA
gucuccgcacucgguguccg

SEQ ID NO: 22894 - RNA, 20 nt, Artificial Sequence
  MKO10022894_A_Grap2
  gRNA
ucuucuccuacgguuccacu

SEQ ID NO: 22895 - RNA, 20 nt, Artificial Sequence
  MKO10022895_A_Grap2
  gRNA
augggaacuucucgguccac

SEQ ID NO: 22896 - RNA, 20 nt, Artificial Sequence
  MKO10022896_A_Grap2
  gRNA
caaagucaugcgugacacca

SEQ ID NO: 22897 - RNA, 20 nt, Artificial Sequence
  MKO10022897_A_Grap
  gRNA
gcacuucaaagugcuucgag

SEQ ID NO: 22898 - RNA, 20 nt, Artificial Sequence
  MKO10022898_A_Grap
  gRNA
guucaacucccucaacgagc

SEQ ID NO: 22899 - RNA, 20 nt, Artificial Sequence
  MKO10022899_A_Grap
  gRNA
ugguacaaagcugagcuccg

SEQ ID NO: 22900 - RNA, 20 nt, Artificial Sequence
  MKO10022900_A_Grasp
  gRNA
cacguugagaccguugacgc

SEQ ID NO: 22901 - RNA, 20 nt, Artificial Sequence
  MKO10022901_A_Grasp
  gRNA
gucgauaucaucaaggcguc

SEQ ID NO: 22902 - RNA, 20 nt, Artificial Sequence
  MKO10022902_A_Grasp
  gRNA
auauggccuucaccaccgag

SEQ ID NO: 22903 - RNA, 20 nt, Artificial Sequence
  MKO10022903_A_Grb10
  gRNA
caacgauauuaacucguccg

SEQ ID NO: 22904 - RNA, 20 nt, Artificial Sequence
  MKO10022904_A_Grb10
  gRNA
ccacuuggaccacgaucuca

SEQ ID NO: 22905 - RNA, 20 nt, Artificial Sequence
  MKO10022905_A_Grb10
  gRNA
ccaugagaucgugguccaag

SEQ ID NO: 22906 - RNA, 20 nt, Artificial Sequence
  MKO10022906_A_Grb14
  gRNA
ccucacagaaagaaccguag

SEQ ID NO: 22907 - RNA, 20 nt, Artificial Sequence
  MKO10022907_A_Grb14
  gRNA
ggugauuaaaguuuacagcg

SEQ ID NO: 22908 - RNA, 20 nt, Artificial Sequence
  MKO10022908_A_Grb14
  gRNA
uuugagcaccuaucucacau

SEQ ID NO: 22909 - RNA, 20 nt, Artificial Sequence
  MKO10022909_A_Grb2
  gRNA
aauacuucccggcuccgucg

SEQ ID NO: 22910 - RNA, 20 nt, Artificial Sequence
  MKO10022910_A_Grb2
  gRNA
gaaacacuuacuugacggac

SEQ ID NO: 22911 - RNA, 20 nt, Artificial Sequence
  MKO10022911_A_Grb2
  gRNA
ggacauagaacagaugccac

SEQ ID NO: 22912 - RNA, 20 nt, Artificial Sequence
  MKO10022912_A_Grb7
  gRNA
acgcccugagcgacgagagc

SEQ ID NO: 22913 - RNA, 20 nt, Artificial Sequence
  MKO10022913_A_Grb7
  gRNA
cucgaauccagagcgggguc

SEQ ID NO: 22914 - RNA, 20 nt, Artificial Sequence
  MKO10022914_A_Grb7
  gRNA
guccccagcucucgucgcuc

SEQ ID NO: 22915 - RNA, 20 nt, Artificial Sequence
  MKO10022915_A_Grcc10
  gRNA
acgcuugaaucaccuccgcc

SEQ ID NO: 22916 - RNA, 20 nt, Artificial Sequence
  MKO10022916_A_Grcc10
  gRNA
gcguucuauggcguccgccu

SEQ ID NO: 22917 - RNA, 20 nt, Artificial Sequence
  MKO10022917_A_Grcc10
  gRNA
ucuagccucguccaugcgca

SEQ ID NO: 22918 - RNA, 20 nt, Artificial Sequence
  MKO10022918_A_Greb1l
  gRNA
ucccuuugauaacacgcccu

SEQ ID NO: 22919 - RNA, 20 nt, Artificial Sequence
  MKO10022919_A_Greb1l
  gRNA
cgauuucuaccagaugacca

SEQ ID NO: 22920 - RNA, 20 nt, Artificial Sequence
  MKO10022920_A_Greb1l
  gRNA
ucugucgugcaagauccuuc

SEQ ID NO: 22921 - RNA, 20 nt, Artificial Sequence
  MKO10022921_A_Greb1
  gRNA
cagcagcugucaucguuaga

SEQ ID NO: 22922 - RNA, 20 nt, Artificial Sequence
  MKO10022922_A_Greb1
  gRNA
uuccuuacgcuccaacaccc

SEQ ID NO: 22923 - RNA, 20 nt, Artificial Sequence
  MKO10022923_A_Greb1
  gRNA
uccgaaccagauaguacuug

SEQ ID NO: 22924 - RNA, 20 nt, Artificial Sequence
  MKO10022924_A_Grem1
  gRNA
ccguugcauauccaucgacu

SEQ ID NO: 22925 - RNA, 20 nt, Artificial Sequence
  MKO10022925_A_Grem1
  gRNA
acuugcgcucugucacgugc

SEQ ID NO: 22926 - RNA, 20 nt, Artificial Sequence
  MKO10022926_A_Grem1
  gRNA
uuugacuuaauccaagucga

SEQ ID NO: 22927 - RNA, 20 nt, Artificial Sequence
  MKO10022927_A_Grem2
  gRNA
caucccgcgacacgugaaga

SEQ ID NO: 22928 - RNA, 20 nt, Artificial Sequence
  MKO10022928_A_Grem2
  gRNA
uucgagcucuacgaugacag

SEQ ID NO: 22929 - RNA, 20 nt, Artificial Sequence
  MKO10022929_A_Grem2
  gRNA
caucguagagcucgaaugcc

SEQ ID NO: 22930 - RNA, 20 nt, Artificial Sequence
  MKO10022930_A_Grhl1
  gRNA
cucugagcccaccgaacgug

SEQ ID NO: 22931 - RNA, 20 nt, Artificial Sequence
  MKO10022931_A_Grhl1
  gRNA
cauccgaaggcugaguuccg

SEQ ID NO: 22932 - RNA, 20 nt, Artificial Sequence
  MKO10022932_A_Grhl1
  gRNA
cuccugaacgcccuccuuga

SEQ ID NO: 22933 - RNA, 20 nt, Artificial Sequence
  MKO10022933_A_Grhl2
  gRNA
cgccuccgcucaaauugauc

SEQ ID NO: 22934 - RNA, 20 nt, Artificial Sequence
  MKO10022934_A_Grhl2
  gRNA
ccgaagagccuacacaagug

SEQ ID NO: 22935 - RNA, 20 nt, Artificial Sequence
  MKO10022935_A_Grhl2
  gRNA
cuauccccgcgcggacagug

SEQ ID NO: 22936 - RNA, 20 nt, Artificial Sequence
  MKO10022936_A_Grhl3
  gRNA
ggggacgguauuggucuugc

SEQ ID NO: 22937 - RNA, 20 nt, Artificial Sequence
  MKO10022937_A_Grhl3
  gRNA
gcuuccaguuuacucggacc

SEQ ID NO: 22938 - RNA, 20 nt, Artificial Sequence
  MKO10022938_A_Grhl3
  gRNA
cuuccucuacgacuacuaua

SEQ ID NO: 22939 - RNA, 20 nt, Artificial Sequence
  MKO10022939_A_Grhpr
  gRNA
ccguagccgcacauccauaa

SEQ ID NO: 22940 - RNA, 20 nt, Artificial Sequence
  MKO10022940_A_Grhpr
  gRNA
ccauuauggaugugcggcua

SEQ ID NO: 22941 - RNA, 20 nt, Artificial Sequence
  MKO10022941_A_Grhpr
  gRNA
gcuuccuagcgggauccggg

SEQ ID NO: 22942 - RNA, 20 nt, Artificial Sequence
  MKO10022942_A_Gria1
  gRNA
auacagccgccgagaagaac

SEQ ID NO: 22943 - RNA, 20 nt, Artificial Sequence
  MKO10022943_A_Gria1
  gRNA
agaacgccucaacgccaucc

SEQ ID NO: 22944 - RNA, 20 nt, Artificial Sequence
  MKO10022944_A_Gria1
  gRNA
gcauuaucgaccauuacaag

SEQ ID NO: 22945 - RNA, 20 nt, Artificial Sequence
  MKO10022945_A_Gria2
  gRNA
gacaccccauaucgacaauu

SEQ ID NO: 22946 - RNA, 20 nt, Artificial Sequence
  MKO10022946_A_Gria2
  gRNA
cuaccuccaaauugucgaua

SEQ ID NO: 22947 - RNA, 20 nt, Artificial Sequence
  MKO10022947_A_Gria2
  gRNA
gguaguacucaaucaagcua

SEQ ID NO: 22948 - RNA, 20 nt, Artificial Sequence
  MKO10022948_A_Gria3
  gRNA
gaacuaccacguagaccacu

SEQ ID NO: 22949 - RNA, 20 nt, Artificial Sequence
  MKO10022949_A_Gria3
  gRNA
aggaauccaaguggucuacg

SEQ ID NO: 22950 - RNA, 20 nt, Artificial Sequence
  MKO10022950_A_Gria3
  gRNA
ccuuuaaggcugggcgcauc

SEQ ID NO: 22951 - RNA, 20 nt, Artificial Sequence
  MKO10022951_A_Gria4
  gRNA
uuaccuauuugaacgcugcu

SEQ ID NO: 22952 - RNA, 20 nt, Artificial Sequence
  MKO10022952_A_Gria4
  gRNA
cagcuaagaccuucauugag

SEQ ID NO: 22953 - RNA, 20 nt, Artificial Sequence
  MKO10022953_A_Gria4
  gRNA
uaccccugucuguaucauac

SEQ ID NO: 22954 - RNA, 20 nt, Artificial Sequence
  MKO10022954_A_Grid1
  gRNA
ccgguagcgauucagcuccu

SEQ ID NO: 22955 - RNA, 20 nt, Artificial Sequence
  MKO10022955_A_Grid1
  gRNA
auuggcggaugcacagcccg

SEQ ID NO: 22956 - RNA, 20 nt, Artificial Sequence
  MKO10022956_A_Grid1
  gRNA
ggcgcacuccuucaucaaug

SEQ ID NO: 22957 - RNA, 20 nt, Artificial Sequence
  MKO10022957_A_Grid2ip
  gRNA
cuucgacgagguggugucgc

SEQ ID NO: 22958 - RNA, 20 nt, Artificial Sequence
  MKO10022958_A_Grid2ip
  gRNA
gcguaccuacgaggaccccc

SEQ ID NO: 22959 - RNA, 20 nt, Artificial Sequence
  MKO10022959_A_Grid2ip
  gRNA
ggaccggucccuuucgccag

SEQ ID NO: 22960 - RNA, 20 nt, Artificial Sequence
  MKO10022960_A_Grid2
  gRNA
ccuagauauccguggaaucc

SEQ ID NO: 22961 - RNA, 20 nt, Artificial Sequence
  MKO10022961_A_Grid2
  gRNA
cccagcugaugugcaaccaa

SEQ ID NO: 22962 - RNA, 20 nt, Artificial Sequence
  MKO10022962_A_Grid2
  gRNA
uucauucagcgcucaacagc

SEQ ID NO: 22963 - RNA, 20 nt, Artificial Sequence
  MKO10022963_A_Grifin
  gRNA
gaaucgagguuugacgugga

SEQ ID NO: 22964 - RNA, 20 nt, Artificial Sequence
  MKO10022964_A_Grifin
  gRNA
auugcccaccaccguggcgc

SEQ ID NO: 22965 - RNA, 20 nt, Artificial Sequence
  MKO10022965_A_Grifin
  gRNA
gccagcggucggugccgaug

SEQ ID NO: 22966 - RNA, 20 nt, Artificial Sequence
  MKO10022966_A_Grik1
  gRNA
auuugauuguucgcacgaga

SEQ ID NO: 22967 - RNA, 20 nt, Artificial Sequence
  MKO10022967_A_Grik1
  gRNA
gguucgguuucgguuaauac

SEQ ID NO: 22968 - RNA, 20 nt, Artificial Sequence
  MKO10022968_A_Grik1
  gRNA
uucaugccgaaacacagucg

SEQ ID NO: 22969 - RNA, 20 nt, Artificial Sequence
  MKO10022969_A_Grik2
  gRNA
agucgaagauuguaccuuga

SEQ ID NO: 22970 - RNA, 20 nt, Artificial Sequence
  MKO10022970_A_Grik2
  gRNA
accgaaucuuaacacaugug

SEQ ID NO: 22971 - RNA, 20 nt, Artificial Sequence
  MKO10022971_A_Grik2
  gRNA
cuguguaucauauguuaacg

SEQ ID NO: 22972 - RNA, 20 nt, Artificial Sequence
  MKO10022972_A_Grik3
  gRNA
cgggagucauccgagucaau

SEQ ID NO: 22973 - RNA, 20 nt, Artificial Sequence
  MKO10022973_A_Grik3
  gRNA
aaccuccaaggcguugcaaa

SEQ ID NO: 22974 - RNA, 20 nt, Artificial Sequence
  MKO10022974_A_Grik3
  gRNA
cugaucgccacuugagggac

SEQ ID NO: 22975 - RNA, 20 nt, Artificial Sequence
  MKO10022975_A_Grik4
  gRNA
cacacucucgguccggaugu

SEQ ID NO: 22976 - RNA, 20 nt, Artificial Sequence
  MKO10022976_A_Grik4
  gRNA
cccgugugucguccaacauc

SEQ ID NO: 22977 - RNA, 20 nt, Artificial Sequence
  MKO10022977_A_Grik4
  gRNA
guaucaaccgcgcaccagag

SEQ ID NO: 22978 - RNA, 20 nt, Artificial Sequence
  MKO10022978_A_Grik5
  gRNA
gccccgcucacugguguccg

SEQ ID NO: 22979 - RNA, 20 nt, Artificial Sequence
  MKO10022979_A_Grik5
  gRNA
cucccaccuuguccuccgua

SEQ ID NO: 22980 - RNA, 20 nt, Artificial Sequence
  MKO10022980_A_Grik5
  gRNA
gaccagaccguguguggccg

SEQ ID NO: 22981 - RNA, 20 nt, Artificial Sequence
  MKO10022981_A_Grin1os
  gRNA
cugcgcacgcucauuguuaa

SEQ ID NO: 22982 - RNA, 20 nt, Artificial Sequence
  MKO10022982_A_Grin1os
  gRNA
gcgcaugccgaugccaaagc

SEQ ID NO: 22983 - RNA, 20 nt, Artificial Sequence
  MKO10022983_A_Grin1os
  gRNA
gcgugccuuccccgagccac

SEQ ID NO: 22984 - RNA, 20 nt, Artificial Sequence
  MKO10022984_A_Grin1
  gRNA
ccaagagccgugucgcuuau

SEQ ID NO: 22985 - RNA, 20 nt, Artificial Sequence
  MKO10022985_A_Grin1
  gRNA
cgcgccgauguugacaaucu

SEQ ID NO: 22986 - RNA, 20 nt, Artificial Sequence
  MKO10022986_A_Grin1
  gRNA
cuucuacagaauccccgucc

SEQ ID NO: 22987 - RNA, 20 nt, Artificial Sequence
  MKO10022987_A_Grin2a
  gRNA
uaugucuucuacgaugacga

SEQ ID NO: 22988 - RNA, 20 nt, Artificial Sequence
  MKO10022988_A_Grin2a
  gRNA
gaucuugacaaacuuccgac

SEQ ID NO: 22989 - RNA, 20 nt, Artificial Sequence
  MKO10022989_A_Grin2a
  gRNA
uuucagucucuuacgacgac

SEQ ID NO: 22990 - RNA, 20 nt, Artificial Sequence
  MKO10022990_A_Grin2b
  gRNA
cgggacuguauuccgcaugc

SEQ ID NO: 22991 - RNA, 20 nt, Artificial Sequence
  MKO10022991_A_Grin2b
  gRNA
cucaccaaucaugccguucc

SEQ ID NO: 22992 - RNA, 20 nt, Artificial Sequence
  MKO10022992_A_Grin2b
  gRNA
aucgugccgagucugguggc

SEQ ID NO: 22993 - RNA, 20 nt, Artificial Sequence
  MKO10022993_A_Grin2c
  gRNA
cgacggcgcgcacgcccucg

SEQ ID NO: 22994 - RNA, 20 nt, Artificial Sequence
  MKO10022994_A_Grin2c
  gRNA
ccagaauggcuacaccgucg

SEQ ID NO: 22995 - RNA, 20 nt, Artificial Sequence
  MKO10022995_A_Grin2c
  gRNA
guucuccuacgacuuguacc

SEQ ID NO: 22996 - RNA, 20 nt, Artificial Sequence
  MKO10022996_A_Grin2d
  gRNA
ugacgacuuggcacgucgag

SEQ ID NO: 22997 - RNA, 20 nt, Artificial Sequence
  MKO10022997_A_Grin2d
  gRNA
gcagugacuacgcgugcccc

SEQ ID NO: 22998 - RNA, 20 nt, Artificial Sequence
  MKO10022998_A_Grin2d
  gRNA
cuuucugguaaacccgucac

SEQ ID NO: 22999 - RNA, 20 nt, Artificial Sequence
  MKO10022999_A_Grin3a
  gRNA
aacuugcaguaugacccuau

SEQ ID NO: 23000 - RNA, 20 nt, Artificial Sequence
  MKO10023000_A_Grin3a
  gRNA
aaagccaauguggacucgcc

SEQ ID NO: 23001 - RNA, 20 nt, Artificial Sequence
  MKO10023001_A_Grin3a
  gRNA
ugauguugaugauagacucg

SEQ ID NO: 23002 - RNA, 20 nt, Artificial Sequence
  MKO10023002_A_Grin3b
  gRNA
cccuacgggcucacgccacg

SEQ ID NO: 23003 - RNA, 20 nt, Artificial Sequence
  MKO10023003_A_Grin3b
  gRNA
gcacucacccucgaucgcaa

SEQ ID NO: 23004 - RNA, 20 nt, Artificial Sequence
  MKO10023004_A_Grin3b
  gRNA
cagcuugcaguccgcaucua

SEQ ID NO: 23005 - RNA, 20 nt, Artificial Sequence
  MKO10023005_A_Grina
  gRNA
ggagauuguauacgccucgc

SEQ ID NO: 23006 - RNA, 20 nt, Artificial Sequence
  MKO10023006_A_Grina
  gRNA
cugggacaagaacauucgcc

SEQ ID NO: 23007 - RNA, 20 nt, Artificial Sequence
  MKO10023007_A_Grina
  gRNA
gaccgucagcuuguccuaca

SEQ ID NO: 23008 - RNA, 20 nt, Artificial Sequence
  MKO10023008_A_Grip1
  gRNA
caaugccucccgauaccguc

SEQ ID NO: 23009 - RNA, 20 nt, Artificial Sequence
  MKO10023009_A_Grip1
  gRNA
gaucucaucguggcggaacu

SEQ ID NO: 23010 - RNA, 20 nt, Artificial Sequence
  MKO10023010_A_Grip1
  gRNA
gaagcucguacucgaccucc

SEQ ID NO: 23011 - RNA, 20 nt, Artificial Sequence
  MKO10023011_A_Grip2
  gRNA
gauggaucccguucacugag

SEQ ID NO: 23012 - RNA, 20 nt, Artificial Sequence
  MKO10023012_A_Grip2
  gRNA
gugugaugaucucgucaugu

SEQ ID NO: 23013 - RNA, 20 nt, Artificial Sequence
  MKO10023013_A_Grip2
  gRNA
accgucuuggaaaugauccu

SEQ ID NO: 23014 - RNA, 20 nt, Artificial Sequence
  MKO10023014_A_Gripap1
  gRNA
ggcgaccuucugucgaagac

SEQ ID NO: 23015 - RNA, 20 nt, Artificial Sequence
  MKO10023015_A_Gripap1
  gRNA
uccgaaguucauccgaaagc

SEQ ID NO: 23016 - RNA, 20 nt, Artificial Sequence
  MKO10023016_A_Gripap1
  gRNA
acuuuccagucuucgacaga

SEQ ID NO: 23017 - RNA, 20 nt, Artificial Sequence
  MKO10023017_A_Grk1
  gRNA
uacgagaugaucgcagccag

SEQ ID NO: 23018 - RNA, 20 nt, Artificial Sequence
  MKO10023018_A_Grk1
  gRNA
aauaagaccaagggcuacgc

SEQ ID NO: 23019 - RNA, 20 nt, Artificial Sequence
  MKO10023019_A_Grk1
  gRNA
ucucguacaaugugaccccc

SEQ ID NO: 23020 - RNA, 20 nt, Artificial Sequence
  MKO10023020_A_Grk4
  gRNA
guacgaaguuaccauugaag

SEQ ID NO: 23021 - RNA, 20 nt, Artificial Sequence
  MKO10023021_A_Grk4
  gRNA
cuguugcugaaggcccgucu

SEQ ID NO: 23022 - RNA, 20 nt, Artificial Sequence
  MKO10023022_A_Grk4
  gRNA
cuuugcgacaaacagccaau

SEQ ID NO: 23023 - RNA, 20 nt, Artificial Sequence
  MKO10023023_A_Grk5
  gRNA
uucgacaguucugugaaacc

SEQ ID NO: 23024 - RNA, 20 nt, Artificial Sequence
  MKO10023024_A_Grk5
  gRNA
agaccagguccuguccaacu

SEQ ID NO: 23025 - RNA, 20 nt, Artificial Sequence
  MKO10023025_A_Grk5
  gRNA
gcuccuuaccuaugguccuu

SEQ ID NO: 23026 - RNA, 20 nt, Artificial Sequence
  MKO10023026_A_Grk6
  gRNA
uacgauguucucgagcucca

SEQ ID NO: 23027 - RNA, 20 nt, Artificial Sequence
  MKO10023027_A_Grk6
  gRNA
cgagaacaucguagcgaaca

SEQ ID NO: 23028 - RNA, 20 nt, Artificial Sequence
  MKO10023028_A_Grk6
  gRNA
caaugggcuggcgcucacau

SEQ ID NO: 23029 - RNA, 20 nt, Artificial Sequence
  MKO10023029_A_Grlf1
  gRNA
agugcugaagaaguucccga

SEQ ID NO: 23030 - RNA, 20 nt, Artificial Sequence
  MKO10023030_A_Grlf1
  gRNA
auugaguacaucgaagccac

SEQ ID NO: 23031 - RNA, 20 nt, Artificial Sequence
  MKO10023031_A_Grlf1
  gRNA
cucuuucagaaaucaacgac

SEQ ID NO: 23032 - RNA, 20 nt, Artificial Sequence
  MKO10023032_A_Grm1
  gRNA
cgaugcuugauaucgucaag

SEQ ID NO: 23033 - RNA, 20 nt, Artificial Sequence
  MKO10023033_A_Grm1
  gRNA
cugagugccaugcgccgccu

SEQ ID NO: 23034 - RNA, 20 nt, Artificial Sequence
  MKO10023034_A_Grm1
  gRNA
agaacucucccacgacgcca

SEQ ID NO: 23035 - RNA, 20 nt, Artificial Sequence
  MKO10023035_A_Grm2
  gRNA
gcggcauaacgccacacccg

SEQ ID NO: 23036 - RNA, 20 nt, Artificial Sequence
  MKO10023036_A_Grm2
  gRNA
aaucgcaucgcucgcaucuu

SEQ ID NO: 23037 - RNA, 20 nt, Artificial Sequence
  MKO10023037_A_Grm2
  gRNA
ucgggcacgcaacaucugcg

SEQ ID NO: 23038 - RNA, 20 nt, Artificial Sequence
  MKO10023038_A_Grm3
  gRNA
cucacggaucacgcugucgu

SEQ ID NO: 23039 - RNA, 20 nt, Artificial Sequence
  MKO10023039_A_Grm3
  gRNA
gaaaccuaacgcgcgaguug

SEQ ID NO: 23040 - RNA, 20 nt, Artificial Sequence
  MKO10023040_A_Grm3
  gRNA
aucugugcauugcgccgacu

SEQ ID NO: 23041 - RNA, 20 nt, Artificial Sequence
  MKO10023041_A_Grm4
  gRNA
gccgcacgcuugacaacaac

SEQ ID NO: 23042 - RNA, 20 nt, Artificial Sequence
  MKO10023042_A_Grm4
  gRNA
gaggguagcuacggcgagag

SEQ ID NO: 23043 - RNA, 20 nt, Artificial Sequence
  MKO10023043_A_Grm4
  gRNA
auguguccgagggcacgacc

SEQ ID NO: 23044 - RNA, 20 nt, Artificial Sequence
  MKO10023044_A_Grm5
  gRNA
augagacgcuugggucuagc

SEQ ID NO: 23045 - RNA, 20 nt, Artificial Sequence
  MKO10023045_A_Grm5
  gRNA
ccgcuccaagaaacccauag

SEQ ID NO: 23046 - RNA, 20 nt, Artificial Sequence
  MKO10023046_A_Grm5
  gRNA
ggcuugguacgcuguguaga

SEQ ID NO: 23047 - RNA, 20 nt, Artificial Sequence
  MKO10023047_A_Grm6
  gRNA
gaugaugaugccccgggcgu

SEQ ID NO: 23048 - RNA, 20 nt, Artificial Sequence
  MKO10023048_A_Grm6
  gRNA
accgucgauugaagcccuuu

SEQ ID NO: 23049 - RNA, 20 nt, Artificial Sequence
  MKO10023049_A_Grm6
  gRNA
auacuuuaugacucguuccc

SEQ ID NO: 23050 - RNA, 20 nt, Artificial Sequence
  MKO10023050_A_Grm7
  gRNA
gacacggaucgcaaaugcac

SEQ ID NO: 23051 - RNA, 20 nt, Artificial Sequence
  MKO10023051_A_Grm7
  gRNA
ccaaccuaagagagcgacug

SEQ ID NO: 23052 - RNA, 20 nt, Artificial Sequence
  MKO10023052_A_Grm7
  gRNA
cuaugacuucuucucucgcg

SEQ ID NO: 23053 - RNA, 20 nt, Artificial Sequence
  MKO10023053_A_Grm8
  gRNA
cauaaucacugcgcgagcgu

SEQ ID NO: 23054 - RNA, 20 nt, Artificial Sequence
  MKO10023054_A_Grm8
  gRNA
aaaaauuaucaaacgccugc

SEQ ID NO: 23055 - RNA, 20 nt, Artificial Sequence
  MKO10023055_A_Grm8
  gRNA
uauggauuggcucagauagu

SEQ ID NO: 23056 - RNA, 20 nt, Artificial Sequence
  MKO10023056_A_Grn
  gRNA
auaacgagccaucaucuaga

SEQ ID NO: 23057 - RNA, 20 nt, Artificial Sequence
  MKO10023057_A_Grn
  gRNA
ggcuaccagcccugccgcga

SEQ ID NO: 23058 - RNA, 20 nt, Artificial Sequence
  MKO10023058_A_Grn
  gRNA
gccggaacacaguguccaga

SEQ ID NO: 23059 - RNA, 20 nt, Artificial Sequence
  MKO10023059_A_Grpel1
  gRNA
guucgacccuuacgaacaug

SEQ ID NO: 23060 - RNA, 20 nt, Artificial Sequence
  MKO10023060_A_Grpel1
  gRNA
guagcugugcacaacaagcg

SEQ ID NO: 23061 - RNA, 20 nt, Artificial Sequence
  MKO10023061_A_Grpel1
  gRNA
aacaaggccucauguucgua

SEQ ID NO: 23062 - RNA, 20 nt, Artificial Sequence
  MKO10023062_A_Grpel2
  gRNA
acauggcggcgcguucgcug

SEQ ID NO: 23063 - RNA, 20 nt, Artificial Sequence
  MKO10023063_A_Grpel2
  gRNA
uacuacucacgguuaaaucc

SEQ ID NO: 23064 - RNA, 20 nt, Artificial Sequence
  MKO10023064_A_Grpel2
  gRNA
cacaaucagcgacagcucuc

SEQ ID NO: 23065 - RNA, 20 nt, Artificial Sequence
  MKO10023065_A_Grpr
  gRNA
aucaucgugauaggucuuau

SEQ ID NO: 23066 - RNA, 20 nt, Artificial Sequence
  MKO10023066_A_Grpr
  gRNA
gcggcuugccaagacaguac

SEQ ID NO: 23067 - RNA, 20 nt, Artificial Sequence
  MKO10023067_A_Grpr
  gRNA
gagugccuacaaucuucccg

SEQ ID NO: 23068 - RNA, 20 nt, Artificial Sequence
  MKO10023068_A_Grp
  gRNA
uguauccgcgcggcagucac

SEQ ID NO: 23069 - RNA, 20 nt, Artificial Sequence
  MKO10023069_A_Grp
  gRNA
uaacgacguucaaaccgcua

SEQ ID NO: 23070 - RNA, 20 nt, Artificial Sequence
  MKO10023070_A_Grp
  gRNA
cgucucugucagccgcauac

SEQ ID NO: 23071 - RNA, 20 nt, Artificial Sequence
  MKO10023071_A_Grrp1
  gRNA
gcgauuggacauccagcgac

SEQ ID NO: 23072 - RNA, 20 nt, Artificial Sequence
  MKO10023072_A_Grrp1
  gRNA
gcguuccaccaccgacaccg

SEQ ID NO: 23073 - RNA, 20 nt, Artificial Sequence
  MKO10023073_A_Grrp1
  gRNA
aaucgcucuuucuccgacag

SEQ ID NO: 23074 - RNA, 20 nt, Artificial Sequence
  MKO10023074_A_Grsf1
  gRNA
uguuuaucucauucgagcuc

SEQ ID NO: 23075 - RNA, 20 nt, Artificial Sequence
  MKO10023075_A_Grsf1
  gRNA
auccaccucgucuccuagcu

SEQ ID NO: 23076 - RNA, 20 nt, Artificial Sequence
  MKO10023076_A_Grsf1
  gRNA
accgcugccccauguacauc

SEQ ID NO: 23077 - RNA, 20 nt, Artificial Sequence
  MKO10023077_A_Grtp1
  gRNA
auacuaccaucgacugcucg

SEQ ID NO: 23078 - RNA, 20 nt, Artificial Sequence
  MKO10023078_A_Grtp1
  gRNA
ucucgcccucgagcagucga

SEQ ID NO: 23079 - RNA, 20 nt, Artificial Sequence
  MKO10023079_A_Grtp1
  gRNA
ucaccaagagggcgaucaaa

SEQ ID NO: 23080 - RNA, 20 nt, Artificial Sequence
  MKO10023080_A_Grwd1
  gRNA
cgguugaugccaccguagug

SEQ ID NO: 23081 - RNA, 20 nt, Artificial Sequence
  MKO10023081_A_Grwd1
  gRNA
ccgccuggguucccgcacac

SEQ ID NO: 23082 - RNA, 20 nt, Artificial Sequence
  MKO10023082_A_Grwd1
  gRNA
ccaaacucaccgggcacccg

SEQ ID NO: 23083 - RNA, 20 nt, Artificial Sequence
  MKO10023083_A_Grxcr1
  gRNA
aaggacacucgugcggaugc

SEQ ID NO: 23084 - RNA, 20 nt, Artificial Sequence
  MKO10023084_A_Grxcr1
  gRNA
aaccaguucgcaucucucga

SEQ ID NO: 23085 - RNA, 20 nt, Artificial Sequence
  MKO10023085_A_Grxcr1
  gRNA
gaccuucgagagaugcgaac

SEQ ID NO: 23086 - RNA, 20 nt, Artificial Sequence
  MKO10023086_A_Grxcr2
  gRNA
ugcccccugccggagcggaa

SEQ ID NO: 23087 - RNA, 20 nt, Artificial Sequence
  MKO10023087_A_Grxcr2
  gRNA
gaaaaucauccgaaccccga

SEQ ID NO: 23088 - RNA, 20 nt, Artificial Sequence
  MKO10023088_A_Grxcr2
  gRNA
ugcccugccugcaacgagaa

SEQ ID NO: 23089 - RNA, 20 nt, Artificial Sequence
  MKO10023089_A_Gsap
  gRNA
gucauucuuuacucccucug

SEQ ID NO: 23090 - RNA, 20 nt, Artificial Sequence
  MKO10023090_A_Gsap
  gRNA
uugccaaaccagacagaaug

SEQ ID NO: 23091 - RNA, 20 nt, Artificial Sequence
  MKO10023091_A_Gsap
  gRNA
guaaagaaugaccuucagcc

SEQ ID NO: 23092 - RNA, 20 nt, Artificial Sequence
  MKO10023092_A_Gsc2
  gRNA
cgccgagcuagacgaacccg

SEQ ID NO: 23093 - RNA, 20 nt, Artificial Sequence
  MKO10023093_A_Gsc2
  gRNA
ggcgggguuccgaccaccga

SEQ ID NO: 23094 - RNA, 20 nt, Artificial Sequence
  MKO10023094_A_Gsc2
  gRNA
gcguucgcgugugccuacgu

SEQ ID NO: 23095 - RNA, 20 nt, Artificial Sequence
  MKO10023095_A_Gsc
  gRNA
gacucgcucuacggcgccgg

SEQ ID NO: 23096 - RNA, 20 nt, Artificial Sequence
  MKO10023096_A_Gsc
  gRNA
guagaaggcgccguaguccg

SEQ ID NO: 23097 - RNA, 20 nt, Artificial Sequence
  MKO10023097_A_Gsc
  gRNA
cgaugagcagcucgaagccc

SEQ ID NO: 23098 - RNA, 20 nt, Artificial Sequence
  MKO10023098_A_Gsdma2
  gRNA
gugagacaacugaucaucua

SEQ ID NO: 23099 - RNA, 20 nt, Artificial Sequence
  MKO10023099_A_Gsdma2
  gRNA
aguacuguccagaugauauc

SEQ ID NO: 23100 - RNA, 20 nt, Artificial Sequence
  MKO10023100_A_Gsdma2
  gRNA
ccagcgugcugcuuugugac

SEQ ID NO: 23101 - RNA, 20 nt, Artificial Sequence
  MKO10023101_A_Gsdma3
  gRNA
caugauaccucaucucguuc

SEQ ID NO: 23102 - RNA, 20 nt, Artificial Sequence
  MKO10023102_A_Gsdma3
  gRNA
uacacgccugaucuuaggga

SEQ ID NO: 23103 - RNA, 20 nt, Artificial Sequence
  MKO10023103_A_Gsdma3
  gRNA
ucucaguagucucacucgau

SEQ ID NO: 23104 - RNA, 20 nt, Artificial Sequence
  MKO10023104_A_Gsdma
  gRNA
acgcggggagaaccucuaug

SEQ ID NO: 23105 - RNA, 20 nt, Artificial Sequence
  MKO10023105_A_Gsdma
  gRNA
cuaucgagugagacaacuga

SEQ ID NO: 23106 - RNA, 20 nt, Artificial Sequence
  MKO10023106_A_Gsdma
  gRNA
cacucuggagcgagccggca

SEQ ID NO: 23107 - RNA, 20 nt, Artificial Sequence
  MKO10023107_A_Gsdmc2
  gRNA
agugucaaucuuucaguuaa

SEQ ID NO: 23108 - RNA, 20 nt, Artificial Sequence
  MKO10023108_A_Gsdmc2
  gRNA
auuuauagaacagaauugca

SEQ ID NO: 23109 - RNA, 20 nt, Artificial Sequence
  MKO10023109_A_Gsdmc2
  gRNA
cuucauacauguccaaucaa

SEQ ID NO: 23110 - RNA, 20 nt, Artificial Sequence
  MKO10023110_A_Gsdmc3
  gRNA
aagaagaagaugaccuuucc

SEQ ID NO: 23111 - RNA, 20 nt, Artificial Sequence
  MKO10023111_A_Gsdmc3
  gRNA
agaggcuuaugaagugucca

SEQ ID NO: 23112 - RNA, 20 nt, Artificial Sequence
  MKO10023112_A_Gsdmc3
  gRNA
auuuauagaacagaauuaca

SEQ ID NO: 23113 - RNA, 20 nt, Artificial Sequence
  MKO10023113_A_Gsdmc4
  gRNA
uccugauaucuuagcguuac

SEQ ID NO: 23114 - RNA, 20 nt, Artificial Sequence
  MKO10023114_A_Gsdmc4
  gRNA
accuguaacgcuaagauauc

SEQ ID NO: 23115 - RNA, 20 nt, Artificial Sequence
  MKO10023115_A_Gsdmc4
  gRNA
acauguccaaucaacagacc

SEQ ID NO: 23116 - RNA, 20 nt, Artificial Sequence
  MKO10023116_A_Gsdmc
  gRNA
cuggaugucgaaaccauugc

SEQ ID NO: 23117 - RNA, 20 nt, Artificial Sequence
  MKO10023117_A_Gsdmc
  gRNA
aaccucgaugucauauccac

SEQ ID NO: 23118 - RNA, 20 nt, Artificial Sequence
  MKO10023118_A_Gsdmc
  gRNA
gucuggacaucuaagauauc

SEQ ID NO: 23119 - RNA, 20 nt, Artificial Sequence
  MKO10023119_A_Gsdmd
  gRNA
aaagucucugaugucgucga

SEQ ID NO: 23120 - RNA, 20 nt, Artificial Sequence
  MKO10023120_A_Gsdmd
  gRNA
cacgacuccgaagcuguugc

SEQ ID NO: 23121 - RNA, 20 nt, Artificial Sequence
  MKO10023121_A_Gsdmd
  gRNA
ucguggggaugaccuguuug

SEQ ID NO: 23122 - RNA, 20 nt, Artificial Sequence
  MKO10023122_A_Gse1
  gRNA
cugggccgacagcguacugc

SEQ ID NO: 23123 - RNA, 20 nt, Artificial Sequence
  MKO10023123_A_Gse1
  gRNA
caguggucgggagcgccuau

SEQ ID NO: 23124 - RNA, 20 nt, Artificial Sequence
  MKO10023124_A_Gse1
  gRNA
ccgggcuaccggugggcacc

SEQ ID NO: 23125 - RNA, 20 nt, Artificial Sequence
  MKO10023125_A_Gsg1l
  gRNA
cuaugaacgucggcuccucc

SEQ ID NO: 23126 - RNA, 20 nt, Artificial Sequence
  MKO10023126_A_Gsg1l
  gRNA
ccaucaaauacuuccgggag

SEQ ID NO: 23127 - RNA, 20 nt, Artificial Sequence
  MKO10023127_A_Gsg1l
  gRNA
cacuccagcagcgucauaga

SEQ ID NO: 23128 - RNA, 20 nt, Artificial Sequence
  MKO10023128_A_Gsg1
  gRNA
gaugaguugaaguccgauau

SEQ ID NO: 23129 - RNA, 20 nt, Artificial Sequence
  MKO10023129_A_Gsg1
  gRNA
gugacaugagccuugcaacg

SEQ ID NO: 23130 - RNA, 20 nt, Artificial Sequence
  MKO10023130_A_Gsg1
  gRNA
cgcguuugcagccgucuccu

SEQ ID NO: 23131 - RNA, 20 nt, Artificial Sequence
  MKO10023131_A_Gsg2
  gRNA
ccggcucuuucgaacguacg

SEQ ID NO: 23132 - RNA, 20 nt, Artificial Sequence
  MKO10023132_A_Gsg2
  gRNA
cagcgacaguaacgagucgc

SEQ ID NO: 23133 - RNA, 20 nt, Artificial Sequence
  MKO10023133_A_Gsg2
  gRNA
ccgcguacguucgaaagagc

SEQ ID NO: 23134 - RNA, 20 nt, Artificial Sequence
  MKO10023134_A_Gsk3a
  gRNA
acugcagauuaugcguaagc

SEQ ID NO: 23135 - RNA, 20 nt, Artificial Sequence
  MKO10023135_A_Gsk3a
  gRNA
cucauucggaguaguauacc

SEQ ID NO: 23136 - RNA, 20 nt, Artificial Sequence
  MKO10023136_A_Gsk3a
  gRNA
uuccuuaggugacagcggga

SEQ ID NO: 23137 - RNA, 20 nt, Artificial Sequence
  MKO10023137_A_Gsk3b
  gRNA
acuguaacauaguccgacug

SEQ ID NO: 23138 - RNA, 20 nt, Artificial Sequence
  MKO10023138_A_Gsk3b
  gRNA
cguaccuugacauagaucac

SEQ ID NO: 23139 - RNA, 20 nt, Artificial Sequence
  MKO10023139_A_Gsk3b
  gRNA
aguagaagaaauaccgcagu

SEQ ID NO: 23140 - RNA, 20 nt, Artificial Sequence
  MKO10023140_A_Gskip
  gRNA
gcgcguuuccgaaugcuucc

SEQ ID NO: 23141 - RNA, 20 nt, Artificial Sequence
  MKO10023141_A_Gskip
  gRNA
auaagaacaugggcgcucgc

SEQ ID NO: 23142 - RNA, 20 nt, Artificial Sequence
  MKO10023142_A_Gskip
  gRNA
ggaaacagacuauaaucccg

SEQ ID NO: 23143 - RNA, 20 nt, Artificial Sequence
  MKO10023143_A_Gsn
  gRNA
ugcaguaugaccuccacuau

SEQ ID NO: 23144 - RNA, 20 nt, Artificial Sequence
  MKO10023144_A_Gsn
  gRNA
cuacacggcguccuuugacc

SEQ ID NO: 23145 - RNA, 20 nt, Artificial Sequence
  MKO10023145_A_Gsn
  gRNA
ccguguaguccgugcuacug

SEQ ID NO: 23146 - RNA, 20 nt, Artificial Sequence
  MKO10023146_A_Gspt1
  gRNA
acggcacgaauucagcggcg

SEQ ID NO: 23147 - RNA, 20 nt, Artificial Sequence
  MKO10023147_A_Gspt1
  gRNA
ucgccuccggcugcgccagc

SEQ ID NO: 23148 - RNA, 20 nt, Artificial Sequence
  MKO10023148_A_Gspt1
  gRNA
aaaacuuaccuucacacgac

SEQ ID NO: 23149 - RNA, 20 nt, Artificial Sequence
  MKO10023149_A_Gspt2
  gRNA
cgugccuagcguaagcgcag

SEQ ID NO: 23150 - RNA, 20 nt, Artificial Sequence
  MKO10023150_A_Gspt2
  gRNA
ggggcgauuccauccccgcu

SEQ ID NO: 23151 - RNA, 20 nt, Artificial Sequence
  MKO10023151_A_Gspt2
  gRNA
aacuccgcugcgcuuacgcu

SEQ ID NO: 23152 - RNA, 20 nt, Artificial Sequence
  MKO10023152_A_Gsr
  gRNA
cugcgaauguugcauagccg

SEQ ID NO: 23153 - RNA, 20 nt, Artificial Sequence
  MKO10023153_A_Gsr
  gRNA
augcacgaucacguggauua

SEQ ID NO: 23154 - RNA, 20 nt, Artificial Sequence
  MKO10023154_A_Gsr
  gRNA
aacugugggcacgccuccug

SEQ ID NO: 23155 - RNA, 20 nt, Artificial Sequence
  MKO10023155_A_Gss
  gRNA
uggagccgucugcgccgcac

SEQ ID NO: 23156 - RNA, 20 nt, Artificial Sequence
  MKO10023156_A_Gss
  gRNA
acauguaaucugagcgauuc

SEQ ID NO: 23157 - RNA, 20 nt, Artificial Sequence
  MKO10023157_A_Gss
  gRNA
accuagacaguguuugcucc

SEQ ID NO: 23158 - RNA, 20 nt, Artificial Sequence
  MKO10023158_A_Gsua1
  gRNA
agagaaguuuauacagaguc

SEQ ID NO: 23159 - RNA, 20 nt, Artificial Sequence
  MKO10023159_A_Gsua1
  gRNA
gauuuggaaaagcuaaaaaa

SEQ ID NO: 23160 - RNA, 20 nt, Artificial Sequence
  MKO10023160_A_Gsua1
  gRNA
ccuucauguccuucccauag

SEQ ID NO: 23161 - RNA, 20 nt, Artificial Sequence
  MKO10023161_A_Gsua2
  gRNA
cauagagaagaaguuccagc

SEQ ID NO: 23162 - RNA, 20 nt, Artificial Sequence
  MKO10023162_A_Gsua2
  gRNA
agagaaguuuauacagaguc

SEQ ID NO: 23163 - RNA, 20 nt, Artificial Sequence
  MKO10023163_A_Gsua2
  gRNA
gauuuggaaaagcuaaaaaa

SEQ ID NO: 23164 - RNA, 20 nt, Artificial Sequence
  MKO10023164_A_Gsua3
  gRNA
aagauuaucucguuggcaac

SEQ ID NO: 23165 - RNA, 20 nt, Artificial Sequence
  MKO10023165_A_Gsua3
  gRNA
gagcagggcugauauugccc

SEQ ID NO: 23166 - RNA, 20 nt, Artificial Sequence
  MKO10023166_A_Gsua3
  gRNA
gaccuggcaagguuacgaag

SEQ ID NO: 23167 - RNA, 20 nt, Artificial Sequence
  MKO10023167_A_Gsua4
  gRNA
guacccuugguugaaaucga

SEQ ID NO: 23168 - RNA, 20 nt, Artificial Sequence
  MKO10023168_A_Gsua4
  gRNA
caacgagaaaagccucuccg

SEQ ID NO: 23169 - RNA, 20 nt, Artificial Sequence
  MKO10023169_A_Gsua4
  gRNA
guccgacuucccucugcugc

SEQ ID NO: 23170 - RNA, 20 nt, Artificial Sequence
  MKO10023170_A_Gsucd
  gRNA
uccugcugccgucagcccga

SEQ ID NO: 23171 - RNA, 20 nt, Artificial Sequence
  MKO10023171_A_Gsucd
  gRNA
accgacuaugaccaaguuga

SEQ ID NO: 23172 - RNA, 20 nt, Artificial Sequence
  MKO10023172_A_Gsucd
  gRNA
agccgccgaccucccgccuc

SEQ ID NO: 23173 - RNA, 20 nt, Artificial Sequence
  MKO10023173_A_Gstk1
  gRNA
uugcggcccacuuuaaucgc

SEQ ID NO: 23174 - RNA, 20 nt, Artificial Sequence
  MKO10023174_A_Gstk1
  gRNA
caugaucccagcgauuaaag

SEQ ID NO: 23175 - RNA, 20 nt, Artificial Sequence
  MKO10023175_A_Gstk1
  gRNA
gagagauauggaugcgugua

SEQ ID NO: 23176 - RNA, 20 nt, Artificial Sequence
  MKO10023176_A_Gstm1
  gRNA
gguggcauuaccgucaccca

SEQ ID NO: 23177 - RNA, 20 nt, Artificial Sequence
  MKO10023177_A_Gstm1
  gRNA
ccuugcccgaaagcaccacc

SEQ ID NO: 23178 - RNA, 20 nt, Artificial Sequence
  MKO10023178_A_Gstm1
  gRNA
acucacccagguggugcuuu

SEQ ID NO: 23179 - RNA, 20 nt, Artificial Sequence
  MKO10023179_A_Gstm2
  gRNA
gguguaaucaccguccccca

SEQ ID NO: 23180 - RNA, 20 nt, Artificial Sequence
  MKO10023180_A_Gstm2
  gRNA
cagcugcccuacuugauuga

SEQ ID NO: 23181 - RNA, 20 nt, Artificial Sequence
  MKO10023181_A_Gstm2
  gRNA
acucacacagguugugcuuu

SEQ ID NO: 23182 - RNA, 20 nt, Artificial Sequence
  MKO10023182_A_Gstm3
  gRNA
ucacuccauccgcuugcucc

SEQ ID NO: 23183 - RNA, 20 nt, Artificial Sequence
  MKO10023183_A_Gstm3
  gRNA
agacuaucaugagcuguaug

SEQ ID NO: 23184 - RNA, 20 nt, Artificial Sequence
  MKO10023184_A_Gstm3
  gRNA
cacuuacauugggaaaaucc

SEQ ID NO: 23185 - RNA, 20 nt, Artificial Sequence
  MKO10023185_A_Gstm4
  gRNA
aauagcauuaccgucuccca

SEQ ID NO: 23186 - RNA, 20 nt, Artificial Sequence
  MKO10023186_A_Gstm4
  gRNA
uauggaugucuccaaucagc

SEQ ID NO: 23187 - RNA, 20 nt, Artificial Sequence
  MKO10023187_A_Gstm4
  gRNA
acagacucgagccagcugau

SEQ ID NO: 23188 - RNA, 20 nt, Artificial Sequence
  MKO10023188_A_Gstm5
  gRNA
gcuugcgugcgauguaucuc

SEQ ID NO: 23189 - RNA, 20 nt, Artificial Sequence
  MKO10023189_A_Gstm5
  gRNA
cauggacuuccgcaugcagc

SEQ ID NO: 23190 - RNA, 20 nt, Artificial Sequence
  MKO10023190_A_Gstm5
  gRNA
ucaugcuauccgcaugcuuc

SEQ ID NO: 23191 - RNA, 20 nt, Artificial Sequence
  MKO10023191_A_Gstm6
  gRNA
cauggacacucgaauucaga

SEQ ID NO: 23192 - RNA, 20 nt, Artificial Sequence
  MKO10023192_A_Gstm6
  gRNA
guuucuccaaaauguccaca

SEQ ID NO: 23193 - RNA, 20 nt, Artificial Sequence
  MKO10023193_A_Gstm6
  gRNA
ugacaaguucaagcuggacc

SEQ ID NO: 23194 - RNA, 20 nt, Artificial Sequence
  MKO10023194_A_Gstm7
  gRNA
ucagcuuauggacaaccgca

SEQ ID NO: 23195 - RNA, 20 nt, Artificial Sequence
  MKO10023195_A_Gstm7
  gRNA
uacuuacguuaggaaagucc

SEQ ID NO: 23196 - RNA, 20 nt, Artificial Sequence
  MKO10023196_A_Gstm7
  gRNA
ccaugccauucgccuguucc

SEQ ID NO: 23197 - RNA, 20 nt, Artificial Sequence
  MKO10023197_A_Gsto1
  gRNA
uccagaugacccguacaaga

SEQ ID NO: 23198 - RNA, 20 nt, Artificial Sequence
  MKO10023198_A_Gsto1
  gRNA
ucguccucaccggauucccu

SEQ ID NO: 23199 - RNA, 20 nt, Artificial Sequence
  MKO10023199_A_Gsto1
  gRNA
cuucgcucagaggacgcuga

SEQ ID NO: 23200 - RNA, 20 nt, Artificial Sequence
  MKO10023200_A_Gsto2
  gRNA
ccaugauugauuaccucguc

SEQ ID NO: 23201 - RNA, 20 nt, Artificial Sequence
  MKO10023201_A_Gsto2
  gRNA
uauacagucuccgccgaaga

SEQ ID NO: 23202 - RNA, 20 nt, Artificial Sequence
  MKO10023202_A_Gsto2
  gRNA
gcucguucauacgggucaua

SEQ ID NO: 23203 - RNA, 20 nt, Artificial Sequence
  MKO10023203_A_Gstp1
  gRNA
gucagccagcagcauucgca

SEQ ID NO: 23204 - RNA, 20 nt, Artificial Sequence
  MKO10023204_A_Gstp1
  gRNA
auugucuacuucccaguucg

SEQ ID NO: 23205 - RNA, 20 nt, Artificial Sequence
  MKO10023205_A_Gstp1
  gRNA
ucacauaguugguguagaug

SEQ ID NO: 23206 - RNA, 20 nt, Artificial Sequence
  MKO10023206_A_Gstp2
  gRNA
gucagccagcagcaugcgca

SEQ ID NO: 23207 - RNA, 20 nt, Artificial Sequence
  MKO10023207_A_Gstp2
  gRNA
gcgcaugcugcuggcugacc

SEQ ID NO: 23208 - RNA, 20 nt, Artificial Sequence
  MKO10023208_A_Gstp2
  gRNA
cacauaguuucuguagauca

SEQ ID NO: 23209 - RNA, 20 nt, Artificial Sequence
  MKO10023209_A_Gsuu1
  gRNA
accucagcgaugcguuugcc

SEQ ID NO: 23210 - RNA, 20 nt, Artificial Sequence
  MKO10023210_A_Gsuu1
  gRNA
cuacacgagcacgagccugc

SEQ ID NO: 23211 - RNA, 20 nt, Artificial Sequence
  MKO10023211_A_Gsuu1
  gRNA
agaacuggauguuaaccuac

SEQ ID NO: 23212 - RNA, 20 nt, Artificial Sequence
  MKO10023212_A_Gsuu2
  gRNA
cugguacccggccgaccuac

SEQ ID NO: 23213 - RNA, 20 nt, Artificial Sequence
  MKO10023213_A_Gsuu2
  gRNA
gauccgcuagcgucaccugc

SEQ ID NO: 23214 - RNA, 20 nt, Artificial Sequence
  MKO10023214_A_Gsuu2
  gRNA
ugcccaaguccacgaauacc

SEQ ID NO: 23215 - RNA, 20 nt, Artificial Sequence
  MKO10023215_A_Gsuu3
  gRNA
ccccgaccacugguacccuc

SEQ ID NO: 23216 - RNA, 20 nt, Artificial Sequence
  MKO10023216_A_Gsuu3
  gRNA
guacacagauuccuucgccc

SEQ ID NO: 23217 - RNA, 20 nt, Artificial Sequence
  MKO10023217_A_Gsuu3
  gRNA
gggacuucgucuuggcagag

SEQ ID NO: 23218 - RNA, 20 nt, Artificial Sequence
  MKO10023218_A_Gsuu4
  gRNA
caaauccucaucuugaucgu

SEQ ID NO: 23219 - RNA, 20 nt, Artificial Sequence
  MKO10023219_A_Gsuu4
  gRNA
uagacccuacgaucaagaug

SEQ ID NO: 23220 - RNA, 20 nt, Artificial Sequence
  MKO10023220_A_Gsuu4
  gRNA
gcgcacuguacuugcgacau

SEQ ID NO: 23221 - RNA, 20 nt, Artificial Sequence
  MKO10023221_A_Gstz1
  gRNA
gucagaaaucaugcgcacga

SEQ ID NO: 23222 - RNA, 20 nt, Artificial Sequence
  MKO10023222_A_Gstz1
  gRNA
auuucugaccucaucgcuag

SEQ ID NO: 23223 - RNA, 20 nt, Artificial Sequence
  MKO10023223_A_Gstz1
  gRNA
aauucgaacucuccaugaac

SEQ ID NO: 23224 - RNA, 20 nt, Artificial Sequence
  MKO10023224_A_Gsx1
  gRNA
gggcgccugccacgcgcgca

SEQ ID NO: 23225 - RNA, 20 nt, Artificial Sequence
  MKO10023225_A_Gsx1
  gRNA
aguaaccaccgcggcggagc

SEQ ID NO: 23226 - RNA, 20 nt, Artificial Sequence
  MKO10023226_A_Gsx1
  gRNA
acauguaccucucccgccug

SEQ ID NO: 23227 - RNA, 20 nt, Artificial Sequence
  MKO10023227_A_Gsx2
  gRNA
caugucgcgcuccuucuacg

SEQ ID NO: 23228 - RNA, 20 nt, Artificial Sequence
  MKO10023228_A_Gsx2
  gRNA
ggcuguccgucccgcaaaag

SEQ ID NO: 23229 - RNA, 20 nt, Artificial Sequence
  MKO10023229_A_Gsx2
  gRNA
ggcgcauuaugcgcgcuccg

SEQ ID NO: 23230 - RNA, 20 nt, Artificial Sequence
  MKO10023230_A_Gtdc1
  gRNA
gauacaaccaaauucucucg

SEQ ID NO: 23231 - RNA, 20 nt, Artificial Sequence
  MKO10023231_A_Gtdc1
  gRNA
auaccuaccacgagagaauu

SEQ ID NO: 23232 - RNA, 20 nt, Artificial Sequence
  MKO10023232_A_Gtdc1
  gRNA
uggaggcucccaucgacagc

SEQ ID NO: 23233 - RNA, 20 nt, Artificial Sequence
  MKO10023233_A_Gtf2a1l
  gRNA
uauccgauccacgucccagc

SEQ ID NO: 23234 - RNA, 20 nt, Artificial Sequence
  MKO10023234_A_Gtf2a1l
  gRNA
gucuagaacaccgccaacug

SEQ ID NO: 23235 - RNA, 20 nt, Artificial Sequence
  MKO10023235_A_Gtf2a1l
  gRNA
aagcuacguaccaggucuuc

SEQ ID NO: 23236 - RNA, 20 nt, Artificial Sequence
  MKO10023236_A_Gtf2a1
  gRNA
uuugcugagguugcgcuugc

SEQ ID NO: 23237 - RNA, 20 nt, Artificial Sequence
  MKO10023237_A_Gtf2a1
  gRNA
gcaagcgcaaccucagcaaa

SEQ ID NO: 23238 - RNA, 20 nt, Artificial Sequence
  MKO10023238_A_Gtf2a1
  gRNA
acugccugcaggagugacuc

SEQ ID NO: 23239 - RNA, 20 nt, Artificial Sequence
  MKO10023239_A_Gtf2a2
  gRNA
agauacuggcucgaauacua

SEQ ID NO: 23240 - RNA, 20 nt, Artificial Sequence
  MKO10023240_A_Gtf2a2
  gRNA
gagccuugaugagcucauac

SEQ ID NO: 23241 - RNA, 20 nt, Artificial Sequence
  MKO10023241_A_Gtf2a2
  gRNA
acagauucugcgauaauguu

SEQ ID NO: 23242 - RNA, 20 nt, Artificial Sequence
  MKO10023242_A_Gtf2b
  gRNA
gaacuuacaacuauauugcg

SEQ ID NO: 23243 - RNA, 20 nt, Artificial Sequence
  MKO10023243_A_Gtf2b
  gRNA
ugauucggacaugugacucu

SEQ ID NO: 23244 - RNA, 20 nt, Artificial Sequence
  MKO10023244_A_Gtf2b
  gRNA
ugagagucuccaacucuaga

SEQ ID NO: 23245 - RNA, 20 nt, Artificial Sequence
  MKO10023245_A_Gtf2e1
  gRNA
ugaugugcaucgccccucgc

SEQ ID NO: 23246 - RNA, 20 nt, Artificial Sequence
  MKO10023246_A_Gtf2e1
  gRNA
cuuuguugguccacgccucu

SEQ ID NO: 23247 - RNA, 20 nt, Artificial Sequence
  MKO10023247_A_Gtf2e1
  gRNA
agagucaucaucugacucgc

SEQ ID NO: 23248 - RNA, 20 nt, Artificial Sequence
  MKO10023248_A_Gtf2e2
  gRNA
gcuacuagacacgacaucag

SEQ ID NO: 23249 - RNA, 20 nt, Artificial Sequence
  MKO10023249_A_Gtf2e2
  gRNA
agauacacauccucuaacgu

SEQ ID NO: 23250 - RNA, 20 nt, Artificial Sequence
  MKO10023250_A_Gtf2e2
  gRNA
acauuaccuugacagcuuuc

SEQ ID NO: 23251 - RNA, 20 nt, Artificial Sequence
  MKO10023251_A_Gtf2f1
  gRNA
cgacguacucggugacauuc

SEQ ID NO: 23252 - RNA, 20 nt, Artificial Sequence
  MKO10023252_A_Gtf2f1
  gRNA
ccuaaaggaguuucggccug

SEQ ID NO: 23253 - RNA, 20 nt, Artificial Sequence
  MKO10023253_A_Gtf2f1
  gRNA
gugaauucaaccgcaagcuu

SEQ ID NO: 23254 - RNA, 20 nt, Artificial Sequence
  MKO10023254_A_Gtf2f2
  gRNA
gguaucauuuacuuugaacg

SEQ ID NO: 23255 - RNA, 20 nt, Artificial Sequence
  MKO10023255_A_Gtf2f2
  gRNA
cuugcaaauauucaugacau

SEQ ID NO: 23256 - RNA, 20 nt, Artificial Sequence
  MKO10023256_A_Gtf2f2
  gRNA
cccaacuucaccucuuccag

SEQ ID NO: 23257 - RNA, 20 nt, Artificial Sequence
  MKO10023257_A_Gtf2h1
  gRNA
ccgacuaaauacaggaucga

SEQ ID NO: 23258 - RNA, 20 nt, Artificial Sequence
  MKO10023258_A_Gtf2h1
  gRNA
ccuucgauccuguauuuagu

SEQ ID NO: 23259 - RNA, 20 nt, Artificial Sequence
  MKO10023259_A_Gtf2h1
  gRNA
auuagcuuuccgcuugaacu

SEQ ID NO: 23260 - RNA, 20 nt, Artificial Sequence
  MKO10023260_A_Gtf2h2
  gRNA
ugaucaaaacccuaucaguc

SEQ ID NO: 23261 - RNA, 20 nt, Artificial Sequence
  MKO10023261_A_Gtf2h2
  gRNA
guagaugcgccaccuguaug

SEQ ID NO: 23262 - RNA, 20 nt, Artificial Sequence
  MKO10023262_A_Gtf2h2
  gRNA
ugucuacauaccugacugau

SEQ ID NO: 23263 - RNA, 20 nt, Artificial Sequence
  MKO10023263_A_Gtf2h3
  gRNA
gcuguugacaguugcaaacg

SEQ ID NO: 23264 - RNA, 20 nt, Artificial Sequence
  MKO10023264_A_Gtf2h3
  gRNA
ccucagccggcucuuauacc

SEQ ID NO: 23265 - RNA, 20 nt, Artificial Sequence
  MKO10023265_A_Gtf2h3
  gRNA
uaguugacaccaacccgauu

SEQ ID NO: 23266 - RNA, 20 nt, Artificial Sequence
  MKO10023266_A_Gtf2h4
  gRNA
acgucccgggcaugcuuguc

SEQ ID NO: 23267 - RNA, 20 nt, Artificial Sequence
  MKO10023267_A_Gtf2h4
  gRNA
ugcugaguggccuccguauc

SEQ ID NO: 23268 - RNA, 20 nt, Artificial Sequence
  MKO10023268_A_Gtf2h4
  gRNA
aaaugacguacccacccaga

SEQ ID NO: 23269 - RNA, 20 nt, Artificial Sequence
  MKO10023269_A_Gtf2h5
  gRNA
cgucuucgucauugccgagc

SEQ ID NO: 23270 - RNA, 20 nt, Artificial Sequence
  MKO10023270_A_Gtf2h5
  gRNA
ucaguuccccuacucgcucc

SEQ ID NO: 23271 - RNA, 20 nt, Artificial Sequence
  MKO10023271_A_Gtf2h5
  gRNA
aagauggucaacgugcugaa

SEQ ID NO: 23272 - RNA, 20 nt, Artificial Sequence
  MKO10023272_A_Gtf2ird1
  gRNA
gaacuccaccuucgcccgca

SEQ ID NO: 23273 - RNA, 20 nt, Artificial Sequence
  MKO10023273_A_Gtf2ird1
  gRNA
gguguccgccuuagacucca

SEQ ID NO: 23274 - RNA, 20 nt, Artificial Sequence
  MKO10023274_A_Gtf2ird1
  gRNA
caaugagagcgucuucguga

SEQ ID NO: 23275 - RNA, 20 nt, Artificial Sequence
  MKO10023275_A_Gtf2ird2
  gRNA
auccugucuggcguugacaa

SEQ ID NO: 23276 - RNA, 20 nt, Artificial Sequence
  MKO10023276_A_Gtf2ird2
  gRNA
agauuaccucuuuacagcga

SEQ ID NO: 23277 - RNA, 20 nt, Artificial Sequence
  MKO10023277_A_Gtf2ird2
  gRNA
guaugagacagacguguacg

SEQ ID NO: 23278 - RNA, 20 nt, Artificial Sequence
  MKO10023278_A_Gtf2i
  gRNA
gaagaugcugcgcgaccagu

SEQ ID NO: 23279 - RNA, 20 nt, Artificial Sequence
  MKO10023279_A_Gtf2i
  gRNA
uugcgaggucguaauguucg

SEQ ID NO: 23280 - RNA, 20 nt, Artificial Sequence
  MKO10023280_A_Gtf2i
  gRNA
agcauccacacucauccgau

SEQ ID NO: 23281 - RNA, 20 nt, Artificial Sequence
  MKO10023281_A_Gtf3a
  gRNA
uuguccuagguguacccacg

SEQ ID NO: 23282 - RNA, 20 nt, Artificial Sequence
  MKO10023282_A_Gtf3a
  gRNA
gccauuuguuugcgacuaug

SEQ ID NO: 23283 - RNA, 20 nt, Artificial Sequence
  MKO10023283_A_Gtf3a
  gRNA
acaccagcgagccgcucuuc

SEQ ID NO: 23284 - RNA, 20 nt, Artificial Sequence
  MKO10023284_A_Gtf3c1
  gRNA
gcuucuaccauuguacaucg

SEQ ID NO: 23285 - RNA, 20 nt, Artificial Sequence
  MKO10023285_A_Gtf3c1
  gRNA
agcgcuuaggucgauccagg

SEQ ID NO: 23286 - RNA, 20 nt, Artificial Sequence
  MKO10023286_A_Gtf3c1
  gRNA
uagcucuuacuugaaagcgg

SEQ ID NO: 23287 - RNA, 20 nt, Artificial Sequence
  MKO10023287_A_Gtf3c2
  gRNA
aagugagaacucgucugauc

SEQ ID NO: 23288 - RNA, 20 nt, Artificial Sequence
  MKO10023288_A_Gtf3c2
  gRNA
ccgggucuucuucggcuucg

SEQ ID NO: 23289 - RNA, 20 nt, Artificial Sequence
  MKO10023289_A_Gtf3c2
  gRNA
cugaguggauuccgguagcc

SEQ ID NO: 23290 - RNA, 20 nt, Artificial Sequence
  MKO10023290_A_Gtf3c3
  gRNA
uccucuagcaaagcgaauau

SEQ ID NO: 23291 - RNA, 20 nt, Artificial Sequence
  MKO10023291_A_Gtf3c3
  gRNA
gccaauauucgcuuugcuag

SEQ ID NO: 23292 - RNA, 20 nt, Artificial Sequence
  MKO10023292_A_Gtf3c3
  gRNA
uccgaaguuccauccucauc

SEQ ID NO: 23293 - RNA, 20 nt, Artificial Sequence
  MKO10023293_A_Gtf3c4
  gRNA
acuugaucgaccugguccgc

SEQ ID NO: 23294 - RNA, 20 nt, Artificial Sequence
  MKO10023294_A_Gtf3c4
  gRNA
ggacaaucgccugacugugc

SEQ ID NO: 23295 - RNA, 20 nt, Artificial Sequence
  MKO10023295_A_Gtf3c4
  gRNA
gcuugcuugcgaucugugaa

SEQ ID NO: 23296 - RNA, 20 nt, Artificial Sequence
  MKO10023296_A_Gtf3c5
  gRNA
cgaacucuacuuccggccca

SEQ ID NO: 23297 - RNA, 20 nt, Artificial Sequence
  MKO10023297_A_Gtf3c5
  gRNA
acagcauuucgugaccaaac

SEQ ID NO: 23298 - RNA, 20 nt, Artificial Sequence
  MKO10023298_A_Gtf3c5
  gRNA
gaaguagaguucgagccucu

SEQ ID NO: 23299 - RNA, 20 nt, Artificial Sequence
  MKO10023299_A_Gtf3c6
  gRNA
auagcuguccacuugcauga

SEQ ID NO: 23300 - RNA, 20 nt, Artificial Sequence
  MKO10023300_A_Gtf3c6
  gRNA
accgucuuaucaguccccuc

SEQ ID NO: 23301 - RNA, 20 nt, Artificial Sequence
  MKO10023301_A_Gtf3c6
  gRNA
ucauguccuaguggauccag

SEQ ID NO: 23302 - RNA, 20 nt, Artificial Sequence
  MKO10023302_A_Gtl3
  gRNA
augacaaaaacguucgucga

SEQ ID NO: 23303 - RNA, 20 nt, Artificial Sequence
  MKO10023303_A_Gtl3
  gRNA
aguucgugccauaugcccgc

SEQ ID NO: 23304 - RNA, 20 nt, Artificial Sequence
  MKO10023304_A_Gtl3
  gRNA
augcaaacugccguauccga

SEQ ID NO: 23305 - RNA, 20 nt, Artificial Sequence
  MKO10023305_A_Gtpbp10
  gRNA
uuguagaguuagcgcacugc

SEQ ID NO: 23306 - RNA, 20 nt, Artificial Sequence
  MKO10023306_A_Gtpbp10
  gRNA
augggaaacccgacucagua

SEQ ID NO: 23307 - RNA, 20 nt, Artificial Sequence
  MKO10023307_A_Gtpbp10
  gRNA
aaaauccuccuuacugaguc

SEQ ID NO: 23308 - RNA, 20 nt, Artificial Sequence
  MKO10023308_A_Gtpbp1
  gRNA
cuucuugacguucucguaag

SEQ ID NO: 23309 - RNA, 20 nt, Artificial Sequence
  MKO10023309_A_Gtpbp1
  gRNA
gugugcgugauuaccuaguc

SEQ ID NO: 23310 - RNA, 20 nt, Artificial Sequence
  MKO10023310_A_Gtpbp1
  gRNA
agugaucaccuucaucgacu

SEQ ID NO: 23311 - RNA, 20 nt, Artificial Sequence
  MKO10023311_A_Gtpbp2
  gRNA
cacugaggugcuaguacgaa

SEQ ID NO: 23312 - RNA, 20 nt, Artificial Sequence
  MKO10023312_A_Gtpbp2
  gRNA
auuaugacagugacgugccc

SEQ ID NO: 23313 - RNA, 20 nt, Artificial Sequence
  MKO10023313_A_Gtpbp2
  gRNA
ccaguuccuagaucuccgug

SEQ ID NO: 23314 - RNA, 20 nt, Artificial Sequence
  MKO10023314_A_Gtpbp3
  gRNA
aucgcagugauccgcaccag

SEQ ID NO: 23315 - RNA, 20 nt, Artificial Sequence
  MKO10023315_A_Gtpbp3
  gRNA
ccgaggccggagaguucacc

SEQ ID NO: 23316 - RNA, 20 nt, Artificial Sequence
  MKO10023316_A_Gtpbp3
  gRNA
uggaccgcucacucguccuc

SEQ ID NO: 23317 - RNA, 20 nt, Artificial Sequence
  MKO10023317_A_Gtpbp4
  gRNA
cgcgcuucagcugcuugcau

SEQ ID NO: 23318 - RNA, 20 nt, Artificial Sequence
  MKO10023318_A_Gtpbp4
  gRNA
uaauaguacacauucgucca

SEQ ID NO: 23319 - RNA, 20 nt, Artificial Sequence
  MKO10023319_A_Gtpbp4
  gRNA
gacucaacgaaagacuccaa

SEQ ID NO: 23320 - RNA, 20 nt, Artificial Sequence
  MKO10023320_A_Gtpbp6
  gRNA
auggucggucgcgaguaccc

SEQ ID NO: 23321 - RNA, 20 nt, Artificial Sequence
  MKO10023321_A_Gtpbp6
  gRNA
uccguuguaacgcacgcacg

SEQ ID NO: 23322 - RNA, 20 nt, Artificial Sequence
  MKO10023322_A_Gtpbp6
  gRNA
auccuggaagugcgcgcacc

SEQ ID NO: 23323 - RNA, 20 nt, Artificial Sequence
  MKO10023323_A_Gtpbp8
  gRNA
uaccaugucaacgaagucuu

SEQ ID NO: 23324 - RNA, 20 nt, Artificial Sequence
  MKO10023324_A_Gtpbp8
  gRNA
acccgaagacuucguugaca

SEQ ID NO: 23325 - RNA, 20 nt, Artificial Sequence
  MKO10023325_A_Gtpbp8
  gRNA
caggggacgugcuguaaacc

SEQ ID NO: 23326 - RNA, 20 nt, Artificial Sequence
  MKO10023326_A_Gtse1
  gRNA
acuuaaaccgccggguuccu

SEQ ID NO: 23327 - RNA, 20 nt, Artificial Sequence
  MKO10023327_A_Gtse1
  gRNA
ccagaugcugccagucgaga

SEQ ID NO: 23328 - RNA, 20 nt, Artificial Sequence
  MKO10023328_A_Gtse1
  gRNA
aucccagagugacgugcucc

SEQ ID NO: 23329 - RNA, 20 nt, Artificial Sequence
  MKO10023329_A_Gtsf1l
  gRNA
accaccgaaucccgcucagc

SEQ ID NO: 23330 - RNA, 20 nt, Artificial Sequence
  MKO10023330_A_Gtsf1l
  gRNA
aaacucuuaaggacgaacau

SEQ ID NO: 23331 - RNA, 20 nt, Artificial Sequence
  MKO10023331_A_Gtsf1l
  gRNA
uaaauacaacgccugccacg

SEQ ID NO: 23332 - RNA, 20 nt, Artificial Sequence
  MKO10023332_A_Gtsf1
  gRNA
gccaauuuguuugcgacauc

SEQ ID NO: 23333 - RNA, 20 nt, Artificial Sequence
  MKO10023333_A_Gtsf1
  gRNA
cucucuuucagucgacuccc

SEQ ID NO: 23334 - RNA, 20 nt, Artificial Sequence
  MKO10023334_A_Gtsf1
  gRNA
aaccugaugccgagcauuga

SEQ ID NO: 23335 - RNA, 20 nt, Artificial Sequence
  MKO10023335_A_Guca1a
  gRNA
ccuccucguguucgccguuc

SEQ ID NO: 23336 - RNA, 20 nt, Artificial Sequence
  MKO10023336_A_Guca1a
  gRNA
acucauggaugagucgcucc

SEQ ID NO: 23337 - RNA, 20 nt, Artificial Sequence
  MKO10023337_A_Guca1a
  gRNA
auccccguugaugucgaucu

SEQ ID NO: 23338 - RNA, 20 nt, Artificial Sequence
  MKO10023338_A_Guca1b
  gRNA
ucauuacccacuuaucgcga

SEQ ID NO: 23339 - RNA, 20 nt, Artificial Sequence
  MKO10023339_A_Guca1b
  gRNA
gucucugaccgaguucaucg

SEQ ID NO: 23340 - RNA, 20 nt, Artificial Sequence
  MKO10023340_A_Guca1b
  gRNA
ggcggucgaugcagccauuu

SEQ ID NO: 23341 - RNA, 20 nt, Artificial Sequence
  MKO10023341_A_Guca2a
  gRNA
gucacucuagcaucccguac

SEQ ID NO: 23342 - RNA, 20 nt, Artificial Sequence
  MKO10023342_A_Guca2a
  gRNA
aaaacuuaagggucuccgcg

SEQ ID NO: 23343 - RNA, 20 nt, Artificial Sequence
  MKO10023343_A_Guca2a
  gRNA
gcguuggguuucucgcagac

SEQ ID NO: 23344 - RNA, 20 nt, Artificial Sequence
  MKO10023344_A_Guca2b
  gRNA
uauacacaguucacauucgu

SEQ ID NO: 23345 - RNA, 20 nt, Artificial Sequence
  MKO10023345_A_Guca2b
  gRNA
ggacgacggcagcccacagu

SEQ ID NO: 23346 - RNA, 20 nt, Artificial Sequence
  MKO10023346_A_Guca2b
  gRNA
auuucaucagcagccuguac

SEQ ID NO: 23347 - RNA, 20 nt, Artificial Sequence
  MKO10023347_A_Gucd1
  gRNA
caaacuccccgucgucgagc

SEQ ID NO: 23348 - RNA, 20 nt, Artificial Sequence
  MKO10023348_A_Gucd1
  gRNA
ugccgcacccccgacuacca

SEQ ID NO: 23349 - RNA, 20 nt, Artificial Sequence
  MKO10023349_A_Gucd1
  gRNA
ucguccugcguggcuauaac

SEQ ID NO: 23350 - RNA, 20 nt, Artificial Sequence
  MKO10023350_A_Gucy1a2
  gRNA
gcauugcaaagcccaccgua

SEQ ID NO: 23351 - RNA, 20 nt, Artificial Sequence
  MKO10023351_A_Gucy1a2
  gRNA
cauaucgaaguuguuuccgu

SEQ ID NO: 23352 - RNA, 20 nt, Artificial Sequence
  MKO10023352_A_Gucy1a2
  gRNA
agagucauguguaucgucug

SEQ ID NO: 23353 - RNA, 20 nt, Artificial Sequence
  MKO10023353_A_Gucy1a3
  gRNA
gcagccgcuuuaaugauacc

SEQ ID NO: 23354 - RNA, 20 nt, Artificial Sequence
  MKO10023354_A_Gucy1a3
  gRNA
ucccaauucauaacgcccug

SEQ ID NO: 23355 - RNA, 20 nt, Artificial Sequence
  MKO10023355_A_Gucy1a3
  gRNA
ugaugccguuacccagcugc

SEQ ID NO: 23356 - RNA, 20 nt, Artificial Sequence
  MKO10023356_A_Gucy1b2
  gRNA
ccggcgucuuaccgaaucuc

SEQ ID NO: 23357 - RNA, 20 nt, Artificial Sequence
  MKO10023357_A_Gucy1b2
  gRNA
gagcaagcgaacccaucuac

SEQ ID NO: 23358 - RNA, 20 nt, Artificial Sequence
  MKO10023358_A_Gucy1b2
  gRNA
cuccuaaacuccgcucgcag

SEQ ID NO: 23359 - RNA, 20 nt, Artificial Sequence
  MKO10023359_A_Gucy1b3
  gRNA
cgguuucgugaaccaugccc

SEQ ID NO: 23360 - RNA, 20 nt, Artificial Sequence
  MKO10023360_A_Gucy1b3
  gRNA
cucuuuccgaguaguagugc

SEQ ID NO: 23361 - RNA, 20 nt, Artificial Sequence
  MKO10023361_A_Gucy1b3
  gRNA
cugcuggugauccgcaauua

SEQ ID NO: 23362 - RNA, 20 nt, Artificial Sequence
  MKO10023362_A_Gucy2c
  gRNA
uagucuuaccggcuucacgc

SEQ ID NO: 23363 - RNA, 20 nt, Artificial Sequence
  MKO10023363_A_Gucy2c
  gRNA
gcgacuuucaucuacuccga

SEQ ID NO: 23364 - RNA, 20 nt, Artificial Sequence
  MKO10023364_A_Gucy2c
  gRNA
cgaaagcgccugcgugaagc

SEQ ID NO: 23365 - RNA, 20 nt, Artificial Sequence
  MKO10023365_A_Gucy2d
  gRNA
cgaaccagcagcuggcguca

SEQ ID NO: 23366 - RNA, 20 nt, Artificial Sequence
  MKO10023366_A_Gucy2d
  gRNA
ccacguaagagcucuugaug

SEQ ID NO: 23367 - RNA, 20 nt, Artificial Sequence
  MKO10023367_A_Gucy2d
  gRNA
uuuguaggcccuguuaaucc

SEQ ID NO: 23368 - RNA, 20 nt, Artificial Sequence
  MKO10023368_A_Gucy2e
  gRNA
agcguagugaagcgugucga

SEQ ID NO: 23369 - RNA, 20 nt, Artificial Sequence
  MKO10023369_A_Gucy2e
  gRNA
caucuguagcccgccaagua

SEQ ID NO: 23370 - RNA, 20 nt, Artificial Sequence
  MKO10023370_A_Gucy2e
  gRNA
ccgcuccgcaguagugauca

SEQ ID NO: 23371 - RNA, 20 nt, Artificial Sequence
  MKO10023371_A_Gucy2f
  gRNA
aacuagguuucaccguuguu

SEQ ID NO: 23372 - RNA, 20 nt, Artificial Sequence
  MKO10023372_A_Gucy2f
  gRNA
uucugcauaggcuucguaga

SEQ ID NO: 23373 - RNA, 20 nt, Artificial Sequence
  MKO10023373_A_Gucy2f
  gRNA
acuguagagcaguacaucau

SEQ ID NO: 23374 - RNA, 20 nt, Artificial Sequence
  MKO10023374_A_Gucy2g
  gRNA
ggaacaugucguaugucgcc

SEQ ID NO: 23375 - RNA, 20 nt, Artificial Sequence
  MKO10023375_A_Gucy2g
  gRNA
cucaucgcacccagcgccua

SEQ ID NO: 23376 - RNA, 20 nt, Artificial Sequence
  MKO10023376_A_Gucy2g
  gRNA
cgacauacgacauguuccug

SEQ ID NO: 23377 - RNA, 20 nt, Artificial Sequence
  MKO10023377_A_Guf1
  gRNA
uugauuaccuuauugauaac

SEQ ID NO: 23378 - RNA, 20 nt, Artificial Sequence
  MKO10023378_A_Guf1
  gRNA
aacuuacuggugugucgaug

SEQ ID NO: 23379 - RNA, 20 nt, Artificial Sequence
  MKO10023379_A_Guf1
  gRNA
ccacuaccaguaaaacaccu

SEQ ID NO: 23380 - RNA, 20 nt, Artificial Sequence
  MKO10023380_A_Guk1
  gRNA
guagugcugagcgggccguc

SEQ ID NO: 23381 - RNA, 20 nt, Artificial Sequence
  MKO10023381_A_Guk1
  gRNA
gugcuagaugucgaccuaca

SEQ ID NO: 23382 - RNA, 20 nt, Artificial Sequence
  MKO10023382_A_Guk1
  gRNA
cgacaucuagcacgcagaug

SEQ ID NO: 23383 - RNA, 20 nt, Artificial Sequence
  MKO10023383_A_Gulo
  gRNA
ucagacaucgccugcaccga

SEQ ID NO: 23384 - RNA, 20 nt, Artificial Sequence
  MKO10023384_A_Gulo
  gRNA
aggcgaugucugaaggcgag

SEQ ID NO: 23385 - RNA, 20 nt, Artificial Sequence
  MKO10023385_A_Gulo
  gRNA
guacuaccagcccacaucag

SEQ ID NO: 23386 - RNA, 20 nt, Artificial Sequence
  MKO10023386_A_Gulp1
  gRNA
guuucuuggcaguaccgaag

SEQ ID NO: 23387 - RNA, 20 nt, Artificial Sequence
  MKO10023387_A_Gulp1
  gRNA
uuacauucccuauaaugcaa

SEQ ID NO: 23388 - RNA, 20 nt, Artificial Sequence
  MKO10023388_A_Gulp1
  gRNA
aaguugugagagaugcuguc

SEQ ID NO: 23389 - RNA, 20 nt, Artificial Sequence
  MKO10023389_A_Gusb
  gRNA
cuuggguccaucgccguggc

SEQ ID NO: 23390 - RNA, 20 nt, Artificial Sequence
  MKO10023390_A_Gusb
  gRNA
ucccuagucgggcccagucu

SEQ ID NO: 23391 - RNA, 20 nt, Artificial Sequence
  MKO10023391_A_Gusb
  gRNA
ggugucagucuuguagacga

SEQ ID NO: 23392 - RNA, 20 nt, Artificial Sequence
  MKO10023392_A_Gvin1
  gRNA
gcuucucgauauuucuugag

SEQ ID NO: 23393 - RNA, 20 nt, Artificial Sequence
  MKO10023393_A_Gvin1
  gRNA
cucaagaaauaucgagaagc

SEQ ID NO: 23394 - RNA, 20 nt, Artificial Sequence
  MKO10023394_A_Gvin1
  gRNA
agccucagcuacaaagcaga

SEQ ID NO: 23395 - RNA, 20 nt, Artificial Sequence
  MKO10023395_A_Gxylt1
  gRNA
cuuuaaagcuaucgugcagu

SEQ ID NO: 23396 - RNA, 20 nt, Artificial Sequence
  MKO10023396_A_Gxylt1
  gRNA
ucugacuuuagcuugccagc

SEQ ID NO: 23397 - RNA, 20 nt, Artificial Sequence
  MKO10023397_A_Gxylt1
  gRNA
ggcuguagucaaaucuccgc

SEQ ID NO: 23398 - RNA, 20 nt, Artificial Sequence
  MKO10023398_A_Gxylt2
  gRNA
cgacuguaccagccgaucuu

SEQ ID NO: 23399 - RNA, 20 nt, Artificial Sequence
  MKO10023399_A_Gxylt2
  gRNA
guacgcaaaggcgaucuuaa

SEQ ID NO: 23400 - RNA, 20 nt, Artificial Sequence
  MKO10023400_A_Gxylt2
  gRNA
acucugugccacccgaacuc

SEQ ID NO: 23401 - RNA, 20 nt, Artificial Sequence
  MKO10023401_A_Gyg
  gRNA
cauugacuaaacuccacugc

SEQ ID NO: 23402 - RNA, 20 nt, Artificial Sequence
  MKO10023402_A_Gyg
  gRNA
uuuggcauaggcaucguuug

SEQ ID NO: 23403 - RNA, 20 nt, Artificial Sequence
  MKO10023403_A_Gyg
  gRNA
uguacuuacgcuuuaaaugc

SEQ ID NO: 23404 - RNA, 20 nt, Artificial Sequence
  MKO10023404_A_Gykl1
  gRNA
auacuagggucgcgaccauc

SEQ ID NO: 23405 - RNA, 20 nt, Artificial Sequence
  MKO10023405_A_Gykl1
  gRNA
gugaaggucguuacgccaca

SEQ ID NO: 23406 - RNA, 20 nt, Artificial Sequence
  MKO10023406_A_Gykl1
  gRNA
uggagcguauaagccugaaa

SEQ ID NO: 23407 - RNA, 20 nt, Artificial Sequence
  MKO10023407_A_Gyk
  gRNA
uuacccacggcauuauagag

SEQ ID NO: 23408 - RNA, 20 nt, Artificial Sequence
  MKO10023408_A_Gyk
  gRNA
agagccucucuauaaugccg

SEQ ID NO: 23409 - RNA, 20 nt, Artificial Sequence
  MKO10023409_A_Gyk
  gRNA
caccaaaaaacgugucgagc

SEQ ID NO: 23410 - RNA, 20 nt, Artificial Sequence
  MKO10023410_A_Gyltl1b
  gRNA
cccucgaugaagacccguac

SEQ ID NO: 23411 - RNA, 20 nt, Artificial Sequence
  MKO10023411_A_Gyltl1b
  gRNA
ggcgcuuacaauccgggucc

SEQ ID NO: 23412 - RNA, 20 nt, Artificial Sequence
  MKO10023412_A_Gyltl1b
  gRNA
ggcacaacuaccucgcacuu

SEQ ID NO: 23413 - RNA, 20 nt, Artificial Sequence
  MKO10023413_A_Gypa
  gRNA
gcaggaaaaucguguugaau

SEQ ID NO: 23414 - RNA, 20 nt, Artificial Sequence
  MKO10023414_A_Gypa
  gRNA
auuguugcugaaugcugauu

SEQ ID NO: 23415 - RNA, 20 nt, Artificial Sequence
  MKO10023415_A_Gypa
  gRNA
uauaacaaaccuccaaugug

SEQ ID NO: 23416 - RNA, 20 nt, Artificial Sequence
  MKO10023416_A_Gypc
  gRNA
auaaugccguaggacuuccc

SEQ ID NO: 23417 - RNA, 20 nt, Artificial Sequence
  MKO10023417_A_Gypc
  gRNA
ucaugcuucgcuaccuguac

SEQ ID NO: 23418 - RNA, 20 nt, Artificial Sequence
  MKO10023418_A_Gypc
  gRNA
aagccgccucccgagcuccu

SEQ ID NO: 23419 - RNA, 20 nt, Artificial Sequence
  MKO10023419_A_Gys1
  gRNA
gagccucgauugcggugauc

SEQ ID NO: 23420 - RNA, 20 nt, Artificial Sequence
  MKO10023420_A_Gys1
  gRNA
cauacggcuucucuucguuc

SEQ ID NO: 23421 - RNA, 20 nt, Artificial Sequence
  MKO10023421_A_Gys1
  gRNA
caacgccagccaaccauucg

SEQ ID NO: 23422 - RNA, 20 nt, Artificial Sequence
  MKO10023422_A_Gys2
  gRNA
ugacguguuuaccgucugcg

SEQ ID NO: 23423 - RNA, 20 nt, Artificial Sequence
  MKO10023423_A_Gys2
  gRNA
ggaguuuccuggcacgagaa

SEQ ID NO: 23424 - RNA, 20 nt, Artificial Sequence
  MKO10023424_A_Gys2
  gRNA
cauagaagggagucccuacg

SEQ ID NO: 23425 - RNA, 20 nt, Artificial Sequence
  MKO10023425_A_Gzf1
  gRNA
uacaugauaagaauacgccg

SEQ ID NO: 23426 - RNA, 20 nt, Artificial Sequence
  MKO10023426_A_Gzf1
  gRNA
ccagcauauuaaaguccaca

SEQ ID NO: 23427 - RNA, 20 nt, Artificial Sequence
  MKO10023427_A_Gzf1
  gRNA
uuacugacaagucuacucuc

SEQ ID NO: 23428 - RNA, 20 nt, Artificial Sequence
  MKO10023428_A_Gzma
  gRNA
uccucacucaagaccguaua

SEQ ID NO: 23429 - RNA, 20 nt, Artificial Sequence
  MKO10023429_A_Gzma
  gRNA
caagaacuuacacguuacag

SEQ ID NO: 23430 - RNA, 20 nt, Artificial Sequence
  MKO10023430_A_Gzma
  gRNA
agaaguguggagaucgccga

SEQ ID NO: 23431 - RNA, 20 nt, Artificial Sequence
  MKO10023431_A_Gzmb
  gRNA
aagcccccacauaucgccuc

SEQ ID NO: 23432 - RNA, 20 nt, Artificial Sequence
  MKO10023432_A_Gzmb
  gRNA
gucccccgcacauaucugau

SEQ ID NO: 23433 - RNA, 20 nt, Artificial Sequence
  MKO10023433_A_Gzmb
  gRNA
ugggggcuuccuuauucgag

SEQ ID NO: 23434 - RNA, 20 nt, Artificial Sequence
  MKO10023434_A_Gzmc
  gRNA
gcacgaauuugucucgaacc

SEQ ID NO: 23435 - RNA, 20 nt, Artificial Sequence
  MKO10023435_A_Gzmc
  gRNA
cuucacaugagcauugcgcc

SEQ ID NO: 23436 - RNA, 20 nt, Artificial Sequence
  MKO10023436_A_Gzmc
  gRNA
ugauccaucaguuugcccgu

SEQ ID NO: 23437 - RNA, 20 nt, Artificial Sequence
  MKO10023437_A_Gzmd
  gRNA
cguuaugucuguggauauua

SEQ ID NO: 23438 - RNA, 20 nt, Artificial Sequence
  MKO10023438_A_Gzmd
  gRNA
gcacaaagucaucuugaauc

SEQ ID NO: 23439 - RNA, 20 nt, Artificial Sequence
  MKO10023439_A_Gzmd
  gRNA
cuucacccgggcauuggauc

SEQ ID NO: 23440 - RNA, 20 nt, Artificial Sequence
  MKO10023440_A_Gzme
  gRNA
agacuuaacaaacgccaugu

SEQ ID NO: 23441 - RNA, 20 nt, Artificial Sequence
  MKO10023441_A_Gzme
  gRNA
caguggcauuauaaucugga

SEQ ID NO: 23442 - RNA, 20 nt, Artificial Sequence
  MKO10023442_A_Gzme
  gRNA
acuggucauccaggaggaug

SEQ ID NO: 23443 - RNA, 20 nt, Artificial Sequence
  MKO10023443_A_Gzmf
  gRNA
aaccucacacgugccaugua

SEQ ID NO: 23444 - RNA, 20 nt, Artificial Sequence
  MKO10023444_A_Gzmf
  gRNA
ccacccagcuuaugaugaua

SEQ ID NO: 23445 - RNA, 20 nt, Artificial Sequence
  MKO10023445_A_Gzmf
  gRNA
cagcucaaugagagucauac

SEQ ID NO: 23446 - RNA, 20 nt, Artificial Sequence
  MKO10023446_A_Gzmg
  gRNA
gugugugacaaccuagcuua

SEQ ID NO: 23447 - RNA, 20 nt, Artificial Sequence
  MKO10023447_A_Gzmg
  gRNA
aagaccacgcagaucugugc

SEQ ID NO: 23448 - RNA, 20 nt, Artificial Sequence
  MKO10023448_A_Gzmg
  gRNA
aagcuagguugucacacacg

SEQ ID NO: 23449 - RNA, 20 nt, Artificial Sequence
  MKO10023449_A_Gzmk
  gRNA
ccggacugaagucgugagaa

SEQ ID NO: 23450 - RNA, 20 nt, Artificial Sequence
  MKO10023450_A_Gzmk
  gRNA
guuaauagcguauagauucc

SEQ ID NO: 23451 - RNA, 20 nt, Artificial Sequence
  MKO10023451_A_Gzmk
  gRNA
ccauucucacgacuucaguc

SEQ ID NO: 23452 - RNA, 20 nt, Artificial Sequence
  MKO10023452_A_Gzmm
  gRNA
ucaggaaggucauuggucgc

SEQ ID NO: 23453 - RNA, 20 nt, Artificial Sequence
  MKO10023453_A_Gzmm
  gRNA
gaguccuugugcaucggaag

SEQ ID NO: 23454 - RNA, 20 nt, Artificial Sequence
  MKO10023454_A_Gzmm
  gRNA
uguguaacaacagccgcuuc

SEQ ID NO: 23455 - RNA, 20 nt, Artificial Sequence
  MKO10023455_A_Gzmn
  gRNA
caaaauagaggcuccgucca

SEQ ID NO: 23456 - RNA, 20 nt, Artificial Sequence
  MKO10023456_A_Gzmn
  gRNA
uggggaagagcuuuauucac

SEQ ID NO: 23457 - RNA, 20 nt, Artificial Sequence
  MKO10023457_A_Gzmn
  gRNA
ccacccagacuauaauccuc

SEQ ID NO: 23458 - RNA, 20 nt, Artificial Sequence
  MKO10023458_A_H13
  gRNA
gaagcgggcggcaucucgac

SEQ ID NO: 23459 - RNA, 20 nt, Artificial Sequence
  MKO10023459_A_H13
  gRNA
gggcggccgcgucgugccgu

SEQ ID NO: 23460 - RNA, 20 nt, Artificial Sequence
  MKO10023460_A_H13
  gRNA
gccucggcgcugccguugug

SEQ ID NO: 23461 - RNA, 20 nt, Artificial Sequence
  MKO10023461_A_H1f0
  gRNA
cccguuugggcuucgccgcc

SEQ ID NO: 23462 - RNA, 20 nt, Artificial Sequence
  MKO10023462_A_H1f0
  gRNA
ggcgaagcccaaacgggcca

SEQ ID NO: 23463 - RNA, 20 nt, Artificial Sequence
  MKO10023463_A_H1f0
  gRNA
aucaagcgccuagugaccac

SEQ ID NO: 23464 - RNA, 20 nt, Artificial Sequence
  MKO10023464_A_H1fnt
  gRNA
cacugacugcguaccccgcu

SEQ ID NO: 23465 - RNA, 20 nt, Artificial Sequence
  MKO10023465_A_H1fnt
  gRNA
ggaucguaaguucugcgccu

SEQ ID NO: 23466 - RNA, 20 nt, Artificial Sequence
  MKO10023466_A_H1fnt
  gRNA
uggcugccuugcgacgcgag

SEQ ID NO: 23467 - RNA, 20 nt, Artificial Sequence
  MKO10023467_A_H1foo
  gRNA
cgagggaagcaacgcuauuc

SEQ ID NO: 23468 - RNA, 20 nt, Artificial Sequence
  MKO10023468_A_H1foo
  gRNA
gcguugcuucccucgccaaa

SEQ ID NO: 23469 - RNA, 20 nt, Artificial Sequence
  MKO10023469_A_H1foo
  gRNA
ccaacacaaguacccgacag

SEQ ID NO: 23470 - RNA, 20 nt, Artificial Sequence
  MKO10023470_A_H1fx
  gRNA
cgucuugcgggccgucccgu

SEQ ID NO: 23471 - RNA, 20 nt, Artificial Sequence
  MKO10023471_A_H1fx
  gRNA
cugccgccaacgagcgccga

SEQ ID NO: 23472 - RNA, 20 nt, Artificial Sequence
  MKO10023472_A_H1fx
  gRNA
gacggcccgcaagacggcca

SEQ ID NO: 23473 - RNA, 20 nt, Artificial Sequence
  MKO10023473_A_H2-Aa
  gRNA
uggaggugccaccugaucgc

SEQ ID NO: 23474 - RNA, 20 nt, Artificial Sequence
  MKO10023474_A_H2-Aa
  gRNA
gucacgguugacgaagaagc

SEQ ID NO: 23475 - RNA, 20 nt, Artificial Sequence
  MKO10023475_A_H2-Aa
  gRNA
aauccaucagccgaccacgu

SEQ ID NO: 23476 - RNA, 20 nt, Artificial Sequence
  MKO10023476_A_H2-Ab1
  gRNA
ucguaugcgcugcgucccgu

SEQ ID NO: 23477 - RNA, 20 nt, Artificial Sequence
  MKO10023477_A_H2-Ab1
  gRNA
gcgagugcuacuucaccaac

SEQ ID NO: 23478 - RNA, 20 nt, Artificial Sequence
  MKO10023478_A_H2-Ab1
  gRNA
uguagaccucuccccgccga

SEQ ID NO: 23479 - RNA, 20 nt, Artificial Sequence
  MKO10023479_A_H2-Bl
  gRNA
auuucgagaccgcaguguuc

SEQ ID NO: 23480 - RNA, 20 nt, Artificial Sequence
  MKO10023480_A_H2-Bl
  gRNA
ugucacagccagacaaccgc

SEQ ID NO: 23481 - RNA, 20 nt, Artificial Sequence
  MKO10023481_A_H2-Bl
  gRNA
gaggccgggccggaacacug

SEQ ID NO: 23482 - RNA, 20 nt, Artificial Sequence
  MKO10023482_A_H2-D1
  gRNA
ggugacuucaccuuuagauc

SEQ ID NO: 23483 - RNA, 20 nt, Artificial Sequence
  MKO10023483_A_H2-D1
  gRNA
cauagccgacagagauguac

SEQ ID NO: 23484 - RNA, 20 nt, Artificial Sequence
  MKO10023484_A_H2-D1
  gRNA
ucacucggaaccacugcucu

SEQ ID NO: 23485 - RNA, 20 nt, Artificial Sequence
  MKO10023485_A_H2-DMa
  gRNA
caccgacccugaccgugaac

SEQ ID NO: 23486 - RNA, 20 nt, Artificial Sequence
  MKO10023486_A_H2-DMa
  gRNA
cacuccugggcggugcucga

SEQ ID NO: 23487 - RNA, 20 nt, Artificial Sequence
  MKO10023487_A_H2-DMa
  gRNA
gaaaagacucgauuccguuc

SEQ ID NO: 23488 - RNA, 20 nt, Artificial Sequence
  MKO10023488_A_H2-DMb1
  gRNA
uguggaaagcacgugcgugc

SEQ ID NO: 23489 - RNA, 20 nt, Artificial Sequence
  MKO10023489_A_H2-DMb1
  gRNA
acaaauguuaccuuccgggu

SEQ ID NO: 23490 - RNA, 20 nt, Artificial Sequence
  MKO10023490_A_H2-DMb1
  gRNA
cuucuccagcguuugcaaaa

SEQ ID NO: 23491 - RNA, 20 nt, Artificial Sequence
  MKO10023491_A_H2-DMb2
  gRNA
uucaaauauccucaacgaac

SEQ ID NO: 23492 - RNA, 20 nt, Artificial Sequence
  MKO10023492_A_H2-DMb2
  gRNA
ucagcacaucccagaaaggu

SEQ ID NO: 23493 - RNA, 20 nt, Artificial Sequence
  MKO10023493_A_H2-DMb2
  gRNA
gaccucugagcccauccgcg

SEQ ID NO: 23494 - RNA, 20 nt, Artificial Sequence
  MKO10023494_A_H2-Ea-ps
  gRNA
aauguuguagaacgccgaca

SEQ ID NO: 23495 - RNA, 20 nt, Artificial Sequence
  MKO10023495_A_H2-Ea-ps
  gRNA
aauggacggccugucaccga

SEQ ID NO: 23496 - RNA, 20 nt, Artificial Sequence
  MKO10023496_A_H2-Ea-ps
  gRNA
cggaagaggugaucgucccu

SEQ ID NO: 23497 - RNA, 20 nt, Artificial Sequence
  MKO10023497_A_H2-Eb1
  gRNA
gacgcagcgcgugcggcuuc

SEQ ID NO: 23498 - RNA, 20 nt, Artificial Sequence
  MKO10023498_A_H2-Eb1
  gRNA
uccagucuccauuucggacc

SEQ ID NO: 23499 - RNA, 20 nt, Artificial Sequence
  MKO10023499_A_H2-Eb1
  gRNA
ucacuccacucgaccgugac

SEQ ID NO: 23500 - RNA, 20 nt, Artificial Sequence
  MKO10023500_A_H2-Eb2
  gRNA
gcccgcuuuaacagugacuu

SEQ ID NO: 23501 - RNA, 20 nt, Artificial Sequence
  MKO10023501_A_H2-Eb2
  gRNA
guguaaaccucuccaccccg

SEQ ID NO: 23502 - RNA, 20 nt, Artificial Sequence
  MKO10023502_A_H2-Eb2
  gRNA
auuaucgugccucaguagac

SEQ ID NO: 23503 - RNA, 20 nt, Artificial Sequence
  MKO10023503_A_H2-K1
  gRNA
ccucggggagccccgguaca

SEQ ID NO: 23504 - RNA, 20 nt, Artificial Sequence
  MKO10023504_A_H2-K1
  gRNA
caaugagcagaguuuccgag

SEQ ID NO: 23505 - RNA, 20 nt, Artificial Sequence
  MKO10023505_A_H2-K1
  gRNA
cgcugaucaccaaacacaag

SEQ ID NO: 23506 - RNA, 20 nt, Artificial Sequence
  MKO10023506_A_H2-Ke2
  gRNA
guugcucugacugccgcucg

SEQ ID NO: 23507 - RNA, 20 nt, Artificial Sequence
  MKO10023507_A_H2-Ke2
  gRNA
ucagcgggcccaagcugcaa

SEQ ID NO: 23508 - RNA, 20 nt, Artificial Sequence
  MKO10023508_A_H2-Ke2
  gRNA
cagaagcuuaaagaccacgu

SEQ ID NO: 23509 - RNA, 20 nt, Artificial Sequence
  MKO10023509_A_H2-Ke6
  gRNA
ugcgaucagcgugcgccuag

SEQ ID NO: 23510 - RNA, 20 nt, Artificial Sequence
  MKO10023510_A_H2-Ke6
  gRNA
cuaggcgcacgcugaucgca

SEQ ID NO: 23511 - RNA, 20 nt, Artificial Sequence
  MKO10023511_A_H2-Ke6
  gRNA
aauuaugcgucguccaaagc

SEQ ID NO: 23512 - RNA, 20 nt, Artificial Sequence
  MKO10023512_A_H2-L
  gRNA
cauagccgacagagauguac

SEQ ID NO: 23513 - RNA, 20 nt, Artificial Sequence
  MKO10023513_A_H2-L
  gRNA
ggccccgacucagacccgcg

SEQ ID NO: 23514 - RNA, 20 nt, Artificial Sequence
  MKO10023514_A_H2-L
  gRNA
gagccccgguacaucucugu

SEQ ID NO: 23515 - RNA, 20 nt, Artificial Sequence
  MKO10023515_A_H2-M10.1
  gRNA
gagcucaacacgcgaagagc

SEQ ID NO: 23516 - RNA, 20 nt, Artificial Sequence
  MKO10023516_A_H2-M10.1
  gRNA
gagacaaguucuucgguuaa

SEQ ID NO: 23517 - RNA, 20 nt, Artificial Sequence
  MKO10023517_A_H2-M10.1
  gRNA
agcucuauccaugcagcucg

SEQ ID NO: 23518 - RNA, 20 nt, Artificial Sequence
  MKO10023518_A_H2-M10.2
  gRNA
cguuugucagugacaagcgc

SEQ ID NO: 23519 - RNA, 20 nt, Artificial Sequence
  MKO10023519_A_H2-M10.2
  gRNA
gaugaacucauagccguagu

SEQ ID NO: 23520 - RNA, 20 nt, Artificial Sequence
  MKO10023520_A_H2-M10.2
  gRNA
gcuuccucggcggucucuac

SEQ ID NO: 23521 - RNA, 20 nt, Artificial Sequence
  MKO10023521_A_H2-M10.3
  gRNA
uuuguacacacuccccucga

SEQ ID NO: 23522 - RNA, 20 nt, Artificial Sequence
  MKO10023522_A_H2-M10.3
  gRNA
aaccgggaauuaaucaugcc

SEQ ID NO: 23523 - RNA, 20 nt, Artificial Sequence
  MKO10023523_A_H2-M10.3
  gRNA
gucuccacguuccaauacuu

SEQ ID NO: 23524 - RNA, 20 nt, Artificial Sequence
  MKO10023524_A_H2-M10.4
  gRNA
cugucacgcuuccuugcguc

SEQ ID NO: 23525 - RNA, 20 nt, Artificial Sequence
  MKO10023525_A_H2-M10.4
  gRNA
ugcuaacagugacgcgccca

SEQ ID NO: 23526 - RNA, 20 nt, Artificial Sequence
  MKO10023526_A_H2-M10.4
  gRNA
ugagcccguagugaccacca

SEQ ID NO: 23527 - RNA, 20 nt, Artificial Sequence
  MKO10023527_A_H2-M10.5
  gRNA
cgcaacgcuugcugucucac

SEQ ID NO: 23528 - RNA, 20 nt, Artificial Sequence
  MKO10023528_A_H2-M10.5
  gRNA
aaccgggaauuaaccaugcc

SEQ ID NO: 23529 - RNA, 20 nt, Artificial Sequence
  MKO10023529_A_H2-M10.5
  gRNA
ugagccggaagugaccgccg

SEQ ID NO: 23530 - RNA, 20 nt, Artificial Sequence
  MKO10023530_A_H2-M10.6
  gRNA
uuuccacgcauuccccuagc

SEQ ID NO: 23531 - RNA, 20 nt, Artificial Sequence
  MKO10023531_A_H2-M10.6
  gRNA
cguauccgaccuggaugaac

SEQ ID NO: 23532 - RNA, 20 nt, Artificial Sequence
  MKO10023532_A_H2-M10.6
  gRNA
uuaccugcuaggggaaugcg

SEQ ID NO: 23533 - RNA, 20 nt, Artificial Sequence
  MKO10023533_A_H2-M11
  gRNA
ccguuucugaaauacccucg

SEQ ID NO: 23534 - RNA, 20 nt, Artificial Sequence
  MKO10023534_A_H2-M11
  gRNA
caaaauacaugugauccgua

SEQ ID NO: 23535 - RNA, 20 nt, Artificial Sequence
  MKO10023535_A_H2-M11
  gRNA
ggcugcuauauccugccucg

SEQ ID NO: 23536 - RNA, 20 nt, Artificial Sequence
  MKO10023536_A_H2-M1
  gRNA
accgugcuuuguccaucuga

SEQ ID NO: 23537 - RNA, 20 nt, Artificial Sequence
  MKO10023537_A_H2-M1
  gRNA
gaacuuacuccaucgauucc

SEQ ID NO: 23538 - RNA, 20 nt, Artificial Sequence
  MKO10023538_A_H2-M1
  gRNA
uagccgagaaagauuaacug

SEQ ID NO: 23539 - RNA, 20 nt, Artificial Sequence
  MKO10023539_A_H2-M2
  gRNA
ugcgaugucgaaguaccgca

SEQ ID NO: 23540 - RNA, 20 nt, Artificial Sequence
  MKO10023540_A_H2-M2
  gRNA
cagcuuucgcaaugcguguc

SEQ ID NO: 23541 - RNA, 20 nt, Artificial Sequence
  MKO10023541_A_H2-M2
  gRNA
gcgugaaguaggugcccguc

SEQ ID NO: 23542 - RNA, 20 nt, Artificial Sequence
  MKO10023542_A_H2-M3
  gRNA
gcuccaagaaggcgcauguc

SEQ ID NO: 23543 - RNA, 20 nt, Artificial Sequence
  MKO10023543_A_H2-M3
  gRNA
gaaucuccuugccauuccgc

SEQ ID NO: 23544 - RNA, 20 nt, Artificial Sequence
  MKO10023544_A_H2-M3
  gRNA
cguugcuagucugguucucc

SEQ ID NO: 23545 - RNA, 20 nt, Artificial Sequence
  MKO10023545_A_H2-M5
  gRNA
agcugugucgccugcgaccc

SEQ ID NO: 23546 - RNA, 20 nt, Artificial Sequence
  MKO10023546_A_H2-M5
  gRNA
caugagaagcacgcauacga

SEQ ID NO: 23547 - RNA, 20 nt, Artificial Sequence
  MKO10023547_A_H2-M5
  gRNA
gauugcccuagugaauuugc

SEQ ID NO: 23548 - RNA, 20 nt, Artificial Sequence
  MKO10023548_A_H2-M9
  gRNA
aucuauaaugauagcaugac

SEQ ID NO: 23549 - RNA, 20 nt, Artificial Sequence
  MKO10023549_A_H2-M9
  gRNA
gucgucaaagucuuuccugc

SEQ ID NO: 23550 - RNA, 20 nt, Artificial Sequence
  MKO10023550_A_H2-M9
  gRNA
aguacguucucugcuugacu

SEQ ID NO: 23551 - RNA, 20 nt, Artificial Sequence
  MKO10023551_A_H2-Oa
  gRNA
uaccaaucuuacgacgcuuc

SEQ ID NO: 23552 - RNA, 20 nt, Artificial Sequence
  MKO10023552_A_H2-Oa
  gRNA
gucguacacauccuccgcag

SEQ ID NO: 23553 - RNA, 20 nt, Artificial Sequence
  MKO10023553_A_H2-Oa
  gRNA
gcuucugcaccugcggauac

SEQ ID NO: 23554 - RNA, 20 nt, Artificial Sequence
  MKO10023554_A_H2-Ob
  gRNA
ccggggacauaagugucaag

SEQ ID NO: 23555 - RNA, 20 nt, Artificial Sequence
  MKO10023555_A_H2-Ob
  gRNA
gcggacuguuacuucaccaa

SEQ ID NO: 23556 - RNA, 20 nt, Artificial Sequence
  MKO10023556_A_H2-Ob
  gRNA
uuuacacuucgacagugacc

SEQ ID NO: 23557 - RNA, 20 nt, Artificial Sequence
  MKO10023557_A_H2-Q10
  gRNA
uaccugcaauacgcauacga

SEQ ID NO: 23558 - RNA, 20 nt, Artificial Sequence
  MKO10023558_A_H2-Q10
  gRNA
auuucgaaaccuccguuucc

SEQ ID NO: 23559 - RNA, 20 nt, Artificial Sequence
  MKO10023559_A_H2-Q10
  gRNA
uaccaccagagcuuuaauga

SEQ ID NO: 23560 - RNA, 20 nt, Artificial Sequence
  MKO10023560_A_H2-Q1
  gRNA
acugcagguacccgcuuuga

SEQ ID NO: 23561 - RNA, 20 nt, Artificial Sequence
  MKO10023561_A_H2-Q1
  gRNA
ucagaugggcgccuucaaag

SEQ ID NO: 23562 - RNA, 20 nt, Artificial Sequence
  MKO10023562_A_H2-Q1
  gRNA
auuucgagaccucggugucc

SEQ ID NO: 23563 - RNA, 20 nt, Artificial Sequence
  MKO10023563_A_H2-Q2
  gRNA
uaugagcagucugccuacga

SEQ ID NO: 23564 - RNA, 20 nt, Artificial Sequence
  MKO10023564_A_H2-Q2
  gRNA
acgucaagcaaucgaccucc

SEQ ID NO: 23565 - RNA, 20 nt, Artificial Sequence
  MKO10023565_A_H2-Q2
  gRNA
guauugggagcggaacacac

SEQ ID NO: 23566 - RNA, 20 nt, Artificial Sequence
  MKO10023566_A_H2-Q4
  gRNA
cgcucacccgccgggggucc

SEQ ID NO: 23567 - RNA, 20 nt, Artificial Sequence
  MKO10023567_A_H2-Q4
  gRNA
gugagaccccgaacuccuuc

SEQ ID NO: 23568 - RNA, 20 nt, Artificial Sequence
  MKO10023568_A_H2-Q4
  gRNA
gcagucccuccgcagauacc

SEQ ID NO: 23569 - RNA, 20 nt, Artificial Sequence
  MKO10023569_A_H2-Q6
  gRNA
agccauguccgccgccgucc

SEQ ID NO: 23570 - RNA, 20 nt, Artificial Sequence
  MKO10023570_A_H2-Q6
  gRNA
cacagaucacccuacacaag

SEQ ID NO: 23571 - RNA, 20 nt, Artificial Sequence
  MKO10023571_A_H2-Q6
  gRNA
ucacucggaaacucuccuca

SEQ ID NO: 23572 - RNA, 20 nt, Artificial Sequence
  MKO10023572_A_H2-Q7
  gRNA
acugcaugcacgugcccucc

SEQ ID NO: 23573 - RNA, 20 nt, Artificial Sequence
  MKO10023573_A_H2-Q7
  gRNA
ggaaauauugcagcgagugu

SEQ ID NO: 23574 - RNA, 20 nt, Artificial Sequence
  MKO10023574_A_H2-Q7
  gRNA
ucccucggaaacucugcuca

SEQ ID NO: 23575 - RNA, 20 nt, Artificial Sequence
  MKO10023575_A_H2-Q8
  gRNA
agccauguccgccgccgucc

SEQ ID NO: 23576 - RNA, 20 nt, Artificial Sequence
  MKO10023576_A_H2-Q8
  gRNA
cacagaucacccuacacaag

SEQ ID NO: 23577 - RNA, 20 nt, Artificial Sequence
  MKO10023577_A_H2-Q8
  gRNA
ucacucggaaacucuccuca

SEQ ID NO: 23578 - RNA, 20 nt, Artificial Sequence
  MKO10023578_A_H2-Q9
  gRNA
acugcaugcacgugcccucc

SEQ ID NO: 23579 - RNA, 20 nt, Artificial Sequence
  MKO10023579_A_H2-Q9
  gRNA
ggaaauauugcagcgagugu

SEQ ID NO: 23580 - RNA, 20 nt, Artificial Sequence
  MKO10023580_A_H2-Q9
  gRNA
ucccucggaaacucugcuca

SEQ ID NO: 23581 - RNA, 20 nt, Artificial Sequence
  MKO10023581_A_H2-T10
  gRNA
gagcccugguucauaauugu

SEQ ID NO: 23582 - RNA, 20 nt, Artificial Sequence
  MKO10023582_A_H2-T10
  gRNA
auagccgacaauuaugaacc

SEQ ID NO: 23583 - RNA, 20 nt, Artificial Sequence
  MKO10023583_A_H2-T10
  gRNA
cgcagaccacagcagcccug

SEQ ID NO: 23584 - RNA, 20 nt, Artificial Sequence
  MKO10023584_A_H2-T22
  gRNA
gagcccugguucauaaucgu

SEQ ID NO: 23585 - RNA, 20 nt, Artificial Sequence
  MKO10023585_A_H2-T22
  gRNA
cacuguaccucacaucucuc

SEQ ID NO: 23586 - RNA, 20 nt, Artificial Sequence
  MKO10023586_A_H2-T22
  gRNA
agugcuguuucccacuguac

SEQ ID NO: 23587 - RNA, 20 nt, Artificial Sequence
  MKO10023587_A_H2-T23
  gRNA
cauucgcgguccaggaacgc

SEQ ID NO: 23588 - RNA, 20 nt, Artificial Sequence
  MKO10023588_A_H2-T23
  gRNA
gugucucauuucccagccgu

SEQ ID NO: 23589 - RNA, 20 nt, Artificial Sequence
  MKO10023589_A_H2-T23
  gRNA
uacuacaaucagaguaacga

SEQ ID NO: 23590 - RNA, 20 nt, Artificial Sequence
  MKO10023590_A_H2-T24
  gRNA
ucucacagccguaugugaac

SEQ ID NO: 23591 - RNA, 20 nt, Artificial Sequence
  MKO10023591_A_H2-T24
  gRNA
ccuucauccacuacgacagc

SEQ ID NO: 23592 - RNA, 20 nt, Artificial Sequence
  MKO10023592_A_H2-T24
  gRNA
ggaaagaacuuuacccgaac

SEQ ID NO: 23593 - RNA, 20 nt, Artificial Sequence
  MKO10023593_A_H2-T3
  gRNA
gcacgaacugagugucaucc

SEQ ID NO: 23594 - RNA, 20 nt, Artificial Sequence
  MKO10023594_A_H2-T3
  gRNA
cauauaagcuaagugcgcca

SEQ ID NO: 23595 - RNA, 20 nt, Artificial Sequence
  MKO10023595_A_H2-T3
  gRNA
cugguuauacagagcuccgu

SEQ ID NO: 23596 - RNA, 20 nt, Artificial Sequence
  MKO10023596_A_H2-T9
  gRNA
gagcccugguucauaaucgu

SEQ ID NO: 23597 - RNA, 20 nt, Artificial Sequence
  MKO10023597_A_H2-T9
  gRNA
cgcagaccacagcggcccug

SEQ ID NO: 23598 - RNA, 20 nt, Artificial Sequence
  MKO10023598_A_H2-T9
  gRNA
cacuguaccucacaucucuc

SEQ ID NO: 23599 - RNA, 20 nt, Artificial Sequence
  MKO10023599_A_H2afb1
  gRNA
aguacucgagcacacccgcg

SEQ ID NO: 23600 - RNA, 20 nt, Artificial Sequence
  MKO10023600_A_H2afb1
  gRNA
uagaauaguuucccucucgu

SEQ ID NO: 23601 - RNA, 20 nt, Artificial Sequence
  MKO10023601_A_H2afb1
  gRNA
guucguuguucuguaccaca

SEQ ID NO: 23602 - RNA, 20 nt, Artificial Sequence
  MKO10023602_A_H2afb2-ps
  gRNA
ugauauggugcccgucuccc

SEQ ID NO: 23603 - RNA, 20 nt, Artificial Sequence
  MKO10023603_A_H2afb2-ps
  gRNA
aggugcgggagugauguugg

SEQ ID NO: 23604 - RNA, 20 nt, Artificial Sequence
  MKO10023604_A_H2afb2-ps
  gRNA
cccaacgcagagguacccag

SEQ ID NO: 23605 - RNA, 20 nt, Artificial Sequence
  MKO10023605_A_H2afb3-ps
  gRNA
ugauacggugcccaucuucc

SEQ ID NO: 23606 - RNA, 20 nt, Artificial Sequence
  MKO10023606_A_H2afb3-ps
  gRNA
gcuggagcuugccggcaaug

SEQ ID NO: 23607 - RNA, 20 nt, Artificial Sequence
  MKO10023607_A_H2afb3-ps
  gRNA
gcaccguaucacugagccuc

SEQ ID NO: 23608 - RNA, 20 nt, Artificial Sequence
  MKO10023608_A_H2afj
  gRNA
gggucgagcauguccgggcg

SEQ ID NO: 23609 - RNA, 20 nt, Artificial Sequence
  MKO10023609_A_H2afj
  gRNA
cgcgcgcgacgagcgcgacu

SEQ ID NO: 23610 - RNA, 20 nt, Artificial Sequence
  MKO10023610_A_H2afj
  gRNA
gggcgguaaggugcgcgcca

SEQ ID NO: 23611 - RNA, 20 nt, Artificial Sequence
  MKO10023611_A_H2afv
  gRNA
auacguaccgcccccggcua

SEQ ID NO: 23612 - RNA, 20 nt, Artificial Sequence
  MKO10023612_A_H2afv
  gRNA
uguguacagugccgcaauuc

SEQ ID NO: 23613 - RNA, 20 nt, Artificial Sequence
  MKO10023613_A_H2afv
  gRNA
acgagacaccgccuuagccu

SEQ ID NO: 23614 - RNA, 20 nt, Artificial Sequence
  MKO10023614_A_H2afx
  gRNA
gaggccuucuugccgaccgc

SEQ ID NO: 23615 - RNA, 20 nt, Artificial Sequence
  MKO10023615_A_H2afx
  gRNA
aagucgcgcucuucacgcgc

SEQ ID NO: 23616 - RNA, 20 nt, Artificial Sequence
  MKO10023616_A_H2afx
  gRNA
cgcgccugcgcccacgcgcu

SEQ ID NO: 23617 - RNA, 20 nt, Artificial Sequence
  MKO10023617_A_H2afy2
  gRNA
cucaccuucuuggacguccg

SEQ ID NO: 23618 - RNA, 20 nt, Artificial Sequence
  MKO10023618_A_H2afy2
  gRNA
gagaauccaccccgaacugc

SEQ ID NO: 23619 - RNA, 20 nt, Artificial Sequence
  MKO10023619_A_H2afy2
  gRNA
uuauauuccagcggaaaucc

SEQ ID NO: 23620 - RNA, 20 nt, Artificial Sequence
  MKO10023620_A_H2afy
  gRNA
auucggcaacacgcccccgc

SEQ ID NO: 23621 - RNA, 20 nt, Artificial Sequence
  MKO10023621_A_H2afy
  gRNA
agccaucaucacgccuccgc

SEQ ID NO: 23622 - RNA, 20 nt, Artificial Sequence
  MKO10023622_A_H2afy
  gRNA
ggccagcgcagacaguacga

SEQ ID NO: 23623 - RNA, 20 nt, Artificial Sequence
  MKO10023623_A_H2afz
  gRNA
ggcgccgcaggcuggcggua

SEQ ID NO: 23624 - RNA, 20 nt, Artificial Sequence
  MKO10023624_A_H2afz
  gRNA
ucccgcuuaccucugcggug

SEQ ID NO: 23625 - RNA, 20 nt, Artificial Sequence
  MKO10023625_A_H2afz
  gRNA
ugacauaccaccaccagcaa

SEQ ID NO: 23626 - RNA, 20 nt, Artificial Sequence
  MKO10023626_A_H2bfm
  gRNA
gagcgacgccgcugcaccuc

SEQ ID NO: 23627 - RNA, 20 nt, Artificial Sequence
  MKO10023627_A_H2bfm
  gRNA
cgagcucugccggcgugcag

SEQ ID NO: 23628 - RNA, 20 nt, Artificial Sequence
  MKO10023628_A_H2bfm
  gRNA
cucagccauggcgucuacca

SEQ ID NO: 23629 - RNA, 20 nt, Artificial Sequence
  MKO10023629_A_H3f3a
  gRNA
uagaaauaccuguaacgaug

SEQ ID NO: 23630 - RNA, 20 nt, Artificial Sequence
  MKO10023630_A_H3f3a
  gRNA
auuguugcaggaggcaagug

SEQ ID NO: 23631 - RNA, 20 nt, Artificial Sequence
  MKO10023631_A_H3f3a
  gRNA
cagacugcccgcaaauccac

SEQ ID NO: 23632 - RNA, 20 nt, Artificial Sequence
  MKO10023632_A_H3f3b
  gRNA
ucugccuaccuguagcggug

SEQ ID NO: 23633 - RNA, 20 nt, Artificial Sequence
  MKO10023633_A_H3f3b
  gRNA
cuuuaccugaagggcaccga

SEQ ID NO: 23634 - RNA, 20 nt, Artificial Sequence
  MKO10023634_A_H3f3b
  gRNA
gaaagccccccgcaaacagc

SEQ ID NO: 23635 - RNA, 20 nt, Artificial Sequence
  MKO10023635_A_H60b
  gRNA
acuguccauguagaguacga

SEQ ID NO: 23636 - RNA, 20 nt, Artificial Sequence
  MKO10023636_A_H60b
  gRNA
uucaaccaucguacucuaca

SEQ ID NO: 23637 - RNA, 20 nt, Artificial Sequence
  MKO10023637_A_H60b
  gRNA
augcuguucaucaguguuga

SEQ ID NO: 23638 - RNA, 20 nt, Artificial Sequence
  MKO10023638_A_H60c
  gRNA
gucaaguaucguacucuaca

SEQ ID NO: 23639 - RNA, 20 nt, Artificial Sequence
  MKO10023639_A_H60c
  gRNA
ugcaaguccagccccuuuga

SEQ ID NO: 23640 - RNA, 20 nt, Artificial Sequence
  MKO10023640_A_H60c
  gRNA
cagggacucaccugcacuac

SEQ ID NO: 23641 - RNA, 20 nt, Artificial Sequence
  MKO10023641_A_H6pd
  gRNA
gguuugguacauggauuacg

SEQ ID NO: 23642 - RNA, 20 nt, Artificial Sequence
  MKO10023642_A_H6pd
  gRNA
ucggcgcaccuguccgcugu

SEQ ID NO: 23643 - RNA, 20 nt, Artificial Sequence
  MKO10023643_A_H6pd
  gRNA
cccagcgcagguugucgaug

SEQ ID NO: 23644 - RNA, 20 nt, Artificial Sequence
  MKO10023644_A_Haao
  gRNA
agacaugauacuacgagucc

SEQ ID NO: 23645 - RNA, 20 nt, Artificial Sequence
  MKO10023645_A_Haao
  gRNA
aacaccgggacgugccuaua

SEQ ID NO: 23646 - RNA, 20 nt, Artificial Sequence
  MKO10023646_A_Haao
  gRNA
gcgugccaagguccuuacag

SEQ ID NO: 23647 - RNA, 20 nt, Artificial Sequence
  MKO10023647_A_Habp2
  gRNA
gggaacagacuccgccauuc

SEQ ID NO: 23648 - RNA, 20 nt, Artificial Sequence
  MKO10023648_A_Habp2
  gRNA
cggggacuguaucaucagag

SEQ ID NO: 23649 - RNA, 20 nt, Artificial Sequence
  MKO10023649_A_Habp2
  gRNA
agcgguaguaggggugcuuc

SEQ ID NO: 23650 - RNA, 20 nt, Artificial Sequence
  MKO10023650_A_Habp4
  gRNA
cagaagcggacuccucgaag

SEQ ID NO: 23651 - RNA, 20 nt, Artificial Sequence
  MKO10023651_A_Habp4
  gRNA
ucaucgguaaacuucuccac

SEQ ID NO: 23652 - RNA, 20 nt, Artificial Sequence
  MKO10023652_A_Habp4
  gRNA
guggcuguggcauucgcccc

SEQ ID NO: 23653 - RNA, 20 nt, Artificial Sequence
  MKO10023653_A_Hace1
  gRNA
cauuucuagcagcgagauga

SEQ ID NO: 23654 - RNA, 20 nt, Artificial Sequence
  MKO10023654_A_Hace1
  gRNA
cuucaucucgcugcuagaaa

SEQ ID NO: 23655 - RNA, 20 nt, Artificial Sequence
  MKO10023655_A_Hace1
  gRNA
uuugaugucaauuaugcauu

SEQ ID NO: 23656 - RNA, 20 nt, Artificial Sequence
  MKO10023656_A_Hacl1
  gRNA
agcaagggcgauuucgguca

SEQ ID NO: 23657 - RNA, 20 nt, Artificial Sequence
  MKO10023657_A_Hacl1
  gRNA
ucccggucucauccacgccu

SEQ ID NO: 23658 - RNA, 20 nt, Artificial Sequence
  MKO10023658_A_Hacl1
  gRNA
ugcauuugccaugccgccca

SEQ ID NO: 23659 - RNA, 20 nt, Artificial Sequence
  MKO10023659_A_Hadha
  gRNA
cgccaucaguggauccugcu

SEQ ID NO: 23660 - RNA, 20 nt, Artificial Sequence
  MKO10023660_A_Hadha
  gRNA
cuuugacgccauaauuaaua

SEQ ID NO: 23661 - RNA, 20 nt, Artificial Sequence
  MKO10023661_A_Hadha
  gRNA
uccacugauggcggccacaa

SEQ ID NO: 23662 - RNA, 20 nt, Artificial Sequence
  MKO10023662_A_Hadhb
  gRNA
cgcauuccauuucugcuguc

SEQ ID NO: 23663 - RNA, 20 nt, Artificial Sequence
  MKO10023663_A_Hadhb
  gRNA
ucccaacugcacucugcccc

SEQ ID NO: 23664 - RNA, 20 nt, Artificial Sequence
  MKO10023664_A_Hadhb
  gRNA
uaccuggggcagagugcagu

SEQ ID NO: 23665 - RNA, 20 nt, Artificial Sequence
  MKO10023665_A_Hadh
  gRNA
accagacaagaccgauuugc

SEQ ID NO: 23666 - RNA, 20 nt, Artificial Sequence
  MKO10023666_A_Hadh
  gRNA
gugcaccacggaugccgcau

SEQ ID NO: 23667 - RNA, 20 nt, Artificial Sequence
  MKO10023667_A_Hadh
  gRNA
cgugccuaugaugaagcuug

SEQ ID NO: 23668 - RNA, 20 nt, Artificial Sequence
  MKO10023668_A_Haghl
  gRNA
gcgucaagaggcaucgcacg

SEQ ID NO: 23669 - RNA, 20 nt, Artificial Sequence
  MKO10023669_A_Haghl
  gRNA
gugcgaugccucuugacgcc

SEQ ID NO: 23670 - RNA, 20 nt, Artificial Sequence
  MKO10023670_A_Haghl
  gRNA
gcauuugcgcucuaacccga

SEQ ID NO: 23671 - RNA, 20 nt, Artificial Sequence
  MKO10023671_A_Hagh
  gRNA
guccacgauggcggccuccu

SEQ ID NO: 23672 - RNA, 20 nt, Artificial Sequence
  MKO10023672_A_Hagh
  gRNA
cacccaggaggccgccaucg

SEQ ID NO: 23673 - RNA, 20 nt, Artificial Sequence
  MKO10023673_A_Hagh
  gRNA
gcuucucguucccaccagcg

SEQ ID NO: 23674 - RNA, 20 nt, Artificial Sequence
  MKO10023674_A_Hal
  gRNA
uucauuccgucgcagccaga

SEQ ID NO: 23675 - RNA, 20 nt, Artificial Sequence
  MKO10023675_A_Hal
  gRNA
guucaguacauugcccuaga

SEQ ID NO: 23676 - RNA, 20 nt, Artificial Sequence
  MKO10023676_A_Hal
  gRNA
ucuuguaacgucccuugccc

SEQ ID NO: 23677 - RNA, 20 nt, Artificial Sequence
  MKO10023677_A_Hamp2
  gRNA
caccaccuaucuccagcaac

SEQ ID NO: 23678 - RNA, 20 nt, Artificial Sequence
  MKO10023678_A_Hamp2
  gRNA
uucuucacaacagauaccac

SEQ ID NO: 23679 - RNA, 20 nt, Artificial Sequence
  MKO10023679_A_Hamp2
  gRNA
ugcuguaacaaacccuccug

SEQ ID NO: 23680 - RNA, 20 nt, Artificial Sequence
  MKO10023680_A_Hamp
  gRNA
ugcuguaacaauucccagug

SEQ ID NO: 23681 - RNA, 20 nt, Artificial Sequence
  MKO10023681_A_Hamp
  gRNA
gcucaccuguugauggagau

SEQ ID NO: 23682 - RNA, 20 nt, Artificial Sequence
  MKO10023682_A_Hamp
  gRNA
caccaccuaucuccaucaac

SEQ ID NO: 23683 - RNA, 20 nt, Artificial Sequence
  MKO10023683_A_Hand1
  gRNA
gagcauuaacagcgcguucg

SEQ ID NO: 23684 - RNA, 20 nt, Artificial Sequence
  MKO10023684_A_Hand1
  gRNA
ccgcuccugguggcaacgcg

SEQ ID NO: 23685 - RNA, 20 nt, Artificial Sequence
  MKO10023685_A_Hand1
  gRNA
cccggcgagaagaggauuaa

SEQ ID NO: 23686 - RNA, 20 nt, Artificial Sequence
  MKO10023686_A_Hand2
  gRNA
cgggcggcacucccccauaa

SEQ ID NO: 23687 - RNA, 20 nt, Artificial Sequence
  MKO10023687_A_Hand2
  gRNA
gucgccccccgacuacagua

SEQ ID NO: 23688 - RNA, 20 nt, Artificial Sequence
  MKO10023688_A_Hand2
  gRNA
caggcuggccacagcacguc

SEQ ID NO: 23689 - RNA, 20 nt, Artificial Sequence
  MKO10023689_A_Hao1
  gRNA
gcaacguugcgaagcauccg

SEQ ID NO: 23690 - RNA, 20 nt, Artificial Sequence
  MKO10023690_A_Hao1
  gRNA
gcaaccgcauugaugacgug

SEQ ID NO: 23691 - RNA, 20 nt, Artificial Sequence
  MKO10023691_A_Hao1
  gRNA
gaucuuggugucgaaucaug

SEQ ID NO: 23692 - RNA, 20 nt, Artificial Sequence
  MKO10023692_A_Hao2
  gRNA
gcagugaagcacaacauccg

SEQ ID NO: 23693 - RNA, 20 nt, Artificial Sequence
  MKO10023693_A_Hao2
  gRNA
aaugucuuccacaguauagc

SEQ ID NO: 23694 - RNA, 20 nt, Artificial Sequence
  MKO10023694_A_Hao2
  gRNA
aaccggcaaugauguguuga

SEQ ID NO: 23695 - RNA, 20 nt, Artificial Sequence
  MKO10023695_A_Hap1
  gRNA
cgaauaaacgccgcacgcuc

SEQ ID NO: 23696 - RNA, 20 nt, Artificial Sequence
  MKO10023696_A_Hap1
  gRNA
aagacaccagccgcguacau

SEQ ID NO: 23697 - RNA, 20 nt, Artificial Sequence
  MKO10023697_A_Hap1
  gRNA
guacggcuugggggcaccau

SEQ ID NO: 23698 - RNA, 20 nt, Artificial Sequence
  MKO10023698_A_Hapln1
  gRNA
agcuugcaccgccucaucgu

SEQ ID NO: 23699 - RNA, 20 nt, Artificial Sequence
  MKO10023699_A_Hapln1
  gRNA
guucccuuacuuuccacgac

SEQ ID NO: 23700 - RNA, 20 nt, Artificial Sequence
  MKO10023700_A_Hapln1
  gRNA
cgccuucuuggucgagaaau

SEQ ID NO: 23701 - RNA, 20 nt, Artificial Sequence
  MKO10023701_A_Hapln2
  gRNA
gcgcggagccguaguagcca

SEQ ID NO: 23702 - RNA, 20 nt, Artificial Sequence
  MKO10023702_A_Hapln2
  gRNA
ucgggcaccucuacgccgcc

SEQ ID NO: 23703 - RNA, 20 nt, Artificial Sequence
  MKO10023703_A_Hapln2
  gRNA
ucacucucgucguggggcca

SEQ ID NO: 23704 - RNA, 20 nt, Artificial Sequence
  MKO10023704_A_Hapln3
  gRNA
gcugccggggcagcacuauu

SEQ ID NO: 23705 - RNA, 20 nt, Artificial Sequence
  MKO10023705_A_Hapln3
  gRNA
agccagcaucacaacgaucc

SEQ ID NO: 23706 - RNA, 20 nt, Artificial Sequence
  MKO10023706_A_Hapln3
  gRNA
gcgcccuucgcgggacuggu

SEQ ID NO: 23707 - RNA, 20 nt, Artificial Sequence
  MKO10023707_A_Hapln4
  gRNA
cuacgggcgcuacgagugcg

SEQ ID NO: 23708 - RNA, 20 nt, Artificial Sequence
  MKO10023708_A_Hapln4
  gRNA
aacgcgggaugguuacgcga

SEQ ID NO: 23709 - RNA, 20 nt, Artificial Sequence
  MKO10023709_A_Hapln4
  gRNA
aucuuguagcgaccuccgcg

SEQ ID NO: 23710 - RNA, 20 nt, Artificial Sequence
  MKO10023710_A_Harbi1
  gRNA
cgauacuccgcugcaguuuc

SEQ ID NO: 23711 - RNA, 20 nt, Artificial Sequence
  MKO10023711_A_Harbi1
  gRNA
uugcaucucccauccgaguc

SEQ ID NO: 23712 - RNA, 20 nt, Artificial Sequence
  MKO10023712_A_Harbi1
  gRNA
acgaauucuauggauuggca

SEQ ID NO: 23713 - RNA, 20 nt, Artificial Sequence
  MKO10023713_A_Hars2
  gRNA
aacagcugauaaucuuaucg

SEQ ID NO: 23714 - RNA, 20 nt, Artificial Sequence
  MKO10023714_A_Hars2
  gRNA
uagcggcccugggcuauagc

SEQ ID NO: 23715 - RNA, 20 nt, Artificial Sequence
  MKO10023715_A_Hars2
  gRNA
aucagcuguuucaaacguca

SEQ ID NO: 23716 - RNA, 20 nt, Artificial Sequence
  MKO10023716_A_Hars
  gRNA
ggcgauacaccuuugcuaua

SEQ ID NO: 23717 - RNA, 20 nt, Artificial Sequence
  MKO10023717_A_Hars
  gRNA
uaaacgcuaccauauagcaa

SEQ ID NO: 23718 - RNA, 20 nt, Artificial Sequence
  MKO10023718_A_Hars
  gRNA
auccgcuguuucaaacgcca

SEQ ID NO: 23719 - RNA, 20 nt, Artificial Sequence
  MKO10023719_A_Has1
  gRNA
agcacgcguaaccucgugug

SEQ ID NO: 23720 - RNA, 20 nt, Artificial Sequence
  MKO10023720_A_Has1
  gRNA
ccgagaagucuucgccgaug

SEQ ID NO: 23721 - RNA, 20 nt, Artificial Sequence
  MKO10023721_A_Has1
  gRNA
auuuggaccagcgggucugu

SEQ ID NO: 23722 - RNA, 20 nt, Artificial Sequence
  MKO10023722_A_Has2
  gRNA
acaaaucggccacguacauc

SEQ ID NO: 23723 - RNA, 20 nt, Artificial Sequence
  MKO10023723_A_Has2
  gRNA
gcgaagcguggauuauguac

SEQ ID NO: 23724 - RNA, 20 nt, Artificial Sequence
  MKO10023724_A_Has2
  gRNA
acuugaugagacccacuagc

SEQ ID NO: 23725 - RNA, 20 nt, Artificial Sequence
  MKO10023725_A_Has3
  gRNA
gguaguggauggcaaucgcc

SEQ ID NO: 23726 - RNA, 20 nt, Artificial Sequence
  MKO10023726_A_Has3
  gRNA
agcgugcuguauacuuaguc

SEQ ID NO: 23727 - RNA, 20 nt, Artificial Sequence
  MKO10023727_A_Has3
  gRNA
caccgucgaaugcgcagggc

SEQ ID NO: 23728 - RNA, 20 nt, Artificial Sequence
  MKO10023728_A_Hau1
  gRNA
uuucagcucgauugcugugu

SEQ ID NO: 23729 - RNA, 20 nt, Artificial Sequence
  MKO10023729_A_Hau1
  gRNA
aucuugcuguacuauauugc

SEQ ID NO: 23730 - RNA, 20 nt, Artificial Sequence
  MKO10023730_A_Hau1
  gRNA
aucagacaaaucauuccacc

SEQ ID NO: 23731 - RNA, 20 nt, Artificial Sequence
  MKO10023731_A_Haus1
  gRNA
cuaacaccagcguugccguc

SEQ ID NO: 23732 - RNA, 20 nt, Artificial Sequence
  MKO10023732_A_Haus1
  gRNA
gcaagugaauaugaauccga

SEQ ID NO: 23733 - RNA, 20 nt, Artificial Sequence
  MKO10023733_A_Haus1
  gRNA
uuaaugguuaggucgcugag

SEQ ID NO: 23734 - RNA, 20 nt, Artificial Sequence
  MKO10023734_A_Haus2
  gRNA
gcaaacuuacucaaauggga

SEQ ID NO: 23735 - RNA, 20 nt, Artificial Sequence
  MKO10023735_A_Haus2
  gRNA
acugcugagacccaugugcc

SEQ ID NO: 23736 - RNA, 20 nt, Artificial Sequence
  MKO10023736_A_Haus2
  gRNA
cauuggaagcuguuuaucac

SEQ ID NO: 23737 - RNA, 20 nt, Artificial Sequence
  MKO10023737_A_Haus3
  gRNA
ucuccagucgucgcucccua

SEQ ID NO: 23738 - RNA, 20 nt, Artificial Sequence
  MKO10023738_A_Haus3
  gRNA
uucagcgaucuccagcgauc

SEQ ID NO: 23739 - RNA, 20 nt, Artificial Sequence
  MKO10023739_A_Haus3
  gRNA
auaucggcaacuagagaguu

SEQ ID NO: 23740 - RNA, 20 nt, Artificial Sequence
  MKO10023740_A_Haus4
  gRNA
guaugagauccucuuccguc

SEQ ID NO: 23741 - RNA, 20 nt, Artificial Sequence
  MKO10023741_A_Haus4
  gRNA
acagaguugcccccgcugcu

SEQ ID NO: 23742 - RNA, 20 nt, Artificial Sequence
  MKO10023742_A_Haus4
  gRNA
aaguggcuugagccucacgc

SEQ ID NO: 23743 - RNA, 20 nt, Artificial Sequence
  MKO10023743_A_Haus5
  gRNA
cuaucagauccaucggaagu

SEQ ID NO: 23744 - RNA, 20 nt, Artificial Sequence
  MKO10023744_A_Haus5
  gRNA
aagccacuguggcccgccuu

SEQ ID NO: 23745 - RNA, 20 nt, Artificial Sequence
  MKO10023745_A_Haus5
  gRNA
guuaccagaggagguuuccc

SEQ ID NO: 23746 - RNA, 20 nt, Artificial Sequence
  MKO10023746_A_Haus6
  gRNA
aaaaucuguuacgugcuaca

SEQ ID NO: 23747 - RNA, 20 nt, Artificial Sequence
  MKO10023747_A_Haus6
  gRNA
accauucacagcaauguuuc

SEQ ID NO: 23748 - RNA, 20 nt, Artificial Sequence
  MKO10023748_A_Haus6
  gRNA
uccggaaacauugcugugaa

SEQ ID NO: 23749 - RNA, 20 nt, Artificial Sequence
  MKO10023749_A_Haus7
  gRNA
agcgcgaaacauggcggagg

SEQ ID NO: 23750 - RNA, 20 nt, Artificial Sequence
  MKO10023750_A_Haus7
  gRNA
uguguaggcccucaaaguac

SEQ ID NO: 23751 - RNA, 20 nt, Artificial Sequence
  MKO10023751_A_Haus7
  gRNA
cuguaauauacaggccgucg

SEQ ID NO: 23752 - RNA, 20 nt, Artificial Sequence
  MKO10023752_A_Haus8
  gRNA
ucacccugcgucccguucug

SEQ ID NO: 23753 - RNA, 20 nt, Artificial Sequence
  MKO10023753_A_Haus8
  gRNA
ucuugucauauugcagauac

SEQ ID NO: 23754 - RNA, 20 nt, Artificial Sequence
  MKO10023754_A_Haus8
  gRNA
cccauaacagguuucuggag

SEQ ID NO: 23755 - RNA, 20 nt, Artificial Sequence
  MKO10023755_A_Havcr1
  gRNA
acaacgacauguuggggccg

SEQ ID NO: 23756 - RNA, 20 nt, Artificial Sequence
  MKO10023756_A_Havcr1
  gRNA
uguacuuacucaacauaucg

SEQ ID NO: 23757 - RNA, 20 nt, Artificial Sequence
  MKO10023757_A_Havcr1
  gRNA
acuuacagugugauuacucc

SEQ ID NO: 23758 - RNA, 20 nt, Artificial Sequence
  MKO10023758_A_Havcr2
  gRNA
uguugagaucgcccuuuagc

SEQ ID NO: 23759 - RNA, 20 nt, Artificial Sequence
  MKO10023759_A_Havcr2
  gRNA
aucaguucugagcaacucgu

SEQ ID NO: 23760 - RNA, 20 nt, Artificial Sequence
  MKO10023760_A_Havcr2
  gRNA
agucucugcuggguugaccc

SEQ ID NO: 23761 - RNA, 20 nt, Artificial Sequence
  MKO10023761_A_Hax1
  gRNA
agaguacucacccuaugaaa

SEQ ID NO: 23762 - RNA, 20 nt, Artificial Sequence
  MKO10023762_A_Hax1
  gRNA
ccuuccagaucuugacuccc

SEQ ID NO: 23763 - RNA, 20 nt, Artificial Sequence
  MKO10023763_A_Hax1
  gRNA
aauucacacaccaggagagu

SEQ ID NO: 23764 - RNA, 20 nt, Artificial Sequence
  MKO10023764_A_Hba-a1
  gRNA
guccagagaggcaugcaccg

SEQ ID NO: 23765 - RNA, 20 nt, Artificial Sequence
  MKO10023765_A_Hba-a1
  gRNA
cagcuccauauucagcacca

SEQ ID NO: 23766 - RNA, 20 nt, Artificial Sequence
  MKO10023766_A_Hba-a1
  gRNA
gaagaaaccauggugcucuc

SEQ ID NO: 23767 - RNA, 20 nt, Artificial Sequence
  MKO10023767_A_Hba-a2
  gRNA
auccagagaggcaugcaccg

SEQ ID NO: 23768 - RNA, 20 nt, Artificial Sequence
  MKO10023768_A_Hba-a2
  gRNA
cagcuccauauucagcacca

SEQ ID NO: 23769 - RNA, 20 nt, Artificial Sequence
  MKO10023769_A_Hba-a2
  gRNA
gaagaaaccauggugcucuc

SEQ ID NO: 23770 - RNA, 20 nt, Artificial Sequence
  MKO10023770_A_Hba-x
  gRNA
uucaagaucaugaccgccgu

SEQ ID NO: 23771 - RNA, 20 nt, Artificial Sequence
  MKO10023771_A_Hba-x
  gRNA
cuuagcgguacuucucaguc

SEQ ID NO: 23772 - RNA, 20 nt, Artificial Sequence
  MKO10023772_A_Hba-x
  gRNA
gcugcucaggccgagcccau

SEQ ID NO: 23773 - RNA, 20 nt, Artificial Sequence
  MKO10023773_A_Hbb-b1
  gRNA
aacaauuaaccauuguucac

SEQ ID NO: 23774 - RNA, 20 nt, Artificial Sequence
  MKO10023774_A_Hbb-b1
  gRNA
ugcaccaugaugucuguuuc

SEQ ID NO: 23775 - RNA, 20 nt, Artificial Sequence
  MKO10023775_A_Hbb-b1
  gRNA
agagagcaucugucaguugu

SEQ ID NO: 23776 - RNA, 20 nt, Artificial Sequence
  MKO10023776_A_Hbb-b2
  gRNA
cugcuauugucuaugcacaa

SEQ ID NO: 23777 - RNA, 20 nt, Artificial Sequence
  MKO10023777_A_Hbb-b2
  gRNA
gauaaaagcuagaugcccaa

SEQ ID NO: 23778 - RNA, 20 nt, Artificial Sequence
  MKO10023778_A_Hbb-b2
  gRNA
aaccucagaaacagacauca

SEQ ID NO: 23779 - RNA, 20 nt, Artificial Sequence
  MKO10023779_A_Hbb-bh1
  gRNA
aauccggggguuucccauga

SEQ ID NO: 23780 - RNA, 20 nt, Artificial Sequence
  MKO10023780_A_Hbb-bh1
  gRNA
auggaguuuaaugguacuug

SEQ ID NO: 23781 - RNA, 20 nt, Artificial Sequence
  MKO10023781_A_Hbb-bh1
  gRNA
ggcuccugauuguuuaccca

SEQ ID NO: 23782 - RNA, 20 nt, Artificial Sequence
  MKO10023782_A_Hbb-bh2
  gRNA
ugccuucaccuuaguccacg

SEQ ID NO: 23783 - RNA, 20 nt, Artificial Sequence
  MKO10023783_A_Hbb-bh2
  gRNA
ugucauggugcagcucacuc

SEQ ID NO: 23784 - RNA, 20 nt, Artificial Sequence
  MKO10023784_A_Hbb-bh2
  gRNA
aaaguggucaaaguaucucu

SEQ ID NO: 23785 - RNA, 20 nt, Artificial Sequence
  MKO10023785_A_Hbb-bs
  gRNA
uuuagugguacuugugagcc

SEQ ID NO: 23786 - RNA, 20 nt, Artificial Sequence
  MKO10023786_A_Hbb-bs
  gRNA
gcaccugacugaugcugaga

SEQ ID NO: 23787 - RNA, 20 nt, Artificial Sequence
  MKO10023787_A_Hbb-bs
  gRNA
ggccucaccaccaacuucau

SEQ ID NO: 23788 - RNA, 20 nt, Artificial Sequence
  MKO10023788_A_Hbb-bt
  gRNA
cuuagugguacuugugagcc

SEQ ID NO: 23789 - RNA, 20 nt, Artificial Sequence
  MKO10023789_A_Hbb-bt
  gRNA
gcaccugacugaugcugaga

SEQ ID NO: 23790 - RNA, 20 nt, Artificial Sequence
  MKO10023790_A_Hbb-bt
  gRNA
ggccucaccaccaacuucau

SEQ ID NO: 23791 - RNA, 20 nt, Artificial Sequence
  MKO10023791_A_Hbb-y
  gRNA
gacccuuggguugcccauua

SEQ ID NO: 23792 - RNA, 20 nt, Artificial Sequence
  MKO10023792_A_Hbb-y
  gRNA
agacccucaucaauggccug

SEQ ID NO: 23793 - RNA, 20 nt, Artificial Sequence
  MKO10023793_A_Hbb-y
  gRNA
caacauugaccuuacuccac

SEQ ID NO: 23794 - RNA, 20 nt, Artificial Sequence
  MKO10023794_A_Hbegf
  gRNA
uuguccaguguuguccgcgu

SEQ ID NO: 23795 - RNA, 20 nt, Artificial Sequence
  MKO10023795_A_Hbegf
  gRNA
gcagguaucugcacuccccg

SEQ ID NO: 23796 - RNA, 20 nt, Artificial Sequence
  MKO10023796_A_Hbegf
  gRNA
guguauaggggauucuccac

SEQ ID NO: 23797 - RNA, 20 nt, Artificial Sequence
  MKO10023797_A_Hbp1
  gRNA
cuugguaauggcgacggguu

SEQ ID NO: 23798 - RNA, 20 nt, Artificial Sequence
  MKO10023798_A_Hbp1
  gRNA
cuagucggagcaccauaaca

SEQ ID NO: 23799 - RNA, 20 nt, Artificial Sequence
  MKO10023799_A_Hbp1
  gRNA
ucacuucccacaccauguua

SEQ ID NO: 23800 - RNA, 20 nt, Artificial Sequence
  MKO10023800_A_Hbq1a
  gRNA
aaucuacacgaccgaggccu

SEQ ID NO: 23801 - RNA, 20 nt, Artificial Sequence
  MKO10023801_A_Hbq1a
  gRNA
augacccagacacgugucca

SEQ ID NO: 23802 - RNA, 20 nt, Artificial Sequence
  MKO10023802_A_Hbq1a
  gRNA
cuucaaguaaugcugaauug

SEQ ID NO: 23803 - RNA, 20 nt, Artificial Sequence
  MKO10023803_A_Hbq1b
  gRNA
auccccaauucagcgauauu

SEQ ID NO: 23804 - RNA, 20 nt, Artificial Sequence
  MKO10023804_A_Hbq1b
  gRNA
aaucuacgcgaccgaggcuu

SEQ ID NO: 23805 - RNA, 20 nt, Artificial Sequence
  MKO10023805_A_Hbq1b
  gRNA
ggcguaccucuccaaagccu

SEQ ID NO: 23806 - RNA, 20 nt, Artificial Sequence
  MKO10023806_A_Hbs1l
  gRNA
cggggauauaacuacgauga

SEQ ID NO: 23807 - RNA, 20 nt, Artificial Sequence
  MKO10023807_A_Hbs1l
  gRNA
uacuguaucucaccaucaac

SEQ ID NO: 23808 - RNA, 20 nt, Artificial Sequence
  MKO10023808_A_Hbs1l
  gRNA
caauuaagugaaauugacca

SEQ ID NO: 23809 - RNA, 20 nt, Artificial Sequence
  MKO10023809_A_Hccs
  gRNA
ccaucguugguccgauuugg

SEQ ID NO: 23810 - RNA, 20 nt, Artificial Sequence
  MKO10023810_A_Hccs
  gRNA
cacucacccuuuccguaaca

SEQ ID NO: 23811 - RNA, 20 nt, Artificial Sequence
  MKO10023811_A_Hccs
  gRNA
aucagaauaaugagcaagcg

SEQ ID NO: 23812 - RNA, 20 nt, Artificial Sequence
  MKO10023812_A_Hcfc1r1
  gRNA
agcuccacgauauccccagc

SEQ ID NO: 23813 - RNA, 20 nt, Artificial Sequence
  MKO10023813_A_Hcfc1r1
  gRNA
caauuacacaccuggcguuu

SEQ ID NO: 23814 - RNA, 20 nt, Artificial Sequence
  MKO10023814_A_Hcfc1r1
  gRNA
gacuugggggaccucgcucc

SEQ ID NO: 23815 - RNA, 20 nt, Artificial Sequence
  MKO10023815_A_Hcfc1
  gRNA
accccaagaacaacauuccg

SEQ ID NO: 23816 - RNA, 20 nt, Artificial Sequence
  MKO10023816_A_Hcfc1
  gRNA
ucaccucggaauguuguucu

SEQ ID NO: 23817 - RNA, 20 nt, Artificial Sequence
  MKO10023817_A_Hcfc1
  gRNA
aggcaggacaccguaaguga

SEQ ID NO: 23818 - RNA, 20 nt, Artificial Sequence
  MKO10023818_A_Hcfc2
  gRNA
uggaaugugcggugcucguc

SEQ ID NO: 23819 - RNA, 20 nt, Artificial Sequence
  MKO10023819_A_Hcfc2
  gRNA
uggagaaggcacaacgccuu

SEQ ID NO: 23820 - RNA, 20 nt, Artificial Sequence
  MKO10023820_A_Hcfc2
  gRNA
gggaugucuccucuaacagc

SEQ ID NO: 23821 - RNA, 20 nt, Artificial Sequence
  MKO10023821_A_Hck
  gRNA
gucguacagugcgaccacaa

SEQ ID NO: 23822 - RNA, 20 nt, Artificial Sequence
  MKO10023822_A_Hck
  gRNA
acggucccuggcuaccaaga

SEQ ID NO: 23823 - RNA, 20 nt, Artificial Sequence
  MKO10023823_A_Hck
  gRNA
gugggauccggcacauacac

SEQ ID NO: 23824 - RNA, 20 nt, Artificial Sequence
  MKO10023824_A_Hcls1
  gRNA
caaaccgaccgccauagcca

SEQ ID NO: 23825 - RNA, 20 nt, Artificial Sequence
  MKO10023825_A_Hcls1
  gRNA
ucucagacugaugccgccag

SEQ ID NO: 23826 - RNA, 20 nt, Artificial Sequence
  MKO10023826_A_Hcls1
  gRNA
ccacgaguauguugcugaug

SEQ ID NO: 23827 - RNA, 20 nt, Artificial Sequence
  MKO10023827_A_Hcn1
  gRNA
ccucacgauacgaagugcuc

SEQ ID NO: 23828 - RNA, 20 nt, Artificial Sequence
  MKO10023828_A_Hcn1
  gRNA
ccagagcacuucguaucgug

SEQ ID NO: 23829 - RNA, 20 nt, Artificial Sequence
  MKO10023829_A_Hcn1
  gRNA
accugcuacgcaauguuugu

SEQ ID NO: 23830 - RNA, 20 nt, Artificial Sequence
  MKO10023830_A_Hcn2
  gRNA
uucgucacggcgccaauacc

SEQ ID NO: 23831 - RNA, 20 nt, Artificial Sequence
  MKO10023831_A_Hcn2
  gRNA
cuacucguucgcgcucuuca

SEQ ID NO: 23832 - RNA, 20 nt, Artificial Sequence
  MKO10023832_A_Hcn2
  gRNA
agaagaaguacuugcguacg

SEQ ID NO: 23833 - RNA, 20 nt, Artificial Sequence
  MKO10023833_A_Hcn3
  gRNA
gaacgcguuaccugcgcacc

SEQ ID NO: 23834 - RNA, 20 nt, Artificial Sequence
  MKO10023834_A_Hcn3
  gRNA
aggugcgcagguaacgcguu

SEQ ID NO: 23835 - RNA, 20 nt, Artificial Sequence
  MKO10023835_A_Hcn3
  gRNA
agcgaugcucguaguacucg

SEQ ID NO: 23836 - RNA, 20 nt, Artificial Sequence
  MKO10023836_A_Hcn4
  gRNA
cacgaugcguaccacggcgc

SEQ ID NO: 23837 - RNA, 20 nt, Artificial Sequence
  MKO10023837_A_Hcn4
  gRNA
caacuuccgcacggggaucg

SEQ ID NO: 23838 - RNA, 20 nt, Artificial Sequence
  MKO10023838_A_Hcn4
  gRNA
gccgggaggagucuagcgac

SEQ ID NO: 23839 - RNA, 20 nt, Artificial Sequence
  MKO10023839_A_Hcrtr1
  gRNA
aucaccgagucguggcucuu

SEQ ID NO: 23840 - RNA, 20 nt, Artificial Sequence
  MKO10023840_A_Hcrtr1
  gRNA
cugagcuagccaaucgcacc

SEQ ID NO: 23841 - RNA, 20 nt, Artificial Sequence
  MKO10023841_A_Hcrtr1
  gRNA
agcacagcucgccgugcccg

SEQ ID NO: 23842 - RNA, 20 nt, Artificial Sequence
  MKO10023842_A_Hcrtr2
  gRNA
uaaagcagauccgagcacga

SEQ ID NO: 23843 - RNA, 20 nt, Artificial Sequence
  MKO10023843_A_Hcrtr2
  gRNA
gaugcuguuucgagcccguu

SEQ ID NO: 23844 - RNA, 20 nt, Artificial Sequence
  MKO10023844_A_Hcrtr2
  gRNA
aauggcguaccaucggucca

SEQ ID NO: 23845 - RNA, 20 nt, Artificial Sequence
  MKO10023845_A_Hcrt
  gRNA
cgugcaacaguucguagaga

SEQ ID NO: 23846 - RNA, 20 nt, Artificial Sequence
  MKO10023846_A_Hcrt
  gRNA
cggacagccgcgaccagagc

SEQ ID NO: 23847 - RNA, 20 nt, Artificial Sequence
  MKO10023847_A_Hcrt
  gRNA
uggcucuuuaccuuuguaga

SEQ ID NO: 23848 - RNA, 20 nt, Artificial Sequence
  MKO10023848_A_Hcst
  gRNA
ucaugucacuccuaauugua

SEQ ID NO: 23849 - RNA, 20 nt, Artificial Sequence
  MKO10023849_A_Hcst
  gRNA
cagcccagcauggacccccc

SEQ ID NO: 23850 - RNA, 20 nt, Artificial Sequence
  MKO10023850_A_Hcst
  gRNA
ugaccgcaucugcagccacu

SEQ ID NO: 23851 - RNA, 20 nt, Artificial Sequence
  MKO10023851_A_Hc
  gRNA
gauacucuaccugacugguc

SEQ ID NO: 23852 - RNA, 20 nt, Artificial Sequence
  MKO10023852_A_Hc
  gRNA
cugucaacagugccgcguuu

SEQ ID NO: 23853 - RNA, 20 nt, Artificial Sequence
  MKO10023853_A_Hc
  gRNA
aguuaagacagucucccguu

SEQ ID NO: 23854 - RNA, 20 nt, Artificial Sequence
  MKO10023854_A_Hdac10
  gRNA
agggcagcugucaggcgcuc

SEQ ID NO: 23855 - RNA, 20 nt, Artificial Sequence
  MKO10023855_A_Hdac10
  gRNA
uggccugcggcagcguggcc

SEQ ID NO: 23856 - RNA, 20 nt, Artificial Sequence
  MKO10023856_A_Hdac10
  gRNA
ugcaccagggcuauauauuc

SEQ ID NO: 23857 - RNA, 20 nt, Artificial Sequence
  MKO10023857_A_Hdac11
  gRNA
guaacguggugaguacacga

SEQ ID NO: 23858 - RNA, 20 nt, Artificial Sequence
  MKO10023858_A_Hdac11
  gRNA
gccucgugugcaccaccagc

SEQ ID NO: 23859 - RNA, 20 nt, Artificial Sequence
  MKO10023859_A_Hdac11
  gRNA
gcgcuaucucaacgagcuga

SEQ ID NO: 23860 - RNA, 20 nt, Artificial Sequence
  MKO10023860_A_Hdac1
  gRNA
cuuaccgacagagccucccg

SEQ ID NO: 23861 - RNA, 20 nt, Artificial Sequence
  MKO10023861_A_Hdac1
  gRNA
uuacgucaaugacaucgucc

SEQ ID NO: 23862 - RNA, 20 nt, Artificial Sequence
  MKO10023862_A_Hdac1
  gRNA
cuuucaagucaauguuggug

SEQ ID NO: 23863 - RNA, 20 nt, Artificial Sequence
  MKO10023863_A_Hdac2
  gRNA
cucaccaacugaaccacccg

SEQ ID NO: 23864 - RNA, 20 nt, Artificial Sequence
  MKO10023864_A_Hdac2
  gRNA
uaacgucggagaagauuguc

SEQ ID NO: 23865 - RNA, 20 nt, Artificial Sequence
  MKO10023865_A_Hdac2
  gRNA
cuggggcugugaaauuaaac

SEQ ID NO: 23866 - RNA, 20 nt, Artificial Sequence
  MKO10023866_A_Hdac3
  gRNA
gagccuuaaugccuucaacg

SEQ ID NO: 23867 - RNA, 20 nt, Artificial Sequence
  MKO10023867_A_Hdac3
  gRNA
uagaccaccggcccaguuga

SEQ ID NO: 23868 - RNA, 20 nt, Artificial Sequence
  MKO10023868_A_Hdac3
  gRNA
gaguucugcucccguuacac

SEQ ID NO: 23869 - RNA, 20 nt, Artificial Sequence
  MKO10023869_A_Hdac4
  gRNA
ucacuuacccauaccaguag

SEQ ID NO: 23870 - RNA, 20 nt, Artificial Sequence
  MKO10023870_A_Hdac4
  gRNA
uuuccagcgauccccgcuac

SEQ ID NO: 23871 - RNA, 20 nt, Artificial Sequence
  MKO10023871_A_Hdac4
  gRNA
aguacccauggaccugcgcu

SEQ ID NO: 23872 - RNA, 20 nt, Artificial Sequence
  MKO10023872_A_Hdac5
  gRNA
ccucgugcugccgcgucaag

SEQ ID NO: 23873 - RNA, 20 nt, Artificial Sequence
  MKO10023873_A_Hdac5
  gRNA
agcagcacgaccacuugacg

SEQ ID NO: 23874 - RNA, 20 nt, Artificial Sequence
  MKO10023874_A_Hdac5
  gRNA
ugcucuucuccuuguugcgc

SEQ ID NO: 23875 - RNA, 20 nt, Artificial Sequence
  MKO10023875_A_Hdac6
  gRNA
cuucuuuaccuccgcuagau

SEQ ID NO: 23876 - RNA, 20 nt, Artificial Sequence
  MKO10023876_A_Hdac6
  gRNA
ccaggcccgguucgcugaga

SEQ ID NO: 23877 - RNA, 20 nt, Artificial Sequence
  MKO10023877_A_Hdac6
  gRNA
aacaccaauccaguaccaac

SEQ ID NO: 23878 - RNA, 20 nt, Artificial Sequence
  MKO10023878_A_Hdac7
  gRNA
cucuggugggggcuccaccg

SEQ ID NO: 23879 - RNA, 20 nt, Artificial Sequence
  MKO10023879_A_Hdac7
  gRNA
gagcuaccuguagggaauac

SEQ ID NO: 23880 - RNA, 20 nt, Artificial Sequence
  MKO10023880_A_Hdac7
  gRNA
uguugcagggucagcagcgc

SEQ ID NO: 23881 - RNA, 20 nt, Artificial Sequence
  MKO10023881_A_Hdac8
  gRNA
gucgcaaucguaauauuccc

SEQ ID NO: 23882 - RNA, 20 nt, Artificial Sequence
  MKO10023882_A_Hdac8
  gRNA
cuuuacacuucccgucaauc

SEQ ID NO: 23883 - RNA, 20 nt, Artificial Sequence
  MKO10023883_A_Hdac8
  gRNA
auuugaccguauucucuacg

SEQ ID NO: 23884 - RNA, 20 nt, Artificial Sequence
  MKO10023884_A_Hdac9
  gRNA
uuguugcugauuuacucaac

SEQ ID NO: 23885 - RNA, 20 nt, Artificial Sequence
  MKO10023885_A_Hdac9
  gRNA
uccaguggacgugaaaucag

SEQ ID NO: 23886 - RNA, 20 nt, Artificial Sequence
  MKO10023886_A_Hdac9
  gRNA
uccuacaaguacacauuacc

SEQ ID NO: 23887 - RNA, 20 nt, Artificial Sequence
  MKO10023887_A_Hdc
  gRNA
auccacuuuaauugcccugc

SEQ ID NO: 23888 - RNA, 20 nt, Artificial Sequence
  MKO10023888_A_Hdc
  gRNA
aacgagccgagcguucaggg

SEQ ID NO: 23889 - RNA, 20 nt, Artificial Sequence
  MKO10023889_A_Hdc
  gRNA
cgggagcacucgcagguagc

SEQ ID NO: 23890 - RNA, 20 nt, Artificial Sequence
  MKO10023890_A_Hddc2
  gRNA
auucugccauaucgugaacc

SEQ ID NO: 23891 - RNA, 20 nt, Artificial Sequence
  MKO10023891_A_Hddc2
  gRNA
cagauguauacgccuagccc

SEQ ID NO: 23892 - RNA, 20 nt, Artificial Sequence
  MKO10023892_A_Hddc2
  gRNA
cagagaugaccgucuuaaca

SEQ ID NO: 23893 - RNA, 20 nt, Artificial Sequence
  MKO10023893_A_Hddc3
  gRNA
agcccggauccuaacccaug

SEQ ID NO: 23894 - RNA, 20 nt, Artificial Sequence
  MKO10023894_A_Hddc3
  gRNA
accgauggggugauuaaugu

SEQ ID NO: 23895 - RNA, 20 nt, Artificial Sequence
  MKO10023895_A_Hddc3
  gRNA
cuguaggggugcagcgauuc

SEQ ID NO: 23896 - RNA, 20 nt, Artificial Sequence
  MKO10023896_A_Hdgfl1
  gRNA
gcgacauguucgauccucgc

SEQ ID NO: 23897 - RNA, 20 nt, Artificial Sequence
  MKO10023897_A_Hdgfl1
  gRNA
gcugaagccgcgccucuugu

SEQ ID NO: 23898 - RNA, 20 nt, Artificial Sequence
  MKO10023898_A_Hdgfl1
  gRNA
ccccggucuuguacuuagag

SEQ ID NO: 23899 - RNA, 20 nt, Artificial Sequence
  MKO10023899_A_Hdgfrp2
  gRNA
caccggaggcgcacuguagc

SEQ ID NO: 23900 - RNA, 20 nt, Artificial Sequence
  MKO10023900_A_Hdgfrp2
  gRNA
ugccagcuacagugcgccuc

SEQ ID NO: 23901 - RNA, 20 nt, Artificial Sequence
  MKO10023901_A_Hdgfrp2
  gRNA
cuggucuucuccgacucaga

SEQ ID NO: 23902 - RNA, 20 nt, Artificial Sequence
  MKO10023902_A_Hdgfrp3
  gRNA
gaaaaaguccuacacgucaa

SEQ ID NO: 23903 - RNA, 20 nt, Artificial Sequence
  MKO10023903_A_Hdgfrp3
  gRNA
ucuuuaucaucuucgucucc

SEQ ID NO: 23904 - RNA, 20 nt, Artificial Sequence
  MKO10023904_A_Hdgfrp3
  gRNA
uucagugaccuuugacgugu

SEQ ID NO: 23905 - RNA, 20 nt, Artificial Sequence
  MKO10023905_A_Hdgf
  gRNA
ucuuaucaccgucacccuca

SEQ ID NO: 23906 - RNA, 20 nt, Artificial Sequence
  MKO10023906_A_Hdgf
  gRNA
cgagaacaacccuacaguca

SEQ ID NO: 23907 - RNA, 20 nt, Artificial Sequence
  MKO10023907_A_Hdgf
  gRNA
cuccuauccagggcauuccu

SEQ ID NO: 23908 - RNA, 20 nt, Artificial Sequence
  MKO10023908_A_Hdhd1a
  gRNA
cuaccugccuuuacggaaua

SEQ ID NO: 23909 - RNA, 20 nt, Artificial Sequence
  MKO10023909_A_Hdhd1a
  gRNA
uguuuggaagguaacggucu

SEQ ID NO: 23910 - RNA, 20 nt, Artificial Sequence
  MKO10023910_A_Hdhd1a
  gRNA
uauucagaauaaguccgucc

SEQ ID NO: 23911 - RNA, 20 nt, Artificial Sequence
  MKO10023911_A_Hdhd2
  gRNA
ccgugcguuaaaagcuguuu

SEQ ID NO: 23912 - RNA, 20 nt, Artificial Sequence
  MKO10023912_A_Hdhd2
  gRNA
cagcugcuuaccggaaugcu

SEQ ID NO: 23913 - RNA, 20 nt, Artificial Sequence
  MKO10023913_A_Hdhd2
  gRNA
gcuucugcucgauuaaguuu

SEQ ID NO: 23914 - RNA, 20 nt, Artificial Sequence
  MKO10023914_A_Hdhd3
  gRNA
caacuuugaccgacgacuag

SEQ ID NO: 23915 - RNA, 20 nt, Artificial Sequence
  MKO10023915_A_Hdhd3
  gRNA
aucaagcuccgccgacccgu

SEQ ID NO: 23916 - RNA, 20 nt, Artificial Sequence
  MKO10023916_A_Hdhd3
  gRNA
uuaggauauccucuagucgu

SEQ ID NO: 23917 - RNA, 20 nt, Artificial Sequence
  MKO10023917_A_Hdlbp
  gRNA
uaacaagauccggcccauca

SEQ ID NO: 23918 - RNA, 20 nt, Artificial Sequence
  MKO10023918_A_Hdlbp
  gRNA
gagcaccaucgcuuuguuau

SEQ ID NO: 23919 - RNA, 20 nt, Artificial Sequence
  MKO10023919_A_Hdlbp
  gRNA
ggucaucugggcgugggauc

SEQ ID NO: 23920 - RNA, 20 nt, Artificial Sequence
  MKO10023920_A_Hdx
  gRNA
ugcuuacuugaugagcuuac

SEQ ID NO: 23921 - RNA, 20 nt, Artificial Sequence
  MKO10023921_A_Hdx
  gRNA
ucaauucagugaccgagacu

SEQ ID NO: 23922 - RNA, 20 nt, Artificial Sequence
  MKO10023922_A_Hdx
  gRNA
auugaaguuccaccuccaag

SEQ ID NO: 23923 - RNA, 20 nt, Artificial Sequence
  MKO10023923_A_Heaur1
  gRNA
uucugccguaccaugagaca

SEQ ID NO: 23924 - RNA, 20 nt, Artificial Sequence
  MKO10023924_A_Heaur1
  gRNA
ccuucacagaucucgucacu

SEQ ID NO: 23925 - RNA, 20 nt, Artificial Sequence
  MKO10023925_A_Heaur1
  gRNA
uggcgacuacauugucugau

SEQ ID NO: 23926 - RNA, 20 nt, Artificial Sequence
  MKO10023926_A_Heaur2
  gRNA
agugcccguggcuucgauaa

SEQ ID NO: 23927 - RNA, 20 nt, Artificial Sequence
  MKO10023927_A_Heaur2
  gRNA
gguagccguuaucgaagcca

SEQ ID NO: 23928 - RNA, 20 nt, Artificial Sequence
  MKO10023928_A_Heaur2
  gRNA
ucugucaugauaucaccgac

SEQ ID NO: 23929 - RNA, 20 nt, Artificial Sequence
  MKO10023929_A_Heaur3
  gRNA
cacuaccagacuuagcccgu

SEQ ID NO: 23930 - RNA, 20 nt, Artificial Sequence
  MKO10023930_A_Heaur3
  gRNA
gccggcgcacagcaucccga

SEQ ID NO: 23931 - RNA, 20 nt, Artificial Sequence
  MKO10023931_A_Heaur3
  gRNA
auugaccuggcugucuccgu

SEQ ID NO: 23932 - RNA, 20 nt, Artificial Sequence
  MKO10023932_A_Heaur5a
  gRNA
ugauauccgcacgucauaau

SEQ ID NO: 23933 - RNA, 20 nt, Artificial Sequence
  MKO10023933_A_Heaur5a
  gRNA
cugagcaaggagcuugcgcg

SEQ ID NO: 23934 - RNA, 20 nt, Artificial Sequence
  MKO10023934_A_Heaur5a
  gRNA
cagccuuguaaacgucccug

SEQ ID NO: 23935 - RNA, 20 nt, Artificial Sequence
  MKO10023935_A_Heaur5b
  gRNA
gucgcaguaucuaagcuacu

SEQ ID NO: 23936 - RNA, 20 nt, Artificial Sequence
  MKO10023936_A_Heaur5b
  gRNA
uacagcauugaugccgaaac

SEQ ID NO: 23937 - RNA, 20 nt, Artificial Sequence
  MKO10023937_A_Heaur5b
  gRNA
cagccaucgaccugucgguc

SEQ ID NO: 23938 - RNA, 20 nt, Artificial Sequence
  MKO10023938_A_Heaur6
  gRNA
gucuccaaaaucgucugaua

SEQ ID NO: 23939 - RNA, 20 nt, Artificial Sequence
  MKO10023939_A_Heaur6
  gRNA
guaaucuguuaagcaaacga

SEQ ID NO: 23940 - RNA, 20 nt, Artificial Sequence
  MKO10023940_A_Heaur6
  gRNA
ucauccauaucagacgauuu

SEQ ID NO: 23941 - RNA, 20 nt, Artificial Sequence
  MKO10023941_A_Hebp1
  gRNA
uguucgggagcguggaaacg

SEQ ID NO: 23942 - RNA, 20 nt, Artificial Sequence
  MKO10023942_A_Hebp1
  gRNA
cggauuccgaaccaauuuca

SEQ ID NO: 23943 - RNA, 20 nt, Artificial Sequence
  MKO10023943_A_Hebp1
  gRNA
gggacgcucaccuuugucau

SEQ ID NO: 23944 - RNA, 20 nt, Artificial Sequence
  MKO10023944_A_Hebp2
  gRNA
gcuccacguagcuugucacg

SEQ ID NO: 23945 - RNA, 20 nt, Artificial Sequence
  MKO10023945_A_Hebp2
  gRNA
cccuccgucgagaacaaaua

SEQ ID NO: 23946 - RNA, 20 nt, Artificial Sequence
  MKO10023946_A_Hebp2
  gRNA
agcccccgugacaagcuacg

SEQ ID NO: 23947 - RNA, 20 nt, Artificial Sequence
  MKO10023947_A_Heca
  gRNA
ccgauccguacgucgaucac

SEQ ID NO: 23948 - RNA, 20 nt, Artificial Sequence
  MKO10023948_A_Heca
  gRNA
ccugugaucgacguacggau

SEQ ID NO: 23949 - RNA, 20 nt, Artificial Sequence
  MKO10023949_A_Heca
  gRNA
accauucuuagcgucucccg

SEQ ID NO: 23950 - RNA, 20 nt, Artificial Sequence
  MKO10023950_A_Hecud1
  gRNA
cuaccccacgacgaguaaac

SEQ ID NO: 23951 - RNA, 20 nt, Artificial Sequence
  MKO10023951_A_Hecud1
  gRNA
cugaucugcacgcgugaguc

SEQ ID NO: 23952 - RNA, 20 nt, Artificial Sequence
  MKO10023952_A_Hecud1
  gRNA
gacuuacaauugucgacacc

SEQ ID NO: 23953 - RNA, 20 nt, Artificial Sequence
  MKO10023953_A_Hecud2
  gRNA
ucucucgcccggagcgccgc

SEQ ID NO: 23954 - RNA, 20 nt, Artificial Sequence
  MKO10023954_A_Hecud2
  gRNA
gaagcugccgcccaucguga

SEQ ID NO: 23955 - RNA, 20 nt, Artificial Sequence
  MKO10023955_A_Hecud2
  gRNA
agcguuaccaucugaaguga

SEQ ID NO: 23956 - RNA, 20 nt, Artificial Sequence
  MKO10023956_A_Hecud3
  gRNA
agcuauuuggcguggacuac

SEQ ID NO: 23957 - RNA, 20 nt, Artificial Sequence
  MKO10023957_A_Hecud3
  gRNA
ucuagugugucgaccagcag

SEQ ID NO: 23958 - RNA, 20 nt, Artificial Sequence
  MKO10023958_A_Hecud3
  gRNA
ccugaccuauucacaucgcc

SEQ ID NO: 23959 - RNA, 20 nt, Artificial Sequence
  MKO10023959_A_Hecw1
  gRNA
ggagugcccuaucgaauagu

SEQ ID NO: 23960 - RNA, 20 nt, Artificial Sequence
  MKO10023960_A_Hecw1
  gRNA
gggguucuuugcaccggcgu

SEQ ID NO: 23961 - RNA, 20 nt, Artificial Sequence
  MKO10023961_A_Hecw1
  gRNA
gcagggccccacuuacuccg

SEQ ID NO: 23962 - RNA, 20 nt, Artificial Sequence
  MKO10023962_A_Hecw2
  gRNA
aagagguugaccccagcgau

SEQ ID NO: 23963 - RNA, 20 nt, Artificial Sequence
  MKO10023963_A_Hecw2
  gRNA
auagaguccuauccaaucgc

SEQ ID NO: 23964 - RNA, 20 nt, Artificial Sequence
  MKO10023964_A_Hecw2
  gRNA
ucuccucagaugggggccga

SEQ ID NO: 23965 - RNA, 20 nt, Artificial Sequence
  MKO10023965_A_Heg1
  gRNA
aggaguacucacacgauggg

SEQ ID NO: 23966 - RNA, 20 nt, Artificial Sequence
  MKO10023966_A_Heg1
  gRNA
cugauauugccgucgacauu

SEQ ID NO: 23967 - RNA, 20 nt, Artificial Sequence
  MKO10023967_A_Heg1
  gRNA
accacuucaaccacgucagc

SEQ ID NO: 23968 - RNA, 20 nt, Artificial Sequence
  MKO10023968_A_Helb
  gRNA
uugcgccucuaauugacgcc

SEQ ID NO: 23969 - RNA, 20 nt, Artificial Sequence
  MKO10023969_A_Helb
  gRNA
ggcgcaaagcccaacgaucc

SEQ ID NO: 23970 - RNA, 20 nt, Artificial Sequence
  MKO10023970_A_Helb
  gRNA
cacaaccagaacucgaaccg

SEQ ID NO: 23971 - RNA, 20 nt, Artificial Sequence
  MKO10023971_A_Hells
  gRNA
acggucauuaaaacuuacag

SEQ ID NO: 23972 - RNA, 20 nt, Artificial Sequence
  MKO10023972_A_Hells
  gRNA
uaggguaaaaguuuaguuga

SEQ ID NO: 23973 - RNA, 20 nt, Artificial Sequence
  MKO10023973_A_Hells
  gRNA
uuggauaggcucaaaagucu

SEQ ID NO: 23974 - RNA, 20 nt, Artificial Sequence
  MKO10023974_A_Helq
  gRNA
uggccgugcucacuaguuuc

SEQ ID NO: 23975 - RNA, 20 nt, Artificial Sequence
  MKO10023975_A_Helq
  gRNA
gggucugguugucgucgaug

SEQ ID NO: 23976 - RNA, 20 nt, Artificial Sequence
  MKO10023976_A_Helq
  gRNA
cuuaaugauccuuccguaug

SEQ ID NO: 23977 - RNA, 20 nt, Artificial Sequence
  MKO10023977_A_Helt
  gRNA
accgucgcgcuggacaagua

SEQ ID NO: 23978 - RNA, 20 nt, Artificial Sequence
  MKO10023978_A_Helt
  gRNA
ugaagccacaauguucccgc

SEQ ID NO: 23979 - RNA, 20 nt, Artificial Sequence
  MKO10023979_A_Helt
  gRNA
uaaccgcugcuugaacgagc

SEQ ID NO: 23980 - RNA, 20 nt, Artificial Sequence
  MKO10023980_A_Helz2
  gRNA
cucguucgaacuaccgacag

SEQ ID NO: 23981 - RNA, 20 nt, Artificial Sequence
  MKO10023981_A_Helz2
  gRNA
ggccaauguguacgucuugc

SEQ ID NO: 23982 - RNA, 20 nt, Artificial Sequence
  MKO10023982_A_Helz2
  gRNA
uauacuguacuguuaggcgc

SEQ ID NO: 23983 - RNA, 20 nt, Artificial Sequence
  MKO10023983_A_Helz
  gRNA
gcaacgaguaauguccuguc

SEQ ID NO: 23984 - RNA, 20 nt, Artificial Sequence
  MKO10023984_A_Helz
  gRNA
cuucuacgugacauccagac

SEQ ID NO: 23985 - RNA, 20 nt, Artificial Sequence
  MKO10023985_A_Helz
  gRNA
gcugaugaagauuguaggca

SEQ ID NO: 23986 - RNA, 20 nt, Artificial Sequence
  MKO10023986_A_Hemgn
  gRNA
cuucaggccccgacauuuca

SEQ ID NO: 23987 - RNA, 20 nt, Artificial Sequence
  MKO10023987_A_Hemgn
  gRNA
ccccaaucagaugucgcuga

SEQ ID NO: 23988 - RNA, 20 nt, Artificial Sequence
  MKO10023988_A_Hemgn
  gRNA
ccgcagacaucauuggaucu

SEQ ID NO: 23989 - RNA, 20 nt, Artificial Sequence
  MKO10023989_A_Hemk1
  gRNA
augccggugcaguauauccu

SEQ ID NO: 23990 - RNA, 20 nt, Artificial Sequence
  MKO10023990_A_Hemk1
  gRNA
gccacugaccccucaacaau

SEQ ID NO: 23991 - RNA, 20 nt, Artificial Sequence
  MKO10023991_A_Hemk1
  gRNA
ccuuccaggaacugguugaa

SEQ ID NO: 23992 - RNA, 20 nt, Artificial Sequence
  MKO10023992_A_Hemt1
  gRNA
cauacagcgucugagauucg

SEQ ID NO: 23993 - RNA, 20 nt, Artificial Sequence
  MKO10023993_A_Hemt1
  gRNA
caagucccucucuaaauuag

SEQ ID NO: 23994 - RNA, 20 nt, Artificial Sequence
  MKO10023994_A_Hemt1
  gRNA
uucaaguauaacuugcaaug

SEQ ID NO: 23995 - RNA, 20 nt, Artificial Sequence
  MKO10023995_A_Henmt1
  gRNA
ucaucuauagguugccgacc

SEQ ID NO: 23996 - RNA, 20 nt, Artificial Sequence
  MKO10023996_A_Henmt1
  gRNA
gcaucgcuugucucccuauu

SEQ ID NO: 23997 - RNA, 20 nt, Artificial Sequence
  MKO10023997_A_Henmt1
  gRNA
acgccgaccauaaauuugag

SEQ ID NO: 23998 - RNA, 20 nt, Artificial Sequence
  MKO10023998_A_Hepacam2
  gRNA
ucgaguuucaucgcgucuuc

SEQ ID NO: 23999 - RNA, 20 nt, Artificial Sequence
  MKO10023999_A_Hepacam2
  gRNA
cccgcugcaguucaccgaug

SEQ ID NO: 24000 - RNA, 20 nt, Artificial Sequence
  MKO10024000_A_Hepacam2
  gRNA
cacgauguaauugcccucau

SEQ ID NO: 24001 - RNA, 20 nt, Artificial Sequence
  MKO10024001_A_Hepacam
  gRNA
cugacuaucgagaccguauc

SEQ ID NO: 24002 - RNA, 20 nt, Artificial Sequence
  MKO10024002_A_Hepacam
  gRNA
gccuagcuacacguggcuga

SEQ ID NO: 24003 - RNA, 20 nt, Artificial Sequence
  MKO10024003_A_Hepacam
  gRNA
agcccaguacgucugaucca

SEQ ID NO: 24004 - RNA, 20 nt, Artificial Sequence
  MKO10024004_A_Hephl1
  gRNA
cgagggcccaacaggauagg

SEQ ID NO: 24005 - RNA, 20 nt, Artificial Sequence
  MKO10024005_A_Hephl1
  gRNA
cucacacauugaugccccua

SEQ ID NO: 24006 - RNA, 20 nt, Artificial Sequence
  MKO10024006_A_Hephl1
  gRNA
gauucgccaacgcacaucuc

SEQ ID NO: 24007 - RNA, 20 nt, Artificial Sequence
  MKO10024007_A_Heph
  gRNA
ggccauucgaaacuacuacu

SEQ ID NO: 24008 - RNA, 20 nt, Artificial Sequence
  MKO10024008_A_Heph
  gRNA
gcccaaguaguaguuucgaa

SEQ ID NO: 24009 - RNA, 20 nt, Artificial Sequence
  MKO10024009_A_Heph
  gRNA
gucggcucgcaaaauucuuc

SEQ ID NO: 24010 - RNA, 20 nt, Artificial Sequence
  MKO10024010_A_Herc1
  gRNA
guacguaccuuucccuguag

SEQ ID NO: 24011 - RNA, 20 nt, Artificial Sequence
  MKO10024011_A_Herc1
  gRNA
acugauuauuggaaucuccg

SEQ ID NO: 24012 - RNA, 20 nt, Artificial Sequence
  MKO10024012_A_Herc1
  gRNA
uacaggguucaucugcugau

SEQ ID NO: 24013 - RNA, 20 nt, Artificial Sequence
  MKO10024013_A_Herc2
  gRNA
aggcaaugaaguagcgcucg

SEQ ID NO: 24014 - RNA, 20 nt, Artificial Sequence
  MKO10024014_A_Herc2
  gRNA
gugcugcucgggauccgacu

SEQ ID NO: 24015 - RNA, 20 nt, Artificial Sequence
  MKO10024015_A_Herc2
  gRNA
guagaaggucuugcccgagu

SEQ ID NO: 24016 - RNA, 20 nt, Artificial Sequence
  MKO10024016_A_Herc3
  gRNA
aaagucgucuauauuaguug

SEQ ID NO: 24017 - RNA, 20 nt, Artificial Sequence
  MKO10024017_A_Herc3
  gRNA
caugacuacugaggauuccg

SEQ ID NO: 24018 - RNA, 20 nt, Artificial Sequence
  MKO10024018_A_Herc3
  gRNA
gugugcguaaaagcuucacg

SEQ ID NO: 24019 - RNA, 20 nt, Artificial Sequence
  MKO10024019_A_Herc4
  gRNA
acgcaacagcuacgauauuc

SEQ ID NO: 24020 - RNA, 20 nt, Artificial Sequence
  MKO10024020_A_Herc4
  gRNA
aauaucguagcuguugcgug

SEQ ID NO: 24021 - RNA, 20 nt, Artificial Sequence
  MKO10024021_A_Herc4
  gRNA
cagauaguacagguugcgug

SEQ ID NO: 24022 - RNA, 20 nt, Artificial Sequence
  MKO10024022_A_Herc6
  gRNA
aucuacaagccgcauucaau

SEQ ID NO: 24023 - RNA, 20 nt, Artificial Sequence
  MKO10024023_A_Herc6
  gRNA
cucagcgggaacaaaguuaa

SEQ ID NO: 24024 - RNA, 20 nt, Artificial Sequence
  MKO10024024_A_Herc6
  gRNA
uccuuccccaugaaaacacg

SEQ ID NO: 24025 - RNA, 20 nt, Artificial Sequence
  MKO10024025_A_Herpud1
  gRNA
gguuccagcagaucuaugca

SEQ ID NO: 24026 - RNA, 20 nt, Artificial Sequence
  MKO10024026_A_Herpud1
  gRNA
uugccguaaaccaucacuug

SEQ ID NO: 24027 - RNA, 20 nt, Artificial Sequence
  MKO10024027_A_Herpud1
  gRNA
ccuagagauguucucccauc

SEQ ID NO: 24028 - RNA, 20 nt, Artificial Sequence
  MKO10024028_A_Herpud2
  gRNA
ccaaaauccagcaccgauag

SEQ ID NO: 24029 - RNA, 20 nt, Artificial Sequence
  MKO10024029_A_Herpud2
  gRNA
acuuacccuuggauuacaua

SEQ ID NO: 24030 - RNA, 20 nt, Artificial Sequence
  MKO10024030_A_Herpud2
  gRNA
auggaguuguugaauccgaa

SEQ ID NO: 24031 - RNA, 20 nt, Artificial Sequence
  MKO10024031_A_Hes1
  gRNA
cggcgcgaauggcgcgugcu

SEQ ID NO: 24032 - RNA, 20 nt, Artificial Sequence
  MKO10024032_A_Hes1
  gRNA
gaccgggccgcugugagcga

SEQ ID NO: 24033 - RNA, 20 nt, Artificial Sequence
  MKO10024033_A_Hes1
  gRNA
cggucaucugcgcccgcugc

SEQ ID NO: 24034 - RNA, 20 nt, Artificial Sequence
  MKO10024034_A_Hes2
  gRNA
ucucguugauccgcgcgcgc

SEQ ID NO: 24035 - RNA, 20 nt, Artificial Sequence
  MKO10024035_A_Hes2
  gRNA
uaguaggcgcgcgcucacug

SEQ ID NO: 24036 - RNA, 20 nt, Artificial Sequence
  MKO10024036_A_Hes2
  gRNA
gacuucccgcucuucgaagu

SEQ ID NO: 24037 - RNA, 20 nt, Artificial Sequence
  MKO10024037_A_Hes3
  gRNA
cggucgccacacgcgaaacc

SEQ ID NO: 24038 - RNA, 20 nt, Artificial Sequence
  MKO10024038_A_Hes3
  gRNA
ucacgccacgcaagccgccu

SEQ ID NO: 24039 - RNA, 20 nt, Artificial Sequence
  MKO10024039_A_Hes3
  gRNA
ugcacgcaucaacgugucac

SEQ ID NO: 24040 - RNA, 20 nt, Artificial Sequence
  MKO10024040_A_Hes5
  gRNA
accucgcgccaacccgccug

SEQ ID NO: 24041 - RNA, 20 nt, Artificial Sequence
  MKO10024041_A_Hes5
  gRNA
gcccggagcugcgccccaac

SEQ ID NO: 24042 - RNA, 20 nt, Artificial Sequence
  MKO10024042_A_Hes5
  gRNA
ccucccgcagcugcggaagc

SEQ ID NO: 24043 - RNA, 20 nt, Artificial Sequence
  MKO10024043_A_Hes6
  gRNA
cgcgcccugcacgcgccuca

SEQ ID NO: 24044 - RNA, 20 nt, Artificial Sequence
  MKO10024044_A_Hes6
  gRNA
uggagaagaagcgacgcgca

SEQ ID NO: 24045 - RNA, 20 nt, Artificial Sequence
  MKO10024045_A_Hes6
  gRNA
aagcugcuacccucacgcag

SEQ ID NO: 24046 - RNA, 20 nt, Artificial Sequence
  MKO10024046_A_Hes7
  gRNA
cgccggcgcgcccgaauccc

SEQ ID NO: 24047 - RNA, 20 nt, Artificial Sequence
  MKO10024047_A_Hes7
  gRNA
ccgcgagugccugcuucgcu

SEQ ID NO: 24048 - RNA, 20 nt, Artificial Sequence
  MKO10024048_A_Hes7
  gRNA
ggagauacuggaguucgccg

SEQ ID NO: 24049 - RNA, 20 nt, Artificial Sequence
  MKO10024049_A_Hesx1
  gRNA
ucaucuuugcucggcgauuu

SEQ ID NO: 24050 - RNA, 20 nt, Artificial Sequence
  MKO10024050_A_Hesx1
  gRNA
ucuggccuuggaugauccac

SEQ ID NO: 24051 - RNA, 20 nt, Artificial Sequence
  MKO10024051_A_Hesx1
  gRNA
auuauucuaggucgaaguau

SEQ ID NO: 24052 - RNA, 20 nt, Artificial Sequence
  MKO10024052_A_Hexa
  gRNA
auguauccagcaguacgccc

SEQ ID NO: 24053 - RNA, 20 nt, Artificial Sequence
  MKO10024053_A_Hexa
  gRNA
auuacauucagcugugacga

SEQ ID NO: 24054 - RNA, 20 nt, Artificial Sequence
  MKO10024054_A_Hexa
  gRNA
acuuuccucgauucccucac

SEQ ID NO: 24055 - RNA, 20 nt, Artificial Sequence
  MKO10024055_A_Hexb
  gRNA
agcguuuggggagcguuacg

SEQ ID NO: 24056 - RNA, 20 nt, Artificial Sequence
  MKO10024056_A_Hexb
  gRNA
uaacgcuccccaaacgcugu

SEQ ID NO: 24057 - RNA, 20 nt, Artificial Sequence
  MKO10024057_A_Hexb
  gRNA
ucuccaagauucccucauag

SEQ ID NO: 24058 - RNA, 20 nt, Artificial Sequence
  MKO10024058_A_Hexdc
  gRNA
acaugucuucguacucaaug

SEQ ID NO: 24059 - RNA, 20 nt, Artificial Sequence
  MKO10024059_A_Hexdc
  gRNA
guguccgaaugucugcacca

SEQ ID NO: 24060 - RNA, 20 nt, Artificial Sequence
  MKO10024060_A_Hexdc
  gRNA
gguuacagagauccugcgcc

SEQ ID NO: 24061 - RNA, 20 nt, Artificial Sequence
  MKO10024061_A_Hexim1
  gRNA
auccgacgacaccagcgaug

SEQ ID NO: 24062 - RNA, 20 nt, Artificial Sequence
  MKO10024062_A_Hexim1
  gRNA
cgaaaauaaccggcugcggc

SEQ ID NO: 24063 - RNA, 20 nt, Artificial Sequence
  MKO10024063_A_Hexim1
  gRNA
cucgaacccgcgaagcucgc

SEQ ID NO: 24064 - RNA, 20 nt, Artificial Sequence
  MKO10024064_A_Hexim2
  gRNA
gggugguguuguagggcgcc

SEQ ID NO: 24065 - RNA, 20 nt, Artificial Sequence
  MKO10024065_A_Hexim2
  gRNA
gagggccucucggguccgug

SEQ ID NO: 24066 - RNA, 20 nt, Artificial Sequence
  MKO10024066_A_Hexim2
  gRNA
acgcuguguugcaguuggua

SEQ ID NO: 24067 - RNA, 20 nt, Artificial Sequence
  MKO10024067_A_Hey1
  gRNA
cgacccgcuucgcguucgcc

SEQ ID NO: 24068 - RNA, 20 nt, Artificial Sequence
  MKO10024068_A_Hey1
  gRNA
accggucccaagccgccacu

SEQ ID NO: 24069 - RNA, 20 nt, Artificial Sequence
  MKO10024069_A_Hey1
  gRNA
guccccaacgacaucguccc

SEQ ID NO: 24070 - RNA, 20 nt, Artificial Sequence
  MKO10024070_A_Hey2
  gRNA
cgcacgcguaguggguccga

SEQ ID NO: 24071 - RNA, 20 nt, Artificial Sequence
  MKO10024071_A_Hey2
  gRNA
gaagauguggauaggcgaca

SEQ ID NO: 24072 - RNA, 20 nt, Artificial Sequence
  MKO10024072_A_Hey2
  gRNA
acgcuacaagcucagugaug

SEQ ID NO: 24073 - RNA, 20 nt, Artificial Sequence
  MKO10024073_A_Heyl
  gRNA
ggcaacaaauuccgccgggu

SEQ ID NO: 24074 - RNA, 20 nt, Artificial Sequence
  MKO10024074_A_Heyl
  gRNA
ccaaucgucgcaauucagaa

SEQ ID NO: 24075 - RNA, 20 nt, Artificial Sequence
  MKO10024075_A_Heyl
  gRNA
ccuuucugaauugcgacgau

SEQ ID NO: 24076 - RNA, 20 nt, Artificial Sequence
  MKO10024076_A_Hfe2
  gRNA
gcguuggcucccgacgaaac

SEQ ID NO: 24077 - RNA, 20 nt, Artificial Sequence
  MKO10024077_A_Hfe2
  gRNA
ggcucaccggacacgccgcg

SEQ ID NO: 24078 - RNA, 20 nt, Artificial Sequence
  MKO10024078_A_Hfe2
  gRNA
aucaaugggggcgaccgacc

SEQ ID NO: 24079 - RNA, 20 nt, Artificial Sequence
  MKO10024079_A_Hfe
  gRNA
cccguuagguagcaccuucu

SEQ ID NO: 24080 - RNA, 20 nt, Artificial Sequence
  MKO10024080_A_Hfe
  gRNA
gccugggugcuccacuugac

SEQ ID NO: 24081 - RNA, 20 nt, Artificial Sequence
  MKO10024081_A_Hfe
  gRNA
agauccgugccaaacagaac

SEQ ID NO: 24082 - RNA, 20 nt, Artificial Sequence
  MKO10024082_A_Hfm1
  gRNA
aaugacaugucccauguagc

SEQ ID NO: 24083 - RNA, 20 nt, Artificial Sequence
  MKO10024083_A_Hfm1
  gRNA
auccuguucauguacauuau

SEQ ID NO: 24084 - RNA, 20 nt, Artificial Sequence
  MKO10024084_A_Hfm1
  gRNA
uucaaagaaccuaagccauu

SEQ ID NO: 24085 - RNA, 20 nt, Artificial Sequence
  MKO10024085_A_Hgd
  gRNA
cccuuugaguccaucgacca

SEQ ID NO: 24086 - RNA, 20 nt, Artificial Sequence
  MKO10024086_A_Hgd
  gRNA
cgccgucuaccuucucuuau

SEQ ID NO: 24087 - RNA, 20 nt, Artificial Sequence
  MKO10024087_A_Hgd
  gRNA
ccuuggucgauggacucaaa

SEQ ID NO: 24088 - RNA, 20 nt, Artificial Sequence
  MKO10024088_A_Hgfac
  gRNA
cacacaacuaugaccgagac

SEQ ID NO: 24089 - RNA, 20 nt, Artificial Sequence
  MKO10024089_A_Hgfac
  gRNA
ugcagguucccuuuccgcua

SEQ ID NO: 24090 - RNA, 20 nt, Artificial Sequence
  MKO10024090_A_Hgfac
  gRNA
cuaccacugcucuugcccgc

SEQ ID NO: 24091 - RNA, 20 nt, Artificial Sequence
  MKO10024091_A_Hgf
  gRNA
ucuuuaccgcgauagcucga

SEQ ID NO: 24092 - RNA, 20 nt, Artificial Sequence
  MKO10024092_A_Hgf
  gRNA
aacuacugucgaaauccucg

SEQ ID NO: 24093 - RNA, 20 nt, Artificial Sequence
  MKO10024093_A_Hgf
  gRNA
agucaagaaaacgaugcuac

SEQ ID NO: 24094 - RNA, 20 nt, Artificial Sequence
  MKO10024094_A_Hgsnau
  gRNA
ccgugagagacguucgccag

SEQ ID NO: 24095 - RNA, 20 nt, Artificial Sequence
  MKO10024095_A_Hgsnau
  gRNA
cgaugagggcuaaaccaaca

SEQ ID NO: 24096 - RNA, 20 nt, Artificial Sequence
  MKO10024096_A_Hgsnau
  gRNA
ggacgagccugacuguguac

SEQ ID NO: 24097 - RNA, 20 nt, Artificial Sequence
  MKO10024097_A_Hgs
  gRNA
gaucugcgaccugauccguc

SEQ ID NO: 24098 - RNA, 20 nt, Artificial Sequence
  MKO10024098_A_Hgs
  gRNA
ccggaacgaacccaaguaca

SEQ ID NO: 24099 - RNA, 20 nt, Artificial Sequence
  MKO10024099_A_Hgs
  gRNA
guuuguuggccacuucauca

SEQ ID NO: 24100 - RNA, 20 nt, Artificial Sequence
  MKO10024100_A_Hhaul
  gRNA
cuucgaccgcuuccaugcuc

SEQ ID NO: 24101 - RNA, 20 nt, Artificial Sequence
  MKO10024101_A_Hhaul
  gRNA
agcaagggaguagcggcggu

SEQ ID NO: 24102 - RNA, 20 nt, Artificial Sequence
  MKO10024102_A_Hhaul
  gRNA
uggugggcacaaugggccca

SEQ ID NO: 24103 - RNA, 20 nt, Artificial Sequence
  MKO10024103_A_Hhau
  gRNA
aguuaaggaugggcccguug

SEQ ID NO: 24104 - RNA, 20 nt, Artificial Sequence
  MKO10024104_A_Hhau
  gRNA
uccgauccgugcuccugucc

SEQ ID NO: 24105 - RNA, 20 nt, Artificial Sequence
  MKO10024105_A_Hhau
  gRNA
cagcaccaucgcguucugcg

SEQ ID NO: 24106 - RNA, 20 nt, Artificial Sequence
  MKO10024106_A_Hhex
  gRNA
guguagucguucaccguccg

SEQ ID NO: 24107 - RNA, 20 nt, Artificial Sequence
  MKO10024107_A_Hhex
  gRNA
accggcgugggcucguacac

SEQ ID NO: 24108 - RNA, 20 nt, Artificial Sequence
  MKO10024108_A_Hhex
  gRNA
ccagacgcuuucucucgggu

SEQ ID NO: 24109 - RNA, 20 nt, Artificial Sequence
  MKO10024109_A_Hhipl1
  gRNA
agucggugucaucuagcgac

SEQ ID NO: 24110 - RNA, 20 nt, Artificial Sequence
  MKO10024110_A_Hhipl1
  gRNA
gagcgcgccagccguaguug

SEQ ID NO: 24111 - RNA, 20 nt, Artificial Sequence
  MKO10024111_A_Hhipl1
  gRNA
ucauccacgaacggguuguc

SEQ ID NO: 24112 - RNA, 20 nt, Artificial Sequence
  MKO10024112_A_Hhipl2
  gRNA
ggccgaggucggauauucug

SEQ ID NO: 24113 - RNA, 20 nt, Artificial Sequence
  MKO10024113_A_Hhipl2
  gRNA
aucguagaggugagccgcgu

SEQ ID NO: 24114 - RNA, 20 nt, Artificial Sequence
  MKO10024114_A_Hhipl2
  gRNA
acuuugccguaaugcguccu

SEQ ID NO: 24115 - RNA, 20 nt, Artificial Sequence
  MKO10024115_A_Hhip
  gRNA
gcccaauagcccaccguucc

SEQ ID NO: 24116 - RNA, 20 nt, Artificial Sequence
  MKO10024116_A_Hhip
  gRNA
ugugucuuauaccaccaacc

SEQ ID NO: 24117 - RNA, 20 nt, Artificial Sequence
  MKO10024117_A_Hhip
  gRNA
ucggcucuucauucuagaga

SEQ ID NO: 24118 - RNA, 20 nt, Artificial Sequence
  MKO10024118_A_Hhla1
  gRNA
uuagagguucuugcaacuac

SEQ ID NO: 24119 - RNA, 20 nt, Artificial Sequence
  MKO10024119_A_Hhla1
  gRNA
aaccugaccgagcuugugaa

SEQ ID NO: 24120 - RNA, 20 nt, Artificial Sequence
  MKO10024120_A_Hhla1
  gRNA
aacucccuaccuguugcagg

SEQ ID NO: 24121 - RNA, 20 nt, Artificial Sequence
  MKO10024121_A_Hiau1
  gRNA
cuccccuaguguguaucaug

SEQ ID NO: 24122 - RNA, 20 nt, Artificial Sequence
  MKO10024122_A_Hiau1
  gRNA
auaaccgcaugauacacacu

SEQ ID NO: 24123 - RNA, 20 nt, Artificial Sequence
  MKO10024123_A_Hiau1
  gRNA
cucugaugaagaucagcccg

SEQ ID NO: 24124 - RNA, 20 nt, Artificial Sequence
  MKO10024124_A_Hiaul1
  gRNA
gcuucccuaucccacuaaug

SEQ ID NO: 24125 - RNA, 20 nt, Artificial Sequence
  MKO10024125_A_Hiaul1
  gRNA
agguaaagaagaccgugcca

SEQ ID NO: 24126 - RNA, 20 nt, Artificial Sequence
  MKO10024126_A_Hiaul1
  gRNA
guaguacuuacagucaacau

SEQ ID NO: 24127 - RNA, 20 nt, Artificial Sequence
  MKO10024127_A_Hibadh
  gRNA
agcuccacaguauaccacgu

SEQ ID NO: 24128 - RNA, 20 nt, Artificial Sequence
  MKO10024128_A_Hibadh
  gRNA
aacuucuaccgcauucauac

SEQ ID NO: 24129 - RNA, 20 nt, Artificial Sequence
  MKO10024129_A_Hibadh
  gRNA
ggcuccaacgugguauacug

SEQ ID NO: 24130 - RNA, 20 nt, Artificial Sequence
  MKO10024130_A_Hibch
  gRNA
uauucagacucagugcguug

SEQ ID NO: 24131 - RNA, 20 nt, Artificial Sequence
  MKO10024131_A_Hibch
  gRNA
cuauugcagaccuuuagcug

SEQ ID NO: 24132 - RNA, 20 nt, Artificial Sequence
  MKO10024132_A_Hibch
  gRNA
cagauguugcagaauaacgc

SEQ ID NO: 24133 - RNA, 20 nt, Artificial Sequence
  MKO10024133_A_Hic1
  gRNA
cggccgggcucaccauguca

SEQ ID NO: 24134 - RNA, 20 nt, Artificial Sequence
  MKO10024134_A_Hic1
  gRNA
cacccggggagccucgaucc

SEQ ID NO: 24135 - RNA, 20 nt, Artificial Sequence
  MKO10024135_A_Hic1
  gRNA
agccgcacacaguccccgcg

SEQ ID NO: 24136 - RNA, 20 nt, Artificial Sequence
  MKO10024136_A_Hic2
  gRNA
cuucucguguugccgcagug

SEQ ID NO: 24137 - RNA, 20 nt, Artificial Sequence
  MKO10024137_A_Hic2
  gRNA
cgcccacuauguauaccggc

SEQ ID NO: 24138 - RNA, 20 nt, Artificial Sequence
  MKO10024138_A_Hic2
  gRNA
cccaggccuaccggagugcc

SEQ ID NO: 24139 - RNA, 20 nt, Artificial Sequence
  MKO10024139_A_Hid1
  gRNA
gucucaccacgucguuccuc

SEQ ID NO: 24140 - RNA, 20 nt, Artificial Sequence
  MKO10024140_A_Hid1
  gRNA
cgcaaagacauccugcaccg

SEQ ID NO: 24141 - RNA, 20 nt, Artificial Sequence
  MKO10024141_A_Hid1
  gRNA
ucauaccuuguagcacagcg

SEQ ID NO: 24142 - RNA, 20 nt, Artificial Sequence
  MKO10024142_A_Hif1an
  gRNA
uuggggaaccucucguaguc

SEQ ID NO: 24143 - RNA, 20 nt, Artificial Sequence
  MKO10024143_A_Hif1an
  gRNA
cccaauuuccgaaauguggu

SEQ ID NO: 24144 - RNA, 20 nt, Artificial Sequence
  MKO10024144_A_Hif1an
  gRNA
cguugccaauauucucuugc

SEQ ID NO: 24145 - RNA, 20 nt, Artificial Sequence
  MKO10024145_A_Hif1a
  gRNA
ucguuaggcccagugagaaa

SEQ ID NO: 24146 - RNA, 20 nt, Artificial Sequence
  MKO10024146_A_Hif1a
  gRNA
ugauguucaucguccucccc

SEQ ID NO: 24147 - RNA, 20 nt, Artificial Sequence
  MKO10024147_A_Hif1a
  gRNA
ucucacacguaaauaacuga

SEQ ID NO: 24148 - RNA, 20 nt, Artificial Sequence
  MKO10024148_A_Hif3a
  gRNA
cgcgcugacgccgcgcgcaa

SEQ ID NO: 24149 - RNA, 20 nt, Artificial Sequence
  MKO10024149_A_Hif3a
  gRNA
cgucagcgcgcaccuggaca

SEQ ID NO: 24150 - RNA, 20 nt, Artificial Sequence
  MKO10024150_A_Hif3a
  gRNA
ugagcgugcucuucauucgc

SEQ ID NO: 24151 - RNA, 20 nt, Artificial Sequence
  MKO10024151_A_Higd1a
  gRNA
gaugaaccuaccaagaguca

SEQ ID NO: 24152 - RNA, 20 nt, Artificial Sequence
  MKO10024152_A_Higd1a
  gRNA
aacuuaccaauggggacaaa

SEQ ID NO: 24153 - RNA, 20 nt, Artificial Sequence
  MKO10024153_A_Higd1a
  gRNA
ucucucucuucauacgauga

SEQ ID NO: 24154 - RNA, 20 nt, Artificial Sequence
  MKO10024154_A_Higd1b
  gRNA
gucagaggaugccgagaagu

SEQ ID NO: 24155 - RNA, 20 nt, Artificial Sequence
  MKO10024155_A_Higd1b
  gRNA
uguacagagauuacaucaag

SEQ ID NO: 24156 - RNA, 20 nt, Artificial Sequence
  MKO10024156_A_Higd1b
  gRNA
uccuguaugcugcuaucacc

SEQ ID NO: 24157 - RNA, 20 nt, Artificial Sequence
  MKO10024157_A_Higd1c
  gRNA
gggagucucucgauuuccgg

SEQ ID NO: 24158 - RNA, 20 nt, Artificial Sequence
  MKO10024158_A_Higd1c
  gRNA
auuuagcuuguaaagaccgu

SEQ ID NO: 24159 - RNA, 20 nt, Artificial Sequence
  MKO10024159_A_Higd1c
  gRNA
cccgcacguggaugagauga

SEQ ID NO: 24160 - RNA, 20 nt, Artificial Sequence
  MKO10024160_A_Higd2a
  gRNA
gggcugaagcccucgauaac

SEQ ID NO: 24161 - RNA, 20 nt, Artificial Sequence
  MKO10024161_A_Higd2a
  gRNA
cccaacucaugaugcgcacc

SEQ ID NO: 24162 - RNA, 20 nt, Artificial Sequence
  MKO10024162_A_Higd2a
  gRNA
guccaagcccccaguuaucg

SEQ ID NO: 24163 - RNA, 20 nt, Artificial Sequence
  MKO10024163_A_Hilpda
  gRNA
uagcugaccccucgugaucc

SEQ ID NO: 24164 - RNA, 20 nt, Artificial Sequence
  MKO10024164_A_Hilpda
  gRNA
cugccagaccauccaucccg

SEQ ID NO: 24165 - RNA, 20 nt, Artificial Sequence
  MKO10024165_A_Hilpda
  gRNA
uuacuggagagcccacugcc

SEQ ID NO: 24166 - RNA, 20 nt, Artificial Sequence
  MKO10024166_A_Hils1
  gRNA
accaagaugccggcacacug

SEQ ID NO: 24167 - RNA, 20 nt, Artificial Sequence
  MKO10024167_A_Hils1
  gRNA
aaccgccauugccauuauua

SEQ ID NO: 24168 - RNA, 20 nt, Artificial Sequence
  MKO10024168_A_Hils1
  gRNA
gguucagacucacgcugccc

SEQ ID NO: 24169 - RNA, 20 nt, Artificial Sequence
  MKO10024169_A_Hinfp
  gRNA
cgugaccacaugcggaacca

SEQ ID NO: 24170 - RNA, 20 nt, Artificial Sequence
  MKO10024170_A_Hinfp
  gRNA
caacuucuuacgauccaaug

SEQ ID NO: 24171 - RNA, 20 nt, Artificial Sequence
  MKO10024171_A_Hinfp
  gRNA
cauccgucgccagaccucau

SEQ ID NO: 24172 - RNA, 20 nt, Artificial Sequence
  MKO10024172_A_Hint1
  gRNA
gccgaagaucgugucgccgc

SEQ ID NO: 24173 - RNA, 20 nt, Artificial Sequence
  MKO10024173_A_Hint1
  gRNA
cccggcggcgacacgaucuu

SEQ ID NO: 24174 - RNA, 20 nt, Artificial Sequence
  MKO10024174_A_Hint1
  gRNA
ccugaagcgcggguaccgga

SEQ ID NO: 24175 - RNA, 20 nt, Artificial Sequence
  MKO10024175_A_Hint2
  gRNA
ccucagguccgaggaaacgc

SEQ ID NO: 24176 - RNA, 20 nt, Artificial Sequence
  MKO10024176_A_Hint2
  gRNA
gguguccgacgggagugaag

SEQ ID NO: 24177 - RNA, 20 nt, Artificial Sequence
  MKO10024177_A_Hint2
  gRNA
cugaaagauggguaucgacu

SEQ ID NO: 24178 - RNA, 20 nt, Artificial Sequence
  MKO10024178_A_Hint3
  gRNA
agauaaugauaaagugccgc

SEQ ID NO: 24179 - RNA, 20 nt, Artificial Sequence
  MKO10024179_A_Hint3
  gRNA
cugguuuacagucgagagca

SEQ ID NO: 24180 - RNA, 20 nt, Artificial Sequence
  MKO10024180_A_Hint3
  gRNA
acuuacugugacaaaccagu

SEQ ID NO: 24181 - RNA, 20 nt, Artificial Sequence
  MKO10024181_A_Hip1r
  gRNA
ucacguugggguguccgucc

SEQ ID NO: 24182 - RNA, 20 nt, Artificial Sequence
  MKO10024182_A_Hip1r
  gRNA
ccuucucaugaugcgugccc

SEQ ID NO: 24183 - RNA, 20 nt, Artificial Sequence
  MKO10024183_A_Hip1r
  gRNA
cggagcaacauacgugagau

SEQ ID NO: 24184 - RNA, 20 nt, Artificial Sequence
  MKO10024184_A_Hip1
  gRNA
gcagacggucagcgucaaua

SEQ ID NO: 24185 - RNA, 20 nt, Artificial Sequence
  MKO10024185_A_Hip1
  gRNA
guccaucucgaagaaguuug

SEQ ID NO: 24186 - RNA, 20 nt, Artificial Sequence
  MKO10024186_A_Hip1
  gRNA
uuccacaaacuucuucgaga

SEQ ID NO: 24187 - RNA, 20 nt, Artificial Sequence
  MKO10024187_A_Hipk1
  gRNA
uggugcuucagaauacgauc

SEQ ID NO: 24188 - RNA, 20 nt, Artificial Sequence
  MKO10024188_A_Hipk1
  gRNA
ggugacucaucgucacaaau

SEQ ID NO: 24189 - RNA, 20 nt, Artificial Sequence
  MKO10024189_A_Hipk1
  gRNA
ugaucguauucugaagcacc

SEQ ID NO: 24190 - RNA, 20 nt, Artificial Sequence
  MKO10024190_A_Hipk2
  gRNA
aaugucuuaccgguaguauc

SEQ ID NO: 24191 - RNA, 20 nt, Artificial Sequence
  MKO10024191_A_Hipk2
  gRNA
ucacagugcuucgacgcauu

SEQ ID NO: 24192 - RNA, 20 nt, Artificial Sequence
  MKO10024192_A_Hipk2
  gRNA
aggugcuucugaguaugauc

SEQ ID NO: 24193 - RNA, 20 nt, Artificial Sequence
  MKO10024193_A_Hipk3
  gRNA
gugaucgcagaguuauuccu

SEQ ID NO: 24194 - RNA, 20 nt, Artificial Sequence
  MKO10024194_A_Hipk3
  gRNA
ggcaaccccaauauaaucuc

SEQ ID NO: 24195 - RNA, 20 nt, Artificial Sequence
  MKO10024195_A_Hipk3
  gRNA
agaugcuucauauuaacgaa

SEQ ID NO: 24196 - RNA, 20 nt, Artificial Sequence
  MKO10024196_A_Hipk4
  gRNA
cggauaacgugggccucguc

SEQ ID NO: 24197 - RNA, 20 nt, Artificial Sequence
  MKO10024197_A_Hipk4
  gRNA
ucucacagauguagcgcacc

SEQ ID NO: 24198 - RNA, 20 nt, Artificial Sequence
  MKO10024198_A_Hipk4
  gRNA
uucgguacgcaucguucuuc

SEQ ID NO: 24199 - RNA, 20 nt, Artificial Sequence
  MKO10024199_A_Hira
  gRNA
acaccgccauugcuccacau

SEQ ID NO: 24200 - RNA, 20 nt, Artificial Sequence
  MKO10024200_A_Hira
  gRNA
acuuaccgccugagugacuc

SEQ ID NO: 24201 - RNA, 20 nt, Artificial Sequence
  MKO10024201_A_Hira
  gRNA
ucaguugauauucacccuga

SEQ ID NO: 24202 - RNA, 20 nt, Artificial Sequence
  MKO10024202_A_Hirip3
  gRNA
caaaaauuucugucgcacga

SEQ ID NO: 24203 - RNA, 20 nt, Artificial Sequence
  MKO10024203_A_Hirip3
  gRNA
aggcgcgccugaguguccuc

SEQ ID NO: 24204 - RNA, 20 nt, Artificial Sequence
  MKO10024204_A_Hirip3
  gRNA
aagcguuacauucgagccug

SEQ ID NO: 24205 - RNA, 20 nt, Artificial Sequence
  MKO10024205_A_Hist1h1a
  gRNA
ggugucggagcucaucgugc

SEQ ID NO: 24206 - RNA, 20 nt, Artificial Sequence
  MKO10024206_A_Hist1h1a
  gRNA
acgaugagcuccgacaccga

SEQ ID NO: 24207 - RNA, 20 nt, Artificial Sequence
  MKO10024207_A_Hist1h1a
  gRNA
ucagugaaggcgaaagcauc

SEQ ID NO: 24208 - RNA, 20 nt, Artificial Sequence
  MKO10024208_A_Hist1h1b
  gRNA
uucuucacuccagccgccgc

SEQ ID NO: 24209 - RNA, 20 nt, Artificial Sequence
  MKO10024209_A_Hist1h1b
  gRNA
gccuaagaccgcuaagccua

SEQ ID NO: 24210 - RNA, 20 nt, Artificial Sequence
  MKO10024210_A_Hist1h1b
  gRNA
gacugcucccgcugagaccg

SEQ ID NO: 24211 - RNA, 20 nt, Artificial Sequence
  MKO10024211_A_Hist1h1c
  gRNA
gcccgccggggugcgccgua

SEQ ID NO: 24212 - RNA, 20 nt, Artificial Sequence
  MKO10024212_A_Hist1h1c
  gRNA
ccggggguccggacgccuua

SEQ ID NO: 24213 - RNA, 20 nt, Artificial Sequence
  MKO10024213_A_Hist1h1c
  gRNA
agacgcgcucuugaccuucu

SEQ ID NO: 24214 - RNA, 20 nt, Artificial Sequence
  MKO10024214_A_Hist1h1d
  gRNA
cauguccgagaccgcucccg

SEQ ID NO: 24215 - RNA, 20 nt, Artificial Sequence
  MKO10024215_A_Hist1h1d
  gRNA
aagaagaccggcgccgcugc

SEQ ID NO: 24216 - RNA, 20 nt, Artificial Sequence
  MKO10024216_A_Hist1h1d
  gRNA
gcaccacucuacuucuugcg

SEQ ID NO: 24217 - RNA, 20 nt, Artificial Sequence
  MKO10024217_A_Hist1h1e
  gRNA
uuugcgcuucgcgccaccug

SEQ ID NO: 24218 - RNA, 20 nt, Artificial Sequence
  MKO10024218_A_Hist1h1e
  gRNA
gggcgcagcaggcgcggucu

SEQ ID NO: 24219 - RNA, 20 nt, Artificial Sequence
  MKO10024219_A_Hist1h1e
  gRNA
cuugcgggccuucuucuuga

SEQ ID NO: 24220 - RNA, 20 nt, Artificial Sequence
  MKO10024220_A_Hist1h1t
  gRNA
cgcaggagccguuuccgaca

SEQ ID NO: 24221 - RNA, 20 nt, Artificial Sequence
  MKO10024221_A_Hist1h1t
  gRNA
gcuacucuugggagaucucg

SEQ ID NO: 24222 - RNA, 20 nt, Artificial Sequence
  MKO10024222_A_Hist1h1t
  gRNA
uuuacguugcugcacgcccu

SEQ ID NO: 24223 - RNA, 20 nt, Artificial Sequence
  MKO10024223_A_Hist1h2aa
  gRNA
gaacuacgcacaacgaauug

SEQ ID NO: 24224 - RNA, 20 nt, Artificial Sequence
  MKO10024224_A_Hist1h2aa
  gRNA
uucguugugcguaguucccu

SEQ ID NO: 24225 - RNA, 20 nt, Artificial Sequence
  MKO10024225_A_Hist1h2aa
  gRNA
gccuugccaccccgcuuugu

SEQ ID NO: 24226 - RNA, 20 nt, Artificial Sequence
  MKO10024226_A_Hist1h2ab
  gRNA
aacgcauacaugucuggacg

SEQ ID NO: 24227 - RNA, 20 nt, Artificial Sequence
  MKO10024227_A_Hist1h2ab
  gRNA
aucgccagauuacuuccccu

SEQ ID NO: 24228 - RNA, 20 nt, Artificial Sequence
  MKO10024228_A_Hist1h2ab
  gRNA
agcgggucuuggccuuagcg

SEQ ID NO: 24229 - RNA, 20 nt, Artificial Sequence
  MKO10024229_A_Hist1h2ac
  gRNA
acuauuacuaugucuggacg

SEQ ID NO: 24230 - RNA, 20 nt, Artificial Sequence
  MKO10024230_A_Hist1h2ac
  gRNA
uucuguugcuuauuuccccu

SEQ ID NO: 24231 - RNA, 20 nt, Artificial Sequence
  MKO10024231_A_Hist1h2ac
  gRNA
gcuccgaguaguuacccuug

SEQ ID NO: 24232 - RNA, 20 nt, Artificial Sequence
  MKO10024232_A_Hist1h2ad
  gRNA
agaccaaucuuauuuccccu

SEQ ID NO: 24233 - RNA, 20 nt, Artificial Sequence
  MKO10024233_A_Hist1h2ad
  gRNA
aucuguacaaugucuggacg

SEQ ID NO: 24234 - RNA, 20 nt, Artificial Sequence
  MKO10024234_A_Hist1h2ad
  gRNA
cgccagguacaccggggcgc

SEQ ID NO: 24235 - RNA, 20 nt, Artificial Sequence
  MKO10024235_A_Hist1h2ae
  gRNA
cuugcgucaaugucuggacg

SEQ ID NO: 24236 - RNA, 20 nt, Artificial Sequence
  MKO10024236_A_Hist1h2ae
  gRNA
agaaagaucuuauuuccccu

SEQ ID NO: 24237 - RNA, 20 nt, Artificial Sequence
  MKO10024237_A_Hist1h2ae
  gRNA
uucccgugggccgcgugcac

SEQ ID NO: 24238 - RNA, 20 nt, Artificial Sequence
  MKO10024238_A_Hist1h2af
  gRNA
guaccuacaaugucuggacg

SEQ ID NO: 24239 - RNA, 20 nt, Artificial Sequence
  MKO10024239_A_Hist1h2af
  gRNA
cgagagccaccauaagccca

SEQ ID NO: 24240 - RNA, 20 nt, Artificial Sequence
  MKO10024240_A_Hist1h2af
  gRNA
cucacuggcuuacuuucccu

SEQ ID NO: 24241 - RNA, 20 nt, Artificial Sequence
  MKO10024241_A_Hist1h2ag
  gRNA
aucuuuacaaugucuggacg

SEQ ID NO: 24242 - RNA, 20 nt, Artificial Sequence
  MKO10024242_A_Hist1h2ag
  gRNA
cgaggagcucaacaagcugc

SEQ ID NO: 24243 - RNA, 20 nt, Artificial Sequence
  MKO10024243_A_Hist1h2ag
  gRNA
cgccagguagaccggggcgc

SEQ ID NO: 24244 - RNA, 20 nt, Artificial Sequence
  MKO10024244_A_Hist1h2ah
  gRNA
uuguacaauaugucuggacg

SEQ ID NO: 24245 - RNA, 20 nt, Artificial Sequence
  MKO10024245_A_Hist1h2ah
  gRNA
accugcuucacuuggccuug

SEQ ID NO: 24246 - RNA, 20 nt, Artificial Sequence
  MKO10024246_A_Hist1h2ah
  gRNA
cgaggagcucaacaagcugc

SEQ ID NO: 24247 - RNA, 20 nt, Artificial Sequence
  MKO10024247_A_Hist1h2ai
  gRNA
agcugaguuaugucuggacg

SEQ ID NO: 24248 - RNA, 20 nt, Artificial Sequence
  MKO10024248_A_Hist1h2ai
  gRNA
uguuugguuucacuuccccu

SEQ ID NO: 24249 - RNA, 20 nt, Artificial Sequence
  MKO10024249_A_Hist1h2ai
  gRNA
cgccagguacaccggggcgc

SEQ ID NO: 24250 - RNA, 20 nt, Artificial Sequence
  MKO10024250_A_Hist1h2ak
  gRNA
gguucuaccaugucaggaag

SEQ ID NO: 24251 - RNA, 20 nt, Artificial Sequence
  MKO10024251_A_Hist1h2ak
  gRNA
ucaagggccucacuuccccu

SEQ ID NO: 24252 - RNA, 20 nt, Artificial Sequence
  MKO10024252_A_Hist1h2ak
  gRNA
cugcuugccucuuccugaca

SEQ ID NO: 24253 - RNA, 20 nt, Artificial Sequence
  MKO10024253_A_Hist1h2an
  gRNA
uuguuuagaaugucuggacg

SEQ ID NO: 24254 - RNA, 20 nt, Artificial Sequence
  MKO10024254_A_Hist1h2an
  gRNA
cagcaguacggccuggaugu

SEQ ID NO: 24255 - RNA, 20 nt, Artificial Sequence
  MKO10024255_A_Hist1h2an
  gRNA
cgaggagcucaacaagcugc

SEQ ID NO: 24256 - RNA, 20 nt, Artificial Sequence
  MKO10024256_A_Hist1h2ao
  gRNA
cuuucuaccaugucuggacg

SEQ ID NO: 24257 - RNA, 20 nt, Artificial Sequence
  MKO10024257_A_Hist1h2ao
  gRNA
cgccagguagaccggggcgc

SEQ ID NO: 24258 - RNA, 20 nt, Artificial Sequence
  MKO10024258_A_Hist1h2ao
  gRNA
cgaggagcucaacaagcugc

SEQ ID NO: 24259 - RNA, 20 nt, Artificial Sequence
  MKO10024259_A_Hist1h2ap
  gRNA
cuuucuaccaugucuggacg

SEQ ID NO: 24260 - RNA, 20 nt, Artificial Sequence
  MKO10024260_A_Hist1h2ap
  gRNA
cgaggagcucaacaagcugc

SEQ ID NO: 24261 - RNA, 20 nt, Artificial Sequence
  MKO10024261_A_Hist1h2ap
  gRNA
cgccagguagaccggggcgc

SEQ ID NO: 24262 - RNA, 20 nt, Artificial Sequence
  MKO10024262_A_Hist1h2ba
  gRNA
ugcggcaucucuuacguuuc

SEQ ID NO: 24263 - RNA, 20 nt, Artificial Sequence
  MKO10024263_A_Hist1h2ba
  gRNA
gaaacguaagagaugccgca

SEQ ID NO: 24264 - RNA, 20 nt, Artificial Sequence
  MKO10024264_A_Hist1h2ba
  gRNA
gcacccuuuaccgccaccuc

SEQ ID NO: 24265 - RNA, 20 nt, Artificial Sequence
  MKO10024265_A_Hist1h2bb
  gRNA
gucugcaccagccccuaaga

SEQ ID NO: 24266 - RNA, 20 nt, Artificial Sequence
  MKO10024266_A_Hist1h2bb
  gRNA
ggugcagacuuagaaggcuc

SEQ ID NO: 24267 - RNA, 20 nt, Artificial Sequence
  MKO10024267_A_Hist1h2bb
  gRNA
cuuucuuagaucccuucuua

SEQ ID NO: 24268 - RNA, 20 nt, Artificial Sequence
  MKO10024268_A_Hist1h2bc
  gRNA
uuggcaggaucacuuggagc

SEQ ID NO: 24269 - RNA, 20 nt, Artificial Sequence
  MKO10024269_A_Hist1h2bc
  gRNA
guccgcucccgccccgaaga

SEQ ID NO: 24270 - RNA, 20 nt, Artificial Sequence
  MKO10024270_A_Hist1h2bc
  gRNA
gccuucuuggagcccuucuu

SEQ ID NO: 24271 - RNA, 20 nt, Artificial Sequence
  MKO10024271_A_Hist1h2be
  gRNA
ggagcggacuuggcuggcuc

SEQ ID NO: 24272 - RNA, 20 nt, Artificial Sequence
  MKO10024272_A_Hist1h2be
  gRNA
cuccaagaaggcugucacca

SEQ ID NO: 24273 - RNA, 20 nt, Artificial Sequence
  MKO10024273_A_Hist1h2be
  gRNA
guccgcucccgccccgaaga

SEQ ID NO: 24274 - RNA, 20 nt, Artificial Sequence
  MKO10024274_A_Hist1h2bf
  gRNA
ggagcggacuuagcaggcuc

SEQ ID NO: 24275 - RNA, 20 nt, Artificial Sequence
  MKO10024275_A_Hist1h2bf
  gRNA
guccgcucccgccccgaaga

SEQ ID NO: 24276 - RNA, 20 nt, Artificial Sequence
  MKO10024276_A_Hist1h2bf
  gRNA
uaaaggaacucacuuggagc

SEQ ID NO: 24277 - RNA, 20 nt, Artificial Sequence
  MKO10024277_A_Hist1h2bg
  gRNA
aggagcggacuucgcaggcu

SEQ ID NO: 24278 - RNA, 20 nt, Artificial Sequence
  MKO10024278_A_Hist1h2bg
  gRNA
uaaaugaacucacuuggagc

SEQ ID NO: 24279 - RNA, 20 nt, Artificial Sequence
  MKO10024279_A_Hist1h2bg
  gRNA
guccgcuccugccccgaaga

SEQ ID NO: 24280 - RNA, 20 nt, Artificial Sequence
  MKO10024280_A_Hist1h2bh
  gRNA
cuugagcacucacuuggagc

SEQ ID NO: 24281 - RNA, 20 nt, Artificial Sequence
  MKO10024281_A_Hist1h2bh
  gRNA
cuccaagaaggcccugacca

SEQ ID NO: 24282 - RNA, 20 nt, Artificial Sequence
  MKO10024282_A_Hist1h2bh
  gRNA
uuuggaggagaugccggugu

SEQ ID NO: 24283 - RNA, 20 nt, Artificial Sequence
  MKO10024283_A_Hist1h2bj
  gRNA
cuacucgguguacgucuaca

SEQ ID NO: 24284 - RNA, 20 nt, Artificial Sequence
  MKO10024284_A_Hist1h2bj
  gRNA
cuuggaggagauaccggugu

SEQ ID NO: 24285 - RNA, 20 nt, Artificial Sequence
  MKO10024285_A_Hist1h2bj
  gRNA
cuggagcgcucacuuggagc

SEQ ID NO: 24286 - RNA, 20 nt, Artificial Sequence
  MKO10024286_A_Hist1h2bk
  gRNA
uuacuuggcgcuaguauacu

SEQ ID NO: 24287 - RNA, 20 nt, Artificial Sequence
  MKO10024287_A_Hist1h2bk
  gRNA
guccgcucccgccccgaaga

SEQ ID NO: 24288 - RNA, 20 nt, Artificial Sequence
  MKO10024288_A_Hist1h2bk
  gRNA
gccuucuuggagcccuucuu

SEQ ID NO: 24289 - RNA, 20 nt, Artificial Sequence
  MKO10024289_A_Hist1h2bl
  gRNA
uaaacgagcucacuuggagc

SEQ ID NO: 24290 - RNA, 20 nt, Artificial Sequence
  MKO10024290_A_Hist1h2bl
  gRNA
guccgcucccgccccgaaga

SEQ ID NO: 24291 - RNA, 20 nt, Artificial Sequence
  MKO10024291_A_Hist1h2bl
  gRNA
gccuucuuggagcccuucuu

SEQ ID NO: 24292 - RNA, 20 nt, Artificial Sequence
  MKO10024292_A_Hist1h2bm
  gRNA
ggagcggacuucguuggcuc

SEQ ID NO: 24293 - RNA, 20 nt, Artificial Sequence
  MKO10024293_A_Hist1h2bm
  gRNA
cagacgaacucacuuggagc

SEQ ID NO: 24294 - RNA, 20 nt, Artificial Sequence
  MKO10024294_A_Hist1h2bm
  gRNA
guccgcucccgccccgaaga

SEQ ID NO: 24295 - RNA, 20 nt, Artificial Sequence
  MKO10024295_A_Hist1h2bn
  gRNA
ggagcggacuuagcggguuc

SEQ ID NO: 24296 - RNA, 20 nt, Artificial Sequence
  MKO10024296_A_Hist1h2bn
  gRNA
gccuucuuggaccccuucuu

SEQ ID NO: 24297 - RNA, 20 nt, Artificial Sequence
  MKO10024297_A_Hist1h2bn
  gRNA
guccaagaaggccgucacca

SEQ ID NO: 24298 - RNA, 20 nt, Artificial Sequence
  MKO10024298_A_Hist1h2bp
  gRNA
ggaacggacuuaacaggcuc

SEQ ID NO: 24299 - RNA, 20 nt, Artificial Sequence
  MKO10024299_A_Hist1h2bp
  gRNA
gauaauagaauuuguuccac

SEQ ID NO: 24300 - RNA, 20 nt, Artificial Sequence
  MKO10024300_A_Hist1h2bp
  gRNA
uuuccucaacuuuaaaagga

SEQ ID NO: 24301 - RNA, 20 nt, Artificial Sequence
  MKO10024301_A_Hist1h2bq
  gRNA
guccgcucccgccccgaaga

SEQ ID NO: 24302 - RNA, 20 nt, Artificial Sequence
  MKO10024302_A_Hist1h2bq
  gRNA
ucacuuggagcugguguacu

SEQ ID NO: 24303 - RNA, 20 nt, Artificial Sequence
  MKO10024303_A_Hist1h2bq
  gRNA
gccuucuuggagcccuucuu

SEQ ID NO: 24304 - RNA, 20 nt, Artificial Sequence
  MKO10024304_A_Hist1h2br
  gRNA
ucacuuggagcugguguacu

SEQ ID NO: 24305 - RNA, 20 nt, Artificial Sequence
  MKO10024305_A_Hist1h2br
  gRNA
guccgcucccgccccgaaga

SEQ ID NO: 24306 - RNA, 20 nt, Artificial Sequence
  MKO10024306_A_Hist1h2br
  gRNA
gccuucuuggagcccuucuu

SEQ ID NO: 24307 - RNA, 20 nt, Artificial Sequence
  MKO10024307_A_Hist1h3a
  gRNA
acaauuacgcccucuccccg

SEQ ID NO: 24308 - RNA, 20 nt, Artificial Sequence
  MKO10024308_A_Hist1h3a
  gRNA
caacuggcccgccgcauccg

SEQ ID NO: 24309 - RNA, 20 nt, Artificial Sequence
  MKO10024309_A_Hist1h3a
  gRNA
gcgggccaguuggauguccu

SEQ ID NO: 24310 - RNA, 20 nt, Artificial Sequence
  MKO10024310_A_Hist1h3b
  gRNA
aagcccucuccccacgaaug

SEQ ID NO: 24311 - RNA, 20 nt, Artificial Sequence
  MKO10024311_A_Hist1h3b
  gRNA
cagcucgcccgccgcauucg

SEQ ID NO: 24312 - RNA, 20 nt, Artificial Sequence
  MKO10024312_A_Hist1h3b
  gRNA
cagaccgcucgcaaguccac

SEQ ID NO: 24313 - RNA, 20 nt, Artificial Sequence
  MKO10024313_A_Hist1h3c
  gRNA
accauuaugcccucucuccg

SEQ ID NO: 24314 - RNA, 20 nt, Artificial Sequence
  MKO10024314_A_Hist1h3c
  gRNA
cagcucgcccgccgcauccg

SEQ ID NO: 24315 - RNA, 20 nt, Artificial Sequence
  MKO10024315_A_Hist1h3c
  gRNA
cagaccgcucgcaaguccac

SEQ ID NO: 24316 - RNA, 20 nt, Artificial Sequence
  MKO10024316_A_Hist1h3d
  gRNA
cccucuccccacgaaugcga

SEQ ID NO: 24317 - RNA, 20 nt, Artificial Sequence
  MKO10024317_A_Hist1h3d
  gRNA
gcuuggcguggauggcacac

SEQ ID NO: 24318 - RNA, 20 nt, Artificial Sequence
  MKO10024318_A_Hist1h3d
  gRNA
cagaccgcucgcaaguccac

SEQ ID NO: 24319 - RNA, 20 nt, Artificial Sequence
  MKO10024319_A_Hist1h3e
  gRNA
ccguggcgcugcgcgaaauc

SEQ ID NO: 24320 - RNA, 20 nt, Artificial Sequence
  MKO10024320_A_Hist1h3e
  gRNA
ccggauuucgcgcagcgcca

SEQ ID NO: 24321 - RNA, 20 nt, Artificial Sequence
  MKO10024321_A_Hist1h3e
  gRNA
cagaccgcucgcaaguccac

SEQ ID NO: 24322 - RNA, 20 nt, Artificial Sequence
  MKO10024322_A_Hist1h3f
  gRNA
gccgccaguggacuugcgag

SEQ ID NO: 24323 - RNA, 20 nt, Artificial Sequence
  MKO10024323_A_Hist1h3f
  gRNA
gugagguuucuucacgccgc

SEQ ID NO: 24324 - RNA, 20 nt, Artificial Sequence
  MKO10024324_A_Hist1h3f
  gRNA
aaaccucaccgcuaccgucc

SEQ ID NO: 24325 - RNA, 20 nt, Artificial Sequence
  MKO10024325_A_Hist1h3g
  gRNA
acccuuaagcccucuccccg

SEQ ID NO: 24326 - RNA, 20 nt, Artificial Sequence
  MKO10024326_A_Hist1h3g
  gRNA
cagaccgcucgcaagucuac

SEQ ID NO: 24327 - RNA, 20 nt, Artificial Sequence
  MKO10024327_A_Hist1h3g
  gRNA
cucgcgcagcgccacagugc

SEQ ID NO: 24328 - RNA, 20 nt, Artificial Sequence
  MKO10024328_A_Hist1h3h
  gRNA
aacuuuaagcccucuccccg

SEQ ID NO: 24329 - RNA, 20 nt, Artificial Sequence
  MKO10024329_A_Hist1h3h
  gRNA
cagcuggcccgccgcauccg

SEQ ID NO: 24330 - RNA, 20 nt, Artificial Sequence
  MKO10024330_A_Hist1h3h
  gRNA
cagaccgcucgcaaguccac

SEQ ID NO: 24331 - RNA, 20 nt, Artificial Sequence
  MKO10024331_A_Hist1h3i
  gRNA
cccucuccccgcgaaugcga

SEQ ID NO: 24332 - RNA, 20 nt, Artificial Sequence
  MKO10024332_A_Hist1h3i
  gRNA
cagaccgcucgcaaguccac

SEQ ID NO: 24333 - RNA, 20 nt, Artificial Sequence
  MKO10024333_A_Hist1h3i
  gRNA
gcgugucaccaucaugccca

SEQ ID NO: 24334 - RNA, 20 nt, Artificial Sequence
  MKO10024334_A_Hist1h4a
  gRNA
uccuaagacaugucgggucg

SEQ ID NO: 24335 - RNA, 20 nt, Artificial Sequence
  MKO10024335_A_Hist1h4a
  gRNA
ugaugcccuggauguuaucg

SEQ ID NO: 24336 - RNA, 20 nt, Artificial Sequence
  MKO10024336_A_Hist1h4a
  gRNA
cuuagccgccgaauccguag

SEQ ID NO: 24337 - RNA, 20 nt, Artificial Sequence
  MKO10024337_A_Hist1h4b
  gRNA
gccgcacccucuacggauuc

SEQ ID NO: 24338 - RNA, 20 nt, Artificial Sequence
  MKO10024338_A_Hist1h4b
  gRNA
aauuuaacuaugucuggucg

SEQ ID NO: 24339 - RNA, 20 nt, Artificial Sequence
  MKO10024339_A_Hist1h4b
  gRNA
ugucgcgcagcacuuugcga

SEQ ID NO: 24340 - RNA, 20 nt, Artificial Sequence
  MKO10024340_A_Hist1h4c
  gRNA
gucauaaccaugucuggacg

SEQ ID NO: 24341 - RNA, 20 nt, Artificial Sequence
  MKO10024341_A_Hist1h4c
  gRNA
gcuuagcgccgccuuuccca

SEQ ID NO: 24342 - RNA, 20 nt, Artificial Sequence
  MKO10024342_A_Hist1h4c
  gRNA
acccuuaccacguccagaca

SEQ ID NO: 24343 - RNA, 20 nt, Artificial Sequence
  MKO10024343_A_Hist1h4d
  gRNA
aggcggcaagggucuuggua

SEQ ID NO: 24344 - RNA, 20 nt, Artificial Sequence
  MKO10024344_A_Hist1h4d
  gRNA
uuugcuaacaugucuggacg

SEQ ID NO: 24345 - RNA, 20 nt, Artificial Sequence
  MKO10024345_A_Hist1h4d
  gRNA
uguugucgcgcagaacuuug

SEQ ID NO: 24346 - RNA, 20 nt, Artificial Sequence
  MKO10024346_A_Hist1h4f
  gRNA
uccauagccaugucuggucg

SEQ ID NO: 24347 - RNA, 20 nt, Artificial Sequence
  MKO10024347_A_Hist1h4f
  gRNA
uguuaucgcgaagaaccuua

SEQ ID NO: 24348 - RNA, 20 nt, Artificial Sequence
  MKO10024348_A_Hist1h4f
  gRNA
ucccuuaccacgaccagaca

SEQ ID NO: 24349 - RNA, 20 nt, Artificial Sequence
  MKO10024349_A_Hist1h4h
  gRNA
aaguacaccaugucuggucg

SEQ ID NO: 24350 - RNA, 20 nt, Artificial Sequence
  MKO10024350_A_Hist1h4h
  gRNA
ggcgguaaaggucuuggcaa

SEQ ID NO: 24351 - RNA, 20 nt, Artificial Sequence
  MKO10024351_A_Hist1h4h
  gRNA
gcccuugccacgaccagaca

SEQ ID NO: 24352 - RNA, 20 nt, Artificial Sequence
  MKO10024352_A_Hist1h4i
  gRNA
agcgccaccgcaaagugcuu

SEQ ID NO: 24353 - RNA, 20 nt, Artificial Sequence
  MKO10024353_A_Hist1h4i
  gRNA
cguacucuguacggguucgg

SEQ ID NO: 24354 - RNA, 20 nt, Artificial Sequence
  MKO10024354_A_Hist1h4i
  gRNA
cgccgaacccguacagagua

SEQ ID NO: 24355 - RNA, 20 nt, Artificial Sequence
  MKO10024355_A_Hist1h4j
  gRNA
cuuagccgccgaacccguag

SEQ ID NO: 24356 - RNA, 20 nt, Artificial Sequence
  MKO10024356_A_Hist1h4j
  gRNA
cgcacccucuacggguucgg

SEQ ID NO: 24357 - RNA, 20 nt, Artificial Sequence
  MKO10024357_A_Hist1h4j
  gRNA
uguugucgcgcagcacuuug

SEQ ID NO: 24358 - RNA, 20 nt, Artificial Sequence
  MKO10024358_A_Hist1h4k
  gRNA
cuuagccuccgaauccguag

SEQ ID NO: 24359 - RNA, 20 nt, Artificial Sequence
  MKO10024359_A_Hist1h4k
  gRNA
agugcagucaugucuggcag

SEQ ID NO: 24360 - RNA, 20 nt, Artificial Sequence
  MKO10024360_A_Hist1h4k
  gRNA
cgcacccucuacggauucgg

SEQ ID NO: 24361 - RNA, 20 nt, Artificial Sequence
  MKO10024361_A_Hist1h4m
  gRNA
gucuucgucaugucuggucg

SEQ ID NO: 24362 - RNA, 20 nt, Artificial Sequence
  MKO10024362_A_Hist1h4m
  gRNA
auuagccgccgaauccguag

SEQ ID NO: 24363 - RNA, 20 nt, Artificial Sequence
  MKO10024363_A_Hist1h4m
  gRNA
cgcacccucuacggauucgg

SEQ ID NO: 24364 - RNA, 20 nt, Artificial Sequence
  MKO10024364_A_Hist1h4n
  gRNA
gucuucaucaugucuggucg

SEQ ID NO: 24365 - RNA, 20 nt, Artificial Sequence
  MKO10024365_A_Hist1h4n
  gRNA
auuagccgccgaauccguag

SEQ ID NO: 24366 - RNA, 20 nt, Artificial Sequence
  MKO10024366_A_Hist1h4n
  gRNA
cgcacccucuacggauucgg

SEQ ID NO: 24367 - RNA, 20 nt, Artificial Sequence
  MKO10024367_A_Hist2h2aa1
  gRNA
cucacuugcccuucgccuua

SEQ ID NO: 24368 - RNA, 20 nt, Artificial Sequence
  MKO10024368_A_Hist2h2aa1
  gRNA
gcuuucgugauguccggucg

SEQ ID NO: 24369 - RNA, 20 nt, Artificial Sequence
  MKO10024369_A_Hist2h2aa1
  gRNA
ggaagaccgcgacuuggccu

SEQ ID NO: 24370 - RNA, 20 nt, Artificial Sequence
  MKO10024370_A_Hist2h2aa2
  gRNA
gcuuucgugauguccggucg

SEQ ID NO: 24371 - RNA, 20 nt, Artificial Sequence
  MKO10024371_A_Hist2h2aa2
  gRNA
cucacuugcccuucgccuua

SEQ ID NO: 24372 - RNA, 20 nt, Artificial Sequence
  MKO10024372_A_Hist2h2aa2
  gRNA
cgaggagcucaacaagcugc

SEQ ID NO: 24373 - RNA, 20 nt, Artificial Sequence
  MKO10024373_A_Hist2h2ab
  gRNA
aagucgcggucgucccgcgc

SEQ ID NO: 24374 - RNA, 20 nt, Artificial Sequence
  MKO10024374_A_Hist2h2ab
  gRNA
uauuccgccaugucuggccg

SEQ ID NO: 24375 - RNA, 20 nt, Artificial Sequence
  MKO10024375_A_Hist2h2ab
  gRNA
uccucacagcuaguugcaga

SEQ ID NO: 24376 - RNA, 20 nt, Artificial Sequence
  MKO10024376_A_Hist2h2ac
  gRNA
cucuaaguuaugucuggccg

SEQ ID NO: 24377 - RNA, 20 nt, Artificial Sequence
  MKO10024377_A_Hist2h2ac
  gRNA
uucacuugcucuuagccuug

SEQ ID NO: 24378 - RNA, 20 nt, Artificial Sequence
  MKO10024378_A_Hist2h2ac
  gRNA
aaagugacgaucgcacaggg

SEQ ID NO: 24379 - RNA, 20 nt, Artificial Sequence
  MKO10024379_A_Hist2h2bb
  gRNA
cucgaagauaucguucacga

SEQ ID NO: 24380 - RNA, 20 nt, Artificial Sequence
  MKO10024380_A_Hist2h2bb
  gRNA
gaagcaagugcaccccgaca

SEQ ID NO: 24381 - RNA, 20 nt, Artificial Sequence
  MKO10024381_A_Hist2h2bb
  gRNA
ggagcagacuucgcuggauc

SEQ ID NO: 24382 - RNA, 20 nt, Artificial Sequence
  MKO10024382_A_Hist2h2be
  gRNA
aucgcgggagauccagacgu

SEQ ID NO: 24383 - RNA, 20 nt, Artificial Sequence
  MKO10024383_A_Hist2h2be
  gRNA
gccuggcgcauuacaacaag

SEQ ID NO: 24384 - RNA, 20 nt, Artificial Sequence
  MKO10024384_A_Hist2h2be
  gRNA
gggaggccucuacuuggcgc

SEQ ID NO: 24385 - RNA, 20 nt, Artificial Sequence
  MKO10024385_A_Hist2h3b
  gRNA
ugcgggcggucugcuucgua

SEQ ID NO: 24386 - RNA, 20 nt, Artificial Sequence
  MKO10024386_A_Hist2h3b
  gRNA
cagaccgcccgcaaguccac

SEQ ID NO: 24387 - RNA, 20 nt, Artificial Sequence
  MKO10024387_A_Hist2h3b
  gRNA
gcgcuuaagcgcgcucccca

SEQ ID NO: 24388 - RNA, 20 nt, Artificial Sequence
  MKO10024388_A_Hist2h3c1
  gRNA
gcgcuuaagcgcgcucccca

SEQ ID NO: 24389 - RNA, 20 nt, Artificial Sequence
  MKO10024389_A_Hist2h3c1
  gRNA
cagacugcccgcaaguccac

SEQ ID NO: 24390 - RNA, 20 nt, Artificial Sequence
  MKO10024390_A_Hist2h3c1
  gRNA
ggcgcucuugcgggcggccu

SEQ ID NO: 24391 - RNA, 20 nt, Artificial Sequence
  MKO10024391_A_Hist2h3c2
  gRNA
cagacugcccgcaaguccac

SEQ ID NO: 24392 - RNA, 20 nt, Artificial Sequence
  MKO10024392_A_Hist2h3c2
  gRNA
gcgcuuaagcgcgcucccca

SEQ ID NO: 24393 - RNA, 20 nt, Artificial Sequence
  MKO10024393_A_Hist2h3c2
  gRNA
acgcgucaccaucaugccca

SEQ ID NO: 24394 - RNA, 20 nt, Artificial Sequence
  MKO10024394_A_Hist2h4
  gRNA
ucuagccuccgaagccguag

SEQ ID NO: 24395 - RNA, 20 nt, Artificial Sequence
  MKO10024395_A_Hist2h4
  gRNA
ugucacgcaagacuuugcga

SEQ ID NO: 24396 - RNA, 20 nt, Artificial Sequence
  MKO10024396_A_Hist2h4
  gRNA
ugaccccaccgcgccgagcc

SEQ ID NO: 24397 - RNA, 20 nt, Artificial Sequence
  MKO10024397_A_Hist3h2a
  gRNA
gauauucuagcacagccgcc

SEQ ID NO: 24398 - RNA, 20 nt, Artificial Sequence
  MKO10024398_A_Hist3h2a
  gRNA
ugugcaccgccuucuccgua

SEQ ID NO: 24399 - RNA, 20 nt, Artificial Sequence
  MKO10024399_A_Hist3h2a
  gRNA
gcuccgaauaauuacccuua

SEQ ID NO: 24400 - RNA, 20 nt, Artificial Sequence
  MKO10024400_A_Hist3h2ba
  gRNA
gcacggccgucugcaccucg

SEQ ID NO: 24401 - RNA, 20 nt, Artificial Sequence
  MKO10024401_A_Hist3h2ba
  gRNA
cuccaagaaagccaucacca

SEQ ID NO: 24402 - RNA, 20 nt, Artificial Sequence
  MKO10024402_A_Hist3h2ba
  gRNA
ggccaagcaugccguguccg

SEQ ID NO: 24403 - RNA, 20 nt, Artificial Sequence
  MKO10024403_A_Hist3h2bb-ps
  gRNA
ggagcugauuuggauggauc

SEQ ID NO: 24404 - RNA, 20 nt, Artificial Sequence
  MKO10024404_A_Hist3h2bb-ps
  gRNA
cauacaaauauucuugcuac

SEQ ID NO: 24405 - RNA, 20 nt, Artificial Sequence
  MKO10024405_A_Hist3h2bb-ps
  gRNA
cauaaugucuaguuguacua

SEQ ID NO: 24406 - RNA, 20 nt, Artificial Sequence
  MKO10024406_A_Hist4h4
  gRNA
gcauuaccaagcccgcuauc

SEQ ID NO: 24407 - RNA, 20 nt, Artificial Sequence
  MKO10024407_A_Hist4h4
  gRNA
uggcggcgugaagcgcaucu

SEQ ID NO: 24408 - RNA, 20 nt, Artificial Sequence
  MKO10024408_A_Hist4h4
  gRNA
cgagcacgccaagcgcaaga

SEQ ID NO: 24409 - RNA, 20 nt, Artificial Sequence
  MKO10024409_A_Hivep1
  gRNA
uguaccacggagccccuuga

SEQ ID NO: 24410 - RNA, 20 nt, Artificial Sequence
  MKO10024410_A_Hivep1
  gRNA
cuuccgauaccuauuucgac

SEQ ID NO: 24411 - RNA, 20 nt, Artificial Sequence
  MKO10024411_A_Hivep1
  gRNA
auuacguguauguccgaggc

SEQ ID NO: 24412 - RNA, 20 nt, Artificial Sequence
  MKO10024412_A_Hivep2
  gRNA
gacgagaccugucgccgaug

SEQ ID NO: 24413 - RNA, 20 nt, Artificial Sequence
  MKO10024413_A_Hivep2
  gRNA
acagaugccucaucggcgac

SEQ ID NO: 24414 - RNA, 20 nt, Artificial Sequence
  MKO10024414_A_Hivep2
  gRNA
uacgcacucauacugauguu

SEQ ID NO: 24415 - RNA, 20 nt, Artificial Sequence
  MKO10024415_A_Hivep3
  gRNA
cucgggccggugaacauugc

SEQ ID NO: 24416 - RNA, 20 nt, Artificial Sequence
  MKO10024416_A_Hivep3
  gRNA
cucacccguugagggcccuc

SEQ ID NO: 24417 - RNA, 20 nt, Artificial Sequence
  MKO10024417_A_Hivep3
  gRNA
ucaggugcaccucccgucgc

SEQ ID NO: 24418 - RNA, 20 nt, Artificial Sequence
  MKO10024418_A_Hjurp
  gRNA
cguacccuggggcgucucgu

SEQ ID NO: 24419 - RNA, 20 nt, Artificial Sequence
  MKO10024419_A_Hjurp
  gRNA
guuaaccuacgagacgcccc

SEQ ID NO: 24420 - RNA, 20 nt, Artificial Sequence
  MKO10024420_A_Hjurp
  gRNA
ggcuguaccugacgcugccu

SEQ ID NO: 24421 - RNA, 20 nt, Artificial Sequence
  MKO10024421_A_Hk1
  gRNA
ugacguucugacucuucucg

SEQ ID NO: 24422 - RNA, 20 nt, Artificial Sequence
  MKO10024422_A_Hk1
  gRNA
gaucacgucgcugaaugccu

SEQ ID NO: 24423 - RNA, 20 nt, Artificial Sequence
  MKO10024423_A_Hk1
  gRNA
aggccguuggguuauaaucc

SEQ ID NO: 24424 - RNA, 20 nt, Artificial Sequence
  MKO10024424_A_Hk2
  gRNA
acuuccgugugcuccgagua

SEQ ID NO: 24425 - RNA, 20 nt, Artificial Sequence
  MKO10024425_A_Hk2
  gRNA
acuaagggguucaaguccag

SEQ ID NO: 24426 - RNA, 20 nt, Artificial Sequence
  MKO10024426_A_Hk2
  gRNA
auaccucauccaguuucguc

SEQ ID NO: 24427 - RNA, 20 nt, Artificial Sequence
  MKO10024427_A_Hk3
  gRNA
uguuacccaccggugccgug

SEQ ID NO: 24428 - RNA, 20 nt, Artificial Sequence
  MKO10024428_A_Hk3
  gRNA
gggcuccacccggcauucuu

SEQ ID NO: 24429 - RNA, 20 nt, Artificial Sequence
  MKO10024429_A_Hk3
  gRNA
uacgugagguccacaccaca

SEQ ID NO: 24430 - RNA, 20 nt, Artificial Sequence
  MKO10024430_A_Hkdc1
  gRNA
cacagacguggugaaccgcc

SEQ ID NO: 24431 - RNA, 20 nt, Artificial Sequence
  MKO10024431_A_Hkdc1
  gRNA
ugacuacguagccgacugcc

SEQ ID NO: 24432 - RNA, 20 nt, Artificial Sequence
  MKO10024432_A_Hkdc1
  gRNA
augcccaaugaaaucacccg

SEQ ID NO: 24433 - RNA, 20 nt, Artificial Sequence
  MKO10024433_A_Hlcs
  gRNA
cgggcgaacucugccccgaa

SEQ ID NO: 24434 - RNA, 20 nt, Artificial Sequence
  MKO10024434_A_Hlcs
  gRNA
aaucugcagaccacgcgccu

SEQ ID NO: 24435 - RNA, 20 nt, Artificial Sequence
  MKO10024435_A_Hlcs
  gRNA
ccgaaagccacccaacguga

SEQ ID NO: 24436 - RNA, 20 nt, Artificial Sequence
  MKO10024436_A_Hlf
  gRNA
gaccugagcacgccguaggg

SEQ ID NO: 24437 - RNA, 20 nt, Artificial Sequence
  MKO10024437_A_Hlf
  gRNA
augaggcccggauugcgauc

SEQ ID NO: 24438 - RNA, 20 nt, Artificial Sequence
  MKO10024438_A_Hlf
  gRNA
gggcuguggucgugcugcga

SEQ ID NO: 24439 - RNA, 20 nt, Artificial Sequence
  MKO10024439_A_Hltf
  gRNA
gauagcuuuagggucgaguu

SEQ ID NO: 24440 - RNA, 20 nt, Artificial Sequence
  MKO10024440_A_Hltf
  gRNA
cuauaguaggccggcucaug

SEQ ID NO: 24441 - RNA, 20 nt, Artificial Sequence
  MKO10024441_A_Hltf
  gRNA
uauucgcagucuguccagua

SEQ ID NO: 24442 - RNA, 20 nt, Artificial Sequence
  MKO10024442_A_Hlx
  gRNA
gaguccccgccgagggugaa

SEQ ID NO: 24443 - RNA, 20 nt, Artificial Sequence
  MKO10024443_A_Hlx
  gRNA
cucaguccguuccgugucgc

SEQ ID NO: 24444 - RNA, 20 nt, Artificial Sequence
  MKO10024444_A_Hlx
  gRNA
acauccugcacgccggcguc

SEQ ID NO: 24445 - RNA, 20 nt, Artificial Sequence
  MKO10024445_A_Hmbox1
  gRNA
ucccgguacgccgaagacgc

SEQ ID NO: 24446 - RNA, 20 nt, Artificial Sequence
  MKO10024446_A_Hmbox1
  gRNA
gucagagucgaaucucucac

SEQ ID NO: 24447 - RNA, 20 nt, Artificial Sequence
  MKO10024447_A_Hmbox1
  gRNA
auaugagcuucccccguagc

SEQ ID NO: 24448 - RNA, 20 nt, Artificial Sequence
  MKO10024448_A_Hmbs
  gRNA
ucgcauacagaccgacacug

SEQ ID NO: 24449 - RNA, 20 nt, Artificial Sequence
  MKO10024449_A_Hmbs
  gRNA
aaagaugagggugauucgag

SEQ ID NO: 24450 - RNA, 20 nt, Artificial Sequence
  MKO10024450_A_Hmbs
  gRNA
uuucuagcuccuugguaaac

SEQ ID NO: 24451 - RNA, 20 nt, Artificial Sequence
  MKO10024451_A_Hmces
  gRNA
cuacgaguggcagcgguguc

SEQ ID NO: 24452 - RNA, 20 nt, Artificial Sequence
  MKO10024452_A_Hmces
  gRNA
cugucguagugauaccauaa

SEQ ID NO: 24453 - RNA, 20 nt, Artificial Sequence
  MKO10024453_A_Hmces
  gRNA
gucuccaaauggcucgacuu

SEQ ID NO: 24454 - RNA, 20 nt, Artificial Sequence
  MKO10024454_A_Hmcn1
  gRNA
cacagcgugcuccaaaugau

SEQ ID NO: 24455 - RNA, 20 nt, Artificial Sequence
  MKO10024455_A_Hmcn1
  gRNA
augggugagccgauaauccu

SEQ ID NO: 24456 - RNA, 20 nt, Artificial Sequence
  MKO10024456_A_Hmcn1
  gRNA
auugagauucgcaauccuuu

SEQ ID NO: 24457 - RNA, 20 nt, Artificial Sequence
  MKO10024457_A_Hmg20a
  gRNA
gcucagguuaacacaccccg

SEQ ID NO: 24458 - RNA, 20 nt, Artificial Sequence
  MKO10024458_A_Hmg20a
  gRNA
ggugcauugcugucucgaag

SEQ ID NO: 24459 - RNA, 20 nt, Artificial Sequence
  MKO10024459_A_Hmg20a
  gRNA
gcaccuaaauccccccuuac

SEQ ID NO: 24460 - RNA, 20 nt, Artificial Sequence
  MKO10024460_A_Hmg20b
  gRNA
acagauucgcacccgccacc

SEQ ID NO: 24461 - RNA, 20 nt, Artificial Sequence
  MKO10024461_A_Hmg20b
  gRNA
cgcagcgaggguucccgagc

SEQ ID NO: 24462 - RNA, 20 nt, Artificial Sequence
  MKO10024462_A_Hmg20b
  gRNA
uuguccccaagaccugcggg

SEQ ID NO: 24463 - RNA, 20 nt, Artificial Sequence
  MKO10024463_A_Hmga1-rs1
  gRNA
uguggugacuuuccgggucu

SEQ ID NO: 24464 - RNA, 20 nt, Artificial Sequence
  MKO10024464_A_Hmga1-rs1
  gRNA
cggaaagucaccacagcucc

SEQ ID NO: 24465 - RNA, 20 nt, Artificial Sequence
  MKO10024465_A_Hmga1-rs1
  gRNA
uuccuccuucuccaguuucu

SEQ ID NO: 24466 - RNA, 20 nt, Artificial Sequence
  MKO10024466_A_Hmga1
  gRNA
gaggcucacccgggucuugg

SEQ ID NO: 24467 - RNA, 20 nt, Artificial Sequence
  MKO10024467_A_Hmga1
  gRNA
caagcaccuaccaguuucuu

SEQ ID NO: 24468 - RNA, 20 nt, Artificial Sequence
  MKO10024468_A_Hmga1
  gRNA
cagaaagucaccacagcucc

SEQ ID NO: 24469 - RNA, 20 nt, Artificial Sequence
  MKO10024469_A_Hmga2
  gRNA
caccuucugggcugcuuuag

SEQ ID NO: 24470 - RNA, 20 nt, Artificial Sequence
  MKO10024470_A_Hmga2
  gRNA
ccccucuaaagcagcccaga

SEQ ID NO: 24471 - RNA, 20 nt, Artificial Sequence
  MKO10024471_A_Hmga2
  gRNA
auccucgcaagaguccgcag

SEQ ID NO: 24472 - RNA, 20 nt, Artificial Sequence
  MKO10024472_A_Hmgb1
  gRNA
ucauacucacggaggccucu

SEQ ID NO: 24473 - RNA, 20 nt, Artificial Sequence
  MKO10024473_A_Hmgb1
  gRNA
ggagauccuaaaaagccgag

SEQ ID NO: 24474 - RNA, 20 nt, Artificial Sequence
  MKO10024474_A_Hmgb1
  gRNA
ccaccucucugagcacuucu

SEQ ID NO: 24475 - RNA, 20 nt, Artificial Sequence
  MKO10024475_A_Hmgb2
  gRNA
cccauagaccaugucugcaa

SEQ ID NO: 24476 - RNA, 20 nt, Artificial Sequence
  MKO10024476_A_Hmgb2
  gRNA
ucaacuuacgguggucucuu

SEQ ID NO: 24477 - RNA, 20 nt, Artificial Sequence
  MKO10024477_A_Hmgb2
  gRNA
cucccucaccuuccaucucu

SEQ ID NO: 24478 - RNA, 20 nt, Artificial Sequence
  MKO10024478_A_Hmgb3
  gRNA
aggcacuuacggaggucuuu

SEQ ID NO: 24479 - RNA, 20 nt, Artificial Sequence
  MKO10024479_A_Hmgb3
  gRNA
ccaccucuccgagcacuucu

SEQ ID NO: 24480 - RNA, 20 nt, Artificial Sequence
  MKO10024480_A_Hmgb3
  gRNA
aggugaccccaagaaaccaa

SEQ ID NO: 24481 - RNA, 20 nt, Artificial Sequence
  MKO10024481_A_Hmgb4
  gRNA
uaugcgggcaaaguauuucg

SEQ ID NO: 24482 - RNA, 20 nt, Artificial Sequence
  MKO10024482_A_Hmgb4
  gRNA
caccugcaccacgguccagu

SEQ ID NO: 24483 - RNA, 20 nt, Artificial Sequence
  MKO10024483_A_Hmgb4
  gRNA
gccuaccgcaaccaauguca

SEQ ID NO: 24484 - RNA, 20 nt, Artificial Sequence
  MKO10024484_A_Hmgcll1
  gRNA
ugaguaaguacccucgcacu

SEQ ID NO: 24485 - RNA, 20 nt, Artificial Sequence
  MKO10024485_A_Hmgcll1
  gRNA
accaaaaacugcuaucuccg

SEQ ID NO: 24486 - RNA, 20 nt, Artificial Sequence
  MKO10024486_A_Hmgcll1
  gRNA
aggacaggauagcgaacucc

SEQ ID NO: 24487 - RNA, 20 nt, Artificial Sequence
  MKO10024487_A_Hmgcl
  gRNA
aucgacaugcuuuccgaagc

SEQ ID NO: 24488 - RNA, 20 nt, Artificial Sequence
  MKO10024488_A_Hmgcl
  gRNA
uagagcaguucgcguucuuc

SEQ ID NO: 24489 - RNA, 20 nt, Artificial Sequence
  MKO10024489_A_Hmgcl
  gRNA
gaacgcgaacugcucuauag

SEQ ID NO: 24490 - RNA, 20 nt, Artificial Sequence
  MKO10024490_A_Hmgcr
  gRNA
ucaucauccugacgauaacg

SEQ ID NO: 24491 - RNA, 20 nt, Artificial Sequence
  MKO10024491_A_Hmgcr
  gRNA
cgaugcaccgcguuaucguc

SEQ ID NO: 24492 - RNA, 20 nt, Artificial Sequence
  MKO10024492_A_Hmgcr
  gRNA
cuaaugcacucgcucuagaa

SEQ ID NO: 24493 - RNA, 20 nt, Artificial Sequence
  MKO10024493_A_Hmgcs1
  gRNA
gcaaaaagauccgugcccag

SEQ ID NO: 24494 - RNA, 20 nt, Artificial Sequence
  MKO10024494_A_Hmgcs1
  gRNA
ucaccucggucaaaaauuag

SEQ ID NO: 24495 - RNA, 20 nt, Artificial Sequence
  MKO10024495_A_Hmgcs1
  gRNA
caugcucuccgaguacccug

SEQ ID NO: 24496 - RNA, 20 nt, Artificial Sequence
  MKO10024496_A_Hmgcs2
  gRNA
ggcaaugcugaucgggccca

SEQ ID NO: 24497 - RNA, 20 nt, Artificial Sequence
  MKO10024497_A_Hmgcs2
  gRNA
gauaccaccaacgccuguua

SEQ ID NO: 24498 - RNA, 20 nt, Artificial Sequence
  MKO10024498_A_Hmgcs2
  gRNA
ugugccgccauaacaggcgu

SEQ ID NO: 24499 - RNA, 20 nt, Artificial Sequence
  MKO10024499_A_Hmgn1
  gRNA
acuuacggccgacagccucg

SEQ ID NO: 24500 - RNA, 20 nt, Artificial Sequence
  MKO10024500_A_Hmgn1
  gRNA
cuccugcagguuagcgcgga

SEQ ID NO: 24501 - RNA, 20 nt, Artificial Sequence
  MKO10024501_A_Hmgn1
  gRNA
cgcacucaccuccgccuugg

SEQ ID NO: 24502 - RNA, 20 nt, Artificial Sequence
  MKO10024502_A_Hmgn2
  gRNA
caaaaccaaggugaaggacg

SEQ ID NO: 24503 - RNA, 20 nt, Artificial Sequence
  MKO10024503_A_Hmgn2
  gRNA
ccacucuaccuggucuguuu

SEQ ID NO: 24504 - RNA, 20 nt, Artificial Sequence
  MKO10024504_A_Hmgn2
  gRNA
acucaccucguccuucaccu

SEQ ID NO: 24505 - RNA, 20 nt, Artificial Sequence
  MKO10024505_A_Hmgn3
  gRNA
aggacuuaccgcggacaacc

SEQ ID NO: 24506 - RNA, 20 nt, Artificial Sequence
  MKO10024506_A_Hmgn3
  gRNA
uaccuccugcuuaguuagcu

SEQ ID NO: 24507 - RNA, 20 nt, Artificial Sequence
  MKO10024507_A_Hmgn3
  gRNA
agucauuaugccgaagagaa

SEQ ID NO: 24508 - RNA, 20 nt, Artificial Sequence
  MKO10024508_A_Hmgn5
  gRNA
uccagguaccuccauaaucu

SEQ ID NO: 24509 - RNA, 20 nt, Artificial Sequence
  MKO10024509_A_Hmgn5
  gRNA
caucacuuacagcagacagu

SEQ ID NO: 24510 - RNA, 20 nt, Artificial Sequence
  MKO10024510_A_Hmgn5
  gRNA
gaugccugugcccuuuacac

SEQ ID NO: 24511 - RNA, 20 nt, Artificial Sequence
  MKO10024511_A_Hmgxb3
  gRNA
ccgaaagauccuuccccgau

SEQ ID NO: 24512 - RNA, 20 nt, Artificial Sequence
  MKO10024512_A_Hmgxb3
  gRNA
ggccgagagaaguuacuacu

SEQ ID NO: 24513 - RNA, 20 nt, Artificial Sequence
  MKO10024513_A_Hmgxb3
  gRNA
ccuccuccaagagcauaucg

SEQ ID NO: 24514 - RNA, 20 nt, Artificial Sequence
  MKO10024514_A_Hmgxb4
  gRNA
ccuccauaguaguaaucguc

SEQ ID NO: 24515 - RNA, 20 nt, Artificial Sequence
  MKO10024515_A_Hmgxb4
  gRNA
acuuggcacccgcugccagu

SEQ ID NO: 24516 - RNA, 20 nt, Artificial Sequence
  MKO10024516_A_Hmgxb4
  gRNA
gucccgagcuaguuucuucg

SEQ ID NO: 24517 - RNA, 20 nt, Artificial Sequence
  MKO10024517_A_Hmha1
  gRNA
cugcccggcagaccuucucg

SEQ ID NO: 24518 - RNA, 20 nt, Artificial Sequence
  MKO10024518_A_Hmha1
  gRNA
ggaggggcccccacauaacg

SEQ ID NO: 24519 - RNA, 20 nt, Artificial Sequence
  MKO10024519_A_Hmha1
  gRNA
ucacauuccuccacguuaug

SEQ ID NO: 24520 - RNA, 20 nt, Artificial Sequence
  MKO10024520_A_Hmmr
  gRNA
cagagccaacgagcuacuaa

SEQ ID NO: 24521 - RNA, 20 nt, Artificial Sequence
  MKO10024521_A_Hmmr
  gRNA
cuuagccuuuaguagcucgu

SEQ ID NO: 24522 - RNA, 20 nt, Artificial Sequence
  MKO10024522_A_Hmmr
  gRNA
uguagguugugcuccaucuc

SEQ ID NO: 24523 - RNA, 20 nt, Artificial Sequence
  MKO10024523_A_Hmox1
  gRNA
cuauguaaagcgucuccacg

SEQ ID NO: 24524 - RNA, 20 nt, Artificial Sequence
  MKO10024524_A_Hmox1
  gRNA
ggggcugucgauguucggga

SEQ ID NO: 24525 - RNA, 20 nt, Artificial Sequence
  MKO10024525_A_Hmox1
  gRNA
acgaagugacgccaucugug

SEQ ID NO: 24526 - RNA, 20 nt, Artificial Sequence
  MKO10024526_A_Hmox2
  gRNA
gaauccgauccacauacuuc

SEQ ID NO: 24527 - RNA, 20 nt, Artificial Sequence
  MKO10024527_A_Hmox2
  gRNA
ccaaggcauucauucuagcg

SEQ ID NO: 24528 - RNA, 20 nt, Artificial Sequence
  MKO10024528_A_Hmox2
  gRNA
gaugggcucccgguacauga

SEQ ID NO: 24529 - RNA, 20 nt, Artificial Sequence
  MKO10024529_A_Hmx1
  gRNA
aggcgcgacgacgacuacag

SEQ ID NO: 24530 - RNA, 20 nt, Artificial Sequence
  MKO10024530_A_Hmx1
  gRNA
cuuccuucgcgcgcagaugc

SEQ ID NO: 24531 - RNA, 20 nt, Artificial Sequence
  MKO10024531_A_Hmx1
  gRNA
agucgucgucgcgccugcuc

SEQ ID NO: 24532 - RNA, 20 nt, Artificial Sequence
  MKO10024532_A_Hmx2
  gRNA
cgccgacgcgugugccaugu

SEQ ID NO: 24533 - RNA, 20 nt, Artificial Sequence
  MKO10024533_A_Hmx2
  gRNA
uccuuggggccgugcggauc

SEQ ID NO: 24534 - RNA, 20 nt, Artificial Sequence
  MKO10024534_A_Hmx2
  gRNA
aaggaauggcgugcgcuccg

SEQ ID NO: 24535 - RNA, 20 nt, Artificial Sequence
  MKO10024535_A_Hmx3
  gRNA
ugucgccguagucgccccua

SEQ ID NO: 24536 - RNA, 20 nt, Artificial Sequence
  MKO10024536_A_Hmx3
  gRNA
cggggagucucgaucggugc

SEQ ID NO: 24537 - RNA, 20 nt, Artificial Sequence
  MKO10024537_A_Hmx3
  gRNA
ugcccugcccgcgcacuacc

SEQ ID NO: 24538 - RNA, 20 nt, Artificial Sequence
  MKO10024538_A_Hn1l
  gRNA
uuguagguccaugaagcccc

SEQ ID NO: 24539 - RNA, 20 nt, Artificial Sequence
  MKO10024539_A_Hn1l
  gRNA
guccauaccuugggcuuguu

SEQ ID NO: 24540 - RNA, 20 nt, Artificial Sequence
  MKO10024540_A_Hn1l
  gRNA
gacucuaagucugaccugaa

SEQ ID NO: 24541 - RNA, 20 nt, Artificial Sequence
  MKO10024541_A_Hn1
  gRNA
cccuggcggcaaguccagcc

SEQ ID NO: 24542 - RNA, 20 nt, Artificial Sequence
  MKO10024542_A_Hn1
  gRNA
uuucuagguuccaagucuag

SEQ ID NO: 24543 - RNA, 20 nt, Artificial Sequence
  MKO10024543_A_Hn1
  gRNA
cagggagaaggugauaugca

SEQ ID NO: 24544 - RNA, 20 nt, Artificial Sequence
  MKO10024544_A_Hnf1a
  gRNA
ggaagccuuccggcacaagu

SEQ ID NO: 24545 - RNA, 20 nt, Artificial Sequence
  MKO10024545_A_Hnf1a
  gRNA
ggcuuccuccuugcgccggu

SEQ ID NO: 24546 - RNA, 20 nt, Artificial Sequence
  MKO10024546_A_Hnf1a
  gRNA
ggcguaggaaccgguucaag

SEQ ID NO: 24547 - RNA, 20 nt, Artificial Sequence
  MKO10024547_A_Hnf1b
  gRNA
acaagaagaugcgccgcaac

SEQ ID NO: 24548 - RNA, 20 nt, Artificial Sequence
  MKO10024548_A_Hnf1b
  gRNA
cucugucuagcgaggacccg

SEQ ID NO: 24549 - RNA, 20 nt, Artificial Sequence
  MKO10024549_A_Hnf1b
  gRNA
acaacugguucgcaaaccgc

SEQ ID NO: 24550 - RNA, 20 nt, Artificial Sequence
  MKO10024550_A_Hnf4a
  gRNA
cacgcggaggucaagcuacg

SEQ ID NO: 24551 - RNA, 20 nt, Artificial Sequence
  MKO10024551_A_Hnf4a
  gRNA
cgggccaccggcaaacacua

SEQ ID NO: 24552 - RNA, 20 nt, Artificial Sequence
  MKO10024552_A_Hnf4a
  gRNA
cguaguguuugccgguggcc

SEQ ID NO: 24553 - RNA, 20 nt, Artificial Sequence
  MKO10024553_A_Hnf4g
  gRNA
uacaagaagaaguaccuacg

SEQ ID NO: 24554 - RNA, 20 nt, Artificial Sequence
  MKO10024554_A_Hnf4g
  gRNA
cgcuugugccagaguguuua

SEQ ID NO: 24555 - RNA, 20 nt, Artificial Sequence
  MKO10024555_A_Hnf4g
  gRNA
ucggcaguguguuguugaca

SEQ ID NO: 24556 - RNA, 20 nt, Artificial Sequence
  MKO10024556_A_Hnmt
  gRNA
ugaauaucaaaaacguaugc

SEQ ID NO: 24557 - RNA, 20 nt, Artificial Sequence
  MKO10024557_A_Hnmt
  gRNA
aagaagaagagccaccgaag

SEQ ID NO: 24558 - RNA, 20 nt, Artificial Sequence
  MKO10024558_A_Hnmt
  gRNA
ucauuguuaauacagauucc

SEQ ID NO: 24559 - RNA, 20 nt, Artificial Sequence
  MKO10024559_A_Hnrnpa0
  gRNA
ugucggccgcgucguggcuc

SEQ ID NO: 24560 - RNA, 20 nt, Artificial Sequence
  MKO10024560_A_Hnrnpa0
  gRNA
cgccgaauccucccgcgaca

SEQ ID NO: 24561 - RNA, 20 nt, Artificial Sequence
  MKO10024561_A_Hnrnpa0
  gRNA
guguugccguccaccgcgug

SEQ ID NO: 24562 - RNA, 20 nt, Artificial Sequence
  MKO10024562_A_Hnrnpa1
  gRNA
uaccgucaugucuaaguccg

SEQ ID NO: 24563 - RNA, 20 nt, Artificial Sequence
  MKO10024563_A_Hnrnpa1
  gRNA
guguuccccauugcucaaaa

SEQ ID NO: 24564 - RNA, 20 nt, Artificial Sequence
  MKO10024564_A_Hnrnpa1
  gRNA
ccaaggagccagaacagcug

SEQ ID NO: 24565 - RNA, 20 nt, Artificial Sequence
  MKO10024565_A_Hnrnpa2b1
  gRNA
caguuccgaaagcucuuuau

SEQ ID NO: 24566 - RNA, 20 nt, Artificial Sequence
  MKO10024566_A_Hnrnpa2b1
  gRNA
ucucuugcuacagcacguuu

SEQ ID NO: 24567 - RNA, 20 nt, Artificial Sequence
  MKO10024567_A_Hnrnpa2b1
  gRNA
agccaccaauaaagagcuuu

SEQ ID NO: 24568 - RNA, 20 nt, Artificial Sequence
  MKO10024568_A_Hnrnpa3
  gRNA
uccucagggccaugauccaa

SEQ ID NO: 24569 - RNA, 20 nt, Artificial Sequence
  MKO10024569_A_Hnrnpa3
  gRNA
gacacaguugauaaaauugu

SEQ ID NO: 24570 - RNA, 20 nt, Artificial Sequence
  MKO10024570_A_Hnrnpa3
  gRNA
uuguaggauucuguaaagcc

SEQ ID NO: 24571 - RNA, 20 nt, Artificial Sequence
  MKO10024571_A_Hnrnpab
  gRNA
cgccaccgagaacggacacg

SEQ ID NO: 24572 - RNA, 20 nt, Artificial Sequence
  MKO10024572_A_Hnrnpab
  gRNA
cuggccgaccaugucggacg

SEQ ID NO: 24573 - RNA, 20 nt, Artificial Sequence
  MKO10024573_A_Hnrnpab
  gRNA
cccaacacuggacgaucaag

SEQ ID NO: 24574 - RNA, 20 nt, Artificial Sequence
  MKO10024574_A_Hnrnpc
  gRNA
aaguuccggaccugaguaga

SEQ ID NO: 24575 - RNA, 20 nt, Artificial Sequence
  MKO10024575_A_Hnrnpc
  gRNA
ggaggaggaggaacccgcgc

SEQ ID NO: 24576 - RNA, 20 nt, Artificial Sequence
  MKO10024576_A_Hnrnpc
  gRNA
agugaaaggugaugaccuuc

SEQ ID NO: 24577 - RNA, 20 nt, Artificial Sequence
  MKO10024577_A_Hnrnpdl
  gRNA
ccucuugaucuucccgugac

SEQ ID NO: 24578 - RNA, 20 nt, Artificial Sequence
  MKO10024578_A_Hnrnpdl
  gRNA
caaaguugcgcaacccaaag

SEQ ID NO: 24579 - RNA, 20 nt, Artificial Sequence
  MKO10024579_A_Hnrnpdl
  gRNA
ggggaaagaacccccuaaaa

SEQ ID NO: 24580 - RNA, 20 nt, Artificial Sequence
  MKO10024580_A_Hnrnpd
  gRNA
aacggcggcgguaggcggcu

SEQ ID NO: 24581 - RNA, 20 nt, Artificial Sequence
  MKO10024581_A_Hnrnpd
  gRNA
acagaacccacgccucuuau

SEQ ID NO: 24582 - RNA, 20 nt, Artificial Sequence
  MKO10024582_A_Hnrnpd
  gRNA
gaucgacgccaguaagaacg

SEQ ID NO: 24583 - RNA, 20 nt, Artificial Sequence
  MKO10024583_A_Hnrnpf
  gRNA
cgcccaugcccugcaucacc

SEQ ID NO: 24584 - RNA, 20 nt, Artificial Sequence
  MKO10024584_A_Hnrnpf
  gRNA
caugggcgugucagcugccc

SEQ ID NO: 24585 - RNA, 20 nt, Artificial Sequence
  MKO10024585_A_Hnrnpf
  gRNA
gcuguucugaccgcuguagc

SEQ ID NO: 24586 - RNA, 20 nt, Artificial Sequence
  MKO10024586_A_Hnrnph1
  gRNA
auagggaccuggccgcugca

SEQ ID NO: 24587 - RNA, 20 nt, Artificial Sequence
  MKO10024587_A_Hnrnph1
  gRNA
ucaacaaaagccucgccacu

SEQ ID NO: 24588 - RNA, 20 nt, Artificial Sequence
  MKO10024588_A_Hnrnph1
  gRNA
aacauugccgguggacuucc

SEQ ID NO: 24589 - RNA, 20 nt, Artificial Sequence
  MKO10024589_A_Hnrnph2
  gRNA
gcucaugacuaugcagcgcc

SEQ ID NO: 24590 - RNA, 20 nt, Artificial Sequence
  MKO10024590_A_Hnrnph2
  gRNA
ccgccucauucuuucaaacc

SEQ ID NO: 24591 - RNA, 20 nt, Artificial Sequence
  MKO10024591_A_Hnrnph2
  gRNA
ccggaccuccauaacuagac

SEQ ID NO: 24592 - RNA, 20 nt, Artificial Sequence
  MKO10024592_A_Hnrnph3
  gRNA
auguaugacagaaugcgacg

SEQ ID NO: 24593 - RNA, 20 nt, Artificial Sequence
  MKO10024593_A_Hnrnph3
  gRNA
ggaccauaugauagaccaau

SEQ ID NO: 24594 - RNA, 20 nt, Artificial Sequence
  MKO10024594_A_Hnrnph3
  gRNA
uuugaugacaggaugcgaga

SEQ ID NO: 24595 - RNA, 20 nt, Artificial Sequence
  MKO10024595_A_Hnrnpk
  gRNA
aaaccuaccucuuccaaggu

SEQ ID NO: 24596 - RNA, 20 nt, Artificial Sequence
  MKO10024596_A_Hnrnpk
  gRNA
cagaaugcuggagcagugau

SEQ ID NO: 24597 - RNA, 20 nt, Artificial Sequence
  MKO10024597_A_Hnrnpk
  gRNA
uaaacgcccugcagaagaua

SEQ ID NO: 24598 - RNA, 20 nt, Artificial Sequence
  MKO10024598_A_Hnrnpll
  gRNA
ggaaauaccgacgauccauc

SEQ ID NO: 24599 - RNA, 20 nt, Artificial Sequence
  MKO10024599_A_Hnrnpll
  gRNA
auucacagagcccucgaaca

SEQ ID NO: 24600 - RNA, 20 nt, Artificial Sequence
  MKO10024600_A_Hnrnpll
  gRNA
gagauacauaccaccguaau

SEQ ID NO: 24601 - RNA, 20 nt, Artificial Sequence
  MKO10024601_A_Hnrnpl
  gRNA
guugucugcagcguaguuua

SEQ ID NO: 24602 - RNA, 20 nt, Artificial Sequence
  MKO10024602_A_Hnrnpl
  gRNA
gaagcacgcuguuuacgcuc

SEQ ID NO: 24603 - RNA, 20 nt, Artificial Sequence
  MKO10024603_A_Hnrnpl
  gRNA
cuuccacuacuccgucaauc

SEQ ID NO: 24604 - RNA, 20 nt, Artificial Sequence
  MKO10024604_A_Hnrnpm
  gRNA
uccguugccgcucggcacgc

SEQ ID NO: 24605 - RNA, 20 nt, Artificial Sequence
  MKO10024605_A_Hnrnpm
  gRNA
cgaagcggcagccgaagugg

SEQ ID NO: 24606 - RNA, 20 nt, Artificial Sequence
  MKO10024606_A_Hnrnpm
  gRNA
gacugccauuucacaucaaa

SEQ ID NO: 24607 - RNA, 20 nt, Artificial Sequence
  MKO10024607_A_Hnrnpr
  gRNA
accuuaccuggacaugagac

SEQ ID NO: 24608 - RNA, 20 nt, Artificial Sequence
  MKO10024608_A_Hnrnpr
  gRNA
ugcgcaggaagcaguuaagc

SEQ ID NO: 24609 - RNA, 20 nt, Artificial Sequence
  MKO10024609_A_Hnrnpr
  gRNA
gcccgaugaagcaaaaauca

SEQ ID NO: 24610 - RNA, 20 nt, Artificial Sequence
  MKO10024610_A_Hnrnpul1
  gRNA
cgcgaaguucguucaccuuc

SEQ ID NO: 24611 - RNA, 20 nt, Artificial Sequence
  MKO10024611_A_Hnrnpul1
  gRNA
gcacucucacaauguccguc

SEQ ID NO: 24612 - RNA, 20 nt, Artificial Sequence
  MKO10024612_A_Hnrnpul1
  gRNA
guacccaccuucgauccucu

SEQ ID NO: 24613 - RNA, 20 nt, Artificial Sequence
  MKO10024613_A_Hnrnpul2
  gRNA
ggaccagacgcuugugaacc

SEQ ID NO: 24614 - RNA, 20 nt, Artificial Sequence
  MKO10024614_A_Hnrnpul2
  gRNA
uguccagguucacaagcguc

SEQ ID NO: 24615 - RNA, 20 nt, Artificial Sequence
  MKO10024615_A_Hnrnpul2
  gRNA
agcuuacuaugaauuccgag

SEQ ID NO: 24616 - RNA, 20 nt, Artificial Sequence
  MKO10024616_A_Hnrnpu
  gRNA
cgaacacuucgaugacacag

SEQ ID NO: 24617 - RNA, 20 nt, Artificial Sequence
  MKO10024617_A_Hnrnpu
  gRNA
accaagcaacauuccacuug

SEQ ID NO: 24618 - RNA, 20 nt, Artificial Sequence
  MKO10024618_A_Hnrnpu
  gRNA
gcuuccuacggugugucaaa

SEQ ID NO: 24619 - RNA, 20 nt, Artificial Sequence
  MKO10024619_A_Hoga1
  gRNA
gugaccccuuguuacuaucg

SEQ ID NO: 24620 - RNA, 20 nt, Artificial Sequence
  MKO10024620_A_Hoga1
  gRNA
gugaacuaucaguccaaucc

SEQ ID NO: 24621 - RNA, 20 nt, Artificial Sequence
  MKO10024621_A_Hoga1
  gRNA
agguagcucuagccccguau

SEQ ID NO: 24622 - RNA, 20 nt, Artificial Sequence
  MKO10024622_A_Homer1
  gRNA
ggaagcugcucggcuugcaa

SEQ ID NO: 24623 - RNA, 20 nt, Artificial Sequence
  MKO10024623_A_Homer1
  gRNA
agccgggcaaacacuguuua

SEQ ID NO: 24624 - RNA, 20 nt, Artificial Sequence
  MKO10024624_A_Homer1
  gRNA
ugagcucgagugcugaagau

SEQ ID NO: 24625 - RNA, 20 nt, Artificial Sequence
  MKO10024625_A_Homer2
  gRNA
gagcaacgcccggcugacca

SEQ ID NO: 24626 - RNA, 20 nt, Artificial Sequence
  MKO10024626_A_Homer2
  gRNA
gccgggcguugcucucccgc

SEQ ID NO: 24627 - RNA, 20 nt, Artificial Sequence
  MKO10024627_A_Homer2
  gRNA
gucgucugugccauugacgc

SEQ ID NO: 24628 - RNA, 20 nt, Artificial Sequence
  MKO10024628_A_Homer3
  gRNA
cacgguaagugcgugcuugc

SEQ ID NO: 24629 - RNA, 20 nt, Artificial Sequence
  MKO10024629_A_Homer3
  gRNA
cgaucuggaauacgugcgcc

SEQ ID NO: 24630 - RNA, 20 nt, Artificial Sequence
  MKO10024630_A_Homer3
  gRNA
gccuaggccguagacagugu

SEQ ID NO: 24631 - RNA, 20 nt, Artificial Sequence
  MKO10024631_A_Homez
  gRNA
auggcccaacgucuccgcug

SEQ ID NO: 24632 - RNA, 20 nt, Artificial Sequence
  MKO10024632_A_Homez
  gRNA
cccaccagauauacgaccuu

SEQ ID NO: 24633 - RNA, 20 nt, Artificial Sequence
  MKO10024633_A_Homez
  gRNA
augaccagcuaaugccgcag

SEQ ID NO: 24634 - RNA, 20 nt, Artificial Sequence
  MKO10024634_A_Hook1
  gRNA
agguugcuucagcuaauucu

SEQ ID NO: 24635 - RNA, 20 nt, Artificial Sequence
  MKO10024635_A_Hook1
  gRNA
aauuacaaguuacuaucaug

SEQ ID NO: 24636 - RNA, 20 nt, Artificial Sequence
  MKO10024636_A_Hook1
  gRNA
agccgaauuaaagaugaugu

SEQ ID NO: 24637 - RNA, 20 nt, Artificial Sequence
  MKO10024637_A_Hook2
  gRNA
cuauggcgaguccgcugcuc

SEQ ID NO: 24638 - RNA, 20 nt, Artificial Sequence
  MKO10024638_A_Hook2
  gRNA
gcgucaccaggucaggaaac

SEQ ID NO: 24639 - RNA, 20 nt, Artificial Sequence
  MKO10024639_A_Hook2
  gRNA
caaacugcuucaguugguac

SEQ ID NO: 24640 - RNA, 20 nt, Artificial Sequence
  MKO10024640_A_Hook3
  gRNA
gccguucguuaaguccuccg

SEQ ID NO: 24641 - RNA, 20 nt, Artificial Sequence
  MKO10024641_A_Hook3
  gRNA
cuguauauuucgacgauaau

SEQ ID NO: 24642 - RNA, 20 nt, Artificial Sequence
  MKO10024642_A_Hook3
  gRNA
caauuaucgucgaaauauac

SEQ ID NO: 24643 - RNA, 20 nt, Artificial Sequence
  MKO10024643_A_Hopx
  gRNA
augucggcgcagaccgcgag

SEQ ID NO: 24644 - RNA, 20 nt, Artificial Sequence
  MKO10024644_A_Hopx
  gRNA
augcagaucuguuacggacu

SEQ ID NO: 24645 - RNA, 20 nt, Artificial Sequence
  MKO10024645_A_Hopx
  gRNA
gcucgcggucugcgccgaca

SEQ ID NO: 24646 - RNA, 20 nt, Artificial Sequence
  MKO10024646_A_Hormad1
  gRNA
ucuugcaucaccuauuugag

SEQ ID NO: 24647 - RNA, 20 nt, Artificial Sequence
  MKO10024647_A_Hormad1
  gRNA
augcucaguugauaucuuau

SEQ ID NO: 24648 - RNA, 20 nt, Artificial Sequence
  MKO10024648_A_Hormad1
  gRNA
uucacuagcugugaagaacc

SEQ ID NO: 24649 - RNA, 20 nt, Artificial Sequence
  MKO10024649_A_Hormad2
  gRNA
cuccuacagagaccgccguu

SEQ ID NO: 24650 - RNA, 20 nt, Artificial Sequence
  MKO10024650_A_Hormad2
  gRNA
ucucauguauaacguaccug

SEQ ID NO: 24651 - RNA, 20 nt, Artificial Sequence
  MKO10024651_A_Hormad2
  gRNA
uuaauaauauguaaugaccc

SEQ ID NO: 24652 - RNA, 20 nt, Artificial Sequence
  MKO10024652_A_Hoxa10
  gRNA
gaugagcgagucgaccaaaa

SEQ ID NO: 24653 - RNA, 20 nt, Artificial Sequence
  MKO10024653_A_Hoxa10
  gRNA
cguaaugaagcgccgucgcc

SEQ ID NO: 24654 - RNA, 20 nt, Artificial Sequence
  MKO10024654_A_Hoxa10
  gRNA
cagccguagcguccaccuca

SEQ ID NO: 24655 - RNA, 20 nt, Artificial Sequence
  MKO10024655_A_Hoxa11
  gRNA
acuucaaguucggacggcgg

SEQ ID NO: 24656 - RNA, 20 nt, Artificial Sequence
  MKO10024656_A_Hoxa11
  gRNA
uuuauacgcaccggagccac

SEQ ID NO: 24657 - RNA, 20 nt, Artificial Sequence
  MKO10024657_A_Hoxa11
  gRNA
caaauaccagauccgagagc

SEQ ID NO: 24658 - RNA, 20 nt, Artificial Sequence
  MKO10024658_A_Hoxa13
  gRNA
cgcgcacgacuugauggcgu

SEQ ID NO: 24659 - RNA, 20 nt, Artificial Sequence
  MKO10024659_A_Hoxa13
  gRNA
cuacuacccgugcgcccgca

SEQ ID NO: 24660 - RNA, 20 nt, Artificial Sequence
  MKO10024660_A_Hoxa13
  gRNA
gaagcgcgugccuuacacua

SEQ ID NO: 24661 - RNA, 20 nt, Artificial Sequence
  MKO10024661_A_Hoxa1
  gRNA
gggguaagcucgcgccgagc

SEQ ID NO: 24662 - RNA, 20 nt, Artificial Sequence
  MKO10024662_A_Hoxa1
  gRNA
ccacccugcgcgcucgugua

SEQ ID NO: 24663 - RNA, 20 nt, Artificial Sequence
  MKO10024663_A_Hoxa1
  gRNA
aguaccuuacacgagcgcgc

SEQ ID NO: 24664 - RNA, 20 nt, Artificial Sequence
  MKO10024664_A_Hoxa2
  gRNA
ugucgagugugaaagcgucg

SEQ ID NO: 24665 - RNA, 20 nt, Artificial Sequence
  MKO10024665_A_Hoxa2
  gRNA
guacgcgguucucagacgcc

SEQ ID NO: 24666 - RNA, 20 nt, Artificial Sequence
  MKO10024666_A_Hoxa2
  gRNA
agucacccucgccacggcgc

SEQ ID NO: 24667 - RNA, 20 nt, Artificial Sequence
  MKO10024667_A_Hoxa3
  gRNA
auacgcgccguccgccgcuc

SEQ ID NO: 24668 - RNA, 20 nt, Artificial Sequence
  MKO10024668_A_Hoxa3
  gRNA
ucgaugguacucaacgccau

SEQ ID NO: 24669 - RNA, 20 nt, Artificial Sequence
  MKO10024669_A_Hoxa3
  gRNA
gccauggacuacgggggcac

SEQ ID NO: 24670 - RNA, 20 nt, Artificial Sequence
  MKO10024670_A_Hoxa4
  gRNA
cccccgcuuacuacgcgccg

SEQ ID NO: 24671 - RNA, 20 nt, Artificial Sequence
  MKO10024671_A_Hoxa4
  gRNA
gcucucgaaccgccuauacc

SEQ ID NO: 24672 - RNA, 20 nt, Artificial Sequence
  MKO10024672_A_Hoxa4
  gRNA
gccacauaccggcgcucacg

SEQ ID NO: 24673 - RNA, 20 nt, Artificial Sequence
  MKO10024673_A_Hoxa5
  gRNA
cgagcgcgcccgcagcuacg

SEQ ID NO: 24674 - RNA, 20 nt, Artificial Sequence
  MKO10024674_A_Hoxa5
  gRNA
gcuaccugacccgccgaaga

SEQ ID NO: 24675 - RNA, 20 nt, Artificial Sequence
  MKO10024675_A_Hoxa5
  gRNA
uggcacggcguccgcagccg

SEQ ID NO: 24676 - RNA, 20 nt, Artificial Sequence
  MKO10024676_A_Hoxa6
  gRNA
uuacggggcgucgagucuuc

SEQ ID NO: 24677 - RNA, 20 nt, Artificial Sequence
  MKO10024677_A_Hoxa6
  gRNA
aagacucgacgccccguaag

SEQ ID NO: 24678 - RNA, 20 nt, Artificial Sequence
  MKO10024678_A_Hoxa6
  gRNA
uggagucuacucgcccgcuu

SEQ ID NO: 24679 - RNA, 20 nt, Artificial Sequence
  MKO10024679_A_Hoxa7
  gRNA
cgccugcgacaaggcggacg

SEQ ID NO: 24680 - RNA, 20 nt, Artificial Sequence
  MKO10024680_A_Hoxa7
  gRNA
uaucagagccccuucgcguc

SEQ ID NO: 24681 - RNA, 20 nt, Artificial Sequence
  MKO10024681_A_Hoxa7
  gRNA
acggagggcaccgcgucuuc

SEQ ID NO: 24682 - RNA, 20 nt, Artificial Sequence
  MKO10024682_A_Hoxa9
  gRNA
acggcagguauaugcgcucc

SEQ ID NO: 24683 - RNA, 20 nt, Artificial Sequence
  MKO10024683_A_Hoxa9
  gRNA
cggcgguguuuggugccucg

SEQ ID NO: 24684 - RNA, 20 nt, Artificial Sequence
  MKO10024684_A_Hoxa9
  gRNA
ggggcaucgcuucuuccgag

SEQ ID NO: 24685 - RNA, 20 nt, Artificial Sequence
  MKO10024685_A_Hoxb13
  gRNA
ucccggguagcccggauaga

SEQ ID NO: 24686 - RNA, 20 nt, Artificial Sequence
  MKO10024686_A_Hoxb13
  gRNA
gccgcgggauggcuagccag

SEQ ID NO: 24687 - RNA, 20 nt, Artificial Sequence
  MKO10024687_A_Hoxb13
  gRNA
cggaaggcacagccgucggg

SEQ ID NO: 24688 - RNA, 20 nt, Artificial Sequence
  MKO10024688_A_Hoxb1
  gRNA
gaaguuugugcggagaccgc

SEQ ID NO: 24689 - RNA, 20 nt, Artificial Sequence
  MKO10024689_A_Hoxb1
  gRNA
uacgcaggggagagccgcua

SEQ ID NO: 24690 - RNA, 20 nt, Artificial Sequence
  MKO10024690_A_Hoxb1
  gRNA
gguggagaucgccgccaccc

SEQ ID NO: 24691 - RNA, 20 nt, Artificial Sequence
  MKO10024691_A_Hoxb2
  gRNA
uccgaggucggaucaccauc

SEQ ID NO: 24692 - RNA, 20 nt, Artificial Sequence
  MKO10024692_A_Hoxb2
  gRNA
cgggcgacgucgcgacucac

SEQ ID NO: 24693 - RNA, 20 nt, Artificial Sequence
  MKO10024693_A_Hoxb2
  gRNA
gcagcgaucucgacgcgacg

SEQ ID NO: 24694 - RNA, 20 nt, Artificial Sequence
  MKO10024694_A_Hoxb3
  gRNA
ucauacuccgacgccggggu

SEQ ID NO: 24695 - RNA, 20 nt, Artificial Sequence
  MKO10024695_A_Hoxb3
  gRNA
cauguggggcggcguugccc

SEQ ID NO: 24696 - RNA, 20 nt, Artificial Sequence
  MKO10024696_A_Hoxb3
  gRNA
ggggcgccgcaacccuuaag

SEQ ID NO: 24697 - RNA, 20 nt, Artificial Sequence
  MKO10024697_A_Hoxb4
  gRNA
cggcguaguacccgggcgag

SEQ ID NO: 24698 - RNA, 20 nt, Artificial Sequence
  MKO10024698_A_Hoxb4
  gRNA
ccaguaaaccccaauuacgc

SEQ ID NO: 24699 - RNA, 20 nt, Artificial Sequence
  MKO10024699_A_Hoxb4
  gRNA
cuuggggggcacuagagcgc

SEQ ID NO: 24700 - RNA, 20 nt, Artificial Sequence
  MKO10024700_A_Hoxb5
  gRNA
cgaucucgauacgucgccgc

SEQ ID NO: 24701 - RNA, 20 nt, Artificial Sequence
  MKO10024701_A_Hoxb5
  gRNA
auuuggauaacgccccgaga

SEQ ID NO: 24702 - RNA, 20 nt, Artificial Sequence
  MKO10024702_A_Hoxb5
  gRNA
uagcuggcucgccgcuuccu

SEQ ID NO: 24703 - RNA, 20 nt, Artificial Sequence
  MKO10024703_A_Hoxb6
  gRNA
gcgcaaguccgacugcgcac

SEQ ID NO: 24704 - RNA, 20 nt, Artificial Sequence
  MKO10024704_A_Hoxb6
  gRNA
cggcacuaccccgcgccuua

SEQ ID NO: 24705 - RNA, 20 nt, Artificial Sequence
  MKO10024705_A_Hoxb6
  gRNA
ccgaccgcugggcccaaaag

SEQ ID NO: 24706 - RNA, 20 nt, Artificial Sequence
  MKO10024706_A_Hoxb7
  gRNA
ggcgucuaugcggccggcua

SEQ ID NO: 24707 - RNA, 20 nt, Artificial Sequence
  MKO10024707_A_Hoxb7
  gRNA
cauagacgccagccgcgcuc

SEQ ID NO: 24708 - RNA, 20 nt, Artificial Sequence
  MKO10024708_A_Hoxb7
  gRNA
guagggccugaccgaaagcg

SEQ ID NO: 24709 - RNA, 20 nt, Artificial Sequence
  MKO10024709_A_Hoxb8
  gRNA
gaucgagguaucgcacgcgc

SEQ ID NO: 24710 - RNA, 20 nt, Artificial Sequence
  MKO10024710_A_Hoxb8
  gRNA
cgccccaauuauuaugacug

SEQ ID NO: 24711 - RNA, 20 nt, Artificial Sequence
  MKO10024711_A_Hoxb8
  gRNA
ucccagcaguaaaugcgagc

SEQ ID NO: 24712 - RNA, 20 nt, Artificial Sequence
  MKO10024712_A_Hoxb9
  gRNA
ggcgccgaacaccggcgcuu

SEQ ID NO: 24713 - RNA, 20 nt, Artificial Sequence
  MKO10024713_A_Hoxb9
  gRNA
agguaccugcuuucggccgc

SEQ ID NO: 24714 - RNA, 20 nt, Artificial Sequence
  MKO10024714_A_Hoxb9
  gRNA
agagcgggcgugcagccagu

SEQ ID NO: 24715 - RNA, 20 nt, Artificial Sequence
  MKO10024715_A_Hoxc10
  gRNA
aagggcuccgcguacgaguu

SEQ ID NO: 24716 - RNA, 20 nt, Artificial Sequence
  MKO10024716_A_Hoxc10
  gRNA
gagcgcuauaaccguaacgc

SEQ ID NO: 24717 - RNA, 20 nt, Artificial Sequence
  MKO10024717_A_Hoxc10
  gRNA
uuugacgcgagagcgccgcc

SEQ ID NO: 24718 - RNA, 20 nt, Artificial Sequence
  MKO10024718_A_Hoxc11
  gRNA
cggccgacgagcuuaugcac

SEQ ID NO: 24719 - RNA, 20 nt, Artificial Sequence
  MKO10024719_A_Hoxc11
  gRNA
cgaagaagcggucgaaagcu

SEQ ID NO: 24720 - RNA, 20 nt, Artificial Sequence
  MKO10024720_A_Hoxc11
  gRNA
cuuauucgaaauuccagauc

SEQ ID NO: 24721 - RNA, 20 nt, Artificial Sequence
  MKO10024721_A_Hoxc12
  gRNA
uuccccaacuuccgcgcguc

SEQ ID NO: 24722 - RNA, 20 nt, Artificial Sequence
  MKO10024722_A_Hoxc12
  gRNA
ccgucggccgagccgugcaa

SEQ ID NO: 24723 - RNA, 20 nt, Artificial Sequence
  MKO10024723_A_Hoxc12
  gRNA
gccguauucgaaguugcagc

SEQ ID NO: 24724 - RNA, 20 nt, Artificial Sequence
  MKO10024724_A_Hoxc13
  gRNA
gacgcgcucaucccuguuga

SEQ ID NO: 24725 - RNA, 20 nt, Artificial Sequence
  MKO10024725_A_Hoxc13
  gRNA
gcgccaaugcgccccaccgc

SEQ ID NO: 24726 - RNA, 20 nt, Artificial Sequence
  MKO10024726_A_Hoxc13
  gRNA
gaagcgcgugcccuauacca

SEQ ID NO: 24727 - RNA, 20 nt, Artificial Sequence
  MKO10024727_A_Hoxc4
  gRNA
aucgcagccgcucugcgagc

SEQ ID NO: 24728 - RNA, 20 nt, Artificial Sequence
  MKO10024728_A_Hoxc4
  gRNA
gugcagcuauacugacgcuc

SEQ ID NO: 24729 - RNA, 20 nt, Artificial Sequence
  MKO10024729_A_Hoxc4
  gRNA
uccaaaaccgucguaugaaa

SEQ ID NO: 24730 - RNA, 20 nt, Artificial Sequence
  MKO10024730_A_Hoxc5
  gRNA
cuaugcgccugcggcgagug

SEQ ID NO: 24731 - RNA, 20 nt, Artificial Sequence
  MKO10024731_A_Hoxc5
  gRNA
ccccgccacagauuuacccg

SEQ ID NO: 24732 - RNA, 20 nt, Artificial Sequence
  MKO10024732_A_Hoxc5
  gRNA
cucguugagacacaaguugu

SEQ ID NO: 24733 - RNA, 20 nt, Artificial Sequence
  MKO10024733_A_Hoxc6
  gRNA
cauuggcgaucucgaugcgc

SEQ ID NO: 24734 - RNA, 20 nt, Artificial Sequence
  MKO10024734_A_Hoxc6
  gRNA
ggaucucuaggggucgguua

SEQ ID NO: 24735 - RNA, 20 nt, Artificial Sequence
  MKO10024735_A_Hoxc6
  gRNA
gguggaauugagggcgacgu

SEQ ID NO: 24736 - RNA, 20 nt, Artificial Sequence
  MKO10024736_A_Hoxc8
  gRNA
gacuucaauccggcgcuuuc

SEQ ID NO: 24737 - RNA, 20 nt, Artificial Sequence
  MKO10024737_A_Hoxc8
  gRNA
aaccggcagucguaauaggc

SEQ ID NO: 24738 - RNA, 20 nt, Artificial Sequence
  MKO10024738_A_Hoxc8
  gRNA
aaccggccuauuacgacugc

SEQ ID NO: 24739 - RNA, 20 nt, Artificial Sequence
  MKO10024739_A_Hoxc9
  gRNA
aguccgcauguagcgcgugu

SEQ ID NO: 24740 - RNA, 20 nt, Artificial Sequence
  MKO10024740_A_Hoxc9
  gRNA
gcgccgacacgcgcuacaug

SEQ ID NO: 24741 - RNA, 20 nt, Artificial Sequence
  MKO10024741_A_Hoxc9
  gRNA
ggauccacgcccguuccaca

SEQ ID NO: 24742 - RNA, 20 nt, Artificial Sequence
  MKO10024742_A_Hoxd10
  gRNA
gaguacaauaacagccccga

SEQ ID NO: 24743 - RNA, 20 nt, Artificial Sequence
  MKO10024743_A_Hoxd10
  gRNA
ugcggcuuggccgcgccacg

SEQ ID NO: 24744 - RNA, 20 nt, Artificial Sequence
  MKO10024744_A_Hoxd10
  gRNA
agagcguuaaccucaccgac

SEQ ID NO: 24745 - RNA, 20 nt, Artificial Sequence
  MKO10024745_A_Hoxd11
  gRNA
acggccacuuggcgcgcucc

SEQ ID NO: 24746 - RNA, 20 nt, Artificial Sequence
  MKO10024746_A_Hoxd11
  gRNA
gcacucgucaaagucguuca

SEQ ID NO: 24747 - RNA, 20 nt, Artificial Sequence
  MKO10024747_A_Hoxd11
  gRNA
caaguaccagauccgcgaac

SEQ ID NO: 24748 - RNA, 20 nt, Artificial Sequence
  MKO10024748_A_Hoxd12
  gRNA
ucggguccguccuuggcgcc

SEQ ID NO: 24749 - RNA, 20 nt, Artificial Sequence
  MKO10024749_A_Hoxd12
  gRNA
cgcggccaacuggcugccau

SEQ ID NO: 24750 - RNA, 20 nt, Artificial Sequence
  MKO10024750_A_Hoxd12
  gRNA
cccgcuucuucuucauacgc

SEQ ID NO: 24751 - RNA, 20 nt, Artificial Sequence
  MKO10024751_A_Hoxd13
  gRNA
ugugaucgccacucgccccg

SEQ ID NO: 24752 - RNA, 20 nt, Artificial Sequence
  MKO10024752_A_Hoxd13
  gRNA
caaagagugucccgcgccag

SEQ ID NO: 24753 - RNA, 20 nt, Artificial Sequence
  MKO10024753_A_Hoxd13
  gRNA
uugucucuccgaaagguucg

SEQ ID NO: 24754 - RNA, 20 nt, Artificial Sequence
  MKO10024754_A_Hoxd1
  gRNA
uacgugucgugcgccgcggg

SEQ ID NO: 24755 - RNA, 20 nt, Artificial Sequence
  MKO10024755_A_Hoxd1
  gRNA
gggguaggcggcgacgugcu

SEQ ID NO: 24756 - RNA, 20 nt, Artificial Sequence
  MKO10024756_A_Hoxd1
  gRNA
cgaugcgucgggcucuaguu

SEQ ID NO: 24757 - RNA, 20 nt, Artificial Sequence
  MKO10024757_A_Hoxd3
  gRNA
aguugcgccgcgcaaauccc

SEQ ID NO: 24758 - RNA, 20 nt, Artificial Sequence
  MKO10024758_A_Hoxd3
  gRNA
gccgccgccguugcucgcca

SEQ ID NO: 24759 - RNA, 20 nt, Artificial Sequence
  MKO10024759_A_Hoxd3
  gRNA
aaugguagcuguaugagacc

SEQ ID NO: 24760 - RNA, 20 nt, Artificial Sequence
  MKO10024760_A_Hoxd4
  gRNA
ugcaccgcugccguaguagu

SEQ ID NO: 24761 - RNA, 20 nt, Artificial Sequence
  MKO10024761_A_Hoxd4
  gRNA
ugugagcgauuucaauccga

SEQ ID NO: 24762 - RNA, 20 nt, Artificial Sequence
  MKO10024762_A_Hoxd4
  gRNA
cucuacccacggcccgacuu

SEQ ID NO: 24763 - RNA, 20 nt, Artificial Sequence
  MKO10024763_A_Hoxd8
  gRNA
aucguauccguaaaacuucg

SEQ ID NO: 24764 - RNA, 20 nt, Artificial Sequence
  MKO10024764_A_Hoxd8
  gRNA
gugacaggcaaucccgccgc

SEQ ID NO: 24765 - RNA, 20 nt, Artificial Sequence
  MKO10024765_A_Hoxd8
  gRNA
ucgcuuccaaacccuagagu

SEQ ID NO: 24766 - RNA, 20 nt, Artificial Sequence
  MKO10024766_A_Hoxd9
  gRNA
gcguacguagcgucccggcu

SEQ ID NO: 24767 - RNA, 20 nt, Artificial Sequence
  MKO10024767_A_Hoxd9
  gRNA
cgaacaccucgucgcccuca

SEQ ID NO: 24768 - RNA, 20 nt, Artificial Sequence
  MKO10024768_A_Hoxd9
  gRNA
uccuggccaccucguagcgc

SEQ ID NO: 24769 - RNA, 20 nt, Artificial Sequence
  MKO10024769_A_Hp1bp3
  gRNA
cuuucgaaucgcaaccaccg

SEQ ID NO: 24770 - RNA, 20 nt, Artificial Sequence
  MKO10024770_A_Hp1bp3
  gRNA
aguuaagauugcguccaucu

SEQ ID NO: 24771 - RNA, 20 nt, Artificial Sequence
  MKO10024771_A_Hp1bp3
  gRNA
gucgagccgugaauucuacc

SEQ ID NO: 24772 - RNA, 20 nt, Artificial Sequence
  MKO10024772_A_Hpcal1
  gRNA
ugaauuccguguguucccgc

SEQ ID NO: 24773 - RNA, 20 nt, Artificial Sequence
  MKO10024773_A_Hpcal1
  gRNA
uuuagcauguacgaccugga

SEQ ID NO: 24774 - RNA, 20 nt, Artificial Sequence
  MKO10024774_A_Hpcal1
  gRNA
ucccucaggcaaacuguccc

SEQ ID NO: 24775 - RNA, 20 nt, Artificial Sequence
  MKO10024775_A_Hpcal4
  gRNA
ugacggccgcaucacacggc

SEQ ID NO: 24776 - RNA, 20 nt, Artificial Sequence
  MKO10024776_A_Hpcal4
  gRNA
ugaacuccuccagcguaauc

SEQ ID NO: 24777 - RNA, 20 nt, Artificial Sequence
  MKO10024777_A_Hpcal4
  gRNA
uuugagauguacgaucugga

SEQ ID NO: 24778 - RNA, 20 nt, Artificial Sequence
  MKO10024778_A_Hpca
  gRNA
aaacuuggaggcgucgccau

SEQ ID NO: 24779 - RNA, 20 nt, Artificial Sequence
  MKO10024779_A_Hpca
  gRNA
augagucgaccccggaaaag

SEQ ID NO: 24780 - RNA, 20 nt, Artificial Sequence
  MKO10024780_A_Hpca
  gRNA
caauggcuacaucagccggg

SEQ ID NO: 24781 - RNA, 20 nt, Artificial Sequence
  MKO10024781_A_Hpdl
  gRNA
gcuccccuaugcuuaugcgc

SEQ ID NO: 24782 - RNA, 20 nt, Artificial Sequence
  MKO10024782_A_Hpdl
  gRNA
auuauucggcggagucugca

SEQ ID NO: 24783 - RNA, 20 nt, Artificial Sequence
  MKO10024783_A_Hpdl
  gRNA
cagcacgcugcagcaacgua

SEQ ID NO: 24784 - RNA, 20 nt, Artificial Sequence
  MKO10024784_A_Hpd
  gRNA
cuuucccuugcuugaugacg

SEQ ID NO: 24785 - RNA, 20 nt, Artificial Sequence
  MKO10024785_A_Hpd
  gRNA
ccuagagacuggcucccggg

SEQ ID NO: 24786 - RNA, 20 nt, Artificial Sequence
  MKO10024786_A_Hpd
  gRNA
auuuccacucggugaccuuc

SEQ ID NO: 24787 - RNA, 20 nt, Artificial Sequence
  MKO10024787_A_Hpgds
  gRNA
ucaaauaucuugcuauugcg

SEQ ID NO: 24788 - RNA, 20 nt, Artificial Sequence
  MKO10024788_A_Hpgds
  gRNA
guuggauaucuaccccaaac

SEQ ID NO: 24789 - RNA, 20 nt, Artificial Sequence
  MKO10024789_A_Hpgds
  gRNA
guuccguaaugacaccaguu

SEQ ID NO: 24790 - RNA, 20 nt, Artificial Sequence
  MKO10024790_A_Hpgd
  gRNA
aaauauccaaucuuccgaaa

SEQ ID NO: 24791 - RNA, 20 nt, Artificial Sequence
  MKO10024791_A_Hpgd
  gRNA
guuuauugugcuucgaagca

SEQ ID NO: 24792 - RNA, 20 nt, Artificial Sequence
  MKO10024792_A_Hpgd
  gRNA
ugcuucgaagcacaauaaac

SEQ ID NO: 24793 - RNA, 20 nt, Artificial Sequence
  MKO10024793_A_Hpn
  gRNA
agucccugacauggcgaagg

SEQ ID NO: 24794 - RNA, 20 nt, Artificial Sequence
  MKO10024794_A_Hpn
  gRNA
accgcaagccgugagucccc

SEQ ID NO: 24795 - RNA, 20 nt, Artificial Sequence
  MKO10024795_A_Hpn
  gRNA
acgcggccccaaugccuguc

SEQ ID NO: 24796 - RNA, 20 nt, Artificial Sequence
  MKO10024796_A_Hprt
  gRNA
cagauuagcgaugaugaacc

SEQ ID NO: 24797 - RNA, 20 nt, Artificial Sequence
  MKO10024797_A_Hprt
  gRNA
uauaccuaaucauuaugccg

SEQ ID NO: 24798 - RNA, 20 nt, Artificial Sequence
  MKO10024798_A_Hprt
  gRNA
gugcuuuaauguaauccagc

SEQ ID NO: 24799 - RNA, 20 nt, Artificial Sequence
  MKO10024799_A_Hps1
  gRNA
cgaugcucuguucgcagagc

SEQ ID NO: 24800 - RNA, 20 nt, Artificial Sequence
  MKO10024800_A_Hps1
  gRNA
uaccuguucgucgccaucaa

SEQ ID NO: 24801 - RNA, 20 nt, Artificial Sequence
  MKO10024801_A_Hps1
  gRNA
ugugcucaaguaucuauucg

SEQ ID NO: 24802 - RNA, 20 nt, Artificial Sequence
  MKO10024802_A_Hps3
  gRNA
cgggagcgacgcgcuguucg

SEQ ID NO: 24803 - RNA, 20 nt, Artificial Sequence
  MKO10024803_A_Hps3
  gRNA
cuguacaaccugcacccguu

SEQ ID NO: 24804 - RNA, 20 nt, Artificial Sequence
  MKO10024804_A_Hps3
  gRNA
cugcuacccauucaccaaag

SEQ ID NO: 24805 - RNA, 20 nt, Artificial Sequence
  MKO10024805_A_Hps4
  gRNA
gaagauccugugcgauucgc

SEQ ID NO: 24806 - RNA, 20 nt, Artificial Sequence
  MKO10024806_A_Hps4
  gRNA
cgcccaugcucauccguaug

SEQ ID NO: 24807 - RNA, 20 nt, Artificial Sequence
  MKO10024807_A_Hps4
  gRNA
cugcuacuucuauccgcccc

SEQ ID NO: 24808 - RNA, 20 nt, Artificial Sequence
  MKO10024808_A_Hps5
  gRNA
ugguuggcguuaggcagcac

SEQ ID NO: 24809 - RNA, 20 nt, Artificial Sequence
  MKO10024809_A_Hps5
  gRNA
gaagcucacccucagacgac

SEQ ID NO: 24810 - RNA, 20 nt, Artificial Sequence
  MKO10024810_A_Hps5
  gRNA
gaauuaaaucaagagcgucg

SEQ ID NO: 24811 - RNA, 20 nt, Artificial Sequence
  MKO10024811_A_Hps6
  gRNA
uugcggccacggccaucacg

SEQ ID NO: 24812 - RNA, 20 nt, Artificial Sequence
  MKO10024812_A_Hps6
  gRNA
ggucccccgccaacaacucg

SEQ ID NO: 24813 - RNA, 20 nt, Artificial Sequence
  MKO10024813_A_Hps6
  gRNA
uaccucgaaggcuccgacgc

SEQ ID NO: 24814 - RNA, 20 nt, Artificial Sequence
  MKO10024814_A_Hpse2
  gRNA
guccgauguuggggccguac

SEQ ID NO: 24815 - RNA, 20 nt, Artificial Sequence
  MKO10024815_A_Hpse2
  gRNA
ucgcccgccuuucugcgcuu

SEQ ID NO: 24816 - RNA, 20 nt, Artificial Sequence
  MKO10024816_A_Hpse2
  gRNA
gucguaaucccaauaacucc

SEQ ID NO: 24817 - RNA, 20 nt, Artificial Sequence
  MKO10024817_A_Hpse
  gRNA
acgcauuuagaccaaagauc

SEQ ID NO: 24818 - RNA, 20 nt, Artificial Sequence
  MKO10024818_A_Hpse
  gRNA
gagcuguuccaccguaaguc

SEQ ID NO: 24819 - RNA, 20 nt, Artificial Sequence
  MKO10024819_A_Hpse
  gRNA
ccuuguccggaucaaaaaua

SEQ ID NO: 24820 - RNA, 20 nt, Artificial Sequence
  MKO10024820_A_Hpx
  gRNA
cccgggaguugaucucagcg

SEQ ID NO: 24821 - RNA, 20 nt, Artificial Sequence
  MKO10024821_A_Hpx
  gRNA
gagcuuugaugcugcgacca

SEQ ID NO: 24822 - RNA, 20 nt, Artificial Sequence
  MKO10024822_A_Hpx
  gRNA
ggucgcagcaucaaagcucc

SEQ ID NO: 24823 - RNA, 20 nt, Artificial Sequence
  MKO10024823_A_Hp
  gRNA
acugccggcgucaccguagc

SEQ ID NO: 24824 - RNA, 20 nt, Artificial Sequence
  MKO10024824_A_Hp
  gRNA
uggcugacgccgucucgcug

SEQ ID NO: 24825 - RNA, 20 nt, Artificial Sequence
  MKO10024825_A_Hp
  gRNA
ccauugcuucucgucguuua

SEQ ID NO: 24826 - RNA, 20 nt, Artificial Sequence
  MKO10024826_A_Hrasls5
  gRNA
gcaagaccgccgauuagaac

SEQ ID NO: 24827 - RNA, 20 nt, Artificial Sequence
  MKO10024827_A_Hrasls5
  gRNA
uggcacauaccugccgcugc

SEQ ID NO: 24828 - RNA, 20 nt, Artificial Sequence
  MKO10024828_A_Hrasls5
  gRNA
agcgaguucucaagcgcugu

SEQ ID NO: 24829 - RNA, 20 nt, Artificial Sequence
  MKO10024829_A_Hrasls
  gRNA
uucuaggccaaccgagcaau

SEQ ID NO: 24830 - RNA, 20 nt, Artificial Sequence
  MKO10024830_A_Hrasls
  gRNA
gugaucaacauugcaccuau

SEQ ID NO: 24831 - RNA, 20 nt, Artificial Sequence
  MKO10024831_A_Hrasls
  gRNA
caacggucagaguucgcuau

SEQ ID NO: 24832 - RNA, 20 nt, Artificial Sequence
  MKO10024832_A_Hras
  gRNA
cgaguaugaucccacuauag

SEQ ID NO: 24833 - RNA, 20 nt, Artificial Sequence
  MKO10024833_A_Hras
  gRNA
caggaccuugcucgcagcua

SEQ ID NO: 24834 - RNA, 20 nt, Artificial Sequence
  MKO10024834_A_Hras
  gRNA
ggaugccauagcugcgagca

SEQ ID NO: 24835 - RNA, 20 nt, Artificial Sequence
  MKO10024835_A_Hrcu1
  gRNA
gaaaccgaguccgacaagcc

SEQ ID NO: 24836 - RNA, 20 nt, Artificial Sequence
  MKO10024836_A_Hrcu1
  gRNA
gugguggugaacgcccacac

SEQ ID NO: 24837 - RNA, 20 nt, Artificial Sequence
  MKO10024837_A_Hrcu1
  gRNA
cgccggccauggaagagucg

SEQ ID NO: 24838 - RNA, 20 nt, Artificial Sequence
  MKO10024838_A_Hrc
  gRNA
aguacgaaaauuaccagcca

SEQ ID NO: 24839 - RNA, 20 nt, Artificial Sequence
  MKO10024839_A_Hrc
  gRNA
auucugcuaccucuguccgc

SEQ ID NO: 24840 - RNA, 20 nt, Artificial Sequence
  MKO10024840_A_Hrc
  gRNA
ugugacacgcucugcacucc

SEQ ID NO: 24841 - RNA, 20 nt, Artificial Sequence
  MKO10024841_A_Hrg
  gRNA
uucagcacuucgcaauacca

SEQ ID NO: 24842 - RNA, 20 nt, Artificial Sequence
  MKO10024842_A_Hrg
  gRNA
ucucaagaucuuagcgugaa

SEQ ID NO: 24843 - RNA, 20 nt, Artificial Sequence
  MKO10024843_A_Hrg
  gRNA
auuucagauugccaccucga

SEQ ID NO: 24844 - RNA, 20 nt, Artificial Sequence
  MKO10024844_A_Hrh1
  gRNA
ccgucaagagacccuacugg

SEQ ID NO: 24845 - RNA, 20 nt, Artificial Sequence
  MKO10024845_A_Hrh1
  gRNA
ugagcgcaagcuacacaccg

SEQ ID NO: 24846 - RNA, 20 nt, Artificial Sequence
  MKO10024846_A_Hrh1
  gRNA
ugacgacugccccuacaauc

SEQ ID NO: 24847 - RNA, 20 nt, Artificial Sequence
  MKO10024847_A_Hrh2
  gRNA
uggucgaggguaucguccua

SEQ ID NO: 24848 - RNA, 20 nt, Artificial Sequence
  MKO10024848_A_Hrh2
  gRNA
gguccgugacagcgcaguag

SEQ ID NO: 24849 - RNA, 20 nt, Artificial Sequence
  MKO10024849_A_Hrh2
  gRNA
ugggaacuuggauucaucac

SEQ ID NO: 24850 - RNA, 20 nt, Artificial Sequence
  MKO10024850_A_Hrh3
  gRNA
gccgaagacgagugcgccuc

SEQ ID NO: 24851 - RNA, 20 nt, Artificial Sequence
  MKO10024851_A_Hrh3
  gRNA
cgcacucgucuucggcugga

SEQ ID NO: 24852 - RNA, 20 nt, Artificial Sequence
  MKO10024852_A_Hrh3
  gRNA
cgacgcguucaucagcccgu

SEQ ID NO: 24853 - RNA, 20 nt, Artificial Sequence
  MKO10024853_A_Hrh4
  gRNA
aaagugcagcgcuucgccaa

SEQ ID NO: 24854 - RNA, 20 nt, Artificial Sequence
  MKO10024854_A_Hrh4
  gRNA
ugcacuuuccgaucgccaga

SEQ ID NO: 24855 - RNA, 20 nt, Artificial Sequence
  MKO10024855_A_Hrh4
  gRNA
augucggagucuaacaguac

SEQ ID NO: 24856 - RNA, 20 nt, Artificial Sequence
  MKO10024856_A_Hrk
  gRNA
agcgucgccgcaaccgcaca

SEQ ID NO: 24857 - RNA, 20 nt, Artificial Sequence
  MKO10024857_A_Hrk
  gRNA
cgcgggcccccggccgugug

SEQ ID NO: 24858 - RNA, 20 nt, Artificial Sequence
  MKO10024858_A_Hrk
  gRNA
agcugcaccgacgcgccaug

SEQ ID NO: 24859 - RNA, 20 nt, Artificial Sequence
  MKO10024859_A_Hrnr
  gRNA
ugcggacaaggcaagucuuc

SEQ ID NO: 24860 - RNA, 20 nt, Artificial Sequence
  MKO10024860_A_Hrnr
  gRNA
ucuagucaugaauuagaauc

SEQ ID NO: 24861 - RNA, 20 nt, Artificial Sequence
  MKO10024861_A_Hrnr
  gRNA
ugcucauaaguagacugacu

SEQ ID NO: 24862 - RNA, 20 nt, Artificial Sequence
  MKO10024862_A_Hrsp12
  gRNA
cucuggguaaagcagcgacu

SEQ ID NO: 24863 - RNA, 20 nt, Artificial Sequence
  MKO10024863_A_Hrsp12
  gRNA
gcaggcugugacuucaauaa

SEQ ID NO: 24864 - RNA, 20 nt, Artificial Sequence
  MKO10024864_A_Hrsp12
  gRNA
gaccauuuacauuucuggac

SEQ ID NO: 24865 - RNA, 20 nt, Artificial Sequence
  MKO10024865_A_Hr
  gRNA
ucggaacaguuugagugccc

SEQ ID NO: 24866 - RNA, 20 nt, Artificial Sequence
  MKO10024866_A_Hr
  gRNA
guagccuguggucgcauagc

SEQ ID NO: 24867 - RNA, 20 nt, Artificial Sequence
  MKO10024867_A_Hr
  gRNA
uuccgaguggcgugugagcc

SEQ ID NO: 24868 - RNA, 20 nt, Artificial Sequence
  MKO10024868_A_Hs1bp3
  gRNA
agaccuaccgcaugauaccc

SEQ ID NO: 24869 - RNA, 20 nt, Artificial Sequence
  MKO10024869_A_Hs1bp3
  gRNA
uaaaaaauacagcgagaucg

SEQ ID NO: 24870 - RNA, 20 nt, Artificial Sequence
  MKO10024870_A_Hs1bp3
  gRNA
ugucagacuccccgacaaac

SEQ ID NO: 24871 - RNA, 20 nt, Artificial Sequence
  MKO10024871_A_Hs2st1
  gRNA
uauggcgcuguucaauuucu

SEQ ID NO: 24872 - RNA, 20 nt, Artificial Sequence
  MKO10024872_A_Hs2st1
  gRNA
cucagccacacauucaucga

SEQ ID NO: 24873 - RNA, 20 nt, Artificial Sequence
  MKO10024873_A_Hs2st1
  gRNA
auucuuugcacacaggucgu

SEQ ID NO: 24874 - RNA, 20 nt, Artificial Sequence
  MKO10024874_A_Hs3st1
  gRNA
ucagccgaccgucccgcauu

SEQ ID NO: 24875 - RNA, 20 nt, Artificial Sequence
  MKO10024875_A_Hs3st1
  gRNA
gauccaccugggggugcgcc

SEQ ID NO: 24876 - RNA, 20 nt, Artificial Sequence
  MKO10024876_A_Hs3st1
  gRNA
cgcugcuuacacgaguccaa

SEQ ID NO: 24877 - RNA, 20 nt, Artificial Sequence
  MKO10024877_A_Hs3st2
  gRNA
gucccgcccgugugaucccc

SEQ ID NO: 24878 - RNA, 20 nt, Artificial Sequence
  MKO10024878_A_Hs3st2
  gRNA
ggaguuuauccgcgugcacc

SEQ ID NO: 24879 - RNA, 20 nt, Artificial Sequence
  MKO10024879_A_Hs3st2
  gRNA
ucuuggaacgcuauccgcau

SEQ ID NO: 24880 - RNA, 20 nt, Artificial Sequence
  MKO10024880_A_Hs3st3a1
  gRNA
gcgcuuccuuggcgcucccg

SEQ ID NO: 24881 - RNA, 20 nt, Artificial Sequence
  MKO10024881_A_Hs3st3a1
  gRNA
cacugucgcgcagcaucuuc

SEQ ID NO: 24882 - RNA, 20 nt, Artificial Sequence
  MKO10024882_A_Hs3st3a1
  gRNA
ccgcagcaccucccgcgcaa

SEQ ID NO: 24883 - RNA, 20 nt, Artificial Sequence
  MKO10024883_A_Hs3st3b1
  gRNA
ccggcccgggacaucgagac

SEQ ID NO: 24884 - RNA, 20 nt, Artificial Sequence
  MKO10024884_A_Hs3st3b1
  gRNA
gcaccccaccaucgcgcgcg

SEQ ID NO: 24885 - RNA, 20 nt, Artificial Sequence
  MKO10024885_A_Hs3st3b1
  gRNA
cucagucccagccgaagucg

SEQ ID NO: 24886 - RNA, 20 nt, Artificial Sequence
  MKO10024886_A_Hs3st4
  gRNA
cgagcgcuucacgacuccug

SEQ ID NO: 24887 - RNA, 20 nt, Artificial Sequence
  MKO10024887_A_Hs3st4
  gRNA
ccgccggacaacgcgagccg

SEQ ID NO: 24888 - RNA, 20 nt, Artificial Sequence
  MKO10024888_A_Hs3st4
  gRNA
augacaucugggucaauucg

SEQ ID NO: 24889 - RNA, 20 nt, Artificial Sequence
  MKO10024889_A_Hs3st5
  gRNA
augacggaggggucuaccuc

SEQ ID NO: 24890 - RNA, 20 nt, Artificial Sequence
  MKO10024890_A_Hs3st5
  gRNA
caaggggcgcauccauccag

SEQ ID NO: 24891 - RNA, 20 nt, Artificial Sequence
  MKO10024891_A_Hs3st5
  gRNA
cuguaucuaguugccagagu

SEQ ID NO: 24892 - RNA, 20 nt, Artificial Sequence
  MKO10024892_A_Hs3st6
  gRNA
aacagaacuacgagcgccag

SEQ ID NO: 24893 - RNA, 20 nt, Artificial Sequence
  MKO10024893_A_Hs3st6
  gRNA
gcgugcucuccgugcuccgc

SEQ ID NO: 24894 - RNA, 20 nt, Artificial Sequence
  MKO10024894_A_Hs3st6
  gRNA
uagugggagaccccgcugcu

SEQ ID NO: 24895 - RNA, 20 nt, Artificial Sequence
  MKO10024895_A_Hs6st1
  gRNA
gucgcggcggucuagcacac

SEQ ID NO: 24896 - RNA, 20 nt, Artificial Sequence
  MKO10024896_A_Hs6st1
  gRNA
ggcgcucuucgcgauugcgc

SEQ ID NO: 24897 - RNA, 20 nt, Artificial Sequence
  MKO10024897_A_Hs6st1
  gRNA
cucgcugcgcuucgacauga

SEQ ID NO: 24898 - RNA, 20 nt, Artificial Sequence
  MKO10024898_A_Hs6st2
  gRNA
cgccgcggcugaaauuguag

SEQ ID NO: 24899 - RNA, 20 nt, Artificial Sequence
  MKO10024899_A_Hs6st2
  gRNA
ggugccggauccguaccgcu

SEQ ID NO: 24900 - RNA, 20 nt, Artificial Sequence
  MKO10024900_A_Hs6st2
  gRNA
ucagucccucaauacgcuuu

SEQ ID NO: 24901 - RNA, 20 nt, Artificial Sequence
  MKO10024901_A_Hs6st3
  gRNA
uccgcuccucgcgccucuuu

SEQ ID NO: 24902 - RNA, 20 nt, Artificial Sequence
  MKO10024902_A_Hs6st3
  gRNA
ggaccgcccgaggggucucg

SEQ ID NO: 24903 - RNA, 20 nt, Artificial Sequence
  MKO10024903_A_Hs6st3
  gRNA
ucuacuacaucacgauguug

SEQ ID NO: 24904 - RNA, 20 nt, Artificial Sequence
  MKO10024904_A_Hsbp1l1
  gRNA
uuugauagaauucucgaucc

SEQ ID NO: 24905 - RNA, 20 nt, Artificial Sequence
  MKO10024905_A_Hsbp1l1
  gRNA
uggggacuugcugcagaacg

SEQ ID NO: 24906 - RNA, 20 nt, Artificial Sequence
  MKO10024906_A_Hsbp1l1
  gRNA
ggcugagaaucuacuucuag

SEQ ID NO: 24907 - RNA, 20 nt, Artificial Sequence
  MKO10024907_A_Hsbp1
  gRNA
ggauauuccuuccgaugauc

SEQ ID NO: 24908 - RNA, 20 nt, Artificial Sequence
  MKO10024908_A_Hsbp1
  gRNA
aucaugucagaccagaucau

SEQ ID NO: 24909 - RNA, 20 nt, Artificial Sequence
  MKO10024909_A_Hsbp1
  gRNA
caccaaggugauguccugca

SEQ ID NO: 24910 - RNA, 20 nt, Artificial Sequence
  MKO10024910_A_Hscb
  gRNA
acguuacgaaacuucagcac

SEQ ID NO: 24911 - RNA, 20 nt, Artificial Sequence
  MKO10024911_A_Hscb
  gRNA
acucgcagacgcccaaagug

SEQ ID NO: 24912 - RNA, 20 nt, Artificial Sequence
  MKO10024912_A_Hscb
  gRNA
uuucguaacguccacccuga

SEQ ID NO: 24913 - RNA, 20 nt, Artificial Sequence
  MKO10024913_A_Hsd11b1
  gRNA
ugcucaugaccacguagcug

SEQ ID NO: 24914 - RNA, 20 nt, Artificial Sequence
  MKO10024914_A_Hsd11b1
  gRNA
cuggagaccuuccuccgacc

SEQ ID NO: 24915 - RNA, 20 nt, Artificial Sequence
  MKO10024915_A_Hsd11b1
  gRNA
ggucaacuuccucagcuacg

SEQ ID NO: 24916 - RNA, 20 nt, Artificial Sequence
  MKO10024916_A_Hsd11b2
  gRNA
ccccucgagugacgcaagag

SEQ ID NO: 24917 - RNA, 20 nt, Artificial Sequence
  MKO10024917_A_Hsd11b2
  gRNA
cgucagccacuacgauauug

SEQ ID NO: 24918 - RNA, 20 nt, Artificial Sequence
  MKO10024918_A_Hsd11b2
  gRNA
ccacgaagccgcuacuaccc

SEQ ID NO: 24919 - RNA, 20 nt, Artificial Sequence
  MKO10024919_A_Hsd17b10
  gRNA
gccuuacauugauaacccgc

SEQ ID NO: 24920 - RNA, 20 nt, Artificial Sequence
  MKO10024920_A_Hsd17b10
  gRNA
cacuuucaaugugauccgcc

SEQ ID NO: 24921 - RNA, 20 nt, Artificial Sequence
  MKO10024921_A_Hsd17b10
  gRNA
cgugugguaacaauugcucc

SEQ ID NO: 24922 - RNA, 20 nt, Artificial Sequence
  MKO10024922_A_Hsd17b11
  gRNA
gauuuacagcgcugcgaaaa

SEQ ID NO: 24923 - RNA, 20 nt, Artificial Sequence
  MKO10024923_A_Hsd17b11
  gRNA
ugcagacuuauuugcuacgc

SEQ ID NO: 24924 - RNA, 20 nt, Artificial Sequence
  MKO10024924_A_Hsd17b11
  gRNA
cgcuguaaaucucuucccgc

SEQ ID NO: 24925 - RNA, 20 nt, Artificial Sequence
  MKO10024925_A_Hsd17b12
  gRNA
cgaguauccggaauacuuuc

SEQ ID NO: 24926 - RNA, 20 nt, Artificial Sequence
  MKO10024926_A_Hsd17b12
  gRNA
uguuugcaguuagcaaaacg

SEQ ID NO: 24927 - RNA, 20 nt, Artificial Sequence
  MKO10024927_A_Hsd17b12
  gRNA
aagacucacguuguccaagu

SEQ ID NO: 24928 - RNA, 20 nt, Artificial Sequence
  MKO10024928_A_Hsd17b13
  gRNA
gacuuacccaaaaauguccg

SEQ ID NO: 24929 - RNA, 20 nt, Artificial Sequence
  MKO10024929_A_Hsd17b13
  gRNA
gagaucgugguaaacaacgc

SEQ ID NO: 24930 - RNA, 20 nt, Artificial Sequence
  MKO10024930_A_Hsd17b13
  gRNA
ggccgucgugcacguguuug

SEQ ID NO: 24931 - RNA, 20 nt, Artificial Sequence
  MKO10024931_A_Hsd17b14
  gRNA
uauccccggugacgugacac

SEQ ID NO: 24932 - RNA, 20 nt, Artificial Sequence
  MKO10024932_A_Hsd17b14
  gRNA
gauuguguggugaauaacgc

SEQ ID NO: 24933 - RNA, 20 nt, Artificial Sequence
  MKO10024933_A_Hsd17b14
  gRNA
ucugagacccucucucgauu

SEQ ID NO: 24934 - RNA, 20 nt, Artificial Sequence
  MKO10024934_A_Hsd17b1
  gRNA
accuucgagcgcaaacuugc

SEQ ID NO: 24935 - RNA, 20 nt, Artificial Sequence
  MKO10024935_A_Hsd17b1
  gRNA
agugugagccucaucgagug

SEQ ID NO: 24936 - RNA, 20 nt, Artificial Sequence
  MKO10024936_A_Hsd17b1
  gRNA
gccagcaaguuugcgcucga

SEQ ID NO: 24937 - RNA, 20 nt, Artificial Sequence
  MKO10024937_A_Hsd17b2
  gRNA
guuccccgucgauagguaag

SEQ ID NO: 24938 - RNA, 20 nt, Artificial Sequence
  MKO10024938_A_Hsd17b2
  gRNA
ggccaaaccgugaccgaaac

SEQ ID NO: 24939 - RNA, 20 nt, Artificial Sequence
  MKO10024939_A_Hsd17b2
  gRNA
gaacuucuucggaacugucg

SEQ ID NO: 24940 - RNA, 20 nt, Artificial Sequence
  MKO10024940_A_Hsd17b3
  gRNA
ugcccgcaguuggccagaca

SEQ ID NO: 24941 - RNA, 20 nt, Artificial Sequence
  MKO10024941_A_Hsd17b3
  gRNA
cuuucagugauuaccggagc

SEQ ID NO: 24942 - RNA, 20 nt, Artificial Sequence
  MKO10024942_A_Hsd17b3
  gRNA
uuucugccagucaacaacgu

SEQ ID NO: 24943 - RNA, 20 nt, Artificial Sequence
  MKO10024943_A_Hsd17b4
  gRNA
auugggccgagcuuacgccc

SEQ ID NO: 24944 - RNA, 20 nt, Artificial Sequence
  MKO10024944_A_Hsd17b4
  gRNA
ugccuugcagugaacgacuu

SEQ ID NO: 24945 - RNA, 20 nt, Artificial Sequence
  MKO10024945_A_Hsd17b4
  gRNA
gacuucaagggaauugguaa

SEQ ID NO: 24946 - RNA, 20 nt, Artificial Sequence
  MKO10024946_A_Hsd17b6
  gRNA
aaguagucuaccagugacgc

SEQ ID NO: 24947 - RNA, 20 nt, Artificial Sequence
  MKO10024947_A_Hsd17b6
  gRNA
gucaaaaaacugcuguccgu

SEQ ID NO: 24948 - RNA, 20 nt, Artificial Sequence
  MKO10024948_A_Hsd17b6
  gRNA
ucucacgauaccaacgcaga

SEQ ID NO: 24949 - RNA, 20 nt, Artificial Sequence
  MKO10024949_A_Hsd17b7
  gRNA
agcuguucgagauacccugc

SEQ ID NO: 24950 - RNA, 20 nt, Artificial Sequence
  MKO10024950_A_Hsd17b7
  gRNA
cugccagcagucgaccgcaa

SEQ ID NO: 24951 - RNA, 20 nt, Artificial Sequence
  MKO10024951_A_Hsd17b7
  gRNA
ggucaaaauuccuuccgcug

SEQ ID NO: 24952 - RNA, 20 nt, Artificial Sequence
  MKO10024952_A_Hsd3b1
  gRNA
gacgaucuucuuguacgagu

SEQ ID NO: 24953 - RNA, 20 nt, Artificial Sequence
  MKO10024953_A_Hsd3b1
  gRNA
ggcuccgcccuaaugccagc

SEQ ID NO: 24954 - RNA, 20 nt, Artificial Sequence
  MKO10024954_A_Hsd3b1
  gRNA
aguauuccgaccagaaacca

SEQ ID NO: 24955 - RNA, 20 nt, Artificial Sequence
  MKO10024955_A_Hsd3b2
  gRNA
ucagaauacccuuauguuua

SEQ ID NO: 24956 - RNA, 20 nt, Artificial Sequence
  MKO10024956_A_Hsd3b2
  gRNA
uauaaguuacaccuugagca

SEQ ID NO: 24957 - RNA, 20 nt, Artificial Sequence
  MKO10024957_A_Hsd3b2
  gRNA
cuuccucuugcaccaacaac

SEQ ID NO: 24958 - RNA, 20 nt, Artificial Sequence
  MKO10024958_A_Hsd3b3
  gRNA
uuucacgaugcucguccucg

SEQ ID NO: 24959 - RNA, 20 nt, Artificial Sequence
  MKO10024959_A_Hsd3b3
  gRNA
uacaaggacauuguccugaa

SEQ ID NO: 24960 - RNA, 20 nt, Artificial Sequence
  MKO10024960_A_Hsd3b3
  gRNA
cagguuugaagaccuugucc

SEQ ID NO: 24961 - RNA, 20 nt, Artificial Sequence
  MKO10024961_A_Hsd3b4
  gRNA
cuguguugaccaugccuggg

SEQ ID NO: 24962 - RNA, 20 nt, Artificial Sequence
  MKO10024962_A_Hsd3b4
  gRNA
agcugccuggugacaggagc

SEQ ID NO: 24963 - RNA, 20 nt, Artificial Sequence
  MKO10024963_A_Hsd3b4
  gRNA
agagcugcagacaaagacca

SEQ ID NO: 24964 - RNA, 20 nt, Artificial Sequence
  MKO10024964_A_Hsd3b5
  gRNA
ucccuucaguacucucaccu

SEQ ID NO: 24965 - RNA, 20 nt, Artificial Sequence
  MKO10024965_A_Hsd3b5
  gRNA
gguggccuauaguuguaaac

SEQ ID NO: 24966 - RNA, 20 nt, Artificial Sequence
  MKO10024966_A_Hsd3b5
  gRNA
uccagccagaaucaaggcag

SEQ ID NO: 24967 - RNA, 20 nt, Artificial Sequence
  MKO10024967_A_Hsd3b6
  gRNA
gauuguccaguuguugaugc

SEQ ID NO: 24968 - RNA, 20 nt, Artificial Sequence
  MKO10024968_A_Hsd3b6
  gRNA
uacaaggagauaauccugaa

SEQ ID NO: 24969 - RNA, 20 nt, Artificial Sequence
  MKO10024969_A_Hsd3b6
  gRNA
cuggucugaagaacuugucc

SEQ ID NO: 24970 - RNA, 20 nt, Artificial Sequence
  MKO10024970_A_Hsd3b7
  gRNA
cgaccgugcuccacagaagc

SEQ ID NO: 24971 - RNA, 20 nt, Artificial Sequence
  MKO10024971_A_Hsd3b7
  gRNA
accuucaccauaaaugcccg

SEQ ID NO: 24972 - RNA, 20 nt, Artificial Sequence
  MKO10024972_A_Hsd3b7
  gRNA
cauccacaaagucaacgugc

SEQ ID NO: 24973 - RNA, 20 nt, Artificial Sequence
  MKO10024973_A_Hsdl1
  gRNA
gcaguacgaguaugccucua

SEQ ID NO: 24974 - RNA, 20 nt, Artificial Sequence
  MKO10024974_A_Hsdl1
  gRNA
aggccucuuuccguaaggag

SEQ ID NO: 24975 - RNA, 20 nt, Artificial Sequence
  MKO10024975_A_Hsdl1
  gRNA
ucgcacaguauaugcccgag

SEQ ID NO: 24976 - RNA, 20 nt, Artificial Sequence
  MKO10024976_A_Hsdl2
  gRNA
cagccguguagauugugccg

SEQ ID NO: 24977 - RNA, 20 nt, Artificial Sequence
  MKO10024977_A_Hsdl2
  gRNA
ucacguaagguaggugcccc

SEQ ID NO: 24978 - RNA, 20 nt, Artificial Sequence
  MKO10024978_A_Hsdl2
  gRNA
uauuagcuugaccaacacgu

SEQ ID NO: 24979 - RNA, 20 nt, Artificial Sequence
  MKO10024979_A_Hsf1
  gRNA
cagcuuccacguguuugacc

SEQ ID NO: 24980 - RNA, 20 nt, Artificial Sequence
  MKO10024980_A_Hsf1
  gRNA
gcagcaccuccuuggcaaac

SEQ ID NO: 24981 - RNA, 20 nt, Artificial Sequence
  MKO10024981_A_Hsf1
  gRNA
ggaccuacugcuucauggcc

SEQ ID NO: 24982 - RNA, 20 nt, Artificial Sequence
  MKO10024982_A_Hsf2bp
  gRNA
cuuccgucgucagccguucc

SEQ ID NO: 24983 - RNA, 20 nt, Artificial Sequence
  MKO10024983_A_Hsf2bp
  gRNA
gaggucgucaaaaccauucu

SEQ ID NO: 24984 - RNA, 20 nt, Artificial Sequence
  MKO10024984_A_Hsf2bp
  gRNA
uuugacgaccuccucgcugc

SEQ ID NO: 24985 - RNA, 20 nt, Artificial Sequence
  MKO10024985_A_Hsf2
  gRNA
aaaguagugcauaucgaauc

SEQ ID NO: 24986 - RNA, 20 nt, Artificial Sequence
  MKO10024986_A_Hsf2
  gRNA
uccgaauaacuuguugcugc

SEQ ID NO: 24987 - RNA, 20 nt, Artificial Sequence
  MKO10024987_A_Hsf2
  gRNA
guucugacaccuccuuccaa

SEQ ID NO: 24988 - RNA, 20 nt, Artificial Sequence
  MKO10024988_A_Hsf3
  gRNA
uauacuagaugguuuccgaa

SEQ ID NO: 24989 - RNA, 20 nt, Artificial Sequence
  MKO10024989_A_Hsf3
  gRNA
ucugaaacucaucagaguag

SEQ ID NO: 24990 - RNA, 20 nt, Artificial Sequence
  MKO10024990_A_Hsf3
  gRNA
ucuugcaaacauuaaacgaa

SEQ ID NO: 24991 - RNA, 20 nt, Artificial Sequence
  MKO10024991_A_Hsf4
  gRNA
cugucaucgccucgcagcgc

SEQ ID NO: 24992 - RNA, 20 nt, Artificial Sequence
  MKO10024992_A_Hsf4
  gRNA
cgaugacagucgauggcguc

SEQ ID NO: 24993 - RNA, 20 nt, Artificial Sequence
  MKO10024993_A_Hsf4
  gRNA
cagcauccgagcuucgugcg

SEQ ID NO: 24994 - RNA, 20 nt, Artificial Sequence
  MKO10024994_A_Hsf5
  gRNA
gugggaugaaguugauacgu

SEQ ID NO: 24995 - RNA, 20 nt, Artificial Sequence
  MKO10024995_A_Hsf5
  gRNA
ucccaagccuacuauccaac

SEQ ID NO: 24996 - RNA, 20 nt, Artificial Sequence
  MKO10024996_A_Hsf5
  gRNA
caagauauucuccgagggau

SEQ ID NO: 24997 - RNA, 20 nt, Artificial Sequence
  MKO10024997_A_Hsfy2
  gRNA
accugaguuaccgauacaca

SEQ ID NO: 24998 - RNA, 20 nt, Artificial Sequence
  MKO10024998_A_Hsfy2
  gRNA
acaagugagacauguccccg

SEQ ID NO: 24999 - RNA, 20 nt, Artificial Sequence
  MKO10024999_A_Hsfy2
  gRNA
accucuauuacucaaaaccg

SEQ ID NO: 25000 - RNA, 20 nt, Artificial Sequence
  MKO10025000_A_Hsh2d
  gRNA
agcuccccgaauggccgaau

SEQ ID NO: 25001 - RNA, 20 nt, Artificial Sequence
  MKO10025001_A_Hsh2d
  gRNA
uccucauaguccacguuugc

SEQ ID NO: 25002 - RNA, 20 nt, Artificial Sequence
  MKO10025002_A_Hsh2d
  gRNA
gaugggacuugugccuucgc

SEQ ID NO: 25003 - RNA, 20 nt, Artificial Sequence
  MKO10025003_A_Hsp90aa1
  gRNA
cccuacuuacucagauacuc

SEQ ID NO: 25004 - RNA, 20 nt, Artificial Sequence
  MKO10025004_A_Hsp90aa1
  gRNA
guaacuuacaaagagaguaa

SEQ ID NO: 25005 - RNA, 20 nt, Artificial Sequence
  MKO10025005_A_Hsp90aa1
  gRNA
uuuccuccaaauacucuguu

SEQ ID NO: 25006 - RNA, 20 nt, Artificial Sequence
  MKO10025006_A_Hsp90ab1
  gRNA
cggguggcuccuucaccguc

SEQ ID NO: 25007 - RNA, 20 nt, Artificial Sequence
  MKO10025007_A_Hsp90ab1
  gRNA
aaacccggaugacaucacgc

SEQ ID NO: 25008 - RNA, 20 nt, Artificial Sequence
  MKO10025008_A_Hsp90ab1
  gRNA
gacaccaaacugcccgauca

SEQ ID NO: 25009 - RNA, 20 nt, Artificial Sequence
  MKO10025009_A_Hsp90b1
  gRNA
agcugaugaugaagucgacg

SEQ ID NO: 25010 - RNA, 20 nt, Artificial Sequence
  MKO10025010_A_Hsp90b1
  gRNA
aaacucgcuuguuccagauu

SEQ ID NO: 25011 - RNA, 20 nt, Artificial Sequence
  MKO10025011_A_Hsp90b1
  gRNA
cucggcaccauagccaaauc

SEQ ID NO: 25012 - RNA, 20 nt, Artificial Sequence
  MKO10025012_A_Hspa12a
  gRNA
gccacacucaccgcaucacg

SEQ ID NO: 25013 - RNA, 20 nt, Artificial Sequence
  MKO10025013_A_Hspa12a
  gRNA
acagcuuuggguacgcugcc

SEQ ID NO: 25014 - RNA, 20 nt, Artificial Sequence
  MKO10025014_A_Hspa12a
  gRNA
uuacgcccugcaguacuuca

SEQ ID NO: 25015 - RNA, 20 nt, Artificial Sequence
  MKO10025015_A_Hspa12b
  gRNA
ucccauuuaccgccucgagc

SEQ ID NO: 25016 - RNA, 20 nt, Artificial Sequence
  MKO10025016_A_Hspa12b
  gRNA
ucuucuggugggccacgccu

SEQ ID NO: 25017 - RNA, 20 nt, Artificial Sequence
  MKO10025017_A_Hspa12b
  gRNA
cuaccacgaccuagacccug

SEQ ID NO: 25018 - RNA, 20 nt, Artificial Sequence
  MKO10025018_A_Hspa13
  gRNA
cguagaacacgucaaccuug

SEQ ID NO: 25019 - RNA, 20 nt, Artificial Sequence
  MKO10025019_A_Hspa13
  gRNA
uaccagacaucgcucguguu

SEQ ID NO: 25020 - RNA, 20 nt, Artificial Sequence
  MKO10025020_A_Hspa13
  gRNA
gggguucuacucguauuccu

SEQ ID NO: 25021 - RNA, 20 nt, Artificial Sequence
  MKO10025021_A_Hspa14
  gRNA
acguuccgaguaagcaacaa

SEQ ID NO: 25022 - RNA, 20 nt, Artificial Sequence
  MKO10025022_A_Hspa14
  gRNA
uuaggauggccgggccgaug

SEQ ID NO: 25023 - RNA, 20 nt, Artificial Sequence
  MKO10025023_A_Hspa14
  gRNA
uugcgguaugaaauagauac

SEQ ID NO: 25024 - RNA, 20 nt, Artificial Sequence
  MKO10025024_A_Hspa1a
  gRNA
cugugcucagaccuguuccg

SEQ ID NO: 25025 - RNA, 20 nt, Artificial Sequence
  MKO10025025_A_Hspa1a
  gRNA
cgaacugagcggcaucccgc

SEQ ID NO: 25026 - RNA, 20 nt, Artificial Sequence
  MKO10025026_A_Hspa1a
  gRNA
ucuuggcggcgucuccgaug

SEQ ID NO: 25027 - RNA, 20 nt, Artificial Sequence
  MKO10025027_A_Hspa1b
  gRNA
ucuuggcggcguccccgaug

SEQ ID NO: 25028 - RNA, 20 nt, Artificial Sequence
  MKO10025028_A_Hspa1b
  gRNA
caggggcgugccgcagaucg

SEQ ID NO: 25029 - RNA, 20 nt, Artificial Sequence
  MKO10025029_A_Hspa1b
  gRNA
cgagcugagcggcaucccgc

SEQ ID NO: 25030 - RNA, 20 nt, Artificial Sequence
  MKO10025030_A_Hspa1l
  gRNA
accgggcccaccuguacgcc

SEQ ID NO: 25031 - RNA, 20 nt, Artificial Sequence
  MKO10025031_A_Hspa1l
  gRNA
aguauacccuggcguacagg

SEQ ID NO: 25032 - RNA, 20 nt, Artificial Sequence
  MKO10025032_A_Hspa1l
  gRNA
cgcccauuaaaauagcugcc

SEQ ID NO: 25033 - RNA, 20 nt, Artificial Sequence
  MKO10025033_A_Hspa2
  gRNA
ugaagcaaaucgcgaucgcg

SEQ ID NO: 25034 - RNA, 20 nt, Artificial Sequence
  MKO10025034_A_Hspa2
  gRNA
uuuccgacuugucgccgaug

SEQ ID NO: 25035 - RNA, 20 nt, Artificial Sequence
  MKO10025035_A_Hspa2
  gRNA
cgaagacuucgacaaccgua

SEQ ID NO: 25036 - RNA, 20 nt, Artificial Sequence
  MKO10025036_A_Hspa4l
  gRNA
uugguuguaggugcgguacc

SEQ ID NO: 25037 - RNA, 20 nt, Artificial Sequence
  MKO10025037_A_Hspa4l
  gRNA
ucugcgucggugaaaaagcu

SEQ ID NO: 25038 - RNA, 20 nt, Artificial Sequence
  MKO10025038_A_Hspa4l
  gRNA
cgcagagagaagauccguga

SEQ ID NO: 25039 - RNA, 20 nt, Artificial Sequence
  MKO10025039_A_Hspa4
  gRNA
gcuccaauugaacgauucuu

SEQ ID NO: 25040 - RNA, 20 nt, Artificial Sequence
  MKO10025040_A_Hspa4
  gRNA
gauauugugcaguugcccac

SEQ ID NO: 25041 - RNA, 20 nt, Artificial Sequence
  MKO10025041_A_Hspa4
  gRNA
cuuuaugcccguuaauccag

SEQ ID NO: 25042 - RNA, 20 nt, Artificial Sequence
  MKO10025042_A_Hspa5
  gRNA
ccgcaucacgccgucguaug

SEQ ID NO: 25043 - RNA, 20 nt, Artificial Sequence
  MKO10025043_A_Hspa5
  gRNA
ccacauacgacggcgugaug

SEQ ID NO: 25044 - RNA, 20 nt, Artificial Sequence
  MKO10025044_A_Hspa5
  gRNA
caucgaaggugccgccaccc

SEQ ID NO: 25045 - RNA, 20 nt, Artificial Sequence
  MKO10025045_A_Hspa8
  gRNA
ugcagaagcguaccucggaa

SEQ ID NO: 25046 - RNA, 20 nt, Artificial Sequence
  MKO10025046_A_Hspa8
  gRNA
uuagaccguuaccaacgcug

SEQ ID NO: 25047 - RNA, 20 nt, Artificial Sequence
  MKO10025047_A_Hspa8
  gRNA
uuugacaggucggagcugaa

SEQ ID NO: 25048 - RNA, 20 nt, Artificial Sequence
  MKO10025048_A_Hspa9
  gRNA
gcagauggagaacgacuugu

SEQ ID NO: 25049 - RNA, 20 nt, Artificial Sequence
  MKO10025049_A_Hspa9
  gRNA
uaugcuacuaagcgucuuau

SEQ ID NO: 25050 - RNA, 20 nt, Artificial Sequence
  MKO10025050_A_Hspa9
  gRNA
gaugcuuggguugaggcuca

SEQ ID NO: 25051 - RNA, 20 nt, Artificial Sequence
  MKO10025051_A_Hspb11
  gRNA
caaugcuagugcggacuuug

SEQ ID NO: 25052 - RNA, 20 nt, Artificial Sequence
  MKO10025052_A_Hspb11
  gRNA
cuaggaauccggaaaccuuu

SEQ ID NO: 25053 - RNA, 20 nt, Artificial Sequence
  MKO10025053_A_Hspb11
  gRNA
caugccuguggugguccaaa

SEQ ID NO: 25054 - RNA, 20 nt, Artificial Sequence
  MKO10025054_A_Hspb1
  gRNA
caccauuccgguuacuuucg

SEQ ID NO: 25055 - RNA, 20 nt, Artificial Sequence
  MKO10025055_A_Hspb1
  gRNA
gcgcgggccucgaaaguaac

SEQ ID NO: 25056 - RNA, 20 nt, Artificial Sequence
  MKO10025056_A_Hspb1
  gRNA
ucagaacucacguguauuuc

SEQ ID NO: 25057 - RNA, 20 nt, Artificial Sequence
  MKO10025057_A_Hspb2
  gRNA
uagagcagcucgaacccgcc

SEQ ID NO: 25058 - RNA, 20 nt, Artificial Sequence
  MKO10025058_A_Hspb2
  gRNA
uccuuaacuuggaggcgccg

SEQ ID NO: 25059 - RNA, 20 nt, Artificial Sequence
  MKO10025059_A_Hspb2
  gRNA
gggguuggcaaauucguacu

SEQ ID NO: 25060 - RNA, 20 nt, Artificial Sequence
  MKO10025060_A_Hspb3
  gRNA
acgaacacggguuuauaucg

SEQ ID NO: 25061 - RNA, 20 nt, Artificial Sequence
  MKO10025061_A_Hspb3
  gRNA
aaacccguguucguccauuc

SEQ ID NO: 25062 - RNA, 20 nt, Artificial Sequence
  MKO10025062_A_Hspb3
  gRNA
ucuuugguuucgacuccauc

SEQ ID NO: 25063 - RNA, 20 nt, Artificial Sequence
  MKO10025063_A_Hspb6
  gRNA
gcagcccuucgccgaaacgc

SEQ ID NO: 25064 - RNA, 20 nt, Artificial Sequence
  MKO10025064_A_Hspb6
  gRNA
cgccucuuugaccagcguuu

SEQ ID NO: 25065 - RNA, 20 nt, Artificial Sequence
  MKO10025065_A_Hspb6
  gRNA
ugcucggcacgaggagcgcc

SEQ ID NO: 25066 - RNA, 20 nt, Artificial Sequence
  MKO10025066_A_Hspb7
  gRNA
ucucagcccgcaccucgaug

SEQ ID NO: 25067 - RNA, 20 nt, Artificial Sequence
  MKO10025067_A_Hspb7
  gRNA
cuugcccacagcccgucccg

SEQ ID NO: 25068 - RNA, 20 nt, Artificial Sequence
  MKO10025068_A_Hspb7
  gRNA
ggcgccgcgcccggauggug

SEQ ID NO: 25069 - RNA, 20 nt, Artificial Sequence
  MKO10025069_A_Hspb8
  gRNA
ggucucggcgcaggcggcuu

SEQ ID NO: 25070 - RNA, 20 nt, Artificial Sequence
  MKO10025070_A_Hspb8
  gRNA
ggggagccucgaugaugagc

SEQ ID NO: 25071 - RNA, 20 nt, Artificial Sequence
  MKO10025071_A_Hspb8
  gRNA
cgagcuuccucaagacaacc

SEQ ID NO: 25072 - RNA, 20 nt, Artificial Sequence
  MKO10025072_A_Hspb9
  gRNA
cauucgacucguguugccgc

SEQ ID NO: 25073 - RNA, 20 nt, Artificial Sequence
  MKO10025073_A_Hspb9
  gRNA
agcgcgaacccggggaaaac

SEQ ID NO: 25074 - RNA, 20 nt, Artificial Sequence
  MKO10025074_A_Hspb9
  gRNA
acgagucgaaugacccgagc

SEQ ID NO: 25075 - RNA, 20 nt, Artificial Sequence
  MKO10025075_A_Hspbap1
  gRNA
ucgauuggccaucacgacac

SEQ ID NO: 25076 - RNA, 20 nt, Artificial Sequence
  MKO10025076_A_Hspbap1
  gRNA
uucgcaguccagugucguga

SEQ ID NO: 25077 - RNA, 20 nt, Artificial Sequence
  MKO10025077_A_Hspbap1
  gRNA
cgcauccacauaacuacauu

SEQ ID NO: 25078 - RNA, 20 nt, Artificial Sequence
  MKO10025078_A_Hspbp1
  gRNA
cuugacucguaccgugucgc

SEQ ID NO: 25079 - RNA, 20 nt, Artificial Sequence
  MKO10025079_A_Hspbp1
  gRNA
aagccaugucggccgccuuc

SEQ ID NO: 25080 - RNA, 20 nt, Artificial Sequence
  MKO10025080_A_Hspbp1
  gRNA
ucugcuggugggucgauacc

SEQ ID NO: 25081 - RNA, 20 nt, Artificial Sequence
  MKO10025081_A_Hspd1
  gRNA
ucuugaacuaggugugaugu

SEQ ID NO: 25082 - RNA, 20 nt, Artificial Sequence
  MKO10025082_A_Hspd1
  gRNA
uuaccucuccggauuuccac

SEQ ID NO: 25083 - RNA, 20 nt, Artificial Sequence
  MKO10025083_A_Hspd1
  gRNA
cuuaccugagcaauuucuuc

SEQ ID NO: 25084 - RNA, 20 nt, Artificial Sequence
  MKO10025084_A_Hspe1
  gRNA
gcugccgaaacuguaaccaa

SEQ ID NO: 25085 - RNA, 20 nt, Artificial Sequence
  MKO10025085_A_Hspe1
  gRNA
ggggucaggagggaaaggaa

SEQ ID NO: 25086 - RNA, 20 nt, Artificial Sequence
  MKO10025086_A_Hspe1
  gRNA
cuugucaucuagaacuacuu

SEQ ID NO: 25087 - RNA, 20 nt, Artificial Sequence
  MKO10025087_A_Hspg2
  gRNA
aucucccauaggugacgcau

SEQ ID NO: 25088 - RNA, 20 nt, Artificial Sequence
  MKO10025088_A_Hspg2
  gRNA
ugcccacgucuccgcugccg

SEQ ID NO: 25089 - RNA, 20 nt, Artificial Sequence
  MKO10025089_A_Hspg2
  gRNA
ccacagccuccgacaccucu

SEQ ID NO: 25090 - RNA, 20 nt, Artificial Sequence
  MKO10025090_A_Hsph1
  gRNA
gcuggaugcugcgcagauug

SEQ ID NO: 25091 - RNA, 20 nt, Artificial Sequence
  MKO10025091_A_Hsph1
  gRNA
caugcugcugacuaaguuaa

SEQ ID NO: 25092 - RNA, 20 nt, Artificial Sequence
  MKO10025092_A_Hsph1
  gRNA
gcggcucaugaaugacauga

SEQ ID NO: 25093 - RNA, 20 nt, Artificial Sequence
  MKO10025093_A_Huauip2
  gRNA
aagagucucguccaggcgaa

SEQ ID NO: 25094 - RNA, 20 nt, Artificial Sequence
  MKO10025094_A_Huauip2
  gRNA
uuccuagccagccauucgcc

SEQ ID NO: 25095 - RNA, 20 nt, Artificial Sequence
  MKO10025095_A_Huauip2
  gRNA
uaagaaacugcuggacuuau

SEQ ID NO: 25096 - RNA, 20 nt, Artificial Sequence
  MKO10025096_A_Huausf1
  gRNA
agauuucauugcuacguauc

SEQ ID NO: 25097 - RNA, 20 nt, Artificial Sequence
  MKO10025097_A_Huausf1
  gRNA
cagcucuacugcgaacgucc

SEQ ID NO: 25098 - RNA, 20 nt, Artificial Sequence
  MKO10025098_A_Huausf1
  gRNA
caucguauucacccuugagc

SEQ ID NO: 25099 - RNA, 20 nt, Artificial Sequence
  MKO10025099_A_Htr1a
  gRNA
ggccgacgauguuccgaagc

SEQ ID NO: 25100 - RNA, 20 nt, Artificial Sequence
  MKO10025100_A_Htr1a
  gRNA
ccaguaccugucuagcgcga

SEQ ID NO: 25101 - RNA, 20 nt, Artificial Sequence
  MKO10025101_A_Htr1a
  gRNA
ugcacucguugggguucgag

SEQ ID NO: 25102 - RNA, 20 nt, Artificial Sequence
  MKO10025102_A_Htr1b
  gRNA
auacaccguagcgauuacaa

SEQ ID NO: 25103 - RNA, 20 nt, Artificial Sequence
  MKO10025103_A_Htr1b
  gRNA
cugauacgcuuuaagugcgc

SEQ ID NO: 25104 - RNA, 20 nt, Artificial Sequence
  MKO10025104_A_Htr1b
  gRNA
aguagaccguguagaggacg

SEQ ID NO: 25105 - RNA, 20 nt, Artificial Sequence
  MKO10025105_A_Htr1d
  gRNA
uacaccaucuacucgaccug

SEQ ID NO: 25106 - RNA, 20 nt, Artificial Sequence
  MKO10025106_A_Htr1d
  gRNA
uacagcaagcgucgaaccgc

SEQ ID NO: 25107 - RNA, 20 nt, Artificial Sequence
  MKO10025107_A_Htr1d
  gRNA
ucucagaaucucgcucgugg

SEQ ID NO: 25108 - RNA, 20 nt, Artificial Sequence
  MKO10025108_A_Htr1f
  gRNA
acuuguacgaugccgauauu

SEQ ID NO: 25109 - RNA, 20 nt, Artificial Sequence
  MKO10025109_A_Htr1f
  gRNA
caaugaucgcagcgaucacg

SEQ ID NO: 25110 - RNA, 20 nt, Artificial Sequence
  MKO10025110_A_Htr1f
  gRNA
caucaugaucacgaucgugu

SEQ ID NO: 25111 - RNA, 20 nt, Artificial Sequence
  MKO10025111_A_Htr2a
  gRNA
caucguccuucggccugcgu

SEQ ID NO: 25112 - RNA, 20 nt, Artificial Sequence
  MKO10025112_A_Htr2a
  gRNA
guccagcuuaccuacggaua

SEQ ID NO: 25113 - RNA, 20 nt, Artificial Sequence
  MKO10025113_A_Htr2a
  gRNA
acacuuccgaagccucgaac

SEQ ID NO: 25114 - RNA, 20 nt, Artificial Sequence
  MKO10025114_A_Htr2b
  gRNA
guauuaucaccgcgaguauc

SEQ ID NO: 25115 - RNA, 20 nt, Artificial Sequence
  MKO10025115_A_Htr2b
  gRNA
agccaccucaacgccuaaca

SEQ ID NO: 25116 - RNA, 20 nt, Artificial Sequence
  MKO10025116_A_Htr2b
  gRNA
cugauccugacuaaccguuc

SEQ ID NO: 25117 - RNA, 20 nt, Artificial Sequence
  MKO10025117_A_Htr2c
  gRNA
ccuuaguccgcgaauugaac

SEQ ID NO: 25118 - RNA, 20 nt, Artificial Sequence
  MKO10025118_A_Htr2c
  gRNA
acccuaggaaucugucgaac

SEQ ID NO: 25119 - RNA, 20 nt, Artificial Sequence
  MKO10025119_A_Htr2c
  gRNA
gacccgaacuucguucucau

SEQ ID NO: 25120 - RNA, 20 nt, Artificial Sequence
  MKO10025120_A_Htr3a
  gRNA
caccugccgguaccauaugu

SEQ ID NO: 25121 - RNA, 20 nt, Artificial Sequence
  MKO10025121_A_Htr3a
  gRNA
uauguguacgugcaucaucg

SEQ ID NO: 25122 - RNA, 20 nt, Artificial Sequence
  MKO10025122_A_Htr3a
  gRNA
gcagcucaccacguugagga

SEQ ID NO: 25123 - RNA, 20 nt, Artificial Sequence
  MKO10025123_A_Htr3b
  gRNA
gguacagcgacaccucagcc

SEQ ID NO: 25124 - RNA, 20 nt, Artificial Sequence
  MKO10025124_A_Htr3b
  gRNA
cggugcagagaagaauuccc

SEQ ID NO: 25125 - RNA, 20 nt, Artificial Sequence
  MKO10025125_A_Htr3b
  gRNA
agaagaguucacguauacau

SEQ ID NO: 25126 - RNA, 20 nt, Artificial Sequence
  MKO10025126_A_Htr4
  gRNA
aacauuaaugcgaugcguag

SEQ ID NO: 25127 - RNA, 20 nt, Artificial Sequence
  MKO10025127_A_Htr4
  gRNA
ucuacgcaucgcauuaaugu

SEQ ID NO: 25128 - RNA, 20 nt, Artificial Sequence
  MKO10025128_A_Htr4
  gRNA
agaucgaugcugugguaagu

SEQ ID NO: 25129 - RNA, 20 nt, Artificial Sequence
  MKO10025129_A_Htr5a
  gRNA
cgaaauuccgcaugggcucc

SEQ ID NO: 25130 - RNA, 20 nt, Artificial Sequence
  MKO10025130_A_Htr5a
  gRNA
augagcugucugggcgccgc

SEQ ID NO: 25131 - RNA, 20 nt, Artificial Sequence
  MKO10025131_A_Htr5a
  gRNA
ggcggaccgugaacaccauc

SEQ ID NO: 25132 - RNA, 20 nt, Artificial Sequence
  MKO10025132_A_Htr5b
  gRNA
cgcucaugaucgcgaucacc

SEQ ID NO: 25133 - RNA, 20 nt, Artificial Sequence
  MKO10025133_A_Htr5b
  gRNA
gguggaaggcgcggacacgc

SEQ ID NO: 25134 - RNA, 20 nt, Artificial Sequence
  MKO10025134_A_Htr5b
  gRNA
agguuacuguugcucggcga

SEQ ID NO: 25135 - RNA, 20 nt, Artificial Sequence
  MKO10025135_A_Htr6
  gRNA
guuagacguguugcgcagcg

SEQ ID NO: 25136 - RNA, 20 nt, Artificial Sequence
  MKO10025136_A_Htr6
  gRNA
ccgacgugaagagcgacacc

SEQ ID NO: 25137 - RNA, 20 nt, Artificial Sequence
  MKO10025137_A_Htr6
  gRNA
ucuugaagucccgcaugaag

SEQ ID NO: 25138 - RNA, 20 nt, Artificial Sequence
  MKO10025138_A_Htr7
  gRNA
gauauaaaacgccacugcgg

SEQ ID NO: 25139 - RNA, 20 nt, Artificial Sequence
  MKO10025139_A_Htr7
  gRNA
caucacgcugcugacgaucg

SEQ ID NO: 25140 - RNA, 20 nt, Artificial Sequence
  MKO10025140_A_Htr7
  gRNA
uucagggagaugacgcucuc

SEQ ID NO: 25141 - RNA, 20 nt, Artificial Sequence
  MKO10025141_A_Htra1
  gRNA
gggacuucggaacuccgaua

SEQ ID NO: 25142 - RNA, 20 nt, Artificial Sequence
  MKO10025142_A_Htra1
  gRNA
ccagcucuuugccgccucgc

SEQ ID NO: 25143 - RNA, 20 nt, Artificial Sequence
  MKO10025143_A_Htra1
  gRNA
guacuuaugacgcaaacugu

SEQ ID NO: 25144 - RNA, 20 nt, Artificial Sequence
  MKO10025144_A_Htra2
  gRNA
gccuagcggggauacuuaug

SEQ ID NO: 25145 - RNA, 20 nt, Artificial Sequence
  MKO10025145_A_Htra2
  gRNA
uaggcagccucacucguacu

SEQ ID NO: 25146 - RNA, 20 nt, Artificial Sequence
  MKO10025146_A_Htra2
  gRNA
acaucagcagagcggccgag

SEQ ID NO: 25147 - RNA, 20 nt, Artificial Sequence
  MKO10025147_A_Htra3
  gRNA
cgcgacacgucgcagcgcgc

SEQ ID NO: 25148 - RNA, 20 nt, Artificial Sequence
  MKO10025148_A_Htra3
  gRNA
cgccagccgucgugcguugc

SEQ ID NO: 25149 - RNA, 20 nt, Artificial Sequence
  MKO10025149_A_Htra3
  gRNA
ccacgaacucgccaggccgc

SEQ ID NO: 25150 - RNA, 20 nt, Artificial Sequence
  MKO10025150_A_Htra4
  gRNA
cuucauaccgggccccgcuc

SEQ ID NO: 25151 - RNA, 20 nt, Artificial Sequence
  MKO10025151_A_Htra4
  gRNA
guacaacuucaucgccgcag

SEQ ID NO: 25152 - RNA, 20 nt, Artificial Sequence
  MKO10025152_A_Htra4
  gRNA
cguuaaugauggcauccguc

SEQ ID NO: 25153 - RNA, 20 nt, Artificial Sequence
  MKO10025153_A_Huu
  gRNA
ucugcugugcagugacgaug

SEQ ID NO: 25154 - RNA, 20 nt, Artificial Sequence
  MKO10025154_A_Huu
  gRNA
uuguuagacaaugauucaca

SEQ ID NO: 25155 - RNA, 20 nt, Artificial Sequence
  MKO10025155_A_Huu
  gRNA
uagaguucuaacuguagccu

SEQ ID NO: 25156 - RNA, 20 nt, Artificial Sequence
  MKO10025156_A_Hunk
  gRNA
caccaaaaaccugcgucgag

SEQ ID NO: 25157 - RNA, 20 nt, Artificial Sequence
  MKO10025157_A_Hunk
  gRNA
ucaaccuuagguagcuauca

SEQ ID NO: 25158 - RNA, 20 nt, Artificial Sequence
  MKO10025158_A_Hunk
  gRNA
uuuggcuugagcaacugugc

SEQ ID NO: 25159 - RNA, 20 nt, Artificial Sequence
  MKO10025159_A_Hus1b
  gRNA
gagcucuauaaaacgcuugc

SEQ ID NO: 25160 - RNA, 20 nt, Artificial Sequence
  MKO10025160_A_Hus1b
  gRNA
gcagcgccccugccuuacuu

SEQ ID NO: 25161 - RNA, 20 nt, Artificial Sequence
  MKO10025161_A_Hus1b
  gRNA
ucacaucagagccccgaaca

SEQ ID NO: 25162 - RNA, 20 nt, Artificial Sequence
  MKO10025162_A_Hus1
  gRNA
cuucauccugugcgacaagc

SEQ ID NO: 25163 - RNA, 20 nt, Artificial Sequence
  MKO10025163_A_Hus1
  gRNA
gauuuauuuagaauuaacgu

SEQ ID NO: 25164 - RNA, 20 nt, Artificial Sequence
  MKO10025164_A_Hus1
  gRNA
aucgagcagcagcagaaucg

SEQ ID NO: 25165 - RNA, 20 nt, Artificial Sequence
  MKO10025165_A_Huwe1
  gRNA
gaucuguuggaccgcuuuga

SEQ ID NO: 25166 - RNA, 20 nt, Artificial Sequence
  MKO10025166_A_Huwe1
  gRNA
agaggacuccgcuacugaca

SEQ ID NO: 25167 - RNA, 20 nt, Artificial Sequence
  MKO10025167_A_Huwe1
  gRNA
ucuagugugaguuauaucac

SEQ ID NO: 25168 - RNA, 20 nt, Artificial Sequence
  MKO10025168_A_Hvcn1
  gRNA
cggacguaccauugaugauc

SEQ ID NO: 25169 - RNA, 20 nt, Artificial Sequence
  MKO10025169_A_Hvcn1
  gRNA
accgcauagucuugcucguc

SEQ ID NO: 25170 - RNA, 20 nt, Artificial Sequence
  MKO10025170_A_Hvcn1
  gRNA
gccggacgagcaagacuaug

SEQ ID NO: 25171 - RNA, 20 nt, Artificial Sequence
  MKO10025171_A_Hyal1
  gRNA
cguucgacaccgugugcaag

SEQ ID NO: 25172 - RNA, 20 nt, Artificial Sequence
  MKO10025172_A_Hyal1
  gRNA
uucugaucacggacgaauac

SEQ ID NO: 25173 - RNA, 20 nt, Artificial Sequence
  MKO10025173_A_Hyal1
  gRNA
auuucauagccaucugcgcc

SEQ ID NO: 25174 - RNA, 20 nt, Artificial Sequence
  MKO10025174_A_Hyal2
  gRNA
acgaguuugaguucgccgcu

SEQ ID NO: 25175 - RNA, 20 nt, Artificial Sequence
  MKO10025175_A_Hyal2
  gRNA
cucgaagggccucccgaaca

SEQ ID NO: 25176 - RNA, 20 nt, Artificial Sequence
  MKO10025176_A_Hyal2
  gRNA
ccuacauagucaacgugucc

SEQ ID NO: 25177 - RNA, 20 nt, Artificial Sequence
  MKO10025177_A_Hyal3
  gRNA
cuuuguccgacaccgccugg

SEQ ID NO: 25178 - RNA, 20 nt, Artificial Sequence
  MKO10025178_A_Hyal3
  gRNA
cuuuccgggcacaucgacca

SEQ ID NO: 25179 - RNA, 20 nt, Artificial Sequence
  MKO10025179_A_Hyal3
  gRNA
cccgaaacacccaacugcgu

SEQ ID NO: 25180 - RNA, 20 nt, Artificial Sequence
  MKO10025180_A_Hyal4
  gRNA
cccugcaaguuaccacauag

SEQ ID NO: 25181 - RNA, 20 nt, Artificial Sequence
  MKO10025181_A_Hyal4
  gRNA
cuuugcacuucucacgauuu

SEQ ID NO: 25182 - RNA, 20 nt, Artificial Sequence
  MKO10025182_A_Hyal4
  gRNA
gcaugacccaguauaguuug

SEQ ID NO: 25183 - RNA, 20 nt, Artificial Sequence
  MKO10025183_A_Hyal5
  gRNA
ucgaacacacgccuugauuc

SEQ ID NO: 25184 - RNA, 20 nt, Artificial Sequence
  MKO10025184_A_Hyal5
  gRNA
uuuaaucagccacuagaucu

SEQ ID NO: 25185 - RNA, 20 nt, Artificial Sequence
  MKO10025185_A_Hyal5
  gRNA
agggugacguugaugauaua

SEQ ID NO: 25186 - RNA, 20 nt, Artificial Sequence
  MKO10025186_A_Hyal6
  gRNA
gucgagugaaggcuagcgag

SEQ ID NO: 25187 - RNA, 20 nt, Artificial Sequence
  MKO10025187_A_Hyal6
  gRNA
gagcugccggagcgaccaga

SEQ ID NO: 25188 - RNA, 20 nt, Artificial Sequence
  MKO10025188_A_Hyal6
  gRNA
gcugaauucaauccacuugc

SEQ ID NO: 25189 - RNA, 20 nt, Artificial Sequence
  MKO10025189_A_Hydin
  gRNA
cuuaccacccaugagcccga

SEQ ID NO: 25190 - RNA, 20 nt, Artificial Sequence
  MKO10025190_A_Hydin
  gRNA
gaucaccgaacucuuagaua

SEQ ID NO: 25191 - RNA, 20 nt, Artificial Sequence
  MKO10025191_A_Hydin
  gRNA
aagaggauucggaauacaga

SEQ ID NO: 25192 - RNA, 20 nt, Artificial Sequence
  MKO10025192_A_Hyi
  gRNA
uaccuugccggggcgugucc

SEQ ID NO: 25193 - RNA, 20 nt, Artificial Sequence
  MKO10025193_A_Hyi
  gRNA
gggguacucggccagccauc

SEQ ID NO: 25194 - RNA, 20 nt, Artificial Sequence
  MKO10025194_A_Hyi
  gRNA
ugggcuccagcagucccacg

SEQ ID NO: 25195 - RNA, 20 nt, Artificial Sequence
  MKO10025195_A_Hykk
  gRNA
uaccgauucuaccagugcag

SEQ ID NO: 25196 - RNA, 20 nt, Artificial Sequence
  MKO10025196_A_Hykk
  gRNA
gccuccguaugccgaacuaa

SEQ ID NO: 25197 - RNA, 20 nt, Artificial Sequence
  MKO10025197_A_Hykk
  gRNA
gacuucggugacaugagcua

SEQ ID NO: 25198 - RNA, 20 nt, Artificial Sequence
  MKO10025198_A_Hyls1
  gRNA
aguuacgcuggaguguccga

SEQ ID NO: 25199 - RNA, 20 nt, Artificial Sequence
  MKO10025199_A_Hyls1
  gRNA
cuacucggucuaucuugccc

SEQ ID NO: 25200 - RNA, 20 nt, Artificial Sequence
  MKO10025200_A_Hyls1
  gRNA
ucggcuuaacugauccaguc

SEQ ID NO: 25201 - RNA, 20 nt, Artificial Sequence
  MKO10025201_A_Hyou1
  gRNA
aaauaacggagcguagccuu

SEQ ID NO: 25202 - RNA, 20 nt, Artificial Sequence
  MKO10025202_A_Hyou1
  gRNA
acaggcggauaacccucaug

SEQ ID NO: 25203 - RNA, 20 nt, Artificial Sequence
  MKO10025203_A_Hyou1
  gRNA
ucugaacuacucccguuccu

SEQ ID NO: 25204 - RNA, 20 nt, Artificial Sequence
  MKO10025204_A_Hypk
  gRNA
ugagaucgaaauggcgaccg

SEQ ID NO: 25205 - RNA, 20 nt, Artificial Sequence
  MKO10025205_A_Hypk
  gRNA
cuacaggcuauguccgucau

SEQ ID NO: 25206 - RNA, 20 nt, Artificial Sequence
  MKO10025206_A_Hypk
  gRNA
cauagucaguaacccgcucu

SEQ ID NO: 25207 - RNA, 20 nt, Artificial Sequence
  MKO10025207_A_I830012O16Rik
  gRNA
ucaagcagaaauucgccgac

SEQ ID NO: 25208 - RNA, 20 nt, Artificial Sequence
  MKO10025208_A_I830012O16Rik
  gRNA
ccaggagaacuuucacguac

SEQ ID NO: 25209 - RNA, 20 nt, Artificial Sequence
  MKO10025209_A_I830012O16Rik
  gRNA
aguuuccccacgugaccagu

SEQ ID NO: 25210 - RNA, 20 nt, Artificial Sequence
  MKO10025210_A_I830077J02Rik
  gRNA
uugacuagaaaccacuccuc

SEQ ID NO: 25211 - RNA, 20 nt, Artificial Sequence
  MKO10025211_A_I830077J02Rik
  gRNA
uucugcagcucuugacaaug

SEQ ID NO: 25212 - RNA, 20 nt, Artificial Sequence
  MKO10025212_A_I830077J02Rik
  gRNA
gauagugggcuccaagccug

SEQ ID NO: 25213 - RNA, 20 nt, Artificial Sequence
  MKO10025213_A_Iah1
  gRNA
augaguacagcgcaaaccug

SEQ ID NO: 25214 - RNA, 20 nt, Artificial Sequence
  MKO10025214_A_Iah1
  gRNA
ccccgcucugcgaagccgcc

SEQ ID NO: 25215 - RNA, 20 nt, Artificial Sequence
  MKO10025215_A_Iah1
  gRNA
gaggauaaucuuggcccauc

SEQ ID NO: 25216 - RNA, 20 nt, Artificial Sequence
  MKO10025216_A_Iapp
  gRNA
augcggcaggggauccaaau

SEQ ID NO: 25217 - RNA, 20 nt, Artificial Sequence
  MKO10025217_A_Iapp
  gRNA
auauguauucgaucccacgu

SEQ ID NO: 25218 - RNA, 20 nt, Artificial Sequence
  MKO10025218_A_Iapp
  gRNA
ugagagcuacaccugucaga

SEQ ID NO: 25219 - RNA, 20 nt, Artificial Sequence
  MKO10025219_A_Iars2
  gRNA
gacgggccuccuuaugccaa

SEQ ID NO: 25220 - RNA, 20 nt, Artificial Sequence
  MKO10025220_A_Iars2
  gRNA
aaucgauuccauaugaugag

SEQ ID NO: 25221 - RNA, 20 nt, Artificial Sequence
  MKO10025221_A_Iars2
  gRNA
cauaaggaggcccgucauga

SEQ ID NO: 25222 - RNA, 20 nt, Artificial Sequence
  MKO10025222_A_Iars
  gRNA
acgagauacgcucaccagag

SEQ ID NO: 25223 - RNA, 20 nt, Artificial Sequence
  MKO10025223_A_Iars
  gRNA
ugucaacgugaaacccgcuc

SEQ ID NO: 25224 - RNA, 20 nt, Artificial Sequence
  MKO10025224_A_Iars
  gRNA
agugccacacgcgguggaga

SEQ ID NO: 25225 - RNA, 20 nt, Artificial Sequence
  MKO10025225_A_Iba57
  gRNA
ggcauacgccgcacgcgcag

SEQ ID NO: 25226 - RNA, 20 nt, Artificial Sequence
  MKO10025226_A_Iba57
  gRNA
gcuugcggaugacaccugua

SEQ ID NO: 25227 - RNA, 20 nt, Artificial Sequence
  MKO10025227_A_Iba57
  gRNA
gccaccccauacgugcaguc

SEQ ID NO: 25228 - RNA, 20 nt, Artificial Sequence
  MKO10025228_A_Ibsp
  gRNA
agacggcgauaguuccgaag

SEQ ID NO: 25229 - RNA, 20 nt, Artificial Sequence
  MKO10025229_A_Ibsp
  gRNA
uggacuggaaaccguuucag

SEQ ID NO: 25230 - RNA, 20 nt, Artificial Sequence
  MKO10025230_A_Ibsp
  gRNA
ccucugcuuugauucuucga

SEQ ID NO: 25231 - RNA, 20 nt, Artificial Sequence
  MKO10025231_A_Ibtk
  gRNA
cuaaccguccuccgcgacca

SEQ ID NO: 25232 - RNA, 20 nt, Artificial Sequence
  MKO10025232_A_Ibtk
  gRNA
uggucacaauuguucgcaag

SEQ ID NO: 25233 - RNA, 20 nt, Artificial Sequence
  MKO10025233_A_Ibtk
  gRNA
cuggguacauuacaacuagc

SEQ ID NO: 25234 - RNA, 20 nt, Artificial Sequence
  MKO10025234_A_Ica1l
  gRNA
cugugcgggcccgcuccaug

SEQ ID NO: 25235 - RNA, 20 nt, Artificial Sequence
  MKO10025235_A_Ica1l
  gRNA
ugaccauuaaccgcauggag

SEQ ID NO: 25236 - RNA, 20 nt, Artificial Sequence
  MKO10025236_A_Ica1l
  gRNA
ccauaccguugagucuuagc

SEQ ID NO: 25237 - RNA, 20 nt, Artificial Sequence
  MKO10025237_A_Ica1
  gRNA
uuccaagacaaaacccgagc

SEQ ID NO: 25238 - RNA, 20 nt, Artificial Sequence
  MKO10025238_A_Ica1
  gRNA
ucgacacaaaggguuucuca

SEQ ID NO: 25239 - RNA, 20 nt, Artificial Sequence
  MKO10025239_A_Ica1
  gRNA
cgauugcuuuagacaagucc

SEQ ID NO: 25240 - RNA, 20 nt, Artificial Sequence
  MKO10025240_A_Icam1
  gRNA
ggaccucaccgaaaguccgg

SEQ ID NO: 25241 - RNA, 20 nt, Artificial Sequence
  MKO10025241_A_Icam1
  gRNA
ucguuugugauccuccgagc

SEQ ID NO: 25242 - RNA, 20 nt, Artificial Sequence
  MKO10025242_A_Icam1
  gRNA
ccugccgcugcgcugcguuu

SEQ ID NO: 25243 - RNA, 20 nt, Artificial Sequence
  MKO10025243_A_Icam2
  gRNA
ucacacgggacgugcccgaa

SEQ ID NO: 25244 - RNA, 20 nt, Artificial Sequence
  MKO10025244_A_Icam2
  gRNA
gagcuggaucuacggcccca

SEQ ID NO: 25245 - RNA, 20 nt, Artificial Sequence
  MKO10025245_A_Icam2
  gRNA
ccaggcagcuagcaccccgu

SEQ ID NO: 25246 - RNA, 20 nt, Artificial Sequence
  MKO10025246_A_Icam4
  gRNA
ugucuacgugcgcaaguacc

SEQ ID NO: 25247 - RNA, 20 nt, Artificial Sequence
  MKO10025247_A_Icam4
  gRNA
ccacuagcccgucgagauug

SEQ ID NO: 25248 - RNA, 20 nt, Artificial Sequence
  MKO10025248_A_Icam4
  gRNA
gcgcuucaccgguucagauu

SEQ ID NO: 25249 - RNA, 20 nt, Artificial Sequence
  MKO10025249_A_Icam5
  gRNA
cggucgcgcuagaaccuuuc

SEQ ID NO: 25250 - RNA, 20 nt, Artificial Sequence
  MKO10025250_A_Icam5
  gRNA
cgcgcuccacgagcgccacg

SEQ ID NO: 25251 - RNA, 20 nt, Artificial Sequence
  MKO10025251_A_Icam5
  gRNA
gaguuuccccguccacaucg

SEQ ID NO: 25252 - RNA, 20 nt, Artificial Sequence
  MKO10025252_A_Ick
  gRNA
uaaauaccuuaaccucccga

SEQ ID NO: 25253 - RNA, 20 nt, Artificial Sequence
  MKO10025253_A_Ick
  gRNA
auauuccuuauagcagacuc

SEQ ID NO: 25254 - RNA, 20 nt, Artificial Sequence
  MKO10025254_A_Ick
  gRNA
uucucgagccaauccaaagu

SEQ ID NO: 25255 - RNA, 20 nt, Artificial Sequence
  MKO10025255_A_Icmt
  gRNA
guuggagccagccguaaaca

SEQ ID NO: 25256 - RNA, 20 nt, Artificial Sequence
  MKO10025256_A_Icmt
  gRNA
uuacuggaguaucggaaccc

SEQ ID NO: 25257 - RNA, 20 nt, Artificial Sequence
  MKO10025257_A_Icmt
  gRNA
cuuccgagaucgcacagaag

SEQ ID NO: 25258 - RNA, 20 nt, Artificial Sequence
  MKO10025258_A_Icosl
  gRNA
ccguuguguugauccaauac

SEQ ID NO: 25259 - RNA, 20 nt, Artificial Sequence
  MKO10025259_A_Icosl
  gRNA
cguccccaccgaagcuauac

SEQ ID NO: 25260 - RNA, 20 nt, Artificial Sequence
  MKO10025260_A_Icosl
  gRNA
ccgcugccgccaguacagca

SEQ ID NO: 25261 - RNA, 20 nt, Artificial Sequence
  MKO10025261_A_Icos
  gRNA
aacgaaagcugcacacccua

SEQ ID NO: 25262 - RNA, 20 nt, Artificial Sequence
  MKO10025262_A_Icos
  gRNA
agggugugcagcuuucguug

SEQ ID NO: 25263 - RNA, 20 nt, Artificial Sequence
  MKO10025263_A_Icos
  gRNA
caccgcauuuccgcuucccu

SEQ ID NO: 25264 - RNA, 20 nt, Artificial Sequence
  MKO10025264_A_Icu1
  gRNA
guaccgugagggcaaucuuc

SEQ ID NO: 25265 - RNA, 20 nt, Artificial Sequence
  MKO10025265_A_Icu1
  gRNA
ccagauugcggaacugauac

SEQ ID NO: 25266 - RNA, 20 nt, Artificial Sequence
  MKO10025266_A_Icu1
  gRNA
aauucgagacaugauugccg

SEQ ID NO: 25267 - RNA, 20 nt, Artificial Sequence
  MKO10025267_A_Id1
  gRNA
cgucccagcgcagcgcgaga

SEQ ID NO: 25268 - RNA, 20 nt, Artificial Sequence
  MKO10025268_A_Id1
  gRNA
gcgacacaagaugcgaucgu

SEQ ID NO: 25269 - RNA, 20 nt, Artificial Sequence
  MKO10025269_A_Id1
  gRNA
cccgccuucagcgaacagcu

SEQ ID NO: 25270 - RNA, 20 nt, Artificial Sequence
  MKO10025270_A_Id2
  gRNA
ugcccaagcugugguccgac

SEQ ID NO: 25271 - RNA, 20 nt, Artificial Sequence
  MKO10025271_A_Id2
  gRNA
gcacgucaucgauuacaucu

SEQ ID NO: 25272 - RNA, 20 nt, Artificial Sequence
  MKO10025272_A_Id2
  gRNA
aaugauagcaaaguacucug

SEQ ID NO: 25273 - RNA, 20 nt, Artificial Sequence
  MKO10025273_A_Id3
  gRNA
cgguaagagcccgucgaccg

SEQ ID NO: 25274 - RNA, 20 nt, Artificial Sequence
  MKO10025274_A_Id3
  gRNA
cuuaccgcggccucgcgcaa

SEQ ID NO: 25275 - RNA, 20 nt, Artificial Sequence
  MKO10025275_A_Id3
  gRNA
gcaaaagcuccucuuguccu

SEQ ID NO: 25276 - RNA, 20 nt, Artificial Sequence
  MKO10025276_A_Id4
  gRNA
cuuguccggucgcgccgccg

SEQ ID NO: 25277 - RNA, 20 nt, Artificial Sequence
  MKO10025277_A_Id4
  gRNA
cucgggccgcaaggcgccgu

SEQ ID NO: 25278 - RNA, 20 nt, Artificial Sequence
  MKO10025278_A_Id4
  gRNA
ggccggcgccgugaacaagc

SEQ ID NO: 25279 - RNA, 20 nt, Artificial Sequence
  MKO10025279_A_Ide
  gRNA
guauuauucguccaaucuga

SEQ ID NO: 25280 - RNA, 20 nt, Artificial Sequence
  MKO10025280_A_Ide
  gRNA
cccuuacgucgaugccuucu

SEQ ID NO: 25281 - RNA, 20 nt, Artificial Sequence
  MKO10025281_A_Ide
  gRNA
cuuagacgaccucacuaacc

SEQ ID NO: 25282 - RNA, 20 nt, Artificial Sequence
  MKO10025282_A_Idh1
  gRNA
ugggccuguaagaauuacga

SEQ ID NO: 25283 - RNA, 20 nt, Artificial Sequence
  MKO10025283_A_Idh1
  gRNA
ggcccaagcuaugaaguccg

SEQ ID NO: 25284 - RNA, 20 nt, Artificial Sequence
  MKO10025284_A_Idh1
  gRNA
agucuucaauugacuuaucc

SEQ ID NO: 25285 - RNA, 20 nt, Artificial Sequence
  MKO10025285_A_Idh2
  gRNA
auguuccggaucguuccguu

SEQ ID NO: 25286 - RNA, 20 nt, Artificial Sequence
  MKO10025286_A_Idh2
  gRNA
agagcccuaacggaacgauc

SEQ ID NO: 25287 - RNA, 20 nt, Artificial Sequence
  MKO10025287_A_Idh2
  gRNA
ucgagcuggcacguucaagu

SEQ ID NO: 25288 - RNA, 20 nt, Artificial Sequence
  MKO10025288_A_Idh3a
  gRNA
aauguaggucucucggcugc

SEQ ID NO: 25289 - RNA, 20 nt, Artificial Sequence
  MKO10025289_A_Idh3a
  gRNA
cuaaagaccccaauagccgc

SEQ ID NO: 25290 - RNA, 20 nt, Artificial Sequence
  MKO10025290_A_Idh3a
  gRNA
gcggcuauuggggucuuuag

SEQ ID NO: 25291 - RNA, 20 nt, Artificial Sequence
  MKO10025291_A_Idh3b
  gRNA
cgcaggcggugcucgccgcu

SEQ ID NO: 25292 - RNA, 20 nt, Artificial Sequence
  MKO10025292_A_Idh3b
  gRNA
aguucacccuuauacuccau

SEQ ID NO: 25293 - RNA, 20 nt, Artificial Sequence
  MKO10025293_A_Idh3b
  gRNA
ccuccuaugauaugcagcug

SEQ ID NO: 25294 - RNA, 20 nt, Artificial Sequence
  MKO10025294_A_Idh3g
  gRNA
uguaagcuccaacgcugaug

SEQ ID NO: 25295 - RNA, 20 nt, Artificial Sequence
  MKO10025295_A_Idh3g
  gRNA
ggacauccgcaaugccauca

SEQ ID NO: 25296 - RNA, 20 nt, Artificial Sequence
  MKO10025296_A_Idh3g
  gRNA
uuacugaggaaaugcuccuu

SEQ ID NO: 25297 - RNA, 20 nt, Artificial Sequence
  MKO10025297_A_Idi1
  gRNA
agagcggguaccucuuccaa

SEQ ID NO: 25298 - RNA, 20 nt, Artificial Sequence
  MKO10025298_A_Idi1
  gRNA
guagguugaucuaaaugaaa

SEQ ID NO: 25299 - RNA, 20 nt, Artificial Sequence
  MKO10025299_A_Idi1
  gRNA
cagccaucuugaugaaaaac

SEQ ID NO: 25300 - RNA, 20 nt, Artificial Sequence
  MKO10025300_A_Idi2
  gRNA
gcucagccugcagacgucuu

SEQ ID NO: 25301 - RNA, 20 nt, Artificial Sequence
  MKO10025301_A_Idi2
  gRNA
ggcagcccuaagacgucugc

SEQ ID NO: 25302 - RNA, 20 nt, Artificial Sequence
  MKO10025302_A_Idi2
  gRNA
gcuacacagagccuucagug

SEQ ID NO: 25303 - RNA, 20 nt, Artificial Sequence
  MKO10025303_A_Idnk
  gRNA
ugccgaugauuaccacuccg

SEQ ID NO: 25304 - RNA, 20 nt, Artificial Sequence
  MKO10025304_A_Idnk
  gRNA
aaucggauaaagauggcgaa

SEQ ID NO: 25305 - RNA, 20 nt, Artificial Sequence
  MKO10025305_A_Idnk
  gRNA
uacagagacaucuugauccg

SEQ ID NO: 25306 - RNA, 20 nt, Artificial Sequence
  MKO10025306_A_Ido1
  gRNA
ugcccgacgcauacagcccc

SEQ ID NO: 25307 - RNA, 20 nt, Artificial Sequence
  MKO10025307_A_Ido1
  gRNA
ugcccguucucaaucagcac

SEQ ID NO: 25308 - RNA, 20 nt, Artificial Sequence
  MKO10025308_A_Ido1
  gRNA
acgccauggugauguacccc

SEQ ID NO: 25309 - RNA, 20 nt, Artificial Sequence
  MKO10025309_A_Ido2
  gRNA
ggcgcuggccgcuaucacca

SEQ ID NO: 25310 - RNA, 20 nt, Artificial Sequence
  MKO10025310_A_Ido2
  gRNA
guacccuguacacgugagcu

SEQ ID NO: 25311 - RNA, 20 nt, Artificial Sequence
  MKO10025311_A_Ido2
  gRNA
gaguuaccgugagcagcgcc

SEQ ID NO: 25312 - RNA, 20 nt, Artificial Sequence
  MKO10025312_A_Ids
  gRNA
guccccgaacauugaccagc

SEQ ID NO: 25313 - RNA, 20 nt, Artificial Sequence
  MKO10025313_A_Ids
  gRNA
gugaugauuauccauauagc

SEQ ID NO: 25314 - RNA, 20 nt, Artificial Sequence
  MKO10025314_A_Ids
  gRNA
auugaagucauacaggcggg

SEQ ID NO: 25315 - RNA, 20 nt, Artificial Sequence
  MKO10025315_A_Idua
  gRNA
cugaccaguacgaccuuagu

SEQ ID NO: 25316 - RNA, 20 nt, Artificial Sequence
  MKO10025316_A_Idua
  gRNA
ccccccacugccucacgacc

SEQ ID NO: 25317 - RNA, 20 nt, Artificial Sequence
  MKO10025317_A_Idua
  gRNA
aaguccgugaaguacccaga

SEQ ID NO: 25318 - RNA, 20 nt, Artificial Sequence
  MKO10025318_A_Ier2
  gRNA
cucgagcgcugcgcauaacg

SEQ ID NO: 25319 - RNA, 20 nt, Artificial Sequence
  MKO10025319_A_Ier2
  gRNA
cgcuugcggcugacucuagc

SEQ ID NO: 25320 - RNA, 20 nt, Artificial Sequence
  MKO10025320_A_Ier2
  gRNA
ccgaguucccgccaucccgc

SEQ ID NO: 25321 - RNA, 20 nt, Artificial Sequence
  MKO10025321_A_Ier3ip1
  gRNA
cuccaaauccaccgauuccc

SEQ ID NO: 25322 - RNA, 20 nt, Artificial Sequence
  MKO10025322_A_Ier3ip1
  gRNA
ucuguaagaaccgugaugag

SEQ ID NO: 25323 - RNA, 20 nt, Artificial Sequence
  MKO10025323_A_Ier3ip1
  gRNA
gaagcgcuccucgugcagca

SEQ ID NO: 25324 - RNA, 20 nt, Artificial Sequence
  MKO10025324_A_Ier3
  gRNA
gcgcguuugaacacuucucg

SEQ ID NO: 25325 - RNA, 20 nt, Artificial Sequence
  MKO10025325_A_Ier3
  gRNA
gcaccgaaaacgcagccgaa

SEQ ID NO: 25326 - RNA, 20 nt, Artificial Sequence
  MKO10025326_A_Ier3
  gRNA
caucgcguuuagaaggccgc

SEQ ID NO: 25327 - RNA, 20 nt, Artificial Sequence
  MKO10025327_A_Ier5l
  gRNA
uuccgggcgccgcguaagcg

SEQ ID NO: 25328 - RNA, 20 nt, Artificial Sequence
  MKO10025328_A_Ier5l
  gRNA
gcucggcguaacgcucgcuc

SEQ ID NO: 25329 - RNA, 20 nt, Artificial Sequence
  MKO10025329_A_Ier5l
  gRNA
gcgcgcguugcggagcacgu

SEQ ID NO: 25330 - RNA, 20 nt, Artificial Sequence
  MKO10025330_A_Ier5
  gRNA
ccuccugaagacgccgcgcg

SEQ ID NO: 25331 - RNA, 20 nt, Artificial Sequence
  MKO10025331_A_Ier5
  gRNA
ccccucucaagaagccgcgc

SEQ ID NO: 25332 - RNA, 20 nt, Artificial Sequence
  MKO10025332_A_Ier5
  gRNA
ccgcguggagcguccgcgcg

SEQ ID NO: 25333 - RNA, 20 nt, Artificial Sequence
  MKO10025333_A_Iffo1
  gRNA
gguccuucucucacgcccgc

SEQ ID NO: 25334 - RNA, 20 nt, Artificial Sequence
  MKO10025334_A_Iffo1
  gRNA
ccggcuucaucagcccgauc

SEQ ID NO: 25335 - RNA, 20 nt, Artificial Sequence
  MKO10025335_A_Iffo1
  gRNA
gcuuggccgugaugucaaug

SEQ ID NO: 25336 - RNA, 20 nt, Artificial Sequence
  MKO10025336_A_Iffo2
  gRNA
gcuuagccgugauaucgauu

SEQ ID NO: 25337 - RNA, 20 nt, Artificial Sequence
  MKO10025337_A_Iffo2
  gRNA
cugccgccgaaucgauauca

SEQ ID NO: 25338 - RNA, 20 nt, Artificial Sequence
  MKO10025338_A_Iffo2
  gRNA
acaggcggcgcaagaagccg

SEQ ID NO: 25339 - RNA, 20 nt, Artificial Sequence
  MKO10025339_A_Ifi202b
  gRNA
gggaaaccaauauuacacuc

SEQ ID NO: 25340 - RNA, 20 nt, Artificial Sequence
  MKO10025340_A_Ifi202b
  gRNA
ugaauauuccagcgugucug

SEQ ID NO: 25341 - RNA, 20 nt, Artificial Sequence
  MKO10025341_A_Ifi202b
  gRNA
accaaucucacaguugacac

SEQ ID NO: 25342 - RNA, 20 nt, Artificial Sequence
  MKO10025342_A_Ifi203
  gRNA
ucagcuggcggacuggauug

SEQ ID NO: 25343 - RNA, 20 nt, Artificial Sequence
  MKO10025343_A_Ifi203
  gRNA
aaggaaaaugcaaaacggcu

SEQ ID NO: 25344 - RNA, 20 nt, Artificial Sequence
  MKO10025344_A_Ifi203
  gRNA
aauguucacaucggacacac

SEQ ID NO: 25345 - RNA, 20 nt, Artificial Sequence
  MKO10025345_A_Ifi204
  gRNA
uucaccugaaaacaauugac

SEQ ID NO: 25346 - RNA, 20 nt, Artificial Sequence
  MKO10025346_A_Ifi204
  gRNA
auggcacaacaucaacugca

SEQ ID NO: 25347 - RNA, 20 nt, Artificial Sequence
  MKO10025347_A_Ifi204
  gRNA
ugcauuucugauaauacugu

SEQ ID NO: 25348 - RNA, 20 nt, Artificial Sequence
  MKO10025348_A_Ifi205
  gRNA
gacugacgugaagaagauca

SEQ ID NO: 25349 - RNA, 20 nt, Artificial Sequence
  MKO10025349_A_Ifi205
  gRNA
augaagccgaagaugagacc

SEQ ID NO: 25350 - RNA, 20 nt, Artificial Sequence
  MKO10025350_A_Ifi205
  gRNA
ggaagagacuuccacagccc

SEQ ID NO: 25351 - RNA, 20 nt, Artificial Sequence
  MKO10025351_A_Ifi27l2a
  gRNA
cuuaccugcugauuggagug

SEQ ID NO: 25352 - RNA, 20 nt, Artificial Sequence
  MKO10025352_A_Ifi27l2a
  gRNA
cucucuauaggaacacuguu

SEQ ID NO: 25353 - RNA, 20 nt, Artificial Sequence
  MKO10025353_A_Ifi27l2a
  gRNA
acaucaacaaaugccauccu

SEQ ID NO: 25354 - RNA, 20 nt, Artificial Sequence
  MKO10025354_A_Ifi27l2b
  gRNA
agggccucaggauccuccgc

SEQ ID NO: 25355 - RNA, 20 nt, Artificial Sequence
  MKO10025355_A_Ifi27l2b
  gRNA
cacaauaaccaacaucaucc

SEQ ID NO: 25356 - RNA, 20 nt, Artificial Sequence
  MKO10025356_A_Ifi27l2b
  gRNA
accugucgcccugagugccg

SEQ ID NO: 25357 - RNA, 20 nt, Artificial Sequence
  MKO10025357_A_Ifi27
  gRNA
caccauucuagcugguucga

SEQ ID NO: 25358 - RNA, 20 nt, Artificial Sequence
  MKO10025358_A_Ifi27
  gRNA
cgugccaucuacugucaucg

SEQ ID NO: 25359 - RNA, 20 nt, Artificial Sequence
  MKO10025359_A_Ifi27
  gRNA
cucugcagggucugccguug

SEQ ID NO: 25360 - RNA, 20 nt, Artificial Sequence
  MKO10025360_A_Ifi30
  gRNA
uugggaacaaaucccggacg

SEQ ID NO: 25361 - RNA, 20 nt, Artificial Sequence
  MKO10025361_A_Ifi30
  gRNA
aguagcgacaagcuccacac

SEQ ID NO: 25362 - RNA, 20 nt, Artificial Sequence
  MKO10025362_A_Ifi30
  gRNA
guuccuaaccaucgucugua

SEQ ID NO: 25363 - RNA, 20 nt, Artificial Sequence
  MKO10025363_A_Ifi35
  gRNA
ugaucgguugcuacaacaaa

SEQ ID NO: 25364 - RNA, 20 nt, Artificial Sequence
  MKO10025364_A_Ifi35
  gRNA
ucacucagccuaaguccagc

SEQ ID NO: 25365 - RNA, 20 nt, Artificial Sequence
  MKO10025365_A_Ifi35
  gRNA
accugaauguuggucaccac

SEQ ID NO: 25366 - RNA, 20 nt, Artificial Sequence
  MKO10025366_A_Ifi44l
  gRNA
cuuagaggacuugccucucg

SEQ ID NO: 25367 - RNA, 20 nt, Artificial Sequence
  MKO10025367_A_Ifi44l
  gRNA
agguuaccaguauccucgag

SEQ ID NO: 25368 - RNA, 20 nt, Artificial Sequence
  MKO10025368_A_Ifi44l
  gRNA
uagucccaaagcucaucaca

SEQ ID NO: 25369 - RNA, 20 nt, Artificial Sequence
  MKO10025369_A_Ifi44
  gRNA
gaacucguguuugcugaacc

SEQ ID NO: 25370 - RNA, 20 nt, Artificial Sequence
  MKO10025370_A_Ifi44
  gRNA
uucggaugguuugaugugau

SEQ ID NO: 25371 - RNA, 20 nt, Artificial Sequence
  MKO10025371_A_Ifi44
  gRNA
cugagagacuacaagcccua

SEQ ID NO: 25372 - RNA, 20 nt, Artificial Sequence
  MKO10025372_A_Ifi47
  gRNA
ggucuagauaagcgucugcg

SEQ ID NO: 25373 - RNA, 20 nt, Artificial Sequence
  MKO10025373_A_Ifi47
  gRNA
caucgucaaccacuauguua

SEQ ID NO: 25374 - RNA, 20 nt, Artificial Sequence
  MKO10025374_A_Ifi47
  gRNA
aacauaugacgcuugugccc

SEQ ID NO: 25375 - RNA, 20 nt, Artificial Sequence
  MKO10025375_A_Ifih1
  gRNA
guuugacauagcgcgcggcu

SEQ ID NO: 25376 - RNA, 20 nt, Artificial Sequence
  MKO10025376_A_Ifih1
  gRNA
gguuaucguucuugucaaua

SEQ ID NO: 25377 - RNA, 20 nt, Artificial Sequence
  MKO10025377_A_Ifih1
  gRNA
ugggccacuuccauuuggua

SEQ ID NO: 25378 - RNA, 20 nt, Artificial Sequence
  MKO10025378_A_Ifit1
  gRNA
caggauauucaccuccgcua

SEQ ID NO: 25379 - RNA, 20 nt, Artificial Sequence
  MKO10025379_A_Ifit1
  gRNA
ugucuacgcgauguuuccua

SEQ ID NO: 25380 - RNA, 20 nt, Artificial Sequence
  MKO10025380_A_Ifit1
  gRNA
cauagcgaaugacauagcuu

SEQ ID NO: 25381 - RNA, 20 nt, Artificial Sequence
  MKO10025381_A_Ifit2
  gRNA
ggccauugcgaacuaccguc

SEQ ID NO: 25382 - RNA, 20 nt, Artificial Sequence
  MKO10025382_A_Ifit2
  gRNA
cgccuaugugcauuacuaua

SEQ ID NO: 25383 - RNA, 20 nt, Artificial Sequence
  MKO10025383_A_Ifit2
  gRNA
cgucaagcuucagugccaag

SEQ ID NO: 25384 - RNA, 20 nt, Artificial Sequence
  MKO10025384_A_Ifit3
  gRNA
ucaaucagaaauucgucgac

SEQ ID NO: 25385 - RNA, 20 nt, Artificial Sequence
  MKO10025385_A_Ifit3
  gRNA
gauccaggcguaguuucccc

SEQ ID NO: 25386 - RNA, 20 nt, Artificial Sequence
  MKO10025386_A_Ifit3
  gRNA
cagaguuuaaauguucgacc

SEQ ID NO: 25387 - RNA, 20 nt, Artificial Sequence
  MKO10025387_A_Ifitm10
  gRNA
ucguucaccuccguaguguc

SEQ ID NO: 25388 - RNA, 20 nt, Artificial Sequence
  MKO10025388_A_Ifitm10
  gRNA
gaaaggcugucuggcgacac

SEQ ID NO: 25389 - RNA, 20 nt, Artificial Sequence
  MKO10025389_A_Ifitm10
  gRNA
guagaccucgaugacugugg

SEQ ID NO: 25390 - RNA, 20 nt, Artificial Sequence
  MKO10025390_A_Ifitm1
  gRNA
gaucuccacgccugaccaug

SEQ ID NO: 25391 - RNA, 20 nt, Artificial Sequence
  MKO10025391_A_Ifitm1
  gRNA
auacaauaccuucacggagu

SEQ ID NO: 25392 - RNA, 20 nt, Artificial Sequence
  MKO10025392_A_Ifitm1
  gRNA
gucucuuccagucuagggac

SEQ ID NO: 25393 - RNA, 20 nt, Artificial Sequence
  MKO10025393_A_Ifitm2
  gRNA
cccggcauugguggacaaga

SEQ ID NO: 25394 - RNA, 20 nt, Artificial Sequence
  MKO10025394_A_Ifitm2
  gRNA
auuuccuucagucuagggac

SEQ ID NO: 25395 - RNA, 20 nt, Artificial Sequence
  MKO10025395_A_Ifitm2
  gRNA
ugccuaugccuacucuguga

SEQ ID NO: 25396 - RNA, 20 nt, Artificial Sequence
  MKO10025396_A_Ifitm3
  gRNA
gaauccucuauuaaguguga

SEQ ID NO: 25397 - RNA, 20 nt, Artificial Sequence
  MKO10025397_A_Ifitm3
  gRNA
uucugcuccagucuagggau

SEQ ID NO: 25398 - RNA, 20 nt, Artificial Sequence
  MKO10025398_A_Ifitm3
  gRNA
cacacucaccuucacggagu

SEQ ID NO: 25399 - RNA, 20 nt, Artificial Sequence
  MKO10025399_A_Ifitm5
  gRNA
caccacgagaucacaugcuc

SEQ ID NO: 25400 - RNA, 20 nt, Artificial Sequence
  MKO10025400_A_Ifitm5
  gRNA
ggacacuucauauccccgug

SEQ ID NO: 25401 - RNA, 20 nt, Artificial Sequence
  MKO10025401_A_Ifitm5
  gRNA
gaagaaagccgcagagucuu

SEQ ID NO: 25402 - RNA, 20 nt, Artificial Sequence
  MKO10025402_A_Ifitm6
  gRNA
caacagugauguuauccagc

SEQ ID NO: 25403 - RNA, 20 nt, Artificial Sequence
  MKO10025403_A_Ifitm6
  gRNA
caccuucaccgaguagaugu

SEQ ID NO: 25404 - RNA, 20 nt, Artificial Sequence
  MKO10025404_A_Ifitm6
  gRNA
ucaugucgcccaccaucuuc

SEQ ID NO: 25405 - RNA, 20 nt, Artificial Sequence
  MKO10025405_A_Ifitm7
  gRNA
accgccccauaacgccugag

SEQ ID NO: 25406 - RNA, 20 nt, Artificial Sequence
  MKO10025406_A_Ifitm7
  gRNA
uaaugggcccggcguugcug

SEQ ID NO: 25407 - RNA, 20 nt, Artificial Sequence
  MKO10025407_A_Ifitm7
  gRNA
ccugauccucuccgucguca

SEQ ID NO: 25408 - RNA, 20 nt, Artificial Sequence
  MKO10025408_A_Ifltd1
  gRNA
acgauaagguggagcuguuc

SEQ ID NO: 25409 - RNA, 20 nt, Artificial Sequence
  MKO10025409_A_Ifltd1
  gRNA
uccucccaaacaaaguccgu

SEQ ID NO: 25410 - RNA, 20 nt, Artificial Sequence
  MKO10025410_A_Ifltd1
  gRNA
aagucggccaauuuacaucc

SEQ ID NO: 25411 - RNA, 20 nt, Artificial Sequence
  MKO10025411_A_Ifna11
  gRNA
ucaucacuaucaagaucaug

SEQ ID NO: 25412 - RNA, 20 nt, Artificial Sequence
  MKO10025412_A_Ifna11
  gRNA
cuugaaccucuucgcaucaa

SEQ ID NO: 25413 - RNA, 20 nt, Artificial Sequence
  MKO10025413_A_Ifna11
  gRNA
ucuugauagugaugagcuac

SEQ ID NO: 25414 - RNA, 20 nt, Artificial Sequence
  MKO10025414_A_Ifna12
  gRNA
ucuugccagcaacuuagcug

SEQ ID NO: 25415 - RNA, 20 nt, Artificial Sequence
  MKO10025415_A_Ifna12
  gRNA
gucuuccucagcuaaguugc

SEQ ID NO: 25416 - RNA, 20 nt, Artificial Sequence
  MKO10025416_A_Ifna12
  gRNA
uaaaguucuuucuguccuuc

SEQ ID NO: 25417 - RNA, 20 nt, Artificial Sequence
  MKO10025417_A_Ifna13
  gRNA
ugggucagcucaugaacaaa

SEQ ID NO: 25418 - RNA, 20 nt, Artificial Sequence
  MKO10025418_A_Ifna13
  gRNA
gcugcaucagacaagcuuug

SEQ ID NO: 25419 - RNA, 20 nt, Artificial Sequence
  MKO10025419_A_Ifna13
  gRNA
caaagcuugucugaugcagc

SEQ ID NO: 25420 - RNA, 20 nt, Artificial Sequence
  MKO10025420_A_Ifna14
  gRNA
gcgggaauccaaaguccuuc

SEQ ID NO: 25421 - RNA, 20 nt, Artificial Sequence
  MKO10025421_A_Ifna14
  gRNA
gaugcagcagguagagauac

SEQ ID NO: 25422 - RNA, 20 nt, Artificial Sequence
  MKO10025422_A_Ifna14
  gRNA
acucagcucaaugaccugca

SEQ ID NO: 25423 - RNA, 20 nt, Artificial Sequence
  MKO10025423_A_Ifna1
  gRNA
ucucagucuucccagcacau

SEQ ID NO: 25424 - RNA, 20 nt, Artificial Sequence
  MKO10025424_A_Ifna1
  gRNA
uaggcucugugcuuuccuga

SEQ ID NO: 25425 - RNA, 20 nt, Artificial Sequence
  MKO10025425_A_Ifna1
  gRNA
caaaguccuuccuguccuuc

SEQ ID NO: 25426 - RNA, 20 nt, Artificial Sequence
  MKO10025426_A_Ifna2
  gRNA
ucaucacuaucagcaucacg

SEQ ID NO: 25427 - RNA, 20 nt, Artificial Sequence
  MKO10025427_A_Ifna2
  gRNA
ugcugauagugaugagcuac

SEQ ID NO: 25428 - RNA, 20 nt, Artificial Sequence
  MKO10025428_A_Ifna2
  gRNA
ugaguaagaucucgcagcac

SEQ ID NO: 25429 - RNA, 20 nt, Artificial Sequence
  MKO10025429_A_Ifna4
  gRNA
aguaguagcucaucauuacc

SEQ ID NO: 25430 - RNA, 20 nt, Artificial Sequence
  MKO10025430_A_Ifna4
  gRNA
caaaagacuugucugcuacu

SEQ ID NO: 25431 - RNA, 20 nt, Artificial Sequence
  MKO10025431_A_Ifna4
  gRNA
ggguaagaucucuuagcaca

SEQ ID NO: 25432 - RNA, 20 nt, Artificial Sequence
  MKO10025432_A_Ifna5
  gRNA
cccgaccuguugcaucacac

SEQ ID NO: 25433 - RNA, 20 nt, Artificial Sequence
  MKO10025433_A_Ifna5
  gRNA
caaagccugugugaugcaac

SEQ ID NO: 25434 - RNA, 20 nt, Artificial Sequence
  MKO10025434_A_Ifna5
  gRNA
ccugagugagcugacccagc

SEQ ID NO: 25435 - RNA, 20 nt, Artificial Sequence
  MKO10025435_A_Ifna6
  gRNA
ucaaggcuuucuuguuccug

SEQ ID NO: 25436 - RNA, 20 nt, Artificial Sequence
  MKO10025436_A_Ifna6
  gRNA
acucagucuugccagcaacu

SEQ ID NO: 25437 - RNA, 20 nt, Artificial Sequence
  MKO10025437_A_Ifna6
  gRNA
uaggcucugugcuuuccuga

SEQ ID NO: 25438 - RNA, 20 nt, Artificial Sequence
  MKO10025438_A_Ifna7
  gRNA
gccaguagcucaacaccacc

SEQ ID NO: 25439 - RNA, 20 nt, Artificial Sequence
  MKO10025439_A_Ifna7
  gRNA
ucagcucaugcagaacacag

SEQ ID NO: 25440 - RNA, 20 nt, Artificial Sequence
  MKO10025440_A_Ifna7
  gRNA
uccuggugguguugagcuac

SEQ ID NO: 25441 - RNA, 20 nt, Artificial Sequence
  MKO10025441_A_Ifna9
  gRNA
gaugcagcuggucgggauga

SEQ ID NO: 25442 - RNA, 20 nt, Artificial Sequence
  MKO10025442_A_Ifna9
  gRNA
ucuugguggugauaagcuac

SEQ ID NO: 25443 - RNA, 20 nt, Artificial Sequence
  MKO10025443_A_Ifna9
  gRNA
cuccuagacucauucugcac

SEQ ID NO: 25444 - RNA, 20 nt, Artificial Sequence
  MKO10025444_A_Ifnab
  gRNA
ugaggcaggucacauccuag

SEQ ID NO: 25445 - RNA, 20 nt, Artificial Sequence
  MKO10025445_A_Ifnab
  gRNA
uaggcucagcacuuuccuaa

SEQ ID NO: 25446 - RNA, 20 nt, Artificial Sequence
  MKO10025446_A_Ifnab
  gRNA
ccugaaaaccugucugaugc

SEQ ID NO: 25447 - RNA, 20 nt, Artificial Sequence
  MKO10025447_A_Ifnar1
  gRNA
cguucgauauucugcugaaa

SEQ ID NO: 25448 - RNA, 20 nt, Artificial Sequence
  MKO10025448_A_Ifnar1
  gRNA
ucaguuacaccauacgaauc

SEQ ID NO: 25449 - RNA, 20 nt, Artificial Sequence
  MKO10025449_A_Ifnar1
  gRNA
ccacauguucccgucuuguc

SEQ ID NO: 25450 - RNA, 20 nt, Artificial Sequence
  MKO10025450_A_Ifnar2
  gRNA
cccucugugcacuaugacga

SEQ ID NO: 25451 - RNA, 20 nt, Artificial Sequence
  MKO10025451_A_Ifnar2
  gRNA
cacgucacaugaugacuucg

SEQ ID NO: 25452 - RNA, 20 nt, Artificial Sequence
  MKO10025452_A_Ifnar2
  gRNA
cacccgcuaacuacacccuc

SEQ ID NO: 25453 - RNA, 20 nt, Artificial Sequence
  MKO10025453_A_Ifnb1
  gRNA
ugaaguacaacagcuacgcc

SEQ ID NO: 25454 - RNA, 20 nt, Artificial Sequence
  MKO10025454_A_Ifnb1
  gRNA
gacuauuguuguacgucucc

SEQ ID NO: 25455 - RNA, 20 nt, Artificial Sequence
  MKO10025455_A_Ifnb1
  gRNA
uccgaauguucguccuuucu

SEQ ID NO: 25456 - RNA, 20 nt, Artificial Sequence
  MKO10025456_A_Ifne
  gRNA
aagagcagcaacaccguuuc

SEQ ID NO: 25457 - RNA, 20 nt, Artificial Sequence
  MKO10025457_A_Ifne
  gRNA
aagucuuagcugcgcuucac

SEQ ID NO: 25458 - RNA, 20 nt, Artificial Sequence
  MKO10025458_A_Ifne
  gRNA
gcucgagugcgcagaaccuu

SEQ ID NO: 25459 - RNA, 20 nt, Artificial Sequence
  MKO10025459_A_Ifngr1
  gRNA
cgaccguauguuucguaugu

SEQ ID NO: 25460 - RNA, 20 nt, Artificial Sequence
  MKO10025460_A_Ifngr1
  gRNA
acuugaacccugucguaugc

SEQ ID NO: 25461 - RNA, 20 nt, Artificial Sequence
  MKO10025461_A_Ifngr1
  gRNA
aguauagucgaauguguaac

SEQ ID NO: 25462 - RNA, 20 nt, Artificial Sequence
  MKO10025462_A_Ifngr2
  gRNA
cucgcuuggcucgcacccgc

SEQ ID NO: 25463 - RNA, 20 nt, Artificial Sequence
  MKO10025463_A_Ifngr2
  gRNA
cuuacaagcuauauuccacc

SEQ ID NO: 25464 - RNA, 20 nt, Artificial Sequence
  MKO10025464_A_Ifngr2
  gRNA
gauacugaaaaguugccccg

SEQ ID NO: 25465 - RNA, 20 nt, Artificial Sequence
  MKO10025465_A_Ifng
  gRNA
auucaaugagcucauccgag

SEQ ID NO: 25466 - RNA, 20 nt, Artificial Sequence
  MKO10025466_A_Ifng
  gRNA
uggauuccggcaacagcugg

SEQ ID NO: 25467 - RNA, 20 nt, Artificial Sequence
  MKO10025467_A_Ifng
  gRNA
gacgcuuauguuguugcuga

SEQ ID NO: 25468 - RNA, 20 nt, Artificial Sequence
  MKO10025468_A_Ifnk
  gRNA
gcggaauguauagagccaca

SEQ ID NO: 25469 - RNA, 20 nt, Artificial Sequence
  MKO10025469_A_Ifnk
  gRNA
gccaccagccauaaaaacuu

SEQ ID NO: 25470 - RNA, 20 nt, Artificial Sequence
  MKO10025470_A_Ifnk
  gRNA
cuauuuaaguucuugcuuga

SEQ ID NO: 25471 - RNA, 20 nt, Artificial Sequence
  MKO10025471_A_Ifnl2
  gRNA
cccgggugagcaggcgaaac

SEQ ID NO: 25472 - RNA, 20 nt, Artificial Sequence
  MKO10025472_A_Ifnl2
  gRNA
gaccucaaguguguggccaa

SEQ ID NO: 25473 - RNA, 20 nt, Artificial Sequence
  MKO10025473_A_Ifnl2
  gRNA
gaacaugacugacucagccc

SEQ ID NO: 25474 - RNA, 20 nt, Artificial Sequence
  MKO10025474_A_Ifnl3
  gRNA
cccggaggagcaguugaaac

SEQ ID NO: 25475 - RNA, 20 nt, Artificial Sequence
  MKO10025475_A_Ifnl3
  gRNA
accuguuucaacugcuccuc

SEQ ID NO: 25476 - RNA, 20 nt, Artificial Sequence
  MKO10025476_A_Ifnl3
  gRNA
cuggcccaggauggugguca

SEQ ID NO: 25477 - RNA, 20 nt, Artificial Sequence
  MKO10025477_A_Ifnlr1
  gRNA
gccaccuugcaugccgucgc

SEQ ID NO: 25478 - RNA, 20 nt, Artificial Sequence
  MKO10025478_A_Ifnlr1
  gRNA
ccuuugguaggucacgaaau

SEQ ID NO: 25479 - RNA, 20 nt, Artificial Sequence
  MKO10025479_A_Ifnlr1
  gRNA
aguuccagcgacggcaugca

SEQ ID NO: 25480 - RNA, 20 nt, Artificial Sequence
  MKO10025480_A_Ifnz
  gRNA
aggcauacagcgcuugcucc

SEQ ID NO: 25481 - RNA, 20 nt, Artificial Sequence
  MKO10025481_A_Ifnz
  gRNA
agguuucuuccgcuaucuga

SEQ ID NO: 25482 - RNA, 20 nt, Artificial Sequence
  MKO10025482_A_Ifnz
  gRNA
agaaaccucggaaguaggug

SEQ ID NO: 25483 - RNA, 20 nt, Artificial Sequence
  MKO10025483_A_Ifrd1
  gRNA
gaucgcuauagccgcugcag

SEQ ID NO: 25484 - RNA, 20 nt, Artificial Sequence
  MKO10025484_A_Ifrd1
  gRNA
ccuaccauccuccgcaaaac

SEQ ID NO: 25485 - RNA, 20 nt, Artificial Sequence
  MKO10025485_A_Ifrd1
  gRNA
aaagagugacgagcagcgug

SEQ ID NO: 25486 - RNA, 20 nt, Artificial Sequence
  MKO10025486_A_Ifrd2
  gRNA
acggaacagcuccucgcccu

SEQ ID NO: 25487 - RNA, 20 nt, Artificial Sequence
  MKO10025487_A_Ifrd2
  gRNA
cccagugccaagacccguca

SEQ ID NO: 25488 - RNA, 20 nt, Artificial Sequence
  MKO10025488_A_Ifrd2
  gRNA
uggcuuugcagguggcgaag

SEQ ID NO: 25489 - RNA, 20 nt, Artificial Sequence
  MKO10025489_A_Ift122
  gRNA
cgaugagggccguguugacg

SEQ ID NO: 25490 - RNA, 20 nt, Artificial Sequence
  MKO10025490_A_Ift122
  gRNA
gaccucgcauuuaagccuga

SEQ ID NO: 25491 - RNA, 20 nt, Artificial Sequence
  MKO10025491_A_Ift122
  gRNA
ugcauacgccacacaguaca

SEQ ID NO: 25492 - RNA, 20 nt, Artificial Sequence
  MKO10025492_A_Ift140
  gRNA
ggaccagcgaggccgaguac

SEQ ID NO: 25493 - RNA, 20 nt, Artificial Sequence
  MKO10025493_A_Ift140
  gRNA
ccacuccugaaacacgaaua

SEQ ID NO: 25494 - RNA, 20 nt, Artificial Sequence
  MKO10025494_A_Ift140
  gRNA
ccuaggcacagugcacuaug

SEQ ID NO: 25495 - RNA, 20 nt, Artificial Sequence
  MKO10025495_A_Ift172
  gRNA
aagacaaugacguauuccgc

SEQ ID NO: 25496 - RNA, 20 nt, Artificial Sequence
  MKO10025496_A_Ift172
  gRNA
gcggaauacgucauugucuu

SEQ ID NO: 25497 - RNA, 20 nt, Artificial Sequence
  MKO10025497_A_Ift172
  gRNA
gauuccacaaaaauugccau

SEQ ID NO: 25498 - RNA, 20 nt, Artificial Sequence
  MKO10025498_A_Ift20
  gRNA
acugaacaagcuccgagugu

SEQ ID NO: 25499 - RNA, 20 nt, Artificial Sequence
  MKO10025499_A_Ift20
  gRNA
ugccucgcccaagauguccu

SEQ ID NO: 25500 - RNA, 20 nt, Artificial Sequence
  MKO10025500_A_Ift20
  gRNA
ucucuuaggccauuggugcu

SEQ ID NO: 25501 - RNA, 20 nt, Artificial Sequence
  MKO10025501_A_Ift27
  gRNA
gugcagauguuccgcagcga

SEQ ID NO: 25502 - RNA, 20 nt, Artificial Sequence
  MKO10025502_A_Ift27
  gRNA
uuuccagaagaacuacaccc

SEQ ID NO: 25503 - RNA, 20 nt, Artificial Sequence
  MKO10025503_A_Ift27
  gRNA
aagguccggucucagacuuc

SEQ ID NO: 25504 - RNA, 20 nt, Artificial Sequence
  MKO10025504_A_Ift43
  gRNA
gagucgacuccugaugagcc

SEQ ID NO: 25505 - RNA, 20 nt, Artificial Sequence
  MKO10025505_A_Ift43
  gRNA
ggcucaucaggagucgacuc

SEQ ID NO: 25506 - RNA, 20 nt, Artificial Sequence
  MKO10025506_A_Ift43
  gRNA
ccccaccgaaaccaccucga

SEQ ID NO: 25507 - RNA, 20 nt, Artificial Sequence
  MKO10025507_A_Ift46
  gRNA
aaccaggugccacgucccga

SEQ ID NO: 25508 - RNA, 20 nt, Artificial Sequence
  MKO10025508_A_Ift46
  gRNA
ucaggcuuuccaucgggacg

SEQ ID NO: 25509 - RNA, 20 nt, Artificial Sequence
  MKO10025509_A_Ift46
  gRNA
cacaccucaguugaucgauc

SEQ ID NO: 25510 - RNA, 20 nt, Artificial Sequence
  MKO10025510_A_Ift52
  gRNA
uuucagacggaguguugaac

SEQ ID NO: 25511 - RNA, 20 nt, Artificial Sequence
  MKO10025511_A_Ift52
  gRNA
agagaaauuagccgagcugc

SEQ ID NO: 25512 - RNA, 20 nt, Artificial Sequence
  MKO10025512_A_Ift52
  gRNA
uuacaaguacuuccauccua

SEQ ID NO: 25513 - RNA, 20 nt, Artificial Sequence
  MKO10025513_A_Ift57
  gRNA
cacuuaccaagcgauagguc

SEQ ID NO: 25514 - RNA, 20 nt, Artificial Sequence
  MKO10025514_A_Ift57
  gRNA
aacauguagaacugcucgcc

SEQ ID NO: 25515 - RNA, 20 nt, Artificial Sequence
  MKO10025515_A_Ift57
  gRNA
uuucaggccaucauacccag

SEQ ID NO: 25516 - RNA, 20 nt, Artificial Sequence
  MKO10025516_A_Ift74
  gRNA
cgugguggucccuuagggac

SEQ ID NO: 25517 - RNA, 20 nt, Artificial Sequence
  MKO10025517_A_Ift74
  gRNA
gaucguccugugacccaaca

SEQ ID NO: 25518 - RNA, 20 nt, Artificial Sequence
  MKO10025518_A_Ift74
  gRNA
acaacuagcagacuacaaca

SEQ ID NO: 25519 - RNA, 20 nt, Artificial Sequence
  MKO10025519_A_Ift80
  gRNA
ucuacccgauagaccuucac

SEQ ID NO: 25520 - RNA, 20 nt, Artificial Sequence
  MKO10025520_A_Ift80
  gRNA
acgaccaccagaucgucaag

SEQ ID NO: 25521 - RNA, 20 nt, Artificial Sequence
  MKO10025521_A_Ift80
  gRNA
cgcaggacgauggaauuaug

SEQ ID NO: 25522 - RNA, 20 nt, Artificial Sequence
  MKO10025522_A_Ift81
  gRNA
guucaacucucuucaugagc

SEQ ID NO: 25523 - RNA, 20 nt, Artificial Sequence
  MKO10025523_A_Ift81
  gRNA
uacuccgcugaagaagccag

SEQ ID NO: 25524 - RNA, 20 nt, Artificial Sequence
  MKO10025524_A_Ift81
  gRNA
aagaagauucaacauucguu

SEQ ID NO: 25525 - RNA, 20 nt, Artificial Sequence
  MKO10025525_A_Ift88
  gRNA
gucagcagacccauagcuac

SEQ ID NO: 25526 - RNA, 20 nt, Artificial Sequence
  MKO10025526_A_Ift88
  gRNA
uaccccauauccaguagcua

SEQ ID NO: 25527 - RNA, 20 nt, Artificial Sequence
  MKO10025527_A_Ift88
  gRNA
gggaggucuucugccaugac

SEQ ID NO: 25528 - RNA, 20 nt, Artificial Sequence
  MKO10025528_A_Igbp1b
  gRNA
cgcagcucgauuuguucagc

SEQ ID NO: 25529 - RNA, 20 nt, Artificial Sequence
  MKO10025529_A_Igbp1b
  gRNA
uggcaagauggcgucguuua

SEQ ID NO: 25530 - RNA, 20 nt, Artificial Sequence
  MKO10025530_A_Igbp1b
  gRNA
ugacacgcucaucgucagcc

SEQ ID NO: 25531 - RNA, 20 nt, Artificial Sequence
  MKO10025531_A_Igbp1
  gRNA
cgaccggggaauagccaagc

SEQ ID NO: 25532 - RNA, 20 nt, Artificial Sequence
  MKO10025532_A_Igbp1
  gRNA
cuauccaaaucucguugcua

SEQ ID NO: 25533 - RNA, 20 nt, Artificial Sequence
  MKO10025533_A_Igbp1
  gRNA
aagcagaugaugagcgcguu

SEQ ID NO: 25534 - RNA, 20 nt, Artificial Sequence
  MKO10025534_A_Igdcc3
  gRNA
aauggggcgcggguugcccg

SEQ ID NO: 25535 - RNA, 20 nt, Artificial Sequence
  MKO10025535_A_Igdcc3
  gRNA
cccgaaguccuguuaucugc

SEQ ID NO: 25536 - RNA, 20 nt, Artificial Sequence
  MKO10025536_A_Igdcc3
  gRNA
ccucucaucguccgugucaa

SEQ ID NO: 25537 - RNA, 20 nt, Artificial Sequence
  MKO10025537_A_Igdcc4
  gRNA
ugcaggcuccuaccgcugcg

SEQ ID NO: 25538 - RNA, 20 nt, Artificial Sequence
  MKO10025538_A_Igdcc4
  gRNA
ccuccuggcugaaucguugg

SEQ ID NO: 25539 - RNA, 20 nt, Artificial Sequence
  MKO10025539_A_Igdcc4
  gRNA
gcacucacccugucggaccc

SEQ ID NO: 25540 - RNA, 20 nt, Artificial Sequence
  MKO10025540_A_Igf1r
  gRNA
auggcggaucuucacguagc

SEQ ID NO: 25541 - RNA, 20 nt, Artificial Sequence
  MKO10025541_A_Igf1r
  gRNA
agcagaagucaccgaaucga

SEQ ID NO: 25542 - RNA, 20 nt, Artificial Sequence
  MKO10025542_A_Igf1r
  gRNA
acauuacucggggggccauc

SEQ ID NO: 25543 - RNA, 20 nt, Artificial Sequence
  MKO10025543_A_Igf1
  gRNA
cgaucguaccuucugagucu

SEQ ID NO: 25544 - RNA, 20 nt, Artificial Sequence
  MKO10025544_A_Igf1
  gRNA
gaugcucuucaguucgugug

SEQ ID NO: 25545 - RNA, 20 nt, Artificial Sequence
  MKO10025545_A_Igf1
  gRNA
ccaccagcucagccccgcaa

SEQ ID NO: 25546 - RNA, 20 nt, Artificial Sequence
  MKO10025546_A_Igf2bp1
  gRNA
auauuccaccucagcuccga

SEQ ID NO: 25547 - RNA, 20 nt, Artificial Sequence
  MKO10025547_A_Igf2bp1
  gRNA
ucaacgucaccuacucuaac

SEQ ID NO: 25548 - RNA, 20 nt, Artificial Sequence
  MKO10025548_A_Igf2bp1
  gRNA
ccaggugcuagauagccugc

SEQ ID NO: 25549 - RNA, 20 nt, Artificial Sequence
  MKO10025549_A_Igf2bp2
  gRNA
gaggcgggauguuccgaauc

SEQ ID NO: 25550 - RNA, 20 nt, Artificial Sequence
  MKO10025550_A_Igf2bp2
  gRNA
uaucuuuacagguguuggau

SEQ ID NO: 25551 - RNA, 20 nt, Artificial Sequence
  MKO10025551_A_Igf2bp2
  gRNA
gcaggcuuaccucccacugc

SEQ ID NO: 25552 - RNA, 20 nt, Artificial Sequence
  MKO10025552_A_Igf2bp3
  gRNA
accgagugcucaacuuccau

SEQ ID NO: 25553 - RNA, 20 nt, Artificial Sequence
  MKO10025553_A_Igf2bp3
  gRNA
auaucccgccccacuuacaa

SEQ ID NO: 25554 - RNA, 20 nt, Artificial Sequence
  MKO10025554_A_Igf2bp3
  gRNA
gauaguuuacuaguccagua

SEQ ID NO: 25555 - RNA, 20 nt, Artificial Sequence
  MKO10025555_A_Igf2r
  gRNA
guuuauaagaucaacgucug

SEQ ID NO: 25556 - RNA, 20 nt, Artificial Sequence
  MKO10025556_A_Igf2r
  gRNA
aucaacguguguagagacau

SEQ ID NO: 25557 - RNA, 20 nt, Artificial Sequence
  MKO10025557_A_Igf2r
  gRNA
aaguucagccagaucacucc

SEQ ID NO: 25558 - RNA, 20 nt, Artificial Sequence
  MKO10025558_A_Igf2
  gRNA
cgacgguuggcacggcuuga

SEQ ID NO: 25559 - RNA, 20 nt, Artificial Sequence
  MKO10025559_A_Igf2
  gRNA
cgugccaaccgucgcagccg

SEQ ID NO: 25560 - RNA, 20 nt, Artificial Sequence
  MKO10025560_A_Igf2
  gRNA
gaacuugcccacgggguauc

SEQ ID NO: 25561 - RNA, 20 nt, Artificial Sequence
  MKO10025561_A_Igfals
  gRNA
acaacgccaucacuagcuug

SEQ ID NO: 25562 - RNA, 20 nt, Artificial Sequence
  MKO10025562_A_Igfals
  gRNA
ucgaggccugagacguuggc

SEQ ID NO: 25563 - RNA, 20 nt, Artificial Sequence
  MKO10025563_A_Igfals
  gRNA
ggaacaauggcucugagaac

SEQ ID NO: 25564 - RNA, 20 nt, Artificial Sequence
  MKO10025564_A_Igfbp1
  gRNA
gcacuuuauagaguucucgu

SEQ ID NO: 25565 - RNA, 20 nt, Artificial Sequence
  MKO10025565_A_Igfbp1
  gRNA
cucagcugccgugcguugcc

SEQ ID NO: 25566 - RNA, 20 nt, Artificial Sequence
  MKO10025566_A_Igfbp1
  gRNA
cccgacaugugccuugccga

SEQ ID NO: 25567 - RNA, 20 nt, Artificial Sequence
  MKO10025567_A_Igfbp2
  gRNA
uccagggggccccgaucauc

SEQ ID NO: 25568 - RNA, 20 nt, Artificial Sequence
  MKO10025568_A_Igfbp2
  gRNA
gcuacgcugcuaucccaacc

SEQ ID NO: 25569 - RNA, 20 nt, Artificial Sequence
  MKO10025569_A_Igfbp2
  gRNA
acccugcacgcccgagcguc

SEQ ID NO: 25570 - RNA, 20 nt, Artificial Sequence
  MKO10025570_A_Igfbp3
  gRNA
cugacuugcgcgcugcgcga

SEQ ID NO: 25571 - RNA, 20 nt, Artificial Sequence
  MKO10025571_A_Igfbp3
  gRNA
gacagcgcacgcgcgucgca

SEQ ID NO: 25572 - RNA, 20 nt, Artificial Sequence
  MKO10025572_A_Igfbp3
  gRNA
acuucuccuccgagucuaag

SEQ ID NO: 25573 - RNA, 20 nt, Artificial Sequence
  MKO10025573_A_Igfbp4
  gRNA
uuguugcgccacuugcgccc

SEQ ID NO: 25574 - RNA, 20 nt, Artificial Sequence
  MKO10025574_A_Igfbp4
  gRNA
uugccguugcggucacaguu

SEQ ID NO: 25575 - RNA, 20 nt, Artificial Sequence
  MKO10025575_A_Igfbp4
  gRNA
gcccgugcaucaauguacgc

SEQ ID NO: 25576 - RNA, 20 nt, Artificial Sequence
  MKO10025576_A_Igfbp5
  gRNA
uugagccgguacggcauagg

SEQ ID NO: 25577 - RNA, 20 nt, Artificial Sequence
  MKO10025577_A_Igfbp5
  gRNA
gcuggccgccuaugccguac

SEQ ID NO: 25578 - RNA, 20 nt, Artificial Sequence
  MKO10025578_A_Igfbp5
  gRNA
cucaacguuacugcugucga

SEQ ID NO: 25579 - RNA, 20 nt, Artificial Sequence
  MKO10025579_A_Igfbp6
  gRNA
gacgcgggaucgccugcaga

SEQ ID NO: 25580 - RNA, 20 nt, Artificial Sequence
  MKO10025580_A_Igfbp6
  gRNA
ccgauuagcagcgcccgcaa

SEQ ID NO: 25581 - RNA, 20 nt, Artificial Sequence
  MKO10025581_A_Igfbp6
  gRNA
uccccagugucguuccucgc

SEQ ID NO: 25582 - RNA, 20 nt, Artificial Sequence
  MKO10025582_A_Igfbp7
  gRNA
ggugagacccgcgacgcgug

SEQ ID NO: 25583 - RNA, 20 nt, Artificial Sequence
  MKO10025583_A_Igfbp7
  gRNA
cgggccgcaggcauccgaag

SEQ ID NO: 25584 - RNA, 20 nt, Artificial Sequence
  MKO10025584_A_Igfbp7
  gRNA
uuccauagugacgcccccca

SEQ ID NO: 25585 - RNA, 20 nt, Artificial Sequence
  MKO10025585_A_Igfbpl1
  gRNA
ggugucgucuacccgcgucg

SEQ ID NO: 25586 - RNA, 20 nt, Artificial Sequence
  MKO10025586_A_Igfbpl1
  gRNA
aucuccgcgcgcgacgagug

SEQ ID NO: 25587 - RNA, 20 nt, Artificial Sequence
  MKO10025587_A_Igfbpl1
  gRNA
ugccacgcagccaacgccau

SEQ ID NO: 25588 - RNA, 20 nt, Artificial Sequence
  MKO10025588_A_Igfl3
  gRNA
cagaacuuacaaccccucag

SEQ ID NO: 25589 - RNA, 20 nt, Artificial Sequence
  MKO10025589_A_Igfl3
  gRNA
gcaguucauccccuaucucc

SEQ ID NO: 25590 - RNA, 20 nt, Artificial Sequence
  MKO10025590_A_Igfl3
  gRNA
aagacaaccaacuuucucuu

SEQ ID NO: 25591 - RNA, 20 nt, Artificial Sequence
  MKO10025591_A_Igflr1
  gRNA
ccauaagccgugcucccgcu

SEQ ID NO: 25592 - RNA, 20 nt, Artificial Sequence
  MKO10025592_A_Igflr1
  gRNA
cggcggcuccgcugcuacac

SEQ ID NO: 25593 - RNA, 20 nt, Artificial Sequence
  MKO10025593_A_Igflr1
  gRNA
uuaugguaccacacgacacc

SEQ ID NO: 25594 - RNA, 20 nt, Artificial Sequence
  MKO10025594_A_Igfn1
  gRNA
acacaccuacccugcggauc

SEQ ID NO: 25595 - RNA, 20 nt, Artificial Sequence
  MKO10025595_A_Igfn1
  gRNA
cugcuacaggccggauccgc

SEQ ID NO: 25596 - RNA, 20 nt, Artificial Sequence
  MKO10025596_A_Igfn1
  gRNA
acaauucaucugucgcccuc

SEQ ID NO: 25597 - RNA, 20 nt, Artificial Sequence
  MKO10025597_A_Ighmbp2
  gRNA
gcccauacagcccugugcgc

SEQ ID NO: 25598 - RNA, 20 nt, Artificial Sequence
  MKO10025598_A_Ighmbp2
  gRNA
uugggguggagcugcccaac

SEQ ID NO: 25599 - RNA, 20 nt, Artificial Sequence
  MKO10025599_A_Ighmbp2
  gRNA
gauucgggucaggaccccag

SEQ ID NO: 25600 - RNA, 20 nt, Artificial Sequence
  MKO10025600_A_Igip
  gRNA
caaccguguugugcaucagc

SEQ ID NO: 25601 - RNA, 20 nt, Artificial Sequence
  MKO10025601_A_Igip
  gRNA
gacuuuaacuaauauacacc

SEQ ID NO: 25602 - RNA, 20 nt, Artificial Sequence
  MKO10025602_A_Igip
  gRNA
uaucaaagcugaagcuagcg

SEQ ID NO: 25603 - RNA, 20 nt, Artificial Sequence
  MKO10025603_A_Igj
  gRNA
cuguaagaaaugcgauccug

SEQ ID NO: 25604 - RNA, 20 nt, Artificial Sequence
  MKO10025604_A_Igj
  gRNA
uuccaccgaggauccuaaug

SEQ ID NO: 25605 - RNA, 20 nt, Artificial Sequence
  MKO10025605_A_Igj
  gRNA
ucagugucccuuugaacaac

SEQ ID NO: 25606 - RNA, 20 nt, Artificial Sequence
  MKO10025606_A_Igll1
  gRNA
gucccaggugcucgccccau

SEQ ID NO: 25607 - RNA, 20 nt, Artificial Sequence
  MKO10025607_A_Igll1
  gRNA
aagucucuuaccugccggga

SEQ ID NO: 25608 - RNA, 20 nt, Artificial Sequence
  MKO10025608_A_Igll1
  gRNA
gcucaccaaacacacuagug

SEQ ID NO: 25609 - RNA, 20 nt, Artificial Sequence
  MKO10025609_A_Iglon5
  gRNA
aacggucauugcccgcauac

SEQ ID NO: 25610 - RNA, 20 nt, Artificial Sequence
  MKO10025610_A_Iglon5
  gRNA
aguaacgcauucguauuccc

SEQ ID NO: 25611 - RNA, 20 nt, Artificial Sequence
  MKO10025611_A_Iglon5
  gRNA
cacacuguauaguuguccgc

SEQ ID NO: 25612 - RNA, 20 nt, Artificial Sequence
  MKO10025612_A_Igsf10
  gRNA
cggacucaccuugcuccgcu

SEQ ID NO: 25613 - RNA, 20 nt, Artificial Sequence
  MKO10025613_A_Igsf10
  gRNA
ggugaguccguaaaacgccu

SEQ ID NO: 25614 - RNA, 20 nt, Artificial Sequence
  MKO10025614_A_Igsf10
  gRNA
auuccacuuguggaacucgc

SEQ ID NO: 25615 - RNA, 20 nt, Artificial Sequence
  MKO10025615_A_Igsf11
  gRNA
aaauguuugacggcgcccuc

SEQ ID NO: 25616 - RNA, 20 nt, Artificial Sequence
  MKO10025616_A_Igsf11
  gRNA
uguacuuacgugagauaacc

SEQ ID NO: 25617 - RNA, 20 nt, Artificial Sequence
  MKO10025617_A_Igsf11
  gRNA
ucccucggcccacguaccuu

SEQ ID NO: 25618 - RNA, 20 nt, Artificial Sequence
  MKO10025618_A_Igsf1
  gRNA
gcccuuacugaguccaauac

SEQ ID NO: 25619 - RNA, 20 nt, Artificial Sequence
  MKO10025619_A_Igsf1
  gRNA
aacuugcuggauacccgaga

SEQ ID NO: 25620 - RNA, 20 nt, Artificial Sequence
  MKO10025620_A_Igsf1
  gRNA
guagauuaccaagucccaac

SEQ ID NO: 25621 - RNA, 20 nt, Artificial Sequence
  MKO10025621_A_Igsf21
  gRNA
cucggucguagauacccacg

SEQ ID NO: 25622 - RNA, 20 nt, Artificial Sequence
  MKO10025622_A_Igsf21
  gRNA
guaucuacgaccgagccacg

SEQ ID NO: 25623 - RNA, 20 nt, Artificial Sequence
  MKO10025623_A_Igsf21
  gRNA
ucccaccuccaucgaagucg

SEQ ID NO: 25624 - RNA, 20 nt, Artificial Sequence
  MKO10025624_A_Igsf23
  gRNA
gagaccgacauguagucguu

SEQ ID NO: 25625 - RNA, 20 nt, Artificial Sequence
  MKO10025625_A_Igsf23
  gRNA
cgccauagcccucaucguag

SEQ ID NO: 25626 - RNA, 20 nt, Artificial Sequence
  MKO10025626_A_Igsf23
  gRNA
acguccucgcacuagccaag

SEQ ID NO: 25627 - RNA, 20 nt, Artificial Sequence
  MKO10025627_A_Igsf3
  gRNA
aacaccgaugagcgcuacuu

SEQ ID NO: 25628 - RNA, 20 nt, Artificial Sequence
  MKO10025628_A_Igsf3
  gRNA
gaagauauaccaccuccgcc

SEQ ID NO: 25629 - RNA, 20 nt, Artificial Sequence
  MKO10025629_A_Igsf3
  gRNA
caaagaguucaccgugcguc

SEQ ID NO: 25630 - RNA, 20 nt, Artificial Sequence
  MKO10025630_A_Igsf5
  gRNA
uugcacggaucccgagucac

SEQ ID NO: 25631 - RNA, 20 nt, Artificial Sequence
  MKO10025631_A_Igsf5
  gRNA
auggcccaggucggcagugc

SEQ ID NO: 25632 - RNA, 20 nt, Artificial Sequence
  MKO10025632_A_Igsf5
  gRNA
cauguggacucuuaaccaaa

SEQ ID NO: 25633 - RNA, 20 nt, Artificial Sequence
  MKO10025633_A_Igsf6
  gRNA
cgguucugacgccgucacca

SEQ ID NO: 25634 - RNA, 20 nt, Artificial Sequence
  MKO10025634_A_Igsf6
  gRNA
ucaccaagcgcuaaacacgu

SEQ ID NO: 25635 - RNA, 20 nt, Artificial Sequence
  MKO10025635_A_Igsf6
  gRNA
gcagagcuaagagcacuauc

SEQ ID NO: 25636 - RNA, 20 nt, Artificial Sequence
  MKO10025636_A_Igsf8
  gRNA
gggccaauccgacguucacc

SEQ ID NO: 25637 - RNA, 20 nt, Artificial Sequence
  MKO10025637_A_Igsf8
  gRNA
ggucccagacccucgaacau

SEQ ID NO: 25638 - RNA, 20 nt, Artificial Sequence
  MKO10025638_A_Igsf8
  gRNA
acagucuaccccuacacgca

SEQ ID NO: 25639 - RNA, 20 nt, Artificial Sequence
  MKO10025639_A_Igsf9b
  gRNA
aggugcccacggccugcgag

SEQ ID NO: 25640 - RNA, 20 nt, Artificial Sequence
  MKO10025640_A_Igsf9b
  gRNA
gauacuuugcacuagcaccg

SEQ ID NO: 25641 - RNA, 20 nt, Artificial Sequence
  MKO10025641_A_Igsf9b
  gRNA
caaacucggguuccucucgc

SEQ ID NO: 25642 - RNA, 20 nt, Artificial Sequence
  MKO10025642_A_Igsf9
  gRNA
ccgaauugaccccgauuacg

SEQ ID NO: 25643 - RNA, 20 nt, Artificial Sequence
  MKO10025643_A_Igsf9
  gRNA
acaacucuuacccacguaau

SEQ ID NO: 25644 - RNA, 20 nt, Artificial Sequence
  MKO10025644_A_Igsf9
  gRNA
ggacgaguccggcugcagac

SEQ ID NO: 25645 - RNA, 20 nt, Artificial Sequence
  MKO10025645_A_Igup
  gRNA
caagcucgucauugaaauag

SEQ ID NO: 25646 - RNA, 20 nt, Artificial Sequence
  MKO10025646_A_Igup
  gRNA
uugccgugaacaaguuccuc

SEQ ID NO: 25647 - RNA, 20 nt, Artificial Sequence
  MKO10025647_A_Igup
  gRNA
caaaguugccacaaaauauc

SEQ ID NO: 25648 - RNA, 20 nt, Artificial Sequence
  MKO10025648_A_Ihh
  gRNA
acugcuggcgcgcuuagcag

SEQ ID NO: 25649 - RNA, 20 nt, Artificial Sequence
  MKO10025649_A_Ihh
  gRNA
ggcgugagcgccagccgacg

SEQ ID NO: 25650 - RNA, 20 nt, Artificial Sequence
  MKO10025650_A_Ihh
  gRNA
uuuacacuaugagggccgcg

SEQ ID NO: 25651 - RNA, 20 nt, Artificial Sequence
  MKO10025651_A_Iigp1
  gRNA
gauuugcccuccagcuuuac

SEQ ID NO: 25652 - RNA, 20 nt, Artificial Sequence
  MKO10025652_A_Iigp1
  gRNA
gagaagggaugauauucacu

SEQ ID NO: 25653 - RNA, 20 nt, Artificial Sequence
  MKO10025653_A_Iigp1
  gRNA
uccuuaauucaaucaaauug

SEQ ID NO: 25654 - RNA, 20 nt, Artificial Sequence
  MKO10025654_A_Ikbip
  gRNA
gagcagcaucgaccgaacau

SEQ ID NO: 25655 - RNA, 20 nt, Artificial Sequence
  MKO10025655_A_Ikbip
  gRNA
ugugcucaucgaaaucgccc

SEQ ID NO: 25656 - RNA, 20 nt, Artificial Sequence
  MKO10025656_A_Ikbip
  gRNA
gcuagucucaauaucacgua

SEQ ID NO: 25657 - RNA, 20 nt, Artificial Sequence
  MKO10025657_A_Ikbkap
  gRNA
gcagacuaugacguccccag

SEQ ID NO: 25658 - RNA, 20 nt, Artificial Sequence
  MKO10025658_A_Ikbkap
  gRNA
ucccgccuuaccaacugcac

SEQ ID NO: 25659 - RNA, 20 nt, Artificial Sequence
  MKO10025659_A_Ikbkap
  gRNA
agacuuugaagugaucgcag

SEQ ID NO: 25660 - RNA, 20 nt, Artificial Sequence
  MKO10025660_A_Ikbkb
  gRNA
gcccuaccugauugugccac

SEQ ID NO: 25661 - RNA, 20 nt, Artificial Sequence
  MKO10025661_A_Ikbkb
  gRNA
cgccaucaagcaaugccgac

SEQ ID NO: 25662 - RNA, 20 nt, Artificial Sequence
  MKO10025662_A_Ikbkb
  gRNA
uuccaaaucccccggucccc

SEQ ID NO: 25663 - RNA, 20 nt, Artificial Sequence
  MKO10025663_A_Ikbke
  gRNA
cgaauagcuucacgauguuc

SEQ ID NO: 25664 - RNA, 20 nt, Artificial Sequence
  MKO10025664_A_Ikbke
  gRNA
caucgugaagcuauucgcag

SEQ ID NO: 25665 - RNA, 20 nt, Artificial Sequence
  MKO10025665_A_Ikbke
  gRNA
gaaagcccgaacguguucuc

SEQ ID NO: 25666 - RNA, 20 nt, Artificial Sequence
  MKO10025666_A_Ikbkg
  gRNA
gcguaugcagaaccagagcg

SEQ ID NO: 25667 - RNA, 20 nt, Artificial Sequence
  MKO10025667_A_Ikbkg
  gRNA
cucuaaagcuugccgauccu

SEQ ID NO: 25668 - RNA, 20 nt, Artificial Sequence
  MKO10025668_A_Ikbkg
  gRNA
caaggaucggcaagcuuuag

SEQ ID NO: 25669 - RNA, 20 nt, Artificial Sequence
  MKO10025669_A_Ikzf1
  gRNA
acauaccggagugcguccuc

SEQ ID NO: 25670 - RNA, 20 nt, Artificial Sequence
  MKO10025670_A_Ikzf1
  gRNA
cagaacuccaagagugaucg

SEQ ID NO: 25671 - RNA, 20 nt, Artificial Sequence
  MKO10025671_A_Ikzf1
  gRNA
acccaugccucgaucacucu

SEQ ID NO: 25672 - RNA, 20 nt, Artificial Sequence
  MKO10025672_A_Ikzf2
  gRNA
gacaaugagcuuucacccga

SEQ ID NO: 25673 - RNA, 20 nt, Artificial Sequence
  MKO10025673_A_Ikzf2
  gRNA
ggguaaaagaagcuccgcac

SEQ ID NO: 25674 - RNA, 20 nt, Artificial Sequence
  MKO10025674_A_Ikzf2
  gRNA
ccaccucgcugcucucaauu

SEQ ID NO: 25675 - RNA, 20 nt, Artificial Sequence
  MKO10025675_A_Ikzf3
  gRNA
ucugcaacuacgcaugccaa

SEQ ID NO: 25676 - RNA, 20 nt, Artificial Sequence
  MKO10025676_A_Ikzf3
  gRNA
caagacguugaagcuaaugc

SEQ ID NO: 25677 - RNA, 20 nt, Artificial Sequence
  MKO10025677_A_Ikzf3
  gRNA
augcgcucacgggacaccuu

SEQ ID NO: 25678 - RNA, 20 nt, Artificial Sequence
  MKO10025678_A_Ikzf4
  gRNA
gucgcacuugagcuugccgu

SEQ ID NO: 25679 - RNA, 20 nt, Artificial Sequence
  MKO10025679_A_Ikzf4
  gRNA
ggccagugagugcgucacgc

SEQ ID NO: 25680 - RNA, 20 nt, Artificial Sequence
  MKO10025680_A_Ikzf4
  gRNA
cgcacuuaccacugagcgag

SEQ ID NO: 25681 - RNA, 20 nt, Artificial Sequence
  MKO10025681_A_Ikzf5
  gRNA
cgcggccaucgcauagucag

SEQ ID NO: 25682 - RNA, 20 nt, Artificial Sequence
  MKO10025682_A_Ikzf5
  gRNA
uaguuccucugacuaugcga

SEQ ID NO: 25683 - RNA, 20 nt, Artificial Sequence
  MKO10025683_A_Ikzf5
  gRNA
uuguuuauagcuggaacaga

SEQ ID NO: 25684 - RNA, 20 nt, Artificial Sequence
  MKO10025684_A_Ik
  gRNA
cuuuacucacgccucagcag

SEQ ID NO: 25685 - RNA, 20 nt, Artificial Sequence
  MKO10025685_A_Ik
  gRNA
ucauggugacgugacuuaga

SEQ ID NO: 25686 - RNA, 20 nt, Artificial Sequence
  MKO10025686_A_Ik
  gRNA
gaugccaagggaguacaaug

SEQ ID NO: 25687 - RNA, 20 nt, Artificial Sequence
  MKO10025687_A_Il10ra
  gRNA
gcaguguuuacuuaucacga

SEQ ID NO: 25688 - RNA, 20 nt, Artificial Sequence
  MKO10025688_A_Il10ra
  gRNA
augggacaauccaucccccc

SEQ ID NO: 25689 - RNA, 20 nt, Artificial Sequence
  MKO10025689_A_Il10ra
  gRNA
ucagguacggaaacucaacc

SEQ ID NO: 25690 - RNA, 20 nt, Artificial Sequence
  MKO10025690_A_Il10rb
  gRNA
uccuccggaaccuggagccg

SEQ ID NO: 25691 - RNA, 20 nt, Artificial Sequence
  MKO10025691_A_Il10rb
  gRNA
ugugucuccguacgacucug

SEQ ID NO: 25692 - RNA, 20 nt, Artificial Sequence
  MKO10025692_A_Il10rb
  gRNA
agagaagucgcacugagucg

SEQ ID NO: 25693 - RNA, 20 nt, Artificial Sequence
  MKO10025693_A_Il10
  gRNA
gcuaaccgacuccuuaaugc

SEQ ID NO: 25694 - RNA, 20 nt, Artificial Sequence
  MKO10025694_A_Il10
  gRNA
aaacuggaucauuuccgaua

SEQ ID NO: 25695 - RNA, 20 nt, Artificial Sequence
  MKO10025695_A_Il10
  gRNA
uuagcaguauguuguccagc

SEQ ID NO: 25696 - RNA, 20 nt, Artificial Sequence
  MKO10025696_A_Il11ra1
  gRNA
uccugaagucuccugccaag

SEQ ID NO: 25697 - RNA, 20 nt, Artificial Sequence
  MKO10025697_A_Il11ra1
  gRNA
caggagacuucaggacgugc

SEQ ID NO: 25698 - RNA, 20 nt, Artificial Sequence
  MKO10025698_A_Il11ra1
  gRNA
cacuuacccagcacucacuc

SEQ ID NO: 25699 - RNA, 20 nt, Artificial Sequence
  MKO10025699_A_Il11ra2
  gRNA
cacuuacccagcacucacuc

SEQ ID NO: 25700 - RNA, 20 nt, Artificial Sequence
  MKO10025700_A_Il11ra2
  gRNA
cccgugaugcugugcugccc

SEQ ID NO: 25701 - RNA, 20 nt, Artificial Sequence
  MKO10025701_A_Il11ra2
  gRNA
ccuccaggacuccagugucc

SEQ ID NO: 25702 - RNA, 20 nt, Artificial Sequence
  MKO10025702_A_Il11
  gRNA
acuccgccguuuacagcucu

SEQ ID NO: 25703 - RNA, 20 nt, Artificial Sequence
  MKO10025703_A_Il11
  gRNA
guacaauggcugcgccgugc

SEQ ID NO: 25704 - RNA, 20 nt, Artificial Sequence
  MKO10025704_A_Il11
  gRNA
ccagauagagucguugcccc

SEQ ID NO: 25705 - RNA, 20 nt, Artificial Sequence
  MKO10025705_A_Il12a
  gRNA
cuucuagaacgagaguugcc

SEQ ID NO: 25706 - RNA, 20 nt, Artificial Sequence
  MKO10025706_A_Il12a
  gRNA
aucgaugucuucagcagugc

SEQ ID NO: 25707 - RNA, 20 nt, Artificial Sequence
  MKO10025707_A_Il12a
  gRNA
auugaagaccuguuuaccac

SEQ ID NO: 25708 - RNA, 20 nt, Artificial Sequence
  MKO10025708_A_Il12b
  gRNA
ccugcccauugaacuggcgu

SEQ ID NO: 25709 - RNA, 20 nt, Artificial Sequence
  MKO10025709_A_Il12b
  gRNA
ccaugagcacgugaaccguc

SEQ ID NO: 25710 - RNA, 20 nt, Artificial Sequence
  MKO10025710_A_Il12b
  gRNA
caugucacugcccgagaguc

SEQ ID NO: 25711 - RNA, 20 nt, Artificial Sequence
  MKO10025711_A_Il12rb1
  gRNA
gccguaugcccacaacgaau

SEQ ID NO: 25712 - RNA, 20 nt, Artificial Sequence
  MKO10025712_A_Il12rb1
  gRNA
acaauguuucucacguccug

SEQ ID NO: 25713 - RNA, 20 nt, Artificial Sequence
  MKO10025713_A_Il12rb1
  gRNA
caccaagguccaauucguug

SEQ ID NO: 25714 - RNA, 20 nt, Artificial Sequence
  MKO10025714_A_Il12rb2
  gRNA
uccgcauacguucacguucu

SEQ ID NO: 25715 - RNA, 20 nt, Artificial Sequence
  MKO10025715_A_Il12rb2
  gRNA
ucgucagaauugcaaucgcc

SEQ ID NO: 25716 - RNA, 20 nt, Artificial Sequence
  MKO10025716_A_Il12rb2
  gRNA
agccucuuaacagcacgucc

SEQ ID NO: 25717 - RNA, 20 nt, Artificial Sequence
  MKO10025717_A_Il13ra1
  gRNA
gagacgcucaaauucgucac

SEQ ID NO: 25718 - RNA, 20 nt, Artificial Sequence
  MKO10025718_A_Il13ra1
  gRNA
aagugcaucucacccccuga

SEQ ID NO: 25719 - RNA, 20 nt, Artificial Sequence
  MKO10025719_A_Il13ra1
  gRNA
uccagaaacucaucguaaag

SEQ ID NO: 25720 - RNA, 20 nt, Artificial Sequence
  MKO10025720_A_Il13ra2
  gRNA
agcugucgcuaucaacauuu

SEQ ID NO: 25721 - RNA, 20 nt, Artificial Sequence
  MKO10025721_A_Il13ra2
  gRNA
gaaauguugauagcgacagc

SEQ ID NO: 25722 - RNA, 20 nt, Artificial Sequence
  MKO10025722_A_Il13ra2
  gRNA
auagucugaugaguccaagu

SEQ ID NO: 25723 - RNA, 20 nt, Artificial Sequence
  MKO10025723_A_Il13
  gRNA
uccuuaccccgccagcggcc

SEQ ID NO: 25724 - RNA, 20 nt, Artificial Sequence
  MKO10025724_A_Il13
  gRNA
auaccaugcugccguugcac

SEQ ID NO: 25725 - RNA, 20 nt, Artificial Sequence
  MKO10025725_A_Il13
  gRNA
uuaccguagugggggccuug

SEQ ID NO: 25726 - RNA, 20 nt, Artificial Sequence
  MKO10025726_A_Il15ra
  gRNA
uucucagccgugccguguug

SEQ ID NO: 25727 - RNA, 20 nt, Artificial Sequence
  MKO10025727_A_Il15ra
  gRNA
ucaacacggcacggcugaga

SEQ ID NO: 25728 - RNA, 20 nt, Artificial Sequence
  MKO10025728_A_Il15ra
  gRNA
auacucaccuuucgucauuu

SEQ ID NO: 25729 - RNA, 20 nt, Artificial Sequence
  MKO10025729_A_Il15
  gRNA
cauugcaguaacuuugcaac

SEQ ID NO: 25730 - RNA, 20 nt, Artificial Sequence
  MKO10025730_A_Il15
  gRNA
auggauguauuccucauaua

SEQ ID NO: 25731 - RNA, 20 nt, Artificial Sequence
  MKO10025731_A_Il15
  gRNA
ucccuaaaacagaggccaac

SEQ ID NO: 25732 - RNA, 20 nt, Artificial Sequence
  MKO10025732_A_Il16
  gRNA
gacagcauuuacggcccuau

SEQ ID NO: 25733 - RNA, 20 nt, Artificial Sequence
  MKO10025733_A_Il16
  gRNA
aaucugcagcucccaccgac

SEQ ID NO: 25734 - RNA, 20 nt, Artificial Sequence
  MKO10025734_A_Il16
  gRNA
gguguuaaccccuacagugc

SEQ ID NO: 25735 - RNA, 20 nt, Artificial Sequence
  MKO10025735_A_Il17a
  gRNA
ucuuacguacuggagagucc

SEQ ID NO: 25736 - RNA, 20 nt, Artificial Sequence
  MKO10025736_A_Il17a
  gRNA
cguggccucgauuguccgcc

SEQ ID NO: 25737 - RNA, 20 nt, Artificial Sequence
  MKO10025737_A_Il17a
  gRNA
gacgcgcaaacaugagucca

SEQ ID NO: 25738 - RNA, 20 nt, Artificial Sequence
  MKO10025738_A_Il17b
  gRNA
cgaggcgcggugccuauguu

SEQ ID NO: 25739 - RNA, 20 nt, Artificial Sequence
  MKO10025739_A_Il17b
  gRNA
aguaaagcccuacgcucgaa

SEQ ID NO: 25740 - RNA, 20 nt, Artificial Sequence
  MKO10025740_A_Il17b
  gRNA
ugggccucaucaggugccgc

SEQ ID NO: 25741 - RNA, 20 nt, Artificial Sequence
  MKO10025741_A_Il17c
  gRNA
uaggguccgccgugccgucu

SEQ ID NO: 25742 - RNA, 20 nt, Artificial Sequence
  MKO10025742_A_Il17c
  gRNA
accuggcacuucgaguuagc

SEQ ID NO: 25743 - RNA, 20 nt, Artificial Sequence
  MKO10025743_A_Il17c
  gRNA
acgagcgcuccaucucacca

SEQ ID NO: 25744 - RNA, 20 nt, Artificial Sequence
  MKO10025744_A_Il17d
  gRNA
agguaccucggaaagcgagc

SEQ ID NO: 25745 - RNA, 20 nt, Artificial Sequence
  MKO10025745_A_Il17d
  gRNA
accugcgcagcgugucgccc

SEQ ID NO: 25746 - RNA, 20 nt, Artificial Sequence
  MKO10025746_A_Il17d
  gRNA
ggccgguccgcgcagucccg

SEQ ID NO: 25747 - RNA, 20 nt, Artificial Sequence
  MKO10025747_A_Il17f
  gRNA
gugcacccgugaaacagcca

SEQ ID NO: 25748 - RNA, 20 nt, Artificial Sequence
  MKO10025748_A_Il17f
  gRNA
ugcagcguugucaggccgcu

SEQ ID NO: 25749 - RNA, 20 nt, Artificial Sequence
  MKO10025749_A_Il17f
  gRNA
agaaccgcuccaguucccca

SEQ ID NO: 25750 - RNA, 20 nt, Artificial Sequence
  MKO10025750_A_Il17ra
  gRNA
cuccucaacagguacuuguc

SEQ ID NO: 25751 - RNA, 20 nt, Artificial Sequence
  MKO10025751_A_Il17ra
  gRNA
ugcugcagcaucaccguaag

SEQ ID NO: 25752 - RNA, 20 nt, Artificial Sequence
  MKO10025752_A_Il17ra
  gRNA
uugugguuuggguccccauc

SEQ ID NO: 25753 - RNA, 20 nt, Artificial Sequence
  MKO10025753_A_Il17rb
  gRNA
guacuugcuuugccgccgga

SEQ ID NO: 25754 - RNA, 20 nt, Artificial Sequence
  MKO10025754_A_Il17rb
  gRNA
uuugccacucacgcagaucu

SEQ ID NO: 25755 - RNA, 20 nt, Artificial Sequence
  MKO10025755_A_Il17rb
  gRNA
ucugugaacuucaccucgcc

SEQ ID NO: 25756 - RNA, 20 nt, Artificial Sequence
  MKO10025756_A_Il17rc
  gRNA
acuuaccaugcacggccaag

SEQ ID NO: 25757 - RNA, 20 nt, Artificial Sequence
  MKO10025757_A_Il17rc
  gRNA
gcaccaggucagcgggcacc

SEQ ID NO: 25758 - RNA, 20 nt, Artificial Sequence
  MKO10025758_A_Il17rc
  gRNA
auacuuaccccagagguggc

SEQ ID NO: 25759 - RNA, 20 nt, Artificial Sequence
  MKO10025759_A_Il17rd
  gRNA
ccaguacgcuugccacgacc

SEQ ID NO: 25760 - RNA, 20 nt, Artificial Sequence
  MKO10025760_A_Il17rd
  gRNA
uuacuuacugucguaucuga

SEQ ID NO: 25761 - RNA, 20 nt, Artificial Sequence
  MKO10025761_A_Il17rd
  gRNA
guggcaagcguacuggcuga

SEQ ID NO: 25762 - RNA, 20 nt, Artificial Sequence
  MKO10025762_A_Il17re
  gRNA
ccaugaccaucugauugugc

SEQ ID NO: 25763 - RNA, 20 nt, Artificial Sequence
  MKO10025763_A_Il17re
  gRNA
gccucacaguguccucuugc

SEQ ID NO: 25764 - RNA, 20 nt, Artificial Sequence
  MKO10025764_A_Il17re
  gRNA
ggugcaaguccacauucucc

SEQ ID NO: 25765 - RNA, 20 nt, Artificial Sequence
  MKO10025765_A_Il18bp
  gRNA
gaaguugguacuucguaggg

SEQ ID NO: 25766 - RNA, 20 nt, Artificial Sequence
  MKO10025766_A_Il18bp
  gRNA
gguuggcuuuaugcaacccc

SEQ ID NO: 25767 - RNA, 20 nt, Artificial Sequence
  MKO10025767_A_Il18bp
  gRNA
ugcuuuccagucgcgagcac

SEQ ID NO: 25768 - RNA, 20 nt, Artificial Sequence
  MKO10025768_A_Il18r1
  gRNA
auccugaaggaugccgaguu

SEQ ID NO: 25769 - RNA, 20 nt, Artificial Sequence
  MKO10025769_A_Il18r1
  gRNA
uuagaaaugaucgucgcaau

SEQ ID NO: 25770 - RNA, 20 nt, Artificial Sequence
  MKO10025770_A_Il18r1
  gRNA
ucaccgaucacaaauucaug

SEQ ID NO: 25771 - RNA, 20 nt, Artificial Sequence
  MKO10025771_A_Il18rap
  gRNA
uccgagguugcauguaccac

SEQ ID NO: 25772 - RNA, 20 nt, Artificial Sequence
  MKO10025772_A_Il18rap
  gRNA
uacguccaguguaucuguaa

SEQ ID NO: 25773 - RNA, 20 nt, Artificial Sequence
  MKO10025773_A_Il18rap
  gRNA
ucggaguggaaguccacuag

SEQ ID NO: 25774 - RNA, 20 nt, Artificial Sequence
  MKO10025774_A_Il18
  gRNA
acuguacaaccgcaguaaua

SEQ ID NO: 25775 - RNA, 20 nt, Artificial Sequence
  MKO10025775_A_Il18
  gRNA
ucagucauauccucgaacac

SEQ ID NO: 25776 - RNA, 20 nt, Artificial Sequence
  MKO10025776_A_Il18
  gRNA
guacauguauauuaucaguc

SEQ ID NO: 25777 - RNA, 20 nt, Artificial Sequence
  MKO10025777_A_Il19
  gRNA
ggcguuucgugucaggcugc

SEQ ID NO: 25778 - RNA, 20 nt, Artificial Sequence
  MKO10025778_A_Il19
  gRNA
ucaccugauuguaguuguca

SEQ ID NO: 25779 - RNA, 20 nt, Artificial Sequence
  MKO10025779_A_Il19
  gRNA
ucaguucuccuagagacuua

SEQ ID NO: 25780 - RNA, 20 nt, Artificial Sequence
  MKO10025780_A_Il1a
  gRNA
gucgucuccucccgacgagu

SEQ ID NO: 25781 - RNA, 20 nt, Artificial Sequence
  MKO10025781_A_Il1a
  gRNA
caacuguucgugagcgcuca

SEQ ID NO: 25782 - RNA, 20 nt, Artificial Sequence
  MKO10025782_A_Il1a
  gRNA
acaaacugaugaagcucguc

SEQ ID NO: 25783 - RNA, 20 nt, Artificial Sequence
  MKO10025783_A_Il1b
  gRNA
ugugccgucuuucauuacac

SEQ ID NO: 25784 - RNA, 20 nt, Artificial Sequence
  MKO10025784_A_Il1b
  gRNA
ccauuagacaacugcacuac

SEQ ID NO: 25785 - RNA, 20 nt, Artificial Sequence
  MKO10025785_A_Il1b
  gRNA
cugcuuccaaaccuuugacc

SEQ ID NO: 25786 - RNA, 20 nt, Artificial Sequence
  MKO10025786_A_Il1f10
  gRNA
gauucagacaauuauagucc

SEQ ID NO: 25787 - RNA, 20 nt, Artificial Sequence
  MKO10025787_A_Il1f10
  gRNA
cucuugucuuuacacacgcc

SEQ ID NO: 25788 - RNA, 20 nt, Artificial Sequence
  MKO10025788_A_Il1f10
  gRNA
cccacaggaugugaacaucg

SEQ ID NO: 25789 - RNA, 20 nt, Artificial Sequence
  MKO10025789_A_Il1f5
  gRNA
ggcuuccuccuugaacgccc

SEQ ID NO: 25790 - RNA, 20 nt, Artificial Sequence
  MKO10025790_A_Il1f5
  gRNA
uucgaauccgcugccuaccc

SEQ ID NO: 25791 - RNA, 20 nt, Artificial Sequence
  MKO10025791_A_Il1f5
  gRNA
guaggcagcggauucgaagc

SEQ ID NO: 25792 - RNA, 20 nt, Artificial Sequence
  MKO10025792_A_Il1f6
  gRNA
cacugacuucgagaugauug

SEQ ID NO: 25793 - RNA, 20 nt, Artificial Sequence
  MKO10025793_A_Il1f6
  gRNA
uccugaacaugucuaagcga

SEQ ID NO: 25794 - RNA, 20 nt, Artificial Sequence
  MKO10025794_A_Il1f6
  gRNA
accuucgcuuagacauguuc

SEQ ID NO: 25795 - RNA, 20 nt, Artificial Sequence
  MKO10025795_A_Il1f8
  gRNA
ccgaaucauaacacuaugca

SEQ ID NO: 25796 - RNA, 20 nt, Artificial Sequence
  MKO10025796_A_Il1f8
  gRNA
cuauaaaccagccaggauag

SEQ ID NO: 25797 - RNA, 20 nt, Artificial Sequence
  MKO10025797_A_Il1f8
  gRNA
ucccacauuugaauacucuu

SEQ ID NO: 25798 - RNA, 20 nt, Artificial Sequence
  MKO10025798_A_Il1f9
  gRNA
uacgaaagauccacaccugc

SEQ ID NO: 25799 - RNA, 20 nt, Artificial Sequence
  MKO10025799_A_Il1f9
  gRNA
cgaagccacagaguaacccc

SEQ ID NO: 25800 - RNA, 20 nt, Artificial Sequence
  MKO10025800_A_Il1f9
  gRNA
acacccuacuuugcugcuaa

SEQ ID NO: 25801 - RNA, 20 nt, Artificial Sequence
  MKO10025801_A_Il1r1
  gRNA
agucccgguccgcugauaug

SEQ ID NO: 25802 - RNA, 20 nt, Artificial Sequence
  MKO10025802_A_Il1r1
  gRNA
gccguauguccuauacguuc

SEQ ID NO: 25803 - RNA, 20 nt, Artificial Sequence
  MKO10025803_A_Il1r1
  gRNA
uugcuucccccggaacguau

SEQ ID NO: 25804 - RNA, 20 nt, Artificial Sequence
  MKO10025804_A_Il1r2
  gRNA
ccucuagggcgccauacucu

SEQ ID NO: 25805 - RNA, 20 nt, Artificial Sequence
  MKO10025805_A_Il1r2
  gRNA
uaucuuuccaucagcguugc

SEQ ID NO: 25806 - RNA, 20 nt, Artificial Sequence
  MKO10025806_A_Il1r2
  gRNA
auugauauccaacacgucca

SEQ ID NO: 25807 - RNA, 20 nt, Artificial Sequence
  MKO10025807_A_Il1rapl1
  gRNA
gaagagccuaucgccuuuga

SEQ ID NO: 25808 - RNA, 20 nt, Artificial Sequence
  MKO10025808_A_Il1rapl1
  gRNA
uacucgcucgcccaaagugc

SEQ ID NO: 25809 - RNA, 20 nt, Artificial Sequence
  MKO10025809_A_Il1rapl1
  gRNA
aauuucaugccgagacauag

SEQ ID NO: 25810 - RNA, 20 nt, Artificial Sequence
  MKO10025810_A_Il1rapl2
  gRNA
accuuguaccauacgacauc

SEQ ID NO: 25811 - RNA, 20 nt, Artificial Sequence
  MKO10025811_A_Il1rapl2
  gRNA
accugaugucguaugguaca

SEQ ID NO: 25812 - RNA, 20 nt, Artificial Sequence
  MKO10025812_A_Il1rapl2
  gRNA
aaguguuauagauguccagc

SEQ ID NO: 25813 - RNA, 20 nt, Artificial Sequence
  MKO10025813_A_Il1rap
  gRNA
agggggcacuugauucgagc

SEQ ID NO: 25814 - RNA, 20 nt, Artificial Sequence
  MKO10025814_A_Il1rap
  gRNA
accuuauaccaagugaccga

SEQ ID NO: 25815 - RNA, 20 nt, Artificial Sequence
  MKO10025815_A_Il1rap
  gRNA
ugcagcuuaccucaacaugc

SEQ ID NO: 25816 - RNA, 20 nt, Artificial Sequence
  MKO10025816_A_Il1rl1
  gRNA
gacuuguagguaaaucgucc

SEQ ID NO: 25817 - RNA, 20 nt, Artificial Sequence
  MKO10025817_A_Il1rl1
  gRNA
auaagucgagcguccucuuu

SEQ ID NO: 25818 - RNA, 20 nt, Artificial Sequence
  MKO10025818_A_Il1rl1
  gRNA
uugauguacucgacaguacg

SEQ ID NO: 25819 - RNA, 20 nt, Artificial Sequence
  MKO10025819_A_Il1rl2
  gRNA
uccuuccccagauacgugug

SEQ ID NO: 25820 - RNA, 20 nt, Artificial Sequence
  MKO10025820_A_Il1rl2
  gRNA
uuuacugccccguuuguuuc

SEQ ID NO: 25821 - RNA, 20 nt, Artificial Sequence
  MKO10025821_A_Il1rl2
  gRNA
ucuugugaacaacguugcug

SEQ ID NO: 25822 - RNA, 20 nt, Artificial Sequence
  MKO10025822_A_Il1rn
  gRNA
agaugauaucaagcuccagc

SEQ ID NO: 25823 - RNA, 20 nt, Artificial Sequence
  MKO10025823_A_Il1rn
  gRNA
aguagaacuucgugacuaua

SEQ ID NO: 25824 - RNA, 20 nt, Artificial Sequence
  MKO10025824_A_Il1rn
  gRNA
cuugauaucaucuccagacu

SEQ ID NO: 25825 - RNA, 20 nt, Artificial Sequence
  MKO10025825_A_Il20ra
  gRNA
cuaaaugcgggaguaucaac

SEQ ID NO: 25826 - RNA, 20 nt, Artificial Sequence
  MKO10025826_A_Il20ra
  gRNA
gcguuccgucucggcccauu

SEQ ID NO: 25827 - RNA, 20 nt, Artificial Sequence
  MKO10025827_A_Il20ra
  gRNA
gaagcagugcaucaguacuu

SEQ ID NO: 25828 - RNA, 20 nt, Artificial Sequence
  MKO10025828_A_Il20rb
  gRNA
cuuacuugcauuucgguuaa

SEQ ID NO: 25829 - RNA, 20 nt, Artificial Sequence
  MKO10025829_A_Il20rb
  gRNA
ggaagccucaccgcggcgcc

SEQ ID NO: 25830 - RNA, 20 nt, Artificial Sequence
  MKO10025830_A_Il20rb
  gRNA
ccacagugccauauaacuuc

SEQ ID NO: 25831 - RNA, 20 nt, Artificial Sequence
  MKO10025831_A_Il20
  gRNA
agaaucucacuagaugacga

SEQ ID NO: 25832 - RNA, 20 nt, Artificial Sequence
  MKO10025832_A_Il20
  gRNA
ucaucuagugagauucuauc

SEQ ID NO: 25833 - RNA, 20 nt, Artificial Sequence
  MKO10025833_A_Il20
  gRNA
cuaugaagugacucagaauu

SEQ ID NO: 25834 - RNA, 20 nt, Artificial Sequence
  MKO10025834_A_Il21r
  gRNA
caggacgcuaugauaucucc

SEQ ID NO: 25835 - RNA, 20 nt, Artificial Sequence
  MKO10025835_A_Il21r
  gRNA
gauaucauagcguccugaga

SEQ ID NO: 25836 - RNA, 20 nt, Artificial Sequence
  MKO10025836_A_Il21r
  gRNA
ggaauugagacaagcgcaua

SEQ ID NO: 25837 - RNA, 20 nt, Artificial Sequence
  MKO10025837_A_Il21
  gRNA
ccugugauucguaugagaaa

SEQ ID NO: 25838 - RNA, 20 nt, Artificial Sequence
  MKO10025838_A_Il21
  gRNA
gacauucaucauugaccucg

SEQ ID NO: 25839 - RNA, 20 nt, Artificial Sequence
  MKO10025839_A_Il21
  gRNA
gaucuuaccuuuacaucuug

SEQ ID NO: 25840 - RNA, 20 nt, Artificial Sequence
  MKO10025840_A_Il22ra1
  gRNA
ggagcucuaagcgguagaac

SEQ ID NO: 25841 - RNA, 20 nt, Artificial Sequence
  MKO10025841_A_Il22ra1
  gRNA
ugccgagugaagacgcugcc

SEQ ID NO: 25842 - RNA, 20 nt, Artificial Sequence
  MKO10025842_A_Il22ra1
  gRNA
acuggaauuucacguguuga

SEQ ID NO: 25843 - RNA, 20 nt, Artificial Sequence
  MKO10025843_A_Il22ra2
  gRNA
cccgcaaagaugcguuaacu

SEQ ID NO: 25844 - RNA, 20 nt, Artificial Sequence
  MKO10025844_A_Il22ra2
  gRNA
cccgaguuaacgcaucuuug

SEQ ID NO: 25845 - RNA, 20 nt, Artificial Sequence
  MKO10025845_A_Il22ra2
  gRNA
cucccguaauacagcucgua

SEQ ID NO: 25846 - RNA, 20 nt, Artificial Sequence
  MKO10025846_A_Il22
  gRNA
gaucaaggcgauuggggaac

SEQ ID NO: 25847 - RNA, 20 nt, Artificial Sequence
  MKO10025847_A_Il22
  gRNA
caucuguguuguuaucugca

SEQ ID NO: 25848 - RNA, 20 nt, Artificial Sequence
  MKO10025848_A_Il22
  gRNA
cagauaacaacacagauguc

SEQ ID NO: 25849 - RNA, 20 nt, Artificial Sequence
  MKO10025849_A_Il23a
  gRNA
acacuuaccauaugucccgc

SEQ ID NO: 25850 - RNA, 20 nt, Artificial Sequence
  MKO10025850_A_Il23a
  gRNA
ccgggcagcuauggccaaaa

SEQ ID NO: 25851 - RNA, 20 nt, Artificial Sequence
  MKO10025851_A_Il23a
  gRNA
cuggaacgcacaugcaccag

SEQ ID NO: 25852 - RNA, 20 nt, Artificial Sequence
  MKO10025852_A_Il23r
  gRNA
auagaacaacagcucggauu

SEQ ID NO: 25853 - RNA, 20 nt, Artificial Sequence
  MKO10025853_A_Il23r
  gRNA
acaacaacuacacguccauc

SEQ ID NO: 25854 - RNA, 20 nt, Artificial Sequence
  MKO10025854_A_Il23r
  gRNA
cccuuaagcacugccgacca

SEQ ID NO: 25855 - RNA, 20 nt, Artificial Sequence
  MKO10025855_A_Il24
  gRNA
guuccgcagagcauucaaac

SEQ ID NO: 25856 - RNA, 20 nt, Artificial Sequence
  MKO10025856_A_Il24
  gRNA
ggagaaccaccccugucacu

SEQ ID NO: 25857 - RNA, 20 nt, Artificial Sequence
  MKO10025857_A_Il24
  gRNA
ugaccucaagaccuugaauu

SEQ ID NO: 25858 - RNA, 20 nt, Artificial Sequence
  MKO10025858_A_Il25
  gRNA
uacccaucgccgcuacugcu

SEQ ID NO: 25859 - RNA, 20 nt, Artificial Sequence
  MKO10025859_A_Il25
  gRNA
gccgccgguagaagaccguc

SEQ ID NO: 25860 - RNA, 20 nt, Artificial Sequence
  MKO10025860_A_Il25
  gRNA
gaacccacaccgucagcuug

SEQ ID NO: 25861 - RNA, 20 nt, Artificial Sequence
  MKO10025861_A_Il27ra
  gRNA
ccgacgcuguagcacugcag

SEQ ID NO: 25862 - RNA, 20 nt, Artificial Sequence
  MKO10025862_A_Il27ra
  gRNA
ggcgaacuccacucgcccca

SEQ ID NO: 25863 - RNA, 20 nt, Artificial Sequence
  MKO10025863_A_Il27ra
  gRNA
ugcagugggcgccgcccgug

SEQ ID NO: 25864 - RNA, 20 nt, Artificial Sequence
  MKO10025864_A_Il27
  gRNA
caggcugaaucucgauugcc

SEQ ID NO: 25865 - RNA, 20 nt, Artificial Sequence
  MKO10025865_A_Il27
  gRNA
ugagccuucaagagcugcgc

SEQ ID NO: 25866 - RNA, 20 nt, Artificial Sequence
  MKO10025866_A_Il27
  gRNA
uuguccugucucgggcuguu

SEQ ID NO: 25867 - RNA, 20 nt, Artificial Sequence
  MKO10025867_A_Il2ra
  gRNA
acaacuuacccagaaaucgg

SEQ ID NO: 25868 - RNA, 20 nt, Artificial Sequence
  MKO10025868_A_Il2ra
  gRNA
aagagaacaccaccgauuuc

SEQ ID NO: 25869 - RNA, 20 nt, Artificial Sequence
  MKO10025869_A_Il2ra
  gRNA
augcaccaagagaaccuuac

SEQ ID NO: 25870 - RNA, 20 nt, Artificial Sequence
  MKO10025870_A_Il2rb
  gRNA
cacucaccgcagguucgacu

SEQ ID NO: 25871 - RNA, 20 nt, Artificial Sequence
  MKO10025871_A_Il2rb
  gRNA
ugaggcccguagacgucuuc

SEQ ID NO: 25872 - RNA, 20 nt, Artificial Sequence
  MKO10025872_A_Il2rb
  gRNA
uccauacucacgguugucaa

SEQ ID NO: 25873 - RNA, 20 nt, Artificial Sequence
  MKO10025873_A_Il2rg
  gRNA
cauaccuauagugcagcgug

SEQ ID NO: 25874 - RNA, 20 nt, Artificial Sequence
  MKO10025874_A_Il2rg
  gRNA
gcuucuguacagcucgccuc

SEQ ID NO: 25875 - RNA, 20 nt, Artificial Sequence
  MKO10025875_A_Il2rg
  gRNA
cugggggagucauacuguag

SEQ ID NO: 25876 - RNA, 20 nt, Artificial Sequence
  MKO10025876_A_Il2
  gRNA
aagugggugcgcuguugaca

SEQ ID NO: 25877 - RNA, 20 nt, Artificial Sequence
  MKO10025877_A_Il2
  gRNA
uugcugacucaucaucgaau

SEQ ID NO: 25878 - RNA, 20 nt, Artificial Sequence
  MKO10025878_A_Il2
  gRNA
cgaugaugagucagcaacug

SEQ ID NO: 25879 - RNA, 20 nt, Artificial Sequence
  MKO10025879_A_Il31ra
  gRNA
aaaccgcgugaaaagacucg

SEQ ID NO: 25880 - RNA, 20 nt, Artificial Sequence
  MKO10025880_A_Il31ra
  gRNA
auguccuggcucuacgauuc

SEQ ID NO: 25881 - RNA, 20 nt, Artificial Sequence
  MKO10025881_A_Il31ra
  gRNA
uguucucuggcuuagucggc

SEQ ID NO: 25882 - RNA, 20 nt, Artificial Sequence
  MKO10025882_A_Il31
  gRNA
cuuaagucuuccuucgauau

SEQ ID NO: 25883 - RNA, 20 nt, Artificial Sequence
  MKO10025883_A_Il31
  gRNA
uuguaaaguguucgugcuua

SEQ ID NO: 25884 - RNA, 20 nt, Artificial Sequence
  MKO10025884_A_Il31
  gRNA
aggaacaacgaagccuaccc

SEQ ID NO: 25885 - RNA, 20 nt, Artificial Sequence
  MKO10025885_A_Il33
  gRNA
cauaguagcguaguagcacc

SEQ ID NO: 25886 - RNA, 20 nt, Artificial Sequence
  MKO10025886_A_Il33
  gRNA
gugaucaauguugacgacuc

SEQ ID NO: 25887 - RNA, 20 nt, Artificial Sequence
  MKO10025887_A_Il33
  gRNA
cccuguccugcaagucaauc

SEQ ID NO: 25888 - RNA, 20 nt, Artificial Sequence
  MKO10025888_A_Il34
  gRNA
ucuugggauccuacuugacg

SEQ ID NO: 25889 - RNA, 20 nt, Artificial Sequence
  MKO10025889_A_Il34
  gRNA
uucccaaagccacgucaagu

SEQ ID NO: 25890 - RNA, 20 nt, Artificial Sequence
  MKO10025890_A_Il34
  gRNA
acgugagugagcgagagcuu

SEQ ID NO: 25891 - RNA, 20 nt, Artificial Sequence
  MKO10025891_A_Il3ra
  gRNA
cccugucgugaugucagcgc

SEQ ID NO: 25892 - RNA, 20 nt, Artificial Sequence
  MKO10025892_A_Il3ra
  gRNA
gagcgggguccgaaagcaac

SEQ ID NO: 25893 - RNA, 20 nt, Artificial Sequence
  MKO10025893_A_Il3ra
  gRNA
cccggcgcugacaucacgac

SEQ ID NO: 25894 - RNA, 20 nt, Artificial Sequence
  MKO10025894_A_Il3
  gRNA
aggggucuucauucgagauc

SEQ ID NO: 25895 - RNA, 20 nt, Artificial Sequence
  MKO10025895_A_Il3
  gRNA
agaccaccucagcccgcauc

SEQ ID NO: 25896 - RNA, 20 nt, Artificial Sequence
  MKO10025896_A_Il3
  gRNA
aguaaaccuguccaaauucg

SEQ ID NO: 25897 - RNA, 20 nt, Artificial Sequence
  MKO10025897_A_Il4i1
  gRNA
ggggccguaucuucacuuuc

SEQ ID NO: 25898 - RNA, 20 nt, Artificial Sequence
  MKO10025898_A_Il4i1
  gRNA
ugaguagcugcucauaaucg

SEQ ID NO: 25899 - RNA, 20 nt, Artificial Sequence
  MKO10025899_A_Il4i1
  gRNA
guucaacaagcauacgcuuc

SEQ ID NO: 25900 - RNA, 20 nt, Artificial Sequence
  MKO10025900_A_Il4ra
  gRNA
ucuacuauacggcgcgugug

SEQ ID NO: 25901 - RNA, 20 nt, Artificial Sequence
  MKO10025901_A_Il4ra
  gRNA
acaccaauguguccgacgaa

SEQ ID NO: 25902 - RNA, 20 nt, Artificial Sequence
  MKO10025902_A_Il4ra
  gRNA
ccaggucagcagccauucgu

SEQ ID NO: 25903 - RNA, 20 nt, Artificial Sequence
  MKO10025903_A_Il4
  gRNA
cuccgcuuaccgaugaaucc

SEQ ID NO: 25904 - RNA, 20 nt, Artificial Sequence
  MKO10025904_A_Il4
  gRNA
aaacguccucacagcaacga

SEQ ID NO: 25905 - RNA, 20 nt, Artificial Sequence
  MKO10025905_A_Il4
  gRNA
cugcaucaagacgccaugca

SEQ ID NO: 25906 - RNA, 20 nt, Artificial Sequence
  MKO10025906_A_Il5ra
  gRNA
acaaguuaaauucguaaccg

SEQ ID NO: 25907 - RNA, 20 nt, Artificial Sequence
  MKO10025907_A_Il5ra
  gRNA
aagugucccuucguugcacc

SEQ ID NO: 25908 - RNA, 20 nt, Artificial Sequence
  MKO10025908_A_Il5ra
  gRNA
aagaacuugagcuaauccag

SEQ ID NO: 25909 - RNA, 20 nt, Artificial Sequence
  MKO10025909_A_Il5
  gRNA
acggaggacgaggcaguucc

SEQ ID NO: 25910 - RNA, 20 nt, Artificial Sequence
  MKO10025910_A_Il5
  gRNA
uucacaggagaaguguggcg

SEQ ID NO: 25911 - RNA, 20 nt, Artificial Sequence
  MKO10025911_A_Il5
  gRNA
cugaagaaucaaacuguccg

SEQ ID NO: 25912 - RNA, 20 nt, Artificial Sequence
  MKO10025912_A_Il6ra
  gRNA
agcuucgauaccgaccugua

SEQ ID NO: 25913 - RNA, 20 nt, Artificial Sequence
  MKO10025913_A_Il6ra
  gRNA
gacgugcagcucagcgacac

SEQ ID NO: 25914 - RNA, 20 nt, Artificial Sequence
  MKO10025914_A_Il6ra
  gRNA
cguugacaaggggguucuuc

SEQ ID NO: 25915 - RNA, 20 nt, Artificial Sequence
  MKO10025915_A_Il6st
  gRNA
cagugaaguucgagccgcgc

SEQ ID NO: 25916 - RNA, 20 nt, Artificial Sequence
  MKO10025916_A_Il6st
  gRNA
ggucuuccacacgauguagc

SEQ ID NO: 25917 - RNA, 20 nt, Artificial Sequence
  MKO10025917_A_Il6st
  gRNA
uaaagucugacauccaauau

SEQ ID NO: 25918 - RNA, 20 nt, Artificial Sequence
  MKO10025918_A_Il6
  gRNA
cuaccaaacuggauauaauc

SEQ ID NO: 25919 - RNA, 20 nt, Artificial Sequence
  MKO10025919_A_Il6
  gRNA
ucuggaguaccauagcuacc

SEQ ID NO: 25920 - RNA, 20 nt, Artificial Sequence
  MKO10025920_A_Il6
  gRNA
aguuguucuucauguacucc

SEQ ID NO: 25921 - RNA, 20 nt, Artificial Sequence
  MKO10025921_A_Il7r
  gRNA
cguccgcgucugcaucuucu

SEQ ID NO: 25922 - RNA, 20 nt, Artificial Sequence
  MKO10025922_A_Il7r
  gRNA
cuuugcgauaaacgacuuuc

SEQ ID NO: 25923 - RNA, 20 nt, Artificial Sequence
  MKO10025923_A_Il7r
  gRNA
ccccauaacgauuacuucaa

SEQ ID NO: 25924 - RNA, 20 nt, Artificial Sequence
  MKO10025924_A_Il7
  gRNA
acuggugaacugcacaagua

SEQ ID NO: 25925 - RNA, 20 nt, Artificial Sequence
  MKO10025925_A_Il7
  gRNA
gaugaucagcaucgaugaau

SEQ ID NO: 25926 - RNA, 20 nt, Artificial Sequence
  MKO10025926_A_Il7
  gRNA
cuugugauacuguuaguaag

SEQ ID NO: 25927 - RNA, 20 nt, Artificial Sequence
  MKO10025927_A_Il9r
  gRNA
uggcggugaaacaggucucc

SEQ ID NO: 25928 - RNA, 20 nt, Artificial Sequence
  MKO10025928_A_Il9r
  gRNA
cacacuucaccgcugcauca

SEQ ID NO: 25929 - RNA, 20 nt, Artificial Sequence
  MKO10025929_A_Il9r
  gRNA
ccacuggucggcuccagagc

SEQ ID NO: 25930 - RNA, 20 nt, Artificial Sequence
  MKO10025930_A_Il9
  gRNA
auuguaccacaccgugcuac

SEQ ID NO: 25931 - RNA, 20 nt, Artificial Sequence
  MKO10025931_A_Il9
  gRNA
ccuaaagaacaucacguguc

SEQ ID NO: 25932 - RNA, 20 nt, Artificial Sequence
  MKO10025932_A_Il9
  gRNA
aaagccaugcaaccagacca

SEQ ID NO: 25933 - RNA, 20 nt, Artificial Sequence
  MKO10025933_A_Ildr1
  gRNA
aaguucgcaucguggcgcag

SEQ ID NO: 25934 - RNA, 20 nt, Artificial Sequence
  MKO10025934_A_Ildr1
  gRNA
ccgguaauccacccccagca

SEQ ID NO: 25935 - RNA, 20 nt, Artificial Sequence
  MKO10025935_A_Ildr1
  gRNA
gccaugucacaaccacgucc

SEQ ID NO: 25936 - RNA, 20 nt, Artificial Sequence
  MKO10025936_A_Ildr2
  gRNA
cagcagaaggaccguccgag

SEQ ID NO: 25937 - RNA, 20 nt, Artificial Sequence
  MKO10025937_A_Ildr2
  gRNA
uccccaccagcacgaagaag

SEQ ID NO: 25938 - RNA, 20 nt, Artificial Sequence
  MKO10025938_A_Ildr2
  gRNA
ucccaugcgauccuggcagu

SEQ ID NO: 25939 - RNA, 20 nt, Artificial Sequence
  MKO10025939_A_Ilf2
  gRNA
cguggucguggugggcgcuu

SEQ ID NO: 25940 - RNA, 20 nt, Artificial Sequence
  MKO10025940_A_Ilf2
  gRNA
cauaccugcucagcagaauu

SEQ ID NO: 25941 - RNA, 20 nt, Artificial Sequence
  MKO10025941_A_Ilf2
  gRNA
ugccccuaauucugcugagc

SEQ ID NO: 25942 - RNA, 20 nt, Artificial Sequence
  MKO10025942_A_Ilf3
  gRNA
cgacccgcaucacgccccuc

SEQ ID NO: 25943 - RNA, 20 nt, Artificial Sequence
  MKO10025943_A_Ilf3
  gRNA
ccauacugagcgggcccuga

SEQ ID NO: 25944 - RNA, 20 nt, Artificial Sequence
  MKO10025944_A_Ilf3
  gRNA
gaaugaugaucgccacguga

SEQ ID NO: 25945 - RNA, 20 nt, Artificial Sequence
  MKO10025945_A_Ilkap
  gRNA
acuccugagugauaucguuc

SEQ ID NO: 25946 - RNA, 20 nt, Artificial Sequence
  MKO10025946_A_Ilkap
  gRNA
cauccugaacgauaucacuc

SEQ ID NO: 25947 - RNA, 20 nt, Artificial Sequence
  MKO10025947_A_Ilkap
  gRNA
uugccuaccugaauugccac

SEQ ID NO: 25948 - RNA, 20 nt, Artificial Sequence
  MKO10025948_A_Ilk
  gRNA
cggauuaaugugaugaaucg

SEQ ID NO: 25949 - RNA, 20 nt, Artificial Sequence
  MKO10025949_A_Ilk
  gRNA
cucacggggccuugugcgag

SEQ ID NO: 25950 - RNA, 20 nt, Artificial Sequence
  MKO10025950_A_Ilk
  gRNA
ggaugauaccccccugcacc

SEQ ID NO: 25951 - RNA, 20 nt, Artificial Sequence
  MKO10025951_A_Iltifb
  gRNA
gaucaaagcgaucggggaac

SEQ ID NO: 25952 - RNA, 20 nt, Artificial Sequence
  MKO10025952_A_Iltifb
  gRNA
cagauaacaacacagacguc

SEQ ID NO: 25953 - RNA, 20 nt, Artificial Sequence
  MKO10025953_A_Iltifb
  gRNA
cgucuguguuguuaucugca

SEQ ID NO: 25954 - RNA, 20 nt, Artificial Sequence
  MKO10025954_A_Ilvbl
  gRNA
ccagaaacggggcgcacuuc

SEQ ID NO: 25955 - RNA, 20 nt, Artificial Sequence
  MKO10025955_A_Ilvbl
  gRNA
gcaauagcugcugcccaguc

SEQ ID NO: 25956 - RNA, 20 nt, Artificial Sequence
  MKO10025956_A_Ilvbl
  gRNA
ugaagacaaagcguacacca

SEQ ID NO: 25957 - RNA, 20 nt, Artificial Sequence
  MKO10025957_A_Immp1l
  gRNA
aagaggacguaucuucuuua

SEQ ID NO: 25958 - RNA, 20 nt, Artificial Sequence
  MKO10025958_A_Immp1l
  gRNA
ucaguguucuggaccaucaa

SEQ ID NO: 25959 - RNA, 20 nt, Artificial Sequence
  MKO10025959_A_Immp1l
  gRNA
cguccucuuauuaguccaua

SEQ ID NO: 25960 - RNA, 20 nt, Artificial Sequence
  MKO10025960_A_Immp2l
  gRNA
agucacuuucuuggaucgcg

SEQ ID NO: 25961 - RNA, 20 nt, Artificial Sequence
  MKO10025961_A_Immp2l
  gRNA
uauuguacccucgcccaauu

SEQ ID NO: 25962 - RNA, 20 nt, Artificial Sequence
  MKO10025962_A_Immp2l
  gRNA
gguggaaggcucgucaaugc

SEQ ID NO: 25963 - RNA, 20 nt, Artificial Sequence
  MKO10025963_A_Immt
  gRNA
uaucuacggcauggucguag

SEQ ID NO: 25964 - RNA, 20 nt, Artificial Sequence
  MKO10025964_A_Immt
  gRNA
gggaaucccauuuggcauac

SEQ ID NO: 25965 - RNA, 20 nt, Artificial Sequence
  MKO10025965_A_Immt
  gRNA
cugcgggccugucaguuauc

SEQ ID NO: 25966 - RNA, 20 nt, Artificial Sequence
  MKO10025966_A_Imp3
  gRNA
cccauuccgcgugcgcgccu

SEQ ID NO: 25967 - RNA, 20 nt, Artificial Sequence
  MKO10025967_A_Imp3
  gRNA
gccgcagcacacgcaguucg

SEQ ID NO: 25968 - RNA, 20 nt, Artificial Sequence
  MKO10025968_A_Imp3
  gRNA
gcugcgccaugcguagcuug

SEQ ID NO: 25969 - RNA, 20 nt, Artificial Sequence
  MKO10025969_A_Imp4
  gRNA
ggaggcgcagcgauccguuc

SEQ ID NO: 25970 - RNA, 20 nt, Artificial Sequence
  MKO10025970_A_Imp4
  gRNA
caacaggucggugaccccgu

SEQ ID NO: 25971 - RNA, 20 nt, Artificial Sequence
  MKO10025971_A_Imp4
  gRNA
ggugcccagcgcaugaaccg

SEQ ID NO: 25972 - RNA, 20 nt, Artificial Sequence
  MKO10025972_A_Impa1
  gRNA
gaacgacuaacuucgugcau

SEQ ID NO: 25973 - RNA, 20 nt, Artificial Sequence
  MKO10025973_A_Impa1
  gRNA
guaacuguuaccaagucggc

SEQ ID NO: 25974 - RNA, 20 nt, Artificial Sequence
  MKO10025974_A_Impa1
  gRNA
uaaaaguucuccagccgacu

SEQ ID NO: 25975 - RNA, 20 nt, Artificial Sequence
  MKO10025975_A_Impa2
  gRNA
gucgauggggucgaugaucc

SEQ ID NO: 25976 - RNA, 20 nt, Artificial Sequence
  MKO10025976_A_Impa2
  gRNA
agcggcuguacaccggcagg

SEQ ID NO: 25977 - RNA, 20 nt, Artificial Sequence
  MKO10025977_A_Impa2
  gRNA
caucggauuugcuguucacc

SEQ ID NO: 25978 - RNA, 20 nt, Artificial Sequence
  MKO10025978_A_Impacu
  gRNA
gcuguacccggguacucacu

SEQ ID NO: 25979 - RNA, 20 nt, Artificial Sequence
  MKO10025979_A_Impacu
  gRNA
acaccacuccucgccauaaa

SEQ ID NO: 25980 - RNA, 20 nt, Artificial Sequence
  MKO10025980_A_Impacu
  gRNA
agacuuaucgaacagccuug

SEQ ID NO: 25981 - RNA, 20 nt, Artificial Sequence
  MKO10025981_A_Impad1
  gRNA
auugugucucgcucucaugc

SEQ ID NO: 25982 - RNA, 20 nt, Artificial Sequence
  MKO10025982_A_Impad1
  gRNA
cuuccggauuuagaaaaguc

SEQ ID NO: 25983 - RNA, 20 nt, Artificial Sequence
  MKO10025983_A_Impad1
  gRNA
ugacccacuugaugcuacac

SEQ ID NO: 25984 - RNA, 20 nt, Artificial Sequence
  MKO10025984_A_Impdh1
  gRNA
ugguauccccaucaccgcga

SEQ ID NO: 25985 - RNA, 20 nt, Artificial Sequence
  MKO10025985_A_Impdh1
  gRNA
cuugaccuuccguacuucau

SEQ ID NO: 25986 - RNA, 20 nt, Artificial Sequence
  MKO10025986_A_Impdh1
  gRNA
accauugaucucgucuccca

SEQ ID NO: 25987 - RNA, 20 nt, Artificial Sequence
  MKO10025987_A_Impdh2
  gRNA
aagccuuaccgccaucgcga

SEQ ID NO: 25988 - RNA, 20 nt, Artificial Sequence
  MKO10025988_A_Impdh2
  gRNA
uggaauggccaucgcgaugg

SEQ ID NO: 25989 - RNA, 20 nt, Artificial Sequence
  MKO10025989_A_Impdh2
  gRNA
uuccuuccagaaauacgaac

SEQ ID NO: 25990 - RNA, 20 nt, Artificial Sequence
  MKO10025990_A_Impg1
  gRNA
caguaugucaagaagucgug

SEQ ID NO: 25991 - RNA, 20 nt, Artificial Sequence
  MKO10025991_A_Impg1
  gRNA
caaaucgaauauucguuuca

SEQ ID NO: 25992 - RNA, 20 nt, Artificial Sequence
  MKO10025992_A_Impg1
  gRNA
aacuuaccuguggguaccac

SEQ ID NO: 25993 - RNA, 20 nt, Artificial Sequence
  MKO10025993_A_Impg2
  gRNA
ucgaucccaaaacguccuga

SEQ ID NO: 25994 - RNA, 20 nt, Artificial Sequence
  MKO10025994_A_Impg2
  gRNA
ugacgauauucaucacgccc

SEQ ID NO: 25995 - RNA, 20 nt, Artificial Sequence
  MKO10025995_A_Impg2
  gRNA
agccucugcaacgguuucac

SEQ ID NO: 25996 - RNA, 20 nt, Artificial Sequence
  MKO10025996_A_Inadl
  gRNA
aaucuuaccucaacaggcga

SEQ ID NO: 25997 - RNA, 20 nt, Artificial Sequence
  MKO10025997_A_Inadl
  gRNA
gucucgcuggcaauaaggac

SEQ ID NO: 25998 - RNA, 20 nt, Artificial Sequence
  MKO10025998_A_Inadl
  gRNA
agaacuacacauuaucgaac

SEQ ID NO: 25999 - RNA, 20 nt, Artificial Sequence
  MKO10025999_A_Ina
  gRNA
cacgccgagccgucgcgcgu

SEQ ID NO: 26000 - RNA, 20 nt, Artificial Sequence
  MKO10026000_A_Ina
  gRNA
aagagcucgccgacgcgcga

SEQ ID NO: 26001 - RNA, 20 nt, Artificial Sequence
  MKO10026001_A_Ina
  gRNA
ccccgagaugcuuaacccgc

SEQ ID NO: 26002 - RNA, 20 nt, Artificial Sequence
  MKO10026002_A_Inca1
  gRNA
ggagccccucaagagggugc

SEQ ID NO: 26003 - RNA, 20 nt, Artificial Sequence
  MKO10026003_A_Inca1
  gRNA
guacuguucuaccauccaau

SEQ ID NO: 26004 - RNA, 20 nt, Artificial Sequence
  MKO10026004_A_Inca1
  gRNA
agaccaaugccucagccgua

SEQ ID NO: 26005 - RNA, 20 nt, Artificial Sequence
  MKO10026005_A_Incenp
  gRNA
cggguuauccgcugcaacac

SEQ ID NO: 26006 - RNA, 20 nt, Artificial Sequence
  MKO10026006_A_Incenp
  gRNA
acuagccucgaaguauaauu

SEQ ID NO: 26007 - RNA, 20 nt, Artificial Sequence
  MKO10026007_A_Incenp
  gRNA
cuccuucucagaaaaaccgu

SEQ ID NO: 26008 - RNA, 20 nt, Artificial Sequence
  MKO10026008_A_Inf2
  gRNA
gaacuucagcgaauuagcga

SEQ ID NO: 26009 - RNA, 20 nt, Artificial Sequence
  MKO10026009_A_Inf2
  gRNA
cgcacugacgcucgaugccc

SEQ ID NO: 26010 - RNA, 20 nt, Artificial Sequence
  MKO10026010_A_Inf2
  gRNA
cagugacaacgugcccuaug

SEQ ID NO: 26011 - RNA, 20 nt, Artificial Sequence
  MKO10026011_A_Ing1
  gRNA
gagaucgacgccaaauacca

SEQ ID NO: 26012 - RNA, 20 nt, Artificial Sequence
  MKO10026012_A_Ing1
  gRNA
gcagugacucgauugagucc

SEQ ID NO: 26013 - RNA, 20 nt, Artificial Sequence
  MKO10026013_A_Ing1
  gRNA
cagacggcacccagaagcgc

SEQ ID NO: 26014 - RNA, 20 nt, Artificial Sequence
  MKO10026014_A_Ing2
  gRNA
ccgcgcuccugaccggagag

SEQ ID NO: 26015 - RNA, 20 nt, Artificial Sequence
  MKO10026015_A_Ing2
  gRNA
ggaucgauggcaaacucgac

SEQ ID NO: 26016 - RNA, 20 nt, Artificial Sequence
  MKO10026016_A_Ing2
  gRNA
ccgcucuccggucaggagcg

SEQ ID NO: 26017 - RNA, 20 nt, Artificial Sequence
  MKO10026017_A_Ing3
  gRNA
ucucgcgcaucuccgugaag

SEQ ID NO: 26018 - RNA, 20 nt, Artificial Sequence
  MKO10026018_A_Ing3
  gRNA
cuucacggagaugcgcgaga

SEQ ID NO: 26019 - RNA, 20 nt, Artificial Sequence
  MKO10026019_A_Ing3
  gRNA
agaucgccacuugagaaagc

SEQ ID NO: 26020 - RNA, 20 nt, Artificial Sequence
  MKO10026020_A_Ing4
  gRNA
ccuagaaggccggacccaaa

SEQ ID NO: 26021 - RNA, 20 nt, Artificial Sequence
  MKO10026021_A_Ing4
  gRNA
ggcgcuacucauauauucag

SEQ ID NO: 26022 - RNA, 20 nt, Artificial Sequence
  MKO10026022_A_Ing4
  gRNA
uauggcaagugcaaggaauu

SEQ ID NO: 26023 - RNA, 20 nt, Artificial Sequence
  MKO10026023_A_Ing5
  gRNA
ccgaagacuugaugcugacc

SEQ ID NO: 26024 - RNA, 20 nt, Artificial Sequence
  MKO10026024_A_Ing5
  gRNA
ucuggaggugcuccacacgc

SEQ ID NO: 26025 - RNA, 20 nt, Artificial Sequence
  MKO10026025_A_Ing5
  gRNA
gaaagcagagaucgacaucc

SEQ ID NO: 26026 - RNA, 20 nt, Artificial Sequence
  MKO10026026_A_Inha
  gRNA
ugcgccccugcuagaucuuc

SEQ ID NO: 26027 - RNA, 20 nt, Artificial Sequence
  MKO10026027_A_Inha
  gRNA
cgcguccgaaccaccucaga

SEQ ID NO: 26028 - RNA, 20 nt, Artificial Sequence
  MKO10026028_A_Inha
  gRNA
gccagggacccgaacuuguc

SEQ ID NO: 26029 - RNA, 20 nt, Artificial Sequence
  MKO10026029_A_Inhba
  gRNA
ucauuaaccacuaccgcaug

SEQ ID NO: 26030 - RNA, 20 nt, Artificial Sequence
  MKO10026030_A_Inhba
  gRNA
cuaucacgccaauuauugug

SEQ ID NO: 26031 - RNA, 20 nt, Artificial Sequence
  MKO10026031_A_Inhba
  gRNA
gcacccaccugacucggcaa

SEQ ID NO: 26032 - RNA, 20 nt, Artificial Sequence
  MKO10026032_A_Inhbb
  gRNA
gccgccaccgcacgacguac

SEQ ID NO: 26033 - RNA, 20 nt, Artificial Sequence
  MKO10026033_A_Inhbb
  gRNA
uaugccagccgcuacguuuc

SEQ ID NO: 26034 - RNA, 20 nt, Artificial Sequence
  MKO10026034_A_Inhbb
  gRNA
caggacaccuguacgucgug

SEQ ID NO: 26035 - RNA, 20 nt, Artificial Sequence
  MKO10026035_A_Inhbc
  gRNA
uccaacaggguuucccgucg

SEQ ID NO: 26036 - RNA, 20 nt, Artificial Sequence
  MKO10026036_A_Inhbc
  gRNA
ccggcgagguaucgauugcc

SEQ ID NO: 26037 - RNA, 20 nt, Artificial Sequence
  MKO10026037_A_Inhbc
  gRNA
gcgggagcugcuucucgauu

SEQ ID NO: 26038 - RNA, 20 nt, Artificial Sequence
  MKO10026038_A_Inhbe
  gRNA
ggaccuuaacagcaccgcug

SEQ ID NO: 26039 - RNA, 20 nt, Artificial Sequence
  MKO10026039_A_Inhbe
  gRNA
gcggaauccucggcaccuag

SEQ ID NO: 26040 - RNA, 20 nt, Artificial Sequence
  MKO10026040_A_Inhbe
  gRNA
accagagcgcguucuccuug

SEQ ID NO: 26041 - RNA, 20 nt, Artificial Sequence
  MKO10026041_A_Inip
  gRNA
acggccaauaccuagcucca

SEQ ID NO: 26042 - RNA, 20 nt, Artificial Sequence
  MKO10026042_A_Inip
  gRNA
caugcauuaccuuguccuga

SEQ ID NO: 26043 - RNA, 20 nt, Artificial Sequence
  MKO10026043_A_Inip
  gRNA
ccggaaguccuugguaagag

SEQ ID NO: 26044 - RNA, 20 nt, Artificial Sequence
  MKO10026044_A_Inmt
  gRNA
ccacaaagcacaaaccgucg

SEQ ID NO: 26045 - RNA, 20 nt, Artificial Sequence
  MKO10026045_A_Inmt
  gRNA
ugugaccaagacacccccgc

SEQ ID NO: 26046 - RNA, 20 nt, Artificial Sequence
  MKO10026046_A_Inmt
  gRNA
uaucuccccaggagguguag

SEQ ID NO: 26047 - RNA, 20 nt, Artificial Sequence
  MKO10026047_A_Ino80b
  gRNA
cguucccacacccacggcgg

SEQ ID NO: 26048 - RNA, 20 nt, Artificial Sequence
  MKO10026048_A_Ino80b
  gRNA
gcggcugcuuacagcgagac

SEQ ID NO: 26049 - RNA, 20 nt, Artificial Sequence
  MKO10026049_A_Ino80b
  gRNA
uccagagguacgccuuccau

SEQ ID NO: 26050 - RNA, 20 nt, Artificial Sequence
  MKO10026050_A_Ino80c
  gRNA
ugccagcuacagcgccgcca

SEQ ID NO: 26051 - RNA, 20 nt, Artificial Sequence
  MKO10026051_A_Ino80c
  gRNA
cugccuucggauguggucac

SEQ ID NO: 26052 - RNA, 20 nt, Artificial Sequence
  MKO10026052_A_Ino80c
  gRNA
aggaauucuccuacauucgc

SEQ ID NO: 26053 - RNA, 20 nt, Artificial Sequence
  MKO10026053_A_Ino80d
  gRNA
gugcacccaaaagcgucagc

SEQ ID NO: 26054 - RNA, 20 nt, Artificial Sequence
  MKO10026054_A_Ino80d
  gRNA
auggaccaugcgacuugaua

SEQ ID NO: 26055 - RNA, 20 nt, Artificial Sequence
  MKO10026055_A_Ino80d
  gRNA
cuucgccauaucaagucgca

SEQ ID NO: 26056 - RNA, 20 nt, Artificial Sequence
  MKO10026056_A_Ino80e
  gRNA
agaaacggccccgccuaccc

SEQ ID NO: 26057 - RNA, 20 nt, Artificial Sequence
  MKO10026057_A_Ino80e
  gRNA
acucuggaaugucgaucacc

SEQ ID NO: 26058 - RNA, 20 nt, Artificial Sequence
  MKO10026058_A_Ino80e
  gRNA
ccugcuuaccucuuaggggc

SEQ ID NO: 26059 - RNA, 20 nt, Artificial Sequence
  MKO10026059_A_Ino80
  gRNA
agaacgccguucagugaaua

SEQ ID NO: 26060 - RNA, 20 nt, Artificial Sequence
  MKO10026060_A_Ino80
  gRNA
aaucccuuauugccugaguc

SEQ ID NO: 26061 - RNA, 20 nt, Artificial Sequence
  MKO10026061_A_Ino80
  gRNA
gcaggccugcacuguaguac

SEQ ID NO: 26062 - RNA, 20 nt, Artificial Sequence
  MKO10026062_A_Inpp1
  gRNA
caugccggcaucggaagcgc

SEQ ID NO: 26063 - RNA, 20 nt, Artificial Sequence
  MKO10026063_A_Inpp1
  gRNA
gguagcgucuuccccgcggc

SEQ ID NO: 26064 - RNA, 20 nt, Artificial Sequence
  MKO10026064_A_Inpp1
  gRNA
gcugcucuuucgcgcgugug

SEQ ID NO: 26065 - RNA, 20 nt, Artificial Sequence
  MKO10026065_A_Inpp4a
  gRNA
aacuacgaugucgucacuau

SEQ ID NO: 26066 - RNA, 20 nt, Artificial Sequence
  MKO10026066_A_Inpp4a
  gRNA
cucgcauccguuguaugugc

SEQ ID NO: 26067 - RNA, 20 nt, Artificial Sequence
  MKO10026067_A_Inpp4a
  gRNA
cgccggaggcucucccagca

SEQ ID NO: 26068 - RNA, 20 nt, Artificial Sequence
  MKO10026068_A_Inpp4b
  gRNA
gauuccgaacgagccacagu

SEQ ID NO: 26069 - RNA, 20 nt, Artificial Sequence
  MKO10026069_A_Inpp4b
  gRNA
gugggaaugugacacccguu

SEQ ID NO: 26070 - RNA, 20 nt, Artificial Sequence
  MKO10026070_A_Inpp4b
  gRNA
acugacagucuacgauguca

SEQ ID NO: 26071 - RNA, 20 nt, Artificial Sequence
  MKO10026071_A_Inpp5a
  gRNA
gucgaagagcgagcccacgu

SEQ ID NO: 26072 - RNA, 20 nt, Artificial Sequence
  MKO10026072_A_Inpp5a
  gRNA
guauucuuucauugcgucac

SEQ ID NO: 26073 - RNA, 20 nt, Artificial Sequence
  MKO10026073_A_Inpp5a
  gRNA
gaccagcaggaccgcggugc

SEQ ID NO: 26074 - RNA, 20 nt, Artificial Sequence
  MKO10026074_A_Inpp5b
  gRNA
gcccuacuuacgcaugcucc

SEQ ID NO: 26075 - RNA, 20 nt, Artificial Sequence
  MKO10026075_A_Inpp5b
  gRNA
ccggcuggaaaaugacgccc

SEQ ID NO: 26076 - RNA, 20 nt, Artificial Sequence
  MKO10026076_A_Inpp5b
  gRNA
agauacaucgucuccuguga

SEQ ID NO: 26077 - RNA, 20 nt, Artificial Sequence
  MKO10026077_A_Inpp5d
  gRNA
gcucccguccuugccggcuc

SEQ ID NO: 26078 - RNA, 20 nt, Artificial Sequence
  MKO10026078_A_Inpp5d
  gRNA
agugaauuuaucguccucau

SEQ ID NO: 26079 - RNA, 20 nt, Artificial Sequence
  MKO10026079_A_Inpp5d
  gRNA
gugccagcgaguccaucccc

SEQ ID NO: 26080 - RNA, 20 nt, Artificial Sequence
  MKO10026080_A_Inpp5e
  gRNA
cacgaugcguguaguuacug

SEQ ID NO: 26081 - RNA, 20 nt, Artificial Sequence
  MKO10026081_A_Inpp5e
  gRNA
guacuucccagaccgaaaca

SEQ ID NO: 26082 - RNA, 20 nt, Artificial Sequence
  MKO10026082_A_Inpp5e
  gRNA
ggagugggagacacgccugc

SEQ ID NO: 26083 - RNA, 20 nt, Artificial Sequence
  MKO10026083_A_Inpp5f
  gRNA
uuuaauucggcagaaagcgu

SEQ ID NO: 26084 - RNA, 20 nt, Artificial Sequence
  MKO10026084_A_Inpp5f
  gRNA
acuggagcggcguuugcuug

SEQ ID NO: 26085 - RNA, 20 nt, Artificial Sequence
  MKO10026085_A_Inpp5f
  gRNA
guggguauaccuucugccac

SEQ ID NO: 26086 - RNA, 20 nt, Artificial Sequence
  MKO10026086_A_Inpp5j
  gRNA
ccuacuugcaagagcgaccc

SEQ ID NO: 26087 - RNA, 20 nt, Artificial Sequence
  MKO10026087_A_Inpp5j
  gRNA
acuaccaccuaccguuccua

SEQ ID NO: 26088 - RNA, 20 nt, Artificial Sequence
  MKO10026088_A_Inpp5j
  gRNA
agucugucugcacgucccgu

SEQ ID NO: 26089 - RNA, 20 nt, Artificial Sequence
  MKO10026089_A_Inpp5k
  gRNA
acagcguacauguugugacg

SEQ ID NO: 26090 - RNA, 20 nt, Artificial Sequence
  MKO10026090_A_Inpp5k
  gRNA
gaucucucaaguccguaugc

SEQ ID NO: 26091 - RNA, 20 nt, Artificial Sequence
  MKO10026091_A_Inpp5k
  gRNA
cguaguagccauaaagcuuc

SEQ ID NO: 26092 - RNA, 20 nt, Artificial Sequence
  MKO10026092_A_Inppl1
  gRNA
cccuugucaccucgugccga

SEQ ID NO: 26093 - RNA, 20 nt, Artificial Sequence
  MKO10026093_A_Inppl1
  gRNA
ugugcgucgcuuccagaccc

SEQ ID NO: 26094 - RNA, 20 nt, Artificial Sequence
  MKO10026094_A_Inppl1
  gRNA
cccccacuacccccgcgcuc

SEQ ID NO: 26095 - RNA, 20 nt, Artificial Sequence
  MKO10026095_A_Ins1
  gRNA
ggacccacaaguggaacaac

SEQ ID NO: 26096 - RNA, 20 nt, Artificial Sequence
  MKO10026096_A_Ins1
  gRNA
gggguaggaagugcaccaac

SEQ ID NO: 26097 - RNA, 20 nt, Artificial Sequence
  MKO10026097_A_Ins1
  gRNA
cuccacuucacggcgggacu

SEQ ID NO: 26098 - RNA, 20 nt, Artificial Sequence
  MKO10026098_A_Ins2
  gRNA
ggggcaggaagcgcauccac

SEQ ID NO: 26099 - RNA, 20 nt, Artificial Sequence
  MKO10026099_A_Ins2
  gRNA
cuggguggaggcccgggagc

SEQ ID NO: 26100 - RNA, 20 nt, Artificial Sequence
  MKO10026100_A_Ins2
  gRNA
uuugucaagcagcaccuuug

SEQ ID NO: 26101 - RNA, 20 nt, Artificial Sequence
  MKO10026101_A_Insc
  gRNA
cugcccgauccuucgaagcu

SEQ ID NO: 26102 - RNA, 20 nt, Artificial Sequence
  MKO10026102_A_Insc
  gRNA
gaccaaagugcucgcccagc

SEQ ID NO: 26103 - RNA, 20 nt, Artificial Sequence
  MKO10026103_A_Insc
  gRNA
uugcaggcuacacuucaugc

SEQ ID NO: 26104 - RNA, 20 nt, Artificial Sequence
  MKO10026104_A_Insig1
  gRNA
ggcaauacagcgcauaacgc

SEQ ID NO: 26105 - RNA, 20 nt, Artificial Sequence
  MKO10026105_A_Insig1
  gRNA
acauuugaucguucccgaag

SEQ ID NO: 26106 - RNA, 20 nt, Artificial Sequence
  MKO10026106_A_Insig1
  gRNA
cgcuguauugccguguucgu

SEQ ID NO: 26107 - RNA, 20 nt, Artificial Sequence
  MKO10026107_A_Insig2
  gRNA
cgccacgcagcgcaugacac

SEQ ID NO: 26108 - RNA, 20 nt, Artificial Sequence
  MKO10026108_A_Insig2
  gRNA
cagugucaugcgcugcgugg

SEQ ID NO: 26109 - RNA, 20 nt, Artificial Sequence
  MKO10026109_A_Insig2
  gRNA
ggcauaacgaugggaaacau

SEQ ID NO: 26110 - RNA, 20 nt, Artificial Sequence
  MKO10026110_A_Insl3
  gRNA
gagacaucuccugcacgcgc

SEQ ID NO: 26111 - RNA, 20 nt, Artificial Sequence
  MKO10026111_A_Insl3
  gRNA
guggccucgggcgaccagcg

SEQ ID NO: 26112 - RNA, 20 nt, Artificial Sequence
  MKO10026112_A_Insl3
  gRNA
cggcccacgcuggucgcccg

SEQ ID NO: 26113 - RNA, 20 nt, Artificial Sequence
  MKO10026113_A_Insl5
  gRNA
ggagcuuguucgagauccac

SEQ ID NO: 26114 - RNA, 20 nt, Artificial Sequence
  MKO10026114_A_Insl5
  gRNA
cuucccaagacggaucucuc

SEQ ID NO: 26115 - RNA, 20 nt, Artificial Sequence
  MKO10026115_A_Insl5
  gRNA
augucuccuccaccgugagc

SEQ ID NO: 26116 - RNA, 20 nt, Artificial Sequence
  MKO10026116_A_Insl6
  gRNA
aaguuguacgcucuuaacau

SEQ ID NO: 26117 - RNA, 20 nt, Artificial Sequence
  MKO10026117_A_Insl6
  gRNA
ugacuggagccgguucgaga

SEQ ID NO: 26118 - RNA, 20 nt, Artificial Sequence
  MKO10026118_A_Insl6
  gRNA
cgcgacggccaucucuucuu

SEQ ID NO: 26119 - RNA, 20 nt, Artificial Sequence
  MKO10026119_A_Insm1
  gRNA
cgcucccgccgagcucaaga

SEQ ID NO: 26120 - RNA, 20 nt, Artificial Sequence
  MKO10026120_A_Insm1
  gRNA
ccugacucggauacgccgcc

SEQ ID NO: 26121 - RNA, 20 nt, Artificial Sequence
  MKO10026121_A_Insm1
  gRNA
aguccacgcccguguccuac

SEQ ID NO: 26122 - RNA, 20 nt, Artificial Sequence
  MKO10026122_A_Insm2
  gRNA
cucggacgucgcuccugcgc

SEQ ID NO: 26123 - RNA, 20 nt, Artificial Sequence
  MKO10026123_A_Insm2
  gRNA
cgcguggggagguuuacucg

SEQ ID NO: 26124 - RNA, 20 nt, Artificial Sequence
  MKO10026124_A_Insm2
  gRNA
gaccgacgaucagcacccgc

SEQ ID NO: 26125 - RNA, 20 nt, Artificial Sequence
  MKO10026125_A_Insrr
  gRNA
acggcagcccgacgucccgu

SEQ ID NO: 26126 - RNA, 20 nt, Artificial Sequence
  MKO10026126_A_Insrr
  gRNA
gacgucgggcugccgucgcu

SEQ ID NO: 26127 - RNA, 20 nt, Artificial Sequence
  MKO10026127_A_Insrr
  gRNA
gccagagcuucaacgcaacc

SEQ ID NO: 26128 - RNA, 20 nt, Artificial Sequence
  MKO10026128_A_Insr
  gRNA
uauagccagacgggcacucg

SEQ ID NO: 26129 - RNA, 20 nt, Artificial Sequence
  MKO10026129_A_Insr
  gRNA
uaucgacuggucccguaucc

SEQ ID NO: 26130 - RNA, 20 nt, Artificial Sequence
  MKO10026130_A_Insr
  gRNA
gauccgccgcuccuaugcuc

SEQ ID NO: 26131 - RNA, 20 nt, Artificial Sequence
  MKO10026131_A_Ints10
  gRNA
ccucucggcauuccguucga

SEQ ID NO: 26132 - RNA, 20 nt, Artificial Sequence
  MKO10026132_A_Ints10
  gRNA
ccguguugcaccacugucuc

SEQ ID NO: 26133 - RNA, 20 nt, Artificial Sequence
  MKO10026133_A_Ints10
  gRNA
augaaauguacaccaucgaa

SEQ ID NO: 26134 - RNA, 20 nt, Artificial Sequence
  MKO10026134_A_Ints12
  gRNA
agaagugaaugacccucgcc

SEQ ID NO: 26135 - RNA, 20 nt, Artificial Sequence
  MKO10026135_A_Ints12
  gRNA
uugccguuacuacugccgga

SEQ ID NO: 26136 - RNA, 20 nt, Artificial Sequence
  MKO10026136_A_Ints12
  gRNA
gcaaagcuuaccuuaucagc

SEQ ID NO: 26137 - RNA, 20 nt, Artificial Sequence
  MKO10026137_A_Ints1
  gRNA
cccucacugccgcaccuucg

SEQ ID NO: 26138 - RNA, 20 nt, Artificial Sequence
  MKO10026138_A_Ints1
  gRNA
ccuucucauggccgcguacg

SEQ ID NO: 26139 - RNA, 20 nt, Artificial Sequence
  MKO10026139_A_Ints1
  gRNA
guucucguccuccucguacg

SEQ ID NO: 26140 - RNA, 20 nt, Artificial Sequence
  MKO10026140_A_Ints2
  gRNA
gugauuccccucgucgauug

SEQ ID NO: 26141 - RNA, 20 nt, Artificial Sequence
  MKO10026141_A_Ints2
  gRNA
agcacaagccgcaaucgacg

SEQ ID NO: 26142 - RNA, 20 nt, Artificial Sequence
  MKO10026142_A_Ints2
  gRNA
uuaccuucguuaaaacuauc

SEQ ID NO: 26143 - RNA, 20 nt, Artificial Sequence
  MKO10026143_A_Ints3
  gRNA
gcaagauaccugccguacuc

SEQ ID NO: 26144 - RNA, 20 nt, Artificial Sequence
  MKO10026144_A_Ints3
  gRNA
auugucacaucgaugaccgc

SEQ ID NO: 26145 - RNA, 20 nt, Artificial Sequence
  MKO10026145_A_Ints3
  gRNA
uggccucaccugaguacggc

SEQ ID NO: 26146 - RNA, 20 nt, Artificial Sequence
  MKO10026146_A_Ints4
  gRNA
agcuacccaagugcgauuag

SEQ ID NO: 26147 - RNA, 20 nt, Artificial Sequence
  MKO10026147_A_Ints4
  gRNA
ccacauccacuaaucgcacu

SEQ ID NO: 26148 - RNA, 20 nt, Artificial Sequence
  MKO10026148_A_Ints4
  gRNA
auagcugcuguucugacccg

SEQ ID NO: 26149 - RNA, 20 nt, Artificial Sequence
  MKO10026149_A_Ints5
  gRNA
ccaccgcaacaucgaucgcc

SEQ ID NO: 26150 - RNA, 20 nt, Artificial Sequence
  MKO10026150_A_Ints5
  gRNA
uccgcguugugcgacccucc

SEQ ID NO: 26151 - RNA, 20 nt, Artificial Sequence
  MKO10026151_A_Ints5
  gRNA
acagcgagcgugaggguugc

SEQ ID NO: 26152 - RNA, 20 nt, Artificial Sequence
  MKO10026152_A_Ints6
  gRNA
ccucugaauucgccguugcc

SEQ ID NO: 26153 - RNA, 20 nt, Artificial Sequence
  MKO10026153_A_Ints6
  gRNA
agagccgcccuaugcuauca

SEQ ID NO: 26154 - RNA, 20 nt, Artificial Sequence
  MKO10026154_A_Ints6
  gRNA
guucauucauaaacguugca

SEQ ID NO: 26155 - RNA, 20 nt, Artificial Sequence
  MKO10026155_A_Ints7
  gRNA
gauccacaguaacgaccccg

SEQ ID NO: 26156 - RNA, 20 nt, Artificial Sequence
  MKO10026156_A_Ints7
  gRNA
uggccacggggucguuacug

SEQ ID NO: 26157 - RNA, 20 nt, Artificial Sequence
  MKO10026157_A_Ints7
  gRNA
ucacaguauccgccagaguc

SEQ ID NO: 26158 - RNA, 20 nt, Artificial Sequence
  MKO10026158_A_Ints8
  gRNA
acgcgauuucucuuguuauc

SEQ ID NO: 26159 - RNA, 20 nt, Artificial Sequence
  MKO10026159_A_Ints8
  gRNA
gagggaccuuacugaugcac

SEQ ID NO: 26160 - RNA, 20 nt, Artificial Sequence
  MKO10026160_A_Ints8
  gRNA
cccucccgggaccaagcacg

SEQ ID NO: 26161 - RNA, 20 nt, Artificial Sequence
  MKO10026161_A_Ints9
  gRNA
cccuacaucaccgagcacac

SEQ ID NO: 26162 - RNA, 20 nt, Artificial Sequence
  MKO10026162_A_Ints9
  gRNA
uugaauuugaguacguugca

SEQ ID NO: 26163 - RNA, 20 nt, Artificial Sequence
  MKO10026163_A_Ints9
  gRNA
cucucaccugccgaucugca

SEQ ID NO: 26164 - RNA, 20 nt, Artificial Sequence
  MKO10026164_A_Intu
  gRNA
cgaaccacgugaaccacgug

SEQ ID NO: 26165 - RNA, 20 nt, Artificial Sequence
  MKO10026165_A_Intu
  gRNA
caccgugcagcagcgguaca

SEQ ID NO: 26166 - RNA, 20 nt, Artificial Sequence
  MKO10026166_A_Intu
  gRNA
acagucgagcacccaagauu

SEQ ID NO: 26167 - RNA, 20 nt, Artificial Sequence
  MKO10026167_A_Invs
  gRNA
gaugaguagcuucgcgugcu

SEQ ID NO: 26168 - RNA, 20 nt, Artificial Sequence
  MKO10026168_A_Invs
  gRNA
uacuuacucgaagagcaaac

SEQ ID NO: 26169 - RNA, 20 nt, Artificial Sequence
  MKO10026169_A_Invs
  gRNA
ucaagacauccaccaccguu

SEQ ID NO: 26170 - RNA, 20 nt, Artificial Sequence
  MKO10026170_A_Ip6k1
  gRNA
cucggcgcaaacacucccgc

SEQ ID NO: 26171 - RNA, 20 nt, Artificial Sequence
  MKO10026171_A_Ip6k1
  gRNA
cggcgggaguguuugcgccg

SEQ ID NO: 26172 - RNA, 20 nt, Artificial Sequence
  MKO10026172_A_Ip6k1
  gRNA
ccgcaugcgcuccgagucca

SEQ ID NO: 26173 - RNA, 20 nt, Artificial Sequence
  MKO10026173_A_Ip6k2
  gRNA
ccgaagcaucaucgccaugc

SEQ ID NO: 26174 - RNA, 20 nt, Artificial Sequence
  MKO10026174_A_Ip6k2
  gRNA
uguucgagugugcggcaugc

SEQ ID NO: 26175 - RNA, 20 nt, Artificial Sequence
  MKO10026175_A_Ip6k2
  gRNA
acuguacugguuucgaugcu

SEQ ID NO: 26176 - RNA, 20 nt, Artificial Sequence
  MKO10026176_A_Ip6k3
  gRNA
cggaugcaucguccccaugc

SEQ ID NO: 26177 - RNA, 20 nt, Artificial Sequence
  MKO10026177_A_Ip6k3
  gRNA
acuucuggcggcgucacuuc

SEQ ID NO: 26178 - RNA, 20 nt, Artificial Sequence
  MKO10026178_A_Ip6k3
  gRNA
ugugagcgaagucaaucauc

SEQ ID NO: 26179 - RNA, 20 nt, Artificial Sequence
  MKO10026179_A_Ipcef1
  gRNA
cuuaggugguuaaacaaacu

SEQ ID NO: 26180 - RNA, 20 nt, Artificial Sequence
  MKO10026180_A_Ipcef1
  gRNA
agauccugaaguugccgugg

SEQ ID NO: 26181 - RNA, 20 nt, Artificial Sequence
  MKO10026181_A_Ipcef1
  gRNA
auucucugcugcaaaguaga

SEQ ID NO: 26182 - RNA, 20 nt, Artificial Sequence
  MKO10026182_A_Ipmk
  gRNA
ggaccagacgccguaguauu

SEQ ID NO: 26183 - RNA, 20 nt, Artificial Sequence
  MKO10026183_A_Ipmk
  gRNA
aaucuucucugaugacgcaa

SEQ ID NO: 26184 - RNA, 20 nt, Artificial Sequence
  MKO10026184_A_Ipmk
  gRNA
aaaugcauuaccguuuggug

SEQ ID NO: 26185 - RNA, 20 nt, Artificial Sequence
  MKO10026185_A_Ipo11
  gRNA
cuaccaugucaccaagacgc

SEQ ID NO: 26186 - RNA, 20 nt, Artificial Sequence
  MKO10026186_A_Ipo11
  gRNA
aaaagucaacauugcgugca

SEQ ID NO: 26187 - RNA, 20 nt, Artificial Sequence
  MKO10026187_A_Ipo11
  gRNA
uugcucgguuagacuguccu

SEQ ID NO: 26188 - RNA, 20 nt, Artificial Sequence
  MKO10026188_A_Ipo13
  gRNA
cgcuugccccaguaccgcaa

SEQ ID NO: 26189 - RNA, 20 nt, Artificial Sequence
  MKO10026189_A_Ipo13
  gRNA
cgcuggcaaagcgggugauc

SEQ ID NO: 26190 - RNA, 20 nt, Artificial Sequence
  MKO10026190_A_Ipo13
  gRNA
accgagagugguucucgccc

SEQ ID NO: 26191 - RNA, 20 nt, Artificial Sequence
  MKO10026191_A_Ipo4
  gRNA
gcccgcacucuucgaucugc

SEQ ID NO: 26192 - RNA, 20 nt, Artificial Sequence
  MKO10026192_A_Ipo4
  gRNA
uucccauagccccgagaaag

SEQ ID NO: 26193 - RNA, 20 nt, Artificial Sequence
  MKO10026193_A_Ipo4
  gRNA
ugccagcagaucgaagagug

SEQ ID NO: 26194 - RNA, 20 nt, Artificial Sequence
  MKO10026194_A_Ipo5
  gRNA
cguccaaauagugcuguugu

SEQ ID NO: 26195 - RNA, 20 nt, Artificial Sequence
  MKO10026195_A_Ipo5
  gRNA
cagaaacacaaccgcugccg

SEQ ID NO: 26196 - RNA, 20 nt, Artificial Sequence
  MKO10026196_A_Ipo5
  gRNA
aggaaucaccuccucggcag

SEQ ID NO: 26197 - RNA, 20 nt, Artificial Sequence
  MKO10026197_A_Ipo7
  gRNA
agaagagcgaaguccguuag

SEQ ID NO: 26198 - RNA, 20 nt, Artificial Sequence
  MKO10026198_A_Ipo7
  gRNA
aacaugacuauccaagccgc

SEQ ID NO: 26199 - RNA, 20 nt, Artificial Sequence
  MKO10026199_A_Ipo7
  gRNA
guuguucugacauaguaauc

SEQ ID NO: 26200 - RNA, 20 nt, Artificial Sequence
  MKO10026200_A_Ipo8
  gRNA
aacuuaccugccugacgcac

SEQ ID NO: 26201 - RNA, 20 nt, Artificial Sequence
  MKO10026201_A_Ipo8
  gRNA
gcagauccgugacaacauug

SEQ ID NO: 26202 - RNA, 20 nt, Artificial Sequence
  MKO10026202_A_Ipo8
  gRNA
ucuaucuugucgaccacugc

SEQ ID NO: 26203 - RNA, 20 nt, Artificial Sequence
  MKO10026203_A_Ipo9
  gRNA
gguaccugucaacacacgca

SEQ ID NO: 26204 - RNA, 20 nt, Artificial Sequence
  MKO10026204_A_Ipo9
  gRNA
ggagacuuaaaugccgucca

SEQ ID NO: 26205 - RNA, 20 nt, Artificial Sequence
  MKO10026205_A_Ipo9
  gRNA
cggauugccagugcccccug

SEQ ID NO: 26206 - RNA, 20 nt, Artificial Sequence
  MKO10026206_A_Ippk
  gRNA
uccagagucccguugugaca

SEQ ID NO: 26207 - RNA, 20 nt, Artificial Sequence
  MKO10026207_A_Ippk
  gRNA
cugcagaacauaguagacuu

SEQ ID NO: 26208 - RNA, 20 nt, Artificial Sequence
  MKO10026208_A_Ippk
  gRNA
gaagucugguuaaauuggga

SEQ ID NO: 26209 - RNA, 20 nt, Artificial Sequence
  MKO10026209_A_Ipp
  gRNA
ucaaugaaucacccccgcug

SEQ ID NO: 26210 - RNA, 20 nt, Artificial Sequence
  MKO10026210_A_Ipp
  gRNA
agacaucuaaaguucgaccu

SEQ ID NO: 26211 - RNA, 20 nt, Artificial Sequence
  MKO10026211_A_Ipp
  gRNA
caaaacguucuacgcagcug

SEQ ID NO: 26212 - RNA, 20 nt, Artificial Sequence
  MKO10026212_A_Iqca
  gRNA
gucuugcacgcuccgcuauc

SEQ ID NO: 26213 - RNA, 20 nt, Artificial Sequence
  MKO10026213_A_Iqca
  gRNA
gaaacgcaugcugauccgca

SEQ ID NO: 26214 - RNA, 20 nt, Artificial Sequence
  MKO10026214_A_Iqca
  gRNA
auucaguuaagauccgagcc

SEQ ID NO: 26215 - RNA, 20 nt, Artificial Sequence
  MKO10026215_A_Iqcb1
  gRNA
ucaagauucuucucgaaucc

SEQ ID NO: 26216 - RNA, 20 nt, Artificial Sequence
  MKO10026216_A_Iqcb1
  gRNA
auguuucaucaaugcaacua

SEQ ID NO: 26217 - RNA, 20 nt, Artificial Sequence
  MKO10026217_A_Iqcb1
  gRNA
ccucauucaguauugucuau

SEQ ID NO: 26218 - RNA, 20 nt, Artificial Sequence
  MKO10026218_A_Iqcc
  gRNA
aacgcagcuugagugcaacg

SEQ ID NO: 26219 - RNA, 20 nt, Artificial Sequence
  MKO10026219_A_Iqcc
  gRNA
cuacauuaggccggcuuccg

SEQ ID NO: 26220 - RNA, 20 nt, Artificial Sequence
  MKO10026220_A_Iqcc
  gRNA
gagccuucgagccgaguaug

SEQ ID NO: 26221 - RNA, 20 nt, Artificial Sequence
  MKO10026221_A_Iqcd
  gRNA
ccucgcauaggacgaauacg

SEQ ID NO: 26222 - RNA, 20 nt, Artificial Sequence
  MKO10026222_A_Iqcd
  gRNA
gaagcuccaccagaccgucg

SEQ ID NO: 26223 - RNA, 20 nt, Artificial Sequence
  MKO10026223_A_Iqcd
  gRNA
aauugaucucgcucucggcc

SEQ ID NO: 26224 - RNA, 20 nt, Artificial Sequence
  MKO10026224_A_Iqce
  gRNA
gagccacauacccuguuucg

SEQ ID NO: 26225 - RNA, 20 nt, Artificial Sequence
  MKO10026225_A_Iqce
  gRNA
ugccgucuucagagaucgcc

SEQ ID NO: 26226 - RNA, 20 nt, Artificial Sequence
  MKO10026226_A_Iqce
  gRNA
guggguccacgcgugcuccg

SEQ ID NO: 26227 - RNA, 20 nt, Artificial Sequence
  MKO10026227_A_Iqcf1
  gRNA
uccggacagccuuaagcaac

SEQ ID NO: 26228 - RNA, 20 nt, Artificial Sequence
  MKO10026228_A_Iqcf1
  gRNA
cagucgucagguugcagucc

SEQ ID NO: 26229 - RNA, 20 nt, Artificial Sequence
  MKO10026229_A_Iqcf1
  gRNA
accuacugacgaugcuccuc

SEQ ID NO: 26230 - RNA, 20 nt, Artificial Sequence
  MKO10026230_A_Iqcf3
  gRNA
uagaucugagggaaccgagu

SEQ ID NO: 26231 - RNA, 20 nt, Artificial Sequence
  MKO10026231_A_Iqcf3
  gRNA
agagugaaguuuccccaacu

SEQ ID NO: 26232 - RNA, 20 nt, Artificial Sequence
  MKO10026232_A_Iqcf3
  gRNA
ugaaucacuccucucaagua

SEQ ID NO: 26233 - RNA, 20 nt, Artificial Sequence
  MKO10026233_A_Iqcf4
  gRNA
uccggacccacgacugaaua

SEQ ID NO: 26234 - RNA, 20 nt, Artificial Sequence
  MKO10026234_A_Iqcf4
  gRNA
ugguauaacugccgcacccg

SEQ ID NO: 26235 - RNA, 20 nt, Artificial Sequence
  MKO10026235_A_Iqcf4
  gRNA
cacguggcccucgaaguuag

SEQ ID NO: 26236 - RNA, 20 nt, Artificial Sequence
  MKO10026236_A_Iqcf5
  gRNA
aguuauacgcucgaaaaacg

SEQ ID NO: 26237 - RNA, 20 nt, Artificial Sequence
  MKO10026237_A_Iqcf5
  gRNA
uaugccaacgccaauaaacc

SEQ ID NO: 26238 - RNA, 20 nt, Artificial Sequence
  MKO10026238_A_Iqcf5
  gRNA
acugaaugauccacgcgcug

SEQ ID NO: 26239 - RNA, 20 nt, Artificial Sequence
  MKO10026239_A_Iqcf6
  gRNA
caugguccgccgaacacuac

SEQ ID NO: 26240 - RNA, 20 nt, Artificial Sequence
  MKO10026240_A_Iqcf6
  gRNA
uaugauccacagccgcuaug

SEQ ID NO: 26241 - RNA, 20 nt, Artificial Sequence
  MKO10026241_A_Iqcf6
  gRNA
uagccuaaaugacggaugag

SEQ ID NO: 26242 - RNA, 20 nt, Artificial Sequence
  MKO10026242_A_Iqcg
  gRNA
acacccucagcacgucuaga

SEQ ID NO: 26243 - RNA, 20 nt, Artificial Sequence
  MKO10026243_A_Iqcg
  gRNA
uaaucauagaugcuccuucg

SEQ ID NO: 26244 - RNA, 20 nt, Artificial Sequence
  MKO10026244_A_Iqcg
  gRNA
agaucuagauuacgaagaag

SEQ ID NO: 26245 - RNA, 20 nt, Artificial Sequence
  MKO10026245_A_Iqch
  gRNA
auuaguaaaauucucagccg

SEQ ID NO: 26246 - RNA, 20 nt, Artificial Sequence
  MKO10026246_A_Iqch
  gRNA
auucacaucgacaaguaucu

SEQ ID NO: 26247 - RNA, 20 nt, Artificial Sequence
  MKO10026247_A_Iqch
  gRNA
aaagauacaguugacuacga

SEQ ID NO: 26248 - RNA, 20 nt, Artificial Sequence
  MKO10026248_A_Iqcj
  gRNA
aguacucucgccaugcucgc

SEQ ID NO: 26249 - RNA, 20 nt, Artificial Sequence
  MKO10026249_A_Iqcj
  gRNA
ccuuuagaacaaguugacga

SEQ ID NO: 26250 - RNA, 20 nt, Artificial Sequence
  MKO10026250_A_Iqcj
  gRNA
ccaucgucaacuuguucuaa

SEQ ID NO: 26251 - RNA, 20 nt, Artificial Sequence
  MKO10026251_A_Iqck
  gRNA
ccaccugcaggucacgcccu

SEQ ID NO: 26252 - RNA, 20 nt, Artificial Sequence
  MKO10026252_A_Iqck
  gRNA
gagcagccgaccuuuccaga

SEQ ID NO: 26253 - RNA, 20 nt, Artificial Sequence
  MKO10026253_A_Iqck
  gRNA
agguucacccagagauuauc

SEQ ID NO: 26254 - RNA, 20 nt, Artificial Sequence
  MKO10026254_A_Iqgap1
  gRNA
uagccguccuggauaaugag

SEQ ID NO: 26255 - RNA, 20 nt, Artificial Sequence
  MKO10026255_A_Iqgap1
  gRNA
gccgcccaccacagagcuag

SEQ ID NO: 26256 - RNA, 20 nt, Artificial Sequence
  MKO10026256_A_Iqgap1
  gRNA
ucuacuguauccacgcccuc

SEQ ID NO: 26257 - RNA, 20 nt, Artificial Sequence
  MKO10026257_A_Iqgap2
  gRNA
ucuauugcauucacgcgcua

SEQ ID NO: 26258 - RNA, 20 nt, Artificial Sequence
  MKO10026258_A_Iqgap2
  gRNA
aaacaacagaugucuacgau

SEQ ID NO: 26259 - RNA, 20 nt, Artificial Sequence
  MKO10026259_A_Iqgap2
  gRNA
gcuuaccuugggcagcccga

SEQ ID NO: 26260 - RNA, 20 nt, Artificial Sequence
  MKO10026260_A_Iqgap3
  gRNA
uuaccgaaggcagaccgaug

SEQ ID NO: 26261 - RNA, 20 nt, Artificial Sequence
  MKO10026261_A_Iqgap3
  gRNA
ccugaagaagaucuacgacg

SEQ ID NO: 26262 - RNA, 20 nt, Artificial Sequence
  MKO10026262_A_Iqgap3
  gRNA
ugaaugcaguagaucacccg

SEQ ID NO: 26263 - RNA, 20 nt, Artificial Sequence
  MKO10026263_A_Iqsec1
  gRNA
gcaacgaugucauccguaag

SEQ ID NO: 26264 - RNA, 20 nt, Artificial Sequence
  MKO10026264_A_Iqsec1
  gRNA
uuggcggaacgccgucugga

SEQ ID NO: 26265 - RNA, 20 nt, Artificial Sequence
  MKO10026265_A_Iqsec1
  gRNA
gcgccuaugggcuguacgca

SEQ ID NO: 26266 - RNA, 20 nt, Artificial Sequence
  MKO10026266_A_Iqsec2
  gRNA
auccaguauuugaucgaacg

SEQ ID NO: 26267 - RNA, 20 nt, Artificial Sequence
  MKO10026267_A_Iqsec2
  gRNA
cuugaacggggccucccuua

SEQ ID NO: 26268 - RNA, 20 nt, Artificial Sequence
  MKO10026268_A_Iqsec2
  gRNA
agccucguucgaucaaauac

SEQ ID NO: 26269 - RNA, 20 nt, Artificial Sequence
  MKO10026269_A_Iqsec3
  gRNA
ugcgguacagccgcuugcgc

SEQ ID NO: 26270 - RNA, 20 nt, Artificial Sequence
  MKO10026270_A_Iqsec3
  gRNA
acgcggcgcgucgggauacc

SEQ ID NO: 26271 - RNA, 20 nt, Artificial Sequence
  MKO10026271_A_Iqsec3
  gRNA
aagggagaguucguauucgg

SEQ ID NO: 26272 - RNA, 20 nt, Artificial Sequence
  MKO10026272_A_Iqub
  gRNA
ccgcaugcaaccgucgagcg

SEQ ID NO: 26273 - RNA, 20 nt, Artificial Sequence
  MKO10026273_A_Iqub
  gRNA
cagcagaguaccacgcucga

SEQ ID NO: 26274 - RNA, 20 nt, Artificial Sequence
  MKO10026274_A_Iqub
  gRNA
cuuaggcaucgaucgcuaug

SEQ ID NO: 26275 - RNA, 20 nt, Artificial Sequence
  MKO10026275_A_Irak1bp1
  gRNA
gaagagugugugucgccgcc

SEQ ID NO: 26276 - RNA, 20 nt, Artificial Sequence
  MKO10026276_A_Irak1bp1
  gRNA
uccaugaacacccgcgaugc

SEQ ID NO: 26277 - RNA, 20 nt, Artificial Sequence
  MKO10026277_A_Irak1bp1
  gRNA
auaacugaugaucauccguu

SEQ ID NO: 26278 - RNA, 20 nt, Artificial Sequence
  MKO10026278_A_Irak1
  gRNA
ggucagcuacgcgcgcguug

SEQ ID NO: 26279 - RNA, 20 nt, Artificial Sequence
  MKO10026279_A_Irak1
  gRNA
acgcccuggagcccgccgac

SEQ ID NO: 26280 - RNA, 20 nt, Artificial Sequence
  MKO10026280_A_Irak1
  gRNA
cgcccagcacuucuuguacg

SEQ ID NO: 26281 - RNA, 20 nt, Artificial Sequence
  MKO10026281_A_Irak2
  gRNA
gcggcagcguccgugcgaga

SEQ ID NO: 26282 - RNA, 20 nt, Artificial Sequence
  MKO10026282_A_Irak2
  gRNA
caaaggugcccucgcugauu

SEQ ID NO: 26283 - RNA, 20 nt, Artificial Sequence
  MKO10026283_A_Irak2
  gRNA
auaucgacacgcucagugag

SEQ ID NO: 26284 - RNA, 20 nt, Artificial Sequence
  MKO10026284_A_Irak3
  gRNA
cggagcgacuuucaaacagc

SEQ ID NO: 26285 - RNA, 20 nt, Artificial Sequence
  MKO10026285_A_Irak3
  gRNA
cugcacgcaugcuucaccuc

SEQ ID NO: 26286 - RNA, 20 nt, Artificial Sequence
  MKO10026286_A_Irak3
  gRNA
agugugcgcaccagaggucc

SEQ ID NO: 26287 - RNA, 20 nt, Artificial Sequence
  MKO10026287_A_Irak4
  gRNA
gugcuacguacgagugucgc

SEQ ID NO: 26288 - RNA, 20 nt, Artificial Sequence
  MKO10026288_A_Irak4
  gRNA
gucgccaacugugcaguucg

SEQ ID NO: 26289 - RNA, 20 nt, Artificial Sequence
  MKO10026289_A_Irak4
  gRNA
gacgagcaacccgcgucugc

SEQ ID NO: 26290 - RNA, 20 nt, Artificial Sequence
  MKO10026290_A_Ireb2
  gRNA
uacuuggugccgccaaguuu

SEQ ID NO: 26291 - RNA, 20 nt, Artificial Sequence
  MKO10026291_A_Ireb2
  gRNA
cacugugagaucugucggac

SEQ ID NO: 26292 - RNA, 20 nt, Artificial Sequence
  MKO10026292_A_Ireb2
  gRNA
uuucaguggaauaccggcaa

SEQ ID NO: 26293 - RNA, 20 nt, Artificial Sequence
  MKO10026293_A_Irf1
  gRNA
cucauccgcauucgagugau

SEQ ID NO: 26294 - RNA, 20 nt, Artificial Sequence
  MKO10026294_A_Irf1
  gRNA
ccuguaggccgauacaaagc

SEQ ID NO: 26295 - RNA, 20 nt, Artificial Sequence
  MKO10026295_A_Irf1
  gRNA
ccaugccaaucacucgaaug

SEQ ID NO: 26296 - RNA, 20 nt, Artificial Sequence
  MKO10026296_A_Irf2bp1
  gRNA
cauggcgccguucauacucg

SEQ ID NO: 26297 - RNA, 20 nt, Artificial Sequence
  MKO10026297_A_Irf2bp1
  gRNA
ccgcgggugcgugaauuucg

SEQ ID NO: 26298 - RNA, 20 nt, Artificial Sequence
  MKO10026298_A_Irf2bp1
  gRNA
ccucgaaauucacgcacccg

SEQ ID NO: 26299 - RNA, 20 nt, Artificial Sequence
  MKO10026299_A_Irf2bp2
  gRNA
caggaugccguucgccggcg

SEQ ID NO: 26300 - RNA, 20 nt, Artificial Sequence
  MKO10026300_A_Irf2bp2
  gRNA
cuacgagggagccgaccgcg

SEQ ID NO: 26301 - RNA, 20 nt, Artificial Sequence
  MKO10026301_A_Irf2bp2
  gRNA
gucgggcccccuaagaucaa

SEQ ID NO: 26302 - RNA, 20 nt, Artificial Sequence
  MKO10026302_A_Irf2bpl
  gRNA
ccguccggucuggagcguua

SEQ ID NO: 26303 - RNA, 20 nt, Artificial Sequence
  MKO10026303_A_Irf2bpl
  gRNA
ucucggcgugggacgcauag

SEQ ID NO: 26304 - RNA, 20 nt, Artificial Sequence
  MKO10026304_A_Irf2bpl
  gRNA
ucgcgucuuugccuucgacg

SEQ ID NO: 26305 - RNA, 20 nt, Artificial Sequence
  MKO10026305_A_Irf2
  gRNA
uccgaacgaccuuccaagaa

SEQ ID NO: 26306 - RNA, 20 nt, Artificial Sequence
  MKO10026306_A_Irf2
  gRNA
gugccgagccgcaugcaucc

SEQ ID NO: 26307 - RNA, 20 nt, Artificial Sequence
  MKO10026307_A_Irf2
  gRNA
ugcaugcggcucggcacgga

SEQ ID NO: 26308 - RNA, 20 nt, Artificial Sequence
  MKO10026308_A_Irf3
  gRNA
cgugggaguggccuaggcgc

SEQ ID NO: 26309 - RNA, 20 nt, Artificial Sequence
  MKO10026309_A_Irf3
  gRNA
ggcgcgggacuucguacauc

SEQ ID NO: 26310 - RNA, 20 nt, Artificial Sequence
  MKO10026310_A_Irf3
  gRNA
acggagccguguucgaccuc

SEQ ID NO: 26311 - RNA, 20 nt, Artificial Sequence
  MKO10026311_A_Irf4
  gRNA
ccuugccagugguggccucg

SEQ ID NO: 26312 - RNA, 20 nt, Artificial Sequence
  MKO10026312_A_Irf4
  gRNA
uaucaauguccugugacguu

SEQ ID NO: 26313 - RNA, 20 nt, Artificial Sequence
  MKO10026313_A_Irf4
  gRNA
agaccuuaugcuuggcucaa

SEQ ID NO: 26314 - RNA, 20 nt, Artificial Sequence
  MKO10026314_A_Irf5
  gRNA
acccacugaugauuacguuc

SEQ ID NO: 26315 - RNA, 20 nt, Artificial Sequence
  MKO10026315_A_Irf5
  gRNA
ucagccguacaagaucuacg

SEQ ID NO: 26316 - RNA, 20 nt, Artificial Sequence
  MKO10026316_A_Irf5
  gRNA
cagaccucguagaucuugua

SEQ ID NO: 26317 - RNA, 20 nt, Artificial Sequence
  MKO10026317_A_Irf6
  gRNA
cccacucaccguugauguuc

SEQ ID NO: 26318 - RNA, 20 nt, Artificial Sequence
  MKO10026318_A_Irf6
  gRNA
ugugccagugcaaaguguac

SEQ ID NO: 26319 - RNA, 20 nt, Artificial Sequence
  MKO10026319_A_Irf6
  gRNA
gaguucaacuugauguacga

SEQ ID NO: 26320 - RNA, 20 nt, Artificial Sequence
  MKO10026320_A_Irf7
  gRNA
gcacagucuuccgcguaccc

SEQ ID NO: 26321 - RNA, 20 nt, Artificial Sequence
  MKO10026321_A_Irf7
  gRNA
gcauuucggucguagggauc

SEQ ID NO: 26322 - RNA, 20 nt, Artificial Sequence
  MKO10026322_A_Irf7
  gRNA
ggauccaguugauccgcaua

SEQ ID NO: 26323 - RNA, 20 nt, Artificial Sequence
  MKO10026323_A_Irf8
  gRNA
aguuuaccgaauuguccccg

SEQ ID NO: 26324 - RNA, 20 nt, Artificial Sequence
  MKO10026324_A_Irf8
  gRNA
cauauccggucaccaguggc

SEQ ID NO: 26325 - RNA, 20 nt, Artificial Sequence
  MKO10026325_A_Irf8
  gRNA
acaauucgguaaacuuuaua

SEQ ID NO: 26326 - RNA, 20 nt, Artificial Sequence
  MKO10026326_A_Irf9
  gRNA
uacgcugcacccgaaagcug

SEQ ID NO: 26327 - RNA, 20 nt, Artificial Sequence
  MKO10026327_A_Irf9
  gRNA
caaauucggaacucuuguug

SEQ ID NO: 26328 - RNA, 20 nt, Artificial Sequence
  MKO10026328_A_Irf9
  gRNA
caacugauacuucgcuugca

SEQ ID NO: 26329 - RNA, 20 nt, Artificial Sequence
  MKO10026329_A_Irg1
  gRNA
caguauagcgugucgaagcu

SEQ ID NO: 26330 - RNA, 20 nt, Artificial Sequence
  MKO10026330_A_Irg1
  gRNA
cugacguccaguacguaaac

SEQ ID NO: 26331 - RNA, 20 nt, Artificial Sequence
  MKO10026331_A_Irg1
  gRNA
cugcugcuggcguucaacgu

SEQ ID NO: 26332 - RNA, 20 nt, Artificial Sequence
  MKO10026332_A_Irgc1
  gRNA
cggccuagacgacgacucgc

SEQ ID NO: 26333 - RNA, 20 nt, Artificial Sequence
  MKO10026333_A_Irgc1
  gRNA
ggcggcuggugacaauuuag

SEQ ID NO: 26334 - RNA, 20 nt, Artificial Sequence
  MKO10026334_A_Irgc1
  gRNA
uggccagcgagucgucgucu

SEQ ID NO: 26335 - RNA, 20 nt, Artificial Sequence
  MKO10026335_A_Irgm1
  gRNA
guacucaguccgcgucuucg

SEQ ID NO: 26336 - RNA, 20 nt, Artificial Sequence
  MKO10026336_A_Irgm1
  gRNA
ggccacagcccaaaccguag

SEQ ID NO: 26337 - RNA, 20 nt, Artificial Sequence
  MKO10026337_A_Irgm1
  gRNA
accucgcaggaacuguguga

SEQ ID NO: 26338 - RNA, 20 nt, Artificial Sequence
  MKO10026338_A_Irgm2
  gRNA
cggguaacgcgauagagauu

SEQ ID NO: 26339 - RNA, 20 nt, Artificial Sequence
  MKO10026339_A_Irgm2
  gRNA
cgaaucucuaucgcguuacc

SEQ ID NO: 26340 - RNA, 20 nt, Artificial Sequence
  MKO10026340_A_Irgm2
  gRNA
aaaggguuucgacgaggccg

SEQ ID NO: 26341 - RNA, 20 nt, Artificial Sequence
  MKO10026341_A_Irgq
  gRNA
aacgguccagagcacuacgu

SEQ ID NO: 26342 - RNA, 20 nt, Artificial Sequence
  MKO10026342_A_Irgq
  gRNA
agcacgacgugagcgcgccu

SEQ ID NO: 26343 - RNA, 20 nt, Artificial Sequence
  MKO10026343_A_Irgq
  gRNA
gcccugaucgccgcguuaug

SEQ ID NO: 26344 - RNA, 20 nt, Artificial Sequence
  MKO10026344_A_Irs1
  gRNA
cuauuuggcaccgaacgggu

SEQ ID NO: 26345 - RNA, 20 nt, Artificial Sequence
  MKO10026345_A_Irs1
  gRNA
acccacgcccaucggcaucg

SEQ ID NO: 26346 - RNA, 20 nt, Artificial Sequence
  MKO10026346_A_Irs1
  gRNA
uuacgcuauugacgauccuc

SEQ ID NO: 26347 - RNA, 20 nt, Artificial Sequence
  MKO10026347_A_Irs2
  gRNA
ccugaucgcccucuacacca

SEQ ID NO: 26348 - RNA, 20 nt, Artificial Sequence
  MKO10026348_A_Irs2
  gRNA
ucgagcgcgaucacucgcuu

SEQ ID NO: 26349 - RNA, 20 nt, Artificial Sequence
  MKO10026349_A_Irs2
  gRNA
agccgcacuugcgcacgcug

SEQ ID NO: 26350 - RNA, 20 nt, Artificial Sequence
  MKO10026350_A_Irs3
  gRNA
cgguggcgcgcaccucgagc

SEQ ID NO: 26351 - RNA, 20 nt, Artificial Sequence
  MKO10026351_A_Irs3
  gRNA
ccuccaggcuaacgguacgc

SEQ ID NO: 26352 - RNA, 20 nt, Artificial Sequence
  MKO10026352_A_Irs3
  gRNA
uugcucagugugcgccgcug

SEQ ID NO: 26353 - RNA, 20 nt, Artificial Sequence
  MKO10026353_A_Irs4
  gRNA
acgcuaggcgcacugccgga

SEQ ID NO: 26354 - RNA, 20 nt, Artificial Sequence
  MKO10026354_A_Irs4
  gRNA
ccaucgcgaaguauucgucc

SEQ ID NO: 26355 - RNA, 20 nt, Artificial Sequence
  MKO10026355_A_Irs4
  gRNA
guugacuccgccuccgcucg

SEQ ID NO: 26356 - RNA, 20 nt, Artificial Sequence
  MKO10026356_A_Irx1
  gRNA
cccgcaauaccuaagcgccg

SEQ ID NO: 26357 - RNA, 20 nt, Artificial Sequence
  MKO10026357_A_Irx1
  gRNA
ugccgcggcgggaccguacg

SEQ ID NO: 26358 - RNA, 20 nt, Artificial Sequence
  MKO10026358_A_Irx1
  gRNA
gaucagaucgacgagcguga

SEQ ID NO: 26359 - RNA, 20 nt, Artificial Sequence
  MKO10026359_A_Irx2
  gRNA
guaccaagcgcccggcucgc

SEQ ID NO: 26360 - RNA, 20 nt, Artificial Sequence
  MKO10026360_A_Irx2
  gRNA
cguaccguaagaacgcuacg

SEQ ID NO: 26361 - RNA, 20 nt, Artificial Sequence
  MKO10026361_A_Irx2
  gRNA
cgucccgcguagcguucuua

SEQ ID NO: 26362 - RNA, 20 nt, Artificial Sequence
  MKO10026362_A_Irx3
  gRNA
uccccguagucgcacggacg

SEQ ID NO: 26363 - RNA, 20 nt, Artificial Sequence
  MKO10026363_A_Irx3
  gRNA
ccuccucguccgugcgacua

SEQ ID NO: 26364 - RNA, 20 nt, Artificial Sequence
  MKO10026364_A_Irx3
  gRNA
ucucuacccacccgaacgcc

SEQ ID NO: 26365 - RNA, 20 nt, Artificial Sequence
  MKO10026365_A_Irx4
  gRNA
agcagccggcucucguagac

SEQ ID NO: 26366 - RNA, 20 nt, Artificial Sequence
  MKO10026366_A_Irx4
  gRNA
cggcccucuaggacgcaauc

SEQ ID NO: 26367 - RNA, 20 nt, Artificial Sequence
  MKO10026367_A_Irx4
  gRNA
gcagaugagaagcgccccua

SEQ ID NO: 26368 - RNA, 20 nt, Artificial Sequence
  MKO10026368_A_Irx5
  gRNA
uccgcguucucgcccuacgc

SEQ ID NO: 26369 - RNA, 20 nt, Artificial Sequence
  MKO10026369_A_Irx5
  gRNA
cgguacgcgggguccccaua

SEQ ID NO: 26370 - RNA, 20 nt, Artificial Sequence
  MKO10026370_A_Irx5
  gRNA
ugggcccgcaaccgcucguc

SEQ ID NO: 26371 - RNA, 20 nt, Artificial Sequence
  MKO10026371_A_Irx6
  gRNA
acggguucuugcggugcucg

SEQ ID NO: 26372 - RNA, 20 nt, Artificial Sequence
  MKO10026372_A_Irx6
  gRNA
aggggccguuucgcagcaag

SEQ ID NO: 26373 - RNA, 20 nt, Artificial Sequence
  MKO10026373_A_Irx6
  gRNA
ugaacugugcaccauacccg

SEQ ID NO: 26374 - RNA, 20 nt, Artificial Sequence
  MKO10026374_A_Isca1
  gRNA
uuucaggugggucugaaagu

SEQ ID NO: 26375 - RNA, 20 nt, Artificial Sequence
  MKO10026375_A_Isca1
  gRNA
cguggacaugucggcgucgu

SEQ ID NO: 26376 - RNA, 20 nt, Artificial Sequence
  MKO10026376_A_Isca1
  gRNA
cagugugagggccgcccgcg

SEQ ID NO: 26377 - RNA, 20 nt, Artificial Sequence
  MKO10026377_A_Isca2
  gRNA
guccuccuugccugucgucg

SEQ ID NO: 26378 - RNA, 20 nt, Artificial Sequence
  MKO10026378_A_Isca2
  gRNA
caguuauuaaccccgacgac

SEQ ID NO: 26379 - RNA, 20 nt, Artificial Sequence
  MKO10026379_A_Isca2
  gRNA
cuugucccuaacugccgagg

SEQ ID NO: 26380 - RNA, 20 nt, Artificial Sequence
  MKO10026380_A_Iscu
  gRNA
uggugacgucaugaaacugc

SEQ ID NO: 26381 - RNA, 20 nt, Artificial Sequence
  MKO10026381_A_Iscu
  gRNA
cuagauccagguggaugaaa

SEQ ID NO: 26382 - RNA, 20 nt, Artificial Sequence
  MKO10026382_A_Iscu
  gRNA
uuuccccuuuacccacucug

SEQ ID NO: 26383 - RNA, 20 nt, Artificial Sequence
  MKO10026383_A_Isg15
  gRNA
gcugggggguaacgauuucc

SEQ ID NO: 26384 - RNA, 20 nt, Artificial Sequence
  MKO10026384_A_Isg15
  gRNA
aaguccacgaagaccaguuc

SEQ ID NO: 26385 - RNA, 20 nt, Artificial Sequence
  MKO10026385_A_Isg15
  gRNA
cagcagcacagugaugcuag

SEQ ID NO: 26386 - RNA, 20 nt, Artificial Sequence
  MKO10026386_A_Isg20l2
  gRNA
aacgcuuugucaagaagcga

SEQ ID NO: 26387 - RNA, 20 nt, Artificial Sequence
  MKO10026387_A_Isg20l2
  gRNA
ccugcuacaucgucaacuac

SEQ ID NO: 26388 - RNA, 20 nt, Artificial Sequence
  MKO10026388_A_Isg20l2
  gRNA
uuaccuggaugucccgacuc

SEQ ID NO: 26389 - RNA, 20 nt, Artificial Sequence
  MKO10026389_A_Isg20
  gRNA
ugacaaguacauccgacccg

SEQ ID NO: 26390 - RNA, 20 nt, Artificial Sequence
  MKO10026390_A_Isg20
  gRNA
gcacgacuucaaugcccuga

SEQ ID NO: 26391 - RNA, 20 nt, Artificial Sequence
  MKO10026391_A_Isg20
  gRNA
gcgaggccacucacccuuug

SEQ ID NO: 26392 - RNA, 20 nt, Artificial Sequence
  MKO10026392_A_Isl1
  gRNA
cgugaugcgugcccgcucua

SEQ ID NO: 26393 - RNA, 20 nt, Artificial Sequence
  MKO10026393_A_Isl1
  gRNA
agacgaauucgcccugcggg

SEQ ID NO: 26394 - RNA, 20 nt, Artificial Sequence
  MKO10026394_A_Isl1
  gRNA
ccccguagccgaacccaucu

SEQ ID NO: 26395 - RNA, 20 nt, Artificial Sequence
  MKO10026395_A_Isl2
  gRNA
cgugcuacgccgccaauccg

SEQ ID NO: 26396 - RNA, 20 nt, Artificial Sequence
  MKO10026396_A_Isl2
  gRNA
gcccgcgggucauccgcgug

SEQ ID NO: 26397 - RNA, 20 nt, Artificial Sequence
  MKO10026397_A_Isl2
  gRNA
acugcaagcgggacuacguc

SEQ ID NO: 26398 - RNA, 20 nt, Artificial Sequence
  MKO10026398_A_Islr2
  gRNA
gccgcgaugcguuucuccau

SEQ ID NO: 26399 - RNA, 20 nt, Artificial Sequence
  MKO10026399_A_Islr2
  gRNA
auguuacauugcgucgccga

SEQ ID NO: 26400 - RNA, 20 nt, Artificial Sequence
  MKO10026400_A_Islr2
  gRNA
cuuagacugucaccugaguc

SEQ ID NO: 26401 - RNA, 20 nt, Artificial Sequence
  MKO10026401_A_Islr
  gRNA
ugcccucggccaacgcgugc

SEQ ID NO: 26402 - RNA, 20 nt, Artificial Sequence
  MKO10026402_A_Islr
  gRNA
ccacaaccgccugcacgcgu

SEQ ID NO: 26403 - RNA, 20 nt, Artificial Sequence
  MKO10026403_A_Islr
  gRNA
cuugaaccacacgaugccac

SEQ ID NO: 26404 - RNA, 20 nt, Artificial Sequence
  MKO10026404_A_Ism1
  gRNA
cagaaacggacccguucuug

SEQ ID NO: 26405 - RNA, 20 nt, Artificial Sequence
  MKO10026405_A_Ism1
  gRNA
cucuggagggaaucgcuguc

SEQ ID NO: 26406 - RNA, 20 nt, Artificial Sequence
  MKO10026406_A_Ism1
  gRNA
ccaaucacccuccccgucug

SEQ ID NO: 26407 - RNA, 20 nt, Artificial Sequence
  MKO10026407_A_Isoc1
  gRNA
gcuaacgcugcuucgacuuc

SEQ ID NO: 26408 - RNA, 20 nt, Artificial Sequence
  MKO10026408_A_Isoc1
  gRNA
uucuagcgucuugcccgcac

SEQ ID NO: 26409 - RNA, 20 nt, Artificial Sequence
  MKO10026409_A_Isoc1
  gRNA
gcagcguuagccgagauucc

SEQ ID NO: 26410 - RNA, 20 nt, Artificial Sequence
  MKO10026410_A_Isoc2a
  gRNA
cugcagaaugagcgauucgc

SEQ ID NO: 26411 - RNA, 20 nt, Artificial Sequence
  MKO10026411_A_Isoc2a
  gRNA
cgcucauucugcagcucgug

SEQ ID NO: 26412 - RNA, 20 nt, Artificial Sequence
  MKO10026412_A_Isoc2a
  gRNA
ccuacuucaccggggacugc

SEQ ID NO: 26413 - RNA, 20 nt, Artificial Sequence
  MKO10026413_A_Isoc2b
  gRNA
cgucuuucuguccacgagcg

SEQ ID NO: 26414 - RNA, 20 nt, Artificial Sequence
  MKO10026414_A_Isoc2b
  gRNA
cccuccgcagugagaugaac

SEQ ID NO: 26415 - RNA, 20 nt, Artificial Sequence
  MKO10026415_A_Isoc2b
  gRNA
gucacagacaucggacuguu

SEQ ID NO: 26416 - RNA, 20 nt, Artificial Sequence
  MKO10026416_A_Ispd
  gRNA
cacuggaccgugccaagcau

SEQ ID NO: 26417 - RNA, 20 nt, Artificial Sequence
  MKO10026417_A_Ispd
  gRNA
ugcgcuuaugcccauaccuc

SEQ ID NO: 26418 - RNA, 20 nt, Artificial Sequence
  MKO10026418_A_Ispd
  gRNA
uaagcgcaucucacuagcug

SEQ ID NO: 26419 - RNA, 20 nt, Artificial Sequence
  MKO10026419_A_Ist1
  gRNA
ugagcgagcacgcauccgug

SEQ ID NO: 26420 - RNA, 20 nt, Artificial Sequence
  MKO10026420_A_Ist1
  gRNA
aauccgugucuacacugauc

SEQ ID NO: 26421 - RNA, 20 nt, Artificial Sequence
  MKO10026421_A_Ist1
  gRNA
aauccgggaggacuaccucg

SEQ ID NO: 26422 - RNA, 20 nt, Artificial Sequence
  MKO10026422_A_Isx
  gRNA
uggcaggcccuacgauccac

SEQ ID NO: 26423 - RNA, 20 nt, Artificial Sequence
  MKO10026423_A_Isx
  gRNA
cauccauguccguucccaau

SEQ ID NO: 26424 - RNA, 20 nt, Artificial Sequence
  MKO10026424_A_Isx
  gRNA
uguaccuguacucgagcuuc

SEQ ID NO: 26425 - RNA, 20 nt, Artificial Sequence
  MKO10026425_A_Isy1
  gRNA
auguacugaguugccgaaag

SEQ ID NO: 26426 - RNA, 20 nt, Artificial Sequence
  MKO10026426_A_Isy1
  gRNA
gagcuugacgaaaccucgcc

SEQ ID NO: 26427 - RNA, 20 nt, Artificial Sequence
  MKO10026427_A_Isy1
  gRNA
cgucuccacuucuccgcuuu

SEQ ID NO: 26428 - RNA, 20 nt, Artificial Sequence
  MKO10026428_A_Isyna1
  gRNA
gccccgacucggggucaugu

SEQ ID NO: 26429 - RNA, 20 nt, Artificial Sequence
  MKO10026429_A_Isyna1
  gRNA
cucgcagaagcgcuccguau

SEQ ID NO: 26430 - RNA, 20 nt, Artificial Sequence
  MKO10026430_A_Isyna1
  gRNA
cgaggccaugcggcgcgcgc

SEQ ID NO: 26431 - RNA, 20 nt, Artificial Sequence
  MKO10026431_A_Iuch
  gRNA
cgaaaacauaauuuacucgu

SEQ ID NO: 26432 - RNA, 20 nt, Artificial Sequence
  MKO10026432_A_Iuch
  gRNA
gaagcugagguuguuacuaa

SEQ ID NO: 26433 - RNA, 20 nt, Artificial Sequence
  MKO10026433_A_Iuch
  gRNA
aaaucucccaucgucucugu

SEQ ID NO: 26434 - RNA, 20 nt, Artificial Sequence
  MKO10026434_A_Itfg1
  gRNA
cuuuaggacuuugagugcgu

SEQ ID NO: 26435 - RNA, 20 nt, Artificial Sequence
  MKO10026435_A_Itfg1
  gRNA
ucaugaccaaccacugauua

SEQ ID NO: 26436 - RNA, 20 nt, Artificial Sequence
  MKO10026436_A_Itfg1
  gRNA
cuucagggauaccuuuaccu

SEQ ID NO: 26437 - RNA, 20 nt, Artificial Sequence
  MKO10026437_A_Itfg2
  gRNA
gucaugcugaucagcgacau

SEQ ID NO: 26438 - RNA, 20 nt, Artificial Sequence
  MKO10026438_A_Itfg2
  gRNA
uggagauggguguuacgagc

SEQ ID NO: 26439 - RNA, 20 nt, Artificial Sequence
  MKO10026439_A_Itfg2
  gRNA
uguauaagaaugacgacagc

SEQ ID NO: 26440 - RNA, 20 nt, Artificial Sequence
  MKO10026440_A_Itfg3
  gRNA
agcucuucccacaacgauac

SEQ ID NO: 26441 - RNA, 20 nt, Artificial Sequence
  MKO10026441_A_Itfg3
  gRNA
acuuuacaagggcgacaucu

SEQ ID NO: 26442 - RNA, 20 nt, Artificial Sequence
  MKO10026442_A_Itfg3
  gRNA
uccagucauguacgacuucc

SEQ ID NO: 26443 - RNA, 20 nt, Artificial Sequence
  MKO10026443_A_Iuga10
  gRNA
aacgauaaacauccccucuc

SEQ ID NO: 26444 - RNA, 20 nt, Artificial Sequence
  MKO10026444_A_Iuga10
  gRNA
cacuggcucacguugggcgg

SEQ ID NO: 26445 - RNA, 20 nt, Artificial Sequence
  MKO10026445_A_Iuga10
  gRNA
caaccaggugacuaucaacu

SEQ ID NO: 26446 - RNA, 20 nt, Artificial Sequence
  MKO10026446_A_Iuga11
  gRNA
auacaaauguccgguaaccc

SEQ ID NO: 26447 - RNA, 20 nt, Artificial Sequence
  MKO10026447_A_Iuga11
  gRNA
ccacacucgugcgaccagag

SEQ ID NO: 26448 - RNA, 20 nt, Artificial Sequence
  MKO10026448_A_Iuga11
  gRNA
auucacggacaccuucaaua

SEQ ID NO: 26449 - RNA, 20 nt, Artificial Sequence
  MKO10026449_A_Iuga1
  gRNA
aacuuuagucaccaauccga

SEQ ID NO: 26450 - RNA, 20 nt, Artificial Sequence
  MKO10026450_A_Iuga1
  gRNA
aacucguucgccccuguaca

SEQ ID NO: 26451 - RNA, 20 nt, Artificial Sequence
  MKO10026451_A_Iuga1
  gRNA
cccuuguaugccuauagaug

SEQ ID NO: 26452 - RNA, 20 nt, Artificial Sequence
  MKO10026452_A_Iuga2b
  gRNA
uguccuggaaaagcgcgaug

SEQ ID NO: 26453 - RNA, 20 nt, Artificial Sequence
  MKO10026453_A_Iuga2b
  gRNA
uuggggcgucggucgucagc

SEQ ID NO: 26454 - RNA, 20 nt, Artificial Sequence
  MKO10026454_A_Iuga2b
  gRNA
acucugcgcggcccccgcuu

SEQ ID NO: 26455 - RNA, 20 nt, Artificial Sequence
  MKO10026455_A_Iuga2
  gRNA
cagcagcuuacgaacccaca

SEQ ID NO: 26456 - RNA, 20 nt, Artificial Sequence
  MKO10026456_A_Iuga2
  gRNA
caugacuuacccugaacugc

SEQ ID NO: 26457 - RNA, 20 nt, Artificial Sequence
  MKO10026457_A_Iuga2
  gRNA
uacccaaacuguucacuuga

SEQ ID NO: 26458 - RNA, 20 nt, Artificial Sequence
  MKO10026458_A_Iuga3
  gRNA
acuugcccaccaugcgccgc

SEQ ID NO: 26459 - RNA, 20 nt, Artificial Sequence
  MKO10026459_A_Iuga3
  gRNA
guucugggugaagccgccgc

SEQ ID NO: 26460 - RNA, 20 nt, Artificial Sequence
  MKO10026460_A_Iuga3
  gRNA
uccguucacagucguccuug

SEQ ID NO: 26461 - RNA, 20 nt, Artificial Sequence
  MKO10026461_A_Iuga4
  gRNA
ccgcaucuguaaaucgcccc

SEQ ID NO: 26462 - RNA, 20 nt, Artificial Sequence
  MKO10026462_A_Iuga4
  gRNA
ucuugcuuuaggcucaucgu

SEQ ID NO: 26463 - RNA, 20 nt, Artificial Sequence
  MKO10026463_A_Iuga4
  gRNA
caugacguagcaaaugccag

SEQ ID NO: 26464 - RNA, 20 nt, Artificial Sequence
  MKO10026464_A_Iuga5
  gRNA
uccccaaggcucccggauuc

SEQ ID NO: 26465 - RNA, 20 nt, Artificial Sequence
  MKO10026465_A_Iuga5
  gRNA
gaguacgcaccuugccgcuc

SEQ ID NO: 26466 - RNA, 20 nt, Artificial Sequence
  MKO10026466_A_Iuga5
  gRNA
gcaccaccuugcaguacacc

SEQ ID NO: 26467 - RNA, 20 nt, Artificial Sequence
  MKO10026467_A_Iuga6
  gRNA
ucaaauucaauccguguaca

SEQ ID NO: 26468 - RNA, 20 nt, Artificial Sequence
  MKO10026468_A_Iuga6
  gRNA
ggagacuggaguuucugcga

SEQ ID NO: 26469 - RNA, 20 nt, Artificial Sequence
  MKO10026469_A_Iuga6
  gRNA
cuuaccaccacuuugccccc

SEQ ID NO: 26470 - RNA, 20 nt, Artificial Sequence
  MKO10026470_A_Iuga7
  gRNA
ugccucagcuaacgugcaga

SEQ ID NO: 26471 - RNA, 20 nt, Artificial Sequence
  MKO10026471_A_Iuga7
  gRNA
ccuggccauccgugaugagc

SEQ ID NO: 26472 - RNA, 20 nt, Artificial Sequence
  MKO10026472_A_Iuga7
  gRNA
cagcaggcaaaccgcaccgg

SEQ ID NO: 26473 - RNA, 20 nt, Artificial Sequence
  MKO10026473_A_Iuga8
  gRNA
gcucccccuucuacgauauc

SEQ ID NO: 26474 - RNA, 20 nt, Artificial Sequence
  MKO10026474_A_Iuga8
  gRNA
guuuagccuagacuucuaua

SEQ ID NO: 26475 - RNA, 20 nt, Artificial Sequence
  MKO10026475_A_Iuga8
  gRNA
ccaggcaaugcugaucccga

SEQ ID NO: 26476 - RNA, 20 nt, Artificial Sequence
  MKO10026476_A_Iuga9
  gRNA
aaaggacacguuggcaucau

SEQ ID NO: 26477 - RNA, 20 nt, Artificial Sequence
  MKO10026477_A_Iuga9
  gRNA
accugacaccagugcuucgc

SEQ ID NO: 26478 - RNA, 20 nt, Artificial Sequence
  MKO10026478_A_Iuga9
  gRNA
gucgucuccaagguuggaga

SEQ ID NO: 26479 - RNA, 20 nt, Artificial Sequence
  MKO10026479_A_Iugad
  gRNA
gaagcccgucguguucaaag

SEQ ID NO: 26480 - RNA, 20 nt, Artificial Sequence
  MKO10026480_A_Iugad
  gRNA
gcgguggcagucaaccaaac

SEQ ID NO: 26481 - RNA, 20 nt, Artificial Sequence
  MKO10026481_A_Iugad
  gRNA
caccacagucuguccgaagc

SEQ ID NO: 26482 - RNA, 20 nt, Artificial Sequence
  MKO10026482_A_Iugae
  gRNA
auuccuguuggagcugcguc

SEQ ID NO: 26483 - RNA, 20 nt, Artificial Sequence
  MKO10026483_A_Iugae
  gRNA
uggauauagcgcaucgauac

SEQ ID NO: 26484 - RNA, 20 nt, Artificial Sequence
  MKO10026484_A_Iugae
  gRNA
uacucaccaaaacaccauug

SEQ ID NO: 26485 - RNA, 20 nt, Artificial Sequence
  MKO10026485_A_Iugal
  gRNA
uguguccagguuguagcucc

SEQ ID NO: 26486 - RNA, 20 nt, Artificial Sequence
  MKO10026486_A_Iugal
  gRNA
ggcagaacucgcugcuuguu

SEQ ID NO: 26487 - RNA, 20 nt, Artificial Sequence
  MKO10026487_A_Iugal
  gRNA
ccuaagcgcagaugaguuuc

SEQ ID NO: 26488 - RNA, 20 nt, Artificial Sequence
  MKO10026488_A_Iugam
  gRNA
uuuaccugguuccgccaagc

SEQ ID NO: 26489 - RNA, 20 nt, Artificial Sequence
  MKO10026489_A_Iugam
  gRNA
ugugguuguugcagcccccc

SEQ ID NO: 26490 - RNA, 20 nt, Artificial Sequence
  MKO10026490_A_Iugam
  gRNA
gcaaaggcuguuaaccagac

SEQ ID NO: 26491 - RNA, 20 nt, Artificial Sequence
  MKO10026491_A_Iugav
  gRNA
gugaaugcucauccagccgc

SEQ ID NO: 26492 - RNA, 20 nt, Artificial Sequence
  MKO10026492_A_Iugav
  gRNA
ccguugaguaugcuccaugc

SEQ ID NO: 26493 - RNA, 20 nt, Artificial Sequence
  MKO10026493_A_Iugav
  gRNA
cugggucguguucgcuuugg

SEQ ID NO: 26494 - RNA, 20 nt, Artificial Sequence
  MKO10026494_A_Iugax
  gRNA
ugcuccaguaugauaguucc

SEQ ID NO: 26495 - RNA, 20 nt, Artificial Sequence
  MKO10026495_A_Iugax
  gRNA
gaacuucccaacugcacagc

SEQ ID NO: 26496 - RNA, 20 nt, Artificial Sequence
  MKO10026496_A_Iugax
  gRNA
cucaccaggaacuaucauac

SEQ ID NO: 26497 - RNA, 20 nt, Artificial Sequence
  MKO10026497_A_Iugb1bp1
  gRNA
gguguguuacgaugacggcc

SEQ ID NO: 26498 - RNA, 20 nt, Artificial Sequence
  MKO10026498_A_Iugb1bp1
  gRNA
aucgaggcuggcgacagugc

SEQ ID NO: 26499 - RNA, 20 nt, Artificial Sequence
  MKO10026499_A_Iugb1bp1
  gRNA
ugcacuuacaugcugauccg

SEQ ID NO: 26500 - RNA, 20 nt, Artificial Sequence
  MKO10026500_A_Iugb1bp2
  gRNA
caccccagggugauagcgac

SEQ ID NO: 26501 - RNA, 20 nt, Artificial Sequence
  MKO10026501_A_Iugb1bp2
  gRNA
cccugccacaaguucacuuc

SEQ ID NO: 26502 - RNA, 20 nt, Artificial Sequence
  MKO10026502_A_Iugb1bp2
  gRNA
agaaaucuacaguucgcuuu

SEQ ID NO: 26503 - RNA, 20 nt, Artificial Sequence
  MKO10026503_A_Iugb1
  gRNA
aaugucaccaaucgcagcaa

SEQ ID NO: 26504 - RNA, 20 nt, Artificial Sequence
  MKO10026504_A_Iugb1
  gRNA
gugcuuagucuuacugacag

SEQ ID NO: 26505 - RNA, 20 nt, Artificial Sequence
  MKO10026505_A_Iugb1
  gRNA
ugccaucccuuugcugcgau

SEQ ID NO: 26506 - RNA, 20 nt, Artificial Sequence
  MKO10026506_A_Iugb2l
  gRNA
cucaccgauucggccugacc

SEQ ID NO: 26507 - RNA, 20 nt, Artificial Sequence
  MKO10026507_A_Iugb2l
  gRNA
cugcacaucugaguaccucg

SEQ ID NO: 26508 - RNA, 20 nt, Artificial Sequence
  MKO10026508_A_Iugb2l
  gRNA
caagacucuugggguccacg

SEQ ID NO: 26509 - RNA, 20 nt, Artificial Sequence
  MKO10026509_A_Iugb2
  gRNA
gacuguauccagucggggcc

SEQ ID NO: 26510 - RNA, 20 nt, Artificial Sequence
  MKO10026510_A_Iugb2
  gRNA
uaacuugagcacgugccgaa

SEQ ID NO: 26511 - RNA, 20 nt, Artificial Sequence
  MKO10026511_A_Iugb2
  gRNA
uuguccagccgaugauauca

SEQ ID NO: 26512 - RNA, 20 nt, Artificial Sequence
  MKO10026512_A_Iugb3bp
  gRNA
cuugagcucaccuguaagac

SEQ ID NO: 26513 - RNA, 20 nt, Artificial Sequence
  MKO10026513_A_Iugb3bp
  gRNA
cacagaaacggaccaucaaa

SEQ ID NO: 26514 - RNA, 20 nt, Artificial Sequence
  MKO10026514_A_Iugb3bp
  gRNA
gaaaaaucuaaguaguauac

SEQ ID NO: 26515 - RNA, 20 nt, Artificial Sequence
  MKO10026515_A_Iugb3
  gRNA
auugcccuucgacuacggcc

SEQ ID NO: 26516 - RNA, 20 nt, Artificial Sequence
  MKO10026516_A_Iugb3
  gRNA
cucaccccgauguaaccuga

SEQ ID NO: 26517 - RNA, 20 nt, Artificial Sequence
  MKO10026517_A_Iugb3
  gRNA
cgauacaggcuuguccacga

SEQ ID NO: 26518 - RNA, 20 nt, Artificial Sequence
  MKO10026518_A_Iugb4
  gRNA
agagcuguaccgagugcauc

SEQ ID NO: 26519 - RNA, 20 nt, Artificial Sequence
  MKO10026519_A_Iugb4
  gRNA
accagccaaccgcugcaaga

SEQ ID NO: 26520 - RNA, 20 nt, Artificial Sequence
  MKO10026520_A_Iugb4
  gRNA
caacuccaugucugacgauc

SEQ ID NO: 26521 - RNA, 20 nt, Artificial Sequence
  MKO10026521_A_Iugb5
  gRNA
cacuuacccaauacacggau

SEQ ID NO: 26522 - RNA, 20 nt, Artificial Sequence
  MKO10026522_A_Iugb5
  gRNA
gcgcucguuccgcgccucgc

SEQ ID NO: 26523 - RNA, 20 nt, Artificial Sequence
  MKO10026523_A_Iugb5
  gRNA
cugguaucucggugccgugu

SEQ ID NO: 26524 - RNA, 20 nt, Artificial Sequence
  MKO10026524_A_Iugb6
  gRNA
ccuuuggcuaaaagauucgc

SEQ ID NO: 26525 - RNA, 20 nt, Artificial Sequence
  MKO10026525_A_Iugb6
  gRNA
cgucauccauagaggcggag

SEQ ID NO: 26526 - RNA, 20 nt, Artificial Sequence
  MKO10026526_A_Iugb6
  gRNA
ucaaaauaagccucucagcg

SEQ ID NO: 26527 - RNA, 20 nt, Artificial Sequence
  MKO10026527_A_Iugb7
  gRNA
caccuggucgcagcgugacg

SEQ ID NO: 26528 - RNA, 20 nt, Artificial Sequence
  MKO10026528_A_Iugb7
  gRNA
auccgcgucacgcugcgacc

SEQ ID NO: 26529 - RNA, 20 nt, Artificial Sequence
  MKO10026529_A_Iugb7
  gRNA
cgcucaagccuucgagagag

SEQ ID NO: 26530 - RNA, 20 nt, Artificial Sequence
  MKO10026530_A_Iugb8
  gRNA
gccauacauuaguauccacc

SEQ ID NO: 26531 - RNA, 20 nt, Artificial Sequence
  MKO10026531_A_Iugb8
  gRNA
ugaacacaccauccgcauuc

SEQ ID NO: 26532 - RNA, 20 nt, Artificial Sequence
  MKO10026532_A_Iugb8
  gRNA
uccggguggauacuaaugua

SEQ ID NO: 26533 - RNA, 20 nt, Artificial Sequence
  MKO10026533_A_Iugbl1
  gRNA
aggugcacgacaucugcguu

SEQ ID NO: 26534 - RNA, 20 nt, Artificial Sequence
  MKO10026534_A_Iugbl1
  gRNA
ugccgcagucacaauuaccg

SEQ ID NO: 26535 - RNA, 20 nt, Artificial Sequence
  MKO10026535_A_Iugbl1
  gRNA
agcgcucugugccaugaccg

SEQ ID NO: 26536 - RNA, 20 nt, Artificial Sequence
  MKO10026536_A_Itih1
  gRNA
gccggaacguggccuugcuc

SEQ ID NO: 26537 - RNA, 20 nt, Artificial Sequence
  MKO10026537_A_Itih1
  gRNA
gacguagugggcaaagcgag

SEQ ID NO: 26538 - RNA, 20 nt, Artificial Sequence
  MKO10026538_A_Itih1
  gRNA
ccuaugaggagguacuaaag

SEQ ID NO: 26539 - RNA, 20 nt, Artificial Sequence
  MKO10026539_A_Itih2
  gRNA
ggccacccgagaaguaauag

SEQ ID NO: 26540 - RNA, 20 nt, Artificial Sequence
  MKO10026540_A_Itih2
  gRNA
acaucgaacacgacacucug

SEQ ID NO: 26541 - RNA, 20 nt, Artificial Sequence
  MKO10026541_A_Itih2
  gRNA
gaaacucaccgucuccucuc

SEQ ID NO: 26542 - RNA, 20 nt, Artificial Sequence
  MKO10026542_A_Itih3
  gRNA
caccuaccccgggaacguca

SEQ ID NO: 26543 - RNA, 20 nt, Artificial Sequence
  MKO10026543_A_Itih3
  gRNA
caaguacgagauguaccuua

SEQ ID NO: 26544 - RNA, 20 nt, Artificial Sequence
  MKO10026544_A_Itih3
  gRNA
cuugggcaguuccacaucaa

SEQ ID NO: 26545 - RNA, 20 nt, Artificial Sequence
  MKO10026545_A_Itih4
  gRNA
gaaacaauacagugccgccg

SEQ ID NO: 26546 - RNA, 20 nt, Artificial Sequence
  MKO10026546_A_Itih4
  gRNA
guuugaagugucagucaacg

SEQ ID NO: 26547 - RNA, 20 nt, Artificial Sequence
  MKO10026547_A_Itih4
  gRNA
ugcuaccuucucggcaguag

SEQ ID NO: 26548 - RNA, 20 nt, Artificial Sequence
  MKO10026548_A_Itih5
  gRNA
augugaugcccgaucgcucc

SEQ ID NO: 26549 - RNA, 20 nt, Artificial Sequence
  MKO10026549_A_Itih5
  gRNA
gcgaucgggcaucacauccu

SEQ ID NO: 26550 - RNA, 20 nt, Artificial Sequence
  MKO10026550_A_Itih5
  gRNA
ucucuuugcaggucgugcuc

SEQ ID NO: 26551 - RNA, 20 nt, Artificial Sequence
  MKO10026551_A_Itk
  gRNA
acagaagaagcgcacguuga

SEQ ID NO: 26552 - RNA, 20 nt, Artificial Sequence
  MKO10026552_A_Itk
  gRNA
cgcugccgacucucacaguc

SEQ ID NO: 26553 - RNA, 20 nt, Artificial Sequence
  MKO10026553_A_Itk
  gRNA
cgcccauccauccagaaauu

SEQ ID NO: 26554 - RNA, 20 nt, Artificial Sequence
  MKO10026554_A_Itln1
  gRNA
ugacaccauucuucgugcgc

SEQ ID NO: 26555 - RNA, 20 nt, Artificial Sequence
  MKO10026555_A_Itln1
  gRNA
uauuuccugcgcacgaagaa

SEQ ID NO: 26556 - RNA, 20 nt, Artificial Sequence
  MKO10026556_A_Itln1
  gRNA
gaaagaauugccccaccugu

SEQ ID NO: 26557 - RNA, 20 nt, Artificial Sequence
  MKO10026557_A_Itm2a
  gRNA
aagucgugaauaauugccgc

SEQ ID NO: 26558 - RNA, 20 nt, Artificial Sequence
  MKO10026558_A_Itm2a
  gRNA
uagacgcagagaccuucugc

SEQ ID NO: 26559 - RNA, 20 nt, Artificial Sequence
  MKO10026559_A_Itm2a
  gRNA
gcagaaggucucugcgucua

SEQ ID NO: 26560 - RNA, 20 nt, Artificial Sequence
  MKO10026560_A_Itm2b
  gRNA
caccgaccgcaucgagaacg

SEQ ID NO: 26561 - RNA, 20 nt, Artificial Sequence
  MKO10026561_A_Itm2b
  gRNA
agaccuacaaacugcagcgc

SEQ ID NO: 26562 - RNA, 20 nt, Artificial Sequence
  MKO10026562_A_Itm2b
  gRNA
uaugccgcccaaaaaccugc

SEQ ID NO: 26563 - RNA, 20 nt, Artificial Sequence
  MKO10026563_A_Itm2c
  gRNA
gacagagcauguccgcgaca

SEQ ID NO: 26564 - RNA, 20 nt, Artificial Sequence
  MKO10026564_A_Itm2c
  gRNA
ugcuacccccacgaaacuuc

SEQ ID NO: 26565 - RNA, 20 nt, Artificial Sequence
  MKO10026565_A_Itm2c
  gRNA
agguguccuucccguugcac

SEQ ID NO: 26566 - RNA, 20 nt, Artificial Sequence
  MKO10026566_A_Itpa
  gRNA
aguacucacauguaggggcc

SEQ ID NO: 26567 - RNA, 20 nt, Artificial Sequence
  MKO10026567_A_Itpa
  gRNA
cugauaagugccugaguacc

SEQ ID NO: 26568 - RNA, 20 nt, Artificial Sequence
  MKO10026568_A_Itpa
  gRNA
gaacaggucauucagauucu

SEQ ID NO: 26569 - RNA, 20 nt, Artificial Sequence
  MKO10026569_A_Itpk1
  gRNA
cgaacuuauccgaaagaucg

SEQ ID NO: 26570 - RNA, 20 nt, Artificial Sequence
  MKO10026570_A_Itpk1
  gRNA
gcgagggauagaagucgugc

SEQ ID NO: 26571 - RNA, 20 nt, Artificial Sequence
  MKO10026571_A_Itpk1
  gRNA
gaaccucagcagaccgauug

SEQ ID NO: 26572 - RNA, 20 nt, Artificial Sequence
  MKO10026572_A_Itpka
  gRNA
caucccgcucgacuaugcca

SEQ ID NO: 26573 - RNA, 20 nt, Artificial Sequence
  MKO10026573_A_Itpka
  gRNA
accugcucgauggcuucgau

SEQ ID NO: 26574 - RNA, 20 nt, Artificial Sequence
  MKO10026574_A_Itpka
  gRNA
ucgcgccauugcauguagcg

SEQ ID NO: 26575 - RNA, 20 nt, Artificial Sequence
  MKO10026575_A_Itpkb
  gRNA
cuucgauucgcccugcguga

SEQ ID NO: 26576 - RNA, 20 nt, Artificial Sequence
  MKO10026576_A_Itpkb
  gRNA
ucagcacauccgccauuaac

SEQ ID NO: 26577 - RNA, 20 nt, Artificial Sequence
  MKO10026577_A_Itpkb
  gRNA
uacauguccuuccgcaagcu

SEQ ID NO: 26578 - RNA, 20 nt, Artificial Sequence
  MKO10026578_A_Itpkc
  gRNA
guccagcuuuccggacacgc

SEQ ID NO: 26579 - RNA, 20 nt, Artificial Sequence
  MKO10026579_A_Itpkc
  gRNA
ucugaaguacucgcccuucg

SEQ ID NO: 26580 - RNA, 20 nt, Artificial Sequence
  MKO10026580_A_Itpkc
  gRNA
ccugaguucaacuuccacgc

SEQ ID NO: 26581 - RNA, 20 nt, Artificial Sequence
  MKO10026581_A_Itpr1
  gRNA
ccuggaucacguugccauau

SEQ ID NO: 26582 - RNA, 20 nt, Artificial Sequence
  MKO10026582_A_Itpr1
  gRNA
uuguuaagguccccggcuuc

SEQ ID NO: 26583 - RNA, 20 nt, Artificial Sequence
  MKO10026583_A_Itpr1
  gRNA
uuggggaccgucauccaaua

SEQ ID NO: 26584 - RNA, 20 nt, Artificial Sequence
  MKO10026584_A_Itpr2
  gRNA
ggacaucgugucccuguacg

SEQ ID NO: 26585 - RNA, 20 nt, Artificial Sequence
  MKO10026585_A_Itpr2
  gRNA
ugaccgagcccuccgcguac

SEQ ID NO: 26586 - RNA, 20 nt, Artificial Sequence
  MKO10026586_A_Itpr2
  gRNA
guuccccuguuucgccugcu

SEQ ID NO: 26587 - RNA, 20 nt, Artificial Sequence
  MKO10026587_A_Itpr3
  gRNA
agcauccagcgucacccgca

SEQ ID NO: 26588 - RNA, 20 nt, Artificial Sequence
  MKO10026588_A_Itpr3
  gRNA
gcuggaugcuacgggcaaug

SEQ ID NO: 26589 - RNA, 20 nt, Artificial Sequence
  MKO10026589_A_Itpr3
  gRNA
ggucuuaccucggaacuucu

SEQ ID NO: 26590 - RNA, 20 nt, Artificial Sequence
  MKO10026590_A_Itpripl1
  gRNA
gcacggucuuacacacgucc

SEQ ID NO: 26591 - RNA, 20 nt, Artificial Sequence
  MKO10026591_A_Itpripl1
  gRNA
ccggcucugggccgucguug

SEQ ID NO: 26592 - RNA, 20 nt, Artificial Sequence
  MKO10026592_A_Itpripl1
  gRNA
gacuccuagcuagcgugucc

SEQ ID NO: 26593 - RNA, 20 nt, Artificial Sequence
  MKO10026593_A_Itpripl2
  gRNA
acccgacagcuucgacgugu

SEQ ID NO: 26594 - RNA, 20 nt, Artificial Sequence
  MKO10026594_A_Itpripl2
  gRNA
gaaaccgcugucugcgccgu

SEQ ID NO: 26595 - RNA, 20 nt, Artificial Sequence
  MKO10026595_A_Itpripl2
  gRNA
agugcgggucgaaaggcgcc

SEQ ID NO: 26596 - RNA, 20 nt, Artificial Sequence
  MKO10026596_A_Itprip
  gRNA
gucgcaacaccucgaugauc

SEQ ID NO: 26597 - RNA, 20 nt, Artificial Sequence
  MKO10026597_A_Itprip
  gRNA
ugccacgauucccgagaacg

SEQ ID NO: 26598 - RNA, 20 nt, Artificial Sequence
  MKO10026598_A_Itprip
  gRNA
gaaucguggcauucucccgu

SEQ ID NO: 26599 - RNA, 20 nt, Artificial Sequence
  MKO10026599_A_Itsn1
  gRNA
ccaguaauaaaucccgcuau

SEQ ID NO: 26600 - RNA, 20 nt, Artificial Sequence
  MKO10026600_A_Itsn1
  gRNA
ccuuagccugaagccgauag

SEQ ID NO: 26601 - RNA, 20 nt, Artificial Sequence
  MKO10026601_A_Itsn1
  gRNA
cuagcggacaugaauaacga

SEQ ID NO: 26602 - RNA, 20 nt, Artificial Sequence
  MKO10026602_A_Itsn2
  gRNA
auaggggguuguuucaugau

SEQ ID NO: 26603 - RNA, 20 nt, Artificial Sequence
  MKO10026603_A_Itsn2
  gRNA
uagcuauagagaacucuugc

SEQ ID NO: 26604 - RNA, 20 nt, Artificial Sequence
  MKO10026604_A_Itsn2
  gRNA
gauguaauagcccacauauu

SEQ ID NO: 26605 - RNA, 20 nt, Artificial Sequence
  MKO10026605_A_Ivd
  gRNA
gucaaccagauuguucgaaa

SEQ ID NO: 26606 - RNA, 20 nt, Artificial Sequence
  MKO10026606_A_Ivd
  gRNA
ggaagagauaucccgggcuu

SEQ ID NO: 26607 - RNA, 20 nt, Artificial Sequence
  MKO10026607_A_Ivd
  gRNA
cugugaugcccaguacgccc

SEQ ID NO: 26608 - RNA, 20 nt, Artificial Sequence
  MKO10026608_A_Ivl
  gRNA
uguuccugcuggauaugauc

SEQ ID NO: 26609 - RNA, 20 nt, Artificial Sequence
  MKO10026609_A_Ivl
  gRNA
gcaagacaugcuaguaccac

SEQ ID NO: 26610 - RNA, 20 nt, Artificial Sequence
  MKO10026610_A_Ivl
  gRNA
cagcaacagauagagcguga

SEQ ID NO: 26611 - RNA, 20 nt, Artificial Sequence
  MKO10026611_A_Ivns1abp
  gRNA
guucugugauguucgacuuc

SEQ ID NO: 26612 - RNA, 20 nt, Artificial Sequence
  MKO10026612_A_Ivns1abp
  gRNA
aauacgcuaccugcuugacu

SEQ ID NO: 26613 - RNA, 20 nt, Artificial Sequence
  MKO10026613_A_Ivns1abp
  gRNA
ucuuaagcuuccgagacuaa

SEQ ID NO: 26614 - RNA, 20 nt, Artificial Sequence
  MKO10026614_A_Iws1
  gRNA
cucuccgagucacuuauccg

SEQ ID NO: 26615 - RNA, 20 nt, Artificial Sequence
  MKO10026615_A_Iws1
  gRNA
uacacuuccagugucggauc

SEQ ID NO: 26616 - RNA, 20 nt, Artificial Sequence
  MKO10026616_A_Iws1
  gRNA
gaaucccgcucguccuguac

SEQ ID NO: 26617 - RNA, 20 nt, Artificial Sequence
  MKO10026617_A_Iyd
  gRNA
cagcagcgagcacgucccaa

SEQ ID NO: 26618 - RNA, 20 nt, Artificial Sequence
  MKO10026618_A_Iyd
  gRNA
ucacacccgauacccagaac

SEQ ID NO: 26619 - RNA, 20 nt, Artificial Sequence
  MKO10026619_A_Iyd
  gRNA
aucaguguguccaucgccug

SEQ ID NO: 26620 - RNA, 20 nt, Artificial Sequence
  MKO10026620_A_Izumo1
  gRNA
ugaugucgcagacuuugauc

SEQ ID NO: 26621 - RNA, 20 nt, Artificial Sequence
  MKO10026621_A_Izumo1
  gRNA
auuggacuuaccgcauuugu

SEQ ID NO: 26622 - RNA, 20 nt, Artificial Sequence
  MKO10026622_A_Izumo1
  gRNA
cauccucaccuccacaaucu

SEQ ID NO: 26623 - RNA, 20 nt, Artificial Sequence
  MKO10026623_A_Izumo2
  gRNA
gucugcagucguggaucaac

SEQ ID NO: 26624 - RNA, 20 nt, Artificial Sequence
  MKO10026624_A_Izumo2
  gRNA
ccgcaugacucugaaguucc

SEQ ID NO: 26625 - RNA, 20 nt, Artificial Sequence
  MKO10026625_A_Izumo2
  gRNA
cgcaaucaggaugaccaaga

SEQ ID NO: 26626 - RNA, 20 nt, Artificial Sequence
  MKO10026626_A_Izumo3
  gRNA
augaccacucgguguuucaa

SEQ ID NO: 26627 - RNA, 20 nt, Artificial Sequence
  MKO10026627_A_Izumo3
  gRNA
ucuggagauccgccaaaacu

SEQ ID NO: 26628 - RNA, 20 nt, Artificial Sequence
  MKO10026628_A_Izumo3
  gRNA
gucuccuuugaaacaccgag

SEQ ID NO: 26629 - RNA, 20 nt, Artificial Sequence
  MKO10026629_A_Izumo4
  gRNA
aagauggcccgcagcucauu

SEQ ID NO: 26630 - RNA, 20 nt, Artificial Sequence
  MKO10026630_A_Izumo4
  gRNA
uagcagaagccguguaccag

SEQ ID NO: 26631 - RNA, 20 nt, Artificial Sequence
  MKO10026631_A_Izumo4
  gRNA
agugacgcugacagucaaug

SEQ ID NO: 26632 - RNA, 20 nt, Artificial Sequence
  MKO10026632_A_Jade1
  gRNA
cguuaggcuacgucgauauc

SEQ ID NO: 26633 - RNA, 20 nt, Artificial Sequence
  MKO10026633_A_Jade1
  gRNA
auaucgacguagccuaacgc

SEQ ID NO: 26634 - RNA, 20 nt, Artificial Sequence
  MKO10026634_A_Jade1
  gRNA
acuacgugcuggcugauccc

SEQ ID NO: 26635 - RNA, 20 nt, Artificial Sequence
  MKO10026635_A_Jade2
  gRNA
uggaugagaucgaugcguac

SEQ ID NO: 26636 - RNA, 20 nt, Artificial Sequence
  MKO10026636_A_Jade2
  gRNA
acuacauccuggcggacccg

SEQ ID NO: 26637 - RNA, 20 nt, Artificial Sequence
  MKO10026637_A_Jade2
  gRNA
aacguuagagcguguucuag

SEQ ID NO: 26638 - RNA, 20 nt, Artificial Sequence
  MKO10026638_A_Jade3
  gRNA
agcggagcgagacgcugcgc

SEQ ID NO: 26639 - RNA, 20 nt, Artificial Sequence
  MKO10026639_A_Jade3
  gRNA
cucaacgugccgggcgaguc

SEQ ID NO: 26640 - RNA, 20 nt, Artificial Sequence
  MKO10026640_A_Jade3
  gRNA
aucagacuuugaccuuacgu

SEQ ID NO: 26641 - RNA, 20 nt, Artificial Sequence
  MKO10026641_A_Jag1
  gRNA
uaucagucccgcgucacugc

SEQ ID NO: 26642 - RNA, 20 nt, Artificial Sequence
  MKO10026642_A_Jag1
  gRNA
aagguguuacccccgaugac

SEQ ID NO: 26643 - RNA, 20 nt, Artificial Sequence
  MKO10026643_A_Jag1
  gRNA
cucggaucugauacucgaag

SEQ ID NO: 26644 - RNA, 20 nt, Artificial Sequence
  MKO10026644_A_Jag2
  gRNA
cuacggcgccacgcccgugc

SEQ ID NO: 26645 - RNA, 20 nt, Artificial Sequence
  MKO10026645_A_Jag2
  gRNA
agccccccgcgcgcgucguc

SEQ ID NO: 26646 - RNA, 20 nt, Artificial Sequence
  MKO10026646_A_Jag2
  gRNA
cuuguugccguacuggucgc

SEQ ID NO: 26647 - RNA, 20 nt, Artificial Sequence
  MKO10026647_A_Jagn1
  gRNA
ccgcgagcggccggcaccga

SEQ ID NO: 26648 - RNA, 20 nt, Artificial Sequence
  MKO10026648_A_Jagn1
  gRNA
ucuacgugcaucucgucaua

SEQ ID NO: 26649 - RNA, 20 nt, Artificial Sequence
  MKO10026649_A_Jagn1
  gRNA
gugcugaaagucgcugccgu

SEQ ID NO: 26650 - RNA, 20 nt, Artificial Sequence
  MKO10026650_A_Jak1
  gRNA
uccggcuccacuaccgcaug

SEQ ID NO: 26651 - RNA, 20 nt, Artificial Sequence
  MKO10026651_A_Jak1
  gRNA
gcuuggugcucucaucguac

SEQ ID NO: 26652 - RNA, 20 nt, Artificial Sequence
  MKO10026652_A_Jak1
  gRNA
augacaacgaacagucugua

SEQ ID NO: 26653 - RNA, 20 nt, Artificial Sequence
  MKO10026653_A_Jak2
  gRNA
aucuucgcucgaacgcacuu

SEQ ID NO: 26654 - RNA, 20 nt, Artificial Sequence
  MKO10026654_A_Jak2
  gRNA
acgggacacuccguaucugu

SEQ ID NO: 26655 - RNA, 20 nt, Artificial Sequence
  MKO10026655_A_Jak2
  gRNA
uccacauagacgagucaacc

SEQ ID NO: 26656 - RNA, 20 nt, Artificial Sequence
  MKO10026656_A_Jak3
  gRNA
ugagcgcguagcggucggcc

SEQ ID NO: 26657 - RNA, 20 nt, Artificial Sequence
  MKO10026657_A_Jak3
  gRNA
gccugcgugucacgaaguuc

SEQ ID NO: 26658 - RNA, 20 nt, Artificial Sequence
  MKO10026658_A_Jak3
  gRNA
cuggagacaugucaccgcuu

SEQ ID NO: 26659 - RNA, 20 nt, Artificial Sequence
  MKO10026659_A_Jakmip1
  gRNA
cgaccugcgcgcugcguacc

SEQ ID NO: 26660 - RNA, 20 nt, Artificial Sequence
  MKO10026660_A_Jakmip1
  gRNA
gcgcgccuccucgcgcgcgu

SEQ ID NO: 26661 - RNA, 20 nt, Artificial Sequence
  MKO10026661_A_Jakmip1
  gRNA
cguuccucucgucagccagc

SEQ ID NO: 26662 - RNA, 20 nt, Artificial Sequence
  MKO10026662_A_Jakmip2
  gRNA
aauccgaacgggauauacgg

SEQ ID NO: 26663 - RNA, 20 nt, Artificial Sequence
  MKO10026663_A_Jakmip2
  gRNA
augcccaguuaaaacgcgug

SEQ ID NO: 26664 - RNA, 20 nt, Artificial Sequence
  MKO10026664_A_Jakmip2
  gRNA
cagccuccguauaucccguu

SEQ ID NO: 26665 - RNA, 20 nt, Artificial Sequence
  MKO10026665_A_Jakmip3
  gRNA
ucgcaacagugccucgcgca

SEQ ID NO: 26666 - RNA, 20 nt, Artificial Sequence
  MKO10026666_A_Jakmip3
  gRNA
cguugcggucuucuagcuua

SEQ ID NO: 26667 - RNA, 20 nt, Artificial Sequence
  MKO10026667_A_Jakmip3
  gRNA
gcacgaacagcgcaagcacg

SEQ ID NO: 26668 - RNA, 20 nt, Artificial Sequence
  MKO10026668_A_Jam2
  gRNA
ugugguggagcuacgaugcc

SEQ ID NO: 26669 - RNA, 20 nt, Artificial Sequence
  MKO10026669_A_Jam2
  gRNA
gucagcgcuccgacugagca

SEQ ID NO: 26670 - RNA, 20 nt, Artificial Sequence
  MKO10026670_A_Jam2
  gRNA
uuguugugugugccgccuuu

SEQ ID NO: 26671 - RNA, 20 nt, Artificial Sequence
  MKO10026671_A_Jam3
  gRNA
aacgaccucacagcgauaga

SEQ ID NO: 26672 - RNA, 20 nt, Artificial Sequence
  MKO10026672_A_Jam3
  gRNA
ggggauagcccucgcucucu

SEQ ID NO: 26673 - RNA, 20 nt, Artificial Sequence
  MKO10026673_A_Jam3
  gRNA
ggaauugucuugcaucauua

SEQ ID NO: 26674 - RNA, 20 nt, Artificial Sequence
  MKO10026674_A_Jarid2
  gRNA
acuaacaucguugcuaguag

SEQ ID NO: 26675 - RNA, 20 nt, Artificial Sequence
  MKO10026675_A_Jarid2
  gRNA
cuucgugccagucaaccccc

SEQ ID NO: 26676 - RNA, 20 nt, Artificial Sequence
  MKO10026676_A_Jarid2
  gRNA
aguccuguauuugucccuaa

SEQ ID NO: 26677 - RNA, 20 nt, Artificial Sequence
  MKO10026677_A_Jazf1
  gRNA
aggcugccacugcuaugucg

SEQ ID NO: 26678 - RNA, 20 nt, Artificial Sequence
  MKO10026678_A_Jazf1
  gRNA
ugcggacgcgaaucuguguu

SEQ ID NO: 26679 - RNA, 20 nt, Artificial Sequence
  MKO10026679_A_Jazf1
  gRNA
cuguccagcuccgugucucg

SEQ ID NO: 26680 - RNA, 20 nt, Artificial Sequence
  MKO10026680_A_Jdp2
  gRNA
uacgcugacauccgcaacau

SEQ ID NO: 26681 - RNA, 20 nt, Artificial Sequence
  MKO10026681_A_Jdp2
  gRNA
gcuaucugugcgcacgaugc

SEQ ID NO: 26682 - RNA, 20 nt, Artificial Sequence
  MKO10026682_A_Jdp2
  gRNA
gccccaacccgugaagagug

SEQ ID NO: 26683 - RNA, 20 nt, Artificial Sequence
  MKO10026683_A_Jkamp
  gRNA
cgcgcucuuugaaugcacca

SEQ ID NO: 26684 - RNA, 20 nt, Artificial Sequence
  MKO10026684_A_Jkamp
  gRNA
aguccccagaacuuuacgac

SEQ ID NO: 26685 - RNA, 20 nt, Artificial Sequence
  MKO10026685_A_Jkamp
  gRNA
cuuacucgugagugaucccg

SEQ ID NO: 26686 - RNA, 20 nt, Artificial Sequence
  MKO10026686_A_Jmjd1c
  gRNA
gaaguauucguccaaauaag

SEQ ID NO: 26687 - RNA, 20 nt, Artificial Sequence
  MKO10026687_A_Jmjd1c
  gRNA
gucguucacucuuuguuaaa

SEQ ID NO: 26688 - RNA, 20 nt, Artificial Sequence
  MKO10026688_A_Jmjd1c
  gRNA
gugaacgacaucaucuagaa

SEQ ID NO: 26689 - RNA, 20 nt, Artificial Sequence
  MKO10026689_A_Jmjd4
  gRNA
uccgcgacuauaucaguuac

SEQ ID NO: 26690 - RNA, 20 nt, Artificial Sequence
  MKO10026690_A_Jmjd4
  gRNA
guucugggacguccucaaug

SEQ ID NO: 26691 - RNA, 20 nt, Artificial Sequence
  MKO10026691_A_Jmjd4
  gRNA
gaggucccgguaguaccgcu

SEQ ID NO: 26692 - RNA, 20 nt, Artificial Sequence
  MKO10026692_A_Jmjd6
  gRNA
ugcguuucucccccgcguau

SEQ ID NO: 26693 - RNA, 20 nt, Artificial Sequence
  MKO10026693_A_Jmjd6
  gRNA
aguucguggagcgcuacgag

SEQ ID NO: 26694 - RNA, 20 nt, Artificial Sequence
  MKO10026694_A_Jmjd6
  gRNA
cuccuggaggucaacugcgu

SEQ ID NO: 26695 - RNA, 20 nt, Artificial Sequence
  MKO10026695_A_Jmjd7
  gRNA
uuaugcggacgcggugcgag

SEQ ID NO: 26696 - RNA, 20 nt, Artificial Sequence
  MKO10026696_A_Jmjd7
  gRNA
accgcguccgcauaaccauc

SEQ ID NO: 26697 - RNA, 20 nt, Artificial Sequence
  MKO10026697_A_Jmjd7
  gRNA
accucguguugugcccuacc

SEQ ID NO: 26698 - RNA, 20 nt, Artificial Sequence
  MKO10026698_A_Jmjd8
  gRNA
aacaauguuguccccgaacg

SEQ ID NO: 26699 - RNA, 20 nt, Artificial Sequence
  MKO10026699_A_Jmjd8
  gRNA
gaaaaccugcuagccucguu

SEQ ID NO: 26700 - RNA, 20 nt, Artificial Sequence
  MKO10026700_A_Jmjd8
  gRNA
gucuggcucaccauugccua

SEQ ID NO: 26701 - RNA, 20 nt, Artificial Sequence
  MKO10026701_A_Jmy
  gRNA
auuccgagacaugcgagaac

SEQ ID NO: 26702 - RNA, 20 nt, Artificial Sequence
  MKO10026702_A_Jmy
  gRNA
agcaucaagagacuuauauc

SEQ ID NO: 26703 - RNA, 20 nt, Artificial Sequence
  MKO10026703_A_Jmy
  gRNA
uacagaagcuauagcucgau

SEQ ID NO: 26704 - RNA, 20 nt, Artificial Sequence
  MKO10026704_A_Josd1
  gRNA
agauuugugggggcgcugcu

SEQ ID NO: 26705 - RNA, 20 nt, Artificial Sequence
  MKO10026705_A_Josd1
  gRNA
uaggcugucuccgaacacua

SEQ ID NO: 26706 - RNA, 20 nt, Artificial Sequence
  MKO10026706_A_Josd1
  gRNA
ugccucucaaaagacagcac

SEQ ID NO: 26707 - RNA, 20 nt, Artificial Sequence
  MKO10026707_A_Josd2
  gRNA
ccaccaauagcaccucgcac

SEQ ID NO: 26708 - RNA, 20 nt, Artificial Sequence
  MKO10026708_A_Josd2
  gRNA
ucaccucuugcagauuucgu

SEQ ID NO: 26709 - RNA, 20 nt, Artificial Sequence
  MKO10026709_A_Josd2
  gRNA
cugccgacgaaaucugcaag

SEQ ID NO: 26710 - RNA, 20 nt, Artificial Sequence
  MKO10026710_A_Jph1
  gRNA
uggaagaacgauaagcgcaa

SEQ ID NO: 26711 - RNA, 20 nt, Artificial Sequence
  MKO10026711_A_Jph1
  gRNA
gcggaccgagcugcgcuugc

SEQ ID NO: 26712 - RNA, 20 nt, Artificial Sequence
  MKO10026712_A_Jph1
  gRNA
agagugcagcuccccguugc

SEQ ID NO: 26713 - RNA, 20 nt, Artificial Sequence
  MKO10026713_A_Jph2
  gRNA
gugagcgcgaaaccaccgcg

SEQ ID NO: 26714 - RNA, 20 nt, Artificial Sequence
  MKO10026714_A_Jph2
  gRNA
cgagguccggcgauccgacu

SEQ ID NO: 26715 - RNA, 20 nt, Artificial Sequence
  MKO10026715_A_Jph2
  gRNA
gaagggcgcagccgcgucgu

SEQ ID NO: 26716 - RNA, 20 nt, Artificial Sequence
  MKO10026716_A_Jph3
  gRNA
cgggugcagugccgccccgu

SEQ ID NO: 26717 - RNA, 20 nt, Artificial Sequence
  MKO10026717_A_Jph3
  gRNA
acuuaagcccguccgagcgc

SEQ ID NO: 26718 - RNA, 20 nt, Artificial Sequence
  MKO10026718_A_Jph3
  gRNA
ucgucagacucgagugcaac

SEQ ID NO: 26719 - RNA, 20 nt, Artificial Sequence
  MKO10026719_A_Jph4
  gRNA
gcaaccgacgccacggauac

SEQ ID NO: 26720 - RNA, 20 nt, Artificial Sequence
  MKO10026720_A_Jph4
  gRNA
uggcgugcggaccggcgcag

SEQ ID NO: 26721 - RNA, 20 nt, Artificial Sequence
  MKO10026721_A_Jph4
  gRNA
aguccauucucguauacccc

SEQ ID NO: 26722 - RNA, 20 nt, Artificial Sequence
  MKO10026722_A_Jrkl
  gRNA
cuuaaguacucucgaaccug

SEQ ID NO: 26723 - RNA, 20 nt, Artificial Sequence
  MKO10026723_A_Jrkl
  gRNA
uuacguauuaccagucuguc

SEQ ID NO: 26724 - RNA, 20 nt, Artificial Sequence
  MKO10026724_A_Jrkl
  gRNA
cuggaccaauuugugccaaa

SEQ ID NO: 26725 - RNA, 20 nt, Artificial Sequence
  MKO10026725_A_Jrk
  gRNA
ugcccucagcgcgcuuuacc

SEQ ID NO: 26726 - RNA, 20 nt, Artificial Sequence
  MKO10026726_A_Jrk
  gRNA
augagcauagggcccgacac

SEQ ID NO: 26727 - RNA, 20 nt, Artificial Sequence
  MKO10026727_A_Jrk
  gRNA
uuccugguaaagcgcgcuga

SEQ ID NO: 26728 - RNA, 20 nt, Artificial Sequence
  MKO10026728_A_Jsrp1
  gRNA
cccggaucguuccugcacgu

SEQ ID NO: 26729 - RNA, 20 nt, Artificial Sequence
  MKO10026729_A_Jsrp1
  gRNA
uccuacgugcaggaacgauc

SEQ ID NO: 26730 - RNA, 20 nt, Artificial Sequence
  MKO10026730_A_Jsrp1
  gRNA
uacuuacagggacauccagg

SEQ ID NO: 26731 - RNA, 20 nt, Artificial Sequence
  MKO10026731_A_Jtb
  gRNA
gauagcuucuccucgcgcac

SEQ ID NO: 26732 - RNA, 20 nt, Artificial Sequence
  MKO10026732_A_Jtb
  gRNA
caucguucgucagcgacaac

SEQ ID NO: 26733 - RNA, 20 nt, Artificial Sequence
  MKO10026733_A_Jtb
  gRNA
gucgcugacgaacgaugaca

SEQ ID NO: 26734 - RNA, 20 nt, Artificial Sequence
  MKO10026734_A_Junb
  gRNA
cgcccggaugugcacgaaaa

SEQ ID NO: 26735 - RNA, 20 nt, Artificial Sequence
  MKO10026735_A_Junb
  gRNA
ucacgacgacucuuacgcag

SEQ ID NO: 26736 - RNA, 20 nt, Artificial Sequence
  MKO10026736_A_Junb
  gRNA
cgugaucacgccguugcugu

SEQ ID NO: 26737 - RNA, 20 nt, Artificial Sequence
  MKO10026737_A_Jund
  gRNA
cgcgcucgggcucaguacgc

SEQ ID NO: 26738 - RNA, 20 nt, Artificial Sequence
  MKO10026738_A_Jund
  gRNA
ccgucggggcgcagcgcaga

SEQ ID NO: 26739 - RNA, 20 nt, Artificial Sequence
  MKO10026739_A_Jund
  gRNA
cgcucgacgcacccgcagcc

SEQ ID NO: 26740 - RNA, 20 nt, Artificial Sequence
  MKO10026740_A_Jun
  gRNA
cuucucacgucgcccgacgu

SEQ ID NO: 26741 - RNA, 20 nt, Artificial Sequence
  MKO10026741_A_Jun
  gRNA
gcgcccuccuauggcgcggc

SEQ ID NO: 26742 - RNA, 20 nt, Artificial Sequence
  MKO10026742_A_Jun
  gRNA
cagcuugagcagcccgacgu

SEQ ID NO: 26743 - RNA, 20 nt, Artificial Sequence
  MKO10026743_A_Jup
  gRNA
gcgagcccauuagagcccgg

SEQ ID NO: 26744 - RNA, 20 nt, Artificial Sequence
  MKO10026744_A_Jup
  gRNA
uugcucgccauauucaaguc

SEQ ID NO: 26745 - RNA, 20 nt, Artificial Sequence
  MKO10026745_A_Jup
  gRNA
cgccaagauggcggugcguc

SEQ ID NO: 26746 - RNA, 20 nt, Artificial Sequence
  MKO10026746_A_Kalrn
  gRNA
aauacgucacaaguuuccgu

SEQ ID NO: 26747 - RNA, 20 nt, Artificial Sequence
  MKO10026747_A_Kalrn
  gRNA
gcuuucgcacgugccacauu

SEQ ID NO: 26748 - RNA, 20 nt, Artificial Sequence
  MKO10026748_A_Kalrn
  gRNA
ucaccgucaucaucgacaug

SEQ ID NO: 26749 - RNA, 20 nt, Artificial Sequence
  MKO10026749_A_Kank1
  gRNA
cacccgcuccagauucgugc

SEQ ID NO: 26750 - RNA, 20 nt, Artificial Sequence
  MKO10026750_A_Kank1
  gRNA
ccgccauuccccgagugucg

SEQ ID NO: 26751 - RNA, 20 nt, Artificial Sequence
  MKO10026751_A_Kank1
  gRNA
cgauggaccgcacgucuuug

SEQ ID NO: 26752 - RNA, 20 nt, Artificial Sequence
  MKO10026752_A_Kank2
  gRNA
aaucggcuccaacccucgug

SEQ ID NO: 26753 - RNA, 20 nt, Artificial Sequence
  MKO10026753_A_Kank2
  gRNA
accccgguggcacccagcgc

SEQ ID NO: 26754 - RNA, 20 nt, Artificial Sequence
  MKO10026754_A_Kank2
  gRNA
ucggguccugacgccaccuc

SEQ ID NO: 26755 - RNA, 20 nt, Artificial Sequence
  MKO10026755_A_Kank3
  gRNA
aagagcgugugcucaacgcg

SEQ ID NO: 26756 - RNA, 20 nt, Artificial Sequence
  MKO10026756_A_Kank3
  gRNA
aggcccguucgagacgcgcg

SEQ ID NO: 26757 - RNA, 20 nt, Artificial Sequence
  MKO10026757_A_Kank3
  gRNA
gugaacugaacccccguuug

SEQ ID NO: 26758 - RNA, 20 nt, Artificial Sequence
  MKO10026758_A_Kank4
  gRNA
gaauauuuaccuggcggcgg

SEQ ID NO: 26759 - RNA, 20 nt, Artificial Sequence
  MKO10026759_A_Kank4
  gRNA
acuggucuccucgcuagacg

SEQ ID NO: 26760 - RNA, 20 nt, Artificial Sequence
  MKO10026760_A_Kank4
  gRNA
cuaugagaccacgucuagcg

SEQ ID NO: 26761 - RNA, 20 nt, Artificial Sequence
  MKO10026761_A_Kansl1l
  gRNA
ugaguacagcugcgcgaaca

SEQ ID NO: 26762 - RNA, 20 nt, Artificial Sequence
  MKO10026762_A_Kansl1l
  gRNA
cucgggaguccaguaaaaag

SEQ ID NO: 26763 - RNA, 20 nt, Artificial Sequence
  MKO10026763_A_Kansl1l
  gRNA
gacaucucaaaaucguguuc

SEQ ID NO: 26764 - RNA, 20 nt, Artificial Sequence
  MKO10026764_A_Kansl1
  gRNA
ucgcggugcuccacaugauu

SEQ ID NO: 26765 - RNA, 20 nt, Artificial Sequence
  MKO10026765_A_Kansl1
  gRNA
cgugugucgcagcccgaacc

SEQ ID NO: 26766 - RNA, 20 nt, Artificial Sequence
  MKO10026766_A_Kansl1
  gRNA
caaacagauacgugcuaaua

SEQ ID NO: 26767 - RNA, 20 nt, Artificial Sequence
  MKO10026767_A_Kansl2
  gRNA
auccuuacccaguauccggc

SEQ ID NO: 26768 - RNA, 20 nt, Artificial Sequence
  MKO10026768_A_Kansl2
  gRNA
uaccuguugagcagccccau

SEQ ID NO: 26769 - RNA, 20 nt, Artificial Sequence
  MKO10026769_A_Kansl2
  gRNA
uugccucagaugaagacagc

SEQ ID NO: 26770 - RNA, 20 nt, Artificial Sequence
  MKO10026770_A_Kansl3
  gRNA
cuugcacgauuggccaauga

SEQ ID NO: 26771 - RNA, 20 nt, Artificial Sequence
  MKO10026771_A_Kansl3
  gRNA
cauuggccaaucgugcaagc

SEQ ID NO: 26772 - RNA, 20 nt, Artificial Sequence
  MKO10026772_A_Kansl3
  gRNA
ugagccugugcugcgucgcg

SEQ ID NO: 26773 - RNA, 20 nt, Artificial Sequence
  MKO10026773_A_Kap
  gRNA
ucccucuguaugaucccagu

SEQ ID NO: 26774 - RNA, 20 nt, Artificial Sequence
  MKO10026774_A_Kap
  gRNA
acagugaaaauuccauuagc

SEQ ID NO: 26775 - RNA, 20 nt, Artificial Sequence
  MKO10026775_A_Kap
  gRNA
aaacucagucuuugaccaac

SEQ ID NO: 26776 - RNA, 20 nt, Artificial Sequence
  MKO10026776_A_Kars
  gRNA
uaggccgcauccacgccaag

SEQ ID NO: 26777 - RNA, 20 nt, Artificial Sequence
  MKO10026777_A_Kars
  gRNA
auaucaauaacaaacugcgc

SEQ ID NO: 26778 - RNA, 20 nt, Artificial Sequence
  MKO10026778_A_Kars
  gRNA
ucaagccguccagcagcuga

SEQ ID NO: 26779 - RNA, 20 nt, Artificial Sequence
  MKO10026779_A_Kau2a
  gRNA
gcugaagccggacugggcgc

SEQ ID NO: 26780 - RNA, 20 nt, Artificial Sequence
  MKO10026780_A_Kau2a
  gRNA
uucgacuccugcgcccaguc

SEQ ID NO: 26781 - RNA, 20 nt, Artificial Sequence
  MKO10026781_A_Kau2a
  gRNA
ugucagaggacgagauuaac

SEQ ID NO: 26782 - RNA, 20 nt, Artificial Sequence
  MKO10026782_A_Kau2b
  gRNA
gaccguagucuccgcugaga

SEQ ID NO: 26783 - RNA, 20 nt, Artificial Sequence
  MKO10026783_A_Kau2b
  gRNA
aguguacuucuaccuauuca

SEQ ID NO: 26784 - RNA, 20 nt, Artificial Sequence
  MKO10026784_A_Kau2b
  gRNA
cgaagcuguagccaugcccu

SEQ ID NO: 26785 - RNA, 20 nt, Artificial Sequence
  MKO10026785_A_Kau5
  gRNA
cugaggguaccguugagcgg

SEQ ID NO: 26786 - RNA, 20 nt, Artificial Sequence
  MKO10026786_A_Kau5
  gRNA
augaaugggugacucacgag

SEQ ID NO: 26787 - RNA, 20 nt, Artificial Sequence
  MKO10026787_A_Kau5
  gRNA
gauuggcaaggucuucccgc

SEQ ID NO: 26788 - RNA, 20 nt, Artificial Sequence
  MKO10026788_A_Kau6a
  gRNA
cggcgcuaugcuaauccaau

SEQ ID NO: 26789 - RNA, 20 nt, Artificial Sequence
  MKO10026789_A_Kau6a
  gRNA
uaugucagauaugccgaccu

SEQ ID NO: 26790 - RNA, 20 nt, Artificial Sequence
  MKO10026790_A_Kau6a
  gRNA
cucaaugcacugccaccgua

SEQ ID NO: 26791 - RNA, 20 nt, Artificial Sequence
  MKO10026791_A_Kau6b
  gRNA
gugcagcgcaugucgagucc

SEQ ID NO: 26792 - RNA, 20 nt, Artificial Sequence
  MKO10026792_A_Kau6b
  gRNA
ugaguuaaccgcaaauguga

SEQ ID NO: 26793 - RNA, 20 nt, Artificial Sequence
  MKO10026793_A_Kau6b
  gRNA
gugggucacagcacuccaua

SEQ ID NO: 26794 - RNA, 20 nt, Artificial Sequence
  MKO10026794_A_Kau7
  gRNA
uucgugaaaucgacgucgcu

SEQ ID NO: 26795 - RNA, 20 nt, Artificial Sequence
  MKO10026795_A_Kau7
  gRNA
agccgccggcaaugccgcga

SEQ ID NO: 26796 - RNA, 20 nt, Artificial Sequence
  MKO10026796_A_Kau7
  gRNA
gcauuuccgguuggaguucg

SEQ ID NO: 26797 - RNA, 20 nt, Artificial Sequence
  MKO10026797_A_Kau8
  gRNA
ccuaacaguuaacaggcgac

SEQ ID NO: 26798 - RNA, 20 nt, Artificial Sequence
  MKO10026798_A_Kau8
  gRNA
ccuggucauucacucgagac

SEQ ID NO: 26799 - RNA, 20 nt, Artificial Sequence
  MKO10026799_A_Kau8
  gRNA
guacucgcagagccaaagcu

SEQ ID NO: 26800 - RNA, 20 nt, Artificial Sequence
  MKO10026800_A_Kauna1
  gRNA
uccacucaccuucgcucaac

SEQ ID NO: 26801 - RNA, 20 nt, Artificial Sequence
  MKO10026801_A_Kauna1
  gRNA
uaugacucaccaccgaacgu

SEQ ID NO: 26802 - RNA, 20 nt, Artificial Sequence
  MKO10026802_A_Kauna1
  gRNA
guguuguuuagacccuuacc

SEQ ID NO: 26803 - RNA, 20 nt, Artificial Sequence
  MKO10026803_A_Kaunal1
  gRNA
cgccggguaugauaaggauc

SEQ ID NO: 26804 - RNA, 20 nt, Artificial Sequence
  MKO10026804_A_Kaunal1
  gRNA
cgguucaucucggcaagaca

SEQ ID NO: 26805 - RNA, 20 nt, Artificial Sequence
  MKO10026805_A_Kaunal1
  gRNA
aucgcgaagugaggccucug

SEQ ID NO: 26806 - RNA, 20 nt, Artificial Sequence
  MKO10026806_A_Kaunal2
  gRNA
aaagcgccguaaucccaguu

SEQ ID NO: 26807 - RNA, 20 nt, Artificial Sequence
  MKO10026807_A_Kaunal2
  gRNA
aauaauuuaccgucacgaag

SEQ ID NO: 26808 - RNA, 20 nt, Artificial Sequence
  MKO10026808_A_Kaunal2
  gRNA
aguuugugacaacguugacc

SEQ ID NO: 26809 - RNA, 20 nt, Artificial Sequence
  MKO10026809_A_Kaunb1
  gRNA
agacgcggauggagcccgac

SEQ ID NO: 26810 - RNA, 20 nt, Artificial Sequence
  MKO10026810_A_Kaunb1
  gRNA
aaggcugugucuuccgauau

SEQ ID NO: 26811 - RNA, 20 nt, Artificial Sequence
  MKO10026811_A_Kaunb1
  gRNA
caucguagcugguucccagu

SEQ ID NO: 26812 - RNA, 20 nt, Artificial Sequence
  MKO10026812_A_Kaunbl1
  gRNA
ugacaaauguccgacugucg

SEQ ID NO: 26813 - RNA, 20 nt, Artificial Sequence
  MKO10026813_A_Kaunbl1
  gRNA
aaaauuuacgccacgacagu

SEQ ID NO: 26814 - RNA, 20 nt, Artificial Sequence
  MKO10026814_A_Kaunbl1
  gRNA
gccuuccuguucuaaccaau

SEQ ID NO: 26815 - RNA, 20 nt, Artificial Sequence
  MKO10026815_A_Kazald1
  gRNA
cggccguccgaaccacagag

SEQ ID NO: 26816 - RNA, 20 nt, Artificial Sequence
  MKO10026816_A_Kazald1
  gRNA
cgcggcgcagcgcacucuuc

SEQ ID NO: 26817 - RNA, 20 nt, Artificial Sequence
  MKO10026817_A_Kazald1
  gRNA
accggacaggaugugaucuu

SEQ ID NO: 26818 - RNA, 20 nt, Artificial Sequence
  MKO10026818_A_Kazn
  gRNA
gacggugcucaauggcaacc

SEQ ID NO: 26819 - RNA, 20 nt, Artificial Sequence
  MKO10026819_A_Kazn
  gRNA
ucucgcccuuuaagcgcuuc

SEQ ID NO: 26820 - RNA, 20 nt, Artificial Sequence
  MKO10026820_A_Kazn
  gRNA
caacuaugagcagcaccgca

SEQ ID NO: 26821 - RNA, 20 nt, Artificial Sequence
  MKO10026821_A_Kbtbd11
  gRNA
cugcgcgagcccgccguauu

SEQ ID NO: 26822 - RNA, 20 nt, Artificial Sequence
  MKO10026822_A_Kbtbd11
  gRNA
uaccggccgcgcuugucugc

SEQ ID NO: 26823 - RNA, 20 nt, Artificial Sequence
  MKO10026823_A_Kbtbd11
  gRNA
agucgaccgcagagcccguc

SEQ ID NO: 26824 - RNA, 20 nt, Artificial Sequence
  MKO10026824_A_Kbtbd12
  gRNA
uuuauaccagcacuucgccg

SEQ ID NO: 26825 - RNA, 20 nt, Artificial Sequence
  MKO10026825_A_Kbtbd12
  gRNA
cauggcuacggucugaacgu

SEQ ID NO: 26826 - RNA, 20 nt, Artificial Sequence
  MKO10026826_A_Kbtbd12
  gRNA
ucuguccuccuaugacauag

SEQ ID NO: 26827 - RNA, 20 nt, Artificial Sequence
  MKO10026827_A_Kbtbd13
  gRNA
gccagcgccauaucauagcg

SEQ ID NO: 26828 - RNA, 20 nt, Artificial Sequence
  MKO10026828_A_Kbtbd13
  gRNA
ucaccaaccgcgcuaugaua

SEQ ID NO: 26829 - RNA, 20 nt, Artificial Sequence
  MKO10026829_A_Kbtbd13
  gRNA
cgcuguggagcacgucgcgc

SEQ ID NO: 26830 - RNA, 20 nt, Artificial Sequence
  MKO10026830_A_Kbtbd2
  gRNA
auaauagcuuacgcguacac

SEQ ID NO: 26831 - RNA, 20 nt, Artificial Sequence
  MKO10026831_A_Kbtbd2
  gRNA
guucacggcuguguaccgcc

SEQ ID NO: 26832 - RNA, 20 nt, Artificial Sequence
  MKO10026832_A_Kbtbd2
  gRNA
aaccacaacagacuuaucgu

SEQ ID NO: 26833 - RNA, 20 nt, Artificial Sequence
  MKO10026833_A_Kbtbd3
  gRNA
cccaugucaucguugugugu

SEQ ID NO: 26834 - RNA, 20 nt, Artificial Sequence
  MKO10026834_A_Kbtbd3
  gRNA
gccaacacacaacgaugaca

SEQ ID NO: 26835 - RNA, 20 nt, Artificial Sequence
  MKO10026835_A_Kbtbd3
  gRNA
cucaaucgauuauuuguuau

SEQ ID NO: 26836 - RNA, 20 nt, Artificial Sequence
  MKO10026836_A_Kbtbd4
  gRNA
gucaucccgcacgcacucau

SEQ ID NO: 26837 - RNA, 20 nt, Artificial Sequence
  MKO10026837_A_Kbtbd4
  gRNA
aguagauaacugcauucgag

SEQ ID NO: 26838 - RNA, 20 nt, Artificial Sequence
  MKO10026838_A_Kbtbd4
  gRNA
uucucgguuucuggcacgca

SEQ ID NO: 26839 - RNA, 20 nt, Artificial Sequence
  MKO10026839_A_Kbtbd7
  gRNA
cucuguuacgacccuuauuc

SEQ ID NO: 26840 - RNA, 20 nt, Artificial Sequence
  MKO10026840_A_Kbtbd7
  gRNA
agaccgcuugcugugucgag

SEQ ID NO: 26841 - RNA, 20 nt, Artificial Sequence
  MKO10026841_A_Kbtbd7
  gRNA
gcggauuaguaauaucccac

SEQ ID NO: 26842 - RNA, 20 nt, Artificial Sequence
  MKO10026842_A_Kbtbd8
  gRNA
ccuugucuagauaucgucac

SEQ ID NO: 26843 - RNA, 20 nt, Artificial Sequence
  MKO10026843_A_Kbtbd8
  gRNA
cgucgucauaccugaaguag

SEQ ID NO: 26844 - RNA, 20 nt, Artificial Sequence
  MKO10026844_A_Kbtbd8
  gRNA
acgccacccaccugccgacg

SEQ ID NO: 26845 - RNA, 20 nt, Artificial Sequence
  MKO10026845_A_Kcmf1
  gRNA
uugaguuacgaugaaucgag

SEQ ID NO: 26846 - RNA, 20 nt, Artificial Sequence
  MKO10026846_A_Kcmf1
  gRNA
auguuugaucuccgagcacg

SEQ ID NO: 26847 - RNA, 20 nt, Artificial Sequence
  MKO10026847_A_Kcmf1
  gRNA
cccauaugugcagcguuacc

SEQ ID NO: 26848 - RNA, 20 nt, Artificial Sequence
  MKO10026848_A_Kcna10
  gRNA
ucaucagcgaaaacaucgau

SEQ ID NO: 26849 - RNA, 20 nt, Artificial Sequence
  MKO10026849_A_Kcna10
  gRNA
gcgaggccauggaccaguuc

SEQ ID NO: 26850 - RNA, 20 nt, Artificial Sequence
  MKO10026850_A_Kcna10
  gRNA
uggaguccaccugcaucgug

SEQ ID NO: 26851 - RNA, 20 nt, Artificial Sequence
  MKO10026851_A_Kcna1
  gRNA
cuacgcgcucgcagcauucg

SEQ ID NO: 26852 - RNA, 20 nt, Artificial Sequence
  MKO10026852_A_Kcna1
  gRNA
gacgaggcuucgaccgcucc

SEQ ID NO: 26853 - RNA, 20 nt, Artificial Sequence
  MKO10026853_A_Kcna1
  gRNA
cgcguaguaaucaacaucuc

SEQ ID NO: 26854 - RNA, 20 nt, Artificial Sequence
  MKO10026854_A_Kcna2
  gRNA
uuagcugaguuucgaaccgc

SEQ ID NO: 26855 - RNA, 20 nt, Artificial Sequence
  MKO10026855_A_Kcna2
  gRNA
ucaggggaggacgggaucuu

SEQ ID NO: 26856 - RNA, 20 nt, Artificial Sequence
  MKO10026856_A_Kcna2
  gRNA
cauucuccgugucauccggu

SEQ ID NO: 26857 - RNA, 20 nt, Artificial Sequence
  MKO10026857_A_Kcna3
  gRNA
aaaguaccgcaugcgccgcu

SEQ ID NO: 26858 - RNA, 20 nt, Artificial Sequence
  MKO10026858_A_Kcna3
  gRNA
gcgaccccaagcggcgcaug

SEQ ID NO: 26859 - RNA, 20 nt, Artificial Sequence
  MKO10026859_A_Kcna3
  gRNA
cguugaccggccggcgaaug

SEQ ID NO: 26860 - RNA, 20 nt, Artificial Sequence
  MKO10026860_A_Kcna4
  gRNA
uucgucugguccgaguauuc

SEQ ID NO: 26861 - RNA, 20 nt, Artificial Sequence
  MKO10026861_A_Kcna4
  gRNA
aaugguuaagacacccgcaa

SEQ ID NO: 26862 - RNA, 20 nt, Artificial Sequence
  MKO10026862_A_Kcna4
  gRNA
agcccugcucaaguuccggg

SEQ ID NO: 26863 - RNA, 20 nt, Artificial Sequence
  MKO10026863_A_Kcna5
  gRNA
gcgcgccacacacgaggaug

SEQ ID NO: 26864 - RNA, 20 nt, Artificial Sequence
  MKO10026864_A_Kcna5
  gRNA
aaguagcgcaggcguuugac

SEQ ID NO: 26865 - RNA, 20 nt, Artificial Sequence
  MKO10026865_A_Kcna5
  gRNA
aaugaccaagaccgacacga

SEQ ID NO: 26866 - RNA, 20 nt, Artificial Sequence
  MKO10026866_A_Kcna6
  gRNA
ccggcguucccgugaagccu

SEQ ID NO: 26867 - RNA, 20 nt, Artificial Sequence
  MKO10026867_A_Kcna6
  gRNA
cggcgccgggggagguccgu

SEQ ID NO: 26868 - RNA, 20 nt, Artificial Sequence
  MKO10026868_A_Kcna6
  gRNA
aucggagaaaucccugacgc

SEQ ID NO: 26869 - RNA, 20 nt, Artificial Sequence
  MKO10026869_A_Kcna7
  gRNA
cgccgcagccgcuucuacga

SEQ ID NO: 26870 - RNA, 20 nt, Artificial Sequence
  MKO10026870_A_Kcna7
  gRNA
ggacauggcacccgucaccg

SEQ ID NO: 26871 - RNA, 20 nt, Artificial Sequence
  MKO10026871_A_Kcna7
  gRNA
ccgcgacgaccgcgaugacc

SEQ ID NO: 26872 - RNA, 20 nt, Artificial Sequence
  MKO10026872_A_Kcnab1
  gRNA
augacaauugccuacgaaag

SEQ ID NO: 26873 - RNA, 20 nt, Artificial Sequence
  MKO10026873_A_Kcnab1
  gRNA
gagauuaacuccacuuucgu

SEQ ID NO: 26874 - RNA, 20 nt, Artificial Sequence
  MKO10026874_A_Kcnab1
  gRNA
cuucagggcugaggugauuc

SEQ ID NO: 26875 - RNA, 20 nt, Artificial Sequence
  MKO10026875_A_Kcnab2
  gRNA
agaccuccgccguaucgaac

SEQ ID NO: 26876 - RNA, 20 nt, Artificial Sequence
  MKO10026876_A_Kcnab2
  gRNA
gcucccccgggaugaucuac

SEQ ID NO: 26877 - RNA, 20 nt, Artificial Sequence
  MKO10026877_A_Kcnab2
  gRNA
cgugguugauuccggauaca

SEQ ID NO: 26878 - RNA, 20 nt, Artificial Sequence
  MKO10026878_A_Kcnab3
  gRNA
ugacacugcugaaguguacg

SEQ ID NO: 26879 - RNA, 20 nt, Artificial Sequence
  MKO10026879_A_Kcnab3
  gRNA
gcagguaccugggucacguu

SEQ ID NO: 26880 - RNA, 20 nt, Artificial Sequence
  MKO10026880_A_Kcnab3
  gRNA
cgugcucauaggcaacuguc

SEQ ID NO: 26881 - RNA, 20 nt, Artificial Sequence
  MKO10026881_A_Kcnb1
  gRNA
ugcucuggccgaauucgucc

SEQ ID NO: 26882 - RNA, 20 nt, Artificial Sequence
  MKO10026882_A_Kcnb1
  gRNA
cuuggcggccaccgaugagu

SEQ ID NO: 26883 - RNA, 20 nt, Artificial Sequence
  MKO10026883_A_Kcnb1
  gRNA
gcgccucaacgucgggggcc

SEQ ID NO: 26884 - RNA, 20 nt, Artificial Sequence
  MKO10026884_A_Kcnb2
  gRNA
guuccagaauguuagacgag

SEQ ID NO: 26885 - RNA, 20 nt, Artificial Sequence
  MKO10026885_A_Kcnb2
  gRNA
auaaccgugaaccucgaugc

SEQ ID NO: 26886 - RNA, 20 nt, Artificial Sequence
  MKO10026886_A_Kcnb2
  gRNA
uguagucaucgcacaccucc

SEQ ID NO: 26887 - RNA, 20 nt, Artificial Sequence
  MKO10026887_A_Kcnc1
  gRNA
agucacuuacccgcgcguag

SEQ ID NO: 26888 - RNA, 20 nt, Artificial Sequence
  MKO10026888_A_Kcnc1
  gRNA
ccuacucaucccgcuacgcg

SEQ ID NO: 26889 - RNA, 20 nt, Artificial Sequence
  MKO10026889_A_Kcnc1
  gRNA
ccaugaucuacuacgccgag

SEQ ID NO: 26890 - RNA, 20 nt, Artificial Sequence
  MKO10026890_A_Kcnc2
  gRNA
gauccguuucgauuucguac

SEQ ID NO: 26891 - RNA, 20 nt, Artificial Sequence
  MKO10026891_A_Kcnc2
  gRNA
guacauauccccguaaccua

SEQ ID NO: 26892 - RNA, 20 nt, Artificial Sequence
  MKO10026892_A_Kcnc2
  gRNA
aacggcggcagcgaccaccc

SEQ ID NO: 26893 - RNA, 20 nt, Artificial Sequence
  MKO10026893_A_Kcnc3
  gRNA
cgcgcgcuuugacuacgacc

SEQ ID NO: 26894 - RNA, 20 nt, Artificial Sequence
  MKO10026894_A_Kcnc3
  gRNA
ggcgcagggacaccccgcuc

SEQ ID NO: 26895 - RNA, 20 nt, Artificial Sequence
  MKO10026895_A_Kcnc3
  gRNA
ccugaacaucaucgacugcg

SEQ ID NO: 26896 - RNA, 20 nt, Artificial Sequence
  MKO10026896_A_Kcnc4
  gRNA
aucuauuaugccgagcgaau

SEQ ID NO: 26897 - RNA, 20 nt, Artificial Sequence
  MKO10026897_A_Kcnc4
  gRNA
cccgcgugccugagcgucuc

SEQ ID NO: 26898 - RNA, 20 nt, Artificial Sequence
  MKO10026898_A_Kcnc4
  gRNA
cggcgggggucggccagagu

SEQ ID NO: 26899 - RNA, 20 nt, Artificial Sequence
  MKO10026899_A_Kcnd1
  gRNA
ugguaccacucuuugccaaa

SEQ ID NO: 26900 - RNA, 20 nt, Artificial Sequence
  MKO10026900_A_Kcnd1
  gRNA
acggacaaaugcugugcguu

SEQ ID NO: 26901 - RNA, 20 nt, Artificial Sequence
  MKO10026901_A_Kcnd1
  gRNA
auauaguuaccugcugugcc

SEQ ID NO: 26902 - RNA, 20 nt, Artificial Sequence
  MKO10026902_A_Kcnd2
  gRNA
cccuucguuugucugcucgu

SEQ ID NO: 26903 - RNA, 20 nt, Artificial Sequence
  MKO10026903_A_Kcnd2
  gRNA
cucacccagguauggcgaca

SEQ ID NO: 26904 - RNA, 20 nt, Artificial Sequence
  MKO10026904_A_Kcnd2
  gRNA
gugacuugaugggcgauuga

SEQ ID NO: 26905 - RNA, 20 nt, Artificial Sequence
  MKO10026905_A_Kcnd3
  gRNA
accgucguccacuuacguug

SEQ ID NO: 26906 - RNA, 20 nt, Artificial Sequence
  MKO10026906_A_Kcnd3
  gRNA
cugaucguccucaacguaag

SEQ ID NO: 26907 - RNA, 20 nt, Artificial Sequence
  MKO10026907_A_Kcnd3
  gRNA
ccacccggauccuggcaagg

SEQ ID NO: 26908 - RNA, 20 nt, Artificial Sequence
  MKO10026908_A_Kcne1l
  gRNA
gucgccucgcggcccacgaa

SEQ ID NO: 26909 - RNA, 20 nt, Artificial Sequence
  MKO10026909_A_Kcne1l
  gRNA
ccgcucccgcaagcucgucg

SEQ ID NO: 26910 - RNA, 20 nt, Artificial Sequence
  MKO10026910_A_Kcne1l
  gRNA
ggucgucccugacccuuucg

SEQ ID NO: 26911 - RNA, 20 nt, Artificial Sequence
  MKO10026911_A_Kcne1
  gRNA
caggcugcucuacggccgcc

SEQ ID NO: 26912 - RNA, 20 nt, Artificial Sequence
  MKO10026912_A_Kcne1
  gRNA
gacucgauguacacguugaa

SEQ ID NO: 26913 - RNA, 20 nt, Artificial Sequence
  MKO10026913_A_Kcne1
  gRNA
gggugugggguucacgacaa

SEQ ID NO: 26914 - RNA, 20 nt, Artificial Sequence
  MKO10026914_A_Kcne2
  gRNA
gccaaucuuccacgauguac

SEQ ID NO: 26915 - RNA, 20 nt, Artificial Sequence
  MKO10026915_A_Kcne2
  gRNA
cccguaccaccaguacaucg

SEQ ID NO: 26916 - RNA, 20 nt, Artificial Sequence
  MKO10026916_A_Kcne2
  gRNA
cuacgucauccuguaccuca

SEQ ID NO: 26917 - RNA, 20 nt, Artificial Sequence
  MKO10026917_A_Kcne3
  gRNA
auauacccguucacgcaaag

SEQ ID NO: 26918 - RNA, 20 nt, Artificial Sequence
  MKO10026918_A_Kcne3
  gRNA
guuuguccacuuugcgugaa

SEQ ID NO: 26919 - RNA, 20 nt, Artificial Sequence
  MKO10026919_A_Kcne3
  gRNA
guuccuauuugccgucacug

SEQ ID NO: 26920 - RNA, 20 nt, Artificial Sequence
  MKO10026920_A_Kcne4
  gRNA
aagccgcuaccuaugauguc

SEQ ID NO: 26921 - RNA, 20 nt, Artificial Sequence
  MKO10026921_A_Kcne4
  gRNA
agcccagcaugauuccgauc

SEQ ID NO: 26922 - RNA, 20 nt, Artificial Sequence
  MKO10026922_A_Kcne4
  gRNA
guccugcacucuuugcucga

SEQ ID NO: 26923 - RNA, 20 nt, Artificial Sequence
  MKO10026923_A_Kcnf1
  gRNA
ucugugcgacgauuacgauc

SEQ ID NO: 26924 - RNA, 20 nt, Artificial Sequence
  MKO10026924_A_Kcnf1
  gRNA
caucgcacgcaucuucaaac

SEQ ID NO: 26925 - RNA, 20 nt, Artificial Sequence
  MKO10026925_A_Kcnf1
  gRNA
aaguagaauucgcgcuugcc

SEQ ID NO: 26926 - RNA, 20 nt, Artificial Sequence
  MKO10026926_A_Kcng1
  gRNA
cguccugcggccgcaaucgu

SEQ ID NO: 26927 - RNA, 20 nt, Artificial Sequence
  MKO10026927_A_Kcng1
  gRNA
cggcgcugcacgcgugaauu

SEQ ID NO: 26928 - RNA, 20 nt, Artificial Sequence
  MKO10026928_A_Kcng1
  gRNA
uguugccggugcucggcuug

SEQ ID NO: 26929 - RNA, 20 nt, Artificial Sequence
  MKO10026929_A_Kcng2
  gRNA
ccccgacguugauaaugacg

SEQ ID NO: 26930 - RNA, 20 nt, Artificial Sequence
  MKO10026930_A_Kcng2
  gRNA
gugcgcuuuccgcgccaucg

SEQ ID NO: 26931 - RNA, 20 nt, Artificial Sequence
  MKO10026931_A_Kcng2
  gRNA
cuucgcgccgcucgugcacc

SEQ ID NO: 26932 - RNA, 20 nt, Artificial Sequence
  MKO10026932_A_Kcng3
  gRNA
ugucggacaugcggucgucu

SEQ ID NO: 26933 - RNA, 20 nt, Artificial Sequence
  MKO10026933_A_Kcng3
  gRNA
gcgcaugcggcggaccuucg

SEQ ID NO: 26934 - RNA, 20 nt, Artificial Sequence
  MKO10026934_A_Kcng3
  gRNA
gaaccgcacgaugcacuccg

SEQ ID NO: 26935 - RNA, 20 nt, Artificial Sequence
  MKO10026935_A_Kcng4
  gRNA
cucccguucgcuggccgaau

SEQ ID NO: 26936 - RNA, 20 nt, Artificial Sequence
  MKO10026936_A_Kcng4
  gRNA
ccugagugacguagaugauc

SEQ ID NO: 26937 - RNA, 20 nt, Artificial Sequence
  MKO10026937_A_Kcng4
  gRNA
gcucugcgaugacuacgaug

SEQ ID NO: 26938 - RNA, 20 nt, Artificial Sequence
  MKO10026938_A_Kcnh1
  gRNA
aacaucgugcggcgguccaa

SEQ ID NO: 26939 - RNA, 20 nt, Artificial Sequence
  MKO10026939_A_Kcnh1
  gRNA
ggaaugcccagauagucgac

SEQ ID NO: 26940 - RNA, 20 nt, Artificial Sequence
  MKO10026940_A_Kcnh1
  gRNA
uugugaagaucgcuccgauc

SEQ ID NO: 26941 - RNA, 20 nt, Artificial Sequence
  MKO10026941_A_Kcnh2
  gRNA
cgugcgccgcgcaucauccg

SEQ ID NO: 26942 - RNA, 20 nt, Artificial Sequence
  MKO10026942_A_Kcnh2
  gRNA
ugccgccgcgcagaucgcgc

SEQ ID NO: 26943 - RNA, 20 nt, Artificial Sequence
  MKO10026943_A_Kcnh2
  gRNA
gcgcgaucugcgcggcggca

SEQ ID NO: 26944 - RNA, 20 nt, Artificial Sequence
  MKO10026944_A_Kcnh3
  gRNA
uggauccggcccgaccauau

SEQ ID NO: 26945 - RNA, 20 nt, Artificial Sequence
  MKO10026945_A_Kcnh3
  gRNA
ggcgguggccggcgccgaua

SEQ ID NO: 26946 - RNA, 20 nt, Artificial Sequence
  MKO10026946_A_Kcnh3
  gRNA
ccuuaccacucuuccgguac

SEQ ID NO: 26947 - RNA, 20 nt, Artificial Sequence
  MKO10026947_A_Kcnh4
  gRNA
agugaccgcgacguagaaug

SEQ ID NO: 26948 - RNA, 20 nt, Artificial Sequence
  MKO10026948_A_Kcnh4
  gRNA
gaccaaaguggccagucaac

SEQ ID NO: 26949 - RNA, 20 nt, Artificial Sequence
  MKO10026949_A_Kcnh4
  gRNA
ugacuggccacuuuggucgc

SEQ ID NO: 26950 - RNA, 20 nt, Artificial Sequence
  MKO10026950_A_Kcnh5
  gRNA
cgaaguuugcccgauugaca

SEQ ID NO: 26951 - RNA, 20 nt, Artificial Sequence
  MKO10026951_A_Kcnh5
  gRNA
uucguugagucauccucuau

SEQ ID NO: 26952 - RNA, 20 nt, Artificial Sequence
  MKO10026952_A_Kcnh5
  gRNA
ccccuacagguaccccuguu

SEQ ID NO: 26953 - RNA, 20 nt, Artificial Sequence
  MKO10026953_A_Kcnh6
  gRNA
acucuucggcuacucccgug

SEQ ID NO: 26954 - RNA, 20 nt, Artificial Sequence
  MKO10026954_A_Kcnh6
  gRNA
caccauccuugcgauaguag

SEQ ID NO: 26955 - RNA, 20 nt, Artificial Sequence
  MKO10026955_A_Kcnh6
  gRNA
cucgucauuaguguugacgu

SEQ ID NO: 26956 - RNA, 20 nt, Artificial Sequence
  MKO10026956_A_Kcnh7
  gRNA
augcccuccguaugcuacag

SEQ ID NO: 26957 - RNA, 20 nt, Artificial Sequence
  MKO10026957_A_Kcnh7
  gRNA
aauaucggguugacccucuc

SEQ ID NO: 26958 - RNA, 20 nt, Artificial Sequence
  MKO10026958_A_Kcnh7
  gRNA
ucucccuuagugaacauauc

SEQ ID NO: 26959 - RNA, 20 nt, Artificial Sequence
  MKO10026959_A_Kcnh8
  gRNA
gacuucaguucgugcaaacc

SEQ ID NO: 26960 - RNA, 20 nt, Artificial Sequence
  MKO10026960_A_Kcnh8
  gRNA
gucuccgggcugagucaaag

SEQ ID NO: 26961 - RNA, 20 nt, Artificial Sequence
  MKO10026961_A_Kcnh8
  gRNA
acugaccguugugcuccgag

SEQ ID NO: 26962 - RNA, 20 nt, Artificial Sequence
  MKO10026962_A_Kcnip1
  gRNA
gagaacugcaagucuuguac

SEQ ID NO: 26963 - RNA, 20 nt, Artificial Sequence
  MKO10026963_A_Kcnip1
  gRNA
gccuucgacaccacccagac

SEQ ID NO: 26964 - RNA, 20 nt, Artificial Sequence
  MKO10026964_A_Kcnip1
  gRNA
cgcugccaugggggccguca

SEQ ID NO: 26965 - RNA, 20 nt, Artificial Sequence
  MKO10026965_A_Kcnip2
  gRNA
gccguccaaaucucgggauu

SEQ ID NO: 26966 - RNA, 20 nt, Artificial Sequence
  MKO10026966_A_Kcnip2
  gRNA
uuuguccgaaucccgagauu

SEQ ID NO: 26967 - RNA, 20 nt, Artificial Sequence
  MKO10026967_A_Kcnip2
  gRNA
aacuauccacggugugccac

SEQ ID NO: 26968 - RNA, 20 nt, Artificial Sequence
  MKO10026968_A_Kcnip3
  gRNA
cucuggcugauggcgcaccg

SEQ ID NO: 26969 - RNA, 20 nt, Artificial Sequence
  MKO10026969_A_Kcnip3
  gRNA
cauggaccgucccucgaagc

SEQ ID NO: 26970 - RNA, 20 nt, Artificial Sequence
  MKO10026970_A_Kcnip3
  gRNA
cccguucccaucagcaucga

SEQ ID NO: 26971 - RNA, 20 nt, Artificial Sequence
  MKO10026971_A_Kcnip4
  gRNA
ucucuucaaugcauucgaca

SEQ ID NO: 26972 - RNA, 20 nt, Artificial Sequence
  MKO10026972_A_Kcnip4
  gRNA
uacugucccucgaagcaaaa

SEQ ID NO: 26973 - RNA, 20 nt, Artificial Sequence
  MKO10026973_A_Kcnip4
  gRNA
agauggcuacugucaggcau

SEQ ID NO: 26974 - RNA, 20 nt, Artificial Sequence
  MKO10026974_A_Kcnj10
  gRNA
gcagaugacgucggucgcua

SEQ ID NO: 26975 - RNA, 20 nt, Artificial Sequence
  MKO10026975_A_Kcnj10
  gRNA
cauagcguacggugcuaucg

SEQ ID NO: 26976 - RNA, 20 nt, Artificial Sequence
  MKO10026976_A_Kcnj10
  gRNA
cguauuccuggggccacuag

SEQ ID NO: 26977 - RNA, 20 nt, Artificial Sequence
  MKO10026977_A_Kcnj11
  gRNA
cccgcgacgaggcgaggguc

SEQ ID NO: 26978 - RNA, 20 nt, Artificial Sequence
  MKO10026978_A_Kcnj11
  gRNA
caugcgcccgccgaaaccaa

SEQ ID NO: 26979 - RNA, 20 nt, Artificial Sequence
  MKO10026979_A_Kcnj11
  gRNA
caacagcccgcucuacgacc

SEQ ID NO: 26980 - RNA, 20 nt, Artificial Sequence
  MKO10026980_A_Kcnj12
  gRNA
aaucuccgacucccgucugu

SEQ ID NO: 26981 - RNA, 20 nt, Artificial Sequence
  MKO10026981_A_Kcnj12
  gRNA
agguugggguacucagacgc

SEQ ID NO: 26982 - RNA, 20 nt, Artificial Sequence
  MKO10026982_A_Kcnj12
  gRNA
agccgacaucgaugucaauc

SEQ ID NO: 26983 - RNA, 20 nt, Artificial Sequence
  MKO10026983_A_Kcnj13
  gRNA
agcgccagcgcauguccauu

SEQ ID NO: 26984 - RNA, 20 nt, Artificial Sequence
  MKO10026984_A_Kcnj13
  gRNA
gaauccuaauggacaugcgc

SEQ ID NO: 26985 - RNA, 20 nt, Artificial Sequence
  MKO10026985_A_Kcnj13
  gRNA
ccgugcaaucuucgccacaa

SEQ ID NO: 26986 - RNA, 20 nt, Artificial Sequence
  MKO10026986_A_Kcnj14
  gRNA
uccccagcucgacuguuucc

SEQ ID NO: 26987 - RNA, 20 nt, Artificial Sequence
  MKO10026987_A_Kcnj14
  gRNA
cggcucccagcuaccggucc

SEQ ID NO: 26988 - RNA, 20 nt, Artificial Sequence
  MKO10026988_A_Kcnj14
  gRNA
ccucauauguucgauggaag

SEQ ID NO: 26989 - RNA, 20 nt, Artificial Sequence
  MKO10026989_A_Kcnj15
  gRNA
ucgccacuucaugucgauga

SEQ ID NO: 26990 - RNA, 20 nt, Artificial Sequence
  MKO10026990_A_Kcnj15
  gRNA
ggccuugaguccaaccccgu

SEQ ID NO: 26991 - RNA, 20 nt, Artificial Sequence
  MKO10026991_A_Kcnj15
  gRNA
agcagagccccaugguagcc

SEQ ID NO: 26992 - RNA, 20 nt, Artificial Sequence
  MKO10026992_A_Kcnj16
  gRNA
guccuucagcgcaguugccg

SEQ ID NO: 26993 - RNA, 20 nt, Artificial Sequence
  MKO10026993_A_Kcnj16
  gRNA
acagcgguaaccguauccaa

SEQ ID NO: 26994 - RNA, 20 nt, Artificial Sequence
  MKO10026994_A_Kcnj16
  gRNA
uugcggucaagggcauacag

SEQ ID NO: 26995 - RNA, 20 nt, Artificial Sequence
  MKO10026995_A_Kcnj1
  gRNA
cauaggcuacgacauaccac

SEQ ID NO: 26996 - RNA, 20 nt, Artificial Sequence
  MKO10026996_A_Kcnj1
  gRNA
aaaccugaauccguaaccua

SEQ ID NO: 26997 - RNA, 20 nt, Artificial Sequence
  MKO10026997_A_Kcnj1
  gRNA
ccagcauggaugcuucagau

SEQ ID NO: 26998 - RNA, 20 nt, Artificial Sequence
  MKO10026998_A_Kcnj2
  gRNA
uaucuccgauucucgccuua

SEQ ID NO: 26999 - RNA, 20 nt, Artificial Sequence
  MKO10026999_A_Kcnj2
  gRNA
uauuucgugaacgauaguga

SEQ ID NO: 27000 - RNA, 20 nt, Artificial Sequence
  MKO10027000_A_Kcnj2
  gRNA
ccgcuacagcaucgucucuu

SEQ ID NO: 27001 - RNA, 20 nt, Artificial Sequence
  MKO10027001_A_Kcnj3
  gRNA
gcccgaaccgcucgacgaag

SEQ ID NO: 27002 - RNA, 20 nt, Artificial Sequence
  MKO10027002_A_Kcnj3
  gRNA
auaagcgaucacccaccaca

SEQ ID NO: 27003 - RNA, 20 nt, Artificial Sequence
  MKO10027003_A_Kcnj3
  gRNA
guucaguuugcaugcuucgc

SEQ ID NO: 27004 - RNA, 20 nt, Artificial Sequence
  MKO10027004_A_Kcnj4
  gRNA
accaccgcaaugaccgccaa

SEQ ID NO: 27005 - RNA, 20 nt, Artificial Sequence
  MKO10027005_A_Kcnj4
  gRNA
cccuguaucaugcacguaaa

SEQ ID NO: 27006 - RNA, 20 nt, Artificial Sequence
  MKO10027006_A_Kcnj4
  gRNA
cauagugcaugaaaucgacg

SEQ ID NO: 27007 - RNA, 20 nt, Artificial Sequence
  MKO10027007_A_Kcnj5
  gRNA
agcgccauuugagguccacc

SEQ ID NO: 27008 - RNA, 20 nt, Artificial Sequence
  MKO10027008_A_Kcnj5
  gRNA
gaagccacgccagcgcuaca

SEQ ID NO: 27009 - RNA, 20 nt, Artificial Sequence
  MKO10027009_A_Kcnj5
  gRNA
ccauguaagagcuccgugcu

SEQ ID NO: 27010 - RNA, 20 nt, Artificial Sequence
  MKO10027010_A_Kcnj6
  gRNA
acgucucccgcacauugccg

SEQ ID NO: 27011 - RNA, 20 nt, Artificial Sequence
  MKO10027011_A_Kcnj6
  gRNA
gacccgguagccauaaccga

SEQ ID NO: 27012 - RNA, 20 nt, Artificial Sequence
  MKO10027012_A_Kcnj6
  gRNA
agccagcuccgcuagcucuu

SEQ ID NO: 27013 - RNA, 20 nt, Artificial Sequence
  MKO10027013_A_Kcnj8
  gRNA
gaccaccuggaugcgcaccg

SEQ ID NO: 27014 - RNA, 20 nt, Artificial Sequence
  MKO10027014_A_Kcnj8
  gRNA
gcugugauugccguccgcaa

SEQ ID NO: 27015 - RNA, 20 nt, Artificial Sequence
  MKO10027015_A_Kcnj8
  gRNA
gggagacggucgcggaugcg

SEQ ID NO: 27016 - RNA, 20 nt, Artificial Sequence
  MKO10027016_A_Kcnj9
  gRNA
ucucgaagucgucccucucg

SEQ ID NO: 27017 - RNA, 20 nt, Artificial Sequence
  MKO10027017_A_Kcnj9
  gRNA
gcgauccucgcacaucgucg

SEQ ID NO: 27018 - RNA, 20 nt, Artificial Sequence
  MKO10027018_A_Kcnj9
  gRNA
ugagcaccgaugugaaccgg

SEQ ID NO: 27019 - RNA, 20 nt, Artificial Sequence
  MKO10027019_A_Kcnk10
  gRNA
aacagggugaugcccguuag

SEQ ID NO: 27020 - RNA, 20 nt, Artificial Sequence
  MKO10027020_A_Kcnk10
  gRNA
gucguggucuaccucgucac

SEQ ID NO: 27021 - RNA, 20 nt, Artificial Sequence
  MKO10027021_A_Kcnk10
  gRNA
ugcacucgaugcugauaacg

SEQ ID NO: 27022 - RNA, 20 nt, Artificial Sequence
  MKO10027022_A_Kcnk12
  gRNA
guacauggccgaggcgcaac

SEQ ID NO: 27023 - RNA, 20 nt, Artificial Sequence
  MKO10027023_A_Kcnk12
  gRNA
guguugacgcacacgcugcg

SEQ ID NO: 27024 - RNA, 20 nt, Artificial Sequence
  MKO10027024_A_Kcnk12
  gRNA
cgcaacuucagcgcugcgca

SEQ ID NO: 27025 - RNA, 20 nt, Artificial Sequence
  MKO10027025_A_Kcnk13
  gRNA
agcgcgcguuguccucguuc

SEQ ID NO: 27026 - RNA, 20 nt, Artificial Sequence
  MKO10027026_A_Kcnk13
  gRNA
cgcccgugaagucccagcga

SEQ ID NO: 27027 - RNA, 20 nt, Artificial Sequence
  MKO10027027_A_Kcnk13
  gRNA
ugccggguaacauccggaac

SEQ ID NO: 27028 - RNA, 20 nt, Artificial Sequence
  MKO10027028_A_Kcnk15
  gRNA
cgccgacgacuaccgcgagc

SEQ ID NO: 27029 - RNA, 20 nt, Artificial Sequence
  MKO10027029_A_Kcnk15
  gRNA
aggguauggucaugccgcgc

SEQ ID NO: 27030 - RNA, 20 nt, Artificial Sequence
  MKO10027030_A_Kcnk15
  gRNA
cggcgguggacugcgcguuc

SEQ ID NO: 27031 - RNA, 20 nt, Artificial Sequence
  MKO10027031_A_Kcnk16
  gRNA
agcauuacaucgcuguguau

SEQ ID NO: 27032 - RNA, 20 nt, Artificial Sequence
  MKO10027032_A_Kcnk16
  gRNA
gcagcuauauggauccuccu

SEQ ID NO: 27033 - RNA, 20 nt, Artificial Sequence
  MKO10027033_A_Kcnk16
  gRNA
gcgggcccaccugaccacau

SEQ ID NO: 27034 - RNA, 20 nt, Artificial Sequence
  MKO10027034_A_Kcnk18
  gRNA
acaaccacccacgcgucccg

SEQ ID NO: 27035 - RNA, 20 nt, Artificial Sequence
  MKO10027035_A_Kcnk18
  gRNA
cuuugcauacaucuccugcg

SEQ ID NO: 27036 - RNA, 20 nt, Artificial Sequence
  MKO10027036_A_Kcnk18
  gRNA
ugcucucuucuccgcugucg

SEQ ID NO: 27037 - RNA, 20 nt, Artificial Sequence
  MKO10027037_A_Kcnk1
  gRNA
agaccacggcgccgaacacc

SEQ ID NO: 27038 - RNA, 20 nt, Artificial Sequence
  MKO10027038_A_Kcnk1
  gRNA
cgccguggucuucucguccg

SEQ ID NO: 27039 - RNA, 20 nt, Artificial Sequence
  MKO10027039_A_Kcnk1
  gRNA
caucugacaggggcaccgug

SEQ ID NO: 27040 - RNA, 20 nt, Artificial Sequence
  MKO10027040_A_Kcnk2
  gRNA
auaguggcagcaauaaacgc

SEQ ID NO: 27041 - RNA, 20 nt, Artificial Sequence
  MKO10027041_A_Kcnk2
  gRNA
augugcuugaauaugaccgc

SEQ ID NO: 27042 - RNA, 20 nt, Artificial Sequence
  MKO10027042_A_Kcnk2
  gRNA
ccacaaaauagauagcgucc

SEQ ID NO: 27043 - RNA, 20 nt, Artificial Sequence
  MKO10027043_A_Kcnk3
  gRNA
cgcaucacgcuucucguccu

SEQ ID NO: 27044 - RNA, 20 nt, Artificial Sequence
  MKO10027044_A_Kcnk3
  gRNA
cgccgcgguguucgacgcac

SEQ ID NO: 27045 - RNA, 20 nt, Artificial Sequence
  MKO10027045_A_Kcnk3
  gRNA
cacagccacucgucgccggg

SEQ ID NO: 27046 - RNA, 20 nt, Artificial Sequence
  MKO10027046_A_Kcnk4
  gRNA
gaaauaccucugcccgaguu

SEQ ID NO: 27047 - RNA, 20 nt, Artificial Sequence
  MKO10027047_A_Kcnk4
  gRNA
gagcagugucccgccgaacu

SEQ ID NO: 27048 - RNA, 20 nt, Artificial Sequence
  MKO10027048_A_Kcnk4
  gRNA
cccaccgaugguagugauga

SEQ ID NO: 27049 - RNA, 20 nt, Artificial Sequence
  MKO10027049_A_Kcnk5
  gRNA
uagggcgugguaguuggcac

SEQ ID NO: 27050 - RNA, 20 nt, Artificial Sequence
  MKO10027050_A_Kcnk5
  gRNA
aagguggacucaucggauga

SEQ ID NO: 27051 - RNA, 20 nt, Artificial Sequence
  MKO10027051_A_Kcnk5
  gRNA
guacagccaucuucaucgug

SEQ ID NO: 27052 - RNA, 20 nt, Artificial Sequence
  MKO10027052_A_Kcnk6
  gRNA
uggagcggccucacgaagcc

SEQ ID NO: 27053 - RNA, 20 nt, Artificial Sequence
  MKO10027053_A_Kcnk6
  gRNA
ccaacgcuucggacccugcg

SEQ ID NO: 27054 - RNA, 20 nt, Artificial Sequence
  MKO10027054_A_Kcnk6
  gRNA
acucaucuugcugcccgauc

SEQ ID NO: 27055 - RNA, 20 nt, Artificial Sequence
  MKO10027055_A_Kcnk7
  gRNA
ggaagucagcucgaucgugu

SEQ ID NO: 27056 - RNA, 20 nt, Artificial Sequence
  MKO10027056_A_Kcnk7
  gRNA
ucacucagcacgaucggccu

SEQ ID NO: 27057 - RNA, 20 nt, Artificial Sequence
  MKO10027057_A_Kcnk7
  gRNA
cugggugcaggccacgucca

SEQ ID NO: 27058 - RNA, 20 nt, Artificial Sequence
  MKO10027058_A_Kcnk9
  gRNA
aaacgguguggacgguagcc

SEQ ID NO: 27059 - RNA, 20 nt, Artificial Sequence
  MKO10027059_A_Kcnk9
  gRNA
acgcacguucugccgcuuca

SEQ ID NO: 27060 - RNA, 20 nt, Artificial Sequence
  MKO10027060_A_Kcnk9
  gRNA
gugcgccucagagacgcaag

SEQ ID NO: 27061 - RNA, 20 nt, Artificial Sequence
  MKO10027061_A_Kcnma1
  gRNA
cucguggaccgaggacgagg

SEQ ID NO: 27062 - RNA, 20 nt, Artificial Sequence
  MKO10027062_A_Kcnma1
  gRNA
gauggaugcgcucaucauac

SEQ ID NO: 27063 - RNA, 20 nt, Artificial Sequence
  MKO10027063_A_Kcnma1
  gRNA
agaugucauccagccgaccu

SEQ ID NO: 27064 - RNA, 20 nt, Artificial Sequence
  MKO10027064_A_Kcnmb1
  gRNA
gucguguaccagcgccucua

SEQ ID NO: 27065 - RNA, 20 nt, Artificial Sequence
  MKO10027065_A_Kcnmb1
  gRNA
aguuguacccaggacguagu

SEQ ID NO: 27066 - RNA, 20 nt, Artificial Sequence
  MKO10027066_A_Kcnmb1
  gRNA
cucgugucucuccgcgcuuc

SEQ ID NO: 27067 - RNA, 20 nt, Artificial Sequence
  MKO10027067_A_Kcnmb2
  gRNA
gucucucgugagugucguca

SEQ ID NO: 27068 - RNA, 20 nt, Artificial Sequence
  MKO10027068_A_Kcnmb2
  gRNA
gccucuccccggaagauguc

SEQ ID NO: 27069 - RNA, 20 nt, Artificial Sequence
  MKO10027069_A_Kcnmb2
  gRNA
gacgacacucacgagagaca

SEQ ID NO: 27070 - RNA, 20 nt, Artificial Sequence
  MKO10027070_A_Kcnmb3
  gRNA
gcuucuccacuacgacgacg

SEQ ID NO: 27071 - RNA, 20 nt, Artificial Sequence
  MKO10027071_A_Kcnmb3
  gRNA
cccuguuucuacagucccga

SEQ ID NO: 27072 - RNA, 20 nt, Artificial Sequence
  MKO10027072_A_Kcnmb3
  gRNA
guucguaaaccugagccacu

SEQ ID NO: 27073 - RNA, 20 nt, Artificial Sequence
  MKO10027073_A_Kcnmb4
  gRNA
ucucgucgugugugcgcugu

SEQ ID NO: 27074 - RNA, 20 nt, Artificial Sequence
  MKO10027074_A_Kcnmb4
  gRNA
cucgcaguaucccugcgucc

SEQ ID NO: 27075 - RNA, 20 nt, Artificial Sequence
  MKO10027075_A_Kcnmb4
  gRNA
cggaguuguucacguacacc

SEQ ID NO: 27076 - RNA, 20 nt, Artificial Sequence
  MKO10027076_A_Kcnn1
  gRNA
aaccagguaccacgauaagc

SEQ ID NO: 27077 - RNA, 20 nt, Artificial Sequence
  MKO10027077_A_Kcnn1
  gRNA
ccguccacgugaagcgauag

SEQ ID NO: 27078 - RNA, 20 nt, Artificial Sequence
  MKO10027078_A_Kcnn1
  gRNA
cgaccaacuccagcgagauc

SEQ ID NO: 27079 - RNA, 20 nt, Artificial Sequence
  MKO10027079_A_Kcnn2
  gRNA
ugaucaucguguaccacgcc

SEQ ID NO: 27080 - RNA, 20 nt, Artificial Sequence
  MKO10027080_A_Kcnn2
  gRNA
ggacuguccgagcuugugaa

SEQ ID NO: 27081 - RNA, 20 nt, Artificial Sequence
  MKO10027081_A_Kcnn2
  gRNA
acuuuaaugacuaucugccc

SEQ ID NO: 27082 - RNA, 20 nt, Artificial Sequence
  MKO10027082_A_Kcnn3
  gRNA
ugcgccuguaccugaucgcc

SEQ ID NO: 27083 - RNA, 20 nt, Artificial Sequence
  MKO10027083_A_Kcnn3
  gRNA
gcagcaugacccgggcgauc

SEQ ID NO: 27084 - RNA, 20 nt, Artificial Sequence
  MKO10027084_A_Kcnn3
  gRNA
ugaucaucgccuaucacaca

SEQ ID NO: 27085 - RNA, 20 nt, Artificial Sequence
  MKO10027085_A_Kcnn4
  gRNA
aacgcguccuaccgcagcau

SEQ ID NO: 27086 - RNA, 20 nt, Artificial Sequence
  MKO10027086_A_Kcnn4
  gRNA
accaaguccgcuuccgccac

SEQ ID NO: 27087 - RNA, 20 nt, Artificial Sequence
  MKO10027087_A_Kcnn4
  gRNA
ucaccaugacuccggugcac

SEQ ID NO: 27088 - RNA, 20 nt, Artificial Sequence
  MKO10027088_A_Kcnq1
  gRNA
gaucgacaugcagcauccgc

SEQ ID NO: 27089 - RNA, 20 nt, Artificial Sequence
  MKO10027089_A_Kcnq1
  gRNA
augcugcaugucgaucgcca

SEQ ID NO: 27090 - RNA, 20 nt, Artificial Sequence
  MKO10027090_A_Kcnq1
  gRNA
uguucgccacaucagcuauc

SEQ ID NO: 27091 - RNA, 20 nt, Artificial Sequence
  MKO10027091_A_Kcnq2
  gRNA
gcgcccgacuccacacgcga

SEQ ID NO: 27092 - RNA, 20 nt, Artificial Sequence
  MKO10027092_A_Kcnq2
  gRNA
gaguagcgcgccgucgcgug

SEQ ID NO: 27093 - RNA, 20 nt, Artificial Sequence
  MKO10027093_A_Kcnq2
  gRNA
augauccguauggaccggag

SEQ ID NO: 27094 - RNA, 20 nt, Artificial Sequence
  MKO10027094_A_Kcnq3
  gRNA
uauccauucgaagcaugcgc

SEQ ID NO: 27095 - RNA, 20 nt, Artificial Sequence
  MKO10027095_A_Kcnq3
  gRNA
ggauguugcugucgauacaa

SEQ ID NO: 27096 - RNA, 20 nt, Artificial Sequence
  MKO10027096_A_Kcnq3
  gRNA
gauccugcgcaugcuucgaa

SEQ ID NO: 27097 - RNA, 20 nt, Artificial Sequence
  MKO10027097_A_Kcnq4
  gRNA
gaagcgcauacugcgcaacg

SEQ ID NO: 27098 - RNA, 20 nt, Artificial Sequence
  MKO10027098_A_Kcnq4
  gRNA
agggacgcuuucgcuucgcc

SEQ ID NO: 27099 - RNA, 20 nt, Artificial Sequence
  MKO10027099_A_Kcnq4
  gRNA
ccuccuaugccgacucgcuc

SEQ ID NO: 27100 - RNA, 20 nt, Artificial Sequence
  MKO10027100_A_Kcnq5
  gRNA
ugacguugcgccgacagcuc

SEQ ID NO: 27101 - RNA, 20 nt, Artificial Sequence
  MKO10027101_A_Kcnq5
  gRNA
caacagcaggccgucgcccc

SEQ ID NO: 27102 - RNA, 20 nt, Artificial Sequence
  MKO10027102_A_Kcnq5
  gRNA
uguccaugcgcaccauacgc

SEQ ID NO: 27103 - RNA, 20 nt, Artificial Sequence
  MKO10027103_A_Kcnrg
  gRNA
cucccacauucaaagugacg

SEQ ID NO: 27104 - RNA, 20 nt, Artificial Sequence
  MKO10027104_A_Kcnrg
  gRNA
aaagccugauaaucgaaaau

SEQ ID NO: 27105 - RNA, 20 nt, Artificial Sequence
  MKO10027105_A_Kcnrg
  gRNA
uaacaugccugccaagcgag

SEQ ID NO: 27106 - RNA, 20 nt, Artificial Sequence
  MKO10027106_A_Kcns1
  gRNA
cugcacguccgagaucucgu

SEQ ID NO: 27107 - RNA, 20 nt, Artificial Sequence
  MKO10027107_A_Kcns1
  gRNA
cugcgucguagucgucgcac

SEQ ID NO: 27108 - RNA, 20 nt, Artificial Sequence
  MKO10027108_A_Kcns1
  gRNA
cagcggucagcgcgaguuug

SEQ ID NO: 27109 - RNA, 20 nt, Artificial Sequence
  MKO10027109_A_Kcns2
  gRNA
uguguccgauaccgacgucg

SEQ ID NO: 27110 - RNA, 20 nt, Artificial Sequence
  MKO10027110_A_Kcns2
  gRNA
uagucccuuaaauugaccga

SEQ ID NO: 27111 - RNA, 20 nt, Artificial Sequence
  MKO10027111_A_Kcns2
  gRNA
gugcuccacaauuucgaacc

SEQ ID NO: 27112 - RNA, 20 nt, Artificial Sequence
  MKO10027112_A_Kcns3
  gRNA
uucaacgcucgaagcaucug

SEQ ID NO: 27113 - RNA, 20 nt, Artificial Sequence
  MKO10027113_A_Kcns3
  gRNA
uggcaaugagcuuggccgac

SEQ ID NO: 27114 - RNA, 20 nt, Artificial Sequence
  MKO10027114_A_Kcns3
  gRNA
agcuaccguacuuuaacauu

SEQ ID NO: 27115 - RNA, 20 nt, Artificial Sequence
  MKO10027115_A_Kcnt1
  gRNA
ucacccaccauccgaugccc

SEQ ID NO: 27116 - RNA, 20 nt, Artificial Sequence
  MKO10027116_A_Kcnt1
  gRNA
cagcuugagccgcucuuuga

SEQ ID NO: 27117 - RNA, 20 nt, Artificial Sequence
  MKO10027117_A_Kcnt1
  gRNA
ccugcuugacaacccagacc

SEQ ID NO: 27118 - RNA, 20 nt, Artificial Sequence
  MKO10027118_A_Kcnt2
  gRNA
guugcuugagaaaccgucac

SEQ ID NO: 27119 - RNA, 20 nt, Artificial Sequence
  MKO10027119_A_Kcnt2
  gRNA
cguucauguagaauucaacu

SEQ ID NO: 27120 - RNA, 20 nt, Artificial Sequence
  MKO10027120_A_Kcnt2
  gRNA
uuaaccgaagucuaccuuua

SEQ ID NO: 27121 - RNA, 20 nt, Artificial Sequence
  MKO10027121_A_Kcnu1
  gRNA
auucucaucacguagaaucg

SEQ ID NO: 27122 - RNA, 20 nt, Artificial Sequence
  MKO10027122_A_Kcnu1
  gRNA
caccaacacuugccccacga

SEQ ID NO: 27123 - RNA, 20 nt, Artificial Sequence
  MKO10027123_A_Kcnu1
  gRNA
uaugaagaacaccuucgaac

SEQ ID NO: 27124 - RNA, 20 nt, Artificial Sequence
  MKO10027124_A_Kcnv1
  gRNA
gcuacuggacucgucgucgc

SEQ ID NO: 27125 - RNA, 20 nt, Artificial Sequence
  MKO10027125_A_Kcnv1
  gRNA
gaccagugcgauaguagugc

SEQ ID NO: 27126 - RNA, 20 nt, Artificial Sequence
  MKO10027126_A_Kcnv1
  gRNA
acacuugugaagguuguauc

SEQ ID NO: 27127 - RNA, 20 nt, Artificial Sequence
  MKO10027127_A_Kcnv2
  gRNA
gcucgagugcuucacgagcg

SEQ ID NO: 27128 - RNA, 20 nt, Artificial Sequence
  MKO10027128_A_Kcnv2
  gRNA
uuucgggacaugcgcuucua

SEQ ID NO: 27129 - RNA, 20 nt, Artificial Sequence
  MKO10027129_A_Kcnv2
  gRNA
cuuacgaguacaccgccauc

SEQ ID NO: 27130 - RNA, 20 nt, Artificial Sequence
  MKO10027130_A_Kcp
  gRNA
acagccugcgugugccguga

SEQ ID NO: 27131 - RNA, 20 nt, Artificial Sequence
  MKO10027131_A_Kcp
  gRNA
ccagcgagcuccuucgggac

SEQ ID NO: 27132 - RNA, 20 nt, Artificial Sequence
  MKO10027132_A_Kcp
  gRNA
gaggucaccuggccggcaga

SEQ ID NO: 27133 - RNA, 20 nt, Artificial Sequence
  MKO10027133_A_Kcud10
  gRNA
gcuuauagcgacgucaaaua

SEQ ID NO: 27134 - RNA, 20 nt, Artificial Sequence
  MKO10027134_A_Kcud10
  gRNA
aggguacacccccgucucgc

SEQ ID NO: 27135 - RNA, 20 nt, Artificial Sequence
  MKO10027135_A_Kcud10
  gRNA
gaagugcucacggacagcga

SEQ ID NO: 27136 - RNA, 20 nt, Artificial Sequence
  MKO10027136_A_Kcud11
  gRNA
uucgagcggagaagugcacc

SEQ ID NO: 27137 - RNA, 20 nt, Artificial Sequence
  MKO10027137_A_Kcud11
  gRNA
gagaggcuuccaauucccgc

SEQ ID NO: 27138 - RNA, 20 nt, Artificial Sequence
  MKO10027138_A_Kcud11
  gRNA
gcccacucuagccgaaaaug

SEQ ID NO: 27139 - RNA, 20 nt, Artificial Sequence
  MKO10027139_A_Kcud12b
  gRNA
aagugaugucaaaccgaccg

SEQ ID NO: 27140 - RNA, 20 nt, Artificial Sequence
  MKO10027140_A_Kcud12b
  gRNA
agaugccaaauuccgccgug

SEQ ID NO: 27141 - RNA, 20 nt, Artificial Sequence
  MKO10027141_A_Kcud12b
  gRNA
uaucgagaaguauaucgcuc

SEQ ID NO: 27142 - RNA, 20 nt, Artificial Sequence
  MKO10027142_A_Kcud12
  gRNA
cgccugagcgucgcgcccga

SEQ ID NO: 27143 - RNA, 20 nt, Artificial Sequence
  MKO10027143_A_Kcud12
  gRNA
gcuccccgauaagagccgcu

SEQ ID NO: 27144 - RNA, 20 nt, Artificial Sequence
  MKO10027144_A_Kcud12
  gRNA
acgguguccggcgugcaguu

SEQ ID NO: 27145 - RNA, 20 nt, Artificial Sequence
  MKO10027145_A_Kcud13
  gRNA
gcagggccgaaaaauugccg

SEQ ID NO: 27146 - RNA, 20 nt, Artificial Sequence
  MKO10027146_A_Kcud13
  gRNA
guggcaccgacccgucccgc

SEQ ID NO: 27147 - RNA, 20 nt, Artificial Sequence
  MKO10027147_A_Kcud13
  gRNA
aggugaagcccgauacuacc

SEQ ID NO: 27148 - RNA, 20 nt, Artificial Sequence
  MKO10027148_A_Kcud14
  gRNA
uguggcgaugcggucgucaa

SEQ ID NO: 27149 - RNA, 20 nt, Artificial Sequence
  MKO10027149_A_Kcud14
  gRNA
cgcuucuucaucgaucggcc

SEQ ID NO: 27150 - RNA, 20 nt, Artificial Sequence
  MKO10027150_A_Kcud14
  gRNA
gaagugcuugaaugaguucc

SEQ ID NO: 27151 - RNA, 20 nt, Artificial Sequence
  MKO10027151_A_Kcud15
  gRNA
agcggaaaaucuccccaucg

SEQ ID NO: 27152 - RNA, 20 nt, Artificial Sequence
  MKO10027152_A_Kcud15
  gRNA
cauuauuucaucgaccgcga

SEQ ID NO: 27153 - RNA, 20 nt, Artificial Sequence
  MKO10027153_A_Kcud15
  gRNA
agucuacaguagccguugag

SEQ ID NO: 27154 - RNA, 20 nt, Artificial Sequence
  MKO10027154_A_Kcud16
  gRNA
ugcuuccucacgaccgcaag

SEQ ID NO: 27155 - RNA, 20 nt, Artificial Sequence
  MKO10027155_A_Kcud16
  gRNA
gccaggaguuugacgagguc

SEQ ID NO: 27156 - RNA, 20 nt, Artificial Sequence
  MKO10027156_A_Kcud16
  gRNA
gcugcuuauguucgacuccc

SEQ ID NO: 27157 - RNA, 20 nt, Artificial Sequence
  MKO10027157_A_Kcud17
  gRNA
cugcucgaagcgccagccgu

SEQ ID NO: 27158 - RNA, 20 nt, Artificial Sequence
  MKO10027158_A_Kcud17
  gRNA
auucaggaugggcccgaagu

SEQ ID NO: 27159 - RNA, 20 nt, Artificial Sequence
  MKO10027159_A_Kcud17
  gRNA
gcgaagagcuucaaucggac

SEQ ID NO: 27160 - RNA, 20 nt, Artificial Sequence
  MKO10027160_A_Kcud18
  gRNA
gcgugcauuauuaaccguga

SEQ ID NO: 27161 - RNA, 20 nt, Artificial Sequence
  MKO10027161_A_Kcud18
  gRNA
aucuucaagggguaagcuac

SEQ ID NO: 27162 - RNA, 20 nt, Artificial Sequence
  MKO10027162_A_Kcud18
  gRNA
ccaggcggcugauagcccuc

SEQ ID NO: 27163 - RNA, 20 nt, Artificial Sequence
  MKO10027163_A_Kcud19
  gRNA
cgcugcauucgcacucgauc

SEQ ID NO: 27164 - RNA, 20 nt, Artificial Sequence
  MKO10027164_A_Kcud19
  gRNA
aguucccagacucgcuguug

SEQ ID NO: 27165 - RNA, 20 nt, Artificial Sequence
  MKO10027165_A_Kcud19
  gRNA
aggagagcuuggacguguag

SEQ ID NO: 27166 - RNA, 20 nt, Artificial Sequence
  MKO10027166_A_Kcud1
  gRNA
acggcccugcgagugccucg

SEQ ID NO: 27167 - RNA, 20 nt, Artificial Sequence
  MKO10027167_A_Kcud1
  gRNA
gcacaucacaucgccgaucu

SEQ ID NO: 27168 - RNA, 20 nt, Artificial Sequence
  MKO10027168_A_Kcud1
  gRNA
guguccgccucaguucccgu

SEQ ID NO: 27169 - RNA, 20 nt, Artificial Sequence
  MKO10027169_A_Kcud20
  gRNA
gcaguuugaccacuaccucg

SEQ ID NO: 27170 - RNA, 20 nt, Artificial Sequence
  MKO10027170_A_Kcud20
  gRNA
cuucaacacuauccgauguc

SEQ ID NO: 27171 - RNA, 20 nt, Artificial Sequence
  MKO10027171_A_Kcud20
  gRNA
cugcuugugggcaccaucgu

SEQ ID NO: 27172 - RNA, 20 nt, Artificial Sequence
  MKO10027172_A_Kcud21
  gRNA
ccgucugcacgcgcugcuuc

SEQ ID NO: 27173 - RNA, 20 nt, Artificial Sequence
  MKO10027173_A_Kcud21
  gRNA
gaucuguggugccucccgca

SEQ ID NO: 27174 - RNA, 20 nt, Artificial Sequence
  MKO10027174_A_Kcud21
  gRNA
ccucgaucaggggcuguacc

SEQ ID NO: 27175 - RNA, 20 nt, Artificial Sequence
  MKO10027175_A_Kcud2
  gRNA
cgucauagagccgagcgaaa

SEQ ID NO: 27176 - RNA, 20 nt, Artificial Sequence
  MKO10027176_A_Kcud2
  gRNA
auccuaaacuaccuccgcca

SEQ ID NO: 27177 - RNA, 20 nt, Artificial Sequence
  MKO10027177_A_Kcud2
  gRNA
gccccgugaagcacguguac

SEQ ID NO: 27178 - RNA, 20 nt, Artificial Sequence
  MKO10027178_A_Kcud3
  gRNA
ccucuagacagacgcucaug

SEQ ID NO: 27179 - RNA, 20 nt, Artificial Sequence
  MKO10027179_A_Kcud3
  gRNA
ucaacacuucgagaugaaac

SEQ ID NO: 27180 - RNA, 20 nt, Artificial Sequence
  MKO10027180_A_Kcud3
  gRNA
ccacaugagcgucugucuag

SEQ ID NO: 27181 - RNA, 20 nt, Artificial Sequence
  MKO10027181_A_Kcud4
  gRNA
gauaaucacgaucgcucaca

SEQ ID NO: 27182 - RNA, 20 nt, Artificial Sequence
  MKO10027182_A_Kcud4
  gRNA
auaaauauccaccaacguug

SEQ ID NO: 27183 - RNA, 20 nt, Artificial Sequence
  MKO10027183_A_Kcud4
  gRNA
cccccgagagacuacuuucu

SEQ ID NO: 27184 - RNA, 20 nt, Artificial Sequence
  MKO10027184_A_Kcud5
  gRNA
uauuaacaaagaccucgcag

SEQ ID NO: 27185 - RNA, 20 nt, Artificial Sequence
  MKO10027185_A_Kcud5
  gRNA
gggaucucugucgauuaaau

SEQ ID NO: 27186 - RNA, 20 nt, Artificial Sequence
  MKO10027186_A_Kcud5
  gRNA
acacgguacacaugcuucac

SEQ ID NO: 27187 - RNA, 20 nt, Artificial Sequence
  MKO10027187_A_Kcud6
  gRNA
gcagucagucguccgucuug

SEQ ID NO: 27188 - RNA, 20 nt, Artificial Sequence
  MKO10027188_A_Kcud6
  gRNA
cuguagacuggcccgcaaga

SEQ ID NO: 27189 - RNA, 20 nt, Artificial Sequence
  MKO10027189_A_Kcud6
  gRNA
ugcuggagcagauggauaau

SEQ ID NO: 27190 - RNA, 20 nt, Artificial Sequence
  MKO10027190_A_Kcud7
  gRNA
cgguacuucaucgaucgaga

SEQ ID NO: 27191 - RNA, 20 nt, Artificial Sequence
  MKO10027191_A_Kcud7
  gRNA
uccgcuguacugcgcgaagc

SEQ ID NO: 27192 - RNA, 20 nt, Artificial Sequence
  MKO10027192_A_Kcud7
  gRNA
caucucgaucgaugaaguac

SEQ ID NO: 27193 - RNA, 20 nt, Artificial Sequence
  MKO10027193_A_Kcud8
  gRNA
gcggacaccaucucgcugau

SEQ ID NO: 27194 - RNA, 20 nt, Artificial Sequence
  MKO10027194_A_Kcud8
  gRNA
cgcuucuucaucgaccgcga

SEQ ID NO: 27195 - RNA, 20 nt, Artificial Sequence
  MKO10027195_A_Kcud8
  gRNA
ugccacuggcguuugcgcuc

SEQ ID NO: 27196 - RNA, 20 nt, Artificial Sequence
  MKO10027196_A_Kcud9
  gRNA
cgggucacgcuguucuugaa

SEQ ID NO: 27197 - RNA, 20 nt, Artificial Sequence
  MKO10027197_A_Kcud9
  gRNA
gacgauacuucacaacaaca

SEQ ID NO: 27198 - RNA, 20 nt, Artificial Sequence
  MKO10027198_A_Kcud9
  gRNA
gccuuucccauuauauacac

SEQ ID NO: 27199 - RNA, 20 nt, Artificial Sequence
  MKO10027199_A_Kdelc1
  gRNA
gguaggcaucacaauauccc

SEQ ID NO: 27200 - RNA, 20 nt, Artificial Sequence
  MKO10027200_A_Kdelc1
  gRNA
ugccucugcccaaaucguuu

SEQ ID NO: 27201 - RNA, 20 nt, Artificial Sequence
  MKO10027201_A_Kdelc1
  gRNA
gaugagcaguucacgagagu

SEQ ID NO: 27202 - RNA, 20 nt, Artificial Sequence
  MKO10027202_A_Kdelc2
  gRNA
gucacaguacucgugguaca

SEQ ID NO: 27203 - RNA, 20 nt, Artificial Sequence
  MKO10027203_A_Kdelc2
  gRNA
accccucauugcuucgagug

SEQ ID NO: 27204 - RNA, 20 nt, Artificial Sequence
  MKO10027204_A_Kdelc2
  gRNA
ccgcucguccccaaaucuug

SEQ ID NO: 27205 - RNA, 20 nt, Artificial Sequence
  MKO10027205_A_Kdelr1
  gRNA
caaccacgacacuuuccggg

SEQ ID NO: 27206 - RNA, 20 nt, Artificial Sequence
  MKO10027206_A_Kdelr1
  gRNA
gaccucaucgccaucguugc

SEQ ID NO: 27207 - RNA, 20 nt, Artificial Sequence
  MKO10027207_A_Kdelr1
  gRNA
acuccacccggaaagugucg

SEQ ID NO: 27208 - RNA, 20 nt, Artificial Sequence
  MKO10027208_A_Kdelr2
  gRNA
ucgugaagaccagugcgaac

SEQ ID NO: 27209 - RNA, 20 nt, Artificial Sequence
  MKO10027209_A_Kdelr2
  gRNA
aaaucacgauaccuuccgag

SEQ ID NO: 27210 - RNA, 20 nt, Artificial Sequence
  MKO10027210_A_Kdelr2
  gRNA
gaucuggcgcuucuacuucg

SEQ ID NO: 27211 - RNA, 20 nt, Artificial Sequence
  MKO10027211_A_Kdelr3
  gRNA
gaacuacaguuacacgccga

SEQ ID NO: 27212 - RNA, 20 nt, Artificial Sequence
  MKO10027212_A_Kdelr3
  gRNA
cugguaccgccugauccagu

SEQ ID NO: 27213 - RNA, 20 nt, Artificial Sequence
  MKO10027213_A_Kdelr3
  gRNA
gcucuaucggcuccucuauc

SEQ ID NO: 27214 - RNA, 20 nt, Artificial Sequence
  MKO10027214_A_Kdm1a
  gRNA
ucaacuucggcaucuacaag

SEQ ID NO: 27215 - RNA, 20 nt, Artificial Sequence
  MKO10027215_A_Kdm1a
  gRNA
gaguggcuucaaacgucagc

SEQ ID NO: 27216 - RNA, 20 nt, Artificial Sequence
  MKO10027216_A_Kdm1a
  gRNA
cacaguuacuuagagcgcca

SEQ ID NO: 27217 - RNA, 20 nt, Artificial Sequence
  MKO10027217_A_Kdm1b
  gRNA
cgguaaguccucgccaugug

SEQ ID NO: 27218 - RNA, 20 nt, Artificial Sequence
  MKO10027218_A_Kdm1b
  gRNA
cagugcacaaaacccgagug

SEQ ID NO: 27219 - RNA, 20 nt, Artificial Sequence
  MKO10027219_A_Kdm1b
  gRNA
gccaugaacgccuuggggcu

SEQ ID NO: 27220 - RNA, 20 nt, Artificial Sequence
  MKO10027220_A_Kdm2a
  gRNA
aucuucauagcgacgacgca

SEQ ID NO: 27221 - RNA, 20 nt, Artificial Sequence
  MKO10027221_A_Kdm2a
  gRNA
ucauguagggagucgucgga

SEQ ID NO: 27222 - RNA, 20 nt, Artificial Sequence
  MKO10027222_A_Kdm2a
  gRNA
cgucgucgcuaugaagauga

SEQ ID NO: 27223 - RNA, 20 nt, Artificial Sequence
  MKO10027223_A_Kdm2b
  gRNA
cgcacuugcggcaucgcguc

SEQ ID NO: 27224 - RNA, 20 nt, Artificial Sequence
  MKO10027224_A_Kdm2b
  gRNA
acucuccacacuccguccgc

SEQ ID NO: 27225 - RNA, 20 nt, Artificial Sequence
  MKO10027225_A_Kdm2b
  gRNA
uacaagcaaaagcguggccc

SEQ ID NO: 27226 - RNA, 20 nt, Artificial Sequence
  MKO10027226_A_Kdm3a
  gRNA
uuaccuguauagguuucaaa

SEQ ID NO: 27227 - RNA, 20 nt, Artificial Sequence
  MKO10027227_A_Kdm3a
  gRNA
uacaggauguuaacagucuu

SEQ ID NO: 27228 - RNA, 20 nt, Artificial Sequence
  MKO10027228_A_Kdm3a
  gRNA
ggccacugaauaacuugcuc

SEQ ID NO: 27229 - RNA, 20 nt, Artificial Sequence
  MKO10027229_A_Kdm3b
  gRNA
gucaaggucuaccaacccga

SEQ ID NO: 27230 - RNA, 20 nt, Artificial Sequence
  MKO10027230_A_Kdm3b
  gRNA
uucagcgugaaccuuaaccc

SEQ ID NO: 27231 - RNA, 20 nt, Artificial Sequence
  MKO10027231_A_Kdm3b
  gRNA
agacgugcuugcgcuucugc

SEQ ID NO: 27232 - RNA, 20 nt, Artificial Sequence
  MKO10027232_A_Kdm4a
  gRNA
uagaucaucaauaucgucgu

SEQ ID NO: 27233 - RNA, 20 nt, Artificial Sequence
  MKO10027233_A_Kdm4a
  gRNA
gaucuugcggaacucacgaa

SEQ ID NO: 27234 - RNA, 20 nt, Artificial Sequence
  MKO10027234_A_Kdm4a
  gRNA
cggccggcugaagaccaucc

SEQ ID NO: 27235 - RNA, 20 nt, Artificial Sequence
  MKO10027235_A_Kdm4b
  gRNA
gggcacuuacaucgucguac

SEQ ID NO: 27236 - RNA, 20 nt, Artificial Sequence
  MKO10027236_A_Kdm4b
  gRNA
cgaaugcgggaccaucauug

SEQ ID NO: 27237 - RNA, 20 nt, Artificial Sequence
  MKO10027237_A_Kdm4b
  gRNA
augucaucauacgucugccg

SEQ ID NO: 27238 - RNA, 20 nt, Artificial Sequence
  MKO10027238_A_Kdm4c
  gRNA
cgacuugaaagacuagccca

SEQ ID NO: 27239 - RNA, 20 nt, Artificial Sequence
  MKO10027239_A_Kdm4c
  gRNA
ucaagucgcuuuccaugcuc

SEQ ID NO: 27240 - RNA, 20 nt, Artificial Sequence
  MKO10027240_A_Kdm4c
  gRNA
agcucgccuaaauacagucu

SEQ ID NO: 27241 - RNA, 20 nt, Artificial Sequence
  MKO10027241_A_Kdm4d
  gRNA
acguuacuuaccguggcuau

SEQ ID NO: 27242 - RNA, 20 nt, Artificial Sequence
  MKO10027242_A_Kdm4d
  gRNA
ugcuuuggucacccgccggg

SEQ ID NO: 27243 - RNA, 20 nt, Artificial Sequence
  MKO10027243_A_Kdm4d
  gRNA
gaagcgucuccggcuucgcc

SEQ ID NO: 27244 - RNA, 20 nt, Artificial Sequence
  MKO10027244_A_Kdm5a
  gRNA
ucuaaaguggguagccgcuu

SEQ ID NO: 27245 - RNA, 20 nt, Artificial Sequence
  MKO10027245_A_Kdm5a
  gRNA
aacaagacgaguuaagucuc

SEQ ID NO: 27246 - RNA, 20 nt, Artificial Sequence
  MKO10027246_A_Kdm5a
  gRNA
uucauucuuguuccccgcuc

SEQ ID NO: 27247 - RNA, 20 nt, Artificial Sequence
  MKO10027247_A_Kdm5b
  gRNA
uuaucgacaucacaagcgaa

SEQ ID NO: 27248 - RNA, 20 nt, Artificial Sequence
  MKO10027248_A_Kdm5b
  gRNA
uaaccugaccuccgacacaa

SEQ ID NO: 27249 - RNA, 20 nt, Artificial Sequence
  MKO10027249_A_Kdm5b
  gRNA
uacucugaagauuccccacg

SEQ ID NO: 27250 - RNA, 20 nt, Artificial Sequence
  MKO10027250_A_Kdm5c
  gRNA
caagauccgccguucuacau

SEQ ID NO: 27251 - RNA, 20 nt, Artificial Sequence
  MKO10027251_A_Kdm5c
  gRNA
aaggcugcacagacugucga

SEQ ID NO: 27252 - RNA, 20 nt, Artificial Sequence
  MKO10027252_A_Kdm5c
  gRNA
cuggcagccacccuuugccg

SEQ ID NO: 27253 - RNA, 20 nt, Artificial Sequence
  MKO10027253_A_Kdm5d
  gRNA
guaaaugauccguucguagu

SEQ ID NO: 27254 - RNA, 20 nt, Artificial Sequence
  MKO10027254_A_Kdm5d
  gRNA
ggaccuuuacagccuuaaua

SEQ ID NO: 27255 - RNA, 20 nt, Artificial Sequence
  MKO10027255_A_Kdm5d
  gRNA
uucaguugcuacaguagacg

SEQ ID NO: 27256 - RNA, 20 nt, Artificial Sequence
  MKO10027256_A_Kdm6a
  gRNA
uuggauaaucuuccaauaag

SEQ ID NO: 27257 - RNA, 20 nt, Artificial Sequence
  MKO10027257_A_Kdm6a
  gRNA
uagcauuaucugcauaccag

SEQ ID NO: 27258 - RNA, 20 nt, Artificial Sequence
  MKO10027258_A_Kdm6a
  gRNA
gaaaccucacgaacccgaaa

SEQ ID NO: 27259 - RNA, 20 nt, Artificial Sequence
  MKO10027259_A_Kdm6b
  gRNA
gggauuccaacuucccguga

SEQ ID NO: 27260 - RNA, 20 nt, Artificial Sequence
  MKO10027260_A_Kdm6b
  gRNA
uggaggaagcuucgccgagc

SEQ ID NO: 27261 - RNA, 20 nt, Artificial Sequence
  MKO10027261_A_Kdm6b
  gRNA
ccggagcuacugccaugaga

SEQ ID NO: 27262 - RNA, 20 nt, Artificial Sequence
  MKO10027262_A_Kdm7a
  gRNA
uugucuuagcuguguuggcg

SEQ ID NO: 27263 - RNA, 20 nt, Artificial Sequence
  MKO10027263_A_Kdm7a
  gRNA
ccguguagagcugcacaguc

SEQ ID NO: 27264 - RNA, 20 nt, Artificial Sequence
  MKO10027264_A_Kdm7a
  gRNA
cugaucacauuuagcacuuu

SEQ ID NO: 27265 - RNA, 20 nt, Artificial Sequence
  MKO10027265_A_Kdm8
  gRNA
ucguagucugcaguacaucc

SEQ ID NO: 27266 - RNA, 20 nt, Artificial Sequence
  MKO10027266_A_Kdm8
  gRNA
uggcugccgcaccguccccg

SEQ ID NO: 27267 - RNA, 20 nt, Artificial Sequence
  MKO10027267_A_Kdm8
  gRNA
gacucaccuggucgaagagc

SEQ ID NO: 27268 - RNA, 20 nt, Artificial Sequence
  MKO10027268_A_Kdr
  gRNA
gucccgguacgagcacuugu

SEQ ID NO: 27269 - RNA, 20 nt, Artificial Sequence
  MKO10027269_A_Kdr
  gRNA
ugauguacacgaugccaugc

SEQ ID NO: 27270 - RNA, 20 nt, Artificial Sequence
  MKO10027270_A_Kdr
  gRNA
caacccuucagauuacuugc

SEQ ID NO: 27271 - RNA, 20 nt, Artificial Sequence
  MKO10027271_A_Kdsr
  gRNA
aacucugguugcacgaaaug

SEQ ID NO: 27272 - RNA, 20 nt, Artificial Sequence
  MKO10027272_A_Kdsr
  gRNA
caguugaccagcauguccac

SEQ ID NO: 27273 - RNA, 20 nt, Artificial Sequence
  MKO10027273_A_Kdsr
  gRNA
gucucaagacuauaaccaag

SEQ ID NO: 27274 - RNA, 20 nt, Artificial Sequence
  MKO10027274_A_Keap1
  gRNA
agcgugccacgcaaccgcau

SEQ ID NO: 27275 - RNA, 20 nt, Artificial Sequence
  MKO10027275_A_Keap1
  gRNA
aacccccgacugcguagaug

SEQ ID NO: 27276 - RNA, 20 nt, Artificial Sequence
  MKO10027276_A_Keap1
  gRNA
gaggcaucaccguagugcgc

SEQ ID NO: 27277 - RNA, 20 nt, Artificial Sequence
  MKO10027277_A_Keg1
  gRNA
uacuguuguuauucgacccc

SEQ ID NO: 27278 - RNA, 20 nt, Artificial Sequence
  MKO10027278_A_Keg1
  gRNA
uacagcguucaaugaacuuc

SEQ ID NO: 27279 - RNA, 20 nt, Artificial Sequence
  MKO10027279_A_Keg1
  gRNA
gaggcaccuugccuaaguac

SEQ ID NO: 27280 - RNA, 20 nt, Artificial Sequence
  MKO10027280_A_Kel
  gRNA
cguagauaggcucggaagaa

SEQ ID NO: 27281 - RNA, 20 nt, Artificial Sequence
  MKO10027281_A_Kel
  gRNA
uccacauacaccaaucaucc

SEQ ID NO: 27282 - RNA, 20 nt, Artificial Sequence
  MKO10027282_A_Kel
  gRNA
ccaugcaggaguuauaaaau

SEQ ID NO: 27283 - RNA, 20 nt, Artificial Sequence
  MKO10027283_A_Kera
  gRNA
gccaccgaucccgauagauu

SEQ ID NO: 27284 - RNA, 20 nt, Artificial Sequence
  MKO10027284_A_Kera
  gRNA
gacacaucaaaaccccucga

SEQ ID NO: 27285 - RNA, 20 nt, Artificial Sequence
  MKO10027285_A_Kera
  gRNA
uuucauucccauccagacgc

SEQ ID NO: 27286 - RNA, 20 nt, Artificial Sequence
  MKO10027286_A_Khdc1a
  gRNA
ucuuccaugucaaacaccag

SEQ ID NO: 27287 - RNA, 20 nt, Artificial Sequence
  MKO10027287_A_Khdc1a
  gRNA
caggaaugagugaccuccgc

SEQ ID NO: 27288 - RNA, 20 nt, Artificial Sequence
  MKO10027288_A_Khdc1a
  gRNA
acccacagccuugccuuaag

SEQ ID NO: 27289 - RNA, 20 nt, Artificial Sequence
  MKO10027289_A_Khdc1b
  gRNA
aguugaugcuacuccauauc

SEQ ID NO: 27290 - RNA, 20 nt, Artificial Sequence
  MKO10027290_A_Khdc1b
  gRNA
gauccgucagaggaugacuc

SEQ ID NO: 27291 - RNA, 20 nt, Artificial Sequence
  MKO10027291_A_Khdc1b
  gRNA
aacacucucgauaaaauuaa

SEQ ID NO: 27292 - RNA, 20 nt, Artificial Sequence
  MKO10027292_A_Khdc1c
  gRNA
ucuuccaugucaaacaccag

SEQ ID NO: 27293 - RNA, 20 nt, Artificial Sequence
  MKO10027293_A_Khdc1c
  gRNA
caggaaugagugaccuccgc

SEQ ID NO: 27294 - RNA, 20 nt, Artificial Sequence
  MKO10027294_A_Khdc1c
  gRNA
acccacagccuugccuuaag

SEQ ID NO: 27295 - RNA, 20 nt, Artificial Sequence
  MKO10027295_A_Khdc3
  gRNA
ucggaccgccgccuuuccga

SEQ ID NO: 27296 - RNA, 20 nt, Artificial Sequence
  MKO10027296_A_Khdc3
  gRNA
uggaguugagcgucgucgua

SEQ ID NO: 27297 - RNA, 20 nt, Artificial Sequence
  MKO10027297_A_Khdc3
  gRNA
ucaacgucccuucggaaagg

SEQ ID NO: 27298 - RNA, 20 nt, Artificial Sequence
  MKO10027298_A_Khdrbs1
  gRNA
ccugaacccucucguggucg

SEQ ID NO: 27299 - RNA, 20 nt, Artificial Sequence
  MKO10027299_A_Khdrbs1
  gRNA
agauaccccacgaccacgag

SEQ ID NO: 27300 - RNA, 20 nt, Artificial Sequence
  MKO10027300_A_Khdrbs1
  gRNA
auaggaggaagaguugcgca

SEQ ID NO: 27301 - RNA, 20 nt, Artificial Sequence
  MKO10027301_A_Khdrbs2
  gRNA
uucacggaugagucaugccu

SEQ ID NO: 27302 - RNA, 20 nt, Artificial Sequence
  MKO10027302_A_Khdrbs2
  gRNA
uaccuuugucuuaucucgca

SEQ ID NO: 27303 - RNA, 20 nt, Artificial Sequence
  MKO10027303_A_Khdrbs2
  gRNA
cauccgugaauaagcuuccc

SEQ ID NO: 27304 - RNA, 20 nt, Artificial Sequence
  MKO10027304_A_Khdrbs3
  gRNA
guagauuucccucgaaccac

SEQ ID NO: 27305 - RNA, 20 nt, Artificial Sequence
  MKO10027305_A_Khdrbs3
  gRNA
aaaucuacuuugcguacgag

SEQ ID NO: 27306 - RNA, 20 nt, Artificial Sequence
  MKO10027306_A_Khdrbs3
  gRNA
uuucuucuuguaagcgcuuc

SEQ ID NO: 27307 - RNA, 20 nt, Artificial Sequence
  MKO10027307_A_Khk
  gRNA
ucuaaacuuacucggcaacg

SEQ ID NO: 27308 - RNA, 20 nt, Artificial Sequence
  MKO10027308_A_Khk
  gRNA
uuacgugucguagaguauaa

SEQ ID NO: 27309 - RNA, 20 nt, Artificial Sequence
  MKO10027309_A_Khk
  gRNA
uugagaaggucgaucugacc

SEQ ID NO: 27310 - RNA, 20 nt, Artificial Sequence
  MKO10027310_A_Khnyn
  gRNA
agcgagagcaauaccccgac

SEQ ID NO: 27311 - RNA, 20 nt, Artificial Sequence
  MKO10027311_A_Khnyn
  gRNA
ccuaaccgaggcguuuguga

SEQ ID NO: 27312 - RNA, 20 nt, Artificial Sequence
  MKO10027312_A_Khnyn
  gRNA
gacuggcacgcagcguuucc

SEQ ID NO: 27313 - RNA, 20 nt, Artificial Sequence
  MKO10027313_A_Khsrp
  gRNA
cccagcgauugguucucaac

SEQ ID NO: 27314 - RNA, 20 nt, Artificial Sequence
  MKO10027314_A_Khsrp
  gRNA
agcagcaucaccuccgauuu

SEQ ID NO: 27315 - RNA, 20 nt, Artificial Sequence
  MKO10027315_A_Khsrp
  gRNA
ccgcuuaccuggggggagga

SEQ ID NO: 27316 - RNA, 20 nt, Artificial Sequence
  MKO10027316_A_Kidins220
  gRNA
caaucuggagcaccgugaca

SEQ ID NO: 27317 - RNA, 20 nt, Artificial Sequence
  MKO10027317_A_Kidins220
  gRNA
cugcccgcugcccagaugau

SEQ ID NO: 27318 - RNA, 20 nt, Artificial Sequence
  MKO10027318_A_Kidins220
  gRNA
acagugucuacccaaucauc

SEQ ID NO: 27319 - RNA, 20 nt, Artificial Sequence
  MKO10027319_A_Kif11
  gRNA
cccugaguuaccuuguuccg

SEQ ID NO: 27320 - RNA, 20 nt, Artificial Sequence
  MKO10027320_A_Kif11
  gRNA
cacugacuucuuuccgugca

SEQ ID NO: 27321 - RNA, 20 nt, Artificial Sequence
  MKO10027321_A_Kif11
  gRNA
uuccgcucugccagauuaaa

SEQ ID NO: 27322 - RNA, 20 nt, Artificial Sequence
  MKO10027322_A_Kif12
  gRNA
cgugcgcgccccguccagua

SEQ ID NO: 27323 - RNA, 20 nt, Artificial Sequence
  MKO10027323_A_Kif12
  gRNA
gccaaagcggaacgccacau

SEQ ID NO: 27324 - RNA, 20 nt, Artificial Sequence
  MKO10027324_A_Kif12
  gRNA
ucugacuggaccuccuccgc

SEQ ID NO: 27325 - RNA, 20 nt, Artificial Sequence
  MKO10027325_A_Kif13a
  gRNA
uguuguguucgauucaucca

SEQ ID NO: 27326 - RNA, 20 nt, Artificial Sequence
  MKO10027326_A_Kif13a
  gRNA
ggaacugaacaccaagugcg

SEQ ID NO: 27327 - RNA, 20 nt, Artificial Sequence
  MKO10027327_A_Kif13a
  gRNA
ucgaacacaacaaaauaugc

SEQ ID NO: 27328 - RNA, 20 nt, Artificial Sequence
  MKO10027328_A_Kif13b
  gRNA
aacuuaccgggcaucuccuu

SEQ ID NO: 27329 - RNA, 20 nt, Artificial Sequence
  MKO10027329_A_Kif13b
  gRNA
ucuguccgagagaaguaugc

SEQ ID NO: 27330 - RNA, 20 nt, Artificial Sequence
  MKO10027330_A_Kif13b
  gRNA
uucaacauccaccacacauu

SEQ ID NO: 27331 - RNA, 20 nt, Artificial Sequence
  MKO10027331_A_Kif14
  gRNA
guuucuggaccguauguuga

SEQ ID NO: 27332 - RNA, 20 nt, Artificial Sequence
  MKO10027332_A_Kif14
  gRNA
ucuccccccagcugcgcgcg

SEQ ID NO: 27333 - RNA, 20 nt, Artificial Sequence
  MKO10027333_A_Kif14
  gRNA
auggggcuuaaugaagaacc

SEQ ID NO: 27334 - RNA, 20 nt, Artificial Sequence
  MKO10027334_A_Kif15
  gRNA
cugcucuccauccgcugauc

SEQ ID NO: 27335 - RNA, 20 nt, Artificial Sequence
  MKO10027335_A_Kif15
  gRNA
gcgaauucguccugcugaag

SEQ ID NO: 27336 - RNA, 20 nt, Artificial Sequence
  MKO10027336_A_Kif15
  gRNA
ugggaagacauuuacuauga

SEQ ID NO: 27337 - RNA, 20 nt, Artificial Sequence
  MKO10027337_A_Kif16b
  gRNA
gcgauucuggcuuaauaccu

SEQ ID NO: 27338 - RNA, 20 nt, Artificial Sequence
  MKO10027338_A_Kif16b
  gRNA
aagagagcuucacagauccg

SEQ ID NO: 27339 - RNA, 20 nt, Artificial Sequence
  MKO10027339_A_Kif16b
  gRNA
aacgacaaucacaaacuuaa

SEQ ID NO: 27340 - RNA, 20 nt, Artificial Sequence
  MKO10027340_A_Kif17
  gRNA
caacgagaucgccuacccgc

SEQ ID NO: 27341 - RNA, 20 nt, Artificial Sequence
  MKO10027341_A_Kif17
  gRNA
gugacgguggacagugcgcg

SEQ ID NO: 27342 - RNA, 20 nt, Artificial Sequence
  MKO10027342_A_Kif17
  gRNA
gcacguguuugagagcguuc

SEQ ID NO: 27343 - RNA, 20 nt, Artificial Sequence
  MKO10027343_A_Kif18a
  gRNA
augucacucaucgaccucgc

SEQ ID NO: 27344 - RNA, 20 nt, Artificial Sequence
  MKO10027344_A_Kif18a
  gRNA
auugucagguacaugacccc

SEQ ID NO: 27345 - RNA, 20 nt, Artificial Sequence
  MKO10027345_A_Kif18a
  gRNA
gaggucgaugagugacauuu

SEQ ID NO: 27346 - RNA, 20 nt, Artificial Sequence
  MKO10027346_A_Kif18b
  gRNA
ggauguggcguuggcauccg

SEQ ID NO: 27347 - RNA, 20 nt, Artificial Sequence
  MKO10027347_A_Kif18b
  gRNA
caagaugagcuugauugacc

SEQ ID NO: 27348 - RNA, 20 nt, Artificial Sequence
  MKO10027348_A_Kif18b
  gRNA
cucccgcagccgcucuccuu

SEQ ID NO: 27349 - RNA, 20 nt, Artificial Sequence
  MKO10027349_A_Kif19a
  gRNA
ugaccuguuccgagccaucg

SEQ ID NO: 27350 - RNA, 20 nt, Artificial Sequence
  MKO10027350_A_Kif19a
  gRNA
cugagaugacgcccucgaug

SEQ ID NO: 27351 - RNA, 20 nt, Artificial Sequence
  MKO10027351_A_Kif19a
  gRNA
gaagucauaccucuuugacg

SEQ ID NO: 27352 - RNA, 20 nt, Artificial Sequence
  MKO10027352_A_Kif1a
  gRNA
ugucguugauucgagagaag

SEQ ID NO: 27353 - RNA, 20 nt, Artificial Sequence
  MKO10027353_A_Kif1a
  gRNA
cgacaacauguccuacucug

SEQ ID NO: 27354 - RNA, 20 nt, Artificial Sequence
  MKO10027354_A_Kif1a
  gRNA
gccggcccccgucugcccau

SEQ ID NO: 27355 - RNA, 20 nt, Artificial Sequence
  MKO10027355_A_Kif1b
  gRNA
ucgaacagcgaccuucacag

SEQ ID NO: 27356 - RNA, 20 nt, Artificial Sequence
  MKO10027356_A_Kif1b
  gRNA
acgauucugcgaugcaaaac

SEQ ID NO: 27357 - RNA, 20 nt, Artificial Sequence
  MKO10027357_A_Kif1b
  gRNA
gcuggucucucgagaauuga

SEQ ID NO: 27358 - RNA, 20 nt, Artificial Sequence
  MKO10027358_A_Kif1c
  gRNA
uugcacguacgggccuagga

SEQ ID NO: 27359 - RNA, 20 nt, Artificial Sequence
  MKO10027359_A_Kif1c
  gRNA
cgugcaagaccugucuaaac

SEQ ID NO: 27360 - RNA, 20 nt, Artificial Sequence
  MKO10027360_A_Kif1c
  gRNA
cgaccaguaagaauagucga

SEQ ID NO: 27361 - RNA, 20 nt, Artificial Sequence
  MKO10027361_A_Kif20a
  gRNA
gucuagccagauuacuucau

SEQ ID NO: 27362 - RNA, 20 nt, Artificial Sequence
  MKO10027362_A_Kif20a
  gRNA
gggaaaacguacaccauuca

SEQ ID NO: 27363 - RNA, 20 nt, Artificial Sequence
  MKO10027363_A_Kif20a
  gRNA
uuggaggccuccaauuagca

SEQ ID NO: 27364 - RNA, 20 nt, Artificial Sequence
  MKO10027364_A_Kif20b
  gRNA
gucgacuguguccuucuaag

SEQ ID NO: 27365 - RNA, 20 nt, Artificial Sequence
  MKO10027365_A_Kif20b
  gRNA
agucgacugaucuucacaua

SEQ ID NO: 27366 - RNA, 20 nt, Artificial Sequence
  MKO10027366_A_Kif20b
  gRNA
uacauugcugcgacaaauua

SEQ ID NO: 27367 - RNA, 20 nt, Artificial Sequence
  MKO10027367_A_Kif21a
  gRNA
caugauguucacgucaaauc

SEQ ID NO: 27368 - RNA, 20 nt, Artificial Sequence
  MKO10027368_A_Kif21a
  gRNA
ccuuuguucagaccggagcu

SEQ ID NO: 27369 - RNA, 20 nt, Artificial Sequence
  MKO10027369_A_Kif21a
  gRNA
ugcaucgaaaagcucauuga

SEQ ID NO: 27370 - RNA, 20 nt, Artificial Sequence
  MKO10027370_A_Kif21b
  gRNA
gcaucgacgaacgcaagcgg

SEQ ID NO: 27371 - RNA, 20 nt, Artificial Sequence
  MKO10027371_A_Kif21b
  gRNA
gauccggccccagcugucaa

SEQ ID NO: 27372 - RNA, 20 nt, Artificial Sequence
  MKO10027372_A_Kif21b
  gRNA
accccgaugcccgacaccgc

SEQ ID NO: 27373 - RNA, 20 nt, Artificial Sequence
  MKO10027373_A_Kif22
  gRNA
guccgccucuagcucgagua

SEQ ID NO: 27374 - RNA, 20 nt, Artificial Sequence
  MKO10027374_A_Kif22
  gRNA
ugugcggcugcgcccguuua

SEQ ID NO: 27375 - RNA, 20 nt, Artificial Sequence
  MKO10027375_A_Kif22
  gRNA
gugauccgcgaagacugccg

SEQ ID NO: 27376 - RNA, 20 nt, Artificial Sequence
  MKO10027376_A_Kif23
  gRNA
aagaucauauucaaacaacg

SEQ ID NO: 27377 - RNA, 20 nt, Artificial Sequence
  MKO10027377_A_Kif23
  gRNA
ugauguuguagcuaaucccu

SEQ ID NO: 27378 - RNA, 20 nt, Artificial Sequence
  MKO10027378_A_Kif23
  gRNA
gcuaucgacucaacagaaau

SEQ ID NO: 27379 - RNA, 20 nt, Artificial Sequence
  MKO10027379_A_Kif24
  gRNA
gguguaagggaaguacgucg

SEQ ID NO: 27380 - RNA, 20 nt, Artificial Sequence
  MKO10027380_A_Kif24
  gRNA
cguacuucccuuacaccuaa

SEQ ID NO: 27381 - RNA, 20 nt, Artificial Sequence
  MKO10027381_A_Kif24
  gRNA
caguguggagcuacuccuac

SEQ ID NO: 27382 - RNA, 20 nt, Artificial Sequence
  MKO10027382_A_Kif26a
  gRNA
uugcgcggggauaccucaag

SEQ ID NO: 27383 - RNA, 20 nt, Artificial Sequence
  MKO10027383_A_Kif26a
  gRNA
cugaacguaugucgaaggcg

SEQ ID NO: 27384 - RNA, 20 nt, Artificial Sequence
  MKO10027384_A_Kif26a
  gRNA
ccacugccacacgaagcucg

SEQ ID NO: 27385 - RNA, 20 nt, Artificial Sequence
  MKO10027385_A_Kif26b
  gRNA
cgagaacuguaacgcccgcu

SEQ ID NO: 27386 - RNA, 20 nt, Artificial Sequence
  MKO10027386_A_Kif26b
  gRNA
aguucucgcaccagacgccg

SEQ ID NO: 27387 - RNA, 20 nt, Artificial Sequence
  MKO10027387_A_Kif26b
  gRNA
gguuacccuguaccccuacc

SEQ ID NO: 27388 - RNA, 20 nt, Artificial Sequence
  MKO10027388_A_Kif27
  gRNA
ggaaacguaauaagcgcccu

SEQ ID NO: 27389 - RNA, 20 nt, Artificial Sequence
  MKO10027389_A_Kif27
  gRNA
uacuggagugcucguucauc

SEQ ID NO: 27390 - RNA, 20 nt, Artificial Sequence
  MKO10027390_A_Kif27
  gRNA
ugcucuggccgccgaccaag

SEQ ID NO: 27391 - RNA, 20 nt, Artificial Sequence
  MKO10027391_A_Kif2a
  gRNA
ccucccccgagagauaauag

SEQ ID NO: 27392 - RNA, 20 nt, Artificial Sequence
  MKO10027392_A_Kif2a
  gRNA
ucuguagaaccggcggacug

SEQ ID NO: 27393 - RNA, 20 nt, Artificial Sequence
  MKO10027393_A_Kif2a
  gRNA
ugguugguucagcacgcgca

SEQ ID NO: 27394 - RNA, 20 nt, Artificial Sequence
  MKO10027394_A_Kif2b
  gRNA
ugucgcgaucaugcacguau

SEQ ID NO: 27395 - RNA, 20 nt, Artificial Sequence
  MKO10027395_A_Kif2b
  gRNA
gaauccguuugucacugcgc

SEQ ID NO: 27396 - RNA, 20 nt, Artificial Sequence
  MKO10027396_A_Kif2b
  gRNA
ugaccacgccuucgacgaca

SEQ ID NO: 27397 - RNA, 20 nt, Artificial Sequence
  MKO10027397_A_Kif2c
  gRNA
ugcgaguggagcggcuucga

SEQ ID NO: 27398 - RNA, 20 nt, Artificial Sequence
  MKO10027398_A_Kif2c
  gRNA
gcuucuucccuuacgaccga

SEQ ID NO: 27399 - RNA, 20 nt, Artificial Sequence
  MKO10027399_A_Kif2c
  gRNA
cagacuguccuucggucgua

SEQ ID NO: 27400 - RNA, 20 nt, Artificial Sequence
  MKO10027400_A_Kif3a
  gRNA
aaggcguucgagcaguaccg

SEQ ID NO: 27401 - RNA, 20 nt, Artificial Sequence
  MKO10027401_A_Kif3a
  gRNA
cguuggaggaaucggucuua

SEQ ID NO: 27402 - RNA, 20 nt, Artificial Sequence
  MKO10027402_A_Kif3a
  gRNA
ccgucagcguggaugaaaug

SEQ ID NO: 27403 - RNA, 20 nt, Artificial Sequence
  MKO10027403_A_Kif3b
  gRNA
acgccaggagaucgcagagc

SEQ ID NO: 27404 - RNA, 20 nt, Artificial Sequence
  MKO10027404_A_Kif3b
  gRNA
gucguggaucucggccuuca

SEQ ID NO: 27405 - RNA, 20 nt, Artificial Sequence
  MKO10027405_A_Kif3b
  gRNA
acuuacuccagucugguuau

SEQ ID NO: 27406 - RNA, 20 nt, Artificial Sequence
  MKO10027406_A_Kif3c
  gRNA
cgcggauguacucuucgugu

SEQ ID NO: 27407 - RNA, 20 nt, Artificial Sequence
  MKO10027407_A_Kif3c
  gRNA
ugcccuagaaacgccgugaa

SEQ ID NO: 27408 - RNA, 20 nt, Artificial Sequence
  MKO10027408_A_Kif3c
  gRNA
acgaagaguacauccgcgug

SEQ ID NO: 27409 - RNA, 20 nt, Artificial Sequence
  MKO10027409_A_Kif4
  gRNA
gaagagcaguuguauuaccc

SEQ ID NO: 27410 - RNA, 20 nt, Artificial Sequence
  MKO10027410_A_Kif4
  gRNA
guuguuacccugcucuagac

SEQ ID NO: 27411 - RNA, 20 nt, Artificial Sequence
  MKO10027411_A_Kif4
  gRNA
ucucacgagaugaacauaga

SEQ ID NO: 27412 - RNA, 20 nt, Artificial Sequence
  MKO10027412_A_Kif5a
  gRNA
ugaagaugucucgagcgauc

SEQ ID NO: 27413 - RNA, 20 nt, Artificial Sequence
  MKO10027413_A_Kif5a
  gRNA
aucuuacuucgagauuuacc

SEQ ID NO: 27414 - RNA, 20 nt, Artificial Sequence
  MKO10027414_A_Kif5a
  gRNA
aagacgcggucaaagacaua

SEQ ID NO: 27415 - RNA, 20 nt, Artificial Sequence
  MKO10027415_A_Kif5b
  gRNA
aucugggaagacccacacga

SEQ ID NO: 27416 - RNA, 20 nt, Artificial Sequence
  MKO10027416_A_Kif5b
  gRNA
gcucuugagaugugcuugac

SEQ ID NO: 27417 - RNA, 20 nt, Artificial Sequence
  MKO10027417_A_Kif5b
  gRNA
aacacacgaucaaaggcaua

SEQ ID NO: 27418 - RNA, 20 nt, Artificial Sequence
  MKO10027418_A_Kif5c
  gRNA
aucaggaaaaacucauacca

SEQ ID NO: 27419 - RNA, 20 nt, Artificial Sequence
  MKO10027419_A_Kif5c
  gRNA
agcacucggucaaagacaua

SEQ ID NO: 27420 - RNA, 20 nt, Artificial Sequence
  MKO10027420_A_Kif5c
  gRNA
guccaaguagaucucaaaau

SEQ ID NO: 27421 - RNA, 20 nt, Artificial Sequence
  MKO10027421_A_Kif6
  gRNA
uugccaaaccagucgccgag

SEQ ID NO: 27422 - RNA, 20 nt, Artificial Sequence
  MKO10027422_A_Kif6
  gRNA
caauccuaccucucggcgac

SEQ ID NO: 27423 - RNA, 20 nt, Artificial Sequence
  MKO10027423_A_Kif6
  gRNA
cgucugcccauaugcgaaga

SEQ ID NO: 27424 - RNA, 20 nt, Artificial Sequence
  MKO10027424_A_Kif7
  gRNA
gcgcugccgcccgcaaagug

SEQ ID NO: 27425 - RNA, 20 nt, Artificial Sequence
  MKO10027425_A_Kif7
  gRNA
agcgcuuucgaugccgcugu

SEQ ID NO: 27426 - RNA, 20 nt, Artificial Sequence
  MKO10027426_A_Kif7
  gRNA
cgcuugccucgacccgccgc

SEQ ID NO: 27427 - RNA, 20 nt, Artificial Sequence
  MKO10027427_A_Kif9
  gRNA
uucaagcguuuguucgaguc

SEQ ID NO: 27428 - RNA, 20 nt, Artificial Sequence
  MKO10027428_A_Kif9
  gRNA
acggacugugauggcgugcg

SEQ ID NO: 27429 - RNA, 20 nt, Artificial Sequence
  MKO10027429_A_Kif9
  gRNA
ccacguagggcagaguggac

SEQ ID NO: 27430 - RNA, 20 nt, Artificial Sequence
  MKO10027430_A_Kifap3
  gRNA
gcagaaccccgaaccuuauc

SEQ ID NO: 27431 - RNA, 20 nt, Artificial Sequence
  MKO10027431_A_Kifap3
  gRNA
gaaccgccgagacucauugc

SEQ ID NO: 27432 - RNA, 20 nt, Artificial Sequence
  MKO10027432_A_Kifap3
  gRNA
ucuguuucagauugacgaag

SEQ ID NO: 27433 - RNA, 20 nt, Artificial Sequence
  MKO10027433_A_Kifc1
  gRNA
ucaacagaggccaccuuugu

SEQ ID NO: 27434 - RNA, 20 nt, Artificial Sequence
  MKO10027434_A_Kifc1
  gRNA
gagugccccugucagcaagc

SEQ ID NO: 27435 - RNA, 20 nt, Artificial Sequence
  MKO10027435_A_Kifc1
  gRNA
ccucgugggugcucugcuau

SEQ ID NO: 27436 - RNA, 20 nt, Artificial Sequence
  MKO10027436_A_Kifc2
  gRNA
cugcgggacgacuccugacc

SEQ ID NO: 27437 - RNA, 20 nt, Artificial Sequence
  MKO10027437_A_Kifc2
  gRNA
gcuccguguccaugccagua

SEQ ID NO: 27438 - RNA, 20 nt, Artificial Sequence
  MKO10027438_A_Kifc2
  gRNA
agaaaagcggcggccaaccu

SEQ ID NO: 27439 - RNA, 20 nt, Artificial Sequence
  MKO10027439_A_Kifc3
  gRNA
ugcgcaccugagcccgcaac

SEQ ID NO: 27440 - RNA, 20 nt, Artificial Sequence
  MKO10027440_A_Kifc3
  gRNA
gcgcugugaggucgaacugc

SEQ ID NO: 27441 - RNA, 20 nt, Artificial Sequence
  MKO10027441_A_Kifc3
  gRNA
uccgggucugggacucgcug

SEQ ID NO: 27442 - RNA, 20 nt, Artificial Sequence
  MKO10027442_A_Kifc5b
  gRNA
cacguacugccaggcuucgc

SEQ ID NO: 27443 - RNA, 20 nt, Artificial Sequence
  MKO10027443_A_Kifc5b
  gRNA
cccgcugcuccugcgaagcc

SEQ ID NO: 27444 - RNA, 20 nt, Artificial Sequence
  MKO10027444_A_Kifc5b
  gRNA
ucuggucaggaccccucuug

SEQ ID NO: 27445 - RNA, 20 nt, Artificial Sequence
  MKO10027445_A_Kin
  gRNA
gccgacuucuucuucuucgc

SEQ ID NO: 27446 - RNA, 20 nt, Artificial Sequence
  MKO10027446_A_Kin
  gRNA
ggaccgcacggacagacgcc

SEQ ID NO: 27447 - RNA, 20 nt, Artificial Sequence
  MKO10027447_A_Kin
  gRNA
cacugaccgacuuuaccaag

SEQ ID NO: 27448 - RNA, 20 nt, Artificial Sequence
  MKO10027448_A_Kir3dl1
  gRNA
cauaacuuggccaggcagau

SEQ ID NO: 27449 - RNA, 20 nt, Artificial Sequence
  MKO10027449_A_Kir3dl1
  gRNA
gaaggggugccucggggaca

SEQ ID NO: 27450 - RNA, 20 nt, Artificial Sequence
  MKO10027450_A_Kir3dl1
  gRNA
gcaggcauccccuguccccg

SEQ ID NO: 27451 - RNA, 20 nt, Artificial Sequence
  MKO10027451_A_Kir3dl2
  gRNA
ugucaugggaccuauugagu

SEQ ID NO: 27452 - RNA, 20 nt, Artificial Sequence
  MKO10027452_A_Kir3dl2
  gRNA
cauaacuuggccaggcauau

SEQ ID NO: 27453 - RNA, 20 nt, Artificial Sequence
  MKO10027453_A_Kir3dl2
  gRNA
cauucccuccugaauucacc

SEQ ID NO: 27454 - RNA, 20 nt, Artificial Sequence
  MKO10027454_A_Kirrel2
  gRNA
aauuccccgauauccaguac

SEQ ID NO: 27455 - RNA, 20 nt, Artificial Sequence
  MKO10027455_A_Kirrel2
  gRNA
ugaauccccacgacuccgac

SEQ ID NO: 27456 - RNA, 20 nt, Artificial Sequence
  MKO10027456_A_Kirrel2
  gRNA
ccuguacgcgcccagagcgc

SEQ ID NO: 27457 - RNA, 20 nt, Artificial Sequence
  MKO10027457_A_Kirrel3
  gRNA
ugaggggguccccugcccga

SEQ ID NO: 27458 - RNA, 20 nt, Artificial Sequence
  MKO10027458_A_Kirrel3
  gRNA
ugaugccguguaugagugcc

SEQ ID NO: 27459 - RNA, 20 nt, Artificial Sequence
  MKO10027459_A_Kirrel3
  gRNA
cccugcacgccucaccgucc

SEQ ID NO: 27460 - RNA, 20 nt, Artificial Sequence
  MKO10027460_A_Kirrel
  gRNA
uacugcgacaggugaauacg

SEQ ID NO: 27461 - RNA, 20 nt, Artificial Sequence
  MKO10027461_A_Kirrel
  gRNA
gucgugggcucugcggaugc

SEQ ID NO: 27462 - RNA, 20 nt, Artificial Sequence
  MKO10027462_A_Kirrel
  gRNA
cauuaaaugcucugcacgug

SEQ ID NO: 27463 - RNA, 20 nt, Artificial Sequence
  MKO10027463_A_Kiss1r
  gRNA
ucgaagcuaugccgccuacg

SEQ ID NO: 27464 - RNA, 20 nt, Artificial Sequence
  MKO10027464_A_Kiss1r
  gRNA
agcccagaucuugaccgcgu

SEQ ID NO: 27465 - RNA, 20 nt, Artificial Sequence
  MKO10027465_A_Kiss1r
  gRNA
cggcggugaagugcacgcag

SEQ ID NO: 27466 - RNA, 20 nt, Artificial Sequence
  MKO10027466_A_Kiss1
  gRNA
gucgccaugcccgccgguug

SEQ ID NO: 27467 - RNA, 20 nt, Artificial Sequence
  MKO10027467_A_Kiss1
  gRNA
gcgcagggaucaggcgacug

SEQ ID NO: 27468 - RNA, 20 nt, Artificial Sequence
  MKO10027468_A_Kiss1
  gRNA
cuccucugugucgccaccua

SEQ ID NO: 27469 - RNA, 20 nt, Artificial Sequence
  MKO10027469_A_Kitl
  gRNA
ggaugaccucguguuaugca

SEQ ID NO: 27470 - RNA, 20 nt, Artificial Sequence
  MKO10027470_A_Kitl
  gRNA
acucagcuugacuacucuuc

SEQ ID NO: 27471 - RNA, 20 nt, Artificial Sequence
  MKO10027471_A_Kitl
  gRNA
auaacccucaacuaugucgc

SEQ ID NO: 27472 - RNA, 20 nt, Artificial Sequence
  MKO10027472_A_Kit
  gRNA
acgugaagcgcgccuaccac

SEQ ID NO: 27473 - RNA, 20 nt, Artificial Sequence
  MKO10027473_A_Kit
  gRNA
acacguaaauagaacucgug

SEQ ID NO: 27474 - RNA, 20 nt, Artificial Sequence
  MKO10027474_A_Kit
  gRNA
gaucaaugcacgucaggcug

SEQ ID NO: 27475 - RNA, 20 nt, Artificial Sequence
  MKO10027475_A_Klb
  gRNA
gguaggugucauuacucgug

SEQ ID NO: 27476 - RNA, 20 nt, Artificial Sequence
  MKO10027476_A_Klb
  gRNA
cgacuauccaucgguuauga

SEQ ID NO: 27477 - RNA, 20 nt, Artificial Sequence
  MKO10027477_A_Klb
  gRNA
ccgacccuucaugucuggcg

SEQ ID NO: 27478 - RNA, 20 nt, Artificial Sequence
  MKO10027478_A_Klc1
  gRNA
gaucucguagccgcccugcu

SEQ ID NO: 27479 - RNA, 20 nt, Artificial Sequence
  MKO10027479_A_Klc1
  gRNA
acagccgucgaaccugagcg

SEQ ID NO: 27480 - RNA, 20 nt, Artificial Sequence
  MKO10027480_A_Klc1
  gRNA
gaagcaaaagcuccgcgcuc

SEQ ID NO: 27481 - RNA, 20 nt, Artificial Sequence
  MKO10027481_A_Klc2
  gRNA
cuuaccgauaaaccagugcc

SEQ ID NO: 27482 - RNA, 20 nt, Artificial Sequence
  MKO10027482_A_Klc2
  gRNA
agcggccuugugaagcauac

SEQ ID NO: 27483 - RNA, 20 nt, Artificial Sequence
  MKO10027483_A_Klc2
  gRNA
ccuggcauuaucaagccauc

SEQ ID NO: 27484 - RNA, 20 nt, Artificial Sequence
  MKO10027484_A_Klc3
  gRNA
uucacgacgcccugcagauc

SEQ ID NO: 27485 - RNA, 20 nt, Artificial Sequence
  MKO10027485_A_Klc3
  gRNA
cugccaccucauagcggccc

SEQ ID NO: 27486 - RNA, 20 nt, Artificial Sequence
  MKO10027486_A_Klc3
  gRNA
ggcaguuccccuaugucgcc

SEQ ID NO: 27487 - RNA, 20 nt, Artificial Sequence
  MKO10027487_A_Klc4
  gRNA
ccuggcauagccgccgcacu

SEQ ID NO: 27488 - RNA, 20 nt, Artificial Sequence
  MKO10027488_A_Klc4
  gRNA
ggcaaacucacagucguugc

SEQ ID NO: 27489 - RNA, 20 nt, Artificial Sequence
  MKO10027489_A_Klc4
  gRNA
ugaguuagugucccgugguc

SEQ ID NO: 27490 - RNA, 20 nt, Artificial Sequence
  MKO10027490_A_Klf10
  gRNA
agaagcgccgaaguugagca

SEQ ID NO: 27491 - RNA, 20 nt, Artificial Sequence
  MKO10027491_A_Klf10
  gRNA
gaguagccucaacauuuccg

SEQ ID NO: 27492 - RNA, 20 nt, Artificial Sequence
  MKO10027492_A_Klf10
  gRNA
ugagggcaccgucguguuug

SEQ ID NO: 27493 - RNA, 20 nt, Artificial Sequence
  MKO10027493_A_Klf11
  gRNA
acuuaccgcgcgcccgucgc

SEQ ID NO: 27494 - RNA, 20 nt, Artificial Sequence
  MKO10027494_A_Klf11
  gRNA
ggucacuccgcaugaagcgc

SEQ ID NO: 27495 - RNA, 20 nt, Artificial Sequence
  MKO10027495_A_Klf11
  gRNA
aagguccacaugcagcgucc

SEQ ID NO: 27496 - RNA, 20 nt, Artificial Sequence
  MKO10027496_A_Klf12
  gRNA
cguccacaacuaccccgaua

SEQ ID NO: 27497 - RNA, 20 nt, Artificial Sequence
  MKO10027497_A_Klf12
  gRNA
cacuauuguuguaccgcucc

SEQ ID NO: 27498 - RNA, 20 nt, Artificial Sequence
  MKO10027498_A_Klf12
  gRNA
cauucgauuuccucggaccc

SEQ ID NO: 27499 - RNA, 20 nt, Artificial Sequence
  MKO10027499_A_Klf13
  gRNA
cgucgcggcgcucgucaacg

SEQ ID NO: 27500 - RNA, 20 nt, Artificial Sequence
  MKO10027500_A_Klf13
  gRNA
cuuucucgcagcccgcguag

SEQ ID NO: 27501 - RNA, 20 nt, Artificial Sequence
  MKO10027501_A_Klf13
  gRNA
caacaagaaguucgcacgcu

SEQ ID NO: 27502 - RNA, 20 nt, Artificial Sequence
  MKO10027502_A_Klf14
  gRNA
cccgacaugaucgaguaccg

SEQ ID NO: 27503 - RNA, 20 nt, Artificial Sequence
  MKO10027503_A_Klf14
  gRNA
gucgcagucgagccaaucac

SEQ ID NO: 27504 - RNA, 20 nt, Artificial Sequence
  MKO10027504_A_Klf14
  gRNA
cgcggguggacauagacacc

SEQ ID NO: 27505 - RNA, 20 nt, Artificial Sequence
  MKO10027505_A_Klf15
  gRNA
cgcaauucgcacaaacuuug

SEQ ID NO: 27506 - RNA, 20 nt, Artificial Sequence
  MKO10027506_A_Klf15
  gRNA
cgcgaauuucuucucgcaca

SEQ ID NO: 27507 - RNA, 20 nt, Artificial Sequence
  MKO10027507_A_Klf15
  gRNA
ucacacccgagugagaucgc

SEQ ID NO: 27508 - RNA, 20 nt, Artificial Sequence
  MKO10027508_A_Klf16
  gRNA
ucgggagccguggugcaucg

SEQ ID NO: 27509 - RNA, 20 nt, Artificial Sequence
  MKO10027509_A_Klf16
  gRNA
ccggaacuccugcgacgacc

SEQ ID NO: 27510 - RNA, 20 nt, Artificial Sequence
  MKO10027510_A_Klf16
  gRNA
gggucguccgcgaugcacca

SEQ ID NO: 27511 - RNA, 20 nt, Artificial Sequence
  MKO10027511_A_Klf17
  gRNA
gugggcggcucacguacgaa

SEQ ID NO: 27512 - RNA, 20 nt, Artificial Sequence
  MKO10027512_A_Klf17
  gRNA
acucacaaggugagagcgcu

SEQ ID NO: 27513 - RNA, 20 nt, Artificial Sequence
  MKO10027513_A_Klf17
  gRNA
uccguuccagucacaugcga

SEQ ID NO: 27514 - RNA, 20 nt, Artificial Sequence
  MKO10027514_A_Klf1
  gRNA
cucguacuccgacucgcgag

SEQ ID NO: 27515 - RNA, 20 nt, Artificial Sequence
  MKO10027515_A_Klf1
  gRNA
gacggccccgugggauucgg

SEQ ID NO: 27516 - RNA, 20 nt, Artificial Sequence
  MKO10027516_A_Klf1
  gRNA
ucagagcgugaaaaagcacg

SEQ ID NO: 27517 - RNA, 20 nt, Artificial Sequence
  MKO10027517_A_Klf2
  gRNA
cgcguccucgaaaagaccga

SEQ ID NO: 27518 - RNA, 20 nt, Artificial Sequence
  MKO10027518_A_Klf2
  gRNA
cuggccgcgaaaugaacccg

SEQ ID NO: 27519 - RNA, 20 nt, Artificial Sequence
  MKO10027519_A_Klf2
  gRNA
gauaggcucgcugagcgcca

SEQ ID NO: 27520 - RNA, 20 nt, Artificial Sequence
  MKO10027520_A_Klf3
  gRNA
ccccgucauucagcccgucg

SEQ ID NO: 27521 - RNA, 20 nt, Artificial Sequence
  MKO10027521_A_Klf3
  gRNA
gaaggagaaccgcccgcagc

SEQ ID NO: 27522 - RNA, 20 nt, Artificial Sequence
  MKO10027522_A_Klf3
  gRNA
gcugcacguggaaguucgcu

SEQ ID NO: 27523 - RNA, 20 nt, Artificial Sequence
  MKO10027523_A_Klf4
  gRNA
uccuucuccacguucgcguc

SEQ ID NO: 27524 - RNA, 20 nt, Artificial Sequence
  MKO10027524_A_Klf4
  gRNA
gcagcuucagcuauccgauc

SEQ ID NO: 27525 - RNA, 20 nt, Artificial Sequence
  MKO10027525_A_Klf4
  gRNA
gccggacgcgaacguggaga

SEQ ID NO: 27526 - RNA, 20 nt, Artificial Sequence
  MKO10027526_A_Klf5
  gRNA
cgcguguuucagaucgucuc

SEQ ID NO: 27527 - RNA, 20 nt, Artificial Sequence
  MKO10027527_A_Klf5
  gRNA
ugcgaacccggcccgcgacg

SEQ ID NO: 27528 - RNA, 20 nt, Artificial Sequence
  MKO10027528_A_Klf5
  gRNA
gaggggccgucgacucgcuc

SEQ ID NO: 27529 - RNA, 20 nt, Artificial Sequence
  MKO10027529_A_Klf6
  gRNA
cgugcacaaucuguaguucc

SEQ ID NO: 27530 - RNA, 20 nt, Artificial Sequence
  MKO10027530_A_Klf6
  gRNA
aucagagguaaauuuggucg

SEQ ID NO: 27531 - RNA, 20 nt, Artificial Sequence
  MKO10027531_A_Klf6
  gRNA
acuacagauugugcacgaaa

SEQ ID NO: 27532 - RNA, 20 nt, Artificial Sequence
  MKO10027532_A_Klf7
  gRNA
acccguuaaacugacagcga

SEQ ID NO: 27533 - RNA, 20 nt, Artificial Sequence
  MKO10027533_A_Klf7
  gRNA
agauccgccgggguucuguc

SEQ ID NO: 27534 - RNA, 20 nt, Artificial Sequence
  MKO10027534_A_Klf7
  gRNA
augagcucacaaggcacuac

SEQ ID NO: 27535 - RNA, 20 nt, Artificial Sequence
  MKO10027535_A_Klf8
  gRNA
auccgagcgagcaaauuucc

SEQ ID NO: 27536 - RNA, 20 nt, Artificial Sequence
  MKO10027536_A_Klf8
  gRNA
uucacauggugucaugacgc

SEQ ID NO: 27537 - RNA, 20 nt, Artificial Sequence
  MKO10027537_A_Klf8
  gRNA
uugccgucuccuccaaugag

SEQ ID NO: 27538 - RNA, 20 nt, Artificial Sequence
  MKO10027538_A_Klf9
  gRNA
cuccaaccgcgccgccgugc

SEQ ID NO: 27539 - RNA, 20 nt, Artificial Sequence
  MKO10027539_A_Klf9
  gRNA
cauguccgcggccgccuaca

SEQ ID NO: 27540 - RNA, 20 nt, Artificial Sequence
  MKO10027540_A_Klf9
  gRNA
gauggaacucggugugacgc

SEQ ID NO: 27541 - RNA, 20 nt, Artificial Sequence
  MKO10027541_A_Klhdc10
  gRNA
gcaguaccuguccguauaua

SEQ ID NO: 27542 - RNA, 20 nt, Artificial Sequence
  MKO10027542_A_Klhdc10
  gRNA
cuguaccuccgaacacuaac

SEQ ID NO: 27543 - RNA, 20 nt, Artificial Sequence
  MKO10027543_A_Klhdc10
  gRNA
ugaaugaagcgccuccuaac

SEQ ID NO: 27544 - RNA, 20 nt, Artificial Sequence
  MKO10027544_A_Klhdc1
  gRNA
cagcccacuaucaauaucgu

SEQ ID NO: 27545 - RNA, 20 nt, Artificial Sequence
  MKO10027545_A_Klhdc1
  gRNA
agccccgcagcuucccgaca

SEQ ID NO: 27546 - RNA, 20 nt, Artificial Sequence
  MKO10027546_A_Klhdc1
  gRNA
uuuggaggcuaugacgacaa

SEQ ID NO: 27547 - RNA, 20 nt, Artificial Sequence
  MKO10027547_A_Klhdc2
  gRNA
gacguucccccgucuauguc

SEQ ID NO: 27548 - RNA, 20 nt, Artificial Sequence
  MKO10027548_A_Klhdc2
  gRNA
gcugcgcugugugcguggac

SEQ ID NO: 27549 - RNA, 20 nt, Artificial Sequence
  MKO10027549_A_Klhdc2
  gRNA
ugggaaaggaucgacugcca

SEQ ID NO: 27550 - RNA, 20 nt, Artificial Sequence
  MKO10027550_A_Klhdc3
  gRNA
gucguucccuacaugcgcua

SEQ ID NO: 27551 - RNA, 20 nt, Artificial Sequence
  MKO10027551_A_Klhdc3
  gRNA
uauccacaguguccuugcgu

SEQ ID NO: 27552 - RNA, 20 nt, Artificial Sequence
  MKO10027552_A_Klhdc3
  gRNA
gcuagggcaauccugcacgu

SEQ ID NO: 27553 - RNA, 20 nt, Artificial Sequence
  MKO10027553_A_Klhdc4
  gRNA
ggggaguuugcaucucccga

SEQ ID NO: 27554 - RNA, 20 nt, Artificial Sequence
  MKO10027554_A_Klhdc4
  gRNA
augguagaacugcucgccau

SEQ ID NO: 27555 - RNA, 20 nt, Artificial Sequence
  MKO10027555_A_Klhdc4
  gRNA
uaccugaugagcacagcgcc

SEQ ID NO: 27556 - RNA, 20 nt, Artificial Sequence
  MKO10027556_A_Klhdc7a
  gRNA
ugccuuccagugcgccguug

SEQ ID NO: 27557 - RNA, 20 nt, Artificial Sequence
  MKO10027557_A_Klhdc7a
  gRNA
auucuccagcgcagguuccg

SEQ ID NO: 27558 - RNA, 20 nt, Artificial Sequence
  MKO10027558_A_Klhdc7a
  gRNA
uguaagaucaguccaaccgu

SEQ ID NO: 27559 - RNA, 20 nt, Artificial Sequence
  MKO10027559_A_Klhdc7b
  gRNA
cuugcugcaugggccgaauc

SEQ ID NO: 27560 - RNA, 20 nt, Artificial Sequence
  MKO10027560_A_Klhdc7b
  gRNA
cguuuccuccuccguugccg

SEQ ID NO: 27561 - RNA, 20 nt, Artificial Sequence
  MKO10027561_A_Klhdc7b
  gRNA
ggaccgggcugugccgaaac

SEQ ID NO: 27562 - RNA, 20 nt, Artificial Sequence
  MKO10027562_A_Klhdc8a
  gRNA
gcccaaguuccuccggacaa

SEQ ID NO: 27563 - RNA, 20 nt, Artificial Sequence
  MKO10027563_A_Klhdc8a
  gRNA
ugcgccagggccgucuguac

SEQ ID NO: 27564 - RNA, 20 nt, Artificial Sequence
  MKO10027564_A_Klhdc8a
  gRNA
gauuaucgaguguaugccgc

SEQ ID NO: 27565 - RNA, 20 nt, Artificial Sequence
  MKO10027565_A_Klhdc8b
  gRNA
uccuuugacaggaggccgcc

SEQ ID NO: 27566 - RNA, 20 nt, Artificial Sequence
  MKO10027566_A_Klhdc8b
  gRNA
uacugguauaugagccccgc

SEQ ID NO: 27567 - RNA, 20 nt, Artificial Sequence
  MKO10027567_A_Klhdc8b
  gRNA
ggggcucauauaccaguacc

SEQ ID NO: 27568 - RNA, 20 nt, Artificial Sequence
  MKO10027568_A_Klhdc9
  gRNA
cgggucacgucgcuuaucca

SEQ ID NO: 27569 - RNA, 20 nt, Artificial Sequence
  MKO10027569_A_Klhdc9
  gRNA
uccgccaaauaguacagcga

SEQ ID NO: 27570 - RNA, 20 nt, Artificial Sequence
  MKO10027570_A_Klhdc9
  gRNA
agaagcacgucucgcgccac

SEQ ID NO: 27571 - RNA, 20 nt, Artificial Sequence
  MKO10027571_A_Klhl10
  gRNA
gugcgccaaguauuagccac

SEQ ID NO: 27572 - RNA, 20 nt, Artificial Sequence
  MKO10027572_A_Klhl10
  gRNA
gcgagcgccacaacacucua

SEQ ID NO: 27573 - RNA, 20 nt, Artificial Sequence
  MKO10027573_A_Klhl10
  gRNA
uaugccauccuauucgcuau

SEQ ID NO: 27574 - RNA, 20 nt, Artificial Sequence
  MKO10027574_A_Klhl11
  gRNA
cgaguuccgugcccaccgcu

SEQ ID NO: 27575 - RNA, 20 nt, Artificial Sequence
  MKO10027575_A_Klhl11
  gRNA
cgcucccgcccgugucgacg

SEQ ID NO: 27576 - RNA, 20 nt, Artificial Sequence
  MKO10027576_A_Klhl11
  gRNA
cugguuugacaugccgugua

SEQ ID NO: 27577 - RNA, 20 nt, Artificial Sequence
  MKO10027577_A_Klhl12
  gRNA
aaucaagugcgacgagauuc

SEQ ID NO: 27578 - RNA, 20 nt, Artificial Sequence
  MKO10027578_A_Klhl12
  gRNA
accuagccgggcccuuguuc

SEQ ID NO: 27579 - RNA, 20 nt, Artificial Sequence
  MKO10027579_A_Klhl12
  gRNA
uccucgugcugcaccacuuc

SEQ ID NO: 27580 - RNA, 20 nt, Artificial Sequence
  MKO10027580_A_Klhl13
  gRNA
guugguggacgaaaugcagc

SEQ ID NO: 27581 - RNA, 20 nt, Artificial Sequence
  MKO10027581_A_Klhl13
  gRNA
gacaaaggcaaggcgcucga

SEQ ID NO: 27582 - RNA, 20 nt, Artificial Sequence
  MKO10027582_A_Klhl13
  gRNA
gcaauccaucaagccgaagc

SEQ ID NO: 27583 - RNA, 20 nt, Artificial Sequence
  MKO10027583_A_Klhl14
  gRNA
ugcccaccacugcguuguag

SEQ ID NO: 27584 - RNA, 20 nt, Artificial Sequence
  MKO10027584_A_Klhl14
  gRNA
augauccccgauuuaauagu

SEQ ID NO: 27585 - RNA, 20 nt, Artificial Sequence
  MKO10027585_A_Klhl14
  gRNA
gauugccucccggaccagac

SEQ ID NO: 27586 - RNA, 20 nt, Artificial Sequence
  MKO10027586_A_Klhl15
  gRNA
ggcugcgacaugauagacga

SEQ ID NO: 27587 - RNA, 20 nt, Artificial Sequence
  MKO10027587_A_Klhl15
  gRNA
auaccugaacacuuucgaag

SEQ ID NO: 27588 - RNA, 20 nt, Artificial Sequence
  MKO10027588_A_Klhl15
  gRNA
ccccaaacuacaguauuccg

SEQ ID NO: 27589 - RNA, 20 nt, Artificial Sequence
  MKO10027589_A_Klhl17
  gRNA
gugcgacaucguccugcaug

SEQ ID NO: 27590 - RNA, 20 nt, Artificial Sequence
  MKO10027590_A_Klhl17
  gRNA
cccgcaagccuuagaccagc

SEQ ID NO: 27591 - RNA, 20 nt, Artificial Sequence
  MKO10027591_A_Klhl17
  gRNA
cugcaaauccucgaaugccc

SEQ ID NO: 27592 - RNA, 20 nt, Artificial Sequence
  MKO10027592_A_Klhl18
  gRNA
auuugugacagcaccguacc

SEQ ID NO: 27593 - RNA, 20 nt, Artificial Sequence
  MKO10027593_A_Klhl18
  gRNA
gcugcacguuccuccgagaa

SEQ ID NO: 27594 - RNA, 20 nt, Artificial Sequence
  MKO10027594_A_Klhl18
  gRNA
uggaggccgcuaagacgauc

SEQ ID NO: 27595 - RNA, 20 nt, Artificial Sequence
  MKO10027595_A_Klhl1
  gRNA
aucgaaagauaccugcucau

SEQ ID NO: 27596 - RNA, 20 nt, Artificial Sequence
  MKO10027596_A_Klhl1
  gRNA
ucuuucgauuuccaacuauc

SEQ ID NO: 27597 - RNA, 20 nt, Artificial Sequence
  MKO10027597_A_Klhl1
  gRNA
caacacacuucgaccacuug

SEQ ID NO: 27598 - RNA, 20 nt, Artificial Sequence
  MKO10027598_A_Klhl20
  gRNA
agguguaccaacauucgacc

SEQ ID NO: 27599 - RNA, 20 nt, Artificial Sequence
  MKO10027599_A_Klhl20
  gRNA
ccacggaaaccuauccgaug

SEQ ID NO: 27600 - RNA, 20 nt, Artificial Sequence
  MKO10027600_A_Klhl20
  gRNA
ugcauuaguggucguucuug

SEQ ID NO: 27601 - RNA, 20 nt, Artificial Sequence
  MKO10027601_A_Klhl21
  gRNA
cugcgcuaccugcgcgacga

SEQ ID NO: 27602 - RNA, 20 nt, Artificial Sequence
  MKO10027602_A_Klhl21
  gRNA
augcguccgcgcccguccac

SEQ ID NO: 27603 - RNA, 20 nt, Artificial Sequence
  MKO10027603_A_Klhl21
  gRNA
gucauagcgcuccgugcugu

SEQ ID NO: 27604 - RNA, 20 nt, Artificial Sequence
  MKO10027604_A_Klhl22
  gRNA
uucgagcugagucccgaugc

SEQ ID NO: 27605 - RNA, 20 nt, Artificial Sequence
  MKO10027605_A_Klhl22
  gRNA
ccaugccaggcccgucgcac

SEQ ID NO: 27606 - RNA, 20 nt, Artificial Sequence
  MKO10027606_A_Klhl22
  gRNA
ccagugcccuuauguaccac

SEQ ID NO: 27607 - RNA, 20 nt, Artificial Sequence
  MKO10027607_A_Klhl23
  gRNA
ggugugggcucgcaguaaua

SEQ ID NO: 27608 - RNA, 20 nt, Artificial Sequence
  MKO10027608_A_Klhl23
  gRNA
ggcugugucuacgcacuagg

SEQ ID NO: 27609 - RNA, 20 nt, Artificial Sequence
  MKO10027609_A_Klhl23
  gRNA
gcaaucucccgagugccaug

SEQ ID NO: 27610 - RNA, 20 nt, Artificial Sequence
  MKO10027610_A_Klhl24
  gRNA
gcccaccagcuacguagauc

SEQ ID NO: 27611 - RNA, 20 nt, Artificial Sequence
  MKO10027611_A_Klhl24
  gRNA
acgaucccguugaagacuac

SEQ ID NO: 27612 - RNA, 20 nt, Artificial Sequence
  MKO10027612_A_Klhl24
  gRNA
guuggaggcugugaacgagu

SEQ ID NO: 27613 - RNA, 20 nt, Artificial Sequence
  MKO10027613_A_Klhl25
  gRNA
gcuccugcguaacgugcgac

SEQ ID NO: 27614 - RNA, 20 nt, Artificial Sequence
  MKO10027614_A_Klhl25
  gRNA
gggccagucgcacguuacgc

SEQ ID NO: 27615 - RNA, 20 nt, Artificial Sequence
  MKO10027615_A_Klhl25
  gRNA
uucucgcaucgucaucaaug

SEQ ID NO: 27616 - RNA, 20 nt, Artificial Sequence
  MKO10027616_A_Klhl26
  gRNA
gcgcucugauguagcguccc

SEQ ID NO: 27617 - RNA, 20 nt, Artificial Sequence
  MKO10027617_A_Klhl26
  gRNA
augauccacagcgcaaucgc

SEQ ID NO: 27618 - RNA, 20 nt, Artificial Sequence
  MKO10027618_A_Klhl26
  gRNA
gacucaccugcucgggcgcu

SEQ ID NO: 27619 - RNA, 20 nt, Artificial Sequence
  MKO10027619_A_Klhl28
  gRNA
ggagcguuacgauccgagua

SEQ ID NO: 27620 - RNA, 20 nt, Artificial Sequence
  MKO10027620_A_Klhl28
  gRNA
cauuguggaguacgccuaua

SEQ ID NO: 27621 - RNA, 20 nt, Artificial Sequence
  MKO10027621_A_Klhl28
  gRNA
auugaaacuagcgugcgucc

SEQ ID NO: 27622 - RNA, 20 nt, Artificial Sequence
  MKO10027622_A_Klhl29
  gRNA
ucaccccgaugacgggggcc

SEQ ID NO: 27623 - RNA, 20 nt, Artificial Sequence
  MKO10027623_A_Klhl29
  gRNA
aacuuaccuuuagggugccc

SEQ ID NO: 27624 - RNA, 20 nt, Artificial Sequence
  MKO10027624_A_Klhl29
  gRNA
acucacgaccagcauccgau

SEQ ID NO: 27625 - RNA, 20 nt, Artificial Sequence
  MKO10027625_A_Klhl2
  gRNA
ugcacaccugcucgaugccg

SEQ ID NO: 27626 - RNA, 20 nt, Artificial Sequence
  MKO10027626_A_Klhl2
  gRNA
ccacgauaaggacguaagac

SEQ ID NO: 27627 - RNA, 20 nt, Artificial Sequence
  MKO10027627_A_Klhl2
  gRNA
ccugucuuacguccuuaucg

SEQ ID NO: 27628 - RNA, 20 nt, Artificial Sequence
  MKO10027628_A_Klhl30
  gRNA
caguugggcucccgucggcc

SEQ ID NO: 27629 - RNA, 20 nt, Artificial Sequence
  MKO10027629_A_Klhl30
  gRNA
gggagcccaacuguccgugu

SEQ ID NO: 27630 - RNA, 20 nt, Artificial Sequence
  MKO10027630_A_Klhl30
  gRNA
guucguacgggccuucagca

SEQ ID NO: 27631 - RNA, 20 nt, Artificial Sequence
  MKO10027631_A_Klhl31
  gRNA
gaucacgcggccgucggcca

SEQ ID NO: 27632 - RNA, 20 nt, Artificial Sequence
  MKO10027632_A_Klhl31
  gRNA
acgaccccgcgcucgacgcg

SEQ ID NO: 27633 - RNA, 20 nt, Artificial Sequence
  MKO10027633_A_Klhl31
  gRNA
agugaucgcguaugcuuaca

SEQ ID NO: 27634 - RNA, 20 nt, Artificial Sequence
  MKO10027634_A_Klhl32
  gRNA
cuaggaccgccuugugagcg

SEQ ID NO: 27635 - RNA, 20 nt, Artificial Sequence
  MKO10027635_A_Klhl32
  gRNA
gccgaugaaguaaauuuacg

SEQ ID NO: 27636 - RNA, 20 nt, Artificial Sequence
  MKO10027636_A_Klhl32
  gRNA
uuugcugauucagcgccgcc

SEQ ID NO: 27637 - RNA, 20 nt, Artificial Sequence
  MKO10027637_A_Klhl33
  gRNA
gcuccgugccgaaagcgccc

SEQ ID NO: 27638 - RNA, 20 nt, Artificial Sequence
  MKO10027638_A_Klhl33
  gRNA
ggcuguagcccccuaguacc

SEQ ID NO: 27639 - RNA, 20 nt, Artificial Sequence
  MKO10027639_A_Klhl33
  gRNA
ugaguccagcuaucgcucuu

SEQ ID NO: 27640 - RNA, 20 nt, Artificial Sequence
  MKO10027640_A_Klhl34
  gRNA
cgggucauaacggugcacua

SEQ ID NO: 27641 - RNA, 20 nt, Artificial Sequence
  MKO10027641_A_Klhl34
  gRNA
gcgaccgcaaccgaguccac

SEQ ID NO: 27642 - RNA, 20 nt, Artificial Sequence
  MKO10027642_A_Klhl34
  gRNA
acaagaagcccucagcgcgu

SEQ ID NO: 27643 - RNA, 20 nt, Artificial Sequence
  MKO10027643_A_Klhl35
  gRNA
cuauacgugauugggggcgc

SEQ ID NO: 27644 - RNA, 20 nt, Artificial Sequence
  MKO10027644_A_Klhl35
  gRNA
cauuggcgggugugaccgaa

SEQ ID NO: 27645 - RNA, 20 nt, Artificial Sequence
  MKO10027645_A_Klhl35
  gRNA
cgcccccaaucacguauagc

SEQ ID NO: 27646 - RNA, 20 nt, Artificial Sequence
  MKO10027646_A_Klhl36
  gRNA
augacccccgccguaaacag

SEQ ID NO: 27647 - RNA, 20 nt, Artificial Sequence
  MKO10027647_A_Klhl36
  gRNA
caguacgaagcuaucgauga

SEQ ID NO: 27648 - RNA, 20 nt, Artificial Sequence
  MKO10027648_A_Klhl36
  gRNA
guggucgucacugcccccga

SEQ ID NO: 27649 - RNA, 20 nt, Artificial Sequence
  MKO10027649_A_Klhl38
  gRNA
auuaccuggauaaggcguac

SEQ ID NO: 27650 - RNA, 20 nt, Artificial Sequence
  MKO10027650_A_Klhl38
  gRNA
augacagcauccgugacguc

SEQ ID NO: 27651 - RNA, 20 nt, Artificial Sequence
  MKO10027651_A_Klhl38
  gRNA
gggaacaagcuguacgugac

SEQ ID NO: 27652 - RNA, 20 nt, Artificial Sequence
  MKO10027652_A_Klhl3
  gRNA
aacguggccuuaugcuucgu

SEQ ID NO: 27653 - RNA, 20 nt, Artificial Sequence
  MKO10027653_A_Klhl3
  gRNA
aaccgucaacgcugcccaca

SEQ ID NO: 27654 - RNA, 20 nt, Artificial Sequence
  MKO10027654_A_Klhl3
  gRNA
gcugugugacgugaugaucg

SEQ ID NO: 27655 - RNA, 20 nt, Artificial Sequence
  MKO10027655_A_Klhl40
  gRNA
acucaguccugugcuacgac

SEQ ID NO: 27656 - RNA, 20 nt, Artificial Sequence
  MKO10027656_A_Klhl40
  gRNA
ccgcugcccuacgccgugua

SEQ ID NO: 27657 - RNA, 20 nt, Artificial Sequence
  MKO10027657_A_Klhl40
  gRNA
cagacagcccgaucgcucuu

SEQ ID NO: 27658 - RNA, 20 nt, Artificial Sequence
  MKO10027658_A_Klhl41
  gRNA
gcgggagcccuguacgccau

SEQ ID NO: 27659 - RNA, 20 nt, Artificial Sequence
  MKO10027659_A_Klhl41
  gRNA
caaagccaccgauggcguac

SEQ ID NO: 27660 - RNA, 20 nt, Artificial Sequence
  MKO10027660_A_Klhl41
  gRNA
gccacgccaaacauggaacg

SEQ ID NO: 27661 - RNA, 20 nt, Artificial Sequence
  MKO10027661_A_Klhl42
  gRNA
cguagccccugacguucacc

SEQ ID NO: 27662 - RNA, 20 nt, Artificial Sequence
  MKO10027662_A_Klhl42
  gRNA
uuccgcgcgcucuaccgcuc

SEQ ID NO: 27663 - RNA, 20 nt, Artificial Sequence
  MKO10027663_A_Klhl42
  gRNA
auuggcggauauaccacccg

SEQ ID NO: 27664 - RNA, 20 nt, Artificial Sequence
  MKO10027664_A_Klhl4
  gRNA
uuagugcaguaugcuuauac

SEQ ID NO: 27665 - RNA, 20 nt, Artificial Sequence
  MKO10027665_A_Klhl4
  gRNA
ucgcucauuuggagaugcac

SEQ ID NO: 27666 - RNA, 20 nt, Artificial Sequence
  MKO10027666_A_Klhl4
  gRNA
ugugaugugcuacuuauugc

SEQ ID NO: 27667 - RNA, 20 nt, Artificial Sequence
  MKO10027667_A_Klhl5
  gRNA
uuaauucaguacgcguacac

SEQ ID NO: 27668 - RNA, 20 nt, Artificial Sequence
  MKO10027668_A_Klhl5
  gRNA
uguguacgcguacugaauua

SEQ ID NO: 27669 - RNA, 20 nt, Artificial Sequence
  MKO10027669_A_Klhl5
  gRNA
uacugaacgcgcuucucacc

SEQ ID NO: 27670 - RNA, 20 nt, Artificial Sequence
  MKO10027670_A_Klhl6
  gRNA
gugguaaacgcacauucucg

SEQ ID NO: 27671 - RNA, 20 nt, Artificial Sequence
  MKO10027671_A_Klhl6
  gRNA
uuucggagcgcaccaagccc

SEQ ID NO: 27672 - RNA, 20 nt, Artificial Sequence
  MKO10027672_A_Klhl6
  gRNA
ccuccaggcgacugcgccuc

SEQ ID NO: 27673 - RNA, 20 nt, Artificial Sequence
  MKO10027673_A_Klhl7
  gRNA
ccccgcucaccgcguugucc

SEQ ID NO: 27674 - RNA, 20 nt, Artificial Sequence
  MKO10027674_A_Klhl7
  gRNA
agccaggacaacgcggugag

SEQ ID NO: 27675 - RNA, 20 nt, Artificial Sequence
  MKO10027675_A_Klhl7
  gRNA
accugauauuauugaacaac

SEQ ID NO: 27676 - RNA, 20 nt, Artificial Sequence
  MKO10027676_A_Klhl8
  gRNA
gaucucgauuaacgccugcu

SEQ ID NO: 27677 - RNA, 20 nt, Artificial Sequence
  MKO10027677_A_Klhl8
  gRNA
ucacaaccgaauagaccuaa

SEQ ID NO: 27678 - RNA, 20 nt, Artificial Sequence
  MKO10027678_A_Klhl8
  gRNA
acacagucaggacgaccccg

SEQ ID NO: 27679 - RNA, 20 nt, Artificial Sequence
  MKO10027679_A_Klhl9
  gRNA
aguuacgaauguacgacgaa

SEQ ID NO: 27680 - RNA, 20 nt, Artificial Sequence
  MKO10027680_A_Klhl9
  gRNA
ccuacuuugugacgugacgc

SEQ ID NO: 27681 - RNA, 20 nt, Artificial Sequence
  MKO10027681_A_Klhl9
  gRNA
auucgccaacucuugaccag

SEQ ID NO: 27682 - RNA, 20 nt, Artificial Sequence
  MKO10027682_A_Klk10
  gRNA
cgccacgcgcguggaccucg

SEQ ID NO: 27683 - RNA, 20 nt, Artificial Sequence
  MKO10027683_A_Klk10
  gRNA
gaugauagucacgcucgcac

SEQ ID NO: 27684 - RNA, 20 nt, Artificial Sequence
  MKO10027684_A_Klk10
  gRNA
ucguguucaucugagcgaug

SEQ ID NO: 27685 - RNA, 20 nt, Artificial Sequence
  MKO10027685_A_Klk11
  gRNA
gcccccuucagggcacguag

SEQ ID NO: 27686 - RNA, 20 nt, Artificial Sequence
  MKO10027686_A_Klk11
  gRNA
cuugcccucuuuccgaacac

SEQ ID NO: 27687 - RNA, 20 nt, Artificial Sequence
  MKO10027687_A_Klk11
  gRNA
acacuccuuguguucgauga

SEQ ID NO: 27688 - RNA, 20 nt, Artificial Sequence
  MKO10027688_A_Klk12
  gRNA
caaggacaccgccacagcgc

SEQ ID NO: 27689 - RNA, 20 nt, Artificial Sequence
  MKO10027689_A_Klk12
  gRNA
cacagcccggcacgucucau

SEQ ID NO: 27690 - RNA, 20 nt, Artificial Sequence
  MKO10027690_A_Klk12
  gRNA
cugucuccaaugagacgugc

SEQ ID NO: 27691 - RNA, 20 nt, Artificial Sequence
  MKO10027691_A_Klk13
  gRNA
gagacucguguguaaacgcc

SEQ ID NO: 27692 - RNA, 20 nt, Artificial Sequence
  MKO10027692_A_Klk13
  gRNA
ugaucucccggauccaacgc

SEQ ID NO: 27693 - RNA, 20 nt, Artificial Sequence
  MKO10027693_A_Klk13
  gRNA
cuccacagagaagucguccg

SEQ ID NO: 27694 - RNA, 20 nt, Artificial Sequence
  MKO10027694_A_Klk14
  gRNA
cucccugccgagugucgggc

SEQ ID NO: 27695 - RNA, 20 nt, Artificial Sequence
  MKO10027695_A_Klk14
  gRNA
auggaacguugugcuaugcc

SEQ ID NO: 27696 - RNA, 20 nt, Artificial Sequence
  MKO10027696_A_Klk14
  gRNA
cgugggccugggguugauac

SEQ ID NO: 27697 - RNA, 20 nt, Artificial Sequence
  MKO10027697_A_Klk15
  gRNA
cacaaucuccgcaaguucga

SEQ ID NO: 27698 - RNA, 20 nt, Artificial Sequence
  MKO10027698_A_Klk15
  gRNA
auggugggcaacacucgacc

SEQ ID NO: 27699 - RNA, 20 nt, Artificial Sequence
  MKO10027699_A_Klk15
  gRNA
cgugccaccgccuucgacgc

SEQ ID NO: 27700 - RNA, 20 nt, Artificial Sequence
  MKO10027700_A_Klk1b11
  gRNA
ucauugcucucaucguccuc

SEQ ID NO: 27701 - RNA, 20 nt, Artificial Sequence
  MKO10027701_A_Klk1b11
  gRNA
aacuuauuaaguuuaccaac

SEQ ID NO: 27702 - RNA, 20 nt, Artificial Sequence
  MKO10027702_A_Klk1b11
  gRNA
gcauggggcccuaucccaug

SEQ ID NO: 27703 - RNA, 20 nt, Artificial Sequence
  MKO10027703_A_Klk1b16
  gRNA
ggccaauugauacgguuccu

SEQ ID NO: 27704 - RNA, 20 nt, Artificial Sequence
  MKO10027704_A_Klk1b16
  gRNA
gauacaccagguauaccgca

SEQ ID NO: 27705 - RNA, 20 nt, Artificial Sequence
  MKO10027705_A_Klk1b16
  gRNA
accuuugaaaaguuaccucc

SEQ ID NO: 27706 - RNA, 20 nt, Artificial Sequence
  MKO10027706_A_Klk1b1
  gRNA
uuuggaugcgguuccgaugg

SEQ ID NO: 27707 - RNA, 20 nt, Artificial Sequence
  MKO10027707_A_Klk1b1
  gRNA
gcuacaacaugagccuccau

SEQ ID NO: 27708 - RNA, 20 nt, Artificial Sequence
  MKO10027708_A_Klk1b1
  gRNA
uguggcuguguaccgcuaca

SEQ ID NO: 27709 - RNA, 20 nt, Artificial Sequence
  MKO10027709_A_Klk1b21
  gRNA
ugcugaggcguaguaacauc

SEQ ID NO: 27710 - RNA, 20 nt, Artificial Sequence
  MKO10027710_A_Klk1b21
  gRNA
aucccaaaugaucuccagug

SEQ ID NO: 27711 - RNA, 20 nt, Artificial Sequence
  MKO10027711_A_Klk1b21
  gRNA
aacccacacuggagaucauu

SEQ ID NO: 27712 - RNA, 20 nt, Artificial Sequence
  MKO10027712_A_Klk1b22
  gRNA
ccaacaggacucccccgcau

SEQ ID NO: 27713 - RNA, 20 nt, Artificial Sequence
  MKO10027713_A_Klk1b22
  gRNA
uugcuuaagucggccccagu

SEQ ID NO: 27714 - RNA, 20 nt, Artificial Sequence
  MKO10027714_A_Klk1b22
  gRNA
cuccuccaaaguguaccuac

SEQ ID NO: 27715 - RNA, 20 nt, Artificial Sequence
  MKO10027715_A_Klk1b24
  gRNA
ugaugacaucccgcaaccua

SEQ ID NO: 27716 - RNA, 20 nt, Artificial Sequence
  MKO10027716_A_Klk1b24
  gRNA
ucaugggguccugucccaug

SEQ ID NO: 27717 - RNA, 20 nt, Artificial Sequence
  MKO10027717_A_Klk1b24
  gRNA
ggcgcauuggguuuaccaca

SEQ ID NO: 27718 - RNA, 20 nt, Artificial Sequence
  MKO10027718_A_Klk1b26
  gRNA
augcuucaaacaacaccucc

SEQ ID NO: 27719 - RNA, 20 nt, Artificial Sequence
  MKO10027719_A_Klk1b26
  gRNA
ucaaauggcccugaaccaug

SEQ ID NO: 27720 - RNA, 20 nt, Artificial Sequence
  MKO10027720_A_Klk1b26
  gRNA
guguuguuugaagcaucagg

SEQ ID NO: 27721 - RNA, 20 nt, Artificial Sequence
  MKO10027721_A_Klk1b27
  gRNA
ucccccgcauauauauuugu

SEQ ID NO: 27722 - RNA, 20 nt, Artificial Sequence
  MKO10027722_A_Klk1b27
  gRNA
ccuguccagucuagaauaau

SEQ ID NO: 27723 - RNA, 20 nt, Artificial Sequence
  MKO10027723_A_Klk1b27
  gRNA
ugcgcuaaacccaaugcgcc

SEQ ID NO: 27724 - RNA, 20 nt, Artificial Sequence
  MKO10027724_A_Klk1b3
  gRNA
ggacacccccgcauaaauau

SEQ ID NO: 27725 - RNA, 20 nt, Artificial Sequence
  MKO10027725_A_Klk1b3
  gRNA
cauaucagguucaccgcaug

SEQ ID NO: 27726 - RNA, 20 nt, Artificial Sequence
  MKO10027726_A_Klk1b3
  gRNA
aucggaugugcuuccucaug

SEQ ID NO: 27727 - RNA, 20 nt, Artificial Sequence
  MKO10027727_A_Klk1b4
  gRNA
ucauggggcccugaaccaug

SEQ ID NO: 27728 - RNA, 20 nt, Artificial Sequence
  MKO10027728_A_Klk1b4
  gRNA
augaaccuucugaccaacac

SEQ ID NO: 27729 - RNA, 20 nt, Artificial Sequence
  MKO10027729_A_Klk1b4
  gRNA
ucucacaguccacuugagac

SEQ ID NO: 27730 - RNA, 20 nt, Artificial Sequence
  MKO10027730_A_Klk1b5
  gRNA
gaguccugcugaacgccaac

SEQ ID NO: 27731 - RNA, 20 nt, Artificial Sequence
  MKO10027731_A_Klk1b5
  gRNA
aacuuauuaaguuuaacucu

SEQ ID NO: 27732 - RNA, 20 nt, Artificial Sequence
  MKO10027732_A_Klk1b5
  gRNA
cgcauugauauuuggugaag

SEQ ID NO: 27733 - RNA, 20 nt, Artificial Sequence
  MKO10027733_A_Klk1b8
  gRNA
acacucaaagagauaccucc

SEQ ID NO: 27734 - RNA, 20 nt, Artificial Sequence
  MKO10027734_A_Klk1b8
  gRNA
ggccuguugaugugauaccu

SEQ ID NO: 27735 - RNA, 20 nt, Artificial Sequence
  MKO10027735_A_Klk1b8
  gRNA
ucaacaggcccuauaccaug

SEQ ID NO: 27736 - RNA, 20 nt, Artificial Sequence
  MKO10027736_A_Klk1b9
  gRNA
gucggaugugguuucuaugg

SEQ ID NO: 27737 - RNA, 20 nt, Artificial Sequence
  MKO10027737_A_Klk1b9
  gRNA
cgcauauauauucguuguaa

SEQ ID NO: 27738 - RNA, 20 nt, Artificial Sequence
  MKO10027738_A_Klk1b9
  gRNA
aaaaaacaaccuauacgaag

SEQ ID NO: 27739 - RNA, 20 nt, Artificial Sequence
  MKO10027739_A_Klk1
  gRNA
guauccugcugaacgccaac

SEQ ID NO: 27740 - RNA, 20 nt, Artificial Sequence
  MKO10027740_A_Klk1
  gRNA
aaaacucugguguagauacc

SEQ ID NO: 27741 - RNA, 20 nt, Artificial Sequence
  MKO10027741_A_Klk1
  gRNA
cccccagcaaguaccaggug

SEQ ID NO: 27742 - RNA, 20 nt, Artificial Sequence
  MKO10027742_A_Klk4
  gRNA
gccuggcagccggauguuag

SEQ ID NO: 27743 - RNA, 20 nt, Artificial Sequence
  MKO10027743_A_Klk4
  gRNA
caccucaguauguucugcgc

SEQ ID NO: 27744 - RNA, 20 nt, Artificial Sequence
  MKO10027744_A_Klk4
  gRNA
caggcccagucccacgaugu

SEQ ID NO: 27745 - RNA, 20 nt, Artificial Sequence
  MKO10027745_A_Klk5
  gRNA
accugugugaguucguuaag

SEQ ID NO: 27746 - RNA, 20 nt, Artificial Sequence
  MKO10027746_A_Klk5
  gRNA
gacaagaccauguucugcgc

SEQ ID NO: 27747 - RNA, 20 nt, Artificial Sequence
  MKO10027747_A_Klk5
  gRNA
agguguaaaaacuccuaccc

SEQ ID NO: 27748 - RNA, 20 nt, Artificial Sequence
  MKO10027748_A_Klk6
  gRNA
aggcgacccccacauacuag

SEQ ID NO: 27749 - RNA, 20 nt, Artificial Sequence
  MKO10027749_A_Klk6
  gRNA
guaugugggggucgccuccg

SEQ ID NO: 27750 - RNA, 20 nt, Artificial Sequence
  MKO10027750_A_Klk6
  gRNA
cagugugagcgugccuaccc

SEQ ID NO: 27751 - RNA, 20 nt, Artificial Sequence
  MKO10027751_A_Klk7
  gRNA
acaaagucauuccggcaccc

SEQ ID NO: 27752 - RNA, 20 nt, Artificial Sequence
  MKO10027752_A_Klk7
  gRNA
cgucauguaccgucucugga

SEQ ID NO: 27753 - RNA, 20 nt, Artificial Sequence
  MKO10027753_A_Klk7
  gRNA
guacaccuucuugcacuccc

SEQ ID NO: 27754 - RNA, 20 nt, Artificial Sequence
  MKO10027754_A_Klk8
  gRNA
aaaucugccgcuacacuacc

SEQ ID NO: 27755 - RNA, 20 nt, Artificial Sequence
  MKO10027755_A_Klk8
  gRNA
ccggcuucaccuuguccccg

SEQ ID NO: 27756 - RNA, 20 nt, Artificial Sequence
  MKO10027756_A_Klk8
  gRNA
caggaaguacuccgugcguc

SEQ ID NO: 27757 - RNA, 20 nt, Artificial Sequence
  MKO10027757_A_Klk9
  gRNA
gagaguugcguacgcauucc

SEQ ID NO: 27758 - RNA, 20 nt, Artificial Sequence
  MKO10027758_A_Klk9
  gRNA
ggagcugacacccgugccgu

SEQ ID NO: 27759 - RNA, 20 nt, Artificial Sequence
  MKO10027759_A_Klk9
  gRNA
gccggaccuuccgagguagc

SEQ ID NO: 27760 - RNA, 20 nt, Artificial Sequence
  MKO10027760_A_Klkb1
  gRNA
accuaucuccgaaagcgcac

SEQ ID NO: 27761 - RNA, 20 nt, Artificial Sequence
  MKO10027761_A_Klkb1
  gRNA
uugccaagaauacaccggac

SEQ ID NO: 27762 - RNA, 20 nt, Artificial Sequence
  MKO10027762_A_Klkb1
  gRNA
acccaccagcauaaagucag

SEQ ID NO: 27763 - RNA, 20 nt, Artificial Sequence
  MKO10027763_A_Klra10
  gRNA
uuuaagaguguucaauauac

SEQ ID NO: 27764 - RNA, 20 nt, Artificial Sequence
  MKO10027764_A_Klra10
  gRNA
uaggcggagguguuaaauac

SEQ ID NO: 27765 - RNA, 20 nt, Artificial Sequence
  MKO10027765_A_Klra10
  gRNA
caacauaccugugucccgug

SEQ ID NO: 27766 - RNA, 20 nt, Artificial Sequence
  MKO10027766_A_Klra12
  gRNA
cugagacaauuaccagucga

SEQ ID NO: 27767 - RNA, 20 nt, Artificial Sequence
  MKO10027767_A_Klra12
  gRNA
cuguaaaagucuugguuuca

SEQ ID NO: 27768 - RNA, 20 nt, Artificial Sequence
  MKO10027768_A_Klra12
  gRNA
gauuccagaagaucagugcc

SEQ ID NO: 27769 - RNA, 20 nt, Artificial Sequence
  MKO10027769_A_Klra15
  gRNA
uuuaaggguguucauuccac

SEQ ID NO: 27770 - RNA, 20 nt, Artificial Sequence
  MKO10027770_A_Klra15
  gRNA
gucuauagagugugaucuuc

SEQ ID NO: 27771 - RNA, 20 nt, Artificial Sequence
  MKO10027771_A_Klra15
  gRNA
aucuguucugaucccuguug

SEQ ID NO: 27772 - RNA, 20 nt, Artificial Sequence
  MKO10027772_A_Klra17
  gRNA
ucuccuguacuacacucuag

SEQ ID NO: 27773 - RNA, 20 nt, Artificial Sequence
  MKO10027773_A_Klra17
  gRNA
gcaaaaugacaucaacgcaa

SEQ ID NO: 27774 - RNA, 20 nt, Artificial Sequence
  MKO10027774_A_Klra17
  gRNA
uuuaagagugcucuaucccc

SEQ ID NO: 27775 - RNA, 20 nt, Artificial Sequence
  MKO10027775_A_Klra18
  gRNA
ccugaaaaagcucgccucag

SEQ ID NO: 27776 - RNA, 20 nt, Artificial Sequence
  MKO10027776_A_Klra18
  gRNA
acauacugugugauaaaacc

SEQ ID NO: 27777 - RNA, 20 nt, Artificial Sequence
  MKO10027777_A_Klra18
  gRNA
gucuauagaguguaaucuuc

SEQ ID NO: 27778 - RNA, 20 nt, Artificial Sequence
  MKO10027778_A_Klra19
  gRNA
caaauaggucuauagacucu

SEQ ID NO: 27779 - RNA, 20 nt, Artificial Sequence
  MKO10027779_A_Klra19
  gRNA
gauagacgaugaaaaugaac

SEQ ID NO: 27780 - RNA, 20 nt, Artificial Sequence
  MKO10027780_A_Klra19
  gRNA
uuagaguuucauggauuucu

SEQ ID NO: 27781 - RNA, 20 nt, Artificial Sequence
  MKO10027781_A_Klra1
  gRNA
uuuaaggguguucauuccac

SEQ ID NO: 27782 - RNA, 20 nt, Artificial Sequence
  MKO10027782_A_Klra1
  gRNA
gucuauagagugugaucuuc

SEQ ID NO: 27783 - RNA, 20 nt, Artificial Sequence
  MKO10027783_A_Klra1
  gRNA
aucuguucugaucccuguug

SEQ ID NO: 27784 - RNA, 20 nt, Artificial Sequence
  MKO10027784_A_Klra21
  gRNA
aauccucuguucccuucggc

SEQ ID NO: 27785 - RNA, 20 nt, Artificial Sequence
  MKO10027785_A_Klra21
  gRNA
ucaucaugaauaaaacuaca

SEQ ID NO: 27786 - RNA, 20 nt, Artificial Sequence
  MKO10027786_A_Klra21
  gRNA
uauuccagaaguucauagcu

SEQ ID NO: 27787 - RNA, 20 nt, Artificial Sequence
  MKO10027787_A_Klra22
  gRNA
uuuaaggguguucauuccac

SEQ ID NO: 27788 - RNA, 20 nt, Artificial Sequence
  MKO10027788_A_Klra22
  gRNA
gucuauagagugugaucuuc

SEQ ID NO: 27789 - RNA, 20 nt, Artificial Sequence
  MKO10027789_A_Klra22
  gRNA
aucuguucugaucccuguug

SEQ ID NO: 27790 - RNA, 20 nt, Artificial Sequence
  MKO10027790_A_Klra23
  gRNA
acagggaagccucgaaaagc

SEQ ID NO: 27791 - RNA, 20 nt, Artificial Sequence
  MKO10027791_A_Klra23
  gRNA
cugagacaauuaccagucga

SEQ ID NO: 27792 - RNA, 20 nt, Artificial Sequence
  MKO10027792_A_Klra23
  gRNA
cuguaaaagucuugguuuca

SEQ ID NO: 27793 - RNA, 20 nt, Artificial Sequence
  MKO10027793_A_Klra2
  gRNA
uaaccuccgucaagaguacc

SEQ ID NO: 27794 - RNA, 20 nt, Artificial Sequence
  MKO10027794_A_Klra2
  gRNA
cauguuucucuuguccaucc

SEQ ID NO: 27795 - RNA, 20 nt, Artificial Sequence
  MKO10027795_A_Klra2
  gRNA
aggauguaaacagaucugcc

SEQ ID NO: 27796 - RNA, 20 nt, Artificial Sequence
  MKO10027796_A_Klra33
  gRNA
acauacugugugauaaaacc

SEQ ID NO: 27797 - RNA, 20 nt, Artificial Sequence
  MKO10027797_A_Klra33
  gRNA
gucuauagaguguaaucuuc

SEQ ID NO: 27798 - RNA, 20 nt, Artificial Sequence
  MKO10027798_A_Klra33
  gRNA
cugcaacaguuaccagucga

SEQ ID NO: 27799 - RNA, 20 nt, Artificial Sequence
  MKO10027799_A_Klra3
  gRNA
uuuaagaguguucagcaccc

SEQ ID NO: 27800 - RNA, 20 nt, Artificial Sequence
  MKO10027800_A_Klra3
  gRNA
auguuauuccagagaauuac

SEQ ID NO: 27801 - RNA, 20 nt, Artificial Sequence
  MKO10027801_A_Klra3
  gRNA
uauuccagaguuucauugcu

SEQ ID NO: 27802 - RNA, 20 nt, Artificial Sequence
  MKO10027802_A_Klra4
  gRNA
acauacugugugauaaaacc

SEQ ID NO: 27803 - RNA, 20 nt, Artificial Sequence
  MKO10027803_A_Klra4
  gRNA
gucuauagaguguaaucuuc

SEQ ID NO: 27804 - RNA, 20 nt, Artificial Sequence
  MKO10027804_A_Klra4
  gRNA
cugcaacaguuaccagucga

SEQ ID NO: 27805 - RNA, 20 nt, Artificial Sequence
  MKO10027805_A_Klra5
  gRNA
gauuccagaaguuccucacc

SEQ ID NO: 27806 - RNA, 20 nt, Artificial Sequence
  MKO10027806_A_Klra5
  gRNA
aagucuauagauugcagucc

SEQ ID NO: 27807 - RNA, 20 nt, Artificial Sequence
  MKO10027807_A_Klra5
  gRNA
cagcucacugugagaucgcu

SEQ ID NO: 27808 - RNA, 20 nt, Artificial Sequence
  MKO10027808_A_Klra6
  gRNA
caaauaggucuauagacucu

SEQ ID NO: 27809 - RNA, 20 nt, Artificial Sequence
  MKO10027809_A_Klra6
  gRNA
gauagacgaugaaaaugaac

SEQ ID NO: 27810 - RNA, 20 nt, Artificial Sequence
  MKO10027810_A_Klra6
  gRNA
acagaaauuccuucaauucc

SEQ ID NO: 27811 - RNA, 20 nt, Artificial Sequence
  MKO10027811_A_Klra7
  gRNA
ccaacaaugcaacaguuacc

SEQ ID NO: 27812 - RNA, 20 nt, Artificial Sequence
  MKO10027812_A_Klra7
  gRNA
caaguugacgucacuuugcg

SEQ ID NO: 27813 - RNA, 20 nt, Artificial Sequence
  MKO10027813_A_Klra7
  gRNA
aucuguucugaucccugcug

SEQ ID NO: 27814 - RNA, 20 nt, Artificial Sequence
  MKO10027814_A_Klra8
  gRNA
aauccucuguucccuucggc

SEQ ID NO: 27815 - RNA, 20 nt, Artificial Sequence
  MKO10027815_A_Klra8
  gRNA
aguaacucucuagaauaaca

SEQ ID NO: 27816 - RNA, 20 nt, Artificial Sequence
  MKO10027816_A_Klra8
  gRNA
ucaucaugaauaaaacuaca

SEQ ID NO: 27817 - RNA, 20 nt, Artificial Sequence
  MKO10027817_A_Klra9
  gRNA
uuuaagaguguucaguaucc

SEQ ID NO: 27818 - RNA, 20 nt, Artificial Sequence
  MKO10027818_A_Klra9
  gRNA
auggaacagugaaaccaaga

SEQ ID NO: 27819 - RNA, 20 nt, Artificial Sequence
  MKO10027819_A_Klra9
  gRNA
uaggcagagguguuaaacac

SEQ ID NO: 27820 - RNA, 20 nt, Artificial Sequence
  MKO10027820_A_Klrb1a
  gRNA
gaugcaucuccuaugcacaa

SEQ ID NO: 27821 - RNA, 20 nt, Artificial Sequence
  MKO10027821_A_Klrb1a
  gRNA
gaaggucuaguugauuguga

SEQ ID NO: 27822 - RNA, 20 nt, Artificial Sequence
  MKO10027822_A_Klrb1a
  gRNA
acuuugguuuaaagccaccc

SEQ ID NO: 27823 - RNA, 20 nt, Artificial Sequence
  MKO10027823_A_Klrb1b
  gRNA
acaccugucggugcccucgc

SEQ ID NO: 27824 - RNA, 20 nt, Artificial Sequence
  MKO10027824_A_Klrb1b
  gRNA
aucaguacaaaaaaucugcg

SEQ ID NO: 27825 - RNA, 20 nt, Artificial Sequence
  MKO10027825_A_Klrb1b
  gRNA
caaucacgaccagcacaaga

SEQ ID NO: 27826 - RNA, 20 nt, Artificial Sequence
  MKO10027826_A_Klrb1c
  gRNA
augccaagcccccagugucc

SEQ ID NO: 27827 - RNA, 20 nt, Artificial Sequence
  MKO10027827_A_Klrb1c
  gRNA
accucgguuuaaagccaccc

SEQ ID NO: 27828 - RNA, 20 nt, Artificial Sequence
  MKO10027828_A_Klrb1c
  gRNA
auuuagagugcccacaagac

SEQ ID NO: 27829 - RNA, 20 nt, Artificial Sequence
  MKO10027829_A_Klrb1f
  gRNA
uacuagagugcccgagauau

SEQ ID NO: 27830 - RNA, 20 nt, Artificial Sequence
  MKO10027830_A_Klrb1f
  gRNA
auaucucgggcacucuagua

SEQ ID NO: 27831 - RNA, 20 nt, Artificial Sequence
  MKO10027831_A_Klrb1f
  gRNA
cuaagacacugaguccaauc

SEQ ID NO: 27832 - RNA, 20 nt, Artificial Sequence
  MKO10027832_A_Klrb1
  gRNA
ucaaccagaccgucagccca

SEQ ID NO: 27833 - RNA, 20 nt, Artificial Sequence
  MKO10027833_A_Klrb1
  gRNA
cacuagagugcccgagagac

SEQ ID NO: 27834 - RNA, 20 nt, Artificial Sequence
  MKO10027834_A_Klrb1
  gRNA
caucggguggcucugaaacu

SEQ ID NO: 27835 - RNA, 20 nt, Artificial Sequence
  MKO10027835_A_Klrc1
  gRNA
cuccauuucagucaucgagc

SEQ ID NO: 27836 - RNA, 20 nt, Artificial Sequence
  MKO10027836_A_Klrc1
  gRNA
guaccagcaaugaguuucuc

SEQ ID NO: 27837 - RNA, 20 nt, Artificial Sequence
  MKO10027837_A_Klrc1
  gRNA
ugcaggaauugccccugcaa

SEQ ID NO: 27838 - RNA, 20 nt, Artificial Sequence
  MKO10027838_A_Klrc2
  gRNA
gcuucacauagauagugaag

SEQ ID NO: 27839 - RNA, 20 nt, Artificial Sequence
  MKO10027839_A_Klrc2
  gRNA
uuccguuucaguaaugcagc

SEQ ID NO: 27840 - RNA, 20 nt, Artificial Sequence
  MKO10027840_A_Klrc2
  gRNA
gcagaggucaggccugggac

SEQ ID NO: 27841 - RNA, 20 nt, Artificial Sequence
  MKO10027841_A_Klrc3
  gRNA
gaauauaagauccauuccuu

SEQ ID NO: 27842 - RNA, 20 nt, Artificial Sequence
  MKO10027842_A_Klrc3
  gRNA
uuugugcugaagauagacug

SEQ ID NO: 27843 - RNA, 20 nt, Artificial Sequence
  MKO10027843_A_Klrc3
  gRNA
caguccaugagaccagugaa

SEQ ID NO: 27844 - RNA, 20 nt, Artificial Sequence
  MKO10027844_A_Klrd1
  gRNA
gaugcccaacccacuugucc

SEQ ID NO: 27845 - RNA, 20 nt, Artificial Sequence
  MKO10027845_A_Klrd1
  gRNA
gccccaauccagaaaugaau

SEQ ID NO: 27846 - RNA, 20 nt, Artificial Sequence
  MKO10027846_A_Klrd1
  gRNA
ugugccauccucccauagcc

SEQ ID NO: 27847 - RNA, 20 nt, Artificial Sequence
  MKO10027847_A_Klre1
  gRNA
gaccauucgguucuacccuc

SEQ ID NO: 27848 - RNA, 20 nt, Artificial Sequence
  MKO10027848_A_Klre1
  gRNA
gcccagaggguagaaccgaa

SEQ ID NO: 27849 - RNA, 20 nt, Artificial Sequence
  MKO10027849_A_Klre1
  gRNA
acacucgagagaagccucca

SEQ ID NO: 27850 - RNA, 20 nt, Artificial Sequence
  MKO10027850_A_Klrg1
  gRNA
cuuuaccucaagcugagcgc

SEQ ID NO: 27851 - RNA, 20 nt, Artificial Sequence
  MKO10027851_A_Klrg1
  gRNA
uuuaccacucccugguuguc

SEQ ID NO: 27852 - RNA, 20 nt, Artificial Sequence
  MKO10027852_A_Klrg1
  gRNA
ugagucuacugauguaucaa

SEQ ID NO: 27853 - RNA, 20 nt, Artificial Sequence
  MKO10027853_A_Klrg2
  gRNA
gccucgucgggcccccaccc

SEQ ID NO: 27854 - RNA, 20 nt, Artificial Sequence
  MKO10027854_A_Klrg2
  gRNA
cccgacgaggcccugaaggc

SEQ ID NO: 27855 - RNA, 20 nt, Artificial Sequence
  MKO10027855_A_Klrg2
  gRNA
aguacaugaagucucugcgc

SEQ ID NO: 27856 - RNA, 20 nt, Artificial Sequence
  MKO10027856_A_Klri1
  gRNA
ccauccuuuggacaccgaag

SEQ ID NO: 27857 - RNA, 20 nt, Artificial Sequence
  MKO10027857_A_Klri1
  gRNA
caggccccaaaucaacagua

SEQ ID NO: 27858 - RNA, 20 nt, Artificial Sequence
  MKO10027858_A_Klri1
  gRNA
augagaauucagcuccucac

SEQ ID NO: 27859 - RNA, 20 nt, Artificial Sequence
  MKO10027859_A_Klri2
  gRNA
uagaucccuggcugacaaca

SEQ ID NO: 27860 - RNA, 20 nt, Artificial Sequence
  MKO10027860_A_Klri2
  gRNA
agcaacguuaugcauuauuu

SEQ ID NO: 27861 - RNA, 20 nt, Artificial Sequence
  MKO10027861_A_Klri2
  gRNA
uucuugauccucuaugugac

SEQ ID NO: 27862 - RNA, 20 nt, Artificial Sequence
  MKO10027862_A_Klrk1
  gRNA
uauccacuagguaucauaag

SEQ ID NO: 27863 - RNA, 20 nt, Artificial Sequence
  MKO10027863_A_Klrk1
  gRNA
gcacuaacuaccagucaacc

SEQ ID NO: 27864 - RNA, 20 nt, Artificial Sequence
  MKO10027864_A_Klrk1
  gRNA
gaauugccaaggcuauagca

SEQ ID NO: 27865 - RNA, 20 nt, Artificial Sequence
  MKO10027865_A_Kl
  gRNA
acgucauuggguacaccgcg

SEQ ID NO: 27866 - RNA, 20 nt, Artificial Sequence
  MKO10027866_A_Kl
  gRNA
caacguagaagaguccucgc

SEQ ID NO: 27867 - RNA, 20 nt, Artificial Sequence
  MKO10027867_A_Kl
  gRNA
ccgcugcaugaucagcgagc

SEQ ID NO: 27868 - RNA, 20 nt, Artificial Sequence
  MKO10027868_A_Kmo
  gRNA
ccuuucuuauagaggacggc

SEQ ID NO: 27869 - RNA, 20 nt, Artificial Sequence
  MKO10027869_A_Kmo
  gRNA
aaguugauguguacgaagcu

SEQ ID NO: 27870 - RNA, 20 nt, Artificial Sequence
  MKO10027870_A_Kmo
  gRNA
ccugccguccucuauaagaa

SEQ ID NO: 27871 - RNA, 20 nt, Artificial Sequence
  MKO10027871_A_Kmt2a
  gRNA
cugaccgguuuaauccuucg

SEQ ID NO: 27872 - RNA, 20 nt, Artificial Sequence
  MKO10027872_A_Kmt2a
  gRNA
gaucgccgcccuuucuucac

SEQ ID NO: 27873 - RNA, 20 nt, Artificial Sequence
  MKO10027873_A_Kmt2a
  gRNA
gugcagauuguaagacggcg

SEQ ID NO: 27874 - RNA, 20 nt, Artificial Sequence
  MKO10027874_A_Kmt2b
  gRNA
gggccuuccccgagaccguc

SEQ ID NO: 27875 - RNA, 20 nt, Artificial Sequence
  MKO10027875_A_Kmt2b
  gRNA
ggggggucgucuuaugcuug

SEQ ID NO: 27876 - RNA, 20 nt, Artificial Sequence
  MKO10027876_A_Kmt2b
  gRNA
ucggcaggaccucgccacug

SEQ ID NO: 27877 - RNA, 20 nt, Artificial Sequence
  MKO10027877_A_Kmt2c
  gRNA
ugcuguaggccucgaaguag

SEQ ID NO: 27878 - RNA, 20 nt, Artificial Sequence
  MKO10027878_A_Kmt2c
  gRNA
caagccuuauuugauuccac

SEQ ID NO: 27879 - RNA, 20 nt, Artificial Sequence
  MKO10027879_A_Kmt2c
  gRNA
caucccauaacuugcccgcc

SEQ ID NO: 27880 - RNA, 20 nt, Artificial Sequence
  MKO10027880_A_Kmt2d
  gRNA
caucaacaggucuccccgag

SEQ ID NO: 27881 - RNA, 20 nt, Artificial Sequence
  MKO10027881_A_Kmt2d
  gRNA
aauuugugaugcguccuccu

SEQ ID NO: 27882 - RNA, 20 nt, Artificial Sequence
  MKO10027882_A_Kmt2d
  gRNA
gaggucuccguccccgguuc

SEQ ID NO: 27883 - RNA, 20 nt, Artificial Sequence
  MKO10027883_A_Kmt2e
  gRNA
gaggacgagcaccauaauua

SEQ ID NO: 27884 - RNA, 20 nt, Artificial Sequence
  MKO10027884_A_Kmt2e
  gRNA
ugggcugacaacguucacau

SEQ ID NO: 27885 - RNA, 20 nt, Artificial Sequence
  MKO10027885_A_Kmt2e
  gRNA
cucauuagcaaaaacgaagu

SEQ ID NO: 27886 - RNA, 20 nt, Artificial Sequence
  MKO10027886_A_Kncn
  gRNA
caucggugucuccgugucca

SEQ ID NO: 27887 - RNA, 20 nt, Artificial Sequence
  MKO10027887_A_Kncn
  gRNA
ccagguugaaccgagccuuc

SEQ ID NO: 27888 - RNA, 20 nt, Artificial Sequence
  MKO10027888_A_Kncn
  gRNA
cugcaggcagcggaagucuc

SEQ ID NO: 27889 - RNA, 20 nt, Artificial Sequence
  MKO10027889_A_Kndc1
  gRNA
ugcgugggcgacacuccgca

SEQ ID NO: 27890 - RNA, 20 nt, Artificial Sequence
  MKO10027890_A_Kndc1
  gRNA
uauucuccaagaugaccccg

SEQ ID NO: 27891 - RNA, 20 nt, Artificial Sequence
  MKO10027891_A_Kndc1
  gRNA
ugggagcuuaccgccagguc

SEQ ID NO: 27892 - RNA, 20 nt, Artificial Sequence
  MKO10027892_A_Kng1
  gRNA
uauguugcaccgagugaucg

SEQ ID NO: 27893 - RNA, 20 nt, Artificial Sequence
  MKO10027893_A_Kng1
  gRNA
ggcaugcacacaaccaauac

SEQ ID NO: 27894 - RNA, 20 nt, Artificial Sequence
  MKO10027894_A_Kng1
  gRNA
ucucugaagcaguuuaaccc

SEQ ID NO: 27895 - RNA, 20 nt, Artificial Sequence
  MKO10027895_A_Kng2
  gRNA
agugaccaagcgcgcuaaaa

SEQ ID NO: 27896 - RNA, 20 nt, Artificial Sequence
  MKO10027896_A_Kng2
  gRNA
ucuggauuaucugccgauau

SEQ ID NO: 27897 - RNA, 20 nt, Artificial Sequence
  MKO10027897_A_Kng2
  gRNA
ucacucgguacaacacaaac

SEQ ID NO: 27898 - RNA, 20 nt, Artificial Sequence
  MKO10027898_A_Knop1
  gRNA
acuaugaccgggccaugagc

SEQ ID NO: 27899 - RNA, 20 nt, Artificial Sequence
  MKO10027899_A_Knop1
  gRNA
cacguccccuucuaacaaug

SEQ ID NO: 27900 - RNA, 20 nt, Artificial Sequence
  MKO10027900_A_Knop1
  gRNA
guuggaccugauagucaugc

SEQ ID NO: 27901 - RNA, 20 nt, Artificial Sequence
  MKO10027901_A_Knstrn
  gRNA
aucgcacaccgucuuagcac

SEQ ID NO: 27902 - RNA, 20 nt, Artificial Sequence
  MKO10027902_A_Knstrn
  gRNA
accaaaucgagacgagagaa

SEQ ID NO: 27903 - RNA, 20 nt, Artificial Sequence
  MKO10027903_A_Knstrn
  gRNA
cccauucucucgucucgauu

SEQ ID NO: 27904 - RNA, 20 nt, Artificial Sequence
  MKO10027904_A_Knuc1
  gRNA
gcuucgaugugacguagaua

SEQ ID NO: 27905 - RNA, 20 nt, Artificial Sequence
  MKO10027905_A_Knuc1
  gRNA
acgagagucagcgaacguac

SEQ ID NO: 27906 - RNA, 20 nt, Artificial Sequence
  MKO10027906_A_Knuc1
  gRNA
cguuagaagcaacauauaau

SEQ ID NO: 27907 - RNA, 20 nt, Artificial Sequence
  MKO10027907_A_Kpna1
  gRNA
ucagacccggaaugugauuc

SEQ ID NO: 27908 - RNA, 20 nt, Artificial Sequence
  MKO10027908_A_Kpna1
  gRNA
gaugaagucaucaacacacc

SEQ ID NO: 27909 - RNA, 20 nt, Artificial Sequence
  MKO10027909_A_Kpna1
  gRNA
ugaggcccagauaaauaaca

SEQ ID NO: 27910 - RNA, 20 nt, Artificial Sequence
  MKO10027910_A_Kpna2
  gRNA
agguagucaccugguuguuc

SEQ ID NO: 27911 - RNA, 20 nt, Artificial Sequence
  MKO10027911_A_Kpna2
  gRNA
uacugccaagguagacagau

SEQ ID NO: 27912 - RNA, 20 nt, Artificial Sequence
  MKO10027912_A_Kpna2
  gRNA
accgagcagcuugaguagcu

SEQ ID NO: 27913 - RNA, 20 nt, Artificial Sequence
  MKO10027913_A_Kpna3
  gRNA
cugccugcacagcacucaac

SEQ ID NO: 27914 - RNA, 20 nt, Artificial Sequence
  MKO10027914_A_Kpna3
  gRNA
aguccaguugagugcugugc

SEQ ID NO: 27915 - RNA, 20 nt, Artificial Sequence
  MKO10027915_A_Kpna3
  gRNA
augaagugacaguugaacuc

SEQ ID NO: 27916 - RNA, 20 nt, Artificial Sequence
  MKO10027916_A_Kpna4
  gRNA
ugugaagacuccgauauaga

SEQ ID NO: 27917 - RNA, 20 nt, Artificial Sequence
  MKO10027917_A_Kpna4
  gRNA
ucuauaaucaccaucuauau

SEQ ID NO: 27918 - RNA, 20 nt, Artificial Sequence
  MKO10027918_A_Kpna4
  gRNA
uaagugcaguucaagcugcu

SEQ ID NO: 27919 - RNA, 20 nt, Artificial Sequence
  MKO10027919_A_Kpna6
  gRNA
cccaguuguagagcucacgu

SEQ ID NO: 27920 - RNA, 20 nt, Artificial Sequence
  MKO10027920_A_Kpna6
  gRNA
uccuacgugagcucuacaac

SEQ ID NO: 27921 - RNA, 20 nt, Artificial Sequence
  MKO10027921_A_Kpna6
  gRNA
acaaaccgaucaacuacucc

SEQ ID NO: 27922 - RNA, 20 nt, Artificial Sequence
  MKO10027922_A_Kpna7
  gRNA
gcacagggaaaugaucucgc

SEQ ID NO: 27923 - RNA, 20 nt, Artificial Sequence
  MKO10027923_A_Kpna7
  gRNA
guagcccgaaaaugcaggau

SEQ ID NO: 27924 - RNA, 20 nt, Artificial Sequence
  MKO10027924_A_Kpna7
  gRNA
ugcggccucgaacugcagcu

SEQ ID NO: 27925 - RNA, 20 nt, Artificial Sequence
  MKO10027925_A_Kpnb1
  gRNA
agaaacguaccggccuaguu

SEQ ID NO: 27926 - RNA, 20 nt, Artificial Sequence
  MKO10027926_A_Kpnb1
  gRNA
gcagaaguuccucgagcgug

SEQ ID NO: 27927 - RNA, 20 nt, Artificial Sequence
  MKO10027927_A_Kpnb1
  gRNA
cuauugaugcuaaugcucga

SEQ ID NO: 27928 - RNA, 20 nt, Artificial Sequence
  MKO10027928_A_Kprp
  gRNA
caacgaacggguugcccaca

SEQ ID NO: 27929 - RNA, 20 nt, Artificial Sequence
  MKO10027929_A_Kprp
  gRNA
agguagccccggaccgacgc

SEQ ID NO: 27930 - RNA, 20 nt, Artificial Sequence
  MKO10027930_A_Kprp
  gRNA
ccaccucggggccgcccuuc

SEQ ID NO: 27931 - RNA, 20 nt, Artificial Sequence
  MKO10027931_A_Kptn
  gRNA
ugacuuguugaaagugucga

SEQ ID NO: 27932 - RNA, 20 nt, Artificial Sequence
  MKO10027932_A_Kptn
  gRNA
gcagaaacaccgucuccagc

SEQ ID NO: 27933 - RNA, 20 nt, Artificial Sequence
  MKO10027933_A_Kptn
  gRNA
cucacucugcguggcacagc

SEQ ID NO: 27934 - RNA, 20 nt, Artificial Sequence
  MKO10027934_A_Kras
  gRNA
ugaguaugacccuacgauag

SEQ ID NO: 27935 - RNA, 20 nt, Artificial Sequence
  MKO10027935_A_Kras
  gRNA
agcagcguuaccucuaucgu

SEQ ID NO: 27936 - RNA, 20 nt, Artificial Sequence
  MKO10027936_A_Kras
  gRNA
uagaacaguagacacgaaac

SEQ ID NO: 27937 - RNA, 20 nt, Artificial Sequence
  MKO10027937_A_Krba1
  gRNA
ccucaccgcauuagugcagc

SEQ ID NO: 27938 - RNA, 20 nt, Artificial Sequence
  MKO10027938_A_Krba1
  gRNA
aggccugcucaauucucuuc

SEQ ID NO: 27939 - RNA, 20 nt, Artificial Sequence
  MKO10027939_A_Krba1
  gRNA
acugaggacuacuccgagag

SEQ ID NO: 27940 - RNA, 20 nt, Artificial Sequence
  MKO10027940_A_Krcc1
  gRNA
ugagcuacugucaauucacc

SEQ ID NO: 27941 - RNA, 20 nt, Artificial Sequence
  MKO10027941_A_Krcc1
  gRNA
aagaacggcccaaacaugag

SEQ ID NO: 27942 - RNA, 20 nt, Artificial Sequence
  MKO10027942_A_Krcc1
  gRNA
cugaucaaacauucuauacc

SEQ ID NO: 27943 - RNA, 20 nt, Artificial Sequence
  MKO10027943_A_Kremen1
  gRNA
uccccuguaaucugcaccgu

SEQ ID NO: 27944 - RNA, 20 nt, Artificial Sequence
  MKO10027944_A_Kremen1
  gRNA
cgugagcccuuggugcuacg

SEQ ID NO: 27945 - RNA, 20 nt, Artificial Sequence
  MKO10027945_A_Kremen1
  gRNA
aauccugccguccccaccgc

SEQ ID NO: 27946 - RNA, 20 nt, Artificial Sequence
  MKO10027946_A_Kremen2
  gRNA
caagggcguccagcuccgcg

SEQ ID NO: 27947 - RNA, 20 nt, Artificial Sequence
  MKO10027947_A_Kremen2
  gRNA
ccuucgauucugccgcauga

SEQ ID NO: 27948 - RNA, 20 nt, Artificial Sequence
  MKO10027948_A_Kremen2
  gRNA
ugggugcgcauaacuucugu

SEQ ID NO: 27949 - RNA, 20 nt, Artificial Sequence
  MKO10027949_A_Kri1
  gRNA
cuggagucgccaccgacguc

SEQ ID NO: 27950 - RNA, 20 nt, Artificial Sequence
  MKO10027950_A_Kri1
  gRNA
auggggagaccguugaccac

SEQ ID NO: 27951 - RNA, 20 nt, Artificial Sequence
  MKO10027951_A_Kri1
  gRNA
uccacagugaaagaucgcua

SEQ ID NO: 27952 - RNA, 20 nt, Artificial Sequence
  MKO10027952_A_Krit1
  gRNA
uuguuuauuagggaaacgag

SEQ ID NO: 27953 - RNA, 20 nt, Artificial Sequence
  MKO10027953_A_Krit1
  gRNA
aucgugccaucaguugucaa

SEQ ID NO: 27954 - RNA, 20 nt, Artificial Sequence
  MKO10027954_A_Krit1
  gRNA
aggacuuagcucuauacucc

SEQ ID NO: 27955 - RNA, 20 nt, Artificial Sequence
  MKO10027955_A_Krr1
  gRNA
cuuguucccgaaauaccgcg

SEQ ID NO: 27956 - RNA, 20 nt, Artificial Sequence
  MKO10027956_A_Krr1
  gRNA
ccugacaaacugcuacguca

SEQ ID NO: 27957 - RNA, 20 nt, Artificial Sequence
  MKO10027957_A_Krr1
  gRNA
cucgcgguauuucgggaaca

SEQ ID NO: 27958 - RNA, 20 nt, Artificial Sequence
  MKO10027958_A_Krt10
  gRNA
ugaauugagacguacuguuc

SEQ ID NO: 27959 - RNA, 20 nt, Artificial Sequence
  MKO10027959_A_Krt10
  gRNA
gucaaucugcagcagcacgu

SEQ ID NO: 27960 - RNA, 20 nt, Artificial Sequence
  MKO10027960_A_Krt10
  gRNA
gauugaacuacagucccagc

SEQ ID NO: 27961 - RNA, 20 nt, Artificial Sequence
  MKO10027961_A_Krt12
  gRNA
gucacgcuaccauggcgagc

SEQ ID NO: 27962 - RNA, 20 nt, Artificial Sequence
  MKO10027962_A_Krt12
  gRNA
gcuucaguccagcaagagcg

SEQ ID NO: 27963 - RNA, 20 nt, Artificial Sequence
  MKO10027963_A_Krt12
  gRNA
uccugcagauugacaacgca

SEQ ID NO: 27964 - RNA, 20 nt, Artificial Sequence
  MKO10027964_A_Krt13
  gRNA
cauugaucugacccgugugc

SEQ ID NO: 27965 - RNA, 20 nt, Artificial Sequence
  MKO10027965_A_Krt13
  gRNA
ugucaaucuccaggaugauc

SEQ ID NO: 27966 - RNA, 20 nt, Artificial Sequence
  MKO10027966_A_Krt13
  gRNA
cuggaucauuucagcguugg

SEQ ID NO: 27967 - RNA, 20 nt, Artificial Sequence
  MKO10027967_A_Krt14
  gRNA
gacauuggcauuguccacgg

SEQ ID NO: 27968 - RNA, 20 nt, Artificial Sequence
  MKO10027968_A_Krt14
  gRNA
gcagagccugcgcaugagcg

SEQ ID NO: 27969 - RNA, 20 nt, Artificial Sequence
  MKO10027969_A_Krt14
  gRNA
gguggguggagacgucaaug

SEQ ID NO: 27970 - RNA, 20 nt, Artificial Sequence
  MKO10027970_A_Krt15
  gRNA
gacaacgcgcgaguugucaa

SEQ ID NO: 27971 - RNA, 20 nt, Artificial Sequence
  MKO10027971_A_Krt15
  gRNA
ugacaacucgcgcguugucc

SEQ ID NO: 27972 - RNA, 20 nt, Artificial Sequence
  MKO10027972_A_Krt15
  gRNA
gguggaccugacccgcaugc

SEQ ID NO: 27973 - RNA, 20 nt, Artificial Sequence
  MKO10027973_A_Krt16
  gRNA
cuagaucauuauugccaccc

SEQ ID NO: 27974 - RNA, 20 nt, Artificial Sequence
  MKO10027974_A_Krt16
  gRNA
cuuugcagauugacaaugcc

SEQ ID NO: 27975 - RNA, 20 nt, Artificial Sequence
  MKO10027975_A_Krt16
  gRNA
gcucaucuagcaccuugcgc

SEQ ID NO: 27976 - RNA, 20 nt, Artificial Sequence
  MKO10027976_A_Krt17
  gRNA
ggugggcggcgaaaucaacg

SEQ ID NO: 27977 - RNA, 20 nt, Artificial Sequence
  MKO10027977_A_Krt17
  gRNA
ccagacgagcauugucaauc

SEQ ID NO: 27978 - RNA, 20 nt, Artificial Sequence
  MKO10027978_A_Krt17
  gRNA
cguugauuucgccgcccacc

SEQ ID NO: 27979 - RNA, 20 nt, Artificial Sequence
  MKO10027979_A_Krt18
  gRNA
gcgucucagcuccgugagug

SEQ ID NO: 27980 - RNA, 20 nt, Artificial Sequence
  MKO10027980_A_Krt18
  gRNA
ugucgaucugcaagacgaug

SEQ ID NO: 27981 - RNA, 20 nt, Artificial Sequence
  MKO10027981_A_Krt18
  gRNA
ccgcgcccaguaugaagcgc

SEQ ID NO: 27982 - RNA, 20 nt, Artificial Sequence
  MKO10027982_A_Krt19
  gRNA
acacgccuugcgucugagcg

SEQ ID NO: 27983 - RNA, 20 nt, Artificial Sequence
  MKO10027983_A_Krt19
  gRNA
ccgucgaagguccgugacuu

SEQ ID NO: 27984 - RNA, 20 nt, Artificial Sequence
  MKO10027984_A_Krt19
  gRNA
agacacguaccaugcugagc

SEQ ID NO: 27985 - RNA, 20 nt, Artificial Sequence
  MKO10027985_A_Krt1
  gRNA
cacgaacucauucucugcgu

SEQ ID NO: 27986 - RNA, 20 nt, Artificial Sequence
  MKO10027986_A_Krt1
  gRNA
caacaaccgcaguuuggauc

SEQ ID NO: 27987 - RNA, 20 nt, Artificial Sequence
  MKO10027987_A_Krt1
  gRNA
gcucagaauccauccgugac

SEQ ID NO: 27988 - RNA, 20 nt, Artificial Sequence
  MKO10027988_A_Krt20
  gRNA
gcuuagcauugucaauucgc

SEQ ID NO: 27989 - RNA, 20 nt, Artificial Sequence
  MKO10027989_A_Krt20
  gRNA
gcgaauugacaaugcuaagc

SEQ ID NO: 27990 - RNA, 20 nt, Artificial Sequence
  MKO10027990_A_Krt20
  gRNA
gcugggcaacaaugucaacg

SEQ ID NO: 27991 - RNA, 20 nt, Artificial Sequence
  MKO10027991_A_Krt222
  gRNA
guaccgccgccugcuagaac

SEQ ID NO: 27992 - RNA, 20 nt, Artificial Sequence
  MKO10027992_A_Krt222
  gRNA
gagacucgauuuccacuugc

SEQ ID NO: 27993 - RNA, 20 nt, Artificial Sequence
  MKO10027993_A_Krt222
  gRNA
aaucgagucucuccacgcug

SEQ ID NO: 27994 - RNA, 20 nt, Artificial Sequence
  MKO10027994_A_Krt23
  gRNA
ucgugcucauugacaacgcc

SEQ ID NO: 27995 - RNA, 20 nt, Artificial Sequence
  MKO10027995_A_Krt23
  gRNA
ugagggccuccgaaagaccu

SEQ ID NO: 27996 - RNA, 20 nt, Artificial Sequence
  MKO10027996_A_Krt23
  gRNA
ggccaguccagcgccuguac

SEQ ID NO: 27997 - RNA, 20 nt, Artificial Sequence
  MKO10027997_A_Krt24
  gRNA
cggccuccaagcacucucga

SEQ ID NO: 27998 - RNA, 20 nt, Artificial Sequence
  MKO10027998_A_Krt24
  gRNA
uuucguccagcacuuugcgc

SEQ ID NO: 27999 - RNA, 20 nt, Artificial Sequence
  MKO10027999_A_Krt24
  gRNA
cugagagacaguucaacgag

SEQ ID NO: 28000 - RNA, 20 nt, Artificial Sequence
  MKO10028000_A_Krt25
  gRNA
uugcagguacgaaaacgagc

SEQ ID NO: 28001 - RNA, 20 nt, Artificial Sequence
  MKO10028001_A_Krt25
  gRNA
uuggagcguucgcuucauuu

SEQ ID NO: 28002 - RNA, 20 nt, Artificial Sequence
  MKO10028002_A_Krt25
  gRNA
ucaguacgaaacccugagcg

SEQ ID NO: 28003 - RNA, 20 nt, Artificial Sequence
  MKO10028003_A_Krt26
  gRNA
gacgcugucuacaaccgacu

SEQ ID NO: 28004 - RNA, 20 nt, Artificial Sequence
  MKO10028004_A_Krt26
  gRNA
caguuccaucaguucguuuc

SEQ ID NO: 28005 - RNA, 20 nt, Artificial Sequence
  MKO10028005_A_Krt26
  gRNA
cucacguaccauagccguga

SEQ ID NO: 28006 - RNA, 20 nt, Artificial Sequence
  MKO10028006_A_Krt27
  gRNA
ugaugucagcaucgacgcuc

SEQ ID NO: 28007 - RNA, 20 nt, Artificial Sequence
  MKO10028007_A_Krt27
  gRNA
ccugugcagaaccgaccuug

SEQ ID NO: 28008 - RNA, 20 nt, Artificial Sequence
  MKO10028008_A_Krt27
  gRNA
caucucuguaaguucguucc

SEQ ID NO: 28009 - RNA, 20 nt, Artificial Sequence
  MKO10028009_A_Krt28
  gRNA
cuuuagucggaaaucgucug

SEQ ID NO: 28010 - RNA, 20 nt, Artificial Sequence
  MKO10028010_A_Krt28
  gRNA
gguggcggcgcccaagucau

SEQ ID NO: 28011 - RNA, 20 nt, Artificial Sequence
  MKO10028011_A_Krt28
  gRNA
gcaaauugauaacgccagac

SEQ ID NO: 28012 - RNA, 20 nt, Artificial Sequence
  MKO10028012_A_Krt2
  gRNA
gaucaacaagcgcacgucug

SEQ ID NO: 28013 - RNA, 20 nt, Artificial Sequence
  MKO10028013_A_Krt2
  gRNA
cccauuugguccgcaacacc

SEQ ID NO: 28014 - RNA, 20 nt, Artificial Sequence
  MKO10028014_A_Krt2
  gRNA
ccugagaacacucuacgaug

SEQ ID NO: 28015 - RNA, 20 nt, Artificial Sequence
  MKO10028015_A_Krt31
  gRNA
ucucguugagcacacgguuc

SEQ ID NO: 28016 - RNA, 20 nt, Artificial Sequence
  MKO10028016_A_Krt31
  gRNA
gcucauccaagauccuucgc

SEQ ID NO: 28017 - RNA, 20 nt, Artificial Sequence
  MKO10028017_A_Krt31
  gRNA
aucuaucugcaccaccaacc

SEQ ID NO: 28018 - RNA, 20 nt, Artificial Sequence
  MKO10028018_A_Krt32
  gRNA
gguccccgagcuguugucga

SEQ ID NO: 28019 - RNA, 20 nt, Artificial Sequence
  MKO10028019_A_Krt32
  gRNA
gguguccuucgacaacagcu

SEQ ID NO: 28020 - RNA, 20 nt, Artificial Sequence
  MKO10028020_A_Krt32
  gRNA
gagacgaacagucaauacuc

SEQ ID NO: 28021 - RNA, 20 nt, Artificial Sequence
  MKO10028021_A_Krt33a
  gRNA
cacuacacaccaguucaugc

SEQ ID NO: 28022 - RNA, 20 nt, Artificial Sequence
  MKO10028022_A_Krt33a
  gRNA
ccucaagcagaaucacgagc

SEQ ID NO: 28023 - RNA, 20 nt, Artificial Sequence
  MKO10028023_A_Krt33a
  gRNA
ccugcucgugauucugcuug

SEQ ID NO: 28024 - RNA, 20 nt, Artificial Sequence
  MKO10028024_A_Krt33b
  gRNA
cagcguccaccucuacguug

SEQ ID NO: 28025 - RNA, 20 nt, Artificial Sequence
  MKO10028025_A_Krt33b
  gRNA
cugacuccaccagcugccgc

SEQ ID NO: 28026 - RNA, 20 nt, Artificial Sequence
  MKO10028026_A_Krt33b
  gRNA
agaccgccucaacguagagg

SEQ ID NO: 28027 - RNA, 20 nt, Artificial Sequence
  MKO10028027_A_Krt34
  gRNA
gugcuaagucugagaacgcc

SEQ ID NO: 28028 - RNA, 20 nt, Artificial Sequence
  MKO10028028_A_Krt34
  gRNA
uuagcucgaugaucucagcc

SEQ ID NO: 28029 - RNA, 20 nt, Artificial Sequence
  MKO10028029_A_Krt34
  gRNA
accagacugagcuguccaug

SEQ ID NO: 28030 - RNA, 20 nt, Artificial Sequence
  MKO10028030_A_Krt35
  gRNA
cgaucggcucaauguugagg

SEQ ID NO: 28031 - RNA, 20 nt, Artificial Sequence
  MKO10028031_A_Krt35
  gRNA
cguugaccugaaccgcguuc

SEQ ID NO: 28032 - RNA, 20 nt, Artificial Sequence
  MKO10028032_A_Krt35
  gRNA
cggugcuuaccaugcucugc

SEQ ID NO: 28033 - RNA, 20 nt, Artificial Sequence
  MKO10028033_A_Krt36
  gRNA
cugacaucaauggucuacgc

SEQ ID NO: 28034 - RNA, 20 nt, Artificial Sequence
  MKO10028034_A_Krt36
  gRNA
gucaauuuguaauaucagcc

SEQ ID NO: 28035 - RNA, 20 nt, Artificial Sequence
  MKO10028035_A_Krt36
  gRNA
aguggaucucaacaagauac

SEQ ID NO: 28036 - RNA, 20 nt, Artificial Sequence
  MKO10028036_A_Krt39
  gRNA
ucuccaugauggacucguac

SEQ ID NO: 28037 - RNA, 20 nt, Artificial Sequence
  MKO10028037_A_Krt39
  gRNA
gaaguuccuccgucagagac

SEQ ID NO: 28038 - RNA, 20 nt, Artificial Sequence
  MKO10028038_A_Krt39
  gRNA
accguaaagacguagaagaa

SEQ ID NO: 28039 - RNA, 20 nt, Artificial Sequence
  MKO10028039_A_Krt40
  gRNA
agaugcgaugucaauacgag

SEQ ID NO: 28040 - RNA, 20 nt, Artificial Sequence
  MKO10028040_A_Krt40
  gRNA
cgaacugucccugcgccagc

SEQ ID NO: 28041 - RNA, 20 nt, Artificial Sequence
  MKO10028041_A_Krt40
  gRNA
gaauucuagacuugccguuc

SEQ ID NO: 28042 - RNA, 20 nt, Artificial Sequence
  MKO10028042_A_Krt42
  gRNA
cauugacguccccgcccacc

SEQ ID NO: 28043 - RNA, 20 nt, Artificial Sequence
  MKO10028043_A_Krt42
  gRNA
cguugucgauuguggcugcc

SEQ ID NO: 28044 - RNA, 20 nt, Artificial Sequence
  MKO10028044_A_Krt42
  gRNA
gcugaaccugcgcaugagcg

SEQ ID NO: 28045 - RNA, 20 nt, Artificial Sequence
  MKO10028045_A_Krt4
  gRNA
ggggccucaccgcuucauag

SEQ ID NO: 28046 - RNA, 20 nt, Artificial Sequence
  MKO10028046_A_Krt4
  gRNA
agacuuacaucaacgccuug

SEQ ID NO: 28047 - RNA, 20 nt, Artificial Sequence
  MKO10028047_A_Krt4
  gRNA
cacgagaguccucuaugaag

SEQ ID NO: 28048 - RNA, 20 nt, Artificial Sequence
  MKO10028048_A_Krt5
  gRNA
ugaaguugaucucguccauc

SEQ ID NO: 28049 - RNA, 20 nt, Artificial Sequence
  MKO10028049_A_Krt5
  gRNA
ugagaucaacaagcguacca

SEQ ID NO: 28050 - RNA, 20 nt, Artificial Sequence
  MKO10028050_A_Krt5
  gRNA
gaaccccguccagcugucua

SEQ ID NO: 28051 - RNA, 20 nt, Artificial Sequence
  MKO10028051_A_Krt6a
  gRNA
cccccaccaggugcgguucc

SEQ ID NO: 28052 - RNA, 20 nt, Artificial Sequence
  MKO10028052_A_Krt6a
  gRNA
aucuguuagacugucugccu

SEQ ID NO: 28053 - RNA, 20 nt, Artificial Sequence
  MKO10028053_A_Krt6a
  gRNA
caguucaacuuuguucaugu

SEQ ID NO: 28054 - RNA, 20 nt, Artificial Sequence
  MKO10028054_A_Krt6b
  gRNA
ccacacacagguccgguucc

SEQ ID NO: 28055 - RNA, 20 nt, Artificial Sequence
  MKO10028055_A_Krt6b
  gRNA
cuuccugagaguuauuuaug

SEQ ID NO: 28056 - RNA, 20 nt, Artificial Sequence
  MKO10028056_A_Krt6b
  gRNA
cugccucauaaauaacucuc

SEQ ID NO: 28057 - RNA, 20 nt, Artificial Sequence
  MKO10028057_A_Krt71
  gRNA
gcuuccgcauguugcugaug

SEQ ID NO: 28058 - RNA, 20 nt, Artificial Sequence
  MKO10028058_A_Krt71
  gRNA
ugagguucgcgcucaguaug

SEQ ID NO: 28059 - RNA, 20 nt, Artificial Sequence
  MKO10028059_A_Krt71
  gRNA
ugacggacaugucgcugaug

SEQ ID NO: 28060 - RNA, 20 nt, Artificial Sequence
  MKO10028060_A_Krt72
  gRNA
caauaaccggcagcuggacc

SEQ ID NO: 28061 - RNA, 20 nt, Artificial Sequence
  MKO10028061_A_Krt72
  gRNA
cagcaccacgaacucguucu

SEQ ID NO: 28062 - RNA, 20 nt, Artificial Sequence
  MKO10028062_A_Krt72
  gRNA
gguggagauuaacagacgca

SEQ ID NO: 28063 - RNA, 20 nt, Artificial Sequence
  MKO10028063_A_Krt73
  gRNA
ucaggccaagguggacgccc

SEQ ID NO: 28064 - RNA, 20 nt, Artificial Sequence
  MKO10028064_A_Krt73
  gRNA
ggaugccgcauacaugagca

SEQ ID NO: 28065 - RNA, 20 nt, Artificial Sequence
  MKO10028065_A_Krt73
  gRNA
ccacagaggugucacuuaug

SEQ ID NO: 28066 - RNA, 20 nt, Artificial Sequence
  MKO10028066_A_Krt75
  gRNA
uugacauauguaucgaagaa

SEQ ID NO: 28067 - RNA, 20 nt, Artificial Sequence
  MKO10028067_A_Krt75
  gRNA
uccccuguagguacgcuucc

SEQ ID NO: 28068 - RNA, 20 nt, Artificial Sequence
  MKO10028068_A_Krt75
  gRNA
uuacugccucauagaucauc

SEQ ID NO: 28069 - RNA, 20 nt, Artificial Sequence
  MKO10028069_A_Krt76
  gRNA
gugaaucuaacugcuugcgc

SEQ ID NO: 28070 - RNA, 20 nt, Artificial Sequence
  MKO10028070_A_Krt76
  gRNA
cagcagcagaccauacgcuc

SEQ ID NO: 28071 - RNA, 20 nt, Artificial Sequence
  MKO10028071_A_Krt76
  gRNA
guccuaccuuggucugguac

SEQ ID NO: 28072 - RNA, 20 nt, Artificial Sequence
  MKO10028072_A_Krt77
  gRNA
cgagcaguugcgccagaaca

SEQ ID NO: 28073 - RNA, 20 nt, Artificial Sequence
  MKO10028073_A_Krt77
  gRNA
cacugacguggguuuguauc

SEQ ID NO: 28074 - RNA, 20 nt, Artificial Sequence
  MKO10028074_A_Krt77
  gRNA
ccguaucaaauagauauuuc

SEQ ID NO: 28075 - RNA, 20 nt, Artificial Sequence
  MKO10028075_A_Krt78
  gRNA
uccgcgugaucuccucguaa

SEQ ID NO: 28076 - RNA, 20 nt, Artificial Sequence
  MKO10028076_A_Krt78
  gRNA
cugguuauaggugcgcuucc

SEQ ID NO: 28077 - RNA, 20 nt, Artificial Sequence
  MKO10028077_A_Krt78
  gRNA
cccguuacgaggagaucacg

SEQ ID NO: 28078 - RNA, 20 nt, Artificial Sequence
  MKO10028078_A_Krt79
  gRNA
guccauggacaguaucacgu

SEQ ID NO: 28079 - RNA, 20 nt, Artificial Sequence
  MKO10028079_A_Krt79
  gRNA
uccuggcgacccccguguuc

SEQ ID NO: 28080 - RNA, 20 nt, Artificial Sequence
  MKO10028080_A_Krt79
  gRNA
cccuggucagguacgcuucc

SEQ ID NO: 28081 - RNA, 20 nt, Artificial Sequence
  MKO10028081_A_Krt7
  gRNA
agaggagaucaaccgacgca

SEQ ID NO: 28082 - RNA, 20 nt, Artificial Sequence
  MKO10028082_A_Krt7
  gRNA
cauucucagcagccgugcgu

SEQ ID NO: 28083 - RNA, 20 nt, Artificial Sequence
  MKO10028083_A_Krt7
  gRNA
gguuggccaucuccucauac

SEQ ID NO: 28084 - RNA, 20 nt, Artificial Sequence
  MKO10028084_A_Krt80
  gRNA
agguggaggaguuucgcguc

SEQ ID NO: 28085 - RNA, 20 nt, Artificial Sequence
  MKO10028085_A_Krt80
  gRNA
cgcugccacaucgaccugag

SEQ ID NO: 28086 - RNA, 20 nt, Artificial Sequence
  MKO10028086_A_Krt80
  gRNA
cuuccuccacgaugccgcuc

SEQ ID NO: 28087 - RNA, 20 nt, Artificial Sequence
  MKO10028087_A_Krt81
  gRNA
ugcugagcucaaccaugcac

SEQ ID NO: 28088 - RNA, 20 nt, Artificial Sequence
  MKO10028088_A_Krt81
  gRNA
ggaaguuucucugagagcca

SEQ ID NO: 28089 - RNA, 20 nt, Artificial Sequence
  MKO10028089_A_Krt81
  gRNA
gaggcgggaagcugagugug

SEQ ID NO: 28090 - RNA, 20 nt, Artificial Sequence
  MKO10028090_A_Krt82
  gRNA
cacaguccagcugucgccgc

SEQ ID NO: 28091 - RNA, 20 nt, Artificial Sequence
  MKO10028091_A_Krt82
  gRNA
uauaacccuccagcgccucc

SEQ ID NO: 28092 - RNA, 20 nt, Artificial Sequence
  MKO10028092_A_Krt82
  gRNA
cggcaucguagccgagauca

SEQ ID NO: 28093 - RNA, 20 nt, Artificial Sequence
  MKO10028093_A_Krt83
  gRNA
ccaaacacaggugcgcuucc

SEQ ID NO: 28094 - RNA, 20 nt, Artificial Sequence
  MKO10028094_A_Krt83
  gRNA
cugugucagcgcuucugcgu

SEQ ID NO: 28095 - RNA, 20 nt, Artificial Sequence
  MKO10028095_A_Krt83
  gRNA
caacgcagaagcgcugacac

SEQ ID NO: 28096 - RNA, 20 nt, Artificial Sequence
  MKO10028096_A_Krt84
  gRNA
gaggcggagucgugcagaug

SEQ ID NO: 28097 - RNA, 20 nt, Artificial Sequence
  MKO10028097_A_Krt84
  gRNA
gugauauaguuaucgaagag

SEQ ID NO: 28098 - RNA, 20 nt, Artificial Sequence
  MKO10028098_A_Krt84
  gRNA
cuucagcuaugaucccaucu

SEQ ID NO: 28099 - RNA, 20 nt, Artificial Sequence
  MKO10028099_A_Krt85
  gRNA
cacaucugucaucgucaaga

SEQ ID NO: 28100 - RNA, 20 nt, Artificial Sequence
  MKO10028100_A_Krt85
  gRNA
augaagaagaaguugcacuc

SEQ ID NO: 28101 - RNA, 20 nt, Artificial Sequence
  MKO10028101_A_Krt85
  gRNA
ugcauggcaggugcgcuucc

SEQ ID NO: 28102 - RNA, 20 nt, Artificial Sequence
  MKO10028102_A_Krt86
  gRNA
agccgagcucaaccaugcgc

SEQ ID NO: 28103 - RNA, 20 nt, Artificial Sequence
  MKO10028103_A_Krt86
  gRNA
cuaccugcgcaagucagacc

SEQ ID NO: 28104 - RNA, 20 nt, Artificial Sequence
  MKO10028104_A_Krt86
  gRNA
uacagcugagaaugaguuug

SEQ ID NO: 28105 - RNA, 20 nt, Artificial Sequence
  MKO10028105_A_Krt8
  gRNA
ugaaaccauguaccagauua

SEQ ID NO: 28106 - RNA, 20 nt, Artificial Sequence
  MKO10028106_A_Krt8
  gRNA
ccgacgagaucaacuuccuc

SEQ ID NO: 28107 - RNA, 20 nt, Artificial Sequence
  MKO10028107_A_Krt8
  gRNA
guaccucuucauggaucugc

SEQ ID NO: 28108 - RNA, 20 nt, Artificial Sequence
  MKO10028108_A_Krt9
  gRNA
cgacaauacucgcaugacua

SEQ ID NO: 28109 - RNA, 20 nt, Artificial Sequence
  MKO10028109_A_Krt9
  gRNA
gcucauuucuaagaaccgcc

SEQ ID NO: 28110 - RNA, 20 nt, Artificial Sequence
  MKO10028110_A_Krt9
  gRNA
cuccuagcacagaucucacc

SEQ ID NO: 28111 - RNA, 20 nt, Artificial Sequence
  MKO10028111_A_Kruap1-3
  gRNA
caaccugggucuuaacaggu

SEQ ID NO: 28112 - RNA, 20 nt, Artificial Sequence
  MKO10028112_A_Kruap1-3
  gRNA
ugcugccguccauccuauug

SEQ ID NO: 28113 - RNA, 20 nt, Artificial Sequence
  MKO10028113_A_Kruap1-3
  gRNA
uuucccacauguuccacugg

SEQ ID NO: 28114 - RNA, 20 nt, Artificial Sequence
  MKO10028114_A_Kruap1-4
  gRNA
agaaccacaugugccgccag

SEQ ID NO: 28115 - RNA, 20 nt, Artificial Sequence
  MKO10028115_A_Kruap1-4
  gRNA
ugcugcgcuacuaguuucug

SEQ ID NO: 28116 - RNA, 20 nt, Artificial Sequence
  MKO10028116_A_Kruap1-4
  gRNA
ccgcccugacugccgugugg

SEQ ID NO: 28117 - RNA, 20 nt, Artificial Sequence
  MKO10028117_A_Kruap1-5
  gRNA
cugccagcugcaccacgccc

SEQ ID NO: 28118 - RNA, 20 nt, Artificial Sequence
  MKO10028118_A_Kruap1-5
  gRNA
acaggcuauggcauuggggg

SEQ ID NO: 28119 - RNA, 20 nt, Artificial Sequence
  MKO10028119_A_Kruap1-5
  gRNA
caccuccaaagccacccucc

SEQ ID NO: 28120 - RNA, 20 nt, Artificial Sequence
  MKO10028120_A_Kruap10-10
  gRNA
ggaggcggccauggcggguu

SEQ ID NO: 28121 - RNA, 20 nt, Artificial Sequence
  MKO10028121_A_Kruap10-10
  gRNA
acagcuugucagcugaucac

SEQ ID NO: 28122 - RNA, 20 nt, Artificial Sequence
  MKO10028122_A_Kruap10-10
  gRNA
gagccuggccggccuaacug

SEQ ID NO: 28123 - RNA, 20 nt, Artificial Sequence
  MKO10028123_A_Kruap10-4
  gRNA
cuccuccagccuacccgcca

SEQ ID NO: 28124 - RNA, 20 nt, Artificial Sequence
  MKO10028124_A_Kruap10-4
  gRNA
uggaggcagccauggcgggu

SEQ ID NO: 28125 - RNA, 20 nt, Artificial Sequence
  MKO10028125_A_Kruap10-4
  gRNA
gaccuaagucagcugucacc

SEQ ID NO: 28126 - RNA, 20 nt, Artificial Sequence
  MKO10028126_A_Kruap11-1
  gRNA
cggcuacagggcguagagca

SEQ ID NO: 28127 - RNA, 20 nt, Artificial Sequence
  MKO10028127_A_Kruap11-1
  gRNA
cuugcucuacgcccuguagc

SEQ ID NO: 28128 - RNA, 20 nt, Artificial Sequence
  MKO10028128_A_Kruap11-1
  gRNA
aggacguuacacugcuccag

SEQ ID NO: 28129 - RNA, 20 nt, Artificial Sequence
  MKO10028129_A_Kruap12-1
  gRNA
gacaggcuugcagaccagag

SEQ ID NO: 28130 - RNA, 20 nt, Artificial Sequence
  MKO10028130_A_Kruap12-1
  gRNA
uugugugucuagucccugcc

SEQ ID NO: 28131 - RNA, 20 nt, Artificial Sequence
  MKO10028131_A_Kruap12-1
  gRNA
agagccugaucaacagcaag

SEQ ID NO: 28132 - RNA, 20 nt, Artificial Sequence
  MKO10028132_A_Kruap13-1
  gRNA
auguccuacggcugcuauuc

SEQ ID NO: 28133 - RNA, 20 nt, Artificial Sequence
  MKO10028133_A_Kruap13-1
  gRNA
agcacucgcuucuacucccc

SEQ ID NO: 28134 - RNA, 20 nt, Artificial Sequence
  MKO10028134_A_Kruap13-1
  gRNA
uagacccauaacccugagag

SEQ ID NO: 28135 - RNA, 20 nt, Artificial Sequence
  MKO10028135_A_Kruap13
  gRNA
gacaacagaucugugauauc

SEQ ID NO: 28136 - RNA, 20 nt, Artificial Sequence
  MKO10028136_A_Kruap13
  gRNA
cagaagcgagauguguagag

SEQ ID NO: 28137 - RNA, 20 nt, Artificial Sequence
  MKO10028137_A_Kruap13
  gRNA
caagaauagaaaucccuaga

SEQ ID NO: 28138 - RNA, 20 nt, Artificial Sequence
  MKO10028138_A_Kruap14
  gRNA
agugcuguagaagacguugu

SEQ ID NO: 28139 - RNA, 20 nt, Artificial Sequence
  MKO10028139_A_Kruap14
  gRNA
gaggaaccgcaugaagagau

SEQ ID NO: 28140 - RNA, 20 nt, Artificial Sequence
  MKO10028140_A_Kruap14
  gRNA
aaaagcuggauccacaauuu

SEQ ID NO: 28141 - RNA, 20 nt, Artificial Sequence
  MKO10028141_A_Kruap15
  gRNA
ggauccaacuucuaccgucc

SEQ ID NO: 28142 - RNA, 20 nt, Artificial Sequence
  MKO10028142_A_Kruap15
  gRNA
augaagguuucgcuaccuga

SEQ ID NO: 28143 - RNA, 20 nt, Artificial Sequence
  MKO10028143_A_Kruap15
  gRNA
guauugcuuaggccggaaac

SEQ ID NO: 28144 - RNA, 20 nt, Artificial Sequence
  MKO10028144_A_Kruap16-1
  gRNA
auccuccacagcaugaagag

SEQ ID NO: 28145 - RNA, 20 nt, Artificial Sequence
  MKO10028145_A_Kruap16-1
  gRNA
ugccgccgcucuucaugcug

SEQ ID NO: 28146 - RNA, 20 nt, Artificial Sequence
  MKO10028146_A_Kruap16-1
  gRNA
aaaaucaugagcuacuacag

SEQ ID NO: 28147 - RNA, 20 nt, Artificial Sequence
  MKO10028147_A_Kruap16-3
  gRNA
uaaucuucccaucgaauuua

SEQ ID NO: 28148 - RNA, 20 nt, Artificial Sequence
  MKO10028148_A_Kruap16-3
  gRNA
cuguaguagcucaugauauc

SEQ ID NO: 28149 - RNA, 20 nt, Artificial Sequence
  MKO10028149_A_Kruap16-3
  gRNA
gcaguucacucaguagaagc

SEQ ID NO: 28150 - RNA, 20 nt, Artificial Sequence
  MKO10028150_A_Kruap17-1
  gRNA
ggcuccggaugcugcggugg

SEQ ID NO: 28151 - RNA, 20 nt, Artificial Sequence
  MKO10028151_A_Kruap17-1
  gRNA
agaaccuccgcagccacagc

SEQ ID NO: 28152 - RNA, 20 nt, Artificial Sequence
  MKO10028152_A_Kruap17-1
  gRNA
ugaggaguguugcugccagc

SEQ ID NO: 28153 - RNA, 20 nt, Artificial Sequence
  MKO10028153_A_Kruap19-1
  gRNA
gcaauucacucaguagaagu

SEQ ID NO: 28154 - RNA, 20 nt, Artificial Sequence
  MKO10028154_A_Kruap19-1
  gRNA
ccauaucuuccacagcauga

SEQ ID NO: 28155 - RNA, 20 nt, Artificial Sequence
  MKO10028155_A_Kruap19-1
  gRNA
ggcucuagcuauggaggcua

SEQ ID NO: 28156 - RNA, 20 nt, Artificial Sequence
  MKO10028156_A_Kruap19-3
  gRNA
ggcuacggcuauggcagcuu

SEQ ID NO: 28157 - RNA, 20 nt, Artificial Sequence
  MKO10028157_A_Kruap19-3
  gRNA
cuccauaguagcugcuguag

SEQ ID NO: 28158 - RNA, 20 nt, Artificial Sequence
  MKO10028158_A_Kruap19-3
  gRNA
agccaaagcccaccagucug

SEQ ID NO: 28159 - RNA, 20 nt, Artificial Sequence
  MKO10028159_A_Kruap19-4
  gRNA
uacaggcgcccccuuuccua

SEQ ID NO: 28160 - RNA, 20 nt, Artificial Sequence
  MKO10028160_A_Kruap19-4
  gRNA
auccauaucccccauaggaa

SEQ ID NO: 28161 - RNA, 20 nt, Artificial Sequence
  MKO10028161_A_Kruap19-4
  gRNA
cuguggcaguuuccgcagac

SEQ ID NO: 28162 - RNA, 20 nt, Artificial Sequence
  MKO10028162_A_Kruap19-5
  gRNA
uaccgccgcccccuuuauua

SEQ ID NO: 28163 - RNA, 20 nt, Artificial Sequence
  MKO10028163_A_Kruap19-5
  gRNA
cauccgaggcuuugggaacc

SEQ ID NO: 28164 - RNA, 20 nt, Artificial Sequence
  MKO10028164_A_Kruap19-5
  gRNA
ggagguuacggauauggauc

SEQ ID NO: 28165 - RNA, 20 nt, Artificial Sequence
  MKO10028165_A_Kruap19-9b
  gRNA
uggaaccauagccauauccc

SEQ ID NO: 28166 - RNA, 20 nt, Artificial Sequence
  MKO10028166_A_Kruap19-9b
  gRNA
aacacaaugagcuacuacua

SEQ ID NO: 28167 - RNA, 20 nt, Artificial Sequence
  MKO10028167_A_Kruap19-9b
  gRNA
caaauauccuccauagaaag

SEQ ID NO: 28168 - RNA, 20 nt, Artificial Sequence
  MKO10028168_A_Kruap2-4
  gRNA
ggcucagcagcagguguuac

SEQ ID NO: 28169 - RNA, 20 nt, Artificial Sequence
  MKO10028169_A_Kruap2-4
  gRNA
accaugacaggcuccugcug

SEQ ID NO: 28170 - RNA, 20 nt, Artificial Sequence
  MKO10028170_A_Kruap2-4
  gRNA
ccuggugcaguggggcacac

SEQ ID NO: 28171 - RNA, 20 nt, Artificial Sequence
  MKO10028171_A_Kruap20-2
  gRNA
caguaucuucuauagcagag

SEQ ID NO: 28172 - RNA, 20 nt, Artificial Sequence
  MKO10028172_A_Kruap20-2
  gRNA
agcucuucaguagaagccac

SEQ ID NO: 28173 - RNA, 20 nt, Artificial Sequence
  MKO10028173_A_Kruap20-2
  gRNA
cacucugcuauagaagauac

SEQ ID NO: 28174 - RNA, 20 nt, Artificial Sequence
  MKO10028174_A_Kruap21-1
  gRNA
uccguaguaguugcagcaca

SEQ ID NO: 28175 - RNA, 20 nt, Artificial Sequence
  MKO10028175_A_Kruap21-1
  gRNA
ugguacagacuagcagcaag

SEQ ID NO: 28176 - RNA, 20 nt, Artificial Sequence
  MKO10028176_A_Kruap21-1
  gRNA
gccguauccacagccuccac

SEQ ID NO: 28177 - RNA, 20 nt, Artificial Sequence
  MKO10028177_A_Kruap22-2
  gRNA
augugcuacggaaacuacuu

SEQ ID NO: 28178 - RNA, 20 nt, Artificial Sequence
  MKO10028178_A_Kruap22-2
  gRNA
accuaucgcccaugcugcua

SEQ ID NO: 28179 - RNA, 20 nt, Artificial Sequence
  MKO10028179_A_Kruap22-2
  gRNA
gaaagucuuccauagcagca

SEQ ID NO: 28180 - RNA, 20 nt, Artificial Sequence
  MKO10028180_A_Kruap24-1
  gRNA
gcgucacggggauguagcag

SEQ ID NO: 28181 - RNA, 20 nt, Artificial Sequence
  MKO10028181_A_Kruap24-1
  gRNA
aagcuugaaggcacguaauu

SEQ ID NO: 28182 - RNA, 20 nt, Artificial Sequence
  MKO10028182_A_Kruap24-1
  gRNA
gcaguuggauacauacccuu

SEQ ID NO: 28183 - RNA, 20 nt, Artificial Sequence
  MKO10028183_A_Kruap26-1
  gRNA
gcuauguaucuagcaguugc

SEQ ID NO: 28184 - RNA, 20 nt, Artificial Sequence
  MKO10028184_A_Kruap26-1
  gRNA
cggcagcuauuggauccaca

SEQ ID NO: 28185 - RNA, 20 nt, Artificial Sequence
  MKO10028185_A_Kruap26-1
  gRNA
ccaccagauacacagcuuac

SEQ ID NO: 28186 - RNA, 20 nt, Artificial Sequence
  MKO10028186_A_Kruap27-1
  gRNA
auagccauugccagucauuc

SEQ ID NO: 28187 - RNA, 20 nt, Artificial Sequence
  MKO10028187_A_Kruap27-1
  gRNA
uggauucaaacuccaacguc

SEQ ID NO: 28188 - RNA, 20 nt, Artificial Sequence
  MKO10028188_A_Kruap27-1
  gRNA
accugccaaccagccaauug

SEQ ID NO: 28189 - RNA, 20 nt, Artificial Sequence
  MKO10028189_A_Kruap3-1
  gRNA
aaguguacgugccaaccugc

SEQ ID NO: 28190 - RNA, 20 nt, Artificial Sequence
  MKO10028190_A_Kruap3-1
  gRNA
uuggcacguacacuucaggc

SEQ ID NO: 28191 - RNA, 20 nt, Artificial Sequence
  MKO10028191_A_Kruap3-1
  gRNA
gacuugacugcuuaacagca

SEQ ID NO: 28192 - RNA, 20 nt, Artificial Sequence
  MKO10028192_A_Kruap3-2
  gRNA
cgcugcugcaguguccccac

SEQ ID NO: 28193 - RNA, 20 nt, Artificial Sequence
  MKO10028193_A_Kruap3-2
  gRNA
gccacaggucagcagcaccu

SEQ ID NO: 28194 - RNA, 20 nt, Artificial Sequence
  MKO10028194_A_Kruap3-2
  gRNA
cgguggggacacugcagcag

SEQ ID NO: 28195 - RNA, 20 nt, Artificial Sequence
  MKO10028195_A_Kruap3-3
  gRNA
cgcugcugcaguguccccac

SEQ ID NO: 28196 - RNA, 20 nt, Artificial Sequence
  MKO10028196_A_Kruap3-3
  gRNA
gccacaggucagcagcaccu

SEQ ID NO: 28197 - RNA, 20 nt, Artificial Sequence
  MKO10028197_A_Kruap3-3
  gRNA
cgguggggacacugcagcag

SEQ ID NO: 28198 - RNA, 20 nt, Artificial Sequence
  MKO10028198_A_Kruap31-1
  gRNA
cgcugauaaccagcucccaa

SEQ ID NO: 28199 - RNA, 20 nt, Artificial Sequence
  MKO10028199_A_Kruap31-1
  gRNA
cuuugggagcugguuaucag

SEQ ID NO: 28200 - RNA, 20 nt, Artificial Sequence
  MKO10028200_A_Kruap31-1
  gRNA
gcugcaaccaaugaucacac

SEQ ID NO: 28201 - RNA, 20 nt, Artificial Sequence
  MKO10028201_A_Kruap31-2
  gRNA
cacugaugaccagcucccaa

SEQ ID NO: 28202 - RNA, 20 nt, Artificial Sequence
  MKO10028202_A_Kruap31-2
  gRNA
cuuugggagcuggucaucag

SEQ ID NO: 28203 - RNA, 20 nt, Artificial Sequence
  MKO10028203_A_Kruap31-2
  gRNA
ggagauggucuugcagcagc

SEQ ID NO: 28204 - RNA, 20 nt, Artificial Sequence
  MKO10028204_A_Kruap4-13
  gRNA
accauggucagcuccugcug

SEQ ID NO: 28205 - RNA, 20 nt, Artificial Sequence
  MKO10028205_A_Kruap4-13
  gRNA
gcagcaagaaccacuagaac

SEQ ID NO: 28206 - RNA, 20 nt, Artificial Sequence
  MKO10028206_A_Kruap4-13
  gRNA
cagcuggaaaugcagcagcu

SEQ ID NO: 28207 - RNA, 20 nt, Artificial Sequence
  MKO10028207_A_Kruap4-16
  gRNA
gcaaguuguacggcagcaag

SEQ ID NO: 28208 - RNA, 20 nt, Artificial Sequence
  MKO10028208_A_Kruap4-16
  gRNA
ugcugccguacaacuugcug

SEQ ID NO: 28209 - RNA, 20 nt, Artificial Sequence
  MKO10028209_A_Kruap4-16
  gRNA
cugugaucaaagucccugcc

SEQ ID NO: 28210 - RNA, 20 nt, Artificial Sequence
  MKO10028210_A_Kruap4-1
  gRNA
agcugcugucgaccuuccug

SEQ ID NO: 28211 - RNA, 20 nt, Artificial Sequence
  MKO10028211_A_Kruap4-1
  gRNA
acaauggucaacucuuguug

SEQ ID NO: 28212 - RNA, 20 nt, Artificial Sequence
  MKO10028212_A_Kruap4-1
  gRNA
uuagggaucucagcagcagc

SEQ ID NO: 28213 - RNA, 20 nt, Artificial Sequence
  MKO10028213_A_Kruap4-2
  gRNA
uucaaagagauuuagcagca

SEQ ID NO: 28214 - RNA, 20 nt, Artificial Sequence
  MKO10028214_A_Kruap4-2
  gRNA
agagccacaagagcugacca

SEQ ID NO: 28215 - RNA, 20 nt, Artificial Sequence
  MKO10028215_A_Kruap4-2
  gRNA
gacaccauggucagcucuug

SEQ ID NO: 28216 - RNA, 20 nt, Artificial Sequence
  MKO10028216_A_Kruap4-6
  gRNA
gacagagccacaacaagagu

SEQ ID NO: 28217 - RNA, 20 nt, Artificial Sequence
  MKO10028217_A_Kruap4-6
  gRNA
accauggccaacucuuguug

SEQ ID NO: 28218 - RNA, 20 nt, Artificial Sequence
  MKO10028218_A_Kruap4-6
  gRNA
caagaaccacuagagcacgc

SEQ ID NO: 28219 - RNA, 20 nt, Artificial Sequence
  MKO10028219_A_Kruap4-7
  gRNA
agcugcugccaaccaucuug

SEQ ID NO: 28220 - RNA, 20 nt, Artificial Sequence
  MKO10028220_A_Kruap4-7
  gRNA
ggcauggaggcucagcaaca

SEQ ID NO: 28221 - RNA, 20 nt, Artificial Sequence
  MKO10028221_A_Kruap4-7
  gRNA
cagcuagaaccaccacaaga

SEQ ID NO: 28222 - RNA, 20 nt, Artificial Sequence
  MKO10028222_A_Kruap4-8
  gRNA
caagagccacuagagcaugc

SEQ ID NO: 28223 - RNA, 20 nt, Artificial Sequence
  MKO10028223_A_Kruap4-8
  gRNA
cccugcugucgucccugcug

SEQ ID NO: 28224 - RNA, 20 nt, Artificial Sequence
  MKO10028224_A_Kruap4-8
  gRNA
acagcuagaacuaccacagc

SEQ ID NO: 28225 - RNA, 20 nt, Artificial Sequence
  MKO10028225_A_Kruap4-9
  gRNA
caagaaccacuagagcauga

SEQ ID NO: 28226 - RNA, 20 nt, Artificial Sequence
  MKO10028226_A_Kruap4-9
  gRNA
gcagcuagaacuaccacagc

SEQ ID NO: 28227 - RNA, 20 nt, Artificial Sequence
  MKO10028227_A_Kruap4-9
  gRNA
ugccgcccaucaugcucuag

SEQ ID NO: 28228 - RNA, 20 nt, Artificial Sequence
  MKO10028228_A_Kruap5-1
  gRNA
ugcaagcccuguugcucuuc

SEQ ID NO: 28229 - RNA, 20 nt, Artificial Sequence
  MKO10028229_A_Kruap5-1
  gRNA
ggcucuggcugugggggaug

SEQ ID NO: 28230 - RNA, 20 nt, Artificial Sequence
  MKO10028230_A_Kruap5-1
  gRNA
gcagcuagacugacaacagc

SEQ ID NO: 28231 - RNA, 20 nt, Artificial Sequence
  MKO10028231_A_Kruap5-2
  gRNA
gguggagagacaagaugugu

SEQ ID NO: 28232 - RNA, 20 nt, Artificial Sequence
  MKO10028232_A_Kruap5-2
  gRNA
ugcccugaugcuuuccugac

SEQ ID NO: 28233 - RNA, 20 nt, Artificial Sequence
  MKO10028233_A_Kruap5-2
  gRNA
acagcuggauuggcaacaac

SEQ ID NO: 28234 - RNA, 20 nt, Artificial Sequence
  MKO10028234_A_Kruap5-3
  gRNA
cauucuuccaugccaauagc

SEQ ID NO: 28235 - RNA, 20 nt, Artificial Sequence
  MKO10028235_A_Kruap5-3
  gRNA
ggaucuggguuuccuauuag

SEQ ID NO: 28236 - RNA, 20 nt, Artificial Sequence
  MKO10028236_A_Kruap5-3
  gRNA
ccauaagguauguucaccac

SEQ ID NO: 28237 - RNA, 20 nt, Artificial Sequence
  MKO10028237_A_Kruap5-4
  gRNA
gcagcccccacagcuagagc

SEQ ID NO: 28238 - RNA, 20 nt, Artificial Sequence
  MKO10028238_A_Kruap5-4
  gRNA
gucuguuccugcucuagcug

SEQ ID NO: 28239 - RNA, 20 nt, Artificial Sequence
  MKO10028239_A_Kruap5-4
  gRNA
gcacacaggggcacagcagc

SEQ ID NO: 28240 - RNA, 20 nt, Artificial Sequence
  MKO10028240_A_Kruap5-5
  gRNA
cccacaaccugaagaacagc

SEQ ID NO: 28241 - RNA, 20 nt, Artificial Sequence
  MKO10028241_A_Kruap5-5
  gRNA
ugcaaacccugcuguucuuc

SEQ ID NO: 28242 - RNA, 20 nt, Artificial Sequence
  MKO10028242_A_Kruap5-5
  gRNA
acccuugcagcccccacagc

SEQ ID NO: 28243 - RNA, 20 nt, Artificial Sequence
  MKO10028243_A_Kruap6-1
  gRNA
uguggcuauggaugcggcuc

SEQ ID NO: 28244 - RNA, 20 nt, Artificial Sequence
  MKO10028244_A_Kruap6-1
  gRNA
agaaccauguguggcuacua

SEQ ID NO: 28245 - RNA, 20 nt, Artificial Sequence
  MKO10028245_A_Kruap6-1
  gRNA
cauagccacagcccagucca

SEQ ID NO: 28246 - RNA, 20 nt, Artificial Sequence
  MKO10028246_A_Kruap6-2
  gRNA
gccuucuaaaaaugugcagc

SEQ ID NO: 28247 - RNA, 20 nt, Artificial Sequence
  MKO10028247_A_Kruap6-2
  gRNA
aacauguguuguaacuacua

SEQ ID NO: 28248 - RNA, 20 nt, Artificial Sequence
  MKO10028248_A_Kruap6-2
  gRNA
acaacacauguugucaauag

SEQ ID NO: 28249 - RNA, 20 nt, Artificial Sequence
  MKO10028249_A_Kruap6-5
  gRNA
ggauuuggcuacuacuacug

SEQ ID NO: 28250 - RNA, 20 nt, Artificial Sequence
  MKO10028250_A_Kruap6-5
  gRNA
ggcuauggaggcuugggcug

SEQ ID NO: 28251 - RNA, 20 nt, Artificial Sequence
  MKO10028251_A_Kruap6-5
  gRNA
cugcuguggcuguggaggcc

SEQ ID NO: 28252 - RNA, 20 nt, Artificial Sequence
  MKO10028252_A_Kruap7-1
  gRNA
augacucgcuauuucugcug

SEQ ID NO: 28253 - RNA, 20 nt, Artificial Sequence
  MKO10028253_A_Kruap7-1
  gRNA
uguacaugguuccgcagcca

SEQ ID NO: 28254 - RNA, 20 nt, Artificial Sequence
  MKO10028254_A_Kruap7-1
  gRNA
agcucccgcaacuucugcua

SEQ ID NO: 28255 - RNA, 20 nt, Artificial Sequence
  MKO10028255_A_Kruap8-1
  gRNA
ccugacaucauguacuacac

SEQ ID NO: 28256 - RNA, 20 nt, Artificial Sequence
  MKO10028256_A_Kruap8-1
  gRNA
cagccaacacuguaccccag

SEQ ID NO: 28257 - RNA, 20 nt, Artificial Sequence
  MKO10028257_A_Kruap8-1
  gRNA
gggcagcuauggcuacccuc

SEQ ID NO: 28258 - RNA, 20 nt, Artificial Sequence
  MKO10028258_A_Kruap9-1
  gRNA
aauaauucaucaacagccac

SEQ ID NO: 28259 - RNA, 20 nt, Artificial Sequence
  MKO10028259_A_Kruap9-1
  gRNA
aguccagcugcugccagccu

SEQ ID NO: 28260 - RNA, 20 nt, Artificial Sequence
  MKO10028260_A_Kruap9-1
  gRNA
aguccagcugcugccagccc

SEQ ID NO: 28261 - RNA, 20 nt, Artificial Sequence
  MKO10028261_A_Kruap9-3
  gRNA
cagccaagcuguugcgagac

SEQ ID NO: 28262 - RNA, 20 nt, Artificial Sequence
  MKO10028262_A_Kruap9-3
  gRNA
aagccagucucgcaacagcu

SEQ ID NO: 28263 - RNA, 20 nt, Artificial Sequence
  MKO10028263_A_Kruap9-3
  gRNA
ccagaaggcuuucaacagcu

SEQ ID NO: 28264 - RNA, 20 nt, Artificial Sequence
  MKO10028264_A_Kruap9-5
  gRNA
cagcagcuaguuauacagau

SEQ ID NO: 28265 - RNA, 20 nt, Artificial Sequence
  MKO10028265_A_Kruap9-5
  gRNA
uggacugcaacuggucacau

SEQ ID NO: 28266 - RNA, 20 nt, Artificial Sequence
  MKO10028266_A_Kruap9-5
  gRNA
gcaggugguuucacacaugc

SEQ ID NO: 28267 - RNA, 20 nt, Artificial Sequence
  MKO10028267_A_Krucap2
  gRNA
ucauuuauaguagucgguac

SEQ ID NO: 28268 - RNA, 20 nt, Artificial Sequence
  MKO10028268_A_Krucap2
  gRNA
gcagaucuacagccgccagc

SEQ ID NO: 28269 - RNA, 20 nt, Artificial Sequence
  MKO10028269_A_Krucap2
  gRNA
gauaucguccacucuguacc

SEQ ID NO: 28270 - RNA, 20 nt, Artificial Sequence
  MKO10028270_A_Krucap3
  gRNA
acucaggagugaccgcgccu

SEQ ID NO: 28271 - RNA, 20 nt, Artificial Sequence
  MKO10028271_A_Krucap3
  gRNA
cguggccaacccccgaggcg

SEQ ID NO: 28272 - RNA, 20 nt, Artificial Sequence
  MKO10028272_A_Krucap3
  gRNA
gauggauccuuccauaccgc

SEQ ID NO: 28273 - RNA, 20 nt, Artificial Sequence
  MKO10028273_A_Krtdap
  gRNA
uaauuacccuaccgcaacag

SEQ ID NO: 28274 - RNA, 20 nt, Artificial Sequence
  MKO10028274_A_Krtdap
  gRNA
guguuuaccucuguugcggu

SEQ ID NO: 28275 - RNA, 20 nt, Artificial Sequence
  MKO10028275_A_Krtdap
  gRNA
cagugaugacgugccaguuc

SEQ ID NO: 28276 - RNA, 20 nt, Artificial Sequence
  MKO10028276_A_Ksr1
  gRNA
ucggggugacgucgucgauu

SEQ ID NO: 28277 - RNA, 20 nt, Artificial Sequence
  MKO10028277_A_Ksr1
  gRNA
gcuuggcgugccgucguagc

SEQ ID NO: 28278 - RNA, 20 nt, Artificial Sequence
  MKO10028278_A_Ksr1
  gRNA
agcucggcgguccugucgcu

SEQ ID NO: 28279 - RNA, 20 nt, Artificial Sequence
  MKO10028279_A_Ksr2
  gRNA
accgcaaggagcgcucggac

SEQ ID NO: 28280 - RNA, 20 nt, Artificial Sequence
  MKO10028280_A_Ksr2
  gRNA
cgucuacacgguucccgagc

SEQ ID NO: 28281 - RNA, 20 nt, Artificial Sequence
  MKO10028281_A_Ksr2
  gRNA
ugcggacuacgugccgcugc

SEQ ID NO: 28282 - RNA, 20 nt, Artificial Sequence
  MKO10028282_A_Kti12
  gRNA
cguccgcuggcucuugccgc

SEQ ID NO: 28283 - RNA, 20 nt, Artificial Sequence
  MKO10028283_A_Kti12
  gRNA
ggagaucaugccgcucgucg

SEQ ID NO: 28284 - RNA, 20 nt, Artificial Sequence
  MKO10028284_A_Kti12
  gRNA
agcccgcaaaccacgacgag

SEQ ID NO: 28285 - RNA, 20 nt, Artificial Sequence
  MKO10028285_A_Ktn1
  gRNA
gcgcuguaagcaguugacuc

SEQ ID NO: 28286 - RNA, 20 nt, Artificial Sequence
  MKO10028286_A_Ktn1
  gRNA
ugcaacuacuuacauuccuu

SEQ ID NO: 28287 - RNA, 20 nt, Artificial Sequence
  MKO10028287_A_Ktn1
  gRNA
ugcuaacucaaaucucauga

SEQ ID NO: 28288 - RNA, 20 nt, Artificial Sequence
  MKO10028288_A_Kxd1
  gRNA
caucuguugcagccgcacac

SEQ ID NO: 28289 - RNA, 20 nt, Artificial Sequence
  MKO10028289_A_Kxd1
  gRNA
caugcaccauacccgcaccu

SEQ ID NO: 28290 - RNA, 20 nt, Artificial Sequence
  MKO10028290_A_Kxd1
  gRNA
cacuuacggcugaaggccuc

SEQ ID NO: 28291 - RNA, 20 nt, Artificial Sequence
  MKO10028291_A_Kynu
  gRNA
ccuuggccuucaaccgaaaa

SEQ ID NO: 28292 - RNA, 20 nt, Artificial Sequence
  MKO10028292_A_Kynu
  gRNA
gaguauuguaagccuuauga

SEQ ID NO: 28293 - RNA, 20 nt, Artificial Sequence
  MKO10028293_A_Kynu
  gRNA
augauguaggcaaacgcccu

SEQ ID NO: 28294 - RNA, 20 nt, Artificial Sequence
  MKO10028294_A_Ky
  gRNA
aacaugagaccccggcagcc

SEQ ID NO: 28295 - RNA, 20 nt, Artificial Sequence
  MKO10028295_A_Ky
  gRNA
aucaccuccuacgacaacca

SEQ ID NO: 28296 - RNA, 20 nt, Artificial Sequence
  MKO10028296_A_Ky
  gRNA
ucucuuaccuugguugucgu

SEQ ID NO: 28297 - RNA, 20 nt, Artificial Sequence
  MKO10028297_A_L1cam
  gRNA
agguuccgcuggacgaaaga

SEQ ID NO: 28298 - RNA, 20 nt, Artificial Sequence
  MKO10028298_A_L1cam
  gRNA
gucgcaugagauccagcucg

SEQ ID NO: 28299 - RNA, 20 nt, Artificial Sequence
  MKO10028299_A_L1cam
  gRNA
gcuagagccaccugucauca

SEQ ID NO: 28300 - RNA, 20 nt, Artificial Sequence
  MKO10028300_A_L1td1
  gRNA
cccaaagagagcccgcccga

SEQ ID NO: 28301 - RNA, 20 nt, Artificial Sequence
  MKO10028301_A_L1td1
  gRNA
gaugagcgcugacaaucucg

SEQ ID NO: 28302 - RNA, 20 nt, Artificial Sequence
  MKO10028302_A_L1td1
  gRNA
uuccuuagcuugcacgauug

SEQ ID NO: 28303 - RNA, 20 nt, Artificial Sequence
  MKO10028303_A_L2hgdh
  gRNA
uaguucacaaugccggugua

SEQ ID NO: 28304 - RNA, 20 nt, Artificial Sequence
  MKO10028304_A_L2hgdh
  gRNA
cagacacucacccugcaaua

SEQ ID NO: 28305 - RNA, 20 nt, Artificial Sequence
  MKO10028305_A_L2hgdh
  gRNA
caccgcuguuguguccaguc

SEQ ID NO: 28306 - RNA, 20 nt, Artificial Sequence
  MKO10028306_A_L3hypdh
  gRNA
auguguguucugcgaagacg

SEQ ID NO: 28307 - RNA, 20 nt, Artificial Sequence
  MKO10028307_A_L3hypdh
  gRNA
cugcguguuugccgaugaac

SEQ ID NO: 28308 - RNA, 20 nt, Artificial Sequence
  MKO10028308_A_L3hypdh
  gRNA
cugucacucccgagccggug

SEQ ID NO: 28309 - RNA, 20 nt, Artificial Sequence
  MKO10028309_A_L3mbtl1
  gRNA
uacgcgccacugaacaugau

SEQ ID NO: 28310 - RNA, 20 nt, Artificial Sequence
  MKO10028310_A_L3mbtl1
  gRNA
cucccgaugaaccaacgucu

SEQ ID NO: 28311 - RNA, 20 nt, Artificial Sequence
  MKO10028311_A_L3mbtl1
  gRNA
aguggagcgaccacgaagcc

SEQ ID NO: 28312 - RNA, 20 nt, Artificial Sequence
  MKO10028312_A_L3mbtl2
  gRNA
cucugcgaacaaccgcuccu

SEQ ID NO: 28313 - RNA, 20 nt, Artificial Sequence
  MKO10028313_A_L3mbtl2
  gRNA
acuugccccagucgaagccc

SEQ ID NO: 28314 - RNA, 20 nt, Artificial Sequence
  MKO10028314_A_L3mbtl2
  gRNA
ucugcagcgucucguguucc

SEQ ID NO: 28315 - RNA, 20 nt, Artificial Sequence
  MKO10028315_A_L3mbtl3
  gRNA
uggcaugccgagcacaauuc

SEQ ID NO: 28316 - RNA, 20 nt, Artificial Sequence
  MKO10028316_A_L3mbtl3
  gRNA
aaauacgggccuggagcucg

SEQ ID NO: 28317 - RNA, 20 nt, Artificial Sequence
  MKO10028317_A_L3mbtl3
  gRNA
caguuucgaguaaaugaguu

SEQ ID NO: 28318 - RNA, 20 nt, Artificial Sequence
  MKO10028318_A_L3mbtl4
  gRNA
gucuacagagcgcaugaauc

SEQ ID NO: 28319 - RNA, 20 nt, Artificial Sequence
  MKO10028319_A_L3mbtl4
  gRNA
cuauuauuaccucgcuuuga

SEQ ID NO: 28320 - RNA, 20 nt, Artificial Sequence
  MKO10028320_A_L3mbtl4
  gRNA
agagugagauaagaacgcgc

SEQ ID NO: 28321 - RNA, 20 nt, Artificial Sequence
  MKO10028321_A_LOC100038947
  gRNA
auaaggugguucaagggugu

SEQ ID NO: 28322 - RNA, 20 nt, Artificial Sequence
  MKO10028322_A_LOC100038947
  gRNA
uacacccuugaaccaccuua

SEQ ID NO: 28323 - RNA, 20 nt, Artificial Sequence
  MKO10028323_A_LOC100038947
  gRNA
cuuacgcauguaaaugacag

SEQ ID NO: 28324 - RNA, 20 nt, Artificial Sequence
  MKO10028324_A_LOC100040786
  gRNA
guucucguagagaagagucu

SEQ ID NO: 28325 - RNA, 20 nt, Artificial Sequence
  MKO10028325_A_LOC100040786
  gRNA
guaaugagccugucacccau

SEQ ID NO: 28326 - RNA, 20 nt, Artificial Sequence
  MKO10028326_A_LOC100040786
  gRNA
ugucacagagcacuggcugg

SEQ ID NO: 28327 - RNA, 20 nt, Artificial Sequence
  MKO10028327_A_LOC100048884
  gRNA
uauuacagauuaauggggaa

SEQ ID NO: 28328 - RNA, 20 nt, Artificial Sequence
  MKO10028328_A_LOC100048884
  gRNA
aguauggaauuuaagaacua

SEQ ID NO: 28329 - RNA, 20 nt, Artificial Sequence
  MKO10028329_A_LOC100048884
  gRNA
agagugcuccgaauuaucua

SEQ ID NO: 28330 - RNA, 20 nt, Artificial Sequence
  MKO10028330_A_LOC100502896
  gRNA
cguuacaaagacuugugugc

SEQ ID NO: 28331 - RNA, 20 nt, Artificial Sequence
  MKO10028331_A_LOC100502896
  gRNA
acacaagucuuuguaacgag

SEQ ID NO: 28332 - RNA, 20 nt, Artificial Sequence
  MKO10028332_A_LOC100502896
  gRNA
ucugaauaccugaggaacuu

SEQ ID NO: 28333 - RNA, 20 nt, Artificial Sequence
  MKO10028333_A_LOC100503280
  gRNA
cucaugcagcuguaccgcug

SEQ ID NO: 28334 - RNA, 20 nt, Artificial Sequence
  MKO10028334_A_LOC100503280
  gRNA
gacaacgcagguggcaguac

SEQ ID NO: 28335 - RNA, 20 nt, Artificial Sequence
  MKO10028335_A_LOC100503280
  gRNA
agcacaggcuacacuucaug

SEQ ID NO: 28336 - RNA, 20 nt, Artificial Sequence
  MKO10028336_A_LOC100504608
  gRNA
ggccagcucucgcaccgauc

SEQ ID NO: 28337 - RNA, 20 nt, Artificial Sequence
  MKO10028337_A_LOC100504608
  gRNA
aggcaagaaggugaucgaac

SEQ ID NO: 28338 - RNA, 20 nt, Artificial Sequence
  MKO10028338_A_LOC100504608
  gRNA
acaaggcgcacacccgagcc

SEQ ID NO: 28339 - RNA, 20 nt, Artificial Sequence
  MKO10028339_A_LOC100861615
  gRNA
ugaacuagaagaacugaaau

SEQ ID NO: 28340 - RNA, 20 nt, Artificial Sequence
  MKO10028340_A_LOC100861615
  gRNA
ucaaauccucauacauguaa

SEQ ID NO: 28341 - RNA, 20 nt, Artificial Sequence
  MKO10028341_A_LOC100861615
  gRNA
acaacaugagaagacaaugu

SEQ ID NO: 28342 - RNA, 20 nt, Artificial Sequence
  MKO10028342_A_LOC100862015
  gRNA
ucugaauaccugaggaacuu

SEQ ID NO: 28343 - RNA, 20 nt, Artificial Sequence
  MKO10028343_A_LOC100862015
  gRNA
gaaaugacaaagaagccaau

SEQ ID NO: 28344 - RNA, 20 nt, Artificial Sequence
  MKO10028344_A_LOC100862015
  gRNA
caccuggcacauagccuccc

SEQ ID NO: 28345 - RNA, 20 nt, Artificial Sequence
  MKO10028345_A_LOC101055863
  gRNA
ucugaauaccugaggaacuu

SEQ ID NO: 28346 - RNA, 20 nt, Artificial Sequence
  MKO10028346_A_LOC101055863
  gRNA
gaaaugacaaagaagccaau

SEQ ID NO: 28347 - RNA, 20 nt, Artificial Sequence
  MKO10028347_A_LOC101055863
  gRNA
caccuggcacauagccuccc

SEQ ID NO: 28348 - RNA, 20 nt, Artificial Sequence
  MKO10028348_A_LOC102308570
  gRNA
guacguacgcccgcuucuug

SEQ ID NO: 28349 - RNA, 20 nt, Artificial Sequence
  MKO10028349_A_LOC102308570
  gRNA
uauuaagcagggaucggcga

SEQ ID NO: 28350 - RNA, 20 nt, Artificial Sequence
  MKO10028350_A_LOC102308570
  gRNA
caucuauagaacacgauuua

SEQ ID NO: 28351 - RNA, 20 nt, Artificial Sequence
  MKO10028351_A_LOC666331
  gRNA
aucgaccagagcaauaugcg

SEQ ID NO: 28352 - RNA, 20 nt, Artificial Sequence
  MKO10028352_A_LOC666331
  gRNA
ccacaccacgcauauugcuc

SEQ ID NO: 28353 - RNA, 20 nt, Artificial Sequence
  MKO10028353_A_LOC666331
  gRNA
gcuugccaccuauaccccaa

SEQ ID NO: 28354 - RNA, 20 nt, Artificial Sequence
  MKO10028354_A_Lacc1
  gRNA
caaucuguguaccgaaguua

SEQ ID NO: 28355 - RNA, 20 nt, Artificial Sequence
  MKO10028355_A_Lacc1
  gRNA
aaggagccugaaucuuacga

SEQ ID NO: 28356 - RNA, 20 nt, Artificial Sequence
  MKO10028356_A_Lacc1
  gRNA
acgaucccaucguaagauuc

SEQ ID NO: 28357 - RNA, 20 nt, Artificial Sequence
  MKO10028357_A_Lace1
  gRNA
cccgauagcucccauagccg

SEQ ID NO: 28358 - RNA, 20 nt, Artificial Sequence
  MKO10028358_A_Lace1
  gRNA
ggcguacacccucggauguc

SEQ ID NO: 28359 - RNA, 20 nt, Artificial Sequence
  MKO10028359_A_Lace1
  gRNA
acgcccaacagccgcuucug

SEQ ID NO: 28360 - RNA, 20 nt, Artificial Sequence
  MKO10028360_A_Lacub2
  gRNA
ugagaaaucauuuaccguaa

SEQ ID NO: 28361 - RNA, 20 nt, Artificial Sequence
  MKO10028361_A_Lacub2
  gRNA
cauuguccuaaguuccguua

SEQ ID NO: 28362 - RNA, 20 nt, Artificial Sequence
  MKO10028362_A_Lacub2
  gRNA
acugcauuaaaaaacuucga

SEQ ID NO: 28363 - RNA, 20 nt, Artificial Sequence
  MKO10028363_A_Lacubl1
  gRNA
cgguacaugguauacucauu

SEQ ID NO: 28364 - RNA, 20 nt, Artificial Sequence
  MKO10028364_A_Lacubl1
  gRNA
gugcuggcauagcgcuccag

SEQ ID NO: 28365 - RNA, 20 nt, Artificial Sequence
  MKO10028365_A_Lacubl1
  gRNA
gguggaugggauucugcgca

SEQ ID NO: 28366 - RNA, 20 nt, Artificial Sequence
  MKO10028366_A_Lacub
  gRNA
agaugccgcagcgcgaagcc

SEQ ID NO: 28367 - RNA, 20 nt, Artificial Sequence
  MKO10028367_A_Lacub
  gRNA
uucgcuguccugcucgacuu

SEQ ID NO: 28368 - RNA, 20 nt, Artificial Sequence
  MKO10028368_A_Lacub
  gRNA
ucgggaacauagugcugcac

SEQ ID NO: 28369 - RNA, 20 nt, Artificial Sequence
  MKO10028369_A_Lad1
  gRNA
cagaaacacccuuaacccgc

SEQ ID NO: 28370 - RNA, 20 nt, Artificial Sequence
  MKO10028370_A_Lad1
  gRNA
cguucuucguccugggccca

SEQ ID NO: 28371 - RNA, 20 nt, Artificial Sequence
  MKO10028371_A_Lad1
  gRNA
cguccuccaaaguccgcugu

SEQ ID NO: 28372 - RNA, 20 nt, Artificial Sequence
  MKO10028372_A_Lag3
  gRNA
ucgaggccuggccgacgcgc

SEQ ID NO: 28373 - RNA, 20 nt, Artificial Sequence
  MKO10028373_A_Lag3
  gRNA
uguagacaggcacucgguuc

SEQ ID NO: 28374 - RNA, 20 nt, Artificial Sequence
  MKO10028374_A_Lag3
  gRNA
gcucagcaccguguagcgac

SEQ ID NO: 28375 - RNA, 20 nt, Artificial Sequence
  MKO10028375_A_Lage3
  gRNA
cacucuuagacgcuggaucg

SEQ ID NO: 28376 - RNA, 20 nt, Artificial Sequence
  MKO10028376_A_Lage3
  gRNA
acagcggcuagucugaccau

SEQ ID NO: 28377 - RNA, 20 nt, Artificial Sequence
  MKO10028377_A_Lage3
  gRNA
ccagaugucgaaccacaucg

SEQ ID NO: 28378 - RNA, 20 nt, Artificial Sequence
  MKO10028378_A_Lair1
  gRNA
acuucauccaguuauccugc

SEQ ID NO: 28379 - RNA, 20 nt, Artificial Sequence
  MKO10028379_A_Lair1
  gRNA
aggacucaccaagcaccagc

SEQ ID NO: 28380 - RNA, 20 nt, Artificial Sequence
  MKO10028380_A_Lair1
  gRNA
auggaaaauuaacacacagg

SEQ ID NO: 28381 - RNA, 20 nt, Artificial Sequence
  MKO10028381_A_Lalba
  gRNA
cuaucaaaggaaucgacuac

SEQ ID NO: 28382 - RNA, 20 nt, Artificial Sequence
  MKO10028382_A_Lalba
  gRNA
caagcuguugucaacgacaa

SEQ ID NO: 28383 - RNA, 20 nt, Artificial Sequence
  MKO10028383_A_Lalba
  gRNA
gccacagauguucuccgacu

SEQ ID NO: 28384 - RNA, 20 nt, Artificial Sequence
  MKO10028384_A_Lama1
  gRNA
auugggcgugucgaacaggc

SEQ ID NO: 28385 - RNA, 20 nt, Artificial Sequence
  MKO10028385_A_Lama1
  gRNA
ccgauaucacacgcaaucga

SEQ ID NO: 28386 - RNA, 20 nt, Artificial Sequence
  MKO10028386_A_Lama1
  gRNA
acucacacgucuugugacaa

SEQ ID NO: 28387 - RNA, 20 nt, Artificial Sequence
  MKO10028387_A_Lama2
  gRNA
ccgauuacgaaugcuauuga

SEQ ID NO: 28388 - RNA, 20 nt, Artificial Sequence
  MKO10028388_A_Lama2
  gRNA
ccaucaauagcauucguaau

SEQ ID NO: 28389 - RNA, 20 nt, Artificial Sequence
  MKO10028389_A_Lama2
  gRNA
uacaauaucuauccccgcac

SEQ ID NO: 28390 - RNA, 20 nt, Artificial Sequence
  MKO10028390_A_Lama3
  gRNA
acucacccggcgcgugacag

SEQ ID NO: 28391 - RNA, 20 nt, Artificial Sequence
  MKO10028391_A_Lama3
  gRNA
guauucccguaucgugccuc

SEQ ID NO: 28392 - RNA, 20 nt, Artificial Sequence
  MKO10028392_A_Lama3
  gRNA
gagaccccacugucacgcgc

SEQ ID NO: 28393 - RNA, 20 nt, Artificial Sequence
  MKO10028393_A_Lama4
  gRNA
gcucuccuguuguguuccgc

SEQ ID NO: 28394 - RNA, 20 nt, Artificial Sequence
  MKO10028394_A_Lama4
  gRNA
gcuuugcagaauccugcuac

SEQ ID NO: 28395 - RNA, 20 nt, Artificial Sequence
  MKO10028395_A_Lama4
  gRNA
uucguaagcaguuccugcac

SEQ ID NO: 28396 - RNA, 20 nt, Artificial Sequence
  MKO10028396_A_Lama5
  gRNA
gugaugcgcucuagaguccg

SEQ ID NO: 28397 - RNA, 20 nt, Artificial Sequence
  MKO10028397_A_Lama5
  gRNA
auacucgcgaauagugccuu

SEQ ID NO: 28398 - RNA, 20 nt, Artificial Sequence
  MKO10028398_A_Lama5
  gRNA
ucugcgaaccaacacgcuac

SEQ ID NO: 28399 - RNA, 20 nt, Artificial Sequence
  MKO10028399_A_Lamb1
  gRNA
cgcacacucgggugccccau

SEQ ID NO: 28400 - RNA, 20 nt, Artificial Sequence
  MKO10028400_A_Lamb1
  gRNA
cucuccgugacuucgacaug

SEQ ID NO: 28401 - RNA, 20 nt, Artificial Sequence
  MKO10028401_A_Lamb1
  gRNA
ggguugagggucucgugaua

SEQ ID NO: 28402 - RNA, 20 nt, Artificial Sequence
  MKO10028402_A_Lamb2
  gRNA
ccggcguuguggcgcaaagc

SEQ ID NO: 28403 - RNA, 20 nt, Artificial Sequence
  MKO10028403_A_Lamb2
  gRNA
cuuaccucgccuuccguaga

SEQ ID NO: 28404 - RNA, 20 nt, Artificial Sequence
  MKO10028404_A_Lamb2
  gRNA
accguucuccgauugccacc

SEQ ID NO: 28405 - RNA, 20 nt, Artificial Sequence
  MKO10028405_A_Lamb3
  gRNA
gagaccuauugcacccaaua

SEQ ID NO: 28406 - RNA, 20 nt, Artificial Sequence
  MKO10028406_A_Lamb3
  gRNA
cgucuucaggccccaugcgc

SEQ ID NO: 28407 - RNA, 20 nt, Artificial Sequence
  MKO10028407_A_Lamb3
  gRNA
cguccugccaguucuugggc

SEQ ID NO: 28408 - RNA, 20 nt, Artificial Sequence
  MKO10028408_A_Lamc1
  gRNA
gcacucacgaaggcacucgc

SEQ ID NO: 28409 - RNA, 20 nt, Artificial Sequence
  MKO10028409_A_Lamc1
  gRNA
ccgggagaauuucuuccgcc

SEQ ID NO: 28410 - RNA, 20 nt, Artificial Sequence
  MKO10028410_A_Lamc1
  gRNA
cucccggcaccucucgcacu

SEQ ID NO: 28411 - RNA, 20 nt, Artificial Sequence
  MKO10028411_A_Lamc2
  gRNA
ggguucacugcgagcggugc

SEQ ID NO: 28412 - RNA, 20 nt, Artificial Sequence
  MKO10028412_A_Lamc2
  gRNA
uuccauaugcucaccgaugc

SEQ ID NO: 28413 - RNA, 20 nt, Artificial Sequence
  MKO10028413_A_Lamc2
  gRNA
acccgcugccugucugucga

SEQ ID NO: 28414 - RNA, 20 nt, Artificial Sequence
  MKO10028414_A_Lamc3
  gRNA
ugagggccacuaccugcgac

SEQ ID NO: 28415 - RNA, 20 nt, Artificial Sequence
  MKO10028415_A_Lamc3
  gRNA
ggcguacgugcgcuuguaga

SEQ ID NO: 28416 - RNA, 20 nt, Artificial Sequence
  MKO10028416_A_Lamc3
  gRNA
acacagcguaguaguaagac

SEQ ID NO: 28417 - RNA, 20 nt, Artificial Sequence
  MKO10028417_A_Lamp1
  gRNA
agaaccauucgcagucucgu

SEQ ID NO: 28418 - RNA, 20 nt, Artificial Sequence
  MKO10028418_A_Lamp1
  gRNA
ugcugaaguugccacucgac

SEQ ID NO: 28419 - RNA, 20 nt, Artificial Sequence
  MKO10028419_A_Lamp1
  gRNA
auucaguugcagugccauag

SEQ ID NO: 28420 - RNA, 20 nt, Artificial Sequence
  MKO10028420_A_Lamp2
  gRNA
augagcuuugcgccuuuaac

SEQ ID NO: 28421 - RNA, 20 nt, Artificial Sequence
  MKO10028421_A_Lamp2
  gRNA
ccccaauauuucugaacgac

SEQ ID NO: 28422 - RNA, 20 nt, Artificial Sequence
  MKO10028422_A_Lamp2
  gRNA
ccaucgugugucgccuuguc

SEQ ID NO: 28423 - RNA, 20 nt, Artificial Sequence
  MKO10028423_A_Lamp3
  gRNA
ucauaaguuccgaucuuggc

SEQ ID NO: 28424 - RNA, 20 nt, Artificial Sequence
  MKO10028424_A_Lamp3
  gRNA
gauuucgaaggagacuccuu

SEQ ID NO: 28425 - RNA, 20 nt, Artificial Sequence
  MKO10028425_A_Lamp3
  gRNA
ucaucuacugacgauaccau

SEQ ID NO: 28426 - RNA, 20 nt, Artificial Sequence
  MKO10028426_A_Lamp5
  gRNA
agauguaaugguccaaaccg

SEQ ID NO: 28427 - RNA, 20 nt, Artificial Sequence
  MKO10028427_A_Lamp5
  gRNA
gcuggaugugcacugcggac

SEQ ID NO: 28428 - RNA, 20 nt, Artificial Sequence
  MKO10028428_A_Lamp5
  gRNA
uucagauuccaagucgccuc

SEQ ID NO: 28429 - RNA, 20 nt, Artificial Sequence
  MKO10028429_A_Lamtor1
  gRNA
gcucuucuuucgcauccacg

SEQ ID NO: 28430 - RNA, 20 nt, Artificial Sequence
  MKO10028430_A_Lamtor1
  gRNA
ugacacucaccuagcugucu

SEQ ID NO: 28431 - RNA, 20 nt, Artificial Sequence
  MKO10028431_A_Lamtor1
  gRNA
ccauccuugccaagacagcu

SEQ ID NO: 28432 - RNA, 20 nt, Artificial Sequence
  MKO10028432_A_Lamtor2
  gRNA
acaucugggccgcguaugau

SEQ ID NO: 28433 - RNA, 20 nt, Artificial Sequence
  MKO10028433_A_Lamtor2
  gRNA
ccacccucguaauggcuaca

SEQ ID NO: 28434 - RNA, 20 nt, Artificial Sequence
  MKO10028434_A_Lamtor2
  gRNA
auacgcggcccagauguuac

SEQ ID NO: 28435 - RNA, 20 nt, Artificial Sequence
  MKO10028435_A_Lamtor3
  gRNA
uccuguacaaaaaguugcca

SEQ ID NO: 28436 - RNA, 20 nt, Artificial Sequence
  MKO10028436_A_Lamtor3
  gRNA
uuagcuuuaccuuuaauaac

SEQ ID NO: 28437 - RNA, 20 nt, Artificial Sequence
  MKO10028437_A_Lamtor3
  gRNA
accuguguuggcacugcugc

SEQ ID NO: 28438 - RNA, 20 nt, Artificial Sequence
  MKO10028438_A_Lamtor4
  gRNA
uguucgugccauggugcaac

SEQ ID NO: 28439 - RNA, 20 nt, Artificial Sequence
  MKO10028439_A_Lamtor4
  gRNA
aucccuuucaaacgccuguc

SEQ ID NO: 28440 - RNA, 20 nt, Artificial Sequence
  MKO10028440_A_Lamtor4
  gRNA
cugggauucgcuccagcccu

SEQ ID NO: 28441 - RNA, 20 nt, Artificial Sequence
  MKO10028441_A_Lamtor5
  gRNA
cguccgcgcucuuuacgaaa

SEQ ID NO: 28442 - RNA, 20 nt, Artificial Sequence
  MKO10028442_A_Lamtor5
  gRNA
cgcgcugaauuucgucccuc

SEQ ID NO: 28443 - RNA, 20 nt, Artificial Sequence
  MKO10028443_A_Lamtor5
  gRNA
ucuaggccgugguacccugu

SEQ ID NO: 28444 - RNA, 20 nt, Artificial Sequence
  MKO10028444_A_Lancl1
  gRNA
cgaugcgggcccccuggcug

SEQ ID NO: 28445 - RNA, 20 nt, Artificial Sequence
  MKO10028445_A_Lancl1
  gRNA
uauuacgugggggcugcuca

SEQ ID NO: 28446 - RNA, 20 nt, Artificial Sequence
  MKO10028446_A_Lancl1
  gRNA
cuggguccccaaacacauug

SEQ ID NO: 28447 - RNA, 20 nt, Artificial Sequence
  MKO10028447_A_Lancl2
  gRNA
guguucucuucacguaaucc

SEQ ID NO: 28448 - RNA, 20 nt, Artificial Sequence
  MKO10028448_A_Lancl2
  gRNA
cuggauacgcuuuaugaagu

SEQ ID NO: 28449 - RNA, 20 nt, Artificial Sequence
  MKO10028449_A_Lancl2
  gRNA
gaccuaccugcuucgauccc

SEQ ID NO: 28450 - RNA, 20 nt, Artificial Sequence
  MKO10028450_A_Lancl3
  gRNA
augggagaccuggagcgccg

SEQ ID NO: 28451 - RNA, 20 nt, Artificial Sequence
  MKO10028451_A_Lancl3
  gRNA
agcaucuacagcuuguacga

SEQ ID NO: 28452 - RNA, 20 nt, Artificial Sequence
  MKO10028452_A_Lancl3
  gRNA
cuucuucuguaccgucuuac

SEQ ID NO: 28453 - RNA, 20 nt, Artificial Sequence
  MKO10028453_A_Lao1
  gRNA
ugaccacccuaccuccgaug

SEQ ID NO: 28454 - RNA, 20 nt, Artificial Sequence
  MKO10028454_A_Lao1
  gRNA
gaaucuugggcuacccccug

SEQ ID NO: 28455 - RNA, 20 nt, Artificial Sequence
  MKO10028455_A_Lao1
  gRNA
gauagcguuguccauugagu

SEQ ID NO: 28456 - RNA, 20 nt, Artificial Sequence
  MKO10028456_A_Lap3
  gRNA
ggucggccuuggcaagcgau

SEQ ID NO: 28457 - RNA, 20 nt, Artificial Sequence
  MKO10028457_A_Lap3
  gRNA
gcugugucggcgaagcucca

SEQ ID NO: 28458 - RNA, 20 nt, Artificial Sequence
  MKO10028458_A_Lap3
  gRNA
cuccagccgaucgcuugcca

SEQ ID NO: 28459 - RNA, 20 nt, Artificial Sequence
  MKO10028459_A_Laptm4a
  gRNA
ugacuucguucucaguuguc

SEQ ID NO: 28460 - RNA, 20 nt, Artificial Sequence
  MKO10028460_A_Laptm4a
  gRNA
ucagguggucaaccuguuga

SEQ ID NO: 28461 - RNA, 20 nt, Artificial Sequence
  MKO10028461_A_Laptm4a
  gRNA
uucugcaguaucaagugggc

SEQ ID NO: 28462 - RNA, 20 nt, Artificial Sequence
  MKO10028462_A_Laptm4b
  gRNA
guaugcaccguaaguagcca

SEQ ID NO: 28463 - RNA, 20 nt, Artificial Sequence
  MKO10028463_A_Laptm4b
  gRNA
guccgugaauccuaccuguu

SEQ ID NO: 28464 - RNA, 20 nt, Artificial Sequence
  MKO10028464_A_Laptm4b
  gRNA
ugucuauccgaacuccauuc

SEQ ID NO: 28465 - RNA, 20 nt, Artificial Sequence
  MKO10028465_A_Laptm5
  gRNA
guacgcuggcaauucgaugu

SEQ ID NO: 28466 - RNA, 20 nt, Artificial Sequence
  MKO10028466_A_Laptm5
  gRNA
cccgcgguaaaguguccugu

SEQ ID NO: 28467 - RNA, 20 nt, Artificial Sequence
  MKO10028467_A_Laptm5
  gRNA
ccuugaccacgccgaacagc

SEQ ID NO: 28468 - RNA, 20 nt, Artificial Sequence
  MKO10028468_A_Large
  gRNA
cagggugacaacgucccugc

SEQ ID NO: 28469 - RNA, 20 nt, Artificial Sequence
  MKO10028469_A_Large
  gRNA
cuucucgaacacgcacuucc

SEQ ID NO: 28470 - RNA, 20 nt, Artificial Sequence
  MKO10028470_A_Large
  gRNA
uagaagucuacucgcacugc

SEQ ID NO: 28471 - RNA, 20 nt, Artificial Sequence
  MKO10028471_A_Larp1b
  gRNA
auaaaccaacgcacaguaau

SEQ ID NO: 28472 - RNA, 20 nt, Artificial Sequence
  MKO10028472_A_Larp1b
  gRNA
accauccgagguuccacuag

SEQ ID NO: 28473 - RNA, 20 nt, Artificial Sequence
  MKO10028473_A_Larp1b
  gRNA
ucauacaucgaggguucccu

SEQ ID NO: 28474 - RNA, 20 nt, Artificial Sequence
  MKO10028474_A_Larp1
  gRNA
agcugcuccuaaaccgcgua

SEQ ID NO: 28475 - RNA, 20 nt, Artificial Sequence
  MKO10028475_A_Larp1
  gRNA
agacauacacccgcuguccg

SEQ ID NO: 28476 - RNA, 20 nt, Artificial Sequence
  MKO10028476_A_Larp1
  gRNA
ucguaaguugccaccuaaga

SEQ ID NO: 28477 - RNA, 20 nt, Artificial Sequence
  MKO10028477_A_Larp4b
  gRNA
uuacccguaucguuguucuc

SEQ ID NO: 28478 - RNA, 20 nt, Artificial Sequence
  MKO10028478_A_Larp4b
  gRNA
ucgagagaaugcagcgcucc

SEQ ID NO: 28479 - RNA, 20 nt, Artificial Sequence
  MKO10028479_A_Larp4b
  gRNA
ggggacucauauguuacauu

SEQ ID NO: 28480 - RNA, 20 nt, Artificial Sequence
  MKO10028480_A_Larp4
  gRNA
gugaucaguucgucccaaua

SEQ ID NO: 28481 - RNA, 20 nt, Artificial Sequence
  MKO10028481_A_Larp4
  gRNA
uaccagaaacaucauagagu

SEQ ID NO: 28482 - RNA, 20 nt, Artificial Sequence
  MKO10028482_A_Larp4
  gRNA
aacaucugcaguauuccuug

SEQ ID NO: 28483 - RNA, 20 nt, Artificial Sequence
  MKO10028483_A_Larp6
  gRNA
gcagauccgugucgccaucc

SEQ ID NO: 28484 - RNA, 20 nt, Artificial Sequence
  MKO10028484_A_Larp6
  gRNA
guucucgcccccacuugucg

SEQ ID NO: 28485 - RNA, 20 nt, Artificial Sequence
  MKO10028485_A_Larp6
  gRNA
uuggcgucaucucaucggug

SEQ ID NO: 28486 - RNA, 20 nt, Artificial Sequence
  MKO10028486_A_Larp7
  gRNA
gugcguuccuccucguccuu

SEQ ID NO: 28487 - RNA, 20 nt, Artificial Sequence
  MKO10028487_A_Larp7
  gRNA
gaaaagcucaucuguuguag

SEQ ID NO: 28488 - RNA, 20 nt, Artificial Sequence
  MKO10028488_A_Larp7
  gRNA
gcacucaccugcuacucgua

SEQ ID NO: 28489 - RNA, 20 nt, Artificial Sequence
  MKO10028489_A_Lars2
  gRNA
accgugcaauggugucgcug

SEQ ID NO: 28490 - RNA, 20 nt, Artificial Sequence
  MKO10028490_A_Lars2
  gRNA
cuucauagaguuugauaaac

SEQ ID NO: 28491 - RNA, 20 nt, Artificial Sequence
  MKO10028491_A_Lars2
  gRNA
ugaguccauuuguaguaauc

SEQ ID NO: 28492 - RNA, 20 nt, Artificial Sequence
  MKO10028492_A_Lars
  gRNA
cuguacugguaugccuauua

SEQ ID NO: 28493 - RNA, 20 nt, Artificial Sequence
  MKO10028493_A_Lars
  gRNA
gaagaaagcagugcuaaacc

SEQ ID NO: 28494 - RNA, 20 nt, Artificial Sequence
  MKO10028494_A_Lars
  gRNA
cguccauucauguauggaua

SEQ ID NO: 28495 - RNA, 20 nt, Artificial Sequence
  MKO10028495_A_Las1l
  gRNA
cauauaaaugagugccgcag

SEQ ID NO: 28496 - RNA, 20 nt, Artificial Sequence
  MKO10028496_A_Las1l
  gRNA
cgaaguucaacaauccaguc

SEQ ID NO: 28497 - RNA, 20 nt, Artificial Sequence
  MKO10028497_A_Las1l
  gRNA
gacauacuggagccgucaac

SEQ ID NO: 28498 - RNA, 20 nt, Artificial Sequence
  MKO10028498_A_Lasp1
  gRNA
uuccggagugucggccacca

SEQ ID NO: 28499 - RNA, 20 nt, Artificial Sequence
  MKO10028499_A_Lasp1
  gRNA
uggccuccaggugcgcuaca

SEQ ID NO: 28500 - RNA, 20 nt, Artificial Sequence
  MKO10028500_A_Lasp1
  gRNA
cuggcacucaccgggggcac

SEQ ID NO: 28501 - RNA, 20 nt, Artificial Sequence
  MKO10028501_A_Lau2
  gRNA
acguaccuggacgggagcag

SEQ ID NO: 28502 - RNA, 20 nt, Artificial Sequence
  MKO10028502_A_Lau2
  gRNA
agccaacaugagugccgagc

SEQ ID NO: 28503 - RNA, 20 nt, Artificial Sequence
  MKO10028503_A_Lau2
  gRNA
augagaaaaucuacgagcag

SEQ ID NO: 28504 - RNA, 20 nt, Artificial Sequence
  MKO10028504_A_Laus1
  gRNA
agacguucugcuccgaaauc

SEQ ID NO: 28505 - RNA, 20 nt, Artificial Sequence
  MKO10028505_A_Laus1
  gRNA
gcggaccacccacucauugu

SEQ ID NO: 28506 - RNA, 20 nt, Artificial Sequence
  MKO10028506_A_Laus1
  gRNA
gcuccaccaucauucgccaa

SEQ ID NO: 28507 - RNA, 20 nt, Artificial Sequence
  MKO10028507_A_Laus2
  gRNA
cgggugcccaacacauguaa

SEQ ID NO: 28508 - RNA, 20 nt, Artificial Sequence
  MKO10028508_A_Laus2
  gRNA
agaagccucgcggccgcaug

SEQ ID NO: 28509 - RNA, 20 nt, Artificial Sequence
  MKO10028509_A_Laus2
  gRNA
gcgauugcaagagauucgag

SEQ ID NO: 28510 - RNA, 20 nt, Artificial Sequence
  MKO10028510_A_Lau
  gRNA
acucacgagguggcuugaug

SEQ ID NO: 28511 - RNA, 20 nt, Artificial Sequence
  MKO10028511_A_Lau
  gRNA
gcauccgaugggaaccccca

SEQ ID NO: 28512 - RNA, 20 nt, Artificial Sequence
  MKO10028512_A_Lau
  gRNA
auacucacgggauggggagc

SEQ ID NO: 28513 - RNA, 20 nt, Artificial Sequence
  MKO10028513_A_Lax1
  gRNA
gggaaugccacggaccacga

SEQ ID NO: 28514 - RNA, 20 nt, Artificial Sequence
  MKO10028514_A_Lax1
  gRNA
uaugcgaguuagagucucac

SEQ ID NO: 28515 - RNA, 20 nt, Artificial Sequence
  MKO10028515_A_Lax1
  gRNA
gguggaggcagagucaacga

SEQ ID NO: 28516 - RNA, 20 nt, Artificial Sequence
  MKO10028516_A_Layn
  gRNA
cauguacgagcccccgaugc

SEQ ID NO: 28517 - RNA, 20 nt, Artificial Sequence
  MKO10028517_A_Layn
  gRNA
ggggcucguacauguuccag

SEQ ID NO: 28518 - RNA, 20 nt, Artificial Sequence
  MKO10028518_A_Layn
  gRNA
caaguacaacacccucuauu

SEQ ID NO: 28519 - RNA, 20 nt, Artificial Sequence
  MKO10028519_A_Lbh
  gRNA
gauuggucucagcccccgca

SEQ ID NO: 28520 - RNA, 20 nt, Artificial Sequence
  MKO10028520_A_Lbh
  gRNA
ccgccugcccuccauagugg

SEQ ID NO: 28521 - RNA, 20 nt, Artificial Sequence
  MKO10028521_A_Lbh
  gRNA
uggagcguucaucaucaccu

SEQ ID NO: 28522 - RNA, 20 nt, Artificial Sequence
  MKO10028522_A_Lbp
  gRNA
gcuucgacucgaucugguug

SEQ ID NO: 28523 - RNA, 20 nt, Artificial Sequence
  MKO10028523_A_Lbp
  gRNA
cucguacugcccacgaccca

SEQ ID NO: 28524 - RNA, 20 nt, Artificial Sequence
  MKO10028524_A_Lbp
  gRNA
gugggcaguacgaguuucau

SEQ ID NO: 28525 - RNA, 20 nt, Artificial Sequence
  MKO10028525_A_Lbr
  gRNA
aagaucacguucccgauccc

SEQ ID NO: 28526 - RNA, 20 nt, Artificial Sequence
  MKO10028526_A_Lbr
  gRNA
caccaaaggacccgcaccuu

SEQ ID NO: 28527 - RNA, 20 nt, Artificial Sequence
  MKO10028527_A_Lbr
  gRNA
agcucucccucucgacgccg

SEQ ID NO: 28528 - RNA, 20 nt, Artificial Sequence
  MKO10028528_A_Lbx1
  gRNA
uccucaacaagccguccgug

SEQ ID NO: 28529 - RNA, 20 nt, Artificial Sequence
  MKO10028529_A_Lbx1
  gRNA
cuccgaguucugcucgaguu

SEQ ID NO: 28530 - RNA, 20 nt, Artificial Sequence
  MKO10028530_A_Lbx1
  gRNA
cgaccaaauugcgcagcagc

SEQ ID NO: 28531 - RNA, 20 nt, Artificial Sequence
  MKO10028531_A_Lbx2
  gRNA
cgcgucaccacugugugcgc

SEQ ID NO: 28532 - RNA, 20 nt, Artificial Sequence
  MKO10028532_A_Lbx2
  gRNA
gcaaguccgucgcgcucuga

SEQ ID NO: 28533 - RNA, 20 nt, Artificial Sequence
  MKO10028533_A_Lbx2
  gRNA
ucccuaugcggguugucccc

SEQ ID NO: 28534 - RNA, 20 nt, Artificial Sequence
  MKO10028534_A_Lca5l
  gRNA
gguccucaguaacucgccgu

SEQ ID NO: 28535 - RNA, 20 nt, Artificial Sequence
  MKO10028535_A_Lca5l
  gRNA
gcuguaauccacgcucccau

SEQ ID NO: 28536 - RNA, 20 nt, Artificial Sequence
  MKO10028536_A_Lca5l
  gRNA
aaaccgacggcgaguuacug

SEQ ID NO: 28537 - RNA, 20 nt, Artificial Sequence
  MKO10028537_A_Lca5
  gRNA
ccuaccggagcgagacgauu

SEQ ID NO: 28538 - RNA, 20 nt, Artificial Sequence
  MKO10028538_A_Lca5
  gRNA
cgucguguugacaggugaug

SEQ ID NO: 28539 - RNA, 20 nt, Artificial Sequence
  MKO10028539_A_Lca5
  gRNA
ccaaaucgucucgcuccggu

SEQ ID NO: 28540 - RNA, 20 nt, Artificial Sequence
  MKO10028540_A_Lcau
  gRNA
gaccgaaucuguugaguacg

SEQ ID NO: 28541 - RNA, 20 nt, Artificial Sequence
  MKO10028541_A_Lcau
  gRNA
auccacguacucaacagauu

SEQ ID NO: 28542 - RNA, 20 nt, Artificial Sequence
  MKO10028542_A_Lcau
  gRNA
uuaucucucucggggcuccg

SEQ ID NO: 28543 - RNA, 20 nt, Artificial Sequence
  MKO10028543_A_Lce1a1
  gRNA
acugcagcaucccccagagc

SEQ ID NO: 28544 - RNA, 20 nt, Artificial Sequence
  MKO10028544_A_Lce1a1
  gRNA
gaggacacuugggagggggc

SEQ ID NO: 28545 - RNA, 20 nt, Artificial Sequence
  MKO10028545_A_Lce1a1
  gRNA
ugugucuuccugcuguaguc

SEQ ID NO: 28546 - RNA, 20 nt, Artificial Sequence
  MKO10028546_A_Lce1a2
  gRNA
gcugcaacagcccccagagc

SEQ ID NO: 28547 - RNA, 20 nt, Artificial Sequence
  MKO10028547_A_Lce1a2
  gRNA
gagggggcugacacugcugc

SEQ ID NO: 28548 - RNA, 20 nt, Artificial Sequence
  MKO10028548_A_Lce1a2
  gRNA
gcacuugggaggacacuuag

SEQ ID NO: 28549 - RNA, 20 nt, Artificial Sequence
  MKO10028549_A_Lce1b
  gRNA
cacaacaacccccagaaccc

SEQ ID NO: 28550 - RNA, 20 nt, Artificial Sequence
  MKO10028550_A_Lce1b
  gRNA
ugugucuuccugcuguagcc

SEQ ID NO: 28551 - RNA, 20 nt, Artificial Sequence
  MKO10028551_A_Lce1b
  gRNA
agcagcagcccccagacugc

SEQ ID NO: 28552 - RNA, 20 nt, Artificial Sequence
  MKO10028552_A_Lce1c
  gRNA
agcagcagucuccagacugc

SEQ ID NO: 28553 - RNA, 20 nt, Artificial Sequence
  MKO10028553_A_Lce1c
  gRNA
ugugucuuccugcuguagcc

SEQ ID NO: 28554 - RNA, 20 nt, Artificial Sequence
  MKO10028554_A_Lce1c
  gRNA
gggugcacuugggaggaggc

SEQ ID NO: 28555 - RNA, 20 nt, Artificial Sequence
  MKO10028555_A_Lce1d
  gRNA
gcauuugggaggacacuuag

SEQ ID NO: 28556 - RNA, 20 nt, Artificial Sequence
  MKO10028556_A_Lce1d
  gRNA
ugugucuuccugcuguagcc

SEQ ID NO: 28557 - RNA, 20 nt, Artificial Sequence
  MKO10028557_A_Lce1d
  gRNA
agcagcaguccccagacugu

SEQ ID NO: 28558 - RNA, 20 nt, Artificial Sequence
  MKO10028558_A_Lce1e
  gRNA
gcacuuugggaucuggcauu

SEQ ID NO: 28559 - RNA, 20 nt, Artificial Sequence
  MKO10028559_A_Lce1e
  gRNA
agcugcugcagcucuggggg

SEQ ID NO: 28560 - RNA, 20 nt, Artificial Sequence
  MKO10028560_A_Lce1e
  gRNA
ugugucuuccugcuguagcu

SEQ ID NO: 28561 - RNA, 20 nt, Artificial Sequence
  MKO10028561_A_Lce1f
  gRNA
uuggagggcacuuuggaguc

SEQ ID NO: 28562 - RNA, 20 nt, Artificial Sequence
  MKO10028562_A_Lce1f
  gRNA
ucuggaggaugcugcagcuc

SEQ ID NO: 28563 - RNA, 20 nt, Artificial Sequence
  MKO10028563_A_Lce1f
  gRNA
agcagcaauccccagacugc

SEQ ID NO: 28564 - RNA, 20 nt, Artificial Sequence
  MKO10028564_A_Lce1g
  gRNA
gcacuugggaggacauuuag

SEQ ID NO: 28565 - RNA, 20 nt, Artificial Sequence
  MKO10028565_A_Lce1g
  gRNA
cugacacuugggagggcacu

SEQ ID NO: 28566 - RNA, 20 nt, Artificial Sequence
  MKO10028566_A_Lce1g
  gRNA
ugugucuuccugcuguagcc

SEQ ID NO: 28567 - RNA, 20 nt, Artificial Sequence
  MKO10028567_A_Lce1h
  gRNA
gaagagaucuguggggucug

SEQ ID NO: 28568 - RNA, 20 nt, Artificial Sequence
  MKO10028568_A_Lce1h
  gRNA
accagaacccaagcuacagc

SEQ ID NO: 28569 - RNA, 20 nt, Artificial Sequence
  MKO10028569_A_Lce1h
  gRNA
uguagcagugguggcaacag

SEQ ID NO: 28570 - RNA, 20 nt, Artificial Sequence
  MKO10028570_A_Lce1i
  gRNA
cuggggccugacacugcugc

SEQ ID NO: 28571 - RNA, 20 nt, Artificial Sequence
  MKO10028571_A_Lce1i
  gRNA
gcagagccagcagcaguguc

SEQ ID NO: 28572 - RNA, 20 nt, Artificial Sequence
  MKO10028572_A_Lce1i
  gRNA
ggcaguagugguggcaguag

SEQ ID NO: 28573 - RNA, 20 nt, Artificial Sequence
  MKO10028573_A_Lce1j
  gRNA
ggcugcuguagcucuggugg

SEQ ID NO: 28574 - RNA, 20 nt, Artificial Sequence
  MKO10028574_A_Lce1j
  gRNA
ggagagaucuguggugucug

SEQ ID NO: 28575 - RNA, 20 nt, Artificial Sequence
  MKO10028575_A_Lce1j
  gRNA
gcugcagcagcacccagagc

SEQ ID NO: 28576 - RNA, 20 nt, Artificial Sequence
  MKO10028576_A_Lce1k
  gRNA
uugggggccuggcacuuuga

SEQ ID NO: 28577 - RNA, 20 nt, Artificial Sequence
  MKO10028577_A_Lce1k
  gRNA
caaaugcccuucaaagugcc

SEQ ID NO: 28578 - RNA, 20 nt, Artificial Sequence
  MKO10028578_A_Lce1k
  gRNA
cgucgucaucgccauagcuc

SEQ ID NO: 28579 - RNA, 20 nt, Artificial Sequence
  MKO10028579_A_Lce1l
  gRNA
uuggggggcauuuaggaguc

SEQ ID NO: 28580 - RNA, 20 nt, Artificial Sequence
  MKO10028580_A_Lce1l
  gRNA
ggugguagcagugacuguug

SEQ ID NO: 28581 - RNA, 20 nt, Artificial Sequence
  MKO10028581_A_Lce1l
  gRNA
uguggugguaaccagcaguc

SEQ ID NO: 28582 - RNA, 20 nt, Artificial Sequence
  MKO10028582_A_Lce1m
  gRNA
uagagcccccagacugcuga

SEQ ID NO: 28583 - RNA, 20 nt, Artificial Sequence
  MKO10028583_A_Lce1m
  gRNA
gcacuuuggggucuugcauu

SEQ ID NO: 28584 - RNA, 20 nt, Artificial Sequence
  MKO10028584_A_Lce1m
  gRNA
aaccucuuccugcuguagcc

SEQ ID NO: 28585 - RNA, 20 nt, Artificial Sequence
  MKO10028585_A_Lce3a
  gRNA
gcuuguagcacagcacgaag

SEQ ID NO: 28586 - RNA, 20 nt, Artificial Sequence
  MKO10028586_A_Lce3a
  gRNA
ucgugcugugcuacaagcuc

SEQ ID NO: 28587 - RNA, 20 nt, Artificial Sequence
  MKO10028587_A_Lce3a
  gRNA
acagcagccucccucagagc

SEQ ID NO: 28588 - RNA, 20 nt, Artificial Sequence
  MKO10028588_A_Lce3b
  gRNA
agugcuccccaaagugcccc

SEQ ID NO: 28589 - RNA, 20 nt, Artificial Sequence
  MKO10028589_A_Lce3b
  gRNA
ggucagcagucugggggguc

SEQ ID NO: 28590 - RNA, 20 nt, Artificial Sequence
  MKO10028590_A_Lce3b
  gRNA
cugcagucuccccagaucug

SEQ ID NO: 28591 - RNA, 20 nt, Artificial Sequence
  MKO10028591_A_Lce3c
  gRNA
agacacugugcugugcucuu

SEQ ID NO: 28592 - RNA, 20 nt, Artificial Sequence
  MKO10028592_A_Lce3c
  gRNA
agggacacuugggaggaggc

SEQ ID NO: 28593 - RNA, 20 nt, Artificial Sequence
  MKO10028593_A_Lce3c
  gRNA
agcagcagcccccagagcug

SEQ ID NO: 28594 - RNA, 20 nt, Artificial Sequence
  MKO10028594_A_Lce3d
  gRNA
agcagcagcccccagagcug

SEQ ID NO: 28595 - RNA, 20 nt, Artificial Sequence
  MKO10028595_A_Lce3d
  gRNA
uccugcugugcuacaaacuc

SEQ ID NO: 28596 - RNA, 20 nt, Artificial Sequence
  MKO10028596_A_Lce3d
  gRNA
cugcuucuggcucugcuggc

SEQ ID NO: 28597 - RNA, 20 nt, Artificial Sequence
  MKO10028597_A_Lce3e
  gRNA
agcagcagcccccagagcug

SEQ ID NO: 28598 - RNA, 20 nt, Artificial Sequence
  MKO10028598_A_Lce3e
  gRNA
uccugcugugcuacaagcuc

SEQ ID NO: 28599 - RNA, 20 nt, Artificial Sequence
  MKO10028599_A_Lce3e
  gRNA
cugcuucuggcucugcuggc

SEQ ID NO: 28600 - RNA, 20 nt, Artificial Sequence
  MKO10028600_A_Lce3f
  gRNA
agcagcagcccccagagcug

SEQ ID NO: 28601 - RNA, 20 nt, Artificial Sequence
  MKO10028601_A_Lce3f
  gRNA
uccugcugugcuacaagcuc

SEQ ID NO: 28602 - RNA, 20 nt, Artificial Sequence
  MKO10028602_A_Lce3f
  gRNA
cugcuucuggcucugcuggc

SEQ ID NO: 28603 - RNA, 20 nt, Artificial Sequence
  MKO10028603_A_Lce6a
  gRNA
guacuaccccuaagacagcg

SEQ ID NO: 28604 - RNA, 20 nt, Artificial Sequence
  MKO10028604_A_Lce6a
  gRNA
acccacaaccucgcugucuu

SEQ ID NO: 28605 - RNA, 20 nt, Artificial Sequence
  MKO10028605_A_Lce6a
  gRNA
agucccacaagaaguugaac

SEQ ID NO: 28606 - RNA, 20 nt, Artificial Sequence
  MKO10028606_A_Lck
  gRNA
gggugaacagcuccgaaucc

SEQ ID NO: 28607 - RNA, 20 nt, Artificial Sequence
  MKO10028607_A_Lck
  gRNA
ugcuuucgccacgaaguuga

SEQ ID NO: 28608 - RNA, 20 nt, Artificial Sequence
  MKO10028608_A_Lck
  gRNA
aacugugcagggcgauaacc

SEQ ID NO: 28609 - RNA, 20 nt, Artificial Sequence
  MKO10028609_A_Lclau1
  gRNA
auuauaaaauaccaccgaac

SEQ ID NO: 28610 - RNA, 20 nt, Artificial Sequence
  MKO10028610_A_Lclau1
  gRNA
augaugacgcuccgcucucc

SEQ ID NO: 28611 - RNA, 20 nt, Artificial Sequence
  MKO10028611_A_Lclau1
  gRNA
gugguggaccgccuaagaga

SEQ ID NO: 28612 - RNA, 20 nt, Artificial Sequence
  MKO10028612_A_Lcmt1
  gRNA
cuuacaagaugcucgaugua

SEQ ID NO: 28613 - RNA, 20 nt, Artificial Sequence
  MKO10028613_A_Lcmt1
  gRNA
cguacaucgagcaucuugua

SEQ ID NO: 28614 - RNA, 20 nt, Artificial Sequence
  MKO10028614_A_Lcmt1
  gRNA
cccauuugaagcguguccuc

SEQ ID NO: 28615 - RNA, 20 nt, Artificial Sequence
  MKO10028615_A_Lcmt2
  gRNA
gauaagcggcgugcgccgca

SEQ ID NO: 28616 - RNA, 20 nt, Artificial Sequence
  MKO10028616_A_Lcmt2
  gRNA
gucgcgcacguauccgugug

SEQ ID NO: 28617 - RNA, 20 nt, Artificial Sequence
  MKO10028617_A_Lcmt2
  gRNA
ucacuagcgcgcucccgucc

SEQ ID NO: 28618 - RNA, 20 nt, Artificial Sequence
  MKO10028618_A_Lcn10
  gRNA
cuguccacggacuacacgua

SEQ ID NO: 28619 - RNA, 20 nt, Artificial Sequence
  MKO10028619_A_Lcn10
  gRNA
caggccguacguguaguccg

SEQ ID NO: 28620 - RNA, 20 nt, Artificial Sequence
  MKO10028620_A_Lcn10
  gRNA
augugguaccgucuuucgga

SEQ ID NO: 28621 - RNA, 20 nt, Artificial Sequence
  MKO10028621_A_Lcn11
  gRNA
gucagucaugaagcaccgau

SEQ ID NO: 28622 - RNA, 20 nt, Artificial Sequence
  MKO10028622_A_Lcn11
  gRNA
cucguucacacacgcagaag

SEQ ID NO: 28623 - RNA, 20 nt, Artificial Sequence
  MKO10028623_A_Lcn11
  gRNA
ugaaugucaccuacuuccac

SEQ ID NO: 28624 - RNA, 20 nt, Artificial Sequence
  MKO10028624_A_Lcn12
  gRNA
acaaguucaucugccugacc

SEQ ID NO: 28625 - RNA, 20 nt, Artificial Sequence
  MKO10028625_A_Lcn12
  gRNA
agacuacaucacguuugccc

SEQ ID NO: 28626 - RNA, 20 nt, Artificial Sequence
  MKO10028626_A_Lcn12
  gRNA
agguguugucugccagaccg

SEQ ID NO: 28627 - RNA, 20 nt, Artificial Sequence
  MKO10028627_A_Lcn2
  gRNA
ggacuacaaccaguucgcca

SEQ ID NO: 28628 - RNA, 20 nt, Artificial Sequence
  MKO10028628_A_Lcn2
  gRNA
ggcgaacugguuguaguccg

SEQ ID NO: 28629 - RNA, 20 nt, Artificial Sequence
  MKO10028629_A_Lcn2
  gRNA
ugguacguugugggccuggc

SEQ ID NO: 28630 - RNA, 20 nt, Artificial Sequence
  MKO10028630_A_Lcn3
  gRNA
aauacuuacaggcaagguac

SEQ ID NO: 28631 - RNA, 20 nt, Artificial Sequence
  MKO10028631_A_Lcn3
  gRNA
ccaucugcucaaguaugacc

SEQ ID NO: 28632 - RNA, 20 nt, Artificial Sequence
  MKO10028632_A_Lcn3
  gRNA
ucuugaagugaccaccaucu

SEQ ID NO: 28633 - RNA, 20 nt, Artificial Sequence
  MKO10028633_A_Lcn4
  gRNA
caccuaugagauauccaaau

SEQ ID NO: 28634 - RNA, 20 nt, Artificial Sequence
  MKO10028634_A_Lcn4
  gRNA
aagggagagugcauuaaugu

SEQ ID NO: 28635 - RNA, 20 nt, Artificial Sequence
  MKO10028635_A_Lcn4
  gRNA
ucacaggcacuguauugacc

SEQ ID NO: 28636 - RNA, 20 nt, Artificial Sequence
  MKO10028636_A_Lcn5
  gRNA
cgcugaaccguccaccugag

SEQ ID NO: 28637 - RNA, 20 nt, Artificial Sequence
  MKO10028637_A_Lcn5
  gRNA
caagccguaugcacccaucu

SEQ ID NO: 28638 - RNA, 20 nt, Artificial Sequence
  MKO10028638_A_Lcn5
  gRNA
ugcauacggcuuggcacaca

SEQ ID NO: 28639 - RNA, 20 nt, Artificial Sequence
  MKO10028639_A_Lcn6
  gRNA
ggcuguggccucccgugcaa

SEQ ID NO: 28640 - RNA, 20 nt, Artificial Sequence
  MKO10028640_A_Lcn6
  gRNA
cggaugucaucagagcaccg

SEQ ID NO: 28641 - RNA, 20 nt, Artificial Sequence
  MKO10028641_A_Lcn6
  gRNA
accaacucacccaugccgag

SEQ ID NO: 28642 - RNA, 20 nt, Artificial Sequence
  MKO10028642_A_Lcn8
  gRNA
caugucgggccaacauguaa

SEQ ID NO: 28643 - RNA, 20 nt, Artificial Sequence
  MKO10028643_A_Lcn8
  gRNA
cauaguccguguccagcacg

SEQ ID NO: 28644 - RNA, 20 nt, Artificial Sequence
  MKO10028644_A_Lcn8
  gRNA
cugugaaagccguguacaac

SEQ ID NO: 28645 - RNA, 20 nt, Artificial Sequence
  MKO10028645_A_Lcn9
  gRNA
ggaaucgagguaccaggucc

SEQ ID NO: 28646 - RNA, 20 nt, Artificial Sequence
  MKO10028646_A_Lcn9
  gRNA
aaugcgagucauguuaucug

SEQ ID NO: 28647 - RNA, 20 nt, Artificial Sequence
  MKO10028647_A_Lcn9
  gRNA
augagucuugucaagcagua

SEQ ID NO: 28648 - RNA, 20 nt, Artificial Sequence
  MKO10028648_A_Lcorl
  gRNA
cuugcguucgagucacagug

SEQ ID NO: 28649 - RNA, 20 nt, Artificial Sequence
  MKO10028649_A_Lcorl
  gRNA
uucacagucaacgccaacag

SEQ ID NO: 28650 - RNA, 20 nt, Artificial Sequence
  MKO10028650_A_Lcorl
  gRNA
ucuuucgaaagagugcauuu

SEQ ID NO: 28651 - RNA, 20 nt, Artificial Sequence
  MKO10028651_A_Lcor
  gRNA
gcgcgcuuaguaaaaaauua

SEQ ID NO: 28652 - RNA, 20 nt, Artificial Sequence
  MKO10028652_A_Lcor
  gRNA
gucuccuucuugauccgaug

SEQ ID NO: 28653 - RNA, 20 nt, Artificial Sequence
  MKO10028653_A_Lcor
  gRNA
guucugaguaguugcagccg

SEQ ID NO: 28654 - RNA, 20 nt, Artificial Sequence
  MKO10028654_A_Lcp1
  gRNA
uggagaaugaccccgacugc

SEQ ID NO: 28655 - RNA, 20 nt, Artificial Sequence
  MKO10028655_A_Lcp1
  gRNA
gcuuaccugaguaagagugc

SEQ ID NO: 28656 - RNA, 20 nt, Artificial Sequence
  MKO10028656_A_Lcp1
  gRNA
guucucucgucaaucguguc

SEQ ID NO: 28657 - RNA, 20 nt, Artificial Sequence
  MKO10028657_A_Lcp2
  gRNA
aaaaccgagcaccaucaaug

SEQ ID NO: 28658 - RNA, 20 nt, Artificial Sequence
  MKO10028658_A_Lcp2
  gRNA
acucacggcauccucagcuu

SEQ ID NO: 28659 - RNA, 20 nt, Artificial Sequence
  MKO10028659_A_Lcp2
  gRNA
ccugucuccucaagaaaccg

SEQ ID NO: 28660 - RNA, 20 nt, Artificial Sequence
  MKO10028660_A_Lcul
  gRNA
gccacccgccguaugcuacc

SEQ ID NO: 28661 - RNA, 20 nt, Artificial Sequence
  MKO10028661_A_Lcul
  gRNA
ccguugugaccuugcaccac

SEQ ID NO: 28662 - RNA, 20 nt, Artificial Sequence
  MKO10028662_A_Lcul
  gRNA
cgggggugauguugcucuuc

SEQ ID NO: 28663 - RNA, 20 nt, Artificial Sequence
  MKO10028663_A_Lcu
  gRNA
cggggcucauuccagucgau

SEQ ID NO: 28664 - RNA, 20 nt, Artificial Sequence
  MKO10028664_A_Lcu
  gRNA
cgucuacacccuaaaaccuc

SEQ ID NO: 28665 - RNA, 20 nt, Artificial Sequence
  MKO10028665_A_Lcu
  gRNA
uaccuugacgagagccgcug

SEQ ID NO: 28666 - RNA, 20 nt, Artificial Sequence
  MKO10028666_A_Ldb1
  gRNA
accccggcaccaugcuggau

SEQ ID NO: 28667 - RNA, 20 nt, Artificial Sequence
  MKO10028667_A_Ldb1
  gRNA
gggcacuuacuauaucucuu

SEQ ID NO: 28668 - RNA, 20 nt, Artificial Sequence
  MKO10028668_A_Ldb1
  gRNA
gaauauuugagcuuaacaaa

SEQ ID NO: 28669 - RNA, 20 nt, Artificial Sequence
  MKO10028669_A_Ldb2
  gRNA
gucuuacccugagguaguug

SEQ ID NO: 28670 - RNA, 20 nt, Artificial Sequence
  MKO10028670_A_Ldb2
  gRNA
auuccauaccuugguaaaca

SEQ ID NO: 28671 - RNA, 20 nt, Artificial Sequence
  MKO10028671_A_Ldb2
  gRNA
ugcuaaaauaacggggaaug

SEQ ID NO: 28672 - RNA, 20 nt, Artificial Sequence
  MKO10028672_A_Ldb3
  gRNA
gucucgcuccuuccgcaucc

SEQ ID NO: 28673 - RNA, 20 nt, Artificial Sequence
  MKO10028673_A_Ldb3
  gRNA
ccggcaccuaccuucuggug

SEQ ID NO: 28674 - RNA, 20 nt, Artificial Sequence
  MKO10028674_A_Ldb3
  gRNA
aggcugaugagugggcccgc

SEQ ID NO: 28675 - RNA, 20 nt, Artificial Sequence
  MKO10028675_A_Ldhal6b
  gRNA
ccacaacggcggccguugcu

SEQ ID NO: 28676 - RNA, 20 nt, Artificial Sequence
  MKO10028676_A_Ldhal6b
  gRNA
gccuuucgcuaugaugccga

SEQ ID NO: 28677 - RNA, 20 nt, Artificial Sequence
  MKO10028677_A_Ldhal6b
  gRNA
gccaucggcaucauagcgaa

SEQ ID NO: 28678 - RNA, 20 nt, Artificial Sequence
  MKO10028678_A_Ldha
  gRNA
cugcugaucgucuccaaucc

SEQ ID NO: 28679 - RNA, 20 nt, Artificial Sequence
  MKO10028679_A_Ldha
  gRNA
uuucccaaaaaccgaguaau

SEQ ID NO: 28680 - RNA, 20 nt, Artificial Sequence
  MKO10028680_A_Ldha
  gRNA
ggagaacauggcgacuccag

SEQ ID NO: 28681 - RNA, 20 nt, Artificial Sequence
  MKO10028681_A_Ldhb
  gRNA
gacggcaggaguccgccagc

SEQ ID NO: 28682 - RNA, 20 nt, Artificial Sequence
  MKO10028682_A_Ldhb
  gRNA
auauucugacuuacgucacc

SEQ ID NO: 28683 - RNA, 20 nt, Artificial Sequence
  MKO10028683_A_Ldhb
  gRNA
ugucuuccaacacauccacc

SEQ ID NO: 28684 - RNA, 20 nt, Artificial Sequence
  MKO10028684_A_Ldhc
  gRNA
ucaugauagcgacauuacgu

SEQ ID NO: 28685 - RNA, 20 nt, Artificial Sequence
  MKO10028685_A_Ldhc
  gRNA
uguucguaucagcgucaaca

SEQ ID NO: 28686 - RNA, 20 nt, Artificial Sequence
  MKO10028686_A_Ldhc
  gRNA
uuggacaaugcccggaacaa

SEQ ID NO: 28687 - RNA, 20 nt, Artificial Sequence
  MKO10028687_A_Ldhd
  gRNA
guuaaucacguugucccgca

SEQ ID NO: 28688 - RNA, 20 nt, Artificial Sequence
  MKO10028688_A_Ldhd
  gRNA
ggcugcuucacaccgcaggc

SEQ ID NO: 28689 - RNA, 20 nt, Artificial Sequence
  MKO10028689_A_Ldhd
  gRNA
cuguauucagcuccgugauc

SEQ ID NO: 28690 - RNA, 20 nt, Artificial Sequence
  MKO10028690_A_Ldlrad1
  gRNA
gguucuugugccacgaccga

SEQ ID NO: 28691 - RNA, 20 nt, Artificial Sequence
  MKO10028691_A_Ldlrad1
  gRNA
ccuguuggcuagugucacgc

SEQ ID NO: 28692 - RNA, 20 nt, Artificial Sequence
  MKO10028692_A_Ldlrad1
  gRNA
ccacucugcugcucacgccg

SEQ ID NO: 28693 - RNA, 20 nt, Artificial Sequence
  MKO10028693_A_Ldlrad2
  gRNA
cccccuaacgaugaccuccc

SEQ ID NO: 28694 - RNA, 20 nt, Artificial Sequence
  MKO10028694_A_Ldlrad2
  gRNA
aauguuugucaccuaugucc

SEQ ID NO: 28695 - RNA, 20 nt, Artificial Sequence
  MKO10028695_A_Ldlrad2
  gRNA
uggagggguccgcucagcug

SEQ ID NO: 28696 - RNA, 20 nt, Artificial Sequence
  MKO10028696_A_Ldlrad3
  gRNA
cugucccgacggcagcgacg

SEQ ID NO: 28697 - RNA, 20 nt, Artificial Sequence
  MKO10028697_A_Ldlrad3
  gRNA
aucggccgcuuccgcugcaa

SEQ ID NO: 28698 - RNA, 20 nt, Artificial Sequence
  MKO10028698_A_Ldlrad3
  gRNA
agcaucacguacgccaucau

SEQ ID NO: 28699 - RNA, 20 nt, Artificial Sequence
  MKO10028699_A_Ldlrad4
  gRNA
aagauacaagcauuuaccgc

SEQ ID NO: 28700 - RNA, 20 nt, Artificial Sequence
  MKO10028700_A_Ldlrad4
  gRNA
gauagcuccgugcagcgccc

SEQ ID NO: 28701 - RNA, 20 nt, Artificial Sequence
  MKO10028701_A_Ldlrad4
  gRNA
ucgauugggcggggcccuca

SEQ ID NO: 28702 - RNA, 20 nt, Artificial Sequence
  MKO10028702_A_Ldlrap1
  gRNA
uggacacguucucgaugagc

SEQ ID NO: 28703 - RNA, 20 nt, Artificial Sequence
  MKO10028703_A_Ldlrap1
  gRNA
gcuccaccagcgucauacca

SEQ ID NO: 28704 - RNA, 20 nt, Artificial Sequence
  MKO10028704_A_Ldlrap1
  gRNA
cgcguguccguccaguucuc

SEQ ID NO: 28705 - RNA, 20 nt, Artificial Sequence
  MKO10028705_A_Ldlr
  gRNA
gacgagcucggcugcgucaa

SEQ ID NO: 28706 - RNA, 20 nt, Artificial Sequence
  MKO10028706_A_Ldlr
  gRNA
acagucgacauccccgucgc

SEQ ID NO: 28707 - RNA, 20 nt, Artificial Sequence
  MKO10028707_A_Ldlr
  gRNA
cuggcggcuaccgugaaugc

SEQ ID NO: 28708 - RNA, 20 nt, Artificial Sequence
  MKO10028708_A_Ldoc1l
  gRNA
cgcacccgagcgcgcauccc

SEQ ID NO: 28709 - RNA, 20 nt, Artificial Sequence
  MKO10028709_A_Ldoc1l
  gRNA
uacgucauccaucugagcgc

SEQ ID NO: 28710 - RNA, 20 nt, Artificial Sequence
  MKO10028710_A_Ldoc1l
  gRNA
gccucaccaacuccgcgcug

SEQ ID NO: 28711 - RNA, 20 nt, Artificial Sequence
  MKO10028711_A_Ldoc1
  gRNA
acucucgccgcuaaaccgug

SEQ ID NO: 28712 - RNA, 20 nt, Artificial Sequence
  MKO10028712_A_Ldoc1
  gRNA
uagggcaccggacagcucgg

SEQ ID NO: 28713 - RNA, 20 nt, Artificial Sequence
  MKO10028713_A_Ldoc1
  gRNA
gguaccgacgacgaagauga

SEQ ID NO: 28714 - RNA, 20 nt, Artificial Sequence
  MKO10028714_A_Leap2
  gRNA
ggcccauuggugccucgugc

SEQ ID NO: 28715 - RNA, 20 nt, Artificial Sequence
  MKO10028715_A_Leap2
  gRNA
aagacgcuguucccuaagug

SEQ ID NO: 28716 - RNA, 20 nt, Artificial Sequence
  MKO10028716_A_Leap2
  gRNA
aucacuccugggccacacuu

SEQ ID NO: 28717 - RNA, 20 nt, Artificial Sequence
  MKO10028717_A_Lecu1
  gRNA
gaguucucuucguaguuagc

SEQ ID NO: 28718 - RNA, 20 nt, Artificial Sequence
  MKO10028718_A_Lecu1
  gRNA
acgaagagaacucgcugauu

SEQ ID NO: 28719 - RNA, 20 nt, Artificial Sequence
  MKO10028719_A_Lecu1
  gRNA
gcaguaccgcgccagaaaug

SEQ ID NO: 28720 - RNA, 20 nt, Artificial Sequence
  MKO10028720_A_Lecu2
  gRNA
gcaaaucuuccaacgagauc

SEQ ID NO: 28721 - RNA, 20 nt, Artificial Sequence
  MKO10028721_A_Lecu2
  gRNA
cuggcacauauguuagccca

SEQ ID NO: 28722 - RNA, 20 nt, Artificial Sequence
  MKO10028722_A_Lecu2
  gRNA
uuucaacguguacaugcgac

SEQ ID NO: 28723 - RNA, 20 nt, Artificial Sequence
  MKO10028723_A_Lef1
  gRNA
gugaucuguccaacgccgcc

SEQ ID NO: 28724 - RNA, 20 nt, Artificial Sequence
  MKO10028724_A_Lef1
  gRNA
cgcgugagagggcugcacca

SEQ ID NO: 28725 - RNA, 20 nt, Artificial Sequence
  MKO10028725_A_Lef1
  gRNA
agaaaagugcucgucgcugu

SEQ ID NO: 28726 - RNA, 20 nt, Artificial Sequence
  MKO10028726_A_Lefty1
  gRNA
ugcgguuggagccgucgucg

SEQ ID NO: 28727 - RNA, 20 nt, Artificial Sequence
  MKO10028727_A_Lefty1
  gRNA
uggcugcgcuuccgcgacga

SEQ ID NO: 28728 - RNA, 20 nt, Artificial Sequence
  MKO10028728_A_Lefty1
  gRNA
agccaugccagccgcucccg

SEQ ID NO: 28729 - RNA, 20 nt, Artificial Sequence
  MKO10028729_A_Lefty2
  gRNA
agucacgcugaccgcucccg

SEQ ID NO: 28730 - RNA, 20 nt, Artificial Sequence
  MKO10028730_A_Lefty2
  gRNA
uccccuaccuagagucgaug

SEQ ID NO: 28731 - RNA, 20 nt, Artificial Sequence
  MKO10028731_A_Lefty2
  gRNA
cacccuggacagcgcggaug

SEQ ID NO: 28732 - RNA, 20 nt, Artificial Sequence
  MKO10028732_A_Lekr1
  gRNA
gguccgacuacuggaauuuc

SEQ ID NO: 28733 - RNA, 20 nt, Artificial Sequence
  MKO10028733_A_Lekr1
  gRNA
auacuccgaccuugccuucu

SEQ ID NO: 28734 - RNA, 20 nt, Artificial Sequence
  MKO10028734_A_Lekr1
  gRNA
cuuaccugaagaaauccaaa

SEQ ID NO: 28735 - RNA, 20 nt, Artificial Sequence
  MKO10028735_A_Lelp1
  gRNA
ccaugccuaccccgaaagug

SEQ ID NO: 28736 - RNA, 20 nt, Artificial Sequence
  MKO10028736_A_Lelp1
  gRNA
cccauggugccucacuuucg

SEQ ID NO: 28737 - RNA, 20 nt, Artificial Sequence
  MKO10028737_A_Lelp1
  gRNA
augaugguggacaacaugcc

SEQ ID NO: 28738 - RNA, 20 nt, Artificial Sequence
  MKO10028738_A_Lemd1
  gRNA
gcuccgagaacaacguccca

SEQ ID NO: 28739 - RNA, 20 nt, Artificial Sequence
  MKO10028739_A_Lemd1
  gRNA
gacauacguaguauugggcc

SEQ ID NO: 28740 - RNA, 20 nt, Artificial Sequence
  MKO10028740_A_Lemd1
  gRNA
cuggcauggaaaguuguucc

SEQ ID NO: 28741 - RNA, 20 nt, Artificial Sequence
  MKO10028741_A_Lemd2
  gRNA
cuauguacuccugcgccucc

SEQ ID NO: 28742 - RNA, 20 nt, Artificial Sequence
  MKO10028742_A_Lemd2
  gRNA
cgcagccuuaaaccucgaag

SEQ ID NO: 28743 - RNA, 20 nt, Artificial Sequence
  MKO10028743_A_Lemd2
  gRNA
ccacguccuuguugcugcuc

SEQ ID NO: 28744 - RNA, 20 nt, Artificial Sequence
  MKO10028744_A_Lemd3
  gRNA
guacaaacuucaugaucgau

SEQ ID NO: 28745 - RNA, 20 nt, Artificial Sequence
  MKO10028745_A_Lemd3
  gRNA
gacuagaacugccacauuca

SEQ ID NO: 28746 - RNA, 20 nt, Artificial Sequence
  MKO10028746_A_Lemd3
  gRNA
aaccccuuugaugaaacauu

SEQ ID NO: 28747 - RNA, 20 nt, Artificial Sequence
  MKO10028747_A_Lenep
  gRNA
ccuggaggccagugccucga

SEQ ID NO: 28748 - RNA, 20 nt, Artificial Sequence
  MKO10028748_A_Lenep
  gRNA
accaacgcagccccugaccc

SEQ ID NO: 28749 - RNA, 20 nt, Artificial Sequence
  MKO10028749_A_Lenep
  gRNA
gggcauguaucgaacccuga

SEQ ID NO: 28750 - RNA, 20 nt, Artificial Sequence
  MKO10028750_A_Leng1
  gRNA
aggacaauguugcccgcgug

SEQ ID NO: 28751 - RNA, 20 nt, Artificial Sequence
  MKO10028751_A_Leng1
  gRNA
aggcccguacggaauuccua

SEQ ID NO: 28752 - RNA, 20 nt, Artificial Sequence
  MKO10028752_A_Leng1
  gRNA
ucuuccguaggaauuccgua

SEQ ID NO: 28753 - RNA, 20 nt, Artificial Sequence
  MKO10028753_A_Leng8
  gRNA
cacuaacuuacguuucaugc

SEQ ID NO: 28754 - RNA, 20 nt, Artificial Sequence
  MKO10028754_A_Leng8
  gRNA
cgagccugccaaaccuaaga

SEQ ID NO: 28755 - RNA, 20 nt, Artificial Sequence
  MKO10028755_A_Leng8
  gRNA
guauagcuacuacuacccca

SEQ ID NO: 28756 - RNA, 20 nt, Artificial Sequence
  MKO10028756_A_Leng9
  gRNA
acgucauccgacgcauccgc

SEQ ID NO: 28757 - RNA, 20 nt, Artificial Sequence
  MKO10028757_A_Leng9
  gRNA
cuagagggccgcugucgcuu

SEQ ID NO: 28758 - RNA, 20 nt, Artificial Sequence
  MKO10028758_A_Leng9
  gRNA
agcgcgcaccgaagcgacag

SEQ ID NO: 28759 - RNA, 20 nt, Artificial Sequence
  MKO10028759_A_Leo1
  gRNA
gaccaggacaacggcgcuuc

SEQ ID NO: 28760 - RNA, 20 nt, Artificial Sequence
  MKO10028760_A_Leo1
  gRNA
uuccgagcgcucugaccacg

SEQ ID NO: 28761 - RNA, 20 nt, Artificial Sequence
  MKO10028761_A_Leo1
  gRNA
gcgcaagaacgcgauuccau

SEQ ID NO: 28762 - RNA, 20 nt, Artificial Sequence
  MKO10028762_A_Lepre1
  gRNA
ggggguacgacucuacucag

SEQ ID NO: 28763 - RNA, 20 nt, Artificial Sequence
  MKO10028763_A_Lepre1
  gRNA
guuguagccgucguagucau

SEQ ID NO: 28764 - RNA, 20 nt, Artificial Sequence
  MKO10028764_A_Lepre1
  gRNA
ucucgaggccaagccccaua

SEQ ID NO: 28765 - RNA, 20 nt, Artificial Sequence
  MKO10028765_A_Leprel1
  gRNA
gaaaguucucgauuggugag

SEQ ID NO: 28766 - RNA, 20 nt, Artificial Sequence
  MKO10028766_A_Leprel1
  gRNA
guauaaagguggucuuuacg

SEQ ID NO: 28767 - RNA, 20 nt, Artificial Sequence
  MKO10028767_A_Leprel1
  gRNA
cuggagguagucguaaugca

SEQ ID NO: 28768 - RNA, 20 nt, Artificial Sequence
  MKO10028768_A_Leprel2
  gRNA
cugcacgaggcguaugcuca

SEQ ID NO: 28769 - RNA, 20 nt, Artificial Sequence
  MKO10028769_A_Leprel2
  gRNA
accuggugacgccccuauac

SEQ ID NO: 28770 - RNA, 20 nt, Artificial Sequence
  MKO10028770_A_Leprel2
  gRNA
acuggcucuaccccaacuag

SEQ ID NO: 28771 - RNA, 20 nt, Artificial Sequence
  MKO10028771_A_Leprel4
  gRNA
accaaucucacccccaacgu

SEQ ID NO: 28772 - RNA, 20 nt, Artificial Sequence
  MKO10028772_A_Leprel4
  gRNA
ugguauauaccugcuaucgc

SEQ ID NO: 28773 - RNA, 20 nt, Artificial Sequence
  MKO10028773_A_Leprel4
  gRNA
uucagugaaugauguacgcc

SEQ ID NO: 28774 - RNA, 20 nt, Artificial Sequence
  MKO10028774_A_Leprotl1
  gRNA
cgccaugagcaacgcgugua

SEQ ID NO: 28775 - RNA, 20 nt, Artificial Sequence
  MKO10028775_A_Leprotl1
  gRNA
ugacguacuuguauaucgga

SEQ ID NO: 28776 - RNA, 20 nt, Artificial Sequence
  MKO10028776_A_Leprotl1
  gRNA
gucaucuucgcgacuauucu

SEQ ID NO: 28777 - RNA, 20 nt, Artificial Sequence
  MKO10028777_A_Leprot
  gRNA
gaaauacgccaguucccgac

SEQ ID NO: 28778 - RNA, 20 nt, Artificial Sequence
  MKO10028778_A_Leprot
  gRNA
agagacauggcgggcguuaa

SEQ ID NO: 28779 - RNA, 20 nt, Artificial Sequence
  MKO10028779_A_Leprot
  gRNA
gaugugcguuggaggacuau

SEQ ID NO: 28780 - RNA, 20 nt, Artificial Sequence
  MKO10028780_A_Lepr
  gRNA
ggcgaaucaucuaugacuuc

SEQ ID NO: 28781 - RNA, 20 nt, Artificial Sequence
  MKO10028781_A_Lepr
  gRNA
aaacaaugccucggcuuuga

SEQ ID NO: 28782 - RNA, 20 nt, Artificial Sequence
  MKO10028782_A_Lepr
  gRNA
agaagcccccuucaaagccg

SEQ ID NO: 28783 - RNA, 20 nt, Artificial Sequence
  MKO10028783_A_Lep
  gRNA
agucgguauccgccaagcag

SEQ ID NO: 28784 - RNA, 20 nt, Artificial Sequence
  MKO10028784_A_Lep
  gRNA
gacucuggcagucuaucaac

SEQ ID NO: 28785 - RNA, 20 nt, Artificial Sequence
  MKO10028785_A_Lep
  gRNA
aaagccacaggaaccgacac

SEQ ID NO: 28786 - RNA, 20 nt, Artificial Sequence
  MKO10028786_A_Letm1
  gRNA
ucgacaccaagaucgcugcc

SEQ ID NO: 28787 - RNA, 20 nt, Artificial Sequence
  MKO10028787_A_Letm1
  gRNA
acucacggcucgucaacccc

SEQ ID NO: 28788 - RNA, 20 nt, Artificial Sequence
  MKO10028788_A_Letm1
  gRNA
gggucagcguauggccauug

SEQ ID NO: 28789 - RNA, 20 nt, Artificial Sequence
  MKO10028789_A_Letm2
  gRNA
augcgcuaaccagacgagag

SEQ ID NO: 28790 - RNA, 20 nt, Artificial Sequence
  MKO10028790_A_Letm2
  gRNA
gugugccgaugucuuccgcu

SEQ ID NO: 28791 - RNA, 20 nt, Artificial Sequence
  MKO10028791_A_Letm2
  gRNA
ggggccggucuaaguguucc

SEQ ID NO: 28792 - RNA, 20 nt, Artificial Sequence
  MKO10028792_A_Letmd1
  gRNA
accaagacaagagcgauuaa

SEQ ID NO: 28793 - RNA, 20 nt, Artificial Sequence
  MKO10028793_A_Letmd1
  gRNA
acguuuaucauggucuccgg

SEQ ID NO: 28794 - RNA, 20 nt, Artificial Sequence
  MKO10028794_A_Letmd1
  gRNA
aaguucuucacguccgccuu

SEQ ID NO: 28795 - RNA, 20 nt, Artificial Sequence
  MKO10028795_A_Lfng
  gRNA
uaugaccgauucauugaguc

SEQ ID NO: 28796 - RNA, 20 nt, Artificial Sequence
  MKO10028796_A_Lfng
  gRNA
gugcucgcugauccguucug

SEQ ID NO: 28797 - RNA, 20 nt, Artificial Sequence
  MKO10028797_A_Lfng
  gRNA
gcuugccgauguacacgucu

SEQ ID NO: 28798 - RNA, 20 nt, Artificial Sequence
  MKO10028798_A_Lgals12
  gRNA
acuuucuucacuaccgcuac

SEQ ID NO: 28799 - RNA, 20 nt, Artificial Sequence
  MKO10028799_A_Lgals12
  gRNA
guagauacccuugacauauc

SEQ ID NO: 28800 - RNA, 20 nt, Artificial Sequence
  MKO10028800_A_Lgals12
  gRNA
ccucucugcagggcgacccc

SEQ ID NO: 28801 - RNA, 20 nt, Artificial Sequence
  MKO10028801_A_Lgals1
  gRNA
gucucaccucuuggcguccg

SEQ ID NO: 28802 - RNA, 20 nt, Artificial Sequence
  MKO10028802_A_Lgals1
  gRNA
agacuucaagauuaagugcg

SEQ ID NO: 28803 - RNA, 20 nt, Artificial Sequence
  MKO10028803_A_Lgals1
  gRNA
ccuccauguugaggcgguug

SEQ ID NO: 28804 - RNA, 20 nt, Artificial Sequence
  MKO10028804_A_Lgals2
  gRNA
cgaagcgaggguuaaaaugc

SEQ ID NO: 28805 - RNA, 20 nt, Artificial Sequence
  MKO10028805_A_Lgals2
  gRNA
cguaccgguccacaucauug

SEQ ID NO: 28806 - RNA, 20 nt, Artificial Sequence
  MKO10028806_A_Lgals2
  gRNA
ccaugcucaaguagugcagu

SEQ ID NO: 28807 - RNA, 20 nt, Artificial Sequence
  MKO10028807_A_Lgals3bp
  gRNA
agcuacuccaauccgacaau

SEQ ID NO: 28808 - RNA, 20 nt, Artificial Sequence
  MKO10028808_A_Lgals3bp
  gRNA
ugaauaggucgcagcccugc

SEQ ID NO: 28809 - RNA, 20 nt, Artificial Sequence
  MKO10028809_A_Lgals3bp
  gRNA
uggaugcccacgucgucugc

SEQ ID NO: 28810 - RNA, 20 nt, Artificial Sequence
  MKO10028810_A_Lgals3
  gRNA
cccggagguucuucauccga

SEQ ID NO: 28811 - RNA, 20 nt, Artificial Sequence
  MKO10028811_A_Lgals3
  gRNA
uucuggcuuagaucauggcg

SEQ ID NO: 28812 - RNA, 20 nt, Artificial Sequence
  MKO10028812_A_Lgals3
  gRNA
acccuuguaccuguuugcgu

SEQ ID NO: 28813 - RNA, 20 nt, Artificial Sequence
  MKO10028813_A_Lgals4
  gRNA
guuccacgugaacuucgcug

SEQ ID NO: 28814 - RNA, 20 nt, Artificial Sequence
  MKO10028814_A_Lgals4
  gRNA
aaacggacaucccgacacug

SEQ ID NO: 28815 - RNA, 20 nt, Artificial Sequence
  MKO10028815_A_Lgals4
  gRNA
gccccacagcgaaguucacg

SEQ ID NO: 28816 - RNA, 20 nt, Artificial Sequence
  MKO10028816_A_Lgals6
  gRNA
guuccacgugaacuucgcug

SEQ ID NO: 28817 - RNA, 20 nt, Artificial Sequence
  MKO10028817_A_Lgals6
  gRNA
aaacggacaucccgacacug

SEQ ID NO: 28818 - RNA, 20 nt, Artificial Sequence
  MKO10028818_A_Lgals6
  gRNA
gacguuccauaccggauaug

SEQ ID NO: 28819 - RNA, 20 nt, Artificial Sequence
  MKO10028819_A_Lgals7
  gRNA
ccgccuugcacuuuaacccg

SEQ ID NO: 28820 - RNA, 20 nt, Artificial Sequence
  MKO10028820_A_Lgals7
  gRNA
accggcauccccuucgagcg

SEQ ID NO: 28821 - RNA, 20 nt, Artificial Sequence
  MKO10028821_A_Lgals7
  gRNA
cuccaccaagcgcacgcgcg

SEQ ID NO: 28822 - RNA, 20 nt, Artificial Sequence
  MKO10028822_A_Lgals8
  gRNA
auguucugcuguacgcccac

SEQ ID NO: 28823 - RNA, 20 nt, Artificial Sequence
  MKO10028823_A_Lgals8
  gRNA
caccaugaacacgaucucaa

SEQ ID NO: 28824 - RNA, 20 nt, Artificial Sequence
  MKO10028824_A_Lgals8
  gRNA
cgagcugaaucugaacccga

SEQ ID NO: 28825 - RNA, 20 nt, Artificial Sequence
  MKO10028825_A_Lgals9
  gRNA
ccgcguacccuaccaccucg

SEQ ID NO: 28826 - RNA, 20 nt, Artificial Sequence
  MKO10028826_A_Lgals9
  gRNA
caacucaccggguuaaugua

SEQ ID NO: 28827 - RNA, 20 nt, Artificial Sequence
  MKO10028827_A_Lgals9
  gRNA
ccacgaggugguaggguacg

SEQ ID NO: 28828 - RNA, 20 nt, Artificial Sequence
  MKO10028828_A_Lgalsl
  gRNA
cgacguguacuucccacgac

SEQ ID NO: 28829 - RNA, 20 nt, Artificial Sequence
  MKO10028829_A_Lgalsl
  gRNA
ucguagaucucaaccccgaa

SEQ ID NO: 28830 - RNA, 20 nt, Artificial Sequence
  MKO10028830_A_Lgalsl
  gRNA
agguaccuacccugaacggc

SEQ ID NO: 28831 - RNA, 20 nt, Artificial Sequence
  MKO10028831_A_Lgi1
  gRNA
ccauuucaagacauacuuuc

SEQ ID NO: 28832 - RNA, 20 nt, Artificial Sequence
  MKO10028832_A_Lgi1
  gRNA
acuuacaaauauucuagaug

SEQ ID NO: 28833 - RNA, 20 nt, Artificial Sequence
  MKO10028833_A_Lgi1
  gRNA
ucucacaagagcugcagcga

SEQ ID NO: 28834 - RNA, 20 nt, Artificial Sequence
  MKO10028834_A_Lgi2
  gRNA
gacuaugaguguaccaccac

SEQ ID NO: 28835 - RNA, 20 nt, Artificial Sequence
  MKO10028835_A_Lgi2
  gRNA
auccgggacgaugccuuugc

SEQ ID NO: 28836 - RNA, 20 nt, Artificial Sequence
  MKO10028836_A_Lgi2
  gRNA
gguacacucauagucaaagc

SEQ ID NO: 28837 - RNA, 20 nt, Artificial Sequence
  MKO10028837_A_Lgi3
  gRNA
cagagacaucuuccgucccc

SEQ ID NO: 28838 - RNA, 20 nt, Artificial Sequence
  MKO10028838_A_Lgi3
  gRNA
caggggacggaagaugucuc

SEQ ID NO: 28839 - RNA, 20 nt, Artificial Sequence
  MKO10028839_A_Lgi3
  gRNA
ucuaacaaguucacacugau

SEQ ID NO: 28840 - RNA, 20 nt, Artificial Sequence
  MKO10028840_A_Lgi4
  gRNA
ggggucucccggcugaaggc

SEQ ID NO: 28841 - RNA, 20 nt, Artificial Sequence
  MKO10028841_A_Lgi4
  gRNA
ugagugagcgaaguccccuc

SEQ ID NO: 28842 - RNA, 20 nt, Artificial Sequence
  MKO10028842_A_Lgi4
  gRNA
uucauugaggacaacaagau

SEQ ID NO: 28843 - RNA, 20 nt, Artificial Sequence
  MKO10028843_A_Lgmn
  gRNA
guugugaucaaccgaccuaa

SEQ ID NO: 28844 - RNA, 20 nt, Artificial Sequence
  MKO10028844_A_Lgmn
  gRNA
ucccguuccgguggaugauc

SEQ ID NO: 28845 - RNA, 20 nt, Artificial Sequence
  MKO10028845_A_Lgmn
  gRNA
uucauuuacuucaccgacca

SEQ ID NO: 28846 - RNA, 20 nt, Artificial Sequence
  MKO10028846_A_Lgr4
  gRNA
caaagcacucaguccacgaa

SEQ ID NO: 28847 - RNA, 20 nt, Artificial Sequence
  MKO10028847_A_Lgr4
  gRNA
acagcacuaccaagcuugaa

SEQ ID NO: 28848 - RNA, 20 nt, Artificial Sequence
  MKO10028848_A_Lgr4
  gRNA
guacccagugaagccauucg

SEQ ID NO: 28849 - RNA, 20 nt, Artificial Sequence
  MKO10028849_A_Lgr5
  gRNA
caaaggcguagucugcuaug

SEQ ID NO: 28850 - RNA, 20 nt, Artificial Sequence
  MKO10028850_A_Lgr5
  gRNA
cacauagcagacuacgccuu

SEQ ID NO: 28851 - RNA, 20 nt, Artificial Sequence
  MKO10028851_A_Lgr5
  gRNA
aaggcccgugaacgcucccu

SEQ ID NO: 28852 - RNA, 20 nt, Artificial Sequence
  MKO10028852_A_Lgr6
  gRNA
gcggauaugguugagagcca

SEQ ID NO: 28853 - RNA, 20 nt, Artificial Sequence
  MKO10028853_A_Lgr6
  gRNA
uugauuugcaggcggcucuc

SEQ ID NO: 28854 - RNA, 20 nt, Artificial Sequence
  MKO10028854_A_Lgr6
  gRNA
caaugacucacagcgacugc

SEQ ID NO: 28855 - RNA, 20 nt, Artificial Sequence
  MKO10028855_A_Lgsn
  gRNA
cgcuugcgacaguugaccgc

SEQ ID NO: 28856 - RNA, 20 nt, Artificial Sequence
  MKO10028856_A_Lgsn
  gRNA
ugcaaccgcgaacccuuacc

SEQ ID NO: 28857 - RNA, 20 nt, Artificial Sequence
  MKO10028857_A_Lgsn
  gRNA
ugccuaccacccgacaccag

SEQ ID NO: 28858 - RNA, 20 nt, Artificial Sequence
  MKO10028858_A_Lhb
  gRNA
gcggccagaguugcguugac

SEQ ID NO: 28859 - RNA, 20 nt, Artificial Sequence
  MKO10028859_A_Lhb
  gRNA
cacucagguccgaguacugc

SEQ ID NO: 28860 - RNA, 20 nt, Artificial Sequence
  MKO10028860_A_Lhb
  gRNA
ucuacacccggugggcagcc

SEQ ID NO: 28861 - RNA, 20 nt, Artificial Sequence
  MKO10028861_A_Lhcgr
  gRNA
aaccugcuauacauugaacc

SEQ ID NO: 28862 - RNA, 20 nt, Artificial Sequence
  MKO10028862_A_Lhcgr
  gRNA
caccggguucaauguauagc

SEQ ID NO: 28863 - RNA, 20 nt, Artificial Sequence
  MKO10028863_A_Lhcgr
  gRNA
aagagaucuucgaaacaucu

SEQ ID NO: 28864 - RNA, 20 nt, Artificial Sequence
  MKO10028864_A_Lhfpl1
  gRNA
ccacagcgguaacuagggac

SEQ ID NO: 28865 - RNA, 20 nt, Artificial Sequence
  MKO10028865_A_Lhfpl1
  gRNA
ccugucccuaguuaccgcug

SEQ ID NO: 28866 - RNA, 20 nt, Artificial Sequence
  MKO10028866_A_Lhfpl1
  gRNA
ccggagguaaugcaaacaug

SEQ ID NO: 28867 - RNA, 20 nt, Artificial Sequence
  MKO10028867_A_Lhfpl2
  gRNA
uugccuucaugagcgccgac

SEQ ID NO: 28868 - RNA, 20 nt, Artificial Sequence
  MKO10028868_A_Lhfpl2
  gRNA
uaugcgucccccuacaaacc

SEQ ID NO: 28869 - RNA, 20 nt, Artificial Sequence
  MKO10028869_A_Lhfpl2
  gRNA
cuccccgaagcucuuggcgu

SEQ ID NO: 28870 - RNA, 20 nt, Artificial Sequence
  MKO10028870_A_Lhfpl3
  gRNA
agccguugccgaugcaguag

SEQ ID NO: 28871 - RNA, 20 nt, Artificial Sequence
  MKO10028871_A_Lhfpl3
  gRNA
guacgcccagcggaccgagc

SEQ ID NO: 28872 - RNA, 20 nt, Artificial Sequence
  MKO10028872_A_Lhfpl3
  gRNA
guuuguacgacuuaucacga

SEQ ID NO: 28873 - RNA, 20 nt, Artificial Sequence
  MKO10028873_A_Lhfpl4
  gRNA
cuacaguaaguuccgugcug

SEQ ID NO: 28874 - RNA, 20 nt, Artificial Sequence
  MKO10028874_A_Lhfpl4
  gRNA
cugccgguugcccagcacga

SEQ ID NO: 28875 - RNA, 20 nt, Artificial Sequence
  MKO10028875_A_Lhfpl4
  gRNA
agugcgcugggcguacauuc

SEQ ID NO: 28876 - RNA, 20 nt, Artificial Sequence
  MKO10028876_A_Lhfpl5
  gRNA
ugugcgaaacucgcgcgcug

SEQ ID NO: 28877 - RNA, 20 nt, Artificial Sequence
  MKO10028877_A_Lhfpl5
  gRNA
agacuagacauccgaucauu

SEQ ID NO: 28878 - RNA, 20 nt, Artificial Sequence
  MKO10028878_A_Lhfpl5
  gRNA
cagcacguugcccacgcagu

SEQ ID NO: 28879 - RNA, 20 nt, Artificial Sequence
  MKO10028879_A_Lhfp
  gRNA
ugccgacucucaucgugaac

SEQ ID NO: 28880 - RNA, 20 nt, Artificial Sequence
  MKO10028880_A_Lhfp
  gRNA
ccgacacgcagcaacccauc

SEQ ID NO: 28881 - RNA, 20 nt, Artificial Sequence
  MKO10028881_A_Lhfp
  gRNA
cccugccccggugcaguagu

SEQ ID NO: 28882 - RNA, 20 nt, Artificial Sequence
  MKO10028882_A_Lhpp
  gRNA
cucuugcagacgcuauuaca

SEQ ID NO: 28883 - RNA, 20 nt, Artificial Sequence
  MKO10028883_A_Lhpp
  gRNA
ucuggccugaugcuggacgu

SEQ ID NO: 28884 - RNA, 20 nt, Artificial Sequence
  MKO10028884_A_Lhpp
  gRNA
aaaccccgugcucauauccc

SEQ ID NO: 28885 - RNA, 20 nt, Artificial Sequence
  MKO10028885_A_Lhx1
  gRNA
accagcggccgcauccgacg

SEQ ID NO: 28886 - RNA, 20 nt, Artificial Sequence
  MKO10028886_A_Lhx1
  gRNA
gguccgggguccccuacguu

SEQ ID NO: 28887 - RNA, 20 nt, Artificial Sequence
  MKO10028887_A_Lhx1
  gRNA
uguuucgguaccaaaugcgc

SEQ ID NO: 28888 - RNA, 20 nt, Artificial Sequence
  MKO10028888_A_Lhx2
  gRNA
ucuucccuacuacaacggcg

SEQ ID NO: 28889 - RNA, 20 nt, Artificial Sequence
  MKO10028889_A_Lhx2
  gRNA
cucagccggggcuaauccgc

SEQ ID NO: 28890 - RNA, 20 nt, Artificial Sequence
  MKO10028890_A_Lhx2
  gRNA
gacgccgucagggcccgccu

SEQ ID NO: 28891 - RNA, 20 nt, Artificial Sequence
  MKO10028891_A_Lhx3
  gRNA
cgcaauaugaagcgcucccg

SEQ ID NO: 28892 - RNA, 20 nt, Artificial Sequence
  MKO10028892_A_Lhx3
  gRNA
gcgcggcgcaccaccugcgu

SEQ ID NO: 28893 - RNA, 20 nt, Artificial Sequence
  MKO10028893_A_Lhx3
  gRNA
ugucggacuuggaacugccg

SEQ ID NO: 28894 - RNA, 20 nt, Artificial Sequence
  MKO10028894_A_Lhx4
  gRNA
cccgacccaggugguccgca

SEQ ID NO: 28895 - RNA, 20 nt, Artificial Sequence
  MKO10028895_A_Lhx4
  gRNA
cugccgguugcagaugaugc

SEQ ID NO: 28896 - RNA, 20 nt, Artificial Sequence
  MKO10028896_A_Lhx4
  gRNA
ccuggacaugagaguaguac

SEQ ID NO: 28897 - RNA, 20 nt, Artificial Sequence
  MKO10028897_A_Lhx5
  gRNA
ccccgcagugucguccugua

SEQ ID NO: 28898 - RNA, 20 nt, Artificial Sequence
  MKO10028898_A_Lhx5
  gRNA
gaccgacaauucgaccucau

SEQ ID NO: 28899 - RNA, 20 nt, Artificial Sequence
  MKO10028899_A_Lhx5
  gRNA
acggccgcuucguugagcuc

SEQ ID NO: 28900 - RNA, 20 nt, Artificial Sequence
  MKO10028900_A_Lhx6
  gRNA
gcgaccacccgcugucucga

SEQ ID NO: 28901 - RNA, 20 nt, Artificial Sequence
  MKO10028901_A_Lhx6
  gRNA
ugcgcgccgcacccagucac

SEQ ID NO: 28902 - RNA, 20 nt, Artificial Sequence
  MKO10028902_A_Lhx6
  gRNA
gauuuggaaccaagugcgcc

SEQ ID NO: 28903 - RNA, 20 nt, Artificial Sequence
  MKO10028903_A_Lhx8
  gRNA
caaggcgaacuccucucccg

SEQ ID NO: 28904 - RNA, 20 nt, Artificial Sequence
  MKO10028904_A_Lhx8
  gRNA
caagggcaacguguaucacc

SEQ ID NO: 28905 - RNA, 20 nt, Artificial Sequence
  MKO10028905_A_Lhx8
  gRNA
gggaggacccgcaaaggcgc

SEQ ID NO: 28906 - RNA, 20 nt, Artificial Sequence
  MKO10028906_A_Lhx9
  gRNA
caucccgaaauggucgcccg

SEQ ID NO: 28907 - RNA, 20 nt, Artificial Sequence
  MKO10028907_A_Lhx9
  gRNA
agugugcgcggcaguacacc

SEQ ID NO: 28908 - RNA, 20 nt, Artificial Sequence
  MKO10028908_A_Lhx9
  gRNA
gaaagaaguucgcauccguu

SEQ ID NO: 28909 - RNA, 20 nt, Artificial Sequence
  MKO10028909_A_Lias
  gRNA
caucucgauccaccgacguc

SEQ ID NO: 28910 - RNA, 20 nt, Artificial Sequence
  MKO10028910_A_Lias
  gRNA
auuuggaagauaugcguuca

SEQ ID NO: 28911 - RNA, 20 nt, Artificial Sequence
  MKO10028911_A_Lias
  gRNA
uuauguuguccugacgucgg

SEQ ID NO: 28912 - RNA, 20 nt, Artificial Sequence
  MKO10028912_A_Lifr
  gRNA
auugugacuucgugaucacc

SEQ ID NO: 28913 - RNA, 20 nt, Artificial Sequence
  MKO10028913_A_Lifr
  gRNA
cucaaacuuacgagugcuac

SEQ ID NO: 28914 - RNA, 20 nt, Artificial Sequence
  MKO10028914_A_Lifr
  gRNA
gucccacacucgcauguugu

SEQ ID NO: 28915 - RNA, 20 nt, Artificial Sequence
  MKO10028915_A_Lif
  gRNA
ggagccguuucccaacaacg

SEQ ID NO: 28916 - RNA, 20 nt, Artificial Sequence
  MKO10028916_A_Lif
  gRNA
ucugugcaacaaguaccgug

SEQ ID NO: 28917 - RNA, 20 nt, Artificial Sequence
  MKO10028917_A_Lif
  gRNA
gaaccagaucaagaaucaac

SEQ ID NO: 28918 - RNA, 20 nt, Artificial Sequence
  MKO10028918_A_Lig1
  gRNA
uccuuaccaguucgacgcuu

SEQ ID NO: 28919 - RNA, 20 nt, Artificial Sequence
  MKO10028919_A_Lig1
  gRNA
ggauucccaaagcgucgaac

SEQ ID NO: 28920 - RNA, 20 nt, Artificial Sequence
  MKO10028920_A_Lig1
  gRNA
gacuuccaggguggcgcuga

SEQ ID NO: 28921 - RNA, 20 nt, Artificial Sequence
  MKO10028921_A_Lig3
  gRNA
uuauuaccaguaccaauccu

SEQ ID NO: 28922 - RNA, 20 nt, Artificial Sequence
  MKO10028922_A_Lig3
  gRNA
accgggaggcuauguccugc

SEQ ID NO: 28923 - RNA, 20 nt, Artificial Sequence
  MKO10028923_A_Lig3
  gRNA
gucugaccuguucuaggucc

SEQ ID NO: 28924 - RNA, 20 nt, Artificial Sequence
  MKO10028924_A_Lig4
  gRNA
agcauccgugcgagcuccac

SEQ ID NO: 28925 - RNA, 20 nt, Artificial Sequence
  MKO10028925_A_Lig4
  gRNA
augauguugucaagcccgag

SEQ ID NO: 28926 - RNA, 20 nt, Artificial Sequence
  MKO10028926_A_Lig4
  gRNA
ccauuuauucacaaugcguu

SEQ ID NO: 28927 - RNA, 20 nt, Artificial Sequence
  MKO10028927_A_Lilra5
  gRNA
ucacggggcccacaguaaau

SEQ ID NO: 28928 - RNA, 20 nt, Artificial Sequence
  MKO10028928_A_Lilra5
  gRNA
ccaucaauugaacaacgauc

SEQ ID NO: 28929 - RNA, 20 nt, Artificial Sequence
  MKO10028929_A_Lilra5
  gRNA
caagagaccuccaugucgga

SEQ ID NO: 28930 - RNA, 20 nt, Artificial Sequence
  MKO10028930_A_Lilra6
  gRNA
caccugucacuacuagcacc

SEQ ID NO: 28931 - RNA, 20 nt, Artificial Sequence
  MKO10028931_A_Lilra6
  gRNA
ucacaguauaacaucucuac

SEQ ID NO: 28932 - RNA, 20 nt, Artificial Sequence
  MKO10028932_A_Lilra6
  gRNA
accaccaucaaagcugaacc

SEQ ID NO: 28933 - RNA, 20 nt, Artificial Sequence
  MKO10028933_A_Lilrb4
  gRNA
ugcagcucauccauaguauu

SEQ ID NO: 28934 - RNA, 20 nt, Artificial Sequence
  MKO10028934_A_Lilrb4
  gRNA
cguauacaucugugauuacc

SEQ ID NO: 28935 - RNA, 20 nt, Artificial Sequence
  MKO10028935_A_Lilrb4
  gRNA
agcaugacaaccucauaugc

SEQ ID NO: 28936 - RNA, 20 nt, Artificial Sequence
  MKO10028936_A_Lim2
  gRNA
ggcgccggcacucaugcauc

SEQ ID NO: 28937 - RNA, 20 nt, Artificial Sequence
  MKO10028937_A_Lim2
  gRNA
gucgggguccuucgcacacc

SEQ ID NO: 28938 - RNA, 20 nt, Artificial Sequence
  MKO10028938_A_Lim2
  gRNA
ucaaggcucaccgaugcucu

SEQ ID NO: 28939 - RNA, 20 nt, Artificial Sequence
  MKO10028939_A_Lima1
  gRNA
cuggacccaaagccgaaaug

SEQ ID NO: 28940 - RNA, 20 nt, Artificial Sequence
  MKO10028940_A_Lima1
  gRNA
uuucuccgaguugaaugcag

SEQ ID NO: 28941 - RNA, 20 nt, Artificial Sequence
  MKO10028941_A_Lima1
  gRNA
acgcugcaggccucgggacc

SEQ ID NO: 28942 - RNA, 20 nt, Artificial Sequence
  MKO10028942_A_Limch1
  gRNA
aagaugauauguccgcacga

SEQ ID NO: 28943 - RNA, 20 nt, Artificial Sequence
  MKO10028943_A_Limch1
  gRNA
cugaaucagacuugccgcac

SEQ ID NO: 28944 - RNA, 20 nt, Artificial Sequence
  MKO10028944_A_Limch1
  gRNA
ucaucccguccguggcgagg

SEQ ID NO: 28945 - RNA, 20 nt, Artificial Sequence
  MKO10028945_A_Limd1
  gRNA
cggggugauaggacuucccu

SEQ ID NO: 28946 - RNA, 20 nt, Artificial Sequence
  MKO10028946_A_Limd1
  gRNA
aucgugguagagaucuccca

SEQ ID NO: 28947 - RNA, 20 nt, Artificial Sequence
  MKO10028947_A_Limd1
  gRNA
cgucaucuguaaugaauguc

SEQ ID NO: 28948 - RNA, 20 nt, Artificial Sequence
  MKO10028948_A_Limd2
  gRNA
caccugagcccgcaagcuaa

SEQ ID NO: 28949 - RNA, 20 nt, Artificial Sequence
  MKO10028949_A_Limd2
  gRNA
cagcacgguacagcggucua

SEQ ID NO: 28950 - RNA, 20 nt, Artificial Sequence
  MKO10028950_A_Limd2
  gRNA
aaaggggucucaggccgucu

SEQ ID NO: 28951 - RNA, 20 nt, Artificial Sequence
  MKO10028951_A_Lime1
  gRNA
augcaggcauauucggcccc

SEQ ID NO: 28952 - RNA, 20 nt, Artificial Sequence
  MKO10028952_A_Lime1
  gRNA
gcagacguuaccugaguagc

SEQ ID NO: 28953 - RNA, 20 nt, Artificial Sequence
  MKO10028953_A_Lime1
  gRNA
agauggacguccuauacucu

SEQ ID NO: 28954 - RNA, 20 nt, Artificial Sequence
  MKO10028954_A_Limk1
  gRNA
ccagugcuacuaccagaccg

SEQ ID NO: 28955 - RNA, 20 nt, Artificial Sequence
  MKO10028955_A_Limk1
  gRNA
ccacggucugguaguagcac

SEQ ID NO: 28956 - RNA, 20 nt, Artificial Sequence
  MKO10028956_A_Limk1
  gRNA
cgcuauggcgagucuugcca

SEQ ID NO: 28957 - RNA, 20 nt, Artificial Sequence
  MKO10028957_A_Limk2
  gRNA
cuccccguggaucaggucgc

SEQ ID NO: 28958 - RNA, 20 nt, Artificial Sequence
  MKO10028958_A_Limk2
  gRNA
uguccguacucugcgaguag

SEQ ID NO: 28959 - RNA, 20 nt, Artificial Sequence
  MKO10028959_A_Limk2
  gRNA
cugcgaccugauccacgggg

SEQ ID NO: 28960 - RNA, 20 nt, Artificial Sequence
  MKO10028960_A_Lims1
  gRNA
cacauacgaagcacuguucg

SEQ ID NO: 28961 - RNA, 20 nt, Artificial Sequence
  MKO10028961_A_Lims1
  gRNA
cgcaguuggcacaguugaag

SEQ ID NO: 28962 - RNA, 20 nt, Artificial Sequence
  MKO10028962_A_Lims1
  gRNA
ugccacgugugagcgcugca

SEQ ID NO: 28963 - RNA, 20 nt, Artificial Sequence
  MKO10028963_A_Lims2
  gRNA
gcuguucgucgauggcgagg

SEQ ID NO: 28964 - RNA, 20 nt, Artificial Sequence
  MKO10028964_A_Lims2
  gRNA
ucccgagggacucuucuacg

SEQ ID NO: 28965 - RNA, 20 nt, Artificial Sequence
  MKO10028965_A_Lims2
  gRNA
caccucguagaagagucccu

SEQ ID NO: 28966 - RNA, 20 nt, Artificial Sequence
  MKO10028966_A_Lin28a
  gRNA
cugucuaugaccgcccgcgc

SEQ ID NO: 28967 - RNA, 20 nt, Artificial Sequence
  MKO10028967_A_Lin28a
  gRNA
ggucgagcgcgaccccagcg

SEQ ID NO: 28968 - RNA, 20 nt, Artificial Sequence
  MKO10028968_A_Lin28a
  gRNA
cuggaauccauccgugucac

SEQ ID NO: 28969 - RNA, 20 nt, Artificial Sequence
  MKO10028969_A_Lin28b
  gRNA
uauugcugcaaacgcuuucg

SEQ ID NO: 28970 - RNA, 20 nt, Artificial Sequence
  MKO10028970_A_Lin28b
  gRNA
caucuccaugauaagucgag

SEQ ID NO: 28971 - RNA, 20 nt, Artificial Sequence
  MKO10028971_A_Lin28b
  gRNA
cuugagucaauacggguaac

SEQ ID NO: 28972 - RNA, 20 nt, Artificial Sequence
  MKO10028972_A_Lin37
  gRNA
uuacuuguugugcguaucca

SEQ ID NO: 28973 - RNA, 20 nt, Artificial Sequence
  MKO10028973_A_Lin37
  gRNA
gccuacucacuggaucucug

SEQ ID NO: 28974 - RNA, 20 nt, Artificial Sequence
  MKO10028974_A_Lin37
  gRNA
cugcccgcuucccccaccag

SEQ ID NO: 28975 - RNA, 20 nt, Artificial Sequence
  MKO10028975_A_Lin52
  gRNA
uuugguucuagggacggauu

SEQ ID NO: 28976 - RNA, 20 nt, Artificial Sequence
  MKO10028976_A_Lin52
  gRNA
cgcuguucuggccagagauc

SEQ ID NO: 28977 - RNA, 20 nt, Artificial Sequence
  MKO10028977_A_Lin52
  gRNA
ucuaucucagccauccauuu

SEQ ID NO: 28978 - RNA, 20 nt, Artificial Sequence
  MKO10028978_A_Lin54
  gRNA
aaaaucagcuucgugaucac

SEQ ID NO: 28979 - RNA, 20 nt, Artificial Sequence
  MKO10028979_A_Lin54
  gRNA
accuuugaagucgccaaaua

SEQ ID NO: 28980 - RNA, 20 nt, Artificial Sequence
  MKO10028980_A_Lin54
  gRNA
accuuauuuggcgacuucaa

SEQ ID NO: 28981 - RNA, 20 nt, Artificial Sequence
  MKO10028981_A_Lin7a
  gRNA
ugcaagagcaaucgaacuac

SEQ ID NO: 28982 - RNA, 20 nt, Artificial Sequence
  MKO10028982_A_Lin7a
  gRNA
cuccguucacugauagcagc

SEQ ID NO: 28983 - RNA, 20 nt, Artificial Sequence
  MKO10028983_A_Lin7a
  gRNA
cugcccugaauuccgugcga

SEQ ID NO: 28984 - RNA, 20 nt, Artificial Sequence
  MKO10028984_A_Lin7b
  gRNA
agaagaugcgaucugcccgu

SEQ ID NO: 28985 - RNA, 20 nt, Artificial Sequence
  MKO10028985_A_Lin7b
  gRNA
gaugcucaccucgcggaugg

SEQ ID NO: 28986 - RNA, 20 nt, Artificial Sequence
  MKO10028986_A_Lin7b
  gRNA
uguggcaugagcccgcaccu

SEQ ID NO: 28987 - RNA, 20 nt, Artificial Sequence
  MKO10028987_A_Lin7c
  gRNA
auuauccgcgauauauagau

SEQ ID NO: 28988 - RNA, 20 nt, Artificial Sequence
  MKO10028988_A_Lin7c
  gRNA
acgguacacaccaaaagucu

SEQ ID NO: 28989 - RNA, 20 nt, Artificial Sequence
  MKO10028989_A_Lin7c
  gRNA
acucaccaaucuauauaucg

SEQ ID NO: 28990 - RNA, 20 nt, Artificial Sequence
  MKO10028990_A_Lin9
  gRNA
acuuacucucgucaggcaac

SEQ ID NO: 28991 - RNA, 20 nt, Artificial Sequence
  MKO10028991_A_Lin9
  gRNA
gugggaucauugccacucuc

SEQ ID NO: 28992 - RNA, 20 nt, Artificial Sequence
  MKO10028992_A_Lin9
  gRNA
aaagcccuugucaguuuaaa

SEQ ID NO: 28993 - RNA, 20 nt, Artificial Sequence
  MKO10028993_A_Lingo1
  gRNA
ggagucguugccgccagcau

SEQ ID NO: 28994 - RNA, 20 nt, Artificial Sequence
  MKO10028994_A_Lingo1
  gRNA
cgccgaccuccagcgacuug

SEQ ID NO: 28995 - RNA, 20 nt, Artificial Sequence
  MKO10028995_A_Lingo1
  gRNA
ccuauacaaccucaagucgc

SEQ ID NO: 28996 - RNA, 20 nt, Artificial Sequence
  MKO10028996_A_Lingo2
  gRNA
ucgcgagcaaucgucuucug

SEQ ID NO: 28997 - RNA, 20 nt, Artificial Sequence
  MKO10028997_A_Lingo2
  gRNA
cucugaccugauccgccuac

SEQ ID NO: 28998 - RNA, 20 nt, Artificial Sequence
  MKO10028998_A_Lingo2
  gRNA
cugcguucccuccgccuaaa

SEQ ID NO: 28999 - RNA, 20 nt, Artificial Sequence
  MKO10028999_A_Lingo3
  gRNA
ccgccggaccguccaccuua

SEQ ID NO: 29000 - RNA, 20 nt, Artificial Sequence
  MKO10029000_A_Lingo3
  gRNA
ugaacuugcgcgcaccaccc

SEQ ID NO: 29001 - RNA, 20 nt, Artificial Sequence
  MKO10029001_A_Lingo3
  gRNA
cccugaccaucgcggacacg

SEQ ID NO: 29002 - RNA, 20 nt, Artificial Sequence
  MKO10029002_A_Lingo4
  gRNA
cccgacuuucggaucagggc

SEQ ID NO: 29003 - RNA, 20 nt, Artificial Sequence
  MKO10029003_A_Lingo4
  gRNA
cagcccccugguacggcucc

SEQ ID NO: 29004 - RNA, 20 nt, Artificial Sequence
  MKO10029004_A_Lingo4
  gRNA
ggggcacuuaccggagaagc

SEQ ID NO: 29005 - RNA, 20 nt, Artificial Sequence
  MKO10029005_A_Lins
  gRNA
ugaaacggagacccacgcaa

SEQ ID NO: 29006 - RNA, 20 nt, Artificial Sequence
  MKO10029006_A_Lins
  gRNA
cacgagguggccacccuucc

SEQ ID NO: 29007 - RNA, 20 nt, Artificial Sequence
  MKO10029007_A_Lins
  gRNA
cgaggcacuucgcagccaug

SEQ ID NO: 29008 - RNA, 20 nt, Artificial Sequence
  MKO10029008_A_Lipa
  gRNA
aagcgucccaauugaaguag

SEQ ID NO: 29009 - RNA, 20 nt, Artificial Sequence
  MKO10029009_A_Lipa
  gRNA
agaccgagauaaucaugcgc

SEQ ID NO: 29010 - RNA, 20 nt, Artificial Sequence
  MKO10029010_A_Lipa
  gRNA
aguauucaccgaaucccucg

SEQ ID NO: 29011 - RNA, 20 nt, Artificial Sequence
  MKO10029011_A_Lipc
  gRNA
gcgcacgucucaggguucgc

SEQ ID NO: 29012 - RNA, 20 nt, Artificial Sequence
  MKO10029012_A_Lipc
  gRNA
cacuuccuaccgaccacccg

SEQ ID NO: 29013 - RNA, 20 nt, Artificial Sequence
  MKO10029013_A_Lipc
  gRNA
gggacguucccucaaacaua

SEQ ID NO: 29014 - RNA, 20 nt, Artificial Sequence
  MKO10029014_A_Lipe
  gRNA
gucuauggcgaaucggccac

SEQ ID NO: 29015 - RNA, 20 nt, Artificial Sequence
  MKO10029015_A_Lipe
  gRNA
gaguaugucacgcuacacaa

SEQ ID NO: 29016 - RNA, 20 nt, Artificial Sequence
  MKO10029016_A_Lipe
  gRNA
cugcugaccaucaaccgacc

SEQ ID NO: 29017 - RNA, 20 nt, Artificial Sequence
  MKO10029017_A_Lipf
  gRNA
ggggucuauagaauuccuua

SEQ ID NO: 29018 - RNA, 20 nt, Artificial Sequence
  MKO10029018_A_Lipf
  gRNA
guauacuucacaguagcaac

SEQ ID NO: 29019 - RNA, 20 nt, Artificial Sequence
  MKO10029019_A_Lipf
  gRNA
ccaugcugcaaauaugccac

SEQ ID NO: 29020 - RNA, 20 nt, Artificial Sequence
  MKO10029020_A_Lipg
  gRNA
gcacacguggcuggauacgc

SEQ ID NO: 29021 - RNA, 20 nt, Artificial Sequence
  MKO10029021_A_Lipg
  gRNA
cccggacgaugcagacuuug

SEQ ID NO: 29022 - RNA, 20 nt, Artificial Sequence
  MKO10029022_A_Lipg
  gRNA
uccacaaagucugcaucguc

SEQ ID NO: 29023 - RNA, 20 nt, Artificial Sequence
  MKO10029023_A_Liph
  gRNA
guccacgaacagugcgucgc

SEQ ID NO: 29024 - RNA, 20 nt, Artificial Sequence
  MKO10029024_A_Liph
  gRNA
cuguaccaaccaccgcgcug

SEQ ID NO: 29025 - RNA, 20 nt, Artificial Sequence
  MKO10029025_A_Liph
  gRNA
ggaggucucccguugaauaa

SEQ ID NO: 29026 - RNA, 20 nt, Artificial Sequence
  MKO10029026_A_Lipi
  gRNA
acaugaaagucguagcgccc

SEQ ID NO: 29027 - RNA, 20 nt, Artificial Sequence
  MKO10029027_A_Lipi
  gRNA
acccagcgaagaaaaccguc

SEQ ID NO: 29028 - RNA, 20 nt, Artificial Sequence
  MKO10029028_A_Lipi
  gRNA
uaauauaaucugcuauucga

SEQ ID NO: 29029 - RNA, 20 nt, Artificial Sequence
  MKO10029029_A_Lipk
  gRNA
ccgauagugguuaugacgug

SEQ ID NO: 29030 - RNA, 20 nt, Artificial Sequence
  MKO10029030_A_Lipk
  gRNA
caccuaaaucaccgcaauau

SEQ ID NO: 29031 - RNA, 20 nt, Artificial Sequence
  MKO10029031_A_Lipk
  gRNA
cuaugguggugcccugcgag

SEQ ID NO: 29032 - RNA, 20 nt, Artificial Sequence
  MKO10029032_A_Lipm
  gRNA
uuuaaccgugucuguccccg

SEQ ID NO: 29033 - RNA, 20 nt, Artificial Sequence
  MKO10029033_A_Lipm
  gRNA
cauaccuugaucaucauauc

SEQ ID NO: 29034 - RNA, 20 nt, Artificial Sequence
  MKO10029034_A_Lipm
  gRNA
ggucuugugcuuccgagacc

SEQ ID NO: 29035 - RNA, 20 nt, Artificial Sequence
  MKO10029035_A_Lipn
  gRNA
uugauucuuugcgccaguuc

SEQ ID NO: 29036 - RNA, 20 nt, Artificial Sequence
  MKO10029036_A_Lipn
  gRNA
aaauugguaaaaacgcuugu

SEQ ID NO: 29037 - RNA, 20 nt, Artificial Sequence
  MKO10029037_A_Lipn
  gRNA
uaugacgucaccaccgcaga

SEQ ID NO: 29038 - RNA, 20 nt, Artificial Sequence
  MKO10029038_A_Lipo1
  gRNA
uaccugggcaaagaaacacg

SEQ ID NO: 29039 - RNA, 20 nt, Artificial Sequence
  MKO10029039_A_Lipo1
  gRNA
cauggcuugcuugcaacacc

SEQ ID NO: 29040 - RNA, 20 nt, Artificial Sequence
  MKO10029040_A_Lipo1
  gRNA
agcuaccauuaauuucauuc

SEQ ID NO: 29041 - RNA, 20 nt, Artificial Sequence
  MKO10029041_A_Lipt1
  gRNA
aucgggugccuuaauagcgc

SEQ ID NO: 29042 - RNA, 20 nt, Artificial Sequence
  MKO10029042_A_Lipt1
  gRNA
uaaacugcccgucgaguagc

SEQ ID NO: 29043 - RNA, 20 nt, Artificial Sequence
  MKO10029043_A_Lipt1
  gRNA
aggagccguguaccacgaca

SEQ ID NO: 29044 - RNA, 20 nt, Artificial Sequence
  MKO10029044_A_Lipt2
  gRNA
cgccgcccuacacuggcguc

SEQ ID NO: 29045 - RNA, 20 nt, Artificial Sequence
  MKO10029045_A_Lipt2
  gRNA
gagcgcaagaucugcgcgau

SEQ ID NO: 29046 - RNA, 20 nt, Artificial Sequence
  MKO10029046_A_Lipt2
  gRNA
gucuuugaagcgccucacuc

SEQ ID NO: 29047 - RNA, 20 nt, Artificial Sequence
  MKO10029047_A_Liuaf
  gRNA
guucugcguagacgcccuac

SEQ ID NO: 29048 - RNA, 20 nt, Artificial Sequence
  MKO10029048_A_Liuaf
  gRNA
agacauacuugcguuggcgu

SEQ ID NO: 29049 - RNA, 20 nt, Artificial Sequence
  MKO10029049_A_Liuaf
  gRNA
acaggcuggguguaguacga

SEQ ID NO: 29050 - RNA, 20 nt, Artificial Sequence
  MKO10029050_A_Lix1l
  gRNA
ugacuugaagaacggggcuc

SEQ ID NO: 29051 - RNA, 20 nt, Artificial Sequence
  MKO10029051_A_Lix1l
  gRNA
aaggcaccaauccccguauu

SEQ ID NO: 29052 - RNA, 20 nt, Artificial Sequence
  MKO10029052_A_Lix1l
  gRNA
caaucuuugcagcacuucgc

SEQ ID NO: 29053 - RNA, 20 nt, Artificial Sequence
  MKO10029053_A_Lix1
  gRNA
caggcgggaugcugcuaaag

SEQ ID NO: 29054 - RNA, 20 nt, Artificial Sequence
  MKO10029054_A_Lix1
  gRNA
cacuuuagcagcaucccgcc

SEQ ID NO: 29055 - RNA, 20 nt, Artificial Sequence
  MKO10029055_A_Lix1
  gRNA
gaauguugugucaauguuac

SEQ ID NO: 29056 - RNA, 20 nt, Artificial Sequence
  MKO10029056_A_Llgl1
  gRNA
ugcuuaagcuucucgcgcug

SEQ ID NO: 29057 - RNA, 20 nt, Artificial Sequence
  MKO10029057_A_Llgl1
  gRNA
cgguggcugcgucccgaugu

SEQ ID NO: 29058 - RNA, 20 nt, Artificial Sequence
  MKO10029058_A_Llgl1
  gRNA
gcagcgcgagaagcuuaagc

SEQ ID NO: 29059 - RNA, 20 nt, Artificial Sequence
  MKO10029059_A_Llgl2
  gRNA
uagcccuucgcugcgcaucc

SEQ ID NO: 29060 - RNA, 20 nt, Artificial Sequence
  MKO10029060_A_Llgl2
  gRNA
cgcugcucaccugaccaggc

SEQ ID NO: 29061 - RNA, 20 nt, Artificial Sequence
  MKO10029061_A_Llgl2
  gRNA
gcauccuuaccuuguuaaac

SEQ ID NO: 29062 - RNA, 20 nt, Artificial Sequence
  MKO10029062_A_Llph
  gRNA
uaauuuagaugacaugaaaa

SEQ ID NO: 29063 - RNA, 20 nt, Artificial Sequence
  MKO10029063_A_Llph
  gRNA
gaagcauggcuaaaagccug

SEQ ID NO: 29064 - RNA, 20 nt, Artificial Sequence
  MKO10029064_A_Llph
  gRNA
gagcauccccguccacucug

SEQ ID NO: 29065 - RNA, 20 nt, Artificial Sequence
  MKO10029065_A_Lman1l
  gRNA
ggccauuccccuuccgagcu

SEQ ID NO: 29066 - RNA, 20 nt, Artificial Sequence
  MKO10029066_A_Lman1l
  gRNA
gaucccgaugccaucccaug

SEQ ID NO: 29067 - RNA, 20 nt, Artificial Sequence
  MKO10029067_A_Lman1l
  gRNA
gcuacccaccuggacaucac

SEQ ID NO: 29068 - RNA, 20 nt, Artificial Sequence
  MKO10029068_A_Lman1
  gRNA
uacguaaucuuugcccggac

SEQ ID NO: 29069 - RNA, 20 nt, Artificial Sequence
  MKO10029069_A_Lman1
  gRNA
acaacucgcuaaagcuugag

SEQ ID NO: 29070 - RNA, 20 nt, Artificial Sequence
  MKO10029070_A_Lman1
  gRNA
agaggucgaauuggagccga

SEQ ID NO: 29071 - RNA, 20 nt, Artificial Sequence
  MKO10029071_A_Lman2l
  gRNA
cccucagcuaugaucacgag

SEQ ID NO: 29072 - RNA, 20 nt, Artificial Sequence
  MKO10029072_A_Lman2l
  gRNA
gaacaagcaguucuucgcua

SEQ ID NO: 29073 - RNA, 20 nt, Artificial Sequence
  MKO10029073_A_Lman2l
  gRNA
aggugucauaacggauauuu

SEQ ID NO: 29074 - RNA, 20 nt, Artificial Sequence
  MKO10029074_A_Lman2
  gRNA
acccgagaccgccucguacc

SEQ ID NO: 29075 - RNA, 20 nt, Artificial Sequence
  MKO10029075_A_Lman2
  gRNA
ucguacgaucauagcaaaga

SEQ ID NO: 29076 - RNA, 20 nt, Artificial Sequence
  MKO10029076_A_Lman2
  gRNA
gcagcaaagagggcucgauc

SEQ ID NO: 29077 - RNA, 20 nt, Artificial Sequence
  MKO10029077_A_Lmbr1l
  gRNA
gcaggaguaagacggcgccc

SEQ ID NO: 29078 - RNA, 20 nt, Artificial Sequence
  MKO10029078_A_Lmbr1l
  gRNA
cacuggauguaguaguugcg

SEQ ID NO: 29079 - RNA, 20 nt, Artificial Sequence
  MKO10029079_A_Lmbr1l
  gRNA
ucacgcaaucuuguuaacug

SEQ ID NO: 29080 - RNA, 20 nt, Artificial Sequence
  MKO10029080_A_Lmbr1
  gRNA
uguauacuaaccguggauga

SEQ ID NO: 29081 - RNA, 20 nt, Artificial Sequence
  MKO10029081_A_Lmbr1
  gRNA
caaaaccgcgccagcugaca

SEQ ID NO: 29082 - RNA, 20 nt, Artificial Sequence
  MKO10029082_A_Lmbr1
  gRNA
guaucuuauaaugaugaagu

SEQ ID NO: 29083 - RNA, 20 nt, Artificial Sequence
  MKO10029083_A_Lmbrd1
  gRNA
ccgaacguagacccagcaaa

SEQ ID NO: 29084 - RNA, 20 nt, Artificial Sequence
  MKO10029084_A_Lmbrd1
  gRNA
auugagaauaccguucugua

SEQ ID NO: 29085 - RNA, 20 nt, Artificial Sequence
  MKO10029085_A_Lmbrd1
  gRNA
cucaaucuguacggugacau

SEQ ID NO: 29086 - RNA, 20 nt, Artificial Sequence
  MKO10029086_A_Lmbrd2
  gRNA
ugcauccagucccguaacgu

SEQ ID NO: 29087 - RNA, 20 nt, Artificial Sequence
  MKO10029087_A_Lmbrd2
  gRNA
caaguaagugccguaauaga

SEQ ID NO: 29088 - RNA, 20 nt, Artificial Sequence
  MKO10029088_A_Lmbrd2
  gRNA
agcauccauguuucaagccg

SEQ ID NO: 29089 - RNA, 20 nt, Artificial Sequence
  MKO10029089_A_Lmcd1
  gRNA
ggggucuuugccgguggcga

SEQ ID NO: 29090 - RNA, 20 nt, Artificial Sequence
  MKO10029090_A_Lmcd1
  gRNA
uugacacuaucaccuacgag

SEQ ID NO: 29091 - RNA, 20 nt, Artificial Sequence
  MKO10029091_A_Lmcd1
  gRNA
ccggcuucgagccucacucg

SEQ ID NO: 29092 - RNA, 20 nt, Artificial Sequence
  MKO10029092_A_Lmf1
  gRNA
agaucugcccuacguugacc

SEQ ID NO: 29093 - RNA, 20 nt, Artificial Sequence
  MKO10029093_A_Lmf1
  gRNA
uacaugucccuggucaacgu

SEQ ID NO: 29094 - RNA, 20 nt, Artificial Sequence
  MKO10029094_A_Lmf1
  gRNA
ccgcggggacaagugcuggc

SEQ ID NO: 29095 - RNA, 20 nt, Artificial Sequence
  MKO10029095_A_Lmf2
  gRNA
guaagucguaggcggcgaau

SEQ ID NO: 29096 - RNA, 20 nt, Artificial Sequence
  MKO10029096_A_Lmf2
  gRNA
guggcacugcgaucucgaug

SEQ ID NO: 29097 - RNA, 20 nt, Artificial Sequence
  MKO10029097_A_Lmf2
  gRNA
uuucgacucauguucgccuc

SEQ ID NO: 29098 - RNA, 20 nt, Artificial Sequence
  MKO10029098_A_Lmln
  gRNA
cacuauaacaggcccgcacu

SEQ ID NO: 29099 - RNA, 20 nt, Artificial Sequence
  MKO10029099_A_Lmln
  gRNA
gugcgacaaaccaguaccua

SEQ ID NO: 29100 - RNA, 20 nt, Artificial Sequence
  MKO10029100_A_Lmln
  gRNA
cuggcaggaucuuacuuagc

SEQ ID NO: 29101 - RNA, 20 nt, Artificial Sequence
  MKO10029101_A_Lmna
  gRNA
ccacaagccgcgucucaugc

SEQ ID NO: 29102 - RNA, 20 nt, Artificial Sequence
  MKO10029102_A_Lmna
  gRNA
cggcuuguggagaucgauaa

SEQ ID NO: 29103 - RNA, 20 nt, Artificial Sequence
  MKO10029103_A_Lmna
  gRNA
gggggacuuguuggcugcgc

SEQ ID NO: 29104 - RNA, 20 nt, Artificial Sequence
  MKO10029104_A_Lmnb1
  gRNA
gaucaagcuucgagaguaug

SEQ ID NO: 29105 - RNA, 20 nt, Artificial Sequence
  MKO10029105_A_Lmnb1
  gRNA
agcagcacgacgcgcaggug

SEQ ID NO: 29106 - RNA, 20 nt, Artificial Sequence
  MKO10029106_A_Lmnb1
  gRNA
gaagcaugagacccgcuugg

SEQ ID NO: 29107 - RNA, 20 nt, Artificial Sequence
  MKO10029107_A_Lmnb2
  gRNA
ccgacggguacuggaugaga

SEQ ID NO: 29108 - RNA, 20 nt, Artificial Sequence
  MKO10029108_A_Lmnb2
  gRNA
ccgucucauccaguacccgu

SEQ ID NO: 29109 - RNA, 20 nt, Artificial Sequence
  MKO10029109_A_Lmnb2
  gRNA
gcacgagcggcgcuuggugg

SEQ ID NO: 29110 - RNA, 20 nt, Artificial Sequence
  MKO10029110_A_Lmo1
  gRNA
gaugcucuccguccaaccua

SEQ ID NO: 29111 - RNA, 20 nt, Artificial Sequence
  MKO10029111_A_Lmo1
  gRNA
ugugccggcgugacuaccug

SEQ ID NO: 29112 - RNA, 20 nt, Artificial Sequence
  MKO10029112_A_Lmo1
  gRNA
auggugggcguuacugaacc

SEQ ID NO: 29113 - RNA, 20 nt, Artificial Sequence
  MKO10029113_A_Lmo2
  gRNA
cggcgcauuugaaacacucc

SEQ ID NO: 29114 - RNA, 20 nt, Artificial Sequence
  MKO10029114_A_Lmo2
  gRNA
caauguccucggccaucgaa

SEQ ID NO: 29115 - RNA, 20 nt, Artificial Sequence
  MKO10029115_A_Lmo2
  gRNA
ugaaagccaucgaccaguac

SEQ ID NO: 29116 - RNA, 20 nt, Artificial Sequence
  MKO10029116_A_Lmo3
  gRNA
gggcuccaccuuguacacga

SEQ ID NO: 29117 - RNA, 20 nt, Artificial Sequence
  MKO10029117_A_Lmo3
  gRNA
ucagauagucucugcgacaa

SEQ ID NO: 29118 - RNA, 20 nt, Artificial Sequence
  MKO10029118_A_Lmo3
  gRNA
caggugguacacauuauccu

SEQ ID NO: 29119 - RNA, 20 nt, Artificial Sequence
  MKO10029119_A_Lmo4
  gRNA
ugacggccggcucccucucc

SEQ ID NO: 29120 - RNA, 20 nt, Artificial Sequence
  MKO10029120_A_Lmo4
  gRNA
agagggagccggccgucacc

SEQ ID NO: 29121 - RNA, 20 nt, Artificial Sequence
  MKO10029121_A_Lmo4
  gRNA
aucgccuggucccgggagau

SEQ ID NO: 29122 - RNA, 20 nt, Artificial Sequence
  MKO10029122_A_Lmo7
  gRNA
uugaucuucuuaacgacgcc

SEQ ID NO: 29123 - RNA, 20 nt, Artificial Sequence
  MKO10029123_A_Lmo7
  gRNA
agacuuacuugacggugacu

SEQ ID NO: 29124 - RNA, 20 nt, Artificial Sequence
  MKO10029124_A_Lmo7
  gRNA
agacugucuaccccaauagc

SEQ ID NO: 29125 - RNA, 20 nt, Artificial Sequence
  MKO10029125_A_Lmod1
  gRNA
gaagcggaccaggaucucgu

SEQ ID NO: 29126 - RNA, 20 nt, Artificial Sequence
  MKO10029126_A_Lmod1
  gRNA
caaucugcucagccgaaaca

SEQ ID NO: 29127 - RNA, 20 nt, Artificial Sequence
  MKO10029127_A_Lmod1
  gRNA
agcccucgggcucauucaac

SEQ ID NO: 29128 - RNA, 20 nt, Artificial Sequence
  MKO10029128_A_Lmod2
  gRNA
gccgggaccaugucuacguu

SEQ ID NO: 29129 - RNA, 20 nt, Artificial Sequence
  MKO10029129_A_Lmod2
  gRNA
gcacauuaccagcguaaacg

SEQ ID NO: 29130 - RNA, 20 nt, Artificial Sequence
  MKO10029130_A_Lmod2
  gRNA
gagagcccaugaugugccgc

SEQ ID NO: 29131 - RNA, 20 nt, Artificial Sequence
  MKO10029131_A_Lmod3
  gRNA
gcucucaucagcaccgacgu

SEQ ID NO: 29132 - RNA, 20 nt, Artificial Sequence
  MKO10029132_A_Lmod3
  gRNA
ggcggccuauuucucggcac

SEQ ID NO: 29133 - RNA, 20 nt, Artificial Sequence
  MKO10029133_A_Lmod3
  gRNA
aaacuaugucggggcacagc

SEQ ID NO: 29134 - RNA, 20 nt, Artificial Sequence
  MKO10029134_A_Lmtk2
  gRNA
cgucgcgagagucauaguga

SEQ ID NO: 29135 - RNA, 20 nt, Artificial Sequence
  MKO10029135_A_Lmtk2
  gRNA
cacuaugacucucgcgacgc

SEQ ID NO: 29136 - RNA, 20 nt, Artificial Sequence
  MKO10029136_A_Lmtk2
  gRNA
ucaauaaacugcacaccgac

SEQ ID NO: 29137 - RNA, 20 nt, Artificial Sequence
  MKO10029137_A_Lmtk3
  gRNA
acagcgcaaguucaucuccg

SEQ ID NO: 29138 - RNA, 20 nt, Artificial Sequence
  MKO10029138_A_Lmtk3
  gRNA
uuuggcuccgcccuacgcug

SEQ ID NO: 29139 - RNA, 20 nt, Artificial Sequence
  MKO10029139_A_Lmtk3
  gRNA
augaggaccacagcguaggg

SEQ ID NO: 29140 - RNA, 20 nt, Artificial Sequence
  MKO10029140_A_Lmx1a
  gRNA
gucagcgggucaucucggac

SEQ ID NO: 29141 - RNA, 20 nt, Artificial Sequence
  MKO10029141_A_Lmx1a
  gRNA
ugcggcucaacgacagcuuc

SEQ ID NO: 29142 - RNA, 20 nt, Artificial Sequence
  MKO10029142_A_Lmx1a
  gRNA
cuuggaggauacuucaaacg

SEQ ID NO: 29143 - RNA, 20 nt, Artificial Sequence
  MKO10029143_A_Lmx1b
  gRNA
acgacucguugacucgcauc

SEQ ID NO: 29144 - RNA, 20 nt, Artificial Sequence
  MKO10029144_A_Lmx1b
  gRNA
ccccuaccgaguucgucaug

SEQ ID NO: 29145 - RNA, 20 nt, Artificial Sequence
  MKO10029145_A_Lmx1b
  gRNA
cccucgcagacggcgggaug

SEQ ID NO: 29146 - RNA, 20 nt, Artificial Sequence
  MKO10029146_A_Lnpep
  gRNA
acaaaucgccguuguugccc

SEQ ID NO: 29147 - RNA, 20 nt, Artificial Sequence
  MKO10029147_A_Lnpep
  gRNA
acuuucccguuuguagcaac

SEQ ID NO: 29148 - RNA, 20 nt, Artificial Sequence
  MKO10029148_A_Lnpep
  gRNA
gcauauuugauaacgcagua

SEQ ID NO: 29149 - RNA, 20 nt, Artificial Sequence
  MKO10029149_A_Lnp
  gRNA
ucuagaacuucuacuguuga

SEQ ID NO: 29150 - RNA, 20 nt, Artificial Sequence
  MKO10029150_A_Lnp
  gRNA
aucagagauugcaaaaauua

SEQ ID NO: 29151 - RNA, 20 nt, Artificial Sequence
  MKO10029151_A_Lnp
  gRNA
ccacaaguacacaauuaaac

SEQ ID NO: 29152 - RNA, 20 nt, Artificial Sequence
  MKO10029152_A_Lnx1
  gRNA
ucgaaggucaugcccguuga

SEQ ID NO: 29153 - RNA, 20 nt, Artificial Sequence
  MKO10029153_A_Lnx1
  gRNA
cgccgaccgacacggccagc

SEQ ID NO: 29154 - RNA, 20 nt, Artificial Sequence
  MKO10029154_A_Lnx1
  gRNA
auccagcauauuuaucgcga

SEQ ID NO: 29155 - RNA, 20 nt, Artificial Sequence
  MKO10029155_A_Lnx2
  gRNA
gugcccgagcaguccguuuc

SEQ ID NO: 29156 - RNA, 20 nt, Artificial Sequence
  MKO10029156_A_Lnx2
  gRNA
ccuggacaaccccgccuucg

SEQ ID NO: 29157 - RNA, 20 nt, Artificial Sequence
  MKO10029157_A_Lnx2
  gRNA
cggcagcgcgccacgggacg

SEQ ID NO: 29158 - RNA, 20 nt, Artificial Sequence
  MKO10029158_A_Loh12cr1
  gRNA
cccggcgaucugaacgccuc

SEQ ID NO: 29159 - RNA, 20 nt, Artificial Sequence
  MKO10029159_A_Loh12cr1
  gRNA
ggccaagauggacgauaucg

SEQ ID NO: 29160 - RNA, 20 nt, Artificial Sequence
  MKO10029160_A_Loh12cr1
  gRNA
accugaggcguucagaucgc

SEQ ID NO: 29161 - RNA, 20 nt, Artificial Sequence
  MKO10029161_A_Lonp1
  gRNA
caaggcgaugauaucccgaa

SEQ ID NO: 29162 - RNA, 20 nt, Artificial Sequence
  MKO10029162_A_Lonp1
  gRNA
cgacuugcacagcccuaugu

SEQ ID NO: 29163 - RNA, 20 nt, Artificial Sequence
  MKO10029163_A_Lonp1
  gRNA
aaguugcgaaugauugucac

SEQ ID NO: 29164 - RNA, 20 nt, Artificial Sequence
  MKO10029164_A_Lonp2
  gRNA
aagccauugaugauacgacc

SEQ ID NO: 29165 - RNA, 20 nt, Artificial Sequence
  MKO10029165_A_Lonp2
  gRNA
cuccaucagccacauccgaa

SEQ ID NO: 29166 - RNA, 20 nt, Artificial Sequence
  MKO10029166_A_Lonp2
  gRNA
gcuugucaaccucauccaau

SEQ ID NO: 29167 - RNA, 20 nt, Artificial Sequence
  MKO10029167_A_Lonrf1
  gRNA
cggcuuaagcuuccuuugac

SEQ ID NO: 29168 - RNA, 20 nt, Artificial Sequence
  MKO10029168_A_Lonrf1
  gRNA
agaacccuuacuguccgccc

SEQ ID NO: 29169 - RNA, 20 nt, Artificial Sequence
  MKO10029169_A_Lonrf1
  gRNA
cgccuuaaacuccugcaggc

SEQ ID NO: 29170 - RNA, 20 nt, Artificial Sequence
  MKO10029170_A_Lonrf2
  gRNA
gucgcaucgauugugaacuc

SEQ ID NO: 29171 - RNA, 20 nt, Artificial Sequence
  MKO10029171_A_Lonrf2
  gRNA
gacgaauccccaguauccuc

SEQ ID NO: 29172 - RNA, 20 nt, Artificial Sequence
  MKO10029172_A_Lonrf2
  gRNA
uucuucgccgaguugcacuc

SEQ ID NO: 29173 - RNA, 20 nt, Artificial Sequence
  MKO10029173_A_Lonrf3
  gRNA
accauuugcuuuauagcaau

SEQ ID NO: 29174 - RNA, 20 nt, Artificial Sequence
  MKO10029174_A_Lonrf3
  gRNA
accgauugcuauaaagcaaa

SEQ ID NO: 29175 - RNA, 20 nt, Artificial Sequence
  MKO10029175_A_Lonrf3
  gRNA
ccuaauaaagucuccaaaca

SEQ ID NO: 29176 - RNA, 20 nt, Artificial Sequence
  MKO10029176_A_Lor
  gRNA
uccugauccgccuccgcagc

SEQ ID NO: 29177 - RNA, 20 nt, Artificial Sequence
  MKO10029177_A_Lor
  gRNA
ggcggcuauuauagcggugg

SEQ ID NO: 29178 - RNA, 20 nt, Artificial Sequence
  MKO10029178_A_Lor
  gRNA
accagaguacuugccgccuc

SEQ ID NO: 29179 - RNA, 20 nt, Artificial Sequence
  MKO10029179_A_Loxhd1
  gRNA
aagccaacguugacguauuc

SEQ ID NO: 29180 - RNA, 20 nt, Artificial Sequence
  MKO10029180_A_Loxhd1
  gRNA
ccacguuauugguucgcacc

SEQ ID NO: 29181 - RNA, 20 nt, Artificial Sequence
  MKO10029181_A_Loxhd1
  gRNA
acagccacaggggauguucg

SEQ ID NO: 29182 - RNA, 20 nt, Artificial Sequence
  MKO10029182_A_Loxl1
  gRNA
gccugcacguaguuaggguc

SEQ ID NO: 29183 - RNA, 20 nt, Artificial Sequence
  MKO10029183_A_Loxl1
  gRNA
cuccuugcgaugcgcagcag

SEQ ID NO: 29184 - RNA, 20 nt, Artificial Sequence
  MKO10029184_A_Loxl1
  gRNA
cuugagguugccgaagucac

SEQ ID NO: 29185 - RNA, 20 nt, Artificial Sequence
  MKO10029185_A_Loxl2
  gRNA
gaauugucaaauuugaagcc

SEQ ID NO: 29186 - RNA, 20 nt, Artificial Sequence
  MKO10029186_A_Loxl2
  gRNA
cugugcaggccccaucuggu

SEQ ID NO: 29187 - RNA, 20 nt, Artificial Sequence
  MKO10029187_A_Loxl2
  gRNA
ccccucuuacuuauaggcuu

SEQ ID NO: 29188 - RNA, 20 nt, Artificial Sequence
  MKO10029188_A_Loxl3
  gRNA
acaggcucgugugcgucuaa

SEQ ID NO: 29189 - RNA, 20 nt, Artificial Sequence
  MKO10029189_A_Loxl3
  gRNA
gugugacagaaugcgccucu

SEQ ID NO: 29190 - RNA, 20 nt, Artificial Sequence
  MKO10029190_A_Loxl3
  gRNA
ugcaaggaccagcgccuucc

SEQ ID NO: 29191 - RNA, 20 nt, Artificial Sequence
  MKO10029191_A_Loxl4
  gRNA
aaguacgguacgacggccac

SEQ ID NO: 29192 - RNA, 20 nt, Artificial Sequence
  MKO10029192_A_Loxl4
  gRNA
gcagggccggcggcuagaag

SEQ ID NO: 29193 - RNA, 20 nt, Artificial Sequence
  MKO10029193_A_Loxl4
  gRNA
uacuguggccugccgacagc

SEQ ID NO: 29194 - RNA, 20 nt, Artificial Sequence
  MKO10029194_A_Lox
  gRNA
aucuuuaggucucccggacc

SEQ ID NO: 29195 - RNA, 20 nt, Artificial Sequence
  MKO10029195_A_Lox
  gRNA
guacaaccugagaugcgcug

SEQ ID NO: 29196 - RNA, 20 nt, Artificial Sequence
  MKO10029196_A_Lox
  gRNA
gcauaggugucauaacaucc

SEQ ID NO: 29197 - RNA, 20 nt, Artificial Sequence
  MKO10029197_A_Lpar1
  gRNA
cagcgcaacgagaacccuaa

SEQ ID NO: 29198 - RNA, 20 nt, Artificial Sequence
  MKO10029198_A_Lpar1
  gRNA
cccacuccgguuauaaaaga

SEQ ID NO: 29199 - RNA, 20 nt, Artificial Sequence
  MKO10029199_A_Lpar1
  gRNA
cugcccgcagugcgaugucc

SEQ ID NO: 29200 - RNA, 20 nt, Artificial Sequence
  MKO10029200_A_Lpar2
  gRNA
cuuggacaguugcucacgca

SEQ ID NO: 29201 - RNA, 20 nt, Artificial Sequence
  MKO10029201_A_Lpar2
  gRNA
ugaguguggucucucgguag

SEQ ID NO: 29202 - RNA, 20 nt, Artificial Sequence
  MKO10029202_A_Lpar2
  gRNA
cuguaaguccugcaacguuc

SEQ ID NO: 29203 - RNA, 20 nt, Artificial Sequence
  MKO10029203_A_Lpar3
  gRNA
aaacguugaccgucaaccgc

SEQ ID NO: 29204 - RNA, 20 nt, Artificial Sequence
  MKO10029204_A_Lpar3
  gRNA
caggaacacguaagcgauuc

SEQ ID NO: 29205 - RNA, 20 nt, Artificial Sequence
  MKO10029205_A_Lpar3
  gRNA
cgagacgggcagccaguacc

SEQ ID NO: 29206 - RNA, 20 nt, Artificial Sequence
  MKO10029206_A_Lpar4
  gRNA
ccuuccgaucgcguaccauc

SEQ ID NO: 29207 - RNA, 20 nt, Artificial Sequence
  MKO10029207_A_Lpar4
  gRNA
uuuacaacuuuaaucgccac

SEQ ID NO: 29208 - RNA, 20 nt, Artificial Sequence
  MKO10029208_A_Lpar4
  gRNA
aauuccgccauugugugcgc

SEQ ID NO: 29209 - RNA, 20 nt, Artificial Sequence
  MKO10029209_A_Lpar5
  gRNA
ggccggcgccaacugcgugc

SEQ ID NO: 29210 - RNA, 20 nt, Artificial Sequence
  MKO10029210_A_Lpar5
  gRNA
aguguacgcgcaguacacgc

SEQ ID NO: 29211 - RNA, 20 nt, Artificial Sequence
  MKO10029211_A_Lpar5
  gRNA
ccguaacacccuucgcaacc

SEQ ID NO: 29212 - RNA, 20 nt, Artificial Sequence
  MKO10029212_A_Lpar6
  gRNA
uaucaguguagaucgauuuc

SEQ ID NO: 29213 - RNA, 20 nt, Artificial Sequence
  MKO10029213_A_Lpar6
  gRNA
gaacguaacuuguucuagua

SEQ ID NO: 29214 - RNA, 20 nt, Artificial Sequence
  MKO10029214_A_Lpar6
  gRNA
cccguacagaguguacuuaa

SEQ ID NO: 29215 - RNA, 20 nt, Artificial Sequence
  MKO10029215_A_Lpcau1
  gRNA
cguugacgcuguuccccauc

SEQ ID NO: 29216 - RNA, 20 nt, Artificial Sequence
  MKO10029216_A_Lpcau1
  gRNA
cugucuuccuucgcgagucc

SEQ ID NO: 29217 - RNA, 20 nt, Artificial Sequence
  MKO10029217_A_Lpcau1
  gRNA
ucagagcgggacacgaacac

SEQ ID NO: 29218 - RNA, 20 nt, Artificial Sequence
  MKO10029218_A_Lpcau2b
  gRNA
agaccgcaaacgaagcauau

SEQ ID NO: 29219 - RNA, 20 nt, Artificial Sequence
  MKO10029219_A_Lpcau2b
  gRNA
cggguagucuuucuagaauu

SEQ ID NO: 29220 - RNA, 20 nt, Artificial Sequence
  MKO10029220_A_Lpcau2b
  gRNA
ugaugcaaucgccguuguug

SEQ ID NO: 29221 - RNA, 20 nt, Artificial Sequence
  MKO10029221_A_Lpcau2
  gRNA
ggcaauuccgucgaagaacg

SEQ ID NO: 29222 - RNA, 20 nt, Artificial Sequence
  MKO10029222_A_Lpcau2
  gRNA
aucaaaaagcgagcgacauc

SEQ ID NO: 29223 - RNA, 20 nt, Artificial Sequence
  MKO10029223_A_Lpcau2
  gRNA
ccucauuccacguucuucga

SEQ ID NO: 29224 - RNA, 20 nt, Artificial Sequence
  MKO10029224_A_Lpcau3
  gRNA
ccggugacuacgauaucaag

SEQ ID NO: 29225 - RNA, 20 nt, Artificial Sequence
  MKO10029225_A_Lpcau3
  gRNA
uaauaacggcagugacggug

SEQ ID NO: 29226 - RNA, 20 nt, Artificial Sequence
  MKO10029226_A_Lpcau3
  gRNA
cucccaucuaggcuacccgu

SEQ ID NO: 29227 - RNA, 20 nt, Artificial Sequence
  MKO10029227_A_Lpcau4
  gRNA
ccccgccucucggcgcagag

SEQ ID NO: 29228 - RNA, 20 nt, Artificial Sequence
  MKO10029228_A_Lpcau4
  gRNA
cucaaccacucugcgccgag

SEQ ID NO: 29229 - RNA, 20 nt, Artificial Sequence
  MKO10029229_A_Lpcau4
  gRNA
uuggggccagcaguaccccc

SEQ ID NO: 29230 - RNA, 20 nt, Artificial Sequence
  MKO10029230_A_Lpgau1
  gRNA
uguaagaauggccgugaccg

SEQ ID NO: 29231 - RNA, 20 nt, Artificial Sequence
  MKO10029231_A_Lpgau1
  gRNA
uuaccgguccuuuauccugu

SEQ ID NO: 29232 - RNA, 20 nt, Artificial Sequence
  MKO10029232_A_Lpgau1
  gRNA
cuaccgcgaccaacagcugc

SEQ ID NO: 29233 - RNA, 20 nt, Artificial Sequence
  MKO10029233_A_Lphn1
  gRNA
caacaccaaugcgaaccgug

SEQ ID NO: 29234 - RNA, 20 nt, Artificial Sequence
  MKO10029234_A_Lphn1
  gRNA
ucccauuuggguugaugcgc

SEQ ID NO: 29235 - RNA, 20 nt, Artificial Sequence
  MKO10029235_A_Lphn1
  gRNA
auggugcaaggacccgcugc

SEQ ID NO: 29236 - RNA, 20 nt, Artificial Sequence
  MKO10029236_A_Lphn2
  gRNA
gaacguccacguacucgccc

SEQ ID NO: 29237 - RNA, 20 nt, Artificial Sequence
  MKO10029237_A_Lphn2
  gRNA
ucuacaacacgcgacuaagc

SEQ ID NO: 29238 - RNA, 20 nt, Artificial Sequence
  MKO10029238_A_Lphn2
  gRNA
ucucgucuaacuaacccgaa

SEQ ID NO: 29239 - RNA, 20 nt, Artificial Sequence
  MKO10029239_A_Lphn3
  gRNA
gagcgcucaacggcucaucg

SEQ ID NO: 29240 - RNA, 20 nt, Artificial Sequence
  MKO10029240_A_Lphn3
  gRNA
augaucgagagcgccaacua

SEQ ID NO: 29241 - RNA, 20 nt, Artificial Sequence
  MKO10029241_A_Lphn3
  gRNA
gccguugagcgcucugccgc

SEQ ID NO: 29242 - RNA, 20 nt, Artificial Sequence
  MKO10029242_A_Lpin1
  gRNA
gucgaugcaucccgacagcg

SEQ ID NO: 29243 - RNA, 20 nt, Artificial Sequence
  MKO10029243_A_Lpin1
  gRNA
gaccauucucuguccgaacu

SEQ ID NO: 29244 - RNA, 20 nt, Artificial Sequence
  MKO10029244_A_Lpin1
  gRNA
acugaaccccgccacgcugu

SEQ ID NO: 29245 - RNA, 20 nt, Artificial Sequence
  MKO10029245_A_Lpin2
  gRNA
uucccgaagcguacgugaaa

SEQ ID NO: 29246 - RNA, 20 nt, Artificial Sequence
  MKO10029246_A_Lpin2
  gRNA
aucgaugcauccagacaacg

SEQ ID NO: 29247 - RNA, 20 nt, Artificial Sequence
  MKO10029247_A_Lpin2
  gRNA
aggauacucacguuucuaau

SEQ ID NO: 29248 - RNA, 20 nt, Artificial Sequence
  MKO10029248_A_Lpin3
  gRNA
guacacucgccaucggagua

SEQ ID NO: 29249 - RNA, 20 nt, Artificial Sequence
  MKO10029249_A_Lpin3
  gRNA
ccugagggccuagucauuac

SEQ ID NO: 29250 - RNA, 20 nt, Artificial Sequence
  MKO10029250_A_Lpin3
  gRNA
uauguccuuaggcugcgaug

SEQ ID NO: 29251 - RNA, 20 nt, Artificial Sequence
  MKO10029251_A_Lpl
  gRNA
cuagacaacguccaccucuu

SEQ ID NO: 29252 - RNA, 20 nt, Artificial Sequence
  MKO10029252_A_Lpl
  gRNA
ucuacaaaaucagcgucauc

SEQ ID NO: 29253 - RNA, 20 nt, Artificial Sequence
  MKO10029253_A_Lpl
  gRNA
gggucaccuggucgaaguau

SEQ ID NO: 29254 - RNA, 20 nt, Artificial Sequence
  MKO10029254_A_Lpo
  gRNA
cugcccgcagaauacgagga

SEQ ID NO: 29255 - RNA, 20 nt, Artificial Sequence
  MKO10029255_A_Lpo
  gRNA
gagcccguccucguauucug

SEQ ID NO: 29256 - RNA, 20 nt, Artificial Sequence
  MKO10029256_A_Lpo
  gRNA
ggcugugcguguccggccuu

SEQ ID NO: 29257 - RNA, 20 nt, Artificial Sequence
  MKO10029257_A_Lpp
  gRNA
gcguaugccccuccugcaag

SEQ ID NO: 29258 - RNA, 20 nt, Artificial Sequence
  MKO10029258_A_Lpp
  gRNA
ccacccgcugacgauuacuu

SEQ ID NO: 29259 - RNA, 20 nt, Artificial Sequence
  MKO10029259_A_Lpp
  gRNA
gcuacgguggcacaucacgc

SEQ ID NO: 29260 - RNA, 20 nt, Artificial Sequence
  MKO10029260_A_Lpxn
  gRNA
uguguuacccugcgaugaca

SEQ ID NO: 29261 - RNA, 20 nt, Artificial Sequence
  MKO10029261_A_Lpxn
  gRNA
auuggaacgcugcaccuuuc

SEQ ID NO: 29262 - RNA, 20 nt, Artificial Sequence
  MKO10029262_A_Lpxn
  gRNA
cguguaugcaaccaauaucc

SEQ ID NO: 29263 - RNA, 20 nt, Artificial Sequence
  MKO10029263_A_Lrau
  gRNA
gcucuuuagcgugagcgucc

SEQ ID NO: 29264 - RNA, 20 nt, Artificial Sequence
  MKO10029264_A_Lrau
  gRNA
cccccagguagaucccauag

SEQ ID NO: 29265 - RNA, 20 nt, Artificial Sequence
  MKO10029265_A_Lrau
  gRNA
gaagggucauauaugaugcc

SEQ ID NO: 29266 - RNA, 20 nt, Artificial Sequence
  MKO10029266_A_Lrba
  gRNA
agaucuucucguugacaugu

SEQ ID NO: 29267 - RNA, 20 nt, Artificial Sequence
  MKO10029267_A_Lrba
  gRNA
gcgucaggaccguacuucug

SEQ ID NO: 29268 - RNA, 20 nt, Artificial Sequence
  MKO10029268_A_Lrba
  gRNA
ucuaacugucaaauuauagc

SEQ ID NO: 29269 - RNA, 20 nt, Artificial Sequence
  MKO10029269_A_Lrch1
  gRNA
cagauccucaccugcgccgg

SEQ ID NO: 29270 - RNA, 20 nt, Artificial Sequence
  MKO10029270_A_Lrch1
  gRNA
ugugaguugcaacgagauca

SEQ ID NO: 29271 - RNA, 20 nt, Artificial Sequence
  MKO10029271_A_Lrch1
  gRNA
gaucaccagcaccuuguugc

SEQ ID NO: 29272 - RNA, 20 nt, Artificial Sequence
  MKO10029272_A_Lrch2
  gRNA
uguuaacauaccuuaacauc

SEQ ID NO: 29273 - RNA, 20 nt, Artificial Sequence
  MKO10029273_A_Lrch2
  gRNA
uuguuacaaaccugugccgg

SEQ ID NO: 29274 - RNA, 20 nt, Artificial Sequence
  MKO10029274_A_Lrch2
  gRNA
caauccauugcaaguaccac

SEQ ID NO: 29275 - RNA, 20 nt, Artificial Sequence
  MKO10029275_A_Lrch3
  gRNA
gagaagucgagccguaucaa

SEQ ID NO: 29276 - RNA, 20 nt, Artificial Sequence
  MKO10029276_A_Lrch3
  gRNA
cugagaggcgauuucgugac

SEQ ID NO: 29277 - RNA, 20 nt, Artificial Sequence
  MKO10029277_A_Lrch3
  gRNA
ucgccucucagaaaucccua

SEQ ID NO: 29278 - RNA, 20 nt, Artificial Sequence
  MKO10029278_A_Lrch4
  gRNA
uucgaacauugagaucccgc

SEQ ID NO: 29279 - RNA, 20 nt, Artificial Sequence
  MKO10029279_A_Lrch4
  gRNA
ugcugaugauaagcacucga

SEQ ID NO: 29280 - RNA, 20 nt, Artificial Sequence
  MKO10029280_A_Lrch4
  gRNA
ccuuagacuugucucggaac

SEQ ID NO: 29281 - RNA, 20 nt, Artificial Sequence
  MKO10029281_A_Lrcol1
  gRNA
cacauuccaaaaacacgguc

SEQ ID NO: 29282 - RNA, 20 nt, Artificial Sequence
  MKO10029282_A_Lrcol1
  gRNA
ucccacugcacaaagcgcac

SEQ ID NO: 29283 - RNA, 20 nt, Artificial Sequence
  MKO10029283_A_Lrcol1
  gRNA
gaagggcuguucucgcucag

SEQ ID NO: 29284 - RNA, 20 nt, Artificial Sequence
  MKO10029284_A_Lrdd
  gRNA
cgggcaaccagagucgauag

SEQ ID NO: 29285 - RNA, 20 nt, Artificial Sequence
  MKO10029285_A_Lrdd
  gRNA
ucaccauccacuaucgacuc

SEQ ID NO: 29286 - RNA, 20 nt, Artificial Sequence
  MKO10029286_A_Lrdd
  gRNA
cgcucccuuugugcgccugc

SEQ ID NO: 29287 - RNA, 20 nt, Artificial Sequence
  MKO10029287_A_Lrfn1
  gRNA
cccccgaacggcuccuucga

SEQ ID NO: 29288 - RNA, 20 nt, Artificial Sequence
  MKO10029288_A_Lrfn1
  gRNA
cuacauaaauugccccccga

SEQ ID NO: 29289 - RNA, 20 nt, Artificial Sequence
  MKO10029289_A_Lrfn1
  gRNA
ccaccgaagcugaccgucaa

SEQ ID NO: 29290 - RNA, 20 nt, Artificial Sequence
  MKO10029290_A_Lrfn2
  gRNA
caugcgccguacggaauccc

SEQ ID NO: 29291 - RNA, 20 nt, Artificial Sequence
  MKO10029291_A_Lrfn2
  gRNA
gggcuacgacuugugcguac

SEQ ID NO: 29292 - RNA, 20 nt, Artificial Sequence
  MKO10029292_A_Lrfn2
  gRNA
cugggauuccguacggcgca

SEQ ID NO: 29293 - RNA, 20 nt, Artificial Sequence
  MKO10029293_A_Lrfn3
  gRNA
ccgcguggccguuagcccgg

SEQ ID NO: 29294 - RNA, 20 nt, Artificial Sequence
  MKO10029294_A_Lrfn3
  gRNA
ccuaggcaacgucaacacgu

SEQ ID NO: 29295 - RNA, 20 nt, Artificial Sequence
  MKO10029295_A_Lrfn3
  gRNA
cggcaccaugaucauagcgc

SEQ ID NO: 29296 - RNA, 20 nt, Artificial Sequence
  MKO10029296_A_Lrfn4
  gRNA
gcgcacaguugaacugcgcc

SEQ ID NO: 29297 - RNA, 20 nt, Artificial Sequence
  MKO10029297_A_Lrfn4
  gRNA
caacugggccgcaucgcccc

SEQ ID NO: 29298 - RNA, 20 nt, Artificial Sequence
  MKO10029298_A_Lrfn4
  gRNA
ugcugggcccuccgaccuca

SEQ ID NO: 29299 - RNA, 20 nt, Artificial Sequence
  MKO10029299_A_Lrfn5
  gRNA
cauccaguuuacuacggaac

SEQ ID NO: 29300 - RNA, 20 nt, Artificial Sequence
  MKO10029300_A_Lrfn5
  gRNA
uaacgaccaguuaaaagugc

SEQ ID NO: 29301 - RNA, 20 nt, Artificial Sequence
  MKO10029301_A_Lrfn5
  gRNA
aauccuguuccguaguaaac

SEQ ID NO: 29302 - RNA, 20 nt, Artificial Sequence
  MKO10029302_A_Lrg1
  gRNA
ccgacccgcgacaugcagga

SEQ ID NO: 29303 - RNA, 20 nt, Artificial Sequence
  MKO10029303_A_Lrg1
  gRNA
cggucgccaccccgaccaac

SEQ ID NO: 29304 - RNA, 20 nt, Artificial Sequence
  MKO10029304_A_Lrg1
  gRNA
gaggagcagcuauggucucu

SEQ ID NO: 29305 - RNA, 20 nt, Artificial Sequence
  MKO10029305_A_Lrguk
  gRNA
ucauacucaccgauagauuc

SEQ ID NO: 29306 - RNA, 20 nt, Artificial Sequence
  MKO10029306_A_Lrguk
  gRNA
cgcugacaggucauacaucu

SEQ ID NO: 29307 - RNA, 20 nt, Artificial Sequence
  MKO10029307_A_Lrguk
  gRNA
uucccgcaggacaaguauga

SEQ ID NO: 29308 - RNA, 20 nt, Artificial Sequence
  MKO10029308_A_Lrif1
  gRNA
uaccaaguaguuccuacgau

SEQ ID NO: 29309 - RNA, 20 nt, Artificial Sequence
  MKO10029309_A_Lrif1
  gRNA
uuuccaucgcugccaaucgu

SEQ ID NO: 29310 - RNA, 20 nt, Artificial Sequence
  MKO10029310_A_Lrif1
  gRNA
ucacaagccauaguacaacc

SEQ ID NO: 29311 - RNA, 20 nt, Artificial Sequence
  MKO10029311_A_Lrig1
  gRNA
cggagcuccuguuucccgaa

SEQ ID NO: 29312 - RNA, 20 nt, Artificial Sequence
  MKO10029312_A_Lrig1
  gRNA
aaaagcagcagagucgaucu

SEQ ID NO: 29313 - RNA, 20 nt, Artificial Sequence
  MKO10029313_A_Lrig1
  gRNA
cucuccgucugagcaaaaac

SEQ ID NO: 29314 - RNA, 20 nt, Artificial Sequence
  MKO10029314_A_Lrig2
  gRNA
gucuaacuggaacaacaccu

SEQ ID NO: 29315 - RNA, 20 nt, Artificial Sequence
  MKO10029315_A_Lrig2
  gRNA
uuaggaauuugagcaauaau

SEQ ID NO: 29316 - RNA, 20 nt, Artificial Sequence
  MKO10029316_A_Lrig2
  gRNA
aauuagcaugauuccaccca

SEQ ID NO: 29317 - RNA, 20 nt, Artificial Sequence
  MKO10029317_A_Lrig3
  gRNA
uaacaaccgagugucgucca

SEQ ID NO: 29318 - RNA, 20 nt, Artificial Sequence
  MKO10029318_A_Lrig3
  gRNA
gguggcucagggaacucguc

SEQ ID NO: 29319 - RNA, 20 nt, Artificial Sequence
  MKO10029319_A_Lrig3
  gRNA
auuagagaccauuccaaacc

SEQ ID NO: 29320 - RNA, 20 nt, Artificial Sequence
  MKO10029320_A_Lrit1
  gRNA
aguccaacuugagccgucac

SEQ ID NO: 29321 - RNA, 20 nt, Artificial Sequence
  MKO10029321_A_Lrit1
  gRNA
uagagagaaccgccauucgc

SEQ ID NO: 29322 - RNA, 20 nt, Artificial Sequence
  MKO10029322_A_Lrit1
  gRNA
gccaauggacgaccacucaa

SEQ ID NO: 29323 - RNA, 20 nt, Artificial Sequence
  MKO10029323_A_Lrit2
  gRNA
uugugcgacugccgauuaag

SEQ ID NO: 29324 - RNA, 20 nt, Artificial Sequence
  MKO10029324_A_Lrit2
  gRNA
ugccuauguugaccuacgag

SEQ ID NO: 29325 - RNA, 20 nt, Artificial Sequence
  MKO10029325_A_Lrit2
  gRNA
acugagcaaguccccuuaau

SEQ ID NO: 29326 - RNA, 20 nt, Artificial Sequence
  MKO10029326_A_Lrit3
  gRNA
guuaguguuguguaacgacc

SEQ ID NO: 29327 - RNA, 20 nt, Artificial Sequence
  MKO10029327_A_Lrit3
  gRNA
cugcacgaguugcguuugga

SEQ ID NO: 29328 - RNA, 20 nt, Artificial Sequence
  MKO10029328_A_Lrit3
  gRNA
caucgcucuuaagauucauc

SEQ ID NO: 29329 - RNA, 20 nt, Artificial Sequence
  MKO10029329_A_Lrmp
  gRNA
ccgagagcccgucacagcuc

SEQ ID NO: 29330 - RNA, 20 nt, Artificial Sequence
  MKO10029330_A_Lrmp
  gRNA
ccguacucacgucuguacuc

SEQ ID NO: 29331 - RNA, 20 nt, Artificial Sequence
  MKO10029331_A_Lrmp
  gRNA
agagccgccucugccaugca

SEQ ID NO: 29332 - RNA, 20 nt, Artificial Sequence
  MKO10029332_A_Lrp10
  gRNA
cgagagcgaugaccagcaac

SEQ ID NO: 29333 - RNA, 20 nt, Artificial Sequence
  MKO10029333_A_Lrp10
  gRNA
uaccagacguucugcgccga

SEQ ID NO: 29334 - RNA, 20 nt, Artificial Sequence
  MKO10029334_A_Lrp10
  gRNA
cuucggcugucccggccuag

SEQ ID NO: 29335 - RNA, 20 nt, Artificial Sequence
  MKO10029335_A_Lrp11
  gRNA
ggacaagccucccguuagca

SEQ ID NO: 29336 - RNA, 20 nt, Artificial Sequence
  MKO10029336_A_Lrp11
  gRNA
cugcuguauugacauagcgu

SEQ ID NO: 29337 - RNA, 20 nt, Artificial Sequence
  MKO10029337_A_Lrp11
  gRNA
aguggcucuugaccgcaagu

SEQ ID NO: 29338 - RNA, 20 nt, Artificial Sequence
  MKO10029338_A_Lrp12
  gRNA
auugaaaguuaccgagcgug

SEQ ID NO: 29339 - RNA, 20 nt, Artificial Sequence
  MKO10029339_A_Lrp12
  gRNA
aacgcuacuuaccaagucga

SEQ ID NO: 29340 - RNA, 20 nt, Artificial Sequence
  MKO10029340_A_Lrp12
  gRNA
gacugugacaugccgacaug

SEQ ID NO: 29341 - RNA, 20 nt, Artificial Sequence
  MKO10029341_A_Lrp1b
  gRNA
ugcuacaagauguuauugcg

SEQ ID NO: 29342 - RNA, 20 nt, Artificial Sequence
  MKO10029342_A_Lrp1b
  gRNA
guccuaugcuugcagcugcg

SEQ ID NO: 29343 - RNA, 20 nt, Artificial Sequence
  MKO10029343_A_Lrp1b
  gRNA
gucagacaacagaucuugca

SEQ ID NO: 29344 - RNA, 20 nt, Artificial Sequence
  MKO10029344_A_Lrp1
  gRNA
uuugacgaguguuccgugua

SEQ ID NO: 29345 - RNA, 20 nt, Artificial Sequence
  MKO10029345_A_Lrp1
  gRNA
cccguugcagagacgagaca

SEQ ID NO: 29346 - RNA, 20 nt, Artificial Sequence
  MKO10029346_A_Lrp1
  gRNA
ccgagccaacuguucucgaa

SEQ ID NO: 29347 - RNA, 20 nt, Artificial Sequence
  MKO10029347_A_Lrp2bp
  gRNA
uuauuaccuccacgcuaauu

SEQ ID NO: 29348 - RNA, 20 nt, Artificial Sequence
  MKO10029348_A_Lrp2bp
  gRNA
cuguauccaccaaauuagcg

SEQ ID NO: 29349 - RNA, 20 nt, Artificial Sequence
  MKO10029349_A_Lrp2bp
  gRNA
cuucaaaauaagcucucccg

SEQ ID NO: 29350 - RNA, 20 nt, Artificial Sequence
  MKO10029350_A_Lrp2
  gRNA
caggauaaggauuguuccga

SEQ ID NO: 29351 - RNA, 20 nt, Artificial Sequence
  MKO10029351_A_Lrp2
  gRNA
caggaaaaagccugaaccgc

SEQ ID NO: 29352 - RNA, 20 nt, Artificial Sequence
  MKO10029352_A_Lrp2
  gRNA
cagcagcugacgugcuccaa

SEQ ID NO: 29353 - RNA, 20 nt, Artificial Sequence
  MKO10029353_A_Lrp3
  gRNA
agcagugcaguucccgccuu

SEQ ID NO: 29354 - RNA, 20 nt, Artificial Sequence
  MKO10029354_A_Lrp3
  gRNA
acuccucuacaucgaaguuu

SEQ ID NO: 29355 - RNA, 20 nt, Artificial Sequence
  MKO10029355_A_Lrp3
  gRNA
gcuggcaucaccucggauau

SEQ ID NO: 29356 - RNA, 20 nt, Artificial Sequence
  MKO10029356_A_Lrp4
  gRNA
uccgaaugcaguagccguuc

SEQ ID NO: 29357 - RNA, 20 nt, Artificial Sequence
  MKO10029357_A_Lrp4
  gRNA
guaccuguauccccgcccag

SEQ ID NO: 29358 - RNA, 20 nt, Artificial Sequence
  MKO10029358_A_Lrp4
  gRNA
gcaagugcauccgacgcucc

SEQ ID NO: 29359 - RNA, 20 nt, Artificial Sequence
  MKO10029359_A_Lrp5
  gRNA
ccucaaugggacgucccgua

SEQ ID NO: 29360 - RNA, 20 nt, Artificial Sequence
  MKO10029360_A_Lrp5
  gRNA
cucaccggaaggagccgucc

SEQ ID NO: 29361 - RNA, 20 nt, Artificial Sequence
  MKO10029361_A_Lrp5
  gRNA
cuccgagaccaaccgcauug

SEQ ID NO: 29362 - RNA, 20 nt, Artificial Sequence
  MKO10029362_A_Lrp6
  gRNA
gagaaugcaacgauuguagu

SEQ ID NO: 29363 - RNA, 20 nt, Artificial Sequence
  MKO10029363_A_Lrp6
  gRNA
cggacugacucuggacuauc

SEQ ID NO: 29364 - RNA, 20 nt, Artificial Sequence
  MKO10029364_A_Lrp6
  gRNA
gugccaaagauagaacgugc

SEQ ID NO: 29365 - RNA, 20 nt, Artificial Sequence
  MKO10029365_A_Lrp8
  gRNA
cgauggcucugacgaaucga

SEQ ID NO: 29366 - RNA, 20 nt, Artificial Sequence
  MKO10029366_A_Lrp8
  gRNA
ccgcagcuuaacuucucggc

SEQ ID NO: 29367 - RNA, 20 nt, Artificial Sequence
  MKO10029367_A_Lrp8
  gRNA
cccgcuucgucacucccguc

SEQ ID NO: 29368 - RNA, 20 nt, Artificial Sequence
  MKO10029368_A_Lrpap1
  gRNA
uccgcaggcgguccaagccc

SEQ ID NO: 29369 - RNA, 20 nt, Artificial Sequence
  MKO10029369_A_Lrpap1
  gRNA
cagacugcgcaguaucaacc

SEQ ID NO: 29370 - RNA, 20 nt, Artificial Sequence
  MKO10029370_A_Lrpap1
  gRNA
ccucccauccaguccguauc

SEQ ID NO: 29371 - RNA, 20 nt, Artificial Sequence
  MKO10029371_A_Lrpprc
  gRNA
ccgaacugagucucgccgag

SEQ ID NO: 29372 - RNA, 20 nt, Artificial Sequence
  MKO10029372_A_Lrpprc
  gRNA
aguuaccuacucgauuuggu

SEQ ID NO: 29373 - RNA, 20 nt, Artificial Sequence
  MKO10029373_A_Lrpprc
  gRNA
agaacaggccgcaucacaaa

SEQ ID NO: 29374 - RNA, 20 nt, Artificial Sequence
  MKO10029374_A_Lrr1
  gRNA
ccgcucgcacgcccuugccu

SEQ ID NO: 29375 - RNA, 20 nt, Artificial Sequence
  MKO10029375_A_Lrr1
  gRNA
ccgaggcaagggcgugcgag

SEQ ID NO: 29376 - RNA, 20 nt, Artificial Sequence
  MKO10029376_A_Lrr1
  gRNA
aggcuccuuuagccggacag

SEQ ID NO: 29377 - RNA, 20 nt, Artificial Sequence
  MKO10029377_A_Lrrc10b
  gRNA
agaccucgaccgcaaccgcc

SEQ ID NO: 29378 - RNA, 20 nt, Artificial Sequence
  MKO10029378_A_Lrrc10b
  gRNA
acuuccugcggcgcuuuccg

SEQ ID NO: 29379 - RNA, 20 nt, Artificial Sequence
  MKO10029379_A_Lrrc10b
  gRNA
ccagcagacgguugccgccc

SEQ ID NO: 29380 - RNA, 20 nt, Artificial Sequence
  MKO10029380_A_Lrrc10
  gRNA
ggcaaagggguucgccgugu

SEQ ID NO: 29381 - RNA, 20 nt, Artificial Sequence
  MKO10029381_A_Lrrc10
  gRNA
gcaugcgaagcaguaccgag

SEQ ID NO: 29382 - RNA, 20 nt, Artificial Sequence
  MKO10029382_A_Lrrc10
  gRNA
cgaccgcugccagaguuaug

SEQ ID NO: 29383 - RNA, 20 nt, Artificial Sequence
  MKO10029383_A_Lrrc14b
  gRNA
ccuugcaggcacgaucacgc

SEQ ID NO: 29384 - RNA, 20 nt, Artificial Sequence
  MKO10029384_A_Lrrc14b
  gRNA
auugcugcaccuguacgucc

SEQ ID NO: 29385 - RNA, 20 nt, Artificial Sequence
  MKO10029385_A_Lrrc14b
  gRNA
gcuagguccaacacucuuag

SEQ ID NO: 29386 - RNA, 20 nt, Artificial Sequence
  MKO10029386_A_Lrrc14
  gRNA
acaggcugagcuacguaccg

SEQ ID NO: 29387 - RNA, 20 nt, Artificial Sequence
  MKO10029387_A_Lrrc14
  gRNA
agaccugcgcuucaauaacc

SEQ ID NO: 29388 - RNA, 20 nt, Artificial Sequence
  MKO10029388_A_Lrrc14
  gRNA
caugcacguagugcagccuc

SEQ ID NO: 29389 - RNA, 20 nt, Artificial Sequence
  MKO10029389_A_Lrrc15
  gRNA
ucucauauagccgaagcacc

SEQ ID NO: 29390 - RNA, 20 nt, Artificial Sequence
  MKO10029390_A_Lrrc15
  gRNA
aacuaaagaaccugcccguu

SEQ ID NO: 29391 - RNA, 20 nt, Artificial Sequence
  MKO10029391_A_Lrrc15
  gRNA
agcaucuucgccaacgucaa

SEQ ID NO: 29392 - RNA, 20 nt, Artificial Sequence
  MKO10029392_A_Lrrc16a
  gRNA
ugggaauauccuccgcaagc

SEQ ID NO: 29393 - RNA, 20 nt, Artificial Sequence
  MKO10029393_A_Lrrc16a
  gRNA
gucagcacgcauccccagca

SEQ ID NO: 29394 - RNA, 20 nt, Artificial Sequence
  MKO10029394_A_Lrrc16a
  gRNA
ugcuggggaugcgugcugac

SEQ ID NO: 29395 - RNA, 20 nt, Artificial Sequence
  MKO10029395_A_Lrrc16b
  gRNA
gcugccauccgccgagagug

SEQ ID NO: 29396 - RNA, 20 nt, Artificial Sequence
  MKO10029396_A_Lrrc16b
  gRNA
ccaguuucacacgauguugc

SEQ ID NO: 29397 - RNA, 20 nt, Artificial Sequence
  MKO10029397_A_Lrrc16b
  gRNA
ccagcaacaucgugugaaac

SEQ ID NO: 29398 - RNA, 20 nt, Artificial Sequence
  MKO10029398_A_Lrrc17
  gRNA
cugcggguauccccgacacu

SEQ ID NO: 29399 - RNA, 20 nt, Artificial Sequence
  MKO10029399_A_Lrrc17
  gRNA
gaacgucagaaugcgcauag

SEQ ID NO: 29400 - RNA, 20 nt, Artificial Sequence
  MKO10029400_A_Lrrc17
  gRNA
aaucagacagcuccgaccca

SEQ ID NO: 29401 - RNA, 20 nt, Artificial Sequence
  MKO10029401_A_Lrrc18
  gRNA
gaacauccgcaccgugaauc

SEQ ID NO: 29402 - RNA, 20 nt, Artificial Sequence
  MKO10029402_A_Lrrc18
  gRNA
aucuccgauucaucugcauu

SEQ ID NO: 29403 - RNA, 20 nt, Artificial Sequence
  MKO10029403_A_Lrrc18
  gRNA
aagcuacucuagaaggugga

SEQ ID NO: 29404 - RNA, 20 nt, Artificial Sequence
  MKO10029404_A_Lrrc19
  gRNA
gaguuacaaccaccaucgcc

SEQ ID NO: 29405 - RNA, 20 nt, Artificial Sequence
  MKO10029405_A_Lrrc19
  gRNA
agcagaauauuguaccauac

SEQ ID NO: 29406 - RNA, 20 nt, Artificial Sequence
  MKO10029406_A_Lrrc19
  gRNA
cugucgugcuuuagcucauc

SEQ ID NO: 29407 - RNA, 20 nt, Artificial Sequence
  MKO10029407_A_Lrrc1
  gRNA
gcuuccguaauuugacuagc

SEQ ID NO: 29408 - RNA, 20 nt, Artificial Sequence
  MKO10029408_A_Lrrc1
  gRNA
ucagcggaaacccacucacc

SEQ ID NO: 29409 - RNA, 20 nt, Artificial Sequence
  MKO10029409_A_Lrrc1
  gRNA
cauuucuagucucuauaacc

SEQ ID NO: 29410 - RNA, 20 nt, Artificial Sequence
  MKO10029410_A_Lrrc20
  gRNA
uacgcgggccccuccgccuu

SEQ ID NO: 29411 - RNA, 20 nt, Artificial Sequence
  MKO10029411_A_Lrrc20
  gRNA
ccuaccucgaagcugauuga

SEQ ID NO: 29412 - RNA, 20 nt, Artificial Sequence
  MKO10029412_A_Lrrc20
  gRNA
uggggcaaucacacgcacgu

SEQ ID NO: 29413 - RNA, 20 nt, Artificial Sequence
  MKO10029413_A_Lrrc23
  gRNA
ggcucacgcuuauauuaagc

SEQ ID NO: 29414 - RNA, 20 nt, Artificial Sequence
  MKO10029414_A_Lrrc23
  gRNA
cuauauccaucuucgcuaug

SEQ ID NO: 29415 - RNA, 20 nt, Artificial Sequence
  MKO10029415_A_Lrrc23
  gRNA
aacagggaaccgcauccacc

SEQ ID NO: 29416 - RNA, 20 nt, Artificial Sequence
  MKO10029416_A_Lrrc24
  gRNA
gcuugaggcuuaccaucgcg

SEQ ID NO: 29417 - RNA, 20 nt, Artificial Sequence
  MKO10029417_A_Lrrc24
  gRNA
caacaauacccugcgugcgc

SEQ ID NO: 29418 - RNA, 20 nt, Artificial Sequence
  MKO10029418_A_Lrrc24
  gRNA
cgccacgcaauccccgaagc

SEQ ID NO: 29419 - RNA, 20 nt, Artificial Sequence
  MKO10029419_A_Lrrc25
  gRNA
uggggcuuucuucgacaagc

SEQ ID NO: 29420 - RNA, 20 nt, Artificial Sequence
  MKO10029420_A_Lrrc25
  gRNA
ucagcccgucuauugcaacc

SEQ ID NO: 29421 - RNA, 20 nt, Artificial Sequence
  MKO10029421_A_Lrrc25
  gRNA
gcggcggcgaagaagucucc

SEQ ID NO: 29422 - RNA, 20 nt, Artificial Sequence
  MKO10029422_A_Lrrc26
  gRNA
ccgauagugaauuguccugc

SEQ ID NO: 29423 - RNA, 20 nt, Artificial Sequence
  MKO10029423_A_Lrrc26
  gRNA
gugcgugcaccgaccgaagc

SEQ ID NO: 29424 - RNA, 20 nt, Artificial Sequence
  MKO10029424_A_Lrrc26
  gRNA
gguggucuacgcucucgggc

SEQ ID NO: 29425 - RNA, 20 nt, Artificial Sequence
  MKO10029425_A_Lrrc27
  gRNA
caaaauguuacccguugagc

SEQ ID NO: 29426 - RNA, 20 nt, Artificial Sequence
  MKO10029426_A_Lrrc27
  gRNA
ucuccacugagcagaugcgu

SEQ ID NO: 29427 - RNA, 20 nt, Artificial Sequence
  MKO10029427_A_Lrrc27
  gRNA
ucuggacuuacuuggagguu

SEQ ID NO: 29428 - RNA, 20 nt, Artificial Sequence
  MKO10029428_A_Lrrc28
  gRNA
gcucucagaccaccgauuuc

SEQ ID NO: 29429 - RNA, 20 nt, Artificial Sequence
  MKO10029429_A_Lrrc28
  gRNA
uaauaccuaccaagguugug

SEQ ID NO: 29430 - RNA, 20 nt, Artificial Sequence
  MKO10029430_A_Lrrc28
  gRNA
aaucuguaagacgaucucug

SEQ ID NO: 29431 - RNA, 20 nt, Artificial Sequence
  MKO10029431_A_Lrrc29
  gRNA
cugcauccagucucgcuucg

SEQ ID NO: 29432 - RNA, 20 nt, Artificial Sequence
  MKO10029432_A_Lrrc29
  gRNA
ccccucccacgaagcgagac

SEQ ID NO: 29433 - RNA, 20 nt, Artificial Sequence
  MKO10029433_A_Lrrc29
  gRNA
gggcccaucccucgucacug

SEQ ID NO: 29434 - RNA, 20 nt, Artificial Sequence
  MKO10029434_A_Lrrc2
  gRNA
uugaaacagcucgauguacg

SEQ ID NO: 29435 - RNA, 20 nt, Artificial Sequence
  MKO10029435_A_Lrrc2
  gRNA
acugcagacgacacauccgc

SEQ ID NO: 29436 - RNA, 20 nt, Artificial Sequence
  MKO10029436_A_Lrrc2
  gRNA
acgugucuuccagcugaaau

SEQ ID NO: 29437 - RNA, 20 nt, Artificial Sequence
  MKO10029437_A_Lrrc30
  gRNA
agagacagaaguucucgucg

SEQ ID NO: 29438 - RNA, 20 nt, Artificial Sequence
  MKO10029438_A_Lrrc30
  gRNA
gggcaggcugacccggauag

SEQ ID NO: 29439 - RNA, 20 nt, Artificial Sequence
  MKO10029439_A_Lrrc30
  gRNA
acaaguuuaggaccacuauc

SEQ ID NO: 29440 - RNA, 20 nt, Artificial Sequence
  MKO10029440_A_Lrrc32
  gRNA
cuauacagcgcuucgucacc

SEQ ID NO: 29441 - RNA, 20 nt, Artificial Sequence
  MKO10029441_A_Lrrc32
  gRNA
guucucccggaggucgagcc

SEQ ID NO: 29442 - RNA, 20 nt, Artificial Sequence
  MKO10029442_A_Lrrc32
  gRNA
cucgacgcugagagauagcc

SEQ ID NO: 29443 - RNA, 20 nt, Artificial Sequence
  MKO10029443_A_Lrrc34
  gRNA
uauaaccucaucggcgaugu

SEQ ID NO: 29444 - RNA, 20 nt, Artificial Sequence
  MKO10029444_A_Lrrc34
  gRNA
gacuccggacaaagaauaac

SEQ ID NO: 29445 - RNA, 20 nt, Artificial Sequence
  MKO10029445_A_Lrrc34
  gRNA
cuaugcugcgaaacuacuuc

SEQ ID NO: 29446 - RNA, 20 nt, Artificial Sequence
  MKO10029446_A_Lrrc36
  gRNA
cucaggacugacgugugacg

SEQ ID NO: 29447 - RNA, 20 nt, Artificial Sequence
  MKO10029447_A_Lrrc36
  gRNA
gagccguccgugacagcgag

SEQ ID NO: 29448 - RNA, 20 nt, Artificial Sequence
  MKO10029448_A_Lrrc36
  gRNA
cgcgucacacgucaguccug

SEQ ID NO: 29449 - RNA, 20 nt, Artificial Sequence
  MKO10029449_A_Lrrc38
  gRNA
gaacaacucgcugcgcucgc

SEQ ID NO: 29450 - RNA, 20 nt, Artificial Sequence
  MKO10029450_A_Lrrc38
  gRNA
uugcaccgacccccauaccg

SEQ ID NO: 29451 - RNA, 20 nt, Artificial Sequence
  MKO10029451_A_Lrrc38
  gRNA
acacucgcugaaacuagcuu

SEQ ID NO: 29452 - RNA, 20 nt, Artificial Sequence
  MKO10029452_A_Lrrc39
  gRNA
acaauuucagagaucccccg

SEQ ID NO: 29453 - RNA, 20 nt, Artificial Sequence
  MKO10029453_A_Lrrc39
  gRNA
gucuuaggcuagugcggauc

SEQ ID NO: 29454 - RNA, 20 nt, Artificial Sequence
  MKO10029454_A_Lrrc39
  gRNA
uagugaacugauucauacuc

SEQ ID NO: 29455 - RNA, 20 nt, Artificial Sequence
  MKO10029455_A_Lrrc3b
  gRNA
guuacacaggucagcgucau

SEQ ID NO: 29456 - RNA, 20 nt, Artificial Sequence
  MKO10029456_A_Lrrc3b
  gRNA
guacuacgugaggcagaauc

SEQ ID NO: 29457 - RNA, 20 nt, Artificial Sequence
  MKO10029457_A_Lrrc3b
  gRNA
ggaugaaucuggucgaccug

SEQ ID NO: 29458 - RNA, 20 nt, Artificial Sequence
  MKO10029458_A_Lrrc3
  gRNA
guacuacguacgccacaacc

SEQ ID NO: 29459 - RNA, 20 nt, Artificial Sequence
  MKO10029459_A_Lrrc3
  gRNA
aauucuucggaugcgauugu

SEQ ID NO: 29460 - RNA, 20 nt, Artificial Sequence
  MKO10029460_A_Lrrc3
  gRNA
gaccaccgaugucgccaugc

SEQ ID NO: 29461 - RNA, 20 nt, Artificial Sequence
  MKO10029461_A_Lrrc40
  gRNA
cauucaguucuacugaacga

SEQ ID NO: 29462 - RNA, 20 nt, Artificial Sequence
  MKO10029462_A_Lrrc40
  gRNA
aagauugagucgcaacagac

SEQ ID NO: 29463 - RNA, 20 nt, Artificial Sequence
  MKO10029463_A_Lrrc40
  gRNA
aaagaugcucaaaucccucg

SEQ ID NO: 29464 - RNA, 20 nt, Artificial Sequence
  MKO10029464_A_Lrrc41
  gRNA
gguggucaacacgaauagac

SEQ ID NO: 29465 - RNA, 20 nt, Artificial Sequence
  MKO10029465_A_Lrrc41
  gRNA
gcugcggcguguuacacgag

SEQ ID NO: 29466 - RNA, 20 nt, Artificial Sequence
  MKO10029466_A_Lrrc41
  gRNA
uaguggcagagcccaaccgu

SEQ ID NO: 29467 - RNA, 20 nt, Artificial Sequence
  MKO10029467_A_Lrrc42
  gRNA
ccaggacaucaaagccguua

SEQ ID NO: 29468 - RNA, 20 nt, Artificial Sequence
  MKO10029468_A_Lrrc42
  gRNA
ccagugcgggugaugaaaag

SEQ ID NO: 29469 - RNA, 20 nt, Artificial Sequence
  MKO10029469_A_Lrrc42
  gRNA
cuaacagcgcuagauucuca

SEQ ID NO: 29470 - RNA, 20 nt, Artificial Sequence
  MKO10029470_A_Lrrc43
  gRNA
caaucugcccccgacauuga

SEQ ID NO: 29471 - RNA, 20 nt, Artificial Sequence
  MKO10029471_A_Lrrc43
  gRNA
auuuguuguggccuagcccc

SEQ ID NO: 29472 - RNA, 20 nt, Artificial Sequence
  MKO10029472_A_Lrrc43
  gRNA
augguaaagccacgguagua

SEQ ID NO: 29473 - RNA, 20 nt, Artificial Sequence
  MKO10029473_A_Lrrc45
  gRNA
ggcaacaaccuccgagcuac

SEQ ID NO: 29474 - RNA, 20 nt, Artificial Sequence
  MKO10029474_A_Lrrc45
  gRNA
gaccugcgcuggaauaacau

SEQ ID NO: 29475 - RNA, 20 nt, Artificial Sequence
  MKO10029475_A_Lrrc45
  gRNA
ggccaauguuauuccagcgc

SEQ ID NO: 29476 - RNA, 20 nt, Artificial Sequence
  MKO10029476_A_Lrrc46
  gRNA
augccaaguucucaaugcgc

SEQ ID NO: 29477 - RNA, 20 nt, Artificial Sequence
  MKO10029477_A_Lrrc46
  gRNA
gauccagcgcauugagaacu

SEQ ID NO: 29478 - RNA, 20 nt, Artificial Sequence
  MKO10029478_A_Lrrc46
  gRNA
acuuuaccgauugcagguag

SEQ ID NO: 29479 - RNA, 20 nt, Artificial Sequence
  MKO10029479_A_Lrrc47
  gRNA
gaugugcgcccauacaucgu

SEQ ID NO: 29480 - RNA, 20 nt, Artificial Sequence
  MKO10029480_A_Lrrc47
  gRNA
auccuagaguaccuucgugc

SEQ ID NO: 29481 - RNA, 20 nt, Artificial Sequence
  MKO10029481_A_Lrrc47
  gRNA
gcggccgggcugcauacagc

SEQ ID NO: 29482 - RNA, 20 nt, Artificial Sequence
  MKO10029482_A_Lrrc48
  gRNA
ugacgagcugaagcaccgcg

SEQ ID NO: 29483 - RNA, 20 nt, Artificial Sequence
  MKO10029483_A_Lrrc48
  gRNA
ccaucugcucaucaacgcgc

SEQ ID NO: 29484 - RNA, 20 nt, Artificial Sequence
  MKO10029484_A_Lrrc48
  gRNA
ccggcgcguugaugagcaga

SEQ ID NO: 29485 - RNA, 20 nt, Artificial Sequence
  MKO10029485_A_Lrrc49
  gRNA
acugugugcccuaucaucga

SEQ ID NO: 29486 - RNA, 20 nt, Artificial Sequence
  MKO10029486_A_Lrrc49
  gRNA
ugcucuuccccgucgaugau

SEQ ID NO: 29487 - RNA, 20 nt, Artificial Sequence
  MKO10029487_A_Lrrc49
  gRNA
ucaugcuguaacagucuacc

SEQ ID NO: 29488 - RNA, 20 nt, Artificial Sequence
  MKO10029488_A_Lrrc4b
  gRNA
cuucgacgaccucaagucgc

SEQ ID NO: 29489 - RNA, 20 nt, Artificial Sequence
  MKO10029489_A_Lrrc4b
  gRNA
cacggccgacacguuaagcg

SEQ ID NO: 29490 - RNA, 20 nt, Artificial Sequence
  MKO10029490_A_Lrrc4b
  gRNA
ccagccgggugaucugcacg

SEQ ID NO: 29491 - RNA, 20 nt, Artificial Sequence
  MKO10029491_A_Lrrc4c
  gRNA
ugccauccggaacuucacga

SEQ ID NO: 29492 - RNA, 20 nt, Artificial Sequence
  MKO10029492_A_Lrrc4c
  gRNA
gccccacuccagugaucgau

SEQ ID NO: 29493 - RNA, 20 nt, Artificial Sequence
  MKO10029493_A_Lrrc4c
  gRNA
cgauuucaaugguucgaaua

SEQ ID NO: 29494 - RNA, 20 nt, Artificial Sequence
  MKO10029494_A_Lrrc4
  gRNA
gaauccacacuugcgccgug

SEQ ID NO: 29495 - RNA, 20 nt, Artificial Sequence
  MKO10029495_A_Lrrc4
  gRNA
cugugacuguacuccgcugc

SEQ ID NO: 29496 - RNA, 20 nt, Artificial Sequence
  MKO10029496_A_Lrrc4
  gRNA
gaccacccgugugcccaagc

SEQ ID NO: 29497 - RNA, 20 nt, Artificial Sequence
  MKO10029497_A_Lrrc51
  gRNA
caacggcauccaucgccuag

SEQ ID NO: 29498 - RNA, 20 nt, Artificial Sequence
  MKO10029498_A_Lrrc51
  gRNA
gauggaugccguugccguga

SEQ ID NO: 29499 - RNA, 20 nt, Artificial Sequence
  MKO10029499_A_Lrrc51
  gRNA
cauuauagaucugguaaccg

SEQ ID NO: 29500 - RNA, 20 nt, Artificial Sequence
  MKO10029500_A_Lrrc52
  gRNA
aaugcccuccgaacgucgag

SEQ ID NO: 29501 - RNA, 20 nt, Artificial Sequence
  MKO10029501_A_Lrrc52
  gRNA
ucagaacaaccggauucgag

SEQ ID NO: 29502 - RNA, 20 nt, Artificial Sequence
  MKO10029502_A_Lrrc52
  gRNA
ugcccagaacgccacgugua

SEQ ID NO: 29503 - RNA, 20 nt, Artificial Sequence
  MKO10029503_A_Lrrc55
  gRNA
cgccaagcgcuuagcacacc

SEQ ID NO: 29504 - RNA, 20 nt, Artificial Sequence
  MKO10029504_A_Lrrc55
  gRNA
cuacauggaacuccgcgugc

SEQ ID NO: 29505 - RNA, 20 nt, Artificial Sequence
  MKO10029505_A_Lrrc55
  gRNA
cggccaacuguugucaccgu

SEQ ID NO: 29506 - RNA, 20 nt, Artificial Sequence
  MKO10029506_A_Lrrc56
  gRNA
cacagcuaguauccggguac

SEQ ID NO: 29507 - RNA, 20 nt, Artificial Sequence
  MKO10029507_A_Lrrc56
  gRNA
gccagcucagcucccguacc

SEQ ID NO: 29508 - RNA, 20 nt, Artificial Sequence
  MKO10029508_A_Lrrc56
  gRNA
ggcucucaccgaaguucccc

SEQ ID NO: 29509 - RNA, 20 nt, Artificial Sequence
  MKO10029509_A_Lrrc57
  gRNA
agccuaccgccucugauaau

SEQ ID NO: 29510 - RNA, 20 nt, Artificial Sequence
  MKO10029510_A_Lrrc57
  gRNA
cugguugagauugaguucga

SEQ ID NO: 29511 - RNA, 20 nt, Artificial Sequence
  MKO10029511_A_Lrrc57
  gRNA
agagagcuaccaucuaccuu

SEQ ID NO: 29512 - RNA, 20 nt, Artificial Sequence
  MKO10029512_A_Lrrc58
  gRNA
cagcgacgucaggcgguugu

SEQ ID NO: 29513 - RNA, 20 nt, Artificial Sequence
  MKO10029513_A_Lrrc58
  gRNA
accgccugacgucgcugccg

SEQ ID NO: 29514 - RNA, 20 nt, Artificial Sequence
  MKO10029514_A_Lrrc58
  gRNA
gaguuuacgaggaaacccgu

SEQ ID NO: 29515 - RNA, 20 nt, Artificial Sequence
  MKO10029515_A_Lrrc59
  gRNA
cagauccaauaccguagccu

SEQ ID NO: 29516 - RNA, 20 nt, Artificial Sequence
  MKO10029516_A_Lrrc59
  gRNA
ggcuccuagucggauuucug

SEQ ID NO: 29517 - RNA, 20 nt, Artificial Sequence
  MKO10029517_A_Lrrc59
  gRNA
cagcagcuacccgcagacuu

SEQ ID NO: 29518 - RNA, 20 nt, Artificial Sequence
  MKO10029518_A_Lrrc61
  gRNA
cagcccuguaagccgauuau

SEQ ID NO: 29519 - RNA, 20 nt, Artificial Sequence
  MKO10029519_A_Lrrc61
  gRNA
cauggguagagcccggcuac

SEQ ID NO: 29520 - RNA, 20 nt, Artificial Sequence
  MKO10029520_A_Lrrc61
  gRNA
ucgucaggccagcgauagcu

SEQ ID NO: 29521 - RNA, 20 nt, Artificial Sequence
  MKO10029521_A_Lrrc63
  gRNA
acuuacuuucaggcgguuug

SEQ ID NO: 29522 - RNA, 20 nt, Artificial Sequence
  MKO10029522_A_Lrrc63
  gRNA
agccaagaaguccucgaaaa

SEQ ID NO: 29523 - RNA, 20 nt, Artificial Sequence
  MKO10029523_A_Lrrc63
  gRNA
gggugaaacuggguaccuag

SEQ ID NO: 29524 - RNA, 20 nt, Artificial Sequence
  MKO10029524_A_Lrrc66
  gRNA
cuacgagucugauuccgacg

SEQ ID NO: 29525 - RNA, 20 nt, Artificial Sequence
  MKO10029525_A_Lrrc66
  gRNA
gggucacuuucgauaugcga

SEQ ID NO: 29526 - RNA, 20 nt, Artificial Sequence
  MKO10029526_A_Lrrc66
  gRNA
ggccacguugaucuauucuc

SEQ ID NO: 29527 - RNA, 20 nt, Artificial Sequence
  MKO10029527_A_Lrrc69
  gRNA
guuacgguugaggcuuaagu

SEQ ID NO: 29528 - RNA, 20 nt, Artificial Sequence
  MKO10029528_A_Lrrc69
  gRNA
uuacgccugccggaaauauc

SEQ ID NO: 29529 - RNA, 20 nt, Artificial Sequence
  MKO10029529_A_Lrrc69
  gRNA
gcaguugacguuacuaaacc

SEQ ID NO: 29530 - RNA, 20 nt, Artificial Sequence
  MKO10029530_A_Lrrc6
  gRNA
ggugaccuuacaacaguuaa

SEQ ID NO: 29531 - RNA, 20 nt, Artificial Sequence
  MKO10029531_A_Lrrc6
  gRNA
gcauaccuuuaacuguugua

SEQ ID NO: 29532 - RNA, 20 nt, Artificial Sequence
  MKO10029532_A_Lrrc6
  gRNA
gauggacgcaccaagcagug

SEQ ID NO: 29533 - RNA, 20 nt, Artificial Sequence
  MKO10029533_A_Lrrc71
  gRNA
ccguggccgggugacaacuu

SEQ ID NO: 29534 - RNA, 20 nt, Artificial Sequence
  MKO10029534_A_Lrrc71
  gRNA
gugaaggagaucuacauucg

SEQ ID NO: 29535 - RNA, 20 nt, Artificial Sequence
  MKO10029535_A_Lrrc71
  gRNA
cucuggcugcaggaugccga

SEQ ID NO: 29536 - RNA, 20 nt, Artificial Sequence
  MKO10029536_A_Lrrc72
  gRNA
ugacguucaccagcaugaac

SEQ ID NO: 29537 - RNA, 20 nt, Artificial Sequence
  MKO10029537_A_Lrrc72
  gRNA
ucaugcuggugaacgucauc

SEQ ID NO: 29538 - RNA, 20 nt, Artificial Sequence
  MKO10029538_A_Lrrc72
  gRNA
gugauucaaucaguagcauu

SEQ ID NO: 29539 - RNA, 20 nt, Artificial Sequence
  MKO10029539_A_Lrrc73
  gRNA
ucaccagacuuggccccguc

SEQ ID NO: 29540 - RNA, 20 nt, Artificial Sequence
  MKO10029540_A_Lrrc73
  gRNA
ccuccagacggggccaaguc

SEQ ID NO: 29541 - RNA, 20 nt, Artificial Sequence
  MKO10029541_A_Lrrc73
  gRNA
ugcuguucucggccaacacc

SEQ ID NO: 29542 - RNA, 20 nt, Artificial Sequence
  MKO10029542_A_Lrrc7
  gRNA
cacacuagaagagcucuauc

SEQ ID NO: 29543 - RNA, 20 nt, Artificial Sequence
  MKO10029543_A_Lrrc7
  gRNA
agguagcuccucaaucugau

SEQ ID NO: 29544 - RNA, 20 nt, Artificial Sequence
  MKO10029544_A_Lrrc7
  gRNA
uacugaugucgaguucuuuc

SEQ ID NO: 29545 - RNA, 20 nt, Artificial Sequence
  MKO10029545_A_Lrrc8a
  gRNA
ccaguacgcccgucuccgau

SEQ ID NO: 29546 - RNA, 20 nt, Artificial Sequence
  MKO10029546_A_Lrrc8a
  gRNA
cccgaagcucgaucugcguc

SEQ ID NO: 29547 - RNA, 20 nt, Artificial Sequence
  MKO10029547_A_Lrrc8a
  gRNA
accugacgcagaucgagcuu

SEQ ID NO: 29548 - RNA, 20 nt, Artificial Sequence
  MKO10029548_A_Lrrc8b
  gRNA
cgacuguucgaucgacgugc

SEQ ID NO: 29549 - RNA, 20 nt, Artificial Sequence
  MKO10029549_A_Lrrc8b
  gRNA
gggcgggguggucgaccacc

SEQ ID NO: 29550 - RNA, 20 nt, Artificial Sequence
  MKO10029550_A_Lrrc8b
  gRNA
aagcguucugccacgggaag

SEQ ID NO: 29551 - RNA, 20 nt, Artificial Sequence
  MKO10029551_A_Lrrc8c
  gRNA
cgcuucaucccgcccgaaau

SEQ ID NO: 29552 - RNA, 20 nt, Artificial Sequence
  MKO10029552_A_Lrrc8c
  gRNA
ugauuccggugaccgaguuc

SEQ ID NO: 29553 - RNA, 20 nt, Artificial Sequence
  MKO10029553_A_Lrrc8c
  gRNA
accgaccaaccccgcgaccg

SEQ ID NO: 29554 - RNA, 20 nt, Artificial Sequence
  MKO10029554_A_Lrrc8d
  gRNA
ccccucuaacaucaccgacg

SEQ ID NO: 29555 - RNA, 20 nt, Artificial Sequence
  MKO10029555_A_Lrrc8d
  gRNA
cgaacaccucguaccccgug

SEQ ID NO: 29556 - RNA, 20 nt, Artificial Sequence
  MKO10029556_A_Lrrc8d
  gRNA
agagcuuggucccgucguug

SEQ ID NO: 29557 - RNA, 20 nt, Artificial Sequence
  MKO10029557_A_Lrrc8e
  gRNA
ggaucuccucgauagaccga

SEQ ID NO: 29558 - RNA, 20 nt, Artificial Sequence
  MKO10029558_A_Lrrc8e
  gRNA
cagacucucgagugcguugu

SEQ ID NO: 29559 - RNA, 20 nt, Artificial Sequence
  MKO10029559_A_Lrrc8e
  gRNA
aacugcuugaacuccgccac

SEQ ID NO: 29560 - RNA, 20 nt, Artificial Sequence
  MKO10029560_A_Lrrc9
  gRNA
ucaggguauccccgaauagu

SEQ ID NO: 29561 - RNA, 20 nt, Artificial Sequence
  MKO10029561_A_Lrrc9
  gRNA
aacuuaugagaucguuggac

SEQ ID NO: 29562 - RNA, 20 nt, Artificial Sequence
  MKO10029562_A_Lrrc9
  gRNA
uaaugauuucaccucgauuu

SEQ ID NO: 29563 - RNA, 20 nt, Artificial Sequence
  MKO10029563_A_Lrrcc1
  gRNA
guguagcgaaaucgaacggg

SEQ ID NO: 29564 - RNA, 20 nt, Artificial Sequence
  MKO10029564_A_Lrrcc1
  gRNA
aauccuaucugccuuauacc

SEQ ID NO: 29565 - RNA, 20 nt, Artificial Sequence
  MKO10029565_A_Lrrcc1
  gRNA
augacagaucuaaaugucgu

SEQ ID NO: 29566 - RNA, 20 nt, Artificial Sequence
  MKO10029566_A_Lrrd1
  gRNA
uccuuugaugagaccgccaa

SEQ ID NO: 29567 - RNA, 20 nt, Artificial Sequence
  MKO10029567_A_Lrrd1
  gRNA
ugaaaguuuguagauaccac

SEQ ID NO: 29568 - RNA, 20 nt, Artificial Sequence
  MKO10029568_A_Lrrd1
  gRNA
gacacauaccucugagaucu

SEQ ID NO: 29569 - RNA, 20 nt, Artificial Sequence
  MKO10029569_A_Lrrfip1
  gRNA
ggacucgcuggccgaaguug

SEQ ID NO: 29570 - RNA, 20 nt, Artificial Sequence
  MKO10029570_A_Lrrfip1
  gRNA
gaagcgugcagcccgagccg

SEQ ID NO: 29571 - RNA, 20 nt, Artificial Sequence
  MKO10029571_A_Lrrfip1
  gRNA
ugcacgcuucgcugcgagcc

SEQ ID NO: 29572 - RNA, 20 nt, Artificial Sequence
  MKO10029572_A_Lrrfip2
  gRNA
uagcagcaaagcgggccgcc

SEQ ID NO: 29573 - RNA, 20 nt, Artificial Sequence
  MKO10029573_A_Lrrfip2
  gRNA
gucguuccaguucccgcaug

SEQ ID NO: 29574 - RNA, 20 nt, Artificial Sequence
  MKO10029574_A_Lrrfip2
  gRNA
uacccgcaguucacucagug

SEQ ID NO: 29575 - RNA, 20 nt, Artificial Sequence
  MKO10029575_A_Lrriq1
  gRNA
aggaguaauaaucucacgaa

SEQ ID NO: 29576 - RNA, 20 nt, Artificial Sequence
  MKO10029576_A_Lrriq1
  gRNA
aaaugcugagcaauuaauga

SEQ ID NO: 29577 - RNA, 20 nt, Artificial Sequence
  MKO10029577_A_Lrriq1
  gRNA
ggaggacagugacgacagcg

SEQ ID NO: 29578 - RNA, 20 nt, Artificial Sequence
  MKO10029578_A_Lrriq3
  gRNA
caaacauggucagcccuaug

SEQ ID NO: 29579 - RNA, 20 nt, Artificial Sequence
  MKO10029579_A_Lrriq3
  gRNA
cugaacgucuuaaaccucuc

SEQ ID NO: 29580 - RNA, 20 nt, Artificial Sequence
  MKO10029580_A_Lrriq3
  gRNA
ugaaaccacguauccaucuu

SEQ ID NO: 29581 - RNA, 20 nt, Artificial Sequence
  MKO10029581_A_Lrriq4
  gRNA
cuuacuucgaguacggcaaa

SEQ ID NO: 29582 - RNA, 20 nt, Artificial Sequence
  MKO10029582_A_Lrriq4
  gRNA
uccgcacccuucgcgagcug

SEQ ID NO: 29583 - RNA, 20 nt, Artificial Sequence
  MKO10029583_A_Lrriq4
  gRNA
gauuugcgcgcucaagaacc

SEQ ID NO: 29584 - RNA, 20 nt, Artificial Sequence
  MKO10029584_A_Lrrk1
  gRNA
acccggagaacuaugccguc

SEQ ID NO: 29585 - RNA, 20 nt, Artificial Sequence
  MKO10029585_A_Lrrk1
  gRNA
uaguaguucacguacuacuu

SEQ ID NO: 29586 - RNA, 20 nt, Artificial Sequence
  MKO10029586_A_Lrrk1
  gRNA
uugucaucggugggcuccgu

SEQ ID NO: 29587 - RNA, 20 nt, Artificial Sequence
  MKO10029587_A_Lrrk2
  gRNA
cccgcuuaccugcuguacac

SEQ ID NO: 29588 - RNA, 20 nt, Artificial Sequence
  MKO10029588_A_Lrrk2
  gRNA
acacuuaccggugaauacca

SEQ ID NO: 29589 - RNA, 20 nt, Artificial Sequence
  MKO10029589_A_Lrrk2
  gRNA
cgugccucuguugauugucc

SEQ ID NO: 29590 - RNA, 20 nt, Artificial Sequence
  MKO10029590_A_Lrrn1
  gRNA
uuucgcgauguaaauagcga

SEQ ID NO: 29591 - RNA, 20 nt, Artificial Sequence
  MKO10029591_A_Lrrn1
  gRNA
ucgcuauuuacaucgcgaaa

SEQ ID NO: 29592 - RNA, 20 nt, Artificial Sequence
  MKO10029592_A_Lrrn1
  gRNA
gaugcugaucucacgcagau

SEQ ID NO: 29593 - RNA, 20 nt, Artificial Sequence
  MKO10029593_A_Lrrn2
  gRNA
uaccagagcaaacuugucga

SEQ ID NO: 29594 - RNA, 20 nt, Artificial Sequence
  MKO10029594_A_Lrrn2
  gRNA
accuucagcgccgcccaguc

SEQ ID NO: 29595 - RNA, 20 nt, Artificial Sequence
  MKO10029595_A_Lrrn2
  gRNA
cgcggcagucgggccaaagc

SEQ ID NO: 29596 - RNA, 20 nt, Artificial Sequence
  MKO10029596_A_Lrrn3
  gRNA
ccccuccguauucuguuaau

SEQ ID NO: 29597 - RNA, 20 nt, Artificial Sequence
  MKO10029597_A_Lrrn3
  gRNA
guugcgacuguguaauccgc

SEQ ID NO: 29598 - RNA, 20 nt, Artificial Sequence
  MKO10029598_A_Lrrn3
  gRNA
auaccagacgacgccuuggc

SEQ ID NO: 29599 - RNA, 20 nt, Artificial Sequence
  MKO10029599_A_Lrrn4cl
  gRNA
gccgccuaagccuguuaccc

SEQ ID NO: 29600 - RNA, 20 nt, Artificial Sequence
  MKO10029600_A_Lrrn4cl
  gRNA
ggcaaccccaucgcucacga

SEQ ID NO: 29601 - RNA, 20 nt, Artificial Sequence
  MKO10029601_A_Lrrn4cl
  gRNA
uugcccccgacgucaaggua

SEQ ID NO: 29602 - RNA, 20 nt, Artificial Sequence
  MKO10029602_A_Lrrn4
  gRNA
cgcacgcugcgcagccucga

SEQ ID NO: 29603 - RNA, 20 nt, Artificial Sequence
  MKO10029603_A_Lrrn4
  gRNA
accgcaucuccgugcuacac

SEQ ID NO: 29604 - RNA, 20 nt, Artificial Sequence
  MKO10029604_A_Lrrn4
  gRNA
ccuguuacugguuagcaccc

SEQ ID NO: 29605 - RNA, 20 nt, Artificial Sequence
  MKO10029605_A_Lrrtm1
  gRNA
ggacagguuauggggcgccu

SEQ ID NO: 29606 - RNA, 20 nt, Artificial Sequence
  MKO10029606_A_Lrrtm1
  gRNA
aguuagcaucguaacguccc

SEQ ID NO: 29607 - RNA, 20 nt, Artificial Sequence
  MKO10029607_A_Lrrtm1
  gRNA
cguugcgcccgcagucccac

SEQ ID NO: 29608 - RNA, 20 nt, Artificial Sequence
  MKO10029608_A_Lrrtm2
  gRNA
cugaaaucccucacgaccgu

SEQ ID NO: 29609 - RNA, 20 nt, Artificial Sequence
  MKO10029609_A_Lrrtm2
  gRNA
cacaaaccguuugcgaaguu

SEQ ID NO: 29610 - RNA, 20 nt, Artificial Sequence
  MKO10029610_A_Lrrtm2
  gRNA
uucgagccaaacuucgcaaa

SEQ ID NO: 29611 - RNA, 20 nt, Artificial Sequence
  MKO10029611_A_Lrrtm3
  gRNA
cgcugcccgcgaugaucuua

SEQ ID NO: 29612 - RNA, 20 nt, Artificial Sequence
  MKO10029612_A_Lrrtm3
  gRNA
agcagcgcucccucaugcga

SEQ ID NO: 29613 - RNA, 20 nt, Artificial Sequence
  MKO10029613_A_Lrrtm3
  gRNA
uugagcacaaucacgucagc

SEQ ID NO: 29614 - RNA, 20 nt, Artificial Sequence
  MKO10029614_A_Lrrtm4
  gRNA
uuaucccgaaacgcguuugc

SEQ ID NO: 29615 - RNA, 20 nt, Artificial Sequence
  MKO10029615_A_Lrrtm4
  gRNA
gacauccaagcaaucgagcc

SEQ ID NO: 29616 - RNA, 20 nt, Artificial Sequence
  MKO10029616_A_Lrrtm4
  gRNA
augugccaggcucgauugcu

SEQ ID NO: 29617 - RNA, 20 nt, Artificial Sequence
  MKO10029617_A_Lrsam1
  gRNA
gucagcugccccaugucauc

SEQ ID NO: 29618 - RNA, 20 nt, Artificial Sequence
  MKO10029618_A_Lrsam1
  gRNA
cacguugcaaaagccccaaa

SEQ ID NO: 29619 - RNA, 20 nt, Artificial Sequence
  MKO10029619_A_Lrsam1
  gRNA
ucuccccaggcaaaagaagc

SEQ ID NO: 29620 - RNA, 20 nt, Artificial Sequence
  MKO10029620_A_Lrtm1
  gRNA
gaucguaugucucaugaugu

SEQ ID NO: 29621 - RNA, 20 nt, Artificial Sequence
  MKO10029621_A_Lrtm1
  gRNA
caggguugguacaguucgug

SEQ ID NO: 29622 - RNA, 20 nt, Artificial Sequence
  MKO10029622_A_Lrtm1
  gRNA
gccgggauauauguugaaug

SEQ ID NO: 29623 - RNA, 20 nt, Artificial Sequence
  MKO10029623_A_Lrtm2
  gRNA
ccggcugacguucgagcccc

SEQ ID NO: 29624 - RNA, 20 nt, Artificial Sequence
  MKO10029624_A_Lrtm2
  gRNA
ugaugcuguuauuccgaagc

SEQ ID NO: 29625 - RNA, 20 nt, Artificial Sequence
  MKO10029625_A_Lrtm2
  gRNA
aucaucgccggggucgugug

SEQ ID NO: 29626 - RNA, 20 nt, Artificial Sequence
  MKO10029626_A_Lrwd1
  gRNA
ccaggugcggaugaucgccg

SEQ ID NO: 29627 - RNA, 20 nt, Artificial Sequence
  MKO10029627_A_Lrwd1
  gRNA
cgcucaucgaguucacgcag

SEQ ID NO: 29628 - RNA, 20 nt, Artificial Sequence
  MKO10029628_A_Lrwd1
  gRNA
ggaccuuagcgucuugcacc

SEQ ID NO: 29629 - RNA, 20 nt, Artificial Sequence
  MKO10029629_A_Lsamp
  gRNA
ugccaacgaggucuccucgg

SEQ ID NO: 29630 - RNA, 20 nt, Artificial Sequence
  MKO10029630_A_Lsamp
  gRNA
gcucuucgacuccgugauag

SEQ ID NO: 29631 - RNA, 20 nt, Artificial Sequence
  MKO10029631_A_Lsamp
  gRNA
cuuguacgaucaaguaaacu

SEQ ID NO: 29632 - RNA, 20 nt, Artificial Sequence
  MKO10029632_A_Lsg1
  gRNA
uauuaaguuuguacccccug

SEQ ID NO: 29633 - RNA, 20 nt, Artificial Sequence
  MKO10029633_A_Lsg1
  gRNA
gaaguccaaguuccguucaa

SEQ ID NO: 29634 - RNA, 20 nt, Artificial Sequence
  MKO10029634_A_Lsg1
  gRNA
ccaacacucaccgcacaagc

SEQ ID NO: 29635 - RNA, 20 nt, Artificial Sequence
  MKO10029635_A_Lsm10
  gRNA
gacguaucggacguuacgac

SEQ ID NO: 29636 - RNA, 20 nt, Artificial Sequence
  MKO10029636_A_Lsm10
  gRNA
cgauacguccauaucccaga

SEQ ID NO: 29637 - RNA, 20 nt, Artificial Sequence
  MKO10029637_A_Lsm10
  gRNA
gucgagaguuccccuccaaa

SEQ ID NO: 29638 - RNA, 20 nt, Artificial Sequence
  MKO10029638_A_Lsm11
  gRNA
ucgucgccuucgacaaguuc

SEQ ID NO: 29639 - RNA, 20 nt, Artificial Sequence
  MKO10029639_A_Lsm11
  gRNA
caccccgcaaugugcuuacg

SEQ ID NO: 29640 - RNA, 20 nt, Artificial Sequence
  MKO10029640_A_Lsm11
  gRNA
uccgguggagguucccgccg

SEQ ID NO: 29641 - RNA, 20 nt, Artificial Sequence
  MKO10029641_A_Lsm12
  gRNA
cccaacucacgucuugugaa

SEQ ID NO: 29642 - RNA, 20 nt, Artificial Sequence
  MKO10029642_A_Lsm12
  gRNA
agcuucacucaauguuagua

SEQ ID NO: 29643 - RNA, 20 nt, Artificial Sequence
  MKO10029643_A_Lsm12
  gRNA
gugaacgcugcaguaucuuu

SEQ ID NO: 29644 - RNA, 20 nt, Artificial Sequence
  MKO10029644_A_Lsm14a
  gRNA
uucuuaccaguucgauccuu

SEQ ID NO: 29645 - RNA, 20 nt, Artificial Sequence
  MKO10029645_A_Lsm14a
  gRNA
acaagcaguacagaccgccu

SEQ ID NO: 29646 - RNA, 20 nt, Artificial Sequence
  MKO10029646_A_Lsm14a
  gRNA
gucgucaucuucauuccagu

SEQ ID NO: 29647 - RNA, 20 nt, Artificial Sequence
  MKO10029647_A_Lsm14b
  gRNA
gcguuaccugaccgccuccg

SEQ ID NO: 29648 - RNA, 20 nt, Artificial Sequence
  MKO10029648_A_Lsm14b
  gRNA
accauggggcucuugccgac

SEQ ID NO: 29649 - RNA, 20 nt, Artificial Sequence
  MKO10029649_A_Lsm14b
  gRNA
accauugagcugugucgccg

SEQ ID NO: 29650 - RNA, 20 nt, Artificial Sequence
  MKO10029650_A_Lsm1
  gRNA
cauuccucgcgcagacacuc

SEQ ID NO: 29651 - RNA, 20 nt, Artificial Sequence
  MKO10029651_A_Lsm1
  gRNA
ucguccagagugucugcgcg

SEQ ID NO: 29652 - RNA, 20 nt, Artificial Sequence
  MKO10029652_A_Lsm1
  gRNA
cacugucgauguccucgaug

SEQ ID NO: 29653 - RNA, 20 nt, Artificial Sequence
  MKO10029653_A_Lsm2
  gRNA
gcucggagccgaugguguuu

SEQ ID NO: 29654 - RNA, 20 nt, Artificial Sequence
  MKO10029654_A_Lsm2
  gRNA
gcacuucugugcuguugacg

SEQ ID NO: 29655 - RNA, 20 nt, Artificial Sequence
  MKO10029655_A_Lsm2
  gRNA
ugucgguuaguuugauauug

SEQ ID NO: 29656 - RNA, 20 nt, Artificial Sequence
  MKO10029656_A_Lsm3
  gRNA
cauggcggacgacguagauc

SEQ ID NO: 29657 - RNA, 20 nt, Artificial Sequence
  MKO10029657_A_Lsm3
  gRNA
acagaccaccaauaccguag

SEQ ID NO: 29658 - RNA, 20 nt, Artificial Sequence
  MKO10029658_A_Lsm3
  gRNA
guagucugccucgaagcucu

SEQ ID NO: 29659 - RNA, 20 nt, Artificial Sequence
  MKO10029659_A_Lsm4
  gRNA
ggagaccuacaacgggcauc

SEQ ID NO: 29660 - RNA, 20 nt, Artificial Sequence
  MKO10029660_A_Lsm4
  gRNA
gcucaccagaugcccguugu

SEQ ID NO: 29661 - RNA, 20 nt, Artificial Sequence
  MKO10029661_A_Lsm4
  gRNA
augccugagugcuacauccg

SEQ ID NO: 29662 - RNA, 20 nt, Artificial Sequence
  MKO10029662_A_Lsm5
  gRNA
ccaaugcagcugguucccgg

SEQ ID NO: 29663 - RNA, 20 nt, Artificial Sequence
  MKO10029663_A_Lsm5
  gRNA
uuuagugaaauuacaccaga

SEQ ID NO: 29664 - RNA, 20 nt, Artificial Sequence
  MKO10029664_A_Lsm5
  gRNA
auuaaauucagauauggugu

SEQ ID NO: 29665 - RNA, 20 nt, Artificial Sequence
  MKO10029665_A_Lsm6
  gRNA
agcucuuaccauuguuuccu

SEQ ID NO: 29666 - RNA, 20 nt, Artificial Sequence
  MKO10029666_A_Lsm6
  gRNA
uccagggguccuggccugcc

SEQ ID NO: 29667 - RNA, 20 nt, Artificial Sequence
  MKO10029667_A_Lsm6
  gRNA
gguuguuaaacaugagccug

SEQ ID NO: 29668 - RNA, 20 nt, Artificial Sequence
  MKO10029668_A_Lsm7
  gRNA
acucaccuucccggccaccc

SEQ ID NO: 29669 - RNA, 20 nt, Artificial Sequence
  MKO10029669_A_Lsm7
  gRNA
gggaccauggaguacaugag

SEQ ID NO: 29670 - RNA, 20 nt, Artificial Sequence
  MKO10029670_A_Lsm7
  gRNA
cucaccucucauguacucca

SEQ ID NO: 29671 - RNA, 20 nt, Artificial Sequence
  MKO10029671_A_Lsm8
  gRNA
gacggauucugcacucgacu

SEQ ID NO: 29672 - RNA, 20 nt, Artificial Sequence
  MKO10029672_A_Lsm8
  gRNA
gcggguguucagcucuucac

SEQ ID NO: 29673 - RNA, 20 nt, Artificial Sequence
  MKO10029673_A_Lsm8
  gRNA
aagagcugaacacccgcuca

SEQ ID NO: 29674 - RNA, 20 nt, Artificial Sequence
  MKO10029674_A_Lsmd1
  gRNA
gccgaccaugcuacuacgag

SEQ ID NO: 29675 - RNA, 20 nt, Artificial Sequence
  MKO10029675_A_Lsmd1
  gRNA
acucgccggccacgcgugca

SEQ ID NO: 29676 - RNA, 20 nt, Artificial Sequence
  MKO10029676_A_Lsmd1
  gRNA
uacagucgcgaucagugcac

SEQ ID NO: 29677 - RNA, 20 nt, Artificial Sequence
  MKO10029677_A_Lsmem1
  gRNA
uucuugacacguccuccauc

SEQ ID NO: 29678 - RNA, 20 nt, Artificial Sequence
  MKO10029678_A_Lsmem1
  gRNA
agaaggaagacucuacguug

SEQ ID NO: 29679 - RNA, 20 nt, Artificial Sequence
  MKO10029679_A_Lsmem1
  gRNA
caaacucagucucugcccga

SEQ ID NO: 29680 - RNA, 20 nt, Artificial Sequence
  MKO10029680_A_Lsp1
  gRNA
uucccccagaauugcugccg

SEQ ID NO: 29681 - RNA, 20 nt, Artificial Sequence
  MKO10029681_A_Lsp1
  gRNA
cggagccacggcagcaauuc

SEQ ID NO: 29682 - RNA, 20 nt, Artificial Sequence
  MKO10029682_A_Lsp1
  gRNA
cugcccgugagcagcgucaa

SEQ ID NO: 29683 - RNA, 20 nt, Artificial Sequence
  MKO10029683_A_Lsr
  gRNA
ugacagugcguacgcugucc

SEQ ID NO: 29684 - RNA, 20 nt, Artificial Sequence
  MKO10029684_A_Lsr
  gRNA
ccccggcuacaaccccuaug

SEQ ID NO: 29685 - RNA, 20 nt, Artificial Sequence
  MKO10029685_A_Lsr
  gRNA
uggaguguauuacugcuccg

SEQ ID NO: 29686 - RNA, 20 nt, Artificial Sequence
  MKO10029686_A_Lss
  gRNA
ccgccaccgaucucacccgc

SEQ ID NO: 29687 - RNA, 20 nt, Artificial Sequence
  MKO10029687_A_Lss
  gRNA
cucaggugucugcggcgucg

SEQ ID NO: 29688 - RNA, 20 nt, Artificial Sequence
  MKO10029688_A_Lss
  gRNA
aaaagcgcaaacagcccaug

SEQ ID NO: 29689 - RNA, 20 nt, Artificial Sequence
  MKO10029689_A_Lst1
  gRNA
cugacuaugccugcaucgcc

SEQ ID NO: 29690 - RNA, 20 nt, Artificial Sequence
  MKO10029690_A_Lst1
  gRNA
gcuuaccucucugacugaac

SEQ ID NO: 29691 - RNA, 20 nt, Artificial Sequence
  MKO10029691_A_Lst1
  gRNA
ccagaugauuuccugcuaaa

SEQ ID NO: 29692 - RNA, 20 nt, Artificial Sequence
  MKO10029692_A_Lua4h
  gRNA
gaaauuaacguacaccgcag

SEQ ID NO: 29693 - RNA, 20 nt, Artificial Sequence
  MKO10029693_A_Lua4h
  gRNA
cucaugagugccauccguga

SEQ ID NO: 29694 - RNA, 20 nt, Artificial Sequence
  MKO10029694_A_Lua4h
  gRNA
cucacuccugaacagacguc

SEQ ID NO: 29695 - RNA, 20 nt, Artificial Sequence
  MKO10029695_A_Lua
  gRNA
ugguacauugagcgcaccca

SEQ ID NO: 29696 - RNA, 20 nt, Artificial Sequence
  MKO10029696_A_Lua
  gRNA
gaucgugccuuucuccgaca

SEQ ID NO: 29697 - RNA, 20 nt, Artificial Sequence
  MKO10029697_A_Lua
  gRNA
guguccgcuucuccgcugcc

SEQ ID NO: 29698 - RNA, 20 nt, Artificial Sequence
  MKO10029698_A_Ltb4r1
  gRNA
ccgcuaugugcucaucgcgc

SEQ ID NO: 29699 - RNA, 20 nt, Artificial Sequence
  MKO10029699_A_Ltb4r1
  gRNA
guacuaaggccuuugcccga

SEQ ID NO: 29700 - RNA, 20 nt, Artificial Sequence
  MKO10029700_A_Ltb4r1
  gRNA
ggccggugcggcgacuacgg

SEQ ID NO: 29701 - RNA, 20 nt, Artificial Sequence
  MKO10029701_A_Ltb4r2
  gRNA
cggcugcuauggcgugacgc

SEQ ID NO: 29702 - RNA, 20 nt, Artificial Sequence
  MKO10029702_A_Ltb4r2
  gRNA
ccuguaggagauugaccgcg

SEQ ID NO: 29703 - RNA, 20 nt, Artificial Sequence
  MKO10029703_A_Ltb4r2
  gRNA
gagcagcagcaccgcgccgu

SEQ ID NO: 29704 - RNA, 20 nt, Artificial Sequence
  MKO10029704_A_Ltbp1
  gRNA
cucacccacucggaaguucg

SEQ ID NO: 29705 - RNA, 20 nt, Artificial Sequence
  MKO10029705_A_Ltbp1
  gRNA
gacagccacgaacuuccgag

SEQ ID NO: 29706 - RNA, 20 nt, Artificial Sequence
  MKO10029706_A_Ltbp1
  gRNA
cugguagaguuugggcauac

SEQ ID NO: 29707 - RNA, 20 nt, Artificial Sequence
  MKO10029707_A_Ltbp2
  gRNA
guucgucgguauccggccac

SEQ ID NO: 29708 - RNA, 20 nt, Artificial Sequence
  MKO10029708_A_Ltbp2
  gRNA
cggauaccgacgaacugucc

SEQ ID NO: 29709 - RNA, 20 nt, Artificial Sequence
  MKO10029709_A_Ltbp2
  gRNA
gguacucacguuugauacag

SEQ ID NO: 29710 - RNA, 20 nt, Artificial Sequence
  MKO10029710_A_Ltbp3
  gRNA
aucgaggggccgaacgcuga

SEQ ID NO: 29711 - RNA, 20 nt, Artificial Sequence
  MKO10029711_A_Ltbp3
  gRNA
acauggccccgguccgggcc

SEQ ID NO: 29712 - RNA, 20 nt, Artificial Sequence
  MKO10029712_A_Ltbp3
  gRNA
cucgaugcggugcaccugaa

SEQ ID NO: 29713 - RNA, 20 nt, Artificial Sequence
  MKO10029713_A_Ltbp4
  gRNA
uuacucagguguuccgcgca

SEQ ID NO: 29714 - RNA, 20 nt, Artificial Sequence
  MKO10029714_A_Ltbp4
  gRNA
cgugcacguggagcacccuc

SEQ ID NO: 29715 - RNA, 20 nt, Artificial Sequence
  MKO10029715_A_Ltbp4
  gRNA
aaccaccgcgaugaugaaca

SEQ ID NO: 29716 - RNA, 20 nt, Artificial Sequence
  MKO10029716_A_Ltbr
  gRNA
gagcagcagacgucgugcau

SEQ ID NO: 29717 - RNA, 20 nt, Artificial Sequence
  MKO10029717_A_Ltbr
  gRNA
uugccccuugcaccagcgau

SEQ ID NO: 29718 - RNA, 20 nt, Artificial Sequence
  MKO10029718_A_Ltbr
  gRNA
cccgcugucaaccccauacc

SEQ ID NO: 29719 - RNA, 20 nt, Artificial Sequence
  MKO10029719_A_Ltb
  gRNA
ccauaacgacccguacccga

SEQ ID NO: 29720 - RNA, 20 nt, Artificial Sequence
  MKO10029720_A_Ltb
  gRNA
ccaucggguacgggucguua

SEQ ID NO: 29721 - RNA, 20 nt, Artificial Sequence
  MKO10029721_A_Ltb
  gRNA
cccuguugcgcaguccucuc

SEQ ID NO: 29722 - RNA, 20 nt, Artificial Sequence
  MKO10029722_A_Luc4s
  gRNA
ucggaagacgcgcucgaacu

SEQ ID NO: 29723 - RNA, 20 nt, Artificial Sequence
  MKO10029723_A_Luc4s
  gRNA
aauagcggaggcgcgcgaac

SEQ ID NO: 29724 - RNA, 20 nt, Artificial Sequence
  MKO10029724_A_Luc4s
  gRNA
acgcgcgcucagcgcaacuc

SEQ ID NO: 29725 - RNA, 20 nt, Artificial Sequence
  MKO10029725_A_Ltf
  gRNA
uauggacgaagugucccuau

SEQ ID NO: 29726 - RNA, 20 nt, Artificial Sequence
  MKO10029726_A_Ltf
  gRNA
ccccuacaaacugcgaccug

SEQ ID NO: 29727 - RNA, 20 nt, Artificial Sequence
  MKO10029727_A_Ltf
  gRNA
cagguggcccauuccaauuc

SEQ ID NO: 29728 - RNA, 20 nt, Artificial Sequence
  MKO10029728_A_Ltk
  gRNA
aucagagggcuugcgguggu

SEQ ID NO: 29729 - RNA, 20 nt, Artificial Sequence
  MKO10029729_A_Ltk
  gRNA
ggccgaaugcacgugcccag

SEQ ID NO: 29730 - RNA, 20 nt, Artificial Sequence
  MKO10029730_A_Ltk
  gRNA
acagcuagcuccgugcccuc

SEQ ID NO: 29731 - RNA, 20 nt, Artificial Sequence
  MKO10029731_A_Ltn1
  gRNA
gcugcgucgccucucgaaca

SEQ ID NO: 29732 - RNA, 20 nt, Artificial Sequence
  MKO10029732_A_Ltn1
  gRNA
gcagcucggccacuguuuga

SEQ ID NO: 29733 - RNA, 20 nt, Artificial Sequence
  MKO10029733_A_Ltn1
  gRNA
ucaugaucgccguguucgag

SEQ ID NO: 29734 - RNA, 20 nt, Artificial Sequence
  MKO10029734_A_Ltv1
  gRNA
uuuccuuguaggaccucgac

SEQ ID NO: 29735 - RNA, 20 nt, Artificial Sequence
  MKO10029735_A_Ltv1
  gRNA
ucaagagcugcaacgauguc

SEQ ID NO: 29736 - RNA, 20 nt, Artificial Sequence
  MKO10029736_A_Ltv1
  gRNA
aaagcuuacugaguauacgc

SEQ ID NO: 29737 - RNA, 20 nt, Artificial Sequence
  MKO10029737_A_Luc7l2
  gRNA
cagcgacuuaccgucccgag

SEQ ID NO: 29738 - RNA, 20 nt, Artificial Sequence
  MKO10029738_A_Luc7l2
  gRNA
gguccagcauagcgcgcauc

SEQ ID NO: 29739 - RNA, 20 nt, Artificial Sequence
  MKO10029739_A_Luc7l2
  gRNA
cuuuccuagagaauggaucu

SEQ ID NO: 29740 - RNA, 20 nt, Artificial Sequence
  MKO10029740_A_Luc7l3
  gRNA
guauuugugaacaauuccgc

SEQ ID NO: 29741 - RNA, 20 nt, Artificial Sequence
  MKO10029741_A_Luc7l3
  gRNA
uagacgaggucaugcucguu

SEQ ID NO: 29742 - RNA, 20 nt, Artificial Sequence
  MKO10029742_A_Luc7l3
  gRNA
acaaauacccguucugaucu

SEQ ID NO: 29743 - RNA, 20 nt, Artificial Sequence
  MKO10029743_A_Luc7l
  gRNA
gaaccgaacuugccaaaaag

SEQ ID NO: 29744 - RNA, 20 nt, Artificial Sequence
  MKO10029744_A_Luc7l
  gRNA
acagggcccgcaucugcgcc

SEQ ID NO: 29745 - RNA, 20 nt, Artificial Sequence
  MKO10029745_A_Luc7l
  gRNA
cugcucgaagagccaagucg

SEQ ID NO: 29746 - RNA, 20 nt, Artificial Sequence
  MKO10029746_A_Lum
  gRNA
guggaccgacggacucgguc

SEQ ID NO: 29747 - RNA, 20 nt, Artificial Sequence
  MKO10029747_A_Lum
  gRNA
aagcgcuugaaguacucauc

SEQ ID NO: 29748 - RNA, 20 nt, Artificial Sequence
  MKO10029748_A_Lum
  gRNA
caagcgcagaugcuugaucu

SEQ ID NO: 29749 - RNA, 20 nt, Artificial Sequence
  MKO10029749_A_Lurap1l
  gRNA
agccuagcgcgcucgcugcg

SEQ ID NO: 29750 - RNA, 20 nt, Artificial Sequence
  MKO10029750_A_Lurap1l
  gRNA
acgcaugagccuuacaucag

SEQ ID NO: 29751 - RNA, 20 nt, Artificial Sequence
  MKO10029751_A_Lurap1l
  gRNA
gcgcugggguggcuacgucg

SEQ ID NO: 29752 - RNA, 20 nt, Artificial Sequence
  MKO10029752_A_Lurap1
  gRNA
gcuucgaggcgagugcgagc

SEQ ID NO: 29753 - RNA, 20 nt, Artificial Sequence
  MKO10029753_A_Lurap1
  gRNA
gacgccggacuugcgagacg

SEQ ID NO: 29754 - RNA, 20 nt, Artificial Sequence
  MKO10029754_A_Lurap1
  gRNA
ugccucaauacccucguuca

SEQ ID NO: 29755 - RNA, 20 nt, Artificial Sequence
  MKO10029755_A_Luzp1
  gRNA
ccgccgccucgaugaguuag

SEQ ID NO: 29756 - RNA, 20 nt, Artificial Sequence
  MKO10029756_A_Luzp1
  gRNA
gccuagagccgucccgagcg

SEQ ID NO: 29757 - RNA, 20 nt, Artificial Sequence
  MKO10029757_A_Luzp1
  gRNA
cggguuguguauucgccugc

SEQ ID NO: 29758 - RNA, 20 nt, Artificial Sequence
  MKO10029758_A_Luzp2
  gRNA
augucuuugucagcugccgc

SEQ ID NO: 29759 - RNA, 20 nt, Artificial Sequence
  MKO10029759_A_Luzp2
  gRNA
gauccgugacuuacagaaug

SEQ ID NO: 29760 - RNA, 20 nt, Artificial Sequence
  MKO10029760_A_Luzp2
  gRNA
aaccgaugugcagaagcuuc

SEQ ID NO: 29761 - RNA, 20 nt, Artificial Sequence
  MKO10029761_A_Luzp4
  gRNA
ugaucuaucccugaguuguu

SEQ ID NO: 29762 - RNA, 20 nt, Artificial Sequence
  MKO10029762_A_Luzp4
  gRNA
uguacuuuaccucucccucg

SEQ ID NO: 29763 - RNA, 20 nt, Artificial Sequence
  MKO10029763_A_Luzp4
  gRNA
uucugaagaagaauacaaug

SEQ ID NO: 29764 - RNA, 20 nt, Artificial Sequence
  MKO10029764_A_Lxn
  gRNA
acuccacgacauugcaucgc

SEQ ID NO: 29765 - RNA, 20 nt, Artificial Sequence
  MKO10029765_A_Lxn
  gRNA
uuaccugcgaugcaaugucg

SEQ ID NO: 29766 - RNA, 20 nt, Artificial Sequence
  MKO10029766_A_Lxn
  gRNA
ucgccugcgguuauguaaug

SEQ ID NO: 29767 - RNA, 20 nt, Artificial Sequence
  MKO10029767_A_Ly6a
  gRNA
ucacguugaccuuaguaccc

SEQ ID NO: 29768 - RNA, 20 nt, Artificial Sequence
  MKO10029768_A_Ly6a
  gRNA
cccuccuaauauugaaagua

SEQ ID NO: 29769 - RNA, 20 nt, Artificial Sequence
  MKO10029769_A_Ly6a
  gRNA
ucaggaggcagcaguuauug

SEQ ID NO: 29770 - RNA, 20 nt, Artificial Sequence
  MKO10029770_A_Ly6c1
  gRNA
caaucagggauccuaacauc

SEQ ID NO: 29771 - RNA, 20 nt, Artificial Sequence
  MKO10029771_A_Ly6c1
  gRNA
ucccugauuggcacaccagc

SEQ ID NO: 29772 - RNA, 20 nt, Artificial Sequence
  MKO10029772_A_Ly6c1
  gRNA
cugugugcucauucuucuug

SEQ ID NO: 29773 - RNA, 20 nt, Artificial Sequence
  MKO10029773_A_Ly6c2
  gRNA
caaucaaggauccuaacauc

SEQ ID NO: 29774 - RNA, 20 nt, Artificial Sequence
  MKO10029774_A_Ly6c2
  gRNA
uccuugauuggcacaccagc

SEQ ID NO: 29775 - RNA, 20 nt, Artificial Sequence
  MKO10029775_A_Ly6c2
  gRNA
caccucuuccugcacacagu

SEQ ID NO: 29776 - RNA, 20 nt, Artificial Sequence
  MKO10029776_A_Ly6d
  gRNA
agacugaccuaugcaacgag

SEQ ID NO: 29777 - RNA, 20 nt, Artificial Sequence
  MKO10029777_A_Ly6d
  gRNA
cacgugacaucgaagugccc

SEQ ID NO: 29778 - RNA, 20 nt, Artificial Sequence
  MKO10029778_A_Ly6d
  gRNA
ugaccagccucucguugcau

SEQ ID NO: 29779 - RNA, 20 nt, Artificial Sequence
  MKO10029779_A_Ly6e
  gRNA
uaucacguuaucugccgcug

SEQ ID NO: 29780 - RNA, 20 nt, Artificial Sequence
  MKO10029780_A_Ly6e
  gRNA
uucugcaacuucagcgcagc

SEQ ID NO: 29781 - RNA, 20 nt, Artificial Sequence
  MKO10029781_A_Ly6e
  gRNA
cuacucaccaaagcccgcag

SEQ ID NO: 29782 - RNA, 20 nt, Artificial Sequence
  MKO10029782_A_Ly6f
  gRNA
ggggcagguaauugauuugc

SEQ ID NO: 29783 - RNA, 20 nt, Artificial Sequence
  MKO10029783_A_Ly6f
  gRNA
caauuccaagugaaacuccc

SEQ ID NO: 29784 - RNA, 20 nt, Artificial Sequence
  MKO10029784_A_Ly6f
  gRNA
gcuucuguuaaaucugggcu

SEQ ID NO: 29785 - RNA, 20 nt, Artificial Sequence
  MKO10029785_A_Ly6g5b
  gRNA
aggaguugcaguaaucguac

SEQ ID NO: 29786 - RNA, 20 nt, Artificial Sequence
  MKO10029786_A_Ly6g5b
  gRNA
augagggcccgcgugcuugu

SEQ ID NO: 29787 - RNA, 20 nt, Artificial Sequence
  MKO10029787_A_Ly6g5b
  gRNA
ucaccauacacggcgaugga

SEQ ID NO: 29788 - RNA, 20 nt, Artificial Sequence
  MKO10029788_A_Ly6g5c
  gRNA
gaauugcuaccgaugucugc

SEQ ID NO: 29789 - RNA, 20 nt, Artificial Sequence
  MKO10029789_A_Ly6g5c
  gRNA
agggugaagguccucgagcu

SEQ ID NO: 29790 - RNA, 20 nt, Artificial Sequence
  MKO10029790_A_Ly6g5c
  gRNA
gagccacuuaccgagaacca

SEQ ID NO: 29791 - RNA, 20 nt, Artificial Sequence
  MKO10029791_A_Ly6g6c
  gRNA
ucguugaagaccucccgaca

SEQ ID NO: 29792 - RNA, 20 nt, Artificial Sequence
  MKO10029792_A_Ly6g6c
  gRNA
cuucuggugugccgcagcgc

SEQ ID NO: 29793 - RNA, 20 nt, Artificial Sequence
  MKO10029793_A_Ly6g6c
  gRNA
caagguacacguuuguuguc

SEQ ID NO: 29794 - RNA, 20 nt, Artificial Sequence
  MKO10029794_A_Ly6g6d
  gRNA
cgcagucauagcaccgcgug

SEQ ID NO: 29795 - RNA, 20 nt, Artificial Sequence
  MKO10029795_A_Ly6g6d
  gRNA
cacgcaucauugcaaucaag

SEQ ID NO: 29796 - RNA, 20 nt, Artificial Sequence
  MKO10029796_A_Ly6g6d
  gRNA
uccugccaggacaccgcacg

SEQ ID NO: 29797 - RNA, 20 nt, Artificial Sequence
  MKO10029797_A_Ly6g6e
  gRNA
gccaugcgaccuacugguca

SEQ ID NO: 29798 - RNA, 20 nt, Artificial Sequence
  MKO10029798_A_Ly6g6e
  gRNA
auguacuccccagccgauca

SEQ ID NO: 29799 - RNA, 20 nt, Artificial Sequence
  MKO10029799_A_Ly6g6e
  gRNA
guaacagcggagccguccuc

SEQ ID NO: 29800 - RNA, 20 nt, Artificial Sequence
  MKO10029800_A_Ly6g6f
  gRNA
aaucggguucggguuuccga

SEQ ID NO: 29801 - RNA, 20 nt, Artificial Sequence
  MKO10029801_A_Ly6g6f
  gRNA
acauccacuuggcccgccuu

SEQ ID NO: 29802 - RNA, 20 nt, Artificial Sequence
  MKO10029802_A_Ly6g6f
  gRNA
cuuaccuaaggcgggccaag

SEQ ID NO: 29803 - RNA, 20 nt, Artificial Sequence
  MKO10029803_A_Ly6h
  gRNA
gugccgcuuaacgaagucgc

SEQ ID NO: 29804 - RNA, 20 nt, Artificial Sequence
  MKO10029804_A_Ly6h
  gRNA
ccuccugcgacuucguuaag

SEQ ID NO: 29805 - RNA, 20 nt, Artificial Sequence
  MKO10029805_A_Ly6h
  gRNA
auaccguuugugccagcgug

SEQ ID NO: 29806 - RNA, 20 nt, Artificial Sequence
  MKO10029806_A_Ly6i
  gRNA
gcaacaggaaauauucaucu

SEQ ID NO: 29807 - RNA, 20 nt, Artificial Sequence
  MKO10029807_A_Ly6i
  gRNA
aauugaaaagaaguuuaucc

SEQ ID NO: 29808 - RNA, 20 nt, Artificial Sequence
  MKO10029808_A_Ly6i
  gRNA
uuuaccugccccuacccuga

SEQ ID NO: 29809 - RNA, 20 nt, Artificial Sequence
  MKO10029809_A_Ly6k
  gRNA
ugucgaaacagugcacccga

SEQ ID NO: 29810 - RNA, 20 nt, Artificial Sequence
  MKO10029810_A_Ly6k
  gRNA
ucuggagauggcguuccuag

SEQ ID NO: 29811 - RNA, 20 nt, Artificial Sequence
  MKO10029811_A_Ly6k
  gRNA
gcacugggacggauucgagc

SEQ ID NO: 29812 - RNA, 20 nt, Artificial Sequence
  MKO10029812_A_Ly75
  gRNA
guuaaaccuacccguaaugu

SEQ ID NO: 29813 - RNA, 20 nt, Artificial Sequence
  MKO10029813_A_Ly75
  gRNA
uguuaguuccgcuacagucc

SEQ ID NO: 29814 - RNA, 20 nt, Artificial Sequence
  MKO10029814_A_Ly75
  gRNA
ugccgaauuagccuacauua

SEQ ID NO: 29815 - RNA, 20 nt, Artificial Sequence
  MKO10029815_A_Ly86
  gRNA
cucuucggcagaucccuuac

SEQ ID NO: 29816 - RNA, 20 nt, Artificial Sequence
  MKO10029816_A_Ly86
  gRNA
ucagaacagauauacuaugc

SEQ ID NO: 29817 - RNA, 20 nt, Artificial Sequence
  MKO10029817_A_Ly86
  gRNA
caaugaaaaccgugcuacug

SEQ ID NO: 29818 - RNA, 20 nt, Artificial Sequence
  MKO10029818_A_Ly96
  gRNA
cauagaguugccgaagcgua

SEQ ID NO: 29819 - RNA, 20 nt, Artificial Sequence
  MKO10029819_A_Ly96
  gRNA
aucaauaccauucucuuucg

SEQ ID NO: 29820 - RNA, 20 nt, Artificial Sequence
  MKO10029820_A_Ly96
  gRNA
cacagaacuuccuuacgcuu

SEQ ID NO: 29821 - RNA, 20 nt, Artificial Sequence
  MKO10029821_A_Ly9
  gRNA
gauucucgccguaagcccaa

SEQ ID NO: 29822 - RNA, 20 nt, Artificial Sequence
  MKO10029822_A_Ly9
  gRNA
agucgcaccucaacgucucc

SEQ ID NO: 29823 - RNA, 20 nt, Artificial Sequence
  MKO10029823_A_Ly9
  gRNA
cguugaggugcgacuucccu

SEQ ID NO: 29824 - RNA, 20 nt, Artificial Sequence
  MKO10029824_A_Lyar
  gRNA
cugcaaaaguucucgcaccu

SEQ ID NO: 29825 - RNA, 20 nt, Artificial Sequence
  MKO10029825_A_Lyar
  gRNA
cagcgacuccguucuagagc

SEQ ID NO: 29826 - RNA, 20 nt, Artificial Sequence
  MKO10029826_A_Lyar
  gRNA
cuucuucuccggugggccgc

SEQ ID NO: 29827 - RNA, 20 nt, Artificial Sequence
  MKO10029827_A_Lyg1
  gRNA
aggcaacuauguggucgacc

SEQ ID NO: 29828 - RNA, 20 nt, Artificial Sequence
  MKO10029828_A_Lyg1
  gRNA
ugaaguauuuggcucgcgca

SEQ ID NO: 29829 - RNA, 20 nt, Artificial Sequence
  MKO10029829_A_Lyg1
  gRNA
cgcuacggccugaccuauug

SEQ ID NO: 29830 - RNA, 20 nt, Artificial Sequence
  MKO10029830_A_Lyg2
  gRNA
uuugcaggacagccccgccg

SEQ ID NO: 29831 - RNA, 20 nt, Artificial Sequence
  MKO10029831_A_Lyg2
  gRNA
ggcggggcuguccugcaaaa

SEQ ID NO: 29832 - RNA, 20 nt, Artificial Sequence
  MKO10029832_A_Lyg2
  gRNA
gugcacccucgucuguacca

SEQ ID NO: 29833 - RNA, 20 nt, Artificial Sequence
  MKO10029833_A_Lyl1
  gRNA
guggagggcagcgcacgcuu

SEQ ID NO: 29834 - RNA, 20 nt, Artificial Sequence
  MKO10029834_A_Lyl1
  gRNA
accgaaacacgugcacuccc

SEQ ID NO: 29835 - RNA, 20 nt, Artificial Sequence
  MKO10029835_A_Lyl1
  gRNA
ggacgucugcuccaacuuga

SEQ ID NO: 29836 - RNA, 20 nt, Artificial Sequence
  MKO10029836_A_Lynx1
  gRNA
gccagacucacaaguucgug

SEQ ID NO: 29837 - RNA, 20 nt, Artificial Sequence
  MKO10029837_A_Lynx1
  gRNA
ugcuuugaaaccguguacga

SEQ ID NO: 29838 - RNA, 20 nt, Artificial Sequence
  MKO10029838_A_Lynx1
  gRNA
cugcagacuucaccccauac

SEQ ID NO: 29839 - RNA, 20 nt, Artificial Sequence
  MKO10029839_A_Lyn
  gRNA
acaaugucaccuuguuccuc

SEQ ID NO: 29840 - RNA, 20 nt, Artificial Sequence
  MKO10029840_A_Lyn
  gRNA
uucuuagauccagaggaaca

SEQ ID NO: 29841 - RNA, 20 nt, Artificial Sequence
  MKO10029841_A_Lyn
  gRNA
uuuguuugaaaucucugucc

SEQ ID NO: 29842 - RNA, 20 nt, Artificial Sequence
  MKO10029842_A_Lypd1
  gRNA
augagcaaucguuguucagc

SEQ ID NO: 29843 - RNA, 20 nt, Artificial Sequence
  MKO10029843_A_Lypd1
  gRNA
cugacgaugcacacgacuuc

SEQ ID NO: 29844 - RNA, 20 nt, Artificial Sequence
  MKO10029844_A_Lypd1
  gRNA
ugcaauuuacgaugaacuca

SEQ ID NO: 29845 - RNA, 20 nt, Artificial Sequence
  MKO10029845_A_Lypd2
  gRNA
gugccccauccacguugcau

SEQ ID NO: 29846 - RNA, 20 nt, Artificial Sequence
  MKO10029846_A_Lypd2
  gRNA
guagagcguagucuugcaca

SEQ ID NO: 29847 - RNA, 20 nt, Artificial Sequence
  MKO10029847_A_Lypd2
  gRNA
caauucugaccuaugcaacg

SEQ ID NO: 29848 - RNA, 20 nt, Artificial Sequence
  MKO10029848_A_Lypd3
  gRNA
gcguuguagcaguucacgac

SEQ ID NO: 29849 - RNA, 20 nt, Artificial Sequence
  MKO10029849_A_Lypd3
  gRNA
ugcgaaggucggcguuacag

SEQ ID NO: 29850 - RNA, 20 nt, Artificial Sequence
  MKO10029850_A_Lypd3
  gRNA
gcccgugaagguccaguccg

SEQ ID NO: 29851 - RNA, 20 nt, Artificial Sequence
  MKO10029851_A_Lypd4
  gRNA
gaccguaguguucaucgaga

SEQ ID NO: 29852 - RNA, 20 nt, Artificial Sequence
  MKO10029852_A_Lypd4
  gRNA
uccuaccucgugucuccgcc

SEQ ID NO: 29853 - RNA, 20 nt, Artificial Sequence
  MKO10029853_A_Lypd4
  gRNA
acccgucucgaugaacacua

SEQ ID NO: 29854 - RNA, 20 nt, Artificial Sequence
  MKO10029854_A_Lypd5
  gRNA
guuccccugagaagucccga

SEQ ID NO: 29855 - RNA, 20 nt, Artificial Sequence
  MKO10029855_A_Lypd5
  gRNA
ccgcccagguuaccgcagcc

SEQ ID NO: 29856 - RNA, 20 nt, Artificial Sequence
  MKO10029856_A_Lypd5
  gRNA
ugacagguccggauguacac

SEQ ID NO: 29857 - RNA, 20 nt, Artificial Sequence
  MKO10029857_A_Lypd6b
  gRNA
cugccgacacagccgagauu

SEQ ID NO: 29858 - RNA, 20 nt, Artificial Sequence
  MKO10029858_A_Lypd6b
  gRNA
ucgcuguaaugcacgcucag

SEQ ID NO: 29859 - RNA, 20 nt, Artificial Sequence
  MKO10029859_A_Lypd6b
  gRNA
ccccuacuuacgaucaagag

SEQ ID NO: 29860 - RNA, 20 nt, Artificial Sequence
  MKO10029860_A_Lypd6
  gRNA
acaauuaugaaugcaaccga

SEQ ID NO: 29861 - RNA, 20 nt, Artificial Sequence
  MKO10029861_A_Lypd6
  gRNA
ugccgagacucagagcacga

SEQ ID NO: 29862 - RNA, 20 nt, Artificial Sequence
  MKO10029862_A_Lypd6
  gRNA
uuuguagccacuccguaucc

SEQ ID NO: 29863 - RNA, 20 nt, Artificial Sequence
  MKO10029863_A_Lypd8
  gRNA
ugggauagugguggucgagu

SEQ ID NO: 29864 - RNA, 20 nt, Artificial Sequence
  MKO10029864_A_Lypd8
  gRNA
guucuccuucguaacacuuu

SEQ ID NO: 29865 - RNA, 20 nt, Artificial Sequence
  MKO10029865_A_Lypd8
  gRNA
augcggagcagaacuuguuc

SEQ ID NO: 29866 - RNA, 20 nt, Artificial Sequence
  MKO10029866_A_Lypla1
  gRNA
uauucuagguuugauaucgu

SEQ ID NO: 29867 - RNA, 20 nt, Artificial Sequence
  MKO10029867_A_Lypla1
  gRNA
cuguaucucccaauccguga

SEQ ID NO: 29868 - RNA, 20 nt, Artificial Sequence
  MKO10029868_A_Lypla1
  gRNA
ggaugggcagaagccuuugc

SEQ ID NO: 29869 - RNA, 20 nt, Artificial Sequence
  MKO10029869_A_Lypla2
  gRNA
aucuucauguugagugucac

SEQ ID NO: 29870 - RNA, 20 nt, Artificial Sequence
  MKO10029870_A_Lypla2
  gRNA
ggacagauguacuugacaug

SEQ ID NO: 29871 - RNA, 20 nt, Artificial Sequence
  MKO10029871_A_Lypla2
  gRNA
cugacgcccucuccaccauc

SEQ ID NO: 29872 - RNA, 20 nt, Artificial Sequence
  MKO10029872_A_Lyplal1
  gRNA
caggccguauacuccucuga

SEQ ID NO: 29873 - RNA, 20 nt, Artificial Sequence
  MKO10029873_A_Lyplal1
  gRNA
gcguaccuggagggggccgu

SEQ ID NO: 29874 - RNA, 20 nt, Artificial Sequence
  MKO10029874_A_Lyplal1
  gRNA
uaucugcagagccgugacac

SEQ ID NO: 29875 - RNA, 20 nt, Artificial Sequence
  MKO10029875_A_Lyrm1
  gRNA
aaguccccgaccucgucgug

SEQ ID NO: 29876 - RNA, 20 nt, Artificial Sequence
  MKO10029876_A_Lyrm1
  gRNA
gucucaccgcacgacgaggu

SEQ ID NO: 29877 - RNA, 20 nt, Artificial Sequence
  MKO10029877_A_Lyrm1
  gRNA
auacucacagggcguggaua

SEQ ID NO: 29878 - RNA, 20 nt, Artificial Sequence
  MKO10029878_A_Lyrm2
  gRNA
auccgaaugaugauaaccca

SEQ ID NO: 29879 - RNA, 20 nt, Artificial Sequence
  MKO10029879_A_Lyrm2
  gRNA
gcaguaccugcuucagcguc

SEQ ID NO: 29880 - RNA, 20 nt, Artificial Sequence
  MKO10029880_A_Lyrm2
  gRNA
cccuugagcaguucaugaga

SEQ ID NO: 29881 - RNA, 20 nt, Artificial Sequence
  MKO10029881_A_Lyrm4
  gRNA
ccuugaaauaauccgcagac

SEQ ID NO: 29882 - RNA, 20 nt, Artificial Sequence
  MKO10029882_A_Lyrm4
  gRNA
cccgggucaccuguaauugu

SEQ ID NO: 29883 - RNA, 20 nt, Artificial Sequence
  MKO10029883_A_Lyrm4
  gRNA
auuucagcgccuacaauuac

SEQ ID NO: 29884 - RNA, 20 nt, Artificial Sequence
  MKO10029884_A_Lyrm5
  gRNA
uacuucuccucguaacgaau

SEQ ID NO: 29885 - RNA, 20 nt, Artificial Sequence
  MKO10029885_A_Lyrm5
  gRNA
aucaaagaacuuaucgcacg

SEQ ID NO: 29886 - RNA, 20 nt, Artificial Sequence
  MKO10029886_A_Lyrm5
  gRNA
aaaauggccaauucguuacg

SEQ ID NO: 29887 - RNA, 20 nt, Artificial Sequence
  MKO10029887_A_Lyrm7
  gRNA
uuuacuuacgcaguguguca

SEQ ID NO: 29888 - RNA, 20 nt, Artificial Sequence
  MKO10029888_A_Lyrm7
  gRNA
ccuggaagcuuuacugcuuc

SEQ ID NO: 29889 - RNA, 20 nt, Artificial Sequence
  MKO10029889_A_Lyrm7
  gRNA
cucagaacagcuguuauuca

SEQ ID NO: 29890 - RNA, 20 nt, Artificial Sequence
  MKO10029890_A_Lyrm9
  gRNA
aaguaacgguacagcugcaa

SEQ ID NO: 29891 - RNA, 20 nt, Artificial Sequence
  MKO10029891_A_Lyrm9
  gRNA
guuacuuguuacguuguugc

SEQ ID NO: 29892 - RNA, 20 nt, Artificial Sequence
  MKO10029892_A_Lyrm9
  gRNA
gagccauugaagaugccgac

SEQ ID NO: 29893 - RNA, 20 nt, Artificial Sequence
  MKO10029893_A_Lysmd1
  gRNA
caucggcaggguaccugagg

SEQ ID NO: 29894 - RNA, 20 nt, Artificial Sequence
  MKO10029894_A_Lysmd1
  gRNA
auuugagugcuaauccagcc

SEQ ID NO: 29895 - RNA, 20 nt, Artificial Sequence
  MKO10029895_A_Lysmd1
  gRNA
cccucuagacagccuccccu

SEQ ID NO: 29896 - RNA, 20 nt, Artificial Sequence
  MKO10029896_A_Lysmd2
  gRNA
uggccgugcugccguacgag

SEQ ID NO: 29897 - RNA, 20 nt, Artificial Sequence
  MKO10029897_A_Lysmd2
  gRNA
cgcaggcgagagauccgcca

SEQ ID NO: 29898 - RNA, 20 nt, Artificial Sequence
  MKO10029898_A_Lysmd2
  gRNA
ccccaagccugcgcaacccg

SEQ ID NO: 29899 - RNA, 20 nt, Artificial Sequence
  MKO10029899_A_Lysmd3
  gRNA
auccguauuacggagcagac

SEQ ID NO: 29900 - RNA, 20 nt, Artificial Sequence
  MKO10029900_A_Lysmd3
  gRNA
ccccagucugcuccguaaua

SEQ ID NO: 29901 - RNA, 20 nt, Artificial Sequence
  MKO10029901_A_Lysmd3
  gRNA
cuaccguacagcaguacuga

SEQ ID NO: 29902 - RNA, 20 nt, Artificial Sequence
  MKO10029902_A_Lysmd4
  gRNA
aucaggugguguuacgaccc

SEQ ID NO: 29903 - RNA, 20 nt, Artificial Sequence
  MKO10029903_A_Lysmd4
  gRNA
caccaagaacuaaugccccu

SEQ ID NO: 29904 - RNA, 20 nt, Artificial Sequence
  MKO10029904_A_Lysmd4
  gRNA
acccagaagccaguagccga

SEQ ID NO: 29905 - RNA, 20 nt, Artificial Sequence
  MKO10029905_A_Lyst
  gRNA
aagggcucggugacgauacu

SEQ ID NO: 29906 - RNA, 20 nt, Artificial Sequence
  MKO10029906_A_Lyst
  gRNA
gcugcaguucuagacgucga

SEQ ID NO: 29907 - RNA, 20 nt, Artificial Sequence
  MKO10029907_A_Lyst
  gRNA
caggauccccugaaaucggu

SEQ ID NO: 29908 - RNA, 20 nt, Artificial Sequence
  MKO10029908_A_Lyve1
  gRNA
uaaaaugugguaacgauuuc

SEQ ID NO: 29909 - RNA, 20 nt, Artificial Sequence
  MKO10029909_A_Lyve1
  gRNA
ugucagcagcagcgccuacu

SEQ ID NO: 29910 - RNA, 20 nt, Artificial Sequence
  MKO10029910_A_Lyve1
  gRNA
auuucugcgcugacucuacc

SEQ ID NO: 29911 - RNA, 20 nt, Artificial Sequence
  MKO10029911_A_Lyz1
  gRNA
ggucuacaaucguugugagu

SEQ ID NO: 29912 - RNA, 20 nt, Artificial Sequence
  MKO10029912_A_Lyz1
  gRNA
cucacaacgauuguagaccu

SEQ ID NO: 29913 - RNA, 20 nt, Artificial Sequence
  MKO10029913_A_Lyz1
  gRNA
ccaagaucuaagaaugccug

SEQ ID NO: 29914 - RNA, 20 nt, Artificial Sequence
  MKO10029914_A_Lyz2
  gRNA
aguuugccagaacucugaaa

SEQ ID NO: 29915 - RNA, 20 nt, Artificial Sequence
  MKO10029915_A_Lyz2
  gRNA
aauggaauggcuggcuacua

SEQ ID NO: 29916 - RNA, 20 nt, Artificial Sequence
  MKO10029916_A_Lyz2
  gRNA
ccaagagcugugaaugccug

SEQ ID NO: 29917 - RNA, 20 nt, Artificial Sequence
  MKO10029917_A_Lyzl1
  gRNA
aaucuacacucgauguaaac

SEQ ID NO: 29918 - RNA, 20 nt, Artificial Sequence
  MKO10029918_A_Lyzl1
  gRNA
caaaucccccguaauugucc

SEQ ID NO: 29919 - RNA, 20 nt, Artificial Sequence
  MKO10029919_A_Lyzl1
  gRNA
cacuacagccgagaaugucc

SEQ ID NO: 29920 - RNA, 20 nt, Artificial Sequence
  MKO10029920_A_Lyzl4
  gRNA
agcuacuugcugacuccgau

SEQ ID NO: 29921 - RNA, 20 nt, Artificial Sequence
  MKO10029921_A_Lyzl4
  gRNA
ggcgacgaugcagcuguacc

SEQ ID NO: 29922 - RNA, 20 nt, Artificial Sequence
  MKO10029922_A_Lyzl4
  gRNA
caagauggcuccaccgguuu

SEQ ID NO: 29923 - RNA, 20 nt, Artificial Sequence
  MKO10029923_A_Lyzl6
  gRNA
uccagaucaacagucguuac

SEQ ID NO: 29924 - RNA, 20 nt, Artificial Sequence
  MKO10029924_A_Lyzl6
  gRNA
accaguaacgacuguugauc

SEQ ID NO: 29925 - RNA, 20 nt, Artificial Sequence
  MKO10029925_A_Lyzl6
  gRNA
caucauccaucgcuguaguu

SEQ ID NO: 29926 - RNA, 20 nt, Artificial Sequence
  MKO10029926_A_Lzic
  gRNA
acuucggacaaggcuagccg

SEQ ID NO: 29927 - RNA, 20 nt, Artificial Sequence
  MKO10029927_A_Lzic
  gRNA
cggcuagccuuguccgaagu

SEQ ID NO: 29928 - RNA, 20 nt, Artificial Sequence
  MKO10029928_A_Lzic
  gRNA
ucaguaucuccaccuuccgc

SEQ ID NO: 29929 - RNA, 20 nt, Artificial Sequence
  MKO10029929_A_Lztfl1
  gRNA
cuugauaccugcuguccuug

SEQ ID NO: 29930 - RNA, 20 nt, Artificial Sequence
  MKO10029930_A_Lztfl1
  gRNA
aaacuuguuccaauuaauga

SEQ ID NO: 29931 - RNA, 20 nt, Artificial Sequence
  MKO10029931_A_Lztfl1
  gRNA
acaucucugaacuugaaaac

SEQ ID NO: 29932 - RNA, 20 nt, Artificial Sequence
  MKO10029932_A_Lztr1
  gRNA
ucuucugcguuucgauguga

SEQ ID NO: 29933 - RNA, 20 nt, Artificial Sequence
  MKO10029933_A_Lztr1
  gRNA
caaucuuccacuccguccac

SEQ ID NO: 29934 - RNA, 20 nt, Artificial Sequence
  MKO10029934_A_Lztr1
  gRNA
gggagcagcauguucgucuu

SEQ ID NO: 29935 - RNA, 20 nt, Artificial Sequence
  MKO10029935_A_Lzts1
  gRNA
aguucgucucuaguccgccg

SEQ ID NO: 29936 - RNA, 20 nt, Artificial Sequence
  MKO10029936_A_Lzts1
  gRNA
acggcggacuagagacgaac

SEQ ID NO: 29937 - RNA, 20 nt, Artificial Sequence
  MKO10029937_A_Lzts1
  gRNA
gggagcugacauccccuacg

SEQ ID NO: 29938 - RNA, 20 nt, Artificial Sequence
  MKO10029938_A_Lzts2
  gRNA
ggcccaaauccgcaagcucg

SEQ ID NO: 29939 - RNA, 20 nt, Artificial Sequence
  MKO10029939_A_Lzts2
  gRNA
aucccggagucccgaugcuu

SEQ ID NO: 29940 - RNA, 20 nt, Artificial Sequence
  MKO10029940_A_Lzts2
  gRNA
ugaaggcuguuggccggauc

SEQ ID NO: 29941 - RNA, 20 nt, Artificial Sequence
  MKO10029941_A_Lzts3
  gRNA
agcggcgacuucgggagcgu

SEQ ID NO: 29942 - RNA, 20 nt, Artificial Sequence
  MKO10029942_A_Lzts3
  gRNA
cucccuggaucagcgcgcac

SEQ ID NO: 29943 - RNA, 20 nt, Artificial Sequence
  MKO10029943_A_Lzts3
  gRNA
ggccggcggguccucaagcu

SEQ ID NO: 29944 - RNA, 20 nt, Artificial Sequence
  MKO10029944_A_M1ap
  gRNA
gacacgccaucagcuguacc

SEQ ID NO: 29945 - RNA, 20 nt, Artificial Sequence
  MKO10029945_A_M1ap
  gRNA
ucgagaauagaugaccccaa

SEQ ID NO: 29946 - RNA, 20 nt, Artificial Sequence
  MKO10029946_A_M1ap
  gRNA
caucguugucuagcgucuca

SEQ ID NO: 29947 - RNA, 20 nt, Artificial Sequence
  MKO10029947_A_M6pr
  gRNA
cgcuagugugugccgauugc

SEQ ID NO: 29948 - RNA, 20 nt, Artificial Sequence
  MKO10029948_A_M6pr
  gRNA
ggguuucuuauaccagcgac

SEQ ID NO: 29949 - RNA, 20 nt, Artificial Sequence
  MKO10029949_A_M6pr
  gRNA
caaagagcagcgccgugcag

SEQ ID NO: 29950 - RNA, 20 nt, Artificial Sequence
  MKO10029950_A_Maaus1
  gRNA
cguugcacgucacucgagag

SEQ ID NO: 29951 - RNA, 20 nt, Artificial Sequence
  MKO10029951_A_Maaus1
  gRNA
uuaccagucugcuucgaauc

SEQ ID NO: 29952 - RNA, 20 nt, Artificial Sequence
  MKO10029952_A_Maaus1
  gRNA
cacucucgagugacgugcaa

SEQ ID NO: 29953 - RNA, 20 nt, Artificial Sequence
  MKO10029953_A_Mab21l1
  gRNA
uuccguucagccgaucgccc

SEQ ID NO: 29954 - RNA, 20 nt, Artificial Sequence
  MKO10029954_A_Mab21l1
  gRNA
ccccaacaugaucgcggccc

SEQ ID NO: 29955 - RNA, 20 nt, Artificial Sequence
  MKO10029955_A_Mab21l1
  gRNA
cggcacgcaaaauccguucc

SEQ ID NO: 29956 - RNA, 20 nt, Artificial Sequence
  MKO10029956_A_Mab21l2
  gRNA
cuagugucuggaaacgcgag

SEQ ID NO: 29957 - RNA, 20 nt, Artificial Sequence
  MKO10029957_A_Mab21l2
  gRNA
ccccaacaugaucgccgcuc

SEQ ID NO: 29958 - RNA, 20 nt, Artificial Sequence
  MKO10029958_A_Mab21l2
  gRNA
ugagauugacgcccgcuacg

SEQ ID NO: 29959 - RNA, 20 nt, Artificial Sequence
  MKO10029959_A_Mab21l3
  gRNA
cggcuucgaaacgacugucc

SEQ ID NO: 29960 - RNA, 20 nt, Artificial Sequence
  MKO10029960_A_Mab21l3
  gRNA
ugugcuagaaaaacgcacua

SEQ ID NO: 29961 - RNA, 20 nt, Artificial Sequence
  MKO10029961_A_Mab21l3
  gRNA
ggccaccaaguuaaacccaa

SEQ ID NO: 29962 - RNA, 20 nt, Artificial Sequence
  MKO10029962_A_Macc1
  gRNA
gcacgaguccgaucuuaccu

SEQ ID NO: 29963 - RNA, 20 nt, Artificial Sequence
  MKO10029963_A_Macc1
  gRNA
cuuuggcaucacuaucacga

SEQ ID NO: 29964 - RNA, 20 nt, Artificial Sequence
  MKO10029964_A_Macc1
  gRNA
ucucuccaccguuuagugac

SEQ ID NO: 29965 - RNA, 20 nt, Artificial Sequence
  MKO10029965_A_Macf1
  gRNA
ucuuaccggagugagcgguc

SEQ ID NO: 29966 - RNA, 20 nt, Artificial Sequence
  MKO10029966_A_Macf1
  gRNA
cuuaccagcgacucggacca

SEQ ID NO: 29967 - RNA, 20 nt, Artificial Sequence
  MKO10029967_A_Macf1
  gRNA
ucagguuguguccaucccga

SEQ ID NO: 29968 - RNA, 20 nt, Artificial Sequence
  MKO10029968_A_Macrod1
  gRNA
ccgauagccgcaagugaucu

SEQ ID NO: 29969 - RNA, 20 nt, Artificial Sequence
  MKO10029969_A_Macrod1
  gRNA
ugcggcauucguccgugagc

SEQ ID NO: 29970 - RNA, 20 nt, Artificial Sequence
  MKO10029970_A_Macrod1
  gRNA
ggaggaccccaaguauaaga

SEQ ID NO: 29971 - RNA, 20 nt, Artificial Sequence
  MKO10029971_A_Macrod2
  gRNA
uuucuuuccauaaccgucuc

SEQ ID NO: 29972 - RNA, 20 nt, Artificial Sequence
  MKO10029972_A_Macrod2
  gRNA
cauucaggaugcaucccuaa

SEQ ID NO: 29973 - RNA, 20 nt, Artificial Sequence
  MKO10029973_A_Macrod2
  gRNA
aggugacaucacucugcuag

SEQ ID NO: 29974 - RNA, 20 nt, Artificial Sequence
  MKO10029974_A_Mad1l1
  gRNA
uggacccaccucguaguucc

SEQ ID NO: 29975 - RNA, 20 nt, Artificial Sequence
  MKO10029975_A_Mad1l1
  gRNA
gcgcgagguagaucgcaacc

SEQ ID NO: 29976 - RNA, 20 nt, Artificial Sequence
  MKO10029976_A_Mad1l1
  gRNA
ggcacgcauucgacagcucc

SEQ ID NO: 29977 - RNA, 20 nt, Artificial Sequence
  MKO10029977_A_Mad2l1bp
  gRNA
gaaagcuuggcucgccacgg

SEQ ID NO: 29978 - RNA, 20 nt, Artificial Sequence
  MKO10029978_A_Mad2l1bp
  gRNA
gcagucgcgauggcugcguc

SEQ ID NO: 29979 - RNA, 20 nt, Artificial Sequence
  MKO10029979_A_Mad2l1bp
  gRNA
cgggaaacaccaccggcacc

SEQ ID NO: 29980 - RNA, 20 nt, Artificial Sequence
  MKO10029980_A_Mad2l1
  gRNA
ccgucucgucagucauugac

SEQ ID NO: 29981 - RNA, 20 nt, Artificial Sequence
  MKO10029981_A_Mad2l1
  gRNA
ugagcgaauuucauccugua

SEQ ID NO: 29982 - RNA, 20 nt, Artificial Sequence
  MKO10029982_A_Mad2l1
  gRNA
ccaccauacuauucacuuua

SEQ ID NO: 29983 - RNA, 20 nt, Artificial Sequence
  MKO10029983_A_Mad2l2
  gRNA
ccugauucucuaugugcgcg

SEQ ID NO: 29984 - RNA, 20 nt, Artificial Sequence
  MKO10029984_A_Mad2l2
  gRNA
ccucgcgcacauagagaauc

SEQ ID NO: 29985 - RNA, 20 nt, Artificial Sequence
  MKO10029985_A_Mad2l2
  gRNA
cugguucagcuccgggugac

SEQ ID NO: 29986 - RNA, 20 nt, Artificial Sequence
  MKO10029986_A_Madcam1
  gRNA
uugccgcccgaaaauccacc

SEQ ID NO: 29987 - RNA, 20 nt, Artificial Sequence
  MKO10029987_A_Madcam1
  gRNA
uguuccgaaugacacaacgc

SEQ ID NO: 29988 - RNA, 20 nt, Artificial Sequence
  MKO10029988_A_Madcam1
  gRNA
cagccuccaccgucguccua

SEQ ID NO: 29989 - RNA, 20 nt, Artificial Sequence
  MKO10029989_A_Madd
  gRNA
ccguaccuuuguacaccucg

SEQ ID NO: 29990 - RNA, 20 nt, Artificial Sequence
  MKO10029990_A_Madd
  gRNA
cuugacuaucucgugaucgu

SEQ ID NO: 29991 - RNA, 20 nt, Artificial Sequence
  MKO10029991_A_Madd
  gRNA
uuugcccuacguuugccccg

SEQ ID NO: 29992 - RNA, 20 nt, Artificial Sequence
  MKO10029992_A_Maea
  gRNA
gaagcgcauggaccggauga

SEQ ID NO: 29993 - RNA, 20 nt, Artificial Sequence
  MKO10029993_A_Maea
  gRNA
augauaacaagucccgacuc

SEQ ID NO: 29994 - RNA, 20 nt, Artificial Sequence
  MKO10029994_A_Maea
  gRNA
gcgcuuccgcuuccacaugc

SEQ ID NO: 29995 - RNA, 20 nt, Artificial Sequence
  MKO10029995_A_Mael
  gRNA
guuauaggugaaauuccacg

SEQ ID NO: 29996 - RNA, 20 nt, Artificial Sequence
  MKO10029996_A_Mael
  gRNA
aggaagcgcuguucacaaug

SEQ ID NO: 29997 - RNA, 20 nt, Artificial Sequence
  MKO10029997_A_Mael
  gRNA
acuuacuugcagccuggcaa

SEQ ID NO: 29998 - RNA, 20 nt, Artificial Sequence
  MKO10029998_A_Maf1
  gRNA
gaucuagacuccgaccccuu

SEQ ID NO: 29999 - RNA, 20 nt, Artificial Sequence
  MKO10029999_A_Maf1
  gRNA
cggcugcacuugucgcucag

SEQ ID NO: 30000 - RNA, 20 nt, Artificial Sequence
  MKO10030000_A_Maf1
  gRNA
ucuuuagcugccgcuccauc

SEQ ID NO: 30001 - RNA, 20 nt, Artificial Sequence
  MKO10030001_A_Mafa
  gRNA
ucgggagcccucgccagcgc

SEQ ID NO: 30002 - RNA, 20 nt, Artificial Sequence
  MKO10030002_A_Mafa
  gRNA
ggucagagcuucgcgggcgg

SEQ ID NO: 30003 - RNA, 20 nt, Artificial Sequence
  MKO10030003_A_Mafa
  gRNA
ugcgcccaucgccagcuccg

SEQ ID NO: 30004 - RNA, 20 nt, Artificial Sequence
  MKO10030004_A_Mafb
  gRNA
cgcguuuauaccugcacgac

SEQ ID NO: 30005 - RNA, 20 nt, Artificial Sequence
  MKO10030005_A_Mafb
  gRNA
ggggcuacgcccagucgugc

SEQ ID NO: 30006 - RNA, 20 nt, Artificial Sequence
  MKO10030006_A_Mafb
  gRNA
ugcgggcggcaacgguagug

SEQ ID NO: 30007 - RNA, 20 nt, Artificial Sequence
  MKO10030007_A_Maff
  gRNA
gcccggcgccgacuugacga

SEQ ID NO: 30008 - RNA, 20 nt, Artificial Sequence
  MKO10030008_A_Maff
  gRNA
cgagaacgccgccaugcgcc

SEQ ID NO: 30009 - RNA, 20 nt, Artificial Sequence
  MKO10030009_A_Maff
  gRNA
cuucagggcuuugcuagaua

SEQ ID NO: 30010 - RNA, 20 nt, Artificial Sequence
  MKO10030010_A_Mafg
  gRNA
cuaugaccgagcauccgucu

SEQ ID NO: 30011 - RNA, 20 nt, Artificial Sequence
  MKO10030011_A_Mafg
  gRNA
uggcaccagcuugaccgacg

SEQ ID NO: 30012 - RNA, 20 nt, Artificial Sequence
  MKO10030012_A_Mafg
  gRNA
guuaugacgacccccaauaa

SEQ ID NO: 30013 - RNA, 20 nt, Artificial Sequence
  MKO10030013_A_Mafk
  gRNA
acagaccuucgcucgcaccg

SEQ ID NO: 30014 - RNA, 20 nt, Artificial Sequence
  MKO10030014_A_Mafk
  gRNA
ucgggccacggugcgagcga

SEQ ID NO: 30015 - RNA, 20 nt, Artificial Sequence
  MKO10030015_A_Mafk
  gRNA
gacuaaucccaagcccaaca

SEQ ID NO: 30016 - RNA, 20 nt, Artificial Sequence
  MKO10030016_A_Maf
  gRNA
gcacuucgacgaccgcuucu

SEQ ID NO: 30017 - RNA, 20 nt, Artificial Sequence
  MKO10030017_A_Maf
  gRNA
ggcgaucacggcggacacca

SEQ ID NO: 30018 - RNA, 20 nt, Artificial Sequence
  MKO10030018_A_Maf
  gRNA
uucuguucgcugcccgagcc

SEQ ID NO: 30019 - RNA, 20 nt, Artificial Sequence
  MKO10030019_A_Magea10
  gRNA
gcguaggagauguaugguug

SEQ ID NO: 30020 - RNA, 20 nt, Artificial Sequence
  MKO10030020_A_Magea10
  gRNA
ccauacaucuccuacgcuuc

SEQ ID NO: 30021 - RNA, 20 nt, Artificial Sequence
  MKO10030021_A_Magea10
  gRNA
gagugcaugcaauuagucuu

SEQ ID NO: 30022 - RNA, 20 nt, Artificial Sequence
  MKO10030022_A_Magea1
  gRNA
cuuugcgagaugagauauac

SEQ ID NO: 30023 - RNA, 20 nt, Artificial Sequence
  MKO10030023_A_Magea1
  gRNA
aaccauggagacgucagagg

SEQ ID NO: 30024 - RNA, 20 nt, Artificial Sequence
  MKO10030024_A_Magea1
  gRNA
cuccuccucugacgucucca

SEQ ID NO: 30025 - RNA, 20 nt, Artificial Sequence
  MKO10030025_A_Magea2
  gRNA
cagccuccaagagagugcuc

SEQ ID NO: 30026 - RNA, 20 nt, Artificial Sequence
  MKO10030026_A_Magea2
  gRNA
cacuacacuagaaugugagc

SEQ ID NO: 30027 - RNA, 20 nt, Artificial Sequence
  MKO10030027_A_Magea2
  gRNA
cacuaccaaagcagaaaugu

SEQ ID NO: 30028 - RNA, 20 nt, Artificial Sequence
  MKO10030028_A_Magea3
  gRNA
caguacacuagaaugugugu

SEQ ID NO: 30029 - RNA, 20 nt, Artificial Sequence
  MKO10030029_A_Magea3
  gRNA
aauagugaucccccuagcua

SEQ ID NO: 30030 - RNA, 20 nt, Artificial Sequence
  MKO10030030_A_Magea3
  gRNA
cugaauaacauaggguugug

SEQ ID NO: 30031 - RNA, 20 nt, Artificial Sequence
  MKO10030031_A_Magea4
  gRNA
uuacacugaaaaauacgcag

SEQ ID NO: 30032 - RNA, 20 nt, Artificial Sequence
  MKO10030032_A_Magea4
  gRNA
gaacauugucuaacucccuu

SEQ ID NO: 30033 - RNA, 20 nt, Artificial Sequence
  MKO10030033_A_Magea4
  gRNA
aacagaggcuaguaucacaa

SEQ ID NO: 30034 - RNA, 20 nt, Artificial Sequence
  MKO10030034_A_Magea5
  gRNA
gaccauggagacauccgagg

SEQ ID NO: 30035 - RNA, 20 nt, Artificial Sequence
  MKO10030035_A_Magea5
  gRNA
ggucuauuucuaccauguca

SEQ ID NO: 30036 - RNA, 20 nt, Artificial Sequence
  MKO10030036_A_Magea5
  gRNA
ggugguaucuuccuccuccu

SEQ ID NO: 30037 - RNA, 20 nt, Artificial Sequence
  MKO10030037_A_Magea6
  gRNA
cuuugcgagaugagauagaa

SEQ ID NO: 30038 - RNA, 20 nt, Artificial Sequence
  MKO10030038_A_Magea6
  gRNA
acuagaauggucagagaaau

SEQ ID NO: 30039 - RNA, 20 nt, Artificial Sequence
  MKO10030039_A_Magea6
  gRNA
ucugcucaagauccaagccu

SEQ ID NO: 30040 - RNA, 20 nt, Artificial Sequence
  MKO10030040_A_Magea8
  gRNA
caguacacuagaauguaagc

SEQ ID NO: 30041 - RNA, 20 nt, Artificial Sequence
  MKO10030041_A_Magea8
  gRNA
ucuguucaagauccacgccu

SEQ ID NO: 30042 - RNA, 20 nt, Artificial Sequence
  MKO10030042_A_Magea8
  gRNA
gaccauggugacaucacagg

SEQ ID NO: 30043 - RNA, 20 nt, Artificial Sequence
  MKO10030043_A_Mageb16
  gRNA
gaagaaugugcagcugacca

SEQ ID NO: 30044 - RNA, 20 nt, Artificial Sequence
  MKO10030044_A_Mageb16
  gRNA
aucagcaugcucuaauagca

SEQ ID NO: 30045 - RNA, 20 nt, Artificial Sequence
  MKO10030045_A_Mageb16
  gRNA
uuaccugugaugacuguaga

SEQ ID NO: 30046 - RNA, 20 nt, Artificial Sequence
  MKO10030046_A_Mageb18
  gRNA
gauguaggcauacuggcaac

SEQ ID NO: 30047 - RNA, 20 nt, Artificial Sequence
  MKO10030047_A_Mageb18
  gRNA
uuucuauggguguccacauc

SEQ ID NO: 30048 - RNA, 20 nt, Artificial Sequence
  MKO10030048_A_Mageb18
  gRNA
cuccauccuuugaauucacg

SEQ ID NO: 30049 - RNA, 20 nt, Artificial Sequence
  MKO10030049_A_Mageb1
  gRNA
uuccuagaaagauguucucc

SEQ ID NO: 30050 - RNA, 20 nt, Artificial Sequence
  MKO10030050_A_Mageb1
  gRNA
cagacucaacuacauguuag

SEQ ID NO: 30051 - RNA, 20 nt, Artificial Sequence
  MKO10030051_A_Mageb1
  gRNA
gguguauccugcacaggcuc

SEQ ID NO: 30052 - RNA, 20 nt, Artificial Sequence
  MKO10030052_A_Mageb2
  gRNA
ucaucuuaaacuuaucuagc

SEQ ID NO: 30053 - RNA, 20 nt, Artificial Sequence
  MKO10030053_A_Mageb2
  gRNA
cagacucaacuacauguuag

SEQ ID NO: 30054 - RNA, 20 nt, Artificial Sequence
  MKO10030054_A_Mageb2
  gRNA
agcacagucaacaugccuag

SEQ ID NO: 30055 - RNA, 20 nt, Artificial Sequence
  MKO10030055_A_Mageb3
  gRNA
cagacucaacuacacauuag

SEQ ID NO: 30056 - RNA, 20 nt, Artificial Sequence
  MKO10030056_A_Mageb3
  gRNA
ucuccuguugaccugagugc

SEQ ID NO: 30057 - RNA, 20 nt, Artificial Sequence
  MKO10030057_A_Mageb3
  gRNA
gugacugcugucguuuagca

SEQ ID NO: 30058 - RNA, 20 nt, Artificial Sequence
  MKO10030058_A_Mageb4
  gRNA
gucccacugguugacuccuc

SEQ ID NO: 30059 - RNA, 20 nt, Artificial Sequence
  MKO10030059_A_Mageb4
  gRNA
cuuguuagaagaucauucug

SEQ ID NO: 30060 - RNA, 20 nt, Artificial Sequence
  MKO10030060_A_Mageb4
  gRNA
ugaccccucuugcaaagaua

SEQ ID NO: 30061 - RNA, 20 nt, Artificial Sequence
  MKO10030061_A_Mageb5
  gRNA
agggcaaacccuuccuuugu

SEQ ID NO: 30062 - RNA, 20 nt, Artificial Sequence
  MKO10030062_A_Mageb5
  gRNA
uccucaaaaagaugagucuc

SEQ ID NO: 30063 - RNA, 20 nt, Artificial Sequence
  MKO10030063_A_Mageb5
  gRNA
auugagguuucauaaccuuc

SEQ ID NO: 30064 - RNA, 20 nt, Artificial Sequence
  MKO10030064_A_Maged1
  gRNA
cgaccuaccugagcgcuuga

SEQ ID NO: 30065 - RNA, 20 nt, Artificial Sequence
  MKO10030065_A_Maged1
  gRNA
ucuugccccgaauuauaguc

SEQ ID NO: 30066 - RNA, 20 nt, Artificial Sequence
  MKO10030066_A_Maged1
  gRNA
gaugcuuaaagacuacacga

SEQ ID NO: 30067 - RNA, 20 nt, Artificial Sequence
  MKO10030067_A_Maged2
  gRNA
aagauucccaucagacgcuc

SEQ ID NO: 30068 - RNA, 20 nt, Artificial Sequence
  MKO10030068_A_Maged2
  gRNA
gccuacaaccccgaccaaaa

SEQ ID NO: 30069 - RNA, 20 nt, Artificial Sequence
  MKO10030069_A_Maged2
  gRNA
ugcgaagcuacagucauccc

SEQ ID NO: 30070 - RNA, 20 nt, Artificial Sequence
  MKO10030070_A_Magee1
  gRNA
cgcaaguugcgaacgaucaa

SEQ ID NO: 30071 - RNA, 20 nt, Artificial Sequence
  MKO10030071_A_Magee1
  gRNA
cgagcccuacuccguuagug

SEQ ID NO: 30072 - RNA, 20 nt, Artificial Sequence
  MKO10030072_A_Magee1
  gRNA
cccguuguuucugcgcgcau

SEQ ID NO: 30073 - RNA, 20 nt, Artificial Sequence
  MKO10030073_A_Magee2
  gRNA
cgacgagcagucccgacguu

SEQ ID NO: 30074 - RNA, 20 nt, Artificial Sequence
  MKO10030074_A_Magee2
  gRNA
cagagcagcucguauucaac

SEQ ID NO: 30075 - RNA, 20 nt, Artificial Sequence
  MKO10030075_A_Magee2
  gRNA
gcguugccucauuagcuuac

SEQ ID NO: 30076 - RNA, 20 nt, Artificial Sequence
  MKO10030076_A_Mageh1
  gRNA
ucggcgccgccggaacgcaa

SEQ ID NO: 30077 - RNA, 20 nt, Artificial Sequence
  MKO10030077_A_Mageh1
  gRNA
cuauucucaauucgggugcu

SEQ ID NO: 30078 - RNA, 20 nt, Artificial Sequence
  MKO10030078_A_Mageh1
  gRNA
cgccgacucuuccguccccg

SEQ ID NO: 30079 - RNA, 20 nt, Artificial Sequence
  MKO10030079_A_Magel2
  gRNA
ggcuaucgguguccccguaa

SEQ ID NO: 30080 - RNA, 20 nt, Artificial Sequence
  MKO10030080_A_Magel2
  gRNA
uacgugaucgaguggagccc

SEQ ID NO: 30081 - RNA, 20 nt, Artificial Sequence
  MKO10030081_A_Magel2
  gRNA
ggauggaucaucacgacacc

SEQ ID NO: 30082 - RNA, 20 nt, Artificial Sequence
  MKO10030082_A_Magi1
  gRNA
acauaguagacaccguagac

SEQ ID NO: 30083 - RNA, 20 nt, Artificial Sequence
  MKO10030083_A_Magi1
  gRNA
gcgaggaugcuacuauucac

SEQ ID NO: 30084 - RNA, 20 nt, Artificial Sequence
  MKO10030084_A_Magi1
  gRNA
cuuggagagugugcucgucc

SEQ ID NO: 30085 - RNA, 20 nt, Artificial Sequence
  MKO10030085_A_Magi2
  gRNA
ggauccgcgacuugcgaaaa

SEQ ID NO: 30086 - RNA, 20 nt, Artificial Sequence
  MKO10030086_A_Magi2
  gRNA
aacggcguggucauaacccc

SEQ ID NO: 30087 - RNA, 20 nt, Artificial Sequence
  MKO10030087_A_Magi2
  gRNA
acgccguuuccauugacuac

SEQ ID NO: 30088 - RNA, 20 nt, Artificial Sequence
  MKO10030088_A_Magi3
  gRNA
aucucggcgcccaagucgcc

SEQ ID NO: 30089 - RNA, 20 nt, Artificial Sequence
  MKO10030089_A_Magi3
  gRNA
ccuggggcggcuccgcgacg

SEQ ID NO: 30090 - RNA, 20 nt, Artificial Sequence
  MKO10030090_A_Magi3
  gRNA
ccugaucaacuggaucgggc

SEQ ID NO: 30091 - RNA, 20 nt, Artificial Sequence
  MKO10030091_A_Magix
  gRNA
uacuagcgcugucaaguccg

SEQ ID NO: 30092 - RNA, 20 nt, Artificial Sequence
  MKO10030092_A_Magix
  gRNA
ucuugugaaacaucgacccc

SEQ ID NO: 30093 - RNA, 20 nt, Artificial Sequence
  MKO10030093_A_Magix
  gRNA
accuacccuccguguggcgc

SEQ ID NO: 30094 - RNA, 20 nt, Artificial Sequence
  MKO10030094_A_Magohb
  gRNA
accugccgcccaacccuguc

SEQ ID NO: 30095 - RNA, 20 nt, Artificial Sequence
  MKO10030095_A_Magohb
  gRNA
caggaacuugaaaucguaau

SEQ ID NO: 30096 - RNA, 20 nt, Artificial Sequence
  MKO10030096_A_Magohb
  gRNA
ucuugaaguguagaccaaug

SEQ ID NO: 30097 - RNA, 20 nt, Artificial Sequence
  MKO10030097_A_Magoh
  gRNA
accugccggcccacgcgauc

SEQ ID NO: 30098 - RNA, 20 nt, Artificial Sequence
  MKO10030098_A_Magoh
  gRNA
ccccuccugaucgcgugggc

SEQ ID NO: 30099 - RNA, 20 nt, Artificial Sequence
  MKO10030099_A_Magoh
  gRNA
uaaaauacucgcaagccuuc

SEQ ID NO: 30100 - RNA, 20 nt, Artificial Sequence
  MKO10030100_A_Magu1
  gRNA
ggcugauacauaugaguugc

SEQ ID NO: 30101 - RNA, 20 nt, Artificial Sequence
  MKO10030101_A_Magu1
  gRNA
auuagaccuccaaauuaugc

SEQ ID NO: 30102 - RNA, 20 nt, Artificial Sequence
  MKO10030102_A_Magu1
  gRNA
gccaagaauuugccaaaauc

SEQ ID NO: 30103 - RNA, 20 nt, Artificial Sequence
  MKO10030103_A_Mag
  gRNA
gcucaucggggaagucgaaa

SEQ ID NO: 30104 - RNA, 20 nt, Artificial Sequence
  MKO10030104_A_Mag
  gRNA
ccagggccgcagccgccuau

SEQ ID NO: 30105 - RNA, 20 nt, Artificial Sequence
  MKO10030105_A_Mag
  gRNA
cucacacuugacguccaaac

SEQ ID NO: 30106 - RNA, 20 nt, Artificial Sequence
  MKO10030106_A_Mak16
  gRNA
uacccguucccagagacgcc

SEQ ID NO: 30107 - RNA, 20 nt, Artificial Sequence
  MKO10030107_A_Mak16
  gRNA
caaucggucguccuguccuc

SEQ ID NO: 30108 - RNA, 20 nt, Artificial Sequence
  MKO10030108_A_Mak16
  gRNA
gcucuauaaccuucauguac

SEQ ID NO: 30109 - RNA, 20 nt, Artificial Sequence
  MKO10030109_A_Mak
  gRNA
cacguaugggaguguacuga

SEQ ID NO: 30110 - RNA, 20 nt, Artificial Sequence
  MKO10030110_A_Mak
  gRNA
guagacacauagucaguaua

SEQ ID NO: 30111 - RNA, 20 nt, Artificial Sequence
  MKO10030111_A_Mak
  gRNA
uaugaacuugcgagaaguua

SEQ ID NO: 30112 - RNA, 20 nt, Artificial Sequence
  MKO10030112_A_Mal2
  gRNA
aguacguccuuaggaugucg

SEQ ID NO: 30113 - RNA, 20 nt, Artificial Sequence
  MKO10030113_A_Mal2
  gRNA
gacauccuaaggacguacuc

SEQ ID NO: 30114 - RNA, 20 nt, Artificial Sequence
  MKO10030114_A_Mal2
  gRNA
caaccaguauaacaucaacg

SEQ ID NO: 30115 - RNA, 20 nt, Artificial Sequence
  MKO10030115_A_Mall
  gRNA
cacgucaggcggggcguagc

SEQ ID NO: 30116 - RNA, 20 nt, Artificial Sequence
  MKO10030116_A_Mall
  gRNA
aacaaggcggcgacccccga

SEQ ID NO: 30117 - RNA, 20 nt, Artificial Sequence
  MKO10030117_A_Mall
  gRNA
cgucgcauaccccuugcugc

SEQ ID NO: 30118 - RNA, 20 nt, Artificial Sequence
  MKO10030118_A_Malsu1
  gRNA
cgagagcuauggguccgggc

SEQ ID NO: 30119 - RNA, 20 nt, Artificial Sequence
  MKO10030119_A_Malsu1
  gRNA
cgauccguaugucaagaucg

SEQ ID NO: 30120 - RNA, 20 nt, Artificial Sequence
  MKO10030120_A_Malsu1
  gRNA
cugcaggcgagcgucgccag

SEQ ID NO: 30121 - RNA, 20 nt, Artificial Sequence
  MKO10030121_A_Malt1
  gRNA
uguaacaacaacaugcugcc

SEQ ID NO: 30122 - RNA, 20 nt, Artificial Sequence
  MKO10030122_A_Malt1
  gRNA
cuuccgcuucucaacccccc

SEQ ID NO: 30123 - RNA, 20 nt, Artificial Sequence
  MKO10030123_A_Malt1
  gRNA
guccuaugccucacuaccag

SEQ ID NO: 30124 - RNA, 20 nt, Artificial Sequence
  MKO10030124_A_Mal
  gRNA
ccaugaaaacaucgccgcag

SEQ ID NO: 30125 - RNA, 20 nt, Artificial Sequence
  MKO10030125_A_Mal
  gRNA
guagaucagagugaccacgu

SEQ ID NO: 30126 - RNA, 20 nt, Artificial Sequence
  MKO10030126_A_Mal
  gRNA
guuccagguguuugccuacg

SEQ ID NO: 30127 - RNA, 20 nt, Artificial Sequence
  MKO10030127_A_Mamdc2
  gRNA
aaugcccuagaccugcccgc

SEQ ID NO: 30128 - RNA, 20 nt, Artificial Sequence
  MKO10030128_A_Mamdc2
  gRNA
ggaguggaacuguuugcgcc

SEQ ID NO: 30129 - RNA, 20 nt, Artificial Sequence
  MKO10030129_A_Mamdc2
  gRNA
uagccguguuuccuuguccc

SEQ ID NO: 30130 - RNA, 20 nt, Artificial Sequence
  MKO10030130_A_Mamdc4
  gRNA
cuaucgauggcuucgagacc

SEQ ID NO: 30131 - RNA, 20 nt, Artificial Sequence
  MKO10030131_A_Mamdc4
  gRNA
ucgaagccaucgauagccug

SEQ ID NO: 30132 - RNA, 20 nt, Artificial Sequence
  MKO10030132_A_Mamdc4
  gRNA
accuggaccaggcugguaua

SEQ ID NO: 30133 - RNA, 20 nt, Artificial Sequence
  MKO10030133_A_Maml1
  gRNA
cgaccugccgugcaugaucg

SEQ ID NO: 30134 - RNA, 20 nt, Artificial Sequence
  MKO10030134_A_Maml1
  gRNA
ccagcgcccgcgaucaugca

SEQ ID NO: 30135 - RNA, 20 nt, Artificial Sequence
  MKO10030135_A_Maml1
  gRNA
gggccagaacgccuccaccu

SEQ ID NO: 30136 - RNA, 20 nt, Artificial Sequence
  MKO10030136_A_Maml2
  gRNA
guuaccguuauuugccccua

SEQ ID NO: 30137 - RNA, 20 nt, Artificial Sequence
  MKO10030137_A_Maml2
  gRNA
cauuguugaagugacguugu

SEQ ID NO: 30138 - RNA, 20 nt, Artificial Sequence
  MKO10030138_A_Maml2
  gRNA
uuacccgaauacugagcagc

SEQ ID NO: 30139 - RNA, 20 nt, Artificial Sequence
  MKO10030139_A_Maml3
  gRNA
ucauacaguuauagcggcga

SEQ ID NO: 30140 - RNA, 20 nt, Artificial Sequence
  MKO10030140_A_Maml3
  gRNA
cgucgcaagcgccauucugc

SEQ ID NO: 30141 - RNA, 20 nt, Artificial Sequence
  MKO10030141_A_Maml3
  gRNA
uccgagaaugacgcccccua

SEQ ID NO: 30142 - RNA, 20 nt, Artificial Sequence
  MKO10030142_A_Mamld1
  gRNA
gcgacagcccccaucccgcc

SEQ ID NO: 30143 - RNA, 20 nt, Artificial Sequence
  MKO10030143_A_Mamld1
  gRNA
cuggggcggcugggauccga

SEQ ID NO: 30144 - RNA, 20 nt, Artificial Sequence
  MKO10030144_A_Mamld1
  gRNA
gaggcaaacuggaccaauug

SEQ ID NO: 30145 - RNA, 20 nt, Artificial Sequence
  MKO10030145_A_Mamstr
  gRNA
ccgucagcucuuccaguuua

SEQ ID NO: 30146 - RNA, 20 nt, Artificial Sequence
  MKO10030146_A_Mamstr
  gRNA
cucaacuugcagauuugccc

SEQ ID NO: 30147 - RNA, 20 nt, Artificial Sequence
  MKO10030147_A_Mamstr
  gRNA
ucuguucuggaggcauguac

SEQ ID NO: 30148 - RNA, 20 nt, Artificial Sequence
  MKO10030148_A_Man1a2
  gRNA
ccacugaccccuacacguug

SEQ ID NO: 30149 - RNA, 20 nt, Artificial Sequence
  MKO10030149_A_Man1a2
  gRNA
caugaagccccaugauauaa

SEQ ID NO: 30150 - RNA, 20 nt, Artificial Sequence
  MKO10030150_A_Man1a2
  gRNA
gucccugucccacaacgugu

SEQ ID NO: 30151 - RNA, 20 nt, Artificial Sequence
  MKO10030151_A_Man1a
  gRNA
gaagucaacauacgcuucgu

SEQ ID NO: 30152 - RNA, 20 nt, Artificial Sequence
  MKO10030152_A_Man1a
  gRNA
auaauuauaaacgcuaugcg

SEQ ID NO: 30153 - RNA, 20 nt, Artificial Sequence
  MKO10030153_A_Man1a
  gRNA
agcuacaauaguagaugccc

SEQ ID NO: 30154 - RNA, 20 nt, Artificial Sequence
  MKO10030154_A_Man1b1
  gRNA
cagccguaugaagagaguac

SEQ ID NO: 30155 - RNA, 20 nt, Artificial Sequence
  MKO10030155_A_Man1b1
  gRNA
acacacagagaaccgucauc

SEQ ID NO: 30156 - RNA, 20 nt, Artificial Sequence
  MKO10030156_A_Man1b1
  gRNA
agccgugauugagccugaac

SEQ ID NO: 30157 - RNA, 20 nt, Artificial Sequence
  MKO10030157_A_Man1c1
  gRNA
gaauuaccgccguuaugcga

SEQ ID NO: 30158 - RNA, 20 nt, Artificial Sequence
  MKO10030158_A_Man1c1
  gRNA
cauucuugcccaucgcauaa

SEQ ID NO: 30159 - RNA, 20 nt, Artificial Sequence
  MKO10030159_A_Man1c1
  gRNA
agagcaguccuccgauauac

SEQ ID NO: 30160 - RNA, 20 nt, Artificial Sequence
  MKO10030160_A_Man2a1
  gRNA
gcguugccuggugacccccg

SEQ ID NO: 30161 - RNA, 20 nt, Artificial Sequence
  MKO10030161_A_Man2a1
  gRNA
cguccuccacagacucgcuc

SEQ ID NO: 30162 - RNA, 20 nt, Artificial Sequence
  MKO10030162_A_Man2a1
  gRNA
cagcuggaaauugugaccgg

SEQ ID NO: 30163 - RNA, 20 nt, Artificial Sequence
  MKO10030163_A_Man2a2
  gRNA
ugacaucauaagccguauca

SEQ ID NO: 30164 - RNA, 20 nt, Artificial Sequence
  MKO10030164_A_Man2a2
  gRNA
cugcccagagaaagcgccgc

SEQ ID NO: 30165 - RNA, 20 nt, Artificial Sequence
  MKO10030165_A_Man2a2
  gRNA
uuugccguuugacaaugugg

SEQ ID NO: 30166 - RNA, 20 nt, Artificial Sequence
  MKO10030166_A_Man2b1
  gRNA
uuucggccacucucgagaac

SEQ ID NO: 30167 - RNA, 20 nt, Artificial Sequence
  MKO10030167_A_Man2b1
  gRNA
cacaaucgcgccauaguggg

SEQ ID NO: 30168 - RNA, 20 nt, Artificial Sequence
  MKO10030168_A_Man2b1
  gRNA
acaugucccccaacgaagcc

SEQ ID NO: 30169 - RNA, 20 nt, Artificial Sequence
  MKO10030169_A_Man2b2
  gRNA
ucguauugacuacgaccuca

SEQ ID NO: 30170 - RNA, 20 nt, Artificial Sequence
  MKO10030170_A_Man2b2
  gRNA
uggcggaacugguccgcgga

SEQ ID NO: 30171 - RNA, 20 nt, Artificial Sequence
  MKO10030171_A_Man2b2
  gRNA
caccacgguaguguagacau

SEQ ID NO: 30172 - RNA, 20 nt, Artificial Sequence
  MKO10030172_A_Man2c1
  gRNA
aagcugucgccgaccugcgc

SEQ ID NO: 30173 - RNA, 20 nt, Artificial Sequence
  MKO10030173_A_Man2c1
  gRNA
ccaguuauguccugagcgag

SEQ ID NO: 30174 - RNA, 20 nt, Artificial Sequence
  MKO10030174_A_Man2c1
  gRNA
caguucuacccgaaaccagc

SEQ ID NO: 30175 - RNA, 20 nt, Artificial Sequence
  MKO10030175_A_Manbal
  gRNA
uugggccauggccuccgacc

SEQ ID NO: 30176 - RNA, 20 nt, Artificial Sequence
  MKO10030176_A_Manbal
  gRNA
gcugcgguauggacucuucc

SEQ ID NO: 30177 - RNA, 20 nt, Artificial Sequence
  MKO10030177_A_Manbal
  gRNA
ccaucgcuuccaccaacaag

SEQ ID NO: 30178 - RNA, 20 nt, Artificial Sequence
  MKO10030178_A_Manba
  gRNA
ucacgucaacuucauccgaa

SEQ ID NO: 30179 - RNA, 20 nt, Artificial Sequence
  MKO10030179_A_Manba
  gRNA
guucacgucuuugacuacgu

SEQ ID NO: 30180 - RNA, 20 nt, Artificial Sequence
  MKO10030180_A_Manba
  gRNA
uuaaugaccugaacuauaga

SEQ ID NO: 30181 - RNA, 20 nt, Artificial Sequence
  MKO10030181_A_Maneal
  gRNA
cggaacuagcaccguucgag

SEQ ID NO: 30182 - RNA, 20 nt, Artificial Sequence
  MKO10030182_A_Maneal
  gRNA
uuccgucgaauccugccgcg

SEQ ID NO: 30183 - RNA, 20 nt, Artificial Sequence
  MKO10030183_A_Maneal
  gRNA
auuuagagcugacccgccgc

SEQ ID NO: 30184 - RNA, 20 nt, Artificial Sequence
  MKO10030184_A_Manea
  gRNA
uuucccgaaugcgcauuuag

SEQ ID NO: 30185 - RNA, 20 nt, Artificial Sequence
  MKO10030185_A_Manea
  gRNA
aaacuggagccaaugucguc

SEQ ID NO: 30186 - RNA, 20 nt, Artificial Sequence
  MKO10030186_A_Manea
  gRNA
guucgcaguucuccuuauga

SEQ ID NO: 30187 - RNA, 20 nt, Artificial Sequence
  MKO10030187_A_Manf
  gRNA
cuacagaucaguccgugcgc

SEQ ID NO: 30188 - RNA, 20 nt, Artificial Sequence
  MKO10030188_A_Manf
  gRNA
aggaggaugugggcuacgcg

SEQ ID NO: 30189 - RNA, 20 nt, Artificial Sequence
  MKO10030189_A_Manf
  gRNA
gaugccuaaauacgccccca

SEQ ID NO: 30190 - RNA, 20 nt, Artificial Sequence
  MKO10030190_A_Mansc1
  gRNA
cagcuuggcuuacucguugc

SEQ ID NO: 30191 - RNA, 20 nt, Artificial Sequence
  MKO10030191_A_Mansc1
  gRNA
uuacuugaccauucgucacc

SEQ ID NO: 30192 - RNA, 20 nt, Artificial Sequence
  MKO10030192_A_Mansc1
  gRNA
ccuggguuucguaccccagc

SEQ ID NO: 30193 - RNA, 20 nt, Artificial Sequence
  MKO10030193_A_Mansc4
  gRNA
ccgcagucuaucccaccauu

SEQ ID NO: 30194 - RNA, 20 nt, Artificial Sequence
  MKO10030194_A_Mansc4
  gRNA
uguucuccgaguaguacuug

SEQ ID NO: 30195 - RNA, 20 nt, Artificial Sequence
  MKO10030195_A_Mansc4
  gRNA
ugcuaauguugagucgagau

SEQ ID NO: 30196 - RNA, 20 nt, Artificial Sequence
  MKO10030196_A_Maoa
  gRNA
acaagcguaagauucuguuc

SEQ ID NO: 30197 - RNA, 20 nt, Artificial Sequence
  MKO10030197_A_Maoa
  gRNA
gcgucuaguucaauauguca

SEQ ID NO: 30198 - RNA, 20 nt, Artificial Sequence
  MKO10030198_A_Maoa
  gRNA
auuuggauuacaacaaccug

SEQ ID NO: 30199 - RNA, 20 nt, Artificial Sequence
  MKO10030199_A_Maob
  gRNA
ccagaaucguaucuuacgau

SEQ ID NO: 30200 - RNA, 20 nt, Artificial Sequence
  MKO10030200_A_Maob
  gRNA
ccaaucguaagauacgauuc

SEQ ID NO: 30201 - RNA, 20 nt, Artificial Sequence
  MKO10030201_A_Maob
  gRNA
gccaaacuucugcaugauug

SEQ ID NO: 30202 - RNA, 20 nt, Artificial Sequence
  MKO10030202_A_Map10
  gRNA
cgagguguauucgcccugcg

SEQ ID NO: 30203 - RNA, 20 nt, Artificial Sequence
  MKO10030203_A_Map10
  gRNA
gucgccgugcgccgcgagcc

SEQ ID NO: 30204 - RNA, 20 nt, Artificial Sequence
  MKO10030204_A_Map10
  gRNA
caaaguugcgaauccccucc

SEQ ID NO: 30205 - RNA, 20 nt, Artificial Sequence
  MKO10030205_A_Map1a
  gRNA
gucuugccgcugcagugauu

SEQ ID NO: 30206 - RNA, 20 nt, Artificial Sequence
  MKO10030206_A_Map1a
  gRNA
gcccgggauguucgaucuac

SEQ ID NO: 30207 - RNA, 20 nt, Artificial Sequence
  MKO10030207_A_Map1a
  gRNA
ggucagaaccgccguccacc

SEQ ID NO: 30208 - RNA, 20 nt, Artificial Sequence
  MKO10030208_A_Map1b
  gRNA
gucgcauaagaucccgccaa

SEQ ID NO: 30209 - RNA, 20 nt, Artificial Sequence
  MKO10030209_A_Map1b
  gRNA
cgcugcccgccauaaacugc

SEQ ID NO: 30210 - RNA, 20 nt, Artificial Sequence
  MKO10030210_A_Map1b
  gRNA
ugacguaggcuucucccggc

SEQ ID NO: 30211 - RNA, 20 nt, Artificial Sequence
  MKO10030211_A_Map1lc3a
  gRNA
guccgcagccgaccgcugua

SEQ ID NO: 30212 - RNA, 20 nt, Artificial Sequence
  MKO10030212_A_Map1lc3a
  gRNA
cccgcgcgaugcccuccgac

SEQ ID NO: 30213 - RNA, 20 nt, Artificial Sequence
  MKO10030213_A_Map1lc3a
  gRNA
gggaggcguagaccauguag

SEQ ID NO: 30214 - RNA, 20 nt, Artificial Sequence
  MKO10030214_A_Map1lc3b
  gRNA
gcgagcucaucaagauaauc

SEQ ID NO: 30215 - RNA, 20 nt, Artificial Sequence
  MKO10030215_A_Map1lc3b
  gRNA
agaaccuacugggaucuugg

SEQ ID NO: 30216 - RNA, 20 nt, Artificial Sequence
  MKO10030216_A_Map1lc3b
  gRNA
cuuucuugcagaacaaagag

SEQ ID NO: 30217 - RNA, 20 nt, Artificial Sequence
  MKO10030217_A_Map1s
  gRNA
aaauccgcccgcgcagcugc

SEQ ID NO: 30218 - RNA, 20 nt, Artificial Sequence
  MKO10030218_A_Map1s
  gRNA
ggacagcguccacgcgaucc

SEQ ID NO: 30219 - RNA, 20 nt, Artificial Sequence
  MKO10030219_A_Map1s
  gRNA
ggcugaaugccgggacacga

SEQ ID NO: 30220 - RNA, 20 nt, Artificial Sequence
  MKO10030220_A_Map2k1
  gRNA
cuugugcuucucccgaagau

SEQ ID NO: 30221 - RNA, 20 nt, Artificial Sequence
  MKO10030221_A_Map2k1
  gRNA
gugcaacuccccguacaucg

SEQ ID NO: 30222 - RNA, 20 nt, Artificial Sequence
  MKO10030222_A_Map2k1
  gRNA
augaucugguuccggauugc

SEQ ID NO: 30223 - RNA, 20 nt, Artificial Sequence
  MKO10030223_A_Map2k2
  gRNA
ugacggccuaugccgggccu

SEQ ID NO: 30224 - RNA, 20 nt, Artificial Sequence
  MKO10030224_A_Map2k2
  gRNA
augaucugguugcgcacggc

SEQ ID NO: 30225 - RNA, 20 nt, Artificial Sequence
  MKO10030225_A_Map2k2
  gRNA
ccgugcgcaaccagaucauc

SEQ ID NO: 30226 - RNA, 20 nt, Artificial Sequence
  MKO10030226_A_Map2k3
  gRNA
uccgggaguccagguuccgg

SEQ ID NO: 30227 - RNA, 20 nt, Artificial Sequence
  MKO10030227_A_Map2k3
  gRNA
acucacgugggguuggacac

SEQ ID NO: 30228 - RNA, 20 nt, Artificial Sequence
  MKO10030228_A_Map2k3
  gRNA
ccacagacccccccggaacc

SEQ ID NO: 30229 - RNA, 20 nt, Artificial Sequence
  MKO10030229_A_Map2k4
  gRNA
uuuguaaaacuuaucgaacg

SEQ ID NO: 30230 - RNA, 20 nt, Artificial Sequence
  MKO10030230_A_Map2k4
  gRNA
aaccgugcugucgauuugac

SEQ ID NO: 30231 - RNA, 20 nt, Artificial Sequence
  MKO10030231_A_Map2k4
  gRNA
caccugucaaaucgacagca

SEQ ID NO: 30232 - RNA, 20 nt, Artificial Sequence
  MKO10030232_A_Map2k5
  gRNA
aacgcugucgucgucgcuuc

SEQ ID NO: 30233 - RNA, 20 nt, Artificial Sequence
  MKO10030233_A_Map2k5
  gRNA
acggaacauacauggccuga

SEQ ID NO: 30234 - RNA, 20 nt, Artificial Sequence
  MKO10030234_A_Map2k5
  gRNA
ccauguauguuccguucccc

SEQ ID NO: 30235 - RNA, 20 nt, Artificial Sequence
  MKO10030235_A_Map2k6
  gRNA
acuuacguggaacuggucug

SEQ ID NO: 30236 - RNA, 20 nt, Artificial Sequence
  MKO10030236_A_Map2k6
  gRNA
ccggaagagugcaccguaga

SEQ ID NO: 30237 - RNA, 20 nt, Artificial Sequence
  MKO10030237_A_Map2k6
  gRNA
aagaugcgucacgugcccag

SEQ ID NO: 30238 - RNA, 20 nt, Artificial Sequence
  MKO10030238_A_Map2k7
  gRNA
guaccuggcccccgauaguc

SEQ ID NO: 30239 - RNA, 20 nt, Artificial Sequence
  MKO10030239_A_Map2k7
  gRNA
cuuguucacaccgcgcagua

SEQ ID NO: 30240 - RNA, 20 nt, Artificial Sequence
  MKO10030240_A_Map2k7
  gRNA
gcuuaccucuccauacugcg

SEQ ID NO: 30241 - RNA, 20 nt, Artificial Sequence
  MKO10030241_A_Map2
  gRNA
uccuucaucuuuccgcucgu

SEQ ID NO: 30242 - RNA, 20 nt, Artificial Sequence
  MKO10030242_A_Map2
  gRNA
ucugaaagauggccgacgag

SEQ ID NO: 30243 - RNA, 20 nt, Artificial Sequence
  MKO10030243_A_Map2
  gRNA
uucgccuguuuaaaagcacc

SEQ ID NO: 30244 - RNA, 20 nt, Artificial Sequence
  MKO10030244_A_Map3k10
  gRNA
cuaccgagaaaucgacgccu

SEQ ID NO: 30245 - RNA, 20 nt, Artificial Sequence
  MKO10030245_A_Map3k10
  gRNA
caaggcgucgauuucucggu

SEQ ID NO: 30246 - RNA, 20 nt, Artificial Sequence
  MKO10030246_A_Map3k10
  gRNA
ccaaaaucuggucgcccgug

SEQ ID NO: 30247 - RNA, 20 nt, Artificial Sequence
  MKO10030247_A_Map3k11
  gRNA
ggcgcacgugcggccguucu

SEQ ID NO: 30248 - RNA, 20 nt, Artificial Sequence
  MKO10030248_A_Map3k11
  gRNA
uggaggcgaagucgggccug

SEQ ID NO: 30249 - RNA, 20 nt, Artificial Sequence
  MKO10030249_A_Map3k11
  gRNA
agaacgcaucagcaugcccc

SEQ ID NO: 30250 - RNA, 20 nt, Artificial Sequence
  MKO10030250_A_Map3k12
  gRNA
gcuaaucacauacgacgaug

SEQ ID NO: 30251 - RNA, 20 nt, Artificial Sequence
  MKO10030251_A_Map3k12
  gRNA
caugccaccagcgaugccca

SEQ ID NO: 30252 - RNA, 20 nt, Artificial Sequence
  MKO10030252_A_Map3k12
  gRNA
cuugagcgcagaauuccaua

SEQ ID NO: 30253 - RNA, 20 nt, Artificial Sequence
  MKO10030253_A_Map3k13
  gRNA
cgucgcguggauggcaccag

SEQ ID NO: 30254 - RNA, 20 nt, Artificial Sequence
  MKO10030254_A_Map3k13
  gRNA
cauuccacuggcgauucccg

SEQ ID NO: 30255 - RNA, 20 nt, Artificial Sequence
  MKO10030255_A_Map3k13
  gRNA
gcagccggggcgugaucuuc

SEQ ID NO: 30256 - RNA, 20 nt, Artificial Sequence
  MKO10030256_A_Map3k14
  gRNA
aggauggggcauuccgcugu

SEQ ID NO: 30257 - RNA, 20 nt, Artificial Sequence
  MKO10030257_A_Map3k14
  gRNA
uaccuggugcaugcgcucca

SEQ ID NO: 30258 - RNA, 20 nt, Artificial Sequence
  MKO10030258_A_Map3k14
  gRNA
aguaucgagaagagguccac

SEQ ID NO: 30259 - RNA, 20 nt, Artificial Sequence
  MKO10030259_A_Map3k15
  gRNA
gggcccgcuguguaugcccc

SEQ ID NO: 30260 - RNA, 20 nt, Artificial Sequence
  MKO10030260_A_Map3k15
  gRNA
ggcuagugaaccugucgacc

SEQ ID NO: 30261 - RNA, 20 nt, Artificial Sequence
  MKO10030261_A_Map3k15
  gRNA
ucuguccuaccgugauaucc

SEQ ID NO: 30262 - RNA, 20 nt, Artificial Sequence
  MKO10030262_A_Map3k19
  gRNA
cccaccaucuccgcgucauc

SEQ ID NO: 30263 - RNA, 20 nt, Artificial Sequence
  MKO10030263_A_Map3k19
  gRNA
ugguuagcauccuccccgug

SEQ ID NO: 30264 - RNA, 20 nt, Artificial Sequence
  MKO10030264_A_Map3k19
  gRNA
ugacuucagcccguucauau

SEQ ID NO: 30265 - RNA, 20 nt, Artificial Sequence
  MKO10030265_A_Map3k1
  gRNA
accccgaagagccccgucac

SEQ ID NO: 30266 - RNA, 20 nt, Artificial Sequence
  MKO10030266_A_Map3k1
  gRNA
ucggugaagccggaaucccc

SEQ ID NO: 30267 - RNA, 20 nt, Artificial Sequence
  MKO10030267_A_Map3k1
  gRNA
gugaagccaaucccuauuaa

SEQ ID NO: 30268 - RNA, 20 nt, Artificial Sequence
  MKO10030268_A_Map3k2
  gRNA
ucuaagucuaagaucgccuu

SEQ ID NO: 30269 - RNA, 20 nt, Artificial Sequence
  MKO10030269_A_Map3k2
  gRNA
uaaagauaaugcuggccgac

SEQ ID NO: 30270 - RNA, 20 nt, Artificial Sequence
  MKO10030270_A_Map3k2
  gRNA
uaacuggucuaguaaccugc

SEQ ID NO: 30271 - RNA, 20 nt, Artificial Sequence
  MKO10030271_A_Map3k3
  gRNA
auccagacaaccggguucgu

SEQ ID NO: 30272 - RNA, 20 nt, Artificial Sequence
  MKO10030272_A_Map3k3
  gRNA
uccagaugagccgacgaacc

SEQ ID NO: 30273 - RNA, 20 nt, Artificial Sequence
  MKO10030273_A_Map3k3
  gRNA
uccacaucuucguaucucac

SEQ ID NO: 30274 - RNA, 20 nt, Artificial Sequence
  MKO10030274_A_Map3k4
  gRNA
agccgguuucaacgggcccu

SEQ ID NO: 30275 - RNA, 20 nt, Artificial Sequence
  MKO10030275_A_Map3k4
  gRNA
accagaucaguucguucgau

SEQ ID NO: 30276 - RNA, 20 nt, Artificial Sequence
  MKO10030276_A_Map3k4
  gRNA
gcucgccuuucaaguucgau

SEQ ID NO: 30277 - RNA, 20 nt, Artificial Sequence
  MKO10030277_A_Map3k5
  gRNA
gcccaucugcuuaccccucg

SEQ ID NO: 30278 - RNA, 20 nt, Artificial Sequence
  MKO10030278_A_Map3k5
  gRNA
uggagaugagcgacgccuuc

SEQ ID NO: 30279 - RNA, 20 nt, Artificial Sequence
  MKO10030279_A_Map3k5
  gRNA
gccuaacuucgagcuccugc

SEQ ID NO: 30280 - RNA, 20 nt, Artificial Sequence
  MKO10030280_A_Map3k6
  gRNA
cugcaucgccacauaagacc

SEQ ID NO: 30281 - RNA, 20 nt, Artificial Sequence
  MKO10030281_A_Map3k6
  gRNA
agaccauucgucaggauauc

SEQ ID NO: 30282 - RNA, 20 nt, Artificial Sequence
  MKO10030282_A_Map3k6
  gRNA
gcuaucguaccgugaugucc

SEQ ID NO: 30283 - RNA, 20 nt, Artificial Sequence
  MKO10030283_A_Map3k7cl
  gRNA
ucuacggagucgugacacgg

SEQ ID NO: 30284 - RNA, 20 nt, Artificial Sequence
  MKO10030284_A_Map3k7cl
  gRNA
cgacuccguagaguccaugc

SEQ ID NO: 30285 - RNA, 20 nt, Artificial Sequence
  MKO10030285_A_Map3k7cl
  gRNA
augcgaacuggcuuaucugc

SEQ ID NO: 30286 - RNA, 20 nt, Artificial Sequence
  MKO10030286_A_Map3k7
  gRNA
gaugaucgaagcgccgucgc

SEQ ID NO: 30287 - RNA, 20 nt, Artificial Sequence
  MKO10030287_A_Map3k7
  gRNA
cggcgcuucgaucaucucac

SEQ ID NO: 30288 - RNA, 20 nt, Artificial Sequence
  MKO10030288_A_Map3k7
  gRNA
gggacuuacuggauucaggc

SEQ ID NO: 30289 - RNA, 20 nt, Artificial Sequence
  MKO10030289_A_Map3k8
  gRNA
ucgaggguagcgcuucaccc

SEQ ID NO: 30290 - RNA, 20 nt, Artificial Sequence
  MKO10030290_A_Map3k8
  gRNA
ggagaacauccgaaucgauu

SEQ ID NO: 30291 - RNA, 20 nt, Artificial Sequence
  MKO10030291_A_Map3k8
  gRNA
gauggacaguaucgccccau

SEQ ID NO: 30292 - RNA, 20 nt, Artificial Sequence
  MKO10030292_A_Map3k9
  gRNA
ccgaacaucauugcgcucag

SEQ ID NO: 30293 - RNA, 20 nt, Artificial Sequence
  MKO10030293_A_Map3k9
  gRNA
acuccucuauagucguuagc

SEQ ID NO: 30294 - RNA, 20 nt, Artificial Sequence
  MKO10030294_A_Map3k9
  gRNA
ccagcuacgguguacugcuu

SEQ ID NO: 30295 - RNA, 20 nt, Artificial Sequence
  MKO10030295_A_Map4k1
  gRNA
ugacgucgccacccuucaga

SEQ ID NO: 30296 - RNA, 20 nt, Artificial Sequence
  MKO10030296_A_Map4k1
  gRNA
aagccacgauguuggcgugc

SEQ ID NO: 30297 - RNA, 20 nt, Artificial Sequence
  MKO10030297_A_Map4k1
  gRNA
ccuuuacaaggcucgcgaca

SEQ ID NO: 30298 - RNA, 20 nt, Artificial Sequence
  MKO10030298_A_Map4k2
  gRNA
guucggacgugacgguguca

SEQ ID NO: 30299 - RNA, 20 nt, Artificial Sequence
  MKO10030299_A_Map4k2
  gRNA
ugacaccgucacguccgaac

SEQ ID NO: 30300 - RNA, 20 nt, Artificial Sequence
  MKO10030300_A_Map4k2
  gRNA
uccccaggaaugaccgauug

SEQ ID NO: 30301 - RNA, 20 nt, Artificial Sequence
  MKO10030301_A_Map4k3
  gRNA
uaggcacggaaugucaacac

SEQ ID NO: 30302 - RNA, 20 nt, Artificial Sequence
  MKO10030302_A_Map4k3
  gRNA
uucacaggcgagauaaacuu

SEQ ID NO: 30303 - RNA, 20 nt, Artificial Sequence
  MKO10030303_A_Map4k3
  gRNA
ucuuuacaggacauauauca

SEQ ID NO: 30304 - RNA, 20 nt, Artificial Sequence
  MKO10030304_A_Map4k4
  gRNA
ggugacguccauaaccuuga

SEQ ID NO: 30305 - RNA, 20 nt, Artificial Sequence
  MKO10030305_A_Map4k4
  gRNA
gcuggccgccaucaagguua

SEQ ID NO: 30306 - RNA, 20 nt, Artificial Sequence
  MKO10030306_A_Map4k4
  gRNA
cgaaauauugccacguacua

SEQ ID NO: 30307 - RNA, 20 nt, Artificial Sequence
  MKO10030307_A_Map4k5
  gRNA
auuugcauggaguacugcgg

SEQ ID NO: 30308 - RNA, 20 nt, Artificial Sequence
  MKO10030308_A_Map4k5
  gRNA
ugcaacaucguagccuacuu

SEQ ID NO: 30309 - RNA, 20 nt, Artificial Sequence
  MKO10030309_A_Map4k5
  gRNA
cgucugcagagagaccuuac

SEQ ID NO: 30310 - RNA, 20 nt, Artificial Sequence
  MKO10030310_A_Map4
  gRNA
agagcccuaugaugacaucg

SEQ ID NO: 30311 - RNA, 20 nt, Artificial Sequence
  MKO10030311_A_Map4
  gRNA
ucaacgcauccacaagacug

SEQ ID NO: 30312 - RNA, 20 nt, Artificial Sequence
  MKO10030312_A_Map4
  gRNA
cuccauuccaugaucaccau

SEQ ID NO: 30313 - RNA, 20 nt, Artificial Sequence
  MKO10030313_A_Map6d1
  gRNA
cagcacguagaccguccggg

SEQ ID NO: 30314 - RNA, 20 nt, Artificial Sequence
  MKO10030314_A_Map6d1
  gRNA
uucgcacaccgaaaucgcgc

SEQ ID NO: 30315 - RNA, 20 nt, Artificial Sequence
  MKO10030315_A_Map6d1
  gRNA
gcugugaguugugacgacuc

SEQ ID NO: 30316 - RNA, 20 nt, Artificial Sequence
  MKO10030316_A_Map6
  gRNA
gugcagacgagcgcgacacg

SEQ ID NO: 30317 - RNA, 20 nt, Artificial Sequence
  MKO10030317_A_Map6
  gRNA
ccuuccuacgugugucgcgc

SEQ ID NO: 30318 - RNA, 20 nt, Artificial Sequence
  MKO10030318_A_Map6
  gRNA
ccguauucuucugcgaucca

SEQ ID NO: 30319 - RNA, 20 nt, Artificial Sequence
  MKO10030319_A_Map7d1
  gRNA
ccgcucuucucggcgcucuu

SEQ ID NO: 30320 - RNA, 20 nt, Artificial Sequence
  MKO10030320_A_Map7d1
  gRNA
cauggagaguggcccgcgug

SEQ ID NO: 30321 - RNA, 20 nt, Artificial Sequence
  MKO10030321_A_Map7d1
  gRNA
ggcuuaccugcgggugcgcc

SEQ ID NO: 30322 - RNA, 20 nt, Artificial Sequence
  MKO10030322_A_Map7d2
  gRNA
accggcgcaucauugcuucc

SEQ ID NO: 30323 - RNA, 20 nt, Artificial Sequence
  MKO10030323_A_Map7d2
  gRNA
gacucaccaucacguccgcc

SEQ ID NO: 30324 - RNA, 20 nt, Artificial Sequence
  MKO10030324_A_Map7d2
  gRNA
guguauaccguugguggacu

SEQ ID NO: 30325 - RNA, 20 nt, Artificial Sequence
  MKO10030325_A_Map7
  gRNA
agaagucuaaccgcuggucc

SEQ ID NO: 30326 - RNA, 20 nt, Artificial Sequence
  MKO10030326_A_Map7
  gRNA
gcuagccagagaacgccgag

SEQ ID NO: 30327 - RNA, 20 nt, Artificial Sequence
  MKO10030327_A_Map7
  gRNA
ucaucaacccguagcacagg

SEQ ID NO: 30328 - RNA, 20 nt, Artificial Sequence
  MKO10030328_A_Map9
  gRNA
cgucaaaagaagcacguccu

SEQ ID NO: 30329 - RNA, 20 nt, Artificial Sequence
  MKO10030329_A_Map9
  gRNA
aucugcaucaagaccgcugc

SEQ ID NO: 30330 - RNA, 20 nt, Artificial Sequence
  MKO10030330_A_Map9
  gRNA
cucggaaaaccucgaucuug

SEQ ID NO: 30331 - RNA, 20 nt, Artificial Sequence
  MKO10030331_A_Mapk10
  gRNA
acagggauucgauaaacacg

SEQ ID NO: 30332 - RNA, 20 nt, Artificial Sequence
  MKO10030332_A_Mapk10
  gRNA
agaaccaaacucacgccaag

SEQ ID NO: 30333 - RNA, 20 nt, Artificial Sequence
  MKO10030333_A_Mapk10
  gRNA
guucugguagcgcuuaagaa

SEQ ID NO: 30334 - RNA, 20 nt, Artificial Sequence
  MKO10030334_A_Mapk11
  gRNA
uccaaucgcugauccacgcg

SEQ ID NO: 30335 - RNA, 20 nt, Artificial Sequence
  MKO10030335_A_Mapk11
  gRNA
gguggaugaugcccgccgag

SEQ ID NO: 30336 - RNA, 20 nt, Artificial Sequence
  MKO10030336_A_Mapk11
  gRNA
gcagcucggccuacgacgcg

SEQ ID NO: 30337 - RNA, 20 nt, Artificial Sequence
  MKO10030337_A_Mapk12
  gRNA
uguggaugacaccagccgca

SEQ ID NO: 30338 - RNA, 20 nt, Artificial Sequence
  MKO10030338_A_Mapk12
  gRNA
aagucguccagagacucauc

SEQ ID NO: 30339 - RNA, 20 nt, Artificial Sequence
  MKO10030339_A_Mapk12
  gRNA
uggccaucaagaaguuguac

SEQ ID NO: 30340 - RNA, 20 nt, Artificial Sequence
  MKO10030340_A_Mapk13
  gRNA
gcagcucggccaucgacaag

SEQ ID NO: 30341 - RNA, 20 nt, Artificial Sequence
  MKO10030341_A_Mapk13
  gRNA
uuucaguacauccacuccgc

SEQ ID NO: 30342 - RNA, 20 nt, Artificial Sequence
  MKO10030342_A_Mapk13
  gRNA
cuccccuguccgcuugucga

SEQ ID NO: 30343 - RNA, 20 nt, Artificial Sequence
  MKO10030343_A_Mapk14
  gRNA
ggcacuucacgauguuguuc

SEQ ID NO: 30344 - RNA, 20 nt, Artificial Sequence
  MKO10030344_A_Mapk14
  gRNA
gguagaugagaaacugaacg

SEQ ID NO: 30345 - RNA, 20 nt, Artificial Sequence
  MKO10030345_A_Mapk14
  gRNA
guucacacccgcaaggucac

SEQ ID NO: 30346 - RNA, 20 nt, Artificial Sequence
  MKO10030346_A_Mapk15
  gRNA
gguaaaagaugcaccgcuug

SEQ ID NO: 30347 - RNA, 20 nt, Artificial Sequence
  MKO10030347_A_Mapk15
  gRNA
aucaagcaggcggaugaugu

SEQ ID NO: 30348 - RNA, 20 nt, Artificial Sequence
  MKO10030348_A_Mapk15
  gRNA
agccaaccuucugaucccga

SEQ ID NO: 30349 - RNA, 20 nt, Artificial Sequence
  MKO10030349_A_Mapk1ip1l
  gRNA
ggcgugggguaugauccugc

SEQ ID NO: 30350 - RNA, 20 nt, Artificial Sequence
  MKO10030350_A_Mapk1ip1l
  gRNA
aacaugccauaucgaucucc

SEQ ID NO: 30351 - RNA, 20 nt, Artificial Sequence
  MKO10030351_A_Mapk1ip1l
  gRNA
cuacucggggggaguccaga

SEQ ID NO: 30352 - RNA, 20 nt, Artificial Sequence
  MKO10030352_A_Mapk1ip1
  gRNA
cccuuccgauucguccaacc

SEQ ID NO: 30353 - RNA, 20 nt, Artificial Sequence
  MKO10030353_A_Mapk1ip1
  gRNA
gcucuccggguuggacgaau

SEQ ID NO: 30354 - RNA, 20 nt, Artificial Sequence
  MKO10030354_A_Mapk1ip1
  gRNA
ucaggaguaggauacugcgc

SEQ ID NO: 30355 - RNA, 20 nt, Artificial Sequence
  MKO10030355_A_Mapk1
  gRNA
uggcagagaugcuauccaac

SEQ ID NO: 30356 - RNA, 20 nt, Artificial Sequence
  MKO10030356_A_Mapk1
  gRNA
cagaguacguagccacacgu

SEQ ID NO: 30357 - RNA, 20 nt, Artificial Sequence
  MKO10030357_A_Mapk1
  gRNA
ggugcagaacguuagcugaa

SEQ ID NO: 30358 - RNA, 20 nt, Artificial Sequence
  MKO10030358_A_Mapk3
  gRNA
ccacucuggucuugcgcacg

SEQ ID NO: 30359 - RNA, 20 nt, Artificial Sequence
  MKO10030359_A_Mapk3
  gRNA
accucugaccuuaaggucgc

SEQ ID NO: 30360 - RNA, 20 nt, Artificial Sequence
  MKO10030360_A_Mapk3
  gRNA
ccacgugcgcaagaccagag

SEQ ID NO: 30361 - RNA, 20 nt, Artificial Sequence
  MKO10030361_A_Mapk4
  gRNA
gugcagcgcgauccacgugc

SEQ ID NO: 30362 - RNA, 20 nt, Artificial Sequence
  MKO10030362_A_Mapk4
  gRNA
guccauggagcgcgccuucg

SEQ ID NO: 30363 - RNA, 20 nt, Artificial Sequence
  MKO10030363_A_Mapk4
  gRNA
gagcccguacucgugccccg

SEQ ID NO: 30364 - RNA, 20 nt, Artificial Sequence
  MKO10030364_A_Mapk6
  gRNA
caaggcgcagaucgcgcuag

SEQ ID NO: 30365 - RNA, 20 nt, Artificial Sequence
  MKO10030365_A_Mapk6
  gRNA
cugaaugguccccgcgauga

SEQ ID NO: 30366 - RNA, 20 nt, Artificial Sequence
  MKO10030366_A_Mapk6
  gRNA
gagcaucuacuccuucccga

SEQ ID NO: 30367 - RNA, 20 nt, Artificial Sequence
  MKO10030367_A_Mapk7
  gRNA
ugcgaguccaccgcucuagc

SEQ ID NO: 30368 - RNA, 20 nt, Artificial Sequence
  MKO10030368_A_Mapk7
  gRNA
cgacaauaucaucgccauca

SEQ ID NO: 30369 - RNA, 20 nt, Artificial Sequence
  MKO10030369_A_Mapk7
  gRNA
uacucgcugguaccgugccc

SEQ ID NO: 30370 - RNA, 20 nt, Artificial Sequence
  MKO10030370_A_Mapk8ip1
  gRNA
ugucaccugccgcgucgauc

SEQ ID NO: 30371 - RNA, 20 nt, Artificial Sequence
  MKO10030371_A_Mapk8ip1
  gRNA
guggcugcacuucggcgaca

SEQ ID NO: 30372 - RNA, 20 nt, Artificial Sequence
  MKO10030372_A_Mapk8ip1
  gRNA
cgguggaagugccgcggucc

SEQ ID NO: 30373 - RNA, 20 nt, Artificial Sequence
  MKO10030373_A_Mapk8ip2
  gRNA
agucguccgugaucucagac

SEQ ID NO: 30374 - RNA, 20 nt, Artificial Sequence
  MKO10030374_A_Mapk8ip2
  gRNA
cgagggucggcgaagcaguc

SEQ ID NO: 30375 - RNA, 20 nt, Artificial Sequence
  MKO10030375_A_Mapk8ip2
  gRNA
gaggcgggagcuacguuacu

SEQ ID NO: 30376 - RNA, 20 nt, Artificial Sequence
  MKO10030376_A_Mapk8ip3
  gRNA
guaccaagacgacuacugcu

SEQ ID NO: 30377 - RNA, 20 nt, Artificial Sequence
  MKO10030377_A_Mapk8ip3
  gRNA
cacgcaauacgagcgcgaga

SEQ ID NO: 30378 - RNA, 20 nt, Artificial Sequence
  MKO10030378_A_Mapk8ip3
  gRNA
ccgauucucguuccuccagu

SEQ ID NO: 30379 - RNA, 20 nt, Artificial Sequence
  MKO10030379_A_Mapk8
  gRNA
cccaugccgagaaugaccuc

SEQ ID NO: 30380 - RNA, 20 nt, Artificial Sequence
  MKO10030380_A_Mapk8
  gRNA
ucgcuacuacagagcaccag

SEQ ID NO: 30381 - RNA, 20 nt, Artificial Sequence
  MKO10030381_A_Mapk8
  gRNA
uugcaaucaagaagcucagc

SEQ ID NO: 30382 - RNA, 20 nt, Artificial Sequence
  MKO10030382_A_Mapk9
  gRNA
agccgaucgguuucaguugc

SEQ ID NO: 30383 - RNA, 20 nt, Artificial Sequence
  MKO10030383_A_Mapk9
  gRNA
uaccagcaacugaaaccgau

SEQ ID NO: 30384 - RNA, 20 nt, Artificial Sequence
  MKO10030384_A_Mapk9
  gRNA
aauacucagguacuugguaa

SEQ ID NO: 30385 - RNA, 20 nt, Artificial Sequence
  MKO10030385_A_Mapkap1
  gRNA
ucgaacaaagagcgacucuu

SEQ ID NO: 30386 - RNA, 20 nt, Artificial Sequence
  MKO10030386_A_Mapkap1
  gRNA
guccauauugucuguacgcc

SEQ ID NO: 30387 - RNA, 20 nt, Artificial Sequence
  MKO10030387_A_Mapkap1
  gRNA
accucaucgggcucaucugu

SEQ ID NO: 30388 - RNA, 20 nt, Artificial Sequence
  MKO10030388_A_Mapkapk2
  gRNA
gagcaauguugaucgagugc

SEQ ID NO: 30389 - RNA, 20 nt, Artificial Sequence
  MKO10030389_A_Mapkapk2
  gRNA
guguuauacaccauacuaug

SEQ ID NO: 30390 - RNA, 20 nt, Artificial Sequence
  MKO10030390_A_Mapkapk2
  gRNA
uccaccucucugcgcgccuu

SEQ ID NO: 30391 - RNA, 20 nt, Artificial Sequence
  MKO10030391_A_Mapkapk3
  gRNA
cccccacaucgugcgcaucc

SEQ ID NO: 30392 - RNA, 20 nt, Artificial Sequence
  MKO10030392_A_Mapkapk3
  gRNA
gcauauucucauacacgucc

SEQ ID NO: 30393 - RNA, 20 nt, Artificial Sequence
  MKO10030393_A_Mapkapk3
  gRNA
uguuccggcugugcaagaac

SEQ ID NO: 30394 - RNA, 20 nt, Artificial Sequence
  MKO10030394_A_Mapkapk5
  gRNA
ccuaacuggaccacuaauuc

SEQ ID NO: 30395 - RNA, 20 nt, Artificial Sequence
  MKO10030395_A_Mapkapk5
  gRNA
aaacugggagccggaauuag

SEQ ID NO: 30396 - RNA, 20 nt, Artificial Sequence
  MKO10030396_A_Mapkapk5
  gRNA
ggcucgacucuuaauuguaa

SEQ ID NO: 30397 - RNA, 20 nt, Artificial Sequence
  MKO10030397_A_Mapkbp1
  gRNA
ggauguggcugaacguagcc

SEQ ID NO: 30398 - RNA, 20 nt, Artificial Sequence
  MKO10030398_A_Mapkbp1
  gRNA
cguugacaaucaugucaugc

SEQ ID NO: 30399 - RNA, 20 nt, Artificial Sequence
  MKO10030399_A_Mapkbp1
  gRNA
cuugcuugugacccccgauc

SEQ ID NO: 30400 - RNA, 20 nt, Artificial Sequence
  MKO10030400_A_Mapre1
  gRNA
ggaauggugcgaaagaaucc

SEQ ID NO: 30401 - RNA, 20 nt, Artificial Sequence
  MKO10030401_A_Mapre1
  gRNA
uucucugcagauaauuccug

SEQ ID NO: 30402 - RNA, 20 nt, Artificial Sequence
  MKO10030402_A_Mapre1
  gRNA
accauuccggggccagccuu

SEQ ID NO: 30403 - RNA, 20 nt, Artificial Sequence
  MKO10030403_A_Mapre2
  gRNA
ucgaaacauaccugcugugg

SEQ ID NO: 30404 - RNA, 20 nt, Artificial Sequence
  MKO10030404_A_Mapre2
  gRNA
gaauugcaucuugcccuugu

SEQ ID NO: 30405 - RNA, 20 nt, Artificial Sequence
  MKO10030405_A_Mapre2
  gRNA
aucaacauucauccguuuaa

SEQ ID NO: 30406 - RNA, 20 nt, Artificial Sequence
  MKO10030406_A_Mapre3
  gRNA
cacguugcugagucguccag

SEQ ID NO: 30407 - RNA, 20 nt, Artificial Sequence
  MKO10030407_A_Mapre3
  gRNA
cugaggggggauucuuccgg

SEQ ID NO: 30408 - RNA, 20 nt, Artificial Sequence
  MKO10030408_A_Mapre3
  gRNA
cgagaacagccccgucaucu

SEQ ID NO: 30409 - RNA, 20 nt, Artificial Sequence
  MKO10030409_A_Mapt
  gRNA
caguauggcugacccucgcc

SEQ ID NO: 30410 - RNA, 20 nt, Artificial Sequence
  MKO10030410_A_Mapt
  gRNA
caucggagacaccccgaacc

SEQ ID NO: 30411 - RNA, 20 nt, Artificial Sequence
  MKO10030411_A_Mapt
  gRNA
uggcguuggacgugcccuuc

SEQ ID NO: 30412 - RNA, 20 nt, Artificial Sequence
  MKO10030412_A_Marcksl1
  gRNA
agcgggcgcuucccccgcga

SEQ ID NO: 30413 - RNA, 20 nt, Artificial Sequence
  MKO10030413_A_Marcksl1
  gRNA
caccuguccguuggccuucg

SEQ ID NO: 30414 - RNA, 20 nt, Artificial Sequence
  MKO10030414_A_Marcksl1
  gRNA
gaugagcgccugcagcgacg

SEQ ID NO: 30415 - RNA, 20 nt, Artificial Sequence
  MKO10030415_A_Marcks
  gRNA
cuccuccacgucgucgccca

SEQ ID NO: 30416 - RNA, 20 nt, Artificial Sequence
  MKO10030416_A_Marcks
  gRNA
gcgaugcguccuccgccgca

SEQ ID NO: 30417 - RNA, 20 nt, Artificial Sequence
  MKO10030417_A_Marcks
  gRNA
guucuccaagaccgcagcga

SEQ ID NO: 30418 - RNA, 20 nt, Artificial Sequence
  MKO10030418_A_Marco
  gRNA
caauggaucacuagcuaucg

SEQ ID NO: 30419 - RNA, 20 nt, Artificial Sequence
  MKO10030419_A_Marco
  gRNA
agccucguucaccuuuaauc

SEQ ID NO: 30420 - RNA, 20 nt, Artificial Sequence
  MKO10030420_A_Marco
  gRNA
acaccugguaccuagagcac

SEQ ID NO: 30421 - RNA, 20 nt, Artificial Sequence
  MKO10030421_A_Marf1
  gRNA
cccacuugggaaaucggaac

SEQ ID NO: 30422 - RNA, 20 nt, Artificial Sequence
  MKO10030422_A_Marf1
  gRNA
ggagcuucccacaacacgac

SEQ ID NO: 30423 - RNA, 20 nt, Artificial Sequence
  MKO10030423_A_Marf1
  gRNA
gcguguuugcgaaccuucgc

SEQ ID NO: 30424 - RNA, 20 nt, Artificial Sequence
  MKO10030424_A_Mark1
  gRNA
ucucuccuagcauacgucug

SEQ ID NO: 30425 - RNA, 20 nt, Artificial Sequence
  MKO10030425_A_Mark1
  gRNA
uucaucugucgcugacguaa

SEQ ID NO: 30426 - RNA, 20 nt, Artificial Sequence
  MKO10030426_A_Mark1
  gRNA
guuucauaccuauguuagga

SEQ ID NO: 30427 - RNA, 20 nt, Artificial Sequence
  MKO10030427_A_Mark2
  gRNA
ugcucaccucuuuccccguc

SEQ ID NO: 30428 - RNA, 20 nt, Artificial Sequence
  MKO10030428_A_Mark2
  gRNA
agccgguaguugccaauaug

SEQ ID NO: 30429 - RNA, 20 nt, Artificial Sequence
  MKO10030429_A_Mark2
  gRNA
gaagacucucuaccuuguca

SEQ ID NO: 30430 - RNA, 20 nt, Artificial Sequence
  MKO10030430_A_Mark3
  gRNA
agucuguaguuuccgaugug

SEQ ID NO: 30431 - RNA, 20 nt, Artificial Sequence
  MKO10030431_A_Mark3
  gRNA
acaccgagcuccagagcgcc

SEQ ID NO: 30432 - RNA, 20 nt, Artificial Sequence
  MKO10030432_A_Mark3
  gRNA
agcgcaauaagauguccacu

SEQ ID NO: 30433 - RNA, 20 nt, Artificial Sequence
  MKO10030433_A_Mark4
  gRNA
gacggagaagacgcuauacc

SEQ ID NO: 30434 - RNA, 20 nt, Artificial Sequence
  MKO10030434_A_Mark4
  gRNA
cucggcauauccucacgggc

SEQ ID NO: 30435 - RNA, 20 nt, Artificial Sequence
  MKO10030435_A_Mark4
  gRNA
augccgagccagcuugacuu

SEQ ID NO: 30436 - RNA, 20 nt, Artificial Sequence
  MKO10030436_A_Mars2
  gRNA
ucgugcucgccgagcgcuag

SEQ ID NO: 30437 - RNA, 20 nt, Artificial Sequence
  MKO10030437_A_Mars2
  gRNA
gcggcguucacguagaagau

SEQ ID NO: 30438 - RNA, 20 nt, Artificial Sequence
  MKO10030438_A_Mars2
  gRNA
ucggcgagcacgaaccguag

SEQ ID NO: 30439 - RNA, 20 nt, Artificial Sequence
  MKO10030439_A_Mars
  gRNA
gaugagacuguucgugagcg

SEQ ID NO: 30440 - RNA, 20 nt, Artificial Sequence
  MKO10030440_A_Mars
  gRNA
accuuaggccggguaaggaa

SEQ ID NO: 30441 - RNA, 20 nt, Artificial Sequence
  MKO10030441_A_Mars
  gRNA
cggccgcgagggcccggggu

SEQ ID NO: 30442 - RNA, 20 nt, Artificial Sequence
  MKO10030442_A_Marveld1
  gRNA
uaccuacucucggcacucua

SEQ ID NO: 30443 - RNA, 20 nt, Artificial Sequence
  MKO10030443_A_Marveld1
  gRNA
acgaagagcgcgaagugcac

SEQ ID NO: 30444 - RNA, 20 nt, Artificial Sequence
  MKO10030444_A_Marveld1
  gRNA
gcgcuggcucguggucaacg

SEQ ID NO: 30445 - RNA, 20 nt, Artificial Sequence
  MKO10030445_A_Marveld2
  gRNA
acccgucguugucaucgaaa

SEQ ID NO: 30446 - RNA, 20 nt, Artificial Sequence
  MKO10030446_A_Marveld2
  gRNA
ugacgaucgagaacgcuaua

SEQ ID NO: 30447 - RNA, 20 nt, Artificial Sequence
  MKO10030447_A_Marveld2
  gRNA
cggacucacgccacguaguc

SEQ ID NO: 30448 - RNA, 20 nt, Artificial Sequence
  MKO10030448_A_Marveld3
  gRNA
cccgcgaccgcucgacgugg

SEQ ID NO: 30449 - RNA, 20 nt, Artificial Sequence
  MKO10030449_A_Marveld3
  gRNA
ugguugcagcgaacgggcuu

SEQ ID NO: 30450 - RNA, 20 nt, Artificial Sequence
  MKO10030450_A_Marveld3
  gRNA
cagccacgccgccguagauc

SEQ ID NO: 30451 - RNA, 20 nt, Artificial Sequence
  MKO10030451_A_Mas1
  gRNA
uaucgguccucuaccccaua

SEQ ID NO: 30452 - RNA, 20 nt, Artificial Sequence
  MKO10030452_A_Mas1
  gRNA
acuugcuguacuacgaguac

SEQ ID NO: 30453 - RNA, 20 nt, Artificial Sequence
  MKO10030453_A_Mas1
  gRNA
acucguaguacagcaaguag

SEQ ID NO: 30454 - RNA, 20 nt, Artificial Sequence
  MKO10030454_A_Masp1
  gRNA
uaugggcugaaaccuccggc

SEQ ID NO: 30455 - RNA, 20 nt, Artificial Sequence
  MKO10030455_A_Masp1
  gRNA
gggggucugcucaguaucgg

SEQ ID NO: 30456 - RNA, 20 nt, Artificial Sequence
  MKO10030456_A_Masp1
  gRNA
caggaagugguucuuucgcc

SEQ ID NO: 30457 - RNA, 20 nt, Artificial Sequence
  MKO10030457_A_Masp2
  gRNA
aguagccgcccaaguaguug

SEQ ID NO: 30458 - RNA, 20 nt, Artificial Sequence
  MKO10030458_A_Masp2
  gRNA
gacaccaggcgcccgaauac

SEQ ID NO: 30459 - RNA, 20 nt, Artificial Sequence
  MKO10030459_A_Masp2
  gRNA
gagaacguagcccgcucugc

SEQ ID NO: 30460 - RNA, 20 nt, Artificial Sequence
  MKO10030460_A_Mast1
  gRNA
caccgagagcaucaccgacg

SEQ ID NO: 30461 - RNA, 20 nt, Artificial Sequence
  MKO10030461_A_Mast1
  gRNA
gcugguacgguaguugaugc

SEQ ID NO: 30462 - RNA, 20 nt, Artificial Sequence
  MKO10030462_A_Mast1
  gRNA
gcagggcggauggacgccga

SEQ ID NO: 30463 - RNA, 20 nt, Artificial Sequence
  MKO10030463_A_Mast2
  gRNA
uggggcaacucggccguccg

SEQ ID NO: 30464 - RNA, 20 nt, Artificial Sequence
  MKO10030464_A_Mast2
  gRNA
cgcagucuuugcccccgcgc

SEQ ID NO: 30465 - RNA, 20 nt, Artificial Sequence
  MKO10030465_A_Mast2
  gRNA
cauccugacuaaguugucgc

SEQ ID NO: 30466 - RNA, 20 nt, Artificial Sequence
  MKO10030466_A_Mast3
  gRNA
ggagcugguguagacgcucc

SEQ ID NO: 30467 - RNA, 20 nt, Artificial Sequence
  MKO10030467_A_Mast3
  gRNA
cccagucaagcucguccucc

SEQ ID NO: 30468 - RNA, 20 nt, Artificial Sequence
  MKO10030468_A_Mast3
  gRNA
ggacacuuaccuccgggcaa

SEQ ID NO: 30469 - RNA, 20 nt, Artificial Sequence
  MKO10030469_A_Mast4
  gRNA
uuggacgucuccgccgaagc

SEQ ID NO: 30470 - RNA, 20 nt, Artificial Sequence
  MKO10030470_A_Mast4
  gRNA
cuccgccacccaugccguuu

SEQ ID NO: 30471 - RNA, 20 nt, Artificial Sequence
  MKO10030471_A_Mast4
  gRNA
gccuguccugcuaccggguu

SEQ ID NO: 30472 - RNA, 20 nt, Artificial Sequence
  MKO10030472_A_Mastl
  gRNA
caguuuaauaugacccucau

SEQ ID NO: 30473 - RNA, 20 nt, Artificial Sequence
  MKO10030473_A_Mastl
  gRNA
augagagauaagacuugucc

SEQ ID NO: 30474 - RNA, 20 nt, Artificial Sequence
  MKO10030474_A_Mastl
  gRNA
ucuauuauagguugucaaaa

SEQ ID NO: 30475 - RNA, 20 nt, Artificial Sequence
  MKO10030475_A_Mau1a
  gRNA
ccagcaccgcaucacuaauc

SEQ ID NO: 30476 - RNA, 20 nt, Artificial Sequence
  MKO10030476_A_Mau1a
  gRNA
gaguuugugagcgagcacga

SEQ ID NO: 30477 - RNA, 20 nt, Artificial Sequence
  MKO10030477_A_Mau1a
  gRNA
auagcagaucugaggcgcuc

SEQ ID NO: 30478 - RNA, 20 nt, Artificial Sequence
  MKO10030478_A_Mau2a
  gRNA
gccgcaaugguacauugccu

SEQ ID NO: 30479 - RNA, 20 nt, Artificial Sequence
  MKO10030479_A_Mau2a
  gRNA
acacaagcuaaaugccaaau

SEQ ID NO: 30480 - RNA, 20 nt, Artificial Sequence
  MKO10030480_A_Mau2a
  gRNA
ccacaagccacuuuagcauc

SEQ ID NO: 30481 - RNA, 20 nt, Artificial Sequence
  MKO10030481_A_Mau2b
  gRNA
caccaguaaugagaacccgc

SEQ ID NO: 30482 - RNA, 20 nt, Artificial Sequence
  MKO10030482_A_Mau2b
  gRNA
ggcuacgucuuucacaugug

SEQ ID NO: 30483 - RNA, 20 nt, Artificial Sequence
  MKO10030483_A_Mau2b
  gRNA
gcacaaugcacuaugacaug

SEQ ID NO: 30484 - RNA, 20 nt, Artificial Sequence
  MKO10030484_A_Mauk
  gRNA
agccuuucgaaagggugaca

SEQ ID NO: 30485 - RNA, 20 nt, Artificial Sequence
  MKO10030485_A_Mauk
  gRNA
gaaacacacggccucaucga

SEQ ID NO: 30486 - RNA, 20 nt, Artificial Sequence
  MKO10030486_A_Mauk
  gRNA
gcccaucucgaugcaaaaca

SEQ ID NO: 30487 - RNA, 20 nt, Artificial Sequence
  MKO10030487_A_Maun1
  gRNA
ccgugggucguguccggcag

SEQ ID NO: 30488 - RNA, 20 nt, Artificial Sequence
  MKO10030488_A_Maun1
  gRNA
cgcucuuggauccgucgaug

SEQ ID NO: 30489 - RNA, 20 nt, Artificial Sequence
  MKO10030489_A_Maun1
  gRNA
uaauccacgugcucguccug

SEQ ID NO: 30490 - RNA, 20 nt, Artificial Sequence
  MKO10030490_A_Maun2
  gRNA
guccaccugaccgacaccga

SEQ ID NO: 30491 - RNA, 20 nt, Artificial Sequence
  MKO10030491_A_Maun2
  gRNA
cacuugcagauguacgagcc

SEQ ID NO: 30492 - RNA, 20 nt, Artificial Sequence
  MKO10030492_A_Maun2
  gRNA
uguuaagagcaaaucccucg

SEQ ID NO: 30493 - RNA, 20 nt, Artificial Sequence
  MKO10030493_A_Maun3
  gRNA
uugauaguucucguagcguc

SEQ ID NO: 30494 - RNA, 20 nt, Artificial Sequence
  MKO10030494_A_Maun3
  gRNA
ggaagagcacgucuucuacg

SEQ ID NO: 30495 - RNA, 20 nt, Artificial Sequence
  MKO10030495_A_Maun3
  gRNA
gcucuggacaaaugcgccuc

SEQ ID NO: 30496 - RNA, 20 nt, Artificial Sequence
  MKO10030496_A_Maun4
  gRNA
ggccgaaggcgcgcgcccau

SEQ ID NO: 30497 - RNA, 20 nt, Artificial Sequence
  MKO10030497_A_Maun4
  gRNA
ggucugaacgccacgcgcgu

SEQ ID NO: 30498 - RNA, 20 nt, Artificial Sequence
  MKO10030498_A_Maun4
  gRNA
acgacagaaauacgagucca

SEQ ID NO: 30499 - RNA, 20 nt, Artificial Sequence
  MKO10030499_A_Maur3
  gRNA
ggcggcggucccagaauccc

SEQ ID NO: 30500 - RNA, 20 nt, Artificial Sequence
  MKO10030500_A_Maur3
  gRNA
gaguggagucaacauaucaa

SEQ ID NO: 30501 - RNA, 20 nt, Artificial Sequence
  MKO10030501_A_Maur3
  gRNA
guagacugcugcagcaugaa

SEQ ID NO: 30502 - RNA, 20 nt, Artificial Sequence
  MKO10030502_A_Mau2
  gRNA
ucucacaacagacgccauac

SEQ ID NO: 30503 - RNA, 20 nt, Artificial Sequence
  MKO10030503_A_Mau2
  gRNA
cauacucagcccccacgccu

SEQ ID NO: 30504 - RNA, 20 nt, Artificial Sequence
  MKO10030504_A_Mau2
  gRNA
gggggcugaguaugcccgag

SEQ ID NO: 30505 - RNA, 20 nt, Artificial Sequence
  MKO10030505_A_Mavs
  gRNA
gccaccagacauccucgcga

SEQ ID NO: 30506 - RNA, 20 nt, Artificial Sequence
  MKO10030506_A_Mavs
  gRNA
gccgucgcgaggaugucugg

SEQ ID NO: 30507 - RNA, 20 nt, Artificial Sequence
  MKO10030507_A_Mavs
  gRNA
uuggugucucucguaagcca

SEQ ID NO: 30508 - RNA, 20 nt, Artificial Sequence
  MKO10030508_A_Max
  gRNA
gagcgauaacgaugacaucg

SEQ ID NO: 30509 - RNA, 20 nt, Artificial Sequence
  MKO10030509_A_Max
  gRNA
gauggugccgcccuuggcgu

SEQ ID NO: 30510 - RNA, 20 nt, Artificial Sequence
  MKO10030510_A_Max
  gRNA
cagccucuacaccaacgcca

SEQ ID NO: 30511 - RNA, 20 nt, Artificial Sequence
  MKO10030511_A_Maz
  gRNA
caggugguagacgucgcgga

SEQ ID NO: 30512 - RNA, 20 nt, Artificial Sequence
  MKO10030512_A_Maz
  gRNA
cgccgucaugugagcgcacg

SEQ ID NO: 30513 - RNA, 20 nt, Artificial Sequence
  MKO10030513_A_Maz
  gRNA
cgugucggacugugugcgcu

SEQ ID NO: 30514 - RNA, 20 nt, Artificial Sequence
  MKO10030514_A_Mb21d1
  gRNA
aaacggcucucgucuuagau

SEQ ID NO: 30515 - RNA, 20 nt, Artificial Sequence
  MKO10030515_A_Mb21d1
  gRNA
ugcuaacaacuuaucgaagc

SEQ ID NO: 30516 - RNA, 20 nt, Artificial Sequence
  MKO10030516_A_Mb21d1
  gRNA
ucucguacccaagaaugcaa

SEQ ID NO: 30517 - RNA, 20 nt, Artificial Sequence
  MKO10030517_A_Mb21d2
  gRNA
guuguacgacaucguccccg

SEQ ID NO: 30518 - RNA, 20 nt, Artificial Sequence
  MKO10030518_A_Mb21d2
  gRNA
acaaucgccgaucacaucaa

SEQ ID NO: 30519 - RNA, 20 nt, Artificial Sequence
  MKO10030519_A_Mb21d2
  gRNA
guauucccgcuggucgugcc

SEQ ID NO: 30520 - RNA, 20 nt, Artificial Sequence
  MKO10030520_A_Mbd1
  gRNA
acguugugcaaagauugucg

SEQ ID NO: 30521 - RNA, 20 nt, Artificial Sequence
  MKO10030521_A_Mbd1
  gRNA
ggggccuuauauucccccug

SEQ ID NO: 30522 - RNA, 20 nt, Artificial Sequence
  MKO10030522_A_Mbd1
  gRNA
ccgcgaacagagaauguuua

SEQ ID NO: 30523 - RNA, 20 nt, Artificial Sequence
  MKO10030523_A_Mbd2
  gRNA
gugguuguucauucauccgc

SEQ ID NO: 30524 - RNA, 20 nt, Artificial Sequence
  MKO10030524_A_Mbd2
  gRNA
cuccuugcaggagucggucc

SEQ ID NO: 30525 - RNA, 20 nt, Artificial Sequence
  MKO10030525_A_Mbd2
  gRNA
agggucucgucauugcuacc

SEQ ID NO: 30526 - RNA, 20 nt, Artificial Sequence
  MKO10030526_A_Mbd3l1
  gRNA
cuccaagccuacagcagugc

SEQ ID NO: 30527 - RNA, 20 nt, Artificial Sequence
  MKO10030527_A_Mbd3l1
  gRNA
uacggaugugaugucaaugc

SEQ ID NO: 30528 - RNA, 20 nt, Artificial Sequence
  MKO10030528_A_Mbd3l1
  gRNA
uguauaacuagacauccuca

SEQ ID NO: 30529 - RNA, 20 nt, Artificial Sequence
  MKO10030529_A_Mbd3l2
  gRNA
gauugucccgaaaaagauaa

SEQ ID NO: 30530 - RNA, 20 nt, Artificial Sequence
  MKO10030530_A_Mbd3l2
  gRNA
gcugacccuuaacaccacuu

SEQ ID NO: 30531 - RNA, 20 nt, Artificial Sequence
  MKO10030531_A_Mbd3l2
  gRNA
aaguacucacuaucaaaggc

SEQ ID NO: 30532 - RNA, 20 nt, Artificial Sequence
  MKO10030532_A_Mbd3
  gRNA
gucgcucuugaccuuguugc

SEQ ID NO: 30533 - RNA, 20 nt, Artificial Sequence
  MKO10030533_A_Mbd3
  gRNA
agcaccuucgacuuccgcac

SEQ ID NO: 30534 - RNA, 20 nt, Artificial Sequence
  MKO10030534_A_Mbd3
  gRNA
aagaaucauagcgcacacgc

SEQ ID NO: 30535 - RNA, 20 nt, Artificial Sequence
  MKO10030535_A_Mbd4
  gRNA
ggugggugcugaucgcgagc

SEQ ID NO: 30536 - RNA, 20 nt, Artificial Sequence
  MKO10030536_A_Mbd4
  gRNA
ucgcgacuauauuucucaau

SEQ ID NO: 30537 - RNA, 20 nt, Artificial Sequence
  MKO10030537_A_Mbd4
  gRNA
ugcgcucacugcuuaucacc

SEQ ID NO: 30538 - RNA, 20 nt, Artificial Sequence
  MKO10030538_A_Mbd5
  gRNA
gccgcccgugaagguacuac

SEQ ID NO: 30539 - RNA, 20 nt, Artificial Sequence
  MKO10030539_A_Mbd5
  gRNA
gcuaaagcagcguuuacauu

SEQ ID NO: 30540 - RNA, 20 nt, Artificial Sequence
  MKO10030540_A_Mbd5
  gRNA
ggguguccugaacucggcau

SEQ ID NO: 30541 - RNA, 20 nt, Artificial Sequence
  MKO10030541_A_Mbd6
  gRNA
cgaguccgucuaggggucug

SEQ ID NO: 30542 - RNA, 20 nt, Artificial Sequence
  MKO10030542_A_Mbd6
  gRNA
cccccaagcaauaacccccc

SEQ ID NO: 30543 - RNA, 20 nt, Artificial Sequence
  MKO10030543_A_Mbd6
  gRNA
acacuccagaccgcacuugc

SEQ ID NO: 30544 - RNA, 20 nt, Artificial Sequence
  MKO10030544_A_Mbip
  gRNA
cguguuguucaagugcagua

SEQ ID NO: 30545 - RNA, 20 nt, Artificial Sequence
  MKO10030545_A_Mbip
  gRNA
aagagccauacaucccaccg

SEQ ID NO: 30546 - RNA, 20 nt, Artificial Sequence
  MKO10030546_A_Mbip
  gRNA
aaauuacaaucgauuggaac

SEQ ID NO: 30547 - RNA, 20 nt, Artificial Sequence
  MKO10030547_A_Mbl1
  gRNA
aucacggacgaggcgacuga

SEQ ID NO: 30548 - RNA, 20 nt, Artificial Sequence
  MKO10030548_A_Mbl1
  gRNA
ucgccucguccgugaugccu

SEQ ID NO: 30549 - RNA, 20 nt, Artificial Sequence
  MKO10030549_A_Mbl1
  gRNA
ucccaacaggucaagggcuc

SEQ ID NO: 30550 - RNA, 20 nt, Artificial Sequence
  MKO10030550_A_Mbl2
  gRNA
uaugcagagaccuuaaccga

SEQ ID NO: 30551 - RNA, 20 nt, Artificial Sequence
  MKO10030551_A_Mbl2
  gRNA
uuccccaucgcccguguugu

SEQ ID NO: 30552 - RNA, 20 nt, Artificial Sequence
  MKO10030552_A_Mbl2
  gRNA
ccgucacguccaucuuugcc

SEQ ID NO: 30553 - RNA, 20 nt, Artificial Sequence
  MKO10030553_A_Mblac1
  gRNA
gcgggacgugagcgucguag

SEQ ID NO: 30554 - RNA, 20 nt, Artificial Sequence
  MKO10030554_A_Mblac1
  gRNA
uuggccccauccgcagacgg

SEQ ID NO: 30555 - RNA, 20 nt, Artificial Sequence
  MKO10030555_A_Mblac1
  gRNA
ggcgauguguucgagcgacu

SEQ ID NO: 30556 - RNA, 20 nt, Artificial Sequence
  MKO10030556_A_Mblac2
  gRNA
caaaguuguccccgcgagcc

SEQ ID NO: 30557 - RNA, 20 nt, Artificial Sequence
  MKO10030557_A_Mblac2
  gRNA
caagaacgguucuacgaguc

SEQ ID NO: 30558 - RNA, 20 nt, Artificial Sequence
  MKO10030558_A_Mblac2
  gRNA
aguggugacgucguguauga

SEQ ID NO: 30559 - RNA, 20 nt, Artificial Sequence
  MKO10030559_A_Mbnl1
  gRNA
gugugucgagaguaccagcg

SEQ ID NO: 30560 - RNA, 20 nt, Artificial Sequence
  MKO10030560_A_Mbnl1
  gRNA
gccaccgcagucuuuaacac

SEQ ID NO: 30561 - RNA, 20 nt, Artificial Sequence
  MKO10030561_A_Mbnl1
  gRNA
cuugccgacugcaccaaugu

SEQ ID NO: 30562 - RNA, 20 nt, Artificial Sequence
  MKO10030562_A_Mbnl2
  gRNA
cccgggcacaguuuccucgc

SEQ ID NO: 30563 - RNA, 20 nt, Artificial Sequence
  MKO10030563_A_Mbnl2
  gRNA
acauaaaggggcguugcaug

SEQ ID NO: 30564 - RNA, 20 nt, Artificial Sequence
  MKO10030564_A_Mbnl2
  gRNA
agcgugagcacguuccucuc

SEQ ID NO: 30565 - RNA, 20 nt, Artificial Sequence
  MKO10030565_A_Mbnl3
  gRNA
uccagucuaucuguacgaau

SEQ ID NO: 30566 - RNA, 20 nt, Artificial Sequence
  MKO10030566_A_Mbnl3
  gRNA
gccaauucguacagauagac

SEQ ID NO: 30567 - RNA, 20 nt, Artificial Sequence
  MKO10030567_A_Mbnl3
  gRNA
cauccguagggugagcauag

SEQ ID NO: 30568 - RNA, 20 nt, Artificial Sequence
  MKO10030568_A_Mboau1
  gRNA
cacucagaagaucacgacgu

SEQ ID NO: 30569 - RNA, 20 nt, Artificial Sequence
  MKO10030569_A_Mboau1
  gRNA
gccaaggugugccggaccuc

SEQ ID NO: 30570 - RNA, 20 nt, Artificial Sequence
  MKO10030570_A_Mboau1
  gRNA
cccugagguccggcacaccu

SEQ ID NO: 30571 - RNA, 20 nt, Artificial Sequence
  MKO10030571_A_Mboau2
  gRNA
gacgccgguaccugaucgau

SEQ ID NO: 30572 - RNA, 20 nt, Artificial Sequence
  MKO10030572_A_Mboau2
  gRNA
cgugcaacugcccaucgauc

SEQ ID NO: 30573 - RNA, 20 nt, Artificial Sequence
  MKO10030573_A_Mboau2
  gRNA
uugccuuguuagcagccguu

SEQ ID NO: 30574 - RNA, 20 nt, Artificial Sequence
  MKO10030574_A_Mboau4
  gRNA
ggagggauacguccccgacg

SEQ ID NO: 30575 - RNA, 20 nt, Artificial Sequence
  MKO10030575_A_Mboau4
  gRNA
cagcgccaaagcccgccgcg

SEQ ID NO: 30576 - RNA, 20 nt, Artificial Sequence
  MKO10030576_A_Mboau4
  gRNA
ucacuacaccgaauacuacc

SEQ ID NO: 30577 - RNA, 20 nt, Artificial Sequence
  MKO10030577_A_Mboau7
  gRNA
cgcggcaaugcaaccgcacu

SEQ ID NO: 30578 - RNA, 20 nt, Artificial Sequence
  MKO10030578_A_Mboau7
  gRNA
gcaugcgcuucuacguugcc

SEQ ID NO: 30579 - RNA, 20 nt, Artificial Sequence
  MKO10030579_A_Mboau7
  gRNA
cagcuauagcuacuguuacg

SEQ ID NO: 30580 - RNA, 20 nt, Artificial Sequence
  MKO10030580_A_Mbp
  gRNA
gggcucucagcgucucgcca

SEQ ID NO: 30581 - RNA, 20 nt, Artificial Sequence
  MKO10030581_A_Mbp
  gRNA
accgcuaaagaagcgcccga

SEQ ID NO: 30582 - RNA, 20 nt, Artificial Sequence
  MKO10030582_A_Mbp
  gRNA
uccaucgggcgcuucuuuag

SEQ ID NO: 30583 - RNA, 20 nt, Artificial Sequence
  MKO10030583_A_Mbtd1
  gRNA
gugauaucucggaaaaugua

SEQ ID NO: 30584 - RNA, 20 nt, Artificial Sequence
  MKO10030584_A_Mbtd1
  gRNA
ugacgaguaacuucuugaac

SEQ ID NO: 30585 - RNA, 20 nt, Artificial Sequence
  MKO10030585_A_Mbtd1
  gRNA
gcagcuaauuuagcaacuaa

SEQ ID NO: 30586 - RNA, 20 nt, Artificial Sequence
  MKO10030586_A_Mbtps1
  gRNA
guuucauuacagggcacgau

SEQ ID NO: 30587 - RNA, 20 nt, Artificial Sequence
  MKO10030587_A_Mbtps1
  gRNA
gcugagagccauuccucgcc

SEQ ID NO: 30588 - RNA, 20 nt, Artificial Sequence
  MKO10030588_A_Mbtps1
  gRNA
ucacuggauggguuguuccg

SEQ ID NO: 30589 - RNA, 20 nt, Artificial Sequence
  MKO10030589_A_Mbtps2
  gRNA
cauguacaacaccacuaaug

SEQ ID NO: 30590 - RNA, 20 nt, Artificial Sequence
  MKO10030590_A_Mbtps2
  gRNA
uucgcugcaguccucauuag

SEQ ID NO: 30591 - RNA, 20 nt, Artificial Sequence
  MKO10030591_A_Mbtps2
  gRNA
ccgccguccccaacuguaaa

SEQ ID NO: 30592 - RNA, 20 nt, Artificial Sequence
  MKO10030592_A_Mb
  gRNA
ugacauugccgccaaguaca

SEQ ID NO: 30593 - RNA, 20 nt, Artificial Sequence
  MKO10030593_A_Mb
  gRNA
ugugcuugguggcgugugau

SEQ ID NO: 30594 - RNA, 20 nt, Artificial Sequence
  MKO10030594_A_Mb
  gRNA
ccuaccuccagguacuugac

SEQ ID NO: 30595 - RNA, 20 nt, Artificial Sequence
  MKO10030595_A_Mc1r
  gRNA
cacgacagcccgucgugcuc

SEQ ID NO: 30596 - RNA, 20 nt, Artificial Sequence
  MKO10030596_A_Mc1r
  gRNA
cgaugcugacacuuaccauc

SEQ ID NO: 30597 - RNA, 20 nt, Artificial Sequence
  MKO10030597_A_Mc1r
  gRNA
auaacgcagcgcauagaaga

SEQ ID NO: 30598 - RNA, 20 nt, Artificial Sequence
  MKO10030598_A_Mc2r
  gRNA
guuauuucuugcggugucau

SEQ ID NO: 30599 - RNA, 20 nt, Artificial Sequence
  MKO10030599_A_Mc2r
  gRNA
gcuccgaaaggcauauauaa

SEQ ID NO: 30600 - RNA, 20 nt, Artificial Sequence
  MKO10030600_A_Mc2r
  gRNA
gggcagucuguauaagaucu

SEQ ID NO: 30601 - RNA, 20 nt, Artificial Sequence
  MKO10030601_A_Mc3r
  gRNA
ucaccuugaucggggucauc

SEQ ID NO: 30602 - RNA, 20 nt, Artificial Sequence
  MKO10030602_A_Mc3r
  gRNA
gacccagaugaccccgauca

SEQ ID NO: 30603 - RNA, 20 nt, Artificial Sequence
  MKO10030603_A_Mc3r
  gRNA
gcacugcgaugcgcuggacg

SEQ ID NO: 30604 - RNA, 20 nt, Artificial Sequence
  MKO10030604_A_Mc4r
  gRNA
gccuaaccgucaugauguua

SEQ ID NO: 30605 - RNA, 20 nt, Artificial Sequence
  MKO10030605_A_Mc4r
  gRNA
ccguauccguacuguuuaac

SEQ ID NO: 30606 - RNA, 20 nt, Artificial Sequence
  MKO10030606_A_Mc4r
  gRNA
gcccuuccccagcgacucgc

SEQ ID NO: 30607 - RNA, 20 nt, Artificial Sequence
  MKO10030607_A_Mc5r
  gRNA
cuuagccguggccgacaugc

SEQ ID NO: 30608 - RNA, 20 nt, Artificial Sequence
  MKO10030608_A_Mc5r
  gRNA
aaggcguuuaauacccgcca

SEQ ID NO: 30609 - RNA, 20 nt, Artificial Sequence
  MKO10030609_A_Mc5r
  gRNA
uucugcucugcuccgcgcaa

SEQ ID NO: 30610 - RNA, 20 nt, Artificial Sequence
  MKO10030610_A_Mcam
  gRNA
gaagcucaacguagugaucc

SEQ ID NO: 30611 - RNA, 20 nt, Artificial Sequence
  MKO10030611_A_Mcam
  gRNA
acgacauuggcuugaauagu

SEQ ID NO: 30612 - RNA, 20 nt, Artificial Sequence
  MKO10030612_A_Mcam
  gRNA
ccagaguagccaccgagucu

SEQ ID NO: 30613 - RNA, 20 nt, Artificial Sequence
  MKO10030613_A_Mcau
  gRNA
ucguagagcugccgcacacg

SEQ ID NO: 30614 - RNA, 20 nt, Artificial Sequence
  MKO10030614_A_Mcau
  gRNA
caaugcacucuaucuacgag

SEQ ID NO: 30615 - RNA, 20 nt, Artificial Sequence
  MKO10030615_A_Mcau
  gRNA
agcucuacgaggccgcgcac

SEQ ID NO: 30616 - RNA, 20 nt, Artificial Sequence
  MKO10030616_A_Mccc1
  gRNA
gcagacgaggcauauuccau

SEQ ID NO: 30617 - RNA, 20 nt, Artificial Sequence
  MKO10030617_A_Mccc1
  gRNA
uccgaaagaaaaccguagcc

SEQ ID NO: 30618 - RNA, 20 nt, Artificial Sequence
  MKO10030618_A_Mccc1
  gRNA
ucagcagagcuaccucgcaa

SEQ ID NO: 30619 - RNA, 20 nt, Artificial Sequence
  MKO10030619_A_Mccc2
  gRNA
cuuccucgucgccauauaac

SEQ ID NO: 30620 - RNA, 20 nt, Artificial Sequence
  MKO10030620_A_Mccc2
  gRNA
cgggcgcggcacacauccag

SEQ ID NO: 30621 - RNA, 20 nt, Artificial Sequence
  MKO10030621_A_Mccc2
  gRNA
gacgaggaaguccccgccgg

SEQ ID NO: 30622 - RNA, 20 nt, Artificial Sequence
  MKO10030622_A_Mcc
  gRNA
gcgcacgacacuccgcuaug

SEQ ID NO: 30623 - RNA, 20 nt, Artificial Sequence
  MKO10030623_A_Mcc
  gRNA
cucuaugugccugucaacgu

SEQ ID NO: 30624 - RNA, 20 nt, Artificial Sequence
  MKO10030624_A_Mcc
  gRNA
accugauggugguaccuugc

SEQ ID NO: 30625 - RNA, 20 nt, Artificial Sequence
  MKO10030625_A_Mcee
  gRNA
gcugggucggcucaaucacg

SEQ ID NO: 30626 - RNA, 20 nt, Artificial Sequence
  MKO10030626_A_Mcee
  gRNA
uguagcgcccgcagccaacg

SEQ ID NO: 30627 - RNA, 20 nt, Artificial Sequence
  MKO10030627_A_Mcee
  gRNA
aaugcaucacgucugcaucg

SEQ ID NO: 30628 - RNA, 20 nt, Artificial Sequence
  MKO10030628_A_Mcf2l
  gRNA
agguacuuacggcuauccgc

SEQ ID NO: 30629 - RNA, 20 nt, Artificial Sequence
  MKO10030629_A_Mcf2l
  gRNA
cacagagcgggacgaugucc

SEQ ID NO: 30630 - RNA, 20 nt, Artificial Sequence
  MKO10030630_A_Mcf2l
  gRNA
agcccgugggccgaagaaca

SEQ ID NO: 30631 - RNA, 20 nt, Artificial Sequence
  MKO10030631_A_Mcf2
  gRNA
cauuggauuucgauuuagcc

SEQ ID NO: 30632 - RNA, 20 nt, Artificial Sequence
  MKO10030632_A_Mcf2
  gRNA
ugcaaggugccgccuaacuc

SEQ ID NO: 30633 - RNA, 20 nt, Artificial Sequence
  MKO10030633_A_Mcf2
  gRNA
cgaaagguaucaccuguuga

SEQ ID NO: 30634 - RNA, 20 nt, Artificial Sequence
  MKO10030634_A_Mcfd2
  gRNA
uucaaaaugcaugauuacga

SEQ ID NO: 30635 - RNA, 20 nt, Artificial Sequence
  MKO10030635_A_Mcfd2
  gRNA
agcucauccucgcucaugac

SEQ ID NO: 30636 - RNA, 20 nt, Artificial Sequence
  MKO10030636_A_Mcfd2
  gRNA
cgugcacugugcucuuaucc

SEQ ID NO: 30637 - RNA, 20 nt, Artificial Sequence
  MKO10030637_A_Mchr1
  gRNA
acuacagcgcaugacgucuu

SEQ ID NO: 30638 - RNA, 20 nt, Artificial Sequence
  MKO10030638_A_Mchr1
  gRNA
ugaccgugcgaagcugcccc

SEQ ID NO: 30639 - RNA, 20 nt, Artificial Sequence
  MKO10030639_A_Mchr1
  gRNA
aaugccagcaacaucuccga

SEQ ID NO: 30640 - RNA, 20 nt, Artificial Sequence
  MKO10030640_A_Mcidas
  gRNA
cgcuucgguuccgagcagcg

SEQ ID NO: 30641 - RNA, 20 nt, Artificial Sequence
  MKO10030641_A_Mcidas
  gRNA
gacgcggacgaaucaccacu

SEQ ID NO: 30642 - RNA, 20 nt, Artificial Sequence
  MKO10030642_A_Mcidas
  gRNA
ggguccucguacaccgccac

SEQ ID NO: 30643 - RNA, 20 nt, Artificial Sequence
  MKO10030643_A_Mcl1
  gRNA
cgacuuaugcagccgccuuu

SEQ ID NO: 30644 - RNA, 20 nt, Artificial Sequence
  MKO10030644_A_Mcl1
  gRNA
cacggccgggcgcuugccga

SEQ ID NO: 30645 - RNA, 20 nt, Artificial Sequence
  MKO10030645_A_Mcl1
  gRNA
cucaggcaugcuccggaaac

SEQ ID NO: 30646 - RNA, 20 nt, Artificial Sequence
  MKO10030646_A_Mcm10
  gRNA
guuaccuugcagcuccucgc

SEQ ID NO: 30647 - RNA, 20 nt, Artificial Sequence
  MKO10030647_A_Mcm10
  gRNA
ccgagcaacccgcuuggcuu

SEQ ID NO: 30648 - RNA, 20 nt, Artificial Sequence
  MKO10030648_A_Mcm10
  gRNA
uacacccgcacagccacuac

SEQ ID NO: 30649 - RNA, 20 nt, Artificial Sequence
  MKO10030649_A_Mcm2
  gRNA
gcucgaugucuacgaggccg

SEQ ID NO: 30650 - RNA, 20 nt, Artificial Sequence
  MKO10030650_A_Mcm2
  gRNA
ccacguagaacgcgccacag

SEQ ID NO: 30651 - RNA, 20 nt, Artificial Sequence
  MKO10030651_A_Mcm2
  gRNA
guucuacguggcggcgcuua

SEQ ID NO: 30652 - RNA, 20 nt, Artificial Sequence
  MKO10030652_A_Mcm3ap
  gRNA
ucguaccuugccgcaugaug

SEQ ID NO: 30653 - RNA, 20 nt, Artificial Sequence
  MKO10030653_A_Mcm3ap
  gRNA
ugcgucuggugaagacccgc

SEQ ID NO: 30654 - RNA, 20 nt, Artificial Sequence
  MKO10030654_A_Mcm3ap
  gRNA
cugugcgccagaguaagcga

SEQ ID NO: 30655 - RNA, 20 nt, Artificial Sequence
  MKO10030655_A_Mcm3
  gRNA
ucagcgugaaugaccugcgc

SEQ ID NO: 30656 - RNA, 20 nt, Artificial Sequence
  MKO10030656_A_Mcm3
  gRNA
gugaacacugcgaacgacuu

SEQ ID NO: 30657 - RNA, 20 nt, Artificial Sequence
  MKO10030657_A_Mcm3
  gRNA
ccuccugaacaaugcguuug

SEQ ID NO: 30658 - RNA, 20 nt, Artificial Sequence
  MKO10030658_A_Mcm4
  gRNA
gguuccuuccacucgcgagc

SEQ ID NO: 30659 - RNA, 20 nt, Artificial Sequence
  MKO10030659_A_Mcm4
  gRNA
uucgccucuacgucuccgau

SEQ ID NO: 30660 - RNA, 20 nt, Artificial Sequence
  MKO10030660_A_Mcm4
  gRNA
aaagcaggucgucacccaau

SEQ ID NO: 30661 - RNA, 20 nt, Artificial Sequence
  MKO10030661_A_Mcm5
  gRNA
augccagcccgucgagcauu

SEQ ID NO: 30662 - RNA, 20 nt, Artificial Sequence
  MKO10030662_A_Mcm5
  gRNA
accaauaucgccaugcgccc

SEQ ID NO: 30663 - RNA, 20 nt, Artificial Sequence
  MKO10030663_A_Mcm5
  gRNA
uucagaauccgaaugcucga

SEQ ID NO: 30664 - RNA, 20 nt, Artificial Sequence
  MKO10030664_A_Mcm6
  gRNA
ucguccugagagaaacacgc

SEQ ID NO: 30665 - RNA, 20 nt, Artificial Sequence
  MKO10030665_A_Mcm6
  gRNA
uucaaggcucgacacaggua

SEQ ID NO: 30666 - RNA, 20 nt, Artificial Sequence
  MKO10030666_A_Mcm6
  gRNA
gggcugcucacccgaaucag

SEQ ID NO: 30667 - RNA, 20 nt, Artificial Sequence
  MKO10030667_A_Mcm7
  gRNA
aaucuucgcaugaguucaga

SEQ ID NO: 30668 - RNA, 20 nt, Artificial Sequence
  MKO10030668_A_Mcm7
  gRNA
uuuagugaguuguauuuccg

SEQ ID NO: 30669 - RNA, 20 nt, Artificial Sequence
  MKO10030669_A_Mcm7
  gRNA
cucagguucaucuggcucau

SEQ ID NO: 30670 - RNA, 20 nt, Artificial Sequence
  MKO10030670_A_Mcm8
  gRNA
gucuaacgguggagagacaa

SEQ ID NO: 30671 - RNA, 20 nt, Artificial Sequence
  MKO10030671_A_Mcm8
  gRNA
cgccgaauuacaagcucaag

SEQ ID NO: 30672 - RNA, 20 nt, Artificial Sequence
  MKO10030672_A_Mcm8
  gRNA
aauauccgagcaacuugcua

SEQ ID NO: 30673 - RNA, 20 nt, Artificial Sequence
  MKO10030673_A_Mcm9
  gRNA
cucgagggggccgccuugcg

SEQ ID NO: 30674 - RNA, 20 nt, Artificial Sequence
  MKO10030674_A_Mcm9
  gRNA
gacagugauccgaacgaguc

SEQ ID NO: 30675 - RNA, 20 nt, Artificial Sequence
  MKO10030675_A_Mcm9
  gRNA
acaugacgauggccgacuga

SEQ ID NO: 30676 - RNA, 20 nt, Artificial Sequence
  MKO10030676_A_Mcmbp
  gRNA
aggggcacuucguucagcga

SEQ ID NO: 30677 - RNA, 20 nt, Artificial Sequence
  MKO10030677_A_Mcmbp
  gRNA
caaguuucguugcaugauuc

SEQ ID NO: 30678 - RNA, 20 nt, Artificial Sequence
  MKO10030678_A_Mcmbp
  gRNA
aaaauggaguuaauccugac

SEQ ID NO: 30679 - RNA, 20 nt, Artificial Sequence
  MKO10030679_A_Mcmdc2
  gRNA
aucuaauucaacaacgucac

SEQ ID NO: 30680 - RNA, 20 nt, Artificial Sequence
  MKO10030680_A_Mcmdc2
  gRNA
guuaagacucucucauuaau

SEQ ID NO: 30681 - RNA, 20 nt, Artificial Sequence
  MKO10030681_A_Mcmdc2
  gRNA
agcagaguuaugcugucuau

SEQ ID NO: 30682 - RNA, 20 nt, Artificial Sequence
  MKO10030682_A_Mcoln1
  gRNA
ugccagcgguacuaccaccg

SEQ ID NO: 30683 - RNA, 20 nt, Artificial Sequence
  MKO10030683_A_Mcoln1
  gRNA
cgguaugccuauguccgugg

SEQ ID NO: 30684 - RNA, 20 nt, Artificial Sequence
  MKO10030684_A_Mcoln1
  gRNA
gggcuggugagguccccacc

SEQ ID NO: 30685 - RNA, 20 nt, Artificial Sequence
  MKO10030685_A_Mcoln2
  gRNA
cuuuccuagcuuguucgguu

SEQ ID NO: 30686 - RNA, 20 nt, Artificial Sequence
  MKO10030686_A_Mcoln2
  gRNA
gauggcgucucucgauucug

SEQ ID NO: 30687 - RNA, 20 nt, Artificial Sequence
  MKO10030687_A_Mcoln2
  gRNA
ggugcucaccacggaacccg

SEQ ID NO: 30688 - RNA, 20 nt, Artificial Sequence
  MKO10030688_A_Mcoln3
  gRNA
cucauaagcgugauugccca

SEQ ID NO: 30689 - RNA, 20 nt, Artificial Sequence
  MKO10030689_A_Mcoln3
  gRNA
agcguaaagucguaacaguc

SEQ ID NO: 30690 - RNA, 20 nt, Artificial Sequence
  MKO10030690_A_Mcoln3
  gRNA
ucugcagacaguucgacacc

SEQ ID NO: 30691 - RNA, 20 nt, Artificial Sequence
  MKO10030691_A_Mcph1
  gRNA
uguucaucgguauucacugc

SEQ ID NO: 30692 - RNA, 20 nt, Artificial Sequence
  MKO10030692_A_Mcph1
  gRNA
cgaagcugguuuccguccuc

SEQ ID NO: 30693 - RNA, 20 nt, Artificial Sequence
  MKO10030693_A_Mcph1
  gRNA
ccagcuucgccccggucuuc

SEQ ID NO: 30694 - RNA, 20 nt, Artificial Sequence
  MKO10030694_A_Mcpt1
  gRNA
cccucugacuuuaucgaccc

SEQ ID NO: 30695 - RNA, 20 nt, Artificial Sequence
  MKO10030695_A_Mcpt1
  gRNA
cugaagaucaucacggacag

SEQ ID NO: 30696 - RNA, 20 nt, Artificial Sequence
  MKO10030696_A_Mcpt1
  gRNA
agcugaguugacuccuacug

SEQ ID NO: 30697 - RNA, 20 nt, Artificial Sequence
  MKO10030697_A_Mcpt2
  gRNA
ugauuacgauuaucaacucc

SEQ ID NO: 30698 - RNA, 20 nt, Artificial Sequence
  MKO10030698_A_Mcpt2
  gRNA
cuccuucgaaccguucuuag

SEQ ID NO: 30699 - RNA, 20 nt, Artificial Sequence
  MKO10030699_A_Mcpt2
  gRNA
guugauaaucguaaucacug

SEQ ID NO: 30700 - RNA, 20 nt, Artificial Sequence
  MKO10030700_A_Mcpt4
  gRNA
gcauuacgacuauaaccucc

SEQ ID NO: 30701 - RNA, 20 nt, Artificial Sequence
  MKO10030701_A_Mcpt4
  gRNA
accacauucucgcccuuaca

SEQ ID NO: 30702 - RNA, 20 nt, Artificial Sequence
  MKO10030702_A_Mcpt4
  gRNA
cccggcuugauaaagucaga

SEQ ID NO: 30703 - RNA, 20 nt, Artificial Sequence
  MKO10030703_A_Mcpt8
  gRNA
gggacaugcugcgacacuuc

SEQ ID NO: 30704 - RNA, 20 nt, Artificial Sequence
  MKO10030704_A_Mcpt8
  gRNA
agcaaaucagucuaucgcug

SEQ ID NO: 30705 - RNA, 20 nt, Artificial Sequence
  MKO10030705_A_Mcpt8
  gRNA
gaaauucuggugaauacccg

SEQ ID NO: 30706 - RNA, 20 nt, Artificial Sequence
  MKO10030706_A_Mcpt9
  gRNA
cacauaaccuuucuuacuga

SEQ ID NO: 30707 - RNA, 20 nt, Artificial Sequence
  MKO10030707_A_Mcpt9
  gRNA
gugaauaccuucaguaagaa

SEQ ID NO: 30708 - RNA, 20 nt, Artificial Sequence
  MKO10030708_A_Mcpt9
  gRNA
acugaaaaucgugggggaaa

SEQ ID NO: 30709 - RNA, 20 nt, Artificial Sequence
  MKO10030709_A_Mcrs1
  gRNA
ccuuccacagguucaucaaa

SEQ ID NO: 30710 - RNA, 20 nt, Artificial Sequence
  MKO10030710_A_Mcrs1
  gRNA
ccucaucaaugcugugcugc

SEQ ID NO: 30711 - RNA, 20 nt, Artificial Sequence
  MKO10030711_A_Mcrs1
  gRNA
cccacucacuuggagaugac

SEQ ID NO: 30712 - RNA, 20 nt, Artificial Sequence
  MKO10030712_A_Mcup1
  gRNA
gucagucauccuuacgccua

SEQ ID NO: 30713 - RNA, 20 nt, Artificial Sequence
  MKO10030713_A_Mcup1
  gRNA
uagcucaccuugauauauag

SEQ ID NO: 30714 - RNA, 20 nt, Artificial Sequence
  MKO10030714_A_Mcup1
  gRNA
ccguaugugaaguuuaaaau

SEQ ID NO: 30715 - RNA, 20 nt, Artificial Sequence
  MKO10030715_A_Mcup2
  gRNA
aaggccgcaaccucgugguc

SEQ ID NO: 30716 - RNA, 20 nt, Artificial Sequence
  MKO10030716_A_Mcup2
  gRNA
uauggugaggagguacgcga

SEQ ID NO: 30717 - RNA, 20 nt, Artificial Sequence
  MKO10030717_A_Mcup2
  gRNA
ugaucaaaagcuccguguga

SEQ ID NO: 30718 - RNA, 20 nt, Artificial Sequence
  MKO10030718_A_Mcus1
  gRNA
acccugugaaaauuguccga

SEQ ID NO: 30719 - RNA, 20 nt, Artificial Sequence
  MKO10030719_A_Mcus1
  gRNA
gcuccgggagaaguuaagcc

SEQ ID NO: 30720 - RNA, 20 nt, Artificial Sequence
  MKO10030720_A_Mcus1
  gRNA
uuuaauacccuuaauaaccg

SEQ ID NO: 30721 - RNA, 20 nt, Artificial Sequence
  MKO10030721_A_Mcus2
  gRNA
ugcugcaguagauaccaucg

SEQ ID NO: 30722 - RNA, 20 nt, Artificial Sequence
  MKO10030722_A_Mcus2
  gRNA
ucuucaugacuccgacacac

SEQ ID NO: 30723 - RNA, 20 nt, Artificial Sequence
  MKO10030723_A_Mcus2
  gRNA
guucaagaaauuugacgaga

SEQ ID NO: 30724 - RNA, 20 nt, Artificial Sequence
  MKO10030724_A_Mcur1
  gRNA
caaucuuagauaauaccugc

SEQ ID NO: 30725 - RNA, 20 nt, Artificial Sequence
  MKO10030725_A_Mcur1
  gRNA
cuacuuugacacccacgcuc

SEQ ID NO: 30726 - RNA, 20 nt, Artificial Sequence
  MKO10030726_A_Mcur1
  gRNA
cuaggaaaucgcucuccagc

SEQ ID NO: 30727 - RNA, 20 nt, Artificial Sequence
  MKO10030727_A_Mcu
  gRNA
uuggcagcgcucgcgucgag

SEQ ID NO: 30728 - RNA, 20 nt, Artificial Sequence
  MKO10030728_A_Mcu
  gRNA
gcugaacgacgugaagaccc

SEQ ID NO: 30729 - RNA, 20 nt, Artificial Sequence
  MKO10030729_A_Mcu
  gRNA
gauuaccggugauaucugug

SEQ ID NO: 30730 - RNA, 20 nt, Artificial Sequence
  MKO10030730_A_Mdc1
  gRNA
gcugucguuccguuagcuuc

SEQ ID NO: 30731 - RNA, 20 nt, Artificial Sequence
  MKO10030731_A_Mdc1
  gRNA
ugcugcaggugacccgcuuu

SEQ ID NO: 30732 - RNA, 20 nt, Artificial Sequence
  MKO10030732_A_Mdc1
  gRNA
uuacgauuugagugccauug

SEQ ID NO: 30733 - RNA, 20 nt, Artificial Sequence
  MKO10030733_A_Mdfic
  gRNA
ugaugcgggaccaguccauu

SEQ ID NO: 30734 - RNA, 20 nt, Artificial Sequence
  MKO10030734_A_Mdfic
  gRNA
agcgagggcuucacccgcgc

SEQ ID NO: 30735 - RNA, 20 nt, Artificial Sequence
  MKO10030735_A_Mdfic
  gRNA
uuguuacucaccgugggccg

SEQ ID NO: 30736 - RNA, 20 nt, Artificial Sequence
  MKO10030736_A_Mdfi
  gRNA
ugaggcgcgucgcagcgaga

SEQ ID NO: 30737 - RNA, 20 nt, Artificial Sequence
  MKO10030737_A_Mdfi
  gRNA
gucacaguccgcgcacucgc

SEQ ID NO: 30738 - RNA, 20 nt, Artificial Sequence
  MKO10030738_A_Mdfi
  gRNA
ucucgcugcgacgcgccuca

SEQ ID NO: 30739 - RNA, 20 nt, Artificial Sequence
  MKO10030739_A_Mdga1
  gRNA
gugcgguggaccaaaacugc

SEQ ID NO: 30740 - RNA, 20 nt, Artificial Sequence
  MKO10030740_A_Mdga1
  gRNA
acccgcccgcccgcuuuauc

SEQ ID NO: 30741 - RNA, 20 nt, Artificial Sequence
  MKO10030741_A_Mdga1
  gRNA
cgagcgcaucgcacgcacgc

SEQ ID NO: 30742 - RNA, 20 nt, Artificial Sequence
  MKO10030742_A_Mdga2
  gRNA
ccgcgcgacgcgaaccgcgc

SEQ ID NO: 30743 - RNA, 20 nt, Artificial Sequence
  MKO10030743_A_Mdga2
  gRNA
ccagcgcgguucgcgucgcg

SEQ ID NO: 30744 - RNA, 20 nt, Artificial Sequence
  MKO10030744_A_Mdga2
  gRNA
gagugcacaauccgaacugu

SEQ ID NO: 30745 - RNA, 20 nt, Artificial Sequence
  MKO10030745_A_Mdh1b
  gRNA
cgcgagcaacauuaucgcag

SEQ ID NO: 30746 - RNA, 20 nt, Artificial Sequence
  MKO10030746_A_Mdh1b
  gRNA
auaauguugcucgcgauguu

SEQ ID NO: 30747 - RNA, 20 nt, Artificial Sequence
  MKO10030747_A_Mdh1b
  gRNA
caucaacuccgucgucaugu

SEQ ID NO: 30748 - RNA, 20 nt, Artificial Sequence
  MKO10030748_A_Mdh1
  gRNA
gaucgauggcgcugacuugg

SEQ ID NO: 30749 - RNA, 20 nt, Artificial Sequence
  MKO10030749_A_Mdh1
  gRNA
gucagcgccaucgaucccca

SEQ ID NO: 30750 - RNA, 20 nt, Artificial Sequence
  MKO10030750_A_Mdh1
  gRNA
auacgccaagaaaucaguua

SEQ ID NO: 30751 - RNA, 20 nt, Artificial Sequence
  MKO10030751_A_Mdh2
  gRNA
ugugugagcgauaucguaga

SEQ ID NO: 30752 - RNA, 20 nt, Artificial Sequence
  MKO10030752_A_Mdh2
  gRNA
cuggcaacugcuccggucca

SEQ ID NO: 30753 - RNA, 20 nt, Artificial Sequence
  MKO10030753_A_Mdh2
  gRNA
guuggcaaugaugcaaacca

SEQ ID NO: 30754 - RNA, 20 nt, Artificial Sequence
  MKO10030754_A_Mdk
  gRNA
ccgcggacgugaccaccaag

SEQ ID NO: 30755 - RNA, 20 nt, Artificial Sequence
  MKO10030755_A_Mdk
  gRNA
gcaccuugcaauggacgcgc

SEQ ID NO: 30756 - RNA, 20 nt, Artificial Sequence
  MKO10030756_A_Mdk
  gRNA
cauuguaccgcgccuucuuc

SEQ ID NO: 30757 - RNA, 20 nt, Artificial Sequence
  MKO10030757_A_Mdm1
  gRNA
cgacaugccggugcgcuuca

SEQ ID NO: 30758 - RNA, 20 nt, Artificial Sequence
  MKO10030758_A_Mdm1
  gRNA
agcuccacauccgcgcuaac

SEQ ID NO: 30759 - RNA, 20 nt, Artificial Sequence
  MKO10030759_A_Mdm1
  gRNA
ggccucaccuugaagcgcac

SEQ ID NO: 30760 - RNA, 20 nt, Artificial Sequence
  MKO10030760_A_Mdm2
  gRNA
cgacacuuacacuaugaaag

SEQ ID NO: 30761 - RNA, 20 nt, Artificial Sequence
  MKO10030761_A_Mdm2
  gRNA
uugaaguuguuaaaguccgu

SEQ ID NO: 30762 - RNA, 20 nt, Artificial Sequence
  MKO10030762_A_Mdm2
  gRNA
accucuuagucauaauauac

SEQ ID NO: 30763 - RNA, 20 nt, Artificial Sequence
  MKO10030763_A_Mdm4
  gRNA
uccaagucaagaccgacuga

SEQ ID NO: 30764 - RNA, 20 nt, Artificial Sequence
  MKO10030764_A_Mdm4
  gRNA
acaucagcuucuauuaacac

SEQ ID NO: 30765 - RNA, 20 nt, Artificial Sequence
  MKO10030765_A_Mdm4
  gRNA
auguagguaaugcacuaucu

SEQ ID NO: 30766 - RNA, 20 nt, Artificial Sequence
  MKO10030766_A_Mdn1
  gRNA
acguaggcggaugaagcucc

SEQ ID NO: 30767 - RNA, 20 nt, Artificial Sequence
  MKO10030767_A_Mdn1
  gRNA
ugagucguucaugcagaucg

SEQ ID NO: 30768 - RNA, 20 nt, Artificial Sequence
  MKO10030768_A_Mdn1
  gRNA
agguguccuuaaaauagcgc

SEQ ID NO: 30769 - RNA, 20 nt, Artificial Sequence
  MKO10030769_A_Mdp1
  gRNA
gcgauggaacuguacgagac

SEQ ID NO: 30770 - RNA, 20 nt, Artificial Sequence
  MKO10030770_A_Mdp1
  gRNA
cucuugcagauuacacgcuc

SEQ ID NO: 30771 - RNA, 20 nt, Artificial Sequence
  MKO10030771_A_Mdp1
  gRNA
cacagguugcaccacaagac

SEQ ID NO: 30772 - RNA, 20 nt, Artificial Sequence
  MKO10030772_A_Me1
  gRNA
cuuaccuugacgacauccuc

SEQ ID NO: 30773 - RNA, 20 nt, Artificial Sequence
  MKO10030773_A_Me1
  gRNA
aagugccauaccuuggcuuc

SEQ ID NO: 30774 - RNA, 20 nt, Artificial Sequence
  MKO10030774_A_Me1
  gRNA
uaaugggaugggcaucccug

SEQ ID NO: 30775 - RNA, 20 nt, Artificial Sequence
  MKO10030775_A_Me2
  gRNA
ccugcccgugugcaucgacg

SEQ ID NO: 30776 - RNA, 20 nt, Artificial Sequence
  MKO10030776_A_Me2
  gRNA
agugcccacgucgaugcaca

SEQ ID NO: 30777 - RNA, 20 nt, Artificial Sequence
  MKO10030777_A_Me2
  gRNA
auuguguacacgccaacagu

SEQ ID NO: 30778 - RNA, 20 nt, Artificial Sequence
  MKO10030778_A_Me3
  gRNA
uagguacucaccggggucgg

SEQ ID NO: 30779 - RNA, 20 nt, Artificial Sequence
  MKO10030779_A_Me3
  gRNA
gccucaccuuccgccgaccc

SEQ ID NO: 30780 - RNA, 20 nt, Artificial Sequence
  MKO10030780_A_Me3
  gRNA
ugagaaucagcagagcgacc

SEQ ID NO: 30781 - RNA, 20 nt, Artificial Sequence
  MKO10030781_A_Mea1
  gRNA
ggcugguacgaguagccugc

SEQ ID NO: 30782 - RNA, 20 nt, Artificial Sequence
  MKO10030782_A_Mea1
  gRNA
accauaccuggauccgaucu

SEQ ID NO: 30783 - RNA, 20 nt, Artificial Sequence
  MKO10030783_A_Mea1
  gRNA
ugccugggcucgggagaucu

SEQ ID NO: 30784 - RNA, 20 nt, Artificial Sequence
  MKO10030784_A_Meaf6
  gRNA
uacagcagccgacgugacug

SEQ ID NO: 30785 - RNA, 20 nt, Artificial Sequence
  MKO10030785_A_Meaf6
  gRNA
gccugcgcaggaggaccccg

SEQ ID NO: 30786 - RNA, 20 nt, Artificial Sequence
  MKO10030786_A_Meaf6
  gRNA
acggagccgucuagguccuc

SEQ ID NO: 30787 - RNA, 20 nt, Artificial Sequence
  MKO10030787_A_Mecom
  gRNA
gagaucgaaugugucgcuga

SEQ ID NO: 30788 - RNA, 20 nt, Artificial Sequence
  MKO10030788_A_Mecom
  gRNA
ucaggccccucgaagccuuc

SEQ ID NO: 30789 - RNA, 20 nt, Artificial Sequence
  MKO10030789_A_Mecom
  gRNA
agaacggcagcaccgcugug

SEQ ID NO: 30790 - RNA, 20 nt, Artificial Sequence
  MKO10030790_A_Mecp2
  gRNA
acgggcguccggcuguccac

SEQ ID NO: 30791 - RNA, 20 nt, Artificial Sequence
  MKO10030791_A_Mecp2
  gRNA
gauaauggagcgccgcuguu

SEQ ID NO: 30792 - RNA, 20 nt, Artificial Sequence
  MKO10030792_A_Mecp2
  gRNA
agcuuucguguccaaccuuc

SEQ ID NO: 30793 - RNA, 20 nt, Artificial Sequence
  MKO10030793_A_Mecr
  gRNA
gaacaccgccucaguccgcc

SEQ ID NO: 30794 - RNA, 20 nt, Artificial Sequence
  MKO10030794_A_Mecr
  gRNA
uuacccaaacccgcauuugc

SEQ ID NO: 30795 - RNA, 20 nt, Artificial Sequence
  MKO10030795_A_Mecr
  gRNA
ccaucaacguuguccgagac

SEQ ID NO: 30796 - RNA, 20 nt, Artificial Sequence
  MKO10030796_A_Med10
  gRNA
ccaaguaucggagcauucgg

SEQ ID NO: 30797 - RNA, 20 nt, Artificial Sequence
  MKO10030797_A_Med10
  gRNA
cccccgaaugcuccgauacu

SEQ ID NO: 30798 - RNA, 20 nt, Artificial Sequence
  MKO10030798_A_Med10
  gRNA
acagcagcugcacgauauca

SEQ ID NO: 30799 - RNA, 20 nt, Artificial Sequence
  MKO10030799_A_Med11
  gRNA
gaacgagcggcugcgcgccc

SEQ ID NO: 30800 - RNA, 20 nt, Artificial Sequence
  MKO10030800_A_Med11
  gRNA
uuucacgcucgauauccucc

SEQ ID NO: 30801 - RNA, 20 nt, Artificial Sequence
  MKO10030801_A_Med11
  gRNA
ccuggcaggaacggcgaucc

SEQ ID NO: 30802 - RNA, 20 nt, Artificial Sequence
  MKO10030802_A_Med12l
  gRNA
uaugaauugcacucugcgau

SEQ ID NO: 30803 - RNA, 20 nt, Artificial Sequence
  MKO10030803_A_Med12l
  gRNA
agccacguugcucgaaccau

SEQ ID NO: 30804 - RNA, 20 nt, Artificial Sequence
  MKO10030804_A_Med12l
  gRNA
cgcagagugcaauucauagu

SEQ ID NO: 30805 - RNA, 20 nt, Artificial Sequence
  MKO10030805_A_Med12
  gRNA
cucagagugcuauuaacacc

SEQ ID NO: 30806 - RNA, 20 nt, Artificial Sequence
  MKO10030806_A_Med12
  gRNA
aggauugaaguugacguucu

SEQ ID NO: 30807 - RNA, 20 nt, Artificial Sequence
  MKO10030807_A_Med12
  gRNA
gcucgccuuguucauguuuc

SEQ ID NO: 30808 - RNA, 20 nt, Artificial Sequence
  MKO10030808_A_Med13l
  gRNA
gccgaucuauuugaucaacg

SEQ ID NO: 30809 - RNA, 20 nt, Artificial Sequence
  MKO10030809_A_Med13l
  gRNA
gagcagcguccuacauucau

SEQ ID NO: 30810 - RNA, 20 nt, Artificial Sequence
  MKO10030810_A_Med13l
  gRNA
gacagcggaugaaacuuaac

SEQ ID NO: 30811 - RNA, 20 nt, Artificial Sequence
  MKO10030811_A_Med13
  gRNA
uuccuucaggccgacuugac

SEQ ID NO: 30812 - RNA, 20 nt, Artificial Sequence
  MKO10030812_A_Med13
  gRNA
agagugccauuuaguccaaa

SEQ ID NO: 30813 - RNA, 20 nt, Artificial Sequence
  MKO10030813_A_Med13
  gRNA
aaccgaaacuuuguacgaau

SEQ ID NO: 30814 - RNA, 20 nt, Artificial Sequence
  MKO10030814_A_Med14
  gRNA
uucuacuuugccagcgucau

SEQ ID NO: 30815 - RNA, 20 nt, Artificial Sequence
  MKO10030815_A_Med14
  gRNA
gaacgaagaguugacguguc

SEQ ID NO: 30816 - RNA, 20 nt, Artificial Sequence
  MKO10030816_A_Med14
  gRNA
gccauugauguacugacuac

SEQ ID NO: 30817 - RNA, 20 nt, Artificial Sequence
  MKO10030817_A_Med15
  gRNA
acuggcguagcgccgccuuu

SEQ ID NO: 30818 - RNA, 20 nt, Artificial Sequence
  MKO10030818_A_Med15
  gRNA
acuuacgaauaucucggaaa

SEQ ID NO: 30819 - RNA, 20 nt, Artificial Sequence
  MKO10030819_A_Med15
  gRNA
gcugaccagcuucugccgaa

SEQ ID NO: 30820 - RNA, 20 nt, Artificial Sequence
  MKO10030820_A_Med16
  gRNA
cccgggcguuggggcgagug

SEQ ID NO: 30821 - RNA, 20 nt, Artificial Sequence
  MKO10030821_A_Med16
  gRNA
uccacacucgccccaacgcc

SEQ ID NO: 30822 - RNA, 20 nt, Artificial Sequence
  MKO10030822_A_Med16
  gRNA
guacugcccgucgcugcccc

SEQ ID NO: 30823 - RNA, 20 nt, Artificial Sequence
  MKO10030823_A_Med17
  gRNA
gcucagaauugaagucucgc

SEQ ID NO: 30824 - RNA, 20 nt, Artificial Sequence
  MKO10030824_A_Med17
  gRNA
augauguccucaguauuguc

SEQ ID NO: 30825 - RNA, 20 nt, Artificial Sequence
  MKO10030825_A_Med17
  gRNA
gacucuggaccccgucucuc

SEQ ID NO: 30826 - RNA, 20 nt, Artificial Sequence
  MKO10030826_A_Med18
  gRNA
uuaaguguugucgccccggc

SEQ ID NO: 30827 - RNA, 20 nt, Artificial Sequence
  MKO10030827_A_Med18
  gRNA
gaccuuccuugaucacgaga

SEQ ID NO: 30828 - RNA, 20 nt, Artificial Sequence
  MKO10030828_A_Med18
  gRNA
gucaccaugaugcccgucac

SEQ ID NO: 30829 - RNA, 20 nt, Artificial Sequence
  MKO10030829_A_Med19
  gRNA
gcuucucaaugagggaucgg

SEQ ID NO: 30830 - RNA, 20 nt, Artificial Sequence
  MKO10030830_A_Med19
  gRNA
cgacauaguccagaccaccc

SEQ ID NO: 30831 - RNA, 20 nt, Artificial Sequence
  MKO10030831_A_Med19
  gRNA
ugcaucagacgacacugcuc

SEQ ID NO: 30832 - RNA, 20 nt, Artificial Sequence
  MKO10030832_A_Med1
  gRNA
uaagcuugugcgucaaguaa

SEQ ID NO: 30833 - RNA, 20 nt, Artificial Sequence
  MKO10030833_A_Med1
  gRNA
gccagcaaugacugaucguu

SEQ ID NO: 30834 - RNA, 20 nt, Artificial Sequence
  MKO10030834_A_Med1
  gRNA
uccaaacgaucagucauugc

SEQ ID NO: 30835 - RNA, 20 nt, Artificial Sequence
  MKO10030835_A_Med20
  gRNA
aauacugguagcgagugccc

SEQ ID NO: 30836 - RNA, 20 nt, Artificial Sequence
  MKO10030836_A_Med20
  gRNA
ccuucgcuaugggagugacg

SEQ ID NO: 30837 - RNA, 20 nt, Artificial Sequence
  MKO10030837_A_Med20
  gRNA
caccauaagcacaucgaagu

SEQ ID NO: 30838 - RNA, 20 nt, Artificial Sequence
  MKO10030838_A_Med21
  gRNA
agcaguugaugcuaugaguc

SEQ ID NO: 30839 - RNA, 20 nt, Artificial Sequence
  MKO10030839_A_Med21
  gRNA
ucacgaagcugcuacauguc

SEQ ID NO: 30840 - RNA, 20 nt, Artificial Sequence
  MKO10030840_A_Med21
  gRNA
gaccucaccuucuguaggau

SEQ ID NO: 30841 - RNA, 20 nt, Artificial Sequence
  MKO10030841_A_Med22
  gRNA
caauggagaccucgucccgc

SEQ ID NO: 30842 - RNA, 20 nt, Artificial Sequence
  MKO10030842_A_Med22
  gRNA
aggaggaguacuacucgucc

SEQ ID NO: 30843 - RNA, 20 nt, Artificial Sequence
  MKO10030843_A_Med22
  gRNA
caucagcagaaucugcgucg

SEQ ID NO: 30844 - RNA, 20 nt, Artificial Sequence
  MKO10030844_A_Med23
  gRNA
ccggggcucgaugguaccga

SEQ ID NO: 30845 - RNA, 20 nt, Artificial Sequence
  MKO10030845_A_Med23
  gRNA
aauguuuauggauacccccg

SEQ ID NO: 30846 - RNA, 20 nt, Artificial Sequence
  MKO10030846_A_Med23
  gRNA
ccauugcuaagcagucauag

SEQ ID NO: 30847 - RNA, 20 nt, Artificial Sequence
  MKO10030847_A_Med24
  gRNA
acauguucugugaccgacuc

SEQ ID NO: 30848 - RNA, 20 nt, Artificial Sequence
  MKO10030848_A_Med24
  gRNA
uuuccuugcagaagcgcucc

SEQ ID NO: 30849 - RNA, 20 nt, Artificial Sequence
  MKO10030849_A_Med24
  gRNA
uaguugccacggcaaagcag

SEQ ID NO: 30850 - RNA, 20 nt, Artificial Sequence
  MKO10030850_A_Med25
  gRNA
cccccaaaguccgucucugc

SEQ ID NO: 30851 - RNA, 20 nt, Artificial Sequence
  MKO10030851_A_Med25
  gRNA
cgucuuugcagguacuucaa

SEQ ID NO: 30852 - RNA, 20 nt, Artificial Sequence
  MKO10030852_A_Med25
  gRNA
aggugcgugacauuguacau

SEQ ID NO: 30853 - RNA, 20 nt, Artificial Sequence
  MKO10030853_A_Med26
  gRNA
ggaugucguugcgauucuuc

SEQ ID NO: 30854 - RNA, 20 nt, Artificial Sequence
  MKO10030854_A_Med26
  gRNA
agauucccgugaacgccgug

SEQ ID NO: 30855 - RNA, 20 nt, Artificial Sequence
  MKO10030855_A_Med26
  gRNA
guuggaagugaucuccaguc

SEQ ID NO: 30856 - RNA, 20 nt, Artificial Sequence
  MKO10030856_A_Med27
  gRNA
caaucgugcgaucgaugaac

SEQ ID NO: 30857 - RNA, 20 nt, Artificial Sequence
  MKO10030857_A_Med27
  gRNA
gucugccaagcggagaccga

SEQ ID NO: 30858 - RNA, 20 nt, Artificial Sequence
  MKO10030858_A_Med27
  gRNA
caucgaucgcacgauuguga

SEQ ID NO: 30859 - RNA, 20 nt, Artificial Sequence
  MKO10030859_A_Med28
  gRNA
acugcagcggaaggaugcgc

SEQ ID NO: 30860 - RNA, 20 nt, Artificial Sequence
  MKO10030860_A_Med28
  gRNA
cugcuugcagaagcgacgcc

SEQ ID NO: 30861 - RNA, 20 nt, Artificial Sequence
  MKO10030861_A_Med28
  gRNA
uuaugucaaugggacugauc

SEQ ID NO: 30862 - RNA, 20 nt, Artificial Sequence
  MKO10030862_A_Med29
  gRNA
acacuugucaaagcgcugca

SEQ ID NO: 30863 - RNA, 20 nt, Artificial Sequence
  MKO10030863_A_Med29
  gRNA
cccggacccccggcagaacc

SEQ ID NO: 30864 - RNA, 20 nt, Artificial Sequence
  MKO10030864_A_Med29
  gRNA
gugucaggcccggguucugc

SEQ ID NO: 30865 - RNA, 20 nt, Artificial Sequence
  MKO10030865_A_Med30
  gRNA
gggcccggacgccaugcccg

SEQ ID NO: 30866 - RNA, 20 nt, Artificial Sequence
  MKO10030866_A_Med30
  gRNA
cgcccacgggcauggcgucc

SEQ ID NO: 30867 - RNA, 20 nt, Artificial Sequence
  MKO10030867_A_Med30
  gRNA
auggcucaaagaacgacgac

SEQ ID NO: 30868 - RNA, 20 nt, Artificial Sequence
  MKO10030868_A_Med31
  gRNA
ccaguaugagcacuuucgca

SEQ ID NO: 30869 - RNA, 20 nt, Artificial Sequence
  MKO10030869_A_Med31
  gRNA
ccuugcgaaagugcucauac

SEQ ID NO: 30870 - RNA, 20 nt, Artificial Sequence
  MKO10030870_A_Med31
  gRNA
uauggccgcggccgucgcua

SEQ ID NO: 30871 - RNA, 20 nt, Artificial Sequence
  MKO10030871_A_Med4
  gRNA
aaaaguucaccacgaaaugc

SEQ ID NO: 30872 - RNA, 20 nt, Artificial Sequence
  MKO10030872_A_Med4
  gRNA
aaaucauuaaauaugcgcac

SEQ ID NO: 30873 - RNA, 20 nt, Artificial Sequence
  MKO10030873_A_Med4
  gRNA
uuaggcaacagcuguuuacc

SEQ ID NO: 30874 - RNA, 20 nt, Artificial Sequence
  MKO10030874_A_Med6
  gRNA
caucgcuggagucaucuauc

SEQ ID NO: 30875 - RNA, 20 nt, Artificial Sequence
  MKO10030875_A_Med6
  gRNA
ugucgauaccauccuuccaa

SEQ ID NO: 30876 - RNA, 20 nt, Artificial Sequence
  MKO10030876_A_Med6
  gRNA
uacaagcuuacugcagugca

SEQ ID NO: 30877 - RNA, 20 nt, Artificial Sequence
  MKO10030877_A_Med7
  gRNA
gagaguuaaagcugagccga

SEQ ID NO: 30878 - RNA, 20 nt, Artificial Sequence
  MKO10030878_A_Med7
  gRNA
gccuccaaugcaguacauca

SEQ ID NO: 30879 - RNA, 20 nt, Artificial Sequence
  MKO10030879_A_Med7
  gRNA
gaugauaacagcaauugucc

SEQ ID NO: 30880 - RNA, 20 nt, Artificial Sequence
  MKO10030880_A_Med8
  gRNA
agaccgagacgaagaccuca

SEQ ID NO: 30881 - RNA, 20 nt, Artificial Sequence
  MKO10030881_A_Med8
  gRNA
gacgccacuguuccgaaacc

SEQ ID NO: 30882 - RNA, 20 nt, Artificial Sequence
  MKO10030882_A_Med8
  gRNA
acgaccucauggcugaaaac

SEQ ID NO: 30883 - RNA, 20 nt, Artificial Sequence
  MKO10030883_A_Med9
  gRNA
auucuccuccuucgcgccag

SEQ ID NO: 30884 - RNA, 20 nt, Artificial Sequence
  MKO10030884_A_Med9
  gRNA
ccgcggccucagucccccgc

SEQ ID NO: 30885 - RNA, 20 nt, Artificial Sequence
  MKO10030885_A_Med9
  gRNA
aagcucaucggcaccaugcc

SEQ ID NO: 30886 - RNA, 20 nt, Artificial Sequence
  MKO10030886_A_Medag
  gRNA
ugagugaaccucuaauacga

SEQ ID NO: 30887 - RNA, 20 nt, Artificial Sequence
  MKO10030887_A_Medag
  gRNA
gagcuucaccuacgaauuca

SEQ ID NO: 30888 - RNA, 20 nt, Artificial Sequence
  MKO10030888_A_Medag
  gRNA
uauuaacgugcagaccaaga

SEQ ID NO: 30889 - RNA, 20 nt, Artificial Sequence
  MKO10030889_A_Mef2a
  gRNA
uucacucgugucaccgucuu

SEQ ID NO: 30890 - RNA, 20 nt, Artificial Sequence
  MKO10030890_A_Mef2a
  gRNA
gcuuugucguacacuaaccc

SEQ ID NO: 30891 - RNA, 20 nt, Artificial Sequence
  MKO10030891_A_Mef2a
  gRNA
ucaaaguaaucgucagcauc

SEQ ID NO: 30892 - RNA, 20 nt, Artificial Sequence
  MKO10030892_A_Mef2b
  gRNA
gcacgagagccgcaccaacg

SEQ ID NO: 30893 - RNA, 20 nt, Artificial Sequence
  MKO10030893_A_Mef2b
  gRNA
cccgccucacuuucgacccc

SEQ ID NO: 30894 - RNA, 20 nt, Artificial Sequence
  MKO10030894_A_Mef2b
  gRNA
uaccugaaggauauccgcgu

SEQ ID NO: 30895 - RNA, 20 nt, Artificial Sequence
  MKO10030895_A_Mef2c
  gRNA
acaacgagccgcacgagagc

SEQ ID NO: 30896 - RNA, 20 nt, Artificial Sequence
  MKO10030896_A_Mef2c
  gRNA
aauggaugagcguaacagac

SEQ ID NO: 30897 - RNA, 20 nt, Artificial Sequence
  MKO10030897_A_Mef2c
  gRNA
cuucuccauaggcggucuga

SEQ ID NO: 30898 - RNA, 20 nt, Artificial Sequence
  MKO10030898_A_Mef2d
  gRNA
caucaguccaaacuuccgcu

SEQ ID NO: 30899 - RNA, 20 nt, Artificial Sequence
  MKO10030899_A_Mef2d
  gRNA
gcuacacucaccaacggggc

SEQ ID NO: 30900 - RNA, 20 nt, Artificial Sequence
  MKO10030900_A_Mef2d
  gRNA
gaugggcucuucaggcgcua

SEQ ID NO: 30901 - RNA, 20 nt, Artificial Sequence
  MKO10030901_A_Mefv
  gRNA
acaucgagugcgccccauag

SEQ ID NO: 30902 - RNA, 20 nt, Artificial Sequence
  MKO10030902_A_Mefv
  gRNA
agcauacuccuccccguagu

SEQ ID NO: 30903 - RNA, 20 nt, Artificial Sequence
  MKO10030903_A_Mefv
  gRNA
gugcccucgucacaugaagc

SEQ ID NO: 30904 - RNA, 20 nt, Artificial Sequence
  MKO10030904_A_Megf10
  gRNA
gccacugcgcugcgggcuac

SEQ ID NO: 30905 - RNA, 20 nt, Artificial Sequence
  MKO10030905_A_Megf10
  gRNA
cguacgugcccuguucacaa

SEQ ID NO: 30906 - RNA, 20 nt, Artificial Sequence
  MKO10030906_A_Megf10
  gRNA
gcugcaccgacauccugaac

SEQ ID NO: 30907 - RNA, 20 nt, Artificial Sequence
  MKO10030907_A_Megf11
  gRNA
uugggaccuccgccgguaca

SEQ ID NO: 30908 - RNA, 20 nt, Artificial Sequence
  MKO10030908_A_Megf11
  gRNA
ccggaggccgcgccuauacg

SEQ ID NO: 30909 - RNA, 20 nt, Artificial Sequence
  MKO10030909_A_Megf11
  gRNA
gugugcgccccgggcuuccg

SEQ ID NO: 30910 - RNA, 20 nt, Artificial Sequence
  MKO10030910_A_Megf6
  gRNA
ucagccgcguagugccugug

SEQ ID NO: 30911 - RNA, 20 nt, Artificial Sequence
  MKO10030911_A_Megf6
  gRNA
ccgccacguaccugcgcucu

SEQ ID NO: 30912 - RNA, 20 nt, Artificial Sequence
  MKO10030912_A_Megf6
  gRNA
ggugauggcaaaacgugcca

SEQ ID NO: 30913 - RNA, 20 nt, Artificial Sequence
  MKO10030913_A_Megf8
  gRNA
cauaagugcacuccgugucc

SEQ ID NO: 30914 - RNA, 20 nt, Artificial Sequence
  MKO10030914_A_Megf8
  gRNA
uccauaccggagcaggcguc

SEQ ID NO: 30915 - RNA, 20 nt, Artificial Sequence
  MKO10030915_A_Megf8
  gRNA
ugugcguuugcgagccgggc

SEQ ID NO: 30916 - RNA, 20 nt, Artificial Sequence
  MKO10030916_A_Megf9
  gRNA
aagcgcugcaaccagaccac

SEQ ID NO: 30917 - RNA, 20 nt, Artificial Sequence
  MKO10030917_A_Megf9
  gRNA
gaucucgaacauagccuucu

SEQ ID NO: 30918 - RNA, 20 nt, Artificial Sequence
  MKO10030918_A_Megf9
  gRNA
uguuccgcagugacuucuac

SEQ ID NO: 30919 - RNA, 20 nt, Artificial Sequence
  MKO10030919_A_Mei1
  gRNA
cgaaaagcacgcguacaaaa

SEQ ID NO: 30920 - RNA, 20 nt, Artificial Sequence
  MKO10030920_A_Mei1
  gRNA
gcucacuacucagccgaaua

SEQ ID NO: 30921 - RNA, 20 nt, Artificial Sequence
  MKO10030921_A_Mei1
  gRNA
uuuggcggacgagcuuguaa

SEQ ID NO: 30922 - RNA, 20 nt, Artificial Sequence
  MKO10030922_A_Mei4
  gRNA
ugaagucaucuuccgacuuu

SEQ ID NO: 30923 - RNA, 20 nt, Artificial Sequence
  MKO10030923_A_Mei4
  gRNA
gacaacguggggagcacauc

SEQ ID NO: 30924 - RNA, 20 nt, Artificial Sequence
  MKO10030924_A_Mei4
  gRNA
gcuccccacguugucagauc

SEQ ID NO: 30925 - RNA, 20 nt, Artificial Sequence
  MKO10030925_A_Meig1
  gRNA
ucccggugcaggucgaccga

SEQ ID NO: 30926 - RNA, 20 nt, Artificial Sequence
  MKO10030926_A_Meig1
  gRNA
uucuucacguacccugucuc

SEQ ID NO: 30927 - RNA, 20 nt, Artificial Sequence
  MKO10030927_A_Meig1
  gRNA
uuucacgucagaaguagcca

SEQ ID NO: 30928 - RNA, 20 nt, Artificial Sequence
  MKO10030928_A_Meiob
  gRNA
uaaucucgagauucuuuaac

SEQ ID NO: 30929 - RNA, 20 nt, Artificial Sequence
  MKO10030929_A_Meiob
  gRNA
aucucgagauuauuauucau

SEQ ID NO: 30930 - RNA, 20 nt, Artificial Sequence
  MKO10030930_A_Meiob
  gRNA
aguuuagcccugcaacuccu

SEQ ID NO: 30931 - RNA, 20 nt, Artificial Sequence
  MKO10030931_A_Meis1
  gRNA
uacuuguaccccccgcgagc

SEQ ID NO: 30932 - RNA, 20 nt, Artificial Sequence
  MKO10030932_A_Meis1
  gRNA
cuuuaaagcgucauugaccg

SEQ ID NO: 30933 - RNA, 20 nt, Artificial Sequence
  MKO10030933_A_Meis1
  gRNA
cagagaggccgauggcgcaa

SEQ ID NO: 30934 - RNA, 20 nt, Artificial Sequence
  MKO10030934_A_Meis2
  gRNA
ugaaccggggggaucggccg

SEQ ID NO: 30935 - RNA, 20 nt, Artificial Sequence
  MKO10030935_A_Meis2
  gRNA
cgcgugagggucuccguaca

SEQ ID NO: 30936 - RNA, 20 nt, Artificial Sequence
  MKO10030936_A_Meis2
  gRNA
caucgcggucuucgccaagc

SEQ ID NO: 30937 - RNA, 20 nt, Artificial Sequence
  MKO10030937_A_Meis3
  gRNA
ccucccagauccgcuccgag

SEQ ID NO: 30938 - RNA, 20 nt, Artificial Sequence
  MKO10030938_A_Meis3
  gRNA
gaugagcugcgccacuaccc

SEQ ID NO: 30939 - RNA, 20 nt, Artificial Sequence
  MKO10030939_A_Meis3
  gRNA
cuacaugcucgccccgugau

SEQ ID NO: 30940 - RNA, 20 nt, Artificial Sequence
  MKO10030940_A_Melk
  gRNA
guuugacuacauaaucuccc

SEQ ID NO: 30941 - RNA, 20 nt, Artificial Sequence
  MKO10030941_A_Melk
  gRNA
cccgggucuccucuuccgac

SEQ ID NO: 30942 - RNA, 20 nt, Artificial Sequence
  MKO10030942_A_Melk
  gRNA
aagcuaaagcugauugacuu

SEQ ID NO: 30943 - RNA, 20 nt, Artificial Sequence
  MKO10030943_A_Memo1
  gRNA
cacaguauguguaucccgca

SEQ ID NO: 30944 - RNA, 20 nt, Artificial Sequence
  MKO10030944_A_Memo1
  gRNA
accucagcugaacgcucagc

SEQ ID NO: 30945 - RNA, 20 nt, Artificial Sequence
  MKO10030945_A_Memo1
  gRNA
cuuuaguuuacggagagcua

SEQ ID NO: 30946 - RNA, 20 nt, Artificial Sequence
  MKO10030946_A_Men1
  gRNA
ucugcgcucuaucgacgacg

SEQ ID NO: 30947 - RNA, 20 nt, Artificial Sequence
  MKO10030947_A_Men1
  gRNA
caugcgcugcgaccguaaga

SEQ ID NO: 30948 - RNA, 20 nt, Artificial Sequence
  MKO10030948_A_Men1
  gRNA
agguguuucuagucgcgaac

SEQ ID NO: 30949 - RNA, 20 nt, Artificial Sequence
  MKO10030949_A_Meox1
  gRNA
gccgggucagguaguugugg

SEQ ID NO: 30950 - RNA, 20 nt, Artificial Sequence
  MKO10030950_A_Meox1
  gRNA
ucgggguaugcugcugucgc

SEQ ID NO: 30951 - RNA, 20 nt, Artificial Sequence
  MKO10030951_A_Meox1
  gRNA
ggggaggauugcaugguacu

SEQ ID NO: 30952 - RNA, 20 nt, Artificial Sequence
  MKO10030952_A_Meox2
  gRNA
gcuugacggccauaaucccc

SEQ ID NO: 30953 - RNA, 20 nt, Artificial Sequence
  MKO10030953_A_Meox2
  gRNA
ucccgcgauuaugcaagacg

SEQ ID NO: 30954 - RNA, 20 nt, Artificial Sequence
  MKO10030954_A_Meox2
  gRNA
ucuagaccucacugaaagac

SEQ ID NO: 30955 - RNA, 20 nt, Artificial Sequence
  MKO10030955_A_Mep1a
  gRNA
ugcgagaucccucaagcaga

SEQ ID NO: 30956 - RNA, 20 nt, Artificial Sequence
  MKO10030956_A_Mep1a
  gRNA
gcuccccauuccauacauuc

SEQ ID NO: 30957 - RNA, 20 nt, Artificial Sequence
  MKO10030957_A_Mep1a
  gRNA
gaaggauguccccuugaaag

SEQ ID NO: 30958 - RNA, 20 nt, Artificial Sequence
  MKO10030958_A_Mep1b
  gRNA
ugagggagacaucaaacucg

SEQ ID NO: 30959 - RNA, 20 nt, Artificial Sequence
  MKO10030959_A_Mep1b
  gRNA
cagccagcuccggaaaaguu

SEQ ID NO: 30960 - RNA, 20 nt, Artificial Sequence
  MKO10030960_A_Mep1b
  gRNA
ugguauguggccaucucuug

SEQ ID NO: 30961 - RNA, 20 nt, Artificial Sequence
  MKO10030961_A_Mepce
  gRNA
cccgacaucgcaaacgucgc

SEQ ID NO: 30962 - RNA, 20 nt, Artificial Sequence
  MKO10030962_A_Mepce
  gRNA
ggugcgguccccggugucua

SEQ ID NO: 30963 - RNA, 20 nt, Artificial Sequence
  MKO10030963_A_Mepce
  gRNA
gaauguuccgccgcaucuac

SEQ ID NO: 30964 - RNA, 20 nt, Artificial Sequence
  MKO10030964_A_Mepe
  gRNA
aacacacccgccagacccga

SEQ ID NO: 30965 - RNA, 20 nt, Artificial Sequence
  MKO10030965_A_Mepe
  gRNA
gcuagcgcgccugugggaau

SEQ ID NO: 30966 - RNA, 20 nt, Artificial Sequence
  MKO10030966_A_Mepe
  gRNA
aaugcuuacuggugccgccc

SEQ ID NO: 30967 - RNA, 20 nt, Artificial Sequence
  MKO10030967_A_Mertk
  gRNA
uagacuuaccagguacgguu

SEQ ID NO: 30968 - RNA, 20 nt, Artificial Sequence
  MKO10030968_A_Mertk
  gRNA
ccgucuguccuaaccguacc

SEQ ID NO: 30969 - RNA, 20 nt, Artificial Sequence
  MKO10030969_A_Mertk
  gRNA
accuugaacuuccacguaua

SEQ ID NO: 30970 - RNA, 20 nt, Artificial Sequence
  MKO10030970_A_Mesdc1
  gRNA
ccccuuagugcgcgcgauga

SEQ ID NO: 30971 - RNA, 20 nt, Artificial Sequence
  MKO10030971_A_Mesdc1
  gRNA
caccaucaucgcgcgcacua

SEQ ID NO: 30972 - RNA, 20 nt, Artificial Sequence
  MKO10030972_A_Mesdc1
  gRNA
cucucgcgaacaguucaagc

SEQ ID NO: 30973 - RNA, 20 nt, Artificial Sequence
  MKO10030973_A_Mesdc2
  gRNA
acgccaacuaugacguucag

SEQ ID NO: 30974 - RNA, 20 nt, Artificial Sequence
  MKO10030974_A_Mesdc2
  gRNA
gcccggaguguccgccgcgu

SEQ ID NO: 30975 - RNA, 20 nt, Artificial Sequence
  MKO10030975_A_Mesdc2
  gRNA
accgcgccaucuucaugcuc

SEQ ID NO: 30976 - RNA, 20 nt, Artificial Sequence
  MKO10030976_A_Mesp1
  gRNA
gcucgguccccguuuaagcc

SEQ ID NO: 30977 - RNA, 20 nt, Artificial Sequence
  MKO10030977_A_Mesp1
  gRNA
cccacgauucugcggcgacu

SEQ ID NO: 30978 - RNA, 20 nt, Artificial Sequence
  MKO10030978_A_Mesp1
  gRNA
agaaaccuggacgccgccgc

SEQ ID NO: 30979 - RNA, 20 nt, Artificial Sequence
  MKO10030979_A_Mesp2
  gRNA
uucgucggggcgccgucgcc

SEQ ID NO: 30980 - RNA, 20 nt, Artificial Sequence
  MKO10030980_A_Mesp2
  gRNA
guagugcgcgugcuacgggc

SEQ ID NO: 30981 - RNA, 20 nt, Artificial Sequence
  MKO10030981_A_Mesp2
  gRNA
uggagagcaccucugcaucg

SEQ ID NO: 30982 - RNA, 20 nt, Artificial Sequence
  MKO10030982_A_Mest
  gRNA
cgaucacucgauggaaccuc

SEQ ID NO: 30983 - RNA, 20 nt, Artificial Sequence
  MKO10030983_A_Mest
  gRNA
uaccuuguaccagucauagc

SEQ ID NO: 30984 - RNA, 20 nt, Artificial Sequence
  MKO10030984_A_Mest
  gRNA
gcaucguagagucccuucug

SEQ ID NO: 30985 - RNA, 20 nt, Artificial Sequence
  MKO10030985_A_Meuap1d
  gRNA
aagccagacuacgugacgac

SEQ ID NO: 30986 - RNA, 20 nt, Artificial Sequence
  MKO10030986_A_Meuap1d
  gRNA
auguuucagccgaccucuuc

SEQ ID NO: 30987 - RNA, 20 nt, Artificial Sequence
  MKO10030987_A_Meuap1d
  gRNA
ugacgcauaucccucaccuc

SEQ ID NO: 30988 - RNA, 20 nt, Artificial Sequence
  MKO10030988_A_Meuap1
  gRNA
guguaccgauagccugccca

SEQ ID NO: 30989 - RNA, 20 nt, Artificial Sequence
  MKO10030989_A_Meuap1
  gRNA
cuuauguaguaacuugugag

SEQ ID NO: 30990 - RNA, 20 nt, Artificial Sequence
  MKO10030990_A_Meuap1
  gRNA
auacucaccaguggauaaug

SEQ ID NO: 30991 - RNA, 20 nt, Artificial Sequence
  MKO10030991_A_Meuap2
  gRNA
cgacuuccgagaagcugcgg

SEQ ID NO: 30992 - RNA, 20 nt, Artificial Sequence
  MKO10030992_A_Meuap2
  gRNA
ggaugacgaugauagaaauc

SEQ ID NO: 30993 - RNA, 20 nt, Artificial Sequence
  MKO10030993_A_Meuap2
  gRNA
ugauucuuacccaucuugug

SEQ ID NO: 30994 - RNA, 20 nt, Artificial Sequence
  MKO10030994_A_Metrnl
  gRNA
gggcgcucauuguuaaccua

SEQ ID NO: 30995 - RNA, 20 nt, Artificial Sequence
  MKO10030995_A_Metrnl
  gRNA
cuacagugggcucacccgag

SEQ ID NO: 30996 - RNA, 20 nt, Artificial Sequence
  MKO10030996_A_Metrnl
  gRNA
ugugaagccuguucacccgc

SEQ ID NO: 30997 - RNA, 20 nt, Artificial Sequence
  MKO10030997_A_Metrn
  gRNA
gucuucgcugaacguaugac

SEQ ID NO: 30998 - RNA, 20 nt, Artificial Sequence
  MKO10030998_A_Metrn
  gRNA
ggagccgauuuggcgaagcu

SEQ ID NO: 30999 - RNA, 20 nt, Artificial Sequence
  MKO10030999_A_Metrn
  gRNA
uuccgaguagccagcgugag

SEQ ID NO: 31000 - RNA, 20 nt, Artificial Sequence
  MKO10031000_A_Meuul10
  gRNA
ucugcauccaccguauuagu

SEQ ID NO: 31001 - RNA, 20 nt, Artificial Sequence
  MKO10031001_A_Meuul10
  gRNA
agaguaugaaccgacuaaua

SEQ ID NO: 31002 - RNA, 20 nt, Artificial Sequence
  MKO10031002_A_Meuul10
  gRNA
gcuaucuaacauuaacuuga

SEQ ID NO: 31003 - RNA, 20 nt, Artificial Sequence
  MKO10031003_A_Meuul11b
  gRNA
augacgacagaguucgucgu

SEQ ID NO: 31004 - RNA, 20 nt, Artificial Sequence
  MKO10031004_A_Meuul11b
  gRNA
cguuaaccugcaaguagcuc

SEQ ID NO: 31005 - RNA, 20 nt, Artificial Sequence
  MKO10031005_A_Meuul11b
  gRNA
cuucugccaacgggaucuaa

SEQ ID NO: 31006 - RNA, 20 nt, Artificial Sequence
  MKO10031006_A_Meuul13
  gRNA
accccgcugugaaaccaucg

SEQ ID NO: 31007 - RNA, 20 nt, Artificial Sequence
  MKO10031007_A_Meuul13
  gRNA
aagacagaugguacuuucgg

SEQ ID NO: 31008 - RNA, 20 nt, Artificial Sequence
  MKO10031008_A_Meuul13
  gRNA
gggagcgccaguacuaugcu

SEQ ID NO: 31009 - RNA, 20 nt, Artificial Sequence
  MKO10031009_A_Meuul14
  gRNA
cgcauaccugcagguuucuc

SEQ ID NO: 31010 - RNA, 20 nt, Artificial Sequence
  MKO10031010_A_Meuul14
  gRNA
acagaccucagaauuucauc

SEQ ID NO: 31011 - RNA, 20 nt, Artificial Sequence
  MKO10031011_A_Meuul14
  gRNA
agauuccaguaccuuucuua

SEQ ID NO: 31012 - RNA, 20 nt, Artificial Sequence
  MKO10031012_A_Meuul15
  gRNA
cgaagggagaaaccucguuc

SEQ ID NO: 31013 - RNA, 20 nt, Artificial Sequence
  MKO10031013_A_Meuul15
  gRNA
aggauuccaucaaucguucc

SEQ ID NO: 31014 - RNA, 20 nt, Artificial Sequence
  MKO10031014_A_Meuul15
  gRNA
ggaaagucuugguagcgaug

SEQ ID NO: 31015 - RNA, 20 nt, Artificial Sequence
  MKO10031015_A_Meuul16
  gRNA
acuguaccuuggcuuccaau

SEQ ID NO: 31016 - RNA, 20 nt, Artificial Sequence
  MKO10031016_A_Meuul16
  gRNA
gacaaaacuacucuccgaag

SEQ ID NO: 31017 - RNA, 20 nt, Artificial Sequence
  MKO10031017_A_Meuul16
  gRNA
ugagacuuaacuauauucac

SEQ ID NO: 31018 - RNA, 20 nt, Artificial Sequence
  MKO10031018_A_Meuul17
  gRNA
aauccgacccguugucuacc

SEQ ID NO: 31019 - RNA, 20 nt, Artificial Sequence
  MKO10031019_A_Meuul17
  gRNA
gcauacgccgcccuugugcc

SEQ ID NO: 31020 - RNA, 20 nt, Artificial Sequence
  MKO10031020_A_Meuul17
  gRNA
ugcgcaaaacuaccuaccau

SEQ ID NO: 31021 - RNA, 20 nt, Artificial Sequence
  MKO10031021_A_Meuul18
  gRNA
gcuugccucgggaucacucu

SEQ ID NO: 31022 - RNA, 20 nt, Artificial Sequence
  MKO10031022_A_Meuul18
  gRNA
aaggcaaucuacagaacguc

SEQ ID NO: 31023 - RNA, 20 nt, Artificial Sequence
  MKO10031023_A_Meuul18
  gRNA
aaauuaacaucccucgauga

SEQ ID NO: 31024 - RNA, 20 nt, Artificial Sequence
  MKO10031024_A_Meuul1
  gRNA
guacaccgucaccgacgugc

SEQ ID NO: 31025 - RNA, 20 nt, Artificial Sequence
  MKO10031025_A_Meuul1
  gRNA
ugcuucguucgcuuaaagug

SEQ ID NO: 31026 - RNA, 20 nt, Artificial Sequence
  MKO10031026_A_Meuul1
  gRNA
uucggagacaggcgauguuc

SEQ ID NO: 31027 - RNA, 20 nt, Artificial Sequence
  MKO10031027_A_Meuul20
  gRNA
cgaguacugauuggugaccc

SEQ ID NO: 31028 - RNA, 20 nt, Artificial Sequence
  MKO10031028_A_Meuul20
  gRNA
uaacccccaggugcaaguuu

SEQ ID NO: 31029 - RNA, 20 nt, Artificial Sequence
  MKO10031029_A_Meuul20
  gRNA
aaaagccguaacuggauuuc

SEQ ID NO: 31030 - RNA, 20 nt, Artificial Sequence
  MKO10031030_A_Meuul21a
  gRNA
aguuacuaucccguucauag

SEQ ID NO: 31031 - RNA, 20 nt, Artificial Sequence
  MKO10031031_A_Meuul21a
  gRNA
cuugccgaauccgcuaugaa

SEQ ID NO: 31032 - RNA, 20 nt, Artificial Sequence
  MKO10031032_A_Meuul21a
  gRNA
cgagaggcuuauggaauuuc

SEQ ID NO: 31033 - RNA, 20 nt, Artificial Sequence
  MKO10031033_A_Meuul21c
  gRNA
cuguuguuaugacuacgugc

SEQ ID NO: 31034 - RNA, 20 nt, Artificial Sequence
  MKO10031034_A_Meuul21c
  gRNA
uccccgagaguaggggcugc

SEQ ID NO: 31035 - RNA, 20 nt, Artificial Sequence
  MKO10031035_A_Meuul21c
  gRNA
caagagcauuaucaguucgc

SEQ ID NO: 31036 - RNA, 20 nt, Artificial Sequence
  MKO10031036_A_Meuul21e
  gRNA
ccugucuaaugcuacucccc

SEQ ID NO: 31037 - RNA, 20 nt, Artificial Sequence
  MKO10031037_A_Meuul21e
  gRNA
ccuggggaguagcauuagac

SEQ ID NO: 31038 - RNA, 20 nt, Artificial Sequence
  MKO10031038_A_Meuul21e
  gRNA
cucugauaacgacuauuccu

SEQ ID NO: 31039 - RNA, 20 nt, Artificial Sequence
  MKO10031039_A_Meuul22
  gRNA
gggaccuggaugugguacga

SEQ ID NO: 31040 - RNA, 20 nt, Artificial Sequence
  MKO10031040_A_Meuul22
  gRNA
ggauauagucugccaggagu

SEQ ID NO: 31041 - RNA, 20 nt, Artificial Sequence
  MKO10031041_A_Meuul22
  gRNA
caucguggcugccacgaugc

SEQ ID NO: 31042 - RNA, 20 nt, Artificial Sequence
  MKO10031042_A_Meuul23
  gRNA
uccauacucaccuucggacc

SEQ ID NO: 31043 - RNA, 20 nt, Artificial Sequence
  MKO10031043_A_Meuul23
  gRNA
aguccuacaacuucgaccug

SEQ ID NO: 31044 - RNA, 20 nt, Artificial Sequence
  MKO10031044_A_Meuul23
  gRNA
gcugaucaucuccuuugcaa

SEQ ID NO: 31045 - RNA, 20 nt, Artificial Sequence
  MKO10031045_A_Meuul24
  gRNA
augcggaucccgccaaucga

SEQ ID NO: 31046 - RNA, 20 nt, Artificial Sequence
  MKO10031046_A_Meuul24
  gRNA
aucaccgcuuguccaucgau

SEQ ID NO: 31047 - RNA, 20 nt, Artificial Sequence
  MKO10031047_A_Meuul24
  gRNA
gaugaaucucgaagacgagc

SEQ ID NO: 31048 - RNA, 20 nt, Artificial Sequence
  MKO10031048_A_Meuul25
  gRNA
uguaaauauccgcagaguac

SEQ ID NO: 31049 - RNA, 20 nt, Artificial Sequence
  MKO10031049_A_Meuul25
  gRNA
ccaucgguggcagacagguc

SEQ ID NO: 31050 - RNA, 20 nt, Artificial Sequence
  MKO10031050_A_Meuul25
  gRNA
ccagaccugucugccaccga

SEQ ID NO: 31051 - RNA, 20 nt, Artificial Sequence
  MKO10031051_A_Meuul2
  gRNA
cacuuuccucuccgccgccg

SEQ ID NO: 31052 - RNA, 20 nt, Artificial Sequence
  MKO10031052_A_Meuul2
  gRNA
gcaggagaacagcuccccgc

SEQ ID NO: 31053 - RNA, 20 nt, Artificial Sequence
  MKO10031053_A_Meuul2
  gRNA
ucaccuagaaauuaguggug

SEQ ID NO: 31054 - RNA, 20 nt, Artificial Sequence
  MKO10031054_A_Meuul3
  gRNA
acgccguuucugcccugcga

SEQ ID NO: 31055 - RNA, 20 nt, Artificial Sequence
  MKO10031055_A_Meuul3
  gRNA
cuugucgcaagcugcacuuc

SEQ ID NO: 31056 - RNA, 20 nt, Artificial Sequence
  MKO10031056_A_Meuul3
  gRNA
guugaaaaguuucgcucucg

SEQ ID NO: 31057 - RNA, 20 nt, Artificial Sequence
  MKO10031057_A_Meuul4
  gRNA
uuaaccgauuuguucuccca

SEQ ID NO: 31058 - RNA, 20 nt, Artificial Sequence
  MKO10031058_A_Meuul4
  gRNA
gcgaaugccuaucccuaaac

SEQ ID NO: 31059 - RNA, 20 nt, Artificial Sequence
  MKO10031059_A_Meuul4
  gRNA
uuacccacuuguugaaaaac

SEQ ID NO: 31060 - RNA, 20 nt, Artificial Sequence
  MKO10031060_A_Meuul5
  gRNA
agcaucggagcggcaaugcu

SEQ ID NO: 31061 - RNA, 20 nt, Artificial Sequence
  MKO10031061_A_Meuul5
  gRNA
caaugucaucguauguguua

SEQ ID NO: 31062 - RNA, 20 nt, Artificial Sequence
  MKO10031062_A_Meuul5
  gRNA
ugagcuuacuucccuaguug

SEQ ID NO: 31063 - RNA, 20 nt, Artificial Sequence
  MKO10031063_A_Meuul6
  gRNA
caagcaggucgucucuagug

SEQ ID NO: 31064 - RNA, 20 nt, Artificial Sequence
  MKO10031064_A_Meuul6
  gRNA
gaucauucagcccguaguca

SEQ ID NO: 31065 - RNA, 20 nt, Artificial Sequence
  MKO10031065_A_Meuul6
  gRNA
aucaguaaaaaaauacgauc

SEQ ID NO: 31066 - RNA, 20 nt, Artificial Sequence
  MKO10031066_A_Meuul7a1
  gRNA
uagcuuuagcuucgagaagc

SEQ ID NO: 31067 - RNA, 20 nt, Artificial Sequence
  MKO10031067_A_Meuul7a1
  gRNA
gcggcugguggucuguaccc

SEQ ID NO: 31068 - RNA, 20 nt, Artificial Sequence
  MKO10031068_A_Meuul7a1
  gRNA
gccgcaccaauguccaggag

SEQ ID NO: 31069 - RNA, 20 nt, Artificial Sequence
  MKO10031069_A_Meuul7a2Higd1c
  gRNA
gggagucucucgauuuccgg

SEQ ID NO: 31070 - RNA, 20 nt, Artificial Sequence
  MKO10031070_A_Meuul7a2Higd1c
  gRNA
auuuagcuuguaaagaccgu

SEQ ID NO: 31071 - RNA, 20 nt, Artificial Sequence
  MKO10031071_A_Meuul7a2Higd1c
  gRNA
cccgcacguggaugagauga

SEQ ID NO: 31072 - RNA, 20 nt, Artificial Sequence
  MKO10031072_A_Meuul7a2
  gRNA
ccaggagaagauucugcgcg

SEQ ID NO: 31073 - RNA, 20 nt, Artificial Sequence
  MKO10031073_A_Meuul7a2
  gRNA
cccagcuccacaugccuaga

SEQ ID NO: 31074 - RNA, 20 nt, Artificial Sequence
  MKO10031074_A_Meuul7a2
  gRNA
ucacagcauagccauagaug

SEQ ID NO: 31075 - RNA, 20 nt, Artificial Sequence
  MKO10031075_A_Meuul7a3
  gRNA
ugcugaagagcuccugcuuu

SEQ ID NO: 31076 - RNA, 20 nt, Artificial Sequence
  MKO10031076_A_Meuul7a3
  gRNA
ccucacgcagaaucuucucu

SEQ ID NO: 31077 - RNA, 20 nt, Artificial Sequence
  MKO10031077_A_Meuul7a3
  gRNA
ucacagcauagccauagaug

SEQ ID NO: 31078 - RNA, 20 nt, Artificial Sequence
  MKO10031078_A_Meuul7b
  gRNA
uuccggcaacguggcccugc

SEQ ID NO: 31079 - RNA, 20 nt, Artificial Sequence
  MKO10031079_A_Meuul7b
  gRNA
ccacaaugaagcgcucauau

SEQ ID NO: 31080 - RNA, 20 nt, Artificial Sequence
  MKO10031080_A_Meuul7b
  gRNA
acaguucuccgaaguccagc

SEQ ID NO: 31081 - RNA, 20 nt, Artificial Sequence
  MKO10031081_A_Meuul8
  gRNA
cgagucgcuccagaagagca

SEQ ID NO: 31082 - RNA, 20 nt, Artificial Sequence
  MKO10031082_A_Meuul8
  gRNA
gaaucauccugggaucaagu

SEQ ID NO: 31083 - RNA, 20 nt, Artificial Sequence
  MKO10031083_A_Meuul8
  gRNA
uaccucuaguauucgaaaag

SEQ ID NO: 31084 - RNA, 20 nt, Artificial Sequence
  MKO10031084_A_Meuul9
  gRNA
caucagcugcuuaaauuugc

SEQ ID NO: 31085 - RNA, 20 nt, Artificial Sequence
  MKO10031085_A_Meuul9
  gRNA
gaaagcuucgacgacaaagc

SEQ ID NO: 31086 - RNA, 20 nt, Artificial Sequence
  MKO10031086_A_Meuul9
  gRNA
gagacugcuuagaauuaauc

SEQ ID NO: 31087 - RNA, 20 nt, Artificial Sequence
  MKO10031087_A_Met
  gRNA
gcagcgcgucgacuuauuca

SEQ ID NO: 31088 - RNA, 20 nt, Artificial Sequence
  MKO10031088_A_Met
  gRNA
aagcgcgcagugacgaguau

SEQ ID NO: 31089 - RNA, 20 nt, Artificial Sequence
  MKO10031089_A_Met
  gRNA
auuccuaccuuauaaaccgc

SEQ ID NO: 31090 - RNA, 20 nt, Artificial Sequence
  MKO10031090_A_Mex3a
  gRNA
uguacgaguacccuaccgcg

SEQ ID NO: 31091 - RNA, 20 nt, Artificial Sequence
  MKO10031091_A_Mex3a
  gRNA
cggcguggacucggccuuug

SEQ ID NO: 31092 - RNA, 20 nt, Artificial Sequence
  MKO10031092_A_Mex3a
  gRNA
agacgagcgcgcccuucagc

SEQ ID NO: 31093 - RNA, 20 nt, Artificial Sequence
  MKO10031093_A_Mex3b
  gRNA
uacgaucuccgcgacguguu

SEQ ID NO: 31094 - RNA, 20 nt, Artificial Sequence
  MKO10031094_A_Mex3b
  gRNA
acccaguuccgaacacgucg

SEQ ID NO: 31095 - RNA, 20 nt, Artificial Sequence
  MKO10031095_A_Mex3b
  gRNA
cuagcgcgauccacguucuc

SEQ ID NO: 31096 - RNA, 20 nt, Artificial Sequence
  MKO10031096_A_Mex3c
  gRNA
ccgccucgcgaccuccgaga

SEQ ID NO: 31097 - RNA, 20 nt, Artificial Sequence
  MKO10031097_A_Mex3c
  gRNA
augcauaucgccaugcguac

SEQ ID NO: 31098 - RNA, 20 nt, Artificial Sequence
  MKO10031098_A_Mex3c
  gRNA
ucggaguaacuauguacgug

SEQ ID NO: 31099 - RNA, 20 nt, Artificial Sequence
  MKO10031099_A_Mex3d
  gRNA
gggacgcuucgacgcgccag

SEQ ID NO: 31100 - RNA, 20 nt, Artificial Sequence
  MKO10031100_A_Mex3d
  gRNA
gcgcgugcccuaccgagugg

SEQ ID NO: 31101 - RNA, 20 nt, Artificial Sequence
  MKO10031101_A_Mex3d
  gRNA
gccacccgagcccgacgacg

SEQ ID NO: 31102 - RNA, 20 nt, Artificial Sequence
  MKO10031102_A_Mfap1a
  gRNA
uugaccaggugagaucucaa

SEQ ID NO: 31103 - RNA, 20 nt, Artificial Sequence
  MKO10031103_A_Mfap1a
  gRNA
acuuacuuucgaaugaagac

SEQ ID NO: 31104 - RNA, 20 nt, Artificial Sequence
  MKO10031104_A_Mfap1a
  gRNA
agcugaagcauugaaacaga

SEQ ID NO: 31105 - RNA, 20 nt, Artificial Sequence
  MKO10031105_A_Mfap1b
  gRNA
uugaccaggugagaucucaa

SEQ ID NO: 31106 - RNA, 20 nt, Artificial Sequence
  MKO10031106_A_Mfap1b
  gRNA
acuuacuuucgaaugaagac

SEQ ID NO: 31107 - RNA, 20 nt, Artificial Sequence
  MKO10031107_A_Mfap1b
  gRNA
agcugaagcauugaaacaga

SEQ ID NO: 31108 - RNA, 20 nt, Artificial Sequence
  MKO10031108_A_Mfap2
  gRNA
uaccaaucuggucgccauag

SEQ ID NO: 31109 - RNA, 20 nt, Artificial Sequence
  MKO10031109_A_Mfap2
  gRNA
uacuggacaugguccgggaa

SEQ ID NO: 31110 - RNA, 20 nt, Artificial Sequence
  MKO10031110_A_Mfap2
  gRNA
gagacugagccuaccgagcc

SEQ ID NO: 31111 - RNA, 20 nt, Artificial Sequence
  MKO10031111_A_Mfap3l
  gRNA
cgaagagacgucuccuguag

SEQ ID NO: 31112 - RNA, 20 nt, Artificial Sequence
  MKO10031112_A_Mfap3l
  gRNA
ugagucccccaccgcugacu

SEQ ID NO: 31113 - RNA, 20 nt, Artificial Sequence
  MKO10031113_A_Mfap3l
  gRNA
ucaguucuggcaaugauuac

SEQ ID NO: 31114 - RNA, 20 nt, Artificial Sequence
  MKO10031114_A_Mfap3
  gRNA
gaguugcuucggccuagcuc

SEQ ID NO: 31115 - RNA, 20 nt, Artificial Sequence
  MKO10031115_A_Mfap3
  gRNA
ggcacagccgagugacguuc

SEQ ID NO: 31116 - RNA, 20 nt, Artificial Sequence
  MKO10031116_A_Mfap3
  gRNA
gaacuuugauucgcucccag

SEQ ID NO: 31117 - RNA, 20 nt, Artificial Sequence
  MKO10031117_A_Mfap4
  gRNA
cugugaugauaucuacgccc

SEQ ID NO: 31118 - RNA, 20 nt, Artificial Sequence
  MKO10031118_A_Mfap4
  gRNA
ggauggcuauacccucuacg

SEQ ID NO: 31119 - RNA, 20 nt, Artificial Sequence
  MKO10031119_A_Mfap4
  gRNA
gcuuguagucgcuccagccc

SEQ ID NO: 31120 - RNA, 20 nt, Artificial Sequence
  MKO10031120_A_Mfap5
  gRNA
gaucccucuacagacgauac

SEQ ID NO: 31121 - RNA, 20 nt, Artificial Sequence
  MKO10031121_A_Mfap5
  gRNA
gucaccuguaucgucuguag

SEQ ID NO: 31122 - RNA, 20 nt, Artificial Sequence
  MKO10031122_A_Mfap5
  gRNA
cgcguugaccacugaccccu

SEQ ID NO: 31123 - RNA, 20 nt, Artificial Sequence
  MKO10031123_A_Mff
  gRNA
gcugacccaccacgcaacac

SEQ ID NO: 31124 - RNA, 20 nt, Artificial Sequence
  MKO10031124_A_Mff
  gRNA
gaaaaugcuguucgccaaaa

SEQ ID NO: 31125 - RNA, 20 nt, Artificial Sequence
  MKO10031125_A_Mff
  gRNA
guccacucccuuuaaaccuc

SEQ ID NO: 31126 - RNA, 20 nt, Artificial Sequence
  MKO10031126_A_Mfge8
  gRNA
cgguacagacgagccagcuc

SEQ ID NO: 31127 - RNA, 20 nt, Artificial Sequence
  MKO10031127_A_Mfge8
  gRNA
guuucaugggcuugcagcgc

SEQ ID NO: 31128 - RNA, 20 nt, Artificial Sequence
  MKO10031128_A_Mfge8
  gRNA
ggcaugcuacucugcgccuc

SEQ ID NO: 31129 - RNA, 20 nt, Artificial Sequence
  MKO10031129_A_Mfhas1
  gRNA
caugccgcggagccauucaa

SEQ ID NO: 31130 - RNA, 20 nt, Artificial Sequence
  MKO10031130_A_Mfhas1
  gRNA
uaggccucgcagccgguugc

SEQ ID NO: 31131 - RNA, 20 nt, Artificial Sequence
  MKO10031131_A_Mfhas1
  gRNA
cgagcgagugaauguggcuu

SEQ ID NO: 31132 - RNA, 20 nt, Artificial Sequence
  MKO10031132_A_Mfi2
  gRNA
cucucuacgagguaaccgac

SEQ ID NO: 31133 - RNA, 20 nt, Artificial Sequence
  MKO10031133_A_Mfi2
  gRNA
gacgcccuucaggguguuga

SEQ ID NO: 31134 - RNA, 20 nt, Artificial Sequence
  MKO10031134_A_Mfi2
  gRNA
uguagucguaguaucucucu

SEQ ID NO: 31135 - RNA, 20 nt, Artificial Sequence
  MKO10031135_A_Mfn1
  gRNA
uugugugaccaaucccgcug

SEQ ID NO: 31136 - RNA, 20 nt, Artificial Sequence
  MKO10031136_A_Mfn1
  gRNA
acuugaucgaauagcauccg

SEQ ID NO: 31137 - RNA, 20 nt, Artificial Sequence
  MKO10031137_A_Mfn1
  gRNA
aaagccuaccuuaugaccga

SEQ ID NO: 31138 - RNA, 20 nt, Artificial Sequence
  MKO10031138_A_Mfn2
  gRNA
aguuaccgucugcaucagcg

SEQ ID NO: 31139 - RNA, 20 nt, Artificial Sequence
  MKO10031139_A_Mfn2
  gRNA
ccgugaucaaugccaugcuc

SEQ ID NO: 31140 - RNA, 20 nt, Artificial Sequence
  MKO10031140_A_Mfn2
  gRNA
acagguacccuuugacgucc

SEQ ID NO: 31141 - RNA, 20 nt, Artificial Sequence
  MKO10031141_A_Mfng
  gRNA
uuucugcaucaaccgccaac

SEQ ID NO: 31142 - RNA, 20 nt, Artificial Sequence
  MKO10031142_A_Mfng
  gRNA
guggaugggccgguucaggc

SEQ ID NO: 31143 - RNA, 20 nt, Artificial Sequence
  MKO10031143_A_Mfng
  gRNA
gcugcagucaaaaaaccgca

SEQ ID NO: 31144 - RNA, 20 nt, Artificial Sequence
  MKO10031144_A_Mfrp
  gRNA
cgacgucauccuccguccag

SEQ ID NO: 31145 - RNA, 20 nt, Artificial Sequence
  MKO10031145_A_Mfrp
  gRNA
agcccgacugccacuucucc

SEQ ID NO: 31146 - RNA, 20 nt, Artificial Sequence
  MKO10031146_A_Mfrp
  gRNA
uugcucaacucacucgccuc

SEQ ID NO: 31147 - RNA, 20 nt, Artificial Sequence
  MKO10031147_A_Mfsd10
  gRNA
ugagcccaggucagcgacaa

SEQ ID NO: 31148 - RNA, 20 nt, Artificial Sequence
  MKO10031148_A_Mfsd10
  gRNA
uucagccaucgggaugccag

SEQ ID NO: 31149 - RNA, 20 nt, Artificial Sequence
  MKO10031149_A_Mfsd10
  gRNA
ggcaaaaaguaggcugaucc

SEQ ID NO: 31150 - RNA, 20 nt, Artificial Sequence
  MKO10031150_A_Mfsd11
  gRNA
aaauuugaucacuccguccg

SEQ ID NO: 31151 - RNA, 20 nt, Artificial Sequence
  MKO10031151_A_Mfsd11
  gRNA
ccaacaauggcgaccacgga

SEQ ID NO: 31152 - RNA, 20 nt, Artificial Sequence
  MKO10031152_A_Mfsd11
  gRNA
gcucaucagaauuuaucguc

SEQ ID NO: 31153 - RNA, 20 nt, Artificial Sequence
  MKO10031153_A_Mfsd12
  gRNA
ucaccguguacggcgcagcc

SEQ ID NO: 31154 - RNA, 20 nt, Artificial Sequence
  MKO10031154_A_Mfsd12
  gRNA
gcggggaagccacgccugaa

SEQ ID NO: 31155 - RNA, 20 nt, Artificial Sequence
  MKO10031155_A_Mfsd12
  gRNA
ccgugagcuccaccuucucg

SEQ ID NO: 31156 - RNA, 20 nt, Artificial Sequence
  MKO10031156_A_Mfsd1
  gRNA
cuuaccguauuccaaauaug

SEQ ID NO: 31157 - RNA, 20 nt, Artificial Sequence
  MKO10031157_A_Mfsd1
  gRNA
auacagcagcaugaauuucg

SEQ ID NO: 31158 - RNA, 20 nt, Artificial Sequence
  MKO10031158_A_Mfsd1
  gRNA
cccguuucaccugagucuga

SEQ ID NO: 31159 - RNA, 20 nt, Artificial Sequence
  MKO10031159_A_Mfsd2a
  gRNA
ggggccccguaccaguugac

SEQ ID NO: 31160 - RNA, 20 nt, Artificial Sequence
  MKO10031160_A_Mfsd2a
  gRNA
gagggacuuacuguaugccg

SEQ ID NO: 31161 - RNA, 20 nt, Artificial Sequence
  MKO10031161_A_Mfsd2a
  gRNA
cuaaugcagaagcccaccag

SEQ ID NO: 31162 - RNA, 20 nt, Artificial Sequence
  MKO10031162_A_Mfsd2b
  gRNA
gaaguaggccagugcgauua

SEQ ID NO: 31163 - RNA, 20 nt, Artificial Sequence
  MKO10031163_A_Mfsd2b
  gRNA
accacacucacgguaugcgg

SEQ ID NO: 31164 - RNA, 20 nt, Artificial Sequence
  MKO10031164_A_Mfsd2b
  gRNA
cauuggugggguccccaacc

SEQ ID NO: 31165 - RNA, 20 nt, Artificial Sequence
  MKO10031165_A_Mfsd3
  gRNA
uaggcugucggccagcacgc

SEQ ID NO: 31166 - RNA, 20 nt, Artificial Sequence
  MKO10031166_A_Mfsd3
  gRNA
gccaggcggagauccagaac

SEQ ID NO: 31167 - RNA, 20 nt, Artificial Sequence
  MKO10031167_A_Mfsd3
  gRNA
cuccuuggguggggcucuac

SEQ ID NO: 31168 - RNA, 20 nt, Artificial Sequence
  MKO10031168_A_Mfsd4
  gRNA
cacccggccgucgcagccca

SEQ ID NO: 31169 - RNA, 20 nt, Artificial Sequence
  MKO10031169_A_Mfsd4
  gRNA
gcccgccagcgcuaugaccg

SEQ ID NO: 31170 - RNA, 20 nt, Artificial Sequence
  MKO10031170_A_Mfsd4
  gRNA
ggggcaacgagcugugcguc

SEQ ID NO: 31171 - RNA, 20 nt, Artificial Sequence
  MKO10031171_A_Mfsd5
  gRNA
cugguacauccacgagcacg

SEQ ID NO: 31172 - RNA, 20 nt, Artificial Sequence
  MKO10031172_A_Mfsd5
  gRNA
ggcaugacuuccccgccgag

SEQ ID NO: 31173 - RNA, 20 nt, Artificial Sequence
  MKO10031173_A_Mfsd5
  gRNA
ggggccggucgcacccuuug

SEQ ID NO: 31174 - RNA, 20 nt, Artificial Sequence
  MKO10031174_A_Mfsd6l
  gRNA
ggacgucccauugcggguug

SEQ ID NO: 31175 - RNA, 20 nt, Artificial Sequence
  MKO10031175_A_Mfsd6l
  gRNA
auuucguagacgccacugau

SEQ ID NO: 31176 - RNA, 20 nt, Artificial Sequence
  MKO10031176_A_Mfsd6l
  gRNA
ggcgggagucaccccuuaug

SEQ ID NO: 31177 - RNA, 20 nt, Artificial Sequence
  MKO10031177_A_Mfsd6
  gRNA
gacuaacacgccuccgauca

SEQ ID NO: 31178 - RNA, 20 nt, Artificial Sequence
  MKO10031178_A_Mfsd6
  gRNA
ugugagugagucgcggcagu

SEQ ID NO: 31179 - RNA, 20 nt, Artificial Sequence
  MKO10031179_A_Mfsd6
  gRNA
ugaucguugccacucaguuc

SEQ ID NO: 31180 - RNA, 20 nt, Artificial Sequence
  MKO10031180_A_Mfsd7a
  gRNA
ucugacuuaccgcuccacgg

SEQ ID NO: 31181 - RNA, 20 nt, Artificial Sequence
  MKO10031181_A_Mfsd7a
  gRNA
cacccaccaguuugagcccu

SEQ ID NO: 31182 - RNA, 20 nt, Artificial Sequence
  MKO10031182_A_Mfsd7a
  gRNA
agcagaugacaucccuauga

SEQ ID NO: 31183 - RNA, 20 nt, Artificial Sequence
  MKO10031183_A_Mfsd7b
  gRNA
cucuuguaggaguacucuuc

SEQ ID NO: 31184 - RNA, 20 nt, Artificial Sequence
  MKO10031184_A_Mfsd7b
  gRNA
accuccguugccuccaaguc

SEQ ID NO: 31185 - RNA, 20 nt, Artificial Sequence
  MKO10031185_A_Mfsd7b
  gRNA
gaggaucgggcugacacugg

SEQ ID NO: 31186 - RNA, 20 nt, Artificial Sequence
  MKO10031186_A_Mfsd7c
  gRNA
ucggacaauggaacuuaagu

SEQ ID NO: 31187 - RNA, 20 nt, Artificial Sequence
  MKO10031187_A_Mfsd7c
  gRNA
ggucugaccaucgucauugc

SEQ ID NO: 31188 - RNA, 20 nt, Artificial Sequence
  MKO10031188_A_Mfsd7c
  gRNA
caccaugcgauucagcagag

SEQ ID NO: 31189 - RNA, 20 nt, Artificial Sequence
  MKO10031189_A_Mfsd8
  gRNA
guuguccgaucauacauugc

SEQ ID NO: 31190 - RNA, 20 nt, Artificial Sequence
  MKO10031190_A_Mfsd8
  gRNA
uagcaccagcaauguaugau

SEQ ID NO: 31191 - RNA, 20 nt, Artificial Sequence
  MKO10031191_A_Mfsd8
  gRNA
aucuacucuuguaaugcucu

SEQ ID NO: 31192 - RNA, 20 nt, Artificial Sequence
  MKO10031192_A_Mfsd9
  gRNA
gaguugcaaaacgccguaug

SEQ ID NO: 31193 - RNA, 20 nt, Artificial Sequence
  MKO10031193_A_Mfsd9
  gRNA
cccguaguggcuggaauagu

SEQ ID NO: 31194 - RNA, 20 nt, Artificial Sequence
  MKO10031194_A_Mfsd9
  gRNA
caauguguuccuguuuacgc

SEQ ID NO: 31195 - RNA, 20 nt, Artificial Sequence
  MKO10031195_A_Mgam
  gRNA
uuaccuucugcacccguguu

SEQ ID NO: 31196 - RNA, 20 nt, Artificial Sequence
  MKO10031196_A_Mgam
  gRNA
gacguuguaaacacaaaugc

SEQ ID NO: 31197 - RNA, 20 nt, Artificial Sequence
  MKO10031197_A_Mgam
  gRNA
aguggaagcgauuugauguc

SEQ ID NO: 31198 - RNA, 20 nt, Artificial Sequence
  MKO10031198_A_Mgarp
  gRNA
aucuggcgauguaucuccgc

SEQ ID NO: 31199 - RNA, 20 nt, Artificial Sequence
  MKO10031199_A_Mgarp
  gRNA
cgagcgcggguccucaguag

SEQ ID NO: 31200 - RNA, 20 nt, Artificial Sequence
  MKO10031200_A_Mgarp
  gRNA
cucuucgccgaaugucaucc

SEQ ID NO: 31201 - RNA, 20 nt, Artificial Sequence
  MKO10031201_A_Mgau1
  gRNA
gcacacgccggccccgaaac

SEQ ID NO: 31202 - RNA, 20 nt, Artificial Sequence
  MKO10031202_A_Mgau1
  gRNA
gcgcauccagucgucccaaa

SEQ ID NO: 31203 - RNA, 20 nt, Artificial Sequence
  MKO10031203_A_Mgau1
  gRNA
gguggaugaccucacgggug

SEQ ID NO: 31204 - RNA, 20 nt, Artificial Sequence
  MKO10031204_A_Mgau2
  gRNA
ggugcuaauccugacgcucg

SEQ ID NO: 31205 - RNA, 20 nt, Artificial Sequence
  MKO10031205_A_Mgau2
  gRNA
acgucgguaaugacggcacc

SEQ ID NO: 31206 - RNA, 20 nt, Artificial Sequence
  MKO10031206_A_Mgau2
  gRNA
ugcuggacgcggagcccgua

SEQ ID NO: 31207 - RNA, 20 nt, Artificial Sequence
  MKO10031207_A_Mgau3
  gRNA
auggcguugauaacccgccu

SEQ ID NO: 31208 - RNA, 20 nt, Artificial Sequence
  MKO10031208_A_Mgau3
  gRNA
ugaggcacguguugaguacg

SEQ ID NO: 31209 - RNA, 20 nt, Artificial Sequence
  MKO10031209_A_Mgau3
  gRNA
cgucuuuaucaucgacgaug

SEQ ID NO: 31210 - RNA, 20 nt, Artificial Sequence
  MKO10031210_A_Mgau4a
  gRNA
cuucagcccgccguacagau

SEQ ID NO: 31211 - RNA, 20 nt, Artificial Sequence
  MKO10031211_A_Mgau4a
  gRNA
uaggauaucucagcgcuccu

SEQ ID NO: 31212 - RNA, 20 nt, Artificial Sequence
  MKO10031212_A_Mgau4a
  gRNA
gacaaugguguuuagcuccg

SEQ ID NO: 31213 - RNA, 20 nt, Artificial Sequence
  MKO10031213_A_Mgau4b
  gRNA
ugcaccucgcgccguacgcu

SEQ ID NO: 31214 - RNA, 20 nt, Artificial Sequence
  MKO10031214_A_Mgau4b
  gRNA
cauuccgagcguacggcgcg

SEQ ID NO: 31215 - RNA, 20 nt, Artificial Sequence
  MKO10031215_A_Mgau4b
  gRNA
cuugcucagccgcgugcaaa

SEQ ID NO: 31216 - RNA, 20 nt, Artificial Sequence
  MKO10031216_A_Mgau4c
  gRNA
uucucacgaucucccacguc

SEQ ID NO: 31217 - RNA, 20 nt, Artificial Sequence
  MKO10031217_A_Mgau4c
  gRNA
acgaacguaucucccauuga

SEQ ID NO: 31218 - RNA, 20 nt, Artificial Sequence
  MKO10031218_A_Mgau4c
  gRNA
cauagcguucagaauuaagu

SEQ ID NO: 31219 - RNA, 20 nt, Artificial Sequence
  MKO10031219_A_Mgau5b
  gRNA
cgaagggcaccacgugacuc

SEQ ID NO: 31220 - RNA, 20 nt, Artificial Sequence
  MKO10031220_A_Mgau5b
  gRNA
ucgcaagaugagcgaccugc

SEQ ID NO: 31221 - RNA, 20 nt, Artificial Sequence
  MKO10031221_A_Mgau5b
  gRNA
ccaguucucugcccggcgcc

SEQ ID NO: 31222 - RNA, 20 nt, Artificial Sequence
  MKO10031222_A_Mgau5
  gRNA
gaaaacgcucgccgucuugc

SEQ ID NO: 31223 - RNA, 20 nt, Artificial Sequence
  MKO10031223_A_Mgau5
  gRNA
cacuccauagucugcguagc

SEQ ID NO: 31224 - RNA, 20 nt, Artificial Sequence
  MKO10031224_A_Mgau5
  gRNA
auggcuacccccacugcgag

SEQ ID NO: 31225 - RNA, 20 nt, Artificial Sequence
  MKO10031225_A_Mga
  gRNA
gggcgaccaccuaaaaacac

SEQ ID NO: 31226 - RNA, 20 nt, Artificial Sequence
  MKO10031226_A_Mga
  gRNA
guaagacgaacacgaugagc

SEQ ID NO: 31227 - RNA, 20 nt, Artificial Sequence
  MKO10031227_A_Mga
  gRNA
aggaauagcuccgaucaaga

SEQ ID NO: 31228 - RNA, 20 nt, Artificial Sequence
  MKO10031228_A_Mgea5
  gRNA
aucaacguugaaacgcaaau

SEQ ID NO: 31229 - RNA, 20 nt, Artificial Sequence
  MKO10031229_A_Mgea5
  gRNA
uucaucuaugcuauuucgcc

SEQ ID NO: 31230 - RNA, 20 nt, Artificial Sequence
  MKO10031230_A_Mgea5
  gRNA
uuggcgagagauguauucag

SEQ ID NO: 31231 - RNA, 20 nt, Artificial Sequence
  MKO10031231_A_Mgl2
  gRNA
agaugaccaccaguagcagg

SEQ ID NO: 31232 - RNA, 20 nt, Artificial Sequence
  MKO10031232_A_Mgl2
  gRNA
gcagcugacaacuucgaaaa

SEQ ID NO: 31233 - RNA, 20 nt, Artificial Sequence
  MKO10031233_A_Mgl2
  gRNA
ccucagccuccugcuacugg

SEQ ID NO: 31234 - RNA, 20 nt, Artificial Sequence
  MKO10031234_A_Mgll
  gRNA
ggacgucgggguaguccuuc

SEQ ID NO: 31235 - RNA, 20 nt, Artificial Sequence
  MKO10031235_A_Mgll
  gRNA
cgccugggugaacuugccuc

SEQ ID NO: 31236 - RNA, 20 nt, Artificial Sequence
  MKO10031236_A_Mgll
  gRNA
acuguccgucugcauugacc

SEQ ID NO: 31237 - RNA, 20 nt, Artificial Sequence
  MKO10031237_A_Mgme1
  gRNA
cuaaacgagaguacuucgcu

SEQ ID NO: 31238 - RNA, 20 nt, Artificial Sequence
  MKO10031238_A_Mgme1
  gRNA
gcagccuuaugcuuacucac

SEQ ID NO: 31239 - RNA, 20 nt, Artificial Sequence
  MKO10031239_A_Mgme1
  gRNA
aagccacuuggcccaauacu

SEQ ID NO: 31240 - RNA, 20 nt, Artificial Sequence
  MKO10031240_A_Mgmt
  gRNA
cccaaagcggcucgugcagu

SEQ ID NO: 31241 - RNA, 20 nt, Artificial Sequence
  MKO10031241_A_Mgmt
  gRNA
ucgaccagcucugagccguc

SEQ ID NO: 31242 - RNA, 20 nt, Artificial Sequence
  MKO10031242_A_Mgmt
  gRNA
ugagcaaccguaucccaugc

SEQ ID NO: 31243 - RNA, 20 nt, Artificial Sequence
  MKO10031243_A_Mgp
  gRNA
gcugugugagcgcuacgcca

SEQ ID NO: 31244 - RNA, 20 nt, Artificial Sequence
  MKO10031244_A_Mgp
  gRNA
cugccuacaaccgcuacuuc

SEQ ID NO: 31245 - RNA, 20 nt, Artificial Sequence
  MKO10031245_A_Mgp
  gRNA
agguuucucaccguagcaca

SEQ ID NO: 31246 - RNA, 20 nt, Artificial Sequence
  MKO10031246_A_Mgrn1
  gRNA
cauccugagucgccgcaucg

SEQ ID NO: 31247 - RNA, 20 nt, Artificial Sequence
  MKO10031247_A_Mgrn1
  gRNA
ggaagcucaccggacuucgg

SEQ ID NO: 31248 - RNA, 20 nt, Artificial Sequence
  MKO10031248_A_Mgrn1
  gRNA
cacacgggcaucggcaucaa

SEQ ID NO: 31249 - RNA, 20 nt, Artificial Sequence
  MKO10031249_A_Mgst1
  gRNA
uuggaagcauggccgaccuc

SEQ ID NO: 31250 - RNA, 20 nt, Artificial Sequence
  MKO10031250_A_Mgst1
  gRNA
guuuguucgcacugacgaga

SEQ ID NO: 31251 - RNA, 20 nt, Artificial Sequence
  MKO10031251_A_Mgst1
  gRNA
caggaggccgaugccgagaa

SEQ ID NO: 31252 - RNA, 20 nt, Artificial Sequence
  MKO10031252_A_Mgst2
  gRNA
gaaaguccagguauucguuc

SEQ ID NO: 31253 - RNA, 20 nt, Artificial Sequence
  MKO10031253_A_Mgst2
  gRNA
acgcccgucacaaguauuuc

SEQ ID NO: 31254 - RNA, 20 nt, Artificial Sequence
  MKO10031254_A_Mgst2
  gRNA
cuguauucaucguaaugcug

SEQ ID NO: 31255 - RNA, 20 nt, Artificial Sequence
  MKO10031255_A_Mgst3
  gRNA
uacgcauauggcuacuacac

SEQ ID NO: 31256 - RNA, 20 nt, Artificial Sequence
  MKO10031256_A_Mgst3
  gRNA
uguaguagccauaugcguaa

SEQ ID NO: 31257 - RNA, 20 nt, Artificial Sequence
  MKO10031257_A_Mgst3
  gRNA
uugaacauaugcccguucuc

SEQ ID NO: 31258 - RNA, 20 nt, Artificial Sequence
  MKO10031258_A_Mia2
  gRNA
cggguccuguguaaucucuc

SEQ ID NO: 31259 - RNA, 20 nt, Artificial Sequence
  MKO10031259_A_Mia2
  gRNA
ggcagguacagaaagcgucu

SEQ ID NO: 31260 - RNA, 20 nt, Artificial Sequence
  MKO10031260_A_Mia2
  gRNA
uucaaucucgacugcaucuc

SEQ ID NO: 31261 - RNA, 20 nt, Artificial Sequence
  MKO10031261_A_Mia3
  gRNA
ggcgagcgcuuaucgucuuc

SEQ ID NO: 31262 - RNA, 20 nt, Artificial Sequence
  MKO10031262_A_Mia3
  gRNA
gcgacaacuauccccccgag

SEQ ID NO: 31263 - RNA, 20 nt, Artificial Sequence
  MKO10031263_A_Mia3
  gRNA
aaauucacaaaacgacaauc

SEQ ID NO: 31264 - RNA, 20 nt, Artificial Sequence
  MKO10031264_A_Mia
  gRNA
aaucaggggccacguagucc

SEQ ID NO: 31265 - RNA, 20 nt, Artificial Sequence
  MKO10031265_A_Mia
  gRNA
gccgcuucuugacuauauau

SEQ ID NO: 31266 - RNA, 20 nt, Artificial Sequence
  MKO10031266_A_Mia
  gRNA
cagacaagacgacgaugcca

SEQ ID NO: 31267 - RNA, 20 nt, Artificial Sequence
  MKO10031267_A_Mib1
  gRNA
uuccaucgaaugccaaugau

SEQ ID NO: 31268 - RNA, 20 nt, Artificial Sequence
  MKO10031268_A_Mib1
  gRNA
acggugcuaagaaccuuuac

SEQ ID NO: 31269 - RNA, 20 nt, Artificial Sequence
  MKO10031269_A_Mib1
  gRNA
ggcuggaugcacuccagucc

SEQ ID NO: 31270 - RNA, 20 nt, Artificial Sequence
  MKO10031270_A_Mib2
  gRNA
aaccacgaacguguaccgag

SEQ ID NO: 31271 - RNA, 20 nt, Artificial Sequence
  MKO10031271_A_Mib2
  gRNA
gguuacgcugagcccccgac

SEQ ID NO: 31272 - RNA, 20 nt, Artificial Sequence
  MKO10031272_A_Mib2
  gRNA
agaugucucauagcgcucga

SEQ ID NO: 31273 - RNA, 20 nt, Artificial Sequence
  MKO10031273_A_Mical1
  gRNA
uucacuauacgagagaugcg

SEQ ID NO: 31274 - RNA, 20 nt, Artificial Sequence
  MKO10031274_A_Mical1
  gRNA
cgugcgcccauucacaaagu

SEQ ID NO: 31275 - RNA, 20 nt, Artificial Sequence
  MKO10031275_A_Mical1
  gRNA
ggauguacugaguagcuuuc

SEQ ID NO: 31276 - RNA, 20 nt, Artificial Sequence
  MKO10031276_A_Mical2
  gRNA
accuagauccgcuggaccau

SEQ ID NO: 31277 - RNA, 20 nt, Artificial Sequence
  MKO10031277_A_Mical2
  gRNA
gcuuauccaguuugugccac

SEQ ID NO: 31278 - RNA, 20 nt, Artificial Sequence
  MKO10031278_A_Mical2
  gRNA
cccccacagugucucaucgu

SEQ ID NO: 31279 - RNA, 20 nt, Artificial Sequence
  MKO10031279_A_Mical3
  gRNA
caggccucggagaucgugua

SEQ ID NO: 31280 - RNA, 20 nt, Artificial Sequence
  MKO10031280_A_Mical3
  gRNA
uucaccauacacgaucuccg

SEQ ID NO: 31281 - RNA, 20 nt, Artificial Sequence
  MKO10031281_A_Mical3
  gRNA
cuaccuucaagaggauuagc

SEQ ID NO: 31282 - RNA, 20 nt, Artificial Sequence
  MKO10031282_A_Micalcl
  gRNA
auggacgacucgguaaacuc

SEQ ID NO: 31283 - RNA, 20 nt, Artificial Sequence
  MKO10031283_A_Micalcl
  gRNA
cugcuccacaacuccgaagc

SEQ ID NO: 31284 - RNA, 20 nt, Artificial Sequence
  MKO10031284_A_Micalcl
  gRNA
ugaugguaccuuuauccuua

SEQ ID NO: 31285 - RNA, 20 nt, Artificial Sequence
  MKO10031285_A_Micall1
  gRNA
ugucuucgagaauaaucgau

SEQ ID NO: 31286 - RNA, 20 nt, Artificial Sequence
  MKO10031286_A_Micall1
  gRNA
caggcugcgcaugcgcugcu

SEQ ID NO: 31287 - RNA, 20 nt, Artificial Sequence
  MKO10031287_A_Micall1
  gRNA
ccgccaaguaccgcugcacc

SEQ ID NO: 31288 - RNA, 20 nt, Artificial Sequence
  MKO10031288_A_Micall2
  gRNA
acucacuuggggaccggcca

SEQ ID NO: 31289 - RNA, 20 nt, Artificial Sequence
  MKO10031289_A_Micall2
  gRNA
gauucgaccgaagaacuuuc

SEQ ID NO: 31290 - RNA, 20 nt, Artificial Sequence
  MKO10031290_A_Micall2
  gRNA
gguagaggcgcccgucagcc

SEQ ID NO: 31291 - RNA, 20 nt, Artificial Sequence
  MKO10031291_A_Micu1
  gRNA
cgaaguguucaugacuccgc

SEQ ID NO: 31292 - RNA, 20 nt, Artificial Sequence
  MKO10031292_A_Micu1
  gRNA
uucuugcuguuaacgcaugg

SEQ ID NO: 31293 - RNA, 20 nt, Artificial Sequence
  MKO10031293_A_Micu1
  gRNA
augaacacuucgguuucacc

SEQ ID NO: 31294 - RNA, 20 nt, Artificial Sequence
  MKO10031294_A_Micu2
  gRNA
aauacucuccgucgugcucc

SEQ ID NO: 31295 - RNA, 20 nt, Artificial Sequence
  MKO10031295_A_Micu2
  gRNA
gauaucgaggauguacuguc

SEQ ID NO: 31296 - RNA, 20 nt, Artificial Sequence
  MKO10031296_A_Micu2
  gRNA
acugcaugaaccgcuguuug

SEQ ID NO: 31297 - RNA, 20 nt, Artificial Sequence
  MKO10031297_A_Micu3
  gRNA
ucucucgagauguagcauag

SEQ ID NO: 31298 - RNA, 20 nt, Artificial Sequence
  MKO10031298_A_Micu3
  gRNA
uuugaugaucccuuccaaac

SEQ ID NO: 31299 - RNA, 20 nt, Artificial Sequence
  MKO10031299_A_Micu3
  gRNA
augcuacaucucgagagaga

SEQ ID NO: 31300 - RNA, 20 nt, Artificial Sequence
  MKO10031300_A_Mid1ip1
  gRNA
cgcgccaaugaagcgauuca

SEQ ID NO: 31301 - RNA, 20 nt, Artificial Sequence
  MKO10031301_A_Mid1ip1
  gRNA
cuccccacucgauaucauug

SEQ ID NO: 31302 - RNA, 20 nt, Artificial Sequence
  MKO10031302_A_Mid1ip1
  gRNA
ccauccgcaaugauaucgag

SEQ ID NO: 31303 - RNA, 20 nt, Artificial Sequence
  MKO10031303_A_Mid1
  gRNA
cuucaacauguugacaaguu

SEQ ID NO: 31304 - RNA, 20 nt, Artificial Sequence
  MKO10031304_A_Mid1
  gRNA
gaagaaacugcuagaauguc

SEQ ID NO: 31305 - RNA, 20 nt, Artificial Sequence
  MKO10031305_A_Mid1
  gRNA
uguguuucucuuaauaagau

SEQ ID NO: 31306 - RNA, 20 nt, Artificial Sequence
  MKO10031306_A_Mid2
  gRNA
guucacuguugcgcuuaacc

SEQ ID NO: 31307 - RNA, 20 nt, Artificial Sequence
  MKO10031307_A_Mid2
  gRNA
cuguugaccgcucaagacac

SEQ ID NO: 31308 - RNA, 20 nt, Artificial Sequence
  MKO10031308_A_Mid2
  gRNA
cugcaaaaaacauugccgag

SEQ ID NO: 31309 - RNA, 20 nt, Artificial Sequence
  MKO10031309_A_Midn
  gRNA
caaguugacgcucgugccca

SEQ ID NO: 31310 - RNA, 20 nt, Artificial Sequence
  MKO10031310_A_Midn
  gRNA
aacggacuguuccggccucg

SEQ ID NO: 31311 - RNA, 20 nt, Artificial Sequence
  MKO10031311_A_Midn
  gRNA
ucaugugauccccgacucgc

SEQ ID NO: 31312 - RNA, 20 nt, Artificial Sequence
  MKO10031312_A_Mief1
  gRNA
cuggguucucacgacgaacc

SEQ ID NO: 31313 - RNA, 20 nt, Artificial Sequence
  MKO10031313_A_Mief1
  gRNA
aaccggucagccaacauguc

SEQ ID NO: 31314 - RNA, 20 nt, Artificial Sequence
  MKO10031314_A_Mief1
  gRNA
cucaaguacaugucccgaag

SEQ ID NO: 31315 - RNA, 20 nt, Artificial Sequence
  MKO10031315_A_Mief2
  gRNA
auccagggcccgcaaacggg

SEQ ID NO: 31316 - RNA, 20 nt, Artificial Sequence
  MKO10031316_A_Mief2
  gRNA
caguagagaccgcccguuug

SEQ ID NO: 31317 - RNA, 20 nt, Artificial Sequence
  MKO10031317_A_Mief2
  gRNA
gccuuacccgcuuuacagcc

SEQ ID NO: 31318 - RNA, 20 nt, Artificial Sequence
  MKO10031318_A_Mien1
  gRNA
ggcacuacggacaccggcgc

SEQ ID NO: 31319 - RNA, 20 nt, Artificial Sequence
  MKO10031319_A_Mien1
  gRNA
cgcgacucaaucucaaugcc

SEQ ID NO: 31320 - RNA, 20 nt, Artificial Sequence
  MKO10031320_A_Mien1
  gRNA
auugagauugagucgcgacu

SEQ ID NO: 31321 - RNA, 20 nt, Artificial Sequence
  MKO10031321_A_Mier1
  gRNA
ucaaaauauuuacaucgacg

SEQ ID NO: 31322 - RNA, 20 nt, Artificial Sequence
  MKO10031322_A_Mier1
  gRNA
cagcacuguucgguuaccug

SEQ ID NO: 31323 - RNA, 20 nt, Artificial Sequence
  MKO10031323_A_Mier1
  gRNA
ugauccaucagcugacaugc

SEQ ID NO: 31324 - RNA, 20 nt, Artificial Sequence
  MKO10031324_A_Mier2
  gRNA
ugacacggcuccagcccugc

SEQ ID NO: 31325 - RNA, 20 nt, Artificial Sequence
  MKO10031325_A_Mier2
  gRNA
acgagcugcuugcacuguau

SEQ ID NO: 31326 - RNA, 20 nt, Artificial Sequence
  MKO10031326_A_Mier2
  gRNA
ggacaaggacuucauugacc

SEQ ID NO: 31327 - RNA, 20 nt, Artificial Sequence
  MKO10031327_A_Mier3
  gRNA
gcacuggaauucgcaaccgc

SEQ ID NO: 31328 - RNA, 20 nt, Artificial Sequence
  MKO10031328_A_Mier3
  gRNA
aucgcgaaagaccugcuguc

SEQ ID NO: 31329 - RNA, 20 nt, Artificial Sequence
  MKO10031329_A_Mier3
  gRNA
cauagccguagaacgccaac

SEQ ID NO: 31330 - RNA, 20 nt, Artificial Sequence
  MKO10031330_A_Mif4gd
  gRNA
gcccacggcggaagacgcuc

SEQ ID NO: 31331 - RNA, 20 nt, Artificial Sequence
  MKO10031331_A_Mif4gd
  gRNA
gccagagcgucuuccgccgu

SEQ ID NO: 31332 - RNA, 20 nt, Artificial Sequence
  MKO10031332_A_Mif4gd
  gRNA
caugugcuacgccaucauuc

SEQ ID NO: 31333 - RNA, 20 nt, Artificial Sequence
  MKO10031333_A_Mif
  gRNA
gcaaaccugugcgggcuugc

SEQ ID NO: 31334 - RNA, 20 nt, Artificial Sequence
  MKO10031334_A_Mif
  gRNA
ggccaccggcaagcccgcac

SEQ ID NO: 31335 - RNA, 20 nt, Artificial Sequence
  MKO10031335_A_Mif
  gRNA
ccaguacaucgcagugcacg

SEQ ID NO: 31336 - RNA, 20 nt, Artificial Sequence
  MKO10031336_A_Miip
  gRNA
ucgagaugacacguuugaug

SEQ ID NO: 31337 - RNA, 20 nt, Artificial Sequence
  MKO10031337_A_Miip
  gRNA
ggccauaccuaggcuaugau

SEQ ID NO: 31338 - RNA, 20 nt, Artificial Sequence
  MKO10031338_A_Miip
  gRNA
aggggggccguaguucuucc

SEQ ID NO: 31339 - RNA, 20 nt, Artificial Sequence
  MKO10031339_A_Mill1
  gRNA
ccuagaguacaggcgguagc

SEQ ID NO: 31340 - RNA, 20 nt, Artificial Sequence
  MKO10031340_A_Mill1
  gRNA
cacccguauucuggccguuc

SEQ ID NO: 31341 - RNA, 20 nt, Artificial Sequence
  MKO10031341_A_Mill1
  gRNA
cagcagguucauugauauug

SEQ ID NO: 31342 - RNA, 20 nt, Artificial Sequence
  MKO10031342_A_Mill2
  gRNA
ugacauuauagcgcagagug

SEQ ID NO: 31343 - RNA, 20 nt, Artificial Sequence
  MKO10031343_A_Mill2
  gRNA
gcucuucaucuacguauauu

SEQ ID NO: 31344 - RNA, 20 nt, Artificial Sequence
  MKO10031344_A_Mill2
  gRNA
gcaguccuacuguugaucuu

SEQ ID NO: 31345 - RNA, 20 nt, Artificial Sequence
  MKO10031345_A_Milr1
  gRNA
acaucaccuauucgcucuuc

SEQ ID NO: 31346 - RNA, 20 nt, Artificial Sequence
  MKO10031346_A_Milr1
  gRNA
aucuccaaugccaacgaguc

SEQ ID NO: 31347 - RNA, 20 nt, Artificial Sequence
  MKO10031347_A_Milr1
  gRNA
uucuggagaugcgccugcac

SEQ ID NO: 31348 - RNA, 20 nt, Artificial Sequence
  MKO10031348_A_Mina
  gRNA
gucaaauacgaaccccgaaa

SEQ ID NO: 31349 - RNA, 20 nt, Artificial Sequence
  MKO10031349_A_Mina
  gRNA
guucguauuugacauugcaa

SEQ ID NO: 31350 - RNA, 20 nt, Artificial Sequence
  MKO10031350_A_Mina
  gRNA
aaggccuuacuuguucuggu

SEQ ID NO: 31351 - RNA, 20 nt, Artificial Sequence
  MKO10031351_A_Mink1
  gRNA
caggggcggcacgucaagac

SEQ ID NO: 31352 - RNA, 20 nt, Artificial Sequence
  MKO10031352_A_Mink1
  gRNA
cagagcuggucaucguuccc

SEQ ID NO: 31353 - RNA, 20 nt, Artificial Sequence
  MKO10031353_A_Mink1
  gRNA
gaugucguccaggcugcggg

SEQ ID NO: 31354 - RNA, 20 nt, Artificial Sequence
  MKO10031354_A_Minos1
  gRNA
accuagcuucacgaccgugu

SEQ ID NO: 31355 - RNA, 20 nt, Artificial Sequence
  MKO10031355_A_Minos1
  gRNA
gaacaugucggaguccgagc

SEQ ID NO: 31356 - RNA, 20 nt, Artificial Sequence
  MKO10031356_A_Minos1
  gRNA
caaucccacgccagaaccaa

SEQ ID NO: 31357 - RNA, 20 nt, Artificial Sequence
  MKO10031357_A_Minpp1
  gRNA
gcucacucgcagagacccgu

SEQ ID NO: 31358 - RNA, 20 nt, Artificial Sequence
  MKO10031358_A_Minpp1
  gRNA
guuaaucgcaaguuccgaag

SEQ ID NO: 31359 - RNA, 20 nt, Artificial Sequence
  MKO10031359_A_Minpp1
  gRNA
gcagcuggaccggcuguuaa

SEQ ID NO: 31360 - RNA, 20 nt, Artificial Sequence
  MKO10031360_A_Mios
  gRNA
augcccccgcuucacucguc

SEQ ID NO: 31361 - RNA, 20 nt, Artificial Sequence
  MKO10031361_A_Mios
  gRNA
ugcguuccugacgagugaag

SEQ ID NO: 31362 - RNA, 20 nt, Artificial Sequence
  MKO10031362_A_Mios
  gRNA
aguugcuguacgugacagag

SEQ ID NO: 31363 - RNA, 20 nt, Artificial Sequence
  MKO10031363_A_Miox
  gRNA
ccacaucgggucgauagacc

SEQ ID NO: 31364 - RNA, 20 nt, Artificial Sequence
  MKO10031364_A_Miox
  gRNA
uccggaugcccuccgcgguc

SEQ ID NO: 31365 - RNA, 20 nt, Artificial Sequence
  MKO10031365_A_Miox
  gRNA
gaucgugcaaaaguccgacc

SEQ ID NO: 31366 - RNA, 20 nt, Artificial Sequence
  MKO10031366_A_Mipep
  gRNA
ccgagaguucgucaaaaaug

SEQ ID NO: 31367 - RNA, 20 nt, Artificial Sequence
  MKO10031367_A_Mipep
  gRNA
agucccuugaugcggaaacc

SEQ ID NO: 31368 - RNA, 20 nt, Artificial Sequence
  MKO10031368_A_Mipep
  gRNA
gguaccugguuuccgcauca

SEQ ID NO: 31369 - RNA, 20 nt, Artificial Sequence
  MKO10031369_A_Mipol1
  gRNA
uuccgcaaugucagccuccg

SEQ ID NO: 31370 - RNA, 20 nt, Artificial Sequence
  MKO10031370_A_Mipol1
  gRNA
ccgacugcaguuagcccuca

SEQ ID NO: 31371 - RNA, 20 nt, Artificial Sequence
  MKO10031371_A_Mipol1
  gRNA
gacauugcggaaaggacugc

SEQ ID NO: 31372 - RNA, 20 nt, Artificial Sequence
  MKO10031372_A_Mip
  gRNA
gcuuggagccucgcuacguu

SEQ ID NO: 31373 - RNA, 20 nt, Artificial Sequence
  MKO10031373_A_Mip
  gRNA
cccaggggcccaacguagcg

SEQ ID NO: 31374 - RNA, 20 nt, Artificial Sequence
  MKO10031374_A_Mip
  gRNA
ucuuugcuacauacgacgag

SEQ ID NO: 31375 - RNA, 20 nt, Artificial Sequence
  MKO10031375_A_Mis12
  gRNA
agaucaccccuguccagacu

SEQ ID NO: 31376 - RNA, 20 nt, Artificial Sequence
  MKO10031376_A_Mis12
  gRNA
gaaacucgagcuucuccaac

SEQ ID NO: 31377 - RNA, 20 nt, Artificial Sequence
  MKO10031377_A_Mis12
  gRNA
augcuacguagauccucagc

SEQ ID NO: 31378 - RNA, 20 nt, Artificial Sequence
  MKO10031378_A_Mis18a
  gRNA
cgucuccuguaacgucucug

SEQ ID NO: 31379 - RNA, 20 nt, Artificial Sequence
  MKO10031379_A_Mis18a
  gRNA
uuucaacggcuucaacgcug

SEQ ID NO: 31380 - RNA, 20 nt, Artificial Sequence
  MKO10031380_A_Mis18a
  gRNA
acaagucgcgcuuguagucc

SEQ ID NO: 31381 - RNA, 20 nt, Artificial Sequence
  MKO10031381_A_Mis18bp1
  gRNA
ugauuaggcaguccaccuac

SEQ ID NO: 31382 - RNA, 20 nt, Artificial Sequence
  MKO10031382_A_Mis18bp1
  gRNA
gaagaacuuguccgccaaac

SEQ ID NO: 31383 - RNA, 20 nt, Artificial Sequence
  MKO10031383_A_Mis18bp1
  gRNA
agaccuaauuuaacacuauc

SEQ ID NO: 31384 - RNA, 20 nt, Artificial Sequence
  MKO10031384_A_Misp
  gRNA
ccugcguccacugcgauuca

SEQ ID NO: 31385 - RNA, 20 nt, Artificial Sequence
  MKO10031385_A_Misp
  gRNA
gccaaggaagacgcgucugu

SEQ ID NO: 31386 - RNA, 20 nt, Artificial Sequence
  MKO10031386_A_Misp
  gRNA
cuugugccgcuuuacccuug

SEQ ID NO: 31387 - RNA, 20 nt, Artificial Sequence
  MKO10031387_A_Mitd1
  gRNA
guucucagaacgaaaaucuc

SEQ ID NO: 31388 - RNA, 20 nt, Artificial Sequence
  MKO10031388_A_Mitd1
  gRNA
cuauacaugaccgagaaauu

SEQ ID NO: 31389 - RNA, 20 nt, Artificial Sequence
  MKO10031389_A_Mitd1
  gRNA
gauaccuacuucauacccag

SEQ ID NO: 31390 - RNA, 20 nt, Artificial Sequence
  MKO10031390_A_Mitf
  gRNA
gaucgaccucuacagcaacc

SEQ ID NO: 31391 - RNA, 20 nt, Artificial Sequence
  MKO10031391_A_Mitf
  gRNA
ugugucuaguuacccgucuc

SEQ ID NO: 31392 - RNA, 20 nt, Artificial Sequence
  MKO10031392_A_Mitf
  gRNA
cucucgagcgucgugcaugc

SEQ ID NO: 31393 - RNA, 20 nt, Artificial Sequence
  MKO10031393_A_Mixl1
  gRNA
cgacggggcggccgagccuu

SEQ ID NO: 31394 - RNA, 20 nt, Artificial Sequence
  MKO10031394_A_Mixl1
  gRNA
caagcgcacgucguucagcu

SEQ ID NO: 31395 - RNA, 20 nt, Artificial Sequence
  MKO10031395_A_Mixl1
  gRNA
gaggaaaacuccccgccuug

SEQ ID NO: 31396 - RNA, 20 nt, Artificial Sequence
  MKO10031396_A_Mki67
  gRNA
guaaccccguuuacuugagu

SEQ ID NO: 31397 - RNA, 20 nt, Artificial Sequence
  MKO10031397_A_Mki67
  gRNA
ccaucauugaccgcuccuuu

SEQ ID NO: 31398 - RNA, 20 nt, Artificial Sequence
  MKO10031398_A_Mki67
  gRNA
uuaauguguaggaaccauca

SEQ ID NO: 31399 - RNA, 20 nt, Artificial Sequence
  MKO10031399_A_Mkks
  gRNA
aauauaggagcaacgccuau

SEQ ID NO: 31400 - RNA, 20 nt, Artificial Sequence
  MKO10031400_A_Mkks
  gRNA
auccucauugacacgaagua

SEQ ID NO: 31401 - RNA, 20 nt, Artificial Sequence
  MKO10031401_A_Mkks
  gRNA
acuggucagauacgcuguca

SEQ ID NO: 31402 - RNA, 20 nt, Artificial Sequence
  MKO10031402_A_Mkl1
  gRNA
cuuccguuucaaauaguccu

SEQ ID NO: 31403 - RNA, 20 nt, Artificial Sequence
  MKO10031403_A_Mkl1
  gRNA
gccuuacccuggcccgcucc

SEQ ID NO: 31404 - RNA, 20 nt, Artificial Sequence
  MKO10031404_A_Mkl1
  gRNA
caccaaugauagccuccuuc

SEQ ID NO: 31405 - RNA, 20 nt, Artificial Sequence
  MKO10031405_A_Mkl2
  gRNA
ucuuacguggcaugaugccc

SEQ ID NO: 31406 - RNA, 20 nt, Artificial Sequence
  MKO10031406_A_Mkl2
  gRNA
gccucauuugccacuagucu

SEQ ID NO: 31407 - RNA, 20 nt, Artificial Sequence
  MKO10031407_A_Mkl2
  gRNA
cccaagacuaguggcaaaug

SEQ ID NO: 31408 - RNA, 20 nt, Artificial Sequence
  MKO10031408_A_Mkln1
  gRNA
guaauauucugaacgauagc

SEQ ID NO: 31409 - RNA, 20 nt, Artificial Sequence
  MKO10031409_A_Mkln1
  gRNA
ccuugucgauucauuaaaau

SEQ ID NO: 31410 - RNA, 20 nt, Artificial Sequence
  MKO10031410_A_Mkln1
  gRNA
cuugcuguaccaguucagac

SEQ ID NO: 31411 - RNA, 20 nt, Artificial Sequence
  MKO10031411_A_Mknk1
  gRNA
ucgaagucgaguguuccgug

SEQ ID NO: 31412 - RNA, 20 nt, Artificial Sequence
  MKO10031412_A_Mknk1
  gRNA
gacgucccgcaccacucuac

SEQ ID NO: 31413 - RNA, 20 nt, Artificial Sequence
  MKO10031413_A_Mknk1
  gRNA
cacucgacuucgacugugcc

SEQ ID NO: 31414 - RNA, 20 nt, Artificial Sequence
  MKO10031414_A_Mknk2
  gRNA
cacguccuguacuaccacgc

SEQ ID NO: 31415 - RNA, 20 nt, Artificial Sequence
  MKO10031415_A_Mknk2
  gRNA
cguuaaaguggcgccuucua

SEQ ID NO: 31416 - RNA, 20 nt, Artificial Sequence
  MKO10031416_A_Mknk2
  gRNA
uuaccuugacagcauauucc

SEQ ID NO: 31417 - RNA, 20 nt, Artificial Sequence
  MKO10031417_A_Mkrn1
  gRNA
gaucccaaagcgacgcucgc

SEQ ID NO: 31418 - RNA, 20 nt, Artificial Sequence
  MKO10031418_A_Mkrn1
  gRNA
guguuuauggagaccgcugc

SEQ ID NO: 31419 - RNA, 20 nt, Artificial Sequence
  MKO10031419_A_Mkrn1
  gRNA
aaccccagcgagcgucgcuu

SEQ ID NO: 31420 - RNA, 20 nt, Artificial Sequence
  MKO10031420_A_Mkrn2
  gRNA
gccuguccugcauccgucaa

SEQ ID NO: 31421 - RNA, 20 nt, Artificial Sequence
  MKO10031421_A_Mkrn2
  gRNA
guugcacucacuuuaugauu

SEQ ID NO: 31422 - RNA, 20 nt, Artificial Sequence
  MKO10031422_A_Mkrn2
  gRNA
uccaaagcgacacuccccag

SEQ ID NO: 31423 - RNA, 20 nt, Artificial Sequence
  MKO10031423_A_Mkrn3
  gRNA
gccucaaacucgccgcgcgc

SEQ ID NO: 31424 - RNA, 20 nt, Artificial Sequence
  MKO10031424_A_Mkrn3
  gRNA
gggaccaugcgaccucggua

SEQ ID NO: 31425 - RNA, 20 nt, Artificial Sequence
  MKO10031425_A_Mkrn3
  gRNA
uagaucuccgccgcccagaa

SEQ ID NO: 31426 - RNA, 20 nt, Artificial Sequence
  MKO10031426_A_Mks1
  gRNA
acaccgcccugacgaagaag

SEQ ID NO: 31427 - RNA, 20 nt, Artificial Sequence
  MKO10031427_A_Mks1
  gRNA
uggcgaacgucaggcggcgg

SEQ ID NO: 31428 - RNA, 20 nt, Artificial Sequence
  MKO10031428_A_Mks1
  gRNA
caguguaagugaagauucgc

SEQ ID NO: 31429 - RNA, 20 nt, Artificial Sequence
  MKO10031429_A_Mkx
  gRNA
uggcgcguccucuuaagcag

SEQ ID NO: 31430 - RNA, 20 nt, Artificial Sequence
  MKO10031430_A_Mkx
  gRNA
cccuuaguagauccgauguc

SEQ ID NO: 31431 - RNA, 20 nt, Artificial Sequence
  MKO10031431_A_Mkx
  gRNA
cucgcagaugacgcuagugc

SEQ ID NO: 31432 - RNA, 20 nt, Artificial Sequence
  MKO10031432_A_Mlana
  gRNA
uaccaccuaccacgggcuga

SEQ ID NO: 31433 - RNA, 20 nt, Artificial Sequence
  MKO10031433_A_Mlana
  gRNA
caggacaaaaggcgucauau

SEQ ID NO: 31434 - RNA, 20 nt, Artificial Sequence
  MKO10031434_A_Mlana
  gRNA
gaucaggaugccgaucccug

SEQ ID NO: 31435 - RNA, 20 nt, Artificial Sequence
  MKO10031435_A_Mlc1
  gRNA
cguaguagucacagcgaacg

SEQ ID NO: 31436 - RNA, 20 nt, Artificial Sequence
  MKO10031436_A_Mlc1
  gRNA
ccgggccgaaaugaucaccg

SEQ ID NO: 31437 - RNA, 20 nt, Artificial Sequence
  MKO10031437_A_Mlc1
  gRNA
cgacucacguuuauggcuga

SEQ ID NO: 31438 - RNA, 20 nt, Artificial Sequence
  MKO10031438_A_Mlec
  gRNA
gguuggaaugaacacuccga

SEQ ID NO: 31439 - RNA, 20 nt, Artificial Sequence
  MKO10031439_A_Mlec
  gRNA
gguccuccgggguggagcgc

SEQ ID NO: 31440 - RNA, 20 nt, Artificial Sequence
  MKO10031440_A_Mlec
  gRNA
caguuucaugccauaguccg

SEQ ID NO: 31441 - RNA, 20 nt, Artificial Sequence
  MKO10031441_A_Mlf1
  gRNA
aaucgucgagaacgugauga

SEQ ID NO: 31442 - RNA, 20 nt, Artificial Sequence
  MKO10031442_A_Mlf1
  gRNA
caucacguucucgacgauua

SEQ ID NO: 31443 - RNA, 20 nt, Artificial Sequence
  MKO10031443_A_Mlf1
  gRNA
gggacacucacgcgaagaag

SEQ ID NO: 31444 - RNA, 20 nt, Artificial Sequence
  MKO10031444_A_Mlf2
  gRNA
uccccaguccggcgguuuca

SEQ ID NO: 31445 - RNA, 20 nt, Artificial Sequence
  MKO10031445_A_Mlf2
  gRNA
agcgcaucuccgacgucucc

SEQ ID NO: 31446 - RNA, 20 nt, Artificial Sequence
  MKO10031446_A_Mlf2
  gRNA
cacaugagccgcauguuguc

SEQ ID NO: 31447 - RNA, 20 nt, Artificial Sequence
  MKO10031447_A_Mlh1
  gRNA
uaccucaccacgaaagccau

SEQ ID NO: 31448 - RNA, 20 nt, Artificial Sequence
  MKO10031448_A_Mlh1
  gRNA
ucaccgugaucagggugccc

SEQ ID NO: 31449 - RNA, 20 nt, Artificial Sequence
  MKO10031449_A_Mlh1
  gRNA
caaccagggcacccugauca

SEQ ID NO: 31450 - RNA, 20 nt, Artificial Sequence
  MKO10031450_A_Mlh3
  gRNA
ugcccaugaacgcauucguu

SEQ ID NO: 31451 - RNA, 20 nt, Artificial Sequence
  MKO10031451_A_Mlh3
  gRNA
auggaugaggauggccgaac

SEQ ID NO: 31452 - RNA, 20 nt, Artificial Sequence
  MKO10031452_A_Mlh3
  gRNA
gcuccaaacgaaugcguuca

SEQ ID NO: 31453 - RNA, 20 nt, Artificial Sequence
  MKO10031453_A_Mlip
  gRNA
gagaucagccccucguacuu

SEQ ID NO: 31454 - RNA, 20 nt, Artificial Sequence
  MKO10031454_A_Mlip
  gRNA
gauacuggauuauccgucag

SEQ ID NO: 31455 - RNA, 20 nt, Artificial Sequence
  MKO10031455_A_Mlip
  gRNA
guuucucgaccagcugcucu

SEQ ID NO: 31456 - RNA, 20 nt, Artificial Sequence
  MKO10031456_A_Mlkl
  gRNA
cccaacaucuugcguauauu

SEQ ID NO: 31457 - RNA, 20 nt, Artificial Sequence
  MKO10031457_A_Mlkl
  gRNA
aggaacaucuuggaccuccg

SEQ ID NO: 31458 - RNA, 20 nt, Artificial Sequence
  MKO10031458_A_Mlkl
  gRNA
ccgauaccuguauaagccuc

SEQ ID NO: 31459 - RNA, 20 nt, Artificial Sequence
  MKO10031459_A_Mllt10
  gRNA
cccacaugaucguuauaaua

SEQ ID NO: 31460 - RNA, 20 nt, Artificial Sequence
  MKO10031460_A_Mllt10
  gRNA
accuuauuauaacgaucaug

SEQ ID NO: 31461 - RNA, 20 nt, Artificial Sequence
  MKO10031461_A_Mllt10
  gRNA
gcagacaauguucaauacug

SEQ ID NO: 31462 - RNA, 20 nt, Artificial Sequence
  MKO10031462_A_Mllt11
  gRNA
uacaccuaccuacgagagca

SEQ ID NO: 31463 - RNA, 20 nt, Artificial Sequence
  MKO10031463_A_Mllt11
  gRNA
uagguguaucugacaggccc

SEQ ID NO: 31464 - RNA, 20 nt, Artificial Sequence
  MKO10031464_A_Mllt11
  gRNA
agcagcguuggcaaaaugaa

SEQ ID NO: 31465 - RNA, 20 nt, Artificial Sequence
  MKO10031465_A_Mllt1
  gRNA
uaggugaugguaaugcccga

SEQ ID NO: 31466 - RNA, 20 nt, Artificial Sequence
  MKO10031466_A_Mllt1
  gRNA
uggugggcuucuuccguagc

SEQ ID NO: 31467 - RNA, 20 nt, Artificial Sequence
  MKO10031467_A_Mllt1
  gRNA
ccucacuaaccuuggagccg

SEQ ID NO: 31468 - RNA, 20 nt, Artificial Sequence
  MKO10031468_A_Mllt3
  gRNA
gacucucuuaccugcgacuu

SEQ ID NO: 31469 - RNA, 20 nt, Artificial Sequence
  MKO10031469_A_Mllt3
  gRNA
ucaggcauaucuagaugagu

SEQ ID NO: 31470 - RNA, 20 nt, Artificial Sequence
  MKO10031470_A_Mllt3
  gRNA
ucugcauucugaugacaacg

SEQ ID NO: 31471 - RNA, 20 nt, Artificial Sequence
  MKO10031471_A_Mllt4
  gRNA
cgccguuucaugacaacuuc

SEQ ID NO: 31472 - RNA, 20 nt, Artificial Sequence
  MKO10031472_A_Mllt4
  gRNA
gaggagagcaugcgcauguc

SEQ ID NO: 31473 - RNA, 20 nt, Artificial Sequence
  MKO10031473_A_Mllt4
  gRNA
caauucaacuguacaacuag

SEQ ID NO: 31474 - RNA, 20 nt, Artificial Sequence
  MKO10031474_A_Mllt6
  gRNA
gccucaugaucgcuucaaca

SEQ ID NO: 31475 - RNA, 20 nt, Artificial Sequence
  MKO10031475_A_Mllt6
  gRNA
guucgccaacgugcucacga

SEQ ID NO: 31476 - RNA, 20 nt, Artificial Sequence
  MKO10031476_A_Mllt6
  gRNA
aagcuugucggcauccgugg

SEQ ID NO: 31477 - RNA, 20 nt, Artificial Sequence
  MKO10031477_A_Mlph
  gRNA
ccccgcagggucgugaagau

SEQ ID NO: 31478 - RNA, 20 nt, Artificial Sequence
  MKO10031478_A_Mlph
  gRNA
ugaagcgagcccucacgugc

SEQ ID NO: 31479 - RNA, 20 nt, Artificial Sequence
  MKO10031479_A_Mlph
  gRNA
ggcacugucgucugcuguuc

SEQ ID NO: 31480 - RNA, 20 nt, Artificial Sequence
  MKO10031480_A_Mlst8
  gRNA
gacuccgucauaacugauga

SEQ ID NO: 31481 - RNA, 20 nt, Artificial Sequence
  MKO10031481_A_Mlst8
  gRNA
aggacugcacagcucgcauc

SEQ ID NO: 31482 - RNA, 20 nt, Artificial Sequence
  MKO10031482_A_Mlst8
  gRNA
cgaagcaugauugcugcugc

SEQ ID NO: 31483 - RNA, 20 nt, Artificial Sequence
  MKO10031483_A_Mlxipl
  gRNA
uuacuggaagcggcgcaucg

SEQ ID NO: 31484 - RNA, 20 nt, Artificial Sequence
  MKO10031484_A_Mlxipl
  gRNA
uucccucagaugugcaacgg

SEQ ID NO: 31485 - RNA, 20 nt, Artificial Sequence
  MKO10031485_A_Mlxipl
  gRNA
ugucccggcauagcaacuug

SEQ ID NO: 31486 - RNA, 20 nt, Artificial Sequence
  MKO10031486_A_Mlxip
  gRNA
cuuggugagcgacgcaucga

SEQ ID NO: 31487 - RNA, 20 nt, Artificial Sequence
  MKO10031487_A_Mlxip
  gRNA
augaucugcugucggcgcgg

SEQ ID NO: 31488 - RNA, 20 nt, Artificial Sequence
  MKO10031488_A_Mlxip
  gRNA
gccggaucuugucccgccac

SEQ ID NO: 31489 - RNA, 20 nt, Artificial Sequence
  MKO10031489_A_Mlx
  gRNA
gagugugcgcacgccgccuc

SEQ ID NO: 31490 - RNA, 20 nt, Artificial Sequence
  MKO10031490_A_Mlx
  gRNA
uagguucacgaugacggagc

SEQ ID NO: 31491 - RNA, 20 nt, Artificial Sequence
  MKO10031491_A_Mlx
  gRNA
cauacucuucuguagaacga

SEQ ID NO: 31492 - RNA, 20 nt, Artificial Sequence
  MKO10031492_A_Mlycd
  gRNA
gugcccuccgacugaaaccg

SEQ ID NO: 31493 - RNA, 20 nt, Artificial Sequence
  MKO10031493_A_Mlycd
  gRNA
auggacaugaagcggcgugu

SEQ ID NO: 31494 - RNA, 20 nt, Artificial Sequence
  MKO10031494_A_Mlycd
  gRNA
cccuugaggcucucgugaac

SEQ ID NO: 31495 - RNA, 20 nt, Artificial Sequence
  MKO10031495_A_Mmaa
  gRNA
auaggacuguccgggccccc

SEQ ID NO: 31496 - RNA, 20 nt, Artificial Sequence
  MKO10031496_A_Mmaa
  gRNA
uccagacuuccgagcgccua

SEQ ID NO: 31497 - RNA, 20 nt, Artificial Sequence
  MKO10031497_A_Mmaa
  gRNA
gcgcacucaaguugcuccgu

SEQ ID NO: 31498 - RNA, 20 nt, Artificial Sequence
  MKO10031498_A_Mmab
  gRNA
cgacguccuguagcaugcac

SEQ ID NO: 31499 - RNA, 20 nt, Artificial Sequence
  MKO10031499_A_Mmab
  gRNA
caggcugcagccguccucga

SEQ ID NO: 31500 - RNA, 20 nt, Artificial Sequence
  MKO10031500_A_Mmab
  gRNA
ugaucaaguauuugaagccg

SEQ ID NO: 31501 - RNA, 20 nt, Artificial Sequence
  MKO10031501_A_Mmachc
  gRNA
gugugcauacacccccgauu

SEQ ID NO: 31502 - RNA, 20 nt, Artificial Sequence
  MKO10031502_A_Mmachc
  gRNA
gcugucugggcgagaaucuu

SEQ ID NO: 31503 - RNA, 20 nt, Artificial Sequence
  MKO10031503_A_Mmachc
  gRNA
gggcugguuugccauccgag

SEQ ID NO: 31504 - RNA, 20 nt, Artificial Sequence
  MKO10031504_A_Mmadhc
  gRNA
ggcuucgauugucaccucaa

SEQ ID NO: 31505 - RNA, 20 nt, Artificial Sequence
  MKO10031505_A_Mmadhc
  gRNA
caaucgaagccuauauuccc

SEQ ID NO: 31506 - RNA, 20 nt, Artificial Sequence
  MKO10031506_A_Mmadhc
  gRNA
cuggaucgcacacucaacuu

SEQ ID NO: 31507 - RNA, 20 nt, Artificial Sequence
  MKO10031507_A_Mmd2
  gRNA
gcugguaccucuugugcgcc

SEQ ID NO: 31508 - RNA, 20 nt, Artificial Sequence
  MKO10031508_A_Mmd2
  gRNA
acugccugcacaugaucgac

SEQ ID NO: 31509 - RNA, 20 nt, Artificial Sequence
  MKO10031509_A_Mmd2
  gRNA
uauggucucccagucgucau

SEQ ID NO: 31510 - RNA, 20 nt, Artificial Sequence
  MKO10031510_A_Mmd
  gRNA
ugaccauccgaucgcacaug

SEQ ID NO: 31511 - RNA, 20 nt, Artificial Sequence
  MKO10031511_A_Mmd
  gRNA
cccuggcaucucauaugcgu

SEQ ID NO: 31512 - RNA, 20 nt, Artificial Sequence
  MKO10031512_A_Mmd
  gRNA
gcuaucuuaccauggggcgu

SEQ ID NO: 31513 - RNA, 20 nt, Artificial Sequence
  MKO10031513_A_Mmel1
  gRNA
gccagccuccgcaagcguac

SEQ ID NO: 31514 - RNA, 20 nt, Artificial Sequence
  MKO10031514_A_Mmel1
  gRNA
aacuucuaccaguacgcuug

SEQ ID NO: 31515 - RNA, 20 nt, Artificial Sequence
  MKO10031515_A_Mmel1
  gRNA
gagaggacgguuguaaaacg

SEQ ID NO: 31516 - RNA, 20 nt, Artificial Sequence
  MKO10031516_A_Mme
  gRNA
ugcucgacugauucagaaua

SEQ ID NO: 31517 - RNA, 20 nt, Artificial Sequence
  MKO10031517_A_Mme
  gRNA
ggccaguagcaucagauaac

SEQ ID NO: 31518 - RNA, 20 nt, Artificial Sequence
  MKO10031518_A_Mme
  gRNA
ucccaguuaucugaugcuac

SEQ ID NO: 31519 - RNA, 20 nt, Artificial Sequence
  MKO10031519_A_Mmgu1
  gRNA
ggaacagcacucgaccacga

SEQ ID NO: 31520 - RNA, 20 nt, Artificial Sequence
  MKO10031520_A_Mmgu1
  gRNA
gaaucauggcgccgucgcug

SEQ ID NO: 31521 - RNA, 20 nt, Artificial Sequence
  MKO10031521_A_Mmgu1
  gRNA
uauggcauaguucauaucgc

SEQ ID NO: 31522 - RNA, 20 nt, Artificial Sequence
  MKO10031522_A_Mmgu2
  gRNA
ugcgcuuaccuguuacggcg

SEQ ID NO: 31523 - RNA, 20 nt, Artificial Sequence
  MKO10031523_A_Mmgu2
  gRNA
agaacuauauccgccggcag

SEQ ID NO: 31524 - RNA, 20 nt, Artificial Sequence
  MKO10031524_A_Mmgu2
  gRNA
aguaugaaccacgccguaac

SEQ ID NO: 31525 - RNA, 20 nt, Artificial Sequence
  MKO10031525_A_Mmp10
  gRNA
caaguucaugggcugcaacc

SEQ ID NO: 31526 - RNA, 20 nt, Artificial Sequence
  MKO10031526_A_Mmp10
  gRNA
cuuguggagaaccuguagac

SEQ ID NO: 31527 - RNA, 20 nt, Artificial Sequence
  MKO10031527_A_Mmp10
  gRNA
cuggcucaugccuacccacc

SEQ ID NO: 31528 - RNA, 20 nt, Artificial Sequence
  MKO10031528_A_Mmp11
  gRNA
cgaagcgcuucugucgguuc

SEQ ID NO: 31529 - RNA, 20 nt, Artificial Sequence
  MKO10031529_A_Mmp11
  gRNA
gccuuagcccagaugaccga

SEQ ID NO: 31530 - RNA, 20 nt, Artificial Sequence
  MKO10031530_A_Mmp11
  gRNA
aacuugccguuugacgggcc

SEQ ID NO: 31531 - RNA, 20 nt, Artificial Sequence
  MKO10031531_A_Mmp12
  gRNA
auaaugcacaucccucgaug

SEQ ID NO: 31532 - RNA, 20 nt, Artificial Sequence
  MKO10031532_A_Mmp12
  gRNA
acauccucacgcuucauguc

SEQ ID NO: 31533 - RNA, 20 nt, Artificial Sequence
  MKO10031533_A_Mmp12
  gRNA
uacguaugucaucagcagag

SEQ ID NO: 31534 - RNA, 20 nt, Artificial Sequence
  MKO10031534_A_Mmp13
  gRNA
accuguaaguuaaguucguu

SEQ ID NO: 31535 - RNA, 20 nt, Artificial Sequence
  MKO10031535_A_Mmp13
  gRNA
cuaccauccugcgacucuug

SEQ ID NO: 31536 - RNA, 20 nt, Artificial Sequence
  MKO10031536_A_Mmp13
  gRNA
ugggcauccccaccauaguu

SEQ ID NO: 31537 - RNA, 20 nt, Artificial Sequence
  MKO10031537_A_Mmp14
  gRNA
gggcgaguaugccacauucg

SEQ ID NO: 31538 - RNA, 20 nt, Artificial Sequence
  MKO10031538_A_Mmp14
  gRNA
augccacggcgaucgucauc

SEQ ID NO: 31539 - RNA, 20 nt, Artificial Sequence
  MKO10031539_A_Mmp14
  gRNA
uugccugaugacgaucgccg

SEQ ID NO: 31540 - RNA, 20 nt, Artificial Sequence
  MKO10031540_A_Mmp15
  gRNA
aacguuuccgccgucgacgc

SEQ ID NO: 31541 - RNA, 20 nt, Artificial Sequence
  MKO10031541_A_Mmp15
  gRNA
ucguagccgaaugucaucau

SEQ ID NO: 31542 - RNA, 20 nt, Artificial Sequence
  MKO10031542_A_Mmp15
  gRNA
ugaaagccaaccugcgucga

SEQ ID NO: 31543 - RNA, 20 nt, Artificial Sequence
  MKO10031543_A_Mmp16
  gRNA
cgaaagcgcuacgcauuaac

SEQ ID NO: 31544 - RNA, 20 nt, Artificial Sequence
  MKO10031544_A_Mmp16
  gRNA
caugauagcgguggggucgu

SEQ ID NO: 31545 - RNA, 20 nt, Artificial Sequence
  MKO10031545_A_Mmp16
  gRNA
caacgaccccaccgcuauca

SEQ ID NO: 31546 - RNA, 20 nt, Artificial Sequence
  MKO10031546_A_Mmp17
  gRNA
aaugacggcuaccccuucga

SEQ ID NO: 31547 - RNA, 20 nt, Artificial Sequence
  MKO10031547_A_Mmp17
  gRNA
gugggugacccgcuacgcua

SEQ ID NO: 31548 - RNA, 20 nt, Artificial Sequence
  MKO10031548_A_Mmp17
  gRNA
cgaagggguagccgucauug

SEQ ID NO: 31549 - RNA, 20 nt, Artificial Sequence
  MKO10031549_A_Mmp19
  gRNA
ugggcacucccgauauaccc

SEQ ID NO: 31550 - RNA, 20 nt, Artificial Sequence
  MKO10031550_A_Mmp19
  gRNA
gucauccaucugaccggaaa

SEQ ID NO: 31551 - RNA, 20 nt, Artificial Sequence
  MKO10031551_A_Mmp19
  gRNA
cguaugaagcagccccguug

SEQ ID NO: 31552 - RNA, 20 nt, Artificial Sequence
  MKO10031552_A_Mmp1a
  gRNA
uucaguguaccacguguaac

SEQ ID NO: 31553 - RNA, 20 nt, Artificial Sequence
  MKO10031553_A_Mmp1a
  gRNA
auuaugaccuugaugagacg

SEQ ID NO: 31554 - RNA, 20 nt, Artificial Sequence
  MKO10031554_A_Mmp1a
  gRNA
cucacucauucuagugauau

SEQ ID NO: 31555 - RNA, 20 nt, Artificial Sequence
  MKO10031555_A_Mmp1b
  gRNA
aaucgcauccaggccuuaua

SEQ ID NO: 31556 - RNA, 20 nt, Artificial Sequence
  MKO10031556_A_Mmp1b
  gRNA
caacuuacccucauuguugu

SEQ ID NO: 31557 - RNA, 20 nt, Artificial Sequence
  MKO10031557_A_Mmp1b
  gRNA
uuuauugcuccauguguagc

SEQ ID NO: 31558 - RNA, 20 nt, Artificial Sequence
  MKO10031558_A_Mmp20
  gRNA
aggcgguaguuagccacauc

SEQ ID NO: 31559 - RNA, 20 nt, Artificial Sequence
  MKO10031559_A_Mmp20
  gRNA
cagcuguacuccacgcaugc

SEQ ID NO: 31560 - RNA, 20 nt, Artificial Sequence
  MKO10031560_A_Mmp20
  gRNA
ggugaaaucuauagggguuc

SEQ ID NO: 31561 - RNA, 20 nt, Artificial Sequence
  MKO10031561_A_Mmp21
  gRNA
ucgaugccuacguccauguc

SEQ ID NO: 31562 - RNA, 20 nt, Artificial Sequence
  MKO10031562_A_Mmp21
  gRNA
ucuacgaaaaccgcaacaac

SEQ ID NO: 31563 - RNA, 20 nt, Artificial Sequence
  MKO10031563_A_Mmp21
  gRNA
ugugaggcaauccgaggacg

SEQ ID NO: 31564 - RNA, 20 nt, Artificial Sequence
  MKO10031564_A_Mmp23
  gRNA
acgccgcuacacgcugacac

SEQ ID NO: 31565 - RNA, 20 nt, Artificial Sequence
  MKO10031565_A_Mmp23
  gRNA
ucagcguguagcggcgucuu

SEQ ID NO: 31566 - RNA, 20 nt, Artificial Sequence
  MKO10031566_A_Mmp23
  gRNA
uaagcccggaagagacgcga

SEQ ID NO: 31567 - RNA, 20 nt, Artificial Sequence
  MKO10031567_A_Mmp24
  gRNA
cgcagaugcccgcgacucau

SEQ ID NO: 31568 - RNA, 20 nt, Artificial Sequence
  MKO10031568_A_Mmp24
  gRNA
acacaacuucaagcuaccgc

SEQ ID NO: 31569 - RNA, 20 nt, Artificial Sequence
  MKO10031569_A_Mmp24
  gRNA
uucgucaggcuuucgaugug

SEQ ID NO: 31570 - RNA, 20 nt, Artificial Sequence
  MKO10031570_A_Mmp25
  gRNA
gcguggacaggauccgccgg

SEQ ID NO: 31571 - RNA, 20 nt, Artificial Sequence
  MKO10031571_A_Mmp25
  gRNA
cacucagagaauagcgacgu

SEQ ID NO: 31572 - RNA, 20 nt, Artificial Sequence
  MKO10031572_A_Mmp25
  gRNA
auccuggggcaaacgguaug

SEQ ID NO: 31573 - RNA, 20 nt, Artificial Sequence
  MKO10031573_A_Mmp27
  gRNA
augcuaucacuacuuuccgc

SEQ ID NO: 31574 - RNA, 20 nt, Artificial Sequence
  MKO10031574_A_Mmp27
  gRNA
gauacuaaccauagauggac

SEQ ID NO: 31575 - RNA, 20 nt, Artificial Sequence
  MKO10031575_A_Mmp27
  gRNA
uugcgaucaugaaagugccc

SEQ ID NO: 31576 - RNA, 20 nt, Artificial Sequence
  MKO10031576_A_Mmp28
  gRNA
cgcacggccccucgaacagc

SEQ ID NO: 31577 - RNA, 20 nt, Artificial Sequence
  MKO10031577_A_Mmp28
  gRNA
gcgggucaucuggcgcagug

SEQ ID NO: 31578 - RNA, 20 nt, Artificial Sequence
  MKO10031578_A_Mmp28
  gRNA
gggcuggccaacgccuucga

SEQ ID NO: 31579 - RNA, 20 nt, Artificial Sequence
  MKO10031579_A_Mmp2
  gRNA
gcagugguccgcguaaagua

SEQ ID NO: 31580 - RNA, 20 nt, Artificial Sequence
  MKO10031580_A_Mmp2
  gRNA
uguauucccgaccguugaac

SEQ ID NO: 31581 - RNA, 20 nt, Artificial Sequence
  MKO10031581_A_Mmp2
  gRNA
aaguuguaguuggccacauc

SEQ ID NO: 31582 - RNA, 20 nt, Artificial Sequence
  MKO10031582_A_Mmp3
  gRNA
acuuugacgaugaugaacga

SEQ ID NO: 31583 - RNA, 20 nt, Artificial Sequence
  MKO10031583_A_Mmp3
  gRNA
aauagguaccaaccuauucc

SEQ ID NO: 31584 - RNA, 20 nt, Artificial Sequence
  MKO10031584_A_Mmp3
  gRNA
ugagcaucuccauuaauccc

SEQ ID NO: 31585 - RNA, 20 nt, Artificial Sequence
  MKO10031585_A_Mmp7
  gRNA
auuugauccacuacgauccg

SEQ ID NO: 31586 - RNA, 20 nt, Artificial Sequence
  MKO10031586_A_Mmp7
  gRNA
caaagugagcaucuccgccu

SEQ ID NO: 31587 - RNA, 20 nt, Artificial Sequence
  MKO10031587_A_Mmp7
  gRNA
gggacugcggauaucauaau

SEQ ID NO: 31588 - RNA, 20 nt, Artificial Sequence
  MKO10031588_A_Mmp8
  gRNA
gaccuucaccgagaucuuac

SEQ ID NO: 31589 - RNA, 20 nt, Artificial Sequence
  MKO10031589_A_Mmp8
  gRNA
acuuaccaagcaaucaauuc

SEQ ID NO: 31590 - RNA, 20 nt, Artificial Sequence
  MKO10031590_A_Mmp8
  gRNA
aagcuucucugcaaccaucg

SEQ ID NO: 31591 - RNA, 20 nt, Artificial Sequence
  MKO10031591_A_Mmp9
  gRNA
acaacucgucgucgucgaaa

SEQ ID NO: 31592 - RNA, 20 nt, Artificial Sequence
  MKO10031592_A_Mmp9
  gRNA
auuucgacgacgacgaguug

SEQ ID NO: 31593 - RNA, 20 nt, Artificial Sequence
  MKO10031593_A_Mmp9
  gRNA
cggcccggguguaaccauag

SEQ ID NO: 31594 - RNA, 20 nt, Artificial Sequence
  MKO10031594_A_Mmrn1
  gRNA
guuauccccgacagugauac

SEQ ID NO: 31595 - RNA, 20 nt, Artificial Sequence
  MKO10031595_A_Mmrn1
  gRNA
agucacaccgcuguugacca

SEQ ID NO: 31596 - RNA, 20 nt, Artificial Sequence
  MKO10031596_A_Mmrn1
  gRNA
cagcggugugacuuucagcc

SEQ ID NO: 31597 - RNA, 20 nt, Artificial Sequence
  MKO10031597_A_Mmrn2
  gRNA
gguguccuuaccagaagucc

SEQ ID NO: 31598 - RNA, 20 nt, Artificial Sequence
  MKO10031598_A_Mmrn2
  gRNA
accuuaaucucauuaaacuc

SEQ ID NO: 31599 - RNA, 20 nt, Artificial Sequence
  MKO10031599_A_Mmrn2
  gRNA
aaagccaucuucuacugacu

SEQ ID NO: 31600 - RNA, 20 nt, Artificial Sequence
  MKO10031600_A_Mms19
  gRNA
gcuccucgagcccgaguucg

SEQ ID NO: 31601 - RNA, 20 nt, Artificial Sequence
  MKO10031601_A_Mms19
  gRNA
ccuaccgcagagcaugucug

SEQ ID NO: 31602 - RNA, 20 nt, Artificial Sequence
  MKO10031602_A_Mms19
  gRNA
aaaaugcugaaccccgaacu

SEQ ID NO: 31603 - RNA, 20 nt, Artificial Sequence
  MKO10031603_A_Mms22l
  gRNA
cguggauuacuucuguacau

SEQ ID NO: 31604 - RNA, 20 nt, Artificial Sequence
  MKO10031604_A_Mms22l
  gRNA
acgccaaagcagacaguauu

SEQ ID NO: 31605 - RNA, 20 nt, Artificial Sequence
  MKO10031605_A_Mms22l
  gRNA
agcucaucgaccaacaugga

SEQ ID NO: 31606 - RNA, 20 nt, Artificial Sequence
  MKO10031606_A_Mn1
  gRNA
gcugcgcgcaugaaagccgu

SEQ ID NO: 31607 - RNA, 20 nt, Artificial Sequence
  MKO10031607_A_Mn1
  gRNA
cgucgcuccgacggagcguu

SEQ ID NO: 31608 - RNA, 20 nt, Artificial Sequence
  MKO10031608_A_Mn1
  gRNA
ucugauaucuccaaccgauu

SEQ ID NO: 31609 - RNA, 20 nt, Artificial Sequence
  MKO10031609_A_Mnau1
  gRNA
gccgucgcugcucauguucu

SEQ ID NO: 31610 - RNA, 20 nt, Artificial Sequence
  MKO10031610_A_Mnau1
  gRNA
gcuuaccagcucaucuaaaa

SEQ ID NO: 31611 - RNA, 20 nt, Artificial Sequence
  MKO10031611_A_Mnau1
  gRNA
ugaagaucccacuguugaua

SEQ ID NO: 31612 - RNA, 20 nt, Artificial Sequence
  MKO10031612_A_Mnd1
  gRNA
acaaacauaccgucucuugc

SEQ ID NO: 31613 - RNA, 20 nt, Artificial Sequence
  MKO10031613_A_Mnd1
  gRNA
agccuccaacuugcgcuucc

SEQ ID NO: 31614 - RNA, 20 nt, Artificial Sequence
  MKO10031614_A_Mnd1
  gRNA
ucaugccaggaagcgcaagu

SEQ ID NO: 31615 - RNA, 20 nt, Artificial Sequence
  MKO10031615_A_Mndal
  gRNA
aaagcuuguaccguagcuga

SEQ ID NO: 31616 - RNA, 20 nt, Artificial Sequence
  MKO10031616_A_Mndal
  gRNA
aaagcgaucgcaaaaacuga

SEQ ID NO: 31617 - RNA, 20 nt, Artificial Sequence
  MKO10031617_A_Mndal
  gRNA
aucuaacauuccuucagcua

SEQ ID NO: 31618 - RNA, 20 nt, Artificial Sequence
  MKO10031618_A_Mnda
  gRNA
aucuaacauucuuucggcua

SEQ ID NO: 31619 - RNA, 20 nt, Artificial Sequence
  MKO10031619_A_Mnda
  gRNA
uucaggaagcauagaaguug

SEQ ID NO: 31620 - RNA, 20 nt, Artificial Sequence
  MKO10031620_A_Mnda
  gRNA
uggugacuggcacauggcug

SEQ ID NO: 31621 - RNA, 20 nt, Artificial Sequence
  MKO10031621_A_Mns1
  gRNA
cuuguuccgccgcucuugcu

SEQ ID NO: 31622 - RNA, 20 nt, Artificial Sequence
  MKO10031622_A_Mns1
  gRNA
ugagcaguuugagcucgaca

SEQ ID NO: 31623 - RNA, 20 nt, Artificial Sequence
  MKO10031623_A_Mns1
  gRNA
gcaaaaugaaaacgacgaga

SEQ ID NO: 31624 - RNA, 20 nt, Artificial Sequence
  MKO10031624_A_Mnt
  gRNA
uggcgaucuucucccgcgca

SEQ ID NO: 31625 - RNA, 20 nt, Artificial Sequence
  MKO10031625_A_Mnt
  gRNA
gaagcgcaacauccccaacg

SEQ ID NO: 31626 - RNA, 20 nt, Artificial Sequence
  MKO10031626_A_Mnt
  gRNA
cuucgaaucugagcgugcug

SEQ ID NO: 31627 - RNA, 20 nt, Artificial Sequence
  MKO10031627_A_Mnx1
  gRNA
caguagacgcgcgcagccac

SEQ ID NO: 31628 - RNA, 20 nt, Artificial Sequence
  MKO10031628_A_Mnx1
  gRNA
gaccagauacuguagucgcg

SEQ ID NO: 31629 - RNA, 20 nt, Artificial Sequence
  MKO10031629_A_Mnx1
  gRNA
ccaagagguucgacugcgcc

SEQ ID NO: 31630 - RNA, 20 nt, Artificial Sequence
  MKO10031630_A_Moap1
  gRNA
cgucuagaccaagucauugc

SEQ ID NO: 31631 - RNA, 20 nt, Artificial Sequence
  MKO10031631_A_Moap1
  gRNA
gcaaccaauagugcuuuccg

SEQ ID NO: 31632 - RNA, 20 nt, Artificial Sequence
  MKO10031632_A_Moap1
  gRNA
ucgagcacccauguuagcac

SEQ ID NO: 31633 - RNA, 20 nt, Artificial Sequence
  MKO10031633_A_Mob1a
  gRNA
cugggaccugccgacaugac

SEQ ID NO: 31634 - RNA, 20 nt, Artificial Sequence
  MKO10031634_A_Mob1a
  gRNA
ugacuccgugaugcagcugc

SEQ ID NO: 31635 - RNA, 20 nt, Artificial Sequence
  MKO10031635_A_Mob1a
  gRNA
agcugcccagucaugucggc

SEQ ID NO: 31636 - RNA, 20 nt, Artificial Sequence
  MKO10031636_A_Mob1b
  gRNA
cacugggcagcggcaaccua

SEQ ID NO: 31637 - RNA, 20 nt, Artificial Sequence
  MKO10031637_A_Mob1b
  gRNA
gaagcaugacagccauccgu

SEQ ID NO: 31638 - RNA, 20 nt, Artificial Sequence
  MKO10031638_A_Mob1b
  gRNA
cccgaagaauuucaugucag

SEQ ID NO: 31639 - RNA, 20 nt, Artificial Sequence
  MKO10031639_A_Mob2
  gRNA
gggagaucgaccucaacgag

SEQ ID NO: 31640 - RNA, 20 nt, Artificial Sequence
  MKO10031640_A_Mob2
  gRNA
auuuggugugcuccggcucc

SEQ ID NO: 31641 - RNA, 20 nt, Artificial Sequence
  MKO10031641_A_Mob2
  gRNA
ccccaaagaaaccgcuguca

SEQ ID NO: 31642 - RNA, 20 nt, Artificial Sequence
  MKO10031642_A_Mob3a
  gRNA
uuucgaccgcaucgcccaga

SEQ ID NO: 31643 - RNA, 20 nt, Artificial Sequence
  MKO10031643_A_Mob3a
  gRNA
gccugacucaccgacauuag

SEQ ID NO: 31644 - RNA, 20 nt, Artificial Sequence
  MKO10031644_A_Mob3a
  gRNA
aguucgaagcgcugcgugcc

SEQ ID NO: 31645 - RNA, 20 nt, Artificial Sequence
  MKO10031645_A_Mob3b
  gRNA
ucagguccacacccgaguug

SEQ ID NO: 31646 - RNA, 20 nt, Artificial Sequence
  MKO10031646_A_Mob3b
  gRNA
gcagccgugcaguuacccaa

SEQ ID NO: 31647 - RNA, 20 nt, Artificial Sequence
  MKO10031647_A_Mob3b
  gRNA
gaugaaccucauagaccgca

SEQ ID NO: 31648 - RNA, 20 nt, Artificial Sequence
  MKO10031648_A_Mob3c
  gRNA
ggccccgcuacgaguaccgc

SEQ ID NO: 31649 - RNA, 20 nt, Artificial Sequence
  MKO10031649_A_Mob3c
  gRNA
aggacgagcgucaguaccga

SEQ ID NO: 31650 - RNA, 20 nt, Artificial Sequence
  MKO10031650_A_Mob3c
  gRNA
agacucggaagagucggguc

SEQ ID NO: 31651 - RNA, 20 nt, Artificial Sequence
  MKO10031651_A_Mob4
  gRNA
caauucugccuugaacuaaa

SEQ ID NO: 31652 - RNA, 20 nt, Artificial Sequence
  MKO10031652_A_Mob4
  gRNA
cagcaaguccauuuaguuca

SEQ ID NO: 31653 - RNA, 20 nt, Artificial Sequence
  MKO10031653_A_Mob4
  gRNA
aguugcugucaucugaguac

SEQ ID NO: 31654 - RNA, 20 nt, Artificial Sequence
  MKO10031654_A_Mobp
  gRNA
caacuccaagcgugagaucg

SEQ ID NO: 31655 - RNA, 20 nt, Artificial Sequence
  MKO10031655_A_Mobp
  gRNA
cgaucucacgcuuggaguug

SEQ ID NO: 31656 - RNA, 20 nt, Artificial Sequence
  MKO10031656_A_Mobp
  gRNA
gccgugccacguccccucag

SEQ ID NO: 31657 - RNA, 20 nt, Artificial Sequence
  MKO10031657_A_Mocos
  gRNA
gcuucagcgcuauuacaucg

SEQ ID NO: 31658 - RNA, 20 nt, Artificial Sequence
  MKO10031658_A_Mocos
  gRNA
gauguaauagcgcugaagca

SEQ ID NO: 31659 - RNA, 20 nt, Artificial Sequence
  MKO10031659_A_Mocos
  gRNA
uauugacuagcagagcaccc

SEQ ID NO: 31660 - RNA, 20 nt, Artificial Sequence
  MKO10031660_A_Mocs1
  gRNA
ccaacggcaucaaccuagcc

SEQ ID NO: 31661 - RNA, 20 nt, Artificial Sequence
  MKO10031661_A_Mocs1
  gRNA
ccgggcuagguugaugccgu

SEQ ID NO: 31662 - RNA, 20 nt, Artificial Sequence
  MKO10031662_A_Mocs1
  gRNA
ugccgcacuauuccgaacgc

SEQ ID NO: 31663 - RNA, 20 nt, Artificial Sequence
  MKO10031663_A_Mocs2
  gRNA
cgucaagaguaugucgagcu

SEQ ID NO: 31664 - RNA, 20 nt, Artificial Sequence
  MKO10031664_A_Mocs2
  gRNA
gaaagauguggacgaugucc

SEQ ID NO: 31665 - RNA, 20 nt, Artificial Sequence
  MKO10031665_A_Mocs2
  gRNA
aauggucuccgagcgaacuc

SEQ ID NO: 31666 - RNA, 20 nt, Artificial Sequence
  MKO10031666_A_Mocs3
  gRNA
caacgugcccacgcgcuacc

SEQ ID NO: 31667 - RNA, 20 nt, Artificial Sequence
  MKO10031667_A_Mocs3
  gRNA
gaucucgucccgcgacagcg

SEQ ID NO: 31668 - RNA, 20 nt, Artificial Sequence
  MKO10031668_A_Mocs3
  gRNA
cguccggccucaaguagagg

SEQ ID NO: 31669 - RNA, 20 nt, Artificial Sequence
  MKO10031669_A_Mogau1
  gRNA
ccucauggaauauucgugcc

SEQ ID NO: 31670 - RNA, 20 nt, Artificial Sequence
  MKO10031670_A_Mogau1
  gRNA
cugugcauccgccagcgcaa

SEQ ID NO: 31671 - RNA, 20 nt, Artificial Sequence
  MKO10031671_A_Mogau1
  gRNA
gcgccuccuuugcaccuccg

SEQ ID NO: 31672 - RNA, 20 nt, Artificial Sequence
  MKO10031672_A_Mogau2
  gRNA
cccuucccggaacuacaucg

SEQ ID NO: 31673 - RNA, 20 nt, Artificial Sequence
  MKO10031673_A_Mogau2
  gRNA
cugcgcgcccccaacgauga

SEQ ID NO: 31674 - RNA, 20 nt, Artificial Sequence
  MKO10031674_A_Mogau2
  gRNA
ggaagcccgcgauguaguuc

SEQ ID NO: 31675 - RNA, 20 nt, Artificial Sequence
  MKO10031675_A_Mogs
  gRNA
ccacacggcaccucgccagu

SEQ ID NO: 31676 - RNA, 20 nt, Artificial Sequence
  MKO10031676_A_Mogs
  gRNA
cgcuggccuucggccugucg

SEQ ID NO: 31677 - RNA, 20 nt, Artificial Sequence
  MKO10031677_A_Mogs
  gRNA
ucggcagcauauccacgaug

SEQ ID NO: 31678 - RNA, 20 nt, Artificial Sequence
  MKO10031678_A_Mog
  gRNA
uaucccauccgggcuuuagu

SEQ ID NO: 31679 - RNA, 20 nt, Artificial Sequence
  MKO10031679_A_Mog
  gRNA
cugccgugccgcaucucucc

SEQ ID NO: 31680 - RNA, 20 nt, Artificial Sequence
  MKO10031680_A_Mog
  gRNA
ugaacuuaccaaaaguccga

SEQ ID NO: 31681 - RNA, 20 nt, Artificial Sequence
  MKO10031681_A_Mon1a
  gRNA
uucgcuccgagcccgagagc

SEQ ID NO: 31682 - RNA, 20 nt, Artificial Sequence
  MKO10031682_A_Mon1a
  gRNA
ccaaauggguuccccgcuuu

SEQ ID NO: 31683 - RNA, 20 nt, Artificial Sequence
  MKO10031683_A_Mon1a
  gRNA
uggcgcauguccguagccag

SEQ ID NO: 31684 - RNA, 20 nt, Artificial Sequence
  MKO10031684_A_Mon1b
  gRNA
gcuaccguaccgugaguaga

SEQ ID NO: 31685 - RNA, 20 nt, Artificial Sequence
  MKO10031685_A_Mon1b
  gRNA
ugccggcgcuuaguugaaga

SEQ ID NO: 31686 - RNA, 20 nt, Artificial Sequence
  MKO10031686_A_Mon1b
  gRNA
ggugcaccagccuucgcggc

SEQ ID NO: 31687 - RNA, 20 nt, Artificial Sequence
  MKO10031687_A_Mon2
  gRNA
guccugcaccaacagccccg

SEQ ID NO: 31688 - RNA, 20 nt, Artificial Sequence
  MKO10031688_A_Mon2
  gRNA
ccuuggucccacaccccauu

SEQ ID NO: 31689 - RNA, 20 nt, Artificial Sequence
  MKO10031689_A_Mon2
  gRNA
agaauaugcagagcgaccug

SEQ ID NO: 31690 - RNA, 20 nt, Artificial Sequence
  MKO10031690_A_Morc1
  gRNA
aauaugguaacgggcuuaag

SEQ ID NO: 31691 - RNA, 20 nt, Artificial Sequence
  MKO10031691_A_Morc1
  gRNA
cacaucgagucuuacagccc

SEQ ID NO: 31692 - RNA, 20 nt, Artificial Sequence
  MKO10031692_A_Morc1
  gRNA
auauugcccgaugaacuuca

SEQ ID NO: 31693 - RNA, 20 nt, Artificial Sequence
  MKO10031693_A_Morc2a
  gRNA
accacucaugaauucuuauu

SEQ ID NO: 31694 - RNA, 20 nt, Artificial Sequence
  MKO10031694_A_Morc2a
  gRNA
gccauacugcccaauuugag

SEQ ID NO: 31695 - RNA, 20 nt, Artificial Sequence
  MKO10031695_A_Morc2a
  gRNA
aaagcauaaauccuccucga

SEQ ID NO: 31696 - RNA, 20 nt, Artificial Sequence
  MKO10031696_A_Morc2b
  gRNA
cccgacgaagaccucagucc

SEQ ID NO: 31697 - RNA, 20 nt, Artificial Sequence
  MKO10031697_A_Morc2b
  gRNA
uauuuacgcugaaaagcgag

SEQ ID NO: 31698 - RNA, 20 nt, Artificial Sequence
  MKO10031698_A_Morc2b
  gRNA
cccguaccgcccaaucugug

SEQ ID NO: 31699 - RNA, 20 nt, Artificial Sequence
  MKO10031699_A_Morc3
  gRNA
uguuuguugaacgucacgau

SEQ ID NO: 31700 - RNA, 20 nt, Artificial Sequence
  MKO10031700_A_Morc3
  gRNA
ccauucccguacaauccaac

SEQ ID NO: 31701 - RNA, 20 nt, Artificial Sequence
  MKO10031701_A_Morc3
  gRNA
caaauucuacuagucauacc

SEQ ID NO: 31702 - RNA, 20 nt, Artificial Sequence
  MKO10031702_A_Morc4
  gRNA
guacaauaaccgccugcgcc

SEQ ID NO: 31703 - RNA, 20 nt, Artificial Sequence
  MKO10031703_A_Morc4
  gRNA
ccgcaggggccccucgguac

SEQ ID NO: 31704 - RNA, 20 nt, Artificial Sequence
  MKO10031704_A_Morc4
  gRNA
gcgacccuucagugccaucg

SEQ ID NO: 31705 - RNA, 20 nt, Artificial Sequence
  MKO10031705_A_Morf4l1
  gRNA
gccucuucucuaugaagcaa

SEQ ID NO: 31706 - RNA, 20 nt, Artificial Sequence
  MKO10031706_A_Morf4l1
  gRNA
accuuugcuucauagagaag

SEQ ID NO: 31707 - RNA, 20 nt, Artificial Sequence
  MKO10031707_A_Morf4l1
  gRNA
cacucacccuccuggaauuu

SEQ ID NO: 31708 - RNA, 20 nt, Artificial Sequence
  MKO10031708_A_Morf4l2
  gRNA
ucuuccgcacagaaccggaa

SEQ ID NO: 31709 - RNA, 20 nt, Artificial Sequence
  MKO10031709_A_Morf4l2
  gRNA
caauucucacgaauaaucuc

SEQ ID NO: 31710 - RNA, 20 nt, Artificial Sequence
  MKO10031710_A_Morf4l2
  gRNA
ucccugcgacuucuuacaau

SEQ ID NO: 31711 - RNA, 20 nt, Artificial Sequence
  MKO10031711_A_Morn1
  gRNA
uuacuacgaaggcgaauuug

SEQ ID NO: 31712 - RNA, 20 nt, Artificial Sequence
  MKO10031712_A_Morn1
  gRNA
uucaugacgccgugcccuug

SEQ ID NO: 31713 - RNA, 20 nt, Artificial Sequence
  MKO10031713_A_Morn1
  gRNA
cuccccuucauagcgaccuc

SEQ ID NO: 31714 - RNA, 20 nt, Artificial Sequence
  MKO10031714_A_Morn2
  gRNA
ccaguguacuuugccccagu

SEQ ID NO: 31715 - RNA, 20 nt, Artificial Sequence
  MKO10031715_A_Morn2
  gRNA
gggacuuacacauucccaac

SEQ ID NO: 31716 - RNA, 20 nt, Artificial Sequence
  MKO10031716_A_Morn2
  gRNA
ggaaguuaccacaccacugc

SEQ ID NO: 31717 - RNA, 20 nt, Artificial Sequence
  MKO10031717_A_Morn3
  gRNA
gaucgacuuuggccgugaug

SEQ ID NO: 31718 - RNA, 20 nt, Artificial Sequence
  MKO10031718_A_Morn3
  gRNA
guaacaaccagcgcagcggg

SEQ ID NO: 31719 - RNA, 20 nt, Artificial Sequence
  MKO10031719_A_Morn3
  gRNA
ggacuacccaccuuagguau

SEQ ID NO: 31720 - RNA, 20 nt, Artificial Sequence
  MKO10031720_A_Morn4
  gRNA
cauggaauaccccgcaacga

SEQ ID NO: 31721 - RNA, 20 nt, Artificial Sequence
  MKO10031721_A_Morn4
  gRNA
guaccgcggcgaguggaaag

SEQ ID NO: 31722 - RNA, 20 nt, Artificial Sequence
  MKO10031722_A_Morn4
  gRNA
ucucgaacagaccuucguug

SEQ ID NO: 31723 - RNA, 20 nt, Artificial Sequence
  MKO10031723_A_Morn5
  gRNA
ccgauguaucucgugucagu

SEQ ID NO: 31724 - RNA, 20 nt, Artificial Sequence
  MKO10031724_A_Morn5
  gRNA
cgucgaaucggcucccacug

SEQ ID NO: 31725 - RNA, 20 nt, Artificial Sequence
  MKO10031725_A_Morn5
  gRNA
ccgguaauccuugaugaccc

SEQ ID NO: 31726 - RNA, 20 nt, Artificial Sequence
  MKO10031726_A_Mospd1
  gRNA
gauguucgauccugucacua

SEQ ID NO: 31727 - RNA, 20 nt, Artificial Sequence
  MKO10031727_A_Mospd1
  gRNA
gucuaucacaccauagugac

SEQ ID NO: 31728 - RNA, 20 nt, Artificial Sequence
  MKO10031728_A_Mospd1
  gRNA
gcccugaugcugccuacucu

SEQ ID NO: 31729 - RNA, 20 nt, Artificial Sequence
  MKO10031729_A_Mospd2
  gRNA
acucagcuucgaaucuccgc

SEQ ID NO: 31730 - RNA, 20 nt, Artificial Sequence
  MKO10031730_A_Mospd2
  gRNA
ggguugaaaguuacuuauac

SEQ ID NO: 31731 - RNA, 20 nt, Artificial Sequence
  MKO10031731_A_Mospd2
  gRNA
auguuugacauguccgaaac

SEQ ID NO: 31732 - RNA, 20 nt, Artificial Sequence
  MKO10031732_A_Mospd3
  gRNA
cugguugcggccuacgucuu

SEQ ID NO: 31733 - RNA, 20 nt, Artificial Sequence
  MKO10031733_A_Mospd3
  gRNA
guucagugugauacggcacg

SEQ ID NO: 31734 - RNA, 20 nt, Artificial Sequence
  MKO10031734_A_Mospd3
  gRNA
ugcaucgaauaccguguauu

SEQ ID NO: 31735 - RNA, 20 nt, Artificial Sequence
  MKO10031735_A_Mos
  gRNA
caacccgaacuauguugucg

SEQ ID NO: 31736 - RNA, 20 nt, Artificial Sequence
  MKO10031736_A_Mos
  gRNA
uacgccacgacaacauaguu

SEQ ID NO: 31737 - RNA, 20 nt, Artificial Sequence
  MKO10031737_A_Mos
  gRNA
accgauggcgacagcucacg

SEQ ID NO: 31738 - RNA, 20 nt, Artificial Sequence
  MKO10031738_A_Mov10l1
  gRNA
aaagcaaaucaaucgugauc

SEQ ID NO: 31739 - RNA, 20 nt, Artificial Sequence
  MKO10031739_A_Mov10l1
  gRNA
cucuccagauguagcaugac

SEQ ID NO: 31740 - RNA, 20 nt, Artificial Sequence
  MKO10031740_A_Mov10l1
  gRNA
auagccagcaccuuccaaca

SEQ ID NO: 31741 - RNA, 20 nt, Artificial Sequence
  MKO10031741_A_Mov10
  gRNA
agguacuaacccuacggcuu

SEQ ID NO: 31742 - RNA, 20 nt, Artificial Sequence
  MKO10031742_A_Mov10
  gRNA
uuccgccguuccgaagccgu

SEQ ID NO: 31743 - RNA, 20 nt, Artificial Sequence
  MKO10031743_A_Mov10
  gRNA
acaccugucgugaaagaucc

SEQ ID NO: 31744 - RNA, 20 nt, Artificial Sequence
  MKO10031744_A_Moxd1
  gRNA
gcgaaacugugauucucgcc

SEQ ID NO: 31745 - RNA, 20 nt, Artificial Sequence
  MKO10031745_A_Moxd1
  gRNA
uuaccaccuagauuacgcca

SEQ ID NO: 31746 - RNA, 20 nt, Artificial Sequence
  MKO10031746_A_Moxd1
  gRNA
agucuuaccguacuuugauc

SEQ ID NO: 31747 - RNA, 20 nt, Artificial Sequence
  MKO10031747_A_Moxd2
  gRNA
cagcccagcccgcgaugacg

SEQ ID NO: 31748 - RNA, 20 nt, Artificial Sequence
  MKO10031748_A_Moxd2
  gRNA
auagcauucgccgaugccug

SEQ ID NO: 31749 - RNA, 20 nt, Artificial Sequence
  MKO10031749_A_Moxd2
  gRNA
accguaaugucacgaucaug

SEQ ID NO: 31750 - RNA, 20 nt, Artificial Sequence
  MKO10031750_A_Mpc1
  gRNA
uuauuuccaggaugaguaag

SEQ ID NO: 31751 - RNA, 20 nt, Artificial Sequence
  MKO10031751_A_Mpc1
  gRNA
auccgcccacugauaaucuc

SEQ ID NO: 31752 - RNA, 20 nt, Artificial Sequence
  MKO10031752_A_Mpc1
  gRNA
ucuggggcccaguugccaac

SEQ ID NO: 31753 - RNA, 20 nt, Artificial Sequence
  MKO10031753_A_Mpc2
  gRNA
ccaaauccgaaacagcugag

SEQ ID NO: 31754 - RNA, 20 nt, Artificial Sequence
  MKO10031754_A_Mpc2
  gRNA
agacuuacccauuucauuau

SEQ ID NO: 31755 - RNA, 20 nt, Artificial Sequence
  MKO10031755_A_Mpc2
  gRNA
agcccagaaaaaaacuguuc

SEQ ID NO: 31756 - RNA, 20 nt, Artificial Sequence
  MKO10031756_A_Mpdu1
  gRNA
ggccuccaauguaccugccg

SEQ ID NO: 31757 - RNA, 20 nt, Artificial Sequence
  MKO10031757_A_Mpdu1
  gRNA
gaugcuguagaccacgguuc

SEQ ID NO: 31758 - RNA, 20 nt, Artificial Sequence
  MKO10031758_A_Mpdu1
  gRNA
gcucuccccgcucacgccuc

SEQ ID NO: 31759 - RNA, 20 nt, Artificial Sequence
  MKO10031759_A_Mpdz
  gRNA
agagcgggaaauccgugggc

SEQ ID NO: 31760 - RNA, 20 nt, Artificial Sequence
  MKO10031760_A_Mpdz
  gRNA
gaccggcggcaaagauccuc

SEQ ID NO: 31761 - RNA, 20 nt, Artificial Sequence
  MKO10031761_A_Mpdz
  gRNA
gagcugaucaaguucgucac

SEQ ID NO: 31762 - RNA, 20 nt, Artificial Sequence
  MKO10031762_A_Mpeg1
  gRNA
cagguaguccuucgucaaac

SEQ ID NO: 31763 - RNA, 20 nt, Artificial Sequence
  MKO10031763_A_Mpeg1
  gRNA
cuaguggcaauagaccgugc

SEQ ID NO: 31764 - RNA, 20 nt, Artificial Sequence
  MKO10031764_A_Mpeg1
  gRNA
guuggugacuuucgcaucac

SEQ ID NO: 31765 - RNA, 20 nt, Artificial Sequence
  MKO10031765_A_Mpg
  gRNA
ggcgacuagaugcccgcgcg

SEQ ID NO: 31766 - RNA, 20 nt, Artificial Sequence
  MKO10031766_A_Mpg
  gRNA
cuguuccaucagcgagucgc

SEQ ID NO: 31767 - RNA, 20 nt, Artificial Sequence
  MKO10031767_A_Mpg
  gRNA
uggagaaguagauacuccgc

SEQ ID NO: 31768 - RNA, 20 nt, Artificial Sequence
  MKO10031768_A_Mphosph10
  gRNA
cauugauucagaugaaagcg

SEQ ID NO: 31769 - RNA, 20 nt, Artificial Sequence
  MKO10031769_A_Mphosph10
  gRNA
guuugggcggcagaagauua

SEQ ID NO: 31770 - RNA, 20 nt, Artificial Sequence
  MKO10031770_A_Mphosph10
  gRNA
auguccucgucacuuucaac

SEQ ID NO: 31771 - RNA, 20 nt, Artificial Sequence
  MKO10031771_A_Mphosph6
  gRNA
ccucaggagcuucaucguag

SEQ ID NO: 31772 - RNA, 20 nt, Artificial Sequence
  MKO10031772_A_Mphosph6
  gRNA
auauuuaauaccucaaccuc

SEQ ID NO: 31773 - RNA, 20 nt, Artificial Sequence
  MKO10031773_A_Mphosph6
  gRNA
gaauucuaagaaccgagcag

SEQ ID NO: 31774 - RNA, 20 nt, Artificial Sequence
  MKO10031774_A_Mphosph8
  gRNA
gagauauauagaaucuccgc

SEQ ID NO: 31775 - RNA, 20 nt, Artificial Sequence
  MKO10031775_A_Mphosph8
  gRNA
cucgagaugagacugacacu

SEQ ID NO: 31776 - RNA, 20 nt, Artificial Sequence
  MKO10031776_A_Mphosph8
  gRNA
augcugguacccgaguuaga

SEQ ID NO: 31777 - RNA, 20 nt, Artificial Sequence
  MKO10031777_A_Mphosph9
  gRNA
gucucggguuccuuggacgc

SEQ ID NO: 31778 - RNA, 20 nt, Artificial Sequence
  MKO10031778_A_Mphosph9
  gRNA
uuccaguucagcucgcuccc

SEQ ID NO: 31779 - RNA, 20 nt, Artificial Sequence
  MKO10031779_A_Mphosph9
  gRNA
acaccccauuuguacuaagg

SEQ ID NO: 31780 - RNA, 20 nt, Artificial Sequence
  MKO10031780_A_Mpi
  gRNA
gggagauccguuucaccaac

SEQ ID NO: 31781 - RNA, 20 nt, Artificial Sequence
  MKO10031781_A_Mpi
  gRNA
ucugggaaauacgguuguca

SEQ ID NO: 31782 - RNA, 20 nt, Artificial Sequence
  MKO10031782_A_Mpi
  gRNA
caggcaugccacuucacuuu

SEQ ID NO: 31783 - RNA, 20 nt, Artificial Sequence
  MKO10031783_A_Mplkip
  gRNA
acucccguacccgucccgcg

SEQ ID NO: 31784 - RNA, 20 nt, Artificial Sequence
  MKO10031784_A_Mplkip
  gRNA
gagaaguugccgccgugccg

SEQ ID NO: 31785 - RNA, 20 nt, Artificial Sequence
  MKO10031785_A_Mplkip
  gRNA
agcaauacgcaaacauucac

SEQ ID NO: 31786 - RNA, 20 nt, Artificial Sequence
  MKO10031786_A_Mpl
  gRNA
cagcugcuguaugccuaccg

SEQ ID NO: 31787 - RNA, 20 nt, Artificial Sequence
  MKO10031787_A_Mpl
  gRNA
ugaacuccgcuauggcccca

SEQ ID NO: 31788 - RNA, 20 nt, Artificial Sequence
  MKO10031788_A_Mpl
  gRNA
ccgacagcaucccaaccgca

SEQ ID NO: 31789 - RNA, 20 nt, Artificial Sequence
  MKO10031789_A_Mpnd
  gRNA
uccgcuacccgucccgcgcu

SEQ ID NO: 31790 - RNA, 20 nt, Artificial Sequence
  MKO10031790_A_Mpnd
  gRNA
cccuagggggcgcgcucacg

SEQ ID NO: 31791 - RNA, 20 nt, Artificial Sequence
  MKO10031791_A_Mpnd
  gRNA
uagcuggugccggcgaagcc

SEQ ID NO: 31792 - RNA, 20 nt, Artificial Sequence
  MKO10031792_A_Mpo
  gRNA
ugcgauacuugucauucggu

SEQ ID NO: 31793 - RNA, 20 nt, Artificial Sequence
  MKO10031793_A_Mpo
  gRNA
acgccaucuucauacucugc

SEQ ID NO: 31794 - RNA, 20 nt, Artificial Sequence
  MKO10031794_A_Mpo
  gRNA
cugugccuaucaggacguga

SEQ ID NO: 31795 - RNA, 20 nt, Artificial Sequence
  MKO10031795_A_Mpp1
  gRNA
gcacucuauaccuguagcgc

SEQ ID NO: 31796 - RNA, 20 nt, Artificial Sequence
  MKO10031796_A_Mpp1
  gRNA
gagucgccuuccugcgcuac

SEQ ID NO: 31797 - RNA, 20 nt, Artificial Sequence
  MKO10031797_A_Mpp1
  gRNA
gucuaugaaucaugccgcca

SEQ ID NO: 31798 - RNA, 20 nt, Artificial Sequence
  MKO10031798_A_Mpp2
  gRNA
agacgaaguuggaggccguc

SEQ ID NO: 31799 - RNA, 20 nt, Artificial Sequence
  MKO10031799_A_Mpp2
  gRNA
cccaccaugcgcaccgcauc

SEQ ID NO: 31800 - RNA, 20 nt, Artificial Sequence
  MKO10031800_A_Mpp2
  gRNA
uacuggcugguugcuaaacg

SEQ ID NO: 31801 - RNA, 20 nt, Artificial Sequence
  MKO10031801_A_Mpp3
  gRNA
gucggugaagauuguucgcu

SEQ ID NO: 31802 - RNA, 20 nt, Artificial Sequence
  MKO10031802_A_Mpp3
  gRNA
ucugcccgauaacaucgaug

SEQ ID NO: 31803 - RNA, 20 nt, Artificial Sequence
  MKO10031803_A_Mpp3
  gRNA
agaaacuccgcuauuaugag

SEQ ID NO: 31804 - RNA, 20 nt, Artificial Sequence
  MKO10031804_A_Mpp4
  gRNA
aggucuacgacugccuccag

SEQ ID NO: 31805 - RNA, 20 nt, Artificial Sequence
  MKO10031805_A_Mpp4
  gRNA
cucgggggaaccggaagcuu

SEQ ID NO: 31806 - RNA, 20 nt, Artificial Sequence
  MKO10031806_A_Mpp4
  gRNA
gagcuguuacccaaagcuuc

SEQ ID NO: 31807 - RNA, 20 nt, Artificial Sequence
  MKO10031807_A_Mpp5
  gRNA
aagaguggccuccugcacga

SEQ ID NO: 31808 - RNA, 20 nt, Artificial Sequence
  MKO10031808_A_Mpp5
  gRNA
aucauaagccggauagugaa

SEQ ID NO: 31809 - RNA, 20 nt, Artificial Sequence
  MKO10031809_A_Mpp5
  gRNA
ucuuguacauuggcgauaag

SEQ ID NO: 31810 - RNA, 20 nt, Artificial Sequence
  MKO10031810_A_Mpp6
  gRNA
ucgacaaggucugcuucacg

SEQ ID NO: 31811 - RNA, 20 nt, Artificial Sequence
  MKO10031811_A_Mpp6
  gRNA
aucgcccgaauccuucaugg

SEQ ID NO: 31812 - RNA, 20 nt, Artificial Sequence
  MKO10031812_A_Mpp6
  gRNA
guagaugccauccguauucu

SEQ ID NO: 31813 - RNA, 20 nt, Artificial Sequence
  MKO10031813_A_Mpp7
  gRNA
cucugugaaaauaauccgcc

SEQ ID NO: 31814 - RNA, 20 nt, Artificial Sequence
  MKO10031814_A_Mpp7
  gRNA
gccugacgauauugaugaug

SEQ ID NO: 31815 - RNA, 20 nt, Artificial Sequence
  MKO10031815_A_Mpp7
  gRNA
cguguucucaccuugacauu

SEQ ID NO: 31816 - RNA, 20 nt, Artificial Sequence
  MKO10031816_A_Mppe1
  gRNA
ccccucaagggaguggcaaa

SEQ ID NO: 31817 - RNA, 20 nt, Artificial Sequence
  MKO10031817_A_Mppe1
  gRNA
acgaugugcagagauuucag

SEQ ID NO: 31818 - RNA, 20 nt, Artificial Sequence
  MKO10031818_A_Mppe1
  gRNA
ucucugcacaucgucugccc

SEQ ID NO: 31819 - RNA, 20 nt, Artificial Sequence
  MKO10031819_A_Mpped1
  gRNA
accacggggagccguagauc

SEQ ID NO: 31820 - RNA, 20 nt, Artificial Sequence
  MKO10031820_A_Mpped1
  gRNA
aucgccguagggcauuugaa

SEQ ID NO: 31821 - RNA, 20 nt, Artificial Sequence
  MKO10031821_A_Mpped1
  gRNA
ccacgagcugaccuucgacc

SEQ ID NO: 31822 - RNA, 20 nt, Artificial Sequence
  MKO10031822_A_Mpped2
  gRNA
gcucggugaaaucgccugug

SEQ ID NO: 31823 - RNA, 20 nt, Artificial Sequence
  MKO10031823_A_Mpped2
  gRNA
agaugcagacaaaccgcgug

SEQ ID NO: 31824 - RNA, 20 nt, Artificial Sequence
  MKO10031824_A_Mpped2
  gRNA
cgugaaucccaccgaacaca

SEQ ID NO: 31825 - RNA, 20 nt, Artificial Sequence
  MKO10031825_A_Mprip
  gRNA
agccgacaugucggcggcca

SEQ ID NO: 31826 - RNA, 20 nt, Artificial Sequence
  MKO10031826_A_Mprip
  gRNA
cuuacccgugaccggugcac

SEQ ID NO: 31827 - RNA, 20 nt, Artificial Sequence
  MKO10031827_A_Mprip
  gRNA
gcgauaugcccuggaugaga

SEQ ID NO: 31828 - RNA, 20 nt, Artificial Sequence
  MKO10031828_A_Mpst
  gRNA
gucguagaucacgacgugcg

SEQ ID NO: 31829 - RNA, 20 nt, Artificial Sequence
  MKO10031829_A_Mpst
  gRNA
caaacucgcgucgugcaucg

SEQ ID NO: 31830 - RNA, 20 nt, Artificial Sequence
  MKO10031830_A_Mpst
  gRNA
cggugucacagccugccacg

SEQ ID NO: 31831 - RNA, 20 nt, Artificial Sequence
  MKO10031831_A_Mptx1
  gRNA
ccauguggucccccuagaaa

SEQ ID NO: 31832 - RNA, 20 nt, Artificial Sequence
  MKO10031832_A_Mptx1
  gRNA
acaauggcaaccuuauaaac

SEQ ID NO: 31833 - RNA, 20 nt, Artificial Sequence
  MKO10031833_A_Mptx1
  gRNA
cugaaagaacagagagaaac

SEQ ID NO: 31834 - RNA, 20 nt, Artificial Sequence
  MKO10031834_A_Mptx2
  gRNA
agaugcuauaagggcgaguc

SEQ ID NO: 31835 - RNA, 20 nt, Artificial Sequence
  MKO10031835_A_Mptx2
  gRNA
cuugaagaagggauacgugg

SEQ ID NO: 31836 - RNA, 20 nt, Artificial Sequence
  MKO10031836_A_Mptx2
  gRNA
cacaauggagaagcuuauug

SEQ ID NO: 31837 - RNA, 20 nt, Artificial Sequence
  MKO10031837_A_Mpv17l2
  gRNA
uuccgagucaccuauaucaa

SEQ ID NO: 31838 - RNA, 20 nt, Artificial Sequence
  MKO10031838_A_Mpv17l2
  gRNA
cgcagccagcauguucgccg

SEQ ID NO: 31839 - RNA, 20 nt, Artificial Sequence
  MKO10031839_A_Mpv17l2
  gRNA
gaggcuucguaggcccgacg

SEQ ID NO: 31840 - RNA, 20 nt, Artificial Sequence
  MKO10031840_A_Mpv17l
  gRNA
cuggcgccagacgcgucgcg

SEQ ID NO: 31841 - RNA, 20 nt, Artificial Sequence
  MKO10031841_A_Mpv17l
  gRNA
uggccccucaccgacguaga

SEQ ID NO: 31842 - RNA, 20 nt, Artificial Sequence
  MKO10031842_A_Mpv17l
  gRNA
aacaggcaugagcguucucc

SEQ ID NO: 31843 - RNA, 20 nt, Artificial Sequence
  MKO10031843_A_Mpv17
  gRNA
uuguaccagccuccgacgac

SEQ ID NO: 31844 - RNA, 20 nt, Artificial Sequence
  MKO10031844_A_Mpv17
  gRNA
ccauugaguaucccgaccag

SEQ ID NO: 31845 - RNA, 20 nt, Artificial Sequence
  MKO10031845_A_Mpv17
  gRNA
gcggggucuccagcaacacc

SEQ ID NO: 31846 - RNA, 20 nt, Artificial Sequence
  MKO10031846_A_Mpzl1
  gRNA
ccuuaccgacacggcgcugu

SEQ ID NO: 31847 - RNA, 20 nt, Artificial Sequence
  MKO10031847_A_Mpzl1
  gRNA
cguggcacugauugcggccc

SEQ ID NO: 31848 - RNA, 20 nt, Artificial Sequence
  MKO10031848_A_Mpzl1
  gRNA
uggacacauuaggcuccacg

SEQ ID NO: 31849 - RNA, 20 nt, Artificial Sequence
  MKO10031849_A_Mpzl2
  gRNA
gagaugcgcuaacugugacg

SEQ ID NO: 31850 - RNA, 20 nt, Artificial Sequence
  MKO10031850_A_Mpzl2
  gRNA
ucuuugaaccguccgcucau

SEQ ID NO: 31851 - RNA, 20 nt, Artificial Sequence
  MKO10031851_A_Mpzl2
  gRNA
aauuuacaccuccggggccc

SEQ ID NO: 31852 - RNA, 20 nt, Artificial Sequence
  MKO10031852_A_Mpzl3
  gRNA
agugccgaugcucacguccg

SEQ ID NO: 31853 - RNA, 20 nt, Artificial Sequence
  MKO10031853_A_Mpzl3
  gRNA
gggauauugugguacacguc

SEQ ID NO: 31854 - RNA, 20 nt, Artificial Sequence
  MKO10031854_A_Mpzl3
  gRNA
cauuccgagaccggaucucc

SEQ ID NO: 31855 - RNA, 20 nt, Artificial Sequence
  MKO10031855_A_Mpz
  gRNA
aaccugccgcccucgcuucg

SEQ ID NO: 31856 - RNA, 20 nt, Artificial Sequence
  MKO10031856_A_Mpz
  gRNA
acaaccuuacaucgaugagg

SEQ ID NO: 31857 - RNA, 20 nt, Artificial Sequence
  MKO10031857_A_Mpz
  gRNA
gcagccagcaguaccgaauc

SEQ ID NO: 31858 - RNA, 20 nt, Artificial Sequence
  MKO10031858_A_Mr1
  gRNA
cagagaucgugcucacucga

SEQ ID NO: 31859 - RNA, 20 nt, Artificial Sequence
  MKO10031859_A_Mr1
  gRNA
cgacagugucacucgacaga

SEQ ID NO: 31860 - RNA, 20 nt, Artificial Sequence
  MKO10031860_A_Mr1
  gRNA
uuucgaguuguucuuaccac

SEQ ID NO: 31861 - RNA, 20 nt, Artificial Sequence
  MKO10031861_A_Mrap2
  gRNA
ccaggucuaugcgugauguc

SEQ ID NO: 31862 - RNA, 20 nt, Artificial Sequence
  MKO10031862_A_Mrap2
  gRNA
gcaacgcggaguccucagag

SEQ ID NO: 31863 - RNA, 20 nt, Artificial Sequence
  MKO10031863_A_Mrap2
  gRNA
cugacuuugcugacgaagac

SEQ ID NO: 31864 - RNA, 20 nt, Artificial Sequence
  MKO10031864_A_Mrap
  gRNA
gacagaggcgucggucccgu

SEQ ID NO: 31865 - RNA, 20 nt, Artificial Sequence
  MKO10031865_A_Mrap
  gRNA
auuccauugucaucgcccug

SEQ ID NO: 31866 - RNA, 20 nt, Artificial Sequence
  MKO10031866_A_Mrap
  gRNA
caccagcuaugaguauuacc

SEQ ID NO: 31867 - RNA, 20 nt, Artificial Sequence
  MKO10031867_A_Mras
  gRNA
gcgguccacgugcucgaagc

SEQ ID NO: 31868 - RNA, 20 nt, Artificial Sequence
  MKO10031868_A_Mras
  gRNA
ugucuacuccgucaccgaca

SEQ ID NO: 31869 - RNA, 20 nt, Artificial Sequence
  MKO10031869_A_Mras
  gRNA
gucauucccaaugauccucg

SEQ ID NO: 31870 - RNA, 20 nt, Artificial Sequence
  MKO10031870_A_Mrc1
  gRNA
gagccauccguccgagcgcc

SEQ ID NO: 31871 - RNA, 20 nt, Artificial Sequence
  MKO10031871_A_Mrc1
  gRNA
ugaagaucacaagcgcugcg

SEQ ID NO: 31872 - RNA, 20 nt, Artificial Sequence
  MKO10031872_A_Mrc1
  gRNA
aacagucugaguguacgcag

SEQ ID NO: 31873 - RNA, 20 nt, Artificial Sequence
  MKO10031873_A_Mrc2
  gRNA
cgauggcagugucguacacu

SEQ ID NO: 31874 - RNA, 20 nt, Artificial Sequence
  MKO10031874_A_Mrc2
  gRNA
ccacugguugucguauuuga

SEQ ID NO: 31875 - RNA, 20 nt, Artificial Sequence
  MKO10031875_A_Mrc2
  gRNA
ccggaaccgacucuucaacc

SEQ ID NO: 31876 - RNA, 20 nt, Artificial Sequence
  MKO10031876_A_Mre11a
  gRNA
uugccguggauacuaaauac

SEQ ID NO: 31877 - RNA, 20 nt, Artificial Sequence
  MKO10031877_A_Mre11a
  gRNA
uuacccccgugggaucauca

SEQ ID NO: 31878 - RNA, 20 nt, Artificial Sequence
  MKO10031878_A_Mre11a
  gRNA
acggucaaugucgguggaga

SEQ ID NO: 31879 - RNA, 20 nt, Artificial Sequence
  MKO10031879_A_Mreg
  gRNA
ccucuccagagucgcuccaa

SEQ ID NO: 31880 - RNA, 20 nt, Artificial Sequence
  MKO10031880_A_Mreg
  gRNA
gcucuccgagagguaccucu

SEQ ID NO: 31881 - RNA, 20 nt, Artificial Sequence
  MKO10031881_A_Mreg
  gRNA
cuucccugcggaucugccgc

SEQ ID NO: 31882 - RNA, 20 nt, Artificial Sequence
  MKO10031882_A_Mrfap1
  gRNA
aaacugcucgaaguccuccu

SEQ ID NO: 31883 - RNA, 20 nt, Artificial Sequence
  MKO10031883_A_Mrfap1
  gRNA
cggcgccgccggcacccugc

SEQ ID NO: 31884 - RNA, 20 nt, Artificial Sequence
  MKO10031884_A_Mrfap1
  gRNA
gcgcgcgccggcgcgcaacc

SEQ ID NO: 31885 - RNA, 20 nt, Artificial Sequence
  MKO10031885_A_Mrgbp
  gRNA
ugucuaugugcggcgccucu

SEQ ID NO: 31886 - RNA, 20 nt, Artificial Sequence
  MKO10031886_A_Mrgbp
  gRNA
gagcacuauguacgacaugc

SEQ ID NO: 31887 - RNA, 20 nt, Artificial Sequence
  MKO10031887_A_Mrgbp
  gRNA
gcgcagccgggucacugaca

SEQ ID NO: 31888 - RNA, 20 nt, Artificial Sequence
  MKO10031888_A_Mrgpra1
  gRNA
ugccaaagggcaauccgcaa

SEQ ID NO: 31889 - RNA, 20 nt, Artificial Sequence
  MKO10031889_A_Mrgpra1
  gRNA
cuccuuugcggauugcccuu

SEQ ID NO: 31890 - RNA, 20 nt, Artificial Sequence
  MKO10031890_A_Mrgpra1
  gRNA
cagcaagaggaaugggggaa

SEQ ID NO: 31891 - RNA, 20 nt, Artificial Sequence
  MKO10031891_A_Mrgpra2a
  gRNA
gauguagacaaccauuauaa

SEQ ID NO: 31892 - RNA, 20 nt, Artificial Sequence
  MKO10031892_A_Mrgpra2a
  gRNA
gugcuuuaacaccauuauaa

SEQ ID NO: 31893 - RNA, 20 nt, Artificial Sequence
  MKO10031893_A_Mrgpra2a
  gRNA
cagcaagaggaaugggggaa

SEQ ID NO: 31894 - RNA, 20 nt, Artificial Sequence
  MKO10031894_A_Mrgpra2b
  gRNA
gauguagacaaccaucauaa

SEQ ID NO: 31895 - RNA, 20 nt, Artificial Sequence
  MKO10031895_A_Mrgpra2b
  gRNA
gugcuuuaacaccauuauga

SEQ ID NO: 31896 - RNA, 20 nt, Artificial Sequence
  MKO10031896_A_Mrgpra2b
  gRNA
cagcaagaggaaugggggaa

SEQ ID NO: 31897 - RNA, 20 nt, Artificial Sequence
  MKO10031897_A_Mrgpra3
  gRNA
uuuauucaaccguugccuga

SEQ ID NO: 31898 - RNA, 20 nt, Artificial Sequence
  MKO10031898_A_Mrgpra3
  gRNA
uaaucuaguacaaacacacc

SEQ ID NO: 31899 - RNA, 20 nt, Artificial Sequence
  MKO10031899_A_Mrgpra3
  gRNA
cagcaagaggaaugggagaa

SEQ ID NO: 31900 - RNA, 20 nt, Artificial Sequence
  MKO10031900_A_Mrgpra4
  gRNA
cacagagucaauuacauauu

SEQ ID NO: 31901 - RNA, 20 nt, Artificial Sequence
  MKO10031901_A_Mrgpra4
  gRNA
augacaguucucuacaucac

SEQ ID NO: 31902 - RNA, 20 nt, Artificial Sequence
  MKO10031902_A_Mrgpra4
  gRNA
ggaaccagaucacagcacac

SEQ ID NO: 31903 - RNA, 20 nt, Artificial Sequence
  MKO10031903_A_Mrgpra6
  gRNA
uccugcucuuccgcuugcgc

SEQ ID NO: 31904 - RNA, 20 nt, Artificial Sequence
  MKO10031904_A_Mrgpra6
  gRNA
cugucagcccgacuaguccg

SEQ ID NO: 31905 - RNA, 20 nt, Artificial Sequence
  MKO10031905_A_Mrgpra6
  gRNA
ccccaucauuuacuucuuug

SEQ ID NO: 31906 - RNA, 20 nt, Artificial Sequence
  MKO10031906_A_Mrgpra9
  gRNA
aucuugaugcugguacuucc

SEQ ID NO: 31907 - RNA, 20 nt, Artificial Sequence
  MKO10031907_A_Mrgpra9
  gRNA
gaacgugagaaguuucugcg

SEQ ID NO: 31908 - RNA, 20 nt, Artificial Sequence
  MKO10031908_A_Mrgpra9
  gRNA
agugaucuacauccagcaaa

SEQ ID NO: 31909 - RNA, 20 nt, Artificial Sequence
  MKO10031909_A_Mrgprb1
  gRNA
ggcuuccuauauuacacuag

SEQ ID NO: 31910 - RNA, 20 nt, Artificial Sequence
  MKO10031910_A_Mrgprb1
  gRNA
uuaggcaccaucgguuucaa

SEQ ID NO: 31911 - RNA, 20 nt, Artificial Sequence
  MKO10031911_A_Mrgprb1
  gRNA
cuauaagaaaaauggagcaa

SEQ ID NO: 31912 - RNA, 20 nt, Artificial Sequence
  MKO10031912_A_Mrgprb2
  gRNA
ccauuaggcaccgaagguuc

SEQ ID NO: 31913 - RNA, 20 nt, Artificial Sequence
  MKO10031913_A_Mrgprb2
  gRNA
gagucuuccgccugaaccuu

SEQ ID NO: 31914 - RNA, 20 nt, Artificial Sequence
  MKO10031914_A_Mrgprb2
  gRNA
cacagcgaauuccuaugacc

SEQ ID NO: 31915 - RNA, 20 nt, Artificial Sequence
  MKO10031915_A_Mrgprb3
  gRNA
gggauaaucaauauaaucuc

SEQ ID NO: 31916 - RNA, 20 nt, Artificial Sequence
  MKO10031916_A_Mrgprb3
  gRNA
gauucugcagagagcuauac

SEQ ID NO: 31917 - RNA, 20 nt, Artificial Sequence
  MKO10031917_A_Mrgprb3
  gRNA
cugaaacuugccaugccuaa

SEQ ID NO: 31918 - RNA, 20 nt, Artificial Sequence
  MKO10031918_A_Mrgprb4
  gRNA
uuagacaacacagguugcga

SEQ ID NO: 31919 - RNA, 20 nt, Artificial Sequence
  MKO10031919_A_Mrgprb4
  gRNA
ucgcaaccuguguugucuaa

SEQ ID NO: 31920 - RNA, 20 nt, Artificial Sequence
  MKO10031920_A_Mrgprb4
  gRNA
acuccauaauccuugauaag

SEQ ID NO: 31921 - RNA, 20 nt, Artificial Sequence
  MKO10031921_A_Mrgprb5
  gRNA
uagagagcgcucaacacuga

SEQ ID NO: 31922 - RNA, 20 nt, Artificial Sequence
  MKO10031922_A_Mrgprb5
  gRNA
ggccacagccuuccccuaau

SEQ ID NO: 31923 - RNA, 20 nt, Artificial Sequence
  MKO10031923_A_Mrgprb5
  gRNA
ugggucuaaccacuccagcc

SEQ ID NO: 31924 - RNA, 20 nt, Artificial Sequence
  MKO10031924_A_Mrgprb8
  gRNA
gagacaauucuccuacuauc

SEQ ID NO: 31925 - RNA, 20 nt, Artificial Sequence
  MKO10031925_A_Mrgprb8
  gRNA
gcguugggcaugauaccaag

SEQ ID NO: 31926 - RNA, 20 nt, Artificial Sequence
  MKO10031926_A_Mrgprb8
  gRNA
uucugucaaugugaccauac

SEQ ID NO: 31927 - RNA, 20 nt, Artificial Sequence
  MKO10031927_A_Mrgprd
  gRNA
gaccccaucauuaguacacg

SEQ ID NO: 31928 - RNA, 20 nt, Artificial Sequence
  MKO10031928_A_Mrgprd
  gRNA
ggaugaccacguacagccgc

SEQ ID NO: 31929 - RNA, 20 nt, Artificial Sequence
  MKO10031929_A_Mrgprd
  gRNA
ccgguggcacuuauaccaga

SEQ ID NO: 31930 - RNA, 20 nt, Artificial Sequence
  MKO10031930_A_Mrgpre
  gRNA
ggagggguucccgaaaccuc

SEQ ID NO: 31931 - RNA, 20 nt, Artificial Sequence
  MKO10031931_A_Mrgpre
  gRNA
ccucaucuccaagugcccgc

SEQ ID NO: 31932 - RNA, 20 nt, Artificial Sequence
  MKO10031932_A_Mrgpre
  gRNA
guagcagaagaaccgcagca

SEQ ID NO: 31933 - RNA, 20 nt, Artificial Sequence
  MKO10031933_A_Mrgprf
  gRNA
gugcucggcacucuacgugc

SEQ ID NO: 31934 - RNA, 20 nt, Artificial Sequence
  MKO10031934_A_Mrgprf
  gRNA
gacacucuucgaauguaguc

SEQ ID NO: 31935 - RNA, 20 nt, Artificial Sequence
  MKO10031935_A_Mrgprf
  gRNA
agauggccggaaacuguuca

SEQ ID NO: 31936 - RNA, 20 nt, Artificial Sequence
  MKO10031936_A_Mrgprg
  gRNA
cucuauugcuacgaucgugu

SEQ ID NO: 31937 - RNA, 20 nt, Artificial Sequence
  MKO10031937_A_Mrgprg
  gRNA
acggcgguuggggcugcaaa

SEQ ID NO: 31938 - RNA, 20 nt, Artificial Sequence
  MKO10031938_A_Mrgprg
  gRNA
auagccccccaagaccugac

SEQ ID NO: 31939 - RNA, 20 nt, Artificial Sequence
  MKO10031939_A_Mrgprh
  gRNA
auguacacguaucggcauuc

SEQ ID NO: 31940 - RNA, 20 nt, Artificial Sequence
  MKO10031940_A_Mrgprh
  gRNA
gcucuacgcugauggccgug

SEQ ID NO: 31941 - RNA, 20 nt, Artificial Sequence
  MKO10031941_A_Mrgprh
  gRNA
auccguaugcucugaagacc

SEQ ID NO: 31942 - RNA, 20 nt, Artificial Sequence
  MKO10031942_A_Mrgprx1
  gRNA
caucacuacccugguuggac

SEQ ID NO: 31943 - RNA, 20 nt, Artificial Sequence
  MKO10031943_A_Mrgprx1
  gRNA
gcaaucauccccuauaucuc

SEQ ID NO: 31944 - RNA, 20 nt, Artificial Sequence
  MKO10031944_A_Mrgprx1
  gRNA
augcuuucuaugcugccuaa

SEQ ID NO: 31945 - RNA, 20 nt, Artificial Sequence
  MKO10031945_A_Mrgprx2
  gRNA
gugaccggauauauacuaca

SEQ ID NO: 31946 - RNA, 20 nt, Artificial Sequence
  MKO10031946_A_Mrgprx2
  gRNA
uugaaaucgaugaugccuaa

SEQ ID NO: 31947 - RNA, 20 nt, Artificial Sequence
  MKO10031947_A_Mrgprx2
  gRNA
ccauaagaaaaauggaggaa

SEQ ID NO: 31948 - RNA, 20 nt, Artificial Sequence
  MKO10031948_A_Mri1
  gRNA
cagagugauccgcuucgccg

SEQ ID NO: 31949 - RNA, 20 nt, Artificial Sequence
  MKO10031949_A_Mri1
  gRNA
ugccaccugugaugaguucg

SEQ ID NO: 31950 - RNA, 20 nt, Artificial Sequence
  MKO10031950_A_Mri1
  gRNA
cugcucguacaccagcucga

SEQ ID NO: 31951 - RNA, 20 nt, Artificial Sequence
  MKO10031951_A_Mrm1
  gRNA
cuagcugcuuagaguucguc

SEQ ID NO: 31952 - RNA, 20 nt, Artificial Sequence
  MKO10031952_A_Mrm1
  gRNA
uucgccacuccugaccugcc

SEQ ID NO: 31953 - RNA, 20 nt, Artificial Sequence
  MKO10031953_A_Mrm1
  gRNA
ccaccacgagccaccccugc

SEQ ID NO: 31954 - RNA, 20 nt, Artificial Sequence
  MKO10031954_A_Mroh1
  gRNA
cucaggaucuucguacggua

SEQ ID NO: 31955 - RNA, 20 nt, Artificial Sequence
  MKO10031955_A_Mroh1
  gRNA
cguaccguacgaagauccug

SEQ ID NO: 31956 - RNA, 20 nt, Artificial Sequence
  MKO10031956_A_Mroh1
  gRNA
caggcauggagugucucguc

SEQ ID NO: 31957 - RNA, 20 nt, Artificial Sequence
  MKO10031957_A_Mroh2a
  gRNA
gagcgcguucaucacuacac

SEQ ID NO: 31958 - RNA, 20 nt, Artificial Sequence
  MKO10031958_A_Mroh2a
  gRNA
gucccgaaaccacuucagcu

SEQ ID NO: 31959 - RNA, 20 nt, Artificial Sequence
  MKO10031959_A_Mroh2a
  gRNA
cagaccccuaccauugccau

SEQ ID NO: 31960 - RNA, 20 nt, Artificial Sequence
  MKO10031960_A_Mroh2b
  gRNA
ggagauauuaaccucacaau

SEQ ID NO: 31961 - RNA, 20 nt, Artificial Sequence
  MKO10031961_A_Mroh2b
  gRNA
agcugguugccaguucagcc

SEQ ID NO: 31962 - RNA, 20 nt, Artificial Sequence
  MKO10031962_A_Mroh2b
  gRNA
uacucagcaucccaauugug

SEQ ID NO: 31963 - RNA, 20 nt, Artificial Sequence
  MKO10031963_A_Mroh4
  gRNA
uacggcccaggugcuccaac

SEQ ID NO: 31964 - RNA, 20 nt, Artificial Sequence
  MKO10031964_A_Mroh4
  gRNA
ccugcgugagugccccagcg

SEQ ID NO: 31965 - RNA, 20 nt, Artificial Sequence
  MKO10031965_A_Mroh4
  gRNA
ugaacccaccucccgcuguc

SEQ ID NO: 31966 - RNA, 20 nt, Artificial Sequence
  MKO10031966_A_Mroh5
  gRNA
ugugagaugcguccugacgg

SEQ ID NO: 31967 - RNA, 20 nt, Artificial Sequence
  MKO10031967_A_Mroh5
  gRNA
uuagcccguaguaggugaac

SEQ ID NO: 31968 - RNA, 20 nt, Artificial Sequence
  MKO10031968_A_Mroh5
  gRNA
cgucugucggcacucauggc

SEQ ID NO: 31969 - RNA, 20 nt, Artificial Sequence
  MKO10031969_A_Mroh6
  gRNA
cuacaggccacucgcgcucu

SEQ ID NO: 31970 - RNA, 20 nt, Artificial Sequence
  MKO10031970_A_Mroh6
  gRNA
caucucuccaagagcgcgag

SEQ ID NO: 31971 - RNA, 20 nt, Artificial Sequence
  MKO10031971_A_Mroh6
  gRNA
gcccguuuacucgcugauuc

SEQ ID NO: 31972 - RNA, 20 nt, Artificial Sequence
  MKO10031972_A_Mroh7
  gRNA
ugagaacacgcuccgcacac

SEQ ID NO: 31973 - RNA, 20 nt, Artificial Sequence
  MKO10031973_A_Mroh7
  gRNA
guucucacugcccuccgugc

SEQ ID NO: 31974 - RNA, 20 nt, Artificial Sequence
  MKO10031974_A_Mroh7
  gRNA
uccauagccugccgucgagc

SEQ ID NO: 31975 - RNA, 20 nt, Artificial Sequence
  MKO10031975_A_Mroh8
  gRNA
caacuuagacgacguucaaa

SEQ ID NO: 31976 - RNA, 20 nt, Artificial Sequence
  MKO10031976_A_Mroh8
  gRNA
cacuacuucuucuguaccgc

SEQ ID NO: 31977 - RNA, 20 nt, Artificial Sequence
  MKO10031977_A_Mroh8
  gRNA
uauaccuuaugacgaaaaca

SEQ ID NO: 31978 - RNA, 20 nt, Artificial Sequence
  MKO10031978_A_Mroh9
  gRNA
aagugaacaauccauaaucu

SEQ ID NO: 31979 - RNA, 20 nt, Artificial Sequence
  MKO10031979_A_Mroh9
  gRNA
guuuaaagccgaaauccuau

SEQ ID NO: 31980 - RNA, 20 nt, Artificial Sequence
  MKO10031980_A_Mroh9
  gRNA
ugugauucaaacugcaccag

SEQ ID NO: 31981 - RNA, 20 nt, Artificial Sequence
  MKO10031981_A_Mro
  gRNA
gaucauacagcccacgaacc

SEQ ID NO: 31982 - RNA, 20 nt, Artificial Sequence
  MKO10031982_A_Mro
  gRNA
aauggccuaagagcgaaucu

SEQ ID NO: 31983 - RNA, 20 nt, Artificial Sequence
  MKO10031983_A_Mro
  gRNA
cagacccaagauucgcucuu

SEQ ID NO: 31984 - RNA, 20 nt, Artificial Sequence
  MKO10031984_A_Mrp63
  gRNA
aagacacgguacgcggccgc

SEQ ID NO: 31985 - RNA, 20 nt, Artificial Sequence
  MKO10031985_A_Mrp63
  gRNA
uaccgugucuuuccaagcga

SEQ ID NO: 31986 - RNA, 20 nt, Artificial Sequence
  MKO10031986_A_Mrp63
  gRNA
gcggccacgccgcggagcga

SEQ ID NO: 31987 - RNA, 20 nt, Artificial Sequence
  MKO10031987_A_Mrpl10
  gRNA
cugcuacuauaucuugacgc

SEQ ID NO: 31988 - RNA, 20 nt, Artificial Sequence
  MKO10031988_A_Mrpl10
  gRNA
agugcaugacucgccagugg

SEQ ID NO: 31989 - RNA, 20 nt, Artificial Sequence
  MKO10031989_A_Mrpl10
  gRNA
gauagcugucugccagaacg

SEQ ID NO: 31990 - RNA, 20 nt, Artificial Sequence
  MKO10031990_A_Mrpl11
  gRNA
aaaacacagcucguuccuuc

SEQ ID NO: 31991 - RNA, 20 nt, Artificial Sequence
  MKO10031991_A_Mrpl11
  gRNA
ccuucaccacucgaaugccc

SEQ ID NO: 31992 - RNA, 20 nt, Artificial Sequence
  MKO10031992_A_Mrpl11
  gRNA
cauuggcucugcccguuccc

SEQ ID NO: 31993 - RNA, 20 nt, Artificial Sequence
  MKO10031993_A_Mrpl12
  gRNA
acacccuaaggcggccgagg

SEQ ID NO: 31994 - RNA, 20 nt, Artificial Sequence
  MKO10031994_A_Mrpl12
  gRNA
auaccuucaggaguucguug

SEQ ID NO: 31995 - RNA, 20 nt, Artificial Sequence
  MKO10031995_A_Mrpl12
  gRNA
agaccucaacgaacuccuga

SEQ ID NO: 31996 - RNA, 20 nt, Artificial Sequence
  MKO10031996_A_Mrpl13
  gRNA
gcuauaaccgcaaguuugcc

SEQ ID NO: 31997 - RNA, 20 nt, Artificial Sequence
  MKO10031997_A_Mrpl13
  gRNA
auaccacauucgagcaaaag

SEQ ID NO: 31998 - RNA, 20 nt, Artificial Sequence
  MKO10031998_A_Mrpl13
  gRNA
aaaguguacuccucacauac

SEQ ID NO: 31999 - RNA, 20 nt, Artificial Sequence
  MKO10031999_A_Mrpl14
  gRNA
gaucccauggccgcccuuac

SEQ ID NO: 32000 - RNA, 20 nt, Artificial Sequence
  MKO10032000_A_Mrpl14
  gRNA
caccgggguggccgauggua

SEQ ID NO: 32001 - RNA, 20 nt, Artificial Sequence
  MKO10032001_A_Mrpl14
  gRNA
ccccacucuuguuauagacg

SEQ ID NO: 32002 - RNA, 20 nt, Artificial Sequence
  MKO10032002_A_Mrpl15
  gRNA
ugaccauccagccgcuuaag

SEQ ID NO: 32003 - RNA, 20 nt, Artificial Sequence
  MKO10032003_A_Mrpl15
  gRNA
gcgcggcugcgggaccagcc

SEQ ID NO: 32004 - RNA, 20 nt, Artificial Sequence
  MKO10032004_A_Mrpl15
  gRNA
accgcgggucauggcuggca

SEQ ID NO: 32005 - RNA, 20 nt, Artificial Sequence
  MKO10032005_A_Mrpl16
  gRNA
cuugacaaucaaccgcuuua

SEQ ID NO: 32006 - RNA, 20 nt, Artificial Sequence
  MKO10032006_A_Mrpl16
  gRNA
gcgcuuucacuacacacgcu

SEQ ID NO: 32007 - RNA, 20 nt, Artificial Sequence
  MKO10032007_A_Mrpl16
  gRNA
gcguccccgcgccgcuccug

SEQ ID NO: 32008 - RNA, 20 nt, Artificial Sequence
  MKO10032008_A_Mrpl17
  gRNA
augucgccucgaugcguucg

SEQ ID NO: 32009 - RNA, 20 nt, Artificial Sequence
  MKO10032009_A_Mrpl17
  gRNA
aguucgccacgaacgcaucg

SEQ ID NO: 32010 - RNA, 20 nt, Artificial Sequence
  MKO10032010_A_Mrpl17
  gRNA
caacgaacgagccaugcgua

SEQ ID NO: 32011 - RNA, 20 nt, Artificial Sequence
  MKO10032011_A_Mrpl18
  gRNA
cugcacggccggcacggaac

SEQ ID NO: 32012 - RNA, 20 nt, Artificial Sequence
  MKO10032012_A_Mrpl18
  gRNA
uagcucggaaagaacggggc

SEQ ID NO: 32013 - RNA, 20 nt, Artificial Sequence
  MKO10032013_A_Mrpl18
  gRNA
uuuaauagcccauucucgag

SEQ ID NO: 32014 - RNA, 20 nt, Artificial Sequence
  MKO10032014_A_Mrpl19
  gRNA
gggcgucccguaaguacagc

SEQ ID NO: 32015 - RNA, 20 nt, Artificial Sequence
  MKO10032015_A_Mrpl19
  gRNA
acagccgaccccuaugccag

SEQ ID NO: 32016 - RNA, 20 nt, Artificial Sequence
  MKO10032016_A_Mrpl19
  gRNA
cguucccagcguuuggacca

SEQ ID NO: 32017 - RNA, 20 nt, Artificial Sequence
  MKO10032017_A_Mrpl1
  gRNA
ucuacuucauagauccgccg

SEQ ID NO: 32018 - RNA, 20 nt, Artificial Sequence
  MKO10032018_A_Mrpl1
  gRNA
ucaacauggcggcggccgua

SEQ ID NO: 32019 - RNA, 20 nt, Artificial Sequence
  MKO10032019_A_Mrpl1
  gRNA
acuuaaaacgcuuauaccca

SEQ ID NO: 32020 - RNA, 20 nt, Artificial Sequence
  MKO10032020_A_Mrpl20
  gRNA
cugaacccgccaauagcgau

SEQ ID NO: 32021 - RNA, 20 nt, Artificial Sequence
  MKO10032021_A_Mrpl20
  gRNA
accgccucaccgaucgcuau

SEQ ID NO: 32022 - RNA, 20 nt, Artificial Sequence
  MKO10032022_A_Mrpl20
  gRNA
agccuucguuaaguguacga

SEQ ID NO: 32023 - RNA, 20 nt, Artificial Sequence
  MKO10032023_A_Mrpl21
  gRNA
cagagcgcuucauauccaca

SEQ ID NO: 32024 - RNA, 20 nt, Artificial Sequence
  MKO10032024_A_Mrpl21
  gRNA
guccugcagagguugugaag

SEQ ID NO: 32025 - RNA, 20 nt, Artificial Sequence
  MKO10032025_A_Mrpl21
  gRNA
accggaggaguggcuugccc

SEQ ID NO: 32026 - RNA, 20 nt, Artificial Sequence
  MKO10032026_A_Mrpl22
  gRNA
aaacuuaccgcuggucuccg

SEQ ID NO: 32027 - RNA, 20 nt, Artificial Sequence
  MKO10032027_A_Mrpl22
  gRNA
guuagcuuaccaucuuugcc

SEQ ID NO: 32028 - RNA, 20 nt, Artificial Sequence
  MKO10032028_A_Mrpl22
  gRNA
ucacguugcaggugcacuga

SEQ ID NO: 32029 - RNA, 20 nt, Artificial Sequence
  MKO10032029_A_Mrpl23
  gRNA
ucacuuacuccauggggauc

SEQ ID NO: 32030 - RNA, 20 nt, Artificial Sequence
  MKO10032030_A_Mrpl23
  gRNA
cagguacccccuuuaccaac

SEQ ID NO: 32031 - RNA, 20 nt, Artificial Sequence
  MKO10032031_A_Mrpl23
  gRNA
cucacucaccagcugcacgu

SEQ ID NO: 32032 - RNA, 20 nt, Artificial Sequence
  MKO10032032_A_Mrpl24
  gRNA
ggacagcauuaccgauacau

SEQ ID NO: 32033 - RNA, 20 nt, Artificial Sequence
  MKO10032033_A_Mrpl24
  gRNA
aguuucgcugccgaacgacu

SEQ ID NO: 32034 - RNA, 20 nt, Artificial Sequence
  MKO10032034_A_Mrpl24
  gRNA
gggggcuucacuagcgauca

SEQ ID NO: 32035 - RNA, 20 nt, Artificial Sequence
  MKO10032035_A_Mrpl27
  gRNA
acgcugaggacgcgggcagc

SEQ ID NO: 32036 - RNA, 20 nt, Artificial Sequence
  MKO10032036_A_Mrpl27
  gRNA
ucaggucacuacguucacgc

SEQ ID NO: 32037 - RNA, 20 nt, Artificial Sequence
  MKO10032037_A_Mrpl27
  gRNA
gagcaacucacaugggcucc

SEQ ID NO: 32038 - RNA, 20 nt, Artificial Sequence
  MKO10032038_A_Mrpl28
  gRNA
gaaccugcuccugaagccgc

SEQ ID NO: 32039 - RNA, 20 nt, Artificial Sequence
  MKO10032039_A_Mrpl28
  gRNA
ccucuacguagaccuugaac

SEQ ID NO: 32040 - RNA, 20 nt, Artificial Sequence
  MKO10032040_A_Mrpl28
  gRNA
gaucucaucgaugaggccua

SEQ ID NO: 32041 - RNA, 20 nt, Artificial Sequence
  MKO10032041_A_Mrpl2
  gRNA
ccgcccagugcauaugucug

SEQ ID NO: 32042 - RNA, 20 nt, Artificial Sequence
  MKO10032042_A_Mrpl2
  gRNA
guacuugguacgacucuucc

SEQ ID NO: 32043 - RNA, 20 nt, Artificial Sequence
  MKO10032043_A_Mrpl2
  gRNA
cgcucucuacguuguugaug

SEQ ID NO: 32044 - RNA, 20 nt, Artificial Sequence
  MKO10032044_A_Mrpl30
  gRNA
uucugcgcuccgcguucccg

SEQ ID NO: 32045 - RNA, 20 nt, Artificial Sequence
  MKO10032045_A_Mrpl30
  gRNA
aagcuuaccugcagucugca

SEQ ID NO: 32046 - RNA, 20 nt, Artificial Sequence
  MKO10032046_A_Mrpl30
  gRNA
cugcuucagacugugaagaa

SEQ ID NO: 32047 - RNA, 20 nt, Artificial Sequence
  MKO10032047_A_Mrpl32
  gRNA
ugcgucccggaccgcuccag

SEQ ID NO: 32048 - RNA, 20 nt, Artificial Sequence
  MKO10032048_A_Mrpl32
  gRNA
ggucucuggacggcuaaugc

SEQ ID NO: 32049 - RNA, 20 nt, Artificial Sequence
  MKO10032049_A_Mrpl32
  gRNA
uaucaugugcuagcucugug

SEQ ID NO: 32050 - RNA, 20 nt, Artificial Sequence
  MKO10032050_A_Mrpl33
  gRNA
gugaaacuagugagccaagc

SEQ ID NO: 32051 - RNA, 20 nt, Artificial Sequence
  MKO10032051_A_Mrpl33
  gRNA
cucggagucggcuucucuug

SEQ ID NO: 32052 - RNA, 20 nt, Artificial Sequence
  MKO10032052_A_Mrpl33
  gRNA
gaccgacuuacaagagacag

SEQ ID NO: 32053 - RNA, 20 nt, Artificial Sequence
  MKO10032053_A_Mrpl34
  gRNA
gauacucguuuccgcgcgcg

SEQ ID NO: 32054 - RNA, 20 nt, Artificial Sequence
  MKO10032054_A_Mrpl34
  gRNA
aggaugaccugcacgccggc

SEQ ID NO: 32055 - RNA, 20 nt, Artificial Sequence
  MKO10032055_A_Mrpl34
  gRNA
acacucaccugccacucaau

SEQ ID NO: 32056 - RNA, 20 nt, Artificial Sequence
  MKO10032056_A_Mrpl35
  gRNA
auuccuggcgcaguuccgau

SEQ ID NO: 32057 - RNA, 20 nt, Artificial Sequence
  MKO10032057_A_Mrpl35
  gRNA
caaccuaucggaacugcgcc

SEQ ID NO: 32058 - RNA, 20 nt, Artificial Sequence
  MKO10032058_A_Mrpl35
  gRNA
aagaggcgcaacugguacgc

SEQ ID NO: 32059 - RNA, 20 nt, Artificial Sequence
  MKO10032059_A_Mrpl36
  gRNA
acgcgccaaacccugcgcag

SEQ ID NO: 32060 - RNA, 20 nt, Artificial Sequence
  MKO10032060_A_Mrpl36
  gRNA
ccugcaccugagucgccucg

SEQ ID NO: 32061 - RNA, 20 nt, Artificial Sequence
  MKO10032061_A_Mrpl36
  gRNA
agacucggggcuucaccgcg

SEQ ID NO: 32062 - RNA, 20 nt, Artificial Sequence
  MKO10032062_A_Mrpl37
  gRNA
aaagcguuguggccguaaau

SEQ ID NO: 32063 - RNA, 20 nt, Artificial Sequence
  MKO10032063_A_Mrpl37
  gRNA
gggugaccuaccgcgguucc

SEQ ID NO: 32064 - RNA, 20 nt, Artificial Sequence
  MKO10032064_A_Mrpl37
  gRNA
guaugguacuacuaguaccu

SEQ ID NO: 32065 - RNA, 20 nt, Artificial Sequence
  MKO10032065_A_Mrpl38
  gRNA
ggcgguaccgcucgaagcuc

SEQ ID NO: 32066 - RNA, 20 nt, Artificial Sequence
  MKO10032066_A_Mrpl38
  gRNA
gcucacgucgauguccucgu

SEQ ID NO: 32067 - RNA, 20 nt, Artificial Sequence
  MKO10032067_A_Mrpl38
  gRNA
caaugaagugacuccgaccg

SEQ ID NO: 32068 - RNA, 20 nt, Artificial Sequence
  MKO10032068_A_Mrpl39
  gRNA
guuaucguuaaccccccgaa

SEQ ID NO: 32069 - RNA, 20 nt, Artificial Sequence
  MKO10032069_A_Mrpl39
  gRNA
ccgcauuucugucagcuccg

SEQ ID NO: 32070 - RNA, 20 nt, Artificial Sequence
  MKO10032070_A_Mrpl39
  gRNA
gcguucuugugccaugaugc

SEQ ID NO: 32071 - RNA, 20 nt, Artificial Sequence
  MKO10032071_A_Mrpl3
  gRNA
acuuacauagaagcgugaca

SEQ ID NO: 32072 - RNA, 20 nt, Artificial Sequence
  MKO10032072_A_Mrpl3
  gRNA
gauaacgcuguaauuaagcc

SEQ ID NO: 32073 - RNA, 20 nt, Artificial Sequence
  MKO10032073_A_Mrpl3
  gRNA
gcaugcagucacauuacuac

SEQ ID NO: 32074 - RNA, 20 nt, Artificial Sequence
  MKO10032074_A_Mrpl40
  gRNA
uaggcugguaucccgcuuua

SEQ ID NO: 32075 - RNA, 20 nt, Artificial Sequence
  MKO10032075_A_Mrpl40
  gRNA
uguucacagacagcgaccuc

SEQ ID NO: 32076 - RNA, 20 nt, Artificial Sequence
  MKO10032076_A_Mrpl40
  gRNA
cgugaaaaacuauggcuacc

SEQ ID NO: 32077 - RNA, 20 nt, Artificial Sequence
  MKO10032077_A_Mrpl41
  gRNA
gacauuugaugcuaacaacc

SEQ ID NO: 32078 - RNA, 20 nt, Artificial Sequence
  MKO10032078_A_Mrpl41
  gRNA
uuccugacugccgugacuca

SEQ ID NO: 32079 - RNA, 20 nt, Artificial Sequence
  MKO10032079_A_Mrpl41
  gRNA
cgacucuuagugaaggugcg

SEQ ID NO: 32080 - RNA, 20 nt, Artificial Sequence
  MKO10032080_A_Mrpl42
  gRNA
gauggacuuacuguccgugc

SEQ ID NO: 32081 - RNA, 20 nt, Artificial Sequence
  MKO10032081_A_Mrpl42
  gRNA
gcguaccaauuguagucauc

SEQ ID NO: 32082 - RNA, 20 nt, Artificial Sequence
  MKO10032082_A_Mrpl42
  gRNA
acguacuuugguguguucgu

SEQ ID NO: 32083 - RNA, 20 nt, Artificial Sequence
  MKO10032083_A_Mrpl43
  gRNA
accguagccaugaccggucg

SEQ ID NO: 32084 - RNA, 20 nt, Artificial Sequence
  MKO10032084_A_Mrpl43
  gRNA
gaugcggaucacauccaagc

SEQ ID NO: 32085 - RNA, 20 nt, Artificial Sequence
  MKO10032085_A_Mrpl43
  gRNA
uucacguauacuacgacucc

SEQ ID NO: 32086 - RNA, 20 nt, Artificial Sequence
  MKO10032086_A_Mrpl44
  gRNA
uucccagacuugcccgccga

SEQ ID NO: 32087 - RNA, 20 nt, Artificial Sequence
  MKO10032087_A_Mrpl44
  gRNA
gcagggcccucgccgccuau

SEQ ID NO: 32088 - RNA, 20 nt, Artificial Sequence
  MKO10032088_A_Mrpl44
  gRNA
cuccucuacgaguaguccca

SEQ ID NO: 32089 - RNA, 20 nt, Artificial Sequence
  MKO10032089_A_Mrpl45
  gRNA
aaugaccaaucccgcuuucc

SEQ ID NO: 32090 - RNA, 20 nt, Artificial Sequence
  MKO10032090_A_Mrpl45
  gRNA
ccuauacauuuggccuguac

SEQ ID NO: 32091 - RNA, 20 nt, Artificial Sequence
  MKO10032091_A_Mrpl45
  gRNA
accuaccggaaaacaguguu

SEQ ID NO: 32092 - RNA, 20 nt, Artificial Sequence
  MKO10032092_A_Mrpl46
  gRNA
gucuagcuuucgaugcaacg

SEQ ID NO: 32093 - RNA, 20 nt, Artificial Sequence
  MKO10032093_A_Mrpl46
  gRNA
cccuaaaagaguacgcccua

SEQ ID NO: 32094 - RNA, 20 nt, Artificial Sequence
  MKO10032094_A_Mrpl46
  gRNA
cagcccggggagacccuucg

SEQ ID NO: 32095 - RNA, 20 nt, Artificial Sequence
  MKO10032095_A_Mrpl47
  gRNA
accgcaggucguugauucca

SEQ ID NO: 32096 - RNA, 20 nt, Artificial Sequence
  MKO10032096_A_Mrpl47
  gRNA
aacuuuaucuacguuaucca

SEQ ID NO: 32097 - RNA, 20 nt, Artificial Sequence
  MKO10032097_A_Mrpl47
  gRNA
aaguccggagcgcuuagaaa

SEQ ID NO: 32098 - RNA, 20 nt, Artificial Sequence
  MKO10032098_A_Mrpl48
  gRNA
uguccaucaaagucgaggaa

SEQ ID NO: 32099 - RNA, 20 nt, Artificial Sequence
  MKO10032099_A_Mrpl48
  gRNA
guaucuuccgaugccacgag

SEQ ID NO: 32100 - RNA, 20 nt, Artificial Sequence
  MKO10032100_A_Mrpl48
  gRNA
cuaccuuuccucgacuuuga

SEQ ID NO: 32101 - RNA, 20 nt, Artificial Sequence
  MKO10032101_A_Mrpl49
  gRNA
gucgcccguagcuccgaccg

SEQ ID NO: 32102 - RNA, 20 nt, Artificial Sequence
  MKO10032102_A_Mrpl49
  gRNA
ccgagagcgacgaacaaagu

SEQ ID NO: 32103 - RNA, 20 nt, Artificial Sequence
  MKO10032103_A_Mrpl49
  gRNA
ccuacuuuguucgucgcucu

SEQ ID NO: 32104 - RNA, 20 nt, Artificial Sequence
  MKO10032104_A_Mrpl4
  gRNA
aggcgccguugcaaacacgu

SEQ ID NO: 32105 - RNA, 20 nt, Artificial Sequence
  MKO10032105_A_Mrpl4
  gRNA
gucucaccagcgcuaucucg

SEQ ID NO: 32106 - RNA, 20 nt, Artificial Sequence
  MKO10032106_A_Mrpl4
  gRNA
ccacucaccuccucgccaua

SEQ ID NO: 32107 - RNA, 20 nt, Artificial Sequence
  MKO10032107_A_Mrpl50
  gRNA
uggcggcgcugaucgugucu

SEQ ID NO: 32108 - RNA, 20 nt, Artificial Sequence
  MKO10032108_A_Mrpl50
  gRNA
uaugagauuccaagcgacuc

SEQ ID NO: 32109 - RNA, 20 nt, Artificial Sequence
  MKO10032109_A_Mrpl50
  gRNA
gccuggaguuagggaccgca

SEQ ID NO: 32110 - RNA, 20 nt, Artificial Sequence
  MKO10032110_A_Mrpl51
  gRNA
uugaucgcuggaacgagaag

SEQ ID NO: 32111 - RNA, 20 nt, Artificial Sequence
  MKO10032111_A_Mrpl51
  gRNA
uucccuaggcgucccacggu

SEQ ID NO: 32112 - RNA, 20 nt, Artificial Sequence
  MKO10032112_A_Mrpl51
  gRNA
acuuacccagagagaagcuu

SEQ ID NO: 32113 - RNA, 20 nt, Artificial Sequence
  MKO10032113_A_Mrpl52
  gRNA
gcacucacuggagucgccac

SEQ ID NO: 32114 - RNA, 20 nt, Artificial Sequence
  MKO10032114_A_Mrpl52
  gRNA
gagauugcacugcagcguag

SEQ ID NO: 32115 - RNA, 20 nt, Artificial Sequence
  MKO10032115_A_Mrpl52
  gRNA
ucacccgcgaaggaccaguc

SEQ ID NO: 32116 - RNA, 20 nt, Artificial Sequence
  MKO10032116_A_Mrpl53
  gRNA
cggacuacggccggucaagc

SEQ ID NO: 32117 - RNA, 20 nt, Artificial Sequence
  MKO10032117_A_Mrpl53
  gRNA
accgaacaacacguccacgc

SEQ ID NO: 32118 - RNA, 20 nt, Artificial Sequence
  MKO10032118_A_Mrpl53
  gRNA
gguaaccauggcggcggcuu

SEQ ID NO: 32119 - RNA, 20 nt, Artificial Sequence
  MKO10032119_A_Mrpl54
  gRNA
cuucccgggugugggcccgc

SEQ ID NO: 32120 - RNA, 20 nt, Artificial Sequence
  MKO10032120_A_Mrpl54
  gRNA
uggcggccgcccaucuccuc

SEQ ID NO: 32121 - RNA, 20 nt, Artificial Sequence
  MKO10032121_A_Mrpl54
  gRNA
gaaguagucgccaguacucu

SEQ ID NO: 32122 - RNA, 20 nt, Artificial Sequence
  MKO10032122_A_Mrpl55
  gRNA
ccgguaucggauauggauag

SEQ ID NO: 32123 - RNA, 20 nt, Artificial Sequence
  MKO10032123_A_Mrpl55
  gRNA
cuuaccgccagcaugcgucg

SEQ ID NO: 32124 - RNA, 20 nt, Artificial Sequence
  MKO10032124_A_Mrpl55
  gRNA
aaccgggcccugcgcucuuc

SEQ ID NO: 32125 - RNA, 20 nt, Artificial Sequence
  MKO10032125_A_Mrpl9
  gRNA
ccaccagagcacggucaucg

SEQ ID NO: 32126 - RNA, 20 nt, Artificial Sequence
  MKO10032126_A_Mrpl9
  gRNA
ugguggaaggugccgcucgc

SEQ ID NO: 32127 - RNA, 20 nt, Artificial Sequence
  MKO10032127_A_Mrpl9
  gRNA
cucuuucagcugagacgcga

SEQ ID NO: 32128 - RNA, 20 nt, Artificial Sequence
  MKO10032128_A_Mrps10
  gRNA
aauucagacacgagccgcca

SEQ ID NO: 32129 - RNA, 20 nt, Artificial Sequence
  MKO10032129_A_Mrps10
  gRNA
aaaggaugugaccagaccua

SEQ ID NO: 32130 - RNA, 20 nt, Artificial Sequence
  MKO10032130_A_Mrps10
  gRNA
ccauaccuuugucacuucca

SEQ ID NO: 32131 - RNA, 20 nt, Artificial Sequence
  MKO10032131_A_Mrps11
  gRNA
aagcggcuccaagucgcuuc

SEQ ID NO: 32132 - RNA, 20 nt, Artificial Sequence
  MKO10032132_A_Mrps11
  gRNA
uacccucaccugaagcgacu

SEQ ID NO: 32133 - RNA, 20 nt, Artificial Sequence
  MKO10032133_A_Mrps11
  gRNA
ggcgcgggccagggacgcau

SEQ ID NO: 32134 - RNA, 20 nt, Artificial Sequence
  MKO10032134_A_Mrps12
  gRNA
gggugcgaccacccuccacg

SEQ ID NO: 32135 - RNA, 20 nt, Artificial Sequence
  MKO10032135_A_Mrps12
  gRNA
cucaccacgucccucagucg

SEQ ID NO: 32136 - RNA, 20 nt, Artificial Sequence
  MKO10032136_A_Mrps12
  gRNA
gaaggaacccccuaagcguc

SEQ ID NO: 32137 - RNA, 20 nt, Artificial Sequence
  MKO10032137_A_Mrps14
  gRNA
aacauggcggcguccgugcu

SEQ ID NO: 32138 - RNA, 20 nt, Artificial Sequence
  MKO10032138_A_Mrps14
  gRNA
cagcgacgcuuaacaccacg

SEQ ID NO: 32139 - RNA, 20 nt, Artificial Sequence
  MKO10032139_A_Mrps14
  gRNA
guuaugacaucucgcccacg

SEQ ID NO: 32140 - RNA, 20 nt, Artificial Sequence
  MKO10032140_A_Mrps15
  gRNA
uacgccgccguccagaaacc

SEQ ID NO: 32141 - RNA, 20 nt, Artificial Sequence
  MKO10032141_A_Mrps15
  gRNA
guauucuuugaugaacgcag

SEQ ID NO: 32142 - RNA, 20 nt, Artificial Sequence
  MKO10032142_A_Mrps15
  gRNA
gggugguucaucguccugcu

SEQ ID NO: 32143 - RNA, 20 nt, Artificial Sequence
  MKO10032143_A_Mrps16
  gRNA
aaaacuaguugcccucaacc

SEQ ID NO: 32144 - RNA, 20 nt, Artificial Sequence
  MKO10032144_A_Mrps16
  gRNA
uggccgauuuguggagcagu

SEQ ID NO: 32145 - RNA, 20 nt, Artificial Sequence
  MKO10032145_A_Mrps16
  gRNA
gcacucacugagcuggacca

SEQ ID NO: 32146 - RNA, 20 nt, Artificial Sequence
  MKO10032146_A_Mrps17
  gRNA
ugcuucacaugcuucgaucg

SEQ ID NO: 32147 - RNA, 20 nt, Artificial Sequence
  MKO10032147_A_Mrps17
  gRNA
guucauccguccacgccaaa

SEQ ID NO: 32148 - RNA, 20 nt, Artificial Sequence
  MKO10032148_A_Mrps17
  gRNA
cgaguuaucgaccccgucac

SEQ ID NO: 32149 - RNA, 20 nt, Artificial Sequence
  MKO10032149_A_Mrps18a
  gRNA
gacuucuuaccgguugagcu

SEQ ID NO: 32150 - RNA, 20 nt, Artificial Sequence
  MKO10032150_A_Mrps18a
  gRNA
ggaagaacaccgaaaaaucg

SEQ ID NO: 32151 - RNA, 20 nt, Artificial Sequence
  MKO10032151_A_Mrps18a
  gRNA
gugaagauggcucaucgagc

SEQ ID NO: 32152 - RNA, 20 nt, Artificial Sequence
  MKO10032152_A_Mrps18b
  gRNA
cagcguaacaauaaaguugc

SEQ ID NO: 32153 - RNA, 20 nt, Artificial Sequence
  MKO10032153_A_Mrps18b
  gRNA
ucagaauaccacaaccgcua

SEQ ID NO: 32154 - RNA, 20 nt, Artificial Sequence
  MKO10032154_A_Mrps18b
  gRNA
gacuaccgccgcaaccacaa

SEQ ID NO: 32155 - RNA, 20 nt, Artificial Sequence
  MKO10032155_A_Mrps18c
  gRNA
ucuuaccagguccucauugc

SEQ ID NO: 32156 - RNA, 20 nt, Artificial Sequence
  MKO10032156_A_Mrps18c
  gRNA
uuuauccuagccagucccaa

SEQ ID NO: 32157 - RNA, 20 nt, Artificial Sequence
  MKO10032157_A_Mrps18c
  gRNA
uccuuguagggguucuccau

SEQ ID NO: 32158 - RNA, 20 nt, Artificial Sequence
  MKO10032158_A_Mrps21
  gRNA
gcgucgucgacuuaugacuu

SEQ ID NO: 32159 - RNA, 20 nt, Artificial Sequence
  MKO10032159_A_Mrps21
  gRNA
gugccuaccggacccugaac

SEQ ID NO: 32160 - RNA, 20 nt, Artificial Sequence
  MKO10032160_A_Mrps21
  gRNA
agccuugccgccgccgccag

SEQ ID NO: 32161 - RNA, 20 nt, Artificial Sequence
  MKO10032161_A_Mrps22
  gRNA
gcuuugcguagugugccacu

SEQ ID NO: 32162 - RNA, 20 nt, Artificial Sequence
  MKO10032162_A_Mrps22
  gRNA
agauuccgcugaguauauca

SEQ ID NO: 32163 - RNA, 20 nt, Artificial Sequence
  MKO10032163_A_Mrps22
  gRNA
ucagcuaauacgucauuuau

SEQ ID NO: 32164 - RNA, 20 nt, Artificial Sequence
  MKO10032164_A_Mrps23
  gRNA
cguaucgcaagcggggccuu

SEQ ID NO: 32165 - RNA, 20 nt, Artificial Sequence
  MKO10032165_A_Mrps23
  gRNA
acgcucgaaucugauccucc

SEQ ID NO: 32166 - RNA, 20 nt, Artificial Sequence
  MKO10032166_A_Mrps23
  gRNA
acuucaagucuaccugucag

SEQ ID NO: 32167 - RNA, 20 nt, Artificial Sequence
  MKO10032167_A_Mrps24
  gRNA
cccuagcccgcgcaccgacg

SEQ ID NO: 32168 - RNA, 20 nt, Artificial Sequence
  MKO10032168_A_Mrps24
  gRNA
gcacuacaucgcacaccgaa

SEQ ID NO: 32169 - RNA, 20 nt, Artificial Sequence
  MKO10032169_A_Mrps24
  gRNA
acucaccuuggcgcagaccg

SEQ ID NO: 32170 - RNA, 20 nt, Artificial Sequence
  MKO10032170_A_Mrps25
  gRNA
uacugcagcguacggcggau

SEQ ID NO: 32171 - RNA, 20 nt, Artificial Sequence
  MKO10032171_A_Mrps25
  gRNA
ccgccguacgcugcaguacc

SEQ ID NO: 32172 - RNA, 20 nt, Artificial Sequence
  MKO10032172_A_Mrps25
  gRNA
cuucgcacaugcacucccgc

SEQ ID NO: 32173 - RNA, 20 nt, Artificial Sequence
  MKO10032173_A_Mrps26
  gRNA
ucaacacgaagaauuccgca

SEQ ID NO: 32174 - RNA, 20 nt, Artificial Sequence
  MKO10032174_A_Mrps26
  gRNA
ccuggaaccgggacgagaac

SEQ ID NO: 32175 - RNA, 20 nt, Artificial Sequence
  MKO10032175_A_Mrps26
  gRNA
guugcgcgcucugaaccgcc

SEQ ID NO: 32176 - RNA, 20 nt, Artificial Sequence
  MKO10032176_A_Mrps27
  gRNA
ccugcuuucugcagcguacg

SEQ ID NO: 32177 - RNA, 20 nt, Artificial Sequence
  MKO10032177_A_Mrps27
  gRNA
ccacguacgcugcagaaagc

SEQ ID NO: 32178 - RNA, 20 nt, Artificial Sequence
  MKO10032178_A_Mrps27
  gRNA
uucgacacagucccaacugc

SEQ ID NO: 32179 - RNA, 20 nt, Artificial Sequence
  MKO10032179_A_Mrps28
  gRNA
ggagucguggguugcgcucu

SEQ ID NO: 32180 - RNA, 20 nt, Artificial Sequence
  MKO10032180_A_Mrps28
  gRNA
aagccgccugaacgcgcccg

SEQ ID NO: 32181 - RNA, 20 nt, Artificial Sequence
  MKO10032181_A_Mrps28
  gRNA
gcgcaucuuccauaucgugg

SEQ ID NO: 32182 - RNA, 20 nt, Artificial Sequence
  MKO10032182_A_Mrps2
  gRNA
gggccaagauaucaucgauc

SEQ ID NO: 32183 - RNA, 20 nt, Artificial Sequence
  MKO10032183_A_Mrps2
  gRNA
ggcucgcugacugcggggac

SEQ ID NO: 32184 - RNA, 20 nt, Artificial Sequence
  MKO10032184_A_Mrps2
  gRNA
gauccagaucgaugauaucu

SEQ ID NO: 32185 - RNA, 20 nt, Artificial Sequence
  MKO10032185_A_Mrps30
  gRNA
guugcuuagauauucgaauc

SEQ ID NO: 32186 - RNA, 20 nt, Artificial Sequence
  MKO10032186_A_Mrps30
  gRNA
acccccguaaaaaucuaugu

SEQ ID NO: 32187 - RNA, 20 nt, Artificial Sequence
  MKO10032187_A_Mrps30
  gRNA
ucauacugccgucugaacaa

SEQ ID NO: 32188 - RNA, 20 nt, Artificial Sequence
  MKO10032188_A_Mrps31
  gRNA
gauucaguuugacgaagaca

SEQ ID NO: 32189 - RNA, 20 nt, Artificial Sequence
  MKO10032189_A_Mrps31
  gRNA
gcugaugaaccaccugaacc

SEQ ID NO: 32190 - RNA, 20 nt, Artificial Sequence
  MKO10032190_A_Mrps31
  gRNA
cuuaacaaaccugguucagg

SEQ ID NO: 32191 - RNA, 20 nt, Artificial Sequence
  MKO10032191_A_Mrps33
  gRNA
ugaagaaaugucuccgcuuu

SEQ ID NO: 32192 - RNA, 20 nt, Artificial Sequence
  MKO10032192_A_Mrps33
  gRNA
ggacuuugagucaguagacc

SEQ ID NO: 32193 - RNA, 20 nt, Artificial Sequence
  MKO10032193_A_Mrps33
  gRNA
gcaugucucgucugagugcc

SEQ ID NO: 32194 - RNA, 20 nt, Artificial Sequence
  MKO10032194_A_Mrps34
  gRNA
cgcgugaggcgccaguagca

SEQ ID NO: 32195 - RNA, 20 nt, Artificial Sequence
  MKO10032195_A_Mrps34
  gRNA
gcggcucucgcgacgcacgu

SEQ ID NO: 32196 - RNA, 20 nt, Artificial Sequence
  MKO10032196_A_Mrps34
  gRNA
agcaagucauguaccacgau

SEQ ID NO: 32197 - RNA, 20 nt, Artificial Sequence
  MKO10032197_A_Mrps35
  gRNA
uccgcuguaucaaucucaac

SEQ ID NO: 32198 - RNA, 20 nt, Artificial Sequence
  MKO10032198_A_Mrps35
  gRNA
aagcccgagccguaacguua

SEQ ID NO: 32199 - RNA, 20 nt, Artificial Sequence
  MKO10032199_A_Mrps35
  gRNA
cgcggcagugggguaaacac

SEQ ID NO: 32200 - RNA, 20 nt, Artificial Sequence
  MKO10032200_A_Mrps36
  gRNA
uacaacuuaccacugaguuu

SEQ ID NO: 32201 - RNA, 20 nt, Artificial Sequence
  MKO10032201_A_Mrps36
  gRNA
agagacaaaccuaaacucag

SEQ ID NO: 32202 - RNA, 20 nt, Artificial Sequence
  MKO10032202_A_Mrps36
  gRNA
ggucacgaugggcagcaaga

SEQ ID NO: 32203 - RNA, 20 nt, Artificial Sequence
  MKO10032203_A_Mrps5
  gRNA
uuaaagagaguugccuagac

SEQ ID NO: 32204 - RNA, 20 nt, Artificial Sequence
  MKO10032204_A_Mrps5
  gRNA
gugguugcgccuuguuuccc

SEQ ID NO: 32205 - RNA, 20 nt, Artificial Sequence
  MKO10032205_A_Mrps5
  gRNA
cugcuggcccguccaguugc

SEQ ID NO: 32206 - RNA, 20 nt, Artificial Sequence
  MKO10032206_A_Mrps6
  gRNA
ggcgaugccccgcuacgagu

SEQ ID NO: 32207 - RNA, 20 nt, Artificial Sequence
  MKO10032207_A_Mrps6
  gRNA
gugagcgugcgcuccccuac

SEQ ID NO: 32208 - RNA, 20 nt, Artificial Sequence
  MKO10032208_A_Mrps6
  gRNA
cuuggcgcgagacauugacg

SEQ ID NO: 32209 - RNA, 20 nt, Artificial Sequence
  MKO10032209_A_Mrps7
  gRNA
cccggaauucgggggcauag

SEQ ID NO: 32210 - RNA, 20 nt, Artificial Sequence
  MKO10032210_A_Mrps7
  gRNA
agugccgagagaauaaaccg

SEQ ID NO: 32211 - RNA, 20 nt, Artificial Sequence
  MKO10032211_A_Mrps7
  gRNA
cgccgacgucggucagcgag

SEQ ID NO: 32212 - RNA, 20 nt, Artificial Sequence
  MKO10032212_A_Mrps9
  gRNA
cgcuucucaaacaaaccacu

SEQ ID NO: 32213 - RNA, 20 nt, Artificial Sequence
  MKO10032213_A_Mrps9
  gRNA
acggccaucuucuccccacu

SEQ ID NO: 32214 - RNA, 20 nt, Artificial Sequence
  MKO10032214_A_Mrps9
  gRNA
guuaggauuaccuucaucau

SEQ ID NO: 32215 - RNA, 20 nt, Artificial Sequence
  MKO10032215_A_Mrrf
  gRNA
cauuagacucaucgagaagc

SEQ ID NO: 32216 - RNA, 20 nt, Artificial Sequence
  MKO10032216_A_Mrrf
  gRNA
uauuaacggucacccuggcc

SEQ ID NO: 32217 - RNA, 20 nt, Artificial Sequence
  MKO10032217_A_Mrrf
  gRNA
ggugaccguuaauagagccu

SEQ ID NO: 32218 - RNA, 20 nt, Artificial Sequence
  MKO10032218_A_Mrs2
  gRNA
ucaagccacuuuagccagcg

SEQ ID NO: 32219 - RNA, 20 nt, Artificial Sequence
  MKO10032219_A_Mrs2
  gRNA
ucaggcuuacccaguacugc

SEQ ID NO: 32220 - RNA, 20 nt, Artificial Sequence
  MKO10032220_A_Mrs2
  gRNA
gcaucacuacuagaaacaac

SEQ ID NO: 32221 - RNA, 20 nt, Artificial Sequence
  MKO10032221_A_Mrto4
  gRNA
cccacagcuucggaaaugug

SEQ ID NO: 32222 - RNA, 20 nt, Artificial Sequence
  MKO10032222_A_Mrto4
  gRNA
cgcucaccggcuguguuucc

SEQ ID NO: 32223 - RNA, 20 nt, Artificial Sequence
  MKO10032223_A_Mrto4
  gRNA
aagcacuuaccucuucuauc

SEQ ID NO: 32224 - RNA, 20 nt, Artificial Sequence
  MKO10032224_A_Mrvi1
  gRNA
aucccccgucaggacgauug

SEQ ID NO: 32225 - RNA, 20 nt, Artificial Sequence
  MKO10032225_A_Mrvi1
  gRNA
cccgccgugggaggaaauca

SEQ ID NO: 32226 - RNA, 20 nt, Artificial Sequence
  MKO10032226_A_Mrvi1
  gRNA
gcuuucccaccgacaccuga

SEQ ID NO: 32227 - RNA, 20 nt, Artificial Sequence
  MKO10032227_A_Ms4a10
  gRNA
gcagaacaagcugauaacgu

SEQ ID NO: 32228 - RNA, 20 nt, Artificial Sequence
  MKO10032228_A_Ms4a10
  gRNA
uaucagcuuguucugcgcac

SEQ ID NO: 32229 - RNA, 20 nt, Artificial Sequence
  MKO10032229_A_Ms4a10
  gRNA
ggucugcaguuucucguugc

SEQ ID NO: 32230 - RNA, 20 nt, Artificial Sequence
  MKO10032230_A_Ms4a13
  gRNA
gauagauuccaaucauaauc

SEQ ID NO: 32231 - RNA, 20 nt, Artificial Sequence
  MKO10032231_A_Ms4a13
  gRNA
cagguuauccagauuaugau

SEQ ID NO: 32232 - RNA, 20 nt, Artificial Sequence
  MKO10032232_A_Ms4a13
  gRNA
ucggugucauauagaaauua

SEQ ID NO: 32233 - RNA, 20 nt, Artificial Sequence
  MKO10032233_A_Ms4a15
  gRNA
ccggucaagaacgucuccau

SEQ ID NO: 32234 - RNA, 20 nt, Artificial Sequence
  MKO10032234_A_Ms4a15
  gRNA
caagguggaugagaccgauc

SEQ ID NO: 32235 - RNA, 20 nt, Artificial Sequence
  MKO10032235_A_Ms4a15
  gRNA
aucccgcccagcaacgccag

SEQ ID NO: 32236 - RNA, 20 nt, Artificial Sequence
  MKO10032236_A_Ms4a18
  gRNA
cuacaacacucaauucuucg

SEQ ID NO: 32237 - RNA, 20 nt, Artificial Sequence
  MKO10032237_A_Ms4a18
  gRNA
gaugaauucaaggagggcga

SEQ ID NO: 32238 - RNA, 20 nt, Artificial Sequence
  MKO10032238_A_Ms4a18
  gRNA
caucagaggacuaaucucac

SEQ ID NO: 32239 - RNA, 20 nt, Artificial Sequence
  MKO10032239_A_Ms4a1
  gRNA
ggaucaucagcagucccccc

SEQ ID NO: 32240 - RNA, 20 nt, Artificial Sequence
  MKO10032240_A_Ms4a1
  gRNA
ggaagaggccauucaugauu

SEQ ID NO: 32241 - RNA, 20 nt, Artificial Sequence
  MKO10032241_A_Ms4a1
  gRNA
cagucguagauaucaacaua

SEQ ID NO: 32242 - RNA, 20 nt, Artificial Sequence
  MKO10032242_A_Ms4a2
  gRNA
cacaaagcagccgucgucuu

SEQ ID NO: 32243 - RNA, 20 nt, Artificial Sequence
  MKO10032243_A_Ms4a2
  gRNA
aagaauguaaccgaagacga

SEQ ID NO: 32244 - RNA, 20 nt, Artificial Sequence
  MKO10032244_A_Ms4a2
  gRNA
aauguccgccaugucugcuu

SEQ ID NO: 32245 - RNA, 20 nt, Artificial Sequence
  MKO10032245_A_Ms4a3
  gRNA
auacaucugaugaggaaccc

SEQ ID NO: 32246 - RNA, 20 nt, Artificial Sequence
  MKO10032246_A_Ms4a3
  gRNA
gagaaaccccacacgaaugc

SEQ ID NO: 32247 - RNA, 20 nt, Artificial Sequence
  MKO10032247_A_Ms4a3
  gRNA
agcacuuaccagcauucgug

SEQ ID NO: 32248 - RNA, 20 nt, Artificial Sequence
  MKO10032248_A_Ms4a4b
  gRNA
gauaguguucagaguuagac

SEQ ID NO: 32249 - RNA, 20 nt, Artificial Sequence
  MKO10032249_A_Ms4a4b
  gRNA
uuccuguuguaacucccgug

SEQ ID NO: 32250 - RNA, 20 nt, Artificial Sequence
  MKO10032250_A_Ms4a4b
  gRNA
acccacuucagugauguuaa

SEQ ID NO: 32251 - RNA, 20 nt, Artificial Sequence
  MKO10032251_A_Ms4a4c
  gRNA
aaauuauuauuccgaagcug

SEQ ID NO: 32252 - RNA, 20 nt, Artificial Sequence
  MKO10032252_A_Ms4a4c
  gRNA
uuccuguuguaacuccagcg

SEQ ID NO: 32253 - RNA, 20 nt, Artificial Sequence
  MKO10032253_A_Ms4a4c
  gRNA
caccucgcuggaguuacaac

SEQ ID NO: 32254 - RNA, 20 nt, Artificial Sequence
  MKO10032254_A_Ms4a4d
  gRNA
auucaugucagugcucuuac

SEQ ID NO: 32255 - RNA, 20 nt, Artificial Sequence
  MKO10032255_A_Ms4a4d
  gRNA
uaaauacucacagcgauggc

SEQ ID NO: 32256 - RNA, 20 nt, Artificial Sequence
  MKO10032256_A_Ms4a4d
  gRNA
ggcgucaucagugugauuuc

SEQ ID NO: 32257 - RNA, 20 nt, Artificial Sequence
  MKO10032257_A_Ms4a5
  gRNA
cacuaaguaaauucauugcc

SEQ ID NO: 32258 - RNA, 20 nt, Artificial Sequence
  MKO10032258_A_Ms4a5
  gRNA
acaccacacugcauaccauc

SEQ ID NO: 32259 - RNA, 20 nt, Artificial Sequence
  MKO10032259_A_Ms4a5
  gRNA
ccuuggguauggguuuacca

SEQ ID NO: 32260 - RNA, 20 nt, Artificial Sequence
  MKO10032260_A_Ms4a6b
  gRNA
gaugcugaucaguacuaugu

SEQ ID NO: 32261 - RNA, 20 nt, Artificial Sequence
  MKO10032261_A_Ms4a6b
  gRNA
cuuugccgccaagucuguuc

SEQ ID NO: 32262 - RNA, 20 nt, Artificial Sequence
  MKO10032262_A_Ms4a6b
  gRNA
ugacuuugucuccgugacga

SEQ ID NO: 32263 - RNA, 20 nt, Artificial Sequence
  MKO10032263_A_Ms4a6c
  gRNA
ucugagcaguuuauugccuc

SEQ ID NO: 32264 - RNA, 20 nt, Artificial Sequence
  MKO10032264_A_Ms4a6c
  gRNA
aaccuuucuacaacucagac

SEQ ID NO: 32265 - RNA, 20 nt, Artificial Sequence
  MKO10032265_A_Ms4a6c
  gRNA
ugacuuucucuccguaauga

SEQ ID NO: 32266 - RNA, 20 nt, Artificial Sequence
  MKO10032266_A_Ms4a6d
  gRNA
gccauuaaacagcugcuucg

SEQ ID NO: 32267 - RNA, 20 nt, Artificial Sequence
  MKO10032267_A_Ms4a6d
  gRNA
ugccuugcagcaauguaagc

SEQ ID NO: 32268 - RNA, 20 nt, Artificial Sequence
  MKO10032268_A_Ms4a6d
  gRNA
cccgagcaguuugccaucuc

SEQ ID NO: 32269 - RNA, 20 nt, Artificial Sequence
  MKO10032269_A_Ms4a7
  gRNA
cacuaggcacuccaaucagc

SEQ ID NO: 32270 - RNA, 20 nt, Artificial Sequence
  MKO10032270_A_Ms4a7
  gRNA
gguacuuaccccagguuugu

SEQ ID NO: 32271 - RNA, 20 nt, Artificial Sequence
  MKO10032271_A_Ms4a7
  gRNA
ggcaccaugcgucuacagcu

SEQ ID NO: 32272 - RNA, 20 nt, Artificial Sequence
  MKO10032272_A_Ms4a8a
  gRNA
gcaggcgguucggucauagc

SEQ ID NO: 32273 - RNA, 20 nt, Artificial Sequence
  MKO10032273_A_Ms4a8a
  gRNA
accgcccaacaguuauccug

SEQ ID NO: 32274 - RNA, 20 nt, Artificial Sequence
  MKO10032274_A_Ms4a8a
  gRNA
cccuagcuacuacccuuacc

SEQ ID NO: 32275 - RNA, 20 nt, Artificial Sequence
  MKO10032275_A_Msantd1
  gRNA
agcaucggagggcccgcaac

SEQ ID NO: 32276 - RNA, 20 nt, Artificial Sequence
  MKO10032276_A_Msantd1
  gRNA
agauagcgaguccaucccgc

SEQ ID NO: 32277 - RNA, 20 nt, Artificial Sequence
  MKO10032277_A_Msantd1
  gRNA
guacaccuuggcauugcgcu

SEQ ID NO: 32278 - RNA, 20 nt, Artificial Sequence
  MKO10032278_A_Msantd2
  gRNA
cgaacgcgcucaucgcugua

SEQ ID NO: 32279 - RNA, 20 nt, Artificial Sequence
  MKO10032279_A_Msantd2
  gRNA
cuugcugccgaauaccgugc

SEQ ID NO: 32280 - RNA, 20 nt, Artificial Sequence
  MKO10032280_A_Msantd2
  gRNA
uagcaguagaugauccgggu

SEQ ID NO: 32281 - RNA, 20 nt, Artificial Sequence
  MKO10032281_A_Msantd3
  gRNA
ggcccgucuccucguuuaac

SEQ ID NO: 32282 - RNA, 20 nt, Artificial Sequence
  MKO10032282_A_Msantd3
  gRNA
aaugcaagaagagcgacgcg

SEQ ID NO: 32283 - RNA, 20 nt, Artificial Sequence
  MKO10032283_A_Msantd3
  gRNA
cgcacucgcgcucgaucugc

SEQ ID NO: 32284 - RNA, 20 nt, Artificial Sequence
  MKO10032284_A_Msantd4
  gRNA
ugagcgcgaacgucuacagc

SEQ ID NO: 32285 - RNA, 20 nt, Artificial Sequence
  MKO10032285_A_Msantd4
  gRNA
gaaagagcgccugcgccacc

SEQ ID NO: 32286 - RNA, 20 nt, Artificial Sequence
  MKO10032286_A_Msantd4
  gRNA
ucaugagugcgcgccagucc

SEQ ID NO: 32287 - RNA, 20 nt, Artificial Sequence
  MKO10032287_A_Msc
  gRNA
agccguaaccgcgcuccaug

SEQ ID NO: 32288 - RNA, 20 nt, Artificial Sequence
  MKO10032288_A_Msc
  gRNA
ucuuccccgcaccgccugcg

SEQ ID NO: 32289 - RNA, 20 nt, Artificial Sequence
  MKO10032289_A_Msc
  gRNA
aagacguuucugcagccaac

SEQ ID NO: 32290 - RNA, 20 nt, Artificial Sequence
  MKO10032290_A_Msgn1
  gRNA
ccucccggguauggacaacc

SEQ ID NO: 32291 - RNA, 20 nt, Artificial Sequence
  MKO10032291_A_Msgn1
  gRNA
cgauggcuacggcagucacg

SEQ ID NO: 32292 - RNA, 20 nt, Artificial Sequence
  MKO10032292_A_Msgn1
  gRNA
guaauccagcucgacuaagc

SEQ ID NO: 32293 - RNA, 20 nt, Artificial Sequence
  MKO10032293_A_Msh2
  gRNA
uuuaauacccauaacgccaa

SEQ ID NO: 32294 - RNA, 20 nt, Artificial Sequence
  MKO10032294_A_Msh2
  gRNA
ugaucaguucuccaaucucg

SEQ ID NO: 32295 - RNA, 20 nt, Artificial Sequence
  MKO10032295_A_Msh2
  gRNA
uauaaacuucaacucgauac

SEQ ID NO: 32296 - RNA, 20 nt, Artificial Sequence
  MKO10032296_A_Msh3
  gRNA
cgugcauguccgccgacuug

SEQ ID NO: 32297 - RNA, 20 nt, Artificial Sequence
  MKO10032297_A_Msh3
  gRNA
ggacaugcacgaacagucug

SEQ ID NO: 32298 - RNA, 20 nt, Artificial Sequence
  MKO10032298_A_Msh3
  gRNA
guccgaagauuccaaaucuc

SEQ ID NO: 32299 - RNA, 20 nt, Artificial Sequence
  MKO10032299_A_Msh4
  gRNA
accaccgcuacaaugacuga

SEQ ID NO: 32300 - RNA, 20 nt, Artificial Sequence
  MKO10032300_A_Msh4
  gRNA
ugccauuccuaucucgccuc

SEQ ID NO: 32301 - RNA, 20 nt, Artificial Sequence
  MKO10032301_A_Msh4
  gRNA
uuuagaacuccguuaucugc

SEQ ID NO: 32302 - RNA, 20 nt, Artificial Sequence
  MKO10032302_A_Msh5
  gRNA
gaggcuaugacucgauuucu

SEQ ID NO: 32303 - RNA, 20 nt, Artificial Sequence
  MKO10032303_A_Msh5
  gRNA
gagcuaccaaaauccacgcu

SEQ ID NO: 32304 - RNA, 20 nt, Artificial Sequence
  MKO10032304_A_Msh5
  gRNA
cucucguggucuggggcauc

SEQ ID NO: 32305 - RNA, 20 nt, Artificial Sequence
  MKO10032305_A_Msh6
  gRNA
cagccuauuagaaugucguu

SEQ ID NO: 32306 - RNA, 20 nt, Artificial Sequence
  MKO10032306_A_Msh6
  gRNA
uuacggguagcgaaauucuc

SEQ ID NO: 32307 - RNA, 20 nt, Artificial Sequence
  MKO10032307_A_Msh6
  gRNA
gucuagcaccauccgcugac

SEQ ID NO: 32308 - RNA, 20 nt, Artificial Sequence
  MKO10032308_A_Msi1
  gRNA
gaagggcugcgcgaauacuu

SEQ ID NO: 32309 - RNA, 20 nt, Artificial Sequence
  MKO10032309_A_Msi1
  gRNA
uuucggcuucgucacuuuca

SEQ ID NO: 32310 - RNA, 20 nt, Artificial Sequence
  MKO10032310_A_Msi1
  gRNA
gcacuuuauccacccccgcc

SEQ ID NO: 32311 - RNA, 20 nt, Artificial Sequence
  MKO10032311_A_Msi2
  gRNA
aucccacaacgaaacgcucc

SEQ ID NO: 32312 - RNA, 20 nt, Artificial Sequence
  MKO10032312_A_Msi2
  gRNA
aaacuuacccggggucgugc

SEQ ID NO: 32313 - RNA, 20 nt, Artificial Sequence
  MKO10032313_A_Msi2
  gRNA
uuaccuggagcguuucguug

SEQ ID NO: 32314 - RNA, 20 nt, Artificial Sequence
  MKO10032314_A_Msl1
  gRNA
ccauacguucaauccgagca

SEQ ID NO: 32315 - RNA, 20 nt, Artificial Sequence
  MKO10032315_A_Msl1
  gRNA
gaggauucccguaaugguaa

SEQ ID NO: 32316 - RNA, 20 nt, Artificial Sequence
  MKO10032316_A_Msl1
  gRNA
accacucaguagagccucua

SEQ ID NO: 32317 - RNA, 20 nt, Artificial Sequence
  MKO10032317_A_Msl2
  gRNA
gcgaucgaguucguccgaca

SEQ ID NO: 32318 - RNA, 20 nt, Artificial Sequence
  MKO10032318_A_Msl2
  gRNA
acuccaucgcagcgacgucg

SEQ ID NO: 32319 - RNA, 20 nt, Artificial Sequence
  MKO10032319_A_Msl2
  gRNA
uaucccgugccagugucguc

SEQ ID NO: 32320 - RNA, 20 nt, Artificial Sequence
  MKO10032320_A_Msl3l2
  gRNA
gugcuacgugcgccacuucu

SEQ ID NO: 32321 - RNA, 20 nt, Artificial Sequence
  MKO10032321_A_Msl3l2
  gRNA
augcugcgcgccauaaaugu

SEQ ID NO: 32322 - RNA, 20 nt, Artificial Sequence
  MKO10032322_A_Msl3l2
  gRNA
cgcaccuaaggaugacggug

SEQ ID NO: 32323 - RNA, 20 nt, Artificial Sequence
  MKO10032323_A_Msl3
  gRNA
uuacuuuaauacgacgcuga

SEQ ID NO: 32324 - RNA, 20 nt, Artificial Sequence
  MKO10032324_A_Msl3
  gRNA
ucagcgucguauuaaaguaa

SEQ ID NO: 32325 - RNA, 20 nt, Artificial Sequence
  MKO10032325_A_Msl3
  gRNA
auugucgcugcguucaagaa

SEQ ID NO: 32326 - RNA, 20 nt, Artificial Sequence
  MKO10032326_A_Mslnl
  gRNA
ugcgcugcagggcaacucuc

SEQ ID NO: 32327 - RNA, 20 nt, Artificial Sequence
  MKO10032327_A_Mslnl
  gRNA
uagccugaggacccgagcag

SEQ ID NO: 32328 - RNA, 20 nt, Artificial Sequence
  MKO10032328_A_Mslnl
  gRNA
cucacucguagaaaaguaga

SEQ ID NO: 32329 - RNA, 20 nt, Artificial Sequence
  MKO10032329_A_Msln
  gRNA
uccuaggcaccucaccgacg

SEQ ID NO: 32330 - RNA, 20 nt, Artificial Sequence
  MKO10032330_A_Msln
  gRNA
cucccggcagcugcguuguc

SEQ ID NO: 32331 - RNA, 20 nt, Artificial Sequence
  MKO10032331_A_Msln
  gRNA
gacagaagaacauuacacuc

SEQ ID NO: 32332 - RNA, 20 nt, Artificial Sequence
  MKO10032332_A_Msmb
  gRNA
cgagacuuacuugguacagc

SEQ ID NO: 32333 - RNA, 20 nt, Artificial Sequence
  MKO10032333_A_Msmb
  gRNA
agaccugucgaguugacagc

SEQ ID NO: 32334 - RNA, 20 nt, Artificial Sequence
  MKO10032334_A_Msmb
  gRNA
aguccagcugucaacucgac

SEQ ID NO: 32335 - RNA, 20 nt, Artificial Sequence
  MKO10032335_A_Msmp
  gRNA
ucggcuaacaccccugcucc

SEQ ID NO: 32336 - RNA, 20 nt, Artificial Sequence
  MKO10032336_A_Msmp
  gRNA
ugaaguauuuacccucguag

SEQ ID NO: 32337 - RNA, 20 nt, Artificial Sequence
  MKO10032337_A_Msmp
  gRNA
agccgagccccauucuaagu

SEQ ID NO: 32338 - RNA, 20 nt, Artificial Sequence
  MKO10032338_A_Msn
  gRNA
uaugccguccagucuaagua

SEQ ID NO: 32339 - RNA, 20 nt, Artificial Sequence
  MKO10032339_A_Msn
  gRNA
ugaagucaccauacuuagac

SEQ ID NO: 32340 - RNA, 20 nt, Artificial Sequence
  MKO10032340_A_Msn
  gRNA
aggagcaccggggcaugcuc

SEQ ID NO: 32341 - RNA, 20 nt, Artificial Sequence
  MKO10032341_A_Msr1
  gRNA
gcguuccgugucuauaaggu

SEQ ID NO: 32342 - RNA, 20 nt, Artificial Sequence
  MKO10032342_A_Msr1
  gRNA
ugaacgugcgucaaauuuca

SEQ ID NO: 32343 - RNA, 20 nt, Artificial Sequence
  MKO10032343_A_Msr1
  gRNA
uuccuugauuucgucagucc

SEQ ID NO: 32344 - RNA, 20 nt, Artificial Sequence
  MKO10032344_A_Msra
  gRNA
gagaaucacgacccgaccca

SEQ ID NO: 32345 - RNA, 20 nt, Artificial Sequence
  MKO10032345_A_Msra
  gRNA
guacacaacccggacgacuu

SEQ ID NO: 32346 - RNA, 20 nt, Artificial Sequence
  MKO10032346_A_Msra
  gRNA
ucccacauccgccgugcaga

SEQ ID NO: 32347 - RNA, 20 nt, Artificial Sequence
  MKO10032347_A_Msrb1
  gRNA
gaaucuugauuguccccgcu

SEQ ID NO: 32348 - RNA, 20 nt, Artificial Sequence
  MKO10032348_A_Msrb1
  gRNA
gugugcguacuucgagugac

SEQ ID NO: 32349 - RNA, 20 nt, Artificial Sequence
  MKO10032349_A_Msrb1
  gRNA
uuccagaaucacuucgagcc

SEQ ID NO: 32350 - RNA, 20 nt, Artificial Sequence
  MKO10032350_A_Msrb2
  gRNA
ugcuucgcuuagagagcgcu

SEQ ID NO: 32351 - RNA, 20 nt, Artificial Sequence
  MKO10032351_A_Msrb2
  gRNA
aggaaguguccagucgucuc

SEQ ID NO: 32352 - RNA, 20 nt, Artificial Sequence
  MKO10032352_A_Msrb2
  gRNA
ccagugggcuuggguccauc

SEQ ID NO: 32353 - RNA, 20 nt, Artificial Sequence
  MKO10032353_A_Msrb3
  gRNA
ccuccgaacugaucacauca

SEQ ID NO: 32354 - RNA, 20 nt, Artificial Sequence
  MKO10032354_A_Msrb3
  gRNA
uuccacccugugcaucccgu

SEQ ID NO: 32355 - RNA, 20 nt, Artificial Sequence
  MKO10032355_A_Msrb3
  gRNA
accugaaccagagucaaauu

SEQ ID NO: 32356 - RNA, 20 nt, Artificial Sequence
  MKO10032356_A_Mss51
  gRNA
uugucgagagcuccgucuug

SEQ ID NO: 32357 - RNA, 20 nt, Artificial Sequence
  MKO10032357_A_Mss51
  gRNA
cuguagaucgugucauggaa

SEQ ID NO: 32358 - RNA, 20 nt, Artificial Sequence
  MKO10032358_A_Mss51
  gRNA
cgaaauccaaagcuugauac

SEQ ID NO: 32359 - RNA, 20 nt, Artificial Sequence
  MKO10032359_A_Mst1r
  gRNA
caaagaguaggucauucccg

SEQ ID NO: 32360 - RNA, 20 nt, Artificial Sequence
  MKO10032360_A_Mst1r
  gRNA
ccacacgggugaagcuagcg

SEQ ID NO: 32361 - RNA, 20 nt, Artificial Sequence
  MKO10032361_A_Mst1r
  gRNA
cccucagguacgacaucauc

SEQ ID NO: 32362 - RNA, 20 nt, Artificial Sequence
  MKO10032362_A_Mst1
  gRNA
uauacgcccacgccaaagaa

SEQ ID NO: 32363 - RNA, 20 nt, Artificial Sequence
  MKO10032363_A_Mst1
  gRNA
gaccccauuguccauaaugc

SEQ ID NO: 32364 - RNA, 20 nt, Artificial Sequence
  MKO10032364_A_Mst1
  gRNA
ccggcaccgcuguguguaac

SEQ ID NO: 32365 - RNA, 20 nt, Artificial Sequence
  MKO10032365_A_Mstn
  gRNA
ugacgauuaucacgcuacca

SEQ ID NO: 32366 - RNA, 20 nt, Artificial Sequence
  MKO10032366_A_Mstn
  gRNA
ucgaucaguacgacguccag

SEQ ID NO: 32367 - RNA, 20 nt, Artificial Sequence
  MKO10032367_A_Mstn
  gRNA
cuucaaaaucgaccgugagg

SEQ ID NO: 32368 - RNA, 20 nt, Artificial Sequence
  MKO10032368_A_Msto1
  gRNA
gucgaggcguauagguuucc

SEQ ID NO: 32369 - RNA, 20 nt, Artificial Sequence
  MKO10032369_A_Msto1
  gRNA
cccgacgucuuguacagaac

SEQ ID NO: 32370 - RNA, 20 nt, Artificial Sequence
  MKO10032370_A_Msto1
  gRNA
cuacagagaccgacagcuag

SEQ ID NO: 32371 - RNA, 20 nt, Artificial Sequence
  MKO10032371_A_Msx1
  gRNA
ccgcgcgcucggcaauagac

SEQ ID NO: 32372 - RNA, 20 nt, Artificial Sequence
  MKO10032372_A_Msx1
  gRNA
aggcccucauggccgaucac

SEQ ID NO: 32373 - RNA, 20 nt, Artificial Sequence
  MKO10032373_A_Msx1
  gRNA
guuccagaaccgucgcgcua

SEQ ID NO: 32374 - RNA, 20 nt, Artificial Sequence
  MKO10032374_A_Msx2
  gRNA
gcgucccggacgccgugucc

SEQ ID NO: 32375 - RNA, 20 nt, Artificial Sequence
  MKO10032375_A_Msx2
  gRNA
caagcccuucgagaccgccu

SEQ ID NO: 32376 - RNA, 20 nt, Artificial Sequence
  MKO10032376_A_Msx2
  gRNA
uaugccacgccgguuggaua

SEQ ID NO: 32377 - RNA, 20 nt, Artificial Sequence
  MKO10032377_A_Msx3
  gRNA
uucggcggcaacgcgguucc

SEQ ID NO: 32378 - RNA, 20 nt, Artificial Sequence
  MKO10032378_A_Msx3
  gRNA
uggcguccgugguuugcgau

SEQ ID NO: 32379 - RNA, 20 nt, Artificial Sequence
  MKO10032379_A_Msx3
  gRNA
ggcgacauucgacaugaacg

SEQ ID NO: 32380 - RNA, 20 nt, Artificial Sequence
  MKO10032380_A_Mt1
  gRNA
gggagucuuaccgguggagc

SEQ ID NO: 32381 - RNA, 20 nt, Artificial Sequence
  MKO10032381_A_Mt1
  gRNA
acagcacgugcacuuguccg

SEQ ID NO: 32382 - RNA, 20 nt, Artificial Sequence
  MKO10032382_A_Mt1
  gRNA
gcacauuuggagcagcccac

SEQ ID NO: 32383 - RNA, 20 nt, Artificial Sequence
  MKO10032383_A_Mt2
  gRNA
gucccccuuaccggaggcac

SEQ ID NO: 32384 - RNA, 20 nt, Artificial Sequence
  MKO10032384_A_Mt2
  gRNA
gauggauccugcuccugcgc

SEQ ID NO: 32385 - RNA, 20 nt, Artificial Sequence
  MKO10032385_A_Mt2
  gRNA
ggcacagcagcugcacuugu

SEQ ID NO: 32386 - RNA, 20 nt, Artificial Sequence
  MKO10032386_A_Mt3
  gRNA
cacacuucucacauccggca

SEQ ID NO: 32387 - RNA, 20 nt, Artificial Sequence
  MKO10032387_A_Mt3
  gRNA
gcacuugcauuuguccgagc

SEQ ID NO: 32388 - RNA, 20 nt, Artificial Sequence
  MKO10032388_A_Mt3
  gRNA
gagaccugccccuguccuac

SEQ ID NO: 32389 - RNA, 20 nt, Artificial Sequence
  MKO10032389_A_Mt4
  gRNA
gacauacacgugcauucccc

SEQ ID NO: 32390 - RNA, 20 nt, Artificial Sequence
  MKO10032390_A_Mt4
  gRNA
acaccuggaccauggacccu

SEQ ID NO: 32391 - RNA, 20 nt, Artificial Sequence
  MKO10032391_A_Mt4
  gRNA
gcccggggcugcaucugcaa

SEQ ID NO: 32392 - RNA, 20 nt, Artificial Sequence
  MKO10032392_A_Mua1
  gRNA
gcuuguccgccagcgcgaug

SEQ ID NO: 32393 - RNA, 20 nt, Artificial Sequence
  MKO10032393_A_Mua1
  gRNA
gcaacccguaccugauccgc

SEQ ID NO: 32394 - RNA, 20 nt, Artificial Sequence
  MKO10032394_A_Mua1
  gRNA
gugacuccgucucauugagc

SEQ ID NO: 32395 - RNA, 20 nt, Artificial Sequence
  MKO10032395_A_Mua2
  gRNA
gcuccucaauccgucuaacc

SEQ ID NO: 32396 - RNA, 20 nt, Artificial Sequence
  MKO10032396_A_Mua2
  gRNA
uacuagaaauaucccuucgc

SEQ ID NO: 32397 - RNA, 20 nt, Artificial Sequence
  MKO10032397_A_Mua2
  gRNA
cguccuauaccuuauguggg

SEQ ID NO: 32398 - RNA, 20 nt, Artificial Sequence
  MKO10032398_A_Mua3
  gRNA
ggagucggagacgccaguug

SEQ ID NO: 32399 - RNA, 20 nt, Artificial Sequence
  MKO10032399_A_Mua3
  gRNA
gcuccucuauccgucugaug

SEQ ID NO: 32400 - RNA, 20 nt, Artificial Sequence
  MKO10032400_A_Mua3
  gRNA
cacugccugcgacacauauc

SEQ ID NO: 32401 - RNA, 20 nt, Artificial Sequence
  MKO10032401_A_Muap7d3
  gRNA
cugcagaugcuugucgucgc

SEQ ID NO: 32402 - RNA, 20 nt, Artificial Sequence
  MKO10032402_A_Muap7d3
  gRNA
cgugguauuaauucuucugc

SEQ ID NO: 32403 - RNA, 20 nt, Artificial Sequence
  MKO10032403_A_Muap7d3
  gRNA
guauugaucaacgacagaaa

SEQ ID NO: 32404 - RNA, 20 nt, Artificial Sequence
  MKO10032404_A_Muap
  gRNA
cggacacuaaccuugccgaa

SEQ ID NO: 32405 - RNA, 20 nt, Artificial Sequence
  MKO10032405_A_Muap
  gRNA
gccauccgaugccuuaauuu

SEQ ID NO: 32406 - RNA, 20 nt, Artificial Sequence
  MKO10032406_A_Muap
  gRNA
ucucaaggacccgcaagcug

SEQ ID NO: 32407 - RNA, 20 nt, Artificial Sequence
  MKO10032407_A_Mtbp
  gRNA
ggaagggaaguuucgauccg

SEQ ID NO: 32408 - RNA, 20 nt, Artificial Sequence
  MKO10032408_A_Mtbp
  gRNA
gauggaucgguacuugcugc

SEQ ID NO: 32409 - RNA, 20 nt, Artificial Sequence
  MKO10032409_A_Mtbp
  gRNA
uuugcggugcaagcaauaug

SEQ ID NO: 32410 - RNA, 20 nt, Artificial Sequence
  MKO10032410_A_Much1
  gRNA
gcaguguguaucgcgaaugc

SEQ ID NO: 32411 - RNA, 20 nt, Artificial Sequence
  MKO10032411_A_Much1
  gRNA
uggacaaggcguuggacaua

SEQ ID NO: 32412 - RNA, 20 nt, Artificial Sequence
  MKO10032412_A_Much1
  gRNA
auccaccugcacaauguacu

SEQ ID NO: 32413 - RNA, 20 nt, Artificial Sequence
  MKO10032413_A_Much2
  gRNA
cuuugaccgaguuaucaaag

SEQ ID NO: 32414 - RNA, 20 nt, Artificial Sequence
  MKO10032414_A_Much2
  gRNA
ggcaccuaccauagcaaaag

SEQ ID NO: 32415 - RNA, 20 nt, Artificial Sequence
  MKO10032415_A_Much2
  gRNA
aaaauauuucguccuauugu

SEQ ID NO: 32416 - RNA, 20 nt, Artificial Sequence
  MKO10032416_A_Mucp1
  gRNA
cacaacacuuacgaaguucu

SEQ ID NO: 32417 - RNA, 20 nt, Artificial Sequence
  MKO10032417_A_Mucp1
  gRNA
uuauccauguagcgcuccuc

SEQ ID NO: 32418 - RNA, 20 nt, Artificial Sequence
  MKO10032418_A_Mucp1
  gRNA
ggcuuaguugcgucaccuaa

SEQ ID NO: 32419 - RNA, 20 nt, Artificial Sequence
  MKO10032419_A_Mtdh
  gRNA
acuucaacaguccguccauu

SEQ ID NO: 32420 - RNA, 20 nt, Artificial Sequence
  MKO10032420_A_Mtdh
  gRNA
ucauuggauucaacuauccc

SEQ ID NO: 32421 - RNA, 20 nt, Artificial Sequence
  MKO10032421_A_Mtdh
  gRNA
caaaacaguucacgccauga

SEQ ID NO: 32422 - RNA, 20 nt, Artificial Sequence
  MKO10032422_A_Mterf1a
  gRNA
cugucgcauuccgcacuaaa

SEQ ID NO: 32423 - RNA, 20 nt, Artificial Sequence
  MKO10032423_A_Mterf1a
  gRNA
gcuuucucuuggaugcagcg

SEQ ID NO: 32424 - RNA, 20 nt, Artificial Sequence
  MKO10032424_A_Mterf1a
  gRNA
uagugcggaaugcgacagua

SEQ ID NO: 32425 - RNA, 20 nt, Artificial Sequence
  MKO10032425_A_Mterf1b
  gRNA
uaguguggaaugcgacagua

SEQ ID NO: 32426 - RNA, 20 nt, Artificial Sequence
  MKO10032426_A_Mterf1b
  gRNA
gcuuucucuugggugcagug

SEQ ID NO: 32427 - RNA, 20 nt, Artificial Sequence
  MKO10032427_A_Mterf1b
  gRNA
uccugaaugaaaucgacuug

SEQ ID NO: 32428 - RNA, 20 nt, Artificial Sequence
  MKO10032428_A_Mterfd1
  gRNA
cgccuuccaaggcuacuaac

SEQ ID NO: 32429 - RNA, 20 nt, Artificial Sequence
  MKO10032429_A_Mterfd1
  gRNA
agacuuccuguuaguagccu

SEQ ID NO: 32430 - RNA, 20 nt, Artificial Sequence
  MKO10032430_A_Mterfd1
  gRNA
ucaaacuuuaccuggucuua

SEQ ID NO: 32431 - RNA, 20 nt, Artificial Sequence
  MKO10032431_A_Mterfd2
  gRNA
accgaguugugaagguccuc

SEQ ID NO: 32432 - RNA, 20 nt, Artificial Sequence
  MKO10032432_A_Mterfd2
  gRNA
gucaaugucccgcugaugca

SEQ ID NO: 32433 - RNA, 20 nt, Artificial Sequence
  MKO10032433_A_Mterfd2
  gRNA
aacuugaaacuccucgacag

SEQ ID NO: 32434 - RNA, 20 nt, Artificial Sequence
  MKO10032434_A_Mterfd3
  gRNA
ggacugcagauaaucgcuuc

SEQ ID NO: 32435 - RNA, 20 nt, Artificial Sequence
  MKO10032435_A_Mterfd3
  gRNA
auuucacaacuaacugucgu

SEQ ID NO: 32436 - RNA, 20 nt, Artificial Sequence
  MKO10032436_A_Mterfd3
  gRNA
auuugcaaucucuucaacgu

SEQ ID NO: 32437 - RNA, 20 nt, Artificial Sequence
  MKO10032437_A_Mtf1
  gRNA
gcgguaccagugcaccuuug

SEQ ID NO: 32438 - RNA, 20 nt, Artificial Sequence
  MKO10032438_A_Mtf1
  gRNA
accaccuuaaaacucacguc

SEQ ID NO: 32439 - RNA, 20 nt, Artificial Sequence
  MKO10032439_A_Mtf1
  gRNA
guacaccuucgucuguaauc

SEQ ID NO: 32440 - RNA, 20 nt, Artificial Sequence
  MKO10032440_A_Mtf2
  gRNA
aucacacucgagucaauaug

SEQ ID NO: 32441 - RNA, 20 nt, Artificial Sequence
  MKO10032441_A_Mtf2
  gRNA
cuugaacaagcugucuuuac

SEQ ID NO: 32442 - RNA, 20 nt, Artificial Sequence
  MKO10032442_A_Mtf2
  gRNA
guaauucacugguccacaag

SEQ ID NO: 32443 - RNA, 20 nt, Artificial Sequence
  MKO10032443_A_Mtfmt
  gRNA
ccagccgagggagugacaua

SEQ ID NO: 32444 - RNA, 20 nt, Artificial Sequence
  MKO10032444_A_Mtfmt
  gRNA
auauucuccagaucccacgu

SEQ ID NO: 32445 - RNA, 20 nt, Artificial Sequence
  MKO10032445_A_Mtfmt
  gRNA
ugucuccaugaagcaccgug

SEQ ID NO: 32446 - RNA, 20 nt, Artificial Sequence
  MKO10032446_A_Mtfp1
  gRNA
gcgccgagcgcgaccucuac

SEQ ID NO: 32447 - RNA, 20 nt, Artificial Sequence
  MKO10032447_A_Mtfp1
  gRNA
ggcccccgacuguccgcaaa

SEQ ID NO: 32448 - RNA, 20 nt, Artificial Sequence
  MKO10032448_A_Mtfp1
  gRNA
aaggccccuaccugucgaug

SEQ ID NO: 32449 - RNA, 20 nt, Artificial Sequence
  MKO10032449_A_Mtfr1l
  gRNA
acauggggcugcucgaagug

SEQ ID NO: 32450 - RNA, 20 nt, Artificial Sequence
  MKO10032450_A_Mtfr1l
  gRNA
cucaccucaaaggaugcccg

SEQ ID NO: 32451 - RNA, 20 nt, Artificial Sequence
  MKO10032451_A_Mtfr1l
  gRNA
uuacguugcaugacaaucag

SEQ ID NO: 32452 - RNA, 20 nt, Artificial Sequence
  MKO10032452_A_Mtfr1
  gRNA
guucaucucgaaguaucgua

SEQ ID NO: 32453 - RNA, 20 nt, Artificial Sequence
  MKO10032453_A_Mtfr1
  gRNA
gaucaagagcagacguacuu

SEQ ID NO: 32454 - RNA, 20 nt, Artificial Sequence
  MKO10032454_A_Mtfr1
  gRNA
uggaguaccaacggaagggg

SEQ ID NO: 32455 - RNA, 20 nt, Artificial Sequence
  MKO10032455_A_Mtfr2
  gRNA
cggaguauuguucguauuau

SEQ ID NO: 32456 - RNA, 20 nt, Artificial Sequence
  MKO10032456_A_Mtfr2
  gRNA
uucaagaaaacgcuguucgu

SEQ ID NO: 32457 - RNA, 20 nt, Artificial Sequence
  MKO10032457_A_Mtfr2
  gRNA
gacuccguagaguucacaug

SEQ ID NO: 32458 - RNA, 20 nt, Artificial Sequence
  MKO10032458_A_Mug1
  gRNA
cuaccgcuaccaucgagccg

SEQ ID NO: 32459 - RNA, 20 nt, Artificial Sequence
  MKO10032459_A_Mug1
  gRNA
uuaucgagguucaugacgcc

SEQ ID NO: 32460 - RNA, 20 nt, Artificial Sequence
  MKO10032460_A_Mug1
  gRNA
cccaaccaaccucggcucga

SEQ ID NO: 32461 - RNA, 20 nt, Artificial Sequence
  MKO10032461_A_Mug2
  gRNA
uagugaacgauccccacgug

SEQ ID NO: 32462 - RNA, 20 nt, Artificial Sequence
  MKO10032462_A_Mug2
  gRNA
uacaggggcacgguugucgu

SEQ ID NO: 32463 - RNA, 20 nt, Artificial Sequence
  MKO10032463_A_Mug2
  gRNA
uaaccugggagacgaguacg

SEQ ID NO: 32464 - RNA, 20 nt, Artificial Sequence
  MKO10032464_A_Mthfd1l
  gRNA
agacgucauucacaauucca

SEQ ID NO: 32465 - RNA, 20 nt, Artificial Sequence
  MKO10032465_A_Mthfd1l
  gRNA
accugaauaaccacaagcac

SEQ ID NO: 32466 - RNA, 20 nt, Artificial Sequence
  MKO10032466_A_Mthfd1l
  gRNA
uggggucuucauuaaucuuc

SEQ ID NO: 32467 - RNA, 20 nt, Artificial Sequence
  MKO10032467_A_Mthfd1
  gRNA
gcuccugcauccgaguuacc

SEQ ID NO: 32468 - RNA, 20 nt, Artificial Sequence
  MKO10032468_A_Mthfd1
  gRNA
caaugccauugcacccgaga

SEQ ID NO: 32469 - RNA, 20 nt, Artificial Sequence
  MKO10032469_A_Mthfd1
  gRNA
cagggaucgacugaagaacc

SEQ ID NO: 32470 - RNA, 20 nt, Artificial Sequence
  MKO10032470_A_Mthfd2l
  gRNA
acuaauauaccgcugacucu

SEQ ID NO: 32471 - RNA, 20 nt, Artificial Sequence
  MKO10032471_A_Mthfd2l
  gRNA
ggcgggaagauccaagaacg

SEQ ID NO: 32472 - RNA, 20 nt, Artificial Sequence
  MKO10032472_A_Mthfd2l
  gRNA
cacgaagccguuaucaucuc

SEQ ID NO: 32473 - RNA, 20 nt, Artificial Sequence
  MKO10032473_A_Mthfd2
  gRNA
auuaucucccacacgcccca

SEQ ID NO: 32474 - RNA, 20 nt, Artificial Sequence
  MKO10032474_A_Mthfd2
  gRNA
aacaacgaugagaacguaga

SEQ ID NO: 32475 - RNA, 20 nt, Artificial Sequence
  MKO10032475_A_Mthfd2
  gRNA
ugggagauaauuaagcgaac

SEQ ID NO: 32476 - RNA, 20 nt, Artificial Sequence
  MKO10032476_A_Mthfr
  gRNA
ccccuacagguuugaccgga

SEQ ID NO: 32477 - RNA, 20 nt, Artificial Sequence
  MKO10032477_A_Mthfr
  gRNA
ccccgaugcagagagcuucg

SEQ ID NO: 32478 - RNA, 20 nt, Artificial Sequence
  MKO10032478_A_Mthfr
  gRNA
gccagguaacaucuacgaag

SEQ ID NO: 32479 - RNA, 20 nt, Artificial Sequence
  MKO10032479_A_Mthfsd
  gRNA
aacagcccuguucgcagucg

SEQ ID NO: 32480 - RNA, 20 nt, Artificial Sequence
  MKO10032480_A_Mthfsd
  gRNA
ccaacaccacgacugcgaac

SEQ ID NO: 32481 - RNA, 20 nt, Artificial Sequence
  MKO10032481_A_Mthfsd
  gRNA
ucagagaaacgcccgcuucc

SEQ ID NO: 32482 - RNA, 20 nt, Artificial Sequence
  MKO10032482_A_Mthfs
  gRNA
aucuugcaugcuuagaaaga

SEQ ID NO: 32483 - RNA, 20 nt, Artificial Sequence
  MKO10032483_A_Mthfs
  gRNA
cuucucgcaccuucugcgug

SEQ ID NO: 32484 - RNA, 20 nt, Artificial Sequence
  MKO10032484_A_Mthfs
  gRNA
cgugguguaacuuaggaugc

SEQ ID NO: 32485 - RNA, 20 nt, Artificial Sequence
  MKO10032485_A_Mtif2
  gRNA
uucuaaugaaucuacgucaa

SEQ ID NO: 32486 - RNA, 20 nt, Artificial Sequence
  MKO10032486_A_Mtif2
  gRNA
agaaacucaaguugcagcga

SEQ ID NO: 32487 - RNA, 20 nt, Artificial Sequence
  MKO10032487_A_Mtif2
  gRNA
ggucaccgacauuguugugu

SEQ ID NO: 32488 - RNA, 20 nt, Artificial Sequence
  MKO10032488_A_Mtif3
  gRNA
ugagcggauuauccgcgucc

SEQ ID NO: 32489 - RNA, 20 nt, Artificial Sequence
  MKO10032489_A_Mtif3
  gRNA
acgagcucuuucgucauagu

SEQ ID NO: 32490 - RNA, 20 nt, Artificial Sequence
  MKO10032490_A_Mtif3
  gRNA
cccggagcuuuagccgcucc

SEQ ID NO: 32491 - RNA, 20 nt, Artificial Sequence
  MKO10032491_A_Mtl5
  gRNA
cgauaacacgugcacgcugu

SEQ ID NO: 32492 - RNA, 20 nt, Artificial Sequence
  MKO10032492_A_Mtl5
  gRNA
gcgcuguugccgcuaagcgc

SEQ ID NO: 32493 - RNA, 20 nt, Artificial Sequence
  MKO10032493_A_Mtl5
  gRNA
gugaugagauuuaacuucgc

SEQ ID NO: 32494 - RNA, 20 nt, Artificial Sequence
  MKO10032494_A_Mtm1
  gRNA
ccaguaauuaguaacucccc

SEQ ID NO: 32495 - RNA, 20 nt, Artificial Sequence
  MKO10032495_A_Mtm1
  gRNA
acaaguaauaucuagaccau

SEQ ID NO: 32496 - RNA, 20 nt, Artificial Sequence
  MKO10032496_A_Mtm1
  gRNA
uaaguauaauucacacuccu

SEQ ID NO: 32497 - RNA, 20 nt, Artificial Sequence
  MKO10032497_A_Mtmr10
  gRNA
guaaagauuuccgaauuguc

SEQ ID NO: 32498 - RNA, 20 nt, Artificial Sequence
  MKO10032498_A_Mtmr10
  gRNA
caaagcgaaaccugacaauu

SEQ ID NO: 32499 - RNA, 20 nt, Artificial Sequence
  MKO10032499_A_Mtmr10
  gRNA
cgaaccgaagauuaaaaagc

SEQ ID NO: 32500 - RNA, 20 nt, Artificial Sequence
  MKO10032500_A_Mtmr11
  gRNA
uaaucgaccaauguugauca

SEQ ID NO: 32501 - RNA, 20 nt, Artificial Sequence
  MKO10032501_A_Mtmr11
  gRNA
gacuuccggcugcuucgagu

SEQ ID NO: 32502 - RNA, 20 nt, Artificial Sequence
  MKO10032502_A_Mtmr11
  gRNA
ucuggaccgaagucuaaccc

SEQ ID NO: 32503 - RNA, 20 nt, Artificial Sequence
  MKO10032503_A_Mtmr12
  gRNA
ucgugucagcgcggcgucua

SEQ ID NO: 32504 - RNA, 20 nt, Artificial Sequence
  MKO10032504_A_Mtmr12
  gRNA
gcacccgcaggucuuugcaa

SEQ ID NO: 32505 - RNA, 20 nt, Artificial Sequence
  MKO10032505_A_Mtmr12
  gRNA
cacauaccccgccauuaucc

SEQ ID NO: 32506 - RNA, 20 nt, Artificial Sequence
  MKO10032506_A_Mtmr14
  gRNA
cccccgccacaucguauucc

SEQ ID NO: 32507 - RNA, 20 nt, Artificial Sequence
  MKO10032507_A_Mtmr14
  gRNA
ucggccacacuggcuggaug

SEQ ID NO: 32508 - RNA, 20 nt, Artificial Sequence
  MKO10032508_A_Mtmr14
  gRNA
auacgauguggcggggguag

SEQ ID NO: 32509 - RNA, 20 nt, Artificial Sequence
  MKO10032509_A_Mtmr1
  gRNA
ccacucacugcucccauaaa

SEQ ID NO: 32510 - RNA, 20 nt, Artificial Sequence
  MKO10032510_A_Mtmr1
  gRNA
acucugcugaucacuccaag

SEQ ID NO: 32511 - RNA, 20 nt, Artificial Sequence
  MKO10032511_A_Mtmr1
  gRNA
agccauggggauaauucuug

SEQ ID NO: 32512 - RNA, 20 nt, Artificial Sequence
  MKO10032512_A_Mtmr2
  gRNA
cgcugacugucacaaguuac

SEQ ID NO: 32513 - RNA, 20 nt, Artificial Sequence
  MKO10032513_A_Mtmr2
  gRNA
agccgaggugaaaacuccua

SEQ ID NO: 32514 - RNA, 20 nt, Artificial Sequence
  MKO10032514_A_Mtmr2
  gRNA
ccccaugcagguccugaggg

SEQ ID NO: 32515 - RNA, 20 nt, Artificial Sequence
  MKO10032515_A_Mtmr3
  gRNA
cucccgaaucagcugcuucc

SEQ ID NO: 32516 - RNA, 20 nt, Artificial Sequence
  MKO10032516_A_Mtmr3
  gRNA
aacaaugcaauccgaccacc

SEQ ID NO: 32517 - RNA, 20 nt, Artificial Sequence
  MKO10032517_A_Mtmr3
  gRNA
agaguaugugggccgugcug

SEQ ID NO: 32518 - RNA, 20 nt, Artificial Sequence
  MKO10032518_A_Mtmr4
  gRNA
agcgagaccugccaagcccg

SEQ ID NO: 32519 - RNA, 20 nt, Artificial Sequence
  MKO10032519_A_Mtmr4
  gRNA
uugccuuugccuaccaugcg

SEQ ID NO: 32520 - RNA, 20 nt, Artificial Sequence
  MKO10032520_A_Mtmr4
  gRNA
caaggaucuguuccccccca

SEQ ID NO: 32521 - RNA, 20 nt, Artificial Sequence
  MKO10032521_A_Mtmr6
  gRNA
agcuagccggccggugaucg

SEQ ID NO: 32522 - RNA, 20 nt, Artificial Sequence
  MKO10032522_A_Mtmr6
  gRNA
ccgaggaacauacagcucuc

SEQ ID NO: 32523 - RNA, 20 nt, Artificial Sequence
  MKO10032523_A_Mtmr6
  gRNA
aaacuugcucugaccacuuc

SEQ ID NO: 32524 - RNA, 20 nt, Artificial Sequence
  MKO10032524_A_Mtmr7
  gRNA
gaaugacaaguuguacgauc

SEQ ID NO: 32525 - RNA, 20 nt, Artificial Sequence
  MKO10032525_A_Mtmr7
  gRNA
guacguccccagaucggcca

SEQ ID NO: 32526 - RNA, 20 nt, Artificial Sequence
  MKO10032526_A_Mtmr7
  gRNA
uuccacgaauaugacgugag

SEQ ID NO: 32527 - RNA, 20 nt, Artificial Sequence
  MKO10032527_A_Mtmr9
  gRNA
ccgaagugcuucgucaucga

SEQ ID NO: 32528 - RNA, 20 nt, Artificial Sequence
  MKO10032528_A_Mtmr9
  gRNA
cugggaagcgccccccaugu

SEQ ID NO: 32529 - RNA, 20 nt, Artificial Sequence
  MKO10032529_A_Mtmr9
  gRNA
cagccccugaccggcacaaa

SEQ ID NO: 32530 - RNA, 20 nt, Artificial Sequence
  MKO10032530_A_Mtnr1a
  gRNA
cggcucgauauucaacauca

SEQ ID NO: 32531 - RNA, 20 nt, Artificial Sequence
  MKO10032531_A_Mtnr1a
  gRNA
acuggaguguuccgguuugc

SEQ ID NO: 32532 - RNA, 20 nt, Artificial Sequence
  MKO10032532_A_Mtnr1a
  gRNA
gcccagaauguccaccacga

SEQ ID NO: 32533 - RNA, 20 nt, Artificial Sequence
  MKO10032533_A_Mtnr1b
  gRNA
aaccgcaagcugcggaacgc

SEQ ID NO: 32534 - RNA, 20 nt, Artificial Sequence
  MKO10032534_A_Mtnr1b
  gRNA
gcagcgccuaguguuccaua

SEQ ID NO: 32535 - RNA, 20 nt, Artificial Sequence
  MKO10032535_A_Mtnr1b
  gRNA
caccugcguuccgcagcuug

SEQ ID NO: 32536 - RNA, 20 nt, Artificial Sequence
  MKO10032536_A_Mto1
  gRNA
uaauggacucuuuagcgagu

SEQ ID NO: 32537 - RNA, 20 nt, Artificial Sequence
  MKO10032537_A_Mto1
  gRNA
ucaccugaauagccacguuc

SEQ ID NO: 32538 - RNA, 20 nt, Artificial Sequence
  MKO10032538_A_Mto1
  gRNA
ugaucccccaaacguccugc

SEQ ID NO: 32539 - RNA, 20 nt, Artificial Sequence
  MKO10032539_A_Mtor
  gRNA
ugauacgaacuagcucguug

SEQ ID NO: 32540 - RNA, 20 nt, Artificial Sequence
  MKO10032540_A_Mtor
  gRNA
guccaaggccauuggccgcc

SEQ ID NO: 32541 - RNA, 20 nt, Artificial Sequence
  MKO10032541_A_Mtor
  gRNA
uuccuuugguucccgcugcg

SEQ ID NO: 32542 - RNA, 20 nt, Artificial Sequence
  MKO10032542_A_Mtpap
  gRNA
aauguaucaaaacaguccgc

SEQ ID NO: 32543 - RNA, 20 nt, Artificial Sequence
  MKO10032543_A_Mtpap
  gRNA
acucaaugcucgauguccac

SEQ ID NO: 32544 - RNA, 20 nt, Artificial Sequence
  MKO10032544_A_Mtpap
  gRNA
aauccgucuagccaaguauc

SEQ ID NO: 32545 - RNA, 20 nt, Artificial Sequence
  MKO10032545_A_Mtpn
  gRNA
cgcugcagucaugugcgaca

SEQ ID NO: 32546 - RNA, 20 nt, Artificial Sequence
  MKO10032546_A_Mtpn
  gRNA
ugacagaagcaauuucacgc

SEQ ID NO: 32547 - RNA, 20 nt, Artificial Sequence
  MKO10032547_A_Mtpn
  gRNA
ucaagggcggucaguccauc

SEQ ID NO: 32548 - RNA, 20 nt, Artificial Sequence
  MKO10032548_A_Mtrf1l
  gRNA
agacaugcgucagccagcgu

SEQ ID NO: 32549 - RNA, 20 nt, Artificial Sequence
  MKO10032549_A_Mtrf1l
  gRNA
cgcuggcugacgcaugucua

SEQ ID NO: 32550 - RNA, 20 nt, Artificial Sequence
  MKO10032550_A_Mtrf1l
  gRNA
uuccuucggaagaaauggau

SEQ ID NO: 32551 - RNA, 20 nt, Artificial Sequence
  MKO10032551_A_Mtrf1
  gRNA
ccgggaugcgcugaacucga

SEQ ID NO: 32552 - RNA, 20 nt, Artificial Sequence
  MKO10032552_A_Mtrf1
  gRNA
acggaugcagcgcauucaca

SEQ ID NO: 32553 - RNA, 20 nt, Artificial Sequence
  MKO10032553_A_Mtrf1
  gRNA
aauuauacaccagccgauua

SEQ ID NO: 32554 - RNA, 20 nt, Artificial Sequence
  MKO10032554_A_Mtrr
  gRNA
guccggugucguagaaacgc

SEQ ID NO: 32555 - RNA, 20 nt, Artificial Sequence
  MKO10032555_A_Mtrr
  gRNA
aguaauugauaaacgacuuc

SEQ ID NO: 32556 - RNA, 20 nt, Artificial Sequence
  MKO10032556_A_Mtrr
  gRNA
aucauuuguagucagccgaa

SEQ ID NO: 32557 - RNA, 20 nt, Artificial Sequence
  MKO10032557_A_Mtr
  gRNA
ugagcuuguugacgcauacc

SEQ ID NO: 32558 - RNA, 20 nt, Artificial Sequence
  MKO10032558_A_Mtr
  gRNA
cagcaguacuaguaucgccc

SEQ ID NO: 32559 - RNA, 20 nt, Artificial Sequence
  MKO10032559_A_Mtr
  gRNA
aaagucucaccaaguguuca

SEQ ID NO: 32560 - RNA, 20 nt, Artificial Sequence
  MKO10032560_A_Mtss1l
  gRNA
cgcugagccaaugucccgcg

SEQ ID NO: 32561 - RNA, 20 nt, Artificial Sequence
  MKO10032561_A_Mtss1l
  gRNA
gagccucaucaauccacugc

SEQ ID NO: 32562 - RNA, 20 nt, Artificial Sequence
  MKO10032562_A_Mtss1l
  gRNA
ucuucgaugcgcuccugcag

SEQ ID NO: 32563 - RNA, 20 nt, Artificial Sequence
  MKO10032563_A_Mtss1
  gRNA
caucugcucaccacgugugu

SEQ ID NO: 32564 - RNA, 20 nt, Artificial Sequence
  MKO10032564_A_Mtss1
  gRNA
ccggugccgcaugcacauuc

SEQ ID NO: 32565 - RNA, 20 nt, Artificial Sequence
  MKO10032565_A_Mtss1
  gRNA
ugagagcugagccgaucucc

SEQ ID NO: 32566 - RNA, 20 nt, Artificial Sequence
  MKO10032566_A_Muup
  gRNA
ggauuguaaagugaccuacc

SEQ ID NO: 32567 - RNA, 20 nt, Artificial Sequence
  MKO10032567_A_Muup
  gRNA
cuccuaugaaaacgagccag

SEQ ID NO: 32568 - RNA, 20 nt, Artificial Sequence
  MKO10032568_A_Muup
  gRNA
gccgcucauuauuuaaugag

SEQ ID NO: 32569 - RNA, 20 nt, Artificial Sequence
  MKO10032569_A_Mturn
  gRNA
cugucgccgcagccguuguc

SEQ ID NO: 32570 - RNA, 20 nt, Artificial Sequence
  MKO10032570_A_Mturn
  gRNA
aacgcgucgucaucugcguc

SEQ ID NO: 32571 - RNA, 20 nt, Artificial Sequence
  MKO10032571_A_Mturn
  gRNA
gauggacuucuacgccgacc

SEQ ID NO: 32572 - RNA, 20 nt, Artificial Sequence
  MKO10032572_A_Mtus1
  gRNA
cuccgagagaacgcuugagu

SEQ ID NO: 32573 - RNA, 20 nt, Artificial Sequence
  MKO10032573_A_Mtus1
  gRNA
aacggucagcgcuucaaacu

SEQ ID NO: 32574 - RNA, 20 nt, Artificial Sequence
  MKO10032574_A_Mtus1
  gRNA
gcaauuccaccuucuccgag

SEQ ID NO: 32575 - RNA, 20 nt, Artificial Sequence
  MKO10032575_A_Mtus2
  gRNA
gcagggagucgugaauagcc

SEQ ID NO: 32576 - RNA, 20 nt, Artificial Sequence
  MKO10032576_A_Mtus2
  gRNA
gcgagugccauccauccgcc

SEQ ID NO: 32577 - RNA, 20 nt, Artificial Sequence
  MKO10032577_A_Mtus2
  gRNA
cauggccgaacgauagaaag

SEQ ID NO: 32578 - RNA, 20 nt, Artificial Sequence
  MKO10032578_A_Mtx1
  gRNA
gcgagcugacagaucguagu

SEQ ID NO: 32579 - RNA, 20 nt, Artificial Sequence
  MKO10032579_A_Mtx1
  gRNA
uacgaucugucagcucgcca

SEQ ID NO: 32580 - RNA, 20 nt, Artificial Sequence
  MKO10032580_A_Mtx1
  gRNA
caucacccaucuucguaaag

SEQ ID NO: 32581 - RNA, 20 nt, Artificial Sequence
  MKO10032581_A_Mtx2
  gRNA
gcccuacacaccacuuugac

SEQ ID NO: 32582 - RNA, 20 nt, Artificial Sequence
  MKO10032582_A_Mtx2
  gRNA
gcggaauauaugucuccauc

SEQ ID NO: 32583 - RNA, 20 nt, Artificial Sequence
  MKO10032583_A_Mtx2
  gRNA
accuuguaucagcaacugag

SEQ ID NO: 32584 - RNA, 20 nt, Artificial Sequence
  MKO10032584_A_Mtx3
  gRNA
acuucaccgugacaaagccg

SEQ ID NO: 32585 - RNA, 20 nt, Artificial Sequence
  MKO10032585_A_Mtx3
  gRNA
ggcaaaccacggcuuuguca

SEQ ID NO: 32586 - RNA, 20 nt, Artificial Sequence
  MKO10032586_A_Mtx3
  gRNA
acuggcuuacaucgcucucc

SEQ ID NO: 32587 - RNA, 20 nt, Artificial Sequence
  MKO10032587_A_Muc13
  gRNA
ugcaacccuaaccccuguaa

SEQ ID NO: 32588 - RNA, 20 nt, Artificial Sequence
  MKO10032588_A_Muc13
  gRNA
uuaccugugcuuccaccgcu

SEQ ID NO: 32589 - RNA, 20 nt, Artificial Sequence
  MKO10032589_A_Muc13
  gRNA
acaagaagcaguuccuuuac

SEQ ID NO: 32590 - RNA, 20 nt, Artificial Sequence
  MKO10032590_A_Muc15
  gRNA
agcagacgcaaauccuuuac

SEQ ID NO: 32591 - RNA, 20 nt, Artificial Sequence
  MKO10032591_A_Muc15
  gRNA
uguuucugaggccucgcaaa

SEQ ID NO: 32592 - RNA, 20 nt, Artificial Sequence
  MKO10032592_A_Muc15
  gRNA
uaugaugacagaaacgaacc

SEQ ID NO: 32593 - RNA, 20 nt, Artificial Sequence
  MKO10032593_A_Muc19
  gRNA
guguaggugaagcaacuaug

SEQ ID NO: 32594 - RNA, 20 nt, Artificial Sequence
  MKO10032594_A_Muc19
  gRNA
gaucgaugacguugagaucu

SEQ ID NO: 32595 - RNA, 20 nt, Artificial Sequence
  MKO10032595_A_Muc19
  gRNA
uguggguguucuagucguag

SEQ ID NO: 32596 - RNA, 20 nt, Artificial Sequence
  MKO10032596_A_Muc1
  gRNA
caacuggggugaacuguuac

SEQ ID NO: 32597 - RNA, 20 nt, Artificial Sequence
  MKO10032597_A_Muc1
  gRNA
uggagugguagucgaugcua

SEQ ID NO: 32598 - RNA, 20 nt, Artificial Sequence
  MKO10032598_A_Muc1
  gRNA
cacagucgauucuaccacca

SEQ ID NO: 32599 - RNA, 20 nt, Artificial Sequence
  MKO10032599_A_Muc20
  gRNA
gagagccgugaaacucacga

SEQ ID NO: 32600 - RNA, 20 nt, Artificial Sequence
  MKO10032600_A_Muc20
  gRNA
cuccccaauagcaucguccc

SEQ ID NO: 32601 - RNA, 20 nt, Artificial Sequence
  MKO10032601_A_Muc20
  gRNA
aggccacggucagccguaca

SEQ ID NO: 32602 - RNA, 20 nt, Artificial Sequence
  MKO10032602_A_Muc2
  gRNA
gccggcccgagaguagaccu

SEQ ID NO: 32603 - RNA, 20 nt, Artificial Sequence
  MKO10032603_A_Muc2
  gRNA
gggccggccucucccucaug

SEQ ID NO: 32604 - RNA, 20 nt, Artificial Sequence
  MKO10032604_A_Muc2
  gRNA
gucuauccugaucaccauua

SEQ ID NO: 32605 - RNA, 20 nt, Artificial Sequence
  MKO10032605_A_Muc4
  gRNA
guguccccgugccauacguc

SEQ ID NO: 32606 - RNA, 20 nt, Artificial Sequence
  MKO10032606_A_Muc4
  gRNA
auacccuaucuacucccguc

SEQ ID NO: 32607 - RNA, 20 nt, Artificial Sequence
  MKO10032607_A_Muc4
  gRNA
ucgaugcuugugagcucauu

SEQ ID NO: 32608 - RNA, 20 nt, Artificial Sequence
  MKO10032608_A_Muc5ac
  gRNA
uauccagcuacgccgugucc

SEQ ID NO: 32609 - RNA, 20 nt, Artificial Sequence
  MKO10032609_A_Muc5ac
  gRNA
cgggugguuauugacuaaga

SEQ ID NO: 32610 - RNA, 20 nt, Artificial Sequence
  MKO10032610_A_Muc5ac
  gRNA
guucacucaccucguaccac

SEQ ID NO: 32611 - RNA, 20 nt, Artificial Sequence
  MKO10032611_A_Muc5b
  gRNA
gcggaacacgucaccaucaa

SEQ ID NO: 32612 - RNA, 20 nt, Artificial Sequence
  MKO10032612_A_Muc5b
  gRNA
uucaacauccaacugcgucg

SEQ ID NO: 32613 - RNA, 20 nt, Artificial Sequence
  MKO10032613_A_Muc5b
  gRNA
guccacuuaccgcucaugcu

SEQ ID NO: 32614 - RNA, 20 nt, Artificial Sequence
  MKO10032614_A_Muc6
  gRNA
cucaccguaagaugggcguc

SEQ ID NO: 32615 - RNA, 20 nt, Artificial Sequence
  MKO10032615_A_Muc6
  gRNA
ggcgggcacgucauccccac

SEQ ID NO: 32616 - RNA, 20 nt, Artificial Sequence
  MKO10032616_A_Muc6
  gRNA
ccauguacuucgucucuacc

SEQ ID NO: 32617 - RNA, 20 nt, Artificial Sequence
  MKO10032617_A_Mucl1
  gRNA
acccacuuuggucugauuag

SEQ ID NO: 32618 - RNA, 20 nt, Artificial Sequence
  MKO10032618_A_Mucl1
  gRNA
ugaguccucuaauuuagcca

SEQ ID NO: 32619 - RNA, 20 nt, Artificial Sequence
  MKO10032619_A_Mucl1
  gRNA
augauauugaauaacauuca

SEQ ID NO: 32620 - RNA, 20 nt, Artificial Sequence
  MKO10032620_A_Mug1
  gRNA
gaaaaaccuguucgaugagc

SEQ ID NO: 32621 - RNA, 20 nt, Artificial Sequence
  MKO10032621_A_Mug1
  gRNA
ccuuccugauugagauacca

SEQ ID NO: 32622 - RNA, 20 nt, Artificial Sequence
  MKO10032622_A_Mug1
  gRNA
gcuacguccccugaaugagu

SEQ ID NO: 32623 - RNA, 20 nt, Artificial Sequence
  MKO10032623_A_Mug2
  gRNA
ucacaaugaaggaaacacau

SEQ ID NO: 32624 - RNA, 20 nt, Artificial Sequence
  MKO10032624_A_Mug2
  gRNA
uuccaggaaguauauggugc

SEQ ID NO: 32625 - RNA, 20 nt, Artificial Sequence
  MKO10032625_A_Mug2
  gRNA
agcuucauaccugauugucc

SEQ ID NO: 32626 - RNA, 20 nt, Artificial Sequence
  MKO10032626_A_Mul1
  gRNA
agcgguucgcgaccgucgcu

SEQ ID NO: 32627 - RNA, 20 nt, Artificial Sequence
  MKO10032627_A_Mul1
  gRNA
acuucucguacacggucucu

SEQ ID NO: 32628 - RNA, 20 nt, Artificial Sequence
  MKO10032628_A_Mul1
  gRNA
ccaguucaccgauccccgug

SEQ ID NO: 32629 - RNA, 20 nt, Artificial Sequence
  MKO10032629_A_Mum1l1
  gRNA
aguaccgggagaguaucgau

SEQ ID NO: 32630 - RNA, 20 nt, Artificial Sequence
  MKO10032630_A_Mum1l1
  gRNA
uuguuagcucggucccgagc

SEQ ID NO: 32631 - RNA, 20 nt, Artificial Sequence
  MKO10032631_A_Mum1l1
  gRNA
cgcaccaaucgauacucucc

SEQ ID NO: 32632 - RNA, 20 nt, Artificial Sequence
  MKO10032632_A_Mum1
  gRNA
uuaccgacgcucccugcgag

SEQ ID NO: 32633 - RNA, 20 nt, Artificial Sequence
  MKO10032633_A_Mum1
  gRNA
uagcccagugcgcauccaag

SEQ ID NO: 32634 - RNA, 20 nt, Artificial Sequence
  MKO10032634_A_Mum1
  gRNA
ccacggcugagcucuuaacc

SEQ ID NO: 32635 - RNA, 20 nt, Artificial Sequence
  MKO10032635_A_Mup10
  gRNA
uauuacagauuaauggggaa

SEQ ID NO: 32636 - RNA, 20 nt, Artificial Sequence
  MKO10032636_A_Mup10
  gRNA
aguauggaauuuaagaacua

SEQ ID NO: 32637 - RNA, 20 nt, Artificial Sequence
  MKO10032637_A_Mup10
  gRNA
agagugcuccgaauuaucua

SEQ ID NO: 32638 - RNA, 20 nt, Artificial Sequence
  MKO10032638_A_Mup11
  gRNA
uauuacagauuaauggggaa

SEQ ID NO: 32639 - RNA, 20 nt, Artificial Sequence
  MKO10032639_A_Mup11
  gRNA
aguauggaauuuaagaacua

SEQ ID NO: 32640 - RNA, 20 nt, Artificial Sequence
  MKO10032640_A_Mup11
  gRNA
cagaagagaugaagagugcu

SEQ ID NO: 32641 - RNA, 20 nt, Artificial Sequence
  MKO10032641_A_Mup12
  gRNA
uauuacagauuaauggggaa

SEQ ID NO: 32642 - RNA, 20 nt, Artificial Sequence
  MKO10032642_A_Mup12
  gRNA
aguauggaauuuaagaacua

SEQ ID NO: 32643 - RNA, 20 nt, Artificial Sequence
  MKO10032643_A_Mup12
  gRNA
cagaagagaugaagagugcu

SEQ ID NO: 32644 - RNA, 20 nt, Artificial Sequence
  MKO10032644_A_Mup13
  gRNA
uauuacagauuaauggggaa

SEQ ID NO: 32645 - RNA, 20 nt, Artificial Sequence
  MKO10032645_A_Mup13
  gRNA
aguauggacuuuaagaacua

SEQ ID NO: 32646 - RNA, 20 nt, Artificial Sequence
  MKO10032646_A_Mup13
  gRNA
cagaagagaugaagagugcu

SEQ ID NO: 32647 - RNA, 20 nt, Artificial Sequence
  MKO10032647_A_Mup14
  gRNA
uauuacagauuaauggggaa

SEQ ID NO: 32648 - RNA, 20 nt, Artificial Sequence
  MKO10032648_A_Mup14
  gRNA
aguauggaauuuaagaacua

SEQ ID NO: 32649 - RNA, 20 nt, Artificial Sequence
  MKO10032649_A_Mup14
  gRNA
cagaagagaugaagagugcu

SEQ ID NO: 32650 - RNA, 20 nt, Artificial Sequence
  MKO10032650_A_Mup15
  gRNA
uauuacagauuaauggggaa

SEQ ID NO: 32651 - RNA, 20 nt, Artificial Sequence
  MKO10032651_A_Mup15
  gRNA
aguauggaauuuaagaacua

SEQ ID NO: 32652 - RNA, 20 nt, Artificial Sequence
  MKO10032652_A_Mup15
  gRNA
cagaagagaugaagagugcu

SEQ ID NO: 32653 - RNA, 20 nt, Artificial Sequence
  MKO10032653_A_Mup16
  gRNA
uauuacagauuaauggggaa

SEQ ID NO: 32654 - RNA, 20 nt, Artificial Sequence
  MKO10032654_A_Mup16
  gRNA
aguauggaauuuaagaacua

SEQ ID NO: 32655 - RNA, 20 nt, Artificial Sequence
  MKO10032655_A_Mup16
  gRNA
agagugcuccgaauuaucua

SEQ ID NO: 32656 - RNA, 20 nt, Artificial Sequence
  MKO10032656_A_Mup17
  gRNA
caccucauuaacgaaaagga

SEQ ID NO: 32657 - RNA, 20 nt, Artificial Sequence
  MKO10032657_A_Mup17
  gRNA
uauuacagauuaauggggaa

SEQ ID NO: 32658 - RNA, 20 nt, Artificial Sequence
  MKO10032658_A_Mup17
  gRNA
aguauggacuuuaagaacua

SEQ ID NO: 32659 - RNA, 20 nt, Artificial Sequence
  MKO10032659_A_Mup19
  gRNA
uauuacagauuaauggggaa

SEQ ID NO: 32660 - RNA, 20 nt, Artificial Sequence
  MKO10032660_A_Mup19
  gRNA
aguauggaauuuaagaacua

SEQ ID NO: 32661 - RNA, 20 nt, Artificial Sequence
  MKO10032661_A_Mup19
  gRNA
agagugcuccgaauuaucua

SEQ ID NO: 32662 - RNA, 20 nt, Artificial Sequence
  MKO10032662_A_Mup1
  gRNA
gaugcugcugcugcugugug

SEQ ID NO: 32663 - RNA, 20 nt, Artificial Sequence
  MKO10032663_A_Mup1
  gRNA
uagaacuagcuucuucugca

SEQ ID NO: 32664 - RNA, 20 nt, Artificial Sequence
  MKO10032664_A_Mup1
  gRNA
uauuacagauuaauggggaa

SEQ ID NO: 32665 - RNA, 20 nt, Artificial Sequence
  MKO10032665_A_Mup20
  gRNA
uggagaaaccuuccagcuga

SEQ ID NO: 32666 - RNA, 20 nt, Artificial Sequence
  MKO10032666_A_Mup20
  gRNA
uauuacagauuaauggggaa

SEQ ID NO: 32667 - RNA, 20 nt, Artificial Sequence
  MKO10032667_A_Mup20
  gRNA
aauauggaauuuaagagcua

SEQ ID NO: 32668 - RNA, 20 nt, Artificial Sequence
  MKO10032668_A_Mup21
  gRNA
ucuuacagauuagcggguau

SEQ ID NO: 32669 - RNA, 20 nt, Artificial Sequence
  MKO10032669_A_Mup21
  gRNA
ugcaccgaaaugacuuugau

SEQ ID NO: 32670 - RNA, 20 nt, Artificial Sequence
  MKO10032670_A_Mup21
  gRNA
augacuuacugacguugguu

SEQ ID NO: 32671 - RNA, 20 nt, Artificial Sequence
  MKO10032671_A_Mup2
  gRNA
uauuacagauuaauggggaa

SEQ ID NO: 32672 - RNA, 20 nt, Artificial Sequence
  MKO10032672_A_Mup2
  gRNA
aguauggaauuuaagaacua

SEQ ID NO: 32673 - RNA, 20 nt, Artificial Sequence
  MKO10032673_A_Mup2
  gRNA
cagaagagaugaagagugcu

SEQ ID NO: 32674 - RNA, 20 nt, Artificial Sequence
  MKO10032674_A_Mup3
  gRNA
ugcaccgaaaugacugcgau

SEQ ID NO: 32675 - RNA, 20 nt, Artificial Sequence
  MKO10032675_A_Mup3
  gRNA
uucaccaaucgcagucauuu

SEQ ID NO: 32676 - RNA, 20 nt, Artificial Sequence
  MKO10032676_A_Mup3
  gRNA
ucuuacagauuaguggguau

SEQ ID NO: 32677 - RNA, 20 nt, Artificial Sequence
  MKO10032677_A_Mup4
  gRNA
guuucaucucauuaacgaaa

SEQ ID NO: 32678 - RNA, 20 nt, Artificial Sequence
  MKO10032678_A_Mup4
  gRNA
gcugacaaaacagagaaggc

SEQ ID NO: 32679 - RNA, 20 nt, Artificial Sequence
  MKO10032679_A_Mup4
  gRNA
uguggagcacauccaugucu

SEQ ID NO: 32680 - RNA, 20 nt, Artificial Sequence
  MKO10032680_A_Mup5
  gRNA
gugcuccacaaaaacucuca

SEQ ID NO: 32681 - RNA, 20 nt, Artificial Sequence
  MKO10032681_A_Mup5
  gRNA
uguggagcacaucgaugucu

SEQ ID NO: 32682 - RNA, 20 nt, Artificial Sequence
  MKO10032682_A_Mup5
  gRNA
agagugcacugaaauauauu

SEQ ID NO: 32683 - RNA, 20 nt, Artificial Sequence
  MKO10032683_A_Mup6
  gRNA
uuccagcugaugucgcucua

SEQ ID NO: 32684 - RNA, 20 nt, Artificial Sequence
  MKO10032684_A_Mup6
  gRNA
uaccauagagcgacaucagc

SEQ ID NO: 32685 - RNA, 20 nt, Artificial Sequence
  MKO10032685_A_Mup6
  gRNA
uugauaucugaauucaaauc

SEQ ID NO: 32686 - RNA, 20 nt, Artificial Sequence
  MKO10032686_A_Mup7
  gRNA
uauuacagauuaauggggaa

SEQ ID NO: 32687 - RNA, 20 nt, Artificial Sequence
  MKO10032687_A_Mup7
  gRNA
aguauggacuuuaagaacua

SEQ ID NO: 32688 - RNA, 20 nt, Artificial Sequence
  MKO10032688_A_Mup7
  gRNA
agagugcuccgaauuaucua

SEQ ID NO: 32689 - RNA, 20 nt, Artificial Sequence
  MKO10032689_A_Mup8
  gRNA
uauuacagauuaauggggaa

SEQ ID NO: 32690 - RNA, 20 nt, Artificial Sequence
  MKO10032690_A_Mup8
  gRNA
aguauggacuuuaagaacua

SEQ ID NO: 32691 - RNA, 20 nt, Artificial Sequence
  MKO10032691_A_Mup8
  gRNA
cagaagagaugaagagugcu

SEQ ID NO: 32692 - RNA, 20 nt, Artificial Sequence
  MKO10032692_A_Mup9
  gRNA
uauuacagauuaauggggaa

SEQ ID NO: 32693 - RNA, 20 nt, Artificial Sequence
  MKO10032693_A_Mup9
  gRNA
aguauggaauuuaagaacua

SEQ ID NO: 32694 - RNA, 20 nt, Artificial Sequence
  MKO10032694_A_Mup9
  gRNA
agagugcuccgaauuaucua

SEQ ID NO: 32695 - RNA, 20 nt, Artificial Sequence
  MKO10032695_A_Murc
  gRNA
ucacacuugacaaccgauuc

SEQ ID NO: 32696 - RNA, 20 nt, Artificial Sequence
  MKO10032696_A_Murc
  gRNA
aacauaauacuccucauccg

SEQ ID NO: 32697 - RNA, 20 nt, Artificial Sequence
  MKO10032697_A_Murc
  gRNA
ucuguccagcacggucacaa

SEQ ID NO: 32698 - RNA, 20 nt, Artificial Sequence
  MKO10032698_A_Mus81
  gRNA
uacccgcuaccauugcgcag

SEQ ID NO: 32699 - RNA, 20 nt, Artificial Sequence
  MKO10032699_A_Mus81
  gRNA
gcuuccuucccgcugcgcaa

SEQ ID NO: 32700 - RNA, 20 nt, Artificial Sequence
  MKO10032700_A_Mus81
  gRNA
ccacagcuuccuaaccaaag

SEQ ID NO: 32701 - RNA, 20 nt, Artificial Sequence
  MKO10032701_A_Musk
  gRNA
ggguuacccaucguagugca

SEQ ID NO: 32702 - RNA, 20 nt, Artificial Sequence
  MKO10032702_A_Musk
  gRNA
aaguuucucagucccgcuga

SEQ ID NO: 32703 - RNA, 20 nt, Artificial Sequence
  MKO10032703_A_Musk
  gRNA
agcauugucccccuugaucc

SEQ ID NO: 32704 - RNA, 20 nt, Artificial Sequence
  MKO10032704_A_Mustn1
  gRNA
agggggccgcuucuucuuga

SEQ ID NO: 32705 - RNA, 20 nt, Artificial Sequence
  MKO10032705_A_Mustn1
  gRNA
gaagaccugaagggggcccg

SEQ ID NO: 32706 - RNA, 20 nt, Artificial Sequence
  MKO10032706_A_Mustn1
  gRNA
guauucagccgcaaccgcac

SEQ ID NO: 32707 - RNA, 20 nt, Artificial Sequence
  MKO10032707_A_Muuyh
  gRNA
ugaucgacuauuauacucga

SEQ ID NO: 32708 - RNA, 20 nt, Artificial Sequence
  MKO10032708_A_Muuyh
  gRNA
auaggcccuccuguccgagu

SEQ ID NO: 32709 - RNA, 20 nt, Artificial Sequence
  MKO10032709_A_Muuyh
  gRNA
uccgaagcaacuugcucagc

SEQ ID NO: 32710 - RNA, 20 nt, Artificial Sequence
  MKO10032710_A_Muu
  gRNA
ccgcacugcaaucgaagcca

SEQ ID NO: 32711 - RNA, 20 nt, Artificial Sequence
  MKO10032711_A_Muu
  gRNA
guacuccaacccaucugcga

SEQ ID NO: 32712 - RNA, 20 nt, Artificial Sequence
  MKO10032712_A_Muu
  gRNA
uaagugaccaccccgauguc

SEQ ID NO: 32713 - RNA, 20 nt, Artificial Sequence
  MKO10032713_A_Mvb12a
  gRNA
cggcuuucugcgcgaagccu

SEQ ID NO: 32714 - RNA, 20 nt, Artificial Sequence
  MKO10032714_A_Mvb12a
  gRNA
caagccccgcacgcucagcc

SEQ ID NO: 32715 - RNA, 20 nt, Artificial Sequence
  MKO10032715_A_Mvb12a
  gRNA
cggaucuuacugauauccug

SEQ ID NO: 32716 - RNA, 20 nt, Artificial Sequence
  MKO10032716_A_Mvb12b
  gRNA
cuuacccgauaaacguguac

SEQ ID NO: 32717 - RNA, 20 nt, Artificial Sequence
  MKO10032717_A_Mvb12b
  gRNA
ucccggaaccgagcaccaac

SEQ ID NO: 32718 - RNA, 20 nt, Artificial Sequence
  MKO10032718_A_Mvb12b
  gRNA
uguugacucacguguaucca

SEQ ID NO: 32719 - RNA, 20 nt, Artificial Sequence
  MKO10032719_A_Mvd
  gRNA
ccuggugcagcgugacgcuc

SEQ ID NO: 32720 - RNA, 20 nt, Artificial Sequence
  MKO10032720_A_Mvd
  gRNA
cacaaccguugccauuagca

SEQ ID NO: 32721 - RNA, 20 nt, Artificial Sequence
  MKO10032721_A_Mvd
  gRNA
cugcccugcaguucgccgcc

SEQ ID NO: 32722 - RNA, 20 nt, Artificial Sequence
  MKO10032722_A_Mvk
  gRNA
caccugcuuaauaccgaugu

SEQ ID NO: 32723 - RNA, 20 nt, Artificial Sequence
  MKO10032723_A_Mvk
  gRNA
cgacuggacacgagcuuucu

SEQ ID NO: 32724 - RNA, 20 nt, Artificial Sequence
  MKO10032724_A_Mvk
  gRNA
gaccuccccagagaccgugc

SEQ ID NO: 32725 - RNA, 20 nt, Artificial Sequence
  MKO10032725_A_Mvp
  gRNA
ccggcuccggcacgcugacc

SEQ ID NO: 32726 - RNA, 20 nt, Artificial Sequence
  MKO10032726_A_Mvp
  gRNA
gggaccgucaccaugcgaac

SEQ ID NO: 32727 - RNA, 20 nt, Artificial Sequence
  MKO10032727_A_Mvp
  gRNA
gcaggacaucaccccgcugc

SEQ ID NO: 32728 - RNA, 20 nt, Artificial Sequence
  MKO10032728_A_Mx1
  gRNA
ggauuccaguuggauauaac

SEQ ID NO: 32729 - RNA, 20 nt, Artificial Sequence
  MKO10032729_A_Mx1
  gRNA
gaguucuuaagaacgucaga

SEQ ID NO: 32730 - RNA, 20 nt, Artificial Sequence
  MKO10032730_A_Mx1
  gRNA
gugucgaugaggucaauaca

SEQ ID NO: 32731 - RNA, 20 nt, Artificial Sequence
  MKO10032731_A_Mx2
  gRNA
gauucagucaacuuacccag

SEQ ID NO: 32732 - RNA, 20 nt, Artificial Sequence
  MKO10032732_A_Mx2
  gRNA
gagucgaugaggucaaugca

SEQ ID NO: 32733 - RNA, 20 nt, Artificial Sequence
  MKO10032733_A_Mx2
  gRNA
cuccuaugaugacaucgaag

SEQ ID NO: 32734 - RNA, 20 nt, Artificial Sequence
  MKO10032734_A_Mxd1
  gRNA
aacagcggcaccugaagcgg

SEQ ID NO: 32735 - RNA, 20 nt, Artificial Sequence
  MKO10032735_A_Mxd1
  gRNA
gccgcuguucccgcugaagc

SEQ ID NO: 32736 - RNA, 20 nt, Artificial Sequence
  MKO10032736_A_Mxd1
  gRNA
cggcuugacucagggcccag

SEQ ID NO: 32737 - RNA, 20 nt, Artificial Sequence
  MKO10032737_A_Mxd3
  gRNA
gcagcaagcccggcggcuca

SEQ ID NO: 32738 - RNA, 20 nt, Artificial Sequence
  MKO10032738_A_Mxd3
  gRNA
gcucuaagcaccgcuucagc

SEQ ID NO: 32739 - RNA, 20 nt, Artificial Sequence
  MKO10032739_A_Mxd3
  gRNA
caggucugugcacaacgagc

SEQ ID NO: 32740 - RNA, 20 nt, Artificial Sequence
  MKO10032740_A_Mxd4
  gRNA
ccuugcgaagucgccgucga

SEQ ID NO: 32741 - RNA, 20 nt, Artificial Sequence
  MKO10032741_A_Mxd4
  gRNA
gcaucuuagcacgcuucaga

SEQ ID NO: 32742 - RNA, 20 nt, Artificial Sequence
  MKO10032742_A_Mxd4
  gRNA
cacggaggcguagccgugcu

SEQ ID NO: 32743 - RNA, 20 nt, Artificial Sequence
  MKO10032743_A_Mxi1
  gRNA
cucguuccaaguucucuagc

SEQ ID NO: 32744 - RNA, 20 nt, Artificial Sequence
  MKO10032744_A_Mxi1
  gRNA
uccccuccaugccgagcccc

SEQ ID NO: 32745 - RNA, 20 nt, Artificial Sequence
  MKO10032745_A_Mxi1
  gRNA
cggauacgaauggacagcau

SEQ ID NO: 32746 - RNA, 20 nt, Artificial Sequence
  MKO10032746_A_Mxra7
  gRNA
ccacggcgcgauggagucgc

SEQ ID NO: 32747 - RNA, 20 nt, Artificial Sequence
  MKO10032747_A_Mxra7
  gRNA
cccgucugacaucucgccaa

SEQ ID NO: 32748 - RNA, 20 nt, Artificial Sequence
  MKO10032748_A_Mxra7
  gRNA
acuccgacucuaugacaugu

SEQ ID NO: 32749 - RNA, 20 nt, Artificial Sequence
  MKO10032749_A_Mxra8
  gRNA
cgcgcuggcgaucaugcagc

SEQ ID NO: 32750 - RNA, 20 nt, Artificial Sequence
  MKO10032750_A_Mxra8
  gRNA
gucaccgcgugcaaaagcgu

SEQ ID NO: 32751 - RNA, 20 nt, Artificial Sequence
  MKO10032751_A_Mxra8
  gRNA
gcgccgagucuuccaccuac

SEQ ID NO: 32752 - RNA, 20 nt, Artificial Sequence
  MKO10032752_A_Myadml2
  gRNA
uuucguaccaugcauccggc

SEQ ID NO: 32753 - RNA, 20 nt, Artificial Sequence
  MKO10032753_A_Myadml2
  gRNA
cccucuguacuucacccgac

SEQ ID NO: 32754 - RNA, 20 nt, Artificial Sequence
  MKO10032754_A_Myadml2
  gRNA
ugaugaugucaugacagcga

SEQ ID NO: 32755 - RNA, 20 nt, Artificial Sequence
  MKO10032755_A_Myadm
  gRNA
cccggguacguccaugagcu

SEQ ID NO: 32756 - RNA, 20 nt, Artificial Sequence
  MKO10032756_A_Myadm
  gRNA
gccaucugcuucauacuagc

SEQ ID NO: 32757 - RNA, 20 nt, Artificial Sequence
  MKO10032757_A_Myadm
  gRNA
ucugguguacuccacucguc

SEQ ID NO: 32758 - RNA, 20 nt, Artificial Sequence
  MKO10032758_A_Mybbp1a
  gRNA
gcccugaagcgccuaaucac

SEQ ID NO: 32759 - RNA, 20 nt, Artificial Sequence
  MKO10032759_A_Mybbp1a
  gRNA
gucucaccugugccagcgcc

SEQ ID NO: 32760 - RNA, 20 nt, Artificial Sequence
  MKO10032760_A_Mybbp1a
  gRNA
cagccuacaagccaugaaca

SEQ ID NO: 32761 - RNA, 20 nt, Artificial Sequence
  MKO10032761_A_Mybl1
  gRNA
auaugaagcacacaagcgcc

SEQ ID NO: 32762 - RNA, 20 nt, Artificial Sequence
  MKO10032762_A_Mybl1
  gRNA
aaaccuucugccaucgaugu

SEQ ID NO: 32763 - RNA, 20 nt, Artificial Sequence
  MKO10032763_A_Mybl1
  gRNA
aacaacacggaacugaugau

SEQ ID NO: 32764 - RNA, 20 nt, Artificial Sequence
  MKO10032764_A_Mybl2
  gRNA
ggcuaucagcguccacuguu

SEQ ID NO: 32765 - RNA, 20 nt, Artificial Sequence
  MKO10032765_A_Mybl2
  gRNA
gagaucgccaagaugcuacc

SEQ ID NO: 32766 - RNA, 20 nt, Artificial Sequence
  MKO10032766_A_Mybl2
  gRNA
ucuggaugaguuacacuacc

SEQ ID NO: 32767 - RNA, 20 nt, Artificial Sequence
  MKO10032767_A_Mybpc1
  gRNA
uacccgaguuugccucucga

SEQ ID NO: 32768 - RNA, 20 nt, Artificial Sequence
  MKO10032768_A_Mybpc1
  gRNA
cucaccaacuuucaccgauc

SEQ ID NO: 32769 - RNA, 20 nt, Artificial Sequence
  MKO10032769_A_Mybpc1
  gRNA
ccccuugaaccauuugacag

SEQ ID NO: 32770 - RNA, 20 nt, Artificial Sequence
  MKO10032770_A_Mybpc2
  gRNA
cgacagcugcucguucaacg

SEQ ID NO: 32771 - RNA, 20 nt, Artificial Sequence
  MKO10032771_A_Mybpc2
  gRNA
ucucuagacgguaauccccg

SEQ ID NO: 32772 - RNA, 20 nt, Artificial Sequence
  MKO10032772_A_Mybpc2
  gRNA
cggagcccgguucaucuuca

SEQ ID NO: 32773 - RNA, 20 nt, Artificial Sequence
  MKO10032773_A_Mybpc3
  gRNA
uggcagugcugccguguucg

SEQ ID NO: 32774 - RNA, 20 nt, Artificial Sequence
  MKO10032774_A_Mybpc3
  gRNA
ccucuuucugaugcgaccac

SEQ ID NO: 32775 - RNA, 20 nt, Artificial Sequence
  MKO10032775_A_Mybpc3
  gRNA
ggagccugcaaugaccgcgu

SEQ ID NO: 32776 - RNA, 20 nt, Artificial Sequence
  MKO10032776_A_Mybphl
  gRNA
ccccauuccgcacgcugaca

SEQ ID NO: 32777 - RNA, 20 nt, Artificial Sequence
  MKO10032777_A_Mybphl
  gRNA
gcuguauugcccguaucuug

SEQ ID NO: 32778 - RNA, 20 nt, Artificial Sequence
  MKO10032778_A_Mybphl
  gRNA
gaaucuacuaaucccgaucc

SEQ ID NO: 32779 - RNA, 20 nt, Artificial Sequence
  MKO10032779_A_Mybph
  gRNA
ccagcagacgguucgaaacc

SEQ ID NO: 32780 - RNA, 20 nt, Artificial Sequence
  MKO10032780_A_Mybph
  gRNA
ucgucagaccuacauccgcc

SEQ ID NO: 32781 - RNA, 20 nt, Artificial Sequence
  MKO10032781_A_Mybph
  gRNA
cuaugagcucaccgugcauc

SEQ ID NO: 32782 - RNA, 20 nt, Artificial Sequence
  MKO10032782_A_Myb
  gRNA
cuaacuuacgggcagauaau

SEQ ID NO: 32783 - RNA, 20 nt, Artificial Sequence
  MKO10032783_A_Myb
  gRNA
aacgcuucggaccauauuuc

SEQ ID NO: 32784 - RNA, 20 nt, Artificial Sequence
  MKO10032784_A_Myb
  gRNA
gcacuuucugccaccggugu

SEQ ID NO: 32785 - RNA, 20 nt, Artificial Sequence
  MKO10032785_A_Mycbp2
  gRNA
aaauuacuguucggaguacu

SEQ ID NO: 32786 - RNA, 20 nt, Artificial Sequence
  MKO10032786_A_Mycbp2
  gRNA
ucacgcuugccaaacuauuc

SEQ ID NO: 32787 - RNA, 20 nt, Artificial Sequence
  MKO10032787_A_Mycbp2
  gRNA
gcccccaaucaagcugccaa

SEQ ID NO: 32788 - RNA, 20 nt, Artificial Sequence
  MKO10032788_A_Mycbpap
  gRNA
cccauaccggaguaguccag

SEQ ID NO: 32789 - RNA, 20 nt, Artificial Sequence
  MKO10032789_A_Mycbpap
  gRNA
ccaggacuuuaaaagaaucg

SEQ ID NO: 32790 - RNA, 20 nt, Artificial Sequence
  MKO10032790_A_Mycbpap
  gRNA
gauccucccucaccagaucu

SEQ ID NO: 32791 - RNA, 20 nt, Artificial Sequence
  MKO10032791_A_Mycbp
  gRNA
acucgaagcgcgagcaguuc

SEQ ID NO: 32792 - RNA, 20 nt, Artificial Sequence
  MKO10032792_A_Mycbp
  gRNA
cugcucgcgcuucgagucgg

SEQ ID NO: 32793 - RNA, 20 nt, Artificial Sequence
  MKO10032793_A_Mycbp
  gRNA
uguucaguaugaaccaccuc

SEQ ID NO: 32794 - RNA, 20 nt, Artificial Sequence
  MKO10032794_A_Mycl
  gRNA
ccgagauuccgccucguccc

SEQ ID NO: 32795 - RNA, 20 nt, Artificial Sequence
  MKO10032795_A_Mycl
  gRNA
guccgggguagcgggcgcuu

SEQ ID NO: 32796 - RNA, 20 nt, Artificial Sequence
  MKO10032796_A_Mycl
  gRNA
ggggucugcucgcaccguga

SEQ ID NO: 32797 - RNA, 20 nt, Artificial Sequence
  MKO10032797_A_Mycn
  gRNA
cgaguacgugcacgcccuac

SEQ ID NO: 32798 - RNA, 20 nt, Artificial Sequence
  MKO10032798_A_Mycn
  gRNA
gccgacucucgcuuguucac

SEQ ID NO: 32799 - RNA, 20 nt, Artificial Sequence
  MKO10032799_A_Mycn
  gRNA
uaaagaagaucgaacacgcu

SEQ ID NO: 32800 - RNA, 20 nt, Artificial Sequence
  MKO10032800_A_Mycs
  gRNA
ugcguucuccugaugcgccg

SEQ ID NO: 32801 - RNA, 20 nt, Artificial Sequence
  MKO10032801_A_Mycs
  gRNA
ggcuaccggucccucgccgu

SEQ ID NO: 32802 - RNA, 20 nt, Artificial Sequence
  MKO10032802_A_Mycs
  gRNA
cgcgccaccguugcccuacg

SEQ ID NO: 32803 - RNA, 20 nt, Artificial Sequence
  MKO10032803_A_Mycu1
  gRNA
gcuaauaacaccacgagcuu

SEQ ID NO: 32804 - RNA, 20 nt, Artificial Sequence
  MKO10032804_A_Mycu1
  gRNA
aauguccuucaccguauccg

SEQ ID NO: 32805 - RNA, 20 nt, Artificial Sequence
  MKO10032805_A_Mycu1
  gRNA
ccagugcacccauuucgcag

SEQ ID NO: 32806 - RNA, 20 nt, Artificial Sequence
  MKO10032806_A_Myc
  gRNA
ggacguagcgaccgcaacau

SEQ ID NO: 32807 - RNA, 20 nt, Artificial Sequence
  MKO10032807_A_Myc
  gRNA
gcuguacggagucguagucg

SEQ ID NO: 32808 - RNA, 20 nt, Artificial Sequence
  MKO10032808_A_Myc
  gRNA
ucgggcucaucuccaucccg

SEQ ID NO: 32809 - RNA, 20 nt, Artificial Sequence
  MKO10032809_A_Myd88
  gRNA
guccgaccgugacguccugc

SEQ ID NO: 32810 - RNA, 20 nt, Artificial Sequence
  MKO10032810_A_Myd88
  gRNA
cucccucaggugucgccgca

SEQ ID NO: 32811 - RNA, 20 nt, Artificial Sequence
  MKO10032811_A_Myd88
  gRNA
caacgauaucgaguuugugc

SEQ ID NO: 32812 - RNA, 20 nt, Artificial Sequence
  MKO10032812_A_Myef2
  gRNA
aaagauuugaugagagaaaa

SEQ ID NO: 32813 - RNA, 20 nt, Artificial Sequence
  MKO10032813_A_Myef2
  gRNA
ggccgaugccgacaaguccg

SEQ ID NO: 32814 - RNA, 20 nt, Artificial Sequence
  MKO10032814_A_Myef2
  gRNA
cgacggcucgcagcagcaac

SEQ ID NO: 32815 - RNA, 20 nt, Artificial Sequence
  MKO10032815_A_Myeov2
  gRNA
ugucgagaugaaacccgcag

SEQ ID NO: 32816 - RNA, 20 nt, Artificial Sequence
  MKO10032816_A_Myeov2
  gRNA
caccucauccagguccacau

SEQ ID NO: 32817 - RNA, 20 nt, Artificial Sequence
  MKO10032817_A_Myeov2
  gRNA
cuccaggcuggagguagcac

SEQ ID NO: 32818 - RNA, 20 nt, Artificial Sequence
  MKO10032818_A_Myf5
  gRNA
cgugauccgauccacaaugc

SEQ ID NO: 32819 - RNA, 20 nt, Artificial Sequence
  MKO10032819_A_Myf5
  gRNA
ggcggccuugcgccgaucca

SEQ ID NO: 32820 - RNA, 20 nt, Artificial Sequence
  MKO10032820_A_Myf5
  gRNA
aagcuuucgagacgcucaag

SEQ ID NO: 32821 - RNA, 20 nt, Artificial Sequence
  MKO10032821_A_Myf6
  gRNA
aagcagcuacccugcgcgaa

SEQ ID NO: 32822 - RNA, 20 nt, Artificial Sequence
  MKO10032822_A_Myf6
  gRNA
cagcuacauugagcgucuac

SEQ ID NO: 32823 - RNA, 20 nt, Artificial Sequence
  MKO10032823_A_Myf6
  gRNA
caaguguuucggaucauucc

SEQ ID NO: 32824 - RNA, 20 nt, Artificial Sequence
  MKO10032824_A_Myg1
  gRNA
ugggauuaagccgagcaacc

SEQ ID NO: 32825 - RNA, 20 nt, Artificial Sequence
  MKO10032825_A_Myg1
  gRNA
gcacuucggacguaagcucc

SEQ ID NO: 32826 - RNA, 20 nt, Artificial Sequence
  MKO10032826_A_Myg1
  gRNA
gugguggucauggcauaccg

SEQ ID NO: 32827 - RNA, 20 nt, Artificial Sequence
  MKO10032827_A_Myh10
  gRNA
cuuacgugcauagaauugac

SEQ ID NO: 32828 - RNA, 20 nt, Artificial Sequence
  MKO10032828_A_Myh10
  gRNA
cuuugugagaagaagcaacg

SEQ ID NO: 32829 - RNA, 20 nt, Artificial Sequence
  MKO10032829_A_Myh10
  gRNA
cacguugcuucuucucacaa

SEQ ID NO: 32830 - RNA, 20 nt, Artificial Sequence
  MKO10032830_A_Myh11
  gRNA
caucuacucagaaaagaucg

SEQ ID NO: 32831 - RNA, 20 nt, Artificial Sequence
  MKO10032831_A_Myh11
  gRNA
agaggaguugucguucuuga

SEQ ID NO: 32832 - RNA, 20 nt, Artificial Sequence
  MKO10032832_A_Myh11
  gRNA
ucgcauugccgaaagccucc

SEQ ID NO: 32833 - RNA, 20 nt, Artificial Sequence
  MKO10032833_A_Myh13
  gRNA
gcuaacucacgugaucaaga

SEQ ID NO: 32834 - RNA, 20 nt, Artificial Sequence
  MKO10032834_A_Myh13
  gRNA
cccuaaguuugacaagaucg

SEQ ID NO: 32835 - RNA, 20 nt, Artificial Sequence
  MKO10032835_A_Myh13
  gRNA
uuaauugacaguggagaauc

SEQ ID NO: 32836 - RNA, 20 nt, Artificial Sequence
  MKO10032836_A_Myh14
  gRNA
cgcguaccgcagcaugcuuc

SEQ ID NO: 32837 - RNA, 20 nt, Artificial Sequence
  MKO10032837_A_Myh14
  gRNA
aacaauggccuccguguaga

SEQ ID NO: 32838 - RNA, 20 nt, Artificial Sequence
  MKO10032838_A_Myh14
  gRNA
auugccaaaggcuucuagga

SEQ ID NO: 32839 - RNA, 20 nt, Artificial Sequence
  MKO10032839_A_Myh15
  gRNA
cauacgugaagacuauagac

SEQ ID NO: 32840 - RNA, 20 nt, Artificial Sequence
  MKO10032840_A_Myh15
  gRNA
guuaaagaaagcggugauga

SEQ ID NO: 32841 - RNA, 20 nt, Artificial Sequence
  MKO10032841_A_Myh15
  gRNA
uacauacauagaucauccaa

SEQ ID NO: 32842 - RNA, 20 nt, Artificial Sequence
  MKO10032842_A_Myh1
  gRNA
ucguuggacagcggagaauc

SEQ ID NO: 32843 - RNA, 20 nt, Artificial Sequence
  MKO10032843_A_Myh1
  gRNA
gccaguguauaacgcagagg

SEQ ID NO: 32844 - RNA, 20 nt, Artificial Sequence
  MKO10032844_A_Myh1
  gRNA
accaccucugcguuauacac

SEQ ID NO: 32845 - RNA, 20 nt, Artificial Sequence
  MKO10032845_A_Myh2
  gRNA
ucaccgucaacccuuacaaa

SEQ ID NO: 32846 - RNA, 20 nt, Artificial Sequence
  MKO10032846_A_Myh2
  gRNA
ugacuuaacagcggagaauc

SEQ ID NO: 32847 - RNA, 20 nt, Artificial Sequence
  MKO10032847_A_Myh2
  gRNA
gaggguucauggggaagauc

SEQ ID NO: 32848 - RNA, 20 nt, Artificial Sequence
  MKO10032848_A_Myh3
  gRNA
cuucuaaauagcggagaauc

SEQ ID NO: 32849 - RNA, 20 nt, Artificial Sequence
  MKO10032849_A_Myh3
  gRNA
uucauggcauacacguccuc

SEQ ID NO: 32850 - RNA, 20 nt, Artificial Sequence
  MKO10032850_A_Myh3
  gRNA
cucacgugaucaggauagac

SEQ ID NO: 32851 - RNA, 20 nt, Artificial Sequence
  MKO10032851_A_Myh4
  gRNA
gucuacuuacguaaucagga

SEQ ID NO: 32852 - RNA, 20 nt, Artificial Sequence
  MKO10032852_A_Myh4
  gRNA
uuaacagacggucaccguca

SEQ ID NO: 32853 - RNA, 20 nt, Artificial Sequence
  MKO10032853_A_Myh4
  gRNA
cugucccucaguggagaauc

SEQ ID NO: 32854 - RNA, 20 nt, Artificial Sequence
  MKO10032854_A_Myh6
  gRNA
ucuccagacggugaccauaa

SEQ ID NO: 32855 - RNA, 20 nt, Artificial Sequence
  MKO10032855_A_Myh6
  gRNA
caaccucaaggagcgcuacg

SEQ ID NO: 32856 - RNA, 20 nt, Artificial Sequence
  MKO10032856_A_Myh6
  gRNA
guugccucaagcggagaauc

SEQ ID NO: 32857 - RNA, 20 nt, Artificial Sequence
  MKO10032857_A_Myh7b
  gRNA
caugaugacgcaccucaacg

SEQ ID NO: 32858 - RNA, 20 nt, Artificial Sequence
  MKO10032858_A_Myh7b
  gRNA
caagggcaagcgucgcuccg

SEQ ID NO: 32859 - RNA, 20 nt, Artificial Sequence
  MKO10032859_A_Myh7b
  gRNA
cccaccccguuucgacuuac

SEQ ID NO: 32860 - RNA, 20 nt, Artificial Sequence
  MKO10032860_A_Myh7
  gRNA
ucaaggagcgcuacgcuucc

SEQ ID NO: 32861 - RNA, 20 nt, Artificial Sequence
  MKO10032861_A_Myh7
  gRNA
uuugcuguuauugccgccau

SEQ ID NO: 32862 - RNA, 20 nt, Artificial Sequence
  MKO10032862_A_Myh7
  gRNA
cuauacucacgugaugagga

SEQ ID NO: 32863 - RNA, 20 nt, Artificial Sequence
  MKO10032863_A_Myh8
  gRNA
agucacauacgugaucagga

SEQ ID NO: 32864 - RNA, 20 nt, Artificial Sequence
  MKO10032864_A_Myh8
  gRNA
guccucgaucuugucauauu

SEQ ID NO: 32865 - RNA, 20 nt, Artificial Sequence
  MKO10032865_A_Myh8
  gRNA
uuaccagacucucaccguca

SEQ ID NO: 32866 - RNA, 20 nt, Artificial Sequence
  MKO10032866_A_Myh9
  gRNA
ucuguuggcaggggggaguc

SEQ ID NO: 32867 - RNA, 20 nt, Artificial Sequence
  MKO10032867_A_Myh9
  gRNA
gcucacccugcaucaugcuc

SEQ ID NO: 32868 - RNA, 20 nt, Artificial Sequence
  MKO10032868_A_Myh9
  gRNA
uaucugugauggcguagaug

SEQ ID NO: 32869 - RNA, 20 nt, Artificial Sequence
  MKO10032869_A_Myl10
  gRNA
uaaggaaaagcuuaugacgc

SEQ ID NO: 32870 - RNA, 20 nt, Artificial Sequence
  MKO10032870_A_Myl10
  gRNA
ucgcauaaaugucaagaacg

SEQ ID NO: 32871 - RNA, 20 nt, Artificial Sequence
  MKO10032871_A_Myl10
  gRNA
cgugcaguauagucucuucu

SEQ ID NO: 32872 - RNA, 20 nt, Artificial Sequence
  MKO10032872_A_Myl12a
  gRNA
cguccagguauucgucaguu

SEQ ID NO: 32873 - RNA, 20 nt, Artificial Sequence
  MKO10032873_A_Myl12a
  gRNA
uuauccuccaggcaccaucc

SEQ ID NO: 32874 - RNA, 20 nt, Artificial Sequence
  MKO10032874_A_Myl12a
  gRNA
aaacccaacugacgaauacc

SEQ ID NO: 32875 - RNA, 20 nt, Artificial Sequence
  MKO10032875_A_Myl12b
  gRNA
uugcccuccaggcaccaucc

SEQ ID NO: 32876 - RNA, 20 nt, Artificial Sequence
  MKO10032876_A_Myl12b
  gRNA
gaaucccacugaugccuacc

SEQ ID NO: 32877 - RNA, 20 nt, Artificial Sequence
  MKO10032877_A_Myl12b
  gRNA
gcuaaacggcacugaccccg

SEQ ID NO: 32878 - RNA, 20 nt, Artificial Sequence
  MKO10032878_A_Myl1
  gRNA
agcccuuacccagaguggcg

SEQ ID NO: 32879 - RNA, 20 nt, Artificial Sequence
  MKO10032879_A_Myl1
  gRNA
guuucuugcagacuucaagg

SEQ ID NO: 32880 - RNA, 20 nt, Artificial Sequence
  MKO10032880_A_Myl1
  gRNA
uuccccaggagagaagauga

SEQ ID NO: 32881 - RNA, 20 nt, Artificial Sequence
  MKO10032881_A_Myl2
  gRNA
cgaugaagccgucucuguuc

SEQ ID NO: 32882 - RNA, 20 nt, Artificial Sequence
  MKO10032882_A_Myl2
  gRNA
gaccauucucaacgcauuca

SEQ ID NO: 32883 - RNA, 20 nt, Artificial Sequence
  MKO10032883_A_Myl2
  gRNA
cccgccuucuauccgcuucu

SEQ ID NO: 32884 - RNA, 20 nt, Artificial Sequence
  MKO10032884_A_Myl3
  gRNA
ugugaucuucaucucgcccu

SEQ ID NO: 32885 - RNA, 20 nt, Artificial Sequence
  MKO10032885_A_Myl3
  gRNA
gcuguucgaccgcacaccca

SEQ ID NO: 32886 - RNA, 20 nt, Artificial Sequence
  MKO10032886_A_Myl3
  gRNA
ccagcguggccagcacgugu

SEQ ID NO: 32887 - RNA, 20 nt, Artificial Sequence
  MKO10032887_A_Myl4
  gRNA
aacgcgcagcaccucugcgu

SEQ ID NO: 32888 - RNA, 20 nt, Artificial Sequence
  MKO10032888_A_Myl4
  gRNA
uucagugcugaccagaucga

SEQ ID NO: 32889 - RNA, 20 nt, Artificial Sequence
  MKO10032889_A_Myl4
  gRNA
auuguuugaccggacuccaa

SEQ ID NO: 32890 - RNA, 20 nt, Artificial Sequence
  MKO10032890_A_Myl6b
  gRNA
acgucucaaagucuacacgu

SEQ ID NO: 32891 - RNA, 20 nt, Artificial Sequence
  MKO10032891_A_Myl6b
  gRNA
uuugagcuguuugaccgagu

SEQ ID NO: 32892 - RNA, 20 nt, Artificial Sequence
  MKO10032892_A_Myl6b
  gRNA
ccuggggaaccccaaaaacg

SEQ ID NO: 32893 - RNA, 20 nt, Artificial Sequence
  MKO10032893_A_Myl6
  gRNA
gacccuuacccagugugacu

SEQ ID NO: 32894 - RNA, 20 nt, Artificial Sequence
  MKO10032894_A_Myl6
  gRNA
cgagcagugugacuucaccg

SEQ ID NO: 32895 - RNA, 20 nt, Artificial Sequence
  MKO10032895_A_Myl6
  gRNA
ccuaccugcggucugguccu

SEQ ID NO: 32896 - RNA, 20 nt, Artificial Sequence
  MKO10032896_A_Myl7
  gRNA
cccuccagggacggaccccg

SEQ ID NO: 32897 - RNA, 20 nt, Artificial Sequence
  MKO10032897_A_Myl7
  gRNA
gcuggggucgaacaugcgga

SEQ ID NO: 32898 - RNA, 20 nt, Artificial Sequence
  MKO10032898_A_Myl7
  gRNA
guucgaacaagcccagauuc

SEQ ID NO: 32899 - RNA, 20 nt, Artificial Sequence
  MKO10032899_A_Myl9
  gRNA
cgaccgauucacggaugagg

SEQ ID NO: 32900 - RNA, 20 nt, Artificial Sequence
  MKO10032900_A_Myl9
  gRNA
cgaggcacccauugauaaga

SEQ ID NO: 32901 - RNA, 20 nt, Artificial Sequence
  MKO10032901_A_Myl9
  gRNA
gcccuccagauacucgucug

SEQ ID NO: 32902 - RNA, 20 nt, Artificial Sequence
  MKO10032902_A_Mylip
  gRNA
cagcaucguugcgaagcaua

SEQ ID NO: 32903 - RNA, 20 nt, Artificial Sequence
  MKO10032903_A_Mylip
  gRNA
caccuuaccgccuuaaacug

SEQ ID NO: 32904 - RNA, 20 nt, Artificial Sequence
  MKO10032904_A_Mylip
  gRNA
gauggcucgguagaggccgc

SEQ ID NO: 32905 - RNA, 20 nt, Artificial Sequence
  MKO10032905_A_Mylk2
  gRNA
gcagcagaaugccgcgaagc

SEQ ID NO: 32906 - RNA, 20 nt, Artificial Sequence
  MKO10032906_A_Mylk2
  gRNA
uaccguucuaguggcaaauu

SEQ ID NO: 32907 - RNA, 20 nt, Artificial Sequence
  MKO10032907_A_Mylk2
  gRNA
acaacagaccucgucuuuac

SEQ ID NO: 32908 - RNA, 20 nt, Artificial Sequence
  MKO10032908_A_Mylk3
  gRNA
gccuucccacagcguccuag

SEQ ID NO: 32909 - RNA, 20 nt, Artificial Sequence
  MKO10032909_A_Mylk3
  gRNA
agcaaucgacagaaucagcg

SEQ ID NO: 32910 - RNA, 20 nt, Artificial Sequence
  MKO10032910_A_Mylk3
  gRNA
gugugcaagcugacgccucu

SEQ ID NO: 32911 - RNA, 20 nt, Artificial Sequence
  MKO10032911_A_Mylk4
  gRNA
auuaccauccgaugaucaaa

SEQ ID NO: 32912 - RNA, 20 nt, Artificial Sequence
  MKO10032912_A_Mylk4
  gRNA
gaucagcgucaugaaccagc

SEQ ID NO: 32913 - RNA, 20 nt, Artificial Sequence
  MKO10032913_A_Mylk4
  gRNA
cugccgcuccauuugaucau

SEQ ID NO: 32914 - RNA, 20 nt, Artificial Sequence
  MKO10032914_A_Mylk
  gRNA
uggcgcccgccaggugaccg

SEQ ID NO: 32915 - RNA, 20 nt, Artificial Sequence
  MKO10032915_A_Mylk
  gRNA
gggagacucguccuagcauc

SEQ ID NO: 32916 - RNA, 20 nt, Artificial Sequence
  MKO10032916_A_Mylk
  gRNA
ugucauccacacuguccgcg

SEQ ID NO: 32917 - RNA, 20 nt, Artificial Sequence
  MKO10032917_A_Mylpf
  gRNA
uuaucgacaaagaggaucuu

SEQ ID NO: 32918 - RNA, 20 nt, Artificial Sequence
  MKO10032918_A_Mylpf
  gRNA
ugucccugcaggugcggacc

SEQ ID NO: 32919 - RNA, 20 nt, Artificial Sequence
  MKO10032919_A_Mylpf
  gRNA
ucacuguaauugaucagaac

SEQ ID NO: 32920 - RNA, 20 nt, Artificial Sequence
  MKO10032920_A_Mynn
  gRNA
cgcgcucucuagaacgucac

SEQ ID NO: 32921 - RNA, 20 nt, Artificial Sequence
  MKO10032921_A_Mynn
  gRNA
cccgauuguuauaaucucgc

SEQ ID NO: 32922 - RNA, 20 nt, Artificial Sequence
  MKO10032922_A_Mynn
  gRNA
caccaugaugcaugcgacua

SEQ ID NO: 32923 - RNA, 20 nt, Artificial Sequence
  MKO10032923_A_Myo10
  gRNA
gggguucacugacgcgauga

SEQ ID NO: 32924 - RNA, 20 nt, Artificial Sequence
  MKO10032924_A_Myo10
  gRNA
ccuguacgagcgcgccacca

SEQ ID NO: 32925 - RNA, 20 nt, Artificial Sequence
  MKO10032925_A_Myo10
  gRNA
gcgcucgcuaccugcuuuga

SEQ ID NO: 32926 - RNA, 20 nt, Artificial Sequence
  MKO10032926_A_Myo15
  gRNA
uagauugcaaacauucgaua

SEQ ID NO: 32927 - RNA, 20 nt, Artificial Sequence
  MKO10032927_A_Myo15
  gRNA
gaugagguuucgcucaaauc

SEQ ID NO: 32928 - RNA, 20 nt, Artificial Sequence
  MKO10032928_A_Myo15
  gRNA
cuuuagguuggcuagcacag

SEQ ID NO: 32929 - RNA, 20 nt, Artificial Sequence
  MKO10032929_A_Myo16
  gRNA
cccuuuagauuaugccguug

SEQ ID NO: 32930 - RNA, 20 nt, Artificial Sequence
  MKO10032930_A_Myo16
  gRNA
uuaucuggcgcagcgagcug

SEQ ID NO: 32931 - RNA, 20 nt, Artificial Sequence
  MKO10032931_A_Myo16
  gRNA
ugacguccguuagcauacuc

SEQ ID NO: 32932 - RNA, 20 nt, Artificial Sequence
  MKO10032932_A_Myo18a
  gRNA
gcaguaucuggcuaccaucg

SEQ ID NO: 32933 - RNA, 20 nt, Artificial Sequence
  MKO10032933_A_Myo18a
  gRNA
cauacacugcgccagcgcua

SEQ ID NO: 32934 - RNA, 20 nt, Artificial Sequence
  MKO10032934_A_Myo18a
  gRNA
cucguugagguauaccagug

SEQ ID NO: 32935 - RNA, 20 nt, Artificial Sequence
  MKO10032935_A_Myo18b
  gRNA
ucugcugauauccccguugu

SEQ ID NO: 32936 - RNA, 20 nt, Artificial Sequence
  MKO10032936_A_Myo18b
  gRNA
uacaacggggauaucagcag

SEQ ID NO: 32937 - RNA, 20 nt, Artificial Sequence
  MKO10032937_A_Myo18b
  gRNA
cagaaggacggguucacgcu

SEQ ID NO: 32938 - RNA, 20 nt, Artificial Sequence
  MKO10032938_A_Myo19
  gRNA
ccaccgcauagaacuucauc

SEQ ID NO: 32939 - RNA, 20 nt, Artificial Sequence
  MKO10032939_A_Myo19
  gRNA
acugguugaccggcucaauc

SEQ ID NO: 32940 - RNA, 20 nt, Artificial Sequence
  MKO10032940_A_Myo19
  gRNA
gaguugagggacgugcuuaa

SEQ ID NO: 32941 - RNA, 20 nt, Artificial Sequence
  MKO10032941_A_Myo1a
  gRNA
uaagcuagugauguccuacg

SEQ ID NO: 32942 - RNA, 20 nt, Artificial Sequence
  MKO10032942_A_Myo1a
  gRNA
gcucauagaaaguauagucc

SEQ ID NO: 32943 - RNA, 20 nt, Artificial Sequence
  MKO10032943_A_Myo1a
  gRNA
aucgagaggaguuguuauug

SEQ ID NO: 32944 - RNA, 20 nt, Artificial Sequence
  MKO10032944_A_Myo1b
  gRNA
cauauauucgccggagaaag

SEQ ID NO: 32945 - RNA, 20 nt, Artificial Sequence
  MKO10032945_A_Myo1b
  gRNA
auaggacaugacgagcuugc

SEQ ID NO: 32946 - RNA, 20 nt, Artificial Sequence
  MKO10032946_A_Myo1b
  gRNA
augaacgucuccucauugag

SEQ ID NO: 32947 - RNA, 20 nt, Artificial Sequence
  MKO10032947_A_Myo1c
  gRNA
cgcacugcgccaccccguuc

SEQ ID NO: 32948 - RNA, 20 nt, Artificial Sequence
  MKO10032948_A_Myo1c
  gRNA
ucguacugagcgucgggacc

SEQ ID NO: 32949 - RNA, 20 nt, Artificial Sequence
  MKO10032949_A_Myo1c
  gRNA
gcgccuugacugcccgagac

SEQ ID NO: 32950 - RNA, 20 nt, Artificial Sequence
  MKO10032950_A_Myo1d
  gRNA
gacacugucgagcaguauaa

SEQ ID NO: 32951 - RNA, 20 nt, Artificial Sequence
  MKO10032951_A_Myo1d
  gRNA
gcugaagucaaacugcguuu

SEQ ID NO: 32952 - RNA, 20 nt, Artificial Sequence
  MKO10032952_A_Myo1d
  gRNA
aucguaaugacaauuccagc

SEQ ID NO: 32953 - RNA, 20 nt, Artificial Sequence
  MKO10032953_A_Myo1e
  gRNA
ucuuuccguagcggugaaag

SEQ ID NO: 32954 - RNA, 20 nt, Artificial Sequence
  MKO10032954_A_Myo1e
  gRNA
caccacugugcuugacauug

SEQ ID NO: 32955 - RNA, 20 nt, Artificial Sequence
  MKO10032955_A_Myo1e
  gRNA
agggcagcaaaggcgccuac

SEQ ID NO: 32956 - RNA, 20 nt, Artificial Sequence
  MKO10032956_A_Myo1f
  gRNA
gacucaccgcgcccugauag

SEQ ID NO: 32957 - RNA, 20 nt, Artificial Sequence
  MKO10032957_A_Myo1f
  gRNA
caaccuccgcaaacgcuuca

SEQ ID NO: 32958 - RNA, 20 nt, Artificial Sequence
  MKO10032958_A_Myo1f
  gRNA
cccucaccgacaacauguac

SEQ ID NO: 32959 - RNA, 20 nt, Artificial Sequence
  MKO10032959_A_Myo1g
  gRNA
cguauccgugaaccccuacc

SEQ ID NO: 32960 - RNA, 20 nt, Artificial Sequence
  MKO10032960_A_Myo1g
  gRNA
accaccucaucuuuacgccg

SEQ ID NO: 32961 - RNA, 20 nt, Artificial Sequence
  MKO10032961_A_Myo1g
  gRNA
gccaaaggcuucgagcacac

SEQ ID NO: 32962 - RNA, 20 nt, Artificial Sequence
  MKO10032962_A_Myo1h
  gRNA
uguggaaguuccgcucgccg

SEQ ID NO: 32963 - RNA, 20 nt, Artificial Sequence
  MKO10032963_A_Myo1h
  gRNA
aucggagcgccucgccuccc

SEQ ID NO: 32964 - RNA, 20 nt, Artificial Sequence
  MKO10032964_A_Myo1h
  gRNA
cuccgagcacaucaugcgau

SEQ ID NO: 32965 - RNA, 20 nt, Artificial Sequence
  MKO10032965_A_Myo3a
  gRNA
cccauaaguuccuuugccga

SEQ ID NO: 32966 - RNA, 20 nt, Artificial Sequence
  MKO10032966_A_Myo3a
  gRNA
acuuucugaccacccaaaug

SEQ ID NO: 32967 - RNA, 20 nt, Artificial Sequence
  MKO10032967_A_Myo3a
  gRNA
aucauugaaaccaucggcaa

SEQ ID NO: 32968 - RNA, 20 nt, Artificial Sequence
  MKO10032968_A_Myo3b
  gRNA
uuacaaagccgaucgcugug

SEQ ID NO: 32969 - RNA, 20 nt, Artificial Sequence
  MKO10032969_A_Myo3b
  gRNA
ggaaucacuccccgauccca

SEQ ID NO: 32970 - RNA, 20 nt, Artificial Sequence
  MKO10032970_A_Myo3b
  gRNA
aaucgucucuauaaucuccc

SEQ ID NO: 32971 - RNA, 20 nt, Artificial Sequence
  MKO10032971_A_Myo5a
  gRNA
uacaguugcgaaguaccgca

SEQ ID NO: 32972 - RNA, 20 nt, Artificial Sequence
  MKO10032972_A_Myo5a
  gRNA
uugcucaaggauuauaagcc

SEQ ID NO: 32973 - RNA, 20 nt, Artificial Sequence
  MKO10032973_A_Myo5a
  gRNA
cggaacccugacauacuugu

SEQ ID NO: 32974 - RNA, 20 nt, Artificial Sequence
  MKO10032974_A_Myo5b
  gRNA
aaaauagcgcauggcguacu

SEQ ID NO: 32975 - RNA, 20 nt, Artificial Sequence
  MKO10032975_A_Myo5b
  gRNA
gccgagcgccacaccucauc

SEQ ID NO: 32976 - RNA, 20 nt, Artificial Sequence
  MKO10032976_A_Myo5b
  gRNA
augacauccuguccguagau

SEQ ID NO: 32977 - RNA, 20 nt, Artificial Sequence
  MKO10032977_A_Myo5c
  gRNA
ugauucuccacucacgauua

SEQ ID NO: 32978 - RNA, 20 nt, Artificial Sequence
  MKO10032978_A_Myo5c
  gRNA
gccaucauccacgccuacag

SEQ ID NO: 32979 - RNA, 20 nt, Artificial Sequence
  MKO10032979_A_Myo5c
  gRNA
ucucugcacgcuaugccaug

SEQ ID NO: 32980 - RNA, 20 nt, Artificial Sequence
  MKO10032980_A_Myo6
  gRNA
agccagucuaucaucguauc

SEQ ID NO: 32981 - RNA, 20 nt, Artificial Sequence
  MKO10032981_A_Myo6
  gRNA
uguaccgaacuuugacauug

SEQ ID NO: 32982 - RNA, 20 nt, Artificial Sequence
  MKO10032982_A_Myo6
  gRNA
cuccagauacgaugauagac

SEQ ID NO: 32983 - RNA, 20 nt, Artificial Sequence
  MKO10032983_A_Myo7a
  gRNA
cuccacgccgugcaccgaug

SEQ ID NO: 32984 - RNA, 20 nt, Artificial Sequence
  MKO10032984_A_Myo7a
  gRNA
gaaaccuucucauucgcuac

SEQ ID NO: 32985 - RNA, 20 nt, Artificial Sequence
  MKO10032985_A_Myo7a
  gRNA
cguggugaagcucugcgacu

SEQ ID NO: 32986 - RNA, 20 nt, Artificial Sequence
  MKO10032986_A_Myo7b
  gRNA
gcauucguggaucgagcaac

SEQ ID NO: 32987 - RNA, 20 nt, Artificial Sequence
  MKO10032987_A_Myo7b
  gRNA
guugcucgauccacgaaugc

SEQ ID NO: 32988 - RNA, 20 nt, Artificial Sequence
  MKO10032988_A_Myo7b
  gRNA
gaccuugauugaggaugacg

SEQ ID NO: 32989 - RNA, 20 nt, Artificial Sequence
  MKO10032989_A_Myo9a
  gRNA
guauucuauuaccuucucgc

SEQ ID NO: 32990 - RNA, 20 nt, Artificial Sequence
  MKO10032990_A_Myo9a
  gRNA
aauaacaauucaagucguuu

SEQ ID NO: 32991 - RNA, 20 nt, Artificial Sequence
  MKO10032991_A_Myo9a
  gRNA
ccucacuugcuccugcgaga

SEQ ID NO: 32992 - RNA, 20 nt, Artificial Sequence
  MKO10032992_A_Myo9b
  gRNA
gaugguccuuucgacgccac

SEQ ID NO: 32993 - RNA, 20 nt, Artificial Sequence
  MKO10032993_A_Myo9b
  gRNA
gcuaugccaguggcgucgaa

SEQ ID NO: 32994 - RNA, 20 nt, Artificial Sequence
  MKO10032994_A_Myo9b
  gRNA
ccuucuugaaaagucucgcc

SEQ ID NO: 32995 - RNA, 20 nt, Artificial Sequence
  MKO10032995_A_Myocd
  gRNA
acucacgcgguauuaagccu

SEQ ID NO: 32996 - RNA, 20 nt, Artificial Sequence
  MKO10032996_A_Myocd
  gRNA
cagguccgaccgugccagcc

SEQ ID NO: 32997 - RNA, 20 nt, Artificial Sequence
  MKO10032997_A_Myocd
  gRNA
uguuucugcccuugcgccuc

SEQ ID NO: 32998 - RNA, 20 nt, Artificial Sequence
  MKO10032998_A_Myoc
  gRNA
cuucgccuacgacacuaaaa

SEQ ID NO: 32999 - RNA, 20 nt, Artificial Sequence
  MKO10032999_A_Myoc
  gRNA
uacuuguagcgauucgugaa

SEQ ID NO: 33000 - RNA, 20 nt, Artificial Sequence
  MKO10033000_A_Myoc
  gRNA
cuaaagccgacuuaucucga

SEQ ID NO: 33001 - RNA, 20 nt, Artificial Sequence
  MKO10033001_A_Myod1
  gRNA
ggagaugcgcuccacuaugc

SEQ ID NO: 33002 - RNA, 20 nt, Artificial Sequence
  MKO10033002_A_Myod1
  gRNA
aacgccauccgcuacaucga

SEQ ID NO: 33003 - RNA, 20 nt, Artificial Sequence
  MKO10033003_A_Myod1
  gRNA
agcuucuaucgccgccacuc

SEQ ID NO: 33004 - RNA, 20 nt, Artificial Sequence
  MKO10033004_A_Myof
  gRNA
gugggguauagccgaucacc

SEQ ID NO: 33005 - RNA, 20 nt, Artificial Sequence
  MKO10033005_A_Myof
  gRNA
cuggucccgcucggaucauu

SEQ ID NO: 33006 - RNA, 20 nt, Artificial Sequence
  MKO10033006_A_Myof
  gRNA
uguagggcaaagaccuguuc

SEQ ID NO: 33007 - RNA, 20 nt, Artificial Sequence
  MKO10033007_A_Myog
  gRNA
ccaguacauugagcgccuac

SEQ ID NO: 33008 - RNA, 20 nt, Artificial Sequence
  MKO10033008_A_Myog
  gRNA
gcacucccuuacguccaucg

SEQ ID NO: 33009 - RNA, 20 nt, Artificial Sequence
  MKO10033009_A_Myog
  gRNA
gagcgcgaucuccgcuacag

SEQ ID NO: 33010 - RNA, 20 nt, Artificial Sequence
  MKO10033010_A_Myom1
  gRNA
caaacauaccacgugagccg

SEQ ID NO: 33011 - RNA, 20 nt, Artificial Sequence
  MKO10033011_A_Myom1
  gRNA
cgugguccguuuggagguug

SEQ ID NO: 33012 - RNA, 20 nt, Artificial Sequence
  MKO10033012_A_Myom1
  gRNA
cacguccacccuucaacgag

SEQ ID NO: 33013 - RNA, 20 nt, Artificial Sequence
  MKO10033013_A_Myom2
  gRNA
ucuuagguaccggucucaag

SEQ ID NO: 33014 - RNA, 20 nt, Artificial Sequence
  MKO10033014_A_Myom2
  gRNA
cguaagaagccgcuugagac

SEQ ID NO: 33015 - RNA, 20 nt, Artificial Sequence
  MKO10033015_A_Myom2
  gRNA
gcaaguaccggauugagagc

SEQ ID NO: 33016 - RNA, 20 nt, Artificial Sequence
  MKO10033016_A_Myom3
  gRNA
cgcuucgaucgcaugccguc

SEQ ID NO: 33017 - RNA, 20 nt, Artificial Sequence
  MKO10033017_A_Myom3
  gRNA
gcccguaguuguuggugaua

SEQ ID NO: 33018 - RNA, 20 nt, Artificial Sequence
  MKO10033018_A_Myom3
  gRNA
gaacugaucgaguugugcuc

SEQ ID NO: 33019 - RNA, 20 nt, Artificial Sequence
  MKO10033019_A_Myot
  gRNA
ucaacgcuucuuucgauccu

SEQ ID NO: 33020 - RNA, 20 nt, Artificial Sequence
  MKO10033020_A_Myot
  gRNA
agaaaacaugucgaucgaag

SEQ ID NO: 33021 - RNA, 20 nt, Artificial Sequence
  MKO10033021_A_Myot
  gRNA
gcgagccaucuucuccucgu

SEQ ID NO: 33022 - RNA, 20 nt, Artificial Sequence
  MKO10033022_A_Myoz1
  gRNA
ggcauugaccuacuggcaua

SEQ ID NO: 33023 - RNA, 20 nt, Artificial Sequence
  MKO10033023_A_Myoz1
  gRNA
cugucccuucuuaccaaccg

SEQ ID NO: 33024 - RNA, 20 nt, Artificial Sequence
  MKO10033024_A_Myoz1
  gRNA
acccccauggcccgauccca

SEQ ID NO: 33025 - RNA, 20 nt, Artificial Sequence
  MKO10033025_A_Myoz2
  gRNA
cuaaguacuaccggucucca

SEQ ID NO: 33026 - RNA, 20 nt, Artificial Sequence
  MKO10033026_A_Myoz2
  gRNA
auuuggggggcuucguggau

SEQ ID NO: 33027 - RNA, 20 nt, Artificial Sequence
  MKO10033027_A_Myoz2
  gRNA
aagcaucgucugcccgaaag

SEQ ID NO: 33028 - RNA, 20 nt, Artificial Sequence
  MKO10033028_A_Myoz3
  gRNA
cuccgagacgcacguguucc

SEQ ID NO: 33029 - RNA, 20 nt, Artificial Sequence
  MKO10033029_A_Myoz3
  gRNA
acacgugcgucucggagugg

SEQ ID NO: 33030 - RNA, 20 nt, Artificial Sequence
  MKO10033030_A_Myoz3
  gRNA
auccuggcgaguagugcccg

SEQ ID NO: 33031 - RNA, 20 nt, Artificial Sequence
  MKO10033031_A_Mypn
  gRNA
ucacucacugaccaucgccg

SEQ ID NO: 33032 - RNA, 20 nt, Artificial Sequence
  MKO10033032_A_Mypn
  gRNA
acucugggcugggccgccaa

SEQ ID NO: 33033 - RNA, 20 nt, Artificial Sequence
  MKO10033033_A_Mypn
  gRNA
gccugcacaauguggauauc

SEQ ID NO: 33034 - RNA, 20 nt, Artificial Sequence
  MKO10033034_A_Mypop
  gRNA
ccgcgugccgcauuccacgc

SEQ ID NO: 33035 - RNA, 20 nt, Artificial Sequence
  MKO10033035_A_Mypop
  gRNA
cgacuucaagcgccgcacca

SEQ ID NO: 33036 - RNA, 20 nt, Artificial Sequence
  MKO10033036_A_Mypop
  gRNA
aggagacugccaaugcuauc

SEQ ID NO: 33037 - RNA, 20 nt, Artificial Sequence
  MKO10033037_A_Myrfl
  gRNA
aagagcaacucguccccaac

SEQ ID NO: 33038 - RNA, 20 nt, Artificial Sequence
  MKO10033038_A_Myrfl
  gRNA
cuucaagcagacucguaucc

SEQ ID NO: 33039 - RNA, 20 nt, Artificial Sequence
  MKO10033039_A_Myrfl
  gRNA
uuaugcuuuacccaggaacg

SEQ ID NO: 33040 - RNA, 20 nt, Artificial Sequence
  MKO10033040_A_Myrf
  gRNA
ucauguagaggucccguugc

SEQ ID NO: 33041 - RNA, 20 nt, Artificial Sequence
  MKO10033041_A_Myrf
  gRNA
auggcagcauaaggggguac

SEQ ID NO: 33042 - RNA, 20 nt, Artificial Sequence
  MKO10033042_A_Myrf
  gRNA
ggaccauccccugggcgcca

SEQ ID NO: 33043 - RNA, 20 nt, Artificial Sequence
  MKO10033043_A_Myrip
  gRNA
gaagugacuccacguucuac

SEQ ID NO: 33044 - RNA, 20 nt, Artificial Sequence
  MKO10033044_A_Myrip
  gRNA
agcagcgcuccacgaacuuc

SEQ ID NO: 33045 - RNA, 20 nt, Artificial Sequence
  MKO10033045_A_Myrip
  gRNA
cccauagcuucucgugcuuc

SEQ ID NO: 33046 - RNA, 20 nt, Artificial Sequence
  MKO10033046_A_Mysm1
  gRNA
aucacuaucuugauucaacg

SEQ ID NO: 33047 - RNA, 20 nt, Artificial Sequence
  MKO10033047_A_Mysm1
  gRNA
aaaauucuggguuaaucaaa

SEQ ID NO: 33048 - RNA, 20 nt, Artificial Sequence
  MKO10033048_A_Mysm1
  gRNA
uaucauugagaaaaugcugu

SEQ ID NO: 33049 - RNA, 20 nt, Artificial Sequence
  MKO10033049_A_Myt1l
  gRNA
cgccaucgcacacgguccaa

SEQ ID NO: 33050 - RNA, 20 nt, Artificial Sequence
  MKO10033050_A_Myt1l
  gRNA
cucauaacauucgucuacug

SEQ ID NO: 33051 - RNA, 20 nt, Artificial Sequence
  MKO10033051_A_Myt1l
  gRNA
uucgcuugggagcagguucu

SEQ ID NO: 33052 - RNA, 20 nt, Artificial Sequence
  MKO10033052_A_Myt1
  gRNA
augacaagcgagcccgcaca

SEQ ID NO: 33053 - RNA, 20 nt, Artificial Sequence
  MKO10033053_A_Myt1
  gRNA
ggccucauaccuucgauguc

SEQ ID NO: 33054 - RNA, 20 nt, Artificial Sequence
  MKO10033054_A_Myt1
  gRNA
gcaaguacuccagacaucga

SEQ ID NO: 33055 - RNA, 20 nt, Artificial Sequence
  MKO10033055_A_Myzap
  gRNA
gaagauccgacagcucaccc

SEQ ID NO: 33056 - RNA, 20 nt, Artificial Sequence
  MKO10033056_A_Myzap
  gRNA
ugaugccaaugccgcauuca

SEQ ID NO: 33057 - RNA, 20 nt, Artificial Sequence
  MKO10033057_A_Myzap
  gRNA
auggacucaccgacaggucc

SEQ ID NO: 33058 - RNA, 20 nt, Artificial Sequence
  MKO10033058_A_Mzb1
  gRNA
aucuaugaagccuaccgcca

SEQ ID NO: 33059 - RNA, 20 nt, Artificial Sequence
  MKO10033059_A_Mzb1
  gRNA
gcagcgccuccagauucgcu

SEQ ID NO: 33060 - RNA, 20 nt, Artificial Sequence
  MKO10033060_A_Mzb1
  gRNA
gcaucgcagcgcaggugagc

SEQ ID NO: 33061 - RNA, 20 nt, Artificial Sequence
  MKO10033061_A_Mzf1
  gRNA
ucuagcagcacggcgcgucg

SEQ ID NO: 33062 - RNA, 20 nt, Artificial Sequence
  MKO10033062_A_Mzf1
  gRNA
ggcgcgugagcuugagucgc

SEQ ID NO: 33063 - RNA, 20 nt, Artificial Sequence
  MKO10033063_A_Mzf1
  gRNA
ucaggcucagugucgcuaug

SEQ ID NO: 33064 - RNA, 20 nt, Artificial Sequence
  MKO10033064_A_Mzt1
  gRNA
uggucucccucaccgcguuc

SEQ ID NO: 33065 - RNA, 20 nt, Artificial Sequence
  MKO10033065_A_Mzt1
  gRNA
cucuccauggcgagcgguag

SEQ ID NO: 33066 - RNA, 20 nt, Artificial Sequence
  MKO10033066_A_Mzt1
  gRNA
cuccuuaauaacagacgaua

SEQ ID NO: 33067 - RNA, 20 nt, Artificial Sequence
  MKO10033067_A_Mzt2
  gRNA
ggcuauacgaauggcggcgg

SEQ ID NO: 33068 - RNA, 20 nt, Artificial Sequence
  MKO10033068_A_Mzt2
  gRNA
gcuucggcggaagaaagugc

SEQ ID NO: 33069 - RNA, 20 nt, Artificial Sequence
  MKO10033069_A_Mzt2
  gRNA
ucagcaucuggaagacggcg

SEQ ID NO: 33070 - RNA, 20 nt, Artificial Sequence
  MKO10033070_A_N28178
  gRNA
cgaugguugccugcgccgca

SEQ ID NO: 33071 - RNA, 20 nt, Artificial Sequence
  MKO10033071_A_N28178
  gRNA
ugcggcgcaggcaaccaucg

SEQ ID NO: 33072 - RNA, 20 nt, Artificial Sequence
  MKO10033072_A_N28178
  gRNA
aacaacggggucacguagag

SEQ ID NO: 33073 - RNA, 20 nt, Artificial Sequence
  MKO10033073_A_N4bp1
  gRNA
cucaaguuguacugucgacc

SEQ ID NO: 33074 - RNA, 20 nt, Artificial Sequence
  MKO10033074_A_N4bp1
  gRNA
ucuacaaaucuaagccccga

SEQ ID NO: 33075 - RNA, 20 nt, Artificial Sequence
  MKO10033075_A_N4bp1
  gRNA
uagguuucuacugcacuuag

SEQ ID NO: 33076 - RNA, 20 nt, Artificial Sequence
  MKO10033076_A_N4bp2l1
  gRNA
aggaacagcgaaccguccag

SEQ ID NO: 33077 - RNA, 20 nt, Artificial Sequence
  MKO10033077_A_N4bp2l1
  gRNA
uaauggccucuacuccaacg

SEQ ID NO: 33078 - RNA, 20 nt, Artificial Sequence
  MKO10033078_A_N4bp2l1
  gRNA
ucaacguucaagaguuagca

SEQ ID NO: 33079 - RNA, 20 nt, Artificial Sequence
  MKO10033079_A_N4bp2l2
  gRNA
auucguagcgauccagcauc

SEQ ID NO: 33080 - RNA, 20 nt, Artificial Sequence
  MKO10033080_A_N4bp2l2
  gRNA
caccucugcucccccucgag

SEQ ID NO: 33081 - RNA, 20 nt, Artificial Sequence
  MKO10033081_A_N4bp2l2
  gRNA
agguacaauguuaaucaacu

SEQ ID NO: 33082 - RNA, 20 nt, Artificial Sequence
  MKO10033082_A_N4bp2
  gRNA
gugcauacgcuucugacgac

SEQ ID NO: 33083 - RNA, 20 nt, Artificial Sequence
  MKO10033083_A_N4bp2
  gRNA
ugcacacaacucaaugcgcu

SEQ ID NO: 33084 - RNA, 20 nt, Artificial Sequence
  MKO10033084_A_N4bp2
  gRNA
gugcugagaaugacgccacc

SEQ ID NO: 33085 - RNA, 20 nt, Artificial Sequence
  MKO10033085_A_N4bp3
  gRNA
cacggcgaccucuucaguag

SEQ ID NO: 33086 - RNA, 20 nt, Artificial Sequence
  MKO10033086_A_N4bp3
  gRNA
ccccgcuggaagaguccgac

SEQ ID NO: 33087 - RNA, 20 nt, Artificial Sequence
  MKO10033087_A_N4bp3
  gRNA
uugucaaagcgaccccgcuc

SEQ ID NO: 33088 - RNA, 20 nt, Artificial Sequence
  MKO10033088_A_N6amt1
  gRNA
ccgcgacguguacgagccag

SEQ ID NO: 33089 - RNA, 20 nt, Artificial Sequence
  MKO10033089_A_N6amt1
  gRNA
cgacccacgugcccguacaa

SEQ ID NO: 33090 - RNA, 20 nt, Artificial Sequence
  MKO10033090_A_N6amt1
  gRNA
uguagugacuccgccugaag

SEQ ID NO: 33091 - RNA, 20 nt, Artificial Sequence
  MKO10033091_A_N6amt2
  gRNA
cuaugcgcagcgauucucuc

SEQ ID NO: 33092 - RNA, 20 nt, Artificial Sequence
  MKO10033092_A_N6amt2
  gRNA
uguuacacgaacuaugacuc

SEQ ID NO: 33093 - RNA, 20 nt, Artificial Sequence
  MKO10033093_A_N6amt2
  gRNA
ucuugccccgagucagaaac

SEQ ID NO: 33094 - RNA, 20 nt, Artificial Sequence
  MKO10033094_A_Naa10
  gRNA
gucaccucacccuagcauug

SEQ ID NO: 33095 - RNA, 20 nt, Artificial Sequence
  MKO10033095_A_Naa10
  gRNA
gaagauugugggcuacgucu

SEQ ID NO: 33096 - RNA, 20 nt, Artificial Sequence
  MKO10033096_A_Naa10
  gRNA
ccagugaggugauaugucca

SEQ ID NO: 33097 - RNA, 20 nt, Artificial Sequence
  MKO10033097_A_Naa11
  gRNA
guucucgaucaucgcccgug

SEQ ID NO: 33098 - RNA, 20 nt, Artificial Sequence
  MKO10033098_A_Naa11
  gRNA
uggccgucaagcgcucacac

SEQ ID NO: 33099 - RNA, 20 nt, Artificial Sequence
  MKO10033099_A_Naa11
  gRNA
gcgccggugugagcgcuuga

SEQ ID NO: 33100 - RNA, 20 nt, Artificial Sequence
  MKO10033100_A_Naa15
  gRNA
acguuaauccuuucauagcc

SEQ ID NO: 33101 - RNA, 20 nt, Artificial Sequence
  MKO10033101_A_Naa15
  gRNA
gcuuaugaauugguucgcag

SEQ ID NO: 33102 - RNA, 20 nt, Artificial Sequence
  MKO10033102_A_Naa15
  gRNA
ucgcauuugaaucugcagua

SEQ ID NO: 33103 - RNA, 20 nt, Artificial Sequence
  MKO10033103_A_Naa16
  gRNA
acuucuuaucagaacguugc

SEQ ID NO: 33104 - RNA, 20 nt, Artificial Sequence
  MKO10033104_A_Naa16
  gRNA
uuucagcaaaugauaagcga

SEQ ID NO: 33105 - RNA, 20 nt, Artificial Sequence
  MKO10033105_A_Naa16
  gRNA
aacccgaaguuugcugaaca

SEQ ID NO: 33106 - RNA, 20 nt, Artificial Sequence
  MKO10033106_A_Naa20
  gRNA
gcggcgcaaugaccacgcuc

SEQ ID NO: 33107 - RNA, 20 nt, Artificial Sequence
  MKO10033107_A_Naa20
  gRNA
ucacucacauguuguugaag

SEQ ID NO: 33108 - RNA, 20 nt, Artificial Sequence
  MKO10033108_A_Naa20
  gRNA
aaggauacaguuucuguaag

SEQ ID NO: 33109 - RNA, 20 nt, Artificial Sequence
  MKO10033109_A_Naa25
  gRNA
acuuacgccggugcaucucu

SEQ ID NO: 33110 - RNA, 20 nt, Artificial Sequence
  MKO10033110_A_Naa25
  gRNA
cuucuuguacucgcccacuc

SEQ ID NO: 33111 - RNA, 20 nt, Artificial Sequence
  MKO10033111_A_Naa25
  gRNA
uucucuaccgagagaugcac

SEQ ID NO: 33112 - RNA, 20 nt, Artificial Sequence
  MKO10033112_A_Naa30
  gRNA
cgaggcggcgaccucggcca

SEQ ID NO: 33113 - RNA, 20 nt, Artificial Sequence
  MKO10033113_A_Naa30
  gRNA
gcgaaggcaagaacgcgccu

SEQ ID NO: 33114 - RNA, 20 nt, Artificial Sequence
  MKO10033114_A_Naa30
  gRNA
acgcacugcgacuuaaacug

SEQ ID NO: 33115 - RNA, 20 nt, Artificial Sequence
  MKO10033115_A_Naa35
  gRNA
aagauggaugccgguaugau

SEQ ID NO: 33116 - RNA, 20 nt, Artificial Sequence
  MKO10033116_A_Naa35
  gRNA
aucauaccggcauccaucuu

SEQ ID NO: 33117 - RNA, 20 nt, Artificial Sequence
  MKO10033117_A_Naa35
  gRNA
cucagccugccugaacugau

SEQ ID NO: 33118 - RNA, 20 nt, Artificial Sequence
  MKO10033118_A_Naa40
  gRNA
uucaagaaguaugaccgcaa

SEQ ID NO: 33119 - RNA, 20 nt, Artificial Sequence
  MKO10033119_A_Naa40
  gRNA
aaaugaccgaugaccgagcc

SEQ ID NO: 33120 - RNA, 20 nt, Artificial Sequence
  MKO10033120_A_Naa40
  gRNA
cggucauacuucuugaagac

SEQ ID NO: 33121 - RNA, 20 nt, Artificial Sequence
  MKO10033121_A_Naa50
  gRNA
uuccaguagccggaucgagc

SEQ ID NO: 33122 - RNA, 20 nt, Artificial Sequence
  MKO10033122_A_Naa50
  gRNA
ugaagcacaugcgcgucugc

SEQ ID NO: 33123 - RNA, 20 nt, Artificial Sequence
  MKO10033123_A_Naa50
  gRNA
guuggcgagcuagcaaaacu

SEQ ID NO: 33124 - RNA, 20 nt, Artificial Sequence
  MKO10033124_A_Naa60
  gRNA
gguggccgccauugauguag

SEQ ID NO: 33125 - RNA, 20 nt, Artificial Sequence
  MKO10033125_A_Naa60
  gRNA
gccuggcgguagauccugug

SEQ ID NO: 33126 - RNA, 20 nt, Artificial Sequence
  MKO10033126_A_Naa60
  gRNA
auaucacgauaccaugaguc

SEQ ID NO: 33127 - RNA, 20 nt, Artificial Sequence
  MKO10033127_A_Naaa
  gRNA
gggucguagugccgcagcau

SEQ ID NO: 33128 - RNA, 20 nt, Artificial Sequence
  MKO10033128_A_Naaa
  gRNA
cccagacuucuugcgcaccg

SEQ ID NO: 33129 - RNA, 20 nt, Artificial Sequence
  MKO10033129_A_Naaa
  gRNA
cacuuacgcggaagccucgu

SEQ ID NO: 33130 - RNA, 20 nt, Artificial Sequence
  MKO10033130_A_Naalad2
  gRNA
ugucaacuacgcucguacug

SEQ ID NO: 33131 - RNA, 20 nt, Artificial Sequence
  MKO10033131_A_Naalad2
  gRNA
cuuuacaaaacuuccccauc

SEQ ID NO: 33132 - RNA, 20 nt, Artificial Sequence
  MKO10033132_A_Naalad2
  gRNA
agagaacaucguaaugaacc

SEQ ID NO: 33133 - RNA, 20 nt, Artificial Sequence
  MKO10033133_A_Naaladl1
  gRNA
cgcuggaaggauacagcgac

SEQ ID NO: 33134 - RNA, 20 nt, Artificial Sequence
  MKO10033134_A_Naaladl1
  gRNA
cccguagcgagucagagcga

SEQ ID NO: 33135 - RNA, 20 nt, Artificial Sequence
  MKO10033135_A_Naaladl1
  gRNA
cuugcauccucaaagccgau

SEQ ID NO: 33136 - RNA, 20 nt, Artificial Sequence
  MKO10033136_A_Nab1
  gRNA
uccggcgagcagagcccuga

SEQ ID NO: 33137 - RNA, 20 nt, Artificial Sequence
  MKO10033137_A_Nab1
  gRNA
gacucacggccgggcucuac

SEQ ID NO: 33138 - RNA, 20 nt, Artificial Sequence
  MKO10033138_A_Nab1
  gRNA
ggauggauuucccgacuucc

SEQ ID NO: 33139 - RNA, 20 nt, Artificial Sequence
  MKO10033139_A_Nab2
  gRNA
cguagaugacgcuguacuuc

SEQ ID NO: 33140 - RNA, 20 nt, Artificial Sequence
  MKO10033140_A_Nab2
  gRNA
cggaaguacagcgucaucua

SEQ ID NO: 33141 - RNA, 20 nt, Artificial Sequence
  MKO10033141_A_Nab2
  gRNA
cguguguuauccccucugcc

SEQ ID NO: 33142 - RNA, 20 nt, Artificial Sequence
  MKO10033142_A_Nabp1
  gRNA
ccucuagguaugcaucaaug

SEQ ID NO: 33143 - RNA, 20 nt, Artificial Sequence
  MKO10033143_A_Nabp1
  gRNA
aucggagggcucauacagac

SEQ ID NO: 33144 - RNA, 20 nt, Artificial Sequence
  MKO10033144_A_Nabp1
  gRNA
gauauuauucgguugaccag

SEQ ID NO: 33145 - RNA, 20 nt, Artificial Sequence
  MKO10033145_A_Nabp2
  gRNA
gggucccguggucgcuugug

SEQ ID NO: 33146 - RNA, 20 nt, Artificial Sequence
  MKO10033146_A_Nabp2
  gRNA
cgagguucggaccuguaaag

SEQ ID NO: 33147 - RNA, 20 nt, Artificial Sequence
  MKO10033147_A_Nabp2
  gRNA
uacugccccacaagcgacca

SEQ ID NO: 33148 - RNA, 20 nt, Artificial Sequence
  MKO10033148_A_Nacad
  gRNA
gccccgcaucgugaugggug

SEQ ID NO: 33149 - RNA, 20 nt, Artificial Sequence
  MKO10033149_A_Nacad
  gRNA
gggaggugucacaauaccgc

SEQ ID NO: 33150 - RNA, 20 nt, Artificial Sequence
  MKO10033150_A_Nacad
  gRNA
ggccucgccaaagaccacgu

SEQ ID NO: 33151 - RNA, 20 nt, Artificial Sequence
  MKO10033151_A_Naca
  gRNA
ucuuuaggcuauguccaaac

SEQ ID NO: 33152 - RNA, 20 nt, Artificial Sequence
  MKO10033152_A_Naca
  gRNA
acacaccugggcuugcugcg

SEQ ID NO: 33153 - RNA, 20 nt, Artificial Sequence
  MKO10033153_A_Naca
  gRNA
gacggccacgcagcaagccc

SEQ ID NO: 33154 - RNA, 20 nt, Artificial Sequence
  MKO10033154_A_Nacc1
  gRNA
uguaccucaccggucaaaga

SEQ ID NO: 33155 - RNA, 20 nt, Artificial Sequence
  MKO10033155_A_Nacc1
  gRNA
gccagccucgccaucguggc

SEQ ID NO: 33156 - RNA, 20 nt, Artificial Sequence
  MKO10033156_A_Nacc1
  gRNA
acuguccaguggcuuucguc

SEQ ID NO: 33157 - RNA, 20 nt, Artificial Sequence
  MKO10033157_A_Nacc2
  gRNA
ccgacgcacccaugacgcua

SEQ ID NO: 33158 - RNA, 20 nt, Artificial Sequence
  MKO10033158_A_Nacc2
  gRNA
cucgccguguccguaagcgc

SEQ ID NO: 33159 - RNA, 20 nt, Artificial Sequence
  MKO10033159_A_Nacc2
  gRNA
uccggggucuacaucacacg

SEQ ID NO: 33160 - RNA, 20 nt, Artificial Sequence
  MKO10033160_A_Nadk2
  gRNA
acgugcguggaacgcgccgg

SEQ ID NO: 33161 - RNA, 20 nt, Artificial Sequence
  MKO10033161_A_Nadk2
  gRNA
cgguagcaagucaugauccg

SEQ ID NO: 33162 - RNA, 20 nt, Artificial Sequence
  MKO10033162_A_Nadk2
  gRNA
cguacucccuccgcuugacc

SEQ ID NO: 33163 - RNA, 20 nt, Artificial Sequence
  MKO10033163_A_Nadk
  gRNA
aaguucugcacguuccguga

SEQ ID NO: 33164 - RNA, 20 nt, Artificial Sequence
  MKO10033164_A_Nadk
  gRNA
caugucaaccguugacuugc

SEQ ID NO: 33165 - RNA, 20 nt, Artificial Sequence
  MKO10033165_A_Nadk
  gRNA
aaacaacaugaucguguaug

SEQ ID NO: 33166 - RNA, 20 nt, Artificial Sequence
  MKO10033166_A_Nadsyn1
  gRNA
ggguaaaccagcgcaguucc

SEQ ID NO: 33167 - RNA, 20 nt, Artificial Sequence
  MKO10033167_A_Nadsyn1
  gRNA
aacugcgcugguuuaccccc

SEQ ID NO: 33168 - RNA, 20 nt, Artificial Sequence
  MKO10033168_A_Nadsyn1
  gRNA
ugcaguuguagcgaacauuc

SEQ ID NO: 33169 - RNA, 20 nt, Artificial Sequence
  MKO10033169_A_Nae1
  gRNA
uauaggcuguggggugauca

SEQ ID NO: 33170 - RNA, 20 nt, Artificial Sequence
  MKO10033170_A_Nae1
  gRNA
gaaccgagcucaagcugcca

SEQ ID NO: 33171 - RNA, 20 nt, Artificial Sequence
  MKO10033171_A_Nae1
  gRNA
gaacuaaauagcgaugucuc

SEQ ID NO: 33172 - RNA, 20 nt, Artificial Sequence
  MKO10033172_A_Naf1
  gRNA
ucaucuccaucugacaacac

SEQ ID NO: 33173 - RNA, 20 nt, Artificial Sequence
  MKO10033173_A_Naf1
  gRNA
augcuugaaaccuucccaag

SEQ ID NO: 33174 - RNA, 20 nt, Artificial Sequence
  MKO10033174_A_Naf1
  gRNA
augacaguauccucauuaac

SEQ ID NO: 33175 - RNA, 20 nt, Artificial Sequence
  MKO10033175_A_Naga
  gRNA
auuggugggcgugacgccuc

SEQ ID NO: 33176 - RNA, 20 nt, Artificial Sequence
  MKO10033176_A_Naga
  gRNA
aaucccgugagggaagcgcu

SEQ ID NO: 33177 - RNA, 20 nt, Artificial Sequence
  MKO10033177_A_Naga
  gRNA
ugggacggcccguggcguuc

SEQ ID NO: 33178 - RNA, 20 nt, Artificial Sequence
  MKO10033178_A_Nagk
  gRNA
cacauccucaccguccggug

SEQ ID NO: 33179 - RNA, 20 nt, Artificial Sequence
  MKO10033179_A_Nagk
  gRNA
ggugccucaacuccucaauc

SEQ ID NO: 33180 - RNA, 20 nt, Artificial Sequence
  MKO10033180_A_Nagk
  gRNA
gcugacucaccaggcuucga

SEQ ID NO: 33181 - RNA, 20 nt, Artificial Sequence
  MKO10033181_A_Naglu
  gRNA
gagaucgauacguacuucac

SEQ ID NO: 33182 - RNA, 20 nt, Artificial Sequence
  MKO10033182_A_Naglu
  gRNA
aguacguaucgaucucugac

SEQ ID NO: 33183 - RNA, 20 nt, Artificial Sequence
  MKO10033183_A_Naglu
  gRNA
gaccccauguuuccccucau

SEQ ID NO: 33184 - RNA, 20 nt, Artificial Sequence
  MKO10033184_A_Nagpa
  gRNA
caguucgguauccgacgcga

SEQ ID NO: 33185 - RNA, 20 nt, Artificial Sequence
  MKO10033185_A_Nagpa
  gRNA
ugacgacaucuuguugacgc

SEQ ID NO: 33186 - RNA, 20 nt, Artificial Sequence
  MKO10033186_A_Nagpa
  gRNA
gucguguggcucauccgcaa

SEQ ID NO: 33187 - RNA, 20 nt, Artificial Sequence
  MKO10033187_A_Nags
  gRNA
cagcuacgguggcaucgucg

SEQ ID NO: 33188 - RNA, 20 nt, Artificial Sequence
  MKO10033188_A_Nags
  gRNA
gccaggcgggauaccgccug

SEQ ID NO: 33189 - RNA, 20 nt, Artificial Sequence
  MKO10033189_A_Nags
  gRNA
cccgcaggcgguaucccgcc

SEQ ID NO: 33190 - RNA, 20 nt, Artificial Sequence
  MKO10033190_A_Naif1
  gRNA
aaucuuuaaucaugggccgg

SEQ ID NO: 33191 - RNA, 20 nt, Artificial Sequence
  MKO10033191_A_Naif1
  gRNA
caagaccgagguccgucgca

SEQ ID NO: 33192 - RNA, 20 nt, Artificial Sequence
  MKO10033192_A_Naif1
  gRNA
acagaugauccggcguucuc

SEQ ID NO: 33193 - RNA, 20 nt, Artificial Sequence
  MKO10033193_A_Naip1
  gRNA
gaacaaaucccucauagccu

SEQ ID NO: 33194 - RNA, 20 nt, Artificial Sequence
  MKO10033194_A_Naip1
  gRNA
ucaaaguaagaaaucuucag

SEQ ID NO: 33195 - RNA, 20 nt, Artificial Sequence
  MKO10033195_A_Naip1
  gRNA
accaaagcaucaacagccac

SEQ ID NO: 33196 - RNA, 20 nt, Artificial Sequence
  MKO10033196_A_Naip2
  gRNA
gacuggccccacgaaucacc

SEQ ID NO: 33197 - RNA, 20 nt, Artificial Sequence
  MKO10033197_A_Naip2
  gRNA
guugcccaagcauccaccac

SEQ ID NO: 33198 - RNA, 20 nt, Artificial Sequence
  MKO10033198_A_Naip2
  gRNA
gaccagagcuucaacagccc

SEQ ID NO: 33199 - RNA, 20 nt, Artificial Sequence
  MKO10033199_A_Naip5
  gRNA
ccucguagcuuugaauauac

SEQ ID NO: 33200 - RNA, 20 nt, Artificial Sequence
  MKO10033200_A_Naip5
  gRNA
acuagagcuucaacacccac

SEQ ID NO: 33201 - RNA, 20 nt, Artificial Sequence
  MKO10033201_A_Naip5
  gRNA
ccaguauauucaaagcuacg

SEQ ID NO: 33202 - RNA, 20 nt, Artificial Sequence
  MKO10033202_A_Naip6
  gRNA
ccucguagucuugaauauac

SEQ ID NO: 33203 - RNA, 20 nt, Artificial Sequence
  MKO10033203_A_Naip6
  gRNA
acuagagcuucaaaacccac

SEQ ID NO: 33204 - RNA, 20 nt, Artificial Sequence
  MKO10033204_A_Naip6
  gRNA
ccaguauauucaagacuacg

SEQ ID NO: 33205 - RNA, 20 nt, Artificial Sequence
  MKO10033205_A_Naip7
  gRNA
ccucguagucuugaauauac

SEQ ID NO: 33206 - RNA, 20 nt, Artificial Sequence
  MKO10033206_A_Naip7
  gRNA
gcugagcucucugcucguuu

SEQ ID NO: 33207 - RNA, 20 nt, Artificial Sequence
  MKO10033207_A_Naip7
  gRNA
ccagcugcugacagugcacg

SEQ ID NO: 33208 - RNA, 20 nt, Artificial Sequence
  MKO10033208_A_Nalcn
  gRNA
auuuccgauucgaacugcca

SEQ ID NO: 33209 - RNA, 20 nt, Artificial Sequence
  MKO10033209_A_Nalcn
  gRNA
gggauccgcagcaugcccca

SEQ ID NO: 33210 - RNA, 20 nt, Artificial Sequence
  MKO10033210_A_Nalcn
  gRNA
acaccagcgauccuucacau

SEQ ID NO: 33211 - RNA, 20 nt, Artificial Sequence
  MKO10033211_A_Nampt
  gRNA
cagaggagucucuucgcaag

SEQ ID NO: 33212 - RNA, 20 nt, Artificial Sequence
  MKO10033212_A_Nampt
  gRNA
ccuacuuaccucaauccaau

SEQ ID NO: 33213 - RNA, 20 nt, Artificial Sequence
  MKO10033213_A_Nampt
  gRNA
gaugaugucuuuaacgaaag

SEQ ID NO: 33214 - RNA, 20 nt, Artificial Sequence
  MKO10033214_A_Nanog
  gRNA
ucacucugcagguuaagacc

SEQ ID NO: 33215 - RNA, 20 nt, Artificial Sequence
  MKO10033215_A_Nanog
  gRNA
ucugaaccugagcuauaagc

SEQ ID NO: 33216 - RNA, 20 nt, Artificial Sequence
  MKO10033216_A_Nanog
  gRNA
cauugcuagucuucaaccac

SEQ ID NO: 33217 - RNA, 20 nt, Artificial Sequence
  MKO10033217_A_Nanos1
  gRNA
gggcacgagcgccauaggcg

SEQ ID NO: 33218 - RNA, 20 nt, Artificial Sequence
  MKO10033218_A_Nanos1
  gRNA
cgucacuucggccguggaug

SEQ ID NO: 33219 - RNA, 20 nt, Artificial Sequence
  MKO10033219_A_Nanos1
  gRNA
cgccgcacgucugcugaaac

SEQ ID NO: 33220 - RNA, 20 nt, Artificial Sequence
  MKO10033220_A_Nanos2
  gRNA
cagucucucuaccgacgcag

SEQ ID NO: 33221 - RNA, 20 nt, Artificial Sequence
  MKO10033221_A_Nanos2
  gRNA
cugaguuucgcccacugcgu

SEQ ID NO: 33222 - RNA, 20 nt, Artificial Sequence
  MKO10033222_A_Nanos2
  gRNA
ucgccgguggcuccacauag

SEQ ID NO: 33223 - RNA, 20 nt, Artificial Sequence
  MKO10033223_A_Nanos3
  gRNA
cagaaugaacauaagcguuc

SEQ ID NO: 33224 - RNA, 20 nt, Artificial Sequence
  MKO10033224_A_Nanos3
  gRNA
uccaagcuccuaggccguag

SEQ ID NO: 33225 - RNA, 20 nt, Artificial Sequence
  MKO10033225_A_Nanos3
  gRNA
cugucccuccacuacggccu

SEQ ID NO: 33226 - RNA, 20 nt, Artificial Sequence
  MKO10033226_A_Nanp
  gRNA
ccgaggcuauggggcugagu

SEQ ID NO: 33227 - RNA, 20 nt, Artificial Sequence
  MKO10033227_A_Nanp
  gRNA
caugccucuccugcucgccc

SEQ ID NO: 33228 - RNA, 20 nt, Artificial Sequence
  MKO10033228_A_Nanp
  gRNA
aaaauaccacuacaaagaag

SEQ ID NO: 33229 - RNA, 20 nt, Artificial Sequence
  MKO10033229_A_Nans
  gRNA
cucgugcccggaauacccga

SEQ ID NO: 33230 - RNA, 20 nt, Artificial Sequence
  MKO10033230_A_Nans
  gRNA
cgcucaccgagaugacgcgc

SEQ ID NO: 33231 - RNA, 20 nt, Artificial Sequence
  MKO10033231_A_Nans
  gRNA
guuggaacgucacauaacgu

SEQ ID NO: 33232 - RNA, 20 nt, Artificial Sequence
  MKO10033232_A_Nap1l1
  gRNA
cuaucagccuuuauuugaua

SEQ ID NO: 33233 - RNA, 20 nt, Artificial Sequence
  MKO10033233_A_Nap1l1
  gRNA
ccccacuuacuugucaaugu

SEQ ID NO: 33234 - RNA, 20 nt, Artificial Sequence
  MKO10033234_A_Nap1l1
  gRNA
auaauuaccuuaucaaauaa

SEQ ID NO: 33235 - RNA, 20 nt, Artificial Sequence
  MKO10033235_A_Nap1l2
  gRNA
cgggccccuccgccauuacc

SEQ ID NO: 33236 - RNA, 20 nt, Artificial Sequence
  MKO10033236_A_Nap1l2
  gRNA
gcuacgauccccacccuuau

SEQ ID NO: 33237 - RNA, 20 nt, Artificial Sequence
  MKO10033237_A_Nap1l2
  gRNA
gagacuaacggcaacgaaga

SEQ ID NO: 33238 - RNA, 20 nt, Artificial Sequence
  MKO10033238_A_Nap1l3
  gRNA
acuacgacccguucuucgcg

SEQ ID NO: 33239 - RNA, 20 nt, Artificial Sequence
  MKO10033239_A_Nap1l3
  gRNA
ucccauccccacgcgaagaa

SEQ ID NO: 33240 - RNA, 20 nt, Artificial Sequence
  MKO10033240_A_Nap1l3
  gRNA
gggacgucgcugggcccuuc

SEQ ID NO: 33241 - RNA, 20 nt, Artificial Sequence
  MKO10033241_A_Nap1l4
  gRNA
gcacgcaccuugucaaauag

SEQ ID NO: 33242 - RNA, 20 nt, Artificial Sequence
  MKO10033242_A_Nap1l4
  gRNA
cauagaagcuaaguucuacg

SEQ ID NO: 33243 - RNA, 20 nt, Artificial Sequence
  MKO10033243_A_Nap1l4
  gRNA
acugcacugaccuguauuac

SEQ ID NO: 33244 - RNA, 20 nt, Artificial Sequence
  MKO10033244_A_Nap1l5
  gRNA
agcggcacugucaccggucg

SEQ ID NO: 33245 - RNA, 20 nt, Artificial Sequence
  MKO10033245_A_Nap1l5
  gRNA
gaagcgcugcgauaagaucg

SEQ ID NO: 33246 - RNA, 20 nt, Artificial Sequence
  MKO10033246_A_Nap1l5
  gRNA
ugcccaauuccgugaaaugc

SEQ ID NO: 33247 - RNA, 20 nt, Artificial Sequence
  MKO10033247_A_Napa
  gRNA
cuugaacauguucgccgcuc

SEQ ID NO: 33248 - RNA, 20 nt, Artificial Sequence
  MKO10033248_A_Napa
  gRNA
uagaggcucauccaaaauag

SEQ ID NO: 33249 - RNA, 20 nt, Artificial Sequence
  MKO10033249_A_Napa
  gRNA
guagguguaguugggcagcc

SEQ ID NO: 33250 - RNA, 20 nt, Artificial Sequence
  MKO10033250_A_Napb
  gRNA
gagcucagucucauagaucu

SEQ ID NO: 33251 - RNA, 20 nt, Artificial Sequence
  MKO10033251_A_Napb
  gRNA
gaucuaugagacugagcucg

SEQ ID NO: 33252 - RNA, 20 nt, Artificial Sequence
  MKO10033252_A_Napb
  gRNA
cuugaacauauuugcagcuc

SEQ ID NO: 33253 - RNA, 20 nt, Artificial Sequence
  MKO10033253_A_Napepld
  gRNA
cgaaccgcucguucaacgcc

SEQ ID NO: 33254 - RNA, 20 nt, Artificial Sequence
  MKO10033254_A_Napepld
  gRNA
cacuacgaccaccuagacua

SEQ ID NO: 33255 - RNA, 20 nt, Artificial Sequence
  MKO10033255_A_Napepld
  gRNA
gacguuugccuuagcuaaug

SEQ ID NO: 33256 - RNA, 20 nt, Artificial Sequence
  MKO10033256_A_Napg
  gRNA
ucucguucuagccugaaaac

SEQ ID NO: 33257 - RNA, 20 nt, Artificial Sequence
  MKO10033257_A_Napg
  gRNA
gacagugccgcuucugaaua

SEQ ID NO: 33258 - RNA, 20 nt, Artificial Sequence
  MKO10033258_A_Napg
  gRNA
ugcagagcuuaugagcaagc

SEQ ID NO: 33259 - RNA, 20 nt, Artificial Sequence
  MKO10033259_A_Naprt1
  gRNA
acaacugagagguguaccgg

SEQ ID NO: 33260 - RNA, 20 nt, Artificial Sequence
  MKO10033260_A_Naprt1
  gRNA
uagugagguaccccccgacc

SEQ ID NO: 33261 - RNA, 20 nt, Artificial Sequence
  MKO10033261_A_Naprt1
  gRNA
caagcguagccgagcagcau

SEQ ID NO: 33262 - RNA, 20 nt, Artificial Sequence
  MKO10033262_A_Napsa
  gRNA
ccucuucaacgaauccaccu

SEQ ID NO: 33263 - RNA, 20 nt, Artificial Sequence
  MKO10033263_A_Napsa
  gRNA
caggauuccgcucagccgcc

SEQ ID NO: 33264 - RNA, 20 nt, Artificial Sequence
  MKO10033264_A_Napsa
  gRNA
gggcggaguucagccuccgc

SEQ ID NO: 33265 - RNA, 20 nt, Artificial Sequence
  MKO10033265_A_Narfl
  gRNA
ugugggguccagccgaaacc

SEQ ID NO: 33266 - RNA, 20 nt, Artificial Sequence
  MKO10033266_A_Narfl
  gRNA
ucuuugauacugccuucgcg

SEQ ID NO: 33267 - RNA, 20 nt, Artificial Sequence
  MKO10033267_A_Narfl
  gRNA
ugacacagccgcugcacgcc

SEQ ID NO: 33268 - RNA, 20 nt, Artificial Sequence
  MKO10033268_A_Narf
  gRNA
gucagaaggaguuuguacgc

SEQ ID NO: 33269 - RNA, 20 nt, Artificial Sequence
  MKO10033269_A_Narf
  gRNA
gcugaaaucugcagcgauug

SEQ ID NO: 33270 - RNA, 20 nt, Artificial Sequence
  MKO10033270_A_Narf
  gRNA
gauggggcccagccaagcga

SEQ ID NO: 33271 - RNA, 20 nt, Artificial Sequence
  MKO10033271_A_Narg2
  gRNA
ugaguugcugaacuaacugc

SEQ ID NO: 33272 - RNA, 20 nt, Artificial Sequence
  MKO10033272_A_Narg2
  gRNA
ucaugaaguuaccagccuaa

SEQ ID NO: 33273 - RNA, 20 nt, Artificial Sequence
  MKO10033273_A_Narg2
  gRNA
cccucaaguuccaagacugu

SEQ ID NO: 33274 - RNA, 20 nt, Artificial Sequence
  MKO10033274_A_Nars2
  gRNA
ugucgcuccuuauacuuuau

SEQ ID NO: 33275 - RNA, 20 nt, Artificial Sequence
  MKO10033275_A_Nars2
  gRNA
acucacauccaacgacugug

SEQ ID NO: 33276 - RNA, 20 nt, Artificial Sequence
  MKO10033276_A_Nars2
  gRNA
aagauccgucauuuacaugc

SEQ ID NO: 33277 - RNA, 20 nt, Artificial Sequence
  MKO10033277_A_Nars
  gRNA
cuguauguaucugaccgaga

SEQ ID NO: 33278 - RNA, 20 nt, Artificial Sequence
  MKO10033278_A_Nars
  gRNA
auacucacacaggccggcuc

SEQ ID NO: 33279 - RNA, 20 nt, Artificial Sequence
  MKO10033279_A_Nars
  gRNA
aacagaugaagaacgacucu

SEQ ID NO: 33280 - RNA, 20 nt, Artificial Sequence
  MKO10033280_A_Nasp
  gRNA
gucagcggaaaccagcuccg

SEQ ID NO: 33281 - RNA, 20 nt, Artificial Sequence
  MKO10033281_A_Nasp
  gRNA
agucacuucuggaguuagcc

SEQ ID NO: 33282 - RNA, 20 nt, Artificial Sequence
  MKO10033282_A_Nasp
  gRNA
agccgcugcugccaucgccg

SEQ ID NO: 33283 - RNA, 20 nt, Artificial Sequence
  MKO10033283_A_Nau10
  gRNA
gcagcuguacacgaugacua

SEQ ID NO: 33284 - RNA, 20 nt, Artificial Sequence
  MKO10033284_A_Nau10
  gRNA
guagcaguagcgaauguuug

SEQ ID NO: 33285 - RNA, 20 nt, Artificial Sequence
  MKO10033285_A_Nau10
  gRNA
agcguuaacuccgaacuugu

SEQ ID NO: 33286 - RNA, 20 nt, Artificial Sequence
  MKO10033286_A_Nau14
  gRNA
ccgaggcucgagcccgagca

SEQ ID NO: 33287 - RNA, 20 nt, Artificial Sequence
  MKO10033287_A_Nau14
  gRNA
ucgggcuccaucccccacgu

SEQ ID NO: 33288 - RNA, 20 nt, Artificial Sequence
  MKO10033288_A_Nau14
  gRNA
cccucauuucccgcacugac

SEQ ID NO: 33289 - RNA, 20 nt, Artificial Sequence
  MKO10033289_A_Nau1
  gRNA
uacauuguggauuccgccua

SEQ ID NO: 33290 - RNA, 20 nt, Artificial Sequence
  MKO10033290_A_Nau1
  gRNA
ucuugagccccgaguuaucg

SEQ ID NO: 33291 - RNA, 20 nt, Artificial Sequence
  MKO10033291_A_Nau1
  gRNA
auucaaaauccucgauaacu

SEQ ID NO: 33292 - RNA, 20 nt, Artificial Sequence
  MKO10033292_A_Nau2
  gRNA
uuggacguuccuaccagaug

SEQ ID NO: 33293 - RNA, 20 nt, Artificial Sequence
  MKO10033293_A_Nau2
  gRNA
uugcuaguaaacacagacgc

SEQ ID NO: 33294 - RNA, 20 nt, Artificial Sequence
  MKO10033294_A_Nau2
  gRNA
caaagggaauagcccguauc

SEQ ID NO: 33295 - RNA, 20 nt, Artificial Sequence
  MKO10033295_A_Nau3
  gRNA
cagaaaucuucaaucguucg

SEQ ID NO: 33296 - RNA, 20 nt, Artificial Sequence
  MKO10033296_A_Nau3
  gRNA
cacgaacgauugaagauuuc

SEQ ID NO: 33297 - RNA, 20 nt, Artificial Sequence
  MKO10033297_A_Nau3
  gRNA
uaugauacaccuucuacuac

SEQ ID NO: 33298 - RNA, 20 nt, Artificial Sequence
  MKO10033298_A_Nau6
  gRNA
ggucuaguacccgugauaag

SEQ ID NO: 33299 - RNA, 20 nt, Artificial Sequence
  MKO10033299_A_Nau6
  gRNA
ugggccaugcccgcuuauca

SEQ ID NO: 33300 - RNA, 20 nt, Artificial Sequence
  MKO10033300_A_Nau6
  gRNA
gguguagccgucggaaaccc

SEQ ID NO: 33301 - RNA, 20 nt, Artificial Sequence
  MKO10033301_A_Nau8l
  gRNA
gcgcgccgcaucuucuacga

SEQ ID NO: 33302 - RNA, 20 nt, Artificial Sequence
  MKO10033302_A_Nau8l
  gRNA
gcgcuacuacuacagccgca

SEQ ID NO: 33303 - RNA, 20 nt, Artificial Sequence
  MKO10033303_A_Nau8l
  gRNA
gacgcgcugcucgucgccgc

SEQ ID NO: 33304 - RNA, 20 nt, Artificial Sequence
  MKO10033304_A_Nau8
  gRNA
gagggacuacaaacaggucg

SEQ ID NO: 33305 - RNA, 20 nt, Artificial Sequence
  MKO10033305_A_Nau8
  gRNA
gaagacaggugaauccuucg

SEQ ID NO: 33306 - RNA, 20 nt, Artificial Sequence
  MKO10033306_A_Nau8
  gRNA
uucggggcagugucagcaag

SEQ ID NO: 33307 - RNA, 20 nt, Artificial Sequence
  MKO10033307_A_Nau9
  gRNA
ucuuaccguaggacaugauc

SEQ ID NO: 33308 - RNA, 20 nt, Artificial Sequence
  MKO10033308_A_Nau9
  gRNA
acuggaggugugacgaaguu

SEQ ID NO: 33309 - RNA, 20 nt, Artificial Sequence
  MKO10033309_A_Nau9
  gRNA
accccugcagauaccacgag

SEQ ID NO: 33310 - RNA, 20 nt, Artificial Sequence
  MKO10033310_A_Nav1
  gRNA
gcgucaucgcugucguaaca

SEQ ID NO: 33311 - RNA, 20 nt, Artificial Sequence
  MKO10033311_A_Nav1
  gRNA
cugucguuccgaggggccac

SEQ ID NO: 33312 - RNA, 20 nt, Artificial Sequence
  MKO10033312_A_Nav1
  gRNA
aguugagcccacucuccgcc

SEQ ID NO: 33313 - RNA, 20 nt, Artificial Sequence
  MKO10033313_A_Nav2
  gRNA
cuuuguagaucuacacggau

SEQ ID NO: 33314 - RNA, 20 nt, Artificial Sequence
  MKO10033314_A_Nav2
  gRNA
guuuguggccggauuuagcg

SEQ ID NO: 33315 - RNA, 20 nt, Artificial Sequence
  MKO10033315_A_Nav2
  gRNA
cgccccggccaccugagacc

SEQ ID NO: 33316 - RNA, 20 nt, Artificial Sequence
  MKO10033316_A_Nav3
  gRNA
cauugcggacgggguccuuc

SEQ ID NO: 33317 - RNA, 20 nt, Artificial Sequence
  MKO10033317_A_Nav3
  gRNA
aguccuugaucagccgcuug

SEQ ID NO: 33318 - RNA, 20 nt, Artificial Sequence
  MKO10033318_A_Nav3
  gRNA
cccagcaagauaugcagucc

SEQ ID NO: 33319 - RNA, 20 nt, Artificial Sequence
  MKO10033319_A_Nbas
  gRNA
accaagcgaaccaguccauc

SEQ ID NO: 33320 - RNA, 20 nt, Artificial Sequence
  MKO10033320_A_Nbas
  gRNA
ugaaugaugcaccgugcuuu

SEQ ID NO: 33321 - RNA, 20 nt, Artificial Sequence
  MKO10033321_A_Nbas
  gRNA
cucagaggcaaccgaaagca

SEQ ID NO: 33322 - RNA, 20 nt, Artificial Sequence
  MKO10033322_A_Nbeal1
  gRNA
aggguggaugauaugccucc

SEQ ID NO: 33323 - RNA, 20 nt, Artificial Sequence
  MKO10033323_A_Nbeal1
  gRNA
agaaccugcagaauauuauc

SEQ ID NO: 33324 - RNA, 20 nt, Artificial Sequence
  MKO10033324_A_Nbeal1
  gRNA
cuaugucuccaauuucuaua

SEQ ID NO: 33325 - RNA, 20 nt, Artificial Sequence
  MKO10033325_A_Nbeal2
  gRNA
gcagggccacguucucuagc

SEQ ID NO: 33326 - RNA, 20 nt, Artificial Sequence
  MKO10033326_A_Nbeal2
  gRNA
gacuaucucguuauccuccc

SEQ ID NO: 33327 - RNA, 20 nt, Artificial Sequence
  MKO10033327_A_Nbeal2
  gRNA
agccuuaccuucgagguucc

SEQ ID NO: 33328 - RNA, 20 nt, Artificial Sequence
  MKO10033328_A_Nbea
  gRNA
aauuccgaacacucuuccgu

SEQ ID NO: 33329 - RNA, 20 nt, Artificial Sequence
  MKO10033329_A_Nbea
  gRNA
cuuaccgcagcacuacaccc

SEQ ID NO: 33330 - RNA, 20 nt, Artificial Sequence
  MKO10033330_A_Nbea
  gRNA
aagcuacagcauuacuguca

SEQ ID NO: 33331 - RNA, 20 nt, Artificial Sequence
  MKO10033331_A_Nbl1
  gRNA
cacccugcacauagacguuc

SEQ ID NO: 33332 - RNA, 20 nt, Artificial Sequence
  MKO10033332_A_Nbl1
  gRNA
cccgccaccuaucaacaagc

SEQ ID NO: 33333 - RNA, 20 nt, Artificial Sequence
  MKO10033333_A_Nbl1
  gRNA
caagaacaucacgcagauug

SEQ ID NO: 33334 - RNA, 20 nt, Artificial Sequence
  MKO10033334_A_Nbn
  gRNA
ccggcguggaguacguuguu

SEQ ID NO: 33335 - RNA, 20 nt, Artificial Sequence
  MKO10033335_A_Nbn
  gRNA
cccaacaacguacuccacgc

SEQ ID NO: 33336 - RNA, 20 nt, Artificial Sequence
  MKO10033336_A_Nbn
  gRNA
acuuaccgcaaacaacugga

SEQ ID NO: 33337 - RNA, 20 nt, Artificial Sequence
  MKO10033337_A_Nbr1
  gRNA
cggauccagaaaauacaacc

SEQ ID NO: 33338 - RNA, 20 nt, Artificial Sequence
  MKO10033338_A_Nbr1
  gRNA
gaacuuaccuugacuauuga

SEQ ID NO: 33339 - RNA, 20 nt, Artificial Sequence
  MKO10033339_A_Nbr1
  gRNA
gccagacagcauggaaccac

SEQ ID NO: 33340 - RNA, 20 nt, Artificial Sequence
  MKO10033340_A_Ncald
  gRNA
uuccauugauaaauguccgc

SEQ ID NO: 33341 - RNA, 20 nt, Artificial Sequence
  MKO10033341_A_Ncald
  gRNA
uuccgcaccuucgaugcaaa

SEQ ID NO: 33342 - RNA, 20 nt, Artificial Sequence
  MKO10033342_A_Ncald
  gRNA
ccccucggaugaauucuucc

SEQ ID NO: 33343 - RNA, 20 nt, Artificial Sequence
  MKO10033343_A_Ncam1
  gRNA
aacgccaacaucgacgaugc

SEQ ID NO: 33344 - RNA, 20 nt, Artificial Sequence
  MKO10033344_A_Ncam1
  gRNA
acaccacugagauccgcugc

SEQ ID NO: 33345 - RNA, 20 nt, Artificial Sequence
  MKO10033345_A_Ncam1
  gRNA
agccaaggagaaaucagcgu

SEQ ID NO: 33346 - RNA, 20 nt, Artificial Sequence
  MKO10033346_A_Ncam2
  gRNA
ugguacaaccagcugaccgc

SEQ ID NO: 33347 - RNA, 20 nt, Artificial Sequence
  MKO10033347_A_Ncam2
  gRNA
uuauaccagucgauacucuc

SEQ ID NO: 33348 - RNA, 20 nt, Artificial Sequence
  MKO10033348_A_Ncam2
  gRNA
uccugacaagcaacccgagc

SEQ ID NO: 33349 - RNA, 20 nt, Artificial Sequence
  MKO10033349_A_Ncan
  gRNA
gcgcgcgggcacaaugucag

SEQ ID NO: 33350 - RNA, 20 nt, Artificial Sequence
  MKO10033350_A_Ncan
  gRNA
uaccgcuucgccaaccgcac

SEQ ID NO: 33351 - RNA, 20 nt, Artificial Sequence
  MKO10033351_A_Ncan
  gRNA
ccgaucacucagucgcgucc

SEQ ID NO: 33352 - RNA, 20 nt, Artificial Sequence
  MKO10033352_A_Ncapd2
  gRNA
uguaucgaagugcuccagua

SEQ ID NO: 33353 - RNA, 20 nt, Artificial Sequence
  MKO10033353_A_Ncapd2
  gRNA
cuaugcccugauacgccuuu

SEQ ID NO: 33354 - RNA, 20 nt, Artificial Sequence
  MKO10033354_A_Ncapd2
  gRNA
uuaccuucccaccgaugucc

SEQ ID NO: 33355 - RNA, 20 nt, Artificial Sequence
  MKO10033355_A_Ncapd3
  gRNA
cccuuugcgacugacgaaag

SEQ ID NO: 33356 - RNA, 20 nt, Artificial Sequence
  MKO10033356_A_Ncapd3
  gRNA
uccacuuucgucagucgcaa

SEQ ID NO: 33357 - RNA, 20 nt, Artificial Sequence
  MKO10033357_A_Ncapd3
  gRNA
agugcacaauaucgagagua

SEQ ID NO: 33358 - RNA, 20 nt, Artificial Sequence
  MKO10033358_A_Ncapg2
  gRNA
agucgagggugcagacgaua

SEQ ID NO: 33359 - RNA, 20 nt, Artificial Sequence
  MKO10033359_A_Ncapg2
  gRNA
aguaguucacuuaagcugaa

SEQ ID NO: 33360 - RNA, 20 nt, Artificial Sequence
  MKO10033360_A_Ncapg2
  gRNA
ucaauauaacagcacacucc

SEQ ID NO: 33361 - RNA, 20 nt, Artificial Sequence
  MKO10033361_A_Ncapg
  gRNA
auauaagcgugaaccugccg

SEQ ID NO: 33362 - RNA, 20 nt, Artificial Sequence
  MKO10033362_A_Ncapg
  gRNA
aaucaucguccuugggaucu

SEQ ID NO: 33363 - RNA, 20 nt, Artificial Sequence
  MKO10033363_A_Ncapg
  gRNA
aacacugcacgucuaacuuc

SEQ ID NO: 33364 - RNA, 20 nt, Artificial Sequence
  MKO10033364_A_Ncaph2
  gRNA
cccugacucccgggcuaaug

SEQ ID NO: 33365 - RNA, 20 nt, Artificial Sequence
  MKO10033365_A_Ncaph2
  gRNA
gcucccaucuuccugaacua

SEQ ID NO: 33366 - RNA, 20 nt, Artificial Sequence
  MKO10033366_A_Ncaph2
  gRNA
ucccugugaaacagagaaug

SEQ ID NO: 33367 - RNA, 20 nt, Artificial Sequence
  MKO10033367_A_Ncaph
  gRNA
gcugggggcacccguuccaa

SEQ ID NO: 33368 - RNA, 20 nt, Artificial Sequence
  MKO10033368_A_Ncaph
  gRNA
caguacagauucgauucauc

SEQ ID NO: 33369 - RNA, 20 nt, Artificial Sequence
  MKO10033369_A_Ncaph
  gRNA
cacacggacagcauagaucu

SEQ ID NO: 33370 - RNA, 20 nt, Artificial Sequence
  MKO10033370_A_Ncbp1
  gRNA
ugugaucgcugccccgucua

SEQ ID NO: 33371 - RNA, 20 nt, Artificial Sequence
  MKO10033371_A_Ncbp1
  gRNA
ucuuuagagagcaaucucga

SEQ ID NO: 33372 - RNA, 20 nt, Artificial Sequence
  MKO10033372_A_Ncbp1
  gRNA
uagguggacaaccucacaaa

SEQ ID NO: 33373 - RNA, 20 nt, Artificial Sequence
  MKO10033373_A_Ncbp2
  gRNA
cccagucuguccguaugauc

SEQ ID NO: 33374 - RNA, 20 nt, Artificial Sequence
  MKO10033374_A_Ncbp2
  gRNA
cccgccucacccgaaagugc

SEQ ID NO: 33375 - RNA, 20 nt, Artificial Sequence
  MKO10033375_A_Ncbp2
  gRNA
uuaagguucgggacgaguau

SEQ ID NO: 33376 - RNA, 20 nt, Artificial Sequence
  MKO10033376_A_Nccrp1
  gRNA
guuagcagcugaccgccgca

SEQ ID NO: 33377 - RNA, 20 nt, Artificial Sequence
  MKO10033377_A_Nccrp1
  gRNA
cacuggccagguaauuuccg

SEQ ID NO: 33378 - RNA, 20 nt, Artificial Sequence
  MKO10033378_A_Nccrp1
  gRNA
gagugguaauguaccaucca

SEQ ID NO: 33379 - RNA, 20 nt, Artificial Sequence
  MKO10033379_A_Ncdn
  gRNA
gcucgugaaucuagcgugcg

SEQ ID NO: 33380 - RNA, 20 nt, Artificial Sequence
  MKO10033380_A_Ncdn
  gRNA
cgcacgcuagauucacgagc

SEQ ID NO: 33381 - RNA, 20 nt, Artificial Sequence
  MKO10033381_A_Ncdn
  gRNA
ggagaccucaucccugcgua

SEQ ID NO: 33382 - RNA, 20 nt, Artificial Sequence
  MKO10033382_A_Nceh1
  gRNA
acaugaucccaucgucccgc

SEQ ID NO: 33383 - RNA, 20 nt, Artificial Sequence
  MKO10033383_A_Nceh1
  gRNA
gaucauguacgccaagcgcu

SEQ ID NO: 33384 - RNA, 20 nt, Artificial Sequence
  MKO10033384_A_Nceh1
  gRNA
uagaugacgcugcgucgcag

SEQ ID NO: 33385 - RNA, 20 nt, Artificial Sequence
  MKO10033385_A_Ncf1
  gRNA
acgagccgcugagagucgcc

SEQ ID NO: 33386 - RNA, 20 nt, Artificial Sequence
  MKO10033386_A_Ncf1
  gRNA
ucguugcccaucaaaccacc

SEQ ID NO: 33387 - RNA, 20 nt, Artificial Sequence
  MKO10033387_A_Ncf1
  gRNA
cacauggaacucguagaucu

SEQ ID NO: 33388 - RNA, 20 nt, Artificial Sequence
  MKO10033388_A_Ncf2
  gRNA
gguggcucagcuggccaaaa

SEQ ID NO: 33389 - RNA, 20 nt, Artificial Sequence
  MKO10033389_A_Ncf2
  gRNA
acucacccagaugcucucca

SEQ ID NO: 33390 - RNA, 20 nt, Artificial Sequence
  MKO10033390_A_Ncf2
  gRNA
ugagccaccugccucucauu

SEQ ID NO: 33391 - RNA, 20 nt, Artificial Sequence
  MKO10033391_A_Ncf4
  gRNA
cguagaacuggcgauagcgg

SEQ ID NO: 33392 - RNA, 20 nt, Artificial Sequence
  MKO10033392_A_Ncf4
  gRNA
cuccucgaugucagcgaugu

SEQ ID NO: 33393 - RNA, 20 nt, Artificial Sequence
  MKO10033393_A_Ncf4
  gRNA
ccaucagcacgcagaccggc

SEQ ID NO: 33394 - RNA, 20 nt, Artificial Sequence
  MKO10033394_A_Nck1
  gRNA
aaucaauggcaugguuggcc

SEQ ID NO: 33395 - RNA, 20 nt, Artificial Sequence
  MKO10033395_A_Nck1
  gRNA
gcaauacuugacccguauuu

SEQ ID NO: 33396 - RNA, 20 nt, Artificial Sequence
  MKO10033396_A_Nck1
  gRNA
acuuaccuaagguguccuuc

SEQ ID NO: 33397 - RNA, 20 nt, Artificial Sequence
  MKO10033397_A_Nck2
  gRNA
cgcuuccuccaaaacguagu

SEQ ID NO: 33398 - RNA, 20 nt, Artificial Sequence
  MKO10033398_A_Nck2
  gRNA
uccgugucucucaaagcguc

SEQ ID NO: 33399 - RNA, 20 nt, Artificial Sequence
  MKO10033399_A_Nck2
  gRNA
guuccccuccaacuacguuu

SEQ ID NO: 33400 - RNA, 20 nt, Artificial Sequence
  MKO10033400_A_Nckap1l
  gRNA
uguacgucacaauuaagucc

SEQ ID NO: 33401 - RNA, 20 nt, Artificial Sequence
  MKO10033401_A_Nckap1l
  gRNA
gaggaccgcaggauacucau

SEQ ID NO: 33402 - RNA, 20 nt, Artificial Sequence
  MKO10033402_A_Nckap1l
  gRNA
cauagauguccgaaauagca

SEQ ID NO: 33403 - RNA, 20 nt, Artificial Sequence
  MKO10033403_A_Nckap1
  gRNA
uuguugcgcguuucuacagc

SEQ ID NO: 33404 - RNA, 20 nt, Artificial Sequence
  MKO10033404_A_Nckap1
  gRNA
uuaggcauguggcgacccca

SEQ ID NO: 33405 - RNA, 20 nt, Artificial Sequence
  MKO10033405_A_Nckap1
  gRNA
cauuaaugauacugcugucc

SEQ ID NO: 33406 - RNA, 20 nt, Artificial Sequence
  MKO10033406_A_Nckap5l
  gRNA
agcguucguaagucucccgc

SEQ ID NO: 33407 - RNA, 20 nt, Artificial Sequence
  MKO10033407_A_Nckap5l
  gRNA
guuugauacacucuucccgc

SEQ ID NO: 33408 - RNA, 20 nt, Artificial Sequence
  MKO10033408_A_Nckap5l
  gRNA
ucaguagagccuguaccacg

SEQ ID NO: 33409 - RNA, 20 nt, Artificial Sequence
  MKO10033409_A_Nckap5
  gRNA
gcacuugcggcuacagagug

SEQ ID NO: 33410 - RNA, 20 nt, Artificial Sequence
  MKO10033410_A_Nckap5
  gRNA
cgcaacaggauccagaugcu

SEQ ID NO: 33411 - RNA, 20 nt, Artificial Sequence
  MKO10033411_A_Nckap5
  gRNA
cuuggcucugcaacagacuu

SEQ ID NO: 33412 - RNA, 20 nt, Artificial Sequence
  MKO10033412_A_Nckipsd
  gRNA
ucacggucucggcgcuucac

SEQ ID NO: 33413 - RNA, 20 nt, Artificial Sequence
  MKO10033413_A_Nckipsd
  gRNA
gccccucggcgagguaccgg

SEQ ID NO: 33414 - RNA, 20 nt, Artificial Sequence
  MKO10033414_A_Nckipsd
  gRNA
gugacccaccacgacgccga

SEQ ID NO: 33415 - RNA, 20 nt, Artificial Sequence
  MKO10033415_A_Ncln
  gRNA
ccgugccccaggaugucguc

SEQ ID NO: 33416 - RNA, 20 nt, Artificial Sequence
  MKO10033416_A_Ncln
  gRNA
cgauuggcucaucaccagcg

SEQ ID NO: 33417 - RNA, 20 nt, Artificial Sequence
  MKO10033417_A_Ncln
  gRNA
gccgccgcugcgugcuuaug

SEQ ID NO: 33418 - RNA, 20 nt, Artificial Sequence
  MKO10033418_A_Ncl
  gRNA
ccguucuuagcccccuuagc

SEQ ID NO: 33419 - RNA, 20 nt, Artificial Sequence
  MKO10033419_A_Ncl
  gRNA
gggagcugccacuccagcua

SEQ ID NO: 33420 - RNA, 20 nt, Artificial Sequence
  MKO10033420_A_Ncl
  gRNA
uuguaggcuggcaaaaccca

SEQ ID NO: 33421 - RNA, 20 nt, Artificial Sequence
  MKO10033421_A_Ncmap
  gRNA
gggucgaaggucacaguagc

SEQ ID NO: 33422 - RNA, 20 nt, Artificial Sequence
  MKO10033422_A_Ncmap
  gRNA
accuguuguacaucuucagc

SEQ ID NO: 33423 - RNA, 20 nt, Artificial Sequence
  MKO10033423_A_Ncmap
  gRNA
cgacccugccaauguccaug

SEQ ID NO: 33424 - RNA, 20 nt, Artificial Sequence
  MKO10033424_A_Ncoa1
  gRNA
cugcacgucaucaucagucg

SEQ ID NO: 33425 - RNA, 20 nt, Artificial Sequence
  MKO10033425_A_Ncoa1
  gRNA
uuucggcguguugccucuug

SEQ ID NO: 33426 - RNA, 20 nt, Artificial Sequence
  MKO10033426_A_Ncoa1
  gRNA
cgucuacagcauacugcaug

SEQ ID NO: 33427 - RNA, 20 nt, Artificial Sequence
  MKO10033427_A_Ncoa2
  gRNA
aaaacaccucugacccgucc

SEQ ID NO: 33428 - RNA, 20 nt, Artificial Sequence
  MKO10033428_A_Ncoa2
  gRNA
ugucaucgacaaggaugcac

SEQ ID NO: 33429 - RNA, 20 nt, Artificial Sequence
  MKO10033429_A_Ncoa2
  gRNA
aaaguuugcgaagaucagcu

SEQ ID NO: 33430 - RNA, 20 nt, Artificial Sequence
  MKO10033430_A_Ncoa3
  gRNA
gucucagccucgcgcuaugc

SEQ ID NO: 33431 - RNA, 20 nt, Artificial Sequence
  MKO10033431_A_Ncoa3
  gRNA
ugagaaguggcgacgggagc

SEQ ID NO: 33432 - RNA, 20 nt, Artificial Sequence
  MKO10033432_A_Ncoa3
  gRNA
ccuucuuccagcauagcgcg

SEQ ID NO: 33433 - RNA, 20 nt, Artificial Sequence
  MKO10033433_A_Ncoa4
  gRNA
ggcuuaccugcucuggcacc

SEQ ID NO: 33434 - RNA, 20 nt, Artificial Sequence
  MKO10033434_A_Ncoa4
  gRNA
cauuacuuacaauggucuua

SEQ ID NO: 33435 - RNA, 20 nt, Artificial Sequence
  MKO10033435_A_Ncoa4
  gRNA
gcaaaucccugagcaucuga

SEQ ID NO: 33436 - RNA, 20 nt, Artificial Sequence
  MKO10033436_A_Ncoa5
  gRNA
cgugaucgcucuccaauucg

SEQ ID NO: 33437 - RNA, 20 nt, Artificial Sequence
  MKO10033437_A_Ncoa5
  gRNA
ucucagcaucaaagcgucgc

SEQ ID NO: 33438 - RNA, 20 nt, Artificial Sequence
  MKO10033438_A_Ncoa5
  gRNA
aguacgagucauccuuccuc

SEQ ID NO: 33439 - RNA, 20 nt, Artificial Sequence
  MKO10033439_A_Ncoa6
  gRNA
cccaaugcaagcgcaacuuc

SEQ ID NO: 33440 - RNA, 20 nt, Artificial Sequence
  MKO10033440_A_Ncoa6
  gRNA
agcagaacggcuacggaucc

SEQ ID NO: 33441 - RNA, 20 nt, Artificial Sequence
  MKO10033441_A_Ncoa6
  gRNA
aggugucuguaccguagcua

SEQ ID NO: 33442 - RNA, 20 nt, Artificial Sequence
  MKO10033442_A_Ncoa7
  gRNA
uuucgccugugccauaauag

SEQ ID NO: 33443 - RNA, 20 nt, Artificial Sequence
  MKO10033443_A_Ncoa7
  gRNA
aaguucagugaccacuauua

SEQ ID NO: 33444 - RNA, 20 nt, Artificial Sequence
  MKO10033444_A_Ncoa7
  gRNA
uggcccgacgacuuccagcc

SEQ ID NO: 33445 - RNA, 20 nt, Artificial Sequence
  MKO10033445_A_Ncor1
  gRNA
ggauaugaacaguuucacuc

SEQ ID NO: 33446 - RNA, 20 nt, Artificial Sequence
  MKO10033446_A_Ncor1
  gRNA
aauguauuaggccucaagaa

SEQ ID NO: 33447 - RNA, 20 nt, Artificial Sequence
  MKO10033447_A_Ncor1
  gRNA
uaugccuuaccugcuggugu

SEQ ID NO: 33448 - RNA, 20 nt, Artificial Sequence
  MKO10033448_A_Ncor2
  gRNA
gcauagagaacaauccgcga

SEQ ID NO: 33449 - RNA, 20 nt, Artificial Sequence
  MKO10033449_A_Ncor2
  gRNA
ucagcuucuuccgcaucgcc

SEQ ID NO: 33450 - RNA, 20 nt, Artificial Sequence
  MKO10033450_A_Ncor2
  gRNA
acuggcgugugucagacggc

SEQ ID NO: 33451 - RNA, 20 nt, Artificial Sequence
  MKO10033451_A_Ncr1
  gRNA
acuuuauucaucgaucucga

SEQ ID NO: 33452 - RNA, 20 nt, Artificial Sequence
  MKO10033452_A_Ncr1
  gRNA
gcucuuacaacgacuaugca

SEQ ID NO: 33453 - RNA, 20 nt, Artificial Sequence
  MKO10033453_A_Ncr1
  gRNA
cccucugugagcccuaguca

SEQ ID NO: 33454 - RNA, 20 nt, Artificial Sequence
  MKO10033454_A_Ncs1
  gRNA
uaugucgagcaucucguucc

SEQ ID NO: 33455 - RNA, 20 nt, Artificial Sequence
  MKO10033455_A_Ncs1
  gRNA
caacgucuucgacgagaaca

SEQ ID NO: 33456 - RNA, 20 nt, Artificial Sequence
  MKO10033456_A_Ncs1
  gRNA
cacugucggugaccucaagg

SEQ ID NO: 33457 - RNA, 20 nt, Artificial Sequence
  MKO10033457_A_Ncstn
  gRNA
cucaacgccacucaucagau

SEQ ID NO: 33458 - RNA, 20 nt, Artificial Sequence
  MKO10033458_A_Ncstn
  gRNA
ggcaagaccagcgauucuac

SEQ ID NO: 33459 - RNA, 20 nt, Artificial Sequence
  MKO10033459_A_Ncstn
  gRNA
guucuggcagcuucaauuag

SEQ ID NO: 33460 - RNA, 20 nt, Artificial Sequence
  MKO10033460_A_Ndc1
  gRNA
gaugcaggauccgcgcuauc

SEQ ID NO: 33461 - RNA, 20 nt, Artificial Sequence
  MKO10033461_A_Ndc1
  gRNA
ccagacuggcccugauagcg

SEQ ID NO: 33462 - RNA, 20 nt, Artificial Sequence
  MKO10033462_A_Ndc1
  gRNA
ucucccguuuccuauuauac

SEQ ID NO: 33463 - RNA, 20 nt, Artificial Sequence
  MKO10033463_A_Ndc80
  gRNA
gcuucuaggacuagcggaca

SEQ ID NO: 33464 - RNA, 20 nt, Artificial Sequence
  MKO10033464_A_Ndc80
  gRNA
gaguacacacaaaccgacau

SEQ ID NO: 33465 - RNA, 20 nt, Artificial Sequence
  MKO10033465_A_Ndc80
  gRNA
ugcccgucguaugaacuucc

SEQ ID NO: 33466 - RNA, 20 nt, Artificial Sequence
  MKO10033466_A_Nde1
  gRNA
uaauggcuuucgucugcgcc

SEQ ID NO: 33467 - RNA, 20 nt, Artificial Sequence
  MKO10033467_A_Nde1
  gRNA
agagaauaaccgccuucgca

SEQ ID NO: 33468 - RNA, 20 nt, Artificial Sequence
  MKO10033468_A_Nde1
  gRNA
ccaauucagcuucguauucu

SEQ ID NO: 33469 - RNA, 20 nt, Artificial Sequence
  MKO10033469_A_Ndel1
  gRNA
uccuugccugcaacgccugu

SEQ ID NO: 33470 - RNA, 20 nt, Artificial Sequence
  MKO10033470_A_Ndel1
  gRNA
augaccuggagcgagcaaaa

SEQ ID NO: 33471 - RNA, 20 nt, Artificial Sequence
  MKO10033471_A_Ndel1
  gRNA
aagaugauuuaagucagacc

SEQ ID NO: 33472 - RNA, 20 nt, Artificial Sequence
  MKO10033472_A_Ndfip1
  gRNA
guuguagccacauuauacga

SEQ ID NO: 33473 - RNA, 20 nt, Artificial Sequence
  MKO10033473_A_Ndfip1
  gRNA
gacugaagcuacgaucccuu

SEQ ID NO: 33474 - RNA, 20 nt, Artificial Sequence
  MKO10033474_A_Ndfip1
  gRNA
caucguuuccuauccucagc

SEQ ID NO: 33475 - RNA, 20 nt, Artificial Sequence
  MKO10033475_A_Ndfip2
  gRNA
uguaucaccaauaccaucgc

SEQ ID NO: 33476 - RNA, 20 nt, Artificial Sequence
  MKO10033476_A_Ndfip2
  gRNA
agcaccguaucuuccagcga

SEQ ID NO: 33477 - RNA, 20 nt, Artificial Sequence
  MKO10033477_A_Ndfip2
  gRNA
uagcuuagcagcgccgacug

SEQ ID NO: 33478 - RNA, 20 nt, Artificial Sequence
  MKO10033478_A_Ndnf
  gRNA
cugcuggauguuuacgucgu

SEQ ID NO: 33479 - RNA, 20 nt, Artificial Sequence
  MKO10033479_A_Ndnf
  gRNA
cacuccaaaggugcaucgca

SEQ ID NO: 33480 - RNA, 20 nt, Artificial Sequence
  MKO10033480_A_Ndnf
  gRNA
cuacgacguaaacauccagc

SEQ ID NO: 33481 - RNA, 20 nt, Artificial Sequence
  MKO10033481_A_Ndnl2
  gRNA
ccccacggucggggccgaca

SEQ ID NO: 33482 - RNA, 20 nt, Artificial Sequence
  MKO10033482_A_Ndnl2
  gRNA
uguacccgaacacguauugc

SEQ ID NO: 33483 - RNA, 20 nt, Artificial Sequence
  MKO10033483_A_Ndnl2
  gRNA
ccugcgugcugggccgaccg

SEQ ID NO: 33484 - RNA, 20 nt, Artificial Sequence
  MKO10033484_A_Ndn
  gRNA
aacaaccguaugcccaugac

SEQ ID NO: 33485 - RNA, 20 nt, Artificial Sequence
  MKO10033485_A_Ndn
  gRNA
cgacccuaacuuugcagccg

SEQ ID NO: 33486 - RNA, 20 nt, Artificial Sequence
  MKO10033486_A_Ndn
  gRNA
auuccagaccgcacccucuc

SEQ ID NO: 33487 - RNA, 20 nt, Artificial Sequence
  MKO10033487_A_Ndor1
  gRNA
gcggcuagguugccgcgugc

SEQ ID NO: 33488 - RNA, 20 nt, Artificial Sequence
  MKO10033488_A_Ndor1
  gRNA
uccucgaggcgaaucucauu

SEQ ID NO: 33489 - RNA, 20 nt, Artificial Sequence
  MKO10033489_A_Ndor1
  gRNA
auauuuguuugugcgaccac

SEQ ID NO: 33490 - RNA, 20 nt, Artificial Sequence
  MKO10033490_A_Ndp
  gRNA
ugcgacuuacugccacuuac

SEQ ID NO: 33491 - RNA, 20 nt, Artificial Sequence
  MKO10033491_A_Ndp
  gRNA
gacugauagaaucgacauaa

SEQ ID NO: 33492 - RNA, 20 nt, Artificial Sequence
  MKO10033492_A_Ndp
  gRNA
auuucuccagauggugcucc

SEQ ID NO: 33493 - RNA, 20 nt, Artificial Sequence
  MKO10033493_A_Ndrg1
  gRNA
ugccgaugucgugauacgug

SEQ ID NO: 33494 - RNA, 20 nt, Artificial Sequence
  MKO10033494_A_Ndrg1
  gRNA
ccugcaagaguucgauguuc

SEQ ID NO: 33495 - RNA, 20 nt, Artificial Sequence
  MKO10033495_A_Ndrg1
  gRNA
caggauauugagacccuaca

SEQ ID NO: 33496 - RNA, 20 nt, Artificial Sequence
  MKO10033496_A_Ndrg2
  gRNA
ggugaauaucgccgggcguu

SEQ ID NO: 33497 - RNA, 20 nt, Artificial Sequence
  MKO10033497_A_Ndrg2
  gRNA
guaaaagugaccgagccaua

SEQ ID NO: 33498 - RNA, 20 nt, Artificial Sequence
  MKO10033498_A_Ndrg2
  gRNA
auauccccgaaccgaaacag

SEQ ID NO: 33499 - RNA, 20 nt, Artificial Sequence
  MKO10033499_A_Ndrg3
  gRNA
uacgguugagcccaaugucg

SEQ ID NO: 33500 - RNA, 20 nt, Artificial Sequence
  MKO10033500_A_Ndrg3
  gRNA
gaauggcacacgaaacuucc

SEQ ID NO: 33501 - RNA, 20 nt, Artificial Sequence
  MKO10033501_A_Ndrg3
  gRNA
augguccacgucaccauaag

SEQ ID NO: 33502 - RNA, 20 nt, Artificial Sequence
  MKO10033502_A_Ndrg4
  gRNA
caugacaucgagacgccuua

SEQ ID NO: 33503 - RNA, 20 nt, Artificial Sequence
  MKO10033503_A_Ndrg4
  gRNA
ucggcaagaugccggagugc

SEQ ID NO: 33504 - RNA, 20 nt, Artificial Sequence
  MKO10033504_A_Ndrg4
  gRNA
ugugccacguggaugccccu

SEQ ID NO: 33505 - RNA, 20 nt, Artificial Sequence
  MKO10033505_A_Ndst1
  gRNA
aagccacggcgguaccgggc

SEQ ID NO: 33506 - RNA, 20 nt, Artificial Sequence
  MKO10033506_A_Ndst1
  gRNA
ugcugcgcugcacgcuacug

SEQ ID NO: 33507 - RNA, 20 nt, Artificial Sequence
  MKO10033507_A_Ndst1
  gRNA
ggauucggaggagcgugucu

SEQ ID NO: 33508 - RNA, 20 nt, Artificial Sequence
  MKO10033508_A_Ndst2
  gRNA
cguccugcucgcuaccgccg

SEQ ID NO: 33509 - RNA, 20 nt, Artificial Sequence
  MKO10033509_A_Ndst2
  gRNA
gaacuagaucgaagcauccg

SEQ ID NO: 33510 - RNA, 20 nt, Artificial Sequence
  MKO10033510_A_Ndst2
  gRNA
acucauuauagaagaucgug

SEQ ID NO: 33511 - RNA, 20 nt, Artificial Sequence
  MKO10033511_A_Ndst3
  gRNA
acugcauaucccauaucggu

SEQ ID NO: 33512 - RNA, 20 nt, Artificial Sequence
  MKO10033512_A_Ndst3
  gRNA
gcacggcaucccuaccgaua

SEQ ID NO: 33513 - RNA, 20 nt, Artificial Sequence
  MKO10033513_A_Ndst3
  gRNA
cuauuaaagacgacucauug

SEQ ID NO: 33514 - RNA, 20 nt, Artificial Sequence
  MKO10033514_A_Ndst4
  gRNA
acauggaauuccgaucaacc

SEQ ID NO: 33515 - RNA, 20 nt, Artificial Sequence
  MKO10033515_A_Ndst4
  gRNA
aagcccuuccuguaccgcgc

SEQ ID NO: 33516 - RNA, 20 nt, Artificial Sequence
  MKO10033516_A_Ndst4
  gRNA
gcccacguacuggauuuaga

SEQ ID NO: 33517 - RNA, 20 nt, Artificial Sequence
  MKO10033517_A_Ndufa10
  gRNA
ucgauauagaugacugcgug

SEQ ID NO: 33518 - RNA, 20 nt, Artificial Sequence
  MKO10033518_A_Ndufa10
  gRNA
cuauaucgaugugcccgugc

SEQ ID NO: 33519 - RNA, 20 nt, Artificial Sequence
  MKO10033519_A_Ndufa10
  gRNA
ccccucgacauagaguuuag

SEQ ID NO: 33520 - RNA, 20 nt, Artificial Sequence
  MKO10033520_A_Ndufa11
  gRNA
cucaccgcaaaugccgccua

SEQ ID NO: 33521 - RNA, 20 nt, Artificial Sequence
  MKO10033521_A_Ndufa11
  gRNA
ucgcaagaccuacaucacca

SEQ ID NO: 33522 - RNA, 20 nt, Artificial Sequence
  MKO10033522_A_Ndufa11
  gRNA
gcugcuauuggagcgauguu

SEQ ID NO: 33523 - RNA, 20 nt, Artificial Sequence
  MKO10033523_A_Ndufa12
  gRNA
ccuaccugaagaaaacccgu

SEQ ID NO: 33524 - RNA, 20 nt, Artificial Sequence
  MKO10033524_A_Ndufa12
  gRNA
cccacucaggccgccaccga

SEQ ID NO: 33525 - RNA, 20 nt, Artificial Sequence
  MKO10033525_A_Ndufa12
  gRNA
ccugcugcacgccgcgcuuc

SEQ ID NO: 33526 - RNA, 20 nt, Artificial Sequence
  MKO10033526_A_Ndufa13
  gRNA
ugcaaguauggcggcgucga

SEQ ID NO: 33527 - RNA, 20 nt, Artificial Sequence
  MKO10033527_A_Ndufa13
  gRNA
acggccccaucgacuacaag

SEQ ID NO: 33528 - RNA, 20 nt, Artificial Sequence
  MKO10033528_A_Ndufa13
  gRNA
guggcacccaucguguggua

SEQ ID NO: 33529 - RNA, 20 nt, Artificial Sequence
  MKO10033529_A_Ndufa1
  gRNA
gaacgcgauagacguaucuc

SEQ ID NO: 33530 - RNA, 20 nt, Artificial Sequence
  MKO10033530_A_Ndufa1
  gRNA
cgcguuccaucagauaccac

SEQ ID NO: 33531 - RNA, 20 nt, Artificial Sequence
  MKO10033531_A_Ndufa1
  gRNA
ccgccuuaccuugcccccgu

SEQ ID NO: 33532 - RNA, 20 nt, Artificial Sequence
  MKO10033532_A_Ndufa2
  gRNA
cauucugauccgcgaaugcu

SEQ ID NO: 33533 - RNA, 20 nt, Artificial Sequence
  MKO10033533_A_Ndufa2
  gRNA
cacuuaugccagcguucccc

SEQ ID NO: 33534 - RNA, 20 nt, Artificial Sequence
  MKO10033534_A_Ndufa2
  gRNA
ccagcuuugcgccgaccgcu

SEQ ID NO: 33535 - RNA, 20 nt, Artificial Sequence
  MKO10033535_A_Ndufa3
  gRNA
cagcaccggcuccuucgccc

SEQ ID NO: 33536 - RNA, 20 nt, Artificial Sequence
  MKO10033536_A_Ndufa3
  gRNA
auguucccgucaucucucac

SEQ ID NO: 33537 - RNA, 20 nt, Artificial Sequence
  MKO10033537_A_Ndufa3
  gRNA
guaugcuagcaugaucaaca

SEQ ID NO: 33538 - RNA, 20 nt, Artificial Sequence
  MKO10033538_A_Ndufa4l2
  gRNA
accagacaucaggacugcgc

SEQ ID NO: 33539 - RNA, 20 nt, Artificial Sequence
  MKO10033539_A_Ndufa4l2
  gRNA
gagucccaaugaccaguaca

SEQ ID NO: 33540 - RNA, 20 nt, Artificial Sequence
  MKO10033540_A_Ndufa4l2
  gRNA
cucaggcgguuccagggcuc

SEQ ID NO: 33541 - RNA, 20 nt, Artificial Sequence
  MKO10033541_A_Ndufa4
  gRNA
acuuacgcugggaugcuucu

SEQ ID NO: 33542 - RNA, 20 nt, Artificial Sequence
  MKO10033542_A_Ndufa4
  gRNA
gggucccaaugaacaauaua

SEQ ID NO: 33543 - RNA, 20 nt, Artificial Sequence
  MKO10033543_A_Ndufa4
  gRNA
ccuuaccuuauauuguucau

SEQ ID NO: 33544 - RNA, 20 nt, Artificial Sequence
  MKO10033544_A_Ndufa5
  gRNA
ggugugcgacacuccacacg

SEQ ID NO: 33545 - RNA, 20 nt, Artificial Sequence
  MKO10033545_A_Ndufa5
  gRNA
aagagccgccugcuaaccag

SEQ ID NO: 33546 - RNA, 20 nt, Artificial Sequence
  MKO10033546_A_Ndufa5
  gRNA
cgcacaccgccaaccccacc

SEQ ID NO: 33547 - RNA, 20 nt, Artificial Sequence
  MKO10033547_A_Ndufa6
  gRNA
uaucgggaggugccgaacac

SEQ ID NO: 33548 - RNA, 20 nt, Artificial Sequence
  MKO10033548_A_Ndufa6
  gRNA
gcaccucccgauaccaagcg

SEQ ID NO: 33549 - RNA, 20 nt, Artificial Sequence
  MKO10033549_A_Ndufa6
  gRNA
ccgcugcuuccauacuuuga

SEQ ID NO: 33550 - RNA, 20 nt, Artificial Sequence
  MKO10033550_A_Ndufa7
  gRNA
cucaccgcuuggcgaucucc

SEQ ID NO: 33551 - RNA, 20 nt, Artificial Sequence
  MKO10033551_A_Ndufa7
  gRNA
gaagcuacagcugcgcuacc

SEQ ID NO: 33552 - RNA, 20 nt, Artificial Sequence
  MKO10033552_A_Ndufa7
  gRNA
ugucaggcaaggccgccgag

SEQ ID NO: 33553 - RNA, 20 nt, Artificial Sequence
  MKO10033553_A_Ndufa8
  gRNA
cgccgucaugccggggauag

SEQ ID NO: 33554 - RNA, 20 nt, Artificial Sequence
  MKO10033554_A_Ndufa8
  gRNA
uuaccuuagacaacugcccc

SEQ ID NO: 33555 - RNA, 20 nt, Artificial Sequence
  MKO10033555_A_Ndufa8
  gRNA
ucagugcgauaaaaccaaua

SEQ ID NO: 33556 - RNA, 20 nt, Artificial Sequence
  MKO10033556_A_Ndufa9
  gRNA
gguuaacaacguaucgaccc

SEQ ID NO: 33557 - RNA, 20 nt, Artificial Sequence
  MKO10033557_A_Ndufa9
  gRNA
cgauacguuguuaaccaccu

SEQ ID NO: 33558 - RNA, 20 nt, Artificial Sequence
  MKO10033558_A_Ndufa9
  gRNA
ucauauacaucacaccgaua

SEQ ID NO: 33559 - RNA, 20 nt, Artificial Sequence
  MKO10033559_A_Ndufab1
  gRNA
guuaccaaauucgucuucca

SEQ ID NO: 33560 - RNA, 20 nt, Artificial Sequence
  MKO10033560_A_Ndufab1
  gRNA
ugauaagauugauccagaaa

SEQ ID NO: 33561 - RNA, 20 nt, Artificial Sequence
  MKO10033561_A_Ndufab1
  gRNA
agucaccugcgcgagcgcca

SEQ ID NO: 33562 - RNA, 20 nt, Artificial Sequence
  MKO10033562_A_Ndufaf1
  gRNA
uguccaaggcccacucguau

SEQ ID NO: 33563 - RNA, 20 nt, Artificial Sequence
  MKO10033563_A_Ndufaf1
  gRNA
aaccgaagugcccugcuuua

SEQ ID NO: 33564 - RNA, 20 nt, Artificial Sequence
  MKO10033564_A_Ndufaf1
  gRNA
acgaaacugccagacaaccc

SEQ ID NO: 33565 - RNA, 20 nt, Artificial Sequence
  MKO10033565_A_Ndufaf2
  gRNA
acgucgccgaguacaagaac

SEQ ID NO: 33566 - RNA, 20 nt, Artificial Sequence
  MKO10033566_A_Ndufaf2
  gRNA
cacgccucugccccguauuu

SEQ ID NO: 33567 - RNA, 20 nt, Artificial Sequence
  MKO10033567_A_Ndufaf2
  gRNA
gcacgugggcacggaccauc

SEQ ID NO: 33568 - RNA, 20 nt, Artificial Sequence
  MKO10033568_A_Ndufaf3
  gRNA
aucugcggaaaucgcguguu

SEQ ID NO: 33569 - RNA, 20 nt, Artificial Sequence
  MKO10033569_A_Ndufaf3
  gRNA
caucguccgccggagaaagc

SEQ ID NO: 33570 - RNA, 20 nt, Artificial Sequence
  MKO10033570_A_Ndufaf3
  gRNA
cuccugucacucgaccuucg

SEQ ID NO: 33571 - RNA, 20 nt, Artificial Sequence
  MKO10033571_A_Ndufaf4
  gRNA
guauacauuaccggcaaggc

SEQ ID NO: 33572 - RNA, 20 nt, Artificial Sequence
  MKO10033572_A_Ndufaf4
  gRNA
cucgcgugacccgcgccuua

SEQ ID NO: 33573 - RNA, 20 nt, Artificial Sequence
  MKO10033573_A_Ndufaf4
  gRNA
gucgcggguagaagggugcu

SEQ ID NO: 33574 - RNA, 20 nt, Artificial Sequence
  MKO10033574_A_Ndufaf5
  gRNA
ccaagaaaacacguuugacc

SEQ ID NO: 33575 - RNA, 20 nt, Artificial Sequence
  MKO10033575_A_Ndufaf5
  gRNA
accguguuuaugacauagcc

SEQ ID NO: 33576 - RNA, 20 nt, Artificial Sequence
  MKO10033576_A_Ndufaf5
  gRNA
accuggcuaugucauaaaca

SEQ ID NO: 33577 - RNA, 20 nt, Artificial Sequence
  MKO10033577_A_Ndufaf6
  gRNA
caaagcguaccgcaguaugc

SEQ ID NO: 33578 - RNA, 20 nt, Artificial Sequence
  MKO10033578_A_Ndufaf6
  gRNA
ugcacugcgggccuucaaug

SEQ ID NO: 33579 - RNA, 20 nt, Artificial Sequence
  MKO10033579_A_Ndufaf6
  gRNA
aaauuaugcugagaauacgc

SEQ ID NO: 33580 - RNA, 20 nt, Artificial Sequence
  MKO10033580_A_Ndufaf7
  gRNA
uuauuaccuccccgaagauu

SEQ ID NO: 33581 - RNA, 20 nt, Artificial Sequence
  MKO10033581_A_Ndufaf7
  gRNA
guuucuggcucaccucuaca

SEQ ID NO: 33582 - RNA, 20 nt, Artificial Sequence
  MKO10033582_A_Ndufaf7
  gRNA
cuccugguaccgagaccuga

SEQ ID NO: 33583 - RNA, 20 nt, Artificial Sequence
  MKO10033583_A_Ndufb10
  gRNA
ucacgggccaguccacgacg

SEQ ID NO: 33584 - RNA, 20 nt, Artificial Sequence
  MKO10033584_A_Ndufb10
  gRNA
ccuacgaccucgucguggac

SEQ ID NO: 33585 - RNA, 20 nt, Artificial Sequence
  MKO10033585_A_Ndufb10
  gRNA
caaagugacuaaagccuacc

SEQ ID NO: 33586 - RNA, 20 nt, Artificial Sequence
  MKO10033586_A_Ndufb11
  gRNA
ggacgaaaacgucuacgcga

SEQ ID NO: 33587 - RNA, 20 nt, Artificial Sequence
  MKO10033587_A_Ndufb11
  gRNA
ucccggcugcucgcguucgc

SEQ ID NO: 33588 - RNA, 20 nt, Artificial Sequence
  MKO10033588_A_Ndufb11
  gRNA
cuugcugggaucgaaguagu

SEQ ID NO: 33589 - RNA, 20 nt, Artificial Sequence
  MKO10033589_A_Ndufb2
  gRNA
uaugucugcgcucacccguc

SEQ ID NO: 33590 - RNA, 20 nt, Artificial Sequence
  MKO10033590_A_Ndufb2
  gRNA
ugucuccagccgcccgcgcg

SEQ ID NO: 33591 - RNA, 20 nt, Artificial Sequence
  MKO10033591_A_Ndufb2
  gRNA
gggaaucccuccugaugacg

SEQ ID NO: 33592 - RNA, 20 nt, Artificial Sequence
  MKO10033592_A_Ndufb3
  gRNA
guagacauggcugcuggaca

SEQ ID NO: 33593 - RNA, 20 nt, Artificial Sequence
  MKO10033593_A_Ndufb3
  gRNA
cagaagaagcuugcugcccg

SEQ ID NO: 33594 - RNA, 20 nt, Artificial Sequence
  MKO10033594_A_Ndufb3
  gRNA
uucccgaguguaauauuaaa

SEQ ID NO: 33595 - RNA, 20 nt, Artificial Sequence
  MKO10033595_A_Ndufb4
  gRNA
cacgaugugcgacacgcguu

SEQ ID NO: 33596 - RNA, 20 nt, Artificial Sequence
  MKO10033596_A_Ndufb4
  gRNA
caaguauaagccugcgcccc

SEQ ID NO: 33597 - RNA, 20 nt, Artificial Sequence
  MKO10033597_A_Ndufb4
  gRNA
aggauccugccuugauucgc

SEQ ID NO: 33598 - RNA, 20 nt, Artificial Sequence
  MKO10033598_A_Ndufb5
  gRNA
cgggcgauccaucuugauau

SEQ ID NO: 33599 - RNA, 20 nt, Artificial Sequence
  MKO10033599_A_Ndufb5
  gRNA
aucgcccggaauuucuauga

SEQ ID NO: 33600 - RNA, 20 nt, Artificial Sequence
  MKO10033600_A_Ndufb5
  gRNA
cgagcgucauaguauaaaga

SEQ ID NO: 33601 - RNA, 20 nt, Artificial Sequence
  MKO10033601_A_Ndufb6
  gRNA
aguuaucccagaaucgcucc

SEQ ID NO: 33602 - RNA, 20 nt, Artificial Sequence
  MKO10033602_A_Ndufb6
  gRNA
cauccugcgcgggggcaaca

SEQ ID NO: 33603 - RNA, 20 nt, Artificial Sequence
  MKO10033603_A_Ndufb6
  gRNA
ucccuagggugauacaauuc

SEQ ID NO: 33604 - RNA, 20 nt, Artificial Sequence
  MKO10033604_A_Ndufb7
  gRNA
cccacagauagcgccggguc

SEQ ID NO: 33605 - RNA, 20 nt, Artificial Sequence
  MKO10033605_A_Ndufb7
  gRNA
caguuacgugaaacgcauga

SEQ ID NO: 33606 - RNA, 20 nt, Artificial Sequence
  MKO10033606_A_Ndufb7
  gRNA
gucgugcugcucgugcuugc

SEQ ID NO: 33607 - RNA, 20 nt, Artificial Sequence
  MKO10033607_A_Ndufb8
  gRNA
cggccgcggcgcguuccucu

SEQ ID NO: 33608 - RNA, 20 nt, Artificial Sequence
  MKO10033608_A_Ndufb8
  gRNA
caagaaguauaacaugcgag

SEQ ID NO: 33609 - RNA, 20 nt, Artificial Sequence
  MKO10033609_A_Ndufb8
  gRNA
gggaccuagacauguacauc

SEQ ID NO: 33610 - RNA, 20 nt, Artificial Sequence
  MKO10033610_A_Ndufb9
  gRNA
uauggcguucugcgcucccc

SEQ ID NO: 33611 - RNA, 20 nt, Artificial Sequence
  MKO10033611_A_Ndufb9
  gRNA
ucgauuuaagggacaaguac

SEQ ID NO: 33612 - RNA, 20 nt, Artificial Sequence
  MKO10033612_A_Ndufb9
  gRNA
guagcacucauaucucucga

SEQ ID NO: 33613 - RNA, 20 nt, Artificial Sequence
  MKO10033613_A_Ndufc1
  gRNA
cacggucgaaguucuauguc

SEQ ID NO: 33614 - RNA, 20 nt, Artificial Sequence
  MKO10033614_A_Ndufc1
  gRNA
uuggcaguuggacuguccgu

SEQ ID NO: 33615 - RNA, 20 nt, Artificial Sequence
  MKO10033615_A_Ndufc1
  gRNA
cgaaaacgagcgcagcacua

SEQ ID NO: 33616 - RNA, 20 nt, Artificial Sequence
  MKO10033616_A_Ndufc2
  gRNA
augcgaccggugaugagagc

SEQ ID NO: 33617 - RNA, 20 nt, Artificial Sequence
  MKO10033617_A_Ndufc2
  gRNA
cgcccaagcugaacgacccg

SEQ ID NO: 33618 - RNA, 20 nt, Artificial Sequence
  MKO10033618_A_Ndufc2
  gRNA
guuacguccuuugucuuugc

SEQ ID NO: 33619 - RNA, 20 nt, Artificial Sequence
  MKO10033619_A_Ndufs1
  gRNA
ugauggccaguucgcacaac

SEQ ID NO: 33620 - RNA, 20 nt, Artificial Sequence
  MKO10033620_A_Ndufs1
  gRNA
cuuauuagcaaaucacccau

SEQ ID NO: 33621 - RNA, 20 nt, Artificial Sequence
  MKO10033621_A_Ndufs1
  gRNA
uguccuauuugugaccaggg

SEQ ID NO: 33622 - RNA, 20 nt, Artificial Sequence
  MKO10033622_A_Ndufs2
  gRNA
ggauauacgccgcgugcauc

SEQ ID NO: 33623 - RNA, 20 nt, Artificial Sequence
  MKO10033623_A_Ndufs2
  gRNA
gucuggggcccggaugcacg

SEQ ID NO: 33624 - RNA, 20 nt, Artificial Sequence
  MKO10033624_A_Ndufs2
  gRNA
aggcccuuccauacuuugac

SEQ ID NO: 33625 - RNA, 20 nt, Artificial Sequence
  MKO10033625_A_Ndufs3
  gRNA
cugggcgacccuccgugcug

SEQ ID NO: 33626 - RNA, 20 nt, Artificial Sequence
  MKO10033626_A_Ndufs3
  gRNA
cgaauauuaccugaacuugu

SEQ ID NO: 33627 - RNA, 20 nt, Artificial Sequence
  MKO10033627_A_Ndufs3
  gRNA
gcacguaagaagggagagcg

SEQ ID NO: 33628 - RNA, 20 nt, Artificial Sequence
  MKO10033628_A_Ndufs4
  gRNA
gacugcauguuauugcgagc

SEQ ID NO: 33629 - RNA, 20 nt, Artificial Sequence
  MKO10033629_A_Ndufs4
  gRNA
uaggauaucacaacuuuaac

SEQ ID NO: 33630 - RNA, 20 nt, Artificial Sequence
  MKO10033630_A_Ndufs4
  gRNA
agcuggcagacaaccagacu

SEQ ID NO: 33631 - RNA, 20 nt, Artificial Sequence
  MKO10033631_A_Ndufs5
  gRNA
caccgagcggcguucuuaua

SEQ ID NO: 33632 - RNA, 20 nt, Artificial Sequence
  MKO10033632_A_Ndufs5
  gRNA
agcccuauaagaacgccgcu

SEQ ID NO: 33633 - RNA, 20 nt, Artificial Sequence
  MKO10033633_A_Ndufs5
  gRNA
ugcaugauaucaagaaacag

SEQ ID NO: 33634 - RNA, 20 nt, Artificial Sequence
  MKO10033634_A_Ndufs6
  gRNA
gggguucaagugucgccgag

SEQ ID NO: 33635 - RNA, 20 nt, Artificial Sequence
  MKO10033635_A_Ndufs6
  gRNA
caccgcaucauagccugcga

SEQ ID NO: 33636 - RNA, 20 nt, Artificial Sequence
  MKO10033636_A_Ndufs6
  gRNA
cccgaaaccccgugcagccc

SEQ ID NO: 33637 - RNA, 20 nt, Artificial Sequence
  MKO10033637_A_Ndufs7
  gRNA
cagauguaccuuucggagcg

SEQ ID NO: 33638 - RNA, 20 nt, Artificial Sequence
  MKO10033638_A_Ndufs7
  gRNA
cacggaacaccacaccgaag

SEQ ID NO: 33639 - RNA, 20 nt, Artificial Sequence
  MKO10033639_A_Ndufs7
  gRNA
ucugaugaacucugcgcagc

SEQ ID NO: 33640 - RNA, 20 nt, Artificial Sequence
  MKO10033640_A_Ndufs8
  gRNA
cgaugucauagcgugucguu

SEQ ID NO: 33641 - RNA, 20 nt, Artificial Sequence
  MKO10033641_A_Ndufs8
  gRNA
gcacugcgccgcuacccauc

SEQ ID NO: 33642 - RNA, 20 nt, Artificial Sequence
  MKO10033642_A_Ndufs8
  gRNA
ccacugaguccgcgcuuccg

SEQ ID NO: 33643 - RNA, 20 nt, Artificial Sequence
  MKO10033643_A_Ndufv1
  gRNA
cccacagguagcuauccgag

SEQ ID NO: 33644 - RNA, 20 nt, Artificial Sequence
  MKO10033644_A_Ndufv1
  gRNA
cggaucuuuaccaaccugua

SEQ ID NO: 33645 - RNA, 20 nt, Artificial Sequence
  MKO10033645_A_Ndufv1
  gRNA
ccucguuguagaauuccccu

SEQ ID NO: 33646 - RNA, 20 nt, Artificial Sequence
  MKO10033646_A_Ndufv2
  gRNA
ugcuggaggagccuuauuug

SEQ ID NO: 33647 - RNA, 20 nt, Artificial Sequence
  MKO10033647_A_Ndufv2
  gRNA
uaguagugcagaccuggaua

SEQ ID NO: 33648 - RNA, 20 nt, Artificial Sequence
  MKO10033648_A_Ndufv2
  gRNA
gcgagauucugacagcauau

SEQ ID NO: 33649 - RNA, 20 nt, Artificial Sequence
  MKO10033649_A_Ndufv3
  gRNA
aggacggauccgggcgcuga

SEQ ID NO: 33650 - RNA, 20 nt, Artificial Sequence
  MKO10033650_A_Ndufv3
  gRNA
agugucuucgaauagcucac

SEQ ID NO: 33651 - RNA, 20 nt, Artificial Sequence
  MKO10033651_A_Ndufv3
  gRNA
gccucccggcccuugacgac

SEQ ID NO: 33652 - RNA, 20 nt, Artificial Sequence
  MKO10033652_A_Nebl
  gRNA
caggacuuacgcauugcaau

SEQ ID NO: 33653 - RNA, 20 nt, Artificial Sequence
  MKO10033653_A_Nebl
  gRNA
aagaggcuucacucccguug

SEQ ID NO: 33654 - RNA, 20 nt, Artificial Sequence
  MKO10033654_A_Nebl
  gRNA
auccugugacugaacgggug

SEQ ID NO: 33655 - RNA, 20 nt, Artificial Sequence
  MKO10033655_A_Neb
  gRNA
guaucacuugugauggcgua

SEQ ID NO: 33656 - RNA, 20 nt, Artificial Sequence
  MKO10033656_A_Neb
  gRNA
gaagaaggucauccgaaaga

SEQ ID NO: 33657 - RNA, 20 nt, Artificial Sequence
  MKO10033657_A_Neb
  gRNA
guccgauguccuugucguug

SEQ ID NO: 33658 - RNA, 20 nt, Artificial Sequence
  MKO10033658_A_Necab1
  gRNA
cucgacacagaagaacuaug

SEQ ID NO: 33659 - RNA, 20 nt, Artificial Sequence
  MKO10033659_A_Necab1
  gRNA
ugauggaaaauuguccuuug

SEQ ID NO: 33660 - RNA, 20 nt, Artificial Sequence
  MKO10033660_A_Necab1
  gRNA
uugucuugcccauugccuuc

SEQ ID NO: 33661 - RNA, 20 nt, Artificial Sequence
  MKO10033661_A_Necab2
  gRNA
uuccgccgcgccgauaaaaa

SEQ ID NO: 33662 - RNA, 20 nt, Artificial Sequence
  MKO10033662_A_Necab2
  gRNA
cuugguguugucugaaucga

SEQ ID NO: 33663 - RNA, 20 nt, Artificial Sequence
  MKO10033663_A_Necab2
  gRNA
uuauagccacguggacacca

SEQ ID NO: 33664 - RNA, 20 nt, Artificial Sequence
  MKO10033664_A_Necab3
  gRNA
ccgguagacacccaggugug

SEQ ID NO: 33665 - RNA, 20 nt, Artificial Sequence
  MKO10033665_A_Necab3
  gRNA
ccgugcggugcucacugcca

SEQ ID NO: 33666 - RNA, 20 nt, Artificial Sequence
  MKO10033666_A_Necab3
  gRNA
ccccaucagcaaaguaauuc

SEQ ID NO: 33667 - RNA, 20 nt, Artificial Sequence
  MKO10033667_A_Necap1
  gRNA
acagggcgcagcgcguuuau

SEQ ID NO: 33668 - RNA, 20 nt, Artificial Sequence
  MKO10033668_A_Necap1
  gRNA
cgccugcgaaucacuucaaa

SEQ ID NO: 33669 - RNA, 20 nt, Artificial Sequence
  MKO10033669_A_Necap1
  gRNA
cccccguagaacaguauccu

SEQ ID NO: 33670 - RNA, 20 nt, Artificial Sequence
  MKO10033670_A_Necap2
  gRNA
ugccgggaaacugguccacg

SEQ ID NO: 33671 - RNA, 20 nt, Artificial Sequence
  MKO10033671_A_Necap2
  gRNA
cggcugcggaucacugcgaa

SEQ ID NO: 33672 - RNA, 20 nt, Artificial Sequence
  MKO10033672_A_Necap2
  gRNA
cuuucgcagugauccgcagc

SEQ ID NO: 33673 - RNA, 20 nt, Artificial Sequence
  MKO10033673_A_Nedd1
  gRNA
aagagaccgaugaagucguu

SEQ ID NO: 33674 - RNA, 20 nt, Artificial Sequence
  MKO10033674_A_Nedd1
  gRNA
uaaaguccaaacgacuucau

SEQ ID NO: 33675 - RNA, 20 nt, Artificial Sequence
  MKO10033675_A_Nedd1
  gRNA
ccuuccgcaagcuccaaaag

SEQ ID NO: 33676 - RNA, 20 nt, Artificial Sequence
  MKO10033676_A_Nedd4l
  gRNA
cacaccgacgcuuccgcucu

SEQ ID NO: 33677 - RNA, 20 nt, Artificial Sequence
  MKO10033677_A_Nedd4l
  gRNA
cagucauaaaucucgaguca

SEQ ID NO: 33678 - RNA, 20 nt, Artificial Sequence
  MKO10033678_A_Nedd4l
  gRNA
auggccuacaugccgaaaaa

SEQ ID NO: 33679 - RNA, 20 nt, Artificial Sequence
  MKO10033679_A_Nedd4
  gRNA
acauuguaugacccgaugag

SEQ ID NO: 33680 - RNA, 20 nt, Artificial Sequence
  MKO10033680_A_Nedd4
  gRNA
guucacugcugauccguacc

SEQ ID NO: 33681 - RNA, 20 nt, Artificial Sequence
  MKO10033681_A_Nedd4
  gRNA
uacaaugucacucuuacgua

SEQ ID NO: 33682 - RNA, 20 nt, Artificial Sequence
  MKO10033682_A_Nedd8
  gRNA
uccaaagguggagcgaauca

SEQ ID NO: 33683 - RNA, 20 nt, Artificial Sequence
  MKO10033683_A_Nedd8
  gRNA
cagcagcggcucaucuacag

SEQ ID NO: 33684 - RNA, 20 nt, Artificial Sequence
  MKO10033684_A_Nedd8
  gRNA
cuccucuaagagccaacacc

SEQ ID NO: 33685 - RNA, 20 nt, Artificial Sequence
  MKO10033685_A_Nedd9
  gRNA
ggacaaugccuuggcgaccg

SEQ ID NO: 33686 - RNA, 20 nt, Artificial Sequence
  MKO10033686_A_Nedd9
  gRNA
ucuaaagagggucuccgcgu

SEQ ID NO: 33687 - RNA, 20 nt, Artificial Sequence
  MKO10033687_A_Nedd9
  gRNA
ccgucacugcuaccgcaguc

SEQ ID NO: 33688 - RNA, 20 nt, Artificial Sequence
  MKO10033688_A_Nefh
  gRNA
gagauccgcgcgcagcucga

SEQ ID NO: 33689 - RNA, 20 nt, Artificial Sequence
  MKO10033689_A_Nefh
  gRNA
ccgacgucacgucgcacuug

SEQ ID NO: 33690 - RNA, 20 nt, Artificial Sequence
  MKO10033690_A_Nefh
  gRNA
uccgacacucuucgccuucc

SEQ ID NO: 33691 - RNA, 20 nt, Artificial Sequence
  MKO10033691_A_Nefl
  gRNA
ccgcgcucaguacgagaagc

SEQ ID NO: 33692 - RNA, 20 nt, Artificial Sequence
  MKO10033692_A_Nefl
  gRNA
ucucgguuagcacggugaag

SEQ ID NO: 33693 - RNA, 20 nt, Artificial Sequence
  MKO10033693_A_Nefl
  gRNA
acguggcugguauaguaggc

SEQ ID NO: 33694 - RNA, 20 nt, Artificial Sequence
  MKO10033694_A_Nefm
  gRNA
ccucuucgugauugcuccgc

SEQ ID NO: 33695 - RNA, 20 nt, Artificial Sequence
  MKO10033695_A_Nefm
  gRNA
gucuuugcgcagcgcgcgaa

SEQ ID NO: 33696 - RNA, 20 nt, Artificial Sequence
  MKO10033696_A_Nefm
  gRNA
ucgucauuugcgagaauacc

SEQ ID NO: 33697 - RNA, 20 nt, Artificial Sequence
  MKO10033697_A_Negr1
  gRNA
gcgcuuguugcucgaaccag

SEQ ID NO: 33698 - RNA, 20 nt, Artificial Sequence
  MKO10033698_A_Negr1
  gRNA
agcaacaagcgcccugcgcc

SEQ ID NO: 33699 - RNA, 20 nt, Artificial Sequence
  MKO10033699_A_Negr1
  gRNA
gauacuugaccuguugagcc

SEQ ID NO: 33700 - RNA, 20 nt, Artificial Sequence
  MKO10033700_A_Neil1
  gRNA
uacggccaugccggucucgc

SEQ ID NO: 33701 - RNA, 20 nt, Artificial Sequence
  MKO10033701_A_Neil1
  gRNA
agcucccugcgagaccggca

SEQ ID NO: 33702 - RNA, 20 nt, Artificial Sequence
  MKO10033702_A_Neil1
  gRNA
ccugcagagagaacguacuu

SEQ ID NO: 33703 - RNA, 20 nt, Artificial Sequence
  MKO10033703_A_Neil2
  gRNA
ggcccucguggaucacgugg

SEQ ID NO: 33704 - RNA, 20 nt, Artificial Sequence
  MKO10033704_A_Neil2
  gRNA
acuccaccacgugauccacg

SEQ ID NO: 33705 - RNA, 20 nt, Artificial Sequence
  MKO10033705_A_Neil2
  gRNA
cccccgucuugaccaccuuc

SEQ ID NO: 33706 - RNA, 20 nt, Artificial Sequence
  MKO10033706_A_Neil3
  gRNA
uugaugauguugcccacgcc

SEQ ID NO: 33707 - RNA, 20 nt, Artificial Sequence
  MKO10033707_A_Neil3
  gRNA
aaucccgagucaucuucaca

SEQ ID NO: 33708 - RNA, 20 nt, Artificial Sequence
  MKO10033708_A_Neil3
  gRNA
ucagaggguguugccuggcg

SEQ ID NO: 33709 - RNA, 20 nt, Artificial Sequence
  MKO10033709_A_Nek10
  gRNA
gaugcgggauccauguuauc

SEQ ID NO: 33710 - RNA, 20 nt, Artificial Sequence
  MKO10033710_A_Nek10
  gRNA
ugcuugacugaacguucaac

SEQ ID NO: 33711 - RNA, 20 nt, Artificial Sequence
  MKO10033711_A_Nek10
  gRNA
acagggggacauagagcucg

SEQ ID NO: 33712 - RNA, 20 nt, Artificial Sequence
  MKO10033712_A_Nek11
  gRNA
uuucuuucagggccgagauc

SEQ ID NO: 33713 - RNA, 20 nt, Artificial Sequence
  MKO10033713_A_Nek11
  gRNA
cccccauuauaugagucccg

SEQ ID NO: 33714 - RNA, 20 nt, Artificial Sequence
  MKO10033714_A_Nek11
  gRNA
gccucgggacucauauaaug

SEQ ID NO: 33715 - RNA, 20 nt, Artificial Sequence
  MKO10033715_A_Nek1
  gRNA
aaggagagaaguugcuguau

SEQ ID NO: 33716 - RNA, 20 nt, Artificial Sequence
  MKO10033716_A_Nek1
  gRNA
cgcucuguuucaagaagacc

SEQ ID NO: 33717 - RNA, 20 nt, Artificial Sequence
  MKO10033717_A_Nek1
  gRNA
aagcugcacugucccaucuu

SEQ ID NO: 33718 - RNA, 20 nt, Artificial Sequence
  MKO10033718_A_Nek2
  gRNA
gauguccgacuucucguugu

SEQ ID NO: 33719 - RNA, 20 nt, Artificial Sequence
  MKO10033719_A_Nek2
  gRNA
cuuauccuacaacgagaagu

SEQ ID NO: 33720 - RNA, 20 nt, Artificial Sequence
  MKO10033720_A_Nek2
  gRNA
agugaugacucaguugacgc

SEQ ID NO: 33721 - RNA, 20 nt, Artificial Sequence
  MKO10033721_A_Nek3
  gRNA
cggcuucuuaccgugucuuc

SEQ ID NO: 33722 - RNA, 20 nt, Artificial Sequence
  MKO10033722_A_Nek3
  gRNA
ccccaauauuguugccuuua

SEQ ID NO: 33723 - RNA, 20 nt, Artificial Sequence
  MKO10033723_A_Nek3
  gRNA
aauauuggggugcuucauuu

SEQ ID NO: 33724 - RNA, 20 nt, Artificial Sequence
  MKO10033724_A_Nek4
  gRNA
gcccgcgucuuagagaauca

SEQ ID NO: 33725 - RNA, 20 nt, Artificial Sequence
  MKO10033725_A_Nek4
  gRNA
caccgugauucucuaagacg

SEQ ID NO: 33726 - RNA, 20 nt, Artificial Sequence
  MKO10033726_A_Nek4
  gRNA
gcucagcagcucgacgcucu

SEQ ID NO: 33727 - RNA, 20 nt, Artificial Sequence
  MKO10033727_A_Nek5
  gRNA
cggcaggcuguuuauuguaa

SEQ ID NO: 33728 - RNA, 20 nt, Artificial Sequence
  MKO10033728_A_Nek5
  gRNA
guugccaagcucggggacuu

SEQ ID NO: 33729 - RNA, 20 nt, Artificial Sequence
  MKO10033729_A_Nek5
  gRNA
gacugaagcauauucaugac

SEQ ID NO: 33730 - RNA, 20 nt, Artificial Sequence
  MKO10033730_A_Nek6
  gRNA
ucccgacgugugaugcaccg

SEQ ID NO: 33731 - RNA, 20 nt, Artificial Sequence
  MKO10033731_A_Nek6
  gRNA
caccucggugcaucacacgu

SEQ ID NO: 33732 - RNA, 20 nt, Artificial Sequence
  MKO10033732_A_Nek6
  gRNA
cagcucauugucuucgauga

SEQ ID NO: 33733 - RNA, 20 nt, Artificial Sequence
  MKO10033733_A_Nek7
  gRNA
gguagcguuaaaaaaaguac

SEQ ID NO: 33734 - RNA, 20 nt, Artificial Sequence
  MKO10033734_A_Nek7
  gRNA
uaaucccugagagaaccguu

SEQ ID NO: 33735 - RNA, 20 nt, Artificial Sequence
  MKO10033735_A_Nek7
  gRNA
gauacaaucagcacgugcuu

SEQ ID NO: 33736 - RNA, 20 nt, Artificial Sequence
  MKO10033736_A_Nek8
  gRNA
cucauaguacucgaugacgu

SEQ ID NO: 33737 - RNA, 20 nt, Artificial Sequence
  MKO10033737_A_Nek8
  gRNA
gcuucuggucggccuuucgc

SEQ ID NO: 33738 - RNA, 20 nt, Artificial Sequence
  MKO10033738_A_Nek8
  gRNA
cagccucaagagggccuucg

SEQ ID NO: 33739 - RNA, 20 nt, Artificial Sequence
  MKO10033739_A_Nek9
  gRNA
uguguugcaggacgacucac

SEQ ID NO: 33740 - RNA, 20 nt, Artificial Sequence
  MKO10033740_A_Nek9
  gRNA
acaacuuguccuucugacga

SEQ ID NO: 33741 - RNA, 20 nt, Artificial Sequence
  MKO10033741_A_Nek9
  gRNA
ugacaaaauccuucgucaga

SEQ ID NO: 33742 - RNA, 20 nt, Artificial Sequence
  MKO10033742_A_Nelfa
  gRNA
ucccauuccacgcuaagggc

SEQ ID NO: 33743 - RNA, 20 nt, Artificial Sequence
  MKO10033743_A_Nelfa
  gRNA
uaucauccagcuggccacgc

SEQ ID NO: 33744 - RNA, 20 nt, Artificial Sequence
  MKO10033744_A_Nelfa
  gRNA
cccagaaggacugaagacgc

SEQ ID NO: 33745 - RNA, 20 nt, Artificial Sequence
  MKO10033745_A_Nelfb
  gRNA
cgccacgcuaccuuauggca

SEQ ID NO: 33746 - RNA, 20 nt, Artificial Sequence
  MKO10033746_A_Nelfb
  gRNA
uccgcaggaacagugugcgc

SEQ ID NO: 33747 - RNA, 20 nt, Artificial Sequence
  MKO10033747_A_Nelfb
  gRNA
cugcccuucuuggaucuaca

SEQ ID NO: 33748 - RNA, 20 nt, Artificial Sequence
  MKO10033748_A_Nelfcd
  gRNA
ugaucaagcacuucgacccu

SEQ ID NO: 33749 - RNA, 20 nt, Artificial Sequence
  MKO10033749_A_Nelfcd
  gRNA
ggcccagacagugaaccugc

SEQ ID NO: 33750 - RNA, 20 nt, Artificial Sequence
  MKO10033750_A_Nelfcd
  gRNA
aaguugagcaucaaacaguc

SEQ ID NO: 33751 - RNA, 20 nt, Artificial Sequence
  MKO10033751_A_Nelfe
  gRNA
uacagcguuugacaccgccc

SEQ ID NO: 33752 - RNA, 20 nt, Artificial Sequence
  MKO10033752_A_Nelfe
  gRNA
acucaggcuucaaacguucu

SEQ ID NO: 33753 - RNA, 20 nt, Artificial Sequence
  MKO10033753_A_Nelfe
  gRNA
ccacuuuccagccguuccag

SEQ ID NO: 33754 - RNA, 20 nt, Artificial Sequence
  MKO10033754_A_Nell1
  gRNA
gauacugucgauccgggagc

SEQ ID NO: 33755 - RNA, 20 nt, Artificial Sequence
  MKO10033755_A_Nell1
  gRNA
cauaccuauugcagucgaca

SEQ ID NO: 33756 - RNA, 20 nt, Artificial Sequence
  MKO10033756_A_Nell1
  gRNA
cacucuuauuccggaauagc

SEQ ID NO: 33757 - RNA, 20 nt, Artificial Sequence
  MKO10033757_A_Nell2
  gRNA
aucagacuccacuaccgcuc

SEQ ID NO: 33758 - RNA, 20 nt, Artificial Sequence
  MKO10033758_A_Nell2
  gRNA
agauggagugcgccaagucc

SEQ ID NO: 33759 - RNA, 20 nt, Artificial Sequence
  MKO10033759_A_Nell2
  gRNA
cuguuaagacgucaaucugu

SEQ ID NO: 33760 - RNA, 20 nt, Artificial Sequence
  MKO10033760_A_Nemf
  gRNA
cuucaucaguucgaaaccuu

SEQ ID NO: 33761 - RNA, 20 nt, Artificial Sequence
  MKO10033761_A_Nemf
  gRNA
cagcuucgucacuuccaaac

SEQ ID NO: 33762 - RNA, 20 nt, Artificial Sequence
  MKO10033762_A_Nemf
  gRNA
gcuacacuguuacuugaguc

SEQ ID NO: 33763 - RNA, 20 nt, Artificial Sequence
  MKO10033763_A_Nenf
  gRNA
gcuggcccgcuacggcggcg

SEQ ID NO: 33764 - RNA, 20 nt, Artificial Sequence
  MKO10033764_A_Nenf
  gRNA
ccuugcugaagacgucaucg

SEQ ID NO: 33765 - RNA, 20 nt, Artificial Sequence
  MKO10033765_A_Nenf
  gRNA
gcugcuggcggcgcucgucc

SEQ ID NO: 33766 - RNA, 20 nt, Artificial Sequence
  MKO10033766_A_Neo1
  gRNA
cacugauagaaaccuucguc

SEQ ID NO: 33767 - RNA, 20 nt, Artificial Sequence
  MKO10033767_A_Neo1
  gRNA
ucagcuucgucacuaaacuu

SEQ ID NO: 33768 - RNA, 20 nt, Artificial Sequence
  MKO10033768_A_Neo1
  gRNA
uaccgcugcauuguugaaag

SEQ ID NO: 33769 - RNA, 20 nt, Artificial Sequence
  MKO10033769_A_Nepn
  gRNA
ccgagauccgguuguuccug

SEQ ID NO: 33770 - RNA, 20 nt, Artificial Sequence
  MKO10033770_A_Nepn
  gRNA
guuggacaaugcacccgcuu

SEQ ID NO: 33771 - RNA, 20 nt, Artificial Sequence
  MKO10033771_A_Nepn
  gRNA
gaaucacaacugcaucgucc

SEQ ID NO: 33772 - RNA, 20 nt, Artificial Sequence
  MKO10033772_A_Nes
  gRNA
cccgccagcgcugaucgacg

SEQ ID NO: 33773 - RNA, 20 nt, Artificial Sequence
  MKO10033773_A_Nes
  gRNA
gggacuccgggcgcaguccg

SEQ ID NO: 33774 - RNA, 20 nt, Artificial Sequence
  MKO10033774_A_Nes
  gRNA
acccuacuaaaggggccuug

SEQ ID NO: 33775 - RNA, 20 nt, Artificial Sequence
  MKO10033775_A_Net1
  gRNA
gcgcuucggucagaccauac

SEQ ID NO: 33776 - RNA, 20 nt, Artificial Sequence
  MKO10033776_A_Net1
  gRNA
gcuuauauaccucugcacga

SEQ ID NO: 33777 - RNA, 20 nt, Artificial Sequence
  MKO10033777_A_Net1
  gRNA
cuuuagucguuuacccuucg

SEQ ID NO: 33778 - RNA, 20 nt, Artificial Sequence
  MKO10033778_A_Neto1
  gRNA
gcucgauauaauuucacacc

SEQ ID NO: 33779 - RNA, 20 nt, Artificial Sequence
  MKO10033779_A_Neto1
  gRNA
aauacucaaucgaaccaucu

SEQ ID NO: 33780 - RNA, 20 nt, Artificial Sequence
  MKO10033780_A_Neto1
  gRNA
aacguggacaaagcaugcag

SEQ ID NO: 33781 - RNA, 20 nt, Artificial Sequence
  MKO10033781_A_Neto2
  gRNA
cccguugaccuaauuaaugc

SEQ ID NO: 33782 - RNA, 20 nt, Artificial Sequence
  MKO10033782_A_Neto2
  gRNA
ccacaguaacgaucuauaag

SEQ ID NO: 33783 - RNA, 20 nt, Artificial Sequence
  MKO10033783_A_Neto2
  gRNA
uucgaacccaaauaccacac

SEQ ID NO: 33784 - RNA, 20 nt, Artificial Sequence
  MKO10033784_A_Neu1
  gRNA
uuucaaccccgacgagugcc

SEQ ID NO: 33785 - RNA, 20 nt, Artificial Sequence
  MKO10033785_A_Neu1
  gRNA
cuccccaucgucuacgauga

SEQ ID NO: 33786 - RNA, 20 nt, Artificial Sequence
  MKO10033786_A_Neu1
  gRNA
guugaaaucgugaucguguu

SEQ ID NO: 33787 - RNA, 20 nt, Artificial Sequence
  MKO10033787_A_Neu2
  gRNA
cgaagccaccaaccguguca

SEQ ID NO: 33788 - RNA, 20 nt, Artificial Sequence
  MKO10033788_A_Neu2
  gRNA
ccacacuuccaugacacccg

SEQ ID NO: 33789 - RNA, 20 nt, Artificial Sequence
  MKO10033789_A_Neu2
  gRNA
cuacaagcuuacucacuacc

SEQ ID NO: 33790 - RNA, 20 nt, Artificial Sequence
  MKO10033790_A_Neu3
  gRNA
uugacuaguggggcccccaa

SEQ ID NO: 33791 - RNA, 20 nt, Artificial Sequence
  MKO10033791_A_Neu3
  gRNA
cgcccguggaucuugaaccg

SEQ ID NO: 33792 - RNA, 20 nt, Artificial Sequence
  MKO10033792_A_Neu3
  gRNA
aacagaguggggugaccuac

SEQ ID NO: 33793 - RNA, 20 nt, Artificial Sequence
  MKO10033793_A_Neu4
  gRNA
gcuaagucgcuguuccgcga

SEQ ID NO: 33794 - RNA, 20 nt, Artificial Sequence
  MKO10033794_A_Neu4
  gRNA
cuugugcccaaccuacgcuc

SEQ ID NO: 33795 - RNA, 20 nt, Artificial Sequence
  MKO10033795_A_Neu4
  gRNA
gaggccgugcaaaucgccac

SEQ ID NO: 33796 - RNA, 20 nt, Artificial Sequence
  MKO10033796_A_Neurl1a
  gRNA
cauugcccgccuacgcuguc

SEQ ID NO: 33797 - RNA, 20 nt, Artificial Sequence
  MKO10033797_A_Neurl1a
  gRNA
ccgccgcgccguugugacuc

SEQ ID NO: 33798 - RNA, 20 nt, Artificial Sequence
  MKO10033798_A_Neurl1a
  gRNA
cgcuuccacgcgcuucgcgc

SEQ ID NO: 33799 - RNA, 20 nt, Artificial Sequence
  MKO10033799_A_Neurl1b
  gRNA
accgccgcguaccgcgaaga

SEQ ID NO: 33800 - RNA, 20 nt, Artificial Sequence
  MKO10033800_A_Neurl1b
  gRNA
cacuguagaagacgcgaccg

SEQ ID NO: 33801 - RNA, 20 nt, Artificial Sequence
  MKO10033801_A_Neurl1b
  gRNA
ccccauucgccuguacgagc

SEQ ID NO: 33802 - RNA, 20 nt, Artificial Sequence
  MKO10033802_A_Neurl2
  gRNA
accgucuggugggccgcagc

SEQ ID NO: 33803 - RNA, 20 nt, Artificial Sequence
  MKO10033803_A_Neurl2
  gRNA
ccagacggucccggggaauu

SEQ ID NO: 33804 - RNA, 20 nt, Artificial Sequence
  MKO10033804_A_Neurl2
  gRNA
gccgacuagugauccagaag

SEQ ID NO: 33805 - RNA, 20 nt, Artificial Sequence
  MKO10033805_A_Neurl3
  gRNA
aggcgcucgacguuccacga

SEQ ID NO: 33806 - RNA, 20 nt, Artificial Sequence
  MKO10033806_A_Neurl3
  gRNA
cauaugucgcuggcagaucg

SEQ ID NO: 33807 - RNA, 20 nt, Artificial Sequence
  MKO10033807_A_Neurl3
  gRNA
cucgaucugccagcgacaua

SEQ ID NO: 33808 - RNA, 20 nt, Artificial Sequence
  MKO10033808_A_Neurl4
  gRNA
ugucuacaagcuugucgauc

SEQ ID NO: 33809 - RNA, 20 nt, Artificial Sequence
  MKO10033809_A_Neurl4
  gRNA
ggcccccauuguaggcagac

SEQ ID NO: 33810 - RNA, 20 nt, Artificial Sequence
  MKO10033810_A_Neurl4
  gRNA
gcgggacgggcgcucugugu

SEQ ID NO: 33811 - RNA, 20 nt, Artificial Sequence
  MKO10033811_A_Neurod1
  gRNA
gccggcgaccaaauugguag

SEQ ID NO: 33812 - RNA, 20 nt, Artificial Sequence
  MKO10033812_A_Neurod1
  gRNA
gucccagcccacuaccaauu

SEQ ID NO: 33813 - RNA, 20 nt, Artificial Sequence
  MKO10033813_A_Neurod1
  gRNA
uucguacagacgcucugcaa

SEQ ID NO: 33814 - RNA, 20 nt, Artificial Sequence
  MKO10033814_A_Neurod2
  gRNA
cgccuacgagacgcuguacg

SEQ ID NO: 33815 - RNA, 20 nt, Artificial Sequence
  MKO10033815_A_Neurod2
  gRNA
uuucuucggcccgcgcuucu

SEQ ID NO: 33816 - RNA, 20 nt, Artificial Sequence
  MKO10033816_A_Neurod2
  gRNA
cgaacuugggcacguccgag

SEQ ID NO: 33817 - RNA, 20 nt, Artificial Sequence
  MKO10033817_A_Neurod4
  gRNA
caagauagagacucuucgac

SEQ ID NO: 33818 - RNA, 20 nt, Artificial Sequence
  MKO10033818_A_Neurod4
  gRNA
aagcucgccuugaaagauuc

SEQ ID NO: 33819 - RNA, 20 nt, Artificial Sequence
  MKO10033819_A_Neurod4
  gRNA
gacucuccuaagauuaucca

SEQ ID NO: 33820 - RNA, 20 nt, Artificial Sequence
  MKO10033820_A_Neurod6
  gRNA
cugcgcagauguaagucgua

SEQ ID NO: 33821 - RNA, 20 nt, Artificial Sequence
  MKO10033821_A_Neurod6
  gRNA
cuaaugcgcgcgagaggaac

SEQ ID NO: 33822 - RNA, 20 nt, Artificial Sequence
  MKO10033822_A_Neurod6
  gRNA
auuacgacagacucgucaaa

SEQ ID NO: 33823 - RNA, 20 nt, Artificial Sequence
  MKO10033823_A_Neurog1
  gRNA
accgggaacauucgaugccc

SEQ ID NO: 33824 - RNA, 20 nt, Artificial Sequence
  MKO10033824_A_Neurog1
  gRNA
aacagggcgucguguggagc

SEQ ID NO: 33825 - RNA, 20 nt, Artificial Sequence
  MKO10033825_A_Neurog1
  gRNA
uccggggcaucgaauguucc

SEQ ID NO: 33826 - RNA, 20 nt, Artificial Sequence
  MKO10033826_A_Neurog2
  gRNA
gagacggcccgugagcgcga

SEQ ID NO: 33827 - RNA, 20 nt, Artificial Sequence
  MKO10033827_A_Neurog2
  gRNA
cucgcgcagcgcguccagcg

SEQ ID NO: 33828 - RNA, 20 nt, Artificial Sequence
  MKO10033828_A_Neurog2
  gRNA
gcaguccggcgucgggugcc

SEQ ID NO: 33829 - RNA, 20 nt, Artificial Sequence
  MKO10033829_A_Neurog3
  gRNA
aggaagcuccgcgcccgacg

SEQ ID NO: 33830 - RNA, 20 nt, Artificial Sequence
  MKO10033830_A_Neurog3
  gRNA
gcgcauccagcgccgaguug

SEQ ID NO: 33831 - RNA, 20 nt, Artificial Sequence
  MKO10033831_A_Neurog3
  gRNA
gccuguugcgcccuccgcgu

SEQ ID NO: 33832 - RNA, 20 nt, Artificial Sequence
  MKO10033832_A_Nexn
  gRNA
uguuaccucugaugcggacu

SEQ ID NO: 33833 - RNA, 20 nt, Artificial Sequence
  MKO10033833_A_Nexn
  gRNA
gcgcgaauuagcaaaaagag

SEQ ID NO: 33834 - RNA, 20 nt, Artificial Sequence
  MKO10033834_A_Nexn
  gRNA
ugacucacuacuuauaacag

SEQ ID NO: 33835 - RNA, 20 nt, Artificial Sequence
  MKO10033835_A_Nf1
  gRNA
uccgaaguucggcugcaugu

SEQ ID NO: 33836 - RNA, 20 nt, Artificial Sequence
  MKO10033836_A_Nf1
  gRNA
ucuuuagucgcauuucuaca

SEQ ID NO: 33837 - RNA, 20 nt, Artificial Sequence
  MKO10033837_A_Nf1
  gRNA
agucagcaccgagcacaaca

SEQ ID NO: 33838 - RNA, 20 nt, Artificial Sequence
  MKO10033838_A_Nf2
  gRNA
gauccgcaccgugaaugucu

SEQ ID NO: 33839 - RNA, 20 nt, Artificial Sequence
  MKO10033839_A_Nf2
  gRNA
gaagcucaugcgagaagcga

SEQ ID NO: 33840 - RNA, 20 nt, Artificial Sequence
  MKO10033840_A_Nf2
  gRNA
cuuggcgucauaugcugucc

SEQ ID NO: 33841 - RNA, 20 nt, Artificial Sequence
  MKO10033841_A_Nfam1
  gRNA
aggcuuugugguuccgacgg

SEQ ID NO: 33842 - RNA, 20 nt, Artificial Sequence
  MKO10033842_A_Nfam1
  gRNA
auauccauggccggagacgc

SEQ ID NO: 33843 - RNA, 20 nt, Artificial Sequence
  MKO10033843_A_Nfam1
  gRNA
gucccuacagcgucgagaga

SEQ ID NO: 33844 - RNA, 20 nt, Artificial Sequence
  MKO10033844_A_Nfasc
  gRNA
acgguccaucggaaucucga

SEQ ID NO: 33845 - RNA, 20 nt, Artificial Sequence
  MKO10033845_A_Nfasc
  gRNA
ggaaaaccuagaccccgucg

SEQ ID NO: 33846 - RNA, 20 nt, Artificial Sequence
  MKO10033846_A_Nfasc
  gRNA
cuacagugcaaccccccacc

SEQ ID NO: 33847 - RNA, 20 nt, Artificial Sequence
  MKO10033847_A_Nfau5
  gRNA
aaagagcacucgugccagau

SEQ ID NO: 33848 - RNA, 20 nt, Artificial Sequence
  MKO10033848_A_Nfau5
  gRNA
auuucgcccaguuacucuac

SEQ ID NO: 33849 - RNA, 20 nt, Artificial Sequence
  MKO10033849_A_Nfau5
  gRNA
augcugcugaacuguguuac

SEQ ID NO: 33850 - RNA, 20 nt, Artificial Sequence
  MKO10033850_A_Nfauc1
  gRNA
accucgauccgaagcucgua

SEQ ID NO: 33851 - RNA, 20 nt, Artificial Sequence
  MKO10033851_A_Nfauc1
  gRNA
gggcuucgcccacugauacg

SEQ ID NO: 33852 - RNA, 20 nt, Artificial Sequence
  MKO10033852_A_Nfauc1
  gRNA
auucugguccauacgagcuu

SEQ ID NO: 33853 - RNA, 20 nt, Artificial Sequence
  MKO10033853_A_Nfauc2ip
  gRNA
ucacuaggucagcccggcac

SEQ ID NO: 33854 - RNA, 20 nt, Artificial Sequence
  MKO10033854_A_Nfauc2ip
  gRNA
cuuugccccaaccuucguca

SEQ ID NO: 33855 - RNA, 20 nt, Artificial Sequence
  MKO10033855_A_Nfauc2ip
  gRNA
gacucuuuacacucaagauc

SEQ ID NO: 33856 - RNA, 20 nt, Artificial Sequence
  MKO10033856_A_Nfauc2
  gRNA
ggacgugcacgcggaacacc

SEQ ID NO: 33857 - RNA, 20 nt, Artificial Sequence
  MKO10033857_A_Nfauc2
  gRNA
uccucggcgaggcugguucg

SEQ ID NO: 33858 - RNA, 20 nt, Artificial Sequence
  MKO10033858_A_Nfauc2
  gRNA
accucgaaccagccucgccg

SEQ ID NO: 33859 - RNA, 20 nt, Artificial Sequence
  MKO10033859_A_Nfauc3
  gRNA
gaucaagcugccauacuacc

SEQ ID NO: 33860 - RNA, 20 nt, Artificial Sequence
  MKO10033860_A_Nfauc3
  gRNA
aggucguaaauaucuaucau

SEQ ID NO: 33861 - RNA, 20 nt, Artificial Sequence
  MKO10033861_A_Nfauc3
  gRNA
uuccaguaauccgaugcacc

SEQ ID NO: 33862 - RNA, 20 nt, Artificial Sequence
  MKO10033862_A_Nfauc4
  gRNA
ggaauagcgccgcuugccgc

SEQ ID NO: 33863 - RNA, 20 nt, Artificial Sequence
  MKO10033863_A_Nfauc4
  gRNA
gaacuagggucccggaccag

SEQ ID NO: 33864 - RNA, 20 nt, Artificial Sequence
  MKO10033864_A_Nfauc4
  gRNA
uaaggucaucuccaacacuu

SEQ ID NO: 33865 - RNA, 20 nt, Artificial Sequence
  MKO10033865_A_Nfe2l1
  gRNA
ggcccgauugcuucgagaaa

SEQ ID NO: 33866 - RNA, 20 nt, Artificial Sequence
  MKO10033866_A_Nfe2l1
  gRNA
uuccgcacccucgccugacc

SEQ ID NO: 33867 - RNA, 20 nt, Artificial Sequence
  MKO10033867_A_Nfe2l1
  gRNA
gaucaauauccugucgccaa

SEQ ID NO: 33868 - RNA, 20 nt, Artificial Sequence
  MKO10033868_A_Nfe2l2
  gRNA
uuacucaucgaucuccucgc

SEQ ID NO: 33869 - RNA, 20 nt, Artificial Sequence
  MKO10033869_A_Nfe2l2
  gRNA
agccuucaauagucccgucc

SEQ ID NO: 33870 - RNA, 20 nt, Artificial Sequence
  MKO10033870_A_Nfe2l2
  gRNA
augugcugggccggcugaau

SEQ ID NO: 33871 - RNA, 20 nt, Artificial Sequence
  MKO10033871_A_Nfe2l3
  gRNA
cgcgcacuucgugcagcagc

SEQ ID NO: 33872 - RNA, 20 nt, Artificial Sequence
  MKO10033872_A_Nfe2l3
  gRNA
cgccgcccgcggaugcugac

SEQ ID NO: 33873 - RNA, 20 nt, Artificial Sequence
  MKO10033873_A_Nfe2l3
  gRNA
ugaugucuaguuuacguuua

SEQ ID NO: 33874 - RNA, 20 nt, Artificial Sequence
  MKO10033874_A_Nfe2
  gRNA
uaguucgggacauccgucga

SEQ ID NO: 33875 - RNA, 20 nt, Artificial Sequence
  MKO10033875_A_Nfe2
  gRNA
ucgggacgagcggcgagccc

SEQ ID NO: 33876 - RNA, 20 nt, Artificial Sequence
  MKO10033876_A_Nfe2
  gRNA
aucucuccaagcuccccaac

SEQ ID NO: 33877 - RNA, 20 nt, Artificial Sequence
  MKO10033877_A_Nfia
  gRNA
cuuguucaaagguauuccgc

SEQ ID NO: 33878 - RNA, 20 nt, Artificial Sequence
  MKO10033878_A_Nfia
  gRNA
gaagugggcuucccgacuuc

SEQ ID NO: 33879 - RNA, 20 nt, Artificial Sequence
  MKO10033879_A_Nfia
  gRNA
cacaggacauuugggcuucc

SEQ ID NO: 33880 - RNA, 20 nt, Artificial Sequence
  MKO10033880_A_Nfib
  gRNA
acugcgcaaagauauccgcc

SEQ ID NO: 33881 - RNA, 20 nt, Artificial Sequence
  MKO10033881_A_Nfib
  gRNA
gcggauaucuuugcgcaguu

SEQ ID NO: 33882 - RNA, 20 nt, Artificial Sequence
  MKO10033882_A_Nfib
  gRNA
uuuacagauucuggacaauc

SEQ ID NO: 33883 - RNA, 20 nt, Artificial Sequence
  MKO10033883_A_Nfic
  gRNA
accgcgcucccgcacaaagu

SEQ ID NO: 33884 - RNA, 20 nt, Artificial Sequence
  MKO10033884_A_Nfic
  gRNA
ugugugcagccgcaccauau

SEQ ID NO: 33885 - RNA, 20 nt, Artificial Sequence
  MKO10033885_A_Nfic
  gRNA
agcugacucacccagcguua

SEQ ID NO: 33886 - RNA, 20 nt, Artificial Sequence
  MKO10033886_A_Nfil3
  gRNA
ccgccguuucucccaauaca

SEQ ID NO: 33887 - RNA, 20 nt, Artificial Sequence
  MKO10033887_A_Nfil3
  gRNA
gcgcuucucccgagaucuuu

SEQ ID NO: 33888 - RNA, 20 nt, Artificial Sequence
  MKO10033888_A_Nfil3
  gRNA
cuggaguccgaagccgagau

SEQ ID NO: 33889 - RNA, 20 nt, Artificial Sequence
  MKO10033889_A_Nfix
  gRNA
gcuccaguugcgacugcauc

SEQ ID NO: 33890 - RNA, 20 nt, Artificial Sequence
  MKO10033890_A_Nfix
  gRNA
caacuucucacuggcggacc

SEQ ID NO: 33891 - RNA, 20 nt, Artificial Sequence
  MKO10033891_A_Nfix
  gRNA
acaggccgggguucgagcac

SEQ ID NO: 33892 - RNA, 20 nt, Artificial Sequence
  MKO10033892_A_Nfkb1
  gRNA
ugcaaagguuaucguucagu

SEQ ID NO: 33893 - RNA, 20 nt, Artificial Sequence
  MKO10033893_A_Nfkb1
  gRNA
cccggaagcccuccguguga

SEQ ID NO: 33894 - RNA, 20 nt, Artificial Sequence
  MKO10033894_A_Nfkb1
  gRNA
cgauuccgcuauguguguga

SEQ ID NO: 33895 - RNA, 20 nt, Artificial Sequence
  MKO10033895_A_Nfkb2
  gRNA
cgaggcuucagauuucgaua

SEQ ID NO: 33896 - RNA, 20 nt, Artificial Sequence
  MKO10033896_A_Nfkb2
  gRNA
ucgugcgcaugcccacaguc

SEQ ID NO: 33897 - RNA, 20 nt, Artificial Sequence
  MKO10033897_A_Nfkb2
  gRNA
ggccaagauugagguggacc

SEQ ID NO: 33898 - RNA, 20 nt, Artificial Sequence
  MKO10033898_A_Nfkbia
  gRNA
gagggcuguccggccauugc

SEQ ID NO: 33899 - RNA, 20 nt, Artificial Sequence
  MKO10033899_A_Nfkbia
  gRNA
gggugcugaugucaacgcuc

SEQ ID NO: 33900 - RNA, 20 nt, Artificial Sequence
  MKO10033900_A_Nfkbia
  gRNA
cugcgucaagacugcuacac

SEQ ID NO: 33901 - RNA, 20 nt, Artificial Sequence
  MKO10033901_A_Nfkbib
  gRNA
cggagccgaccucaauaaac

SEQ ID NO: 33902 - RNA, 20 nt, Artificial Sequence
  MKO10033902_A_Nfkbib
  gRNA
agccgcgugaugaagacugg

SEQ ID NO: 33903 - RNA, 20 nt, Artificial Sequence
  MKO10033903_A_Nfkbib
  gRNA
ggugcggcccccauacaugc

SEQ ID NO: 33904 - RNA, 20 nt, Artificial Sequence
  MKO10033904_A_Nfkbid
  gRNA
ugacuuacagacgccgcucc

SEQ ID NO: 33905 - RNA, 20 nt, Artificial Sequence
  MKO10033905_A_Nfkbid
  gRNA
ugucuccagggacgguccgg

SEQ ID NO: 33906 - RNA, 20 nt, Artificial Sequence
  MKO10033906_A_Nfkbid
  gRNA
guuacagauguaccgacagc

SEQ ID NO: 33907 - RNA, 20 nt, Artificial Sequence
  MKO10033907_A_Nfkbie
  gRNA
gggggccagccgaauucugc

SEQ ID NO: 33908 - RNA, 20 nt, Artificial Sequence
  MKO10033908_A_Nfkbie
  gRNA
caucuacccgggcaccggcc

SEQ ID NO: 33909 - RNA, 20 nt, Artificial Sequence
  MKO10033909_A_Nfkbie
  gRNA
ggcgccgacaggccacaugc

SEQ ID NO: 33910 - RNA, 20 nt, Artificial Sequence
  MKO10033910_A_Nfkbil1
  gRNA
accgccgagagcgacgcuuc

SEQ ID NO: 33911 - RNA, 20 nt, Artificial Sequence
  MKO10033911_A_Nfkbil1
  gRNA
agcgucgcucucggcggugc

SEQ ID NO: 33912 - RNA, 20 nt, Artificial Sequence
  MKO10033912_A_Nfkbil1
  gRNA
uacccgacagacagacguag

SEQ ID NO: 33913 - RNA, 20 nt, Artificial Sequence
  MKO10033913_A_Nfkbiz
  gRNA
cgucgucggggugcacgaug

SEQ ID NO: 33914 - RNA, 20 nt, Artificial Sequence
  MKO10033914_A_Nfkbiz
  gRNA
aauacugguacauugacgcc

SEQ ID NO: 33915 - RNA, 20 nt, Artificial Sequence
  MKO10033915_A_Nfkbiz
  gRNA
acgcuuaccacgaagugaga

SEQ ID NO: 33916 - RNA, 20 nt, Artificial Sequence
  MKO10033916_A_Nfrkb
  gRNA
agacuuucaaguaacgcugc

SEQ ID NO: 33917 - RNA, 20 nt, Artificial Sequence
  MKO10033917_A_Nfrkb
  gRNA
guccgccacucccgcuccuc

SEQ ID NO: 33918 - RNA, 20 nt, Artificial Sequence
  MKO10033918_A_Nfrkb
  gRNA
ugacgauacuugaccaccuc

SEQ ID NO: 33919 - RNA, 20 nt, Artificial Sequence
  MKO10033919_A_Nfs1
  gRNA
cuagugaaaaugaucucccg

SEQ ID NO: 33920 - RNA, 20 nt, Artificial Sequence
  MKO10033920_A_Nfs1
  gRNA
aaccuggcgagcacguucca

SEQ ID NO: 33921 - RNA, 20 nt, Artificial Sequence
  MKO10033921_A_Nfs1
  gRNA
ccauaguaguugacaaggua

SEQ ID NO: 33922 - RNA, 20 nt, Artificial Sequence
  MKO10033922_A_Nfu1
  gRNA
augguccucgucucaagaac

SEQ ID NO: 33923 - RNA, 20 nt, Artificial Sequence
  MKO10033923_A_Nfu1
  gRNA
cgcgcacccuuguguaacac

SEQ ID NO: 33924 - RNA, 20 nt, Artificial Sequence
  MKO10033924_A_Nfu1
  gRNA
cuccguacauauugaugcag

SEQ ID NO: 33925 - RNA, 20 nt, Artificial Sequence
  MKO10033925_A_Nfx1
  gRNA
aaccgaccugcaugcgaugc

SEQ ID NO: 33926 - RNA, 20 nt, Artificial Sequence
  MKO10033926_A_Nfx1
  gRNA
aggugguuaucgcagauccc

SEQ ID NO: 33927 - RNA, 20 nt, Artificial Sequence
  MKO10033927_A_Nfx1
  gRNA
cuguaguuagcugcucaauc

SEQ ID NO: 33928 - RNA, 20 nt, Artificial Sequence
  MKO10033928_A_Nfxl1
  gRNA
aagauccaccuuuagauccg

SEQ ID NO: 33929 - RNA, 20 nt, Artificial Sequence
  MKO10033929_A_Nfxl1
  gRNA
ucugugacagacgaugauuu

SEQ ID NO: 33930 - RNA, 20 nt, Artificial Sequence
  MKO10033930_A_Nfxl1
  gRNA
cacgaaugagguacaagcca

SEQ ID NO: 33931 - RNA, 20 nt, Artificial Sequence
  MKO10033931_A_Nfya
  gRNA
gguccaggggcagccguuaa

SEQ ID NO: 33932 - RNA, 20 nt, Artificial Sequence
  MKO10033932_A_Nfya
  gRNA
ggccagcuuauuacaucaac

SEQ ID NO: 33933 - RNA, 20 nt, Artificial Sequence
  MKO10033933_A_Nfya
  gRNA
guuugucguauacugcucca

SEQ ID NO: 33934 - RNA, 20 nt, Artificial Sequence
  MKO10033934_A_Nfyb
  gRNA
auuuauaagcuucaucacgu

SEQ ID NO: 33935 - RNA, 20 nt, Artificial Sequence
  MKO10033935_A_Nfyb
  gRNA
auuucugcagacuacaucgg

SEQ ID NO: 33936 - RNA, 20 nt, Artificial Sequence
  MKO10033936_A_Nfyb
  gRNA
guagcugucaaagccuagag

SEQ ID NO: 33937 - RNA, 20 nt, Artificial Sequence
  MKO10033937_A_Nfyc
  gRNA
uaacaagcgucguacucuuc

SEQ ID NO: 33938 - RNA, 20 nt, Artificial Sequence
  MKO10033938_A_Nfyc
  gRNA
ucccagcucaccuggcgcuu

SEQ ID NO: 33939 - RNA, 20 nt, Artificial Sequence
  MKO10033939_A_Nfyc
  gRNA
ucagaaagauuuccgaguac

SEQ ID NO: 33940 - RNA, 20 nt, Artificial Sequence
  MKO10033940_A_Ngb
  gRNA
accgccuggagccgacucua

SEQ ID NO: 33941 - RNA, 20 nt, Artificial Sequence
  MKO10033941_A_Ngb
  gRNA
cuccaggcgguccuuguagc

SEQ ID NO: 33942 - RNA, 20 nt, Artificial Sequence
  MKO10033942_A_Ngb
  gRNA
ugaugcugcagugaccaacg

SEQ ID NO: 33943 - RNA, 20 nt, Artificial Sequence
  MKO10033943_A_Ngdn
  gRNA
cugacgacaaaaguucgagc

SEQ ID NO: 33944 - RNA, 20 nt, Artificial Sequence
  MKO10033944_A_Ngdn
  gRNA
gcuguugcucauguaccuua

SEQ ID NO: 33945 - RNA, 20 nt, Artificial Sequence
  MKO10033945_A_Ngdn
  gRNA
uuuagaaaaacuucguccuu

SEQ ID NO: 33946 - RNA, 20 nt, Artificial Sequence
  MKO10033946_A_Ngef
  gRNA
agaagugaucagcugcguaa

SEQ ID NO: 33947 - RNA, 20 nt, Artificial Sequence
  MKO10033947_A_Ngef
  gRNA
aucccauucccgccgacucc

SEQ ID NO: 33948 - RNA, 20 nt, Artificial Sequence
  MKO10033948_A_Ngef
  gRNA
cgucaguaaccagaccuacc

SEQ ID NO: 33949 - RNA, 20 nt, Artificial Sequence
  MKO10033949_A_Ngfrap1
  gRNA
gaauggcccaucggaaguua

SEQ ID NO: 33950 - RNA, 20 nt, Artificial Sequence
  MKO10033950_A_Ngfrap1
  gRNA
gacuugccccuaacuuccga

SEQ ID NO: 33951 - RNA, 20 nt, Artificial Sequence
  MKO10033951_A_Ngfrap1
  gRNA
agaauucaucauggugaucg

SEQ ID NO: 33952 - RNA, 20 nt, Artificial Sequence
  MKO10033952_A_Ngfr
  gRNA
aguuacgcgagugcacgccc

SEQ ID NO: 33953 - RNA, 20 nt, Artificial Sequence
  MKO10033953_A_Ngfr
  gRNA
agggcgugcacucgcguaac

SEQ ID NO: 33954 - RNA, 20 nt, Artificial Sequence
  MKO10033954_A_Ngfr
  gRNA
acggucugguuggcuccgca

SEQ ID NO: 33955 - RNA, 20 nt, Artificial Sequence
  MKO10033955_A_Ngf
  gRNA
uguugucaacgccuugacga

SEQ ID NO: 33956 - RNA, 20 nt, Artificial Sequence
  MKO10033956_A_Ngf
  gRNA
cacgacucacaccuucguca

SEQ ID NO: 33957 - RNA, 20 nt, Artificial Sequence
  MKO10033957_A_Ngf
  gRNA
uuucuauacuggccgcagug

SEQ ID NO: 33958 - RNA, 20 nt, Artificial Sequence
  MKO10033958_A_Ngly1
  gRNA
gagugccguauuaacccagc

SEQ ID NO: 33959 - RNA, 20 nt, Artificial Sequence
  MKO10033959_A_Ngly1
  gRNA
aguugagcaaccgcuuccca

SEQ ID NO: 33960 - RNA, 20 nt, Artificial Sequence
  MKO10033960_A_Ngly1
  gRNA
agagaauugcaccuucuuac

SEQ ID NO: 33961 - RNA, 20 nt, Artificial Sequence
  MKO10033961_A_Ngp
  gRNA
ugccacuccgccuucuaguc

SEQ ID NO: 33962 - RNA, 20 nt, Artificial Sequence
  MKO10033962_A_Ngp
  gRNA
ccuucgacaacuaagauaug

SEQ ID NO: 33963 - RNA, 20 nt, Artificial Sequence
  MKO10033963_A_Ngp
  gRNA
ucgacugcaaucccugucgc

SEQ ID NO: 33964 - RNA, 20 nt, Artificial Sequence
  MKO10033964_A_Ngrn
  gRNA
ugcgauuccagaaaauacga

SEQ ID NO: 33965 - RNA, 20 nt, Artificial Sequence
  MKO10033965_A_Ngrn
  gRNA
cguaggcucaaauucuguag

SEQ ID NO: 33966 - RNA, 20 nt, Artificial Sequence
  MKO10033966_A_Ngrn
  gRNA
guucgcgucccaggucaugg

SEQ ID NO: 33967 - RNA, 20 nt, Artificial Sequence
  MKO10033967_A_Nhej1
  gRNA
cccuaugcauagagcucggc

SEQ ID NO: 33968 - RNA, 20 nt, Artificial Sequence
  MKO10033968_A_Nhej1
  gRNA
accagccgagcucuaugcau

SEQ ID NO: 33969 - RNA, 20 nt, Artificial Sequence
  MKO10033969_A_Nhej1
  gRNA
ggcugguuaucaguuccucg

SEQ ID NO: 33970 - RNA, 20 nt, Artificial Sequence
  MKO10033970_A_Nhlh1
  gRNA
accgcacggcacacgccacg

SEQ ID NO: 33971 - RNA, 20 nt, Artificial Sequence
  MKO10033971_A_Nhlh1
  gRNA
cuagguugaaggcuuccacg

SEQ ID NO: 33972 - RNA, 20 nt, Artificial Sequence
  MKO10033972_A_Nhlh1
  gRNA
gaugcucaacuccgauacca

SEQ ID NO: 33973 - RNA, 20 nt, Artificial Sequence
  MKO10033973_A_Nhlh2
  gRNA
cgcggguggcgugggccgau

SEQ ID NO: 33974 - RNA, 20 nt, Artificial Sequence
  MKO10033974_A_Nhlh2
  gRNA
cacccgcgagcgcauccgag

SEQ ID NO: 33975 - RNA, 20 nt, Artificial Sequence
  MKO10033975_A_Nhlh2
  gRNA
gcgaagaaaagcgccgccgc

SEQ ID NO: 33976 - RNA, 20 nt, Artificial Sequence
  MKO10033976_A_Nhlrc1
  gRNA
gcacgacgugaaguacccac

SEQ ID NO: 33977 - RNA, 20 nt, Artificial Sequence
  MKO10033977_A_Nhlrc1
  gRNA
ucgccgcucucgcgcacccg

SEQ ID NO: 33978 - RNA, 20 nt, Artificial Sequence
  MKO10033978_A_Nhlrc1
  gRNA
gcuucgagagguucggccac

SEQ ID NO: 33979 - RNA, 20 nt, Artificial Sequence
  MKO10033979_A_Nhlrc2
  gRNA
gucccaagcgcaacguccca

SEQ ID NO: 33980 - RNA, 20 nt, Artificial Sequence
  MKO10033980_A_Nhlrc2
  gRNA
uaucagagaaucugcgcucc

SEQ ID NO: 33981 - RNA, 20 nt, Artificial Sequence
  MKO10033981_A_Nhlrc2
  gRNA
cuggucauacugggaccccg

SEQ ID NO: 33982 - RNA, 20 nt, Artificial Sequence
  MKO10033982_A_Nhlrc3
  gRNA
cuacguaaacuaacccguug

SEQ ID NO: 33983 - RNA, 20 nt, Artificial Sequence
  MKO10033983_A_Nhlrc3
  gRNA
caccauuugaacaguccguc

SEQ ID NO: 33984 - RNA, 20 nt, Artificial Sequence
  MKO10033984_A_Nhlrc3
  gRNA
agcguuacacuugacgcagu

SEQ ID NO: 33985 - RNA, 20 nt, Artificial Sequence
  MKO10033985_A_Nhlrc4
  gRNA
aggccaucucccccagauac

SEQ ID NO: 33986 - RNA, 20 nt, Artificial Sequence
  MKO10033986_A_Nhlrc4
  gRNA
acuaaagaggcccuugggua

SEQ ID NO: 33987 - RNA, 20 nt, Artificial Sequence
  MKO10033987_A_Nhlrc4
  gRNA
gcuucauguuaggaccaacc

SEQ ID NO: 33988 - RNA, 20 nt, Artificial Sequence
  MKO10033988_A_Nhp2l1
  gRNA
agaggcugaugugaauccga

SEQ ID NO: 33989 - RNA, 20 nt, Artificial Sequence
  MKO10033989_A_Nhp2l1
  gRNA
aguuacaugacuguugaaca

SEQ ID NO: 33990 - RNA, 20 nt, Artificial Sequence
  MKO10033990_A_Nhp2l1
  gRNA
gccaccaaaacccucaacag

SEQ ID NO: 33991 - RNA, 20 nt, Artificial Sequence
  MKO10033991_A_Nhp2
  gRNA
gcgcacguacaaagagcugc

SEQ ID NO: 33992 - RNA, 20 nt, Artificial Sequence
  MKO10033992_A_Nhp2
  gRNA
aggagauacauugccgauug

SEQ ID NO: 33993 - RNA, 20 nt, Artificial Sequence
  MKO10033993_A_Nhp2
  gRNA
ucccgaagaguccgaggcgc

SEQ ID NO: 33994 - RNA, 20 nt, Artificial Sequence
  MKO10033994_A_Nhsl1
  gRNA
ucucgccucaguaacgauac

SEQ ID NO: 33995 - RNA, 20 nt, Artificial Sequence
  MKO10033995_A_Nhsl1
  gRNA
cggaagcgagcucgucacag

SEQ ID NO: 33996 - RNA, 20 nt, Artificial Sequence
  MKO10033996_A_Nhsl1
  gRNA
uucaucuugauaaucgucgc

SEQ ID NO: 33997 - RNA, 20 nt, Artificial Sequence
  MKO10033997_A_Nhsl2
  gRNA
gucgccaugacgaccucgag

SEQ ID NO: 33998 - RNA, 20 nt, Artificial Sequence
  MKO10033998_A_Nhsl2
  gRNA
uguagaggaacugcuucgcg

SEQ ID NO: 33999 - RNA, 20 nt, Artificial Sequence
  MKO10033999_A_Nhsl2
  gRNA
cgaggaugagaccacgaccc

SEQ ID NO: 34000 - RNA, 20 nt, Artificial Sequence
  MKO10034000_A_Nhs
  gRNA
ggaucaguuaccucuacgaa

SEQ ID NO: 34001 - RNA, 20 nt, Artificial Sequence
  MKO10034001_A_Nhs
  gRNA
ccaugcuuaccguuaggaag

SEQ ID NO: 34002 - RNA, 20 nt, Artificial Sequence
  MKO10034002_A_Nhs
  gRNA
guguauacuaccgugcacca

SEQ ID NO: 34003 - RNA, 20 nt, Artificial Sequence
  MKO10034003_A_Niacr1
  gRNA
uaauaaccgaagcacuagug

SEQ ID NO: 34004 - RNA, 20 nt, Artificial Sequence
  MKO10034004_A_Niacr1
  gRNA
ccgagaugaaaacaucgcca

SEQ ID NO: 34005 - RNA, 20 nt, Artificial Sequence
  MKO10034005_A_Niacr1
  gRNA
uggcuguggaccgcuacuuc

SEQ ID NO: 34006 - RNA, 20 nt, Artificial Sequence
  MKO10034006_A_Nicn1
  gRNA
gucgaagcggccgauccucg

SEQ ID NO: 34007 - RNA, 20 nt, Artificial Sequence
  MKO10034007_A_Nicn1
  gRNA
agagagcuuaccucaaggcg

SEQ ID NO: 34008 - RNA, 20 nt, Artificial Sequence
  MKO10034008_A_Nicn1
  gRNA
aagccacuuggggaacgcca

SEQ ID NO: 34009 - RNA, 20 nt, Artificial Sequence
  MKO10034009_A_Nid1
  gRNA
ugcugagggaaccucuccgc

SEQ ID NO: 34010 - RNA, 20 nt, Artificial Sequence
  MKO10034010_A_Nid1
  gRNA
cuuggacacaaccgauggcc

SEQ ID NO: 34011 - RNA, 20 nt, Artificial Sequence
  MKO10034011_A_Nid1
  gRNA
cauggcgaugauaccauuug

SEQ ID NO: 34012 - RNA, 20 nt, Artificial Sequence
  MKO10034012_A_Nid2
  gRNA
ggagcacgugggcgccuacg

SEQ ID NO: 34013 - RNA, 20 nt, Artificial Sequence
  MKO10034013_A_Nid2
  gRNA
augaggugccgacguccaca

SEQ ID NO: 34014 - RNA, 20 nt, Artificial Sequence
  MKO10034014_A_Nid2
  gRNA
cguuuccguaaaaccucgac

SEQ ID NO: 34015 - RNA, 20 nt, Artificial Sequence
  MKO10034015_A_Nif3l1
  gRNA
uucgcucuaucauuauugcc

SEQ ID NO: 34016 - RNA, 20 nt, Artificial Sequence
  MKO10034016_A_Nif3l1
  gRNA
aaugggacgguugugcacac

SEQ ID NO: 34017 - RNA, 20 nt, Artificial Sequence
  MKO10034017_A_Nif3l1
  gRNA
ugugaaccgcagccaagacc

SEQ ID NO: 34018 - RNA, 20 nt, Artificial Sequence
  MKO10034018_A_Nifk
  gRNA
cgauuauagcgcuucacugc

SEQ ID NO: 34019 - RNA, 20 nt, Artificial Sequence
  MKO10034019_A_Nifk
  gRNA
cagcagugaagcgcuauaau

SEQ ID NO: 34020 - RNA, 20 nt, Artificial Sequence
  MKO10034020_A_Nifk
  gRNA
aucugcuaaugucgccaaac

SEQ ID NO: 34021 - RNA, 20 nt, Artificial Sequence
  MKO10034021_A_Nim1
  gRNA
uuucgagaccaacacuacgu

SEQ ID NO: 34022 - RNA, 20 nt, Artificial Sequence
  MKO10034022_A_Nim1
  gRNA
gccauuucgagcggagaccg

SEQ ID NO: 34023 - RNA, 20 nt, Artificial Sequence
  MKO10034023_A_Nim1
  gRNA
cguccgucuuuaugaagucg

SEQ ID NO: 34024 - RNA, 20 nt, Artificial Sequence
  MKO10034024_A_Ninj1
  gRNA
gcucaacggcgaccugcgcc

SEQ ID NO: 34025 - RNA, 20 nt, Artificial Sequence
  MKO10034025_A_Ninj1
  gRNA
cgcgucgcagcugaaggccg

SEQ ID NO: 34026 - RNA, 20 nt, Artificial Sequence
  MKO10034026_A_Ninj1
  gRNA
accugggcguucuacugccg

SEQ ID NO: 34027 - RNA, 20 nt, Artificial Sequence
  MKO10034027_A_Ninj2
  gRNA
gugguguaguacuccgcgaa

SEQ ID NO: 34028 - RNA, 20 nt, Artificial Sequence
  MKO10034028_A_Ninj2
  gRNA
aaaaguucaggucuaugcgc

SEQ ID NO: 34029 - RNA, 20 nt, Artificial Sequence
  MKO10034029_A_Ninj2
  gRNA
agccauccugaaccugaaug

SEQ ID NO: 34030 - RNA, 20 nt, Artificial Sequence
  MKO10034030_A_Ninl
  gRNA
acuccggcagguuaacuuug

SEQ ID NO: 34031 - RNA, 20 nt, Artificial Sequence
  MKO10034031_A_Ninl
  gRNA
gcuguggucugccgaagcau

SEQ ID NO: 34032 - RNA, 20 nt, Artificial Sequence
  MKO10034032_A_Ninl
  gRNA
uggcguagagcccuccgaug

SEQ ID NO: 34033 - RNA, 20 nt, Artificial Sequence
  MKO10034033_A_Nin
  gRNA
aguagcgucuguugcagcac

SEQ ID NO: 34034 - RNA, 20 nt, Artificial Sequence
  MKO10034034_A_Nin
  gRNA
gcucagcccaaauauguuag

SEQ ID NO: 34035 - RNA, 20 nt, Artificial Sequence
  MKO10034035_A_Nin
  gRNA
gacagugcuugagccacuag

SEQ ID NO: 34036 - RNA, 20 nt, Artificial Sequence
  MKO10034036_A_Nip7
  gRNA
ccacaacguaccuuggcaua

SEQ ID NO: 34037 - RNA, 20 nt, Artificial Sequence
  MKO10034037_A_Nip7
  gRNA
acgaccgaguguacuaugug

SEQ ID NO: 34038 - RNA, 20 nt, Artificial Sequence
  MKO10034038_A_Nip7
  gRNA
ccgcuugcacgugacagcuc

SEQ ID NO: 34039 - RNA, 20 nt, Artificial Sequence
  MKO10034039_A_Nipa1
  gRNA
cucacccaaacgguacucca

SEQ ID NO: 34040 - RNA, 20 nt, Artificial Sequence
  MKO10034040_A_Nipa1
  gRNA
ccacgggcccaccaacauca

SEQ ID NO: 34041 - RNA, 20 nt, Artificial Sequence
  MKO10034041_A_Nipa1
  gRNA
ugcuucgacuccucuguauu

SEQ ID NO: 34042 - RNA, 20 nt, Artificial Sequence
  MKO10034042_A_Nipa2
  gRNA
gugcgcucagcguccucgua

SEQ ID NO: 34043 - RNA, 20 nt, Artificial Sequence
  MKO10034043_A_Nipa2
  gRNA
aggacgcugagcgcaccuag

SEQ ID NO: 34044 - RNA, 20 nt, Artificial Sequence
  MKO10034044_A_Nipa2
  gRNA
uucugcagcacccccucgcc

SEQ ID NO: 34045 - RNA, 20 nt, Artificial Sequence
  MKO10034045_A_Nipal1
  gRNA
uucagguucguguagacgac

SEQ ID NO: 34046 - RNA, 20 nt, Artificial Sequence
  MKO10034046_A_Nipal1
  gRNA
accaggguauguacugucgc

SEQ ID NO: 34047 - RNA, 20 nt, Artificial Sequence
  MKO10034047_A_Nipal1
  gRNA
gguuauccacgccccacaag

SEQ ID NO: 34048 - RNA, 20 nt, Artificial Sequence
  MKO10034048_A_Nipal2
  gRNA
uuacucaccuaguaaauccg

SEQ ID NO: 34049 - RNA, 20 nt, Artificial Sequence
  MKO10034049_A_Nipal2
  gRNA
acaggcaauuucgcagccua

SEQ ID NO: 34050 - RNA, 20 nt, Artificial Sequence
  MKO10034050_A_Nipal2
  gRNA
caucacucugaucgcaccac

SEQ ID NO: 34051 - RNA, 20 nt, Artificial Sequence
  MKO10034051_A_Nipal3
  gRNA
uacugccacauccgccuagc

SEQ ID NO: 34052 - RNA, 20 nt, Artificial Sequence
  MKO10034052_A_Nipal3
  gRNA
gaugaauaugauuccgauga

SEQ ID NO: 34053 - RNA, 20 nt, Artificial Sequence
  MKO10034053_A_Nipal3
  gRNA
cucagugccgucuccgugau

SEQ ID NO: 34054 - RNA, 20 nt, Artificial Sequence
  MKO10034054_A_Nipal4
  gRNA
cgucgcaggugcaaaugcau

SEQ ID NO: 34055 - RNA, 20 nt, Artificial Sequence
  MKO10034055_A_Nipal4
  gRNA
cuguggccacaagccgaaug

SEQ ID NO: 34056 - RNA, 20 nt, Artificial Sequence
  MKO10034056_A_Nipal4
  gRNA
guccucugucagaucgugag

SEQ ID NO: 34057 - RNA, 20 nt, Artificial Sequence
  MKO10034057_A_Nipbl
  gRNA
cgauauacccgucuuguugc

SEQ ID NO: 34058 - RNA, 20 nt, Artificial Sequence
  MKO10034058_A_Nipbl
  gRNA
gcuuguccauagucucaacc

SEQ ID NO: 34059 - RNA, 20 nt, Artificial Sequence
  MKO10034059_A_Nipbl
  gRNA
aaccaaauugucaucccuac

SEQ ID NO: 34060 - RNA, 20 nt, Artificial Sequence
  MKO10034060_A_Nipsnap1
  gRNA
guggagugggcguccuuccg

SEQ ID NO: 34061 - RNA, 20 nt, Artificial Sequence
  MKO10034061_A_Nipsnap1
  gRNA
ggacuaucccugcucgcuug

SEQ ID NO: 34062 - RNA, 20 nt, Artificial Sequence
  MKO10034062_A_Nipsnap1
  gRNA
caacgugaagcccgaauguc

SEQ ID NO: 34063 - RNA, 20 nt, Artificial Sequence
  MKO10034063_A_Nipsnap3a
  gRNA
uuaccuuaagcccgcaagug

SEQ ID NO: 34064 - RNA, 20 nt, Artificial Sequence
  MKO10034064_A_Nipsnap3a
  gRNA
cuuccacacuugcgggcuua

SEQ ID NO: 34065 - RNA, 20 nt, Artificial Sequence
  MKO10034065_A_Nipsnap3a
  gRNA
ggugugagaacgcagacgcu

SEQ ID NO: 34066 - RNA, 20 nt, Artificial Sequence
  MKO10034066_A_Nipsnap3b
  gRNA
uuucagagugagcuguccga

SEQ ID NO: 34067 - RNA, 20 nt, Artificial Sequence
  MKO10034067_A_Nipsnap3b
  gRNA
agagguugagauuaccuacu

SEQ ID NO: 34068 - RNA, 20 nt, Artificial Sequence
  MKO10034068_A_Nipsnap3b
  gRNA
aacugcaguccgcaaagccu

SEQ ID NO: 34069 - RNA, 20 nt, Artificial Sequence
  MKO10034069_A_Nisch
  gRNA
gguguuugaucguccacuca

SEQ ID NO: 34070 - RNA, 20 nt, Artificial Sequence
  MKO10034070_A_Nisch
  gRNA
uuaccgauggcaaccaugag

SEQ ID NO: 34071 - RNA, 20 nt, Artificial Sequence
  MKO10034071_A_Nisch
  gRNA
agguugugaggagcgucugg

SEQ ID NO: 34072 - RNA, 20 nt, Artificial Sequence
  MKO10034072_A_Nit1
  gRNA
uugggcgguuuccacgagcg

SEQ ID NO: 34073 - RNA, 20 nt, Artificial Sequence
  MKO10034073_A_Nit1
  gRNA
acgcucguggaaaccgccca

SEQ ID NO: 34074 - RNA, 20 nt, Artificial Sequence
  MKO10034074_A_Nit1
  gRNA
cugugcgauguagagauccc

SEQ ID NO: 34075 - RNA, 20 nt, Artificial Sequence
  MKO10034075_A_Nit2
  gRNA
guacguacgcguaucaaaug

SEQ ID NO: 34076 - RNA, 20 nt, Artificial Sequence
  MKO10034076_A_Nit2
  gRNA
gaaucuaaaacauugagccc

SEQ ID NO: 34077 - RNA, 20 nt, Artificial Sequence
  MKO10034077_A_Nit2
  gRNA
gguaagguuaucugauuuaa

SEQ ID NO: 34078 - RNA, 20 nt, Artificial Sequence
  MKO10034078_A_Nkain1
  gRNA
ucuuugguaccgugcaguau

SEQ ID NO: 34079 - RNA, 20 nt, Artificial Sequence
  MKO10034079_A_Nkain1
  gRNA
ggaggaccaccacgucaucu

SEQ ID NO: 34080 - RNA, 20 nt, Artificial Sequence
  MKO10034080_A_Nkain1
  gRNA
acacaucccugcaucgcucc

SEQ ID NO: 34081 - RNA, 20 nt, Artificial Sequence
  MKO10034081_A_Nkain2
  gRNA
uauagaccucguuacguaac

SEQ ID NO: 34082 - RNA, 20 nt, Artificial Sequence
  MKO10034082_A_Nkain2
  gRNA
ucccacgucggccaccgucg

SEQ ID NO: 34083 - RNA, 20 nt, Artificial Sequence
  MKO10034083_A_Nkain2
  gRNA
uauguguggcgggcgcggcu

SEQ ID NO: 34084 - RNA, 20 nt, Artificial Sequence
  MKO10034084_A_Nkain3
  gRNA
cuuaccaccaugauguaacg

SEQ ID NO: 34085 - RNA, 20 nt, Artificial Sequence
  MKO10034085_A_Nkain3
  gRNA
cgcuguacaaauacugcuau

SEQ ID NO: 34086 - RNA, 20 nt, Artificial Sequence
  MKO10034086_A_Nkain3
  gRNA
guauagaccacguuacauca

SEQ ID NO: 34087 - RNA, 20 nt, Artificial Sequence
  MKO10034087_A_Nkain4
  gRNA
cucaccaccacgauguagcg

SEQ ID NO: 34088 - RNA, 20 nt, Artificial Sequence
  MKO10034088_A_Nkain4
  gRNA
caacuucacccacaucaucg

SEQ ID NO: 34089 - RNA, 20 nt, Artificial Sequence
  MKO10034089_A_Nkain4
  gRNA
ucaccgcuagcaggaucugc

SEQ ID NO: 34090 - RNA, 20 nt, Artificial Sequence
  MKO10034090_A_Nkapl
  gRNA
cggcuagucuguaacgccga

SEQ ID NO: 34091 - RNA, 20 nt, Artificial Sequence
  MKO10034091_A_Nkapl
  gRNA
ucagaaacgacgacguuucu

SEQ ID NO: 34092 - RNA, 20 nt, Artificial Sequence
  MKO10034092_A_Nkapl
  gRNA
uggagaacgaccgcuaccgc

SEQ ID NO: 34093 - RNA, 20 nt, Artificial Sequence
  MKO10034093_A_Nkap
  gRNA
ugaugaacauacaccaguag

SEQ ID NO: 34094 - RNA, 20 nt, Artificial Sequence
  MKO10034094_A_Nkap
  gRNA
aauugggagcuccugaaguu

SEQ ID NO: 34095 - RNA, 20 nt, Artificial Sequence
  MKO10034095_A_Nkap
  gRNA
uacucugguucaggauucuu

SEQ ID NO: 34096 - RNA, 20 nt, Artificial Sequence
  MKO10034096_A_Nkd1
  gRNA
agcagacaccaaacccgcug

SEQ ID NO: 34097 - RNA, 20 nt, Artificial Sequence
  MKO10034097_A_Nkd1
  gRNA
cuauaugacuucgacaacaa

SEQ ID NO: 34098 - RNA, 20 nt, Artificial Sequence
  MKO10034098_A_Nkd1
  gRNA
ucuuaccgguaugguugaaa

SEQ ID NO: 34099 - RNA, 20 nt, Artificial Sequence
  MKO10034099_A_Nkd2
  gRNA
ggaagaaacggaccggcgcg

SEQ ID NO: 34100 - RNA, 20 nt, Artificial Sequence
  MKO10034100_A_Nkd2
  gRNA
cugcguacgggagcggucgc

SEQ ID NO: 34101 - RNA, 20 nt, Artificial Sequence
  MKO10034101_A_Nkd2
  gRNA
gaacccuugucgucccagaa

SEQ ID NO: 34102 - RNA, 20 nt, Artificial Sequence
  MKO10034102_A_Nkg7
  gRNA
agguuucauacucagcccga

SEQ ID NO: 34103 - RNA, 20 nt, Artificial Sequence
  MKO10034103_A_Nkg7
  gRNA
gugcucacuguagaacccgu

SEQ ID NO: 34104 - RNA, 20 nt, Artificial Sequence
  MKO10034104_A_Nkg7
  gRNA
gccacggccgggagcagaca

SEQ ID NO: 34105 - RNA, 20 nt, Artificial Sequence
  MKO10034105_A_Nkiras1
  gRNA
cagguggcaaucguuguguu

SEQ ID NO: 34106 - RNA, 20 nt, Artificial Sequence
  MKO10034106_A_Nkiras1
  gRNA
cugcacuuguaugacacccg

SEQ ID NO: 34107 - RNA, 20 nt, Artificial Sequence
  MKO10034107_A_Nkiras1
  gRNA
gauugaacccuucacuuuac

SEQ ID NO: 34108 - RNA, 20 nt, Artificial Sequence
  MKO10034108_A_Nkiras2
  gRNA
gcgucgcguagacccugacg

SEQ ID NO: 34109 - RNA, 20 nt, Artificial Sequence
  MKO10034109_A_Nkiras2
  gRNA
ucuugagcagcucgacgcgc

SEQ ID NO: 34110 - RNA, 20 nt, Artificial Sequence
  MKO10034110_A_Nkiras2
  gRNA
ggcuccaucgagacagaccg

SEQ ID NO: 34111 - RNA, 20 nt, Artificial Sequence
  MKO10034111_A_Nkpd1
  gRNA
ggcuacgcaccgcaucgugc

SEQ ID NO: 34112 - RNA, 20 nt, Artificial Sequence
  MKO10034112_A_Nkpd1
  gRNA
uagcaccgaguacacgcuaa

SEQ ID NO: 34113 - RNA, 20 nt, Artificial Sequence
  MKO10034113_A_Nkpd1
  gRNA
cgaucgcgggugaccccuuc

SEQ ID NO: 34114 - RNA, 20 nt, Artificial Sequence
  MKO10034114_A_Nkrf
  gRNA
auacucgacaccgccaugug

SEQ ID NO: 34115 - RNA, 20 nt, Artificial Sequence
  MKO10034115_A_Nkrf
  gRNA
uaugcuaacucguuguauuc

SEQ ID NO: 34116 - RNA, 20 nt, Artificial Sequence
  MKO10034116_A_Nkrf
  gRNA
cgcuaccuuucaaccuacga

SEQ ID NO: 34117 - RNA, 20 nt, Artificial Sequence
  MKO10034117_A_Nktr
  gRNA
cucgauuugccauugacaaa

SEQ ID NO: 34118 - RNA, 20 nt, Artificial Sequence
  MKO10034118_A_Nktr
  gRNA
aaucgagggaaacauaccaa

SEQ ID NO: 34119 - RNA, 20 nt, Artificial Sequence
  MKO10034119_A_Nktr
  gRNA
aacuuccuaugccugugcuc

SEQ ID NO: 34120 - RNA, 20 nt, Artificial Sequence
  MKO10034120_A_Nkx1-2
  gRNA
ucgagccacgcgcuaucugu

SEQ ID NO: 34121 - RNA, 20 nt, Artificial Sequence
  MKO10034121_A_Nkx1-2
  gRNA
ggccgacggcgccgugcagg

SEQ ID NO: 34122 - RNA, 20 nt, Artificial Sequence
  MKO10034122_A_Nkx1-2
  gRNA
cacgcgagcugcccucccgc

SEQ ID NO: 34123 - RNA, 20 nt, Artificial Sequence
  MKO10034123_A_Nkx2-1
  gRNA
gcccgaagcgcuguuccgca

SEQ ID NO: 34124 - RNA, 20 nt, Artificial Sequence
  MKO10034124_A_Nkx2-1
  gRNA
uccgcucgcagcguacagac

SEQ ID NO: 34125 - RNA, 20 nt, Artificial Sequence
  MKO10034125_A_Nkx2-1
  gRNA
cucauauucaugccgcucgc

SEQ ID NO: 34126 - RNA, 20 nt, Artificial Sequence
  MKO10034126_A_Nkx2-2
  gRNA
cauccgucucacgccgacac

SEQ ID NO: 34127 - RNA, 20 nt, Artificial Sequence
  MKO10034127_A_Nkx2-2
  gRNA
guccggugacucgucagccg

SEQ ID NO: 34128 - RNA, 20 nt, Artificial Sequence
  MKO10034128_A_Nkx2-2
  gRNA
gcgacaaccccuacacucgc

SEQ ID NO: 34129 - RNA, 20 nt, Artificial Sequence
  MKO10034129_A_Nkx2-3
  gRNA
ucgcccuacggcgugggcgc

SEQ ID NO: 34130 - RNA, 20 nt, Artificial Sequence
  MKO10034130_A_Nkx2-3
  gRNA
uacggcugcgccuauccgac

SEQ ID NO: 34131 - RNA, 20 nt, Artificial Sequence
  MKO10034131_A_Nkx2-3
  gRNA
aagcgucucggagaacugua

SEQ ID NO: 34132 - RNA, 20 nt, Artificial Sequence
  MKO10034132_A_Nkx2-4
  gRNA
gacgccgccgaacuucuugu

SEQ ID NO: 34133 - RNA, 20 nt, Artificial Sequence
  MKO10034133_A_Nkx2-4
  gRNA
caagaaguucggcggcguca

SEQ ID NO: 34134 - RNA, 20 nt, Artificial Sequence
  MKO10034134_A_Nkx2-4
  gRNA
cacgccuccgccguaguccc

SEQ ID NO: 34135 - RNA, 20 nt, Artificial Sequence
  MKO10034135_A_Nkx2-5
  gRNA
cuucccgucgcgcaccagca

SEQ ID NO: 34136 - RNA, 20 nt, Artificial Sequence
  MKO10034136_A_Nkx2-5
  gRNA
ggcauugagacccacgccgu

SEQ ID NO: 34137 - RNA, 20 nt, Artificial Sequence
  MKO10034137_A_Nkx2-5
  gRNA
ggaccugucugcgcgccucg

SEQ ID NO: 34138 - RNA, 20 nt, Artificial Sequence
  MKO10034138_A_Nkx2-6
  gRNA
cccacgccgcgaucggucau

SEQ ID NO: 34139 - RNA, 20 nt, Artificial Sequence
  MKO10034139_A_Nkx2-6
  gRNA
cccaaugaccgaucgcggcg

SEQ ID NO: 34140 - RNA, 20 nt, Artificial Sequence
  MKO10034140_A_Nkx2-6
  gRNA
uacuuacguggcucccccac

SEQ ID NO: 34141 - RNA, 20 nt, Artificial Sequence
  MKO10034141_A_Nkx2-9
  gRNA
guaccacuacgcggcgcagc

SEQ ID NO: 34142 - RNA, 20 nt, Artificial Sequence
  MKO10034142_A_Nkx2-9
  gRNA
ccgcguagugguacccgugc

SEQ ID NO: 34143 - RNA, 20 nt, Artificial Sequence
  MKO10034143_A_Nkx2-9
  gRNA
cauccuguucagguaaauuc

SEQ ID NO: 34144 - RNA, 20 nt, Artificial Sequence
  MKO10034144_A_Nkx3-1
  gRNA
uuccgacagcugcuuucgcu

SEQ ID NO: 34145 - RNA, 20 nt, Artificial Sequence
  MKO10034145_A_Nkx3-1
  gRNA
gcggggcuaugccggauacu

SEQ ID NO: 34146 - RNA, 20 nt, Artificial Sequence
  MKO10034146_A_Nkx3-1
  gRNA
acaccgacugaacccgaguc

SEQ ID NO: 34147 - RNA, 20 nt, Artificial Sequence
  MKO10034147_A_Nkx3-2
  gRNA
gaggcgcugcgccgaugucc

SEQ ID NO: 34148 - RNA, 20 nt, Artificial Sequence
  MKO10034148_A_Nkx3-2
  gRNA
cgcccgaaccagaacagccg

SEQ ID NO: 34149 - RNA, 20 nt, Artificial Sequence
  MKO10034149_A_Nkx3-2
  gRNA
cugggcgcuguccacgugcg

SEQ ID NO: 34150 - RNA, 20 nt, Artificial Sequence
  MKO10034150_A_Nkx6-1
  gRNA
ccggcauagagggccggcuc

SEQ ID NO: 34151 - RNA, 20 nt, Artificial Sequence
  MKO10034151_A_Nkx6-1
  gRNA
uccgaccgggcagcucggcc

SEQ ID NO: 34152 - RNA, 20 nt, Artificial Sequence
  MKO10034152_A_Nkx6-1
  gRNA
ucgcgcucaggacgagcccu

SEQ ID NO: 34153 - RNA, 20 nt, Artificial Sequence
  MKO10034153_A_Nkx6-2
  gRNA
gcuaacgagcgccaaguucg

SEQ ID NO: 34154 - RNA, 20 nt, Artificial Sequence
  MKO10034154_A_Nkx6-2
  gRNA
cgcgugccgcuugcgccacu

SEQ ID NO: 34155 - RNA, 20 nt, Artificial Sequence
  MKO10034155_A_Nkx6-2
  gRNA
uuuagccgcgcugcacaaca

SEQ ID NO: 34156 - RNA, 20 nt, Artificial Sequence
  MKO10034156_A_Nkx6-3
  gRNA
aagaguucugcaccgaguac

SEQ ID NO: 34157 - RNA, 20 nt, Artificial Sequence
  MKO10034157_A_Nkx6-3
  gRNA
cgaugaguacaacaagccgc

SEQ ID NO: 34158 - RNA, 20 nt, Artificial Sequence
  MKO10034158_A_Nkx6-3
  gRNA
ccugggcaugacggagucac

SEQ ID NO: 34159 - RNA, 20 nt, Artificial Sequence
  MKO10034159_A_Nle1
  gRNA
caucguggacguagaacgcc

SEQ ID NO: 34160 - RNA, 20 nt, Artificial Sequence
  MKO10034160_A_Nle1
  gRNA
auguccacuggcacgucgaa

SEQ ID NO: 34161 - RNA, 20 nt, Artificial Sequence
  MKO10034161_A_Nle1
  gRNA
cuccccguucgacgugccag

SEQ ID NO: 34162 - RNA, 20 nt, Artificial Sequence
  MKO10034162_A_Nlgn1
  gRNA
gugagccaaaguucgaguga

SEQ ID NO: 34163 - RNA, 20 nt, Artificial Sequence
  MKO10034163_A_Nlgn1
  gRNA
ccauaugccgcuccaccaac

SEQ ID NO: 34164 - RNA, 20 nt, Artificial Sequence
  MKO10034164_A_Nlgn1
  gRNA
aaagaacccaauguucucgc

SEQ ID NO: 34165 - RNA, 20 nt, Artificial Sequence
  MKO10034165_A_Nlgn2
  gRNA
acgcucaauccgccagacac

SEQ ID NO: 34166 - RNA, 20 nt, Artificial Sequence
  MKO10034166_A_Nlgn2
  gRNA
gucugcgccggaagucuucc

SEQ ID NO: 34167 - RNA, 20 nt, Artificial Sequence
  MKO10034167_A_Nlgn2
  gRNA
accagccgcucaaguacacg

SEQ ID NO: 34168 - RNA, 20 nt, Artificial Sequence
  MKO10034168_A_Nlgn3
  gRNA
gcaccccgacccgauaguug

SEQ ID NO: 34169 - RNA, 20 nt, Artificial Sequence
  MKO10034169_A_Nlgn3
  gRNA
gccgaucugcacgcccgcua

SEQ ID NO: 34170 - RNA, 20 nt, Artificial Sequence
  MKO10034170_A_Nlgn3
  gRNA
cucgcccuguuucuuagcgc

SEQ ID NO: 34171 - RNA, 20 nt, Artificial Sequence
  MKO10034171_A_Nlk
  gRNA
uugcaucgagacauuaagcc

SEQ ID NO: 34172 - RNA, 20 nt, Artificial Sequence
  MKO10034172_A_Nlk
  gRNA
uugaaauaucuccauucagc

SEQ ID NO: 34173 - RNA, 20 nt, Artificial Sequence
  MKO10034173_A_Nlk
  gRNA
gcccaacgucuuccagaauc

SEQ ID NO: 34174 - RNA, 20 nt, Artificial Sequence
  MKO10034174_A_Nln
  gRNA
augucuuccuacaccgccgc

SEQ ID NO: 34175 - RNA, 20 nt, Artificial Sequence
  MKO10034175_A_Nln
  gRNA
cgucauucugagccgaaucc

SEQ ID NO: 34176 - RNA, 20 nt, Artificial Sequence
  MKO10034176_A_Nln
  gRNA
auuuaaggaaacgugcgauu

SEQ ID NO: 34177 - RNA, 20 nt, Artificial Sequence
  MKO10034177_A_Nlrc3
  gRNA
acugucgcauucgaaagauc

SEQ ID NO: 34178 - RNA, 20 nt, Artificial Sequence
  MKO10034178_A_Nlrc3
  gRNA
ugggucacuuguaucgcacc

SEQ ID NO: 34179 - RNA, 20 nt, Artificial Sequence
  MKO10034179_A_Nlrc3
  gRNA
ugggcaagaccacgcuagug

SEQ ID NO: 34180 - RNA, 20 nt, Artificial Sequence
  MKO10034180_A_Nlrc4
  gRNA
uguuucgaauaguccccccc

SEQ ID NO: 34181 - RNA, 20 nt, Artificial Sequence
  MKO10034181_A_Nlrc4
  gRNA
auugaugccacacucuacga

SEQ ID NO: 34182 - RNA, 20 nt, Artificial Sequence
  MKO10034182_A_Nlrc4
  gRNA
gaaccucgagagacucauac

SEQ ID NO: 34183 - RNA, 20 nt, Artificial Sequence
  MKO10034183_A_Nlrc5
  gRNA
accucgagugacaguacuac

SEQ ID NO: 34184 - RNA, 20 nt, Artificial Sequence
  MKO10034184_A_Nlrc5
  gRNA
ugaugaccaccucccguccu

SEQ ID NO: 34185 - RNA, 20 nt, Artificial Sequence
  MKO10034185_A_Nlrc5
  gRNA
cggcucaccccagcgucuuc

SEQ ID NO: 34186 - RNA, 20 nt, Artificial Sequence
  MKO10034186_A_Nlrp10
  gRNA
cuacucaaccccgcccauag

SEQ ID NO: 34187 - RNA, 20 nt, Artificial Sequence
  MKO10034187_A_Nlrp10
  gRNA
guugaguaggacuccgccuc

SEQ ID NO: 34188 - RNA, 20 nt, Artificial Sequence
  MKO10034188_A_Nlrp10
  gRNA
auugggucacaucucguaag

SEQ ID NO: 34189 - RNA, 20 nt, Artificial Sequence
  MKO10034189_A_Nlrp12
  gRNA
ggcucggggcguucuucguc

SEQ ID NO: 34190 - RNA, 20 nt, Artificial Sequence
  MKO10034190_A_Nlrp12
  gRNA
auucgccuaaucgugcauug

SEQ ID NO: 34191 - RNA, 20 nt, Artificial Sequence
  MKO10034191_A_Nlrp12
  gRNA
gcccaaggcauuucgguaua

SEQ ID NO: 34192 - RNA, 20 nt, Artificial Sequence
  MKO10034192_A_Nlrp14
  gRNA
ccucaacguguaaagcuguc

SEQ ID NO: 34193 - RNA, 20 nt, Artificial Sequence
  MKO10034193_A_Nlrp14
  gRNA
ccugacagcuuuacacguug

SEQ ID NO: 34194 - RNA, 20 nt, Artificial Sequence
  MKO10034194_A_Nlrp14
  gRNA
cuguucaagucauucacuac

SEQ ID NO: 34195 - RNA, 20 nt, Artificial Sequence
  MKO10034195_A_Nlrp1a
  gRNA
gacauaaguuuacggccccu

SEQ ID NO: 34196 - RNA, 20 nt, Artificial Sequence
  MKO10034196_A_Nlrp1a
  gRNA
uguacgacccugagaaagcg

SEQ ID NO: 34197 - RNA, 20 nt, Artificial Sequence
  MKO10034197_A_Nlrp1a
  gRNA
acguacgaagcaaguaaaag

SEQ ID NO: 34198 - RNA, 20 nt, Artificial Sequence
  MKO10034198_A_Nlrp1b
  gRNA
cuaaaugaccugugugacga

SEQ ID NO: 34199 - RNA, 20 nt, Artificial Sequence
  MKO10034199_A_Nlrp1b
  gRNA
ugugaugccaugauauaccc

SEQ ID NO: 34200 - RNA, 20 nt, Artificial Sequence
  MKO10034200_A_Nlrp1b
  gRNA
uccuuacaccaucgucacac

SEQ ID NO: 34201 - RNA, 20 nt, Artificial Sequence
  MKO10034201_A_Nlrp2
  gRNA
guuaacaugcguuguucauc

SEQ ID NO: 34202 - RNA, 20 nt, Artificial Sequence
  MKO10034202_A_Nlrp2
  gRNA
cccagaguuucuacuaguag

SEQ ID NO: 34203 - RNA, 20 nt, Artificial Sequence
  MKO10034203_A_Nlrp2
  gRNA
ccuaaacaauuugcauccca

SEQ ID NO: 34204 - RNA, 20 nt, Artificial Sequence
  MKO10034204_A_Nlrp3
  gRNA
aaggacaggaacgcgcgucu

SEQ ID NO: 34205 - RNA, 20 nt, Artificial Sequence
  MKO10034205_A_Nlrp3
  gRNA
aggcuccgagugcccguccu

SEQ ID NO: 34206 - RNA, 20 nt, Artificial Sequence
  MKO10034206_A_Nlrp3
  gRNA
guccuccuggcauaccauag

SEQ ID NO: 34207 - RNA, 20 nt, Artificial Sequence
  MKO10034207_A_Nlrp4a
  gRNA
agacuuacacaagaacguua

SEQ ID NO: 34208 - RNA, 20 nt, Artificial Sequence
  MKO10034208_A_Nlrp4a
  gRNA
guucauagcuucuacuaaga

SEQ ID NO: 34209 - RNA, 20 nt, Artificial Sequence
  MKO10034209_A_Nlrp4a
  gRNA
uauacagggagguaguacaa

SEQ ID NO: 34210 - RNA, 20 nt, Artificial Sequence
  MKO10034210_A_Nlrp4b
  gRNA
augugauaagcgccuauucu

SEQ ID NO: 34211 - RNA, 20 nt, Artificial Sequence
  MKO10034211_A_Nlrp4b
  gRNA
agagugcaacauacgcauac

SEQ ID NO: 34212 - RNA, 20 nt, Artificial Sequence
  MKO10034212_A_Nlrp4b
  gRNA
uaacaauagcgaagaccugc

SEQ ID NO: 34213 - RNA, 20 nt, Artificial Sequence
  MKO10034213_A_Nlrp4c
  gRNA
auccuuacguccagcagugu

SEQ ID NO: 34214 - RNA, 20 nt, Artificial Sequence
  MKO10034214_A_Nlrp4c
  gRNA
cacuggcugcuucuccgugc

SEQ ID NO: 34215 - RNA, 20 nt, Artificial Sequence
  MKO10034215_A_Nlrp4c
  gRNA
aaguucuucagaacgcaguc

SEQ ID NO: 34216 - RNA, 20 nt, Artificial Sequence
  MKO10034216_A_Nlrp4e
  gRNA
uccauacaguucauaacuug

SEQ ID NO: 34217 - RNA, 20 nt, Artificial Sequence
  MKO10034217_A_Nlrp4e
  gRNA
ucaacaucuugcugcugauc

SEQ ID NO: 34218 - RNA, 20 nt, Artificial Sequence
  MKO10034218_A_Nlrp4e
  gRNA
ccuuucaccugaugacugca

SEQ ID NO: 34219 - RNA, 20 nt, Artificial Sequence
  MKO10034219_A_Nlrp4f
  gRNA
gagguccaaguauugcaaac

SEQ ID NO: 34220 - RNA, 20 nt, Artificial Sequence
  MKO10034220_A_Nlrp4f
  gRNA
gaugagcagcaagucguuga

SEQ ID NO: 34221 - RNA, 20 nt, Artificial Sequence
  MKO10034221_A_Nlrp4f
  gRNA
guauguucuuggacaaccgg

SEQ ID NO: 34222 - RNA, 20 nt, Artificial Sequence
  MKO10034222_A_Nlrp4g
  gRNA
auauucauacaagauucgaa

SEQ ID NO: 34223 - RNA, 20 nt, Artificial Sequence
  MKO10034223_A_Nlrp4g
  gRNA
guuguagauucuuccccucu

SEQ ID NO: 34224 - RNA, 20 nt, Artificial Sequence
  MKO10034224_A_Nlrp4g
  gRNA
cuugggcucugaucuuaucu

SEQ ID NO: 34225 - RNA, 20 nt, Artificial Sequence
  MKO10034225_A_Nlrp5
  gRNA
gaagaaguggaacaggcguc

SEQ ID NO: 34226 - RNA, 20 nt, Artificial Sequence
  MKO10034226_A_Nlrp5
  gRNA
cuucugauccacugucuuuc

SEQ ID NO: 34227 - RNA, 20 nt, Artificial Sequence
  MKO10034227_A_Nlrp5
  gRNA
cuccauugcagaaagcacaa

SEQ ID NO: 34228 - RNA, 20 nt, Artificial Sequence
  MKO10034228_A_Nlrp6
  gRNA
guccgagcgccgagcgcguu

SEQ ID NO: 34229 - RNA, 20 nt, Artificial Sequence
  MKO10034229_A_Nlrp6
  gRNA
caccaauggaccccggguuc

SEQ ID NO: 34230 - RNA, 20 nt, Artificial Sequence
  MKO10034230_A_Nlrp6
  gRNA
cucgaauauccgaccucuuc

SEQ ID NO: 34231 - RNA, 20 nt, Artificial Sequence
  MKO10034231_A_Nlrp9a
  gRNA
aacagaacagggcccguaua

SEQ ID NO: 34232 - RNA, 20 nt, Artificial Sequence
  MKO10034232_A_Nlrp9a
  gRNA
agagagguagcaagucguuu

SEQ ID NO: 34233 - RNA, 20 nt, Artificial Sequence
  MKO10034233_A_Nlrp9a
  gRNA
uuaaacuuaaaccuaucucc

SEQ ID NO: 34234 - RNA, 20 nt, Artificial Sequence
  MKO10034234_A_Nlrp9b
  gRNA
gcagaaauacagccgaauau

SEQ ID NO: 34235 - RNA, 20 nt, Artificial Sequence
  MKO10034235_A_Nlrp9b
  gRNA
gcagcaauccuuaucuaugc

SEQ ID NO: 34236 - RNA, 20 nt, Artificial Sequence
  MKO10034236_A_Nlrp9b
  gRNA
ugggauaucugaauccgaua

SEQ ID NO: 34237 - RNA, 20 nt, Artificial Sequence
  MKO10034237_A_Nlrp9c
  gRNA
gcagcaauccuaguauguug

SEQ ID NO: 34238 - RNA, 20 nt, Artificial Sequence
  MKO10034238_A_Nlrp9c
  gRNA
uuuguauugacgaucuauaa

SEQ ID NO: 34239 - RNA, 20 nt, Artificial Sequence
  MKO10034239_A_Nlrp9c
  gRNA
gaaauguucaacaugucgag

SEQ ID NO: 34240 - RNA, 20 nt, Artificial Sequence
  MKO10034240_A_Nlrx1
  gRNA
aucgccggaaccucaccgag

SEQ ID NO: 34241 - RNA, 20 nt, Artificial Sequence
  MKO10034241_A_Nlrx1
  gRNA
cggugaacacgaagguaccc

SEQ ID NO: 34242 - RNA, 20 nt, Artificial Sequence
  MKO10034242_A_Nlrx1
  gRNA
ucgggaugacacgcccucgu

SEQ ID NO: 34243 - RNA, 20 nt, Artificial Sequence
  MKO10034243_A_Nmbr
  gRNA
gacauuccgcauggcgcugu

SEQ ID NO: 34244 - RNA, 20 nt, Artificial Sequence
  MKO10034244_A_Nmbr
  gRNA
accacguccucuacuuguau

SEQ ID NO: 34245 - RNA, 20 nt, Artificial Sequence
  MKO10034245_A_Nmbr
  gRNA
accggacgucugcaugucca

SEQ ID NO: 34246 - RNA, 20 nt, Artificial Sequence
  MKO10034246_A_Nmb
  gRNA
gcaagauucgagugcacccu

SEQ ID NO: 34247 - RNA, 20 nt, Artificial Sequence
  MKO10034247_A_Nmb
  gRNA
aacacuuaccggucgcccag

SEQ ID NO: 34248 - RNA, 20 nt, Artificial Sequence
  MKO10034248_A_Nmb
  gRNA
cagcacccccuaacaccccg

SEQ ID NO: 34249 - RNA, 20 nt, Artificial Sequence
  MKO10034249_A_Nmd3
  gRNA
aagguucggcuugucgaugc

SEQ ID NO: 34250 - RNA, 20 nt, Artificial Sequence
  MKO10034250_A_Nmd3
  gRNA
gucaacuuuacuucguaaac

SEQ ID NO: 34251 - RNA, 20 nt, Artificial Sequence
  MKO10034251_A_Nmd3
  gRNA
uacugaccuaccuuacucag

SEQ ID NO: 34252 - RNA, 20 nt, Artificial Sequence
  MKO10034252_A_Nme1
  gRNA
cagaagggguuccgccuugu

SEQ ID NO: 34253 - RNA, 20 nt, Artificial Sequence
  MKO10034253_A_Nme1
  gRNA
aagucuccucguaugguccc

SEQ ID NO: 34254 - RNA, 20 nt, Artificial Sequence
  MKO10034254_A_Nme1
  gRNA
aaggaccgccccuucuuuac

SEQ ID NO: 34255 - RNA, 20 nt, Artificial Sequence
  MKO10034255_A_Nme2
  gRNA
uguuacccgaaggaacuuca

SEQ ID NO: 34256 - RNA, 20 nt, Artificial Sequence
  MKO10034256_A_Nme2
  gRNA
uggugggcgagaucaucaaa

SEQ ID NO: 34257 - RNA, 20 nt, Artificial Sequence
  MKO10034257_A_Nme2
  gRNA
agcacucaccauggccacca

SEQ ID NO: 34258 - RNA, 20 nt, Artificial Sequence
  MKO10034258_A_Nme3
  gRNA
cgugaacgagcgcacguucu

SEQ ID NO: 34259 - RNA, 20 nt, Artificial Sequence
  MKO10034259_A_Nme3
  gRNA
ugaagcccgacggcgugcag

SEQ ID NO: 34260 - RNA, 20 nt, Artificial Sequence
  MKO10034260_A_Nme3
  gRNA
gaaacccuucuacagccgac

SEQ ID NO: 34261 - RNA, 20 nt, Artificial Sequence
  MKO10034261_A_Nme4
  gRNA
cauccacagaaucgcuagca

SEQ ID NO: 34262 - RNA, 20 nt, Artificial Sequence
  MKO10034262_A_Nme4
  gRNA
cagcaaccagcguccgcucu

SEQ ID NO: 34263 - RNA, 20 nt, Artificial Sequence
  MKO10034263_A_Nme4
  gRNA
cugugauacaacgcuuugag

SEQ ID NO: 34264 - RNA, 20 nt, Artificial Sequence
  MKO10034264_A_Nme5
  gRNA
ucuagcuuaagggcgauaua

SEQ ID NO: 34265 - RNA, 20 nt, Artificial Sequence
  MKO10034265_A_Nme5
  gRNA
guagcgccaacccuacuuca

SEQ ID NO: 34266 - RNA, 20 nt, Artificial Sequence
  MKO10034266_A_Nme5
  gRNA
gaaccugaucucucgcucug

SEQ ID NO: 34267 - RNA, 20 nt, Artificial Sequence
  MKO10034267_A_Nme6
  gRNA
aguuccucauuguacgaacg

SEQ ID NO: 34268 - RNA, 20 nt, Artificial Sequence
  MKO10034268_A_Nme6
  gRNA
gacacccgaaauacuaccca

SEQ ID NO: 34269 - RNA, 20 nt, Artificial Sequence
  MKO10034269_A_Nme6
  gRNA
guucccucguucguacaaug

SEQ ID NO: 34270 - RNA, 20 nt, Artificial Sequence
  MKO10034270_A_Nme7
  gRNA
aucgucgcaccuucuuaaag

SEQ ID NO: 34271 - RNA, 20 nt, Artificial Sequence
  MKO10034271_A_Nme7
  gRNA
ccaauacacagcccgccagc

SEQ ID NO: 34272 - RNA, 20 nt, Artificial Sequence
  MKO10034272_A_Nme7
  gRNA
aaaacagcagcucauagcgu

SEQ ID NO: 34273 - RNA, 20 nt, Artificial Sequence
  MKO10034273_A_Nme8
  gRNA
ucgucaauagucagaacuug

SEQ ID NO: 34274 - RNA, 20 nt, Artificial Sequence
  MKO10034274_A_Nme8
  gRNA
aaagcgugaaguccagcuac

SEQ ID NO: 34275 - RNA, 20 nt, Artificial Sequence
  MKO10034275_A_Nme8
  gRNA
cacauuuaucucuaaauggc

SEQ ID NO: 34276 - RNA, 20 nt, Artificial Sequence
  MKO10034276_A_Nme9
  gRNA
ggcaguuguggacgucuacc

SEQ ID NO: 34277 - RNA, 20 nt, Artificial Sequence
  MKO10034277_A_Nme9
  gRNA
ggcagaccgccuugauguuc

SEQ ID NO: 34278 - RNA, 20 nt, Artificial Sequence
  MKO10034278_A_Nme9
  gRNA
cuuaaugaugcccaauguac

SEQ ID NO: 34279 - RNA, 20 nt, Artificial Sequence
  MKO10034279_A_Nmi
  gRNA
cgcacaaaaugugauaucga

SEQ ID NO: 34280 - RNA, 20 nt, Artificial Sequence
  MKO10034280_A_Nmi
  gRNA
cggcggcgaaguggaaagcg

SEQ ID NO: 34281 - RNA, 20 nt, Artificial Sequence
  MKO10034281_A_Nmi
  gRNA
cacuucgccgccgccauucc

SEQ ID NO: 34282 - RNA, 20 nt, Artificial Sequence
  MKO10034282_A_Nmnau1
  gRNA
ggaggacaucacgcaaaucg

SEQ ID NO: 34283 - RNA, 20 nt, Artificial Sequence
  MKO10034283_A_Nmnau1
  gRNA
gggccagagcauccgcuacu

SEQ ID NO: 34284 - RNA, 20 nt, Artificial Sequence
  MKO10034284_A_Nmnau1
  gRNA
uucuuguacgcaucaccgac

SEQ ID NO: 34285 - RNA, 20 nt, Artificial Sequence
  MKO10034285_A_Nmnau2
  gRNA
ugcuguggcuguccgaucac

SEQ ID NO: 34286 - RNA, 20 nt, Artificial Sequence
  MKO10034286_A_Nmnau2
  gRNA
cauggaagguguguugacgu

SEQ ID NO: 34287 - RNA, 20 nt, Artificial Sequence
  MKO10034287_A_Nmnau2
  gRNA
ucuccgguccaugacuccua

SEQ ID NO: 34288 - RNA, 20 nt, Artificial Sequence
  MKO10034288_A_Nmnau3
  gRNA
ucuacaucaaugacgguucc

SEQ ID NO: 34289 - RNA, 20 nt, Artificial Sequence
  MKO10034289_A_Nmnau3
  gRNA
ucggcuuggugugcgugagc

SEQ ID NO: 34290 - RNA, 20 nt, Artificial Sequence
  MKO10034290_A_Nmnau3
  gRNA
uggccaccucaaacaagcgc

SEQ ID NO: 34291 - RNA, 20 nt, Artificial Sequence
  MKO10034291_A_Nmral1
  gRNA
cucuucacaggugcgcaagg

SEQ ID NO: 34292 - RNA, 20 nt, Artificial Sequence
  MKO10034292_A_Nmral1
  gRNA
gaggaauacuuccgagacau

SEQ ID NO: 34293 - RNA, 20 nt, Artificial Sequence
  MKO10034293_A_Nmral1
  gRNA
agccgaucuagccaaacgcu

SEQ ID NO: 34294 - RNA, 20 nt, Artificial Sequence
  MKO10034294_A_Nmrk1
  gRNA
agugcuugaagcgcuaaaua

SEQ ID NO: 34295 - RNA, 20 nt, Artificial Sequence
  MKO10034295_A_Nmrk1
  gRNA
guaggccucuggacaccaua

SEQ ID NO: 34296 - RNA, 20 nt, Artificial Sequence
  MKO10034296_A_Nmrk1
  gRNA
gcagccuuggaaagugcuca

SEQ ID NO: 34297 - RNA, 20 nt, Artificial Sequence
  MKO10034297_A_Nmrk2
  gRNA
cguccucuccgacugcuauu

SEQ ID NO: 34298 - RNA, 20 nt, Artificial Sequence
  MKO10034298_A_Nmrk2
  gRNA
cuuccugaccgugccguaug

SEQ ID NO: 34299 - RNA, 20 nt, Artificial Sequence
  MKO10034299_A_Nmrk2
  gRNA
caacugcugcgugauccauc

SEQ ID NO: 34300 - RNA, 20 nt, Artificial Sequence
  MKO10034300_A_Nms
  gRNA
guacggaccucagcgcuaac

SEQ ID NO: 34301 - RNA, 20 nt, Artificial Sequence
  MKO10034301_A_Nms
  gRNA
augugucgguuuccgaguuc

SEQ ID NO: 34302 - RNA, 20 nt, Artificial Sequence
  MKO10034302_A_Nms
  gRNA
ccuuuagcugauucucccga

SEQ ID NO: 34303 - RNA, 20 nt, Artificial Sequence
  MKO10034303_A_Nmt1
  gRNA
guaaacggagcuaccaguuc

SEQ ID NO: 34304 - RNA, 20 nt, Artificial Sequence
  MKO10034304_A_Nmt1
  gRNA
cuuccacguaguucucguuc

SEQ ID NO: 34305 - RNA, 20 nt, Artificial Sequence
  MKO10034305_A_Nmt1
  gRNA
gaacugguagcuccguuuac

SEQ ID NO: 34306 - RNA, 20 nt, Artificial Sequence
  MKO10034306_A_Nmt2
  gRNA
cugcauagcacaacgccauc

SEQ ID NO: 34307 - RNA, 20 nt, Artificial Sequence
  MKO10034307_A_Nmt2
  gRNA
agcuuacucaauuugggcac

SEQ ID NO: 34308 - RNA, 20 nt, Artificial Sequence
  MKO10034308_A_Nmt2
  gRNA
cuccccagguggugauacua

SEQ ID NO: 34309 - RNA, 20 nt, Artificial Sequence
  MKO10034309_A_Nmur1
  gRNA
cgacucagcuauauguucgc

SEQ ID NO: 34310 - RNA, 20 nt, Artificial Sequence
  MKO10034310_A_Nmur1
  gRNA
gcccaugugcgccgcauggu

SEQ ID NO: 34311 - RNA, 20 nt, Artificial Sequence
  MKO10034311_A_Nmur1
  gRNA
uccaugcugaccguaucaug

SEQ ID NO: 34312 - RNA, 20 nt, Artificial Sequence
  MKO10034312_A_Nmur2
  gRNA
guagcgcucaaugcuaaccg

SEQ ID NO: 34313 - RNA, 20 nt, Artificial Sequence
  MKO10034313_A_Nmur2
  gRNA
gcacacggcgacgggcccuc

SEQ ID NO: 34314 - RNA, 20 nt, Artificial Sequence
  MKO10034314_A_Nmur2
  gRNA
caacauuccgaaaggccgcc

SEQ ID NO: 34315 - RNA, 20 nt, Artificial Sequence
  MKO10034315_A_Nmu
  gRNA
ugcaaucuuugaggugauau

SEQ ID NO: 34316 - RNA, 20 nt, Artificial Sequence
  MKO10034316_A_Nmu
  gRNA
gugagaaagauaauacuaag

SEQ ID NO: 34317 - RNA, 20 nt, Artificial Sequence
  MKO10034317_A_Nmu
  gRNA
cuuaggcaucuguugcacug

SEQ ID NO: 34318 - RNA, 20 nt, Artificial Sequence
  MKO10034318_A_Nnau
  gRNA
cgcacacggugucccggacc

SEQ ID NO: 34319 - RNA, 20 nt, Artificial Sequence
  MKO10034319_A_Nnau
  gRNA
acagcccauugcgagaagug

SEQ ID NO: 34320 - RNA, 20 nt, Artificial Sequence
  MKO10034320_A_Nnau
  gRNA
guauaccucacuucucgcaa

SEQ ID NO: 34321 - RNA, 20 nt, Artificial Sequence
  MKO10034321_A_Nnmt
  gRNA
gugcgauaggccgggagguc

SEQ ID NO: 34322 - RNA, 20 nt, Artificial Sequence
  MKO10034322_A_Nnmt
  gRNA
ucccuaguggggcgaaagcc

SEQ ID NO: 34323 - RNA, 20 nt, Artificial Sequence
  MKO10034323_A_Nnmt
  gRNA
gaccacuggggaccagucaa

SEQ ID NO: 34324 - RNA, 20 nt, Artificial Sequence
  MKO10034324_A_Nnt
  gRNA
gcuucgugagcgccuaacgu

SEQ ID NO: 34325 - RNA, 20 nt, Artificial Sequence
  MKO10034325_A_Nnt
  gRNA
aauuggggauccgaaacguu

SEQ ID NO: 34326 - RNA, 20 nt, Artificial Sequence
  MKO10034326_A_Nnt
  gRNA
augcaacucgcuucucguuu

SEQ ID NO: 34327 - RNA, 20 nt, Artificial Sequence
  MKO10034327_A_Noa1
  gRNA
agcccgaauagauuuccuac

SEQ ID NO: 34328 - RNA, 20 nt, Artificial Sequence
  MKO10034328_A_Noa1
  gRNA
ugggcgucuuucacguccuc

SEQ ID NO: 34329 - RNA, 20 nt, Artificial Sequence
  MKO10034329_A_Noa1
  gRNA
gcaaauagagcuaaccccag

SEQ ID NO: 34330 - RNA, 20 nt, Artificial Sequence
  MKO10034330_A_Nob1
  gRNA
ggugcgagagauucgcgaca

SEQ ID NO: 34331 - RNA, 20 nt, Artificial Sequence
  MKO10034331_A_Nob1
  gRNA
ccgauccacugcuucuugua

SEQ ID NO: 34332 - RNA, 20 nt, Artificial Sequence
  MKO10034332_A_Nob1
  gRNA
gaaucucucgcaccaccucc

SEQ ID NO: 34333 - RNA, 20 nt, Artificial Sequence
  MKO10034333_A_Nobox
  gRNA
acccgaacccuguaccgcuc

SEQ ID NO: 34334 - RNA, 20 nt, Artificial Sequence
  MKO10034334_A_Nobox
  gRNA
aggacuaaccugagcgguac

SEQ ID NO: 34335 - RNA, 20 nt, Artificial Sequence
  MKO10034335_A_Nobox
  gRNA
gccacugucgaagaccucug

SEQ ID NO: 34336 - RNA, 20 nt, Artificial Sequence
  MKO10034336_A_Noc2l
  gRNA
gccccgcguaccguccugcg

SEQ ID NO: 34337 - RNA, 20 nt, Artificial Sequence
  MKO10034337_A_Noc2l
  gRNA
ucagaggcgcggcccuuacg

SEQ ID NO: 34338 - RNA, 20 nt, Artificial Sequence
  MKO10034338_A_Noc2l
  gRNA
gacagugacgcguugcccag

SEQ ID NO: 34339 - RNA, 20 nt, Artificial Sequence
  MKO10034339_A_Noc3l
  gRNA
gucuaaaaaacccauuccgc

SEQ ID NO: 34340 - RNA, 20 nt, Artificial Sequence
  MKO10034340_A_Noc3l
  gRNA
aagaacucugcaaaccgcac

SEQ ID NO: 34341 - RNA, 20 nt, Artificial Sequence
  MKO10034341_A_Noc3l
  gRNA
uuuaucaacuugcgaaagcu

SEQ ID NO: 34342 - RNA, 20 nt, Artificial Sequence
  MKO10034342_A_Noc4l
  gRNA
cucgcugccgagcgaagaca

SEQ ID NO: 34343 - RNA, 20 nt, Artificial Sequence
  MKO10034343_A_Noc4l
  gRNA
cagcugcuguaaccgccuag

SEQ ID NO: 34344 - RNA, 20 nt, Artificial Sequence
  MKO10034344_A_Noc4l
  gRNA
cauccgguaccacacaaugc

SEQ ID NO: 34345 - RNA, 20 nt, Artificial Sequence
  MKO10034345_A_Nod1
  gRNA
accugcgcgccuaugcccgc

SEQ ID NO: 34346 - RNA, 20 nt, Artificial Sequence
  MKO10034346_A_Nod1
  gRNA
cuucgaccugagccgcgugc

SEQ ID NO: 34347 - RNA, 20 nt, Artificial Sequence
  MKO10034347_A_Nod1
  gRNA
cgucaaccagaucaccgaca

SEQ ID NO: 34348 - RNA, 20 nt, Artificial Sequence
  MKO10034348_A_Nod2
  gRNA
acaucguccugagcgacauc

SEQ ID NO: 34349 - RNA, 20 nt, Artificial Sequence
  MKO10034349_A_Nod2
  gRNA
ggcacgugcccgcucguguc

SEQ ID NO: 34350 - RNA, 20 nt, Artificial Sequence
  MKO10034350_A_Nod2
  gRNA
uacguacccucguaaggcag

SEQ ID NO: 34351 - RNA, 20 nt, Artificial Sequence
  MKO10034351_A_Nodal
  gRNA
gggguugguaucguuucagc

SEQ ID NO: 34352 - RNA, 20 nt, Artificial Sequence
  MKO10034352_A_Nodal
  gRNA
cugcggaugauguccgcccg

SEQ ID NO: 34353 - RNA, 20 nt, Artificial Sequence
  MKO10034353_A_Nodal
  gRNA
guacaaugccuaucgcugug

SEQ ID NO: 34354 - RNA, 20 nt, Artificial Sequence
  MKO10034354_A_Nog
  gRNA
cugcccaccuucacguagcg

SEQ ID NO: 34355 - RNA, 20 nt, Artificial Sequence
  MKO10034355_A_Nog
  gRNA
augaccuaggcagccgcuuu

SEQ ID NO: 34356 - RNA, 20 nt, Artificial Sequence
  MKO10034356_A_Nog
  gRNA
gccaugccgagcgagaucaa

SEQ ID NO: 34357 - RNA, 20 nt, Artificial Sequence
  MKO10034357_A_Nol10
  gRNA
uaggagaauugaacuuauuc

SEQ ID NO: 34358 - RNA, 20 nt, Artificial Sequence
  MKO10034358_A_Nol10
  gRNA
uacuguguguacuacuauca

SEQ ID NO: 34359 - RNA, 20 nt, Artificial Sequence
  MKO10034359_A_Nol10
  gRNA
acugauaugugucauaacac

SEQ ID NO: 34360 - RNA, 20 nt, Artificial Sequence
  MKO10034360_A_Nol11
  gRNA
agccgaccaguuccuaguga

SEQ ID NO: 34361 - RNA, 20 nt, Artificial Sequence
  MKO10034361_A_Nol11
  gRNA
cgaaucugucauaccugaug

SEQ ID NO: 34362 - RNA, 20 nt, Artificial Sequence
  MKO10034362_A_Nol11
  gRNA
uccugccgcuguccgucacu

SEQ ID NO: 34363 - RNA, 20 nt, Artificial Sequence
  MKO10034363_A_Nol12
  gRNA
gcggaagguagagcgcaaga

SEQ ID NO: 34364 - RNA, 20 nt, Artificial Sequence
  MKO10034364_A_Nol12
  gRNA
cuagcagccgggccccugag

SEQ ID NO: 34365 - RNA, 20 nt, Artificial Sequence
  MKO10034365_A_Nol12
  gRNA
ucuugcagggaguaccugac

SEQ ID NO: 34366 - RNA, 20 nt, Artificial Sequence
  MKO10034366_A_Nol3
  gRNA
aacagugcgcaugccagacc

SEQ ID NO: 34367 - RNA, 20 nt, Artificial Sequence
  MKO10034367_A_Nol3
  gRNA
cgcauccaaggcuucguacu

SEQ ID NO: 34368 - RNA, 20 nt, Artificial Sequence
  MKO10034368_A_Nol3
  gRNA
cgagcccgacuuccaagaag

SEQ ID NO: 34369 - RNA, 20 nt, Artificial Sequence
  MKO10034369_A_Nol4
  gRNA
aaccgugucaccgcuucucu

SEQ ID NO: 34370 - RNA, 20 nt, Artificial Sequence
  MKO10034370_A_Nol4
  gRNA
ggccgaauggagagcaaauc

SEQ ID NO: 34371 - RNA, 20 nt, Artificial Sequence
  MKO10034371_A_Nol4
  gRNA
ccuuugugauccguuccauc

SEQ ID NO: 34372 - RNA, 20 nt, Artificial Sequence
  MKO10034372_A_Nol6
  gRNA
ccgcaagcgagcccuuuacc

SEQ ID NO: 34373 - RNA, 20 nt, Artificial Sequence
  MKO10034373_A_Nol6
  gRNA
uaugcgaccagauaucaaug

SEQ ID NO: 34374 - RNA, 20 nt, Artificial Sequence
  MKO10034374_A_Nol6
  gRNA
gugauggaacuugccuucga

SEQ ID NO: 34375 - RNA, 20 nt, Artificial Sequence
  MKO10034375_A_Nol7
  gRNA
cagggauaaaacgcuguuga

SEQ ID NO: 34376 - RNA, 20 nt, Artificial Sequence
  MKO10034376_A_Nol7
  gRNA
ggagcuguucaucgaacaga

SEQ ID NO: 34377 - RNA, 20 nt, Artificial Sequence
  MKO10034377_A_Nol7
  gRNA
aaaucaccagaaaacguaaa

SEQ ID NO: 34378 - RNA, 20 nt, Artificial Sequence
  MKO10034378_A_Nol8
  gRNA
auuuggagaaguuucugacg

SEQ ID NO: 34379 - RNA, 20 nt, Artificial Sequence
  MKO10034379_A_Nol8
  gRNA
aucacucggaaagaugacca

SEQ ID NO: 34380 - RNA, 20 nt, Artificial Sequence
  MKO10034380_A_Nol8
  gRNA
gaaggacucacuuuaugccc

SEQ ID NO: 34381 - RNA, 20 nt, Artificial Sequence
  MKO10034381_A_Nol9
  gRNA
ucgagcugcgacgccugcga

SEQ ID NO: 34382 - RNA, 20 nt, Artificial Sequence
  MKO10034382_A_Nol9
  gRNA
cgcggacgcggugcauggcg

SEQ ID NO: 34383 - RNA, 20 nt, Artificial Sequence
  MKO10034383_A_Nol9
  gRNA
caauuaccuaguuucgugua

SEQ ID NO: 34384 - RNA, 20 nt, Artificial Sequence
  MKO10034384_A_Nolc1
  gRNA
agucagaccuccugcgaaga

SEQ ID NO: 34385 - RNA, 20 nt, Artificial Sequence
  MKO10034385_A_Nolc1
  gRNA
gagcucucugccuucuucgc

SEQ ID NO: 34386 - RNA, 20 nt, Artificial Sequence
  MKO10034386_A_Nolc1
  gRNA
acuggcucgcuugaccugug

SEQ ID NO: 34387 - RNA, 20 nt, Artificial Sequence
  MKO10034387_A_Nom1
  gRNA
aguacaucccuccucggcug

SEQ ID NO: 34388 - RNA, 20 nt, Artificial Sequence
  MKO10034388_A_Nom1
  gRNA
guaccucuauuccgaccgug

SEQ ID NO: 34389 - RNA, 20 nt, Artificial Sequence
  MKO10034389_A_Nom1
  gRNA
auguuaaaggccuaauuaac

SEQ ID NO: 34390 - RNA, 20 nt, Artificial Sequence
  MKO10034390_A_Nomo1
  gRNA
ugugagcgacaucugcacga

SEQ ID NO: 34391 - RNA, 20 nt, Artificial Sequence
  MKO10034391_A_Nomo1
  gRNA
aucauaaaguagccguuguu

SEQ ID NO: 34392 - RNA, 20 nt, Artificial Sequence
  MKO10034392_A_Nomo1
  gRNA
agucagcaccggugcuucuc

SEQ ID NO: 34393 - RNA, 20 nt, Artificial Sequence
  MKO10034393_A_Nono
  gRNA
uacuuacguagucagcaaga

SEQ ID NO: 34394 - RNA, 20 nt, Artificial Sequence
  MKO10034394_A_Nono
  gRNA
ccacacacuuguggaauugc

SEQ ID NO: 34395 - RNA, 20 nt, Artificial Sequence
  MKO10034395_A_Nono
  gRNA
aguucguucgacacguacug

SEQ ID NO: 34396 - RNA, 20 nt, Artificial Sequence
  MKO10034396_A_Nop10
  gRNA
cgaucgcguuuauacgcuga

SEQ ID NO: 34397 - RNA, 20 nt, Artificial Sequence
  MKO10034397_A_Nop10
  gRNA
cgcgaucgcccugcucguug

SEQ ID NO: 34398 - RNA, 20 nt, Artificial Sequence
  MKO10034398_A_Nop10
  gRNA
uuaacgagcccucagaggac

SEQ ID NO: 34399 - RNA, 20 nt, Artificial Sequence
  MKO10034399_A_Nop14
  gRNA
guguucgcagacaaacgcuu

SEQ ID NO: 34400 - RNA, 20 nt, Artificial Sequence
  MKO10034400_A_Nop14
  gRNA
gcguuugucugcgaacacau

SEQ ID NO: 34401 - RNA, 20 nt, Artificial Sequence
  MKO10034401_A_Nop14
  gRNA
aucaguuccuuccgugucuu

SEQ ID NO: 34402 - RNA, 20 nt, Artificial Sequence
  MKO10034402_A_Nop16
  gRNA
uguaccgcacauagucgaug

SEQ ID NO: 34403 - RNA, 20 nt, Artificial Sequence
  MKO10034403_A_Nop16
  gRNA
guucccacauacgacaugcc

SEQ ID NO: 34404 - RNA, 20 nt, Artificial Sequence
  MKO10034404_A_Nop16
  gRNA
uagacacggaggagcgaccc

SEQ ID NO: 34405 - RNA, 20 nt, Artificial Sequence
  MKO10034405_A_Nop2
  gRNA
ggcgcuucuuaccucgagcc

SEQ ID NO: 34406 - RNA, 20 nt, Artificial Sequence
  MKO10034406_A_Nop2
  gRNA
ugucgagucgugcccgaaag

SEQ ID NO: 34407 - RNA, 20 nt, Artificial Sequence
  MKO10034407_A_Nop2
  gRNA
ggcacgacucgacagccucu

SEQ ID NO: 34408 - RNA, 20 nt, Artificial Sequence
  MKO10034408_A_Nop56
  gRNA
uuaccugacgcgcaucgaga

SEQ ID NO: 34409 - RNA, 20 nt, Artificial Sequence
  MKO10034409_A_Nop56
  gRNA
auaccuucucgaugcgcguc

SEQ ID NO: 34410 - RNA, 20 nt, Artificial Sequence
  MKO10034410_A_Nop56
  gRNA
auuccacaaugucguucguc

SEQ ID NO: 34411 - RNA, 20 nt, Artificial Sequence
  MKO10034411_A_Nop58
  gRNA
gucgcugaugcuaaacuagg

SEQ ID NO: 34412 - RNA, 20 nt, Artificial Sequence
  MKO10034412_A_Nop58
  gRNA
guuguuaaugaacuuaugag

SEQ ID NO: 34413 - RNA, 20 nt, Artificial Sequence
  MKO10034413_A_Nop58
  gRNA
gugggccaauccaagacaca

SEQ ID NO: 34414 - RNA, 20 nt, Artificial Sequence
  MKO10034414_A_Nop9
  gRNA
gcgccccaacuugcgcuucg

SEQ ID NO: 34415 - RNA, 20 nt, Artificial Sequence
  MKO10034415_A_Nop9
  gRNA
gagcggcccacacucgacac

SEQ ID NO: 34416 - RNA, 20 nt, Artificial Sequence
  MKO10034416_A_Nop9
  gRNA
aaccuucuugaaucgccuuc

SEQ ID NO: 34417 - RNA, 20 nt, Artificial Sequence
  MKO10034417_A_Nos1ap
  gRNA
acucacccggauucugcgca

SEQ ID NO: 34418 - RNA, 20 nt, Artificial Sequence
  MKO10034418_A_Nos1ap
  gRNA
ugaugcaggacccuaucuac

SEQ ID NO: 34419 - RNA, 20 nt, Artificial Sequence
  MKO10034419_A_Nos1ap
  gRNA
agggcucuuaccuguagaua

SEQ ID NO: 34420 - RNA, 20 nt, Artificial Sequence
  MKO10034420_A_Nos1
  gRNA
cccguauucagagaacgaac

SEQ ID NO: 34421 - RNA, 20 nt, Artificial Sequence
  MKO10034421_A_Nos1
  gRNA
cggaacgccucucgcugugu

SEQ ID NO: 34422 - RNA, 20 nt, Artificial Sequence
  MKO10034422_A_Nos1
  gRNA
acagcgagaggcguuccgcc

SEQ ID NO: 34423 - RNA, 20 nt, Artificial Sequence
  MKO10034423_A_Nos2
  gRNA
cgacccguccacaguaugug

SEQ ID NO: 34424 - RNA, 20 nt, Artificial Sequence
  MKO10034424_A_Nos2
  gRNA
aggaaugccccucgcugcau

SEQ ID NO: 34425 - RNA, 20 nt, Artificial Sequence
  MKO10034425_A_Nos2
  gRNA
gcagcgaggggcauuccucc

SEQ ID NO: 34426 - RNA, 20 nt, Artificial Sequence
  MKO10034426_A_Nos3
  gRNA
acaacagccccccgcuaacc

SEQ ID NO: 34427 - RNA, 20 nt, Artificial Sequence
  MKO10034427_A_Nos3
  gRNA
acagcggggagcauugcgcc

SEQ ID NO: 34428 - RNA, 20 nt, Artificial Sequence
  MKO10034428_A_Nos3
  gRNA
gcgcaaugcuccccgcugug

SEQ ID NO: 34429 - RNA, 20 nt, Artificial Sequence
  MKO10034429_A_Nosip
  gRNA
guucugggucccauagcccg

SEQ ID NO: 34430 - RNA, 20 nt, Artificial Sequence
  MKO10034430_A_Nosip
  gRNA
cccagaacauucgacugagc

SEQ ID NO: 34431 - RNA, 20 nt, Artificial Sequence
  MKO10034431_A_Nosip
  gRNA
uuagacaggaugacgcggca

SEQ ID NO: 34432 - RNA, 20 nt, Artificial Sequence
  MKO10034432_A_Nostrin
  gRNA
cuggagauuagcuacgccaa

SEQ ID NO: 34433 - RNA, 20 nt, Artificial Sequence
  MKO10034433_A_Nostrin
  gRNA
cuuuggcguagcuaaucucc

SEQ ID NO: 34434 - RNA, 20 nt, Artificial Sequence
  MKO10034434_A_Nostrin
  gRNA
agcgauaaagccaacacacc

SEQ ID NO: 34435 - RNA, 20 nt, Artificial Sequence
  MKO10034435_A_Nouch1
  gRNA
auauacauacccguccacuc

SEQ ID NO: 34436 - RNA, 20 nt, Artificial Sequence
  MKO10034436_A_Nouch1
  gRNA
agcacaccguguaagaaugc

SEQ ID NO: 34437 - RNA, 20 nt, Artificial Sequence
  MKO10034437_A_Nouch1
  gRNA
gguauucacgccguccacac

SEQ ID NO: 34438 - RNA, 20 nt, Artificial Sequence
  MKO10034438_A_Nouch2
  gRNA
gucgucgauauuccgcucac

SEQ ID NO: 34439 - RNA, 20 nt, Artificial Sequence
  MKO10034439_A_Nouch2
  gRNA
gccuccguugacgcagggcg

SEQ ID NO: 34440 - RNA, 20 nt, Artificial Sequence
  MKO10034440_A_Nouch2
  gRNA
uacgagugcaccugccaagu

SEQ ID NO: 34441 - RNA, 20 nt, Artificial Sequence
  MKO10034441_A_Nouch3
  gRNA
ccaccauuacgacacgggga

SEQ ID NO: 34442 - RNA, 20 nt, Artificial Sequence
  MKO10034442_A_Nouch3
  gRNA
gccccuuccccgugucguaa

SEQ ID NO: 34443 - RNA, 20 nt, Artificial Sequence
  MKO10034443_A_Nouch3
  gRNA
ccauugagacaccgaugucc

SEQ ID NO: 34444 - RNA, 20 nt, Artificial Sequence
  MKO10034444_A_Nouch4
  gRNA
cucguugaugucgcguucac

SEQ ID NO: 34445 - RNA, 20 nt, Artificial Sequence
  MKO10034445_A_Nouch4
  gRNA
aacauagcagugacccccgu

SEQ ID NO: 34446 - RNA, 20 nt, Artificial Sequence
  MKO10034446_A_Nouch4
  gRNA
ugaucgaugccaaacccauc

SEQ ID NO: 34447 - RNA, 20 nt, Artificial Sequence
  MKO10034447_A_Noto
  gRNA
cguacugcgacaccgcaccg

SEQ ID NO: 34448 - RNA, 20 nt, Artificial Sequence
  MKO10034448_A_Noto
  gRNA
uugucccgcgccgacuagcu

SEQ ID NO: 34449 - RNA, 20 nt, Artificial Sequence
  MKO10034449_A_Noto
  gRNA
gauacuucacccugcgauuu

SEQ ID NO: 34450 - RNA, 20 nt, Artificial Sequence
  MKO10034450_A_Notum
  gRNA
uaaccaccgccgacugcccu

SEQ ID NO: 34451 - RNA, 20 nt, Artificial Sequence
  MKO10034451_A_Notum
  gRNA
ggagcucaugaggcgccgca

SEQ ID NO: 34452 - RNA, 20 nt, Artificial Sequence
  MKO10034452_A_Notum
  gRNA
gcggcugguauugcuucaac

SEQ ID NO: 34453 - RNA, 20 nt, Artificial Sequence
  MKO10034453_A_Nova1
  gRNA
cucacuuguuugaugcgauc

SEQ ID NO: 34454 - RNA, 20 nt, Artificial Sequence
  MKO10034454_A_Nova1
  gRNA
aaaaagggagaauucguacc

SEQ ID NO: 34455 - RNA, 20 nt, Artificial Sequence
  MKO10034455_A_Nova1
  gRNA
cucauaccuaguuaugcugc

SEQ ID NO: 34456 - RNA, 20 nt, Artificial Sequence
  MKO10034456_A_Nova2
  gRNA
ccaccucggggggcgucucg

SEQ ID NO: 34457 - RNA, 20 nt, Artificial Sequence
  MKO10034457_A_Nova2
  gRNA
cgugagcgccaucgugcaga

SEQ ID NO: 34458 - RNA, 20 nt, Artificial Sequence
  MKO10034458_A_Nova2
  gRNA
caacaucagcuacgccaacg

SEQ ID NO: 34459 - RNA, 20 nt, Artificial Sequence
  MKO10034459_A_Nov
  gRNA
ccggcaguagcacgucuagc

SEQ ID NO: 34460 - RNA, 20 nt, Artificial Sequence
  MKO10034460_A_Nov
  gRNA
cagaacaacucuccccgcgc

SEQ ID NO: 34461 - RNA, 20 nt, Artificial Sequence
  MKO10034461_A_Nov
  gRNA
auuccuguuggugacccggg

SEQ ID NO: 34462 - RNA, 20 nt, Artificial Sequence
  MKO10034462_A_Nox1
  gRNA
uguagcguucgaaguuaaau

SEQ ID NO: 34463 - RNA, 20 nt, Artificial Sequence
  MKO10034463_A_Nox1
  gRNA
gauuucgacacacaggaauc

SEQ ID NO: 34464 - RNA, 20 nt, Artificial Sequence
  MKO10034464_A_Nox1
  gRNA
agaagcgagagauccaucca

SEQ ID NO: 34465 - RNA, 20 nt, Artificial Sequence
  MKO10034465_A_Nox3
  gRNA
ugaauugacagcuaucccgu

SEQ ID NO: 34466 - RNA, 20 nt, Artificial Sequence
  MKO10034466_A_Nox3
  gRNA
caaccuggagcguuaucacc

SEQ ID NO: 34467 - RNA, 20 nt, Artificial Sequence
  MKO10034467_A_Nox3
  gRNA
uuccacaaacucguugccua

SEQ ID NO: 34468 - RNA, 20 nt, Artificial Sequence
  MKO10034468_A_Nox4
  gRNA
ugugcauguagccgcccacu

SEQ ID NO: 34469 - RNA, 20 nt, Artificial Sequence
  MKO10034469_A_Nox4
  gRNA
uccagaaaaguagaacguuu

SEQ ID NO: 34470 - RNA, 20 nt, Artificial Sequence
  MKO10034470_A_Nox4
  gRNA
auucacuuacgcccaacauu

SEQ ID NO: 34471 - RNA, 20 nt, Artificial Sequence
  MKO10034471_A_Noxa1
  gRNA
uggccguggcacgcgaagac

SEQ ID NO: 34472 - RNA, 20 nt, Artificial Sequence
  MKO10034472_A_Noxa1
  gRNA
gucccagucuucgcgugcca

SEQ ID NO: 34473 - RNA, 20 nt, Artificial Sequence
  MKO10034473_A_Noxa1
  gRNA
aauuggccacuccccgcugg

SEQ ID NO: 34474 - RNA, 20 nt, Artificial Sequence
  MKO10034474_A_Noxo1
  gRNA
cuuguucagaucuccguagc

SEQ ID NO: 34475 - RNA, 20 nt, Artificial Sequence
  MKO10034475_A_Noxo1
  gRNA
augcuccauugcugacacgu

SEQ ID NO: 34476 - RNA, 20 nt, Artificial Sequence
  MKO10034476_A_Noxo1
  gRNA
ugcccccgacgugucagcaa

SEQ ID NO: 34477 - RNA, 20 nt, Artificial Sequence
  MKO10034477_A_Noxred1
  gRNA
cccggauaaucguuguaucu

SEQ ID NO: 34478 - RNA, 20 nt, Artificial Sequence
  MKO10034478_A_Noxred1
  gRNA
ccaggugaguuacggaaacu

SEQ ID NO: 34479 - RNA, 20 nt, Artificial Sequence
  MKO10034479_A_Noxred1
  gRNA
auuugauaacgccgcuacug

SEQ ID NO: 34480 - RNA, 20 nt, Artificial Sequence
  MKO10034480_A_Npas1
  gRNA
ccagcgcggcaaaacgacgc

SEQ ID NO: 34481 - RNA, 20 nt, Artificial Sequence
  MKO10034481_A_Npas1
  gRNA
ggugacgcuaagacgcacga

SEQ ID NO: 34482 - RNA, 20 nt, Artificial Sequence
  MKO10034482_A_Npas1
  gRNA
gucuucgacuacauccaucc

SEQ ID NO: 34483 - RNA, 20 nt, Artificial Sequence
  MKO10034483_A_Npas2
  gRNA
gggaauccgucacaagcaua

SEQ ID NO: 34484 - RNA, 20 nt, Artificial Sequence
  MKO10034484_A_Npas2
  gRNA
gucaucgucgugacaacaga

SEQ ID NO: 34485 - RNA, 20 nt, Artificial Sequence
  MKO10034485_A_Npas2
  gRNA
aauggacaaaaccaccgugc

SEQ ID NO: 34486 - RNA, 20 nt, Artificial Sequence
  MKO10034486_A_Npas3
  gRNA
aaguuauaggugcacaacga

SEQ ID NO: 34487 - RNA, 20 nt, Artificial Sequence
  MKO10034487_A_Npas3
  gRNA
gagaugcugcucgaucccgc

SEQ ID NO: 34488 - RNA, 20 nt, Artificial Sequence
  MKO10034488_A_Npas3
  gRNA
gaaaccgucucuaucuaccu

SEQ ID NO: 34489 - RNA, 20 nt, Artificial Sequence
  MKO10034489_A_Npas4
  gRNA
uaucguagauacugucgccc

SEQ ID NO: 34490 - RNA, 20 nt, Artificial Sequence
  MKO10034490_A_Npas4
  gRNA
gguccuuagcaugccggcuc

SEQ ID NO: 34491 - RNA, 20 nt, Artificial Sequence
  MKO10034491_A_Npas4
  gRNA
gcgcagaaagcggugaacac

SEQ ID NO: 34492 - RNA, 20 nt, Artificial Sequence
  MKO10034492_A_Npau
  gRNA
accacacacucucucagauc

SEQ ID NO: 34493 - RNA, 20 nt, Artificial Sequence
  MKO10034493_A_Npau
  gRNA
cauagagaugacauuauugu

SEQ ID NO: 34494 - RNA, 20 nt, Artificial Sequence
  MKO10034494_A_Npau
  gRNA
uaacucaccaguaagcaggc

SEQ ID NO: 34495 - RNA, 20 nt, Artificial Sequence
  MKO10034495_A_Npbwr1
  gRNA
cagccgagcgaauaccgcaa

SEQ ID NO: 34496 - RNA, 20 nt, Artificial Sequence
  MKO10034496_A_Npbwr1
  gRNA
cgcugcaccguaagugcgcc

SEQ ID NO: 34497 - RNA, 20 nt, Artificial Sequence
  MKO10034497_A_Npbwr1
  gRNA
cgaccucccgcaaacgccgc

SEQ ID NO: 34498 - RNA, 20 nt, Artificial Sequence
  MKO10034498_A_Npb
  gRNA
cucggcuguugaguugccgc

SEQ ID NO: 34499 - RNA, 20 nt, Artificial Sequence
  MKO10034499_A_Npb
  gRNA
gacucggagcgucgcgugga

SEQ ID NO: 34500 - RNA, 20 nt, Artificial Sequence
  MKO10034500_A_Npb
  gRNA
ccgcgggcuuguaccacgcg

SEQ ID NO: 34501 - RNA, 20 nt, Artificial Sequence
  MKO10034501_A_Npc1l1
  gRNA
cuucaucaauguuacucgcg

SEQ ID NO: 34502 - RNA, 20 nt, Artificial Sequence
  MKO10034502_A_Npc1l1
  gRNA
auaggcggggacagacgcgc

SEQ ID NO: 34503 - RNA, 20 nt, Artificial Sequence
  MKO10034503_A_Npc1l1
  gRNA
gaucaaucgcacuaccaucc

SEQ ID NO: 34504 - RNA, 20 nt, Artificial Sequence
  MKO10034504_A_Npc1
  gRNA
acuaagucauagccguccuu

SEQ ID NO: 34505 - RNA, 20 nt, Artificial Sequence
  MKO10034505_A_Npc1
  gRNA
ggcgccuuccaguaacgaga

SEQ ID NO: 34506 - RNA, 20 nt, Artificial Sequence
  MKO10034506_A_Npc1
  gRNA
guacaaugccugccgugaug

SEQ ID NO: 34507 - RNA, 20 nt, Artificial Sequence
  MKO10034507_A_Npc2
  gRNA
auuccacucuuacaaccguc

SEQ ID NO: 34508 - RNA, 20 nt, Artificial Sequence
  MKO10034508_A_Npc2
  gRNA
caucuacucaccgcugguaa

SEQ ID NO: 34509 - RNA, 20 nt, Artificial Sequence
  MKO10034509_A_Npc2
  gRNA
cagcuaccugaauaagcuuc

SEQ ID NO: 34510 - RNA, 20 nt, Artificial Sequence
  MKO10034510_A_Npcd
  gRNA
ccgaauccaucauuaaacgc

SEQ ID NO: 34511 - RNA, 20 nt, Artificial Sequence
  MKO10034511_A_Npcd
  gRNA
gagggcucaccuugcggauc

SEQ ID NO: 34512 - RNA, 20 nt, Artificial Sequence
  MKO10034512_A_Npcd
  gRNA
ucagggacgcaucgaguacc

SEQ ID NO: 34513 - RNA, 20 nt, Artificial Sequence
  MKO10034513_A_Npdc1
  gRNA
cucacaguggggucaacgac

SEQ ID NO: 34514 - RNA, 20 nt, Artificial Sequence
  MKO10034514_A_Npdc1
  gRNA
cuuagcaagcucagccgccc

SEQ ID NO: 34515 - RNA, 20 nt, Artificial Sequence
  MKO10034515_A_Npdc1
  gRNA
accugugcagauguccccgc

SEQ ID NO: 34516 - RNA, 20 nt, Artificial Sequence
  MKO10034516_A_Npepl1
  gRNA
uagcugcucaucgcggauga

SEQ ID NO: 34517 - RNA, 20 nt, Artificial Sequence
  MKO10034517_A_Npepl1
  gRNA
ccgacuagcagcucgcauug

SEQ ID NO: 34518 - RNA, 20 nt, Artificial Sequence
  MKO10034518_A_Npepl1
  gRNA
caucccggcgcgcagagaag

SEQ ID NO: 34519 - RNA, 20 nt, Artificial Sequence
  MKO10034519_A_Npepps
  gRNA
agcagcauagcgcaccucgc

SEQ ID NO: 34520 - RNA, 20 nt, Artificial Sequence
  MKO10034520_A_Npepps
  gRNA
uuaaggcuacugaugcccga

SEQ ID NO: 34521 - RNA, 20 nt, Artificial Sequence
  MKO10034521_A_Npepps
  gRNA
uuuccagaaauccaugcgac

SEQ ID NO: 34522 - RNA, 20 nt, Artificial Sequence
  MKO10034522_A_Npffr1
  gRNA
gcucuucgcgcacaucuauc

SEQ ID NO: 34523 - RNA, 20 nt, Artificial Sequence
  MKO10034523_A_Npffr1
  gRNA
cacucugaccgucacgcgag

SEQ ID NO: 34524 - RNA, 20 nt, Artificial Sequence
  MKO10034524_A_Npffr1
  gRNA
cgcguaggcggcgaugaaca

SEQ ID NO: 34525 - RNA, 20 nt, Artificial Sequence
  MKO10034525_A_Npffr2
  gRNA
gguccaccaugagcgagaaa

SEQ ID NO: 34526 - RNA, 20 nt, Artificial Sequence
  MKO10034526_A_Npffr2
  gRNA
ccuugccauaagugauuuac

SEQ ID NO: 34527 - RNA, 20 nt, Artificial Sequence
  MKO10034527_A_Npffr2
  gRNA
gaugguggcaaauagcaccg

SEQ ID NO: 34528 - RNA, 20 nt, Artificial Sequence
  MKO10034528_A_Npff
  gRNA
cuggccgcuccucagcgcuu

SEQ ID NO: 34529 - RNA, 20 nt, Artificial Sequence
  MKO10034529_A_Npff
  gRNA
caaggaacagcuaaauccgc

SEQ ID NO: 34530 - RNA, 20 nt, Artificial Sequence
  MKO10034530_A_Npff
  gRNA
ccuggagcagaacacgaaag

SEQ ID NO: 34531 - RNA, 20 nt, Artificial Sequence
  MKO10034531_A_Nphp1
  gRNA
agcuugccgugagcaucagc

SEQ ID NO: 34532 - RNA, 20 nt, Artificial Sequence
  MKO10034532_A_Nphp1
  gRNA
acugucacauacaucgcucu

SEQ ID NO: 34533 - RNA, 20 nt, Artificial Sequence
  MKO10034533_A_Nphp1
  gRNA
cucugcucauaguuccccac

SEQ ID NO: 34534 - RNA, 20 nt, Artificial Sequence
  MKO10034534_A_Nphp3
  gRNA
gggauccaaguguucgaccc

SEQ ID NO: 34535 - RNA, 20 nt, Artificial Sequence
  MKO10034535_A_Nphp3
  gRNA
cccuuugcaaacaucaaccg

SEQ ID NO: 34536 - RNA, 20 nt, Artificial Sequence
  MKO10034536_A_Nphp3
  gRNA
ucauccgagucagacucccc

SEQ ID NO: 34537 - RNA, 20 nt, Artificial Sequence
  MKO10034537_A_Nphp4
  gRNA
uucuaccacagccacgaugc

SEQ ID NO: 34538 - RNA, 20 nt, Artificial Sequence
  MKO10034538_A_Nphp4
  gRNA
ucuuacguucuaugggaucc

SEQ ID NO: 34539 - RNA, 20 nt, Artificial Sequence
  MKO10034539_A_Nphp4
  gRNA
gugguagaaguggucaccga

SEQ ID NO: 34540 - RNA, 20 nt, Artificial Sequence
  MKO10034540_A_Nphs1
  gRNA
ccaacucggagcggccgacu

SEQ ID NO: 34541 - RNA, 20 nt, Artificial Sequence
  MKO10034541_A_Nphs1
  gRNA
ccaagucggccgcuccgagu

SEQ ID NO: 34542 - RNA, 20 nt, Artificial Sequence
  MKO10034542_A_Nphs1
  gRNA
aagggucgacaguuaagcug

SEQ ID NO: 34543 - RNA, 20 nt, Artificial Sequence
  MKO10034543_A_Nphs2
  gRNA
cgcugucugcuacuaccgca

SEQ ID NO: 34544 - RNA, 20 nt, Artificial Sequence
  MKO10034544_A_Nphs2
  gRNA
aagaguaauuauauuccgac

SEQ ID NO: 34545 - RNA, 20 nt, Artificial Sequence
  MKO10034545_A_Nphs2
  gRNA
aaccaccaugaagcgccucu

SEQ ID NO: 34546 - RNA, 20 nt, Artificial Sequence
  MKO10034546_A_Nploc4
  gRNA
ggccuuuggugcuccuaacg

SEQ ID NO: 34547 - RNA, 20 nt, Artificial Sequence
  MKO10034547_A_Nploc4
  gRNA
aaaggccuuuaacccuaccg

SEQ ID NO: 34548 - RNA, 20 nt, Artificial Sequence
  MKO10034548_A_Nploc4
  gRNA
acucacgaugcucucggcca

SEQ ID NO: 34549 - RNA, 20 nt, Artificial Sequence
  MKO10034549_A_Npl
  gRNA
uaacccauuccuccgcgacc

SEQ ID NO: 34550 - RNA, 20 nt, Artificial Sequence
  MKO10034550_A_Npl
  gRNA
gagcgucucugaacgucgcc

SEQ ID NO: 34551 - RNA, 20 nt, Artificial Sequence
  MKO10034551_A_Npl
  gRNA
cgugggagcacuaaacguga

SEQ ID NO: 34552 - RNA, 20 nt, Artificial Sequence
  MKO10034552_A_Npm1
  gRNA
auuaguggacagcaucuagu

SEQ ID NO: 34553 - RNA, 20 nt, Artificial Sequence
  MKO10034553_A_Npm1
  gRNA
ucacaggucaguuuaggagc

SEQ ID NO: 34554 - RNA, 20 nt, Artificial Sequence
  MKO10034554_A_Npm1
  gRNA
acauacaggcugugaacuaa

SEQ ID NO: 34555 - RNA, 20 nt, Artificial Sequence
  MKO10034555_A_Npm2
  gRNA
aaucacuauugcuacgcuga

SEQ ID NO: 34556 - RNA, 20 nt, Artificial Sequence
  MKO10034556_A_Npm2
  gRNA
ugcagguagugaacucaauc

SEQ ID NO: 34557 - RNA, 20 nt, Artificial Sequence
  MKO10034557_A_Npm2
  gRNA
agcuguccuucuucucgccu

SEQ ID NO: 34558 - RNA, 20 nt, Artificial Sequence
  MKO10034558_A_Npm3
  gRNA
cuuucagcugugccuuaccg

SEQ ID NO: 34559 - RNA, 20 nt, Artificial Sequence
  MKO10034559_A_Npm3
  gRNA
ucuucucaccgaucugaugc

SEQ ID NO: 34560 - RNA, 20 nt, Artificial Sequence
  MKO10034560_A_Npm3
  gRNA
caccacauuacacucguccg

SEQ ID NO: 34561 - RNA, 20 nt, Artificial Sequence
  MKO10034561_A_Npnt
  gRNA
uccgcagauuuaaacgagug

SEQ ID NO: 34562 - RNA, 20 nt, Artificial Sequence
  MKO10034562_A_Npnt
  gRNA
gccucaccucccgucgaagu

SEQ ID NO: 34563 - RNA, 20 nt, Artificial Sequence
  MKO10034563_A_Npnt
  gRNA
uggcugccgacuucgacggg

SEQ ID NO: 34564 - RNA, 20 nt, Artificial Sequence
  MKO10034564_A_Nppa
  gRNA
uguugcagccuaguccacuc

SEQ ID NO: 34565 - RNA, 20 nt, Artificial Sequence
  MKO10034565_A_Nppa
  gRNA
aauccuacccccgaagcagc

SEQ ID NO: 34566 - RNA, 20 nt, Artificial Sequence
  MKO10034566_A_Nppa
  gRNA
cacagaucugauggauuuca

SEQ ID NO: 34567 - RNA, 20 nt, Artificial Sequence
  MKO10034567_A_Nppb
  gRNA
gaucggauccgucagucguu

SEQ ID NO: 34568 - RNA, 20 nt, Artificial Sequence
  MKO10034568_A_Nppb
  gRNA
guuacagcccaaacgacuga

SEQ ID NO: 34569 - RNA, 20 nt, Artificial Sequence
  MKO10034569_A_Nppb
  gRNA
cugcggcauggaucuccuga

SEQ ID NO: 34570 - RNA, 20 nt, Artificial Sequence
  MKO10034570_A_Nppc
  gRNA
gagaccgaucgcgacugcuc

SEQ ID NO: 34571 - RNA, 20 nt, Artificial Sequence
  MKO10034571_A_Nppc
  gRNA
cgaucggucucccuugagau

SEQ ID NO: 34572 - RNA, 20 nt, Artificial Sequence
  MKO10034572_A_Nppc
  gRNA
caagcccgggacaccaccga

SEQ ID NO: 34573 - RNA, 20 nt, Artificial Sequence
  MKO10034573_A_Npr1
  gRNA
cauagagcaggagcccguca

SEQ ID NO: 34574 - RNA, 20 nt, Artificial Sequence
  MKO10034574_A_Npr1
  gRNA
agaacaucacucagcggaug

SEQ ID NO: 34575 - RNA, 20 nt, Artificial Sequence
  MKO10034575_A_Npr1
  gRNA
acccgauaauccugaguacu

SEQ ID NO: 34576 - RNA, 20 nt, Artificial Sequence
  MKO10034576_A_Npr2
  gRNA
gcgagacugauuucguccug

SEQ ID NO: 34577 - RNA, 20 nt, Artificial Sequence
  MKO10034577_A_Npr2
  gRNA
gcaggccccacccgugcaac

SEQ ID NO: 34578 - RNA, 20 nt, Artificial Sequence
  MKO10034578_A_Npr2
  gRNA
auggcaggacaaucgaaccc

SEQ ID NO: 34579 - RNA, 20 nt, Artificial Sequence
  MKO10034579_A_Npr3
  gRNA
cgccaacaugauucuccgaa

SEQ ID NO: 34580 - RNA, 20 nt, Artificial Sequence
  MKO10034580_A_Npr3
  gRNA
uccuguagguaucgccgggc

SEQ ID NO: 34581 - RNA, 20 nt, Artificial Sequence
  MKO10034581_A_Npr3
  gRNA
cucccguaggagauggcucg

SEQ ID NO: 34582 - RNA, 20 nt, Artificial Sequence
  MKO10034582_A_Nprl2
  gRNA
gcugcucgaucaccuucaag

SEQ ID NO: 34583 - RNA, 20 nt, Artificial Sequence
  MKO10034583_A_Nprl2
  gRNA
gccagacccuccuguugcgc

SEQ ID NO: 34584 - RNA, 20 nt, Artificial Sequence
  MKO10034584_A_Nprl2
  gRNA
ucucgcgagaugaaauccuc

SEQ ID NO: 34585 - RNA, 20 nt, Artificial Sequence
  MKO10034585_A_Nprl3
  gRNA
agcggcgcuccucaugcugc

SEQ ID NO: 34586 - RNA, 20 nt, Artificial Sequence
  MKO10034586_A_Nprl3
  gRNA
cugccaguaccucacucgag

SEQ ID NO: 34587 - RNA, 20 nt, Artificial Sequence
  MKO10034587_A_Nprl3
  gRNA
aagguucucggauguuauuc

SEQ ID NO: 34588 - RNA, 20 nt, Artificial Sequence
  MKO10034588_A_Npsr1
  gRNA
cgcuauuccgaugaggacuu

SEQ ID NO: 34589 - RNA, 20 nt, Artificial Sequence
  MKO10034589_A_Npsr1
  gRNA
caugaccaucgucgccuuuc

SEQ ID NO: 34590 - RNA, 20 nt, Artificial Sequence
  MKO10034590_A_Npsr1
  gRNA
guaugccucuaccuacgucc

SEQ ID NO: 34591 - RNA, 20 nt, Artificial Sequence
  MKO10034591_A_Nps
  gRNA
ugagccgacuccguugcgaa

SEQ ID NO: 34592 - RNA, 20 nt, Artificial Sequence
  MKO10034592_A_Nps
  gRNA
augaaaagguccuuucgcaa

SEQ ID NO: 34593 - RNA, 20 nt, Artificial Sequence
  MKO10034593_A_Nps
  gRNA
acgcccuuaccuuggaagag

SEQ ID NO: 34594 - RNA, 20 nt, Artificial Sequence
  MKO10034594_A_Nptn
  gRNA
gcauuacauucauacucucc

SEQ ID NO: 34595 - RNA, 20 nt, Artificial Sequence
  MKO10034595_A_Nptn
  gRNA
ccuccguuuccaccguccuc

SEQ ID NO: 34596 - RNA, 20 nt, Artificial Sequence
  MKO10034596_A_Nptn
  gRNA
uucuugcgccauauccacuc

SEQ ID NO: 34597 - RNA, 20 nt, Artificial Sequence
  MKO10034597_A_Nptx1
  gRNA
cugccguuuguaaucaacga

SEQ ID NO: 34598 - RNA, 20 nt, Artificial Sequence
  MKO10034598_A_Nptx1
  gRNA
acgaacugguccucaucgag

SEQ ID NO: 34599 - RNA, 20 nt, Artificial Sequence
  MKO10034599_A_Nptx1
  gRNA
cucaaguccagugcggcgcc

SEQ ID NO: 34600 - RNA, 20 nt, Artificial Sequence
  MKO10034600_A_Nptx2
  gRNA
gagcacgcccccuggcuuaa

SEQ ID NO: 34601 - RNA, 20 nt, Artificial Sequence
  MKO10034601_A_Nptx2
  gRNA
cgcggucccauauguugaac

SEQ ID NO: 34602 - RNA, 20 nt, Artificial Sequence
  MKO10034602_A_Nptx2
  gRNA
gacaacaaugucgauguguu

SEQ ID NO: 34603 - RNA, 20 nt, Artificial Sequence
  MKO10034603_A_Nptxr
  gRNA
ccggcagcgccuugcgcacg

SEQ ID NO: 34604 - RNA, 20 nt, Artificial Sequence
  MKO10034604_A_Nptxr
  gRNA
ggccaaugagaucgugcuuc

SEQ ID NO: 34605 - RNA, 20 nt, Artificial Sequence
  MKO10034605_A_Nptxr
  gRNA
aaccccgcaguucuccgucc

SEQ ID NO: 34606 - RNA, 20 nt, Artificial Sequence
  MKO10034606_A_Npvf
  gRNA
caugacguagagcaacucgc

SEQ ID NO: 34607 - RNA, 20 nt, Artificial Sequence
  MKO10034607_A_Npvf
  gRNA
uaccucguucgcuuuccacc

SEQ ID NO: 34608 - RNA, 20 nt, Artificial Sequence
  MKO10034608_A_Npvf
  gRNA
uuuaaggagaggagcguuug

SEQ ID NO: 34609 - RNA, 20 nt, Artificial Sequence
  MKO10034609_A_Npw
  gRNA
acucgccacgugcuuauacc

SEQ ID NO: 34610 - RNA, 20 nt, Artificial Sequence
  MKO10034610_A_Npw
  gRNA
ugcgccgcucgcccuaccag

SEQ ID NO: 34611 - RNA, 20 nt, Artificial Sequence
  MKO10034611_A_Npw
  gRNA
caucgguucuugggccugac

SEQ ID NO: 34612 - RNA, 20 nt, Artificial Sequence
  MKO10034612_A_Npy1r
  gRNA
cguagucaucgucucgagac

SEQ ID NO: 34613 - RNA, 20 nt, Artificial Sequence
  MKO10034613_A_Npy1r
  gRNA
uucaccuuggcucucgcuua

SEQ ID NO: 34614 - RNA, 20 nt, Artificial Sequence
  MKO10034614_A_Npy1r
  gRNA
ucuucaacacuguguucgac

SEQ ID NO: 34615 - RNA, 20 nt, Artificial Sequence
  MKO10034615_A_Npy2r
  gRNA
cuuucuccuacacccguauc

SEQ ID NO: 34616 - RNA, 20 nt, Artificial Sequence
  MKO10034616_A_Npy2r
  gRNA
ggugguagacaaugcaacga

SEQ ID NO: 34617 - RNA, 20 nt, Artificial Sequence
  MKO10034617_A_Npy2r
  gRNA
guucugaagaugggcccggu

SEQ ID NO: 34618 - RNA, 20 nt, Artificial Sequence
  MKO10034618_A_Npy4r
  gRNA
accuauccaagggaucgaug

SEQ ID NO: 34619 - RNA, 20 nt, Artificial Sequence
  MKO10034619_A_Npy4r
  gRNA
gugagcugcaagcgugcgca

SEQ ID NO: 34620 - RNA, 20 nt, Artificial Sequence
  MKO10034620_A_Npy4r
  gRNA
acccauccucaucgaucccu

SEQ ID NO: 34621 - RNA, 20 nt, Artificial Sequence
  MKO10034621_A_Npy5r
  gRNA
cuuacuguuaaacauacuag

SEQ ID NO: 34622 - RNA, 20 nt, Artificial Sequence
  MKO10034622_A_Npy5r
  gRNA
ugcguguuacccgccccagc

SEQ ID NO: 34623 - RNA, 20 nt, Artificial Sequence
  MKO10034623_A_Npy5r
  gRNA
aggggaggccguguucugac

SEQ ID NO: 34624 - RNA, 20 nt, Artificial Sequence
  MKO10034624_A_Npy6r
  gRNA
ggcuccaaaagucacuacga

SEQ ID NO: 34625 - RNA, 20 nt, Artificial Sequence
  MKO10034625_A_Npy6r
  gRNA
cgaguuguugcucuugccac

SEQ ID NO: 34626 - RNA, 20 nt, Artificial Sequence
  MKO10034626_A_Npy6r
  gRNA
agaguguagaugaccguaaa

SEQ ID NO: 34627 - RNA, 20 nt, Artificial Sequence
  MKO10034627_A_Npy
  gRNA
gcguccucgcccggauuguc

SEQ ID NO: 34628 - RNA, 20 nt, Artificial Sequence
  MKO10034628_A_Npy
  gRNA
ugagggguaccccuccaagc

SEQ ID NO: 34629 - RNA, 20 nt, Artificial Sequence
  MKO10034629_A_Npy
  gRNA
ggcuugaagacccuuccaug

SEQ ID NO: 34630 - RNA, 20 nt, Artificial Sequence
  MKO10034630_A_Nqo1
  gRNA
aucauucaacuacgccauga

SEQ ID NO: 34631 - RNA, 20 nt, Artificial Sequence
  MKO10034631_A_Nqo1
  gRNA
gaaugacguucauguccccg

SEQ ID NO: 34632 - RNA, 20 nt, Artificial Sequence
  MKO10034632_A_Nqo1
  gRNA
uuugagagagugcucguagc

SEQ ID NO: 34633 - RNA, 20 nt, Artificial Sequence
  MKO10034633_A_Nqo2
  gRNA
ggaacgcugaaccaguauag

SEQ ID NO: 34634 - RNA, 20 nt, Artificial Sequence
  MKO10034634_A_Nqo2
  gRNA
auggauagggugcugugccg

SEQ ID NO: 34635 - RNA, 20 nt, Artificial Sequence
  MKO10034635_A_Nqo2
  gRNA
caucuccgcuguaccucccg

SEQ ID NO: 34636 - RNA, 20 nt, Artificial Sequence
  MKO10034636_A_Nr0b1
  gRNA
cccggagaccaacacgacgc

SEQ ID NO: 34637 - RNA, 20 nt, Artificial Sequence
  MKO10034637_A_Nr0b1
  gRNA
gagaaucacccgcgccaggg

SEQ ID NO: 34638 - RNA, 20 nt, Artificial Sequence
  MKO10034638_A_Nr0b1
  gRNA
cgcuauugaugaaucucagc

SEQ ID NO: 34639 - RNA, 20 nt, Artificial Sequence
  MKO10034639_A_Nr0b2
  gRNA
guuguggccggucugauggc

SEQ ID NO: 34640 - RNA, 20 nt, Artificial Sequence
  MKO10034640_A_Nr0b2
  gRNA
caaggaguaugcguaccuga

SEQ ID NO: 34641 - RNA, 20 nt, Artificial Sequence
  MKO10034641_A_Nr0b2
  gRNA
ccaugaggaggauucgggcc

SEQ ID NO: 34642 - RNA, 20 nt, Artificial Sequence
  MKO10034642_A_Nr1d1
  gRNA
guugcgauugaugcgaacga

SEQ ID NO: 34643 - RNA, 20 nt, Artificial Sequence
  MKO10034643_A_Nr1d1
  gRNA
cgucauaaugaagcgcugaa

SEQ ID NO: 34644 - RNA, 20 nt, Artificial Sequence
  MKO10034644_A_Nr1d1
  gRNA
cuucuggggccgaauauacg

SEQ ID NO: 34645 - RNA, 20 nt, Artificial Sequence
  MKO10034645_A_Nr1d2
  gRNA
cucuucauagcuguucgauu

SEQ ID NO: 34646 - RNA, 20 nt, Artificial Sequence
  MKO10034646_A_Nr1d2
  gRNA
gcuagagauaucagcguucu

SEQ ID NO: 34647 - RNA, 20 nt, Artificial Sequence
  MKO10034647_A_Nr1d2
  gRNA
gcugauaucucuagcaucga

SEQ ID NO: 34648 - RNA, 20 nt, Artificial Sequence
  MKO10034648_A_Nr1h2
  gRNA
cagggcgauaccgugacuuu

SEQ ID NO: 34649 - RNA, 20 nt, Artificial Sequence
  MKO10034649_A_Nr1h2
  gRNA
ccucaaugguggacgccuuc

SEQ ID NO: 34650 - RNA, 20 nt, Artificial Sequence
  MKO10034650_A_Nr1h2
  gRNA
gggccgggcgcuaugccugu

SEQ ID NO: 34651 - RNA, 20 nt, Artificial Sequence
  MKO10034651_A_Nr1h3
  gRNA
ggucaaguaccgugacgcgc

SEQ ID NO: 34652 - RNA, 20 nt, Artificial Sequence
  MKO10034652_A_Nr1h3
  gRNA
cucagaccgccugcgcguca

SEQ ID NO: 34653 - RNA, 20 nt, Artificial Sequence
  MKO10034653_A_Nr1h3
  gRNA
ucgacuucgcaaaugccgcc

SEQ ID NO: 34654 - RNA, 20 nt, Artificial Sequence
  MKO10034654_A_Nr1h4
  gRNA
uauucugccugccgaugccg

SEQ ID NO: 34655 - RNA, 20 nt, Artificial Sequence
  MKO10034655_A_Nr1h4
  gRNA
auucgcggcuucuuugucac

SEQ ID NO: 34656 - RNA, 20 nt, Artificial Sequence
  MKO10034656_A_Nr1h4
  gRNA
gccguguacaaguguaagaa

SEQ ID NO: 34657 - RNA, 20 nt, Artificial Sequence
  MKO10034657_A_Nr1h5
  gRNA
ggacucgacgcucgagaauc

SEQ ID NO: 34658 - RNA, 20 nt, Artificial Sequence
  MKO10034658_A_Nr1h5
  gRNA
gaagucucuucgacuuacac

SEQ ID NO: 34659 - RNA, 20 nt, Artificial Sequence
  MKO10034659_A_Nr1h5
  gRNA
gagcaacuuguucuuuacgc

SEQ ID NO: 34660 - RNA, 20 nt, Artificial Sequence
  MKO10034660_A_Nr1i2
  gRNA
cgaacaucguguugaaccuc

SEQ ID NO: 34661 - RNA, 20 nt, Artificial Sequence
  MKO10034661_A_Nr1i2
  gRNA
uacugcuucgaagacccuaa

SEQ ID NO: 34662 - RNA, 20 nt, Artificial Sequence
  MKO10034662_A_Nr1i2
  gRNA
gaucauguccgaugccgcug

SEQ ID NO: 34663 - RNA, 20 nt, Artificial Sequence
  MKO10034663_A_Nr1i3
  gRNA
uggggcccacauggcgagug

SEQ ID NO: 34664 - RNA, 20 nt, Artificial Sequence
  MKO10034664_A_Nr1i3
  gRNA
ccggugaugcaugaacagau

SEQ ID NO: 34665 - RNA, 20 nt, Artificial Sequence
  MKO10034665_A_Nr1i3
  gRNA
ccaucuguccguuugcugga

SEQ ID NO: 34666 - RNA, 20 nt, Artificial Sequence
  MKO10034666_A_Nr2c1
  gRNA
aaccuagucuauuccugucg

SEQ ID NO: 34667 - RNA, 20 nt, Artificial Sequence
  MKO10034667_A_Nr2c1
  gRNA
auccucgacaggaauagacu

SEQ ID NO: 34668 - RNA, 20 nt, Artificial Sequence
  MKO10034668_A_Nr2c1
  gRNA
ucccuggcguggaucccucg

SEQ ID NO: 34669 - RNA, 20 nt, Artificial Sequence
  MKO10034669_A_Nr2c2ap
  gRNA
cugugcucaaucgcaacagc

SEQ ID NO: 34670 - RNA, 20 nt, Artificial Sequence
  MKO10034670_A_Nr2c2ap
  gRNA
gaaacucgagugacacccac

SEQ ID NO: 34671 - RNA, 20 nt, Artificial Sequence
  MKO10034671_A_Nr2c2ap
  gRNA
uccauugcagguucacgggg

SEQ ID NO: 34672 - RNA, 20 nt, Artificial Sequence
  MKO10034672_A_Nr2c2
  gRNA
uuucucccguugcacaucaa

SEQ ID NO: 34673 - RNA, 20 nt, Artificial Sequence
  MKO10034673_A_Nr2c2
  gRNA
gauccagauagucaccgcag

SEQ ID NO: 34674 - RNA, 20 nt, Artificial Sequence
  MKO10034674_A_Nr2c2
  gRNA
aacugacagccccauagugc

SEQ ID NO: 34675 - RNA, 20 nt, Artificial Sequence
  MKO10034675_A_Nr2e1
  gRNA
gacguccaccauccgcaaac

SEQ ID NO: 34676 - RNA, 20 nt, Artificial Sequence
  MKO10034676_A_Nr2e1
  gRNA
cccaauguaucucuacgaag

SEQ ID NO: 34677 - RNA, 20 nt, Artificial Sequence
  MKO10034677_A_Nr2e1
  gRNA
gcggccaacuccagaccgug

SEQ ID NO: 34678 - RNA, 20 nt, Artificial Sequence
  MKO10034678_A_Nr2e3
  gRNA
cgccgaaacuugugcuaaac

SEQ ID NO: 34679 - RNA, 20 nt, Artificial Sequence
  MKO10034679_A_Nr2e3
  gRNA
ucgcuccagugccgagugug

SEQ ID NO: 34680 - RNA, 20 nt, Artificial Sequence
  MKO10034680_A_Nr2e3
  gRNA
aggccuggcacugauugcga

SEQ ID NO: 34681 - RNA, 20 nt, Artificial Sequence
  MKO10034681_A_Nr2f1
  gRNA
gcaacucuucuucguacguu

SEQ ID NO: 34682 - RNA, 20 nt, Artificial Sequence
  MKO10034682_A_Nr2f1
  gRNA
cuggcugccauaacgcgacg

SEQ ID NO: 34683 - RNA, 20 nt, Artificial Sequence
  MKO10034683_A_Nr2f1
  gRNA
cccuaccccacgucgcguua

SEQ ID NO: 34684 - RNA, 20 nt, Artificial Sequence
  MKO10034684_A_Nr2f2
  gRNA
uauauccggacagguacgag

SEQ ID NO: 34685 - RNA, 20 nt, Artificial Sequence
  MKO10034685_A_Nr2f2
  gRNA
uggcgcggcacguguagcuc

SEQ ID NO: 34686 - RNA, 20 nt, Artificial Sequence
  MKO10034686_A_Nr2f2
  gRNA
gguccauaaaagcgaccacc

SEQ ID NO: 34687 - RNA, 20 nt, Artificial Sequence
  MKO10034687_A_Nr2f6
  gRNA
acgauucggcgucaccuccc

SEQ ID NO: 34688 - RNA, 20 nt, Artificial Sequence
  MKO10034688_A_Nr2f6
  gRNA
gguucgacgcccgucgcgcc

SEQ ID NO: 34689 - RNA, 20 nt, Artificial Sequence
  MKO10034689_A_Nr2f6
  gRNA
gacgggcgucgaaccuuuca

SEQ ID NO: 34690 - RNA, 20 nt, Artificial Sequence
  MKO10034690_A_Nr3c1
  gRNA
augaccacgcucaacauguu

SEQ ID NO: 34691 - RNA, 20 nt, Artificial Sequence
  MKO10034691_A_Nr3c1
  gRNA
cacacgucagcaccccauaa

SEQ ID NO: 34692 - RNA, 20 nt, Artificial Sequence
  MKO10034692_A_Nr3c1
  gRNA
cagcacaauuaccuuugugc

SEQ ID NO: 34693 - RNA, 20 nt, Artificial Sequence
  MKO10034693_A_Nr3c2
  gRNA
cgugagcgcacgcgugaucg

SEQ ID NO: 34694 - RNA, 20 nt, Artificial Sequence
  MKO10034694_A_Nr3c2
  gRNA
guagccugcauacacgaucu

SEQ ID NO: 34695 - RNA, 20 nt, Artificial Sequence
  MKO10034695_A_Nr3c2
  gRNA
cacuaugggguagugaccug

SEQ ID NO: 34696 - RNA, 20 nt, Artificial Sequence
  MKO10034696_A_Nr4a1
  gRNA
cccacuuucggauaacgucc

SEQ ID NO: 34697 - RNA, 20 nt, Artificial Sequence
  MKO10034697_A_Nr4a1
  gRNA
cccuggacguuauccgaaag

SEQ ID NO: 34698 - RNA, 20 nt, Artificial Sequence
  MKO10034698_A_Nr4a1
  gRNA
uuccgccgccucuuguccac

SEQ ID NO: 34699 - RNA, 20 nt, Artificial Sequence
  MKO10034699_A_Nr4a2
  gRNA
uugccggauuggaaucgacg

SEQ ID NO: 34700 - RNA, 20 nt, Artificial Sequence
  MKO10034700_A_Nr4a2
  gRNA
ucgaggguaaacgaccucuc

SEQ ID NO: 34701 - RNA, 20 nt, Artificial Sequence
  MKO10034701_A_Nr4a2
  gRNA
gacaguacugacaacgauuu

SEQ ID NO: 34702 - RNA, 20 nt, Artificial Sequence
  MKO10034702_A_Nr4a3
  gRNA
ccaguacugucccaccgacc

SEQ ID NO: 34703 - RNA, 20 nt, Artificial Sequence
  MKO10034703_A_Nr4a3
  gRNA
cgucaauggaggccgucaga

SEQ ID NO: 34704 - RNA, 20 nt, Artificial Sequence
  MKO10034704_A_Nr4a3
  gRNA
caucgacuucagugccuucg

SEQ ID NO: 34705 - RNA, 20 nt, Artificial Sequence
  MKO10034705_A_Nr5a1
  gRNA
guuggaccacaucuaccgcc

SEQ ID NO: 34706 - RNA, 20 nt, Artificial Sequence
  MKO10034706_A_Nr5a1
  gRNA
ccaggugcgcgcucgcaucg

SEQ ID NO: 34707 - RNA, 20 nt, Artificial Sequence
  MKO10034707_A_Nr5a1
  gRNA
cugugcgugcugaucgaaug

SEQ ID NO: 34708 - RNA, 20 nt, Artificial Sequence
  MKO10034708_A_Nr5a2
  gRNA
guaagagccgaccgcaugcg

SEQ ID NO: 34709 - RNA, 20 nt, Artificial Sequence
  MKO10034709_A_Nr5a2
  gRNA
ccuugcagcuuucgcacgug

SEQ ID NO: 34710 - RNA, 20 nt, Artificial Sequence
  MKO10034710_A_Nr5a2
  gRNA
uauuucugcccccucgcaug

SEQ ID NO: 34711 - RNA, 20 nt, Artificial Sequence
  MKO10034711_A_Nr6a1
  gRNA
cauagugcaagcccguagcg

SEQ ID NO: 34712 - RNA, 20 nt, Artificial Sequence
  MKO10034712_A_Nr6a1
  gRNA
cgcgcuacgggcuugcacua

SEQ ID NO: 34713 - RNA, 20 nt, Artificial Sequence
  MKO10034713_A_Nr6a1
  gRNA
gacagcgaccacaguucccc

SEQ ID NO: 34714 - RNA, 20 nt, Artificial Sequence
  MKO10034714_A_Nradd
  gRNA
cagcuggcgagcucaaaacc

SEQ ID NO: 34715 - RNA, 20 nt, Artificial Sequence
  MKO10034715_A_Nradd
  gRNA
cguugcugucaccacgccuc

SEQ ID NO: 34716 - RNA, 20 nt, Artificial Sequence
  MKO10034716_A_Nradd
  gRNA
aaagcucggacuguagagcu

SEQ ID NO: 34717 - RNA, 20 nt, Artificial Sequence
  MKO10034717_A_Nrap
  gRNA
cauuuaaauccguucuccau

SEQ ID NO: 34718 - RNA, 20 nt, Artificial Sequence
  MKO10034718_A_Nrap
  gRNA
gacacuuacgcgugacagua

SEQ ID NO: 34719 - RNA, 20 nt, Artificial Sequence
  MKO10034719_A_Nrap
  gRNA
cuagugaacguguuguucuu

SEQ ID NO: 34720 - RNA, 20 nt, Artificial Sequence
  MKO10034720_A_Nrarp
  gRNA
auccgccuagcuaaccgcga

SEQ ID NO: 34721 - RNA, 20 nt, Artificial Sequence
  MKO10034721_A_Nrarp
  gRNA
gcgcuacacaucgccgcuuu

SEQ ID NO: 34722 - RNA, 20 nt, Artificial Sequence
  MKO10034722_A_Nrarp
  gRNA
gaauucaacgugaacucguu

SEQ ID NO: 34723 - RNA, 20 nt, Artificial Sequence
  MKO10034723_A_Nras
  gRNA
cuagcauaccugucgggucu

SEQ ID NO: 34724 - RNA, 20 nt, Artificial Sequence
  MKO10034724_A_Nras
  gRNA
gaccucagccaagacccgac

SEQ ID NO: 34725 - RNA, 20 nt, Artificial Sequence
  MKO10034725_A_Nras
  gRNA
uugcagauauuaaccucuac

SEQ ID NO: 34726 - RNA, 20 nt, Artificial Sequence
  MKO10034726_A_Nrbf2
  gRNA
cgaccacucacaagguugag

SEQ ID NO: 34727 - RNA, 20 nt, Artificial Sequence
  MKO10034727_A_Nrbf2
  gRNA
gucucaggcucacuuaucac

SEQ ID NO: 34728 - RNA, 20 nt, Artificial Sequence
  MKO10034728_A_Nrbf2
  gRNA
gagccaucagagcccuguau

SEQ ID NO: 34729 - RNA, 20 nt, Artificial Sequence
  MKO10034729_A_Nrbp1
  gRNA
gugaaucagcguaauguacc

SEQ ID NO: 34730 - RNA, 20 nt, Artificial Sequence
  MKO10034730_A_Nrbp1
  gRNA
uuaccuaccuuagggcagag

SEQ ID NO: 34731 - RNA, 20 nt, Artificial Sequence
  MKO10034731_A_Nrbp1
  gRNA
aucacagaauacauguccuc

SEQ ID NO: 34732 - RNA, 20 nt, Artificial Sequence
  MKO10034732_A_Nrbp2
  gRNA
ugagugccuggcucgagcga

SEQ ID NO: 34733 - RNA, 20 nt, Artificial Sequence
  MKO10034733_A_Nrbp2
  gRNA
aagcugcucacccgcauguu

SEQ ID NO: 34734 - RNA, 20 nt, Artificial Sequence
  MKO10034734_A_Nrbp2
  gRNA
cuuccaccgagugcucuuug

SEQ ID NO: 34735 - RNA, 20 nt, Artificial Sequence
  MKO10034735_A_Nrcam
  gRNA
gugaguuccauuacgagucc

SEQ ID NO: 34736 - RNA, 20 nt, Artificial Sequence
  MKO10034736_A_Nrcam
  gRNA
gugccagaugaucagcgcgc

SEQ ID NO: 34737 - RNA, 20 nt, Artificial Sequence
  MKO10034737_A_Nrcam
  gRNA
cauccagcgcgcugaucauc

SEQ ID NO: 34738 - RNA, 20 nt, Artificial Sequence
  MKO10034738_A_Nrd1
  gRNA
gcaucaaauccauucucauc

SEQ ID NO: 34739 - RNA, 20 nt, Artificial Sequence
  MKO10034739_A_Nrd1
  gRNA
ugugcguucacaaucaguug

SEQ ID NO: 34740 - RNA, 20 nt, Artificial Sequence
  MKO10034740_A_Nrd1
  gRNA
gcugauccagaugaccugcc

SEQ ID NO: 34741 - RNA, 20 nt, Artificial Sequence
  MKO10034741_A_Nrde2
  gRNA
acgaucugaccgacgucuuc

SEQ ID NO: 34742 - RNA, 20 nt, Artificial Sequence
  MKO10034742_A_Nrde2
  gRNA
auccauaguugcguguccca

SEQ ID NO: 34743 - RNA, 20 nt, Artificial Sequence
  MKO10034743_A_Nrde2
  gRNA
cacgacgcaccaggguuucu

SEQ ID NO: 34744 - RNA, 20 nt, Artificial Sequence
  MKO10034744_A_Nrep
  gRNA
gcugccucgcugacuccgcc

SEQ ID NO: 34745 - RNA, 20 nt, Artificial Sequence
  MKO10034745_A_Nrep
  gRNA
cugacccagaccaagaguuc

SEQ ID NO: 34746 - RNA, 20 nt, Artificial Sequence
  MKO10034746_A_Nrep
  gRNA
ggugggacgauuaaaaaggg

SEQ ID NO: 34747 - RNA, 20 nt, Artificial Sequence
  MKO10034747_A_Nrf1
  gRNA
cgucguguacucauccaacg

SEQ ID NO: 34748 - RNA, 20 nt, Artificial Sequence
  MKO10034748_A_Nrf1
  gRNA
cugccgccucucaccaucga

SEQ ID NO: 34749 - RNA, 20 nt, Artificial Sequence
  MKO10034749_A_Nrf1
  gRNA
ugaugagguaacugcccauc

SEQ ID NO: 34750 - RNA, 20 nt, Artificial Sequence
  MKO10034750_A_Nrg1
  gRNA
ucguugccaaaacuacguaa

SEQ ID NO: 34751 - RNA, 20 nt, Artificial Sequence
  MKO10034751_A_Nrg1
  gRNA
acaugaugccgaccaccaac

SEQ ID NO: 34752 - RNA, 20 nt, Artificial Sequence
  MKO10034752_A_Nrg1
  gRNA
cccagucguggauguagaug

SEQ ID NO: 34753 - RNA, 20 nt, Artificial Sequence
  MKO10034753_A_Nrg2
  gRNA
ugaugcgaauaucacgacuc

SEQ ID NO: 34754 - RNA, 20 nt, Artificial Sequence
  MKO10034754_A_Nrg2
  gRNA
gccauccuugaaccagcgau

SEQ ID NO: 34755 - RNA, 20 nt, Artificial Sequence
  MKO10034755_A_Nrg2
  gRNA
cucuguccgaagaauccguu

SEQ ID NO: 34756 - RNA, 20 nt, Artificial Sequence
  MKO10034756_A_Nrg3
  gRNA
gcuaauccgguuaggcgucc

SEQ ID NO: 34757 - RNA, 20 nt, Artificial Sequence
  MKO10034757_A_Nrg3
  gRNA
ggaaggcaucgccugcguac

SEQ ID NO: 34758 - RNA, 20 nt, Artificial Sequence
  MKO10034758_A_Nrg3
  gRNA
ccuacuuggauccgauaaga

SEQ ID NO: 34759 - RNA, 20 nt, Artificial Sequence
  MKO10034759_A_Nrg4
  gRNA
gccgacagauuacuuucgcu

SEQ ID NO: 34760 - RNA, 20 nt, Artificial Sequence
  MKO10034760_A_Nrg4
  gRNA
aaccucuucgcagcgugcuc

SEQ ID NO: 34761 - RNA, 20 nt, Artificial Sequence
  MKO10034761_A_Nrg4
  gRNA
cauaacaaauccccccauug

SEQ ID NO: 34762 - RNA, 20 nt, Artificial Sequence
  MKO10034762_A_Nrgn
  gRNA
augucaagaauaucgucguc

SEQ ID NO: 34763 - RNA, 20 nt, Artificial Sequence
  MKO10034763_A_Nrgn
  gRNA
cgauauucuugacaucccgc

SEQ ID NO: 34764 - RNA, 20 nt, Artificial Sequence
  MKO10034764_A_Nrgn
  gRNA
accggcaauggacugcugca

SEQ ID NO: 34765 - RNA, 20 nt, Artificial Sequence
  MKO10034765_A_Nrip1
  gRNA
aacgacccguagaguacuuc

SEQ ID NO: 34766 - RNA, 20 nt, Artificial Sequence
  MKO10034766_A_Nrip1
  gRNA
gaugcauuaguaacccuucg

SEQ ID NO: 34767 - RNA, 20 nt, Artificial Sequence
  MKO10034767_A_Nrip1
  gRNA
auugucuuaacuuaccucga

SEQ ID NO: 34768 - RNA, 20 nt, Artificial Sequence
  MKO10034768_A_Nrip2
  gRNA
ccuguuugaguuggcgcugc

SEQ ID NO: 34769 - RNA, 20 nt, Artificial Sequence
  MKO10034769_A_Nrip2
  gRNA
ccagcagcgccaacucaaac

SEQ ID NO: 34770 - RNA, 20 nt, Artificial Sequence
  MKO10034770_A_Nrip2
  gRNA
ccaggaccagaugcuucgag

SEQ ID NO: 34771 - RNA, 20 nt, Artificial Sequence
  MKO10034771_A_Nrip3
  gRNA
cccaagggacacgagugcuc

SEQ ID NO: 34772 - RNA, 20 nt, Artificial Sequence
  MKO10034772_A_Nrip3
  gRNA
cgccucugcagaauguuaug

SEQ ID NO: 34773 - RNA, 20 nt, Artificial Sequence
  MKO10034773_A_Nrip3
  gRNA
ccacggcaucucaaaguagu

SEQ ID NO: 34774 - RNA, 20 nt, Artificial Sequence
  MKO10034774_A_Nrk
  gRNA
aucuccauccaacagacuuu

SEQ ID NO: 34775 - RNA, 20 nt, Artificial Sequence
  MKO10034775_A_Nrk
  gRNA
ggacggaacucaaccugcug

SEQ ID NO: 34776 - RNA, 20 nt, Artificial Sequence
  MKO10034776_A_Nrk
  gRNA
cucacccgucuuccuaucuc

SEQ ID NO: 34777 - RNA, 20 nt, Artificial Sequence
  MKO10034777_A_Nrl
  gRNA
agaggucgcgcucgcgagcc

SEQ ID NO: 34778 - RNA, 20 nt, Artificial Sequence
  MKO10034778_A_Nrl
  gRNA
ucgcgagcgcgaccucuaua

SEQ ID NO: 34779 - RNA, 20 nt, Artificial Sequence
  MKO10034779_A_Nrl
  gRNA
gagccuucugagggccgauc

SEQ ID NO: 34780 - RNA, 20 nt, Artificial Sequence
  MKO10034780_A_Nrm
  gRNA
gagccgaucggugcccaagg

SEQ ID NO: 34781 - RNA, 20 nt, Artificial Sequence
  MKO10034781_A_Nrm
  gRNA
gcacagccuuauggcgacug

SEQ ID NO: 34782 - RNA, 20 nt, Artificial Sequence
  MKO10034782_A_Nrm
  gRNA
ucaccgggaccgccagacuc

SEQ ID NO: 34783 - RNA, 20 nt, Artificial Sequence
  MKO10034783_A_Nrn1l
  gRNA
uauaugguaucacagcgguu

SEQ ID NO: 34784 - RNA, 20 nt, Artificial Sequence
  MKO10034784_A_Nrn1l
  gRNA
auccgcucccgaacacucac

SEQ ID NO: 34785 - RNA, 20 nt, Artificial Sequence
  MKO10034785_A_Nrn1l
  gRNA
cgcugugauaccauauacca

SEQ ID NO: 34786 - RNA, 20 nt, Artificial Sequence
  MKO10034786_A_Nrn1
  gRNA
ugauguucgucuugucgucc

SEQ ID NO: 34787 - RNA, 20 nt, Artificial Sequence
  MKO10034787_A_Nrn1
  gRNA
gcacggaaagcgccgggagc

SEQ ID NO: 34788 - RNA, 20 nt, Artificial Sequence
  MKO10034788_A_Nrn1
  gRNA
acuuaccuauuugcaccgcg

SEQ ID NO: 34789 - RNA, 20 nt, Artificial Sequence
  MKO10034789_A_Nrp1
  gRNA
cucuucaggcguucuaucca

SEQ ID NO: 34790 - RNA, 20 nt, Artificial Sequence
  MKO10034790_A_Nrp1
  gRNA
ccacaauaacgcccaaugug

SEQ ID NO: 34791 - RNA, 20 nt, Artificial Sequence
  MKO10034791_A_Nrp1
  gRNA
cuucaacccacauuucgauu

SEQ ID NO: 34792 - RNA, 20 nt, Artificial Sequence
  MKO10034792_A_Nrp2
  gRNA
uucagccgaccuccgcaggg

SEQ ID NO: 34793 - RNA, 20 nt, Artificial Sequence
  MKO10034793_A_Nrp2
  gRNA
ggauaguccuggggguagcc

SEQ ID NO: 34794 - RNA, 20 nt, Artificial Sequence
  MKO10034794_A_Nrp2
  gRNA
caugcuccaggucaaagguc

SEQ ID NO: 34795 - RNA, 20 nt, Artificial Sequence
  MKO10034795_A_Nrp
  gRNA
ccgacugggccacccgagac

SEQ ID NO: 34796 - RNA, 20 nt, Artificial Sequence
  MKO10034796_A_Nrp
  gRNA
gucucaaaccguuaauccgu

SEQ ID NO: 34797 - RNA, 20 nt, Artificial Sequence
  MKO10034797_A_Nrp
  gRNA
ggcccagucggccgcuaggc

SEQ ID NO: 34798 - RNA, 20 nt, Artificial Sequence
  MKO10034798_A_Nrros
  gRNA
uagagucgucgagccucaug

SEQ ID NO: 34799 - RNA, 20 nt, Artificial Sequence
  MKO10034799_A_Nrros
  gRNA
cauccggcaagugccggaac

SEQ ID NO: 34800 - RNA, 20 nt, Artificial Sequence
  MKO10034800_A_Nrros
  gRNA
aggggcgggaacuccaucuc

SEQ ID NO: 34801 - RNA, 20 nt, Artificial Sequence
  MKO10034801_A_Nrsn1
  gRNA
agauccagagaucgccuaac

SEQ ID NO: 34802 - RNA, 20 nt, Artificial Sequence
  MKO10034802_A_Nrsn1
  gRNA
uucgccaaaagcuucgauuu

SEQ ID NO: 34803 - RNA, 20 nt, Artificial Sequence
  MKO10034803_A_Nrsn1
  gRNA
accgaacuccauagcgcugc

SEQ ID NO: 34804 - RNA, 20 nt, Artificial Sequence
  MKO10034804_A_Nrsn2
  gRNA
agcgacgcugugcggaguag

SEQ ID NO: 34805 - RNA, 20 nt, Artificial Sequence
  MKO10034805_A_Nrsn2
  gRNA
gggucgguugauauaccgaa

SEQ ID NO: 34806 - RNA, 20 nt, Artificial Sequence
  MKO10034806_A_Nrsn2
  gRNA
caagaacggcgacugacuac

SEQ ID NO: 34807 - RNA, 20 nt, Artificial Sequence
  MKO10034807_A_Nrtn
  gRNA
gcgucguagcggggcaagcg

SEQ ID NO: 34808 - RNA, 20 nt, Artificial Sequence
  MKO10034808_A_Nrtn
  gRNA
gcacccguguugucgcccga

SEQ ID NO: 34809 - RNA, 20 nt, Artificial Sequence
  MKO10034809_A_Nrtn
  gRNA
cccgggaccgcgccgucgag

SEQ ID NO: 34810 - RNA, 20 nt, Artificial Sequence
  MKO10034810_A_Nrxn1
  gRNA
cgccggucaacgacggcgcc

SEQ ID NO: 34811 - RNA, 20 nt, Artificial Sequence
  MKO10034811_A_Nrxn1
  gRNA
gcucuacaucgaccgcgccg

SEQ ID NO: 34812 - RNA, 20 nt, Artificial Sequence
  MKO10034812_A_Nrxn1
  gRNA
agaguauauugccacguuca

SEQ ID NO: 34813 - RNA, 20 nt, Artificial Sequence
  MKO10034813_A_Nrxn2
  gRNA
gcucgcuacgcgcguugggc

SEQ ID NO: 34814 - RNA, 20 nt, Artificial Sequence
  MKO10034814_A_Nrxn2
  gRNA
uguugcugacccgcgacgcg

SEQ ID NO: 34815 - RNA, 20 nt, Artificial Sequence
  MKO10034815_A_Nrxn2
  gRNA
caccugacguuaaacagcga

SEQ ID NO: 34816 - RNA, 20 nt, Artificial Sequence
  MKO10034816_A_Nrxn3
  gRNA
auccgcgaccuguucaucga

SEQ ID NO: 34817 - RNA, 20 nt, Artificial Sequence
  MKO10034817_A_Nrxn3
  gRNA
auacuacgcaccucuuucgc

SEQ ID NO: 34818 - RNA, 20 nt, Artificial Sequence
  MKO10034818_A_Nrxn3
  gRNA
agauacacugcgucuagagu

SEQ ID NO: 34819 - RNA, 20 nt, Artificial Sequence
  MKO10034819_A_Nsa2
  gRNA
gaauugcaccgcaaacgaua

SEQ ID NO: 34820 - RNA, 20 nt, Artificial Sequence
  MKO10034820_A_Nsa2
  gRNA
gagaaaaagagaaagaaaga

SEQ ID NO: 34821 - RNA, 20 nt, Artificial Sequence
  MKO10034821_A_Nsa2
  gRNA
gaagagaaacaccaagcaga

SEQ ID NO: 34822 - RNA, 20 nt, Artificial Sequence
  MKO10034822_A_Nsd1
  gRNA
ucuacguaguauucgcgaua

SEQ ID NO: 34823 - RNA, 20 nt, Artificial Sequence
  MKO10034823_A_Nsd1
  gRNA
aaaucuguuagcacgcuuuc

SEQ ID NO: 34824 - RNA, 20 nt, Artificial Sequence
  MKO10034824_A_Nsd1
  gRNA
auaucgcgaauacuacguag

SEQ ID NO: 34825 - RNA, 20 nt, Artificial Sequence
  MKO10034825_A_Nsdhl
  gRNA
cggcccaagggacccccagu

SEQ ID NO: 34826 - RNA, 20 nt, Artificial Sequence
  MKO10034826_A_Nsdhl
  gRNA
cgccuauaaagaacugcacc

SEQ ID NO: 34827 - RNA, 20 nt, Artificial Sequence
  MKO10034827_A_Nsdhl
  gRNA
ccccgggugcaguucuuuau

SEQ ID NO: 34828 - RNA, 20 nt, Artificial Sequence
  MKO10034828_A_Nsfl1c
  gRNA
uaugcucacucucgguuuac

SEQ ID NO: 34829 - RNA, 20 nt, Artificial Sequence
  MKO10034829_A_Nsfl1c
  gRNA
uuaccuaggagcugugccuc

SEQ ID NO: 34830 - RNA, 20 nt, Artificial Sequence
  MKO10034830_A_Nsfl1c
  gRNA
cauucaugaccaagaugaag

SEQ ID NO: 34831 - RNA, 20 nt, Artificial Sequence
  MKO10034831_A_Nsf
  gRNA
gccaucuugucggugucgua

SEQ ID NO: 34832 - RNA, 20 nt, Artificial Sequence
  MKO10034832_A_Nsf
  gRNA
cccuuacgacaccgacaaga

SEQ ID NO: 34833 - RNA, 20 nt, Artificial Sequence
  MKO10034833_A_Nsf
  gRNA
aagcugaacgcgaugcaucc

SEQ ID NO: 34834 - RNA, 20 nt, Artificial Sequence
  MKO10034834_A_Nsg1
  gRNA
ucacccgcuccgugucgcca

SEQ ID NO: 34835 - RNA, 20 nt, Artificial Sequence
  MKO10034835_A_Nsg1
  gRNA
uaugaaccugaucgcaaaaa

SEQ ID NO: 34836 - RNA, 20 nt, Artificial Sequence
  MKO10034836_A_Nsg1
  gRNA
uaugaccgcgccugcccuga

SEQ ID NO: 34837 - RNA, 20 nt, Artificial Sequence
  MKO10034837_A_Nsg2
  gRNA
cgaguaguaagcauccagcg

SEQ ID NO: 34838 - RNA, 20 nt, Artificial Sequence
  MKO10034838_A_Nsg2
  gRNA
ccucuaauggcccugcgucu

SEQ ID NO: 34839 - RNA, 20 nt, Artificial Sequence
  MKO10034839_A_Nsg2
  gRNA
gggggccaagccgccuuccg

SEQ ID NO: 34840 - RNA, 20 nt, Artificial Sequence
  MKO10034840_A_Nsl1
  gRNA
gaaagcacagcacgcgaguc

SEQ ID NO: 34841 - RNA, 20 nt, Artificial Sequence
  MKO10034841_A_Nsl1
  gRNA
guagaagauuugaaaugccg

SEQ ID NO: 34842 - RNA, 20 nt, Artificial Sequence
  MKO10034842_A_Nsl1
  gRNA
caggagaacgucagcuuuaa

SEQ ID NO: 34843 - RNA, 20 nt, Artificial Sequence
  MKO10034843_A_Nsmaf
  gRNA
cuccaaguugagaagcagua

SEQ ID NO: 34844 - RNA, 20 nt, Artificial Sequence
  MKO10034844_A_Nsmaf
  gRNA
aauaucucagcccauucuua

SEQ ID NO: 34845 - RNA, 20 nt, Artificial Sequence
  MKO10034845_A_Nsmaf
  gRNA
aacaccuuuaccuuaagaau

SEQ ID NO: 34846 - RNA, 20 nt, Artificial Sequence
  MKO10034846_A_Nsmce1
  gRNA
agcacuuacggucauggacc

SEQ ID NO: 34847 - RNA, 20 nt, Artificial Sequence
  MKO10034847_A_Nsmce1
  gRNA
aaaugcgacuguagauaagc

SEQ ID NO: 34848 - RNA, 20 nt, Artificial Sequence
  MKO10034848_A_Nsmce1
  gRNA
ucccuuugaguugaucaacu

SEQ ID NO: 34849 - RNA, 20 nt, Artificial Sequence
  MKO10034849_A_Nsmce2
  gRNA
acccguuacauauccuucag

SEQ ID NO: 34850 - RNA, 20 nt, Artificial Sequence
  MKO10034850_A_Nsmce2
  gRNA
acuuacuuugagucuccaca

SEQ ID NO: 34851 - RNA, 20 nt, Artificial Sequence
  MKO10034851_A_Nsmce2
  gRNA
aguaccagauuuaaaauuac

SEQ ID NO: 34852 - RNA, 20 nt, Artificial Sequence
  MKO10034852_A_Nsmce4a
  gRNA
uuaacauaucaaacgagcuc

SEQ ID NO: 34853 - RNA, 20 nt, Artificial Sequence
  MKO10034853_A_Nsmce4a
  gRNA
ugucuuggccgaucacuucg

SEQ ID NO: 34854 - RNA, 20 nt, Artificial Sequence
  MKO10034854_A_Nsmce4a
  gRNA
acuagguuggguucaauaca

SEQ ID NO: 34855 - RNA, 20 nt, Artificial Sequence
  MKO10034855_A_Nsmf
  gRNA
ccuuacuuuggccgcuaccg

SEQ ID NO: 34856 - RNA, 20 nt, Artificial Sequence
  MKO10034856_A_Nsmf
  gRNA
aacucacgcuugcauaguug

SEQ ID NO: 34857 - RNA, 20 nt, Artificial Sequence
  MKO10034857_A_Nsmf
  gRNA
gacgccuacucuggccacga

SEQ ID NO: 34858 - RNA, 20 nt, Artificial Sequence
  MKO10034858_A_Nsun2
  gRNA
gcucuucgagcacuacuauc

SEQ ID NO: 34859 - RNA, 20 nt, Artificial Sequence
  MKO10034859_A_Nsun2
  gRNA
ugguacgcuaccuuauggug

SEQ ID NO: 34860 - RNA, 20 nt, Artificial Sequence
  MKO10034860_A_Nsun2
  gRNA
cagacucagucucgcugacc

SEQ ID NO: 34861 - RNA, 20 nt, Artificial Sequence
  MKO10034861_A_Nsun3
  gRNA
aacgaguaugaucgcccgag

SEQ ID NO: 34862 - RNA, 20 nt, Artificial Sequence
  MKO10034862_A_Nsun3
  gRNA
accuuacgaguucuaccugu

SEQ ID NO: 34863 - RNA, 20 nt, Artificial Sequence
  MKO10034863_A_Nsun3
  gRNA
gugauagccccucagaugca

SEQ ID NO: 34864 - RNA, 20 nt, Artificial Sequence
  MKO10034864_A_Nsun4
  gRNA
gaauggcgguccgugguaca

SEQ ID NO: 34865 - RNA, 20 nt, Artificial Sequence
  MKO10034865_A_Nsun4
  gRNA
accaaguccgaguuaccuca

SEQ ID NO: 34866 - RNA, 20 nt, Artificial Sequence
  MKO10034866_A_Nsun4
  gRNA
gaccucuccacuucccgaac

SEQ ID NO: 34867 - RNA, 20 nt, Artificial Sequence
  MKO10034867_A_Nsun5
  gRNA
ucagcuucuucucggcgcga

SEQ ID NO: 34868 - RNA, 20 nt, Artificial Sequence
  MKO10034868_A_Nsun5
  gRNA
ucggggugugagccgaaaug

SEQ ID NO: 34869 - RNA, 20 nt, Artificial Sequence
  MKO10034869_A_Nsun5
  gRNA
gagcauccacucuaccgugc

SEQ ID NO: 34870 - RNA, 20 nt, Artificial Sequence
  MKO10034870_A_Nsun6
  gRNA
gucagagugaauacgcauuu

SEQ ID NO: 34871 - RNA, 20 nt, Artificial Sequence
  MKO10034871_A_Nsun6
  gRNA
ggaugagcaagacauccggg

SEQ ID NO: 34872 - RNA, 20 nt, Artificial Sequence
  MKO10034872_A_Nsun6
  gRNA
gccguuaauaucagaauaca

SEQ ID NO: 34873 - RNA, 20 nt, Artificial Sequence
  MKO10034873_A_Nsun7
  gRNA
uuugauucgacaucucgcca

SEQ ID NO: 34874 - RNA, 20 nt, Artificial Sequence
  MKO10034874_A_Nsun7
  gRNA
uggucucuucauucucggaa

SEQ ID NO: 34875 - RNA, 20 nt, Artificial Sequence
  MKO10034875_A_Nsun7
  gRNA
cagaauaugguaaaucgaga

SEQ ID NO: 34876 - RNA, 20 nt, Artificial Sequence
  MKO10034876_A_Nt5c1a
  gRNA
ggaguacgugcgauaccagc

SEQ ID NO: 34877 - RNA, 20 nt, Artificial Sequence
  MKO10034877_A_Nt5c1a
  gRNA
cgagaacaaaccuuuggcgc

SEQ ID NO: 34878 - RNA, 20 nt, Artificial Sequence
  MKO10034878_A_Nt5c1a
  gRNA
ggcucuggaggacaccgcga

SEQ ID NO: 34879 - RNA, 20 nt, Artificial Sequence
  MKO10034879_A_Nt5c1b
  gRNA
gccgauguucgucucgaguu

SEQ ID NO: 34880 - RNA, 20 nt, Artificial Sequence
  MKO10034880_A_Nt5c1b
  gRNA
uguauacgggcagugauccg

SEQ ID NO: 34881 - RNA, 20 nt, Artificial Sequence
  MKO10034881_A_Nt5c1b
  gRNA
gccagcguuccgguuuguca

SEQ ID NO: 34882 - RNA, 20 nt, Artificial Sequence
  MKO10034882_A_Nt5c2
  gRNA
accgucgagaagccuaucac

SEQ ID NO: 34883 - RNA, 20 nt, Artificial Sequence
  MKO10034883_A_Nt5c2
  gRNA
ugugaaccgaaguuuagcca

SEQ ID NO: 34884 - RNA, 20 nt, Artificial Sequence
  MKO10034884_A_Nt5c2
  gRNA
accggugauaggcuucucga

SEQ ID NO: 34885 - RNA, 20 nt, Artificial Sequence
  MKO10034885_A_Nt5c3b
  gRNA
aaauugugggcgcccuucgc

SEQ ID NO: 34886 - RNA, 20 nt, Artificial Sequence
  MKO10034886_A_Nt5c3b
  gRNA
acgguccugaugcggcagcc

SEQ ID NO: 34887 - RNA, 20 nt, Artificial Sequence
  MKO10034887_A_Nt5c3b
  gRNA
cauuguaagcaaaucugcuc

SEQ ID NO: 34888 - RNA, 20 nt, Artificial Sequence
  MKO10034888_A_Nt5c3
  gRNA
acucaccacucuaccaugua

SEQ ID NO: 34889 - RNA, 20 nt, Artificial Sequence
  MKO10034889_A_Nt5c3
  gRNA
ucucacuuacuaugacacgu

SEQ ID NO: 34890 - RNA, 20 nt, Artificial Sequence
  MKO10034890_A_Nt5c3
  gRNA
aggaggcgcugccaaacuuc

SEQ ID NO: 34891 - RNA, 20 nt, Artificial Sequence
  MKO10034891_A_Nt5c
  gRNA
caucucucgcaaagcgucca

SEQ ID NO: 34892 - RNA, 20 nt, Artificial Sequence
  MKO10034892_A_Nt5c
  gRNA
gccuauacaguaccgcuggg

SEQ ID NO: 34893 - RNA, 20 nt, Artificial Sequence
  MKO10034893_A_Nt5c
  gRNA
auaauccgcuccacaaacuc

SEQ ID NO: 34894 - RNA, 20 nt, Artificial Sequence
  MKO10034894_A_Nt5dc1
  gRNA
uccgacauuccuugcugcuc

SEQ ID NO: 34895 - RNA, 20 nt, Artificial Sequence
  MKO10034895_A_Nt5dc1
  gRNA
cgcuguacaucagacaagcc

SEQ ID NO: 34896 - RNA, 20 nt, Artificial Sequence
  MKO10034896_A_Nt5dc1
  gRNA
ugauaacuacuuugaccugc

SEQ ID NO: 34897 - RNA, 20 nt, Artificial Sequence
  MKO10034897_A_Nt5dc2
  gRNA
aucacuucaucguccggcac

SEQ ID NO: 34898 - RNA, 20 nt, Artificial Sequence
  MKO10034898_A_Nt5dc2
  gRNA
ccaugucuugcucgauccac

SEQ ID NO: 34899 - RNA, 20 nt, Artificial Sequence
  MKO10034899_A_Nt5dc2
  gRNA
uauccgcgaugugcauguaa

SEQ ID NO: 34900 - RNA, 20 nt, Artificial Sequence
  MKO10034900_A_Nt5dc3
  gRNA
gacuccauuacgacguccag

SEQ ID NO: 34901 - RNA, 20 nt, Artificial Sequence
  MKO10034901_A_Nt5dc3
  gRNA
accuucucaucaacgaacac

SEQ ID NO: 34902 - RNA, 20 nt, Artificial Sequence
  MKO10034902_A_Nt5dc3
  gRNA
ucacccgcuggacgucguaa

SEQ ID NO: 34903 - RNA, 20 nt, Artificial Sequence
  MKO10034903_A_Nt5e
  gRNA
ccacucagacgugccgcuuc

SEQ ID NO: 34904 - RNA, 20 nt, Artificial Sequence
  MKO10034904_A_Nt5e
  gRNA
cgggagaacgaucgucuacc

SEQ ID NO: 34905 - RNA, 20 nt, Artificial Sequence
  MKO10034905_A_Nt5e
  gRNA
cuuaucgcucagaaaguucg

SEQ ID NO: 34906 - RNA, 20 nt, Artificial Sequence
  MKO10034906_A_Nt5m
  gRNA
agcugcagcccccucgccgc

SEQ ID NO: 34907 - RNA, 20 nt, Artificial Sequence
  MKO10034907_A_Nt5m
  gRNA
ccgaccuucucauagaugac

SEQ ID NO: 34908 - RNA, 20 nt, Artificial Sequence
  MKO10034908_A_Nt5m
  gRNA
ugcacucaugggcagacgac

SEQ ID NO: 34909 - RNA, 20 nt, Artificial Sequence
  MKO10034909_A_Nuan1
  gRNA
cagauccaucacaauguguc

SEQ ID NO: 34910 - RNA, 20 nt, Artificial Sequence
  MKO10034910_A_Nuan1
  gRNA
auuguaguccugagacauac

SEQ ID NO: 34911 - RNA, 20 nt, Artificial Sequence
  MKO10034911_A_Nuan1
  gRNA
caggcuggaaguacaucuug

SEQ ID NO: 34912 - RNA, 20 nt, Artificial Sequence
  MKO10034912_A_Ntf3
  gRNA
agagacgcuacaauucgccc

SEQ ID NO: 34913 - RNA, 20 nt, Artificial Sequence
  MKO10034913_A_Ntf3
  gRNA
ucugcauagcguuuccuccg

SEQ ID NO: 34914 - RNA, 20 nt, Artificial Sequence
  MKO10034914_A_Ntf3
  gRNA
uaccguggcagaaguaacca

SEQ ID NO: 34915 - RNA, 20 nt, Artificial Sequence
  MKO10034915_A_Ntf5
  gRNA
agaccgcacccgcaagccgc

SEQ ID NO: 34916 - RNA, 20 nt, Artificial Sequence
  MKO10034916_A_Ntf5
  gRNA
cuucuucgagacgcgcugca

SEQ ID NO: 34917 - RNA, 20 nt, Artificial Sequence
  MKO10034917_A_Ntf5
  gRNA
gcaguaugcgacgcagugag

SEQ ID NO: 34918 - RNA, 20 nt, Artificial Sequence
  MKO10034918_A_Nthl1
  gRNA
acagaauagccaaccgacug

SEQ ID NO: 34919 - RNA, 20 nt, Artificial Sequence
  MKO10034919_A_Nthl1
  gRNA
auccugcagcagcgcuacga

SEQ ID NO: 34920 - RNA, 20 nt, Artificial Sequence
  MKO10034920_A_Nthl1
  gRNA
ucugccuagcgugucaucau

SEQ ID NO: 34921 - RNA, 20 nt, Artificial Sequence
  MKO10034921_A_Ntmt1
  gRNA
uggugacgucaugacgagcg

SEQ ID NO: 34922 - RNA, 20 nt, Artificial Sequence
  MKO10034922_A_Ntmt1
  gRNA
ggucgacauggucgacguga

SEQ ID NO: 34923 - RNA, 20 nt, Artificial Sequence
  MKO10034923_A_Ntmt1
  gRNA
cgccggaucauccgcacugc

SEQ ID NO: 34924 - RNA, 20 nt, Artificial Sequence
  MKO10034924_A_Ntm
  gRNA
gucuguaccgagcagguaua

SEQ ID NO: 34925 - RNA, 20 nt, Artificial Sequence
  MKO10034925_A_Ntm
  gRNA
accuucacucuucguaccac

SEQ ID NO: 34926 - RNA, 20 nt, Artificial Sequence
  MKO10034926_A_Ntm
  gRNA
guggugccuagauccucgug

SEQ ID NO: 34927 - RNA, 20 nt, Artificial Sequence
  MKO10034927_A_Ntn1
  gRNA
gcccgucacgccguccuugc

SEQ ID NO: 34928 - RNA, 20 nt, Artificial Sequence
  MKO10034928_A_Ntn1
  gRNA
uuccgguuccuccacgcugc

SEQ ID NO: 34929 - RNA, 20 nt, Artificial Sequence
  MKO10034929_A_Ntn1
  gRNA
gccuuuggcacaucgguugc

SEQ ID NO: 34930 - RNA, 20 nt, Artificial Sequence
  MKO10034930_A_Ntn3
  gRNA
cgacuguccggccgccgcag

SEQ ID NO: 34931 - RNA, 20 nt, Artificial Sequence
  MKO10034931_A_Ntn3
  gRNA
ucacauugcagaccugcgcg

SEQ ID NO: 34932 - RNA, 20 nt, Artificial Sequence
  MKO10034932_A_Ntn3
  gRNA
gaucacgauagaagcccucc

SEQ ID NO: 34933 - RNA, 20 nt, Artificial Sequence
  MKO10034933_A_Ntn4
  gRNA
gucgcuugagcagccgcacu

SEQ ID NO: 34934 - RNA, 20 nt, Artificial Sequence
  MKO10034934_A_Ntn4
  gRNA
ugcguaccuuugcaagcguc

SEQ ID NO: 34935 - RNA, 20 nt, Artificial Sequence
  MKO10034935_A_Ntn4
  gRNA
cacguugacgucgaagugac

SEQ ID NO: 34936 - RNA, 20 nt, Artificial Sequence
  MKO10034936_A_Ntn5
  gRNA
gucgcccaucccaucgagac

SEQ ID NO: 34937 - RNA, 20 nt, Artificial Sequence
  MKO10034937_A_Ntn5
  gRNA
accccuguugcaucucgauc

SEQ ID NO: 34938 - RNA, 20 nt, Artificial Sequence
  MKO10034938_A_Ntn5
  gRNA
gucccgcugugcagaaacgc

SEQ ID NO: 34939 - RNA, 20 nt, Artificial Sequence
  MKO10034939_A_Ntng1
  gRNA
gaagccauauuucguagccg

SEQ ID NO: 34940 - RNA, 20 nt, Artificial Sequence
  MKO10034940_A_Ntng1
  gRNA
cuagagaaaucucucgacua

SEQ ID NO: 34941 - RNA, 20 nt, Artificial Sequence
  MKO10034941_A_Ntng1
  gRNA
ucauguccguggauuccggc

SEQ ID NO: 34942 - RNA, 20 nt, Artificial Sequence
  MKO10034942_A_Ntng2
  gRNA
gcaccgaggaguacucacgc

SEQ ID NO: 34943 - RNA, 20 nt, Artificial Sequence
  MKO10034943_A_Ntng2
  gRNA
acguaggugccacccagcgc

SEQ ID NO: 34944 - RNA, 20 nt, Artificial Sequence
  MKO10034944_A_Ntng2
  gRNA
agaacuuccgcacacgcgcc

SEQ ID NO: 34945 - RNA, 20 nt, Artificial Sequence
  MKO10034945_A_Ntpcr
  gRNA
acagcaucuggcggaccgcu

SEQ ID NO: 34946 - RNA, 20 nt, Artificial Sequence
  MKO10034946_A_Ntpcr
  gRNA
cguccggcugcucugcacga

SEQ ID NO: 34947 - RNA, 20 nt, Artificial Sequence
  MKO10034947_A_Ntpcr
  gRNA
auacugccccacucgacacu

SEQ ID NO: 34948 - RNA, 20 nt, Artificial Sequence
  MKO10034948_A_Ntrk1
  gRNA
ccucaaacuccaagcguugc

SEQ ID NO: 34949 - RNA, 20 nt, Artificial Sequence
  MKO10034949_A_Ntrk1
  gRNA
ccuagaaccaucgugaagag

SEQ ID NO: 34950 - RNA, 20 nt, Artificial Sequence
  MKO10034950_A_Ntrk1
  gRNA
gcggaggccacucuucacga

SEQ ID NO: 34951 - RNA, 20 nt, Artificial Sequence
  MKO10034951_A_Ntrk2
  gRNA
uaagccccagagccgcgcca

SEQ ID NO: 34952 - RNA, 20 nt, Artificial Sequence
  MKO10034952_A_Ntrk2
  gRNA
ggcagcucgggaugucgccc

SEQ ID NO: 34953 - RNA, 20 nt, Artificial Sequence
  MKO10034953_A_Ntrk2
  gRNA
agaugacguugaagcuuacg

SEQ ID NO: 34954 - RNA, 20 nt, Artificial Sequence
  MKO10034954_A_Ntrk3
  gRNA
aauccgccagaaacuacacu

SEQ ID NO: 34955 - RNA, 20 nt, Artificial Sequence
  MKO10034955_A_Ntrk3
  gRNA
uccgaacuuacaauucccga

SEQ ID NO: 34956 - RNA, 20 nt, Artificial Sequence
  MKO10034956_A_Ntrk3
  gRNA
ggacuaugugggcuccgugc

SEQ ID NO: 34957 - RNA, 20 nt, Artificial Sequence
  MKO10034957_A_Ntsr1
  gRNA
ggcgccgccgccgaaagaag

SEQ ID NO: 34958 - RNA, 20 nt, Artificial Sequence
  MKO10034958_A_Ntsr1
  gRNA
uacguaagacgaggacucca

SEQ ID NO: 34959 - RNA, 20 nt, Artificial Sequence
  MKO10034959_A_Ntsr1
  gRNA
gcuggugaccgcuguauacc

SEQ ID NO: 34960 - RNA, 20 nt, Artificial Sequence
  MKO10034960_A_Ntsr2
  gRNA
aguaagucgcgccacgcucc

SEQ ID NO: 34961 - RNA, 20 nt, Artificial Sequence
  MKO10034961_A_Ntsr2
  gRNA
uauucgcucaucuucgcgcu

SEQ ID NO: 34962 - RNA, 20 nt, Artificial Sequence
  MKO10034962_A_Ntsr2
  gRNA
guguggugaacagcgcuccg

SEQ ID NO: 34963 - RNA, 20 nt, Artificial Sequence
  MKO10034963_A_Nts
  gRNA
cgucaaugauaaaaacgaga

SEQ ID NO: 34964 - RNA, 20 nt, Artificial Sequence
  MKO10034964_A_Nts
  gRNA
augcaugaugacgaccuugu

SEQ ID NO: 34965 - RNA, 20 nt, Artificial Sequence
  MKO10034965_A_Nts
  gRNA
uccagaaaaucugccgcagc

SEQ ID NO: 34966 - RNA, 20 nt, Artificial Sequence
  MKO10034966_A_Nuak1
  gRNA
gcgucgcccgagauugucaa

SEQ ID NO: 34967 - RNA, 20 nt, Artificial Sequence
  MKO10034967_A_Nuak1
  gRNA
augauuacaucagugagcgc

SEQ ID NO: 34968 - RNA, 20 nt, Artificial Sequence
  MKO10034968_A_Nuak1
  gRNA
aggccugccguugacaaucu

SEQ ID NO: 34969 - RNA, 20 nt, Artificial Sequence
  MKO10034969_A_Nuak2
  gRNA
uguaaucauacagaucgccu

SEQ ID NO: 34970 - RNA, 20 nt, Artificial Sequence
  MKO10034970_A_Nuak2
  gRNA
uugaugagcccguccgccag

SEQ ID NO: 34971 - RNA, 20 nt, Artificial Sequence
  MKO10034971_A_Nuak2
  gRNA
agcgcccggccgcuggcgga

SEQ ID NO: 34972 - RNA, 20 nt, Artificial Sequence
  MKO10034972_A_Nub1
  gRNA
cgcgcucaauugcuuugcgu

SEQ ID NO: 34973 - RNA, 20 nt, Artificial Sequence
  MKO10034973_A_Nub1
  gRNA
cgacgcaaagcaauugagcg

SEQ ID NO: 34974 - RNA, 20 nt, Artificial Sequence
  MKO10034974_A_Nub1
  gRNA
augguguaccucucuccgcc

SEQ ID NO: 34975 - RNA, 20 nt, Artificial Sequence
  MKO10034975_A_Nubp1
  gRNA
gccaucgauucccaagauca

SEQ ID NO: 34976 - RNA, 20 nt, Artificial Sequence
  MKO10034976_A_Nubp1
  gRNA
uucagugcacaccucgccca

SEQ ID NO: 34977 - RNA, 20 nt, Artificial Sequence
  MKO10034977_A_Nubp1
  gRNA
accgggauccggagcagcgc

SEQ ID NO: 34978 - RNA, 20 nt, Artificial Sequence
  MKO10034978_A_Nubp2
  gRNA
gauccacaggcggugucuau

SEQ ID NO: 34979 - RNA, 20 nt, Artificial Sequence
  MKO10034979_A_Nubp2
  gRNA
ugaugugucgcaccccggcc

SEQ ID NO: 34980 - RNA, 20 nt, Artificial Sequence
  MKO10034980_A_Nubp2
  gRNA
ggggcgcagggcuuccauag

SEQ ID NO: 34981 - RNA, 20 nt, Artificial Sequence
  MKO10034981_A_Nubpl
  gRNA
uucuugcaguccaaggcggu

SEQ ID NO: 34982 - RNA, 20 nt, Artificial Sequence
  MKO10034982_A_Nubpl
  gRNA
guuggaaagucuaccaccgc

SEQ ID NO: 34983 - RNA, 20 nt, Artificial Sequence
  MKO10034983_A_Nubpl
  gRNA
uacucacuuggugauaauuc

SEQ ID NO: 34984 - RNA, 20 nt, Artificial Sequence
  MKO10034984_A_Nucb1
  gRNA
cccgagccucaaacgugugc

SEQ ID NO: 34985 - RNA, 20 nt, Artificial Sequence
  MKO10034985_A_Nucb1
  gRNA
cguagcguuugaacucuuca

SEQ ID NO: 34986 - RNA, 20 nt, Artificial Sequence
  MKO10034986_A_Nucb1
  gRNA
ucaagcgacaggaggugucg

SEQ ID NO: 34987 - RNA, 20 nt, Artificial Sequence
  MKO10034987_A_Nucb2
  gRNA
gcuuuaggcuaccgcggauc

SEQ ID NO: 34988 - RNA, 20 nt, Artificial Sequence
  MKO10034988_A_Nucb2
  gRNA
uaaacucuucaugccgaguc

SEQ ID NO: 34989 - RNA, 20 nt, Artificial Sequence
  MKO10034989_A_Nucb2
  gRNA
acuuaguaagucacaaagug

SEQ ID NO: 34990 - RNA, 20 nt, Artificial Sequence
  MKO10034990_A_Nucks1
  gRNA
aaauguacgccagcaacgac

SEQ ID NO: 34991 - RNA, 20 nt, Artificial Sequence
  MKO10034991_A_Nucks1
  gRNA
uagaugcugccugucguugc

SEQ ID NO: 34992 - RNA, 20 nt, Artificial Sequence
  MKO10034992_A_Nucks1
  gRNA
gaugaccgaaucuucuuagc

SEQ ID NO: 34993 - RNA, 20 nt, Artificial Sequence
  MKO10034993_A_Nudcd1
  gRNA
ucuuucuaggacaccgccuu

SEQ ID NO: 34994 - RNA, 20 nt, Artificial Sequence
  MKO10034994_A_Nudcd1
  gRNA
acaaagcaucauguucuccg

SEQ ID NO: 34995 - RNA, 20 nt, Artificial Sequence
  MKO10034995_A_Nudcd1
  gRNA
ccugcuucuucgaauagaga

SEQ ID NO: 34996 - RNA, 20 nt, Artificial Sequence
  MKO10034996_A_Nudcd2
  gRNA
gauguccugcgcgcgagugc

SEQ ID NO: 34997 - RNA, 20 nt, Artificial Sequence
  MKO10034997_A_Nudcd2
  gRNA
cagaauguccgccccguuug

SEQ ID NO: 34998 - RNA, 20 nt, Artificial Sequence
  MKO10034998_A_Nudcd2
  gRNA
aaucucagggaacuacacga

SEQ ID NO: 34999 - RNA, 20 nt, Artificial Sequence
  MKO10034999_A_Nudcd3
  gRNA
guugaucuugucgaugucga

SEQ ID NO: 35000 - RNA, 20 nt, Artificial Sequence
  MKO10035000_A_Nudcd3
  gRNA
auggcaccguuguaacuguc

SEQ ID NO: 35001 - RNA, 20 nt, Artificial Sequence
  MKO10035001_A_Nudcd3
  gRNA
gcaagacuacaccgaccugg

SEQ ID NO: 35002 - RNA, 20 nt, Artificial Sequence
  MKO10035002_A_Nudc
  gRNA
acauccagcggcggcaucuc

SEQ ID NO: 35003 - RNA, 20 nt, Artificial Sequence
  MKO10035003_A_Nudc
  gRNA
gaucaaggaguugacugaug

SEQ ID NO: 35004 - RNA, 20 nt, Artificial Sequence
  MKO10035004_A_Nudc
  gRNA
cccggagagagaagcgagcu

SEQ ID NO: 35005 - RNA, 20 nt, Artificial Sequence
  MKO10035005_A_Nudt10
  gRNA
acucggcgugcacgggcuua

SEQ ID NO: 35006 - RNA, 20 nt, Artificial Sequence
  MKO10035006_A_Nudt10
  gRNA
agugcaagccgaaccagacg

SEQ ID NO: 35007 - RNA, 20 nt, Artificial Sequence
  MKO10035007_A_Nudt10
  gRNA
acauacuagggcucgcucuc

SEQ ID NO: 35008 - RNA, 20 nt, Artificial Sequence
  MKO10035008_A_Nudt11
  gRNA
acucggcgugcacgggcuug

SEQ ID NO: 35009 - RNA, 20 nt, Artificial Sequence
  MKO10035009_A_Nudt11
  gRNA
acauacuagggcucgcucuc

SEQ ID NO: 35010 - RNA, 20 nt, Artificial Sequence
  MKO10035010_A_Nudt11
  gRNA
agugcaagccgaaccagacg

SEQ ID NO: 35011 - RNA, 20 nt, Artificial Sequence
  MKO10035011_A_Nudt12
  gRNA
augaccugcauaauuacgac

SEQ ID NO: 35012 - RNA, 20 nt, Artificial Sequence
  MKO10035012_A_Nudt12
  gRNA
agauccagucguaauuaugc

SEQ ID NO: 35013 - RNA, 20 nt, Artificial Sequence
  MKO10035013_A_Nudt12
  gRNA
gaacuuguaucgacuaugcc

SEQ ID NO: 35014 - RNA, 20 nt, Artificial Sequence
  MKO10035014_A_Nudt13
  gRNA
gguaucgauguccugacgcc

SEQ ID NO: 35015 - RNA, 20 nt, Artificial Sequence
  MKO10035015_A_Nudt13
  gRNA
gggggacauaccacggcugg

SEQ ID NO: 35016 - RNA, 20 nt, Artificial Sequence
  MKO10035016_A_Nudt13
  gRNA
aggaguccaccgaguucagc

SEQ ID NO: 35017 - RNA, 20 nt, Artificial Sequence
  MKO10035017_A_Nudt14
  gRNA
ugucaccuccgcguagaaca

SEQ ID NO: 35018 - RNA, 20 nt, Artificial Sequence
  MKO10035018_A_Nudt14
  gRNA
gggcgucaucuaaauucaga

SEQ ID NO: 35019 - RNA, 20 nt, Artificial Sequence
  MKO10035019_A_Nudt14
  gRNA
uguggcaacucugcgcagau

SEQ ID NO: 35020 - RNA, 20 nt, Artificial Sequence
  MKO10035020_A_Nudt15
  gRNA
cugcucacccgaauuccaaa

SEQ ID NO: 35021 - RNA, 20 nt, Artificial Sequence
  MKO10035021_A_Nudt15
  gRNA
aaaugugugcuuugccuccg

SEQ ID NO: 35022 - RNA, 20 nt, Artificial Sequence
  MKO10035022_A_Nudt15
  gRNA
uggccgcuaacgcagagccg

SEQ ID NO: 35023 - RNA, 20 nt, Artificial Sequence
  MKO10035023_A_Nudt16l1
  gRNA
uggcggcguauagcauggcg

SEQ ID NO: 35024 - RNA, 20 nt, Artificial Sequence
  MKO10035024_A_Nudt16l1
  gRNA
ccggcgcuucuggucgcugg

SEQ ID NO: 35025 - RNA, 20 nt, Artificial Sequence
  MKO10035025_A_Nudt16l1
  gRNA
gauacguccgaaaagcugcc

SEQ ID NO: 35026 - RNA, 20 nt, Artificial Sequence
  MKO10035026_A_Nudt16
  gRNA
ugcgcguccacgaagccgcc

SEQ ID NO: 35027 - RNA, 20 nt, Artificial Sequence
  MKO10035027_A_Nudt16
  gRNA
gaugcggccgaacagcuugc

SEQ ID NO: 35028 - RNA, 20 nt, Artificial Sequence
  MKO10035028_A_Nudt16
  gRNA
cgggcgcguagagcagcgca

SEQ ID NO: 35029 - RNA, 20 nt, Artificial Sequence
  MKO10035029_A_Nudt17
  gRNA
guugcgccucgccgggcgcc

SEQ ID NO: 35030 - RNA, 20 nt, Artificial Sequence
  MKO10035030_A_Nudt17
  gRNA
gcugcgcgauggcugccgca

SEQ ID NO: 35031 - RNA, 20 nt, Artificial Sequence
  MKO10035031_A_Nudt17
  gRNA
agacuguacuguugacccga

SEQ ID NO: 35032 - RNA, 20 nt, Artificial Sequence
  MKO10035032_A_Nudt18
  gRNA
ggauaccuguuggucgagcg

SEQ ID NO: 35033 - RNA, 20 nt, Artificial Sequence
  MKO10035033_A_Nudt18
  gRNA
guguuccucgcucgaccaac

SEQ ID NO: 35034 - RNA, 20 nt, Artificial Sequence
  MKO10035034_A_Nudt18
  gRNA
ggccguguuccucaacgagc

SEQ ID NO: 35035 - RNA, 20 nt, Artificial Sequence
  MKO10035035_A_Nudt19
  gRNA
gaugcgcagcgcuacgucau

SEQ ID NO: 35036 - RNA, 20 nt, Artificial Sequence
  MKO10035036_A_Nudt19
  gRNA
ccacgcgcggaaugucgcgc

SEQ ID NO: 35037 - RNA, 20 nt, Artificial Sequence
  MKO10035037_A_Nudt19
  gRNA
uguggaucacaacucgguua

SEQ ID NO: 35038 - RNA, 20 nt, Artificial Sequence
  MKO10035038_A_Nudt1
  gRNA
ccucaguuacucgcugcgag

SEQ ID NO: 35039 - RNA, 20 nt, Artificial Sequence
  MKO10035039_A_Nudt1
  gRNA
agauccccuuugccgaccug

SEQ ID NO: 35040 - RNA, 20 nt, Artificial Sequence
  MKO10035040_A_Nudt1
  gRNA
auaugcacguccaucagcuc

SEQ ID NO: 35041 - RNA, 20 nt, Artificial Sequence
  MKO10035041_A_Nudt21
  gRNA
acuaaaacgcuuaaugacag

SEQ ID NO: 35042 - RNA, 20 nt, Artificial Sequence
  MKO10035042_A_Nudt21
  gRNA
accugaggagguucaaaauu

SEQ ID NO: 35043 - RNA, 20 nt, Artificial Sequence
  MKO10035043_A_Nudt21
  gRNA
cugguucagcuucaagagaa

SEQ ID NO: 35044 - RNA, 20 nt, Artificial Sequence
  MKO10035044_A_Nudt22
  gRNA
cgcuugcaaugagaccagcg

SEQ ID NO: 35045 - RNA, 20 nt, Artificial Sequence
  MKO10035045_A_Nudt22
  gRNA
cuggggcgcuagggugacuc

SEQ ID NO: 35046 - RNA, 20 nt, Artificial Sequence
  MKO10035046_A_Nudt22
  gRNA
caagcgauucccaacaacag

SEQ ID NO: 35047 - RNA, 20 nt, Artificial Sequence
  MKO10035047_A_Nudt2
  gRNA
gcaucaagccuaccgcuggc

SEQ ID NO: 35048 - RNA, 20 nt, Artificial Sequence
  MKO10035048_A_Nudt2
  gRNA
cagaagggagcucaauuacg

SEQ ID NO: 35049 - RNA, 20 nt, Artificial Sequence
  MKO10035049_A_Nudt2
  gRNA
ugaucaagccacaugcccuc

SEQ ID NO: 35050 - RNA, 20 nt, Artificial Sequence
  MKO10035050_A_Nudt3
  gRNA
cguguaugugcucaucguca

SEQ ID NO: 35051 - RNA, 20 nt, Artificial Sequence
  MKO10035051_A_Nudt3
  gRNA
guagccgccauccagaccga

SEQ ID NO: 35052 - RNA, 20 nt, Artificial Sequence
  MKO10035052_A_Nudt3
  gRNA
cucaaaguaugacgccugca

SEQ ID NO: 35053 - RNA, 20 nt, Artificial Sequence
  MKO10035053_A_Nudt4
  gRNA
accgaggaauuuccauuggu

SEQ ID NO: 35054 - RNA, 20 nt, Artificial Sequence
  MKO10035054_A_Nudt4
  gRNA
cagacugcucggaauauuug

SEQ ID NO: 35055 - RNA, 20 nt, Artificial Sequence
  MKO10035055_A_Nudt4
  gRNA
gugacugcugcgccgcccuc

SEQ ID NO: 35056 - RNA, 20 nt, Artificial Sequence
  MKO10035056_A_Nudt5
  gRNA
gaagcaguuccggcccccga

SEQ ID NO: 35057 - RNA, 20 nt, Artificial Sequence
  MKO10035057_A_Nudt5
  gRNA
gcaccaugagugcgucaucc

SEQ ID NO: 35058 - RNA, 20 nt, Artificial Sequence
  MKO10035058_A_Nudt5
  gRNA
ccuccaggguucaucgaaga

SEQ ID NO: 35059 - RNA, 20 nt, Artificial Sequence
  MKO10035059_A_Nudt6
  gRNA
guacaugucugacaucccga

SEQ ID NO: 35060 - RNA, 20 nt, Artificial Sequence
  MKO10035060_A_Nudt6
  gRNA
uauucagucugcucccguug

SEQ ID NO: 35061 - RNA, 20 nt, Artificial Sequence
  MKO10035061_A_Nudt6
  gRNA
ccaggaggccugucggagcc

SEQ ID NO: 35062 - RNA, 20 nt, Artificial Sequence
  MKO10035062_A_Nudt7
  gRNA
guccuuacaucaaauacgua

SEQ ID NO: 35063 - RNA, 20 nt, Artificial Sequence
  MKO10035063_A_Nudt7
  gRNA
gggcugaugucgcgaccuug

SEQ ID NO: 35064 - RNA, 20 nt, Artificial Sequence
  MKO10035064_A_Nudt7
  gRNA
ucccgacaucagacuuucuc

SEQ ID NO: 35065 - RNA, 20 nt, Artificial Sequence
  MKO10035065_A_Nudt8
  gRNA
cacgcugcguucuagucgcc

SEQ ID NO: 35066 - RNA, 20 nt, Artificial Sequence
  MKO10035066_A_Nudt8
  gRNA
ccgcgagcguaaccgggcag

SEQ ID NO: 35067 - RNA, 20 nt, Artificial Sequence
  MKO10035067_A_Nudt8
  gRNA
auguauuacaucuuggucgu

SEQ ID NO: 35068 - RNA, 20 nt, Artificial Sequence
  MKO10035068_A_Nudt9
  gRNA
ccgcagauccuauuauaacc

SEQ ID NO: 35069 - RNA, 20 nt, Artificial Sequence
  MKO10035069_A_Nudt9
  gRNA
uucaaaagucgagcgaaguc

SEQ ID NO: 35070 - RNA, 20 nt, Artificial Sequence
  MKO10035070_A_Nudt9
  gRNA
gagaccgcgguguacuccac

SEQ ID NO: 35071 - RNA, 20 nt, Artificial Sequence
  MKO10035071_A_Nuf2
  gRNA
ccggcuggagcacuucuaca

SEQ ID NO: 35072 - RNA, 20 nt, Artificial Sequence
  MKO10035072_A_Nuf2
  gRNA
cacuuaaaaaacgacuuguc

SEQ ID NO: 35073 - RNA, 20 nt, Artificial Sequence
  MKO10035073_A_Nuf2
  gRNA
ccauguagaagugcuccagc

SEQ ID NO: 35074 - RNA, 20 nt, Artificial Sequence
  MKO10035074_A_Nufip1
  gRNA
agcuugaucuucuucauacc

SEQ ID NO: 35075 - RNA, 20 nt, Artificial Sequence
  MKO10035075_A_Nufip1
  gRNA
ugccccuagaugcaugcucc

SEQ ID NO: 35076 - RNA, 20 nt, Artificial Sequence
  MKO10035076_A_Nufip1
  gRNA
uucugugauaccugugaucg

SEQ ID NO: 35077 - RNA, 20 nt, Artificial Sequence
  MKO10035077_A_Nufip2
  gRNA
uaucggucuuaucuacagcc

SEQ ID NO: 35078 - RNA, 20 nt, Artificial Sequence
  MKO10035078_A_Nufip2
  gRNA
gagccuaacaaaguguucgu

SEQ ID NO: 35079 - RNA, 20 nt, Artificial Sequence
  MKO10035079_A_Nufip2
  gRNA
agucugguccuucauugauc

SEQ ID NO: 35080 - RNA, 20 nt, Artificial Sequence
  MKO10035080_A_Nuggc
  gRNA
cuggaauagccggucccaag

SEQ ID NO: 35081 - RNA, 20 nt, Artificial Sequence
  MKO10035081_A_Nuggc
  gRNA
gacgcagguugcaucgagac

SEQ ID NO: 35082 - RNA, 20 nt, Artificial Sequence
  MKO10035082_A_Nuggc
  gRNA
aauucaccuucuguccgauc

SEQ ID NO: 35083 - RNA, 20 nt, Artificial Sequence
  MKO10035083_A_Numa1
  gRNA
guugccccucuuuaguguca

SEQ ID NO: 35084 - RNA, 20 nt, Artificial Sequence
  MKO10035084_A_Numa1
  gRNA
ucugcauguugcugaccccg

SEQ ID NO: 35085 - RNA, 20 nt, Artificial Sequence
  MKO10035085_A_Numa1
  gRNA
auccgagauggaacuggcca

SEQ ID NO: 35086 - RNA, 20 nt, Artificial Sequence
  MKO10035086_A_Numbl
  gRNA
gaugaggaugcggugcgcaa

SEQ ID NO: 35087 - RNA, 20 nt, Artificial Sequence
  MKO10035087_A_Numbl
  gRNA
cggggcccccugaaaccuuc

SEQ ID NO: 35088 - RNA, 20 nt, Artificial Sequence
  MKO10035088_A_Numbl
  gRNA
aucacgcccacaccaguggc

SEQ ID NO: 35089 - RNA, 20 nt, Artificial Sequence
  MKO10035089_A_Numb
  gRNA
uugacucaucaacuucuacg

SEQ ID NO: 35090 - RNA, 20 nt, Artificial Sequence
  MKO10035090_A_Numb
  gRNA
aguuguggacgagaaaacua

SEQ ID NO: 35091 - RNA, 20 nt, Artificial Sequence
  MKO10035091_A_Numb
  gRNA
gaaagacguuuaugucccag

SEQ ID NO: 35092 - RNA, 20 nt, Artificial Sequence
  MKO10035092_A_Nup107
  gRNA
cggaggugacgaggacugcc

SEQ ID NO: 35093 - RNA, 20 nt, Artificial Sequence
  MKO10035093_A_Nup107
  gRNA
aaucuuacaaggcugucgaa

SEQ ID NO: 35094 - RNA, 20 nt, Artificial Sequence
  MKO10035094_A_Nup107
  gRNA
uuguguagagcccuaaacgc

SEQ ID NO: 35095 - RNA, 20 nt, Artificial Sequence
  MKO10035095_A_Nup133
  gRNA
aagagggguccauccgcuau

SEQ ID NO: 35096 - RNA, 20 nt, Artificial Sequence
  MKO10035096_A_Nup133
  gRNA
ccaccaaaucagcgcucccg

SEQ ID NO: 35097 - RNA, 20 nt, Artificial Sequence
  MKO10035097_A_Nup133
  gRNA
uggugggggaauauccgagu

SEQ ID NO: 35098 - RNA, 20 nt, Artificial Sequence
  MKO10035098_A_Nup153
  gRNA
aguacgaaguacaccuuacc

SEQ ID NO: 35099 - RNA, 20 nt, Artificial Sequence
  MKO10035099_A_Nup153
  gRNA
gaaaauccagaacugccgau

SEQ ID NO: 35100 - RNA, 20 nt, Artificial Sequence
  MKO10035100_A_Nup153
  gRNA
agaugagcaugcgauuuaug

SEQ ID NO: 35101 - RNA, 20 nt, Artificial Sequence
  MKO10035101_A_Nup155
  gRNA
gucacugucaaucguaagcc

SEQ ID NO: 35102 - RNA, 20 nt, Artificial Sequence
  MKO10035102_A_Nup155
  gRNA
aguuccccucccgccugagc

SEQ ID NO: 35103 - RNA, 20 nt, Artificial Sequence
  MKO10035103_A_Nup155
  gRNA
ccaagaauuacuauauccac

SEQ ID NO: 35104 - RNA, 20 nt, Artificial Sequence
  MKO10035104_A_Nup160
  gRNA
guacuucaccguuccaaacg

SEQ ID NO: 35105 - RNA, 20 nt, Artificial Sequence
  MKO10035105_A_Nup160
  gRNA
gggacugcaagugccgcguu

SEQ ID NO: 35106 - RNA, 20 nt, Artificial Sequence
  MKO10035106_A_Nup160
  gRNA
cugccuccuuaugacguacc

SEQ ID NO: 35107 - RNA, 20 nt, Artificial Sequence
  MKO10035107_A_Nup188
  gRNA
agacguagcgucaccucuga

SEQ ID NO: 35108 - RNA, 20 nt, Artificial Sequence
  MKO10035108_A_Nup188
  gRNA
ggguacucgggacucacuaa

SEQ ID NO: 35109 - RNA, 20 nt, Artificial Sequence
  MKO10035109_A_Nup188
  gRNA
gaggucagcucuuagagaau

SEQ ID NO: 35110 - RNA, 20 nt, Artificial Sequence
  MKO10035110_A_Nup205
  gRNA
aucuguaaagcguguuguca

SEQ ID NO: 35111 - RNA, 20 nt, Artificial Sequence
  MKO10035111_A_Nup205
  gRNA
guugcgauccaggggcaaca

SEQ ID NO: 35112 - RNA, 20 nt, Artificial Sequence
  MKO10035112_A_Nup205
  gRNA
cagugagaaacaccgcaaag

SEQ ID NO: 35113 - RNA, 20 nt, Artificial Sequence
  MKO10035113_A_Nup210l
  gRNA
guauguggacgaugcaccgc

SEQ ID NO: 35114 - RNA, 20 nt, Artificial Sequence
  MKO10035114_A_Nup210l
  gRNA
caucauucuugcucgagaag

SEQ ID NO: 35115 - RNA, 20 nt, Artificial Sequence
  MKO10035115_A_Nup210l
  gRNA
ugagcuacgcugugauguaa

SEQ ID NO: 35116 - RNA, 20 nt, Artificial Sequence
  MKO10035116_A_Nup210
  gRNA
gguagccagcauagagccgu

SEQ ID NO: 35117 - RNA, 20 nt, Artificial Sequence
  MKO10035117_A_Nup210
  gRNA
uagagacaaucugaaugccg

SEQ ID NO: 35118 - RNA, 20 nt, Artificial Sequence
  MKO10035118_A_Nup210
  gRNA
ccucuuaccggagugcauug

SEQ ID NO: 35119 - RNA, 20 nt, Artificial Sequence
  MKO10035119_A_Nup214
  gRNA
uucaaacgaugccagcggaa

SEQ ID NO: 35120 - RNA, 20 nt, Artificial Sequence
  MKO10035120_A_Nup214
  gRNA
aagcacacucgagcgcuccu

SEQ ID NO: 35121 - RNA, 20 nt, Artificial Sequence
  MKO10035121_A_Nup214
  gRNA
acguccauuuaccuaucaca

SEQ ID NO: 35122 - RNA, 20 nt, Artificial Sequence
  MKO10035122_A_Nup35
  gRNA
auuaacccaccugcuaguaa

SEQ ID NO: 35123 - RNA, 20 nt, Artificial Sequence
  MKO10035123_A_Nup35
  gRNA
uuguugcagaguccucuugu

SEQ ID NO: 35124 - RNA, 20 nt, Artificial Sequence
  MKO10035124_A_Nup35
  gRNA
accugucuucuugaagucaa

SEQ ID NO: 35125 - RNA, 20 nt, Artificial Sequence
  MKO10035125_A_Nup37
  gRNA
cacucacgcuugcgagcucc

SEQ ID NO: 35126 - RNA, 20 nt, Artificial Sequence
  MKO10035126_A_Nup37
  gRNA
uccaggcaaugccgucaacu

SEQ ID NO: 35127 - RNA, 20 nt, Artificial Sequence
  MKO10035127_A_Nup37
  gRNA
uccgaguugacggcauugcc

SEQ ID NO: 35128 - RNA, 20 nt, Artificial Sequence
  MKO10035128_A_Nup43
  gRNA
cugugcgauauuagacauca

SEQ ID NO: 35129 - RNA, 20 nt, Artificial Sequence
  MKO10035129_A_Nup43
  gRNA
uucgaaggaagguuacggca

SEQ ID NO: 35130 - RNA, 20 nt, Artificial Sequence
  MKO10035130_A_Nup43
  gRNA
auuguagcugcuucgucaac

SEQ ID NO: 35131 - RNA, 20 nt, Artificial Sequence
  MKO10035131_A_Nup50
  gRNA
ugaacugcuccguccgcgau

SEQ ID NO: 35132 - RNA, 20 nt, Artificial Sequence
  MKO10035132_A_Nup50
  gRNA
cgugcuucacuauccaaucg

SEQ ID NO: 35133 - RNA, 20 nt, Artificial Sequence
  MKO10035133_A_Nup50
  gRNA
guguuucagucugauagcgg

SEQ ID NO: 35134 - RNA, 20 nt, Artificial Sequence
  MKO10035134_A_Nup54
  gRNA
ugauaccuuaaaccggcaaa

SEQ ID NO: 35135 - RNA, 20 nt, Artificial Sequence
  MKO10035135_A_Nup54
  gRNA
ucauugaaaggccuucucgg

SEQ ID NO: 35136 - RNA, 20 nt, Artificial Sequence
  MKO10035136_A_Nup54
  gRNA
ucucuucagucagccgaccc

SEQ ID NO: 35137 - RNA, 20 nt, Artificial Sequence
  MKO10035137_A_Nup62-il4i1
  gRNA
ggggccguaucuucacuuuc

SEQ ID NO: 35138 - RNA, 20 nt, Artificial Sequence
  MKO10035138_A_Nup62-il4i1
  gRNA
ugaguagcugcucauaaucg

SEQ ID NO: 35139 - RNA, 20 nt, Artificial Sequence
  MKO10035139_A_Nup62-il4i1
  gRNA
guucaacaagcauacgcuuc

SEQ ID NO: 35140 - RNA, 20 nt, Artificial Sequence
  MKO10035140_A_Nup62cl
  gRNA
gccacuuguaaucgugguag

SEQ ID NO: 35141 - RNA, 20 nt, Artificial Sequence
  MKO10035141_A_Nup62cl
  gRNA
uggagaguauggcgaacaau

SEQ ID NO: 35142 - RNA, 20 nt, Artificial Sequence
  MKO10035142_A_Nup62cl
  gRNA
accacuaccacgauuacaag

SEQ ID NO: 35143 - RNA, 20 nt, Artificial Sequence
  MKO10035143_A_Nup62
  gRNA
gcuccucaucagcgugcuga

SEQ ID NO: 35144 - RNA, 20 nt, Artificial Sequence
  MKO10035144_A_Nup62
  gRNA
auaccuucagcacgcugaug

SEQ ID NO: 35145 - RNA, 20 nt, Artificial Sequence
  MKO10035145_A_Nup62
  gRNA
guguggcagcugcguuacuc

SEQ ID NO: 35146 - RNA, 20 nt, Artificial Sequence
  MKO10035146_A_Nup85
  gRNA
aagaacugucggggaagucc

SEQ ID NO: 35147 - RNA, 20 nt, Artificial Sequence
  MKO10035147_A_Nup85
  gRNA
uguuggccugcaaaaaauug

SEQ ID NO: 35148 - RNA, 20 nt, Artificial Sequence
  MKO10035148_A_Nup85
  gRNA
cugccuaccuguuugguuga

SEQ ID NO: 35149 - RNA, 20 nt, Artificial Sequence
  MKO10035149_A_Nup88
  gRNA
aggcuccacgccaccaccgc

SEQ ID NO: 35150 - RNA, 20 nt, Artificial Sequence
  MKO10035150_A_Nup88
  gRNA
ccgaagaccagguuucucgu

SEQ ID NO: 35151 - RNA, 20 nt, Artificial Sequence
  MKO10035151_A_Nup88
  gRNA
ugacaucagacaacgugaua

SEQ ID NO: 35152 - RNA, 20 nt, Artificial Sequence
  MKO10035152_A_Nup93
  gRNA
guaucaucgagaaucaaugc

SEQ ID NO: 35153 - RNA, 20 nt, Artificial Sequence
  MKO10035153_A_Nup93
  gRNA
uucacaucaccgauguaacu

SEQ ID NO: 35154 - RNA, 20 nt, Artificial Sequence
  MKO10035154_A_Nup93
  gRNA
ucccccugggcgaagcucuc

SEQ ID NO: 35155 - RNA, 20 nt, Artificial Sequence
  MKO10035155_A_Nup98
  gRNA
aucucuucaggaggauuauu

SEQ ID NO: 35156 - RNA, 20 nt, Artificial Sequence
  MKO10035156_A_Nup98
  gRNA
ggugcugcuguaaaacuacu

SEQ ID NO: 35157 - RNA, 20 nt, Artificial Sequence
  MKO10035157_A_Nup98
  gRNA
acgacuaguggaggagcauu

SEQ ID NO: 35158 - RNA, 20 nt, Artificial Sequence
  MKO10035158_A_Nupl1
  gRNA
uccuccuagaguaaauccag

SEQ ID NO: 35159 - RNA, 20 nt, Artificial Sequence
  MKO10035159_A_Nupl1
  gRNA
ucuuuagggggagccuuagc

SEQ ID NO: 35160 - RNA, 20 nt, Artificial Sequence
  MKO10035160_A_Nupl1
  gRNA
acaacaucugcgucuacaac

SEQ ID NO: 35161 - RNA, 20 nt, Artificial Sequence
  MKO10035161_A_Nupl2
  gRNA
aaucuaacuaugucgaccaa

SEQ ID NO: 35162 - RNA, 20 nt, Artificial Sequence
  MKO10035162_A_Nupl2
  gRNA
ugcuggcauuccacccucga

SEQ ID NO: 35163 - RNA, 20 nt, Artificial Sequence
  MKO10035163_A_Nupl2
  gRNA
ggaugacguuggaguaccuc

SEQ ID NO: 35164 - RNA, 20 nt, Artificial Sequence
  MKO10035164_A_Nupr1l
  gRNA
gcccaccgucggcuucgaag

SEQ ID NO: 35165 - RNA, 20 nt, Artificial Sequence
  MKO10035165_A_Nupr1l
  gRNA
gcccggcggccacgagcgca

SEQ ID NO: 35166 - RNA, 20 nt, Artificial Sequence
  MKO10035166_A_Nupr1l
  gRNA
caccuccucuucgaagccga

SEQ ID NO: 35167 - RNA, 20 nt, Artificial Sequence
  MKO10035167_A_Nupr1
  gRNA
aauaccaaccgcccuagccc

SEQ ID NO: 35168 - RNA, 20 nt, Artificial Sequence
  MKO10035168_A_Nupr1
  gRNA
ucuucauccucuagguuuag

SEQ ID NO: 35169 - RNA, 20 nt, Artificial Sequence
  MKO10035169_A_Nupr1
  gRNA
agcuuccucucaugcccgcc

SEQ ID NO: 35170 - RNA, 20 nt, Artificial Sequence
  MKO10035170_A_Nus1
  gRNA
cgcaagcugcauacugccga

SEQ ID NO: 35171 - RNA, 20 nt, Artificial Sequence
  MKO10035171_A_Nus1
  gRNA
gacagcaccuucacugccga

SEQ ID NO: 35172 - RNA, 20 nt, Artificial Sequence
  MKO10035172_A_Nus1
  gRNA
ucaccuaaacaucagcuaug

SEQ ID NO: 35173 - RNA, 20 nt, Artificial Sequence
  MKO10035173_A_Nusap1
  gRNA
acgguaccuucauguuagcc

SEQ ID NO: 35174 - RNA, 20 nt, Artificial Sequence
  MKO10035174_A_Nusap1
  gRNA
gaagccgcauugccguccuc

SEQ ID NO: 35175 - RNA, 20 nt, Artificial Sequence
  MKO10035175_A_Nusap1
  gRNA
ugagauacacguuagcagug

SEQ ID NO: 35176 - RNA, 20 nt, Artificial Sequence
  MKO10035176_A_Nuuf2
  gRNA
uuacauaaauugcgccuagu

SEQ ID NO: 35177 - RNA, 20 nt, Artificial Sequence
  MKO10035177_A_Nuuf2
  gRNA
cacagauagcuucuccacaa

SEQ ID NO: 35178 - RNA, 20 nt, Artificial Sequence
  MKO10035178_A_Nuuf2
  gRNA
ggaugggagacaagccaauu

SEQ ID NO: 35179 - RNA, 20 nt, Artificial Sequence
  MKO10035179_A_Nuum1
  gRNA
uuuaugagaacuaucgucgc

SEQ ID NO: 35180 - RNA, 20 nt, Artificial Sequence
  MKO10035180_A_Nuum1
  gRNA
gguuugcguugccgccgccg

SEQ ID NO: 35181 - RNA, 20 nt, Artificial Sequence
  MKO10035181_A_Nuum1
  gRNA
agcggaccagcaacuuugac

SEQ ID NO: 35182 - RNA, 20 nt, Artificial Sequence
  MKO10035182_A_Nvl
  gRNA
ccgacuugcaaagacuguac

SEQ ID NO: 35183 - RNA, 20 nt, Artificial Sequence
  MKO10035183_A_Nvl
  gRNA
uucugaugaugauucgaaca

SEQ ID NO: 35184 - RNA, 20 nt, Artificial Sequence
  MKO10035184_A_Nvl
  gRNA
ccuguacagucuuugcaagu

SEQ ID NO: 35185 - RNA, 20 nt, Artificial Sequence
  MKO10035185_A_Nwd1
  gRNA
uggaugugcuaucaccgauc

SEQ ID NO: 35186 - RNA, 20 nt, Artificial Sequence
  MKO10035186_A_Nwd1
  gRNA
gaaccgggcaggggccguac

SEQ ID NO: 35187 - RNA, 20 nt, Artificial Sequence
  MKO10035187_A_Nwd1
  gRNA
gcaguugagcgagcaguucg

SEQ ID NO: 35188 - RNA, 20 nt, Artificial Sequence
  MKO10035188_A_Nxf1
  gRNA
uguacagucuucccgauuug

SEQ ID NO: 35189 - RNA, 20 nt, Artificial Sequence
  MKO10035189_A_Nxf1
  gRNA
caaccaucuccccgacgauu

SEQ ID NO: 35190 - RNA, 20 nt, Artificial Sequence
  MKO10035190_A_Nxf1
  gRNA
gggccuuuccgauggaagug

SEQ ID NO: 35191 - RNA, 20 nt, Artificial Sequence
  MKO10035191_A_Nxf2
  gRNA
gagacauauaaacaacgaua

SEQ ID NO: 35192 - RNA, 20 nt, Artificial Sequence
  MKO10035192_A_Nxf2
  gRNA
uccuagugcuccauaugcca

SEQ ID NO: 35193 - RNA, 20 nt, Artificial Sequence
  MKO10035193_A_Nxf2
  gRNA
ucugagagauucuaucauuc

SEQ ID NO: 35194 - RNA, 20 nt, Artificial Sequence
  MKO10035194_A_Nxf3
  gRNA
cuuaccugcaccggagugaa

SEQ ID NO: 35195 - RNA, 20 nt, Artificial Sequence
  MKO10035195_A_Nxf3
  gRNA
acuguaucacugacgugagc

SEQ ID NO: 35196 - RNA, 20 nt, Artificial Sequence
  MKO10035196_A_Nxf3
  gRNA
ccuccauguuaacauccguu

SEQ ID NO: 35197 - RNA, 20 nt, Artificial Sequence
  MKO10035197_A_Nxf7
  gRNA
accgaucauuaugagcauac

SEQ ID NO: 35198 - RNA, 20 nt, Artificial Sequence
  MKO10035198_A_Nxf7
  gRNA
uuguaggaacaacuaaugcc

SEQ ID NO: 35199 - RNA, 20 nt, Artificial Sequence
  MKO10035199_A_Nxf7
  gRNA
cccaguaugcucauaaugau

SEQ ID NO: 35200 - RNA, 20 nt, Artificial Sequence
  MKO10035200_A_Nxnl1
  gRNA
gucgcaaguaccgaguagac

SEQ ID NO: 35201 - RNA, 20 nt, Artificial Sequence
  MKO10035201_A_Nxnl1
  gRNA
caccagagucgcggccguuu

SEQ ID NO: 35202 - RNA, 20 nt, Artificial Sequence
  MKO10035202_A_Nxnl1
  gRNA
cugacgaguucuacgugcug

SEQ ID NO: 35203 - RNA, 20 nt, Artificial Sequence
  MKO10035203_A_Nxnl2
  gRNA
agcaagcuagcccgcgcucu

SEQ ID NO: 35204 - RNA, 20 nt, Artificial Sequence
  MKO10035204_A_Nxnl2
  gRNA
cgacacgaaaaccaccucga

SEQ ID NO: 35205 - RNA, 20 nt, Artificial Sequence
  MKO10035205_A_Nxnl2
  gRNA
agucgcggcugggcgagcac

SEQ ID NO: 35206 - RNA, 20 nt, Artificial Sequence
  MKO10035206_A_Nxn
  gRNA
ccccgcaauaacuucccgga

SEQ ID NO: 35207 - RNA, 20 nt, Artificial Sequence
  MKO10035207_A_Nxn
  gRNA
gcgucuaggaauauuagcga

SEQ ID NO: 35208 - RNA, 20 nt, Artificial Sequence
  MKO10035208_A_Nxn
  gRNA
ucucgucucaaccgacugua

SEQ ID NO: 35209 - RNA, 20 nt, Artificial Sequence
  MKO10035209_A_Nxpe2
  gRNA
ccuacgcaguagguacgcug

SEQ ID NO: 35210 - RNA, 20 nt, Artificial Sequence
  MKO10035210_A_Nxpe2
  gRNA
ccgcagcguaccuacugcgu

SEQ ID NO: 35211 - RNA, 20 nt, Artificial Sequence
  MKO10035211_A_Nxpe2
  gRNA
gugauucaacacugcgccag

SEQ ID NO: 35212 - RNA, 20 nt, Artificial Sequence
  MKO10035212_A_Nxpe3
  gRNA
aaagacgcucgugaagcgaa

SEQ ID NO: 35213 - RNA, 20 nt, Artificial Sequence
  MKO10035213_A_Nxpe3
  gRNA
gucuuuaccuuucguucgcc

SEQ ID NO: 35214 - RNA, 20 nt, Artificial Sequence
  MKO10035214_A_Nxpe3
  gRNA
uaccacgcggcccacggcgc

SEQ ID NO: 35215 - RNA, 20 nt, Artificial Sequence
  MKO10035215_A_Nxpe4
  gRNA
acugcaacaccaacuugccg

SEQ ID NO: 35216 - RNA, 20 nt, Artificial Sequence
  MKO10035216_A_Nxpe4
  gRNA
ggaccacuuacuguugcauu

SEQ ID NO: 35217 - RNA, 20 nt, Artificial Sequence
  MKO10035217_A_Nxpe4
  gRNA
cccacacaguguguaucccg

SEQ ID NO: 35218 - RNA, 20 nt, Artificial Sequence
  MKO10035218_A_Nxpe5
  gRNA
cucauguuccccugcguugc

SEQ ID NO: 35219 - RNA, 20 nt, Artificial Sequence
  MKO10035219_A_Nxpe5
  gRNA
aucaucaaacuggccaauac

SEQ ID NO: 35220 - RNA, 20 nt, Artificial Sequence
  MKO10035220_A_Nxpe5
  gRNA
ccuggucuuaccagcaacgc

SEQ ID NO: 35221 - RNA, 20 nt, Artificial Sequence
  MKO10035221_A_Nxph1
  gRNA
gccacuuaccaaguagacgg

SEQ ID NO: 35222 - RNA, 20 nt, Artificial Sequence
  MKO10035222_A_Nxph1
  gRNA
uauuucaggcauaacuccac

SEQ ID NO: 35223 - RNA, 20 nt, Artificial Sequence
  MKO10035223_A_Nxph1
  gRNA
aaaucggaacuacugaaguc

SEQ ID NO: 35224 - RNA, 20 nt, Artificial Sequence
  MKO10035224_A_Nxph2
  gRNA
ugggucgaaauugcacaaag

SEQ ID NO: 35225 - RNA, 20 nt, Artificial Sequence
  MKO10035225_A_Nxph2
  gRNA
ucacuaugguaauuguaguc

SEQ ID NO: 35226 - RNA, 20 nt, Artificial Sequence
  MKO10035226_A_Nxph2
  gRNA
cagcuggcacgaugagcuug

SEQ ID NO: 35227 - RNA, 20 nt, Artificial Sequence
  MKO10035227_A_Nxph3
  gRNA
ucgauaguccgugcuauaga

SEQ ID NO: 35228 - RNA, 20 nt, Artificial Sequence
  MKO10035228_A_Nxph3
  gRNA
ccuagggugccucgcaagcg

SEQ ID NO: 35229 - RNA, 20 nt, Artificial Sequence
  MKO10035229_A_Nxph3
  gRNA
gauagaggcugcccugcacu

SEQ ID NO: 35230 - RNA, 20 nt, Artificial Sequence
  MKO10035230_A_Nxph4
  gRNA
acuccuagcgcgcuuccgag

SEQ ID NO: 35231 - RNA, 20 nt, Artificial Sequence
  MKO10035231_A_Nxph4
  gRNA
cguccgugccgcgcaccaag

SEQ ID NO: 35232 - RNA, 20 nt, Artificial Sequence
  MKO10035232_A_Nxph4
  gRNA
aagagcaagaggagccauuc

SEQ ID NO: 35233 - RNA, 20 nt, Artificial Sequence
  MKO10035233_A_Nxt1
  gRNA
aagccagaccaccgugcuug

SEQ ID NO: 35234 - RNA, 20 nt, Artificial Sequence
  MKO10035234_A_Nxt1
  gRNA
ggcuugguguagcgucauca

SEQ ID NO: 35235 - RNA, 20 nt, Artificial Sequence
  MKO10035235_A_Nxt1
  gRNA
cgucacccaguaacacggug

SEQ ID NO: 35236 - RNA, 20 nt, Artificial Sequence
  MKO10035236_A_Nxt2
  gRNA
cauauugaucuggaauucgc

SEQ ID NO: 35237 - RNA, 20 nt, Artificial Sequence
  MKO10035237_A_Nxt2
  gRNA
ucacaacgagcacuguaguu

SEQ ID NO: 35238 - RNA, 20 nt, Artificial Sequence
  MKO10035238_A_Nxt2
  gRNA
uuagauugccaaccaguuca

SEQ ID NO: 35239 - RNA, 20 nt, Artificial Sequence
  MKO10035239_A_Nyap1
  gRNA
cucgacaccguugccacccc

SEQ ID NO: 35240 - RNA, 20 nt, Artificial Sequence
  MKO10035240_A_Nyap1
  gRNA
ggcgucucccgcucucgugc

SEQ ID NO: 35241 - RNA, 20 nt, Artificial Sequence
  MKO10035241_A_Nyap1
  gRNA
ugcggcucccuccucgauca

SEQ ID NO: 35242 - RNA, 20 nt, Artificial Sequence
  MKO10035242_A_Nyap2
  gRNA
gaacgagaaacgucgacgac

SEQ ID NO: 35243 - RNA, 20 nt, Artificial Sequence
  MKO10035243_A_Nyap2
  gRNA
ugacgcccuugagucucaag

SEQ ID NO: 35244 - RNA, 20 nt, Artificial Sequence
  MKO10035244_A_Nyap2
  gRNA
aucauucucgcgagcaaugu

SEQ ID NO: 35245 - RNA, 20 nt, Artificial Sequence
  MKO10035245_A_Nynrin
  gRNA
gcuucggguacuugagccag

SEQ ID NO: 35246 - RNA, 20 nt, Artificial Sequence
  MKO10035246_A_Nynrin
  gRNA
cucugagcgcguacacaucc

SEQ ID NO: 35247 - RNA, 20 nt, Artificial Sequence
  MKO10035247_A_Nynrin
  gRNA
agaucaccacuuacgauuac

SEQ ID NO: 35248 - RNA, 20 nt, Artificial Sequence
  MKO10035248_A_Nyx
  gRNA
uuucgagcgcagccgcaucg

SEQ ID NO: 35249 - RNA, 20 nt, Artificial Sequence
  MKO10035249_A_Nyx
  gRNA
cagggcgccgcagucgccaa

SEQ ID NO: 35250 - RNA, 20 nt, Artificial Sequence
  MKO10035250_A_Nyx
  gRNA
augcugauccugcuucuuca

SEQ ID NO: 35251 - RNA, 20 nt, Artificial Sequence
  MKO10035251_A_OTTMUSG00000016609
  gRNA
ucuguucuuagugucuucgc

SEQ ID NO: 35252 - RNA, 20 nt, Artificial Sequence
  MKO10035252_A_OTTMUSG00000016609
  gRNA
caagcucagaacuucacaca

SEQ ID NO: 35253 - RNA, 20 nt, Artificial Sequence
  MKO10035253_A_OTTMUSG00000016609
  gRNA
cgugcaugugaacuucacuc

SEQ ID NO: 35254 - RNA, 20 nt, Artificial Sequence
  MKO10035254_A_Oacyl
  gRNA
gagucugccuuugcgaaaca

SEQ ID NO: 35255 - RNA, 20 nt, Artificial Sequence
  MKO10035255_A_Oacyl
  gRNA
acuccccuuggggcuccggg

SEQ ID NO: 35256 - RNA, 20 nt, Artificial Sequence
  MKO10035256_A_Oacyl
  gRNA
agccccaaggggaguuuccg

SEQ ID NO: 35257 - RNA, 20 nt, Artificial Sequence
  MKO10035257_A_Oaf
  gRNA
cgucggguuugcgcagauca

SEQ ID NO: 35258 - RNA, 20 nt, Artificial Sequence
  MKO10035258_A_Oaf
  gRNA
agaaaaacccccgcgcagug

SEQ ID NO: 35259 - RNA, 20 nt, Artificial Sequence
  MKO10035259_A_Oaf
  gRNA
cuugaucugcgcaaacccga

SEQ ID NO: 35260 - RNA, 20 nt, Artificial Sequence
  MKO10035260_A_Oard1
  gRNA
uguaucugcgauucucgaag

SEQ ID NO: 35261 - RNA, 20 nt, Artificial Sequence
  MKO10035261_A_Oard1
  gRNA
ucuagcccauuguaucagug

SEQ ID NO: 35262 - RNA, 20 nt, Artificial Sequence
  MKO10035262_A_Oard1
  gRNA
ucccuugccugggcauggag

SEQ ID NO: 35263 - RNA, 20 nt, Artificial Sequence
  MKO10035263_A_Oas1a
  gRNA
aaucuaugccauccucaucg

SEQ ID NO: 35264 - RNA, 20 nt, Artificial Sequence
  MKO10035264_A_Oas1a
  gRNA
gguacauuccucgaugagga

SEQ ID NO: 35265 - RNA, 20 nt, Artificial Sequence
  MKO10035265_A_Oas1a
  gRNA
guauuaugacuuucaacacc

SEQ ID NO: 35266 - RNA, 20 nt, Artificial Sequence
  MKO10035266_A_Oas1b
  gRNA
gggcaaaggcaccgcgcuca

SEQ ID NO: 35267 - RNA, 20 nt, Artificial Sequence
  MKO10035267_A_Oas1b
  gRNA
guuuaaggagucccaacucc

SEQ ID NO: 35268 - RNA, 20 nt, Artificial Sequence
  MKO10035268_A_Oas1b
  gRNA
uacucgacucccauacuccc

SEQ ID NO: 35269 - RNA, 20 nt, Artificial Sequence
  MKO10035269_A_Oas1c
  gRNA
gauucgaagauucuuguaau

SEQ ID NO: 35270 - RNA, 20 nt, Artificial Sequence
  MKO10035270_A_Oas1c
  gRNA
cgaccaguucuaagaagguc

SEQ ID NO: 35271 - RNA, 20 nt, Artificial Sequence
  MKO10035271_A_Oas1c
  gRNA
cguagacuuuguuguagaau

SEQ ID NO: 35272 - RNA, 20 nt, Artificial Sequence
  MKO10035272_A_Oas1d
  gRNA
ccccgagcgccagcaugagu

SEQ ID NO: 35273 - RNA, 20 nt, Artificial Sequence
  MKO10035273_A_Oas1d
  gRNA
cgagaucucugacuaccugc

SEQ ID NO: 35274 - RNA, 20 nt, Artificial Sequence
  MKO10035274_A_Oas1d
  gRNA
uacgggauccacgaaaaccc

SEQ ID NO: 35275 - RNA, 20 nt, Artificial Sequence
  MKO10035275_A_Oas1e
  gRNA
acacuugcugccacuuuaac

SEQ ID NO: 35276 - RNA, 20 nt, Artificial Sequence
  MKO10035276_A_Oas1e
  gRNA
gugcuccccagagcgccagc

SEQ ID NO: 35277 - RNA, 20 nt, Artificial Sequence
  MKO10035277_A_Oas1e
  gRNA
accauguccaguagauuaga

SEQ ID NO: 35278 - RNA, 20 nt, Artificial Sequence
  MKO10035278_A_Oas1f
  gRNA
gaacugugauacgugccucg

SEQ ID NO: 35279 - RNA, 20 nt, Artificial Sequence
  MKO10035279_A_Oas1f
  gRNA
gagugcaguguguucgucgu

SEQ ID NO: 35280 - RNA, 20 nt, Artificial Sequence
  MKO10035280_A_Oas1f
  gRNA
gcugaagaaccucauccguu

SEQ ID NO: 35281 - RNA, 20 nt, Artificial Sequence
  MKO10035281_A_Oas1g
  gRNA
uaaucuacaccauccucauc

SEQ ID NO: 35282 - RNA, 20 nt, Artificial Sequence
  MKO10035282_A_Oas1g
  gRNA
guugguaccaguguuugacc

SEQ ID NO: 35283 - RNA, 20 nt, Artificial Sequence
  MKO10035283_A_Oas1g
  gRNA
guauuaugacuuucaacaca

SEQ ID NO: 35284 - RNA, 20 nt, Artificial Sequence
  MKO10035284_A_Oas1h
  gRNA
gagcacaguguaucgauugu

SEQ ID NO: 35285 - RNA, 20 nt, Artificial Sequence
  MKO10035285_A_Oas1h
  gRNA
gagcaauccgagugcugcua

SEQ ID NO: 35286 - RNA, 20 nt, Artificial Sequence
  MKO10035286_A_Oas1h
  gRNA
cauccgugagugcaccaugc

SEQ ID NO: 35287 - RNA, 20 nt, Artificial Sequence
  MKO10035287_A_Oas2
  gRNA
ccgcuggauaagucgcagca

SEQ ID NO: 35288 - RNA, 20 nt, Artificial Sequence
  MKO10035288_A_Oas2
  gRNA
ccgugcugcgacuuauccag

SEQ ID NO: 35289 - RNA, 20 nt, Artificial Sequence
  MKO10035289_A_Oas2
  gRNA
gccacaguucaaugacguca

SEQ ID NO: 35290 - RNA, 20 nt, Artificial Sequence
  MKO10035290_A_Oas3
  gRNA
cgguccggagcccuugggcc

SEQ ID NO: 35291 - RNA, 20 nt, Artificial Sequence
  MKO10035291_A_Oas3
  gRNA
agcugauccaacgugggacg

SEQ ID NO: 35292 - RNA, 20 nt, Artificial Sequence
  MKO10035292_A_Oas3
  gRNA
gcaacgggacagccuggcgc

SEQ ID NO: 35293 - RNA, 20 nt, Artificial Sequence
  MKO10035293_A_Oasl1
  gRNA
agcgaaacuucgugaagcau

SEQ ID NO: 35294 - RNA, 20 nt, Artificial Sequence
  MKO10035294_A_Oasl1
  gRNA
gaucagauuugcguagaccu

SEQ ID NO: 35295 - RNA, 20 nt, Artificial Sequence
  MKO10035295_A_Oasl1
  gRNA
gcagcuccaucaccguggcg

SEQ ID NO: 35296 - RNA, 20 nt, Artificial Sequence
  MKO10035296_A_Oasl2
  gRNA
cuguacauuccagcgcucgc

SEQ ID NO: 35297 - RNA, 20 nt, Artificial Sequence
  MKO10035297_A_Oasl2
  gRNA
cuguaggccccagcgagcgc

SEQ ID NO: 35298 - RNA, 20 nt, Artificial Sequence
  MKO10035298_A_Oasl2
  gRNA
aguuccugacgaccucguuu

SEQ ID NO: 35299 - RNA, 20 nt, Artificial Sequence
  MKO10035299_A_Oau
  gRNA
cauguaagcucgcucgucgu

SEQ ID NO: 35300 - RNA, 20 nt, Artificial Sequence
  MKO10035300_A_Oau
  gRNA
acagauccgaccaguuauga

SEQ ID NO: 35301 - RNA, 20 nt, Artificial Sequence
  MKO10035301_A_Oau
  gRNA
auauaacgaucugcccgcac

SEQ ID NO: 35302 - RNA, 20 nt, Artificial Sequence
  MKO10035302_A_Oaz1
  gRNA
uaccuguccuuacugcccuc

SEQ ID NO: 35303 - RNA, 20 nt, Artificial Sequence
  MKO10035303_A_Oaz1
  gRNA
aauaccaaccucuguccuca

SEQ ID NO: 35304 - RNA, 20 nt, Artificial Sequence
  MKO10035304_A_Oaz1
  gRNA
ggacaucaggagcaccaccg

SEQ ID NO: 35305 - RNA, 20 nt, Artificial Sequence
  MKO10035305_A_Oaz2
  gRNA
gaacaaugugccugcagcac

SEQ ID NO: 35306 - RNA, 20 nt, Artificial Sequence
  MKO10035306_A_Oaz2
  gRNA
caucguucacagggaggucc

SEQ ID NO: 35307 - RNA, 20 nt, Artificial Sequence
  MKO10035307_A_Oaz2
  gRNA
agcuggggacacuuacucaa

SEQ ID NO: 35308 - RNA, 20 nt, Artificial Sequence
  MKO10035308_A_Oaz3
  gRNA
cucuguccuuccgaucgauu

SEQ ID NO: 35309 - RNA, 20 nt, Artificial Sequence
  MKO10035309_A_Oaz3
  gRNA
gugugaucaccgacucuucc

SEQ ID NO: 35310 - RNA, 20 nt, Artificial Sequence
  MKO10035310_A_Oaz3
  gRNA
uugugaacuuccaaaucgau

SEQ ID NO: 35311 - RNA, 20 nt, Artificial Sequence
  MKO10035311_A_Obfc1
  gRNA
ggagauaucauccgaguccg

SEQ ID NO: 35312 - RNA, 20 nt, Artificial Sequence
  MKO10035312_A_Obfc1
  gRNA
augauaucuacccgccuuau

SEQ ID NO: 35313 - RNA, 20 nt, Artificial Sequence
  MKO10035313_A_Obfc1
  gRNA
cuuccguaacccagcccuac

SEQ ID NO: 35314 - RNA, 20 nt, Artificial Sequence
  MKO10035314_A_Obox1
  gRNA
uguguacaccaaagaacagc

SEQ ID NO: 35315 - RNA, 20 nt, Artificial Sequence
  MKO10035315_A_Obox1
  gRNA
guacuuguucaauauucugg

SEQ ID NO: 35316 - RNA, 20 nt, Artificial Sequence
  MKO10035316_A_Obox1
  gRNA
cuugagacucuugcuuaagu

SEQ ID NO: 35317 - RNA, 20 nt, Artificial Sequence
  MKO10035317_A_Obox2
  gRNA
uguguacaccaaagaagagc

SEQ ID NO: 35318 - RNA, 20 nt, Artificial Sequence
  MKO10035318_A_Obox2
  gRNA
uaacaaacaaacuagcccaa

SEQ ID NO: 35319 - RNA, 20 nt, Artificial Sequence
  MKO10035319_A_Obox2
  gRNA
cuucagacucuugcuuaagu

SEQ ID NO: 35320 - RNA, 20 nt, Artificial Sequence
  MKO10035320_A_Obox3
  gRNA
cagaauccccuaaugacucc

SEQ ID NO: 35321 - RNA, 20 nt, Artificial Sequence
  MKO10035321_A_Obox3
  gRNA
uuccauaccuguuguugacu

SEQ ID NO: 35322 - RNA, 20 nt, Artificial Sequence
  MKO10035322_A_Obox3
  gRNA
ccauuguccgagucaacaac

SEQ ID NO: 35323 - RNA, 20 nt, Artificial Sequence
  MKO10035323_A_Obox5
  gRNA
gcagcauaugccagccugac

SEQ ID NO: 35324 - RNA, 20 nt, Artificial Sequence
  MKO10035324_A_Obox5
  gRNA
uauuugggaucugauuucua

SEQ ID NO: 35325 - RNA, 20 nt, Artificial Sequence
  MKO10035325_A_Obox5
  gRNA
ccacaagaauaccugcuuga

SEQ ID NO: 35326 - RNA, 20 nt, Artificial Sequence
  MKO10035326_A_Obox6
  gRNA
aucuucuccgccucauuauc

SEQ ID NO: 35327 - RNA, 20 nt, Artificial Sequence
  MKO10035327_A_Obox6
  gRNA
uaacuaggugaccgcaccau

SEQ ID NO: 35328 - RNA, 20 nt, Artificial Sequence
  MKO10035328_A_Obox6
  gRNA
gaugaggugaaugcauuaag

SEQ ID NO: 35329 - RNA, 20 nt, Artificial Sequence
  MKO10035329_A_Obp1a
  gRNA
gaauaaucguuauaaacuug

SEQ ID NO: 35330 - RNA, 20 nt, Artificial Sequence
  MKO10035330_A_Obp1a
  gRNA
cccuuuaacuucugaacaaa

SEQ ID NO: 35331 - RNA, 20 nt, Artificial Sequence
  MKO10035331_A_Obp1a
  gRNA
aucagagaaguccugauuac

SEQ ID NO: 35332 - RNA, 20 nt, Artificial Sequence
  MKO10035332_A_Obp2a
  gRNA
cacaaugggacgucgucauu

SEQ ID NO: 35333 - RNA, 20 nt, Artificial Sequence
  MKO10035333_A_Obp2a
  gRNA
aaagcgcaugaaucuccgac

SEQ ID NO: 35334 - RNA, 20 nt, Artificial Sequence
  MKO10035334_A_Obp2a
  gRNA
cacguaccagaauacaacug

SEQ ID NO: 35335 - RNA, 20 nt, Artificial Sequence
  MKO10035335_A_Obp2b
  gRNA
caucauuguacccgagcagc

SEQ ID NO: 35336 - RNA, 20 nt, Artificial Sequence
  MKO10035336_A_Obp2b
  gRNA
cccuaugaccgugauagccc

SEQ ID NO: 35337 - RNA, 20 nt, Artificial Sequence
  MKO10035337_A_Obp2b
  gRNA
caagaagaccaucuauauac

SEQ ID NO: 35338 - RNA, 20 nt, Artificial Sequence
  MKO10035338_A_Obscn
  gRNA
gagcgcgcuucgcauccguu

SEQ ID NO: 35339 - RNA, 20 nt, Artificial Sequence
  MKO10035339_A_Obscn
  gRNA
gugagccuccaacgcgacau

SEQ ID NO: 35340 - RNA, 20 nt, Artificial Sequence
  MKO10035340_A_Obscn
  gRNA
gucugccgagacguugcgca

SEQ ID NO: 35341 - RNA, 20 nt, Artificial Sequence
  MKO10035341_A_Obsl1
  gRNA
gcggugggaauucgagaguu

SEQ ID NO: 35342 - RNA, 20 nt, Artificial Sequence
  MKO10035342_A_Obsl1
  gRNA
gcuuccgggguaaacgcuuc

SEQ ID NO: 35343 - RNA, 20 nt, Artificial Sequence
  MKO10035343_A_Obsl1
  gRNA
ggccgggugaaccguaggcg

SEQ ID NO: 35344 - RNA, 20 nt, Artificial Sequence
  MKO10035344_A_Oc90
  gRNA
uacauaucagacucguccac

SEQ ID NO: 35345 - RNA, 20 nt, Artificial Sequence
  MKO10035345_A_Oc90
  gRNA
ccucauagcaccugcgaugc

SEQ ID NO: 35346 - RNA, 20 nt, Artificial Sequence
  MKO10035346_A_Oc90
  gRNA
acuuacaggggcccaugcuc

SEQ ID NO: 35347 - RNA, 20 nt, Artificial Sequence
  MKO10035347_A_Oca2
  gRNA
gggaaaauggccuuacugcc

SEQ ID NO: 35348 - RNA, 20 nt, Artificial Sequence
  MKO10035348_A_Oca2
  gRNA
cauuggccuccucagagaaa

SEQ ID NO: 35349 - RNA, 20 nt, Artificial Sequence
  MKO10035349_A_Oca2
  gRNA
gagugucuuccuuaaaagaa

SEQ ID NO: 35350 - RNA, 20 nt, Artificial Sequence
  MKO10035350_A_Ocel1
  gRNA
ggcacucacagcucguaguc

SEQ ID NO: 35351 - RNA, 20 nt, Artificial Sequence
  MKO10035351_A_Ocel1
  gRNA
cauccgcaaacacgaucuuc

SEQ ID NO: 35352 - RNA, 20 nt, Artificial Sequence
  MKO10035352_A_Ocel1
  gRNA
ccgcaaauuugaugaccagc

SEQ ID NO: 35353 - RNA, 20 nt, Artificial Sequence
  MKO10035353_A_Ociad1
  gRNA
ucugccuauagcugugccgu

SEQ ID NO: 35354 - RNA, 20 nt, Artificial Sequence
  MKO10035354_A_Ociad1
  gRNA
acaaguaugcugauuacuca

SEQ ID NO: 35355 - RNA, 20 nt, Artificial Sequence
  MKO10035355_A_Ociad1
  gRNA
caagugucaagaccuauucc

SEQ ID NO: 35356 - RNA, 20 nt, Artificial Sequence
  MKO10035356_A_Ociad2
  gRNA
uaccuugguggacgaguccc

SEQ ID NO: 35357 - RNA, 20 nt, Artificial Sequence
  MKO10035357_A_Ociad2
  gRNA
accacggagcugaucuucaa

SEQ ID NO: 35358 - RNA, 20 nt, Artificial Sequence
  MKO10035358_A_Ociad2
  gRNA
acucuggcacacucuuauau

SEQ ID NO: 35359 - RNA, 20 nt, Artificial Sequence
  MKO10035359_A_Ocln
  gRNA
ugccacgaucguguacauaa

SEQ ID NO: 35360 - RNA, 20 nt, Artificial Sequence
  MKO10035360_A_Ocln
  gRNA
ucccauuauguacacgaucg

SEQ ID NO: 35361 - RNA, 20 nt, Artificial Sequence
  MKO10035361_A_Ocln
  gRNA
uaugaaacagacuacacgac

SEQ ID NO: 35362 - RNA, 20 nt, Artificial Sequence
  MKO10035362_A_Ocm
  gRNA
ucaguucucuagcgucgcuc

SEQ ID NO: 35363 - RNA, 20 nt, Artificial Sequence
  MKO10035363_A_Ocm
  gRNA
uucauagacaacgaccagag

SEQ ID NO: 35364 - RNA, 20 nt, Artificial Sequence
  MKO10035364_A_Ocm
  gRNA
ucuggucguugucuaugaac

SEQ ID NO: 35365 - RNA, 20 nt, Artificial Sequence
  MKO10035365_A_Ocrl
  gRNA
aauuucaaaguggcgcucuc

SEQ ID NO: 35366 - RNA, 20 nt, Artificial Sequence
  MKO10035366_A_Ocrl
  gRNA
ccugcauaugguggcggguu

SEQ ID NO: 35367 - RNA, 20 nt, Artificial Sequence
  MKO10035367_A_Ocrl
  gRNA
guuuaccuuccugagcuucg

SEQ ID NO: 35368 - RNA, 20 nt, Artificial Sequence
  MKO10035368_A_Ocsuamp
  gRNA
cguagauauugucgaaacgc

SEQ ID NO: 35369 - RNA, 20 nt, Artificial Sequence
  MKO10035369_A_Ocsuamp
  gRNA
cgcacauugccuaagacguu

SEQ ID NO: 35370 - RNA, 20 nt, Artificial Sequence
  MKO10035370_A_Ocsuamp
  gRNA
uucccggguggccauagugc

SEQ ID NO: 35371 - RNA, 20 nt, Artificial Sequence
  MKO10035371_A_Odam
  gRNA
aguccaaccugucuugauaa

SEQ ID NO: 35372 - RNA, 20 nt, Artificial Sequence
  MKO10035372_A_Odam
  gRNA
cuacuccugaaucuuaauaa

SEQ ID NO: 35373 - RNA, 20 nt, Artificial Sequence
  MKO10035373_A_Odam
  gRNA
aguaccucaagaucaaacac

SEQ ID NO: 35374 - RNA, 20 nt, Artificial Sequence
  MKO10035374_A_Odc1
  gRNA
uuccaccuagguugguucua

SEQ ID NO: 35375 - RNA, 20 nt, Artificial Sequence
  MKO10035375_A_Odc1
  gRNA
cuuucagacugaaauacagu

SEQ ID NO: 35376 - RNA, 20 nt, Artificial Sequence
  MKO10035376_A_Odc1
  gRNA
aggauuugacugugcaagca

SEQ ID NO: 35377 - RNA, 20 nt, Artificial Sequence
  MKO10035377_A_Odf1
  gRNA
aaggacgugacguacuccua

SEQ ID NO: 35378 - RNA, 20 nt, Artificial Sequence
  MKO10035378_A_Odf1
  gRNA
acgcgcacuuugacuugauc

SEQ ID NO: 35379 - RNA, 20 nt, Artificial Sequence
  MKO10035379_A_Odf1
  gRNA
uccaagcgaucccgcuccug

SEQ ID NO: 35380 - RNA, 20 nt, Artificial Sequence
  MKO10035380_A_Odf2l
  gRNA
aacgcuuaaggaagcucagu

SEQ ID NO: 35381 - RNA, 20 nt, Artificial Sequence
  MKO10035381_A_Odf2l
  gRNA
gaaagacuuccaucacuagu

SEQ ID NO: 35382 - RNA, 20 nt, Artificial Sequence
  MKO10035382_A_Odf2l
  gRNA
agacgucgcaaauacaaaga

SEQ ID NO: 35383 - RNA, 20 nt, Artificial Sequence
  MKO10035383_A_Odf2
  gRNA
acacaacaucgagcguauca

SEQ ID NO: 35384 - RNA, 20 nt, Artificial Sequence
  MKO10035384_A_Odf2
  gRNA
gauugacagucuaaugaacg

SEQ ID NO: 35385 - RNA, 20 nt, Artificial Sequence
  MKO10035385_A_Odf2
  gRNA
ucuacagaagacgacgauuc

SEQ ID NO: 35386 - RNA, 20 nt, Artificial Sequence
  MKO10035386_A_Odf3b
  gRNA
guaacucggcccggguccgc

SEQ ID NO: 35387 - RNA, 20 nt, Artificial Sequence
  MKO10035387_A_Odf3b
  gRNA
acaaacugcacgacccgucu

SEQ ID NO: 35388 - RNA, 20 nt, Artificial Sequence
  MKO10035388_A_Odf3b
  gRNA
gucacauuucucgcgcguuc

SEQ ID NO: 35389 - RNA, 20 nt, Artificial Sequence
  MKO10035389_A_Odf3l1
  gRNA
accgguagccaaaaguguac

SEQ ID NO: 35390 - RNA, 20 nt, Artificial Sequence
  MKO10035390_A_Odf3l1
  gRNA
cuugagaagacucgacccuc

SEQ ID NO: 35391 - RNA, 20 nt, Artificial Sequence
  MKO10035391_A_Odf3l1
  gRNA
aaucccaaaguaacucguuu

SEQ ID NO: 35392 - RNA, 20 nt, Artificial Sequence
  MKO10035392_A_Odf3l2
  gRNA
accucggacaccacggcccc

SEQ ID NO: 35393 - RNA, 20 nt, Artificial Sequence
  MKO10035393_A_Odf3l2
  gRNA
ccuacgcugccgguaggugu

SEQ ID NO: 35394 - RNA, 20 nt, Artificial Sequence
  MKO10035394_A_Odf3l2
  gRNA
cuucacugggccuccgagcg

SEQ ID NO: 35395 - RNA, 20 nt, Artificial Sequence
  MKO10035395_A_Odf3
  gRNA
ggguuacucacccgggccgg

SEQ ID NO: 35396 - RNA, 20 nt, Artificial Sequence
  MKO10035396_A_Odf3
  gRNA
ucuugguaugguagcgcccc

SEQ ID NO: 35397 - RNA, 20 nt, Artificial Sequence
  MKO10035397_A_Odf3
  gRNA
ggucuuaguccgggcagaaa

SEQ ID NO: 35398 - RNA, 20 nt, Artificial Sequence
  MKO10035398_A_Odf4
  gRNA
aucuuagccaccccaaaaac

SEQ ID NO: 35399 - RNA, 20 nt, Artificial Sequence
  MKO10035399_A_Odf4
  gRNA
aucggcuggagcuauuucau

SEQ ID NO: 35400 - RNA, 20 nt, Artificial Sequence
  MKO10035400_A_Odf4
  gRNA
aaugaaauagcuccagccga

SEQ ID NO: 35401 - RNA, 20 nt, Artificial Sequence
  MKO10035401_A_Ofcc1
  gRNA
caucagaaauucagccgacg

SEQ ID NO: 35402 - RNA, 20 nt, Artificial Sequence
  MKO10035402_A_Ofcc1
  gRNA
accgaaggugccgggaaucc

SEQ ID NO: 35403 - RNA, 20 nt, Artificial Sequence
  MKO10035403_A_Ofcc1
  gRNA
caggcucucaguggaacguc

SEQ ID NO: 35404 - RNA, 20 nt, Artificial Sequence
  MKO10035404_A_Ofd1
  gRNA
caccccgauccuuaaacguc

SEQ ID NO: 35405 - RNA, 20 nt, Artificial Sequence
  MKO10035405_A_Ofd1
  gRNA
gcgaguuagaagccccuauu

SEQ ID NO: 35406 - RNA, 20 nt, Artificial Sequence
  MKO10035406_A_Ofd1
  gRNA
aagggagugcccuccuaaua

SEQ ID NO: 35407 - RNA, 20 nt, Artificial Sequence
  MKO10035407_A_Ogdhl
  gRNA
ucgagagaucauacgucgcu

SEQ ID NO: 35408 - RNA, 20 nt, Artificial Sequence
  MKO10035408_A_Ogdhl
  gRNA
acggaaaacugcaucacgcc

SEQ ID NO: 35409 - RNA, 20 nt, Artificial Sequence
  MKO10035409_A_Ogdhl
  gRNA
gcccccgaugaaagucgugg

SEQ ID NO: 35410 - RNA, 20 nt, Artificial Sequence
  MKO10035410_A_Ogdh
  gRNA
accuaacgucgacaaacucg

SEQ ID NO: 35411 - RNA, 20 nt, Artificial Sequence
  MKO10035411_A_Ogdh
  gRNA
uccacgaguuugucgacguu

SEQ ID NO: 35412 - RNA, 20 nt, Artificial Sequence
  MKO10035412_A_Ogdh
  gRNA
ccugguggaucguacaagcc

SEQ ID NO: 35413 - RNA, 20 nt, Artificial Sequence
  MKO10035413_A_Ogfod1
  gRNA
ugugcgaaauacgaguucac

SEQ ID NO: 35414 - RNA, 20 nt, Artificial Sequence
  MKO10035414_A_Ogfod1
  gRNA
uuucgcacacgacaugucaa

SEQ ID NO: 35415 - RNA, 20 nt, Artificial Sequence
  MKO10035415_A_Ogfod1
  gRNA
cgcgcugggccaggauccgc

SEQ ID NO: 35416 - RNA, 20 nt, Artificial Sequence
  MKO10035416_A_Ogfod2
  gRNA
gcugaauauaguacgucccc

SEQ ID NO: 35417 - RNA, 20 nt, Artificial Sequence
  MKO10035417_A_Ogfod2
  gRNA
ccuagccgggugguaggagc

SEQ ID NO: 35418 - RNA, 20 nt, Artificial Sequence
  MKO10035418_A_Ogfod2
  gRNA
ucguagcuccugcgcagccg

SEQ ID NO: 35419 - RNA, 20 nt, Artificial Sequence
  MKO10035419_A_Ogfod3
  gRNA
cucucccuagguggaucgga

SEQ ID NO: 35420 - RNA, 20 nt, Artificial Sequence
  MKO10035420_A_Ogfod3
  gRNA
gauggucaccgaagguuuga

SEQ ID NO: 35421 - RNA, 20 nt, Artificial Sequence
  MKO10035421_A_Ogfod3
  gRNA
accaucguaguccucagagc

SEQ ID NO: 35422 - RNA, 20 nt, Artificial Sequence
  MKO10035422_A_Ogfrl1
  gRNA
uacucaccauccggcuuaaa

SEQ ID NO: 35423 - RNA, 20 nt, Artificial Sequence
  MKO10035423_A_Ogfrl1
  gRNA
agagaagcuucuaugccgcg

SEQ ID NO: 35424 - RNA, 20 nt, Artificial Sequence
  MKO10035424_A_Ogfrl1
  gRNA
cugaccauuggauguacgug

SEQ ID NO: 35425 - RNA, 20 nt, Artificial Sequence
  MKO10035425_A_Ogfr
  gRNA
ccgaaacuggcgugcuaugc

SEQ ID NO: 35426 - RNA, 20 nt, Artificial Sequence
  MKO10035426_A_Ogfr
  gRNA
uaccuaccggguaguugugc

SEQ ID NO: 35427 - RNA, 20 nt, Artificial Sequence
  MKO10035427_A_Ogfr
  gRNA
uuggcaugccaguucacucc

SEQ ID NO: 35428 - RNA, 20 nt, Artificial Sequence
  MKO10035428_A_Ogg1
  gRNA
gaugccagccguagucacga

SEQ ID NO: 35429 - RNA, 20 nt, Artificial Sequence
  MKO10035429_A_Ogg1
  gRNA
cagauugcccaucgugacua

SEQ ID NO: 35430 - RNA, 20 nt, Artificial Sequence
  MKO10035430_A_Ogg1
  gRNA
gcgugcuggcagaucaagua

SEQ ID NO: 35431 - RNA, 20 nt, Artificial Sequence
  MKO10035431_A_Ogn
  gRNA
ugaauuacacguagacuuuc

SEQ ID NO: 35432 - RNA, 20 nt, Artificial Sequence
  MKO10035432_A_Ogn
  gRNA
ucuacguguaauucaccuuc

SEQ ID NO: 35433 - RNA, 20 nt, Artificial Sequence
  MKO10035433_A_Ogn
  gRNA
ccguaaaaucaagucuucuu

SEQ ID NO: 35434 - RNA, 20 nt, Artificial Sequence
  MKO10035434_A_Ogu
  gRNA
cuauacacuuccagugucga

SEQ ID NO: 35435 - RNA, 20 nt, Artificial Sequence
  MKO10035435_A_Ogu
  gRNA
aaggaaagcauacguuucgu

SEQ ID NO: 35436 - RNA, 20 nt, Artificial Sequence
  MKO10035436_A_Ogu
  gRNA
agcauuaucgacaugccuug

SEQ ID NO: 35437 - RNA, 20 nt, Artificial Sequence
  MKO10035437_A_Oip5
  gRNA
uacucgucuaaacucacuga

SEQ ID NO: 35438 - RNA, 20 nt, Artificial Sequence
  MKO10035438_A_Oip5
  gRNA
cuguacucuaccuugcuugu

SEQ ID NO: 35439 - RNA, 20 nt, Artificial Sequence
  MKO10035439_A_Oip5
  gRNA
auauucuacccaugcugcua

SEQ ID NO: 35440 - RNA, 20 nt, Artificial Sequence
  MKO10035440_A_Oit1
  gRNA
cugcccacguuguuucgcac

SEQ ID NO: 35441 - RNA, 20 nt, Artificial Sequence
  MKO10035441_A_Oit1
  gRNA
aaacaauucgucugccacgc

SEQ ID NO: 35442 - RNA, 20 nt, Artificial Sequence
  MKO10035442_A_Oit1
  gRNA
gaguccagugcgaaacaacg

SEQ ID NO: 35443 - RNA, 20 nt, Artificial Sequence
  MKO10035443_A_Oit3
  gRNA
ccgauacacguaguagccuc

SEQ ID NO: 35444 - RNA, 20 nt, Artificial Sequence
  MKO10035444_A_Oit3
  gRNA
gugguaucgcuucacgggga

SEQ ID NO: 35445 - RNA, 20 nt, Artificial Sequence
  MKO10035445_A_Oit3
  gRNA
ucccgucgcuccugagcacg

SEQ ID NO: 35446 - RNA, 20 nt, Artificial Sequence
  MKO10035446_A_Ola1
  gRNA
cgugaauuaucucuaugucu

SEQ ID NO: 35447 - RNA, 20 nt, Artificial Sequence
  MKO10035447_A_Ola1
  gRNA
gaugauaucacgcauguuga

SEQ ID NO: 35448 - RNA, 20 nt, Artificial Sequence
  MKO10035448_A_Ola1
  gRNA
agaaagucgaaccucucauc

SEQ ID NO: 35449 - RNA, 20 nt, Artificial Sequence
  MKO10035449_A_Olah
  gRNA
caagcaucucaucgaagacc

SEQ ID NO: 35450 - RNA, 20 nt, Artificial Sequence
  MKO10035450_A_Olah
  gRNA
uauuacugcacugcaccuaa

SEQ ID NO: 35451 - RNA, 20 nt, Artificial Sequence
  MKO10035451_A_Olah
  gRNA
ugacaucuaccagauagcug

SEQ ID NO: 35452 - RNA, 20 nt, Artificial Sequence
  MKO10035452_A_Olfm1
  gRNA
cccgcgaacacauggucugc

SEQ ID NO: 35453 - RNA, 20 nt, Artificial Sequence
  MKO10035453_A_Olfm1
  gRNA
cgccgcuggcggccgaaagc

SEQ ID NO: 35454 - RNA, 20 nt, Artificial Sequence
  MKO10035454_A_Olfm1
  gRNA
gguauugaggcccaccagcg

SEQ ID NO: 35455 - RNA, 20 nt, Artificial Sequence
  MKO10035455_A_Olfm2
  gRNA
uugcaaguccucguacccgu

SEQ ID NO: 35456 - RNA, 20 nt, Artificial Sequence
  MKO10035456_A_Olfm2
  gRNA
aaugggugccuacggguacg

SEQ ID NO: 35457 - RNA, 20 nt, Artificial Sequence
  MKO10035457_A_Olfm2
  gRNA
gcagcuuuauacgucagccc

SEQ ID NO: 35458 - RNA, 20 nt, Artificial Sequence
  MKO10035458_A_Olfm3
  gRNA
guacaaaugcaucgcccauc

SEQ ID NO: 35459 - RNA, 20 nt, Artificial Sequence
  MKO10035459_A_Olfm3
  gRNA
aucuucaaucugccgaaacu

SEQ ID NO: 35460 - RNA, 20 nt, Artificial Sequence
  MKO10035460_A_Olfm3
  gRNA
uucggcagauugaagaugau

SEQ ID NO: 35461 - RNA, 20 nt, Artificial Sequence
  MKO10035461_A_Olfm4
  gRNA
uagcauucgccgccagaucu

SEQ ID NO: 35462 - RNA, 20 nt, Artificial Sequence
  MKO10035462_A_Olfm4
  gRNA
gaaccugacgguccgaguag

SEQ ID NO: 35463 - RNA, 20 nt, Artificial Sequence
  MKO10035463_A_Olfm4
  gRNA
uauuauugacaugcucgaag

SEQ ID NO: 35464 - RNA, 20 nt, Artificial Sequence
  MKO10035464_A_Olfml1
  gRNA
gcagguagucgaucuccugc

SEQ ID NO: 35465 - RNA, 20 nt, Artificial Sequence
  MKO10035465_A_Olfml1
  gRNA
ugcaaacuugcgggcauuca

SEQ ID NO: 35466 - RNA, 20 nt, Artificial Sequence
  MKO10035466_A_Olfml1
  gRNA
cugguagauguaguguacca

SEQ ID NO: 35467 - RNA, 20 nt, Artificial Sequence
  MKO10035467_A_Olfml2a
  gRNA
gcaugcagccgggugcgaag

SEQ ID NO: 35468 - RNA, 20 nt, Artificial Sequence
  MKO10035468_A_Olfml2a
  gRNA
gugcucgcccacuucgcacc

SEQ ID NO: 35469 - RNA, 20 nt, Artificial Sequence
  MKO10035469_A_Olfml2a
  gRNA
ggccucccagaugaauacgc

SEQ ID NO: 35470 - RNA, 20 nt, Artificial Sequence
  MKO10035470_A_Olfml2b
  gRNA
cacuaaacucguggggcgag

SEQ ID NO: 35471 - RNA, 20 nt, Artificial Sequence
  MKO10035471_A_Olfml2b
  gRNA
cacucgccccacgaguuuag

SEQ ID NO: 35472 - RNA, 20 nt, Artificial Sequence
  MKO10035472_A_Olfml2b
  gRNA
cgaacggagcugaacaagcg

SEQ ID NO: 35473 - RNA, 20 nt, Artificial Sequence
  MKO10035473_A_Olfml3
  gRNA
gcucacggggguuauagcga

SEQ ID NO: 35474 - RNA, 20 nt, Artificial Sequence
  MKO10035474_A_Olfml3
  gRNA
gcaugggcaccauaucggcg

SEQ ID NO: 35475 - RNA, 20 nt, Artificial Sequence
  MKO10035475_A_Olfml3
  gRNA
acgccgacuagcugccuuag

SEQ ID NO: 35476 - RNA, 20 nt, Artificial Sequence
  MKO10035476_A_Olfr1000
  gRNA
ugacacgcagaugauuaagu

SEQ ID NO: 35477 - RNA, 20 nt, Artificial Sequence
  MKO10035477_A_Olfr1000
  gRNA
ugacugucgcuauccuguau

SEQ ID NO: 35478 - RNA, 20 nt, Artificial Sequence
  MKO10035478_A_Olfr1000
  gRNA
guucacuggucugauaauuc

SEQ ID NO: 35479 - RNA, 20 nt, Artificial Sequence
  MKO10035479_A_Olfr1002
  gRNA
cauaggccuuauaagcacug

SEQ ID NO: 35480 - RNA, 20 nt, Artificial Sequence
  MKO10035480_A_Olfr1002
  gRNA
cuuauaaggccuaugcugua

SEQ ID NO: 35481 - RNA, 20 nt, Artificial Sequence
  MKO10035481_A_Olfr1002
  gRNA
gaauaaaugcagaaguagua

SEQ ID NO: 35482 - RNA, 20 nt, Artificial Sequence
  MKO10035482_A_Olfr1006
  gRNA
cuaguagcuggguguuacau

SEQ ID NO: 35483 - RNA, 20 nt, Artificial Sequence
  MKO10035483_A_Olfr1006
  gRNA
auagacacggguaucuguac

SEQ ID NO: 35484 - RNA, 20 nt, Artificial Sequence
  MKO10035484_A_Olfr1006
  gRNA
uaugcagucuagaaucaauu

SEQ ID NO: 35485 - RNA, 20 nt, Artificial Sequence
  MKO10035485_A_Olfr1008
  gRNA
gaaucaggacauauaaucca

SEQ ID NO: 35486 - RNA, 20 nt, Artificial Sequence
  MKO10035486_A_Olfr1008
  gRNA
auaucucuacagcaccuucc

SEQ ID NO: 35487 - RNA, 20 nt, Artificial Sequence
  MKO10035487_A_Olfr1008
  gRNA
agguaaaaaaugcuuucaac

SEQ ID NO: 35488 - RNA, 20 nt, Artificial Sequence
  MKO10035488_A_Olfr1009
  gRNA
cauaccuaaguuucccguca

SEQ ID NO: 35489 - RNA, 20 nt, Artificial Sequence
  MKO10035489_A_Olfr1009
  gRNA
cauuugcuucucgucagucg

SEQ ID NO: 35490 - RNA, 20 nt, Artificial Sequence
  MKO10035490_A_Olfr1009
  gRNA
cccucauaugugcugacaua

SEQ ID NO: 35491 - RNA, 20 nt, Artificial Sequence
  MKO10035491_A_Olfr100
  gRNA
ugcugcaagaacgagucuug

SEQ ID NO: 35492 - RNA, 20 nt, Artificial Sequence
  MKO10035492_A_Olfr100
  gRNA
ccacaggccagauccaacaa

SEQ ID NO: 35493 - RNA, 20 nt, Artificial Sequence
  MKO10035493_A_Olfr100
  gRNA
auuaaacccuauucucuuug

SEQ ID NO: 35494 - RNA, 20 nt, Artificial Sequence
  MKO10035494_A_Olfr1010
  gRNA
acaagacuggcacguaaccu

SEQ ID NO: 35495 - RNA, 20 nt, Artificial Sequence
  MKO10035495_A_Olfr1010
  gRNA
gcacaaguuaugcccuggag

SEQ ID NO: 35496 - RNA, 20 nt, Artificial Sequence
  MKO10035496_A_Olfr1010
  gRNA
auuuacaucauuagucugcu

SEQ ID NO: 35497 - RNA, 20 nt, Artificial Sequence
  MKO10035497_A_Olfr1012
  gRNA
augcucaagcuaugucacga

SEQ ID NO: 35498 - RNA, 20 nt, Artificial Sequence
  MKO10035498_A_Olfr1012
  gRNA
auugacaaauccuccuguau

SEQ ID NO: 35499 - RNA, 20 nt, Artificial Sequence
  MKO10035499_A_Olfr1012
  gRNA
uugguuguauauuccuauac

SEQ ID NO: 35500 - RNA, 20 nt, Artificial Sequence
  MKO10035500_A_Olfr1013
  gRNA
uguguacacauugacuuuga

SEQ ID NO: 35501 - RNA, 20 nt, Artificial Sequence
  MKO10035501_A_Olfr1013
  gRNA
uguuagugaguucaucaugu

SEQ ID NO: 35502 - RNA, 20 nt, Artificial Sequence
  MKO10035502_A_Olfr1013
  gRNA
uguagacagaagacaaucca

SEQ ID NO: 35503 - RNA, 20 nt, Artificial Sequence
  MKO10035503_A_Olfr1014
  gRNA
ugccacaugagagcuuuacc

SEQ ID NO: 35504 - RNA, 20 nt, Artificial Sequence
  MKO10035504_A_Olfr1014
  gRNA
cauugcagaucaacacaaug

SEQ ID NO: 35505 - RNA, 20 nt, Artificial Sequence
  MKO10035505_A_Olfr1014
  gRNA
guauacugaguguuaucugu

SEQ ID NO: 35506 - RNA, 20 nt, Artificial Sequence
  MKO10035506_A_Olfr1015
  gRNA
agcgugucgaucauaugcca

SEQ ID NO: 35507 - RNA, 20 nt, Artificial Sequence
  MKO10035507_A_Olfr1015
  gRNA
gacagugaagcccaccauac

SEQ ID NO: 35508 - RNA, 20 nt, Artificial Sequence
  MKO10035508_A_Olfr1015
  gRNA
agaggauaagcguauuucuu

SEQ ID NO: 35509 - RNA, 20 nt, Artificial Sequence
  MKO10035509_A_Olfr1016
  gRNA
agaaggccuucaugcgaccc

SEQ ID NO: 35510 - RNA, 20 nt, Artificial Sequence
  MKO10035510_A_Olfr1016
  gRNA
cuugagaauccguuccaccc

SEQ ID NO: 35511 - RNA, 20 nt, Artificial Sequence
  MKO10035511_A_Olfr1016
  gRNA
guucuucuucucugcgggac

SEQ ID NO: 35512 - RNA, 20 nt, Artificial Sequence
  MKO10035512_A_Olfr1018
  gRNA
aagcaucugcggaacauuag

SEQ ID NO: 35513 - RNA, 20 nt, Artificial Sequence
  MKO10035513_A_Olfr1018
  gRNA
aucugaucccaagguacagc

SEQ ID NO: 35514 - RNA, 20 nt, Artificial Sequence
  MKO10035514_A_Olfr1018
  gRNA
ccaaaacaccuguauccaac

SEQ ID NO: 35515 - RNA, 20 nt, Artificial Sequence
  MKO10035515_A_Olfr1019
  gRNA
uaugcgccacuaaacucacu

SEQ ID NO: 35516 - RNA, 20 nt, Artificial Sequence
  MKO10035516_A_Olfr1019
  gRNA
gccgcuuucaagaaacugau

SEQ ID NO: 35517 - RNA, 20 nt, Artificial Sequence
  MKO10035517_A_Olfr1019
  gRNA
aucagaauucgaucagcuga

SEQ ID NO: 35518 - RNA, 20 nt, Artificial Sequence
  MKO10035518_A_Olfr101
  gRNA
uggcacuguuacaguagaau

SEQ ID NO: 35519 - RNA, 20 nt, Artificial Sequence
  MKO10035519_A_Olfr101
  gRNA
cugugauauuaagccauugc

SEQ ID NO: 35520 - RNA, 20 nt, Artificial Sequence
  MKO10035520_A_Olfr101
  gRNA
ccacaggccagauccagcaa

SEQ ID NO: 35521 - RNA, 20 nt, Artificial Sequence
  MKO10035521_A_Olfr1020
  gRNA
aagaggacaccuugcaaguc

SEQ ID NO: 35522 - RNA, 20 nt, Artificial Sequence
  MKO10035522_A_Olfr1020
  gRNA
ucagacaauccagacuugca

SEQ ID NO: 35523 - RNA, 20 nt, Artificial Sequence
  MKO10035523_A_Olfr1020
  gRNA
cccuaccucuagcuacucua

SEQ ID NO: 35524 - RNA, 20 nt, Artificial Sequence
  MKO10035524_A_Olfr1022
  gRNA
ugauggcugcaaaaauguac

SEQ ID NO: 35525 - RNA, 20 nt, Artificial Sequence
  MKO10035525_A_Olfr1022
  gRNA
uguguaugauugugcugauc

SEQ ID NO: 35526 - RNA, 20 nt, Artificial Sequence
  MKO10035526_A_Olfr1022
  gRNA
caucacugcaguguuguuua

SEQ ID NO: 35527 - RNA, 20 nt, Artificial Sequence
  MKO10035527_A_Olfr1023
  gRNA
gagcaagcuagcaugaucag

SEQ ID NO: 35528 - RNA, 20 nt, Artificial Sequence
  MKO10035528_A_Olfr1023
  gRNA
uguucaugauugugcugauc

SEQ ID NO: 35529 - RNA, 20 nt, Artificial Sequence
  MKO10035529_A_Olfr1023
  gRNA
uuugccuucccuuagcugaa

SEQ ID NO: 35530 - RNA, 20 nt, Artificial Sequence
  MKO10035530_A_Olfr1024
  gRNA
uuccagugaagggcaacgaa

SEQ ID NO: 35531 - RNA, 20 nt, Artificial Sequence
  MKO10035531_A_Olfr1024
  gRNA
uuggcaugaucuuauuaauc

SEQ ID NO: 35532 - RNA, 20 nt, Artificial Sequence
  MKO10035532_A_Olfr1024
  gRNA
agccuuucguugcccuucac

SEQ ID NO: 35533 - RNA, 20 nt, Artificial Sequence
  MKO10035533_A_Olfr1026
  gRNA
cugcucgaucugucaauccu

SEQ ID NO: 35534 - RNA, 20 nt, Artificial Sequence
  MKO10035534_A_Olfr1026
  gRNA
aaagccguaaauguacugug

SEQ ID NO: 35535 - RNA, 20 nt, Artificial Sequence
  MKO10035535_A_Olfr1026
  gRNA
cuacuauaugcuugcaguua

SEQ ID NO: 35536 - RNA, 20 nt, Artificial Sequence
  MKO10035536_A_Olfr1028
  gRNA
guuuauauugucaccgucuu

SEQ ID NO: 35537 - RNA, 20 nt, Artificial Sequence
  MKO10035537_A_Olfr1028
  gRNA
caugguggcucugauuagac

SEQ ID NO: 35538 - RNA, 20 nt, Artificial Sequence
  MKO10035538_A_Olfr1028
  gRNA
aaagcucgcugauauuaaca

SEQ ID NO: 35539 - RNA, 20 nt, Artificial Sequence
  MKO10035539_A_Olfr1029
  gRNA
auuuaccuugucaccgucuu

SEQ ID NO: 35540 - RNA, 20 nt, Artificial Sequence
  MKO10035540_A_Olfr1029
  gRNA
aucagcugaaggaagacgca

SEQ ID NO: 35541 - RNA, 20 nt, Artificial Sequence
  MKO10035541_A_Olfr1029
  gRNA
cuugauggcucugauuagac

SEQ ID NO: 35542 - RNA, 20 nt, Artificial Sequence
  MKO10035542_A_Olfr102
  gRNA
ugcugcaagaacgagucuug

SEQ ID NO: 35543 - RNA, 20 nt, Artificial Sequence
  MKO10035543_A_Olfr102
  gRNA
ccacaggccagauccaacaa

SEQ ID NO: 35544 - RNA, 20 nt, Artificial Sequence
  MKO10035544_A_Olfr102
  gRNA
auuaaacccuauucucuuug

SEQ ID NO: 35545 - RNA, 20 nt, Artificial Sequence
  MKO10035545_A_Olfr1030
  gRNA
cagugaucagauagaucacc

SEQ ID NO: 35546 - RNA, 20 nt, Artificial Sequence
  MKO10035546_A_Olfr1030
  gRNA
uacaguagcaagauguccaa

SEQ ID NO: 35547 - RNA, 20 nt, Artificial Sequence
  MKO10035547_A_Olfr1030
  gRNA
cugcuccacugauuuaucug

SEQ ID NO: 35548 - RNA, 20 nt, Artificial Sequence
  MKO10035548_A_Olfr1031
  gRNA
ugauccaccauugauuaagc

SEQ ID NO: 35549 - RNA, 20 nt, Artificial Sequence
  MKO10035549_A_Olfr1031
  gRNA
agccagguuguaaguccaca

SEQ ID NO: 35550 - RNA, 20 nt, Artificial Sequence
  MKO10035550_A_Olfr1031
  gRNA
accuccaugcuuguuguagc

SEQ ID NO: 35551 - RNA, 20 nt, Artificial Sequence
  MKO10035551_A_Olfr1032
  gRNA
uauacaaugauuauacuugc

SEQ ID NO: 35552 - RNA, 20 nt, Artificial Sequence
  MKO10035552_A_Olfr1032
  gRNA
aacuugcaguuccuuucugc

SEQ ID NO: 35553 - RNA, 20 nt, Artificial Sequence
  MKO10035553_A_Olfr1032
  gRNA
agauccaccccuuaucaaga

SEQ ID NO: 35554 - RNA, 20 nt, Artificial Sequence
  MKO10035554_A_Olfr1033
  gRNA
agauccaccccucaucaaga

SEQ ID NO: 35555 - RNA, 20 nt, Artificial Sequence
  MKO10035555_A_Olfr1033
  gRNA
uauacaaugcuauuucuugc

SEQ ID NO: 35556 - RNA, 20 nt, Artificial Sequence
  MKO10035556_A_Olfr1033
  gRNA
ggagaugaugacaacaauca

SEQ ID NO: 35557 - RNA, 20 nt, Artificial Sequence
  MKO10035557_A_Olfr1034
  gRNA
gcacguggaggucuauauuc

SEQ ID NO: 35558 - RNA, 20 nt, Artificial Sequence
  MKO10035558_A_Olfr1034
  gRNA
uuacgcaugcacucagcuga

SEQ ID NO: 35559 - RNA, 20 nt, Artificial Sequence
  MKO10035559_A_Olfr1034
  gRNA
cuucacguauuccuugucag

SEQ ID NO: 35560 - RNA, 20 nt, Artificial Sequence
  MKO10035560_A_Olfr1036
  gRNA
ucauauucauguaucugaga

SEQ ID NO: 35561 - RNA, 20 nt, Artificial Sequence
  MKO10035561_A_Olfr1036
  gRNA
agucugcaagauaguugcca

SEQ ID NO: 35562 - RNA, 20 nt, Artificial Sequence
  MKO10035562_A_Olfr1036
  gRNA
gauggccuucgaucgcuacg

SEQ ID NO: 35563 - RNA, 20 nt, Artificial Sequence
  MKO10035563_A_Olfr1037
  gRNA
uacaaucguguagaauacug

SEQ ID NO: 35564 - RNA, 20 nt, Artificial Sequence
  MKO10035564_A_Olfr1037
  gRNA
gaugauuucacuaaucagga

SEQ ID NO: 35565 - RNA, 20 nt, Artificial Sequence
  MKO10035565_A_Olfr1037
  gRNA
uuguaauccucuucuguaua

SEQ ID NO: 35566 - RNA, 20 nt, Artificial Sequence
  MKO10035566_A_Olfr1038-ps
  gRNA
accuuucgcuugacauauug

SEQ ID NO: 35567 - RNA, 20 nt, Artificial Sequence
  MKO10035567_A_Olfr1038-ps
  gRNA
uccacaauaugucaagcgaa

SEQ ID NO: 35568 - RNA, 20 nt, Artificial Sequence
  MKO10035568_A_Olfr1038-ps
  gRNA
uacuuaaauaaaucaacaua

SEQ ID NO: 35569 - RNA, 20 nt, Artificial Sequence
  MKO10035569_A_Olfr1039
  gRNA
ugacuacuacucagacuuuc

SEQ ID NO: 35570 - RNA, 20 nt, Artificial Sequence
  MKO10035570_A_Olfr1039
  gRNA
ugaacuguuaccuucagcca

SEQ ID NO: 35571 - RNA, 20 nt, Artificial Sequence
  MKO10035571_A_Olfr1039
  gRNA
agaaaguuuauaauuguguu

SEQ ID NO: 35572 - RNA, 20 nt, Artificial Sequence
  MKO10035572_A_Olfr103
  gRNA
accuauauccgucccaccuc

SEQ ID NO: 35573 - RNA, 20 nt, Artificial Sequence
  MKO10035573_A_Olfr103
  gRNA
uguaacagugccaaaaaugc

SEQ ID NO: 35574 - RNA, 20 nt, Artificial Sequence
  MKO10035574_A_Olfr103
  gRNA
ugaggcaaugguaccuguaa

SEQ ID NO: 35575 - RNA, 20 nt, Artificial Sequence
  MKO10035575_A_Olfr1040
  gRNA
guacaucaguucauccucgu

SEQ ID NO: 35576 - RNA, 20 nt, Artificial Sequence
  MKO10035576_A_Olfr1040
  gRNA
cuucaacagaacgaauucuc

SEQ ID NO: 35577 - RNA, 20 nt, Artificial Sequence
  MKO10035577_A_Olfr1040
  gRNA
cugagaauucguucuguuga

SEQ ID NO: 35578 - RNA, 20 nt, Artificial Sequence
  MKO10035578_A_Olfr1042
  gRNA
ucuaugcgguccgcaugccu

SEQ ID NO: 35579 - RNA, 20 nt, Artificial Sequence
  MKO10035579_A_Olfr1042
  gRNA
caucuaccuaacuaguguug

SEQ ID NO: 35580 - RNA, 20 nt, Artificial Sequence
  MKO10035580_A_Olfr1042
  gRNA
cauuacccacaacacuaguu

SEQ ID NO: 35581 - RNA, 20 nt, Artificial Sequence
  MKO10035581_A_Olfr1043
  gRNA
cugugucacgccaaaugcgc

SEQ ID NO: 35582 - RNA, 20 nt, Artificial Sequence
  MKO10035582_A_Olfr1043
  gRNA
gaauugcagacacgaugaau

SEQ ID NO: 35583 - RNA, 20 nt, Artificial Sequence
  MKO10035583_A_Olfr1043
  gRNA
aaaaaauucaccagcgcauu

SEQ ID NO: 35584 - RNA, 20 nt, Artificial Sequence
  MKO10035584_A_Olfr1044
  gRNA
aauuucaugacgauaacauu

SEQ ID NO: 35585 - RNA, 20 nt, Artificial Sequence
  MKO10035585_A_Olfr1044
  gRNA
ucagcuccucgcgaucugug

SEQ ID NO: 35586 - RNA, 20 nt, Artificial Sequence
  MKO10035586_A_Olfr1044
  gRNA
auuaggaccauauagaguag

SEQ ID NO: 35587 - RNA, 20 nt, Artificial Sequence
  MKO10035587_A_Olfr1045
  gRNA
acaucguguugucuauccua

SEQ ID NO: 35588 - RNA, 20 nt, Artificial Sequence
  MKO10035588_A_Olfr1045
  gRNA
augugagcgacaccaacaga

SEQ ID NO: 35589 - RNA, 20 nt, Artificial Sequence
  MKO10035589_A_Olfr1045
  gRNA
cuacgaaugugccacucagc

SEQ ID NO: 35590 - RNA, 20 nt, Artificial Sequence
  MKO10035590_A_Olfr1046
  gRNA
cagcucucaucugacaguag

SEQ ID NO: 35591 - RNA, 20 nt, Artificial Sequence
  MKO10035591_A_Olfr1046
  gRNA
acugaugggcaaucugggca

SEQ ID NO: 35592 - RNA, 20 nt, Artificial Sequence
  MKO10035592_A_Olfr1046
  gRNA
ugucagaugagagcugcacg

SEQ ID NO: 35593 - RNA, 20 nt, Artificial Sequence
  MKO10035593_A_Olfr1047
  gRNA
ucuugguuauucuacauccg

SEQ ID NO: 35594 - RNA, 20 nt, Artificial Sequence
  MKO10035594_A_Olfr1047
  gRNA
agaagacaaugacuacuguc

SEQ ID NO: 35595 - RNA, 20 nt, Artificial Sequence
  MKO10035595_A_Olfr1047
  gRNA
uuguagcuuggaguccacug

SEQ ID NO: 35596 - RNA, 20 nt, Artificial Sequence
  MKO10035596_A_Olfr1048
  gRNA
cuaugcuugugccgugcaga

SEQ ID NO: 35597 - RNA, 20 nt, Artificial Sequence
  MKO10035597_A_Olfr1048
  gRNA
aucuacggaguugccaugau

SEQ ID NO: 35598 - RNA, 20 nt, Artificial Sequence
  MKO10035598_A_Olfr1048
  gRNA
gcagagacgcugucauguuc

SEQ ID NO: 35599 - RNA, 20 nt, Artificial Sequence
  MKO10035599_A_Olfr1049
  gRNA
agacgcugucaagugcuuau

SEQ ID NO: 35600 - RNA, 20 nt, Artificial Sequence
  MKO10035600_A_Olfr1049
  gRNA
cacuaucuaugcaaucaccg

SEQ ID NO: 35601 - RNA, 20 nt, Artificial Sequence
  MKO10035601_A_Olfr1049
  gRNA
ugcagaacgcauuugaaaua

SEQ ID NO: 35602 - RNA, 20 nt, Artificial Sequence
  MKO10035602_A_Olfr1051
  gRNA
agacgcugucaagugcucau

SEQ ID NO: 35603 - RNA, 20 nt, Artificial Sequence
  MKO10035603_A_Olfr1051
  gRNA
ugcuaucuaugcaaucaccg

SEQ ID NO: 35604 - RNA, 20 nt, Artificial Sequence
  MKO10035604_A_Olfr1051
  gRNA
ugcagaacgcauucgaaaua

SEQ ID NO: 35605 - RNA, 20 nt, Artificial Sequence
  MKO10035605_A_Olfr1052
  gRNA
ggugucgguguucuauacac

SEQ ID NO: 35606 - RNA, 20 nt, Artificial Sequence
  MKO10035606_A_Olfr1052
  gRNA
gguuaacaacugccacauaa

SEQ ID NO: 35607 - RNA, 20 nt, Artificial Sequence
  MKO10035607_A_Olfr1052
  gRNA
agcugagcguauucucaaaa

SEQ ID NO: 35608 - RNA, 20 nt, Artificial Sequence
  MKO10035608_A_Olfr1053
  gRNA
guaccucuacagcaccgucc

SEQ ID NO: 35609 - RNA, 20 nt, Artificial Sequence
  MKO10035609_A_Olfr1053
  gRNA
gagccuggacggugcuguag

SEQ ID NO: 35610 - RNA, 20 nt, Artificial Sequence
  MKO10035610_A_Olfr1053
  gRNA
acccuuuaguacccuguaga

SEQ ID NO: 35611 - RNA, 20 nt, Artificial Sequence
  MKO10035611_A_Olfr1054
  gRNA
uugcaaucgggaguccacca

SEQ ID NO: 35612 - RNA, 20 nt, Artificial Sequence
  MKO10035612_A_Olfr1054
  gRNA
augagaaacaagccgaacaa

SEQ ID NO: 35613 - RNA, 20 nt, Artificial Sequence
  MKO10035613_A_Olfr1054
  gRNA
uaauuugguuucaucucucg

SEQ ID NO: 35614 - RNA, 20 nt, Artificial Sequence
  MKO10035614_A_Olfr1055
  gRNA
ugcgacuugaccagucucaa

SEQ ID NO: 35615 - RNA, 20 nt, Artificial Sequence
  MKO10035615_A_Olfr1055
  gRNA
cgcaucuuuguucuauacac

SEQ ID NO: 35616 - RNA, 20 nt, Artificial Sequence
  MKO10035616_A_Olfr1055
  gRNA
cagagaucauguauauaaug

SEQ ID NO: 35617 - RNA, 20 nt, Artificial Sequence
  MKO10035617_A_Olfr1056
  gRNA
uugcaaccucucauccaacu

SEQ ID NO: 35618 - RNA, 20 nt, Artificial Sequence
  MKO10035618_A_Olfr1056
  gRNA
cguguccuauaccuuuaucc

SEQ ID NO: 35619 - RNA, 20 nt, Artificial Sequence
  MKO10035619_A_Olfr1056
  gRNA
aaaauaccauccccuauaau

SEQ ID NO: 35620 - RNA, 20 nt, Artificial Sequence
  MKO10035620_A_Olfr1057
  gRNA
auaagauugaaucguuugca

SEQ ID NO: 35621 - RNA, 20 nt, Artificial Sequence
  MKO10035621_A_Olfr1057
  gRNA
ugccaaaguugaugaucgcc

SEQ ID NO: 35622 - RNA, 20 nt, Artificial Sequence
  MKO10035622_A_Olfr1057
  gRNA
uguagcagagaucuuuaugc

SEQ ID NO: 35623 - RNA, 20 nt, Artificial Sequence
  MKO10035623_A_Olfr1058
  gRNA
gagauaucagauagauuaug

SEQ ID NO: 35624 - RNA, 20 nt, Artificial Sequence
  MKO10035624_A_Olfr1058
  gRNA
uuguagucuggaguccacca

SEQ ID NO: 35625 - RNA, 20 nt, Artificial Sequence
  MKO10035625_A_Olfr1058
  gRNA
caccucucuacuacagaccu

SEQ ID NO: 35626 - RNA, 20 nt, Artificial Sequence
  MKO10035626_A_Olfr1061
  gRNA
gcccaaguuaucgaccagug

SEQ ID NO: 35627 - RNA, 20 nt, Artificial Sequence
  MKO10035627_A_Olfr1061
  gRNA
aaucacuuuaccagugucaa

SEQ ID NO: 35628 - RNA, 20 nt, Artificial Sequence
  MKO10035628_A_Olfr1061
  gRNA
gacaauuauacuguagagau

SEQ ID NO: 35629 - RNA, 20 nt, Artificial Sequence
  MKO10035629_A_Olfr1062
  gRNA
cuaugaaugugccacgcagc

SEQ ID NO: 35630 - RNA, 20 nt, Artificial Sequence
  MKO10035630_A_Olfr1062
  gRNA
guucaacauugguauuauua

SEQ ID NO: 35631 - RNA, 20 nt, Artificial Sequence
  MKO10035631_A_Olfr1062
  gRNA
gguaucagagaucuucaugc

SEQ ID NO: 35632 - RNA, 20 nt, Artificial Sequence
  MKO10035632_A_Olfr1065
  gRNA
ucauccuaaguauagcuaua

SEQ ID NO: 35633 - RNA, 20 nt, Artificial Sequence
  MKO10035633_A_Olfr1065
  gRNA
gagcugcaauccucauuguu

SEQ ID NO: 35634 - RNA, 20 nt, Artificial Sequence
  MKO10035634_A_Olfr1065
  gRNA
gggcaugauuguccuuacaa

SEQ ID NO: 35635 - RNA, 20 nt, Artificial Sequence
  MKO10035635_A_Olfr1066
  gRNA
caccuugcuacuacugaucu

SEQ ID NO: 35636 - RNA, 20 nt, Artificial Sequence
  MKO10035636_A_Olfr1066
  gRNA
gcccaaguugccaaacagug

SEQ ID NO: 35637 - RNA, 20 nt, Artificial Sequence
  MKO10035637_A_Olfr1066
  gRNA
agucccuuuaccagugucaa

SEQ ID NO: 35638 - RNA, 20 nt, Artificial Sequence
  MKO10035638_A_Olfr1076
  gRNA
agccaccuugucaguguuua

SEQ ID NO: 35639 - RNA, 20 nt, Artificial Sequence
  MKO10035639_A_Olfr1076
  gRNA
agaaaugacugauaauauug

SEQ ID NO: 35640 - RNA, 20 nt, Artificial Sequence
  MKO10035640_A_Olfr1076
  gRNA
ugucugcaaugucuuaugac

SEQ ID NO: 35641 - RNA, 20 nt, Artificial Sequence
  MKO10035641_A_Olfr1079
  gRNA
ggcggucagugaugccccug

SEQ ID NO: 35642 - RNA, 20 nt, Artificial Sequence
  MKO10035642_A_Olfr1079
  gRNA
caccuagcuaucacagaucu

SEQ ID NO: 35643 - RNA, 20 nt, Artificial Sequence
  MKO10035643_A_Olfr1079
  gRNA
uagugacugaauuuauccuc

SEQ ID NO: 35644 - RNA, 20 nt, Artificial Sequence
  MKO10035644_A_Olfr107
  gRNA
agaugcgaaguucuugccag

SEQ ID NO: 35645 - RNA, 20 nt, Artificial Sequence
  MKO10035645_A_Olfr107
  gRNA
ccugaaacuuguccauguuc

SEQ ID NO: 35646 - RNA, 20 nt, Artificial Sequence
  MKO10035646_A_Olfr107
  gRNA
agcuauuccccaugacccac

SEQ ID NO: 35647 - RNA, 20 nt, Artificial Sequence
  MKO10035647_A_Olfr1080
  gRNA
cuagaacccaacauacuuua

SEQ ID NO: 35648 - RNA, 20 nt, Artificial Sequence
  MKO10035648_A_Olfr1080
  gRNA
agaauacuguaacuacuguc

SEQ ID NO: 35649 - RNA, 20 nt, Artificial Sequence
  MKO10035649_A_Olfr1080
  gRNA
acaguaguuacaguauucua

SEQ ID NO: 35650 - RNA, 20 nt, Artificial Sequence
  MKO10035650_A_Olfr1082
  gRNA
cuuauaguuaugaucuuugc

SEQ ID NO: 35651 - RNA, 20 nt, Artificial Sequence
  MKO10035651_A_Olfr1082
  gRNA
cuuuguuuauucgacaacug

SEQ ID NO: 35652 - RNA, 20 nt, Artificial Sequence
  MKO10035652_A_Olfr1082
  gRNA
aagaugcucuacaaagaaca

SEQ ID NO: 35653 - RNA, 20 nt, Artificial Sequence
  MKO10035653_A_Olfr1084
  gRNA
aggacauaagcacgacgaca

SEQ ID NO: 35654 - RNA, 20 nt, Artificial Sequence
  MKO10035654_A_Olfr1084
  gRNA
ucaauugaaugacuagauac

SEQ ID NO: 35655 - RNA, 20 nt, Artificial Sequence
  MKO10035655_A_Olfr1084
  gRNA
cccaagauugccaaccacug

SEQ ID NO: 35656 - RNA, 20 nt, Artificial Sequence
  MKO10035656_A_Olfr1085
  gRNA
aucugcugcaggcagaugca

SEQ ID NO: 35657 - RNA, 20 nt, Artificial Sequence
  MKO10035657_A_Olfr1085
  gRNA
caucaucauuauuacuaaug

SEQ ID NO: 35658 - RNA, 20 nt, Artificial Sequence
  MKO10035658_A_Olfr1085
  gRNA
aaugucuuaugaccguuacg

SEQ ID NO: 35659 - RNA, 20 nt, Artificial Sequence
  MKO10035659_A_Olfr1086
  gRNA
ggugauaacaguagaauagc

SEQ ID NO: 35660 - RNA, 20 nt, Artificial Sequence
  MKO10035660_A_Olfr1086
  gRNA
ugucagaacaugaaauugcc

SEQ ID NO: 35661 - RNA, 20 nt, Artificial Sequence
  MKO10035661_A_Olfr1086
  gRNA
acaaagucaacuaccauuug

SEQ ID NO: 35662 - RNA, 20 nt, Artificial Sequence
  MKO10035662_A_Olfr1087
  gRNA
uacugagcgcccugaacuac

SEQ ID NO: 35663 - RNA, 20 nt, Artificial Sequence
  MKO10035663_A_Olfr1087
  gRNA
gguuuaacauggguauaauc

SEQ ID NO: 35664 - RNA, 20 nt, Artificial Sequence
  MKO10035664_A_Olfr1087
  gRNA
acacugucaucaugucgcaa

SEQ ID NO: 35665 - RNA, 20 nt, Artificial Sequence
  MKO10035665_A_Olfr1089
  gRNA
cacuaaucggccugagcuga

SEQ ID NO: 35666 - RNA, 20 nt, Artificial Sequence
  MKO10035666_A_Olfr1089
  gRNA
auaguaauugcuuaucugua

SEQ ID NO: 35667 - RNA, 20 nt, Artificial Sequence
  MKO10035667_A_Olfr1089
  gRNA
caugaucauacucacaauag

SEQ ID NO: 35668 - RNA, 20 nt, Artificial Sequence
  MKO10035668_A_Olfr108
  gRNA
uucugacacucaccucaaug

SEQ ID NO: 35669 - RNA, 20 nt, Artificial Sequence
  MKO10035669_A_Olfr108
  gRNA
aagaagugcugccacuucuc

SEQ ID NO: 35670 - RNA, 20 nt, Artificial Sequence
  MKO10035670_A_Olfr108
  gRNA
gucccagcaaguaaagaccu

SEQ ID NO: 35671 - RNA, 20 nt, Artificial Sequence
  MKO10035671_A_Olfr1090
  gRNA
auccaagaucuguaauagcc

SEQ ID NO: 35672 - RNA, 20 nt, Artificial Sequence
  MKO10035672_A_Olfr1090
  gRNA
ucccaaauuaccuaccauug

SEQ ID NO: 35673 - RNA, 20 nt, Artificial Sequence
  MKO10035673_A_Olfr1090
  gRNA
auucagcauggguauaacga

SEQ ID NO: 35674 - RNA, 20 nt, Artificial Sequence
  MKO10035674_A_Olfr1093
  gRNA
uaggccucauauaagugaaa

SEQ ID NO: 35675 - RNA, 20 nt, Artificial Sequence
  MKO10035675_A_Olfr1093
  gRNA
gucaugauuugaagcauaac

SEQ ID NO: 35676 - RNA, 20 nt, Artificial Sequence
  MKO10035676_A_Olfr1093
  gRNA
cuguagaauagcaagcaucc

SEQ ID NO: 35677 - RNA, 20 nt, Artificial Sequence
  MKO10035677_A_Olfr1094
  gRNA
cguugucacuccgaagaugu

SEQ ID NO: 35678 - RNA, 20 nt, Artificial Sequence
  MKO10035678_A_Olfr1094
  gRNA
gaaaugucgauacauucacc

SEQ ID NO: 35679 - RNA, 20 nt, Artificial Sequence
  MKO10035679_A_Olfr1094
  gRNA
auucuucguacaguguaacc

SEQ ID NO: 35680 - RNA, 20 nt, Artificial Sequence
  MKO10035680_A_Olfr1095
  gRNA
augagugguaaauagacucg

SEQ ID NO: 35681 - RNA, 20 nt, Artificial Sequence
  MKO10035681_A_Olfr1095
  gRNA
aucacuccaaauauguuagu

SEQ ID NO: 35682 - RNA, 20 nt, Artificial Sequence
  MKO10035682_A_Olfr1095
  gRNA
cuucagcugaauucaucuuc

SEQ ID NO: 35683 - RNA, 20 nt, Artificial Sequence
  MKO10035683_A_Olfr1097
  gRNA
auccaaaacuccaaucaugu

SEQ ID NO: 35684 - RNA, 20 nt, Artificial Sequence
  MKO10035684_A_Olfr1097
  gRNA
ugaaccugaguucacgcuug

SEQ ID NO: 35685 - RNA, 20 nt, Artificial Sequence
  MKO10035685_A_Olfr1097
  gRNA
accagcuaaaacgaauauag

SEQ ID NO: 35686 - RNA, 20 nt, Artificial Sequence
  MKO10035686_A_Olfr1098
  gRNA
aucuauagcuccaacgaugu

SEQ ID NO: 35687 - RNA, 20 nt, Artificial Sequence
  MKO10035687_A_Olfr1098
  gRNA
accagcuaaaacgaauauug

SEQ ID NO: 35688 - RNA, 20 nt, Artificial Sequence
  MKO10035688_A_Olfr1098
  gRNA
aucacuguguccuacaucgu

SEQ ID NO: 35689 - RNA, 20 nt, Artificial Sequence
  MKO10035689_A_Olfr1099
  gRNA
cacugucaauauguuaugca

SEQ ID NO: 35690 - RNA, 20 nt, Artificial Sequence
  MKO10035690_A_Olfr1099
  gRNA
uucuguagugcccuccuuac

SEQ ID NO: 35691 - RNA, 20 nt, Artificial Sequence
  MKO10035691_A_Olfr1099
  gRNA
aacacucaguagcugccaaa

SEQ ID NO: 35692 - RNA, 20 nt, Artificial Sequence
  MKO10035692_A_Olfr109
  gRNA
uggcccuacgccucgagaga

SEQ ID NO: 35693 - RNA, 20 nt, Artificial Sequence
  MKO10035693_A_Olfr109
  gRNA
uauauuaaugaucgucacuc

SEQ ID NO: 35694 - RNA, 20 nt, Artificial Sequence
  MKO10035694_A_Olfr109
  gRNA
cguagggccauaucauuccu

SEQ ID NO: 35695 - RNA, 20 nt, Artificial Sequence
  MKO10035695_A_Olfr10
  gRNA
gggaaccuucaauaucaguu

SEQ ID NO: 35696 - RNA, 20 nt, Artificial Sequence
  MKO10035696_A_Olfr10
  gRNA
uccucccaaacugauauuga

SEQ ID NO: 35697 - RNA, 20 nt, Artificial Sequence
  MKO10035697_A_Olfr10
  gRNA
gucaguaacugcacgcagaa

SEQ ID NO: 35698 - RNA, 20 nt, Artificial Sequence
  MKO10035698_A_Olfr1100
  gRNA
guucguucacaaugaacacc

SEQ ID NO: 35699 - RNA, 20 nt, Artificial Sequence
  MKO10035699_A_Olfr1100
  gRNA
ccaaguaauuccuacuacuc

SEQ ID NO: 35700 - RNA, 20 nt, Artificial Sequence
  MKO10035700_A_Olfr1100
  gRNA
aaggguacuacagaaucuug

SEQ ID NO: 35701 - RNA, 20 nt, Artificial Sequence
  MKO10035701_A_Olfr1101
  gRNA
acuggcguguccauauauua

SEQ ID NO: 35702 - RNA, 20 nt, Artificial Sequence
  MKO10035702_A_Olfr1101
  gRNA
gucaugcucuaauguguagc

SEQ ID NO: 35703 - RNA, 20 nt, Artificial Sequence
  MKO10035703_A_Olfr1101
  gRNA
ggacugaucucaguagucau

SEQ ID NO: 35704 - RNA, 20 nt, Artificial Sequence
  MKO10035704_A_Olfr1102
  gRNA
uacgaauacaaaaacuacac

SEQ ID NO: 35705 - RNA, 20 nt, Artificial Sequence
  MKO10035705_A_Olfr1102
  gRNA
gucuuguucaaguguguagu

SEQ ID NO: 35706 - RNA, 20 nt, Artificial Sequence
  MKO10035706_A_Olfr1102
  gRNA
aguacuaacucccaaaaugu

SEQ ID NO: 35707 - RNA, 20 nt, Artificial Sequence
  MKO10035707_A_Olfr1104
  gRNA
gaucaccaauuccgugcuga

SEQ ID NO: 35708 - RNA, 20 nt, Artificial Sequence
  MKO10035708_A_Olfr1104
  gRNA
gcaguaauaccauacaugau

SEQ ID NO: 35709 - RNA, 20 nt, Artificial Sequence
  MKO10035709_A_Olfr1104
  gRNA
gugagggaugauguguuauc

SEQ ID NO: 35710 - RNA, 20 nt, Artificial Sequence
  MKO10035710_A_Olfr1105
  gRNA
acugucaugaguaucagagc

SEQ ID NO: 35711 - RNA, 20 nt, Artificial Sequence
  MKO10035711_A_Olfr1105
  gRNA
cacaagguagaugcaaaacg

SEQ ID NO: 35712 - RNA, 20 nt, Artificial Sequence
  MKO10035712_A_Olfr1105
  gRNA
caaaacagcaucucguacca

SEQ ID NO: 35713 - RNA, 20 nt, Artificial Sequence
  MKO10035713_A_Olfr1106
  gRNA
cacgaucugucagucccaaa

SEQ ID NO: 35714 - RNA, 20 nt, Artificial Sequence
  MKO10035714_A_Olfr1106
  gRNA
ugugucugccugccgcugaa

SEQ ID NO: 35715 - RNA, 20 nt, Artificial Sequence
  MKO10035715_A_Olfr1106
  gRNA
gacagaucgugaugaacuua

SEQ ID NO: 35716 - RNA, 20 nt, Artificial Sequence
  MKO10035716_A_Olfr1107
  gRNA
gguuugcgauugccacauaa

SEQ ID NO: 35717 - RNA, 20 nt, Artificial Sequence
  MKO10035717_A_Olfr1107
  gRNA
gucaaggaauucaugcuccu

SEQ ID NO: 35718 - RNA, 20 nt, Artificial Sequence
  MKO10035718_A_Olfr1107
  gRNA
gcaguauacauaacuacaga

SEQ ID NO: 35719 - RNA, 20 nt, Artificial Sequence
  MKO10035719_A_Olfr1109
  gRNA
cacaauaagucuacugagac

SEQ ID NO: 35720 - RNA, 20 nt, Artificial Sequence
  MKO10035720_A_Olfr1109
  gRNA
uucacaacuguaugauuccc

SEQ ID NO: 35721 - RNA, 20 nt, Artificial Sequence
  MKO10035721_A_Olfr1109
  gRNA
ucugaaaauccgcucaacug

SEQ ID NO: 35722 - RNA, 20 nt, Artificial Sequence
  MKO10035722_A_Olfr110
  gRNA
auccuguaauuuauacgcua

SEQ ID NO: 35723 - RNA, 20 nt, Artificial Sequence
  MKO10035723_A_Olfr110
  gRNA
uuagcagcuucaugcuggac

SEQ ID NO: 35724 - RNA, 20 nt, Artificial Sequence
  MKO10035724_A_Olfr110
  gRNA
ucucaacucaguguugcaca

SEQ ID NO: 35725 - RNA, 20 nt, Artificial Sequence
  MKO10035725_A_Olfr1110
  gRNA
gccugacugaaaauccuaau

SEQ ID NO: 35726 - RNA, 20 nt, Artificial Sequence
  MKO10035726_A_Olfr1110
  gRNA
aggugugagugaauucauuc

SEQ ID NO: 35727 - RNA, 20 nt, Artificial Sequence
  MKO10035727_A_Olfr1110
  gRNA
ugcaaaucccuuaauguaua

SEQ ID NO: 35728 - RNA, 20 nt, Artificial Sequence
  MKO10035728_A_Olfr1111
  gRNA
uagcggaagcgugaccucac

SEQ ID NO: 35729 - RNA, 20 nt, Artificial Sequence
  MKO10035729_A_Olfr1111
  gRNA
gcaacuaccuuaucaguguc

SEQ ID NO: 35730 - RNA, 20 nt, Artificial Sequence
  MKO10035730_A_Olfr1111
  gRNA
acaauauuggaccuacagua

SEQ ID NO: 35731 - RNA, 20 nt, Artificial Sequence
  MKO10035731_A_Olfr1112
  gRNA
ggucuaucuaauuauucuga

SEQ ID NO: 35732 - RNA, 20 nt, Artificial Sequence
  MKO10035732_A_Olfr1112
  gRNA
ccaguccugacccuagcuug

SEQ ID NO: 35733 - RNA, 20 nt, Artificial Sequence
  MKO10035733_A_Olfr1112
  gRNA
uagagaucuguuaauaaccu

SEQ ID NO: 35734 - RNA, 20 nt, Artificial Sequence
  MKO10035734_A_Olfr1113
  gRNA
gucuguccccucaaacuuau

SEQ ID NO: 35735 - RNA, 20 nt, Artificial Sequence
  MKO10035735_A_Olfr1113
  gRNA
accuaaguccaauaaguuug

SEQ ID NO: 35736 - RNA, 20 nt, Artificial Sequence
  MKO10035736_A_Olfr1113
  gRNA
aaugugucuauuccugaucc

SEQ ID NO: 35737 - RNA, 20 nt, Artificial Sequence
  MKO10035737_A_Olfr1115
  gRNA
accuaagucuaauaaguaug

SEQ ID NO: 35738 - RNA, 20 nt, Artificial Sequence
  MKO10035738_A_Olfr1115
  gRNA
uccucauacuuauuagacuu

SEQ ID NO: 35739 - RNA, 20 nt, Artificial Sequence
  MKO10035739_A_Olfr1115
  gRNA
ccacaugccaaucugaguag

SEQ ID NO: 35740 - RNA, 20 nt, Artificial Sequence
  MKO10035740_A_Olfr1116-ps
  gRNA
acucugugccucccaacgua

SEQ ID NO: 35741 - RNA, 20 nt, Artificial Sequence
  MKO10035741_A_Olfr1116-ps
  gRNA
uagcugccuccuggaucagu

SEQ ID NO: 35742 - RNA, 20 nt, Artificial Sequence
  MKO10035742_A_Olfr1116-ps
  gRNA
agaacaagauuacaacuauc

SEQ ID NO: 35743 - RNA, 20 nt, Artificial Sequence
  MKO10035743_A_Olfr1118
  gRNA
ugcuagcaagaggcacucug

SEQ ID NO: 35744 - RNA, 20 nt, Artificial Sequence
  MKO10035744_A_Olfr1118
  gRNA
uagcugccucuuggaucagu

SEQ ID NO: 35745 - RNA, 20 nt, Artificial Sequence
  MKO10035745_A_Olfr1118
  gRNA
uaggucugcccaauuuguac

SEQ ID NO: 35746 - RNA, 20 nt, Artificial Sequence
  MKO10035746_A_Olfr111
  gRNA
cucuagcgaguaagaugaga

SEQ ID NO: 35747 - RNA, 20 nt, Artificial Sequence
  MKO10035747_A_Olfr111
  gRNA
auccuauaauuuaugcacug

SEQ ID NO: 35748 - RNA, 20 nt, Artificial Sequence
  MKO10035748_A_Olfr111
  gRNA
gcagccucaugcuggacaug

SEQ ID NO: 35749 - RNA, 20 nt, Artificial Sequence
  MKO10035749_A_Olfr1120
  gRNA
cccgcauucucuacaaucuu

SEQ ID NO: 35750 - RNA, 20 nt, Artificial Sequence
  MKO10035750_A_Olfr1120
  gRNA
ucuugcuauaacaaguauag

SEQ ID NO: 35751 - RNA, 20 nt, Artificial Sequence
  MKO10035751_A_Olfr1120
  gRNA
uguucccccaauucucaagc

SEQ ID NO: 35752 - RNA, 20 nt, Artificial Sequence
  MKO10035752_A_Olfr1121
  gRNA
cauacccccugugcuuaaac

SEQ ID NO: 35753 - RNA, 20 nt, Artificial Sequence
  MKO10035753_A_Olfr1121
  gRNA
uucgaucguccuucagcagu

SEQ ID NO: 35754 - RNA, 20 nt, Artificial Sequence
  MKO10035754_A_Olfr1121
  gRNA
aaugugcuucuuccuaaugu

SEQ ID NO: 35755 - RNA, 20 nt, Artificial Sequence
  MKO10035755_A_Olfr1122
  gRNA
auaucccaaaaagcauccac

SEQ ID NO: 35756 - RNA, 20 nt, Artificial Sequence
  MKO10035756_A_Olfr1122
  gRNA
uaucugcaacguucuaaaac

SEQ ID NO: 35757 - RNA, 20 nt, Artificial Sequence
  MKO10035757_A_Olfr1122
  gRNA
cacuacugaagcaauauaga

SEQ ID NO: 35758 - RNA, 20 nt, Artificial Sequence
  MKO10035758_A_Olfr1123
  gRNA
agcagucuacguaguugcga

SEQ ID NO: 35759 - RNA, 20 nt, Artificial Sequence
  MKO10035759_A_Olfr1123
  gRNA
agugucauaccaguuguaau

SEQ ID NO: 35760 - RNA, 20 nt, Artificial Sequence
  MKO10035760_A_Olfr1123
  gRNA
cugauugaauuuauccuacu

SEQ ID NO: 35761 - RNA, 20 nt, Artificial Sequence
  MKO10035761_A_Olfr1124
  gRNA
agauccaauaguagucauuc

SEQ ID NO: 35762 - RNA, 20 nt, Artificial Sequence
  MKO10035762_A_Olfr1124
  gRNA
ucauaacuagaggauaaugc

SEQ ID NO: 35763 - RNA, 20 nt, Artificial Sequence
  MKO10035763_A_Olfr1124
  gRNA
gaugucugcccuaucugaau

SEQ ID NO: 35764 - RNA, 20 nt, Artificial Sequence
  MKO10035764_A_Olfr1126
  gRNA
guguauugaaguaucuccac

SEQ ID NO: 35765 - RNA, 20 nt, Artificial Sequence
  MKO10035765_A_Olfr1126
  gRNA
acucaguagcucccagcaua

SEQ ID NO: 35766 - RNA, 20 nt, Artificial Sequence
  MKO10035766_A_Olfr1126
  gRNA
gagaguaguuuaucaguucc

SEQ ID NO: 35767 - RNA, 20 nt, Artificial Sequence
  MKO10035767_A_Olfr1128
  gRNA
auauuuaguacacucgugau

SEQ ID NO: 35768 - RNA, 20 nt, Artificial Sequence
  MKO10035768_A_Olfr1128
  gRNA
guccauggaguaaagugagc

SEQ ID NO: 35769 - RNA, 20 nt, Artificial Sequence
  MKO10035769_A_Olfr1128
  gRNA
uuacaguuaugccguaaaca

SEQ ID NO: 35770 - RNA, 20 nt, Artificial Sequence
  MKO10035770_A_Olfr1129
  gRNA
uaaugagcuaucugucuauu

SEQ ID NO: 35771 - RNA, 20 nt, Artificial Sequence
  MKO10035771_A_Olfr1129
  gRNA
auuaauugacgugucuccgc

SEQ ID NO: 35772 - RNA, 20 nt, Artificial Sequence
  MKO10035772_A_Olfr1129
  gRNA
uguuggcaacuucagaauug

SEQ ID NO: 35773 - RNA, 20 nt, Artificial Sequence
  MKO10035773_A_Olfr112
  gRNA
gaugacaaucccagugaaac

SEQ ID NO: 35774 - RNA, 20 nt, Artificial Sequence
  MKO10035774_A_Olfr112
  gRNA
uaaccauguccauuauuaca

SEQ ID NO: 35775 - RNA, 20 nt, Artificial Sequence
  MKO10035775_A_Olfr112
  gRNA
uaaugaccaccuuguaauaa

SEQ ID NO: 35776 - RNA, 20 nt, Artificial Sequence
  MKO10035776_A_Olfr1130
  gRNA
ugagcuaucugucuauuuag

SEQ ID NO: 35777 - RNA, 20 nt, Artificial Sequence
  MKO10035777_A_Olfr1130
  gRNA
acucaguggcugccagcaua

SEQ ID NO: 35778 - RNA, 20 nt, Artificial Sequence
  MKO10035778_A_Olfr1130
  gRNA
acaacuggguggcacagcug

SEQ ID NO: 35779 - RNA, 20 nt, Artificial Sequence
  MKO10035779_A_Olfr1131
  gRNA
aaacauaucuagcagcaucu

SEQ ID NO: 35780 - RNA, 20 nt, Artificial Sequence
  MKO10035780_A_Olfr1131
  gRNA
uuaaaaauccguucagcuga

SEQ ID NO: 35781 - RNA, 20 nt, Artificial Sequence
  MKO10035781_A_Olfr1131
  gRNA
uagacccgcagaaacacaag

SEQ ID NO: 35782 - RNA, 20 nt, Artificial Sequence
  MKO10035782_A_Olfr1132
  gRNA
gaccucacucuucuacaccc

SEQ ID NO: 35783 - RNA, 20 nt, Artificial Sequence
  MKO10035783_A_Olfr1132
  gRNA
uaauuaagaugaucauccca

SEQ ID NO: 35784 - RNA, 20 nt, Artificial Sequence
  MKO10035784_A_Olfr1132
  gRNA
gaagaugaauucaucuacug

SEQ ID NO: 35785 - RNA, 20 nt, Artificial Sequence
  MKO10035785_A_Olfr1133
  gRNA
auagugauguucacauuaau

SEQ ID NO: 35786 - RNA, 20 nt, Artificial Sequence
  MKO10035786_A_Olfr1133
  gRNA
aucugaaugcacaggaugug

SEQ ID NO: 35787 - RNA, 20 nt, Artificial Sequence
  MKO10035787_A_Olfr1133
  gRNA
aagcagaguuccauaaaaaa

SEQ ID NO: 35788 - RNA, 20 nt, Artificial Sequence
  MKO10035788_A_Olfr1134
  gRNA
acaucgcaauuguauagagu

SEQ ID NO: 35789 - RNA, 20 nt, Artificial Sequence
  MKO10035789_A_Olfr1134
  gRNA
aucggaauguacagcuugua

SEQ ID NO: 35790 - RNA, 20 nt, Artificial Sequence
  MKO10035790_A_Olfr1134
  gRNA
caccgucucucccaagaugc

SEQ ID NO: 35791 - RNA, 20 nt, Artificial Sequence
  MKO10035791_A_Olfr1135
  gRNA
uaucugagcaagauaguagc

SEQ ID NO: 35792 - RNA, 20 nt, Artificial Sequence
  MKO10035792_A_Olfr1135
  gRNA
auaccgacuacauacaucag

SEQ ID NO: 35793 - RNA, 20 nt, Artificial Sequence
  MKO10035793_A_Olfr1135
  gRNA
aaagaugcuaguugaccuaa

SEQ ID NO: 35794 - RNA, 20 nt, Artificial Sequence
  MKO10035794_A_Olfr1136
  gRNA
gucuuaaagauuaguucuac

SEQ ID NO: 35795 - RNA, 20 nt, Artificial Sequence
  MKO10035795_A_Olfr1136
  gRNA
acuauucuucugacaaacgu

SEQ ID NO: 35796 - RNA, 20 nt, Artificial Sequence
  MKO10035796_A_Olfr1136
  gRNA
uuaucauagggauaacaagg

SEQ ID NO: 35797 - RNA, 20 nt, Artificial Sequence
  MKO10035797_A_Olfr1137
  gRNA
uugaauguuucucggcuacu

SEQ ID NO: 35798 - RNA, 20 nt, Artificial Sequence
  MKO10035798_A_Olfr1137
  gRNA
uaccugacaaguacuauaga

SEQ ID NO: 35799 - RNA, 20 nt, Artificial Sequence
  MKO10035799_A_Olfr1137
  gRNA
aaacugguagcacaccuugc

SEQ ID NO: 35800 - RNA, 20 nt, Artificial Sequence
  MKO10035800_A_Olfr1138
  gRNA
gugugcuuccaauuauugac

SEQ ID NO: 35801 - RNA, 20 nt, Artificial Sequence
  MKO10035801_A_Olfr1138
  gRNA
acuaaucugcugacaaaucu

SEQ ID NO: 35802 - RNA, 20 nt, Artificial Sequence
  MKO10035802_A_Olfr1138
  gRNA
gaacaagacaguacuaacac

SEQ ID NO: 35803 - RNA, 20 nt, Artificial Sequence
  MKO10035803_A_Olfr113
  gRNA
cuauugaguucaaaauucac

SEQ ID NO: 35804 - RNA, 20 nt, Artificial Sequence
  MKO10035804_A_Olfr113
  gRNA
cagccacuccaacuguuaca

SEQ ID NO: 35805 - RNA, 20 nt, Artificial Sequence
  MKO10035805_A_Olfr113
  gRNA
gaugauuaccuuguaacagu

SEQ ID NO: 35806 - RNA, 20 nt, Artificial Sequence
  MKO10035806_A_Olfr1140
  gRNA
guugaguugugcacuauuuc

SEQ ID NO: 35807 - RNA, 20 nt, Artificial Sequence
  MKO10035807_A_Olfr1140
  gRNA
aaagaugcugguagauuuac

SEQ ID NO: 35808 - RNA, 20 nt, Artificial Sequence
  MKO10035808_A_Olfr1140
  gRNA
cucaacaucuauaaagacac

SEQ ID NO: 35809 - RNA, 20 nt, Artificial Sequence
  MKO10035809_A_Olfr1141
  gRNA
gaauugguagcauacucuau

SEQ ID NO: 35810 - RNA, 20 nt, Artificial Sequence
  MKO10035810_A_Olfr1141
  gRNA
uagaguaugcuaccaauucc

SEQ ID NO: 35811 - RNA, 20 nt, Artificial Sequence
  MKO10035811_A_Olfr1141
  gRNA
aguauuagcacuuucauguc

SEQ ID NO: 35812 - RNA, 20 nt, Artificial Sequence
  MKO10035812_A_Olfr1143
  gRNA
cugugcuccuuguuaguggc

SEQ ID NO: 35813 - RNA, 20 nt, Artificial Sequence
  MKO10035813_A_Olfr1143
  gRNA
auaaacuccagccacuaaca

SEQ ID NO: 35814 - RNA, 20 nt, Artificial Sequence
  MKO10035814_A_Olfr1143
  gRNA
ucuaucuaaucaaucucauu

SEQ ID NO: 35815 - RNA, 20 nt, Artificial Sequence
  MKO10035815_A_Olfr1145
  gRNA
gacagcaauuuaucaauucc

SEQ ID NO: 35816 - RNA, 20 nt, Artificial Sequence
  MKO10035816_A_Olfr1145
  gRNA
aauuggaaugccacuuagcc

SEQ ID NO: 35817 - RNA, 20 nt, Artificial Sequence
  MKO10035817_A_Olfr1145
  gRNA
ccaaagucuacgcauucccc

SEQ ID NO: 35818 - RNA, 20 nt, Artificial Sequence
  MKO10035818_A_Olfr1148
  gRNA
uugccaacagccaaaggucg

SEQ ID NO: 35819 - RNA, 20 nt, Artificial Sequence
  MKO10035819_A_Olfr1148
  gRNA
cauaccaccaauucucacgc

SEQ ID NO: 35820 - RNA, 20 nt, Artificial Sequence
  MKO10035820_A_Olfr1148
  gRNA
ggauguaagcaccaauauaa

SEQ ID NO: 35821 - RNA, 20 nt, Artificial Sequence
  MKO10035821_A_Olfr114
  gRNA
uggcuaagcagcaguauucc

SEQ ID NO: 35822 - RNA, 20 nt, Artificial Sequence
  MKO10035822_A_Olfr114
  gRNA
cagccacucccauuauuaca

SEQ ID NO: 35823 - RNA, 20 nt, Artificial Sequence
  MKO10035823_A_Olfr114
  gRNA
augccauaaagaguguugua

SEQ ID NO: 35824 - RNA, 20 nt, Artificial Sequence
  MKO10035824_A_Olfr1151
  gRNA
aaccaucuguuguugccacc

SEQ ID NO: 35825 - RNA, 20 nt, Artificial Sequence
  MKO10035825_A_Olfr1151
  gRNA
gugucuacugcuagcaguaa

SEQ ID NO: 35826 - RNA, 20 nt, Artificial Sequence
  MKO10035826_A_Olfr1151
  gRNA
uaccugguggcaacaacaga

SEQ ID NO: 35827 - RNA, 20 nt, Artificial Sequence
  MKO10035827_A_Olfr1152
  gRNA
cauaucuacugcauauagca

SEQ ID NO: 35828 - RNA, 20 nt, Artificial Sequence
  MKO10035828_A_Olfr1152
  gRNA
guguacuacagcaucuacaa

SEQ ID NO: 35829 - RNA, 20 nt, Artificial Sequence
  MKO10035829_A_Olfr1152
  gRNA
caccaagguguaaaacagug

SEQ ID NO: 35830 - RNA, 20 nt, Artificial Sequence
  MKO10035830_A_Olfr1153
  gRNA
cuaguuauauucacccuauu

SEQ ID NO: 35831 - RNA, 20 nt, Artificial Sequence
  MKO10035831_A_Olfr1153
  gRNA
agugguaugcuaucagcucc

SEQ ID NO: 35832 - RNA, 20 nt, Artificial Sequence
  MKO10035832_A_Olfr1153
  gRNA
uaucugaacaagauaguaau

SEQ ID NO: 35833 - RNA, 20 nt, Artificial Sequence
  MKO10035833_A_Olfr1154
  gRNA
aagacgucaaauuugcguuu

SEQ ID NO: 35834 - RNA, 20 nt, Artificial Sequence
  MKO10035834_A_Olfr1154
  gRNA
uacacaugacauuauacucg

SEQ ID NO: 35835 - RNA, 20 nt, Artificial Sequence
  MKO10035835_A_Olfr1154
  gRNA
gauaaauaguaacuacuguc

SEQ ID NO: 35836 - RNA, 20 nt, Artificial Sequence
  MKO10035836_A_Olfr1155
  gRNA
acaugacuacuguguacagc

SEQ ID NO: 35837 - RNA, 20 nt, Artificial Sequence
  MKO10035837_A_Olfr1155
  gRNA
agauagugauggcugucaua

SEQ ID NO: 35838 - RNA, 20 nt, Artificial Sequence
  MKO10035838_A_Olfr1155
  gRNA
aaccccgaaaauauaaauuu

SEQ ID NO: 35839 - RNA, 20 nt, Artificial Sequence
  MKO10035839_A_Olfr1156
  gRNA
auuuauugucagcccaacuc

SEQ ID NO: 35840 - RNA, 20 nt, Artificial Sequence
  MKO10035840_A_Olfr1156
  gRNA
gagaacacacugaugcauag

SEQ ID NO: 35841 - RNA, 20 nt, Artificial Sequence
  MKO10035841_A_Olfr1156
  gRNA
gaaucaguacagucaugccc

SEQ ID NO: 35842 - RNA, 20 nt, Artificial Sequence
  MKO10035842_A_Olfr1157
  gRNA
augauagccguauauaguag

SEQ ID NO: 35843 - RNA, 20 nt, Artificial Sequence
  MKO10035843_A_Olfr1157
  gRNA
cucaaaucuccguaugauac

SEQ ID NO: 35844 - RNA, 20 nt, Artificial Sequence
  MKO10035844_A_Olfr1157
  gRNA
agucaccgcccuggccaacc

SEQ ID NO: 35845 - RNA, 20 nt, Artificial Sequence
  MKO10035845_A_Olfr1158
  gRNA
gauaaauggugauuacugcc

SEQ ID NO: 35846 - RNA, 20 nt, Artificial Sequence
  MKO10035846_A_Olfr1158
  gRNA
cagcugaguacagacccucu

SEQ ID NO: 35847 - RNA, 20 nt, Artificial Sequence
  MKO10035847_A_Olfr1158
  gRNA
uuacacacaugacauuauac

SEQ ID NO: 35848 - RNA, 20 nt, Artificial Sequence
  MKO10035848_A_Olfr115
  gRNA
uagcaacuccaauuguuaca

SEQ ID NO: 35849 - RNA, 20 nt, Artificial Sequence
  MKO10035849_A_Olfr115
  gRNA
ugcuaauauccugucugcag

SEQ ID NO: 35850 - RNA, 20 nt, Artificial Sequence
  MKO10035850_A_Olfr115
  gRNA
gaaaauauaaccacgaugag

SEQ ID NO: 35851 - RNA, 20 nt, Artificial Sequence
  MKO10035851_A_Olfr1160
  gRNA
gccaugauagauggugauua

SEQ ID NO: 35852 - RNA, 20 nt, Artificial Sequence
  MKO10035852_A_Olfr1160
  gRNA
cuacacacaugacauaauau

SEQ ID NO: 35853 - RNA, 20 nt, Artificial Sequence
  MKO10035853_A_Olfr1160
  gRNA
caacugaauacagacucucu

SEQ ID NO: 35854 - RNA, 20 nt, Artificial Sequence
  MKO10035854_A_Olfr1161
  gRNA
caaggaucaacguacuuuag

SEQ ID NO: 35855 - RNA, 20 nt, Artificial Sequence
  MKO10035855_A_Olfr1161
  gRNA
caagccauguuacugacaua

SEQ ID NO: 35856 - RNA, 20 nt, Artificial Sequence
  MKO10035856_A_Olfr1161
  gRNA
cacacguauagaaagccuuu

SEQ ID NO: 35857 - RNA, 20 nt, Artificial Sequence
  MKO10035857_A_Olfr1162
  gRNA
cauguacguuaucacuguag

SEQ ID NO: 35858 - RNA, 20 nt, Artificial Sequence
  MKO10035858_A_Olfr1162
  gRNA
gauaggcauuauggugccaa

SEQ ID NO: 35859 - RNA, 20 nt, Artificial Sequence
  MKO10035859_A_Olfr1162
  gRNA
ugaugagugcuaucauccca

SEQ ID NO: 35860 - RNA, 20 nt, Artificial Sequence
  MKO10035860_A_Olfr1163
  gRNA
gacaacugcauaaaagaccg

SEQ ID NO: 35861 - RNA, 20 nt, Artificial Sequence
  MKO10035861_A_Olfr1163
  gRNA
gcuguccacuauggugccac

SEQ ID NO: 35862 - RNA, 20 nt, Artificial Sequence
  MKO10035862_A_Olfr1163
  gRNA
ggagauuaacuuuguccugu

SEQ ID NO: 35863 - RNA, 20 nt, Artificial Sequence
  MKO10035863_A_Olfr1164
  gRNA
aacaggggcaauuggagguu

SEQ ID NO: 35864 - RNA, 20 nt, Artificial Sequence
  MKO10035864_A_Olfr1164
  gRNA
gacagacaccaauagcuuuc

SEQ ID NO: 35865 - RNA, 20 nt, Artificial Sequence
  MKO10035865_A_Olfr1164
  gRNA
guaauuacuuacauaugggc

SEQ ID NO: 35866 - RNA, 20 nt, Artificial Sequence
  MKO10035866_A_Olfr1166
  gRNA
acuaacuauagcaaugacua

SEQ ID NO: 35867 - RNA, 20 nt, Artificial Sequence
  MKO10035867_A_Olfr1166
  gRNA
cauaugaugcuagagugauc

SEQ ID NO: 35868 - RNA, 20 nt, Artificial Sequence
  MKO10035868_A_Olfr1166
  gRNA
uguaucuuucaaagcaugca

SEQ ID NO: 35869 - RNA, 20 nt, Artificial Sequence
  MKO10035869_A_Olfr1167
  gRNA
aaauuguuauggcagucaag

SEQ ID NO: 35870 - RNA, 20 nt, Artificial Sequence
  MKO10035870_A_Olfr1167
  gRNA
caucaguguuacugaguaga

SEQ ID NO: 35871 - RNA, 20 nt, Artificial Sequence
  MKO10035871_A_Olfr1167
  gRNA
auaggaggaguaagauccca

SEQ ID NO: 35872 - RNA, 20 nt, Artificial Sequence
  MKO10035872_A_Olfr1168
  gRNA
gcuacuacccucacuuaaua

SEQ ID NO: 35873 - RNA, 20 nt, Artificial Sequence
  MKO10035873_A_Olfr1168
  gRNA
uaguagccuucuuaucacua

SEQ ID NO: 35874 - RNA, 20 nt, Artificial Sequence
  MKO10035874_A_Olfr1168
  gRNA
agucauuuccauauuaagug

SEQ ID NO: 35875 - RNA, 20 nt, Artificial Sequence
  MKO10035875_A_Olfr116
  gRNA
gagaauagcuaccucacccc

SEQ ID NO: 35876 - RNA, 20 nt, Artificial Sequence
  MKO10035876_A_Olfr116
  gRNA
uaaccaucccuauuacuaca

SEQ ID NO: 35877 - RNA, 20 nt, Artificial Sequence
  MKO10035877_A_Olfr116
  gRNA
ucacagugaugucauacgau

SEQ ID NO: 35878 - RNA, 20 nt, Artificial Sequence
  MKO10035878_A_Olfr1170
  gRNA
uaagcaugccaacugacuaa

SEQ ID NO: 35879 - RNA, 20 nt, Artificial Sequence
  MKO10035879_A_Olfr1170
  gRNA
ugauuccuccuuuagucagu

SEQ ID NO: 35880 - RNA, 20 nt, Artificial Sequence
  MKO10035880_A_Olfr1170
  gRNA
caucaauguuacugaguaga

SEQ ID NO: 35881 - RNA, 20 nt, Artificial Sequence
  MKO10035881_A_Olfr1173
  gRNA
aaguuauauguggggagguc

SEQ ID NO: 35882 - RNA, 20 nt, Artificial Sequence
  MKO10035882_A_Olfr1173
  gRNA
cagcugucuuauugugaacc

SEQ ID NO: 35883 - RNA, 20 nt, Artificial Sequence
  MKO10035883_A_Olfr1173
  gRNA
acuacuaaccucauuuaaca

SEQ ID NO: 35884 - RNA, 20 nt, Artificial Sequence
  MKO10035884_A_Olfr1176
  gRNA
guuaucaagauccccacuaa

SEQ ID NO: 35885 - RNA, 20 nt, Artificial Sequence
  MKO10035885_A_Olfr1176
  gRNA
cucagaguauccgaacuuac

SEQ ID NO: 35886 - RNA, 20 nt, Artificial Sequence
  MKO10035886_A_Olfr1176
  gRNA
aaauuaacaagcacgcuauc

SEQ ID NO: 35887 - RNA, 20 nt, Artificial Sequence
  MKO10035887_A_Olfr1178
  gRNA
acuacaccauccuuaugagc

SEQ ID NO: 35888 - RNA, 20 nt, Artificial Sequence
  MKO10035888_A_Olfr1178
  gRNA
agacuauguuaccuuauguc

SEQ ID NO: 35889 - RNA, 20 nt, Artificial Sequence
  MKO10035889_A_Olfr1178
  gRNA
gugugaucuuauacacuguc

SEQ ID NO: 35890 - RNA, 20 nt, Artificial Sequence
  MKO10035890_A_Olfr1179
  gRNA
aaguccgacucugugcguau

SEQ ID NO: 35891 - RNA, 20 nt, Artificial Sequence
  MKO10035891_A_Olfr1179
  gRNA
ucaccuucguagucuugaug

SEQ ID NO: 35892 - RNA, 20 nt, Artificial Sequence
  MKO10035892_A_Olfr1179
  gRNA
ucacugaccuucucguagaa

SEQ ID NO: 35893 - RNA, 20 nt, Artificial Sequence
  MKO10035893_A_Olfr117
  gRNA
aaaauaguacuacuacaauu

SEQ ID NO: 35894 - RNA, 20 nt, Artificial Sequence
  MKO10035894_A_Olfr117
  gRNA
guaaggaaagauucuagcac

SEQ ID NO: 35895 - RNA, 20 nt, Artificial Sequence
  MKO10035895_A_Olfr117
  gRNA
cagcuccuaugcacagaguc

SEQ ID NO: 35896 - RNA, 20 nt, Artificial Sequence
  MKO10035896_A_Olfr1180
  gRNA
uuucugccaguaaaucaguc

SEQ ID NO: 35897 - RNA, 20 nt, Artificial Sequence
  MKO10035897_A_Olfr1180
  gRNA
gugcaagccaauuucaauaa

SEQ ID NO: 35898 - RNA, 20 nt, Artificial Sequence
  MKO10035898_A_Olfr1180
  gRNA
uaauugcacgcuucaucucu

SEQ ID NO: 35899 - RNA, 20 nt, Artificial Sequence
  MKO10035899_A_Olfr1181
  gRNA
cugcaagccucucuacuaca

SEQ ID NO: 35900 - RNA, 20 nt, Artificial Sequence
  MKO10035900_A_Olfr1181
  gRNA
uucccgaauuggcaaccaug

SEQ ID NO: 35901 - RNA, 20 nt, Artificial Sequence
  MKO10035901_A_Olfr1181
  gRNA
aggucuaagguagacaaaga

SEQ ID NO: 35902 - RNA, 20 nt, Artificial Sequence
  MKO10035902_A_Olfr1182
  gRNA
agccaugacugucaggauua

SEQ ID NO: 35903 - RNA, 20 nt, Artificial Sequence
  MKO10035903_A_Olfr1182
  gRNA
gaaauucugauauguuccuc

SEQ ID NO: 35904 - RNA, 20 nt, Artificial Sequence
  MKO10035904_A_Olfr1182
  gRNA
uagcagauccccaaucaauu

SEQ ID NO: 35905 - RNA, 20 nt, Artificial Sequence
  MKO10035905_A_Olfr1183
  gRNA
auaaugagccaacguauuug

SEQ ID NO: 35906 - RNA, 20 nt, Artificial Sequence
  MKO10035906_A_Olfr1183
  gRNA
cuaauaugccacaaauacgu

SEQ ID NO: 35907 - RNA, 20 nt, Artificial Sequence
  MKO10035907_A_Olfr1183
  gRNA
gugaauacaagacccuaccc

SEQ ID NO: 35908 - RNA, 20 nt, Artificial Sequence
  MKO10035908_A_Olfr1184
  gRNA
uguaccgacaccaccaucac

SEQ ID NO: 35909 - RNA, 20 nt, Artificial Sequence
  MKO10035909_A_Olfr1184
  gRNA
gcaggugccauauccugauc

SEQ ID NO: 35910 - RNA, 20 nt, Artificial Sequence
  MKO10035910_A_Olfr1184
  gRNA
uguuaccuugccaucuugug

SEQ ID NO: 35911 - RNA, 20 nt, Artificial Sequence
  MKO10035911_A_Olfr1186
  gRNA
gaaugaauucagucaucgua

SEQ ID NO: 35912 - RNA, 20 nt, Artificial Sequence
  MKO10035912_A_Olfr1186
  gRNA
auaaugagccaacauaucug

SEQ ID NO: 35913 - RNA, 20 nt, Artificial Sequence
  MKO10035913_A_Olfr1186
  gRNA
cuaauacaccacagauaugu

SEQ ID NO: 35914 - RNA, 20 nt, Artificial Sequence
  MKO10035914_A_Olfr1188
  gRNA
accuacaucauuacugucac

SEQ ID NO: 35915 - RNA, 20 nt, Artificial Sequence
  MKO10035915_A_Olfr1188
  gRNA
aguaacaaguaucugaccaa

SEQ ID NO: 35916 - RNA, 20 nt, Artificial Sequence
  MKO10035916_A_Olfr1188
  gRNA
caccaccauugcaagcaacc

SEQ ID NO: 35917 - RNA, 20 nt, Artificial Sequence
  MKO10035917_A_Olfr1189
  gRNA
accaucaagcagcacacccu

SEQ ID NO: 35918 - RNA, 20 nt, Artificial Sequence
  MKO10035918_A_Olfr1189
  gRNA
uaaccagaagcccuagucug

SEQ ID NO: 35919 - RNA, 20 nt, Artificial Sequence
  MKO10035919_A_Olfr1189
  gRNA
cuucagaacuauaagacuua

SEQ ID NO: 35920 - RNA, 20 nt, Artificial Sequence
  MKO10035920_A_Olfr118
  gRNA
aaccuuguaagugagauccg

SEQ ID NO: 35921 - RNA, 20 nt, Artificial Sequence
  MKO10035921_A_Olfr118
  gRNA
cucaacccgaaugagucgug

SEQ ID NO: 35922 - RNA, 20 nt, Artificial Sequence
  MKO10035922_A_Olfr118
  gRNA
acccuucccgagagauaccu

SEQ ID NO: 35923 - RNA, 20 nt, Artificial Sequence
  MKO10035923_A_Olfr1193
  gRNA
ucuccacuauaugacuauga

SEQ ID NO: 35924 - RNA, 20 nt, Artificial Sequence
  MKO10035924_A_Olfr1193
  gRNA
aacaauguaagugucagugc

SEQ ID NO: 35925 - RNA, 20 nt, Artificial Sequence
  MKO10035925_A_Olfr1193
  gRNA
aaaugaugacaacagcaaug

SEQ ID NO: 35926 - RNA, 20 nt, Artificial Sequence
  MKO10035926_A_Olfr1195
  gRNA
uguacaaaggguuccacuau

SEQ ID NO: 35927 - RNA, 20 nt, Artificial Sequence
  MKO10035927_A_Olfr1195
  gRNA
uguagccccgagaacaauug

SEQ ID NO: 35928 - RNA, 20 nt, Artificial Sequence
  MKO10035928_A_Olfr1195
  gRNA
uauaugagaccaugagcaua

SEQ ID NO: 35929 - RNA, 20 nt, Artificial Sequence
  MKO10035929_A_Olfr1196
  gRNA
ggccaagucucugaugagcc

SEQ ID NO: 35930 - RNA, 20 nt, Artificial Sequence
  MKO10035930_A_Olfr1196
  gRNA
aucuuagcaauugccaacuc

SEQ ID NO: 35931 - RNA, 20 nt, Artificial Sequence
  MKO10035931_A_Olfr1196
  gRNA
aaaaagcaccaucccagagu

SEQ ID NO: 35932 - RNA, 20 nt, Artificial Sequence
  MKO10035932_A_Olfr1197
  gRNA
ugcucagucugccguucugu

SEQ ID NO: 35933 - RNA, 20 nt, Artificial Sequence
  MKO10035933_A_Olfr1197
  gRNA
uuuccacaccugcuagcaag

SEQ ID NO: 35934 - RNA, 20 nt, Artificial Sequence
  MKO10035934_A_Olfr1197
  gRNA
aucuuaacaauugccaacuc

SEQ ID NO: 35935 - RNA, 20 nt, Artificial Sequence
  MKO10035935_A_Olfr1198
  gRNA
caugagccuuguaucugugc

SEQ ID NO: 35936 - RNA, 20 nt, Artificial Sequence
  MKO10035936_A_Olfr1198
  gRNA
auuguaaucauuaccacuac

SEQ ID NO: 35937 - RNA, 20 nt, Artificial Sequence
  MKO10035937_A_Olfr1198
  gRNA
cuugugauagccucagcuau

SEQ ID NO: 35938 - RNA, 20 nt, Artificial Sequence
  MKO10035938_A_Olfr1199
  gRNA
cugaacuaaagaaugcacgc

SEQ ID NO: 35939 - RNA, 20 nt, Artificial Sequence
  MKO10035939_A_Olfr1199
  gRNA
gauaagcaaguugcccagua

SEQ ID NO: 35940 - RNA, 20 nt, Artificial Sequence
  MKO10035940_A_Olfr1199
  gRNA
cauaggagaacauuagcaca

SEQ ID NO: 35941 - RNA, 20 nt, Artificial Sequence
  MKO10035941_A_Olfr119
  gRNA
accccacuacucauucgugu

SEQ ID NO: 35942 - RNA, 20 nt, Artificial Sequence
  MKO10035942_A_Olfr119
  gRNA
uauggcuuaugaccgcugca

SEQ ID NO: 35943 - RNA, 20 nt, Artificial Sequence
  MKO10035943_A_Olfr119
  gRNA
auggauuggugcagaugaca

SEQ ID NO: 35944 - RNA, 20 nt, Artificial Sequence
  MKO10035944_A_Olfr11
  gRNA
uugaaaauccaaucugccga

SEQ ID NO: 35945 - RNA, 20 nt, Artificial Sequence
  MKO10035945_A_Olfr11
  gRNA
uucaguuggcggcuguaucc

SEQ ID NO: 35946 - RNA, 20 nt, Artificial Sequence
  MKO10035946_A_Olfr11
  gRNA
uguggaguuuaggauccaaa

SEQ ID NO: 35947 - RNA, 20 nt, Artificial Sequence
  MKO10035947_A_Olfr1200
  gRNA
uuacagaccagcuucaaaag

SEQ ID NO: 35948 - RNA, 20 nt, Artificial Sequence
  MKO10035948_A_Olfr1200
  gRNA
aucagagcagaauuacaaga

SEQ ID NO: 35949 - RNA, 20 nt, Artificial Sequence
  MKO10035949_A_Olfr1200
  gRNA
caagaucaucugcagggaag

SEQ ID NO: 35950 - RNA, 20 nt, Artificial Sequence
  MKO10035950_A_Olfr1201
  gRNA
uugugacaaucaaguucagu

SEQ ID NO: 35951 - RNA, 20 nt, Artificial Sequence
  MKO10035951_A_Olfr1201
  gRNA
cugcgaaaccauagugcaga

SEQ ID NO: 35952 - RNA, 20 nt, Artificial Sequence
  MKO10035952_A_Olfr1201
  gRNA
caugaugacugaguaacgca

SEQ ID NO: 35953 - RNA, 20 nt, Artificial Sequence
  MKO10035953_A_Olfr1202
  gRNA
ccuacugcuugucuccuacc

SEQ ID NO: 35954 - RNA, 20 nt, Artificial Sequence
  MKO10035954_A_Olfr1202
  gRNA
uugcugauucacuacauaaa

SEQ ID NO: 35955 - RNA, 20 nt, Artificial Sequence
  MKO10035955_A_Olfr1202
  gRNA
uuagggaguuaagaaugacc

SEQ ID NO: 35956 - RNA, 20 nt, Artificial Sequence
  MKO10035956_A_Olfr1204
  gRNA
aaaguaucagcaagcaguuu

SEQ ID NO: 35957 - RNA, 20 nt, Artificial Sequence
  MKO10035957_A_Olfr1204
  gRNA
caaagcgacugcuuuaucaa

SEQ ID NO: 35958 - RNA, 20 nt, Artificial Sequence
  MKO10035958_A_Olfr1204
  gRNA
ggaguuaaggaugaccaagu

SEQ ID NO: 35959 - RNA, 20 nt, Artificial Sequence
  MKO10035959_A_Olfr1205
  gRNA
cugugacuuacagcccuuau

SEQ ID NO: 35960 - RNA, 20 nt, Artificial Sequence
  MKO10035960_A_Olfr1205
  gRNA
auaguaguugucuuauccuu

SEQ ID NO: 35961 - RNA, 20 nt, Artificial Sequence
  MKO10035961_A_Olfr1205
  gRNA
guugagaaagggugauccaa

SEQ ID NO: 35962 - RNA, 20 nt, Artificial Sequence
  MKO10035962_A_Olfr1206
  gRNA
gucacgaaguuuauacuacu

SEQ ID NO: 35963 - RNA, 20 nt, Artificial Sequence
  MKO10035963_A_Olfr1206
  gRNA
ucaucuugauuauucuugcc

SEQ ID NO: 35964 - RNA, 20 nt, Artificial Sequence
  MKO10035964_A_Olfr1206
  gRNA
cugcuauuagugucuaacag

SEQ ID NO: 35965 - RNA, 20 nt, Artificial Sequence
  MKO10035965_A_Olfr1208
  gRNA
cauucugaccuuuguugcau

SEQ ID NO: 35966 - RNA, 20 nt, Artificial Sequence
  MKO10035966_A_Olfr1208
  gRNA
auuguaaucauuacuaccac

SEQ ID NO: 35967 - RNA, 20 nt, Artificial Sequence
  MKO10035967_A_Olfr1208
  gRNA
guagccccaaaauuuauuau

SEQ ID NO: 35968 - RNA, 20 nt, Artificial Sequence
  MKO10035968_A_Olfr1209
  gRNA
cauagcuccaagaacaauug

SEQ ID NO: 35969 - RNA, 20 nt, Artificial Sequence
  MKO10035969_A_Olfr1209
  gRNA
cauaagagaccaucagcaug

SEQ ID NO: 35970 - RNA, 20 nt, Artificial Sequence
  MKO10035970_A_Olfr1209
  gRNA
aucaagacaagccagacccu

SEQ ID NO: 35971 - RNA, 20 nt, Artificial Sequence
  MKO10035971_A_Olfr120
  gRNA
guugaagaaccuuguaacug

SEQ ID NO: 35972 - RNA, 20 nt, Artificial Sequence
  MKO10035972_A_Olfr120
  gRNA
cccgagggaucucucgggaa

SEQ ID NO: 35973 - RNA, 20 nt, Artificial Sequence
  MKO10035973_A_Olfr120
  gRNA
guucagcauggaagucaccg

SEQ ID NO: 35974 - RNA, 20 nt, Artificial Sequence
  MKO10035974_A_Olfr1211
  gRNA
ugcacugauacucauaucuu

SEQ ID NO: 35975 - RNA, 20 nt, Artificial Sequence
  MKO10035975_A_Olfr1211
  gRNA
aggcucuguggcacacuuau

SEQ ID NO: 35976 - RNA, 20 nt, Artificial Sequence
  MKO10035976_A_Olfr1211
  gRNA
caaugcugggcuacagacaa

SEQ ID NO: 35977 - RNA, 20 nt, Artificial Sequence
  MKO10035977_A_Olfr1212
  gRNA
ugcacuaacacuuaugucua

SEQ ID NO: 35978 - RNA, 20 nt, Artificial Sequence
  MKO10035978_A_Olfr1212
  gRNA
ugaacucuguuacaauaguu

SEQ ID NO: 35979 - RNA, 20 nt, Artificial Sequence
  MKO10035979_A_Olfr1212
  gRNA
ucuauguugcuaaucuccua

SEQ ID NO: 35980 - RNA, 20 nt, Artificial Sequence
  MKO10035980_A_Olfr1213
  gRNA
cauauguagucgugcacuuc

SEQ ID NO: 35981 - RNA, 20 nt, Artificial Sequence
  MKO10035981_A_Olfr1213
  gRNA
aagugcacgacuacauauga

SEQ ID NO: 35982 - RNA, 20 nt, Artificial Sequence
  MKO10035982_A_Olfr1213
  gRNA
uucaucuacauugcaacagu

SEQ ID NO: 35983 - RNA, 20 nt, Artificial Sequence
  MKO10035983_A_Olfr1214
  gRNA
ugucuacaguccugcacuac

SEQ ID NO: 35984 - RNA, 20 nt, Artificial Sequence
  MKO10035984_A_Olfr1214
  gRNA
gcacuuucuuacugcuguag

SEQ ID NO: 35985 - RNA, 20 nt, Artificial Sequence
  MKO10035985_A_Olfr1214
  gRNA
ccgugcauauauuaauauac

SEQ ID NO: 35986 - RNA, 20 nt, Artificial Sequence
  MKO10035986_A_Olfr1215
  gRNA
gcuucgaguccuguguugcu

SEQ ID NO: 35987 - RNA, 20 nt, Artificial Sequence
  MKO10035987_A_Olfr1215
  gRNA
ggugaucauucuggcagcua

SEQ ID NO: 35988 - RNA, 20 nt, Artificial Sequence
  MKO10035988_A_Olfr1215
  gRNA
gacaccguuacucaauccug

SEQ ID NO: 35989 - RNA, 20 nt, Artificial Sequence
  MKO10035989_A_Olfr1216
  gRNA
uucuacuguuacacccaaga

SEQ ID NO: 35990 - RNA, 20 nt, Artificial Sequence
  MKO10035990_A_Olfr1216
  gRNA
ugcuacagagccuccgagua

SEQ ID NO: 35991 - RNA, 20 nt, Artificial Sequence
  MKO10035991_A_Olfr1216
  gRNA
aagcccuaagauuaugaacu

SEQ ID NO: 35992 - RNA, 20 nt, Artificial Sequence
  MKO10035992_A_Olfr1217
  gRNA
uagaagaagugcaugcaucc

SEQ ID NO: 35993 - RNA, 20 nt, Artificial Sequence
  MKO10035993_A_Olfr1217
  gRNA
uacgucgcccuucagaacuc

SEQ ID NO: 35994 - RNA, 20 nt, Artificial Sequence
  MKO10035994_A_Olfr1217
  gRNA
uccuuauugauugucuccua

SEQ ID NO: 35995 - RNA, 20 nt, Artificial Sequence
  MKO10035995_A_Olfr1218
  gRNA
uugcaucaugcaacagccaa

SEQ ID NO: 35996 - RNA, 20 nt, Artificial Sequence
  MKO10035996_A_Olfr1218
  gRNA
uggaagagacacauagaucc

SEQ ID NO: 35997 - RNA, 20 nt, Artificial Sequence
  MKO10035997_A_Olfr1218
  gRNA
gugcaagaagcccccugccc

SEQ ID NO: 35998 - RNA, 20 nt, Artificial Sequence
  MKO10035998_A_Olfr1219
  gRNA
uaggucuugcauauauuaau

SEQ ID NO: 35999 - RNA, 20 nt, Artificial Sequence
  MKO10035999_A_Olfr1219
  gRNA
agaaguuaaugcauccagua

SEQ ID NO: 36000 - RNA, 20 nt, Artificial Sequence
  MKO10036000_A_Olfr1219
  gRNA
acagagccuccgagucauga

SEQ ID NO: 36001 - RNA, 20 nt, Artificial Sequence
  MKO10036001_A_Olfr121
  gRNA
guucagcauggaugucaccg

SEQ ID NO: 36002 - RNA, 20 nt, Artificial Sequence
  MKO10036002_A_Olfr121
  gRNA
uaugcaacacgaaugaguca

SEQ ID NO: 36003 - RNA, 20 nt, Artificial Sequence
  MKO10036003_A_Olfr121
  gRNA
aucccucccgagagauuucu

SEQ ID NO: 36004 - RNA, 20 nt, Artificial Sequence
  MKO10036004_A_Olfr1220
  gRNA
uugguauaccuagcaacaau

SEQ ID NO: 36005 - RNA, 20 nt, Artificial Sequence
  MKO10036005_A_Olfr1220
  gRNA
uguugccuccgauuguugcu

SEQ ID NO: 36006 - RNA, 20 nt, Artificial Sequence
  MKO10036006_A_Olfr1220
  gRNA
aagagcuuuaagucguccuu

SEQ ID NO: 36007 - RNA, 20 nt, Artificial Sequence
  MKO10036007_A_Olfr1221
  gRNA
guaacaccuaagaugaucgu

SEQ ID NO: 36008 - RNA, 20 nt, Artificial Sequence
  MKO10036008_A_Olfr1221
  gRNA
uaccgcaguaaagaagugua

SEQ ID NO: 36009 - RNA, 20 nt, Artificial Sequence
  MKO10036009_A_Olfr1221
  gRNA
accuguccauuaugagcaag

SEQ ID NO: 36010 - RNA, 20 nt, Artificial Sequence
  MKO10036010_A_Olfr1222
  gRNA
gcucuguggcacucucguaa

SEQ ID NO: 36011 - RNA, 20 nt, Artificial Sequence
  MKO10036011_A_Olfr1222
  gRNA
ggugauuaucuugacaucua

SEQ ID NO: 36012 - RNA, 20 nt, Artificial Sequence
  MKO10036012_A_Olfr1222
  gRNA
ccucaacuccugcaaagaag

SEQ ID NO: 36013 - RNA, 20 nt, Artificial Sequence
  MKO10036013_A_Olfr1223
  gRNA
uggaggcaacauaguaauug

SEQ ID NO: 36014 - RNA, 20 nt, Artificial Sequence
  MKO10036014_A_Olfr1223
  gRNA
ccagagacucugugucauuc

SEQ ID NO: 36015 - RNA, 20 nt, Artificial Sequence
  MKO10036015_A_Olfr1223
  gRNA
caucuccuuugaauguugua

SEQ ID NO: 36016 - RNA, 20 nt, Artificial Sequence
  MKO10036016_A_Olfr1225
  gRNA
gcucuguggcaaucuuguga

SEQ ID NO: 36017 - RNA, 20 nt, Artificial Sequence
  MKO10036017_A_Olfr1225
  gRNA
uuuaaagcccucucaaccug

SEQ ID NO: 36018 - RNA, 20 nt, Artificial Sequence
  MKO10036018_A_Olfr1225
  gRNA
uaaacuacagaauugagcaa

SEQ ID NO: 36019 - RNA, 20 nt, Artificial Sequence
  MKO10036019_A_Olfr1226
  gRNA
ugaacucagugacacuacug

SEQ ID NO: 36020 - RNA, 20 nt, Artificial Sequence
  MKO10036020_A_Olfr1226
  gRNA
gggaaaugaagaaugcuauu

SEQ ID NO: 36021 - RNA, 20 nt, Artificial Sequence
  MKO10036021_A_Olfr1226
  gRNA
cagaagugguguuaugauug

SEQ ID NO: 36022 - RNA, 20 nt, Artificial Sequence
  MKO10036022_A_Olfr1228
  gRNA
cacugucaccccuaagauga

SEQ ID NO: 36023 - RNA, 20 nt, Artificial Sequence
  MKO10036023_A_Olfr1228
  gRNA
auucagaagugguguuauga

SEQ ID NO: 36024 - RNA, 20 nt, Artificial Sequence
  MKO10036024_A_Olfr1228
  gRNA
cacaguauguucucaacauu

SEQ ID NO: 36025 - RNA, 20 nt, Artificial Sequence
  MKO10036025_A_Olfr1229
  gRNA
ggugacuguuguuucuacuc

SEQ ID NO: 36026 - RNA, 20 nt, Artificial Sequence
  MKO10036026_A_Olfr1229
  gRNA
caaauuccguuauaaaacuc

SEQ ID NO: 36027 - RNA, 20 nt, Artificial Sequence
  MKO10036027_A_Olfr1229
  gRNA
cugugguacucuagugggag

SEQ ID NO: 36028 - RNA, 20 nt, Artificial Sequence
  MKO10036028_A_Olfr122
  gRNA
gccaagaguuuauccacuuc

SEQ ID NO: 36029 - RNA, 20 nt, Artificial Sequence
  MKO10036029_A_Olfr122
  gRNA
caacgucugccaccuauuug

SEQ ID NO: 36030 - RNA, 20 nt, Artificial Sequence
  MKO10036030_A_Olfr122
  gRNA
cccgagggaucucacgggaa

SEQ ID NO: 36031 - RNA, 20 nt, Artificial Sequence
  MKO10036031_A_Olfr1230
  gRNA
gaucauccuucucaucguga

SEQ ID NO: 36032 - RNA, 20 nt, Artificial Sequence
  MKO10036032_A_Olfr1230
  gRNA
uuguuaguccccgaguaugc

SEQ ID NO: 36033 - RNA, 20 nt, Artificial Sequence
  MKO10036033_A_Olfr1230
  gRNA
guuguugcaacuagccugca

SEQ ID NO: 36034 - RNA, 20 nt, Artificial Sequence
  MKO10036034_A_Olfr1231
  gRNA
uauaugaccauuaugcguca

SEQ ID NO: 36035 - RNA, 20 nt, Artificial Sequence
  MKO10036035_A_Olfr1231
  gRNA
aucauaguggccgccaacag

SEQ ID NO: 36036 - RNA, 20 nt, Artificial Sequence
  MKO10036036_A_Olfr1231
  gRNA
auguaagaucccuccaaucc

SEQ ID NO: 36037 - RNA, 20 nt, Artificial Sequence
  MKO10036037_A_Olfr1232
  gRNA
aaggucuguggcacgcuggu

SEQ ID NO: 36038 - RNA, 20 nt, Artificial Sequence
  MKO10036038_A_Olfr1232
  gRNA
ugucuguagcccuacacugc

SEQ ID NO: 36039 - RNA, 20 nt, Artificial Sequence
  MKO10036039_A_Olfr1232
  gRNA
cagcgugccacagaccuucc

SEQ ID NO: 36040 - RNA, 20 nt, Artificial Sequence
  MKO10036040_A_Olfr1233
  gRNA
uuauccaacauaccccgacu

SEQ ID NO: 36041 - RNA, 20 nt, Artificial Sequence
  MKO10036041_A_Olfr1233
  gRNA
cgaguaucuguccaaaagag

SEQ ID NO: 36042 - RNA, 20 nt, Artificial Sequence
  MKO10036042_A_Olfr1233
  gRNA
gcacaggccaacuguaguaa

SEQ ID NO: 36043 - RNA, 20 nt, Artificial Sequence
  MKO10036043_A_Olfr1234
  gRNA
gugauauagcccacuuacga

SEQ ID NO: 36044 - RNA, 20 nt, Artificial Sequence
  MKO10036044_A_Olfr1234
  gRNA
aaaucuagcuccaucguaag

SEQ ID NO: 36045 - RNA, 20 nt, Artificial Sequence
  MKO10036045_A_Olfr1234
  gRNA
acacacucgucgauucauga

SEQ ID NO: 36046 - RNA, 20 nt, Artificial Sequence
  MKO10036046_A_Olfr1238
  gRNA
cuuacugugguugcgaaugg

SEQ ID NO: 36047 - RNA, 20 nt, Artificial Sequence
  MKO10036047_A_Olfr1238
  gRNA
uaucucauucucagcuugca

SEQ ID NO: 36048 - RNA, 20 nt, Artificial Sequence
  MKO10036048_A_Olfr1238
  gRNA
uacacuuaucgacuuaucaa

SEQ ID NO: 36049 - RNA, 20 nt, Artificial Sequence
  MKO10036049_A_Olfr1239
  gRNA
aucuauguugugacaauggc

SEQ ID NO: 36050 - RNA, 20 nt, Artificial Sequence
  MKO10036050_A_Olfr1239
  gRNA
ugcacagacaccuauguuau

SEQ ID NO: 36051 - RNA, 20 nt, Artificial Sequence
  MKO10036051_A_Olfr1239
  gRNA
uacagucaaugacuuaucaa

SEQ ID NO: 36052 - RNA, 20 nt, Artificial Sequence
  MKO10036052_A_Olfr123
  gRNA
gcccugauacugacguccua

SEQ ID NO: 36053 - RNA, 20 nt, Artificial Sequence
  MKO10036053_A_Olfr123
  gRNA
cggcucuucaauagagccuc

SEQ ID NO: 36054 - RNA, 20 nt, Artificial Sequence
  MKO10036054_A_Olfr123
  gRNA
ucaguaucagggcuaagggu

SEQ ID NO: 36055 - RNA, 20 nt, Artificial Sequence
  MKO10036055_A_Olfr1240
  gRNA
auuuccguuucagcuugcau

SEQ ID NO: 36056 - RNA, 20 nt, Artificial Sequence
  MKO10036056_A_Olfr1240
  gRNA
cuauugguggcagccugugc

SEQ ID NO: 36057 - RNA, 20 nt, Artificial Sequence
  MKO10036057_A_Olfr1240
  gRNA
uguacugacacuuacuuaau

SEQ ID NO: 36058 - RNA, 20 nt, Artificial Sequence
  MKO10036058_A_Olfr1241
  gRNA
gaaguacauuggagucccua

SEQ ID NO: 36059 - RNA, 20 nt, Artificial Sequence
  MKO10036059_A_Olfr1241
  gRNA
ugcuaucucacccaaguuga

SEQ ID NO: 36060 - RNA, 20 nt, Artificial Sequence
  MKO10036060_A_Olfr1241
  gRNA
guccaacaugaucuugagug

SEQ ID NO: 36061 - RNA, 20 nt, Artificial Sequence
  MKO10036061_A_Olfr1242
  gRNA
ugugacaugaaucaauuacu

SEQ ID NO: 36062 - RNA, 20 nt, Artificial Sequence
  MKO10036062_A_Olfr1242
  gRNA
ucacuguaagugcaaugagc

SEQ ID NO: 36063 - RNA, 20 nt, Artificial Sequence
  MKO10036063_A_Olfr1242
  gRNA
auucuucuauugcugauagc

SEQ ID NO: 36064 - RNA, 20 nt, Artificial Sequence
  MKO10036064_A_Olfr1243
  gRNA
aucucacccaauuugauuau

SEQ ID NO: 36065 - RNA, 20 nt, Artificial Sequence
  MKO10036065_A_Olfr1243
  gRNA
ucaccgucacugcaaugagc

SEQ ID NO: 36066 - RNA, 20 nt, Artificial Sequence
  MKO10036066_A_Olfr1243
  gRNA
gugugauaugaauccauuac

SEQ ID NO: 36067 - RNA, 20 nt, Artificial Sequence
  MKO10036067_A_Olfr1245
  gRNA
guguguaaaaccaccagucc

SEQ ID NO: 36068 - RNA, 20 nt, Artificial Sequence
  MKO10036068_A_Olfr1245
  gRNA
ucacuuuguugauaauugcc

SEQ ID NO: 36069 - RNA, 20 nt, Artificial Sequence
  MKO10036069_A_Olfr1245
  gRNA
gugcaugcaaguaccaauaa

SEQ ID NO: 36070 - RNA, 20 nt, Artificial Sequence
  MKO10036070_A_Olfr1246
  gRNA
cuuacccucauugccaaugg

SEQ ID NO: 36071 - RNA, 20 nt, Artificial Sequence
  MKO10036071_A_Olfr1246
  gRNA
gaggguaagaccaaugaagu

SEQ ID NO: 36072 - RNA, 20 nt, Artificial Sequence
  MKO10036072_A_Olfr1246
  gRNA
aucucucaagaauuauaguc

SEQ ID NO: 36073 - RNA, 20 nt, Artificial Sequence
  MKO10036073_A_Olfr1247
  gRNA
uaccgugaggccaauaaagu

SEQ ID NO: 36074 - RNA, 20 nt, Artificial Sequence
  MKO10036074_A_Olfr1247
  gRNA
cucacgguaguugccaauaa

SEQ ID NO: 36075 - RNA, 20 nt, Artificial Sequence
  MKO10036075_A_Olfr1247
  gRNA
ugggggauuugcacaugcuc

SEQ ID NO: 36076 - RNA, 20 nt, Artificial Sequence
  MKO10036076_A_Olfr1248
  gRNA
cucacuguaguuagcaguua

SEQ ID NO: 36077 - RNA, 20 nt, Artificial Sequence
  MKO10036077_A_Olfr1248
  gRNA
cucucuuaagacugauaguc

SEQ ID NO: 36078 - RNA, 20 nt, Artificial Sequence
  MKO10036078_A_Olfr1248
  gRNA
ugugacauauacccauuguu

SEQ ID NO: 36079 - RNA, 20 nt, Artificial Sequence
  MKO10036079_A_Olfr1249
  gRNA
gaagacagccguauucuacu

SEQ ID NO: 36080 - RNA, 20 nt, Artificial Sequence
  MKO10036080_A_Olfr1249
  gRNA
cauuauugccaaugauagaa

SEQ ID NO: 36081 - RNA, 20 nt, Artificial Sequence
  MKO10036081_A_Olfr1249
  gRNA
gguugacauugucauucugc

SEQ ID NO: 36082 - RNA, 20 nt, Artificial Sequence
  MKO10036082_A_Olfr124
  gRNA
guuugcaaauccgcuaaucc

SEQ ID NO: 36083 - RNA, 20 nt, Artificial Sequence
  MKO10036083_A_Olfr124
  gRNA
ccauaugaaugcaucguuuc

SEQ ID NO: 36084 - RNA, 20 nt, Artificial Sequence
  MKO10036084_A_Olfr124
  gRNA
uccguucugcugagagucgc

SEQ ID NO: 36085 - RNA, 20 nt, Artificial Sequence
  MKO10036085_A_Olfr1250
  gRNA
gguuugcauucucuuguugg

SEQ ID NO: 36086 - RNA, 20 nt, Artificial Sequence
  MKO10036086_A_Olfr1250
  gRNA
uguacugacaccuauuuccu

SEQ ID NO: 36087 - RNA, 20 nt, Artificial Sequence
  MKO10036087_A_Olfr1250
  gRNA
agcaaaaugaucaaugacau

SEQ ID NO: 36088 - RNA, 20 nt, Artificial Sequence
  MKO10036088_A_Olfr1251
  gRNA
gaagaaagacguauucuaca

SEQ ID NO: 36089 - RNA, 20 nt, Artificial Sequence
  MKO10036089_A_Olfr1251
  gRNA
guacaugcaaguagcaauag

SEQ ID NO: 36090 - RNA, 20 nt, Artificial Sequence
  MKO10036090_A_Olfr1251
  gRNA
cauugucauucuaguugcaa

SEQ ID NO: 36091 - RNA, 20 nt, Artificial Sequence
  MKO10036091_A_Olfr1252
  gRNA
gguuugcauucucuuauugg

SEQ ID NO: 36092 - RNA, 20 nt, Artificial Sequence
  MKO10036092_A_Olfr1252
  gRNA
aaaguacauuggggauccca

SEQ ID NO: 36093 - RNA, 20 nt, Artificial Sequence
  MKO10036093_A_Olfr1252
  gRNA
aaauaauuccauaagagaca

SEQ ID NO: 36094 - RNA, 20 nt, Artificial Sequence
  MKO10036094_A_Olfr1253
  gRNA
gguugauauugucauucucg

SEQ ID NO: 36095 - RNA, 20 nt, Artificial Sequence
  MKO10036095_A_Olfr1253
  gRNA
caccauuagcaaugauagug

SEQ ID NO: 36096 - RNA, 20 nt, Artificial Sequence
  MKO10036096_A_Olfr1253
  gRNA
cucacuaucauugcuaaugg

SEQ ID NO: 36097 - RNA, 20 nt, Artificial Sequence
  MKO10036097_A_Olfr1254
  gRNA
cauacagauugcuccaucgu

SEQ ID NO: 36098 - RNA, 20 nt, Artificial Sequence
  MKO10036098_A_Olfr1254
  gRNA
cuuacugucauugccaacga

SEQ ID NO: 36099 - RNA, 20 nt, Artificial Sequence
  MKO10036099_A_Olfr1254
  gRNA
uggaggguuugcacacucca

SEQ ID NO: 36100 - RNA, 20 nt, Artificial Sequence
  MKO10036100_A_Olfr1255
  gRNA
cuguacaugauaacaauuuc

SEQ ID NO: 36101 - RNA, 20 nt, Artificial Sequence
  MKO10036101_A_Olfr1255
  gRNA
gugugacuuguacccauugu

SEQ ID NO: 36102 - RNA, 20 nt, Artificial Sequence
  MKO10036102_A_Olfr1255
  gRNA
cuacacccucagaaauucug

SEQ ID NO: 36103 - RNA, 20 nt, Artificial Sequence
  MKO10036103_A_Olfr1256
  gRNA
cgugcagaucagcccuccau

SEQ ID NO: 36104 - RNA, 20 nt, Artificial Sequence
  MKO10036104_A_Olfr1256
  gRNA
cucucuaaagaaccuuaauc

SEQ ID NO: 36105 - RNA, 20 nt, Artificial Sequence
  MKO10036105_A_Olfr1256
  gRNA
auucagcucaguacuauuua

SEQ ID NO: 36106 - RNA, 20 nt, Artificial Sequence
  MKO10036106_A_Olfr1257
  gRNA
ggagcgcaggauggcaacau

SEQ ID NO: 36107 - RNA, 20 nt, Artificial Sequence
  MKO10036107_A_Olfr1257
  gRNA
agugcuacccaauuucuuaa

SEQ ID NO: 36108 - RNA, 20 nt, Artificial Sequence
  MKO10036108_A_Olfr1257
  gRNA
aagacuauguagccugcuag

SEQ ID NO: 36109 - RNA, 20 nt, Artificial Sequence
  MKO10036109_A_Olfr1258
  gRNA
uaucacugccaguccaucgc

SEQ ID NO: 36110 - RNA, 20 nt, Artificial Sequence
  MKO10036110_A_Olfr1258
  gRNA
cccauaccacuccuaccagc

SEQ ID NO: 36111 - RNA, 20 nt, Artificial Sequence
  MKO10036111_A_Olfr1258
  gRNA
gugcaugcaagguuaagcaa

SEQ ID NO: 36112 - RNA, 20 nt, Artificial Sequence
  MKO10036112_A_Olfr1259
  gRNA
accacuuugccacuugauaa

SEQ ID NO: 36113 - RNA, 20 nt, Artificial Sequence
  MKO10036113_A_Olfr1259
  gRNA
gugugacuuguauccauugu

SEQ ID NO: 36114 - RNA, 20 nt, Artificial Sequence
  MKO10036114_A_Olfr1259
  gRNA
acagcaacaccuuuaucaag

SEQ ID NO: 36115 - RNA, 20 nt, Artificial Sequence
  MKO10036115_A_Olfr125
  gRNA
uuaguccgacuaucagcuga

SEQ ID NO: 36116 - RNA, 20 nt, Artificial Sequence
  MKO10036116_A_Olfr125
  gRNA
auaugagguccauugcugac

SEQ ID NO: 36117 - RNA, 20 nt, Artificial Sequence
  MKO10036117_A_Olfr125
  gRNA
cuaucugggcuccuacacac

SEQ ID NO: 36118 - RNA, 20 nt, Artificial Sequence
  MKO10036118_A_Olfr1260
  gRNA
ccugcauauucguuuaccuu

SEQ ID NO: 36119 - RNA, 20 nt, Artificial Sequence
  MKO10036119_A_Olfr1260
  gRNA
cauacacauuagcccgcugu

SEQ ID NO: 36120 - RNA, 20 nt, Artificial Sequence
  MKO10036120_A_Olfr1260
  gRNA
agagcagcagccaucuacga

SEQ ID NO: 36121 - RNA, 20 nt, Artificial Sequence
  MKO10036121_A_Olfr1261
  gRNA
acacagaggucgguucauga

SEQ ID NO: 36122 - RNA, 20 nt, Artificial Sequence
  MKO10036122_A_Olfr1261
  gRNA
guaaucuuaggauucaucca

SEQ ID NO: 36123 - RNA, 20 nt, Artificial Sequence
  MKO10036123_A_Olfr1261
  gRNA
agauuacagcagcccccacc

SEQ ID NO: 36124 - RNA, 20 nt, Artificial Sequence
  MKO10036124_A_Olfr1262
  gRNA
ggaaucgugggguuuguuca

SEQ ID NO: 36125 - RNA, 20 nt, Artificial Sequence
  MKO10036125_A_Olfr1262
  gRNA
guuugacaugauuugacccc

SEQ ID NO: 36126 - RNA, 20 nt, Artificial Sequence
  MKO10036126_A_Olfr1262
  gRNA
uggucauccuucgcucccua

SEQ ID NO: 36127 - RNA, 20 nt, Artificial Sequence
  MKO10036127_A_Olfr1263
  gRNA
aaucaucuuguugauugcca

SEQ ID NO: 36128 - RNA, 20 nt, Artificial Sequence
  MKO10036128_A_Olfr1263
  gRNA
guaaucuuaggauucauuca

SEQ ID NO: 36129 - RNA, 20 nt, Artificial Sequence
  MKO10036129_A_Olfr1263
  gRNA
aaugaauccuaagauuacag

SEQ ID NO: 36130 - RNA, 20 nt, Artificial Sequence
  MKO10036130_A_Olfr1264
  gRNA
ccgccaccagcacgacacaa

SEQ ID NO: 36131 - RNA, 20 nt, Artificial Sequence
  MKO10036131_A_Olfr1264
  gRNA
aagagucgucccuucauaca

SEQ ID NO: 36132 - RNA, 20 nt, Artificial Sequence
  MKO10036132_A_Olfr1264
  gRNA
ugcaccaacacauacgucau

SEQ ID NO: 36133 - RNA, 20 nt, Artificial Sequence
  MKO10036133_A_Olfr1265
  gRNA
cacugacagaguucccgcau

SEQ ID NO: 36134 - RNA, 20 nt, Artificial Sequence
  MKO10036134_A_Olfr1265
  gRNA
cuauccaugcuguuccuacg

SEQ ID NO: 36135 - RNA, 20 nt, Artificial Sequence
  MKO10036135_A_Olfr1265
  gRNA
cacauuucgguucauaaugc

SEQ ID NO: 36136 - RNA, 20 nt, Artificial Sequence
  MKO10036136_A_Olfr1269
  gRNA
ugacuccauaggaugcuaag

SEQ ID NO: 36137 - RNA, 20 nt, Artificial Sequence
  MKO10036137_A_Olfr1269
  gRNA
gaugagaaguauuugagcaa

SEQ ID NO: 36138 - RNA, 20 nt, Artificial Sequence
  MKO10036138_A_Olfr1269
  gRNA
cuauccaugcuguucccaug

SEQ ID NO: 36139 - RNA, 20 nt, Artificial Sequence
  MKO10036139_A_Olfr126
  gRNA
ccuguaagaucugcaauuca

SEQ ID NO: 36140 - RNA, 20 nt, Artificial Sequence
  MKO10036140_A_Olfr126
  gRNA
uccugcucuaaugauuacuu

SEQ ID NO: 36141 - RNA, 20 nt, Artificial Sequence
  MKO10036141_A_Olfr126
  gRNA
ucugaagcaacuuuccacuc

SEQ ID NO: 36142 - RNA, 20 nt, Artificial Sequence
  MKO10036142_A_Olfr1270
  gRNA
caauggccucauuguugcaa

SEQ ID NO: 36143 - RNA, 20 nt, Artificial Sequence
  MKO10036143_A_Olfr1270
  gRNA
ccugcagccauuauucaagc

SEQ ID NO: 36144 - RNA, 20 nt, Artificial Sequence
  MKO10036144_A_Olfr1270
  gRNA
caaugaccauugcaacaaug

SEQ ID NO: 36145 - RNA, 20 nt, Artificial Sequence
  MKO10036145_A_Olfr1271
  gRNA
aaaaugcuauacguauguuc

SEQ ID NO: 36146 - RNA, 20 nt, Artificial Sequence
  MKO10036146_A_Olfr1271
  gRNA
uacaauaaaccucuccauaa

SEQ ID NO: 36147 - RNA, 20 nt, Artificial Sequence
  MKO10036147_A_Olfr1271
  gRNA
ugcuugcagugacaccuuua

SEQ ID NO: 36148 - RNA, 20 nt, Artificial Sequence
  MKO10036148_A_Olfr1272
  gRNA
gggcaacagucuuauuguug

SEQ ID NO: 36149 - RNA, 20 nt, Artificial Sequence
  MKO10036149_A_Olfr1272
  gRNA
cauaagccaucaccacaagc

SEQ ID NO: 36150 - RNA, 20 nt, Artificial Sequence
  MKO10036150_A_Olfr1272
  gRNA
ucugagccagacagcccuuc

SEQ ID NO: 36151 - RNA, 20 nt, Artificial Sequence
  MKO10036151_A_Olfr1273-ps
  gRNA
cacuaauugucacaacaaug

SEQ ID NO: 36152 - RNA, 20 nt, Artificial Sequence
  MKO10036152_A_Olfr1273-ps
  gRNA
ggaguagcaaaucucuacua

SEQ ID NO: 36153 - RNA, 20 nt, Artificial Sequence
  MKO10036153_A_Olfr1273-ps
  gRNA
auggaauagugaugacgauc

SEQ ID NO: 36154 - RNA, 20 nt, Artificial Sequence
  MKO10036154_A_Olfr1274-ps
  gRNA
cauaggccaucaucguaagc

SEQ ID NO: 36155 - RNA, 20 nt, Artificial Sequence
  MKO10036155_A_Olfr1274-ps
  gRNA
gauguuccugcuuacgauga

SEQ ID NO: 36156 - RNA, 20 nt, Artificial Sequence
  MKO10036156_A_Olfr1274-ps
  gRNA
caccagcaucaugaaccgac

SEQ ID NO: 36157 - RNA, 20 nt, Artificial Sequence
  MKO10036157_A_Olfr1275
  gRNA
gauguuuguccuccaucuac

SEQ ID NO: 36158 - RNA, 20 nt, Artificial Sequence
  MKO10036158_A_Olfr1275
  gRNA
ucuuccucgauucaucaaaa

SEQ ID NO: 36159 - RNA, 20 nt, Artificial Sequence
  MKO10036159_A_Olfr1275
  gRNA
ugugccaguggauaaguucc

SEQ ID NO: 36160 - RNA, 20 nt, Artificial Sequence
  MKO10036160_A_Olfr1276
  gRNA
cauucuguaguugucuaugc

SEQ ID NO: 36161 - RNA, 20 nt, Artificial Sequence
  MKO10036161_A_Olfr1276
  gRNA
ggcucaugaugguuaaauag

SEQ ID NO: 36162 - RNA, 20 nt, Artificial Sequence
  MKO10036162_A_Olfr1276
  gRNA
augugccuauugcuucuauc

SEQ ID NO: 36163 - RNA, 20 nt, Artificial Sequence
  MKO10036163_A_Olfr1277
  gRNA
ugugcauucaauaagccaac

SEQ ID NO: 36164 - RNA, 20 nt, Artificial Sequence
  MKO10036164_A_Olfr1277
  gRNA
gugauggcgucauggaugau

SEQ ID NO: 36165 - RNA, 20 nt, Artificial Sequence
  MKO10036165_A_Olfr1277
  gRNA
gacagaagucaaugaacgag

SEQ ID NO: 36166 - RNA, 20 nt, Artificial Sequence
  MKO10036166_A_Olfr1278
  gRNA
ugugagcagaaagcguagag

SEQ ID NO: 36167 - RNA, 20 nt, Artificial Sequence
  MKO10036167_A_Olfr1278
  gRNA
aauuuauccacuggcaccgu

SEQ ID NO: 36168 - RNA, 20 nt, Artificial Sequence
  MKO10036168_A_Olfr1278
  gRNA
acuuuauguggccaucgugc

SEQ ID NO: 36169 - RNA, 20 nt, Artificial Sequence
  MKO10036169_A_Olfr1279
  gRNA
accugucuuugaacgaugug

SEQ ID NO: 36170 - RNA, 20 nt, Artificial Sequence
  MKO10036170_A_Olfr1279
  gRNA
auacaacuggcgugcacuga

SEQ ID NO: 36171 - RNA, 20 nt, Artificial Sequence
  MKO10036171_A_Olfr1279
  gRNA
cacgccaguuguaugauccg

SEQ ID NO: 36172 - RNA, 20 nt, Artificial Sequence
  MKO10036172_A_Olfr127
  gRNA
aguucccugcugaauccaau

SEQ ID NO: 36173 - RNA, 20 nt, Artificial Sequence
  MKO10036173_A_Olfr127
  gRNA
gagagaugagaaguccauaa

SEQ ID NO: 36174 - RNA, 20 nt, Artificial Sequence
  MKO10036174_A_Olfr127
  gRNA
cuguuugucuauuguuguga

SEQ ID NO: 36175 - RNA, 20 nt, Artificial Sequence
  MKO10036175_A_Olfr1280
  gRNA
auguacuucucauauuauag

SEQ ID NO: 36176 - RNA, 20 nt, Artificial Sequence
  MKO10036176_A_Olfr1280
  gRNA
cacccucuacaugaugacug

SEQ ID NO: 36177 - RNA, 20 nt, Artificial Sequence
  MKO10036177_A_Olfr1280
  gRNA
auccagcaaucuauacacug

SEQ ID NO: 36178 - RNA, 20 nt, Artificial Sequence
  MKO10036178_A_Olfr1281
  gRNA
uccacccaagugauguuuac

SEQ ID NO: 36179 - RNA, 20 nt, Artificial Sequence
  MKO10036179_A_Olfr1281
  gRNA
caaaugauagauuagcuaac

SEQ ID NO: 36180 - RNA, 20 nt, Artificial Sequence
  MKO10036180_A_Olfr1281
  gRNA
cuaccaaagucaccagauag

SEQ ID NO: 36181 - RNA, 20 nt, Artificial Sequence
  MKO10036181_A_Olfr1282
  gRNA
cugccucauauacccuacaa

SEQ ID NO: 36182 - RNA, 20 nt, Artificial Sequence
  MKO10036182_A_Olfr1282
  gRNA
gugacuuaugaguuucuuua

SEQ ID NO: 36183 - RNA, 20 nt, Artificial Sequence
  MKO10036183_A_Olfr1282
  gRNA
aaguauaagauauaagcaag

SEQ ID NO: 36184 - RNA, 20 nt, Artificial Sequence
  MKO10036184_A_Olfr1283
  gRNA
ucuggcucguugugaucucg

SEQ ID NO: 36185 - RNA, 20 nt, Artificial Sequence
  MKO10036185_A_Olfr1283
  gRNA
ugccaugagucaacuuauuc

SEQ ID NO: 36186 - RNA, 20 nt, Artificial Sequence
  MKO10036186_A_Olfr1283
  gRNA
aaccagaauaaguugacuca

SEQ ID NO: 36187 - RNA, 20 nt, Artificial Sequence
  MKO10036187_A_Olfr1284
  gRNA
cguguaccugucaaacgcca

SEQ ID NO: 36188 - RNA, 20 nt, Artificial Sequence
  MKO10036188_A_Olfr1284
  gRNA
gcucuauguaagcaucaucg

SEQ ID NO: 36189 - RNA, 20 nt, Artificial Sequence
  MKO10036189_A_Olfr1284
  gRNA
caugccaguuguaugauucg

SEQ ID NO: 36190 - RNA, 20 nt, Artificial Sequence
  MKO10036190_A_Olfr1286
  gRNA
ggaagacucuaaucauacug

SEQ ID NO: 36191 - RNA, 20 nt, Artificial Sequence
  MKO10036191_A_Olfr1286
  gRNA
ucugguuccuugugauucca

SEQ ID NO: 36192 - RNA, 20 nt, Artificial Sequence
  MKO10036192_A_Olfr1286
  gRNA
agaagugcacacagacgauc

SEQ ID NO: 36193 - RNA, 20 nt, Artificial Sequence
  MKO10036193_A_Olfr1287
  gRNA
uaguauaagauaucaguaag

SEQ ID NO: 36194 - RNA, 20 nt, Artificial Sequence
  MKO10036194_A_Olfr1287
  gRNA
auccucuguguguacuucuu

SEQ ID NO: 36195 - RNA, 20 nt, Artificial Sequence
  MKO10036195_A_Olfr1287
  gRNA
uaaacucagagaccacaguc

SEQ ID NO: 36196 - RNA, 20 nt, Artificial Sequence
  MKO10036196_A_Olfr1288
  gRNA
ugaagaauguugucguacac

SEQ ID NO: 36197 - RNA, 20 nt, Artificial Sequence
  MKO10036197_A_Olfr1288
  gRNA
ggcccaagucaaugagcgaa

SEQ ID NO: 36198 - RNA, 20 nt, Artificial Sequence
  MKO10036198_A_Olfr1288
  gRNA
caaccuuucgcucauugacu

SEQ ID NO: 36199 - RNA, 20 nt, Artificial Sequence
  MKO10036199_A_Olfr1289
  gRNA
gaaggguaagcuuauagcaa

SEQ ID NO: 36200 - RNA, 20 nt, Artificial Sequence
  MKO10036200_A_Olfr1289
  gRNA
ggucauuagaauaauaccau

SEQ ID NO: 36201 - RNA, 20 nt, Artificial Sequence
  MKO10036201_A_Olfr1289
  gRNA
gaucugaaguucccgagaau

SEQ ID NO: 36202 - RNA, 20 nt, Artificial Sequence
  MKO10036202_A_Olfr128
  gRNA
agcaugaagucuaaaguagu

SEQ ID NO: 36203 - RNA, 20 nt, Artificial Sequence
  MKO10036203_A_Olfr128
  gRNA
cauaagacaucacuguaaga

SEQ ID NO: 36204 - RNA, 20 nt, Artificial Sequence
  MKO10036204_A_Olfr128
  gRNA
gaaggcaauccccauaaagc

SEQ ID NO: 36205 - RNA, 20 nt, Artificial Sequence
  MKO10036205_A_Olfr1290
  gRNA
agaucagcaccaccguaaug

SEQ ID NO: 36206 - RNA, 20 nt, Artificial Sequence
  MKO10036206_A_Olfr1290
  gRNA
ggaugaaggcaaucacacua

SEQ ID NO: 36207 - RNA, 20 nt, Artificial Sequence
  MKO10036207_A_Olfr1290
  gRNA
aguaacuaccuuagucacaa

SEQ ID NO: 36208 - RNA, 20 nt, Artificial Sequence
  MKO10036208_A_Olfr1294
  gRNA
agauuagcacgacuguaaug

SEQ ID NO: 36209 - RNA, 20 nt, Artificial Sequence
  MKO10036209_A_Olfr1294
  gRNA
ccaaacugcugcaucucuua

SEQ ID NO: 36210 - RNA, 20 nt, Artificial Sequence
  MKO10036210_A_Olfr1294
  gRNA
ccuuaagagaugcagcaguu

SEQ ID NO: 36211 - RNA, 20 nt, Artificial Sequence
  MKO10036211_A_Olfr1295
  gRNA
auauaauggauggaggcaac

SEQ ID NO: 36212 - RNA, 20 nt, Artificial Sequence
  MKO10036212_A_Olfr1295
  gRNA
guuagcaagagcucuaaagc

SEQ ID NO: 36213 - RNA, 20 nt, Artificial Sequence
  MKO10036213_A_Olfr1295
  gRNA
uauacaugguauaaguuacu

SEQ ID NO: 36214 - RNA, 20 nt, Artificial Sequence
  MKO10036214_A_Olfr1297
  gRNA
guucaucagaauucgaaaac

SEQ ID NO: 36215 - RNA, 20 nt, Artificial Sequence
  MKO10036215_A_Olfr1297
  gRNA
uuuacaugguauaagucacg

SEQ ID NO: 36216 - RNA, 20 nt, Artificial Sequence
  MKO10036216_A_Olfr1297
  gRNA
ggucaguuguuauuaagauu

SEQ ID NO: 36217 - RNA, 20 nt, Artificial Sequence
  MKO10036217_A_Olfr1298
  gRNA
guucgccagacuucaaaaaa

SEQ ID NO: 36218 - RNA, 20 nt, Artificial Sequence
  MKO10036218_A_Olfr1298
  gRNA
uuuauauuaggaauuuccuu

SEQ ID NO: 36219 - RNA, 20 nt, Artificial Sequence
  MKO10036219_A_Olfr1298
  gRNA
aaaaaguaacagcauaaagc

SEQ ID NO: 36220 - RNA, 20 nt, Artificial Sequence
  MKO10036220_A_Olfr1299
  gRNA
cugcacagauucccaugauu

SEQ ID NO: 36221 - RNA, 20 nt, Artificial Sequence
  MKO10036221_A_Olfr1299
  gRNA
caggcuaguuugauuacuag

SEQ ID NO: 36222 - RNA, 20 nt, Artificial Sequence
  MKO10036222_A_Olfr1299
  gRNA
cucaguuaccacaccaaaaa

SEQ ID NO: 36223 - RNA, 20 nt, Artificial Sequence
  MKO10036223_A_Olfr129
  gRNA
uauacaacccgaaugaaucg

SEQ ID NO: 36224 - RNA, 20 nt, Artificial Sequence
  MKO10036224_A_Olfr129
  gRNA
aacagguugcauuguagggu

SEQ ID NO: 36225 - RNA, 20 nt, Artificial Sequence
  MKO10036225_A_Olfr129
  gRNA
gaugaacagaaacccgggag

SEQ ID NO: 36226 - RNA, 20 nt, Artificial Sequence
  MKO10036226_A_Olfr12
  gRNA
ccaccagcacaaacacucgc

SEQ ID NO: 36227 - RNA, 20 nt, Artificial Sequence
  MKO10036227_A_Olfr12
  gRNA
gucccugcgaguguuugugc

SEQ ID NO: 36228 - RNA, 20 nt, Artificial Sequence
  MKO10036228_A_Olfr12
  gRNA
aaaacaaagacaccgcuguc

SEQ ID NO: 36229 - RNA, 20 nt, Artificial Sequence
  MKO10036229_A_Olfr1301
  gRNA
ggauggaaguaaucgcuccc

SEQ ID NO: 36230 - RNA, 20 nt, Artificial Sequence
  MKO10036230_A_Olfr1301
  gRNA
auuuauaugaaugucgacug

SEQ ID NO: 36231 - RNA, 20 nt, Artificial Sequence
  MKO10036231_A_Olfr1301
  gRNA
augcacaaaggcaauugccc

SEQ ID NO: 36232 - RNA, 20 nt, Artificial Sequence
  MKO10036232_A_Olfr1302
  gRNA
gcaguuccacaaucacuacc

SEQ ID NO: 36233 - RNA, 20 nt, Artificial Sequence
  MKO10036233_A_Olfr1302
  gRNA
cuggauauuaggacuucccu

SEQ ID NO: 36234 - RNA, 20 nt, Artificial Sequence
  MKO10036234_A_Olfr1302
  gRNA
caaauuaugagaauccauac

SEQ ID NO: 36235 - RNA, 20 nt, Artificial Sequence
  MKO10036235_A_Olfr1303
  gRNA
ucuccacuccaccaacuaaa

SEQ ID NO: 36236 - RNA, 20 nt, Artificial Sequence
  MKO10036236_A_Olfr1303
  gRNA
cuacucuguuuauauauacg

SEQ ID NO: 36237 - RNA, 20 nt, Artificial Sequence
  MKO10036237_A_Olfr1303
  gRNA
aaaacauuauuaaccuuuag

SEQ ID NO: 36238 - RNA, 20 nt, Artificial Sequence
  MKO10036238_A_Olfr1305
  gRNA
aagcagcaacuaauauuagc

SEQ ID NO: 36239 - RNA, 20 nt, Artificial Sequence
  MKO10036239_A_Olfr1305
  gRNA
augauggucagauagcguaa

SEQ ID NO: 36240 - RNA, 20 nt, Artificial Sequence
  MKO10036240_A_Olfr1305
  gRNA
uucuauguauccaguuugac

SEQ ID NO: 36241 - RNA, 20 nt, Artificial Sequence
  MKO10036241_A_Olfr1306
  gRNA
aacuuaucaagauguguuga

SEQ ID NO: 36242 - RNA, 20 nt, Artificial Sequence
  MKO10036242_A_Olfr1306
  gRNA
cugcauaaauacuuaccagc

SEQ ID NO: 36243 - RNA, 20 nt, Artificial Sequence
  MKO10036243_A_Olfr1306
  gRNA
caugcuugccacauaaaacg

SEQ ID NO: 36244 - RNA, 20 nt, Artificial Sequence
  MKO10036244_A_Olfr1307
  gRNA
aacuuaucaaggugugucga

SEQ ID NO: 36245 - RNA, 20 nt, Artificial Sequence
  MKO10036245_A_Olfr1307
  gRNA
cugcauagacacuaaccagc

SEQ ID NO: 36246 - RNA, 20 nt, Artificial Sequence
  MKO10036246_A_Olfr1307
  gRNA
uaauugaauacuccaagagu

SEQ ID NO: 36247 - RNA, 20 nt, Artificial Sequence
  MKO10036247_A_Olfr1308
  gRNA
gugacgauugcaucaaauau

SEQ ID NO: 36248 - RNA, 20 nt, Artificial Sequence
  MKO10036248_A_Olfr1308
  gRNA
agucaacaguggauucaugu

SEQ ID NO: 36249 - RNA, 20 nt, Artificial Sequence
  MKO10036249_A_Olfr1308
  gRNA
gagaguacuuagacagauaa

SEQ ID NO: 36250 - RNA, 20 nt, Artificial Sequence
  MKO10036250_A_Olfr1309
  gRNA
cccauauauuagugaucccg

SEQ ID NO: 36251 - RNA, 20 nt, Artificial Sequence
  MKO10036251_A_Olfr1309
  gRNA
acgaaugaugauucugaugu

SEQ ID NO: 36252 - RNA, 20 nt, Artificial Sequence
  MKO10036252_A_Olfr1309
  gRNA
caagucugaggagucggggc

SEQ ID NO: 36253 - RNA, 20 nt, Artificial Sequence
  MKO10036253_A_Olfr130
  gRNA
uaccagcaugugcgacccac

SEQ ID NO: 36254 - RNA, 20 nt, Artificial Sequence
  MKO10036254_A_Olfr130
  gRNA
aaccugugggucgcacaugc

SEQ ID NO: 36255 - RNA, 20 nt, Artificial Sequence
  MKO10036255_A_Olfr130
  gRNA
caugaauagcugcacuucau

SEQ ID NO: 36256 - RNA, 20 nt, Artificial Sequence
  MKO10036256_A_Olfr1310
  gRNA
ucucggugccaccuacugca

SEQ ID NO: 36257 - RNA, 20 nt, Artificial Sequence
  MKO10036257_A_Olfr1310
  gRNA
uccccuauguacuuccuauu

SEQ ID NO: 36258 - RNA, 20 nt, Artificial Sequence
  MKO10036258_A_Olfr1310
  gRNA
acuugccacguagaauauac

SEQ ID NO: 36259 - RNA, 20 nt, Artificial Sequence
  MKO10036259_A_Olfr1311
  gRNA
gaccaugaacaccaauuuac

SEQ ID NO: 36260 - RNA, 20 nt, Artificial Sequence
  MKO10036260_A_Olfr1311
  gRNA
ccacugagugaauaagucca

SEQ ID NO: 36261 - RNA, 20 nt, Artificial Sequence
  MKO10036261_A_Olfr1311
  gRNA
guucuacauagcgaguguga

SEQ ID NO: 36262 - RNA, 20 nt, Artificial Sequence
  MKO10036262_A_Olfr1312
  gRNA
uuacuggucucaaucaauag

SEQ ID NO: 36263 - RNA, 20 nt, Artificial Sequence
  MKO10036263_A_Olfr1312
  gRNA
uaguugaauauuccaagaau

SEQ ID NO: 36264 - RNA, 20 nt, Artificial Sequence
  MKO10036264_A_Olfr1312
  gRNA
gagaguauucaguaagcuaa

SEQ ID NO: 36265 - RNA, 20 nt, Artificial Sequence
  MKO10036265_A_Olfr1313
  gRNA
aaguguagacagcgcuuugu

SEQ ID NO: 36266 - RNA, 20 nt, Artificial Sequence
  MKO10036266_A_Olfr1313
  gRNA
uaugcacucugugauacaac

SEQ ID NO: 36267 - RNA, 20 nt, Artificial Sequence
  MKO10036267_A_Olfr1313
  gRNA
gugcauaagaccaacuaccc

SEQ ID NO: 36268 - RNA, 20 nt, Artificial Sequence
  MKO10036268_A_Olfr1314
  gRNA
cacacaccuggauaaguacc

SEQ ID NO: 36269 - RNA, 20 nt, Artificial Sequence
  MKO10036269_A_Olfr1314
  gRNA
cugaaaccauuaauucuaau

SEQ ID NO: 36270 - RNA, 20 nt, Artificial Sequence
  MKO10036270_A_Olfr1314
  gRNA
agauaugacuaguaugaaga

SEQ ID NO: 36271 - RNA, 20 nt, Artificial Sequence
  MKO10036271_A_Olfr1316
  gRNA
ggugaugacugcaucaaaua

SEQ ID NO: 36272 - RNA, 20 nt, Artificial Sequence
  MKO10036272_A_Olfr1316
  gRNA
gaacagaucauaaaucaucu

SEQ ID NO: 36273 - RNA, 20 nt, Artificial Sequence
  MKO10036273_A_Olfr1316
  gRNA
uacugacauacaugcuaaug

SEQ ID NO: 36274 - RNA, 20 nt, Artificial Sequence
  MKO10036274_A_Olfr1317
  gRNA
aguguuuacgaacugugacc

SEQ ID NO: 36275 - RNA, 20 nt, Artificial Sequence
  MKO10036275_A_Olfr1317
  gRNA
auucauagaaggagugauaa

SEQ ID NO: 36276 - RNA, 20 nt, Artificial Sequence
  MKO10036276_A_Olfr1317
  gRNA
caaugaggagacucuuugcu

SEQ ID NO: 36277 - RNA, 20 nt, Artificial Sequence
  MKO10036277_A_Olfr1318
  gRNA
cgaugaggagacuauuuauu

SEQ ID NO: 36278 - RNA, 20 nt, Artificial Sequence
  MKO10036278_A_Olfr1318
  gRNA
ggauggaggaaaucacucaa

SEQ ID NO: 36279 - RNA, 20 nt, Artificial Sequence
  MKO10036279_A_Olfr1318
  gRNA
ugcuaggccucaccaauuca

SEQ ID NO: 36280 - RNA, 20 nt, Artificial Sequence
  MKO10036280_A_Olfr131
  gRNA
aguuaucauguguugacacc

SEQ ID NO: 36281 - RNA, 20 nt, Artificial Sequence
  MKO10036281_A_Olfr131
  gRNA
agaagagccauuuccagucg

SEQ ID NO: 36282 - RNA, 20 nt, Artificial Sequence
  MKO10036282_A_Olfr131
  gRNA
gccuaccagaauaaagccau

SEQ ID NO: 36283 - RNA, 20 nt, Artificial Sequence
  MKO10036283_A_Olfr1320
  gRNA
gucuaugcuguaccauuagc

SEQ ID NO: 36284 - RNA, 20 nt, Artificial Sequence
  MKO10036284_A_Olfr1320
  gRNA
caauauuguaccccgaaugc

SEQ ID NO: 36285 - RNA, 20 nt, Artificial Sequence
  MKO10036285_A_Olfr1320
  gRNA
gacuaacuuuagucucuuac

SEQ ID NO: 36286 - RNA, 20 nt, Artificial Sequence
  MKO10036286_A_Olfr1321
  gRNA
augagagauggguaccgaag

SEQ ID NO: 36287 - RNA, 20 nt, Artificial Sequence
  MKO10036287_A_Olfr1321
  gRNA
gagcccaaaucucauagaua

SEQ ID NO: 36288 - RNA, 20 nt, Artificial Sequence
  MKO10036288_A_Olfr1321
  gRNA
gucauugugacaguaacaac

SEQ ID NO: 36289 - RNA, 20 nt, Artificial Sequence
  MKO10036289_A_Olfr1322
  gRNA
uguaccucauuauucgcucu

SEQ ID NO: 36290 - RNA, 20 nt, Artificial Sequence
  MKO10036290_A_Olfr1322
  gRNA
agcuacuugaguauuagugc

SEQ ID NO: 36291 - RNA, 20 nt, Artificial Sequence
  MKO10036291_A_Olfr1322
  gRNA
acuacacuauuccaguauca

SEQ ID NO: 36292 - RNA, 20 nt, Artificial Sequence
  MKO10036292_A_Olfr1323
  gRNA
acacguauuugcaacccucu

SEQ ID NO: 36293 - RNA, 20 nt, Artificial Sequence
  MKO10036293_A_Olfr1323
  gRNA
gaauuaguaccacaagcccu

SEQ ID NO: 36294 - RNA, 20 nt, Artificial Sequence
  MKO10036294_A_Olfr1323
  gRNA
ucaauggagaauucaucuac

SEQ ID NO: 36295 - RNA, 20 nt, Artificial Sequence
  MKO10036295_A_Olfr1324
  gRNA
aaccaacagggcacagcgcu

SEQ ID NO: 36296 - RNA, 20 nt, Artificial Sequence
  MKO10036296_A_Olfr1324
  gRNA
acuagauuagagauaaccca

SEQ ID NO: 36297 - RNA, 20 nt, Artificial Sequence
  MKO10036297_A_Olfr1324
  gRNA
agcagugccaauaagugcau

SEQ ID NO: 36298 - RNA, 20 nt, Artificial Sequence
  MKO10036298_A_Olfr1325
  gRNA
caguguuguacccuugauca

SEQ ID NO: 36299 - RNA, 20 nt, Artificial Sequence
  MKO10036299_A_Olfr1325
  gRNA
auaaccagauuauaccugag

SEQ ID NO: 36300 - RNA, 20 nt, Artificial Sequence
  MKO10036300_A_Olfr1325
  gRNA
auugagaguugccuccuacu

SEQ ID NO: 36301 - RNA, 20 nt, Artificial Sequence
  MKO10036301_A_Olfr1328
  gRNA
cagccacuuacaucuaccuu

SEQ ID NO: 36302 - RNA, 20 nt, Artificial Sequence
  MKO10036302_A_Olfr1328
  gRNA
guguacuuucuucguuguca

SEQ ID NO: 36303 - RNA, 20 nt, Artificial Sequence
  MKO10036303_A_Olfr1328
  gRNA
ucaaggugaugggacauagu

SEQ ID NO: 36304 - RNA, 20 nt, Artificial Sequence
  MKO10036304_A_Olfr1329
  gRNA
cugccagcuacaucuaccuu

SEQ ID NO: 36305 - RNA, 20 nt, Artificial Sequence
  MKO10036305_A_Olfr1329
  gRNA
cuccuacauucguauuguca

SEQ ID NO: 36306 - RNA, 20 nt, Artificial Sequence
  MKO10036306_A_Olfr1329
  gRNA
ggccugugcauacgguuggc

SEQ ID NO: 36307 - RNA, 20 nt, Artificial Sequence
  MKO10036307_A_Olfr132
  gRNA
accugaggguagcaguagau

SEQ ID NO: 36308 - RNA, 20 nt, Artificial Sequence
  MKO10036308_A_Olfr132
  gRNA
uccaaucuacugcuacccuc

SEQ ID NO: 36309 - RNA, 20 nt, Artificial Sequence
  MKO10036309_A_Olfr132
  gRNA
uauccuccuaguguuacccu

SEQ ID NO: 36310 - RNA, 20 nt, Artificial Sequence
  MKO10036310_A_Olfr1330
  gRNA
cucugcauacauuugacagc

SEQ ID NO: 36311 - RNA, 20 nt, Artificial Sequence
  MKO10036311_A_Olfr1330
  gRNA
cugcugucaaauguaugcag

SEQ ID NO: 36312 - RNA, 20 nt, Artificial Sequence
  MKO10036312_A_Olfr1330
  gRNA
gcuguugguuguggggucgc

SEQ ID NO: 36313 - RNA, 20 nt, Artificial Sequence
  MKO10036313_A_Olfr1331
  gRNA
gggccucaaguaaguguaag

SEQ ID NO: 36314 - RNA, 20 nt, Artificial Sequence
  MKO10036314_A_Olfr1331
  gRNA
uuucucaaggugauggguua

SEQ ID NO: 36315 - RNA, 20 nt, Artificial Sequence
  MKO10036315_A_Olfr1331
  gRNA
cagccacuuacacuuacuug

SEQ ID NO: 36316 - RNA, 20 nt, Artificial Sequence
  MKO10036316_A_Olfr1333
  gRNA
uuaaggugauggguuaugac

SEQ ID NO: 36317 - RNA, 20 nt, Artificial Sequence
  MKO10036317_A_Olfr1333
  gRNA
caccaaaaacaaacaucugc

SEQ ID NO: 36318 - RNA, 20 nt, Artificial Sequence
  MKO10036318_A_Olfr1333
  gRNA
gagaucugcuugucuugcuc

SEQ ID NO: 36319 - RNA, 20 nt, Artificial Sequence
  MKO10036319_A_Olfr1335
  gRNA
gguggacccguggaccacaa

SEQ ID NO: 36320 - RNA, 20 nt, Artificial Sequence
  MKO10036320_A_Olfr1335
  gRNA
uaucuaaggauucaccauug

SEQ ID NO: 36321 - RNA, 20 nt, Artificial Sequence
  MKO10036321_A_Olfr1335
  gRNA
cucauguagauguaaguagc

SEQ ID NO: 36322 - RNA, 20 nt, Artificial Sequence
  MKO10036322_A_Olfr1336
  gRNA
uccauggcuucuaugcggcu

SEQ ID NO: 36323 - RNA, 20 nt, Artificial Sequence
  MKO10036323_A_Olfr1336
  gRNA
agcccaauaggacaaacucc

SEQ ID NO: 36324 - RNA, 20 nt, Artificial Sequence
  MKO10036324_A_Olfr1336
  gRNA
cauuggggccacaauaggac

SEQ ID NO: 36325 - RNA, 20 nt, Artificial Sequence
  MKO10036325_A_Olfr1337
  gRNA
cuugaucuugagaaucgcca

SEQ ID NO: 36326 - RNA, 20 nt, Artificial Sequence
  MKO10036326_A_Olfr1337
  gRNA
ggcuugugcauacgguuggc

SEQ ID NO: 36327 - RNA, 20 nt, Artificial Sequence
  MKO10036327_A_Olfr1337
  gRNA
auccuguuggguccacaaua

SEQ ID NO: 36328 - RNA, 20 nt, Artificial Sequence
  MKO10036328_A_Olfr1338
  gRNA
gaaauaguggucaacccuuu

SEQ ID NO: 36329 - RNA, 20 nt, Artificial Sequence
  MKO10036329_A_Olfr1338
  gRNA
guugaccacuauuucuguga

SEQ ID NO: 36330 - RNA, 20 nt, Artificial Sequence
  MKO10036330_A_Olfr1338
  gRNA
uuccuacauucacauuacca

SEQ ID NO: 36331 - RNA, 20 nt, Artificial Sequence
  MKO10036331_A_Olfr1339
  gRNA
cauugcccacaagcguagag

SEQ ID NO: 36332 - RNA, 20 nt, Artificial Sequence
  MKO10036332_A_Olfr1339
  gRNA
ccucuaccucucuacgcuug

SEQ ID NO: 36333 - RNA, 20 nt, Artificial Sequence
  MKO10036333_A_Olfr1339
  gRNA
aaaaggccuucagucgaccu

SEQ ID NO: 36334 - RNA, 20 nt, Artificial Sequence
  MKO10036334_A_Olfr133
  gRNA
acacugcaauugccucuuug

SEQ ID NO: 36335 - RNA, 20 nt, Artificial Sequence
  MKO10036335_A_Olfr133
  gRNA
acucuguaccccccauugug

SEQ ID NO: 36336 - RNA, 20 nt, Artificial Sequence
  MKO10036336_A_Olfr133
  gRNA
ugcacaccucauguagcuga

SEQ ID NO: 36337 - RNA, 20 nt, Artificial Sequence
  MKO10036337_A_Olfr1340
  gRNA
gacgagcaucuauucuaauc

SEQ ID NO: 36338 - RNA, 20 nt, Artificial Sequence
  MKO10036338_A_Olfr1340
  gRNA
cucuacccaaggacggauga

SEQ ID NO: 36339 - RNA, 20 nt, Artificial Sequence
  MKO10036339_A_Olfr1340
  gRNA
ggcucaucuugacuccauag

SEQ ID NO: 36340 - RNA, 20 nt, Artificial Sequence
  MKO10036340_A_Olfr1341
  gRNA
uaccacagccuguuaccuug

SEQ ID NO: 36341 - RNA, 20 nt, Artificial Sequence
  MKO10036341_A_Olfr1341
  gRNA
gguguagccuaaguccaaca

SEQ ID NO: 36342 - RNA, 20 nt, Artificial Sequence
  MKO10036342_A_Olfr1341
  gRNA
cuugaagauccguucagcac

SEQ ID NO: 36343 - RNA, 20 nt, Artificial Sequence
  MKO10036343_A_Olfr1342
  gRNA
ugagcggauucuuaagaugg

SEQ ID NO: 36344 - RNA, 20 nt, Artificial Sequence
  MKO10036344_A_Olfr1342
  gRNA
cacauccuucaaugaccgcu

SEQ ID NO: 36345 - RNA, 20 nt, Artificial Sequence
  MKO10036345_A_Olfr1342
  gRNA
gccagcuucuugucccguuc

SEQ ID NO: 36346 - RNA, 20 nt, Artificial Sequence
  MKO10036346_A_Olfr1344
  gRNA
caaugcgcgucccccgcagc

SEQ ID NO: 36347 - RNA, 20 nt, Artificial Sequence
  MKO10036347_A_Olfr1344
  gRNA
ugugaguaccacgcuaccgc

SEQ ID NO: 36348 - RNA, 20 nt, Artificial Sequence
  MKO10036348_A_Olfr1344
  gRNA
accgcugcauuaugcgaccc

SEQ ID NO: 36349 - RNA, 20 nt, Artificial Sequence
  MKO10036349_A_Olfr1346
  gRNA
gggagguccaugcaguguug

SEQ ID NO: 36350 - RNA, 20 nt, Artificial Sequence
  MKO10036350_A_Olfr1346
  gRNA
gguugcucuggccucuuaug

SEQ ID NO: 36351 - RNA, 20 nt, Artificial Sequence
  MKO10036351_A_Olfr1346
  gRNA
gauggagagaucucuacaac

SEQ ID NO: 36352 - RNA, 20 nt, Artificial Sequence
  MKO10036352_A_Olfr1347
  gRNA
ucuuuaucgccgagaccaca

SEQ ID NO: 36353 - RNA, 20 nt, Artificial Sequence
  MKO10036353_A_Olfr1347
  gRNA
cauugggaccacaguagauc

SEQ ID NO: 36354 - RNA, 20 nt, Artificial Sequence
  MKO10036354_A_Olfr1347
  gRNA
cguccacagucccacgagua

SEQ ID NO: 36355 - RNA, 20 nt, Artificial Sequence
  MKO10036355_A_Olfr1348
  gRNA
cguccauagacccacaagua

SEQ ID NO: 36356 - RNA, 20 nt, Artificial Sequence
  MKO10036356_A_Olfr1348
  gRNA
ucuacagauggcuagauccu

SEQ ID NO: 36357 - RNA, 20 nt, Artificial Sequence
  MKO10036357_A_Olfr1348
  gRNA
auugccagucugucuuacug

SEQ ID NO: 36358 - RNA, 20 nt, Artificial Sequence
  MKO10036358_A_Olfr1349
  gRNA
cgaacuccagcucgcgugcu

SEQ ID NO: 36359 - RNA, 20 nt, Artificial Sequence
  MKO10036359_A_Olfr1349
  gRNA
agaucucuaccagcgccagu

SEQ ID NO: 36360 - RNA, 20 nt, Artificial Sequence
  MKO10036360_A_Olfr1349
  gRNA
ggucauccacuugcgcccca

SEQ ID NO: 36361 - RNA, 20 nt, Artificial Sequence
  MKO10036361_A_Olfr134
  gRNA
ccucagaugcuaaccaaccu

SEQ ID NO: 36362 - RNA, 20 nt, Artificial Sequence
  MKO10036362_A_Olfr134
  gRNA
cuuuguggaacuuccaaggu

SEQ ID NO: 36363 - RNA, 20 nt, Artificial Sequence
  MKO10036363_A_Olfr134
  gRNA
ccacaauaaacuggaucacu

SEQ ID NO: 36364 - RNA, 20 nt, Artificial Sequence
  MKO10036364_A_Olfr1350
  gRNA
cggccaugcgcccuugcagu

SEQ ID NO: 36365 - RNA, 20 nt, Artificial Sequence
  MKO10036365_A_Olfr1350
  gRNA
ucaugguuaccccauauguc

SEQ ID NO: 36366 - RNA, 20 nt, Artificial Sequence
  MKO10036366_A_Olfr1350
  gRNA
ccacucaugcaucuagcuug

SEQ ID NO: 36367 - RNA, 20 nt, Artificial Sequence
  MKO10036367_A_Olfr1351
  gRNA
ugacagccguaaugccaaaa

SEQ ID NO: 36368 - RNA, 20 nt, Artificial Sequence
  MKO10036368_A_Olfr1351
  gRNA
cuaugcaaacugcaucaccc

SEQ ID NO: 36369 - RNA, 20 nt, Artificial Sequence
  MKO10036369_A_Olfr1351
  gRNA
ugcugugacucaaaaugcac

SEQ ID NO: 36370 - RNA, 20 nt, Artificial Sequence
  MKO10036370_A_Olfr1352
  gRNA
ugccauccacugcauuauac

SEQ ID NO: 36371 - RNA, 20 nt, Artificial Sequence
  MKO10036371_A_Olfr1352
  gRNA
ucguauggaggauacuaucu

SEQ ID NO: 36372 - RNA, 20 nt, Artificial Sequence
  MKO10036372_A_Olfr1352
  gRNA
aacuugcagccuguuauaug

SEQ ID NO: 36373 - RNA, 20 nt, Artificial Sequence
  MKO10036373_A_Olfr1353
  gRNA
cccuaaaaagacucuucgug

SEQ ID NO: 36374 - RNA, 20 nt, Artificial Sequence
  MKO10036374_A_Olfr1353
  gRNA
gugaguugaaucaccugauu

SEQ ID NO: 36375 - RNA, 20 nt, Artificial Sequence
  MKO10036375_A_Olfr1353
  gRNA
cgugcaauguccucaguuca

SEQ ID NO: 36376 - RNA, 20 nt, Artificial Sequence
  MKO10036376_A_Olfr1354
  gRNA
acaaugacuguguaauauaa

SEQ ID NO: 36377 - RNA, 20 nt, Artificial Sequence
  MKO10036377_A_Olfr1354
  gRNA
ccaacagcucuguauacuga

SEQ ID NO: 36378 - RNA, 20 nt, Artificial Sequence
  MKO10036378_A_Olfr1354
  gRNA
ccaucaguauacagagcugu

SEQ ID NO: 36379 - RNA, 20 nt, Artificial Sequence
  MKO10036379_A_Olfr1355
  gRNA
ccaacaacucuguaugcuga

SEQ ID NO: 36380 - RNA, 20 nt, Artificial Sequence
  MKO10036380_A_Olfr1355
  gRNA
gaaauggcucccaauagaac

SEQ ID NO: 36381 - RNA, 20 nt, Artificial Sequence
  MKO10036381_A_Olfr1355
  gRNA
ccaucagcauacagaguugu

SEQ ID NO: 36382 - RNA, 20 nt, Artificial Sequence
  MKO10036382_A_Olfr1356
  gRNA
cugauaggaguaaauugucc

SEQ ID NO: 36383 - RNA, 20 nt, Artificial Sequence
  MKO10036383_A_Olfr1356
  gRNA
uucuugcuucugugcgaugc

SEQ ID NO: 36384 - RNA, 20 nt, Artificial Sequence
  MKO10036384_A_Olfr1356
  gRNA
uuguacuugcccccagcuga

SEQ ID NO: 36385 - RNA, 20 nt, Artificial Sequence
  MKO10036385_A_Olfr1357
  gRNA
agcugucuauagucccaaag

SEQ ID NO: 36386 - RNA, 20 nt, Artificial Sequence
  MKO10036386_A_Olfr1357
  gRNA
accaguagugcgcagacaug

SEQ ID NO: 36387 - RNA, 20 nt, Artificial Sequence
  MKO10036387_A_Olfr1357
  gRNA
cccacaugucugcgcacuac

SEQ ID NO: 36388 - RNA, 20 nt, Artificial Sequence
  MKO10036388_A_Olfr1359
  gRNA
gcccagcagaaagcauucug

SEQ ID NO: 36389 - RNA, 20 nt, Artificial Sequence
  MKO10036389_A_Olfr1359
  gRNA
acuagaaacaccacaaagag

SEQ ID NO: 36390 - RNA, 20 nt, Artificial Sequence
  MKO10036390_A_Olfr1359
  gRNA
uuccacagaaugcuuucugc

SEQ ID NO: 36391 - RNA, 20 nt, Artificial Sequence
  MKO10036391_A_Olfr135
  gRNA
ugaagauacauacuaauacc

SEQ ID NO: 36392 - RNA, 20 nt, Artificial Sequence
  MKO10036392_A_Olfr135
  gRNA
aguuacgccgauucauuaug

SEQ ID NO: 36393 - RNA, 20 nt, Artificial Sequence
  MKO10036393_A_Olfr135
  gRNA
uacacaccucaaguagcuga

SEQ ID NO: 36394 - RNA, 20 nt, Artificial Sequence
  MKO10036394_A_Olfr1360
  gRNA
auucugugcaacccaaagcc

SEQ ID NO: 36395 - RNA, 20 nt, Artificial Sequence
  MKO10036395_A_Olfr1360
  gRNA
acuagaaauaccacaaagag

SEQ ID NO: 36396 - RNA, 20 nt, Artificial Sequence
  MKO10036396_A_Olfr1360
  gRNA
uugcacagaaugcuuucugc

SEQ ID NO: 36397 - RNA, 20 nt, Artificial Sequence
  MKO10036397_A_Olfr1361
  gRNA
acguugauguugccccgcug

SEQ ID NO: 36398 - RNA, 20 nt, Artificial Sequence
  MKO10036398_A_Olfr1361
  gRNA
guuaacacuaggagugacaa

SEQ ID NO: 36399 - RNA, 20 nt, Artificial Sequence
  MKO10036399_A_Olfr1361
  gRNA
acuugauccuaaacacugcu

SEQ ID NO: 36400 - RNA, 20 nt, Artificial Sequence
  MKO10036400_A_Olfr1362
  gRNA
aauucuccggcggccacauc

SEQ ID NO: 36401 - RNA, 20 nt, Artificial Sequence
  MKO10036401_A_Olfr1362
  gRNA
acucuacacugccaaucgac

SEQ ID NO: 36402 - RNA, 20 nt, Artificial Sequence
  MKO10036402_A_Olfr1362
  gRNA
auuggcgaguccaacccccc

SEQ ID NO: 36403 - RNA, 20 nt, Artificial Sequence
  MKO10036403_A_Olfr1364
  gRNA
gaugauauucccguaaaaca

SEQ ID NO: 36404 - RNA, 20 nt, Artificial Sequence
  MKO10036404_A_Olfr1364
  gRNA
accaugaagcugccucgaug

SEQ ID NO: 36405 - RNA, 20 nt, Artificial Sequence
  MKO10036405_A_Olfr1364
  gRNA
gcauaaugaccgaguaguga

SEQ ID NO: 36406 - RNA, 20 nt, Artificial Sequence
  MKO10036406_A_Olfr1366
  gRNA
ucucuugcauacccucauga

SEQ ID NO: 36407 - RNA, 20 nt, Artificial Sequence
  MKO10036407_A_Olfr1366
  gRNA
uguggugggccugauauuug

SEQ ID NO: 36408 - RNA, 20 nt, Artificial Sequence
  MKO10036408_A_Olfr1366
  gRNA
aucaugaggguaugcaagag

SEQ ID NO: 36409 - RNA, 20 nt, Artificial Sequence
  MKO10036409_A_Olfr1367
  gRNA
uugagccucccugccgcaga

SEQ ID NO: 36410 - RNA, 20 nt, Artificial Sequence
  MKO10036410_A_Olfr1367
  gRNA
cacuugcucaucgcaccugc

SEQ ID NO: 36411 - RNA, 20 nt, Artificial Sequence
  MKO10036411_A_Olfr1367
  gRNA
cuccuacauguucacauugc

SEQ ID NO: 36412 - RNA, 20 nt, Artificial Sequence
  MKO10036412_A_Olfr1368
  gRNA
cacaacgaucucaaucacuc

SEQ ID NO: 36413 - RNA, 20 nt, Artificial Sequence
  MKO10036413_A_Olfr1368
  gRNA
acugccgagaccacccaacc

SEQ ID NO: 36414 - RNA, 20 nt, Artificial Sequence
  MKO10036414_A_Olfr1368
  gRNA
caaugcuaguaguauaacag

SEQ ID NO: 36415 - RNA, 20 nt, Artificial Sequence
  MKO10036415_A_Olfr136
  gRNA
aguuuauguaugccacacaa

SEQ ID NO: 36416 - RNA, 20 nt, Artificial Sequence
  MKO10036416_A_Olfr136
  gRNA
agccuucuucauccauuaca

SEQ ID NO: 36417 - RNA, 20 nt, Artificial Sequence
  MKO10036417_A_Olfr136
  gRNA
ugaagguacaugcuaauggc

SEQ ID NO: 36418 - RNA, 20 nt, Artificial Sequence
  MKO10036418_A_Olfr1370
  gRNA
uugccauaugcaagccccua

SEQ ID NO: 36419 - RNA, 20 nt, Artificial Sequence
  MKO10036419_A_Olfr1370
  gRNA
uacaucgggcuguccaguug

SEQ ID NO: 36420 - RNA, 20 nt, Artificial Sequence
  MKO10036420_A_Olfr1370
  gRNA
uuauuguagcaacugugcuu

SEQ ID NO: 36421 - RNA, 20 nt, Artificial Sequence
  MKO10036421_A_Olfr1371
  gRNA
gauaccugagccauaaaaca

SEQ ID NO: 36422 - RNA, 20 nt, Artificial Sequence
  MKO10036422_A_Olfr1371
  gRNA
uuugaacaccaguucagaag

SEQ ID NO: 36423 - RNA, 20 nt, Artificial Sequence
  MKO10036423_A_Olfr1371
  gRNA
uuccucagcguauagaucag

SEQ ID NO: 36424 - RNA, 20 nt, Artificial Sequence
  MKO10036424_A_Olfr1373
  gRNA
aaugaagcccuccucugaac

SEQ ID NO: 36425 - RNA, 20 nt, Artificial Sequence
  MKO10036425_A_Olfr1373
  gRNA
agugcugaacaucaggucag

SEQ ID NO: 36426 - RNA, 20 nt, Artificial Sequence
  MKO10036426_A_Olfr1373
  gRNA
gggaacugagugugugcuuu

SEQ ID NO: 36427 - RNA, 20 nt, Artificial Sequence
  MKO10036427_A_Olfr1377
  gRNA
caaugcaugaaaacgguguc

SEQ ID NO: 36428 - RNA, 20 nt, Artificial Sequence
  MKO10036428_A_Olfr1377
  gRNA
cugaagauaccaucugcccg

SEQ ID NO: 36429 - RNA, 20 nt, Artificial Sequence
  MKO10036429_A_Olfr1377
  gRNA
acagggcuuuccuuaucccg

SEQ ID NO: 36430 - RNA, 20 nt, Artificial Sequence
  MKO10036430_A_Olfr1378
  gRNA
auguacuuggucaccguuug

SEQ ID NO: 36431 - RNA, 20 nt, Artificial Sequence
  MKO10036431_A_Olfr1378
  gRNA
ggaauucuauggcuguugac

SEQ ID NO: 36432 - RNA, 20 nt, Artificial Sequence
  MKO10036432_A_Olfr1378
  gRNA
gcaugugaacggugugauag

SEQ ID NO: 36433 - RNA, 20 nt, Artificial Sequence
  MKO10036433_A_Olfr137
  gRNA
agaaguggucuacuuugcga

SEQ ID NO: 36434 - RNA, 20 nt, Artificial Sequence
  MKO10036434_A_Olfr137
  gRNA
agugguaaagccacauaccc

SEQ ID NO: 36435 - RNA, 20 nt, Artificial Sequence
  MKO10036435_A_Olfr137
  gRNA
gaaaacuuucugaagucgag

SEQ ID NO: 36436 - RNA, 20 nt, Artificial Sequence
  MKO10036436_A_Olfr1380
  gRNA
ggcggagguccaguugagac

SEQ ID NO: 36437 - RNA, 20 nt, Artificial Sequence
  MKO10036437_A_Olfr1380
  gRNA
gauccagacaagcuuuguga

SEQ ID NO: 36438 - RNA, 20 nt, Artificial Sequence
  MKO10036438_A_Olfr1380
  gRNA
uggccaucacaaagcuuguc

SEQ ID NO: 36439 - RNA, 20 nt, Artificial Sequence
  MKO10036439_A_Olfr1381
  gRNA
cucucccuagcaccuuccac

SEQ ID NO: 36440 - RNA, 20 nt, Artificial Sequence
  MKO10036440_A_Olfr1381
  gRNA
aggaugugaaaggagcccug

SEQ ID NO: 36441 - RNA, 20 nt, Artificial Sequence
  MKO10036441_A_Olfr1381
  gRNA
uuugaacaccaguucagaag

SEQ ID NO: 36442 - RNA, 20 nt, Artificial Sequence
  MKO10036442_A_Olfr1382
  gRNA
ccucacuaucagaauaccug

SEQ ID NO: 36443 - RNA, 20 nt, Artificial Sequence
  MKO10036443_A_Olfr1382
  gRNA
gcucuucauaaugcucucac

SEQ ID NO: 36444 - RNA, 20 nt, Artificial Sequence
  MKO10036444_A_Olfr1382
  gRNA
agagaggcauggucaucaca

SEQ ID NO: 36445 - RNA, 20 nt, Artificial Sequence
  MKO10036445_A_Olfr1383
  gRNA
cacauggacagguuggagau

SEQ ID NO: 36446 - RNA, 20 nt, Artificial Sequence
  MKO10036446_A_Olfr1383
  gRNA
caucaucacaaucucacgaa

SEQ ID NO: 36447 - RNA, 20 nt, Artificial Sequence
  MKO10036447_A_Olfr1383
  gRNA
ugugaagggggcucuaugca

SEQ ID NO: 36448 - RNA, 20 nt, Artificial Sequence
  MKO10036448_A_Olfr1384
  gRNA
cagccuauccacacguauuc

SEQ ID NO: 36449 - RNA, 20 nt, Artificial Sequence
  MKO10036449_A_Olfr1384
  gRNA
cuucacuaccagaauacgug

SEQ ID NO: 36450 - RNA, 20 nt, Artificial Sequence
  MKO10036450_A_Olfr1384
  gRNA
ucaacuggaacuuauccucc

SEQ ID NO: 36451 - RNA, 20 nt, Artificial Sequence
  MKO10036451_A_Olfr1385
  gRNA
cgguguugccaaagauaguu

SEQ ID NO: 36452 - RNA, 20 nt, Artificial Sequence
  MKO10036452_A_Olfr1385
  gRNA
gugcaagagauaugaaaagc

SEQ ID NO: 36453 - RNA, 20 nt, Artificial Sequence
  MKO10036453_A_Olfr1385
  gRNA
cacugagugugugcucuuag

SEQ ID NO: 36454 - RNA, 20 nt, Artificial Sequence
  MKO10036454_A_Olfr1386
  gRNA
uaguguugccaaagauaguu

SEQ ID NO: 36455 - RNA, 20 nt, Artificial Sequence
  MKO10036455_A_Olfr1386
  gRNA
gcuguucauauaucuugcuc

SEQ ID NO: 36456 - RNA, 20 nt, Artificial Sequence
  MKO10036456_A_Olfr1386
  gRNA
gagcaagauauaugaacagc

SEQ ID NO: 36457 - RNA, 20 nt, Artificial Sequence
  MKO10036457_A_Olfr1387
  gRNA
gguucauaaugcugguauag

SEQ ID NO: 36458 - RNA, 20 nt, Artificial Sequence
  MKO10036458_A_Olfr1387
  gRNA
caaguccucggagguugaug

SEQ ID NO: 36459 - RNA, 20 nt, Artificial Sequence
  MKO10036459_A_Olfr1387
  gRNA
uggccaucacaagcccuguu

SEQ ID NO: 36460 - RNA, 20 nt, Artificial Sequence
  MKO10036460_A_Olfr1388
  gRNA
cugcccugcggcacuuaucc

SEQ ID NO: 36461 - RNA, 20 nt, Artificial Sequence
  MKO10036461_A_Olfr1388
  gRNA
uguggcccgaacaauaguuu

SEQ ID NO: 36462 - RNA, 20 nt, Artificial Sequence
  MKO10036462_A_Olfr1388
  gRNA
caucauugcucucucucgac

SEQ ID NO: 36463 - RNA, 20 nt, Artificial Sequence
  MKO10036463_A_Olfr1389
  gRNA
gaugcccauauuccugaaau

SEQ ID NO: 36464 - RNA, 20 nt, Artificial Sequence
  MKO10036464_A_Olfr1389
  gRNA
uuggauaggaccaucagcua

SEQ ID NO: 36465 - RNA, 20 nt, Artificial Sequence
  MKO10036465_A_Olfr1389
  gRNA
uaugaagccuuucccuaaac

SEQ ID NO: 36466 - RNA, 20 nt, Artificial Sequence
  MKO10036466_A_Olfr138
  gRNA
ugaagguacaugcuaauacc

SEQ ID NO: 36467 - RNA, 20 nt, Artificial Sequence
  MKO10036467_A_Olfr138
  gRNA
cugacaaaaugcauacucuu

SEQ ID NO: 36468 - RNA, 20 nt, Artificial Sequence
  MKO10036468_A_Olfr138
  gRNA
acauugcaacugccauuaug

SEQ ID NO: 36469 - RNA, 20 nt, Artificial Sequence
  MKO10036469_A_Olfr1390
  gRNA
aauucagacgagccucauga

SEQ ID NO: 36470 - RNA, 20 nt, Artificial Sequence
  MKO10036470_A_Olfr1390
  gRNA
cuccuaugcaaacauugcuc

SEQ ID NO: 36471 - RNA, 20 nt, Artificial Sequence
  MKO10036471_A_Olfr1390
  gRNA
ucucacuagcuauuguuucg

SEQ ID NO: 36472 - RNA, 20 nt, Artificial Sequence
  MKO10036472_A_Olfr1391
  gRNA
ccugaucaauauugcugcac

SEQ ID NO: 36473 - RNA, 20 nt, Artificial Sequence
  MKO10036473_A_Olfr1391
  gRNA
gcuaucucuucuuggguagc

SEQ ID NO: 36474 - RNA, 20 nt, Artificial Sequence
  MKO10036474_A_Olfr1391
  gRNA
uucagucgauaccugcagag

SEQ ID NO: 36475 - RNA, 20 nt, Artificial Sequence
  MKO10036475_A_Olfr1392
  gRNA
ggaaagcuucaacaucaguu

SEQ ID NO: 36476 - RNA, 20 nt, Artificial Sequence
  MKO10036476_A_Olfr1392
  gRNA
gcucuucauaacucuugcuc

SEQ ID NO: 36477 - RNA, 20 nt, Artificial Sequence
  MKO10036477_A_Olfr1392
  gRNA
caguguucccaaagagaguu

SEQ ID NO: 36478 - RNA, 20 nt, Artificial Sequence
  MKO10036478_A_Olfr1393
  gRNA
gggaaccuucaacaccaguu

SEQ ID NO: 36479 - RNA, 20 nt, Artificial Sequence
  MKO10036479_A_Olfr1393
  gRNA
cauagaacagagauaccacc

SEQ ID NO: 36480 - RNA, 20 nt, Artificial Sequence
  MKO10036480_A_Olfr1393
  gRNA
cacugcaacaaucaccacuc

SEQ ID NO: 36481 - RNA, 20 nt, Artificial Sequence
  MKO10036481_A_Olfr1394
  gRNA
aguggccgaacaggccggca

SEQ ID NO: 36482 - RNA, 20 nt, Artificial Sequence
  MKO10036482_A_Olfr1394
  gRNA
ccguggugggccucuacuac

SEQ ID NO: 36483 - RNA, 20 nt, Artificial Sequence
  MKO10036483_A_Olfr1394
  gRNA
gacagccauauaccuaucgu

SEQ ID NO: 36484 - RNA, 20 nt, Artificial Sequence
  MKO10036484_A_Olfr1395
  gRNA
ucaugagccgccgugucugc

SEQ ID NO: 36485 - RNA, 20 nt, Artificial Sequence
  MKO10036485_A_Olfr1395
  gRNA
ggccuaccacuccuccaagc

SEQ ID NO: 36486 - RNA, 20 nt, Artificial Sequence
  MKO10036486_A_Olfr1395
  gRNA
gcccuucugcagagcgcauc

SEQ ID NO: 36487 - RNA, 20 nt, Artificial Sequence
  MKO10036487_A_Olfr1396
  gRNA
cuugggguucgguauugucu

SEQ ID NO: 36488 - RNA, 20 nt, Artificial Sequence
  MKO10036488_A_Olfr1396
  gRNA
acaauaccgaaccccaagcc

SEQ ID NO: 36489 - RNA, 20 nt, Artificial Sequence
  MKO10036489_A_Olfr1396
  gRNA
uuguaugccacaaccuacga

SEQ ID NO: 36490 - RNA, 20 nt, Artificial Sequence
  MKO10036490_A_Olfr139
  gRNA
ccgcaugagccgugaagugc

SEQ ID NO: 36491 - RNA, 20 nt, Artificial Sequence
  MKO10036491_A_Olfr139
  gRNA
acguugcagcugcaguacua

SEQ ID NO: 36492 - RNA, 20 nt, Artificial Sequence
  MKO10036492_A_Olfr139
  gRNA
guaguacugcagcugcaacg

SEQ ID NO: 36493 - RNA, 20 nt, Artificial Sequence
  MKO10036493_A_Olfr13
  gRNA
cacacaccucaaugagacga

SEQ ID NO: 36494 - RNA, 20 nt, Artificial Sequence
  MKO10036494_A_Olfr13
  gRNA
guaaggguaaaaguaacacg

SEQ ID NO: 36495 - RNA, 20 nt, Artificial Sequence
  MKO10036495_A_Olfr13
  gRNA
accgccauugucauguacgu

SEQ ID NO: 36496 - RNA, 20 nt, Artificial Sequence
  MKO10036496_A_Olfr1402
  gRNA
ucaugcuagugaacuucuuc

SEQ ID NO: 36497 - RNA, 20 nt, Artificial Sequence
  MKO10036497_A_Olfr1402
  gRNA
aagaaguucacuagcaugac

SEQ ID NO: 36498 - RNA, 20 nt, Artificial Sequence
  MKO10036498_A_Olfr1402
  gRNA
ggcagagaugaucaguauau

SEQ ID NO: 36499 - RNA, 20 nt, Artificial Sequence
  MKO10036499_A_Olfr1404
  gRNA
uauaauagucacgguauagc

SEQ ID NO: 36500 - RNA, 20 nt, Artificial Sequence
  MKO10036500_A_Olfr1404
  gRNA
uuccgcagaguguauaccaa

SEQ ID NO: 36501 - RNA, 20 nt, Artificial Sequence
  MKO10036501_A_Olfr1404
  gRNA
agucucgaaaagcaaucgug

SEQ ID NO: 36502 - RNA, 20 nt, Artificial Sequence
  MKO10036502_A_Olfr1406
  gRNA
gacguuagcucuuagccuua

SEQ ID NO: 36503 - RNA, 20 nt, Artificial Sequence
  MKO10036503_A_Olfr1406
  gRNA
gucaagauaucauugaugac

SEQ ID NO: 36504 - RNA, 20 nt, Artificial Sequence
  MKO10036504_A_Olfr1406
  gRNA
guucuugcucucacuaauuc

SEQ ID NO: 36505 - RNA, 20 nt, Artificial Sequence
  MKO10036505_A_Olfr1408
  gRNA
cuauauauccugacgcugac

SEQ ID NO: 36506 - RNA, 20 nt, Artificial Sequence
  MKO10036506_A_Olfr1408
  gRNA
acuguaguagugauucacua

SEQ ID NO: 36507 - RNA, 20 nt, Artificial Sequence
  MKO10036507_A_Olfr1408
  gRNA
cucugcggaaaguguugugu

SEQ ID NO: 36508 - RNA, 20 nt, Artificial Sequence
  MKO10036508_A_Olfr140
  gRNA
uugucauccugcgcacuuug

SEQ ID NO: 36509 - RNA, 20 nt, Artificial Sequence
  MKO10036509_A_Olfr140
  gRNA
aaaaauucugugacauugcg

SEQ ID NO: 36510 - RNA, 20 nt, Artificial Sequence
  MKO10036510_A_Olfr140
  gRNA
cagggagucagcgaugaguu

SEQ ID NO: 36511 - RNA, 20 nt, Artificial Sequence
  MKO10036511_A_Olfr1410
  gRNA
accauccucagaaugcguuc

SEQ ID NO: 36512 - RNA, 20 nt, Artificial Sequence
  MKO10036512_A_Olfr1410
  gRNA
ucauggccacaucaguccac

SEQ ID NO: 36513 - RNA, 20 nt, Artificial Sequence
  MKO10036513_A_Olfr1410
  gRNA
ggucuccacaaucuacaccc

SEQ ID NO: 36514 - RNA, 20 nt, Artificial Sequence
  MKO10036514_A_Olfr1411
  gRNA
ucauggccauagcagucuac

SEQ ID NO: 36515 - RNA, 20 nt, Artificial Sequence
  MKO10036515_A_Olfr1411
  gRNA
uccauuccuguagacugcua

SEQ ID NO: 36516 - RNA, 20 nt, Artificial Sequence
  MKO10036516_A_Olfr1411
  gRNA
gcccagcaccagacggguac

SEQ ID NO: 36517 - RNA, 20 nt, Artificial Sequence
  MKO10036517_A_Olfr1412
  gRNA
agguugccucaacuccauug

SEQ ID NO: 36518 - RNA, 20 nt, Artificial Sequence
  MKO10036518_A_Olfr1412
  gRNA
gaagaaauggucgaugugau

SEQ ID NO: 36519 - RNA, 20 nt, Artificial Sequence
  MKO10036519_A_Olfr1412
  gRNA
cccaaaucccaccagcacga

SEQ ID NO: 36520 - RNA, 20 nt, Artificial Sequence
  MKO10036520_A_Olfr1413
  gRNA
acuagucgggcacaugccau

SEQ ID NO: 36521 - RNA, 20 nt, Artificial Sequence
  MKO10036521_A_Olfr1413
  gRNA
gguucagcaugggaauaacc

SEQ ID NO: 36522 - RNA, 20 nt, Artificial Sequence
  MKO10036522_A_Olfr1413
  gRNA
ccuguauguagugaccgucc

SEQ ID NO: 36523 - RNA, 20 nt, Artificial Sequence
  MKO10036523_A_Olfr1414
  gRNA
agcuccggguaucgauggcc

SEQ ID NO: 36524 - RNA, 20 nt, Artificial Sequence
  MKO10036524_A_Olfr1414
  gRNA
gggagcuugacccaagccca

SEQ ID NO: 36525 - RNA, 20 nt, Artificial Sequence
  MKO10036525_A_Olfr1414
  gRNA
ucauguccaccuuggagauc

SEQ ID NO: 36526 - RNA, 20 nt, Artificial Sequence
  MKO10036526_A_Olfr1415
  gRNA
auagagugugacccaaaccc

SEQ ID NO: 36527 - RNA, 20 nt, Artificial Sequence
  MKO10036527_A_Olfr1415
  gRNA
accccuugauuuauugccua

SEQ ID NO: 36528 - RNA, 20 nt, Artificial Sequence
  MKO10036528_A_Olfr1415
  gRNA
auaaaucaagggguuuaaga

SEQ ID NO: 36529 - RNA, 20 nt, Artificial Sequence
  MKO10036529_A_Olfr1416
  gRNA
cuucauguaugugcgacccc

SEQ ID NO: 36530 - RNA, 20 nt, Artificial Sequence
  MKO10036530_A_Olfr1416
  gRNA
auucaucaugggcgugagga

SEQ ID NO: 36531 - RNA, 20 nt, Artificial Sequence
  MKO10036531_A_Olfr1416
  gRNA
guagaccuuaaucacagaga

SEQ ID NO: 36532 - RNA, 20 nt, Artificial Sequence
  MKO10036532_A_Olfr1417
  gRNA
gcuauacccucaucaugagc

SEQ ID NO: 36533 - RNA, 20 nt, Artificial Sequence
  MKO10036533_A_Olfr1417
  gRNA
auucagcacaggagugauga

SEQ ID NO: 36534 - RNA, 20 nt, Artificial Sequence
  MKO10036534_A_Olfr1417
  gRNA
ggcuuccacauccauacugc

SEQ ID NO: 36535 - RNA, 20 nt, Artificial Sequence
  MKO10036535_A_Olfr1418
  gRNA
gacuugugcauccauacugc

SEQ ID NO: 36536 - RNA, 20 nt, Artificial Sequence
  MKO10036536_A_Olfr1418
  gRNA
ucuagagugcuucuuguguu

SEQ ID NO: 36537 - RNA, 20 nt, Artificial Sequence
  MKO10036537_A_Olfr1418
  gRNA
cuuguguguccaguuggccc

SEQ ID NO: 36538 - RNA, 20 nt, Artificial Sequence
  MKO10036538_A_Olfr1419
  gRNA
agagcugccaacucauaaug

SEQ ID NO: 36539 - RNA, 20 nt, Artificial Sequence
  MKO10036539_A_Olfr1419
  gRNA
ggaauagccaagcucuaaug

SEQ ID NO: 36540 - RNA, 20 nt, Artificial Sequence
  MKO10036540_A_Olfr1419
  gRNA
agcucucuuugccaucagcg

SEQ ID NO: 36541 - RNA, 20 nt, Artificial Sequence
  MKO10036541_A_Olfr141
  gRNA
ggugauaucuguagaauaac

SEQ ID NO: 36542 - RNA, 20 nt, Artificial Sequence
  MKO10036542_A_Olfr141
  gRNA
aucaccccaaauaugcuagu

SEQ ID NO: 36543 - RNA, 20 nt, Artificial Sequence
  MKO10036543_A_Olfr141
  gRNA
auaagugguauauagacucg

SEQ ID NO: 36544 - RNA, 20 nt, Artificial Sequence
  MKO10036544_A_Olfr1420
  gRNA
gaggaccacuacgaugugag

SEQ ID NO: 36545 - RNA, 20 nt, Artificial Sequence
  MKO10036545_A_Olfr1420
  gRNA
guggagacacgcauguucau

SEQ ID NO: 36546 - RNA, 20 nt, Artificial Sequence
  MKO10036546_A_Olfr1420
  gRNA
ggucagguacaucaccaaga

SEQ ID NO: 36547 - RNA, 20 nt, Artificial Sequence
  MKO10036547_A_Olfr1423
  gRNA
cgugugcagacgggacucaa

SEQ ID NO: 36548 - RNA, 20 nt, Artificial Sequence
  MKO10036548_A_Olfr1423
  gRNA
ccacccaggaggccgcgaug

SEQ ID NO: 36549 - RNA, 20 nt, Artificial Sequence
  MKO10036549_A_Olfr1423
  gRNA
gcaccgcuuacuacucauga

SEQ ID NO: 36550 - RNA, 20 nt, Artificial Sequence
  MKO10036550_A_Olfr1424
  gRNA
cugcgcuuacuugcugacuu

SEQ ID NO: 36551 - RNA, 20 nt, Artificial Sequence
  MKO10036551_A_Olfr1424
  gRNA
uggagauggaaaacuacacc

SEQ ID NO: 36552 - RNA, 20 nt, Artificial Sequence
  MKO10036552_A_Olfr1424
  gRNA
gguaagauccacaagaaccu

SEQ ID NO: 36553 - RNA, 20 nt, Artificial Sequence
  MKO10036553_A_Olfr1425
  gRNA
aaagacuuggaccuucuuau

SEQ ID NO: 36554 - RNA, 20 nt, Artificial Sequence
  MKO10036554_A_Olfr1425
  gRNA
uaccucucuauccaauaaga

SEQ ID NO: 36555 - RNA, 20 nt, Artificial Sequence
  MKO10036555_A_Olfr1425
  gRNA
augagauggaaaacuauacc

SEQ ID NO: 36556 - RNA, 20 nt, Artificial Sequence
  MKO10036556_A_Olfr1426
  gRNA
augaugcuuagaucucauuc

SEQ ID NO: 36557 - RNA, 20 nt, Artificial Sequence
  MKO10036557_A_Olfr1426
  gRNA
caaaccacagaguagcaacc

SEQ ID NO: 36558 - RNA, 20 nt, Artificial Sequence
  MKO10036558_A_Olfr1426
  gRNA
uauugcucuucucuaucaaa

SEQ ID NO: 36559 - RNA, 20 nt, Artificial Sequence
  MKO10036559_A_Olfr1427
  gRNA
caaaccauagcguagugauc

SEQ ID NO: 36560 - RNA, 20 nt, Artificial Sequence
  MKO10036560_A_Olfr1427
  gRNA
cguguggaggcgggacuccc

SEQ ID NO: 36561 - RNA, 20 nt, Artificial Sequence
  MKO10036561_A_Olfr1427
  gRNA
cuccuccauuacuguuccaa

SEQ ID NO: 36562 - RNA, 20 nt, Artificial Sequence
  MKO10036562_A_Olfr1428
  gRNA
acuuacucgcauccgggaac

SEQ ID NO: 36563 - RNA, 20 nt, Artificial Sequence
  MKO10036563_A_Olfr1428
  gRNA
ugcacuauguaaccauuaug

SEQ ID NO: 36564 - RNA, 20 nt, Artificial Sequence
  MKO10036564_A_Olfr1428
  gRNA
ccuucugagagcaauaagcu

SEQ ID NO: 36565 - RNA, 20 nt, Artificial Sequence
  MKO10036565_A_Olfr142
  gRNA
caagcuuaaauaauuguugc

SEQ ID NO: 36566 - RNA, 20 nt, Artificial Sequence
  MKO10036566_A_Olfr142
  gRNA
aaaaugcuauacgaaugucc

SEQ ID NO: 36567 - RNA, 20 nt, Artificial Sequence
  MKO10036567_A_Olfr142
  gRNA
cacaauaaaccccuccauaa

SEQ ID NO: 36568 - RNA, 20 nt, Artificial Sequence
  MKO10036568_A_Olfr1431
  gRNA
ucuacauuaugacuaugacc

SEQ ID NO: 36569 - RNA, 20 nt, Artificial Sequence
  MKO10036569_A_Olfr1431
  gRNA
guuucucucuucuauaguac

SEQ ID NO: 36570 - RNA, 20 nt, Artificial Sequence
  MKO10036570_A_Olfr1431
  gRNA
agaugugaaucugucaaaac

SEQ ID NO: 36571 - RNA, 20 nt, Artificial Sequence
  MKO10036571_A_Olfr1433
  gRNA
aggucagugcuguaauauac

SEQ ID NO: 36572 - RNA, 20 nt, Artificial Sequence
  MKO10036572_A_Olfr1433
  gRNA
auacccauaggacaccauga

SEQ ID NO: 36573 - RNA, 20 nt, Artificial Sequence
  MKO10036573_A_Olfr1433
  gRNA
gaucacucaauuuauccucc

SEQ ID NO: 36574 - RNA, 20 nt, Artificial Sequence
  MKO10036574_A_Olfr1434
  gRNA
aggucagugcuguaauauac

SEQ ID NO: 36575 - RNA, 20 nt, Artificial Sequence
  MKO10036575_A_Olfr1434
  gRNA
auacccauaggacaccauga

SEQ ID NO: 36576 - RNA, 20 nt, Artificial Sequence
  MKO10036576_A_Olfr1434
  gRNA
gaucacucaauuuauccucc

SEQ ID NO: 36577 - RNA, 20 nt, Artificial Sequence
  MKO10036577_A_Olfr1436
  gRNA
agcuacacagcuggauuuau

SEQ ID NO: 36578 - RNA, 20 nt, Artificial Sequence
  MKO10036578_A_Olfr1436
  gRNA
aucauggaggcaaugauuaa

SEQ ID NO: 36579 - RNA, 20 nt, Artificial Sequence
  MKO10036579_A_Olfr1436
  gRNA
gauuacuauguugaacccuu

SEQ ID NO: 36580 - RNA, 20 nt, Artificial Sequence
  MKO10036580_A_Olfr1437
  gRNA
caccaucugagcgcaaagug

SEQ ID NO: 36581 - RNA, 20 nt, Artificial Sequence
  MKO10036581_A_Olfr1437
  gRNA
uguauauuacaacccugacc

SEQ ID NO: 36582 - RNA, 20 nt, Artificial Sequence
  MKO10036582_A_Olfr1437
  gRNA
aggucaggguuguaauauac

SEQ ID NO: 36583 - RNA, 20 nt, Artificial Sequence
  MKO10036583_A_Olfr143
  gRNA
ugagcuuaugaguucaguug

SEQ ID NO: 36584 - RNA, 20 nt, Artificial Sequence
  MKO10036584_A_Olfr143
  gRNA
cauugauuucuguuauucga

SEQ ID NO: 36585 - RNA, 20 nt, Artificial Sequence
  MKO10036585_A_Olfr143
  gRNA
acucauaagcucauuaacau

SEQ ID NO: 36586 - RNA, 20 nt, Artificial Sequence
  MKO10036586_A_Olfr1440
  gRNA
gcuccgagacgaugccugga

SEQ ID NO: 36587 - RNA, 20 nt, Artificial Sequence
  MKO10036587_A_Olfr1440
  gRNA
aagccaucuugucauaaccc

SEQ ID NO: 36588 - RNA, 20 nt, Artificial Sequence
  MKO10036588_A_Olfr1440
  gRNA
agaguccugauccaaaaaag

SEQ ID NO: 36589 - RNA, 20 nt, Artificial Sequence
  MKO10036589_A_Olfr1441
  gRNA
ucauaccuccauucuaaugc

SEQ ID NO: 36590 - RNA, 20 nt, Artificial Sequence
  MKO10036590_A_Olfr1441
  gRNA
ugugggaagaaacauuagcg

SEQ ID NO: 36591 - RNA, 20 nt, Artificial Sequence
  MKO10036591_A_Olfr1441
  gRNA
acaucauugcugccgucaug

SEQ ID NO: 36592 - RNA, 20 nt, Artificial Sequence
  MKO10036592_A_Olfr1442
  gRNA
cuggugcguucgucaguccu

SEQ ID NO: 36593 - RNA, 20 nt, Artificial Sequence
  MKO10036593_A_Olfr1442
  gRNA
ugacgaacgcaccagaacug

SEQ ID NO: 36594 - RNA, 20 nt, Artificial Sequence
  MKO10036594_A_Olfr1442
  gRNA
agcuguagcuccaacaauuu

SEQ ID NO: 36595 - RNA, 20 nt, Artificial Sequence
  MKO10036595_A_Olfr1443
  gRNA
guuaccccaacaguuguugc

SEQ ID NO: 36596 - RNA, 20 nt, Artificial Sequence
  MKO10036596_A_Olfr1443
  gRNA
ugacaaaacuugcuccauau

SEQ ID NO: 36597 - RNA, 20 nt, Artificial Sequence
  MKO10036597_A_Olfr1443
  gRNA
cuacuucugcaaguccaaug

SEQ ID NO: 36598 - RNA, 20 nt, Artificial Sequence
  MKO10036598_A_Olfr1444
  gRNA
cuacucacacuaaaagacgc

SEQ ID NO: 36599 - RNA, 20 nt, Artificial Sequence
  MKO10036599_A_Olfr1444
  gRNA
guguguaccauccuaaccau

SEQ ID NO: 36600 - RNA, 20 nt, Artificial Sequence
  MKO10036600_A_Olfr1444
  gRNA
cacuguugagugcuaucuuu

SEQ ID NO: 36601 - RNA, 20 nt, Artificial Sequence
  MKO10036601_A_Olfr1445
  gRNA
uugucuauugaaaggagacc

SEQ ID NO: 36602 - RNA, 20 nt, Artificial Sequence
  MKO10036602_A_Olfr1445
  gRNA
caaugauaucuucucuauug

SEQ ID NO: 36603 - RNA, 20 nt, Artificial Sequence
  MKO10036603_A_Olfr1445
  gRNA
accauaacacacaaugcuug

SEQ ID NO: 36604 - RNA, 20 nt, Artificial Sequence
  MKO10036604_A_Olfr1446
  gRNA
uguaacuuugucuaugucca

SEQ ID NO: 36605 - RNA, 20 nt, Artificial Sequence
  MKO10036605_A_Olfr1446
  gRNA
caagugagagccauuauugc

SEQ ID NO: 36606 - RNA, 20 nt, Artificial Sequence
  MKO10036606_A_Olfr1446
  gRNA
ugacuaaaaguguguauaca

SEQ ID NO: 36607 - RNA, 20 nt, Artificial Sequence
  MKO10036607_A_Olfr1447
  gRNA
uaguagcccauucaugacug

SEQ ID NO: 36608 - RNA, 20 nt, Artificial Sequence
  MKO10036608_A_Olfr1447
  gRNA
ccaccagagaaagauuacca

SEQ ID NO: 36609 - RNA, 20 nt, Artificial Sequence
  MKO10036609_A_Olfr1447
  gRNA
uacuguggagaacuaucugu

SEQ ID NO: 36610 - RNA, 20 nt, Artificial Sequence
  MKO10036610_A_Olfr1448
  gRNA
ugucugagcacgauagggcc

SEQ ID NO: 36611 - RNA, 20 nt, Artificial Sequence
  MKO10036611_A_Olfr1448
  gRNA
cacccaauucuucuucuucg

SEQ ID NO: 36612 - RNA, 20 nt, Artificial Sequence
  MKO10036612_A_Olfr1448
  gRNA
accauaucccauaacacuug

SEQ ID NO: 36613 - RNA, 20 nt, Artificial Sequence
  MKO10036613_A_Olfr1449
  gRNA
agacugaacgugacgaacag

SEQ ID NO: 36614 - RNA, 20 nt, Artificial Sequence
  MKO10036614_A_Olfr1449
  gRNA
ugggcauuaucguguugaua

SEQ ID NO: 36615 - RNA, 20 nt, Artificial Sequence
  MKO10036615_A_Olfr1449
  gRNA
uuugagucugcuauacauac

SEQ ID NO: 36616 - RNA, 20 nt, Artificial Sequence
  MKO10036616_A_Olfr1450
  gRNA
acuaacugacaacccagacc

SEQ ID NO: 36617 - RNA, 20 nt, Artificial Sequence
  MKO10036617_A_Olfr1450
  gRNA
acccaguuguuuauagcuua

SEQ ID NO: 36618 - RNA, 20 nt, Artificial Sequence
  MKO10036618_A_Olfr1450
  gRNA
agaucaacacaaucaugccc

SEQ ID NO: 36619 - RNA, 20 nt, Artificial Sequence
  MKO10036619_A_Olfr1451
  gRNA
aaacacggggcugauaaugu

SEQ ID NO: 36620 - RNA, 20 nt, Artificial Sequence
  MKO10036620_A_Olfr1451
  gRNA
cauccccacacuaaacccuu

SEQ ID NO: 36621 - RNA, 20 nt, Artificial Sequence
  MKO10036621_A_Olfr1451
  gRNA
aaccccugcauuacucuacc

SEQ ID NO: 36622 - RNA, 20 nt, Artificial Sequence
  MKO10036622_A_Olfr1453
  gRNA
aagauacaaucauuacugca

SEQ ID NO: 36623 - RNA, 20 nt, Artificial Sequence
  MKO10036623_A_Olfr1453
  gRNA
cugaagauccacucaucugc

SEQ ID NO: 36624 - RNA, 20 nt, Artificial Sequence
  MKO10036624_A_Olfr1453
  gRNA
caucugcauguugaacccuc

SEQ ID NO: 36625 - RNA, 20 nt, Artificial Sequence
  MKO10036625_A_Olfr1454
  gRNA
uaaugcaucuacaguauaaa

SEQ ID NO: 36626 - RNA, 20 nt, Artificial Sequence
  MKO10036626_A_Olfr1454
  gRNA
cuaaaguugcagucagcugc

SEQ ID NO: 36627 - RNA, 20 nt, Artificial Sequence
  MKO10036627_A_Olfr1454
  gRNA
agaaauccagcuaugacuuu

SEQ ID NO: 36628 - RNA, 20 nt, Artificial Sequence
  MKO10036628_A_Olfr1457
  gRNA
uacucuuguagucauagugc

SEQ ID NO: 36629 - RNA, 20 nt, Artificial Sequence
  MKO10036629_A_Olfr1457
  gRNA
gcuaaaaugcacucaagugc

SEQ ID NO: 36630 - RNA, 20 nt, Artificial Sequence
  MKO10036630_A_Olfr1457
  gRNA
agaagcucagucaugacacu

SEQ ID NO: 36631 - RNA, 20 nt, Artificial Sequence
  MKO10036631_A_Olfr1459
  gRNA
aucuauacuguuaccuuugu

SEQ ID NO: 36632 - RNA, 20 nt, Artificial Sequence
  MKO10036632_A_Olfr1459
  gRNA
aacaugucuaucagagcaag

SEQ ID NO: 36633 - RNA, 20 nt, Artificial Sequence
  MKO10036633_A_Olfr1459
  gRNA
gaagacagcuguuaagugug

SEQ ID NO: 36634 - RNA, 20 nt, Artificial Sequence
  MKO10036634_A_Olfr145
  gRNA
ccucuguggaacugaugcga

SEQ ID NO: 36635 - RNA, 20 nt, Artificial Sequence
  MKO10036635_A_Olfr145
  gRNA
gacacuuuccccugguucau

SEQ ID NO: 36636 - RNA, 20 nt, Artificial Sequence
  MKO10036636_A_Olfr145
  gRNA
gacuaccagcucauuuacau

SEQ ID NO: 36637 - RNA, 20 nt, Artificial Sequence
  MKO10036637_A_Olfr1461
  gRNA
aagaguaacaaacguccacc

SEQ ID NO: 36638 - RNA, 20 nt, Artificial Sequence
  MKO10036638_A_Olfr1461
  gRNA
uuaaacaugcgcucaagagc

SEQ ID NO: 36639 - RNA, 20 nt, Artificial Sequence
  MKO10036639_A_Olfr1461
  gRNA
cgaagauauugaagcuugcu

SEQ ID NO: 36640 - RNA, 20 nt, Artificial Sequence
  MKO10036640_A_Olfr1462
  gRNA
gaaugcuuccaucuauacag

SEQ ID NO: 36641 - RNA, 20 nt, Artificial Sequence
  MKO10036641_A_Olfr1462
  gRNA
cuggauuucuuacaggagau

SEQ ID NO: 36642 - RNA, 20 nt, Artificial Sequence
  MKO10036642_A_Olfr1462
  gRNA
cacugcuacauaaugaucau

SEQ ID NO: 36643 - RNA, 20 nt, Artificial Sequence
  MKO10036643_A_Olfr1463
  gRNA
gaaucagcagaaucaacccc

SEQ ID NO: 36644 - RNA, 20 nt, Artificial Sequence
  MKO10036644_A_Olfr1463
  gRNA
agagacuaaauguaucucca

SEQ ID NO: 36645 - RNA, 20 nt, Artificial Sequence
  MKO10036645_A_Olfr1463
  gRNA
ucaagagugcauucaugaaa

SEQ ID NO: 36646 - RNA, 20 nt, Artificial Sequence
  MKO10036646_A_Olfr1465
  gRNA
ugauuagaaguaucaugaag

SEQ ID NO: 36647 - RNA, 20 nt, Artificial Sequence
  MKO10036647_A_Olfr1465
  gRNA
gaguguggagacacgagucc

SEQ ID NO: 36648 - RNA, 20 nt, Artificial Sequence
  MKO10036648_A_Olfr1465
  gRNA
gacuuugggugugacaucag

SEQ ID NO: 36649 - RNA, 20 nt, Artificial Sequence
  MKO10036649_A_Olfr1466
  gRNA
gucauggcuggucucauaau

SEQ ID NO: 36650 - RNA, 20 nt, Artificial Sequence
  MKO10036650_A_Olfr1466
  gRNA
ucauggugguagcauaguau

SEQ ID NO: 36651 - RNA, 20 nt, Artificial Sequence
  MKO10036651_A_Olfr1466
  gRNA
aagaguaaauaacauccacc

SEQ ID NO: 36652 - RNA, 20 nt, Artificial Sequence
  MKO10036652_A_Olfr1467
  gRNA
agcugauugcaucuucacga

SEQ ID NO: 36653 - RNA, 20 nt, Artificial Sequence
  MKO10036653_A_Olfr1467
  gRNA
ugacuacaaguguguguacg

SEQ ID NO: 36654 - RNA, 20 nt, Artificial Sequence
  MKO10036654_A_Olfr1467
  gRNA
gccaaguuccaaucacucua

SEQ ID NO: 36655 - RNA, 20 nt, Artificial Sequence
  MKO10036655_A_Olfr1469
  gRNA
ugauaccgcaaugaagugug

SEQ ID NO: 36656 - RNA, 20 nt, Artificial Sequence
  MKO10036656_A_Olfr1469
  gRNA
ggaggcauucaaaaaaccac

SEQ ID NO: 36657 - RNA, 20 nt, Artificial Sequence
  MKO10036657_A_Olfr1469
  gRNA
uguaaaaugcacucaaguuc

SEQ ID NO: 36658 - RNA, 20 nt, Artificial Sequence
  MKO10036658_A_Olfr146
  gRNA
cccaucaucuucccauucga

SEQ ID NO: 36659 - RNA, 20 nt, Artificial Sequence
  MKO10036659_A_Olfr146
  gRNA
aaacuccuaaaacgagagaa

SEQ ID NO: 36660 - RNA, 20 nt, Artificial Sequence
  MKO10036660_A_Olfr146
  gRNA
guugagcaugggaacaauga

SEQ ID NO: 36661 - RNA, 20 nt, Artificial Sequence
  MKO10036661_A_Olfr1471
  gRNA
ugagauuacacugcuugucu

SEQ ID NO: 36662 - RNA, 20 nt, Artificial Sequence
  MKO10036662_A_Olfr1471
  gRNA
aaguuugauccuugccucga

SEQ ID NO: 36663 - RNA, 20 nt, Artificial Sequence
  MKO10036663_A_Olfr1471
  gRNA
gcccaguuucaaucauucca

SEQ ID NO: 36664 - RNA, 20 nt, Artificial Sequence
  MKO10036664_A_Olfr1472
  gRNA
uuccuuaaacuguauacgac

SEQ ID NO: 36665 - RNA, 20 nt, Artificial Sequence
  MKO10036665_A_Olfr1472
  gRNA
guucauagaaugauuagaac

SEQ ID NO: 36666 - RNA, 20 nt, Artificial Sequence
  MKO10036666_A_Olfr1472
  gRNA
caucacaaguucccaagaua

SEQ ID NO: 36667 - RNA, 20 nt, Artificial Sequence
  MKO10036667_A_Olfr1474
  gRNA
ccaccaccgagagauuacag

SEQ ID NO: 36668 - RNA, 20 nt, Artificial Sequence
  MKO10036668_A_Olfr1474
  gRNA
ugagauuacacugcucgucu

SEQ ID NO: 36669 - RNA, 20 nt, Artificial Sequence
  MKO10036669_A_Olfr1474
  gRNA
ccugcauucuaauugucacu

SEQ ID NO: 36670 - RNA, 20 nt, Artificial Sequence
  MKO10036670_A_Olfr1475
  gRNA
uuccuuaaacuguauacuac

SEQ ID NO: 36671 - RNA, 20 nt, Artificial Sequence
  MKO10036671_A_Olfr1475
  gRNA
caucacaaguacccaagaua

SEQ ID NO: 36672 - RNA, 20 nt, Artificial Sequence
  MKO10036672_A_Olfr1475
  gRNA
acccuguaguauacaguuua

SEQ ID NO: 36673 - RNA, 20 nt, Artificial Sequence
  MKO10036673_A_Olfr1477
  gRNA
aauuucauuugugcgaauac

SEQ ID NO: 36674 - RNA, 20 nt, Artificial Sequence
  MKO10036674_A_Olfr1477
  gRNA
aaaauucucaguaauagcaa

SEQ ID NO: 36675 - RNA, 20 nt, Artificial Sequence
  MKO10036675_A_Olfr1477
  gRNA
gaugauaaugcugauucugc

SEQ ID NO: 36676 - RNA, 20 nt, Artificial Sequence
  MKO10036676_A_Olfr147
  gRNA
aggaugucaagguggcauua

SEQ ID NO: 36677 - RNA, 20 nt, Artificial Sequence
  MKO10036677_A_Olfr147
  gRNA
cuguaauccacuauuguaua

SEQ ID NO: 36678 - RNA, 20 nt, Artificial Sequence
  MKO10036678_A_Olfr147
  gRNA
uugagucaugcaccccgcau

SEQ ID NO: 36679 - RNA, 20 nt, Artificial Sequence
  MKO10036679_A_Olfr1480
  gRNA
aaaacucuccguaauaacaa

SEQ ID NO: 36680 - RNA, 20 nt, Artificial Sequence
  MKO10036680_A_Olfr1480
  gRNA
cuuuguagccuuuguuauua

SEQ ID NO: 36681 - RNA, 20 nt, Artificial Sequence
  MKO10036681_A_Olfr1480
  gRNA
aauuucauuuguguaaauac

SEQ ID NO: 36682 - RNA, 20 nt, Artificial Sequence
  MKO10036682_A_Olfr1484
  gRNA
gucacccccaaagugauaga

SEQ ID NO: 36683 - RNA, 20 nt, Artificial Sequence
  MKO10036683_A_Olfr1484
  gRNA
gagaaacccuucuaucacuu

SEQ ID NO: 36684 - RNA, 20 nt, Artificial Sequence
  MKO10036684_A_Olfr1484
  gRNA
aaaacacucaguaauagcaa

SEQ ID NO: 36685 - RNA, 20 nt, Artificial Sequence
  MKO10036685_A_Olfr1487
  gRNA
gaaacuuucaacaguagcaa

SEQ ID NO: 36686 - RNA, 20 nt, Artificial Sequence
  MKO10036686_A_Olfr1487
  gRNA
uacuguugaaaguuucaugc

SEQ ID NO: 36687 - RNA, 20 nt, Artificial Sequence
  MKO10036687_A_Olfr1487
  gRNA
ugccaucuugucaguaucca

SEQ ID NO: 36688 - RNA, 20 nt, Artificial Sequence
  MKO10036688_A_Olfr1489
  gRNA
caauauagcuuuaacuauau

SEQ ID NO: 36689 - RNA, 20 nt, Artificial Sequence
  MKO10036689_A_Olfr1489
  gRNA
aauauguacccugcucauug

SEQ ID NO: 36690 - RNA, 20 nt, Artificial Sequence
  MKO10036690_A_Olfr1489
  gRNA
gggcaucuguuaaucccaca

SEQ ID NO: 36691 - RNA, 20 nt, Artificial Sequence
  MKO10036691_A_Olfr148
  gRNA
ugcacaguagacuaauugaa

SEQ ID NO: 36692 - RNA, 20 nt, Artificial Sequence
  MKO10036692_A_Olfr148
  gRNA
gaugagugaauuuccgagca

SEQ ID NO: 36693 - RNA, 20 nt, Artificial Sequence
  MKO10036693_A_Olfr148
  gRNA
ugagcuugguaauaauagcu

SEQ ID NO: 36694 - RNA, 20 nt, Artificial Sequence
  MKO10036694_A_Olfr1490
  gRNA
gacggggcgcaaguacauga

SEQ ID NO: 36695 - RNA, 20 nt, Artificial Sequence
  MKO10036695_A_Olfr1490
  gRNA
aagcagagcauacguagcuc

SEQ ID NO: 36696 - RNA, 20 nt, Artificial Sequence
  MKO10036696_A_Olfr1490
  gRNA
cagcacuaccaaguccaaug

SEQ ID NO: 36697 - RNA, 20 nt, Artificial Sequence
  MKO10036697_A_Olfr1491
  gRNA
gacccagaagccuauaucgc

SEQ ID NO: 36698 - RNA, 20 nt, Artificial Sequence
  MKO10036698_A_Olfr1491
  gRNA
aaacuuguccuuaaccaauc

SEQ ID NO: 36699 - RNA, 20 nt, Artificial Sequence
  MKO10036699_A_Olfr1491
  gRNA
ccaggaugcccacuacguag

SEQ ID NO: 36700 - RNA, 20 nt, Artificial Sequence
  MKO10036700_A_Olfr1494
  gRNA
agcggggccucagauauaca

SEQ ID NO: 36701 - RNA, 20 nt, Artificial Sequence
  MKO10036701_A_Olfr1494
  gRNA
caguggucccagacugauug

SEQ ID NO: 36702 - RNA, 20 nt, Artificial Sequence
  MKO10036702_A_Olfr1494
  gRNA
ggcccagaaacccauaucac

SEQ ID NO: 36703 - RNA, 20 nt, Artificial Sequence
  MKO10036703_A_Olfr1495
  gRNA
ccgugucuuaaccaauguuc

SEQ ID NO: 36704 - RNA, 20 nt, Artificial Sequence
  MKO10036704_A_Olfr1495
  gRNA
uaucaacuagugucagaagc

SEQ ID NO: 36705 - RNA, 20 nt, Artificial Sequence
  MKO10036705_A_Olfr1495
  gRNA
ugcagaaugcaugcguagaa

SEQ ID NO: 36706 - RNA, 20 nt, Artificial Sequence
  MKO10036706_A_Olfr1496
  gRNA
uuguguaaugcagcccucau

SEQ ID NO: 36707 - RNA, 20 nt, Artificial Sequence
  MKO10036707_A_Olfr1496
  gRNA
uagucaauccauuuccuaug

SEQ ID NO: 36708 - RNA, 20 nt, Artificial Sequence
  MKO10036708_A_Olfr1496
  gRNA
ugcccugacacauacucuuc

SEQ ID NO: 36709 - RNA, 20 nt, Artificial Sequence
  MKO10036709_A_Olfr1497
  gRNA
uuugaagucggcgguucuuc

SEQ ID NO: 36710 - RNA, 20 nt, Artificial Sequence
  MKO10036710_A_Olfr1497
  gRNA
cccguguaggucugguaacu

SEQ ID NO: 36711 - RNA, 20 nt, Artificial Sequence
  MKO10036711_A_Olfr1497
  gRNA
ccauuguuaaaacucguaug

SEQ ID NO: 36712 - RNA, 20 nt, Artificial Sequence
  MKO10036712_A_Olfr1499
  gRNA
guacugguggccuauguaug

SEQ ID NO: 36713 - RNA, 20 nt, Artificial Sequence
  MKO10036713_A_Olfr1499
  gRNA
cugggcagcacaaugauuau

SEQ ID NO: 36714 - RNA, 20 nt, Artificial Sequence
  MKO10036714_A_Olfr1499
  gRNA
accuucauguauauaagaag

SEQ ID NO: 36715 - RNA, 20 nt, Artificial Sequence
  MKO10036715_A_Olfr149
  gRNA
auuaugacugaguagcguag

SEQ ID NO: 36716 - RNA, 20 nt, Artificial Sequence
  MKO10036716_A_Olfr149
  gRNA
uugugcagacacaucgaccc

SEQ ID NO: 36717 - RNA, 20 nt, Artificial Sequence
  MKO10036717_A_Olfr149
  gRNA
ggaccgaacuauacagcugu

SEQ ID NO: 36718 - RNA, 20 nt, Artificial Sequence
  MKO10036718_A_Olfr1500
  gRNA
uguggagccugcgauccaug

SEQ ID NO: 36719 - RNA, 20 nt, Artificial Sequence
  MKO10036719_A_Olfr1500
  gRNA
cugagcaacacagcgugcau

SEQ ID NO: 36720 - RNA, 20 nt, Artificial Sequence
  MKO10036720_A_Olfr1500
  gRNA
agccaagagguagcaaucga

SEQ ID NO: 36721 - RNA, 20 nt, Artificial Sequence
  MKO10036721_A_Olfr1501
  gRNA
ugagacuaaguuacgcgaac

SEQ ID NO: 36722 - RNA, 20 nt, Artificial Sequence
  MKO10036722_A_Olfr1501
  gRNA
gcguaacuuagucucacuac

SEQ ID NO: 36723 - RNA, 20 nt, Artificial Sequence
  MKO10036723_A_Olfr1501
  gRNA
uaacccgcuccuuuaugcga

SEQ ID NO: 36724 - RNA, 20 nt, Artificial Sequence
  MKO10036724_A_Olfr1502
  gRNA
gguggucauuaaagccuauu

SEQ ID NO: 36725 - RNA, 20 nt, Artificial Sequence
  MKO10036725_A_Olfr1502
  gRNA
guaguaggagcauauaucug

SEQ ID NO: 36726 - RNA, 20 nt, Artificial Sequence
  MKO10036726_A_Olfr1502
  gRNA
ggugaugacugaaguauagc

SEQ ID NO: 36727 - RNA, 20 nt, Artificial Sequence
  MKO10036727_A_Olfr1504
  gRNA
cuguagugagaccaaguuac

SEQ ID NO: 36728 - RNA, 20 nt, Artificial Sequence
  MKO10036728_A_Olfr1504
  gRNA
uaacccccuccuuuaugcca

SEQ ID NO: 36729 - RNA, 20 nt, Artificial Sequence
  MKO10036729_A_Olfr1504
  gRNA
gauuacuuguuccuguaacu

SEQ ID NO: 36730 - RNA, 20 nt, Artificial Sequence
  MKO10036730_A_Olfr1505
  gRNA
gguaaaacagucguuuccua

SEQ ID NO: 36731 - RNA, 20 nt, Artificial Sequence
  MKO10036731_A_Olfr1505
  gRNA
ucacucaguauuguaugcug

SEQ ID NO: 36732 - RNA, 20 nt, Artificial Sequence
  MKO10036732_A_Olfr1505
  gRNA
guaguaggagcauaugucug

SEQ ID NO: 36733 - RNA, 20 nt, Artificial Sequence
  MKO10036733_A_Olfr1506
  gRNA
uacuagcaucaugaaccgac

SEQ ID NO: 36734 - RNA, 20 nt, Artificial Sequence
  MKO10036734_A_Olfr1506
  gRNA
gagcagacaaguuuaagcac

SEQ ID NO: 36735 - RNA, 20 nt, Artificial Sequence
  MKO10036735_A_Olfr1506
  gRNA
guguacaguccuuguaggaa

SEQ ID NO: 36736 - RNA, 20 nt, Artificial Sequence
  MKO10036736_A_Olfr1507
  gRNA
caggccaguucgaucaccug

SEQ ID NO: 36737 - RNA, 20 nt, Artificial Sequence
  MKO10036737_A_Olfr1507
  gRNA
caacgagaaucucagugaua

SEQ ID NO: 36738 - RNA, 20 nt, Artificial Sequence
  MKO10036738_A_Olfr1507
  gRNA
gugccuugaagaaguuaauc

SEQ ID NO: 36739 - RNA, 20 nt, Artificial Sequence
  MKO10036739_A_Olfr1508
  gRNA
uaacaaucauauaugaccgc

SEQ ID NO: 36740 - RNA, 20 nt, Artificial Sequence
  MKO10036740_A_Olfr1508
  gRNA
aucccauuaucuacacccuu

SEQ ID NO: 36741 - RNA, 20 nt, Artificial Sequence
  MKO10036741_A_Olfr1508
  gRNA
ucacugaaguuucguugaug

SEQ ID NO: 36742 - RNA, 20 nt, Artificial Sequence
  MKO10036742_A_Olfr1509
  gRNA
aaccgauaccaccuugucga

SEQ ID NO: 36743 - RNA, 20 nt, Artificial Sequence
  MKO10036743_A_Olfr1509
  gRNA
cguaccuccugucaucaagc

SEQ ID NO: 36744 - RNA, 20 nt, Artificial Sequence
  MKO10036744_A_Olfr1509
  gRNA
acacgaucagaaucccugua

SEQ ID NO: 36745 - RNA, 20 nt, Artificial Sequence
  MKO10036745_A_Olfr150
  gRNA
aaaaaaugucaucuccuauc

SEQ ID NO: 36746 - RNA, 20 nt, Artificial Sequence
  MKO10036746_A_Olfr150
  gRNA
ccuccguaucaaauccacug

SEQ ID NO: 36747 - RNA, 20 nt, Artificial Sequence
  MKO10036747_A_Olfr150
  gRNA
ugauuauuguggaguagcag

SEQ ID NO: 36748 - RNA, 20 nt, Artificial Sequence
  MKO10036748_A_Olfr1510
  gRNA
agcguccagcgauguguuuc

SEQ ID NO: 36749 - RNA, 20 nt, Artificial Sequence
  MKO10036749_A_Olfr1510
  gRNA
uacagcaacugcuccgucaa

SEQ ID NO: 36750 - RNA, 20 nt, Artificial Sequence
  MKO10036750_A_Olfr1510
  gRNA
ugagcugcacaaccaccaaa

SEQ ID NO: 36751 - RNA, 20 nt, Artificial Sequence
  MKO10036751_A_Olfr1511
  gRNA
gugaaguuuaauauaauccg

SEQ ID NO: 36752 - RNA, 20 nt, Artificial Sequence
  MKO10036752_A_Olfr1511
  gRNA
accaaaugcgauaaccuugc

SEQ ID NO: 36753 - RNA, 20 nt, Artificial Sequence
  MKO10036753_A_Olfr1511
  gRNA
gaaguugugcacaauucuag

SEQ ID NO: 36754 - RNA, 20 nt, Artificial Sequence
  MKO10036754_A_Olfr1512
  gRNA
guguuuccuauacaccacua

SEQ ID NO: 36755 - RNA, 20 nt, Artificial Sequence
  MKO10036755_A_Olfr1512
  gRNA
ugcuaaguugaguaucuugc

SEQ ID NO: 36756 - RNA, 20 nt, Artificial Sequence
  MKO10036756_A_Olfr1512
  gRNA
ugcuguggcugucaggucga

SEQ ID NO: 36757 - RNA, 20 nt, Artificial Sequence
  MKO10036757_A_Olfr1513
  gRNA
uaaguugaguaccuugcucg

SEQ ID NO: 36758 - RNA, 20 nt, Artificial Sequence
  MKO10036758_A_Olfr1513
  gRNA
ugccauggcugucaggucgc

SEQ ID NO: 36759 - RNA, 20 nt, Artificial Sequence
  MKO10036759_A_Olfr1513
  gRNA
ccaagcuccagccacgagca

SEQ ID NO: 36760 - RNA, 20 nt, Artificial Sequence
  MKO10036760_A_Olfr151
  gRNA
auccucguagucaccauggu

SEQ ID NO: 36761 - RNA, 20 nt, Artificial Sequence
  MKO10036761_A_Olfr151
  gRNA
ugcugaaccgaugaguccua

SEQ ID NO: 36762 - RNA, 20 nt, Artificial Sequence
  MKO10036762_A_Olfr151
  gRNA
gucuaugccguaggacucau

SEQ ID NO: 36763 - RNA, 20 nt, Artificial Sequence
  MKO10036763_A_Olfr152
  gRNA
guuaauggauguguccguac

SEQ ID NO: 36764 - RNA, 20 nt, Artificial Sequence
  MKO10036764_A_Olfr152
  gRNA
cuuguguuucugacguuaua

SEQ ID NO: 36765 - RNA, 20 nt, Artificial Sequence
  MKO10036765_A_Olfr152
  gRNA
aaaacugcagugcacagccg

SEQ ID NO: 36766 - RNA, 20 nt, Artificial Sequence
  MKO10036766_A_Olfr1532-ps1
  gRNA
caggaauauuugccuacaug

SEQ ID NO: 36767 - RNA, 20 nt, Artificial Sequence
  MKO10036767_A_Olfr1532-ps1
  gRNA
cuccaagauaaugaaugaaa

SEQ ID NO: 36768 - RNA, 20 nt, Artificial Sequence
  MKO10036768_A_Olfr1532-ps1
  gRNA
cauauacagccugagaaaca

SEQ ID NO: 36769 - RNA, 20 nt, Artificial Sequence
  MKO10036769_A_Olfr1535
  gRNA
cugccgaccacuccacuaca

SEQ ID NO: 36770 - RNA, 20 nt, Artificial Sequence
  MKO10036770_A_Olfr1535
  gRNA
accaugagucguccccucug

SEQ ID NO: 36771 - RNA, 20 nt, Artificial Sequence
  MKO10036771_A_Olfr1535
  gRNA
uugaaguuaaacagcgucug

SEQ ID NO: 36772 - RNA, 20 nt, Artificial Sequence
  MKO10036772_A_Olfr1537
  gRNA
acucugcaauaccaaaagug

SEQ ID NO: 36773 - RNA, 20 nt, Artificial Sequence
  MKO10036773_A_Olfr1537
  gRNA
aucuguucauccuuuaacac

SEQ ID NO: 36774 - RNA, 20 nt, Artificial Sequence
  MKO10036774_A_Olfr1537
  gRNA
aagcaugaagccaguguuaa

SEQ ID NO: 36775 - RNA, 20 nt, Artificial Sequence
  MKO10036775_A_Olfr153
  gRNA
uuaaaaauccguucaacuga

SEQ ID NO: 36776 - RNA, 20 nt, Artificial Sequence
  MKO10036776_A_Olfr153
  gRNA
ugaaccucccuucaguugaa

SEQ ID NO: 36777 - RNA, 20 nt, Artificial Sequence
  MKO10036777_A_Olfr153
  gRNA
cauaaauagugaauagugcc

SEQ ID NO: 36778 - RNA, 20 nt, Artificial Sequence
  MKO10036778_A_Olfr154
  gRNA
cauaggcuuuguaagcacua

SEQ ID NO: 36779 - RNA, 20 nt, Artificial Sequence
  MKO10036779_A_Olfr154
  gRNA
cuuacaaagccuaugcugua

SEQ ID NO: 36780 - RNA, 20 nt, Artificial Sequence
  MKO10036780_A_Olfr154
  gRNA
gcauuuguccuuccauacug

SEQ ID NO: 36781 - RNA, 20 nt, Artificial Sequence
  MKO10036781_A_Olfr155
  gRNA
aaugagaccgccccccuguc

SEQ ID NO: 36782 - RNA, 20 nt, Artificial Sequence
  MKO10036782_A_Olfr155
  gRNA
auuagugauaccaccugccc

SEQ ID NO: 36783 - RNA, 20 nt, Artificial Sequence
  MKO10036783_A_Olfr155
  gRNA
ggucucauuggaucugucca

SEQ ID NO: 36784 - RNA, 20 nt, Artificial Sequence
  MKO10036784_A_Olfr156
  gRNA
cuccucgauucccuuagucc

SEQ ID NO: 36785 - RNA, 20 nt, Artificial Sequence
  MKO10036785_A_Olfr156
  gRNA
uucagcuaccguagacugau

SEQ ID NO: 36786 - RNA, 20 nt, Artificial Sequence
  MKO10036786_A_Olfr156
  gRNA
ggaaggagccaaucagucua

SEQ ID NO: 36787 - RNA, 20 nt, Artificial Sequence
  MKO10036787_A_Olfr157
  gRNA
gcucaucuugucaauguacc

SEQ ID NO: 36788 - RNA, 20 nt, Artificial Sequence
  MKO10036788_A_Olfr157
  gRNA
ugacaagaugagcacgaaga

SEQ ID NO: 36789 - RNA, 20 nt, Artificial Sequence
  MKO10036789_A_Olfr157
  gRNA
caaauucuguuacagucguc

SEQ ID NO: 36790 - RNA, 20 nt, Artificial Sequence
  MKO10036790_A_Olfr159
  gRNA
gaaggccgcugugacaaacc

SEQ ID NO: 36791 - RNA, 20 nt, Artificial Sequence
  MKO10036791_A_Olfr159
  gRNA
ugaggacgacauugcccagc

SEQ ID NO: 36792 - RNA, 20 nt, Artificial Sequence
  MKO10036792_A_Olfr159
  gRNA
ugggccagaaacacuucaag

SEQ ID NO: 36793 - RNA, 20 nt, Artificial Sequence
  MKO10036793_A_Olfr15
  gRNA
uucgacgucccuccacagag

SEQ ID NO: 36794 - RNA, 20 nt, Artificial Sequence
  MKO10036794_A_Olfr15
  gRNA
ucuuacuuguugacgcuggu

SEQ ID NO: 36795 - RNA, 20 nt, Artificial Sequence
  MKO10036795_A_Olfr15
  gRNA
caauacgugugucucccacu

SEQ ID NO: 36796 - RNA, 20 nt, Artificial Sequence
  MKO10036796_A_Olfr160
  gRNA
gucuaugccaugggacucau

SEQ ID NO: 36797 - RNA, 20 nt, Artificial Sequence
  MKO10036797_A_Olfr160
  gRNA
uuauguagauccccaggaag

SEQ ID NO: 36798 - RNA, 20 nt, Artificial Sequence
  MKO10036798_A_Olfr160
  gRNA
ccuucgcaucagcuccaaug

SEQ ID NO: 36799 - RNA, 20 nt, Artificial Sequence
  MKO10036799_A_Olfr161
  gRNA
aaucaagccauuucguucuc

SEQ ID NO: 36800 - RNA, 20 nt, Artificial Sequence
  MKO10036800_A_Olfr161
  gRNA
gugcaacagagcauucagac

SEQ ID NO: 36801 - RNA, 20 nt, Artificial Sequence
  MKO10036801_A_Olfr161
  gRNA
auccugaaaaucucauccac

SEQ ID NO: 36802 - RNA, 20 nt, Artificial Sequence
  MKO10036802_A_Olfr164
  gRNA
gaagcaauaaugauugcuac

SEQ ID NO: 36803 - RNA, 20 nt, Artificial Sequence
  MKO10036803_A_Olfr164
  gRNA
uguuccggagacuauaaaug

SEQ ID NO: 36804 - RNA, 20 nt, Artificial Sequence
  MKO10036804_A_Olfr164
  gRNA
cuguacuacaguaccccaaa

SEQ ID NO: 36805 - RNA, 20 nt, Artificial Sequence
  MKO10036805_A_Olfr165
  gRNA
caacaucgauuauaccauca

SEQ ID NO: 36806 - RNA, 20 nt, Artificial Sequence
  MKO10036806_A_Olfr165
  gRNA
cacuacaugaaauaguuagc

SEQ ID NO: 36807 - RNA, 20 nt, Artificial Sequence
  MKO10036807_A_Olfr165
  gRNA
uccgcaacaaagaaguagcc

SEQ ID NO: 36808 - RNA, 20 nt, Artificial Sequence
  MKO10036808_A_Olfr166
  gRNA
aaugguuacgguuuaguuga

SEQ ID NO: 36809 - RNA, 20 nt, Artificial Sequence
  MKO10036809_A_Olfr166
  gRNA
ccucagaacaugccauaguc

SEQ ID NO: 36810 - RNA, 20 nt, Artificial Sequence
  MKO10036810_A_Olfr166
  gRNA
agcaaaaaggacccgaccau

SEQ ID NO: 36811 - RNA, 20 nt, Artificial Sequence
  MKO10036811_A_Olfr167
  gRNA
gagggaucuugggcguagau

SEQ ID NO: 36812 - RNA, 20 nt, Artificial Sequence
  MKO10036812_A_Olfr167
  gRNA
uccccgcccuagaaugcaua

SEQ ID NO: 36813 - RNA, 20 nt, Artificial Sequence
  MKO10036813_A_Olfr167
  gRNA
cucuaccauugucccuaaaa

SEQ ID NO: 36814 - RNA, 20 nt, Artificial Sequence
  MKO10036814_A_Olfr168
  gRNA
agcaaaaaggacccuaccau

SEQ ID NO: 36815 - RNA, 20 nt, Artificial Sequence
  MKO10036815_A_Olfr168
  gRNA
ugaugagcaucauaaguagu

SEQ ID NO: 36816 - RNA, 20 nt, Artificial Sequence
  MKO10036816_A_Olfr168
  gRNA
ugucccaaggacucuuguca

SEQ ID NO: 36817 - RNA, 20 nt, Artificial Sequence
  MKO10036817_A_Olfr169
  gRNA
gccaaaaauuuauccugccc

SEQ ID NO: 36818 - RNA, 20 nt, Artificial Sequence
  MKO10036818_A_Olfr169
  gRNA
uaacagcgacuucauccucu

SEQ ID NO: 36819 - RNA, 20 nt, Artificial Sequence
  MKO10036819_A_Olfr169
  gRNA
auuacgaaagcuguagauua

SEQ ID NO: 36820 - RNA, 20 nt, Artificial Sequence
  MKO10036820_A_Olfr16
  gRNA
ugcgcagccugccaaggaua

SEQ ID NO: 36821 - RNA, 20 nt, Artificial Sequence
  MKO10036821_A_Olfr16
  gRNA
uuacaaccuucccauauccu

SEQ ID NO: 36822 - RNA, 20 nt, Artificial Sequence
  MKO10036822_A_Olfr16
  gRNA
agugauagaguucgucuucc

SEQ ID NO: 36823 - RNA, 20 nt, Artificial Sequence
  MKO10036823_A_Olfr170
  gRNA
guugaguuugggugucaaga

SEQ ID NO: 36824 - RNA, 20 nt, Artificial Sequence
  MKO10036824_A_Olfr170
  gRNA
gacacaacacacuaugagca

SEQ ID NO: 36825 - RNA, 20 nt, Artificial Sequence
  MKO10036825_A_Olfr170
  gRNA
uaguugucauaauguacuau

SEQ ID NO: 36826 - RNA, 20 nt, Artificial Sequence
  MKO10036826_A_Olfr171
  gRNA
uaacagcgacuucauccuuu

SEQ ID NO: 36827 - RNA, 20 nt, Artificial Sequence
  MKO10036827_A_Olfr171
  gRNA
uaguugucauaauguacuac

SEQ ID NO: 36828 - RNA, 20 nt, Artificial Sequence
  MKO10036828_A_Olfr171
  gRNA
aguuaagcuuaucuuugaag

SEQ ID NO: 36829 - RNA, 20 nt, Artificial Sequence
  MKO10036829_A_Olfr172
  gRNA
aggcucccgugaucaucuga

SEQ ID NO: 36830 - RNA, 20 nt, Artificial Sequence
  MKO10036830_A_Olfr172
  gRNA
caagcccauauucccuauca

SEQ ID NO: 36831 - RNA, 20 nt, Artificial Sequence
  MKO10036831_A_Olfr172
  gRNA
aaacaugaguuuauccucac

SEQ ID NO: 36832 - RNA, 20 nt, Artificial Sequence
  MKO10036832_A_Olfr173
  gRNA
aagcucccgucgucaucuga

SEQ ID NO: 36833 - RNA, 20 nt, Artificial Sequence
  MKO10036833_A_Olfr173
  gRNA
uaauacaagcucguugauau

SEQ ID NO: 36834 - RNA, 20 nt, Artificial Sequence
  MKO10036834_A_Olfr173
  gRNA
caaacucacguuucauggug

SEQ ID NO: 36835 - RNA, 20 nt, Artificial Sequence
  MKO10036835_A_Olfr175-ps1
  gRNA
cgaccaaguucuaucaacga

SEQ ID NO: 36836 - RNA, 20 nt, Artificial Sequence
  MKO10036836_A_Olfr175-ps1
  gRNA
uuuccuucguugauagaacu

SEQ ID NO: 36837 - RNA, 20 nt, Artificial Sequence
  MKO10036837_A_Olfr175-ps1
  gRNA
gauagaugguagauaacacc

SEQ ID NO: 36838 - RNA, 20 nt, Artificial Sequence
  MKO10036838_A_Olfr176
  gRNA
cgaccaaguucacuuaauga

SEQ ID NO: 36839 - RNA, 20 nt, Artificial Sequence
  MKO10036839_A_Olfr176
  gRNA
uacccuucauuaagugaacu

SEQ ID NO: 36840 - RNA, 20 nt, Artificial Sequence
  MKO10036840_A_Olfr176
  gRNA
gacugaggacaacuacuccu

SEQ ID NO: 36841 - RNA, 20 nt, Artificial Sequence
  MKO10036841_A_Olfr177
  gRNA
cgaccaaguucacuuaauga

SEQ ID NO: 36842 - RNA, 20 nt, Artificial Sequence
  MKO10036842_A_Olfr177
  gRNA
uacccuucauuaagugaacu

SEQ ID NO: 36843 - RNA, 20 nt, Artificial Sequence
  MKO10036843_A_Olfr177
  gRNA
gacugaggacaacuacuccu

SEQ ID NO: 36844 - RNA, 20 nt, Artificial Sequence
  MKO10036844_A_Olfr178
  gRNA
ucccaccaggaugaauugug

SEQ ID NO: 36845 - RNA, 20 nt, Artificial Sequence
  MKO10036845_A_Olfr178
  gRNA
gagacacccuacaugaagaa

SEQ ID NO: 36846 - RNA, 20 nt, Artificial Sequence
  MKO10036846_A_Olfr178
  gRNA
ucuaauauacaugagaagac

SEQ ID NO: 36847 - RNA, 20 nt, Artificial Sequence
  MKO10036847_A_Olfr17
  gRNA
gaucuucggcucaugauuau

SEQ ID NO: 36848 - RNA, 20 nt, Artificial Sequence
  MKO10036848_A_Olfr17
  gRNA
ugauacaucccuauuugaac

SEQ ID NO: 36849 - RNA, 20 nt, Artificial Sequence
  MKO10036849_A_Olfr17
  gRNA
agcguggccggaaguaugug

SEQ ID NO: 36850 - RNA, 20 nt, Artificial Sequence
  MKO10036850_A_Olfr180
  gRNA
ucuuuauuaccuucgucaaa

SEQ ID NO: 36851 - RNA, 20 nt, Artificial Sequence
  MKO10036851_A_Olfr180
  gRNA
uauauuagaccauuugacga

SEQ ID NO: 36852 - RNA, 20 nt, Artificial Sequence
  MKO10036852_A_Olfr180
  gRNA
gagacacccuacaugaauca

SEQ ID NO: 36853 - RNA, 20 nt, Artificial Sequence
  MKO10036853_A_Olfr181
  gRNA
auuguauaaaauacaccuac

SEQ ID NO: 36854 - RNA, 20 nt, Artificial Sequence
  MKO10036854_A_Olfr181
  gRNA
cugcauuccuugauacauac

SEQ ID NO: 36855 - RNA, 20 nt, Artificial Sequence
  MKO10036855_A_Olfr181
  gRNA
uguacaggagaguuuauaca

SEQ ID NO: 36856 - RNA, 20 nt, Artificial Sequence
  MKO10036856_A_Olfr183
  gRNA
uaggcgaacacauaaucuau

SEQ ID NO: 36857 - RNA, 20 nt, Artificial Sequence
  MKO10036857_A_Olfr183
  gRNA
cuauuagccuuaucauuuau

SEQ ID NO: 36858 - RNA, 20 nt, Artificial Sequence
  MKO10036858_A_Olfr183
  gRNA
gcuauuuaaucucuuggaca

SEQ ID NO: 36859 - RNA, 20 nt, Artificial Sequence
  MKO10036859_A_Olfr186
  gRNA
agucacugcggaugauaucc

SEQ ID NO: 36860 - RNA, 20 nt, Artificial Sequence
  MKO10036860_A_Olfr186
  gRNA
agucuauuggucauaauaac

SEQ ID NO: 36861 - RNA, 20 nt, Artificial Sequence
  MKO10036861_A_Olfr186
  gRNA
auuaagaguaggaucaguac

SEQ ID NO: 36862 - RNA, 20 nt, Artificial Sequence
  MKO10036862_A_Olfr187
  gRNA
cauaguauaaagacacggau

SEQ ID NO: 36863 - RNA, 20 nt, Artificial Sequence
  MKO10036863_A_Olfr187
  gRNA
uacccaguaguuaugaccaa

SEQ ID NO: 36864 - RNA, 20 nt, Artificial Sequence
  MKO10036864_A_Olfr187
  gRNA
uaagcaaguuauagauucac

SEQ ID NO: 36865 - RNA, 20 nt, Artificial Sequence
  MKO10036865_A_Olfr18
  gRNA
auuaugaacccucgucuuug

SEQ ID NO: 36866 - RNA, 20 nt, Artificial Sequence
  MKO10036866_A_Olfr18
  gRNA
accaacaagccacaaagacg

SEQ ID NO: 36867 - RNA, 20 nt, Artificial Sequence
  MKO10036867_A_Olfr18
  gRNA
ucuaugcugaugcaugauga

SEQ ID NO: 36868 - RNA, 20 nt, Artificial Sequence
  MKO10036868_A_Olfr190
  gRNA
cgucaauagcacuaguguau

SEQ ID NO: 36869 - RNA, 20 nt, Artificial Sequence
  MKO10036869_A_Olfr190
  gRNA
caagaacaaucacaacggug

SEQ ID NO: 36870 - RNA, 20 nt, Artificial Sequence
  MKO10036870_A_Olfr190
  gRNA
aucuaucucauuacuauugu

SEQ ID NO: 36871 - RNA, 20 nt, Artificial Sequence
  MKO10036871_A_Olfr191
  gRNA
auuuguagugagugcaacca

SEQ ID NO: 36872 - RNA, 20 nt, Artificial Sequence
  MKO10036872_A_Olfr191
  gRNA
auucaugcuuuaauucacga

SEQ ID NO: 36873 - RNA, 20 nt, Artificial Sequence
  MKO10036873_A_Olfr191
  gRNA
augaaugaauccaccuaaaa

SEQ ID NO: 36874 - RNA, 20 nt, Artificial Sequence
  MKO10036874_A_Olfr192
  gRNA
ugcuguuuacaauucugcaa

SEQ ID NO: 36875 - RNA, 20 nt, Artificial Sequence
  MKO10036875_A_Olfr192
  gRNA
gucuguccaagguaugaaga

SEQ ID NO: 36876 - RNA, 20 nt, Artificial Sequence
  MKO10036876_A_Olfr192
  gRNA
cacagggucuucagagcuac

SEQ ID NO: 36877 - RNA, 20 nt, Artificial Sequence
  MKO10036877_A_Olfr193
  gRNA
acccaauuaucuauaguuug

SEQ ID NO: 36878 - RNA, 20 nt, Artificial Sequence
  MKO10036878_A_Olfr193
  gRNA
ugccaaaagaaaacauuccg

SEQ ID NO: 36879 - RNA, 20 nt, Artificial Sequence
  MKO10036879_A_Olfr193
  gRNA
gcauaacaucacaauaaaag

SEQ ID NO: 36880 - RNA, 20 nt, Artificial Sequence
  MKO10036880_A_Olfr194
  gRNA
guguguacuugccugauaag

SEQ ID NO: 36881 - RNA, 20 nt, Artificial Sequence
  MKO10036881_A_Olfr194
  gRNA
aauaaaccuacaugaauaag

SEQ ID NO: 36882 - RNA, 20 nt, Artificial Sequence
  MKO10036882_A_Olfr194
  gRNA
ugagaacaaaaucagacacc

SEQ ID NO: 36883 - RNA, 20 nt, Artificial Sequence
  MKO10036883_A_Olfr195
  gRNA
ugaacugauauuacuugucu

SEQ ID NO: 36884 - RNA, 20 nt, Artificial Sequence
  MKO10036884_A_Olfr195
  gRNA
ggaguaagacacuagaacua

SEQ ID NO: 36885 - RNA, 20 nt, Artificial Sequence
  MKO10036885_A_Olfr195
  gRNA
aaaagcccuacuucaaucau

SEQ ID NO: 36886 - RNA, 20 nt, Artificial Sequence
  MKO10036886_A_Olfr196
  gRNA
auaucuugaucgucuacuug

SEQ ID NO: 36887 - RNA, 20 nt, Artificial Sequence
  MKO10036887_A_Olfr196
  gRNA
aguagacgaucaagauauga

SEQ ID NO: 36888 - RNA, 20 nt, Artificial Sequence
  MKO10036888_A_Olfr196
  gRNA
gaaagagaucaguuugcucu

SEQ ID NO: 36889 - RNA, 20 nt, Artificial Sequence
  MKO10036889_A_Olfr197
  gRNA
auuaagagaagggucgguac

SEQ ID NO: 36890 - RNA, 20 nt, Artificial Sequence
  MKO10036890_A_Olfr197
  gRNA
uacauggguauuugaaggcg

SEQ ID NO: 36891 - RNA, 20 nt, Artificial Sequence
  MKO10036891_A_Olfr197
  gRNA
uccugcaucccaaaaagcac

SEQ ID NO: 36892 - RNA, 20 nt, Artificial Sequence
  MKO10036892_A_Olfr198
  gRNA
guucauuguaggaucagugc

SEQ ID NO: 36893 - RNA, 20 nt, Artificial Sequence
  MKO10036893_A_Olfr198
  gRNA
aucuucaccugauccagacc

SEQ ID NO: 36894 - RNA, 20 nt, Artificial Sequence
  MKO10036894_A_Olfr198
  gRNA
uuccucauguaugugcgucc

SEQ ID NO: 36895 - RNA, 20 nt, Artificial Sequence
  MKO10036895_A_Olfr199
  gRNA
caccgaccaucccaaguuaa

SEQ ID NO: 36896 - RNA, 20 nt, Artificial Sequence
  MKO10036896_A_Olfr199
  gRNA
cuucacauuuguaaccgucu

SEQ ID NO: 36897 - RNA, 20 nt, Artificial Sequence
  MKO10036897_A_Olfr199
  gRNA
agcaccaaguaaguaugcca

SEQ ID NO: 36898 - RNA, 20 nt, Artificial Sequence
  MKO10036898_A_Olfr19
  gRNA
ugaugaugagauugcacgua

SEQ ID NO: 36899 - RNA, 20 nt, Artificial Sequence
  MKO10036899_A_Olfr19
  gRNA
cugucacccucugcacuaua

SEQ ID NO: 36900 - RNA, 20 nt, Artificial Sequence
  MKO10036900_A_Olfr19
  gRNA
gaggauccucugaaauuccc

SEQ ID NO: 36901 - RNA, 20 nt, Artificial Sequence
  MKO10036901_A_Olfr1
  gRNA
caaccugcauagggaaucga

SEQ ID NO: 36902 - RNA, 20 nt, Artificial Sequence
  MKO10036902_A_Olfr1
  gRNA
cugguggaauggguaggccc

SEQ ID NO: 36903 - RNA, 20 nt, Artificial Sequence
  MKO10036903_A_Olfr1
  gRNA
ggaagacacaauucuuacau

SEQ ID NO: 36904 - RNA, 20 nt, Artificial Sequence
  MKO10036904_A_Olfr201
  gRNA
caccgaccaucccacgcuaa

SEQ ID NO: 36905 - RNA, 20 nt, Artificial Sequence
  MKO10036905_A_Olfr201
  gRNA
ggcagaaggaaaccgcacuc

SEQ ID NO: 36906 - RNA, 20 nt, Artificial Sequence
  MKO10036906_A_Olfr201
  gRNA
agucuauuagacaucaacac

SEQ ID NO: 36907 - RNA, 20 nt, Artificial Sequence
  MKO10036907_A_Olfr202
  gRNA
uaauuagauuaacguucugc

SEQ ID NO: 36908 - RNA, 20 nt, Artificial Sequence
  MKO10036908_A_Olfr202
  gRNA
acaucaccaccggauaaagg

SEQ ID NO: 36909 - RNA, 20 nt, Artificial Sequence
  MKO10036909_A_Olfr202
  gRNA
ucugaauucaacaauucacg

SEQ ID NO: 36910 - RNA, 20 nt, Artificial Sequence
  MKO10036910_A_Olfr203
  gRNA
ugagaauaaacgcagucacc

SEQ ID NO: 36911 - RNA, 20 nt, Artificial Sequence
  MKO10036911_A_Olfr203
  gRNA
gugauguuauggaggugaac

SEQ ID NO: 36912 - RNA, 20 nt, Artificial Sequence
  MKO10036912_A_Olfr203
  gRNA
aguagaccuacaugaauaag

SEQ ID NO: 36913 - RNA, 20 nt, Artificial Sequence
  MKO10036913_A_Olfr204
  gRNA
gugcaagaaaucgcauagag

SEQ ID NO: 36914 - RNA, 20 nt, Artificial Sequence
  MKO10036914_A_Olfr204
  gRNA
gccaccaauccauuaagaga

SEQ ID NO: 36915 - RNA, 20 nt, Artificial Sequence
  MKO10036915_A_Olfr204
  gRNA
auaagaaugacauaauaucc

SEQ ID NO: 36916 - RNA, 20 nt, Artificial Sequence
  MKO10036916_A_Olfr205
  gRNA
uuaugcccguguccuauuug

SEQ ID NO: 36917 - RNA, 20 nt, Artificial Sequence
  MKO10036917_A_Olfr205
  gRNA
cuucaucuaugucaucacua

SEQ ID NO: 36918 - RNA, 20 nt, Artificial Sequence
  MKO10036918_A_Olfr205
  gRNA
gugcaagaaauuguguagag

SEQ ID NO: 36919 - RNA, 20 nt, Artificial Sequence
  MKO10036919_A_Olfr206
  gRNA
agauccaucucuuaacacau

SEQ ID NO: 36920 - RNA, 20 nt, Artificial Sequence
  MKO10036920_A_Olfr206
  gRNA
acgaccaauguguuaagaga

SEQ ID NO: 36921 - RNA, 20 nt, Artificial Sequence
  MKO10036921_A_Olfr206
  gRNA
guuuacaaaaccaauuauau

SEQ ID NO: 36922 - RNA, 20 nt, Artificial Sequence
  MKO10036922_A_Olfr207
  gRNA
ugacccaucuaucaauguac

SEQ ID NO: 36923 - RNA, 20 nt, Artificial Sequence
  MKO10036923_A_Olfr207
  gRNA
gcuaccaguacauugauaga

SEQ ID NO: 36924 - RNA, 20 nt, Artificial Sequence
  MKO10036924_A_Olfr207
  gRNA
uaucuaauuggacuucuaca

SEQ ID NO: 36925 - RNA, 20 nt, Artificial Sequence
  MKO10036925_A_Olfr208
  gRNA
ugacccaucuaucaauguac

SEQ ID NO: 36926 - RNA, 20 nt, Artificial Sequence
  MKO10036926_A_Olfr208
  gRNA
gcuaccaguacauugauaga

SEQ ID NO: 36927 - RNA, 20 nt, Artificial Sequence
  MKO10036927_A_Olfr208
  gRNA
uaucuaauuggacuucuaca

SEQ ID NO: 36928 - RNA, 20 nt, Artificial Sequence
  MKO10036928_A_Olfr209
  gRNA
ugacccaucuaucaauguac

SEQ ID NO: 36929 - RNA, 20 nt, Artificial Sequence
  MKO10036929_A_Olfr209
  gRNA
gcuaccaguacauugauaga

SEQ ID NO: 36930 - RNA, 20 nt, Artificial Sequence
  MKO10036930_A_Olfr209
  gRNA
uaucuaauuggacuucuaca

SEQ ID NO: 36931 - RNA, 20 nt, Artificial Sequence
  MKO10036931_A_Olfr20
  gRNA
auaucaccaauucauuaacg

SEQ ID NO: 36932 - RNA, 20 nt, Artificial Sequence
  MKO10036932_A_Olfr20
  gRNA
ugacacccacguuaaugaau

SEQ ID NO: 36933 - RNA, 20 nt, Artificial Sequence
  MKO10036933_A_Olfr20
  gRNA
cgguggugagguacaugagc

SEQ ID NO: 36934 - RNA, 20 nt, Artificial Sequence
  MKO10036934_A_Olfr211
  gRNA
gaugaagccguaugacacaa

SEQ ID NO: 36935 - RNA, 20 nt, Artificial Sequence
  MKO10036935_A_Olfr211
  gRNA
ggucguaggccaugacagug

SEQ ID NO: 36936 - RNA, 20 nt, Artificial Sequence
  MKO10036936_A_Olfr211
  gRNA
ucuuugacaccagaccccuc

SEQ ID NO: 36937 - RNA, 20 nt, Artificial Sequence
  MKO10036937_A_Olfr212
  gRNA
aaauagcaucucaaccgacc

SEQ ID NO: 36938 - RNA, 20 nt, Artificial Sequence
  MKO10036938_A_Olfr212
  gRNA
cugcaaucggugguccaagc

SEQ ID NO: 36939 - RNA, 20 nt, Artificial Sequence
  MKO10036939_A_Olfr212
  gRNA
aucucucauguuuagauacc

SEQ ID NO: 36940 - RNA, 20 nt, Artificial Sequence
  MKO10036940_A_Olfr213
  gRNA
cugcaaucggugguccacgc

SEQ ID NO: 36941 - RNA, 20 nt, Artificial Sequence
  MKO10036941_A_Olfr213
  gRNA
uucaauuacccagauaucac

SEQ ID NO: 36942 - RNA, 20 nt, Artificial Sequence
  MKO10036942_A_Olfr213
  gRNA
aguaggccagcaaaugcauc

SEQ ID NO: 36943 - RNA, 20 nt, Artificial Sequence
  MKO10036943_A_Olfr214
  gRNA
gcgaggaucggaccacguga

SEQ ID NO: 36944 - RNA, 20 nt, Artificial Sequence
  MKO10036944_A_Olfr214
  gRNA
agaggccgcucucguaaaca

SEQ ID NO: 36945 - RNA, 20 nt, Artificial Sequence
  MKO10036945_A_Olfr214
  gRNA
cacuaccguguuuacgagag

SEQ ID NO: 36946 - RNA, 20 nt, Artificial Sequence
  MKO10036946_A_Olfr215
  gRNA
guaucacgguuauccuucug

SEQ ID NO: 36947 - RNA, 20 nt, Artificial Sequence
  MKO10036947_A_Olfr215
  gRNA
ucacuacuagccacgugauc

SEQ ID NO: 36948 - RNA, 20 nt, Artificial Sequence
  MKO10036948_A_Olfr215
  gRNA
acggguacuggugcagauga

SEQ ID NO: 36949 - RNA, 20 nt, Artificial Sequence
  MKO10036949_A_Olfr218
  gRNA
auuauuccacgaaugcuagc

SEQ ID NO: 36950 - RNA, 20 nt, Artificial Sequence
  MKO10036950_A_Olfr218
  gRNA
aggaggccagcuagcauucg

SEQ ID NO: 36951 - RNA, 20 nt, Artificial Sequence
  MKO10036951_A_Olfr218
  gRNA
cauugugacaauuauucguc

SEQ ID NO: 36952 - RNA, 20 nt, Artificial Sequence
  MKO10036952_A_Olfr220
  gRNA
auagcucgacugcgcuacug

SEQ ID NO: 36953 - RNA, 20 nt, Artificial Sequence
  MKO10036953_A_Olfr220
  gRNA
auaauaacaggguagcguag

SEQ ID NO: 36954 - RNA, 20 nt, Artificial Sequence
  MKO10036954_A_Olfr220
  gRNA
caguugcccaucacugcgua

SEQ ID NO: 36955 - RNA, 20 nt, Artificial Sequence
  MKO10036955_A_Olfr221
  gRNA
gagacacuauggucggauag

SEQ ID NO: 36956 - RNA, 20 nt, Artificial Sequence
  MKO10036956_A_Olfr221
  gRNA
agcaaugagauagcacucgc

SEQ ID NO: 36957 - RNA, 20 nt, Artificial Sequence
  MKO10036957_A_Olfr221
  gRNA
aacuaaccugagccacgaga

SEQ ID NO: 36958 - RNA, 20 nt, Artificial Sequence
  MKO10036958_A_Olfr222
  gRNA
cugcaccgagugcguugucu

SEQ ID NO: 36959 - RNA, 20 nt, Artificial Sequence
  MKO10036959_A_Olfr222
  gRNA
ggccgccaagacaacgcacu

SEQ ID NO: 36960 - RNA, 20 nt, Artificial Sequence
  MKO10036960_A_Olfr222
  gRNA
ugcccgagcaaugaagccgu

SEQ ID NO: 36961 - RNA, 20 nt, Artificial Sequence
  MKO10036961_A_Olfr223
  gRNA
uggagguacguguacauacc

SEQ ID NO: 36962 - RNA, 20 nt, Artificial Sequence
  MKO10036962_A_Olfr223
  gRNA
gcccaccagaacaaaugugu

SEQ ID NO: 36963 - RNA, 20 nt, Artificial Sequence
  MKO10036963_A_Olfr223
  gRNA
augcacuucucacuugcucg

SEQ ID NO: 36964 - RNA, 20 nt, Artificial Sequence
  MKO10036964_A_Olfr224
  gRNA
uccaacagguugauaucagg

SEQ ID NO: 36965 - RNA, 20 nt, Artificial Sequence
  MKO10036965_A_Olfr224
  gRNA
ugaagccauccaaugauccu

SEQ ID NO: 36966 - RNA, 20 nt, Artificial Sequence
  MKO10036966_A_Olfr224
  gRNA
auguucuuauacaugucacu

SEQ ID NO: 36967 - RNA, 20 nt, Artificial Sequence
  MKO10036967_A_Olfr225
  gRNA
gucuacagcuagucggcgca

SEQ ID NO: 36968 - RNA, 20 nt, Artificial Sequence
  MKO10036968_A_Olfr225
  gRNA
uagaaaccugcucgacccgc

SEQ ID NO: 36969 - RNA, 20 nt, Artificial Sequence
  MKO10036969_A_Olfr225
  gRNA
acauugcugccgccguccug

SEQ ID NO: 36970 - RNA, 20 nt, Artificial Sequence
  MKO10036970_A_Olfr228
  gRNA
acauauugaagaaaguuaac

SEQ ID NO: 36971 - RNA, 20 nt, Artificial Sequence
  MKO10036971_A_Olfr228
  gRNA
gauuuaacauggggauuauu

SEQ ID NO: 36972 - RNA, 20 nt, Artificial Sequence
  MKO10036972_A_Olfr228
  gRNA
ugacuccuuaaaaacugaca

SEQ ID NO: 36973 - RNA, 20 nt, Artificial Sequence
  MKO10036973_A_Olfr229
  gRNA
gccaucaucaguaaguucga

SEQ ID NO: 36974 - RNA, 20 nt, Artificial Sequence
  MKO10036974_A_Olfr229
  gRNA
caccgugggaguuuacaguu

SEQ ID NO: 36975 - RNA, 20 nt, Artificial Sequence
  MKO10036975_A_Olfr229
  gRNA
ggggacuggaaaccauucaa

SEQ ID NO: 36976 - RNA, 20 nt, Artificial Sequence
  MKO10036976_A_Olfr231
  gRNA
caccagcgauguauccguac

SEQ ID NO: 36977 - RNA, 20 nt, Artificial Sequence
  MKO10036977_A_Olfr231
  gRNA
cuguacggauacaucgcugg

SEQ ID NO: 36978 - RNA, 20 nt, Artificial Sequence
  MKO10036978_A_Olfr231
  gRNA
guccuauauccgaaucauca

SEQ ID NO: 36979 - RNA, 20 nt, Artificial Sequence
  MKO10036979_A_Olfr235
  gRNA
ggaucgcaaauagacaaaga

SEQ ID NO: 36980 - RNA, 20 nt, Artificial Sequence
  MKO10036980_A_Olfr235
  gRNA
ugcaaaucugucaaaacuag

SEQ ID NO: 36981 - RNA, 20 nt, Artificial Sequence
  MKO10036981_A_Olfr235
  gRNA
agcuacacagcuggacucac

SEQ ID NO: 36982 - RNA, 20 nt, Artificial Sequence
  MKO10036982_A_Olfr237-ps1
  gRNA
caucuuuggaauaaucugcc

SEQ ID NO: 36983 - RNA, 20 nt, Artificial Sequence
  MKO10036983_A_Olfr237-ps1
  gRNA
cagaagaaagcuaaauaucc

SEQ ID NO: 36984 - RNA, 20 nt, Artificial Sequence
  MKO10036984_A_Olfr237-ps1
  gRNA
gauacaagaauguuugcauu

SEQ ID NO: 36985 - RNA, 20 nt, Artificial Sequence
  MKO10036985_A_Olfr239
  gRNA
uuccuuucuacuaaccguca

SEQ ID NO: 36986 - RNA, 20 nt, Artificial Sequence
  MKO10036986_A_Olfr239
  gRNA
uuaccaggcaggcacaacca

SEQ ID NO: 36987 - RNA, 20 nt, Artificial Sequence
  MKO10036987_A_Olfr239
  gRNA
gaacaugacaagcaaaaugg

SEQ ID NO: 36988 - RNA, 20 nt, Artificial Sequence
  MKO10036988_A_Olfr23
  gRNA
acacaauguugucagugccc

SEQ ID NO: 36989 - RNA, 20 nt, Artificial Sequence
  MKO10036989_A_Olfr23
  gRNA
ugaaccgggagaugacaguu

SEQ ID NO: 36990 - RNA, 20 nt, Artificial Sequence
  MKO10036990_A_Olfr23
  gRNA
cccaaaccucugugugagua

SEQ ID NO: 36991 - RNA, 20 nt, Artificial Sequence
  MKO10036991_A_Olfr242
  gRNA
uucaaugauaaacguauuag

SEQ ID NO: 36992 - RNA, 20 nt, Artificial Sequence
  MKO10036992_A_Olfr242
  gRNA
cucuacuucuuccucauauu

SEQ ID NO: 36993 - RNA, 20 nt, Artificial Sequence
  MKO10036993_A_Olfr242
  gRNA
cugggcaugaucacacuaau

SEQ ID NO: 36994 - RNA, 20 nt, Artificial Sequence
  MKO10036994_A_Olfr243
  gRNA
acauuccaauguauugaguc

SEQ ID NO: 36995 - RNA, 20 nt, Artificial Sequence
  MKO10036995_A_Olfr243
  gRNA
agaugccugacucaauacau

SEQ ID NO: 36996 - RNA, 20 nt, Artificial Sequence
  MKO10036996_A_Olfr243
  gRNA
cuguugcuccaagcauugcu

SEQ ID NO: 36997 - RNA, 20 nt, Artificial Sequence
  MKO10036997_A_Olfr247
  gRNA
aacucugagcucaugaagaa

SEQ ID NO: 36998 - RNA, 20 nt, Artificial Sequence
  MKO10036998_A_Olfr247
  gRNA
gauguauguauucaccaucu

SEQ ID NO: 36999 - RNA, 20 nt, Artificial Sequence
  MKO10036999_A_Olfr247
  gRNA
gcugacagaguguugccuuc

SEQ ID NO: 37000 - RNA, 20 nt, Artificial Sequence
  MKO10037000_A_Olfr248
  gRNA
ucucaagaccccuucagccg

SEQ ID NO: 37001 - RNA, 20 nt, Artificial Sequence
  MKO10037001_A_Olfr248
  gRNA
gacaaccgcauuucagacau

SEQ ID NO: 37002 - RNA, 20 nt, Artificial Sequence
  MKO10037002_A_Olfr248
  gRNA
acaacauguggccacugcuu

SEQ ID NO: 37003 - RNA, 20 nt, Artificial Sequence
  MKO10037003_A_Olfr24
  gRNA
ggccacgaugauucgagcau

SEQ ID NO: 37004 - RNA, 20 nt, Artificial Sequence
  MKO10037004_A_Olfr24
  gRNA
cuccuaugcucgaaucaucg

SEQ ID NO: 37005 - RNA, 20 nt, Artificial Sequence
  MKO10037005_A_Olfr24
  gRNA
uacaucugggucagacaaca

SEQ ID NO: 37006 - RNA, 20 nt, Artificial Sequence
  MKO10037006_A_Olfr250
  gRNA
guugacaugacugcuaccac

SEQ ID NO: 37007 - RNA, 20 nt, Artificial Sequence
  MKO10037007_A_Olfr250
  gRNA
uacaacauaagcacuucccu

SEQ ID NO: 37008 - RNA, 20 nt, Artificial Sequence
  MKO10037008_A_Olfr250
  gRNA
agugugcagcaagcauuaac

SEQ ID NO: 37009 - RNA, 20 nt, Artificial Sequence
  MKO10037009_A_Olfr251
  gRNA
gcucacaagcucguugacau

SEQ ID NO: 37010 - RNA, 20 nt, Artificial Sequence
  MKO10037010_A_Olfr251
  gRNA
gcaauccagacccauaaaag

SEQ ID NO: 37011 - RNA, 20 nt, Artificial Sequence
  MKO10037011_A_Olfr251
  gRNA
cagaacaccauauccuauga

SEQ ID NO: 37012 - RNA, 20 nt, Artificial Sequence
  MKO10037012_A_Olfr257
  gRNA
aggugggcaugacguagcgc

SEQ ID NO: 37013 - RNA, 20 nt, Artificial Sequence
  MKO10037013_A_Olfr257
  gRNA
accauagugacguuguacuu

SEQ ID NO: 37014 - RNA, 20 nt, Artificial Sequence
  MKO10037014_A_Olfr257
  gRNA
cauaagaacauaccacgaga

SEQ ID NO: 37015 - RNA, 20 nt, Artificial Sequence
  MKO10037015_A_Olfr259
  gRNA
uaucagaacacaagucuacg

SEQ ID NO: 37016 - RNA, 20 nt, Artificial Sequence
  MKO10037016_A_Olfr259
  gRNA
gccaaguucucaauacucca

SEQ ID NO: 37017 - RNA, 20 nt, Artificial Sequence
  MKO10037017_A_Olfr259
  gRNA
agacaggaguauuacuucug

SEQ ID NO: 37018 - RNA, 20 nt, Artificial Sequence
  MKO10037018_A_Olfr25
  gRNA
uguuacugcaggagauccga

SEQ ID NO: 37019 - RNA, 20 nt, Artificial Sequence
  MKO10037019_A_Olfr25
  gRNA
gcugaaccauacuguuauag

SEQ ID NO: 37020 - RNA, 20 nt, Artificial Sequence
  MKO10037020_A_Olfr25
  gRNA
uacccaccacuauaacagua

SEQ ID NO: 37021 - RNA, 20 nt, Artificial Sequence
  MKO10037021_A_Olfr262
  gRNA
acaccagggaaaugauugcc

SEQ ID NO: 37022 - RNA, 20 nt, Artificial Sequence
  MKO10037022_A_Olfr262
  gRNA
ugacauuaguuccacaaaaa

SEQ ID NO: 37023 - RNA, 20 nt, Artificial Sequence
  MKO10037023_A_Olfr262
  gRNA
gaaaaagacaaucugcaacu

SEQ ID NO: 37024 - RNA, 20 nt, Artificial Sequence
  MKO10037024_A_Olfr263
  gRNA
accacagauuugccgaagua

SEQ ID NO: 37025 - RNA, 20 nt, Artificial Sequence
  MKO10037025_A_Olfr263
  gRNA
aucaucuugacgcauagacg

SEQ ID NO: 37026 - RNA, 20 nt, Artificial Sequence
  MKO10037026_A_Olfr263
  gRNA
aucuacauguaucuacaacc

SEQ ID NO: 37027 - RNA, 20 nt, Artificial Sequence
  MKO10037027_A_Olfr266
  gRNA
ucuucccaauauuuacgcaa

SEQ ID NO: 37028 - RNA, 20 nt, Artificial Sequence
  MKO10037028_A_Olfr266
  gRNA
agaaaccuuugcguaaauau

SEQ ID NO: 37029 - RNA, 20 nt, Artificial Sequence
  MKO10037029_A_Olfr266
  gRNA
cucugcuuuagguuggcuau

SEQ ID NO: 37030 - RNA, 20 nt, Artificial Sequence
  MKO10037030_A_Olfr267
  gRNA
guccacagaguguauacuuc

SEQ ID NO: 37031 - RNA, 20 nt, Artificial Sequence
  MKO10037031_A_Olfr267
  gRNA
agaugcaaugauaaaacugc

SEQ ID NO: 37032 - RNA, 20 nt, Artificial Sequence
  MKO10037032_A_Olfr267
  gRNA
agauaagaguacaguuaccc

SEQ ID NO: 37033 - RNA, 20 nt, Artificial Sequence
  MKO10037033_A_Olfr26
  gRNA
ugaacccuccaauaauaaau

SEQ ID NO: 37034 - RNA, 20 nt, Artificial Sequence
  MKO10037034_A_Olfr26
  gRNA
cucuugcuccagagaguuac

SEQ ID NO: 37035 - RNA, 20 nt, Artificial Sequence
  MKO10037035_A_Olfr26
  gRNA
aacagcuagaguaggcacca

SEQ ID NO: 37036 - RNA, 20 nt, Artificial Sequence
  MKO10037036_A_Olfr270
  gRNA
cuacaaaugguuaucucccu

SEQ ID NO: 37037 - RNA, 20 nt, Artificial Sequence
  MKO10037037_A_Olfr270
  gRNA
ggauuaucaaguacaugaug

SEQ ID NO: 37038 - RNA, 20 nt, Artificial Sequence
  MKO10037038_A_Olfr270
  gRNA
cuguucagcccaccuaaccg

SEQ ID NO: 37039 - RNA, 20 nt, Artificial Sequence
  MKO10037039_A_Olfr272
  gRNA
ccagaauuucgcagacgaag

SEQ ID NO: 37040 - RNA, 20 nt, Artificial Sequence
  MKO10037040_A_Olfr272
  gRNA
cccaagucuaaagacaccgc

SEQ ID NO: 37041 - RNA, 20 nt, Artificial Sequence
  MKO10037041_A_Olfr272
  gRNA
cccagcggugucuuuagacu

SEQ ID NO: 37042 - RNA, 20 nt, Artificial Sequence
  MKO10037042_A_Olfr273
  gRNA
cccagucagaucuugagauu

SEQ ID NO: 37043 - RNA, 20 nt, Artificial Sequence
  MKO10037043_A_Olfr273
  gRNA
auguaucuagugauucuaac

SEQ ID NO: 37044 - RNA, 20 nt, Artificial Sequence
  MKO10037044_A_Olfr273
  gRNA
cauaucaaauauggccuucc

SEQ ID NO: 37045 - RNA, 20 nt, Artificial Sequence
  MKO10037045_A_Olfr275
  gRNA
gauguaucugaucaccuugc

SEQ ID NO: 37046 - RNA, 20 nt, Artificial Sequence
  MKO10037046_A_Olfr275
  gRNA
gauaucccauuauuaugaac

SEQ ID NO: 37047 - RNA, 20 nt, Artificial Sequence
  MKO10037047_A_Olfr275
  gRNA
gaaacaaaguuugccagcau

SEQ ID NO: 37048 - RNA, 20 nt, Artificial Sequence
  MKO10037048_A_Olfr279
  gRNA
cguaggacgcgacgaucaac

SEQ ID NO: 37049 - RNA, 20 nt, Artificial Sequence
  MKO10037049_A_Olfr279
  gRNA
acacauccaacaucgugccu

SEQ ID NO: 37050 - RNA, 20 nt, Artificial Sequence
  MKO10037050_A_Olfr279
  gRNA
uguguggaggguccgacugg

SEQ ID NO: 37051 - RNA, 20 nt, Artificial Sequence
  MKO10037051_A_Olfr27
  gRNA
uucaaugauaaacguauuag

SEQ ID NO: 37052 - RNA, 20 nt, Artificial Sequence
  MKO10037052_A_Olfr27
  gRNA
cucuacuucuuccucauauu

SEQ ID NO: 37053 - RNA, 20 nt, Artificial Sequence
  MKO10037053_A_Olfr27
  gRNA
cugggcaugaucacacuaau

SEQ ID NO: 37054 - RNA, 20 nt, Artificial Sequence
  MKO10037054_A_Olfr281
  gRNA
agggaagugccugcgauacu

SEQ ID NO: 37055 - RNA, 20 nt, Artificial Sequence
  MKO10037055_A_Olfr281
  gRNA
cgugacugcgcuguacugca

SEQ ID NO: 37056 - RNA, 20 nt, Artificial Sequence
  MKO10037056_A_Olfr281
  gRNA
gcagucacuccaaguaucgc

SEQ ID NO: 37057 - RNA, 20 nt, Artificial Sequence
  MKO10037057_A_Olfr282
  gRNA
cacgauaccgaaacugcuga

SEQ ID NO: 37058 - RNA, 20 nt, Artificial Sequence
  MKO10037058_A_Olfr282
  gRNA
cagcaguuucgguaucguga

SEQ ID NO: 37059 - RNA, 20 nt, Artificial Sequence
  MKO10037059_A_Olfr282
  gRNA
cgcaaccaucaucgugcucu

SEQ ID NO: 37060 - RNA, 20 nt, Artificial Sequence
  MKO10037060_A_Olfr283
  gRNA
gaucagcucuugagucgauc

SEQ ID NO: 37061 - RNA, 20 nt, Artificial Sequence
  MKO10037061_A_Olfr283
  gRNA
uaaacucggggaccgugcug

SEQ ID NO: 37062 - RNA, 20 nt, Artificial Sequence
  MKO10037062_A_Olfr283
  gRNA
uccccgaguuuauccugcuu

SEQ ID NO: 37063 - RNA, 20 nt, Artificial Sequence
  MKO10037063_A_Olfr284
  gRNA
gccuucuucgucuucgccac

SEQ ID NO: 37064 - RNA, 20 nt, Artificial Sequence
  MKO10037064_A_Olfr284
  gRNA
gccgguggcgaagacgaaga

SEQ ID NO: 37065 - RNA, 20 nt, Artificial Sequence
  MKO10037065_A_Olfr284
  gRNA
uccuccgucgugcauuucuu

SEQ ID NO: 37066 - RNA, 20 nt, Artificial Sequence
  MKO10037066_A_Olfr285
  gRNA
aggugggcaugacguagcgc

SEQ ID NO: 37067 - RNA, 20 nt, Artificial Sequence
  MKO10037067_A_Olfr285
  gRNA
accauagugacguuguacuu

SEQ ID NO: 37068 - RNA, 20 nt, Artificial Sequence
  MKO10037068_A_Olfr285
  gRNA
cauaagaacauaccacgaga

SEQ ID NO: 37069 - RNA, 20 nt, Artificial Sequence
  MKO10037069_A_Olfr286
  gRNA
ggcucuguacaaaucgccgu

SEQ ID NO: 37070 - RNA, 20 nt, Artificial Sequence
  MKO10037070_A_Olfr286
  gRNA
cacaccuucgcuccgaugua

SEQ ID NO: 37071 - RNA, 20 nt, Artificial Sequence
  MKO10037071_A_Olfr286
  gRNA
cuugauuacaugacauuccg

SEQ ID NO: 37072 - RNA, 20 nt, Artificial Sequence
  MKO10037072_A_Olfr287
  gRNA
ugggauagguagccuggcuc

SEQ ID NO: 37073 - RNA, 20 nt, Artificial Sequence
  MKO10037073_A_Olfr287
  gRNA
gucacagugcugcuguucuu

SEQ ID NO: 37074 - RNA, 20 nt, Artificial Sequence
  MKO10037074_A_Olfr287
  gRNA
uaucacccccaugugcaacc

SEQ ID NO: 37075 - RNA, 20 nt, Artificial Sequence
  MKO10037075_A_Olfr288
  gRNA
gggccuccuccucaagccau

SEQ ID NO: 37076 - RNA, 20 nt, Artificial Sequence
  MKO10037076_A_Olfr288
  gRNA
caucaugcccaugugcaacc

SEQ ID NO: 37077 - RNA, 20 nt, Artificial Sequence
  MKO10037077_A_Olfr288
  gRNA
acaaaaagaugaccacaguc

SEQ ID NO: 37078 - RNA, 20 nt, Artificial Sequence
  MKO10037078_A_Olfr290
  gRNA
acuggagguugggcgaauau

SEQ ID NO: 37079 - RNA, 20 nt, Artificial Sequence
  MKO10037079_A_Olfr290
  gRNA
ugcgcuuuccuucagcugac

SEQ ID NO: 37080 - RNA, 20 nt, Artificial Sequence
  MKO10037080_A_Olfr290
  gRNA
cuacugugauauuccaccug

SEQ ID NO: 37081 - RNA, 20 nt, Artificial Sequence
  MKO10037081_A_Olfr291
  gRNA
acuggagguugggcgcauau

SEQ ID NO: 37082 - RNA, 20 nt, Artificial Sequence
  MKO10037082_A_Olfr291
  gRNA
uuauugugauauuccaccug

SEQ ID NO: 37083 - RNA, 20 nt, Artificial Sequence
  MKO10037083_A_Olfr291
  gRNA
agaagacuucagucccagcu

SEQ ID NO: 37084 - RNA, 20 nt, Artificial Sequence
  MKO10037084_A_Olfr292
  gRNA
gauucaauuccuuaccacga

SEQ ID NO: 37085 - RNA, 20 nt, Artificial Sequence
  MKO10037085_A_Olfr292
  gRNA
gucauauccucaauuauuuc

SEQ ID NO: 37086 - RNA, 20 nt, Artificial Sequence
  MKO10037086_A_Olfr292
  gRNA
cauauuaucaacaguguuga

SEQ ID NO: 37087 - RNA, 20 nt, Artificial Sequence
  MKO10037087_A_Olfr293
  gRNA
ccuaguuaccaauuccaccu

SEQ ID NO: 37088 - RNA, 20 nt, Artificial Sequence
  MKO10037088_A_Olfr293
  gRNA
ccaagguggaauugguaacu

SEQ ID NO: 37089 - RNA, 20 nt, Artificial Sequence
  MKO10037089_A_Olfr293
  gRNA
acuacuuccaauguuacuac

SEQ ID NO: 37090 - RNA, 20 nt, Artificial Sequence
  MKO10037090_A_Olfr294
  gRNA
gaugaacccuguuauucuag

SEQ ID NO: 37091 - RNA, 20 nt, Artificial Sequence
  MKO10037091_A_Olfr294
  gRNA
ugcaauugaugcugaacgug

SEQ ID NO: 37092 - RNA, 20 nt, Artificial Sequence
  MKO10037092_A_Olfr294
  gRNA
uagucguaacuguaugcuga

SEQ ID NO: 37093 - RNA, 20 nt, Artificial Sequence
  MKO10037093_A_Olfr295
  gRNA
acuauuucugagauugcuga

SEQ ID NO: 37094 - RNA, 20 nt, Artificial Sequence
  MKO10037094_A_Olfr295
  gRNA
gcuguucuuguugauguacc

SEQ ID NO: 37095 - RNA, 20 nt, Artificial Sequence
  MKO10037095_A_Olfr295
  gRNA
ugaugauaagauuccccaac

SEQ ID NO: 37096 - RNA, 20 nt, Artificial Sequence
  MKO10037096_A_Olfr297
  gRNA
aaauaugcuacaaugaugug

SEQ ID NO: 37097 - RNA, 20 nt, Artificial Sequence
  MKO10037097_A_Olfr297
  gRNA
agcaaucucagaaguaguug

SEQ ID NO: 37098 - RNA, 20 nt, Artificial Sequence
  MKO10037098_A_Olfr297
  gRNA
aaguaaagcagguaccacua

SEQ ID NO: 37099 - RNA, 20 nt, Artificial Sequence
  MKO10037099_A_Olfr298
  gRNA
augucaagcgugcuuugaag

SEQ ID NO: 37100 - RNA, 20 nt, Artificial Sequence
  MKO10037100_A_Olfr298
  gRNA
uuguaccaucaauuucagac

SEQ ID NO: 37101 - RNA, 20 nt, Artificial Sequence
  MKO10037101_A_Olfr298
  gRNA
guuacaugaagugaaccacu

SEQ ID NO: 37102 - RNA, 20 nt, Artificial Sequence
  MKO10037102_A_Olfr299
  gRNA
aaggaugaacaauuccaccc

SEQ ID NO: 37103 - RNA, 20 nt, Artificial Sequence
  MKO10037103_A_Olfr299
  gRNA
gcagcugcaaccaaugauaa

SEQ ID NO: 37104 - RNA, 20 nt, Artificial Sequence
  MKO10037104_A_Olfr299
  gRNA
uccuuaacuacuucuaaugu

SEQ ID NO: 37105 - RNA, 20 nt, Artificial Sequence
  MKO10037105_A_Olfr2
  gRNA
ccaggugcagagugcgacgu

SEQ ID NO: 37106 - RNA, 20 nt, Artificial Sequence
  MKO10037106_A_Olfr2
  gRNA
auuucuugguauuggcgucc

SEQ ID NO: 37107 - RNA, 20 nt, Artificial Sequence
  MKO10037107_A_Olfr2
  gRNA
ccuacgucgcacucugcacc

SEQ ID NO: 37108 - RNA, 20 nt, Artificial Sequence
  MKO10037108_A_Olfr301
  gRNA
uguaccuguacagccugaua

SEQ ID NO: 37109 - RNA, 20 nt, Artificial Sequence
  MKO10037109_A_Olfr301
  gRNA
gcuacuucuaauguuaccac

SEQ ID NO: 37110 - RNA, 20 nt, Artificial Sequence
  MKO10037110_A_Olfr301
  gRNA
ugaugauaagauucccuauc

SEQ ID NO: 37111 - RNA, 20 nt, Artificial Sequence
  MKO10037111_A_Olfr303
  gRNA
acaucguggucacaauaauc

SEQ ID NO: 37112 - RNA, 20 nt, Artificial Sequence
  MKO10037112_A_Olfr303
  gRNA
agccacggugccuaaguugc

SEQ ID NO: 37113 - RNA, 20 nt, Artificial Sequence
  MKO10037113_A_Olfr303
  gRNA
ucggacauaggcaaagauua

SEQ ID NO: 37114 - RNA, 20 nt, Artificial Sequence
  MKO10037114_A_Olfr304
  gRNA
gugauguucccucguuacua

SEQ ID NO: 37115 - RNA, 20 nt, Artificial Sequence
  MKO10037115_A_Olfr304
  gRNA
caacaauuacauuucgauuc

SEQ ID NO: 37116 - RNA, 20 nt, Artificial Sequence
  MKO10037116_A_Olfr304
  gRNA
uguuaaguaguaugaauccc

SEQ ID NO: 37117 - RNA, 20 nt, Artificial Sequence
  MKO10037117_A_Olfr305
  gRNA
uugcaguccccuacauuaug

SEQ ID NO: 37118 - RNA, 20 nt, Artificial Sequence
  MKO10037118_A_Olfr305
  gRNA
uagugaugaugagcguuucc

SEQ ID NO: 37119 - RNA, 20 nt, Artificial Sequence
  MKO10037119_A_Olfr305
  gRNA
aacgcucaucaucacuacac

SEQ ID NO: 37120 - RNA, 20 nt, Artificial Sequence
  MKO10037120_A_Olfr307
  gRNA
agguggcaaacgcuuuagac

SEQ ID NO: 37121 - RNA, 20 nt, Artificial Sequence
  MKO10037121_A_Olfr307
  gRNA
ucaugauggcaccauaguuc

SEQ ID NO: 37122 - RNA, 20 nt, Artificial Sequence
  MKO10037122_A_Olfr307
  gRNA
gacggcguucuuugacagcc

SEQ ID NO: 37123 - RNA, 20 nt, Artificial Sequence
  MKO10037123_A_Olfr308
  gRNA
auguaccuccucaccauugg

SEQ ID NO: 37124 - RNA, 20 nt, Artificial Sequence
  MKO10037124_A_Olfr308
  gRNA
ccuggccuguaccaguacac

SEQ ID NO: 37125 - RNA, 20 nt, Artificial Sequence
  MKO10037125_A_Olfr308
  gRNA
ucuucugcgacauugcaccc

SEQ ID NO: 37126 - RNA, 20 nt, Artificial Sequence
  MKO10037126_A_Olfr309
  gRNA
auaauaguacuauagcgaag

SEQ ID NO: 37127 - RNA, 20 nt, Artificial Sequence
  MKO10037127_A_Olfr309
  gRNA
gcuggaugcaggucggauau

SEQ ID NO: 37128 - RNA, 20 nt, Artificial Sequence
  MKO10037128_A_Olfr309
  gRNA
uuccugaagcuauauacuau

SEQ ID NO: 37129 - RNA, 20 nt, Artificial Sequence
  MKO10037129_A_Olfr30
  gRNA
agaagagauugacgacuguc

SEQ ID NO: 37130 - RNA, 20 nt, Artificial Sequence
  MKO10037130_A_Olfr30
  gRNA
ccguguugccugccauagca

SEQ ID NO: 37131 - RNA, 20 nt, Artificial Sequence
  MKO10037131_A_Olfr30
  gRNA
guugagggacccucccaacc

SEQ ID NO: 37132 - RNA, 20 nt, Artificial Sequence
  MKO10037132_A_Olfr310
  gRNA
gagagaguugauacagguac

SEQ ID NO: 37133 - RNA, 20 nt, Artificial Sequence
  MKO10037133_A_Olfr310
  gRNA
guauugaagauucccgucaa

SEQ ID NO: 37134 - RNA, 20 nt, Artificial Sequence
  MKO10037134_A_Olfr310
  gRNA
cuaauacuucugacugucau

SEQ ID NO: 37135 - RNA, 20 nt, Artificial Sequence
  MKO10037135_A_Olfr311
  gRNA
uacauguuuaucacacugug

SEQ ID NO: 37136 - RNA, 20 nt, Artificial Sequence
  MKO10037136_A_Olfr311
  gRNA
cacugauuaccaucucaaug

SEQ ID NO: 37137 - RNA, 20 nt, Artificial Sequence
  MKO10037137_A_Olfr311
  gRNA
agcccaccuccucauugaga

SEQ ID NO: 37138 - RNA, 20 nt, Artificial Sequence
  MKO10037138_A_Olfr312
  gRNA
uacagaaugcuuucuacuca

SEQ ID NO: 37139 - RNA, 20 nt, Artificial Sequence
  MKO10037139_A_Olfr312
  gRNA
gagcucauucguccucacag

SEQ ID NO: 37140 - RNA, 20 nt, Artificial Sequence
  MKO10037140_A_Olfr312
  gRNA
cacugacuaccaucucacug

SEQ ID NO: 37141 - RNA, 20 nt, Artificial Sequence
  MKO10037141_A_Olfr313
  gRNA
uggucacugccuggguaggu

SEQ ID NO: 37142 - RNA, 20 nt, Artificial Sequence
  MKO10037142_A_Olfr313
  gRNA
cacugacuaccaucucagug

SEQ ID NO: 37143 - RNA, 20 nt, Artificial Sequence
  MKO10037143_A_Olfr313
  gRNA
guguaaaugagcaagaaaac

SEQ ID NO: 37144 - RNA, 20 nt, Artificial Sequence
  MKO10037144_A_Olfr314
  gRNA
augccacccauugcgcuauc

SEQ ID NO: 37145 - RNA, 20 nt, Artificial Sequence
  MKO10037145_A_Olfr314
  gRNA
uaccgccaagugcgaggagc

SEQ ID NO: 37146 - RNA, 20 nt, Artificial Sequence
  MKO10037146_A_Olfr314
  gRNA
uggccgcuguccuccgaaug

SEQ ID NO: 37147 - RNA, 20 nt, Artificial Sequence
  MKO10037147_A_Olfr315
  gRNA
ggaucgcaugcggagcaccg

SEQ ID NO: 37148 - RNA, 20 nt, Artificial Sequence
  MKO10037148_A_Olfr315
  gRNA
guucagcaccggcgugaaga

SEQ ID NO: 37149 - RNA, 20 nt, Artificial Sequence
  MKO10037149_A_Olfr315
  gRNA
agugguugauuguucgagag

SEQ ID NO: 37150 - RNA, 20 nt, Artificial Sequence
  MKO10037150_A_Olfr316
  gRNA
aguggugacauagaacaagc

SEQ ID NO: 37151 - RNA, 20 nt, Artificial Sequence
  MKO10037151_A_Olfr316
  gRNA
ugugugcacugaugcaguga

SEQ ID NO: 37152 - RNA, 20 nt, Artificial Sequence
  MKO10037152_A_Olfr316
  gRNA
gucuuugguccagccugaug

SEQ ID NO: 37153 - RNA, 20 nt, Artificial Sequence
  MKO10037153_A_Olfr317
  gRNA
gucaacacagcugucguuga

SEQ ID NO: 37154 - RNA, 20 nt, Artificial Sequence
  MKO10037154_A_Olfr317
  gRNA
aacgacagcuguguugacac

SEQ ID NO: 37155 - RNA, 20 nt, Artificial Sequence
  MKO10037155_A_Olfr317
  gRNA
cuucucugaccggccugagc

SEQ ID NO: 37156 - RNA, 20 nt, Artificial Sequence
  MKO10037156_A_Olfr318
  gRNA
auacuggaaaagaccaacua

SEQ ID NO: 37157 - RNA, 20 nt, Artificial Sequence
  MKO10037157_A_Olfr318
  gRNA
gucuucgguccagccugaug

SEQ ID NO: 37158 - RNA, 20 nt, Artificial Sequence
  MKO10037158_A_Olfr318
  gRNA
gauguacaucaugucgauga

SEQ ID NO: 37159 - RNA, 20 nt, Artificial Sequence
  MKO10037159_A_Olfr319
  gRNA
uguaugcgcuaaagcauuga

SEQ ID NO: 37160 - RNA, 20 nt, Artificial Sequence
  MKO10037160_A_Olfr319
  gRNA
cucacauccuaaaacggaaa

SEQ ID NO: 37161 - RNA, 20 nt, Artificial Sequence
  MKO10037161_A_Olfr319
  gRNA
accggugacauagaacagac

SEQ ID NO: 37162 - RNA, 20 nt, Artificial Sequence
  MKO10037162_A_Olfr31
  gRNA
cucauccuaugcgcggauuc

SEQ ID NO: 37163 - RNA, 20 nt, Artificial Sequence
  MKO10037163_A_Olfr31
  gRNA
aguggccagaauccgcgcau

SEQ ID NO: 37164 - RNA, 20 nt, Artificial Sequence
  MKO10037164_A_Olfr31
  gRNA
cauacaucaccgucucauag

SEQ ID NO: 37165 - RNA, 20 nt, Artificial Sequence
  MKO10037165_A_Olfr320
  gRNA
agaguccaguaacauagaac

SEQ ID NO: 37166 - RNA, 20 nt, Artificial Sequence
  MKO10037166_A_Olfr320
  gRNA
cuugguuguuguacuccaga

SEQ ID NO: 37167 - RNA, 20 nt, Artificial Sequence
  MKO10037167_A_Olfr320
  gRNA
caucucuaccacugugccca

SEQ ID NO: 37168 - RNA, 20 nt, Artificial Sequence
  MKO10037168_A_Olfr322
  gRNA
accgucuucguccuggcaau

SEQ ID NO: 37169 - RNA, 20 nt, Artificial Sequence
  MKO10037169_A_Olfr322
  gRNA
uuacaaauccgcuccgcugc

SEQ ID NO: 37170 - RNA, 20 nt, Artificial Sequence
  MKO10037170_A_Olfr322
  gRNA
gccggucagagaagccuaua

SEQ ID NO: 37171 - RNA, 20 nt, Artificial Sequence
  MKO10037171_A_Olfr323
  gRNA
caggacagcuggauuaacgg

SEQ ID NO: 37172 - RNA, 20 nt, Artificial Sequence
  MKO10037172_A_Olfr323
  gRNA
ugcagggucccuacguagug

SEQ ID NO: 37173 - RNA, 20 nt, Artificial Sequence
  MKO10037173_A_Olfr323
  gRNA
uggauguguaccaaaucucc

SEQ ID NO: 37174 - RNA, 20 nt, Artificial Sequence
  MKO10037174_A_Olfr324
  gRNA
gagccccguuccguaauaga

SEQ ID NO: 37175 - RNA, 20 nt, Artificial Sequence
  MKO10037175_A_Olfr324
  gRNA
gaagguaggagagcgcaauc

SEQ ID NO: 37176 - RNA, 20 nt, Artificial Sequence
  MKO10037176_A_Olfr324
  gRNA
gccuucgauuucuucucguu

SEQ ID NO: 37177 - RNA, 20 nt, Artificial Sequence
  MKO10037177_A_Olfr325
  gRNA
cuucuuucaagaaucuuuaa

SEQ ID NO: 37178 - RNA, 20 nt, Artificial Sequence
  MKO10037178_A_Olfr325
  gRNA
uccaacauaaagacaucagc

SEQ ID NO: 37179 - RNA, 20 nt, Artificial Sequence
  MKO10037179_A_Olfr325
  gRNA
cuuuaaagauucuugaaaga

SEQ ID NO: 37180 - RNA, 20 nt, Artificial Sequence
  MKO10037180_A_Olfr328
  gRNA
auucugacccuccuauugac

SEQ ID NO: 37181 - RNA, 20 nt, Artificial Sequence
  MKO10037181_A_Olfr328
  gRNA
auguuccuguaccugucaau

SEQ ID NO: 37182 - RNA, 20 nt, Artificial Sequence
  MKO10037182_A_Olfr328
  gRNA
acuaugaccuucccaaucug

SEQ ID NO: 37183 - RNA, 20 nt, Artificial Sequence
  MKO10037183_A_Olfr329-ps
  gRNA
cauggcacuauaagggcuuc

SEQ ID NO: 37184 - RNA, 20 nt, Artificial Sequence
  MKO10037184_A_Olfr329-ps
  gRNA
ucucuacacaucuguugaua

SEQ ID NO: 37185 - RNA, 20 nt, Artificial Sequence
  MKO10037185_A_Olfr329-ps
  gRNA
accuggaugaacaacucuac

SEQ ID NO: 37186 - RNA, 20 nt, Artificial Sequence
  MKO10037186_A_Olfr32
  gRNA
aaaugucaccggcugguggc

SEQ ID NO: 37187 - RNA, 20 nt, Artificial Sequence
  MKO10037187_A_Olfr32
  gRNA
uggaggcaggucucaaguag

SEQ ID NO: 37188 - RNA, 20 nt, Artificial Sequence
  MKO10037188_A_Olfr32
  gRNA
uguugacugucacaacaaug

SEQ ID NO: 37189 - RNA, 20 nt, Artificial Sequence
  MKO10037189_A_Olfr330
  gRNA
aaccugcuagugucacauag

SEQ ID NO: 37190 - RNA, 20 nt, Artificial Sequence
  MKO10037190_A_Olfr330
  gRNA
uuccucuaugugacacuagc

SEQ ID NO: 37191 - RNA, 20 nt, Artificial Sequence
  MKO10037191_A_Olfr330
  gRNA
auaccggaguggauggcaga

SEQ ID NO: 37192 - RNA, 20 nt, Artificial Sequence
  MKO10037192_A_Olfr331
  gRNA
agauagcagcaccauaguag

SEQ ID NO: 37193 - RNA, 20 nt, Artificial Sequence
  MKO10037193_A_Olfr331
  gRNA
acuuuacuguuucuugaaag

SEQ ID NO: 37194 - RNA, 20 nt, Artificial Sequence
  MKO10037194_A_Olfr331
  gRNA
uccaacagacagacaucagc

SEQ ID NO: 37195 - RNA, 20 nt, Artificial Sequence
  MKO10037195_A_Olfr332
  gRNA
caaggcuuuauuccgccccu

SEQ ID NO: 37196 - RNA, 20 nt, Artificial Sequence
  MKO10037196_A_Olfr332
  gRNA
uacgguaugaacgagggcug

SEQ ID NO: 37197 - RNA, 20 nt, Artificial Sequence
  MKO10037197_A_Olfr332
  gRNA
ugaugauggccgccuccacc

SEQ ID NO: 37198 - RNA, 20 nt, Artificial Sequence
  MKO10037198_A_Olfr338
  gRNA
ucauaaugguuacuccaaug

SEQ ID NO: 37199 - RNA, 20 nt, Artificial Sequence
  MKO10037199_A_Olfr338
  gRNA
auuugcagaagauaaggccc

SEQ ID NO: 37200 - RNA, 20 nt, Artificial Sequence
  MKO10037200_A_Olfr338
  gRNA
caacuacuagaaggacacag

SEQ ID NO: 37201 - RNA, 20 nt, Artificial Sequence
  MKO10037201_A_Olfr339
  gRNA
aagggugugcgcaagagcau

SEQ ID NO: 37202 - RNA, 20 nt, Artificial Sequence
  MKO10037202_A_Olfr339
  gRNA
aacacacccuguauauggga

SEQ ID NO: 37203 - RNA, 20 nt, Artificial Sequence
  MKO10037203_A_Olfr339
  gRNA
uucuucuaguaguaauauca

SEQ ID NO: 37204 - RNA, 20 nt, Artificial Sequence
  MKO10037204_A_Olfr33
  gRNA
ccagucaucaggaaagauug

SEQ ID NO: 37205 - RNA, 20 nt, Artificial Sequence
  MKO10037205_A_Olfr33
  gRNA
uccaagaaugaucuccucaa

SEQ ID NO: 37206 - RNA, 20 nt, Artificial Sequence
  MKO10037206_A_Olfr33
  gRNA
gugucaaguccaaacccauc

SEQ ID NO: 37207 - RNA, 20 nt, Artificial Sequence
  MKO10037207_A_Olfr340
  gRNA
gugaccaaagucucccgcug

SEQ ID NO: 37208 - RNA, 20 nt, Artificial Sequence
  MKO10037208_A_Olfr340
  gRNA
aucagucgcaucuccaaaaa

SEQ ID NO: 37209 - RNA, 20 nt, Artificial Sequence
  MKO10037209_A_Olfr340
  gRNA
guuggcaguagauaaagucc

SEQ ID NO: 37210 - RNA, 20 nt, Artificial Sequence
  MKO10037210_A_Olfr341
  gRNA
ugagcucgacaggcucaaua

SEQ ID NO: 37211 - RNA, 20 nt, Artificial Sequence
  MKO10037211_A_Olfr341
  gRNA
guaaugacuaguguaccuaa

SEQ ID NO: 37212 - RNA, 20 nt, Artificial Sequence
  MKO10037212_A_Olfr341
  gRNA
aaagaccauuauuaccacug

SEQ ID NO: 37213 - RNA, 20 nt, Artificial Sequence
  MKO10037213_A_Olfr342
  gRNA
ugaccauaguaccuaaagua

SEQ ID NO: 37214 - RNA, 20 nt, Artificial Sequence
  MKO10037214_A_Olfr342
  gRNA
gacaaaauacagugcaauua

SEQ ID NO: 37215 - RNA, 20 nt, Artificial Sequence
  MKO10037215_A_Olfr342
  gRNA
gaguugcuuauccuuacuuu

SEQ ID NO: 37216 - RNA, 20 nt, Artificial Sequence
  MKO10037216_A_Olfr344
  gRNA
agucaguccauuucauauga

SEQ ID NO: 37217 - RNA, 20 nt, Artificial Sequence
  MKO10037217_A_Olfr344
  gRNA
aacacacccaucauaugaaa

SEQ ID NO: 37218 - RNA, 20 nt, Artificial Sequence
  MKO10037218_A_Olfr344
  gRNA
ucagggaagaguaaauaacu

SEQ ID NO: 37219 - RNA, 20 nt, Artificial Sequence
  MKO10037219_A_Olfr345
  gRNA
aguacaaggaaacuacgcag

SEQ ID NO: 37220 - RNA, 20 nt, Artificial Sequence
  MKO10037220_A_Olfr345
  gRNA
auuggcaauggauaaggccc

SEQ ID NO: 37221 - RNA, 20 nt, Artificial Sequence
  MKO10037221_A_Olfr345
  gRNA
uauucuugucuuaggcaaug

SEQ ID NO: 37222 - RNA, 20 nt, Artificial Sequence
  MKO10037222_A_Olfr346
  gRNA
caaggcuuugcggauucccu

SEQ ID NO: 37223 - RNA, 20 nt, Artificial Sequence
  MKO10037223_A_Olfr346
  gRNA
uucuucuaguaguagugucc

SEQ ID NO: 37224 - RNA, 20 nt, Artificial Sequence
  MKO10037224_A_Olfr346
  gRNA
aaugacagauccauaguaca

SEQ ID NO: 37225 - RNA, 20 nt, Artificial Sequence
  MKO10037225_A_Olfr347
  gRNA
aucuaauaacacuaauguac

SEQ ID NO: 37226 - RNA, 20 nt, Artificial Sequence
  MKO10037226_A_Olfr347
  gRNA
auuggcaguggauaaggucc

SEQ ID NO: 37227 - RNA, 20 nt, Artificial Sequence
  MKO10037227_A_Olfr347
  gRNA
uugcagauacccuucauaga

SEQ ID NO: 37228 - RNA, 20 nt, Artificial Sequence
  MKO10037228_A_Olfr348
  gRNA
ucuuacuagucauugaaucc

SEQ ID NO: 37229 - RNA, 20 nt, Artificial Sequence
  MKO10037229_A_Olfr348
  gRNA
gacucaugauucuuguauag

SEQ ID NO: 37230 - RNA, 20 nt, Artificial Sequence
  MKO10037230_A_Olfr348
  gRNA
ugagcuagauagcuuaauua

SEQ ID NO: 37231 - RNA, 20 nt, Artificial Sequence
  MKO10037231_A_Olfr350
  gRNA
ucuuacucguagcuauaucc

SEQ ID NO: 37232 - RNA, 20 nt, Artificial Sequence
  MKO10037232_A_Olfr350
  gRNA
gcccuugucaguagaaguaa

SEQ ID NO: 37233 - RNA, 20 nt, Artificial Sequence
  MKO10037233_A_Olfr350
  gRNA
ugugcuauacacucugcaua

SEQ ID NO: 37234 - RNA, 20 nt, Artificial Sequence
  MKO10037234_A_Olfr351
  gRNA
aaccccugguggcgguacaa

SEQ ID NO: 37235 - RNA, 20 nt, Artificial Sequence
  MKO10037235_A_Olfr351
  gRNA
aaggccuuuguaccgccacc

SEQ ID NO: 37236 - RNA, 20 nt, Artificial Sequence
  MKO10037236_A_Olfr351
  gRNA
caugaguacuguacccccua

SEQ ID NO: 37237 - RNA, 20 nt, Artificial Sequence
  MKO10037237_A_Olfr352
  gRNA
gaagauaaccaguucguuaa

SEQ ID NO: 37238 - RNA, 20 nt, Artificial Sequence
  MKO10037238_A_Olfr352
  gRNA
agacaccaccauuaacgaac

SEQ ID NO: 37239 - RNA, 20 nt, Artificial Sequence
  MKO10037239_A_Olfr352
  gRNA
aaugcaucccguauaugaga

SEQ ID NO: 37240 - RNA, 20 nt, Artificial Sequence
  MKO10037240_A_Olfr353
  gRNA
uugaacucccgccagaaguc

SEQ ID NO: 37241 - RNA, 20 nt, Artificial Sequence
  MKO10037241_A_Olfr353
  gRNA
gacuucuggcgggaguucaa

SEQ ID NO: 37242 - RNA, 20 nt, Artificial Sequence
  MKO10037242_A_Olfr353
  gRNA
uguagcagcugcgauguaua

SEQ ID NO: 37243 - RNA, 20 nt, Artificial Sequence
  MKO10037243_A_Olfr354
  gRNA
ugucgaggccgccaaacauc

SEQ ID NO: 37244 - RNA, 20 nt, Artificial Sequence
  MKO10037244_A_Olfr354
  gRNA
cggccucgacaacugccuuc

SEQ ID NO: 37245 - RNA, 20 nt, Artificial Sequence
  MKO10037245_A_Olfr354
  gRNA
ugagcugaugaucauuacca

SEQ ID NO: 37246 - RNA, 20 nt, Artificial Sequence
  MKO10037246_A_Olfr355
  gRNA
ccaguagggcacaucgauga

SEQ ID NO: 37247 - RNA, 20 nt, Artificial Sequence
  MKO10037247_A_Olfr355
  gRNA
gguucccuguuagaguaacc

SEQ ID NO: 37248 - RNA, 20 nt, Artificial Sequence
  MKO10037248_A_Olfr355
  gRNA
ccaucaucgaugugcccuac

SEQ ID NO: 37249 - RNA, 20 nt, Artificial Sequence
  MKO10037249_A_Olfr356
  gRNA
auagggaugucgucaccagc

SEQ ID NO: 37250 - RNA, 20 nt, Artificial Sequence
  MKO10037250_A_Olfr356
  gRNA
cuagcugaaucagcagcgua

SEQ ID NO: 37251 - RNA, 20 nt, Artificial Sequence
  MKO10037251_A_Olfr356
  gRNA
uguuucauauguccgcauug

SEQ ID NO: 37252 - RNA, 20 nt, Artificial Sequence
  MKO10037252_A_Olfr357
  gRNA
cguuacuccucaauacugac

SEQ ID NO: 37253 - RNA, 20 nt, Artificial Sequence
  MKO10037253_A_Olfr357
  gRNA
uauucuacggcacucucaca

SEQ ID NO: 37254 - RNA, 20 nt, Artificial Sequence
  MKO10037254_A_Olfr357
  gRNA
guugaguugggugcugcuac

SEQ ID NO: 37255 - RNA, 20 nt, Artificial Sequence
  MKO10037255_A_Olfr358
  gRNA
ugcgaaucacagaaccauac

SEQ ID NO: 37256 - RNA, 20 nt, Artificial Sequence
  MKO10037256_A_Olfr358
  gRNA
gucuaccuaugacuuaaacc

SEQ ID NO: 37257 - RNA, 20 nt, Artificial Sequence
  MKO10037257_A_Olfr358
  gRNA
aguuguccuuaucauguacc

SEQ ID NO: 37258 - RNA, 20 nt, Artificial Sequence
  MKO10037258_A_Olfr360
  gRNA
uugugucaugcaacgauuau

SEQ ID NO: 37259 - RNA, 20 nt, Artificial Sequence
  MKO10037259_A_Olfr360
  gRNA
cagcauggaagucuacuugc

SEQ ID NO: 37260 - RNA, 20 nt, Artificial Sequence
  MKO10037260_A_Olfr360
  gRNA
ccaucauccagcuaugacuu

SEQ ID NO: 37261 - RNA, 20 nt, Artificial Sequence
  MKO10037261_A_Olfr361
  gRNA
aacaauaccuaugcgaacau

SEQ ID NO: 37262 - RNA, 20 nt, Artificial Sequence
  MKO10037262_A_Olfr361
  gRNA
caaucuagaacaagaucgcc

SEQ ID NO: 37263 - RNA, 20 nt, Artificial Sequence
  MKO10037263_A_Olfr361
  gRNA
aaagugugugcaccagcauc

SEQ ID NO: 37264 - RNA, 20 nt, Artificial Sequence
  MKO10037264_A_Olfr362
  gRNA
guacacugcuauuaccccau

SEQ ID NO: 37265 - RNA, 20 nt, Artificial Sequence
  MKO10037265_A_Olfr362
  gRNA
uguuuauagucuccguaaua

SEQ ID NO: 37266 - RNA, 20 nt, Artificial Sequence
  MKO10037266_A_Olfr362
  gRNA
guacuuuccuaugcccgaau

SEQ ID NO: 37267 - RNA, 20 nt, Artificial Sequence
  MKO10037267_A_Olfr365
  gRNA
guagcuaucaguguucccua

SEQ ID NO: 37268 - RNA, 20 nt, Artificial Sequence
  MKO10037268_A_Olfr365
  gRNA
gauggccaccagucggucaa

SEQ ID NO: 37269 - RNA, 20 nt, Artificial Sequence
  MKO10037269_A_Olfr365
  gRNA
uauacauaacaguagcuacc

SEQ ID NO: 37270 - RNA, 20 nt, Artificial Sequence
  MKO10037270_A_Olfr366
  gRNA
caccagcaagcgacagcgcc

SEQ ID NO: 37271 - RNA, 20 nt, Artificial Sequence
  MKO10037271_A_Olfr366
  gRNA
gcgaauguacacugauauua

SEQ ID NO: 37272 - RNA, 20 nt, Artificial Sequence
  MKO10037272_A_Olfr366
  gRNA
ggcgacccaugagaauugug

SEQ ID NO: 37273 - RNA, 20 nt, Artificial Sequence
  MKO10037273_A_Olfr367-ps
  gRNA
cuuaucacucauacuccaga

SEQ ID NO: 37274 - RNA, 20 nt, Artificial Sequence
  MKO10037274_A_Olfr367-ps
  gRNA
ggcuucgguuguuuauacaa

SEQ ID NO: 37275 - RNA, 20 nt, Artificial Sequence
  MKO10037275_A_Olfr367-ps
  gRNA
gugaauucaacuacuuugau

SEQ ID NO: 37276 - RNA, 20 nt, Artificial Sequence
  MKO10037276_A_Olfr368
  gRNA
auugagacuggugucguugc

SEQ ID NO: 37277 - RNA, 20 nt, Artificial Sequence
  MKO10037277_A_Olfr368
  gRNA
cagucacgagugcuccgccc

SEQ ID NO: 37278 - RNA, 20 nt, Artificial Sequence
  MKO10037278_A_Olfr368
  gRNA
agaaucgaugccaagugcgc

SEQ ID NO: 37279 - RNA, 20 nt, Artificial Sequence
  MKO10037279_A_Olfr370
  gRNA
auacugauaucagcgcaucc

SEQ ID NO: 37280 - RNA, 20 nt, Artificial Sequence
  MKO10037280_A_Olfr370
  gRNA
aguugauuggaagagcggaa

SEQ ID NO: 37281 - RNA, 20 nt, Artificial Sequence
  MKO10037281_A_Olfr370
  gRNA
caucuuccugcuuugcgcgc

SEQ ID NO: 37282 - RNA, 20 nt, Artificial Sequence
  MKO10037282_A_Olfr371
  gRNA
uaacacaacguuauugauga

SEQ ID NO: 37283 - RNA, 20 nt, Artificial Sequence
  MKO10037283_A_Olfr371
  gRNA
cacuacauaguaguguauuc

SEQ ID NO: 37284 - RNA, 20 nt, Artificial Sequence
  MKO10037284_A_Olfr371
  gRNA
cucagugcaguuaaacucuc

SEQ ID NO: 37285 - RNA, 20 nt, Artificial Sequence
  MKO10037285_A_Olfr372
  gRNA
gauacaacguuauccuguuu

SEQ ID NO: 37286 - RNA, 20 nt, Artificial Sequence
  MKO10037286_A_Olfr372
  gRNA
ugggagcuguacugcacaug

SEQ ID NO: 37287 - RNA, 20 nt, Artificial Sequence
  MKO10037287_A_Olfr372
  gRNA
augccacccccugcauuacc

SEQ ID NO: 37288 - RNA, 20 nt, Artificial Sequence
  MKO10037288_A_Olfr373
  gRNA
cuucagcugaccgcaugagc

SEQ ID NO: 37289 - RNA, 20 nt, Artificial Sequence
  MKO10037289_A_Olfr373
  gRNA
gauaccacauuauccuguuu

SEQ ID NO: 37290 - RNA, 20 nt, Artificial Sequence
  MKO10037290_A_Olfr373
  gRNA
augccacccccugcacuacc

SEQ ID NO: 37291 - RNA, 20 nt, Artificial Sequence
  MKO10037291_A_Olfr374
  gRNA
auacaaccucgaucacacca

SEQ ID NO: 37292 - RNA, 20 nt, Artificial Sequence
  MKO10037292_A_Olfr374
  gRNA
aucgagguuguauaauguag

SEQ ID NO: 37293 - RNA, 20 nt, Artificial Sequence
  MKO10037293_A_Olfr374
  gRNA
uccuucggacaaaggucauc

SEQ ID NO: 37294 - RNA, 20 nt, Artificial Sequence
  MKO10037294_A_Olfr376
  gRNA
ugacaccuauguuaaugaau

SEQ ID NO: 37295 - RNA, 20 nt, Artificial Sequence
  MKO10037295_A_Olfr376
  gRNA
ggcaguuugauuccuuucug

SEQ ID NO: 37296 - RNA, 20 nt, Artificial Sequence
  MKO10037296_A_Olfr376
  gRNA
caauucgugcauaggacaca

SEQ ID NO: 37297 - RNA, 20 nt, Artificial Sequence
  MKO10037297_A_Olfr378
  gRNA
caugucuuuaauguacacga

SEQ ID NO: 37298 - RNA, 20 nt, Artificial Sequence
  MKO10037298_A_Olfr378
  gRNA
uaugucuacucugcuuaaag

SEQ ID NO: 37299 - RNA, 20 nt, Artificial Sequence
  MKO10037299_A_Olfr378
  gRNA
agcuaauaacacuuauguga

SEQ ID NO: 37300 - RNA, 20 nt, Artificial Sequence
  MKO10037300_A_Olfr380
  gRNA
auucaguauacuaaucaccc

SEQ ID NO: 37301 - RNA, 20 nt, Artificial Sequence
  MKO10037301_A_Olfr380
  gRNA
ucuugauaagaacguuuaua

SEQ ID NO: 37302 - RNA, 20 nt, Artificial Sequence
  MKO10037302_A_Olfr380
  gRNA
agcuaauaacuuuacagcaa

SEQ ID NO: 37303 - RNA, 20 nt, Artificial Sequence
  MKO10037303_A_Olfr381
  gRNA
auacagcauacuaaucaccc

SEQ ID NO: 37304 - RNA, 20 nt, Artificial Sequence
  MKO10037304_A_Olfr381
  gRNA
uuccaggcuuccaaaaagau

SEQ ID NO: 37305 - RNA, 20 nt, Artificial Sequence
  MKO10037305_A_Olfr381
  gRNA
gguggagaagaccuugugua

SEQ ID NO: 37306 - RNA, 20 nt, Artificial Sequence
  MKO10037306_A_Olfr382
  gRNA
ugugucugcuaguguuaucc

SEQ ID NO: 37307 - RNA, 20 nt, Artificial Sequence
  MKO10037307_A_Olfr382
  gRNA
auacagcacaguaaauaccc

SEQ ID NO: 37308 - RNA, 20 nt, Artificial Sequence
  MKO10037308_A_Olfr382
  gRNA
ccuggagagcauccuucuuu

SEQ ID NO: 37309 - RNA, 20 nt, Artificial Sequence
  MKO10037309_A_Olfr384
  gRNA
cacccggcauaggagaugga

SEQ ID NO: 37310 - RNA, 20 nt, Artificial Sequence
  MKO10037310_A_Olfr384
  gRNA
acccauccaucuccuaugcc

SEQ ID NO: 37311 - RNA, 20 nt, Artificial Sequence
  MKO10037311_A_Olfr384
  gRNA
aggggauuugcuucuuacau

SEQ ID NO: 37312 - RNA, 20 nt, Artificial Sequence
  MKO10037312_A_Olfr385
  gRNA
auucagcaugguaaguaacc

SEQ ID NO: 37313 - RNA, 20 nt, Artificial Sequence
  MKO10037313_A_Olfr385
  gRNA
ugagcuaacgauauuuauca

SEQ ID NO: 37314 - RNA, 20 nt, Artificial Sequence
  MKO10037314_A_Olfr385
  gRNA
cauaucugccguucucaagu

SEQ ID NO: 37315 - RNA, 20 nt, Artificial Sequence
  MKO10037315_A_Olfr389
  gRNA
cauaggacauaacuaugagu

SEQ ID NO: 37316 - RNA, 20 nt, Artificial Sequence
  MKO10037316_A_Olfr389
  gRNA
gauaucaaaguuccuccuuc

SEQ ID NO: 37317 - RNA, 20 nt, Artificial Sequence
  MKO10037317_A_Olfr389
  gRNA
aaucauugcccuuguucgac

SEQ ID NO: 37318 - RNA, 20 nt, Artificial Sequence
  MKO10037318_A_Olfr38
  gRNA
aacccuugcugucgucagau

SEQ ID NO: 37319 - RNA, 20 nt, Artificial Sequence
  MKO10037319_A_Olfr38
  gRNA
aagccaaucugacgacagca

SEQ ID NO: 37320 - RNA, 20 nt, Artificial Sequence
  MKO10037320_A_Olfr38
  gRNA
gauugcaaucuuguuagaug

SEQ ID NO: 37321 - RNA, 20 nt, Artificial Sequence
  MKO10037321_A_Olfr390
  gRNA
cucgaguugaagggaccuug

SEQ ID NO: 37322 - RNA, 20 nt, Artificial Sequence
  MKO10037322_A_Olfr390
  gRNA
uagaacaagugcucguacuc

SEQ ID NO: 37323 - RNA, 20 nt, Artificial Sequence
  MKO10037323_A_Olfr390
  gRNA
ugagucuugugcugcugauc

SEQ ID NO: 37324 - RNA, 20 nt, Artificial Sequence
  MKO10037324_A_Olfr391-ps
  gRNA
guggaagcugaguucguuuc

SEQ ID NO: 37325 - RNA, 20 nt, Artificial Sequence
  MKO10037325_A_Olfr391-ps
  gRNA
aaucauuguccuuguucaac

SEQ ID NO: 37326 - RNA, 20 nt, Artificial Sequence
  MKO10037326_A_Olfr391-ps
  gRNA
uuguagaucccuugaauaga

SEQ ID NO: 37327 - RNA, 20 nt, Artificial Sequence
  MKO10037327_A_Olfr392
  gRNA
auuauuccguuccuacucau

SEQ ID NO: 37328 - RNA, 20 nt, Artificial Sequence
  MKO10037328_A_Olfr392
  gRNA
guaccaacaauauccuaugc

SEQ ID NO: 37329 - RNA, 20 nt, Artificial Sequence
  MKO10037329_A_Olfr392
  gRNA
gaacaacagcugguacucug

SEQ ID NO: 37330 - RNA, 20 nt, Artificial Sequence
  MKO10037330_A_Olfr393
  gRNA
aagacaaucuugcugcaagc

SEQ ID NO: 37331 - RNA, 20 nt, Artificial Sequence
  MKO10037331_A_Olfr393
  gRNA
uuguauaugccuugaguaga

SEQ ID NO: 37332 - RNA, 20 nt, Artificial Sequence
  MKO10037332_A_Olfr393
  gRNA
acccauccauccccuaugga

SEQ ID NO: 37333 - RNA, 20 nt, Artificial Sequence
  MKO10037333_A_Olfr394
  gRNA
uauguaccucacuaccaucu

SEQ ID NO: 37334 - RNA, 20 nt, Artificial Sequence
  MKO10037334_A_Olfr394
  gRNA
agggcccuaauaagaauuau

SEQ ID NO: 37335 - RNA, 20 nt, Artificial Sequence
  MKO10037335_A_Olfr394
  gRNA
cacuagcaucaugaguccua

SEQ ID NO: 37336 - RNA, 20 nt, Artificial Sequence
  MKO10037336_A_Olfr395
  gRNA
caaucugcauaggauaucgu

SEQ ID NO: 37337 - RNA, 20 nt, Artificial Sequence
  MKO10037337_A_Olfr395
  gRNA
acaguagaauuauugccuga

SEQ ID NO: 37338 - RNA, 20 nt, Artificial Sequence
  MKO10037338_A_Olfr395
  gRNA
cacuaguaaagcacaaaauu

SEQ ID NO: 37339 - RNA, 20 nt, Artificial Sequence
  MKO10037339_A_Olfr397
  gRNA
agcuaauaauucaaccauua

SEQ ID NO: 37340 - RNA, 20 nt, Artificial Sequence
  MKO10037340_A_Olfr397
  gRNA
guagccaagauagugccacc

SEQ ID NO: 37341 - RNA, 20 nt, Artificial Sequence
  MKO10037341_A_Olfr397
  gRNA
ucucgagaucugcaaaaagc

SEQ ID NO: 37342 - RNA, 20 nt, Artificial Sequence
  MKO10037342_A_Olfr398
  gRNA
cucagcucguuaugaccgca

SEQ ID NO: 37343 - RNA, 20 nt, Artificial Sequence
  MKO10037343_A_Olfr398
  gRNA
gugcuuggaauucggaccac

SEQ ID NO: 37344 - RNA, 20 nt, Artificial Sequence
  MKO10037344_A_Olfr398
  gRNA
gcggucauaacgagcugagu

SEQ ID NO: 37345 - RNA, 20 nt, Artificial Sequence
  MKO10037345_A_Olfr399
  gRNA
cuugcuuauguagcuacgcu

SEQ ID NO: 37346 - RNA, 20 nt, Artificial Sequence
  MKO10037346_A_Olfr399
  gRNA
cagcugcaguucuucguauc

SEQ ID NO: 37347 - RNA, 20 nt, Artificial Sequence
  MKO10037347_A_Olfr399
  gRNA
gcucuauaaugauagcagcc

SEQ ID NO: 37348 - RNA, 20 nt, Artificial Sequence
  MKO10037348_A_Olfr39
  gRNA
gcuuccuugugcuaaugugc

SEQ ID NO: 37349 - RNA, 20 nt, Artificial Sequence
  MKO10037349_A_Olfr39
  gRNA
caauaauaucgcauuauaug

SEQ ID NO: 37350 - RNA, 20 nt, Artificial Sequence
  MKO10037350_A_Olfr39
  gRNA
gggguuuaccucaguucagc

SEQ ID NO: 37351 - RNA, 20 nt, Artificial Sequence
  MKO10037351_A_Olfr3
  gRNA
ggaggauggugaacccaaua

SEQ ID NO: 37352 - RNA, 20 nt, Artificial Sequence
  MKO10037352_A_Olfr3
  gRNA
uauuggguucaccauccucc

SEQ ID NO: 37353 - RNA, 20 nt, Artificial Sequence
  MKO10037353_A_Olfr3
  gRNA
gacucaugauagugauguaa

SEQ ID NO: 37354 - RNA, 20 nt, Artificial Sequence
  MKO10037354_A_Olfr401
  gRNA
gcucagguugccuccaacug

SEQ ID NO: 37355 - RNA, 20 nt, Artificial Sequence
  MKO10037355_A_Olfr401
  gRNA
ucauucgggugcuauaggug

SEQ ID NO: 37356 - RNA, 20 nt, Artificial Sequence
  MKO10037356_A_Olfr401
  gRNA
guguggaugucgccacagug

SEQ ID NO: 37357 - RNA, 20 nt, Artificial Sequence
  MKO10037357_A_Olfr402
  gRNA
gaaugaacuacacuauacag

SEQ ID NO: 37358 - RNA, 20 nt, Artificial Sequence
  MKO10037358_A_Olfr402
  gRNA
cagacaaagccuagaaucaa

SEQ ID NO: 37359 - RNA, 20 nt, Artificial Sequence
  MKO10037359_A_Olfr402
  gRNA
ucuguauaguguaguucauu

SEQ ID NO: 37360 - RNA, 20 nt, Artificial Sequence
  MKO10037360_A_Olfr403
  gRNA
gcaucaucaucuccuauguc

SEQ ID NO: 37361 - RNA, 20 nt, Artificial Sequence
  MKO10037361_A_Olfr403
  gRNA
uaccauagauuucacucucc

SEQ ID NO: 37362 - RNA, 20 nt, Artificial Sequence
  MKO10037362_A_Olfr403
  gRNA
acagcuagauuguccuucug

SEQ ID NO: 37363 - RNA, 20 nt, Artificial Sequence
  MKO10037363_A_Olfr406
  gRNA
aagguuuguaaggguccaac

SEQ ID NO: 37364 - RNA, 20 nt, Artificial Sequence
  MKO10037364_A_Olfr406
  gRNA
gcauugugucagccaucauc

SEQ ID NO: 37365 - RNA, 20 nt, Artificial Sequence
  MKO10037365_A_Olfr406
  gRNA
gauucccugcuacagugacc

SEQ ID NO: 37366 - RNA, 20 nt, Artificial Sequence
  MKO10037366_A_Olfr410
  gRNA
cauaagcguacaauuccaua

SEQ ID NO: 37367 - RNA, 20 nt, Artificial Sequence
  MKO10037367_A_Olfr410
  gRNA
agucaaccccaacuagcaga

SEQ ID NO: 37368 - RNA, 20 nt, Artificial Sequence
  MKO10037368_A_Olfr410
  gRNA
agcugccacaugcauauaag

SEQ ID NO: 37369 - RNA, 20 nt, Artificial Sequence
  MKO10037369_A_Olfr411
  gRNA
gaugcagccgacauccaaca

SEQ ID NO: 37370 - RNA, 20 nt, Artificial Sequence
  MKO10037370_A_Olfr411
  gRNA
uucgccuacuugcucacagu

SEQ ID NO: 37371 - RNA, 20 nt, Artificial Sequence
  MKO10037371_A_Olfr411
  gRNA
cauagggaacugugcgcuug

SEQ ID NO: 37372 - RNA, 20 nt, Artificial Sequence
  MKO10037372_A_Olfr412
  gRNA
ucacaugaugcugaucgcca

SEQ ID NO: 37373 - RNA, 20 nt, Artificial Sequence
  MKO10037373_A_Olfr412
  gRNA
gacucauggcuguaguguaa

SEQ ID NO: 37374 - RNA, 20 nt, Artificial Sequence
  MKO10037374_A_Olfr412
  gRNA
agcaucagcgcauccuauuc

SEQ ID NO: 37375 - RNA, 20 nt, Artificial Sequence
  MKO10037375_A_Olfr414
  gRNA
gcaugagacuaggguaacga

SEQ ID NO: 37376 - RNA, 20 nt, Artificial Sequence
  MKO10037376_A_Olfr414
  gRNA
cgaguuaguagacuuccugc

SEQ ID NO: 37377 - RNA, 20 nt, Artificial Sequence
  MKO10037377_A_Olfr414
  gRNA
cauggcucggggucgugcau

SEQ ID NO: 37378 - RNA, 20 nt, Artificial Sequence
  MKO10037378_A_Olfr417
  gRNA
cuuacccacuuguacagacc

SEQ ID NO: 37379 - RNA, 20 nt, Artificial Sequence
  MKO10037379_A_Olfr417
  gRNA
cacccaaguuaaacccauga

SEQ ID NO: 37380 - RNA, 20 nt, Artificial Sequence
  MKO10037380_A_Olfr417
  gRNA
ggaugaacacguaagucaga

SEQ ID NO: 37381 - RNA, 20 nt, Artificial Sequence
  MKO10037381_A_Olfr418-ps1
  gRNA
augccauuuaccgugcuauu

SEQ ID NO: 37382 - RNA, 20 nt, Artificial Sequence
  MKO10037382_A_Olfr418-ps1
  gRNA
uuucccaauagcacgguaaa

SEQ ID NO: 37383 - RNA, 20 nt, Artificial Sequence
  MKO10037383_A_Olfr418-ps1
  gRNA
gcggaugucacagaaauagu

SEQ ID NO: 37384 - RNA, 20 nt, Artificial Sequence
  MKO10037384_A_Olfr419
  gRNA
uggcuuguccccccauaacc

SEQ ID NO: 37385 - RNA, 20 nt, Artificial Sequence
  MKO10037385_A_Olfr419
  gRNA
ccagugcuaagccucgccug

SEQ ID NO: 37386 - RNA, 20 nt, Artificial Sequence
  MKO10037386_A_Olfr419
  gRNA
caucaucauagugaucagac

SEQ ID NO: 37387 - RNA, 20 nt, Artificial Sequence
  MKO10037387_A_Olfr420
  gRNA
uaccaccugaaucaugacga

SEQ ID NO: 37388 - RNA, 20 nt, Artificial Sequence
  MKO10037388_A_Olfr420
  gRNA
cuagccugcuuagugaacga

SEQ ID NO: 37389 - RNA, 20 nt, Artificial Sequence
  MKO10037389_A_Olfr420
  gRNA
aucuaugcuuucauuaucgu

SEQ ID NO: 37390 - RNA, 20 nt, Artificial Sequence
  MKO10037390_A_Olfr421-ps1
  gRNA
ggaggccaccauucuugagc

SEQ ID NO: 37391 - RNA, 20 nt, Artificial Sequence
  MKO10037391_A_Olfr421-ps1
  gRNA
cagagaaucgaagauacaua

SEQ ID NO: 37392 - RNA, 20 nt, Artificial Sequence
  MKO10037392_A_Olfr421-ps1
  gRNA
aucuugaaccaagaucacug

SEQ ID NO: 37393 - RNA, 20 nt, Artificial Sequence
  MKO10037393_A_Olfr424
  gRNA
uacggacaccuccaugauuc

SEQ ID NO: 37394 - RNA, 20 nt, Artificial Sequence
  MKO10037394_A_Olfr424
  gRNA
uccccucuggugaaggccgu

SEQ ID NO: 37395 - RNA, 20 nt, Artificial Sequence
  MKO10037395_A_Olfr424
  gRNA
guacaugccaaacgcaacac

SEQ ID NO: 37396 - RNA, 20 nt, Artificial Sequence
  MKO10037396_A_Olfr426
  gRNA
ugucaccuuccaaccacuau

SEQ ID NO: 37397 - RNA, 20 nt, Artificial Sequence
  MKO10037397_A_Olfr426
  gRNA
auaaugauugcauagcgaag

SEQ ID NO: 37398 - RNA, 20 nt, Artificial Sequence
  MKO10037398_A_Olfr426
  gRNA
caaaagauacucacugucuc

SEQ ID NO: 37399 - RNA, 20 nt, Artificial Sequence
  MKO10037399_A_Olfr427
  gRNA
ugucaccuuccaaccacuau

SEQ ID NO: 37400 - RNA, 20 nt, Artificial Sequence
  MKO10037400_A_Olfr427
  gRNA
auaaugauugcauagcgaag

SEQ ID NO: 37401 - RNA, 20 nt, Artificial Sequence
  MKO10037401_A_Olfr427
  gRNA
guaguccugaagauuccauc

SEQ ID NO: 37402 - RNA, 20 nt, Artificial Sequence
  MKO10037402_A_Olfr429
  gRNA
ccuugacuacgaccgagccu

SEQ ID NO: 37403 - RNA, 20 nt, Artificial Sequence
  MKO10037403_A_Olfr429
  gRNA
ugugcggauuaucugcaagu

SEQ ID NO: 37404 - RNA, 20 nt, Artificial Sequence
  MKO10037404_A_Olfr429
  gRNA
acagguacuuagccauuugc

SEQ ID NO: 37405 - RNA, 20 nt, Artificial Sequence
  MKO10037405_A_Olfr430
  gRNA
caucuuccuagucauacgac

SEQ ID NO: 37406 - RNA, 20 nt, Artificial Sequence
  MKO10037406_A_Olfr430
  gRNA
cugcauccagucguaugacu

SEQ ID NO: 37407 - RNA, 20 nt, Artificial Sequence
  MKO10037407_A_Olfr430
  gRNA
accaaugauccucccauaag

SEQ ID NO: 37408 - RNA, 20 nt, Artificial Sequence
  MKO10037408_A_Olfr432
  gRNA
uauuuauacucuucgcaaua

SEQ ID NO: 37409 - RNA, 20 nt, Artificial Sequence
  MKO10037409_A_Olfr432
  gRNA
aacaguuaguugggguuaca

SEQ ID NO: 37410 - RNA, 20 nt, Artificial Sequence
  MKO10037410_A_Olfr432
  gRNA
cugccuucagcucgaaucuc

SEQ ID NO: 37411 - RNA, 20 nt, Artificial Sequence
  MKO10037411_A_Olfr433
  gRNA
gguguaguugacaugaucca

SEQ ID NO: 37412 - RNA, 20 nt, Artificial Sequence
  MKO10037412_A_Olfr433
  gRNA
uuucaagcaauacgguaaac

SEQ ID NO: 37413 - RNA, 20 nt, Artificial Sequence
  MKO10037413_A_Olfr433
  gRNA
augaccgagugcuaccuguu

SEQ ID NO: 37414 - RNA, 20 nt, Artificial Sequence
  MKO10037414_A_Olfr434
  gRNA
gguguucggaccauaaaucu

SEQ ID NO: 37415 - RNA, 20 nt, Artificial Sequence
  MKO10037415_A_Olfr434
  gRNA
aggugaagggcgcccucaag

SEQ ID NO: 37416 - RNA, 20 nt, Artificial Sequence
  MKO10037416_A_Olfr434
  gRNA
agacuaguacaaagcauagg

SEQ ID NO: 37417 - RNA, 20 nt, Artificial Sequence
  MKO10037417_A_Olfr435
  gRNA
gcucuaggcagauuagccca

SEQ ID NO: 37418 - RNA, 20 nt, Artificial Sequence
  MKO10037418_A_Olfr435
  gRNA
gguucaaauaucacaccaau

SEQ ID NO: 37419 - RNA, 20 nt, Artificial Sequence
  MKO10037419_A_Olfr435
  gRNA
ggcuaaucugccuagagccc

SEQ ID NO: 37420 - RNA, 20 nt, Artificial Sequence
  MKO10037420_A_Olfr437
  gRNA
agauuauuccauuugcgagc

SEQ ID NO: 37421 - RNA, 20 nt, Artificial Sequence
  MKO10037421_A_Olfr437
  gRNA
uuucuauaccugcgcugagc

SEQ ID NO: 37422 - RNA, 20 nt, Artificial Sequence
  MKO10037422_A_Olfr437
  gRNA
cgcuucggagugcuugauuu

SEQ ID NO: 37423 - RNA, 20 nt, Artificial Sequence
  MKO10037423_A_Olfr43
  gRNA
gauguacuucaugauaggcu

SEQ ID NO: 37424 - RNA, 20 nt, Artificial Sequence
  MKO10037424_A_Olfr43
  gRNA
gcaucaucaucuccuacguc

SEQ ID NO: 37425 - RNA, 20 nt, Artificial Sequence
  MKO10037425_A_Olfr43
  gRNA
acagcuagacuguccuucug

SEQ ID NO: 37426 - RNA, 20 nt, Artificial Sequence
  MKO10037426_A_Olfr441
  gRNA
cacuaaaaucaggcacucua

SEQ ID NO: 37427 - RNA, 20 nt, Artificial Sequence
  MKO10037427_A_Olfr441
  gRNA
gccucaggaugagaauuaaa

SEQ ID NO: 37428 - RNA, 20 nt, Artificial Sequence
  MKO10037428_A_Olfr441
  gRNA
gaaugagagccaaucagaca

SEQ ID NO: 37429 - RNA, 20 nt, Artificial Sequence
  MKO10037429_A_Olfr444
  gRNA
uugcauuaugcacagaauga

SEQ ID NO: 37430 - RNA, 20 nt, Artificial Sequence
  MKO10037430_A_Olfr444
  gRNA
aucacagagguaacucugcu

SEQ ID NO: 37431 - RNA, 20 nt, Artificial Sequence
  MKO10037431_A_Olfr444
  gRNA
auuccaagcagaccugagug

SEQ ID NO: 37432 - RNA, 20 nt, Artificial Sequence
  MKO10037432_A_Olfr446
  gRNA
gucuuagaaugagcgugaua

SEQ ID NO: 37433 - RNA, 20 nt, Artificial Sequence
  MKO10037433_A_Olfr446
  gRNA
gugccuugagacgaguucuu

SEQ ID NO: 37434 - RNA, 20 nt, Artificial Sequence
  MKO10037434_A_Olfr446
  gRNA
uuuccaaagaacucgucuca

SEQ ID NO: 37435 - RNA, 20 nt, Artificial Sequence
  MKO10037435_A_Olfr447
  gRNA
gccaagccaaucucuuucgc

SEQ ID NO: 37436 - RNA, 20 nt, Artificial Sequence
  MKO10037436_A_Olfr447
  gRNA
gauauacugcuaucaugagc

SEQ ID NO: 37437 - RNA, 20 nt, Artificial Sequence
  MKO10037437_A_Olfr447
  gRNA
ccaugagguuuaccagcauc

SEQ ID NO: 37438 - RNA, 20 nt, Artificial Sequence
  MKO10037438_A_Olfr448
  gRNA
agcauaugaaauaucgacga

SEQ ID NO: 37439 - RNA, 20 nt, Artificial Sequence
  MKO10037439_A_Olfr448
  gRNA
gccucaggauaagaacaacg

SEQ ID NO: 37440 - RNA, 20 nt, Artificial Sequence
  MKO10037440_A_Olfr448
  gRNA
ggcaaucaggauacgugugu

SEQ ID NO: 37441 - RNA, 20 nt, Artificial Sequence
  MKO10037441_A_Olfr449
  gRNA
cacgguaacagagauguacc

SEQ ID NO: 37442 - RNA, 20 nt, Artificial Sequence
  MKO10037442_A_Olfr449
  gRNA
aaacgugaucaucauccuac

SEQ ID NO: 37443 - RNA, 20 nt, Artificial Sequence
  MKO10037443_A_Olfr449
  gRNA
ucgggcauacauaaaaauag

SEQ ID NO: 37444 - RNA, 20 nt, Artificial Sequence
  MKO10037444_A_Olfr44
  gRNA
acuccgcaauugcaaauaug

SEQ ID NO: 37445 - RNA, 20 nt, Artificial Sequence
  MKO10037445_A_Olfr44
  gRNA
uugggcaugaucauacugau

SEQ ID NO: 37446 - RNA, 20 nt, Artificial Sequence
  MKO10037446_A_Olfr44
  gRNA
cuuccucauauuugcaauug

SEQ ID NO: 37447 - RNA, 20 nt, Artificial Sequence
  MKO10037447_A_Olfr450
  gRNA
aguagaucgaaugcgcagaa

SEQ ID NO: 37448 - RNA, 20 nt, Artificial Sequence
  MKO10037448_A_Olfr450
  gRNA
ucugcgcauucgaucuacuc

SEQ ID NO: 37449 - RNA, 20 nt, Artificial Sequence
  MKO10037449_A_Olfr450
  gRNA
cacaacaguuacgacauaca

SEQ ID NO: 37450 - RNA, 20 nt, Artificial Sequence
  MKO10037450_A_Olfr452
  gRNA
gacuugagugccccagucau

SEQ ID NO: 37451 - RNA, 20 nt, Artificial Sequence
  MKO10037451_A_Olfr452
  gRNA
uuccugugaaauucuagcug

SEQ ID NO: 37452 - RNA, 20 nt, Artificial Sequence
  MKO10037452_A_Olfr452
  gRNA
auccaaugagauugugauca

SEQ ID NO: 37453 - RNA, 20 nt, Artificial Sequence
  MKO10037453_A_Olfr453
  gRNA
uacuccgccauaaugcauac

SEQ ID NO: 37454 - RNA, 20 nt, Artificial Sequence
  MKO10037454_A_Olfr453
  gRNA
gcauaguccuguaugcauua

SEQ ID NO: 37455 - RNA, 20 nt, Artificial Sequence
  MKO10037455_A_Olfr453
  gRNA
gggggcuuggcagaaauuac

SEQ ID NO: 37456 - RNA, 20 nt, Artificial Sequence
  MKO10037456_A_Olfr455
  gRNA
ucacuauagaugcauaucgc

SEQ ID NO: 37457 - RNA, 20 nt, Artificial Sequence
  MKO10037457_A_Olfr455
  gRNA
gcuagugugcgauccagucg

SEQ ID NO: 37458 - RNA, 20 nt, Artificial Sequence
  MKO10037458_A_Olfr455
  gRNA
ugaacucugcuacacgcuag

SEQ ID NO: 37459 - RNA, 20 nt, Artificial Sequence
  MKO10037459_A_Olfr456
  gRNA
gcugaugauacccugcucuc

SEQ ID NO: 37460 - RNA, 20 nt, Artificial Sequence
  MKO10037460_A_Olfr456
  gRNA
ugucacuuguuaaacccaua

SEQ ID NO: 37461 - RNA, 20 nt, Artificial Sequence
  MKO10037461_A_Olfr456
  gRNA
gguagugaucuucuaugcuu

SEQ ID NO: 37462 - RNA, 20 nt, Artificial Sequence
  MKO10037462_A_Olfr457
  gRNA
aaccagugccagugucucac

SEQ ID NO: 37463 - RNA, 20 nt, Artificial Sequence
  MKO10037463_A_Olfr457
  gRNA
gguugugcuauucuaugcug

SEQ ID NO: 37464 - RNA, 20 nt, Artificial Sequence
  MKO10037464_A_Olfr457
  gRNA
gacacuggcacugguuagac

SEQ ID NO: 37465 - RNA, 20 nt, Artificial Sequence
  MKO10037465_A_Olfr458
  gRNA
cuugaaaauccgcucuaccc

SEQ ID NO: 37466 - RNA, 20 nt, Artificial Sequence
  MKO10037466_A_Olfr458
  gRNA
aauggcccucuucacacaca

SEQ ID NO: 37467 - RNA, 20 nt, Artificial Sequence
  MKO10037467_A_Olfr458
  gRNA
ccagugucucacaugccaca

SEQ ID NO: 37468 - RNA, 20 nt, Artificial Sequence
  MKO10037468_A_Olfr459
  gRNA
ugaacagccgcacuugcauc

SEQ ID NO: 37469 - RNA, 20 nt, Artificial Sequence
  MKO10037469_A_Olfr459
  gRNA
gaacaauuguaguuguaacc

SEQ ID NO: 37470 - RNA, 20 nt, Artificial Sequence
  MKO10037470_A_Olfr459
  gRNA
aaaggauguaguguagcucu

SEQ ID NO: 37471 - RNA, 20 nt, Artificial Sequence
  MKO10037471_A_Olfr45
  gRNA
gacgaucgaguauaacacug

SEQ ID NO: 37472 - RNA, 20 nt, Artificial Sequence
  MKO10037472_A_Olfr45
  gRNA
ccaucagagccauuauguag

SEQ ID NO: 37473 - RNA, 20 nt, Artificial Sequence
  MKO10037473_A_Olfr45
  gRNA
aaauaccauuaugacucuuu

SEQ ID NO: 37474 - RNA, 20 nt, Artificial Sequence
  MKO10037474_A_Olfr460
  gRNA
cacuucaccugcgucgucau

SEQ ID NO: 37475 - RNA, 20 nt, Artificial Sequence
  MKO10037475_A_Olfr460
  gRNA
gccguagccaaugacgacgc

SEQ ID NO: 37476 - RNA, 20 nt, Artificial Sequence
  MKO10037476_A_Olfr460
  gRNA
agcguuucacuccaucccga

SEQ ID NO: 37477 - RNA, 20 nt, Artificial Sequence
  MKO10037477_A_Olfr461
  gRNA
ggagauccucaucacauccg

SEQ ID NO: 37478 - RNA, 20 nt, Artificial Sequence
  MKO10037478_A_Olfr461
  gRNA
gccguagccaaucacaacau

SEQ ID NO: 37479 - RNA, 20 nt, Artificial Sequence
  MKO10037479_A_Olfr461
  gRNA
caacagggugguuucacugc

SEQ ID NO: 37480 - RNA, 20 nt, Artificial Sequence
  MKO10037480_A_Olfr462
  gRNA
accgccugguggcuaucucc

SEQ ID NO: 37481 - RNA, 20 nt, Artificial Sequence
  MKO10037481_A_Olfr462
  gRNA
ggggccgggagauagccacc

SEQ ID NO: 37482 - RNA, 20 nt, Artificial Sequence
  MKO10037482_A_Olfr462
  gRNA
augcucccguugccauucug

SEQ ID NO: 37483 - RNA, 20 nt, Artificial Sequence
  MKO10037483_A_Olfr463
  gRNA
agcgcuuagcgcuuugcaac

SEQ ID NO: 37484 - RNA, 20 nt, Artificial Sequence
  MKO10037484_A_Olfr463
  gRNA
gaggucgggaaauagccacc

SEQ ID NO: 37485 - RNA, 20 nt, Artificial Sequence
  MKO10037485_A_Olfr463
  gRNA
augcucccguugccguucug

SEQ ID NO: 37486 - RNA, 20 nt, Artificial Sequence
  MKO10037486_A_Olfr464
  gRNA
ggucaagaccguguagcuga

SEQ ID NO: 37487 - RNA, 20 nt, Artificial Sequence
  MKO10037487_A_Olfr464
  gRNA
gacuaagaccaucucguacc

SEQ ID NO: 37488 - RNA, 20 nt, Artificial Sequence
  MKO10037488_A_Olfr464
  gRNA
ggccguguccaucagcuaca

SEQ ID NO: 37489 - RNA, 20 nt, Artificial Sequence
  MKO10037489_A_Olfr466
  gRNA
auugaagauccgcacagugc

SEQ ID NO: 37490 - RNA, 20 nt, Artificial Sequence
  MKO10037490_A_Olfr466
  gRNA
auucacugcaccccaugaau

SEQ ID NO: 37491 - RNA, 20 nt, Artificial Sequence
  MKO10037491_A_Olfr466
  gRNA
aucauacaauauccuuuagu

SEQ ID NO: 37492 - RNA, 20 nt, Artificial Sequence
  MKO10037492_A_Olfr467
  gRNA
auuuacacauccacccacau

SEQ ID NO: 37493 - RNA, 20 nt, Artificial Sequence
  MKO10037493_A_Olfr467
  gRNA
cuucaaaaaagauggagccu

SEQ ID NO: 37494 - RNA, 20 nt, Artificial Sequence
  MKO10037494_A_Olfr467
  gRNA
agucagacucagcaaacagc

SEQ ID NO: 37495 - RNA, 20 nt, Artificial Sequence
  MKO10037495_A_Olfr469
  gRNA
ucaguggagaagcuugauuu

SEQ ID NO: 37496 - RNA, 20 nt, Artificial Sequence
  MKO10037496_A_Olfr469
  gRNA
agauugugcuucucuccacc

SEQ ID NO: 37497 - RNA, 20 nt, Artificial Sequence
  MKO10037497_A_Olfr469
  gRNA
acaaaaugaggcaggaacua

SEQ ID NO: 37498 - RNA, 20 nt, Artificial Sequence
  MKO10037498_A_Olfr46
  gRNA
ccugugcaacuuagcgacca

SEQ ID NO: 37499 - RNA, 20 nt, Artificial Sequence
  MKO10037499_A_Olfr46
  gRNA
agaugcauuuagugcgcaga

SEQ ID NO: 37500 - RNA, 20 nt, Artificial Sequence
  MKO10037500_A_Olfr46
  gRNA
gcucugugggaccuuugccg

SEQ ID NO: 37501 - RNA, 20 nt, Artificial Sequence
  MKO10037501_A_Olfr470
  gRNA
acugcagugacucucuauua

SEQ ID NO: 37502 - RNA, 20 nt, Artificial Sequence
  MKO10037502_A_Olfr470
  gRNA
gaauagugauugacucuauu

SEQ ID NO: 37503 - RNA, 20 nt, Artificial Sequence
  MKO10037503_A_Olfr470
  gRNA
gcccaaauccagcuacucca

SEQ ID NO: 37504 - RNA, 20 nt, Artificial Sequence
  MKO10037504_A_Olfr472
  gRNA
uucaguagaguagcucgauu

SEQ ID NO: 37505 - RNA, 20 nt, Artificial Sequence
  MKO10037505_A_Olfr472
  gRNA
caucacguaaaugacgguaa

SEQ ID NO: 37506 - RNA, 20 nt, Artificial Sequence
  MKO10037506_A_Olfr472
  gRNA
gucagccgagugcuucuuac

SEQ ID NO: 37507 - RNA, 20 nt, Artificial Sequence
  MKO10037507_A_Olfr473
  gRNA
guaaggcuagcccaugucca

SEQ ID NO: 37508 - RNA, 20 nt, Artificial Sequence
  MKO10037508_A_Olfr473
  gRNA
augcauuauaacugagaccg

SEQ ID NO: 37509 - RNA, 20 nt, Artificial Sequence
  MKO10037509_A_Olfr473
  gRNA
gaugauuagcucugccaccg

SEQ ID NO: 37510 - RNA, 20 nt, Artificial Sequence
  MKO10037510_A_Olfr474
  gRNA
aagcauuauaaccgagacca

SEQ ID NO: 37511 - RNA, 20 nt, Artificial Sequence
  MKO10037511_A_Olfr474
  gRNA
cagaauguaggguccucugu

SEQ ID NO: 37512 - RNA, 20 nt, Artificial Sequence
  MKO10037512_A_Olfr474
  gRNA
ugguugaggaauagauacac

SEQ ID NO: 37513 - RNA, 20 nt, Artificial Sequence
  MKO10037513_A_Olfr476
  gRNA
acuacgugucauccuauuua

SEQ ID NO: 37514 - RNA, 20 nt, Artificial Sequence
  MKO10037514_A_Olfr476
  gRNA
augucacugugaugcagaau

SEQ ID NO: 37515 - RNA, 20 nt, Artificial Sequence
  MKO10037515_A_Olfr476
  gRNA
ggugaugagaauguaggcgu

SEQ ID NO: 37516 - RNA, 20 nt, Artificial Sequence
  MKO10037516_A_Olfr477
  gRNA
aucacaccuauaaugcuuac

SEQ ID NO: 37517 - RNA, 20 nt, Artificial Sequence
  MKO10037517_A_Olfr477
  gRNA
ucagcaucaucaguuuaaua

SEQ ID NO: 37518 - RNA, 20 nt, Artificial Sequence
  MKO10037518_A_Olfr477
  gRNA
caucuagcucuuguagacau

SEQ ID NO: 37519 - RNA, 20 nt, Artificial Sequence
  MKO10037519_A_Olfr478
  gRNA
agauuguaugucuuuccacc

SEQ ID NO: 37520 - RNA, 20 nt, Artificial Sequence
  MKO10037520_A_Olfr478
  gRNA
gguugcaaauugccaugaag

SEQ ID NO: 37521 - RNA, 20 nt, Artificial Sequence
  MKO10037521_A_Olfr478
  gRNA
uugcucuuaauugcuuacau

SEQ ID NO: 37522 - RNA, 20 nt, Artificial Sequence
  MKO10037522_A_Olfr479
  gRNA
uacugcuuaguaccuuccuc

SEQ ID NO: 37523 - RNA, 20 nt, Artificial Sequence
  MKO10037523_A_Olfr479
  gRNA
augaugagcaguguaaucac

SEQ ID NO: 37524 - RNA, 20 nt, Artificial Sequence
  MKO10037524_A_Olfr479
  gRNA
uacaacaaggaauacuauga

SEQ ID NO: 37525 - RNA, 20 nt, Artificial Sequence
  MKO10037525_A_Olfr47
  gRNA
gguguucccaccacaagccu

SEQ ID NO: 37526 - RNA, 20 nt, Artificial Sequence
  MKO10037526_A_Olfr47
  gRNA
ccccacuaaagugaacacac

SEQ ID NO: 37527 - RNA, 20 nt, Artificial Sequence
  MKO10037527_A_Olfr47
  gRNA
caccgaaugucuucuucuug

SEQ ID NO: 37528 - RNA, 20 nt, Artificial Sequence
  MKO10037528_A_Olfr480
  gRNA
ggaguacccaaugucuagaa

SEQ ID NO: 37529 - RNA, 20 nt, Artificial Sequence
  MKO10037529_A_Olfr480
  gRNA
aacuuccuaccuagguggau

SEQ ID NO: 37530 - RNA, 20 nt, Artificial Sequence
  MKO10037530_A_Olfr480
  gRNA
cgucuauucuguuacuuuaa

SEQ ID NO: 37531 - RNA, 20 nt, Artificial Sequence
  MKO10037531_A_Olfr481
  gRNA
gcugugggcugcuccgaauu

SEQ ID NO: 37532 - RNA, 20 nt, Artificial Sequence
  MKO10037532_A_Olfr481
  gRNA
gaaacuacuaucccucucgc

SEQ ID NO: 37533 - RNA, 20 nt, Artificial Sequence
  MKO10037533_A_Olfr481
  gRNA
ucguagagagcgugcucaca

SEQ ID NO: 37534 - RNA, 20 nt, Artificial Sequence
  MKO10037534_A_Olfr482
  gRNA
agaugguauuauucucugcc

SEQ ID NO: 37535 - RNA, 20 nt, Artificial Sequence
  MKO10037535_A_Olfr482
  gRNA
ugcagugacagaguucauuu

SEQ ID NO: 37536 - RNA, 20 nt, Artificial Sequence
  MKO10037536_A_Olfr482
  gRNA
uucggcucagcuacuuucuu

SEQ ID NO: 37537 - RNA, 20 nt, Artificial Sequence
  MKO10037537_A_Olfr483
  gRNA
aaaaguaaacugugacgaug

SEQ ID NO: 37538 - RNA, 20 nt, Artificial Sequence
  MKO10037538_A_Olfr483
  gRNA
auccguugaaugcuuccuuu

SEQ ID NO: 37539 - RNA, 20 nt, Artificial Sequence
  MKO10037539_A_Olfr483
  gRNA
agauugugcuucucuccaac

SEQ ID NO: 37540 - RNA, 20 nt, Artificial Sequence
  MKO10037540_A_Olfr484
  gRNA
agcucuccuguucugauguc

SEQ ID NO: 37541 - RNA, 20 nt, Artificial Sequence
  MKO10037541_A_Olfr484
  gRNA
aguuacuaugcuaacagugu

SEQ ID NO: 37542 - RNA, 20 nt, Artificial Sequence
  MKO10037542_A_Olfr484
  gRNA
aacugugccagcagaaaaug

SEQ ID NO: 37543 - RNA, 20 nt, Artificial Sequence
  MKO10037543_A_Olfr485
  gRNA
uaagcagcuaugauauccua

SEQ ID NO: 37544 - RNA, 20 nt, Artificial Sequence
  MKO10037544_A_Olfr485
  gRNA
uccccggaguagguggauuu

SEQ ID NO: 37545 - RNA, 20 nt, Artificial Sequence
  MKO10037545_A_Olfr485
  gRNA
augccaaaauccaccuacuc

SEQ ID NO: 37546 - RNA, 20 nt, Artificial Sequence
  MKO10037546_A_Olfr486
  gRNA
ccuuaaucucauuguuccga

SEQ ID NO: 37547 - RNA, 20 nt, Artificial Sequence
  MKO10037547_A_Olfr486
  gRNA
cuugaagauucguuccacug

SEQ ID NO: 37548 - RNA, 20 nt, Artificial Sequence
  MKO10037548_A_Olfr486
  gRNA
ugcagaagaguaugacuuua

SEQ ID NO: 37549 - RNA, 20 nt, Artificial Sequence
  MKO10037549_A_Olfr487
  gRNA
ugcccaaguccaucuacucc

SEQ ID NO: 37550 - RNA, 20 nt, Artificial Sequence
  MKO10037550_A_Olfr487
  gRNA
aguggugucucuguucuacg

SEQ ID NO: 37551 - RNA, 20 nt, Artificial Sequence
  MKO10037551_A_Olfr487
  gRNA
cauaaguaccuacaaccaac

SEQ ID NO: 37552 - RNA, 20 nt, Artificial Sequence
  MKO10037552_A_Olfr488
  gRNA
cacacgauucuguauccagu

SEQ ID NO: 37553 - RNA, 20 nt, Artificial Sequence
  MKO10037553_A_Olfr488
  gRNA
acagaaucguguggacaauu

SEQ ID NO: 37554 - RNA, 20 nt, Artificial Sequence
  MKO10037554_A_Olfr488
  gRNA
cacuuagcuacuguugaccu

SEQ ID NO: 37555 - RNA, 20 nt, Artificial Sequence
  MKO10037555_A_Olfr48
  gRNA
agcagccaucuaucagcgac

SEQ ID NO: 37556 - RNA, 20 nt, Artificial Sequence
  MKO10037556_A_Olfr48
  gRNA
caccgcuuuaucaauagaga

SEQ ID NO: 37557 - RNA, 20 nt, Artificial Sequence
  MKO10037557_A_Olfr48
  gRNA
uaucaccgaauucauccuug

SEQ ID NO: 37558 - RNA, 20 nt, Artificial Sequence
  MKO10037558_A_Olfr490
  gRNA
gccuaaguccagcuauucaa

SEQ ID NO: 37559 - RNA, 20 nt, Artificial Sequence
  MKO10037559_A_Olfr490
  gRNA
gaacacgagagcucagcuaa

SEQ ID NO: 37560 - RNA, 20 nt, Artificial Sequence
  MKO10037560_A_Olfr490
  gRNA
uccauugaauagcuggacuu

SEQ ID NO: 37561 - RNA, 20 nt, Artificial Sequence
  MKO10037561_A_Olfr491
  gRNA
guuacaccuauaauguuaau

SEQ ID NO: 37562 - RNA, 20 nt, Artificial Sequence
  MKO10037562_A_Olfr491
  gRNA
gagauguuaaggaagcgcug

SEQ ID NO: 37563 - RNA, 20 nt, Artificial Sequence
  MKO10037563_A_Olfr491
  gRNA
gcuacucaacuaagcagaac

SEQ ID NO: 37564 - RNA, 20 nt, Artificial Sequence
  MKO10037564_A_Olfr492
  gRNA
uuguaggaucuuauacaggg

SEQ ID NO: 37565 - RNA, 20 nt, Artificial Sequence
  MKO10037565_A_Olfr492
  gRNA
caaugucaacagagcccacg

SEQ ID NO: 37566 - RNA, 20 nt, Artificial Sequence
  MKO10037566_A_Olfr492
  gRNA
aaacacaccauugccuaccu

SEQ ID NO: 37567 - RNA, 20 nt, Artificial Sequence
  MKO10037567_A_Olfr493
  gRNA
aguuacuaugaucacaaugu

SEQ ID NO: 37568 - RNA, 20 nt, Artificial Sequence
  MKO10037568_A_Olfr493
  gRNA
gguacacccaagauaggaaa

SEQ ID NO: 37569 - RNA, 20 nt, Artificial Sequence
  MKO10037569_A_Olfr493
  gRNA
cauggcuuaugaucgguuua

SEQ ID NO: 37570 - RNA, 20 nt, Artificial Sequence
  MKO10037570_A_Olfr494
  gRNA
uauaagaucccacgacuaac

SEQ ID NO: 37571 - RNA, 20 nt, Artificial Sequence
  MKO10037571_A_Olfr494
  gRNA
guccuguauccaguuagucg

SEQ ID NO: 37572 - RNA, 20 nt, Artificial Sequence
  MKO10037572_A_Olfr494
  gRNA
gacugaaccagcagaaaaug

SEQ ID NO: 37573 - RNA, 20 nt, Artificial Sequence
  MKO10037573_A_Olfr495
  gRNA
ggaagcacucaacugucgca

SEQ ID NO: 37574 - RNA, 20 nt, Artificial Sequence
  MKO10037574_A_Olfr495
  gRNA
cuccacagaaagucgauaca

SEQ ID NO: 37575 - RNA, 20 nt, Artificial Sequence
  MKO10037575_A_Olfr495
  gRNA
ggccuuguaucgacuuucug

SEQ ID NO: 37576 - RNA, 20 nt, Artificial Sequence
  MKO10037576_A_Olfr497
  gRNA
uagugaagaguacaacucug

SEQ ID NO: 37577 - RNA, 20 nt, Artificial Sequence
  MKO10037577_A_Olfr497
  gRNA
aaaugguauuucucucaauc

SEQ ID NO: 37578 - RNA, 20 nt, Artificial Sequence
  MKO10037578_A_Olfr497
  gRNA
aaaaaaugaucaacucuauu

SEQ ID NO: 37579 - RNA, 20 nt, Artificial Sequence
  MKO10037579_A_Olfr498
  gRNA
gaaggccuugcaucgacuuu

SEQ ID NO: 37580 - RNA, 20 nt, Artificial Sequence
  MKO10037580_A_Olfr498
  gRNA
cuccaccgaaagucgaugca

SEQ ID NO: 37581 - RNA, 20 nt, Artificial Sequence
  MKO10037581_A_Olfr498
  gRNA
auggucauacuggguaauug

SEQ ID NO: 37582 - RNA, 20 nt, Artificial Sequence
  MKO10037582_A_Olfr49
  gRNA
aacaguagugcuguucgcca

SEQ ID NO: 37583 - RNA, 20 nt, Artificial Sequence
  MKO10037583_A_Olfr49
  gRNA
ccuccgcaacuuugccaugc

SEQ ID NO: 37584 - RNA, 20 nt, Artificial Sequence
  MKO10037584_A_Olfr49
  gRNA
guauuucagcagccguucug

SEQ ID NO: 37585 - RNA, 20 nt, Artificial Sequence
  MKO10037585_A_Olfr502
  gRNA
gugaaugagggaacaacugc

SEQ ID NO: 37586 - RNA, 20 nt, Artificial Sequence
  MKO10037586_A_Olfr502
  gRNA
gccacauccuagauaggaga

SEQ ID NO: 37587 - RNA, 20 nt, Artificial Sequence
  MKO10037587_A_Olfr502
  gRNA
guuguucccucauucacagc

SEQ ID NO: 37588 - RNA, 20 nt, Artificial Sequence
  MKO10037588_A_Olfr503
  gRNA
uuagcauggucaugucagcg

SEQ ID NO: 37589 - RNA, 20 nt, Artificial Sequence
  MKO10037589_A_Olfr503
  gRNA
aagugccuacccuacuuucg

SEQ ID NO: 37590 - RNA, 20 nt, Artificial Sequence
  MKO10037590_A_Olfr503
  gRNA
uauuauauugccucgaaagu

SEQ ID NO: 37591 - RNA, 20 nt, Artificial Sequence
  MKO10037591_A_Olfr504
  gRNA
cuacaaugacaguauagaag

SEQ ID NO: 37592 - RNA, 20 nt, Artificial Sequence
  MKO10037592_A_Olfr504
  gRNA
agcuccgacaaagcaccuuu

SEQ ID NO: 37593 - RNA, 20 nt, Artificial Sequence
  MKO10037593_A_Olfr504
  gRNA
ggcccauguccaccagagaa

SEQ ID NO: 37594 - RNA, 20 nt, Artificial Sequence
  MKO10037594_A_Olfr506
  gRNA
uguaugcuacuacaagcaac

SEQ ID NO: 37595 - RNA, 20 nt, Artificial Sequence
  MKO10037595_A_Olfr506
  gRNA
gacagugccaacagauauag

SEQ ID NO: 37596 - RNA, 20 nt, Artificial Sequence
  MKO10037596_A_Olfr506
  gRNA
cuuguaguagcauacauaag

SEQ ID NO: 37597 - RNA, 20 nt, Artificial Sequence
  MKO10037597_A_Olfr507
  gRNA
cugucccauggguauccuga

SEQ ID NO: 37598 - RNA, 20 nt, Artificial Sequence
  MKO10037598_A_Olfr507
  gRNA
uauaagaucccacuagcaac

SEQ ID NO: 37599 - RNA, 20 nt, Artificial Sequence
  MKO10037599_A_Olfr507
  gRNA
agucuguauccaguugcuag

SEQ ID NO: 37600 - RNA, 20 nt, Artificial Sequence
  MKO10037600_A_Olfr508
  gRNA
uaugcucgcauugcccauua

SEQ ID NO: 37601 - RNA, 20 nt, Artificial Sequence
  MKO10037601_A_Olfr508
  gRNA
aucgacccugaagagauugc

SEQ ID NO: 37602 - RNA, 20 nt, Artificial Sequence
  MKO10037602_A_Olfr508
  gRNA
aucugcguggcauagagcag

SEQ ID NO: 37603 - RNA, 20 nt, Artificial Sequence
  MKO10037603_A_Olfr509
  gRNA
gaucugccuucaccucaucg

SEQ ID NO: 37604 - RNA, 20 nt, Artificial Sequence
  MKO10037604_A_Olfr509
  gRNA
uugauaucaaguccacuaac

SEQ ID NO: 37605 - RNA, 20 nt, Artificial Sequence
  MKO10037605_A_Olfr509
  gRNA
gauccugccccgccuguuag

SEQ ID NO: 37606 - RNA, 20 nt, Artificial Sequence
  MKO10037606_A_Olfr50
  gRNA
uuaggauaguggccccuaug

SEQ ID NO: 37607 - RNA, 20 nt, Artificial Sequence
  MKO10037607_A_Olfr50
  gRNA
aguaauccucacuuuagcag

SEQ ID NO: 37608 - RNA, 20 nt, Artificial Sequence
  MKO10037608_A_Olfr50
  gRNA
ugaccaccacugcuaaagug

SEQ ID NO: 37609 - RNA, 20 nt, Artificial Sequence
  MKO10037609_A_Olfr510
  gRNA
aguauauccuacauugggug

SEQ ID NO: 37610 - RNA, 20 nt, Artificial Sequence
  MKO10037610_A_Olfr510
  gRNA
auauacugcuccucuccacc

SEQ ID NO: 37611 - RNA, 20 nt, Artificial Sequence
  MKO10037611_A_Olfr510
  gRNA
guguguauccaauugcuugu

SEQ ID NO: 37612 - RNA, 20 nt, Artificial Sequence
  MKO10037612_A_Olfr512
  gRNA
uugccuccucauuacaauau

SEQ ID NO: 37613 - RNA, 20 nt, Artificial Sequence
  MKO10037613_A_Olfr512
  gRNA
guuccaauauuguaaugagg

SEQ ID NO: 37614 - RNA, 20 nt, Artificial Sequence
  MKO10037614_A_Olfr512
  gRNA
gacuuuccuaguuaucuauc

SEQ ID NO: 37615 - RNA, 20 nt, Artificial Sequence
  MKO10037615_A_Olfr513
  gRNA
gcagacccgcugugucauga

SEQ ID NO: 37616 - RNA, 20 nt, Artificial Sequence
  MKO10037616_A_Olfr513
  gRNA
uauaaaaauugagccuuccc

SEQ ID NO: 37617 - RNA, 20 nt, Artificial Sequence
  MKO10037617_A_Olfr513
  gRNA
gaggacaaauucuguuacug

SEQ ID NO: 37618 - RNA, 20 nt, Artificial Sequence
  MKO10037618_A_Olfr514
  gRNA
aaauucucuucaccguccug

SEQ ID NO: 37619 - RNA, 20 nt, Artificial Sequence
  MKO10037619_A_Olfr514
  gRNA
aagcuccaaacauguguacu

SEQ ID NO: 37620 - RNA, 20 nt, Artificial Sequence
  MKO10037620_A_Olfr514
  gRNA
cugcgcaaaacaacccccaa

SEQ ID NO: 37621 - RNA, 20 nt, Artificial Sequence
  MKO10037621_A_Olfr516
  gRNA
ugaugacuguacugaaacag

SEQ ID NO: 37622 - RNA, 20 nt, Artificial Sequence
  MKO10037622_A_Olfr516
  gRNA
uauaagacaagaguaucaac

SEQ ID NO: 37623 - RNA, 20 nt, Artificial Sequence
  MKO10037623_A_Olfr516
  gRNA
ugacuacucugcagaccaca

SEQ ID NO: 37624 - RNA, 20 nt, Artificial Sequence
  MKO10037624_A_Olfr517
  gRNA
agacaaaagaaucagcacga

SEQ ID NO: 37625 - RNA, 20 nt, Artificial Sequence
  MKO10037625_A_Olfr517
  gRNA
aagccccaaacauuugccuu

SEQ ID NO: 37626 - RNA, 20 nt, Artificial Sequence
  MKO10037626_A_Olfr517
  gRNA
ugacuacuuugcagaccaua

SEQ ID NO: 37627 - RNA, 20 nt, Artificial Sequence
  MKO10037627_A_Olfr518
  gRNA
ugguugcuuucucgcuggua

SEQ ID NO: 37628 - RNA, 20 nt, Artificial Sequence
  MKO10037628_A_Olfr518
  gRNA
agaggcgcaaaauauaagag

SEQ ID NO: 37629 - RNA, 20 nt, Artificial Sequence
  MKO10037629_A_Olfr518
  gRNA
uugcgccucuaagagcagcu

SEQ ID NO: 37630 - RNA, 20 nt, Artificial Sequence
  MKO10037630_A_Olfr519
  gRNA
gucaugauacucaagaccca

SEQ ID NO: 37631 - RNA, 20 nt, Artificial Sequence
  MKO10037631_A_Olfr519
  gRNA
gucuggugaguacccggauu

SEQ ID NO: 37632 - RNA, 20 nt, Artificial Sequence
  MKO10037632_A_Olfr519
  gRNA
ugaaauuggugaugugucca

SEQ ID NO: 37633 - RNA, 20 nt, Artificial Sequence
  MKO10037633_A_Olfr51
  gRNA
cuuuaaugucacgauuccuc

SEQ ID NO: 37634 - RNA, 20 nt, Artificial Sequence
  MKO10037634_A_Olfr51
  gRNA
aggaaagcccugucgacgug

SEQ ID NO: 37635 - RNA, 20 nt, Artificial Sequence
  MKO10037635_A_Olfr51
  gRNA
acugucuagugagucccaag

SEQ ID NO: 37636 - RNA, 20 nt, Artificial Sequence
  MKO10037636_A_Olfr520
  gRNA
uuaccgagcuaaccugcccu

SEQ ID NO: 37637 - RNA, 20 nt, Artificial Sequence
  MKO10037637_A_Olfr520
  gRNA
gaauccugacgucagugcuu

SEQ ID NO: 37638 - RNA, 20 nt, Artificial Sequence
  MKO10037638_A_Olfr520
  gRNA
ugauccgaagcacugacguc

SEQ ID NO: 37639 - RNA, 20 nt, Artificial Sequence
  MKO10037639_A_Olfr521
  gRNA
ggaguugauccgaaguacug

SEQ ID NO: 37640 - RNA, 20 nt, Artificial Sequence
  MKO10037640_A_Olfr521
  gRNA
uuaccgggcugaccuacccu

SEQ ID NO: 37641 - RNA, 20 nt, Artificial Sequence
  MKO10037641_A_Olfr521
  gRNA
caauguugucaaacgccauc

SEQ ID NO: 37642 - RNA, 20 nt, Artificial Sequence
  MKO10037642_A_Olfr522
  gRNA
caacugcagcaacaacgcuu

SEQ ID NO: 37643 - RNA, 20 nt, Artificial Sequence
  MKO10037643_A_Olfr522
  gRNA
gcgcaaccgugacaucagag

SEQ ID NO: 37644 - RNA, 20 nt, Artificial Sequence
  MKO10037644_A_Olfr522
  gRNA
ucgaaggagcuuauggcaug

SEQ ID NO: 37645 - RNA, 20 nt, Artificial Sequence
  MKO10037645_A_Olfr523
  gRNA
cuacuaucuucuugcacgug

SEQ ID NO: 37646 - RNA, 20 nt, Artificial Sequence
  MKO10037646_A_Olfr523
  gRNA
guccaaggagcucucuaccg

SEQ ID NO: 37647 - RNA, 20 nt, Artificial Sequence
  MKO10037647_A_Olfr523
  gRNA
augaugccaccguagcgcag

SEQ ID NO: 37648 - RNA, 20 nt, Artificial Sequence
  MKO10037648_A_Olfr524
  gRNA
cuguaccgagugcgcgcucu

SEQ ID NO: 37649 - RNA, 20 nt, Artificial Sequence
  MKO10037649_A_Olfr524
  gRNA
gugcuacgcaugcccuccgc

SEQ ID NO: 37650 - RNA, 20 nt, Artificial Sequence
  MKO10037650_A_Olfr524
  gRNA
gacacccaagagcgcgcacu

SEQ ID NO: 37651 - RNA, 20 nt, Artificial Sequence
  MKO10037651_A_Olfr525
  gRNA
accccgccauuuauucucua

SEQ ID NO: 37652 - RNA, 20 nt, Artificial Sequence
  MKO10037652_A_Olfr525
  gRNA
aucuacaccuauuugcagcc

SEQ ID NO: 37653 - RNA, 20 nt, Artificial Sequence
  MKO10037653_A_Olfr525
  gRNA
ccugcgcauccgcuccacag

SEQ ID NO: 37654 - RNA, 20 nt, Artificial Sequence
  MKO10037654_A_Olfr527
  gRNA
ugugcacgcugguguuaguc

SEQ ID NO: 37655 - RNA, 20 nt, Artificial Sequence
  MKO10037655_A_Olfr527
  gRNA
agaaugguagacgcaacauc

SEQ ID NO: 37656 - RNA, 20 nt, Artificial Sequence
  MKO10037656_A_Olfr527
  gRNA
auucaauugcguuggagcac

SEQ ID NO: 37657 - RNA, 20 nt, Artificial Sequence
  MKO10037657_A_Olfr52
  gRNA
cuacaagcagcugucuauuu

SEQ ID NO: 37658 - RNA, 20 nt, Artificial Sequence
  MKO10037658_A_Olfr52
  gRNA
cuauagcuauaguuuccuca

SEQ ID NO: 37659 - RNA, 20 nt, Artificial Sequence
  MKO10037659_A_Olfr52
  gRNA
guucucuaaauauagaaguc

SEQ ID NO: 37660 - RNA, 20 nt, Artificial Sequence
  MKO10037660_A_Olfr530
  gRNA
cauggcgcugguaaaccagu

SEQ ID NO: 37661 - RNA, 20 nt, Artificial Sequence
  MKO10037661_A_Olfr530
  gRNA
cacagaccuugccgcucaug

SEQ ID NO: 37662 - RNA, 20 nt, Artificial Sequence
  MKO10037662_A_Olfr530
  gRNA
ugaacauggucacaaccgac

SEQ ID NO: 37663 - RNA, 20 nt, Artificial Sequence
  MKO10037663_A_Olfr531
  gRNA
gcccucugcauuauaguacc

SEQ ID NO: 37664 - RNA, 20 nt, Artificial Sequence
  MKO10037664_A_Olfr531
  gRNA
ugaggaaaaguaguauccga

SEQ ID NO: 37665 - RNA, 20 nt, Artificial Sequence
  MKO10037665_A_Olfr531
  gRNA
agaaugguagacguagcacc

SEQ ID NO: 37666 - RNA, 20 nt, Artificial Sequence
  MKO10037666_A_Olfr532
  gRNA
aucuacaccuaucuacagcc

SEQ ID NO: 37667 - RNA, 20 nt, Artificial Sequence
  MKO10037667_A_Olfr532
  gRNA
uagccaucagccucaaccca

SEQ ID NO: 37668 - RNA, 20 nt, Artificial Sequence
  MKO10037668_A_Olfr532
  gRNA
cuggugcgacucaauuucug

SEQ ID NO: 37669 - RNA, 20 nt, Artificial Sequence
  MKO10037669_A_Olfr533
  gRNA
cacuggagcuuucaauucau

SEQ ID NO: 37670 - RNA, 20 nt, Artificial Sequence
  MKO10037670_A_Olfr533
  gRNA
ccucuugagaacuuugagcu

SEQ ID NO: 37671 - RNA, 20 nt, Artificial Sequence
  MKO10037671_A_Olfr533
  gRNA
ccaagcucaaaguucucaag

SEQ ID NO: 37672 - RNA, 20 nt, Artificial Sequence
  MKO10037672_A_Olfr535
  gRNA
ucugauuggccuaguguuug

SEQ ID NO: 37673 - RNA, 20 nt, Artificial Sequence
  MKO10037673_A_Olfr535
  gRNA
augcugacccuguuguccua

SEQ ID NO: 37674 - RNA, 20 nt, Artificial Sequence
  MKO10037674_A_Olfr535
  gRNA
ucuggacuauagcuagaagc

SEQ ID NO: 37675 - RNA, 20 nt, Artificial Sequence
  MKO10037675_A_Olfr536
  gRNA
aaaacuucguugaugacccc

SEQ ID NO: 37676 - RNA, 20 nt, Artificial Sequence
  MKO10037676_A_Olfr536
  gRNA
auagagcaguagaguaauaa

SEQ ID NO: 37677 - RNA, 20 nt, Artificial Sequence
  MKO10037677_A_Olfr536
  gRNA
ugaacaugguuauagcugac

SEQ ID NO: 37678 - RNA, 20 nt, Artificial Sequence
  MKO10037678_A_Olfr538
  gRNA
ccuaugcaacuuagcaacca

SEQ ID NO: 37679 - RNA, 20 nt, Artificial Sequence
  MKO10037679_A_Olfr538
  gRNA
cucuacuuaauuugauaaag

SEQ ID NO: 37680 - RNA, 20 nt, Artificial Sequence
  MKO10037680_A_Olfr538
  gRNA
auaacgcuauuuacauaugu

SEQ ID NO: 37681 - RNA, 20 nt, Artificial Sequence
  MKO10037681_A_Olfr539
  gRNA
gcaucaucauggagagcacc

SEQ ID NO: 37682 - RNA, 20 nt, Artificial Sequence
  MKO10037682_A_Olfr539
  gRNA
agcgugucauuagaccagug

SEQ ID NO: 37683 - RNA, 20 nt, Artificial Sequence
  MKO10037683_A_Olfr539
  gRNA
gauacacacaaugguggacc

SEQ ID NO: 37684 - RNA, 20 nt, Artificial Sequence
  MKO10037684_A_Olfr53
  gRNA
gacgaccgaguauagcacug

SEQ ID NO: 37685 - RNA, 20 nt, Artificial Sequence
  MKO10037685_A_Olfr53
  gRNA
uuguugagucucaaccagac

SEQ ID NO: 37686 - RNA, 20 nt, Artificial Sequence
  MKO10037686_A_Olfr53
  gRNA
ugaugaagccauaagauaac

SEQ ID NO: 37687 - RNA, 20 nt, Artificial Sequence
  MKO10037687_A_Olfr541
  gRNA
gugcuaacacuguuguccua

SEQ ID NO: 37688 - RNA, 20 nt, Artificial Sequence
  MKO10037688_A_Olfr541
  gRNA
gaucuaagauuguuccucau

SEQ ID NO: 37689 - RNA, 20 nt, Artificial Sequence
  MKO10037689_A_Olfr541
  gRNA
cccugguuggccuagugucu

SEQ ID NO: 37690 - RNA, 20 nt, Artificial Sequence
  MKO10037690_A_Olfr543
  gRNA
caacagugcgauguacucgc

SEQ ID NO: 37691 - RNA, 20 nt, Artificial Sequence
  MKO10037691_A_Olfr543
  gRNA
gcuccgcguuaucgcaaaag

SEQ ID NO: 37692 - RNA, 20 nt, Artificial Sequence
  MKO10037692_A_Olfr543
  gRNA
uaucuacuuuacgcuccuuc

SEQ ID NO: 37693 - RNA, 20 nt, Artificial Sequence
  MKO10037693_A_Olfr544
  gRNA
cccucgaauagagagcuucc

SEQ ID NO: 37694 - RNA, 20 nt, Artificial Sequence
  MKO10037694_A_Olfr544
  gRNA
ucgcaucuucaaccgagucc

SEQ ID NO: 37695 - RNA, 20 nt, Artificial Sequence
  MKO10037695_A_Olfr544
  gRNA
caucucgcugaauaagacgg

SEQ ID NO: 37696 - RNA, 20 nt, Artificial Sequence
  MKO10037696_A_Olfr545
  gRNA
ccucaggcgucauguugggu

SEQ ID NO: 37697 - RNA, 20 nt, Artificial Sequence
  MKO10037697_A_Olfr545
  gRNA
ucgaaccuuuaauagagucc

SEQ ID NO: 37698 - RNA, 20 nt, Artificial Sequence
  MKO10037698_A_Olfr545
  gRNA
auucagcgagaugucuccac

SEQ ID NO: 37699 - RNA, 20 nt, Artificial Sequence
  MKO10037699_A_Olfr547
  gRNA
guaagcgucgugaagauccc

SEQ ID NO: 37700 - RNA, 20 nt, Artificial Sequence
  MKO10037700_A_Olfr547
  gRNA
ucuucacgacgcuuacacag

SEQ ID NO: 37701 - RNA, 20 nt, Artificial Sequence
  MKO10037701_A_Olfr547
  gRNA
auagcauccgaguaaacauu

SEQ ID NO: 37702 - RNA, 20 nt, Artificial Sequence
  MKO10037702_A_Olfr549
  gRNA
aauccccgacucggcaauga

SEQ ID NO: 37703 - RNA, 20 nt, Artificial Sequence
  MKO10037703_A_Olfr549
  gRNA
uacacgcucacgaaucuguc

SEQ ID NO: 37704 - RNA, 20 nt, Artificial Sequence
  MKO10037704_A_Olfr549
  gRNA
ugcuaccuucauugccgagu

SEQ ID NO: 37705 - RNA, 20 nt, Artificial Sequence
  MKO10037705_A_Olfr54
  gRNA
cuugugccggcccuuugcag

SEQ ID NO: 37706 - RNA, 20 nt, Artificial Sequence
  MKO10037706_A_Olfr54
  gRNA
ucaggaaguacgucugaguu

SEQ ID NO: 37707 - RNA, 20 nt, Artificial Sequence
  MKO10037707_A_Olfr54
  gRNA
aggacuuagagccccuguug

SEQ ID NO: 37708 - RNA, 20 nt, Artificial Sequence
  MKO10037708_A_Olfr550
  gRNA
gauccguacggaucaggaaa

SEQ ID NO: 37709 - RNA, 20 nt, Artificial Sequence
  MKO10037709_A_Olfr550
  gRNA
gaaagaucagacgccgcaga

SEQ ID NO: 37710 - RNA, 20 nt, Artificial Sequence
  MKO10037710_A_Olfr550
  gRNA
caaugcccagcacaguccgu

SEQ ID NO: 37711 - RNA, 20 nt, Artificial Sequence
  MKO10037711_A_Olfr551
  gRNA
guagucggagugcuccaucu

SEQ ID NO: 37712 - RNA, 20 nt, Artificial Sequence
  MKO10037712_A_Olfr551
  gRNA
agcacuccgacuacucaaga

SEQ ID NO: 37713 - RNA, 20 nt, Artificial Sequence
  MKO10037713_A_Olfr551
  gRNA
ggccgggaauccccaugagc

SEQ ID NO: 37714 - RNA, 20 nt, Artificial Sequence
  MKO10037714_A_Olfr552
  gRNA
agacguuuccauuacugucg

SEQ ID NO: 37715 - RNA, 20 nt, Artificial Sequence
  MKO10037715_A_Olfr552
  gRNA
ucacugugccucgacaguaa

SEQ ID NO: 37716 - RNA, 20 nt, Artificial Sequence
  MKO10037716_A_Olfr552
  gRNA
cagauuagagagcgagucuu

SEQ ID NO: 37717 - RNA, 20 nt, Artificial Sequence
  MKO10037717_A_Olfr553
  gRNA
gcacauuguggccgaaacga

SEQ ID NO: 37718 - RNA, 20 nt, Artificial Sequence
  MKO10037718_A_Olfr553
  gRNA
uuccacuucuaauucgccua

SEQ ID NO: 37719 - RNA, 20 nt, Artificial Sequence
  MKO10037719_A_Olfr553
  gRNA
guccaauguagaauacuccu

SEQ ID NO: 37720 - RNA, 20 nt, Artificial Sequence
  MKO10037720_A_Olfr554
  gRNA
aaccgcaggcggaucauaag

SEQ ID NO: 37721 - RNA, 20 nt, Artificial Sequence
  MKO10037721_A_Olfr554
  gRNA
uaccacuuaugauccgccug

SEQ ID NO: 37722 - RNA, 20 nt, Artificial Sequence
  MKO10037722_A_Olfr554
  gRNA
gacuggagaccuugcacaua

SEQ ID NO: 37723 - RNA, 20 nt, Artificial Sequence
  MKO10037723_A_Olfr555
  gRNA
aagcauaacgcaaugggucu

SEQ ID NO: 37724 - RNA, 20 nt, Artificial Sequence
  MKO10037724_A_Olfr555
  gRNA
caccauagcuucauucugac

SEQ ID NO: 37725 - RNA, 20 nt, Artificial Sequence
  MKO10037725_A_Olfr555
  gRNA
caccauccuagcaguuguca

SEQ ID NO: 37726 - RNA, 20 nt, Artificial Sequence
  MKO10037726_A_Olfr556
  gRNA
ucucacccgucaugugaugc

SEQ ID NO: 37727 - RNA, 20 nt, Artificial Sequence
  MKO10037727_A_Olfr556
  gRNA
aacucgguccugcccuagcc

SEQ ID NO: 37728 - RNA, 20 nt, Artificial Sequence
  MKO10037728_A_Olfr556
  gRNA
uauuaggaccagacaaaucc

SEQ ID NO: 37729 - RNA, 20 nt, Artificial Sequence
  MKO10037729_A_Olfr557
  gRNA
cccauaaacgacauuaacuu

SEQ ID NO: 37730 - RNA, 20 nt, Artificial Sequence
  MKO10037730_A_Olfr557
  gRNA
uauucaugcccuaucugcca

SEQ ID NO: 37731 - RNA, 20 nt, Artificial Sequence
  MKO10037731_A_Olfr557
  gRNA
cuaucagugguacauaggcu

SEQ ID NO: 37732 - RNA, 20 nt, Artificial Sequence
  MKO10037732_A_Olfr558
  gRNA
accaucgacaauccaaugaa

SEQ ID NO: 37733 - RNA, 20 nt, Artificial Sequence
  MKO10037733_A_Olfr558
  gRNA
aaagacgaagaaugcgcugc

SEQ ID NO: 37734 - RNA, 20 nt, Artificial Sequence
  MKO10037734_A_Olfr558
  gRNA
ggucaggggugcaguacuaa

SEQ ID NO: 37735 - RNA, 20 nt, Artificial Sequence
  MKO10037735_A_Olfr559
  gRNA
gugucaaguccaagcccauc

SEQ ID NO: 37736 - RNA, 20 nt, Artificial Sequence
  MKO10037736_A_Olfr559
  gRNA
ucuccaaggaugaucccuuc

SEQ ID NO: 37737 - RNA, 20 nt, Artificial Sequence
  MKO10037737_A_Olfr559
  gRNA
agaugcauagcgcagugggu

SEQ ID NO: 37738 - RNA, 20 nt, Artificial Sequence
  MKO10037738_A_Olfr55
  gRNA
gaacaugacaaguaaaaugg

SEQ ID NO: 37739 - RNA, 20 nt, Artificial Sequence
  MKO10037739_A_Olfr55
  gRNA
auguaccucuucacucugcu

SEQ ID NO: 37740 - RNA, 20 nt, Artificial Sequence
  MKO10037740_A_Olfr55
  gRNA
acccaugacagugaguagaa

SEQ ID NO: 37741 - RNA, 20 nt, Artificial Sequence
  MKO10037741_A_Olfr560
  gRNA
cucuuaagaagugcgaccau

SEQ ID NO: 37742 - RNA, 20 nt, Artificial Sequence
  MKO10037742_A_Olfr560
  gRNA
auauagcuacagccccgaua

SEQ ID NO: 37743 - RNA, 20 nt, Artificial Sequence
  MKO10037743_A_Olfr560
  gRNA
cacagcuuuacguaucuguu

SEQ ID NO: 37744 - RNA, 20 nt, Artificial Sequence
  MKO10037744_A_Olfr561
  gRNA
cacugcaaugauucgagaau

SEQ ID NO: 37745 - RNA, 20 nt, Artificial Sequence
  MKO10037745_A_Olfr561
  gRNA
guaggcagugcucucguuga

SEQ ID NO: 37746 - RNA, 20 nt, Artificial Sequence
  MKO10037746_A_Olfr561
  gRNA
caaaucugugcaccaaugac

SEQ ID NO: 37747 - RNA, 20 nt, Artificial Sequence
  MKO10037747_A_Olfr564
  gRNA
aagaccgaagcauaccuaag

SEQ ID NO: 37748 - RNA, 20 nt, Artificial Sequence
  MKO10037748_A_Olfr564
  gRNA
cacagccuuccguaucuucu

SEQ ID NO: 37749 - RNA, 20 nt, Artificial Sequence
  MKO10037749_A_Olfr564
  gRNA
aaacuagcucuuugucaugc

SEQ ID NO: 37750 - RNA, 20 nt, Artificial Sequence
  MKO10037750_A_Olfr566
  gRNA
auauggucggucagcaccca

SEQ ID NO: 37751 - RNA, 20 nt, Artificial Sequence
  MKO10037751_A_Olfr566
  gRNA
acagagcacgcauuaucacu

SEQ ID NO: 37752 - RNA, 20 nt, Artificial Sequence
  MKO10037752_A_Olfr566
  gRNA
guaucgccuccucugaagaa

SEQ ID NO: 37753 - RNA, 20 nt, Artificial Sequence
  MKO10037753_A_Olfr568
  gRNA
cgggugcugaauggccguag

SEQ ID NO: 37754 - RNA, 20 nt, Artificial Sequence
  MKO10037754_A_Olfr568
  gRNA
uugucucuuguacaccgcua

SEQ ID NO: 37755 - RNA, 20 nt, Artificial Sequence
  MKO10037755_A_Olfr568
  gRNA
gcucacgaacgaucaccagc

SEQ ID NO: 37756 - RNA, 20 nt, Artificial Sequence
  MKO10037756_A_Olfr569
  gRNA
ggucaauucggauuauguau

SEQ ID NO: 37757 - RNA, 20 nt, Artificial Sequence
  MKO10037757_A_Olfr569
  gRNA
acagggucauccgaggauuc

SEQ ID NO: 37758 - RNA, 20 nt, Artificial Sequence
  MKO10037758_A_Olfr569
  gRNA
auacaacgccugccucaucc

SEQ ID NO: 37759 - RNA, 20 nt, Artificial Sequence
  MKO10037759_A_Olfr56
  gRNA
cuaggagcgcgauaucgccu

SEQ ID NO: 37760 - RNA, 20 nt, Artificial Sequence
  MKO10037760_A_Olfr56
  gRNA
uccgauuuguaugccacagc

SEQ ID NO: 37761 - RNA, 20 nt, Artificial Sequence
  MKO10037761_A_Olfr56
  gRNA
gacuuccuaugcucgcaucu

SEQ ID NO: 37762 - RNA, 20 nt, Artificial Sequence
  MKO10037762_A_Olfr570
  gRNA
guauugcaucccauggggag

SEQ ID NO: 37763 - RNA, 20 nt, Artificial Sequence
  MKO10037763_A_Olfr570
  gRNA
gaugauucucaauaccuccg

SEQ ID NO: 37764 - RNA, 20 nt, Artificial Sequence
  MKO10037764_A_Olfr570
  gRNA
gaaugaagagauuucgaccu

SEQ ID NO: 37765 - RNA, 20 nt, Artificial Sequence
  MKO10037765_A_Olfr571
  gRNA
caugccauauugccguccac

SEQ ID NO: 37766 - RNA, 20 nt, Artificial Sequence
  MKO10037766_A_Olfr571
  gRNA
caagcuaggcgagccauauc

SEQ ID NO: 37767 - RNA, 20 nt, Artificial Sequence
  MKO10037767_A_Olfr571
  gRNA
gauggcuacugcccgaucga

SEQ ID NO: 37768 - RNA, 20 nt, Artificial Sequence
  MKO10037768_A_Olfr572
  gRNA
gauugcuaugacccgaucaa

SEQ ID NO: 37769 - RNA, 20 nt, Artificial Sequence
  MKO10037769_A_Olfr572
  gRNA
ucgaaccaagauuacaacag

SEQ ID NO: 37770 - RNA, 20 nt, Artificial Sequence
  MKO10037770_A_Olfr572
  gRNA
cgugcgaaguaugaacacau

SEQ ID NO: 37771 - RNA, 20 nt, Artificial Sequence
  MKO10037771_A_Olfr574
  gRNA
uauggcuuggcgaauaaccu

SEQ ID NO: 37772 - RNA, 20 nt, Artificial Sequence
  MKO10037772_A_Olfr574
  gRNA
acgugagcaaguucuaaucc

SEQ ID NO: 37773 - RNA, 20 nt, Artificial Sequence
  MKO10037773_A_Olfr574
  gRNA
acaauaagucagugccguuc

SEQ ID NO: 37774 - RNA, 20 nt, Artificial Sequence
  MKO10037774_A_Olfr575
  gRNA
uuagcauccaugcaccgcuu

SEQ ID NO: 37775 - RNA, 20 nt, Artificial Sequence
  MKO10037775_A_Olfr575
  gRNA
cagugcaagagucgccaaaa

SEQ ID NO: 37776 - RNA, 20 nt, Artificial Sequence
  MKO10037776_A_Olfr575
  gRNA
aucccauaaagagcgccuca

SEQ ID NO: 37777 - RNA, 20 nt, Artificial Sequence
  MKO10037777_A_Olfr576
  gRNA
caaagcgauguauggcagcc

SEQ ID NO: 37778 - RNA, 20 nt, Artificial Sequence
  MKO10037778_A_Olfr576
  gRNA
gauaaugcaguuacccauga

SEQ ID NO: 37779 - RNA, 20 nt, Artificial Sequence
  MKO10037779_A_Olfr576
  gRNA
caaauccgggagaaggucuu

SEQ ID NO: 37780 - RNA, 20 nt, Artificial Sequence
  MKO10037780_A_Olfr577
  gRNA
ggugcgcagaauaagugcau

SEQ ID NO: 37781 - RNA, 20 nt, Artificial Sequence
  MKO10037781_A_Olfr577
  gRNA
uacccuaucccguaucuguu

SEQ ID NO: 37782 - RNA, 20 nt, Artificial Sequence
  MKO10037782_A_Olfr577
  gRNA
gggaaccguuugagcaugaa

SEQ ID NO: 37783 - RNA, 20 nt, Artificial Sequence
  MKO10037783_A_Olfr578
  gRNA
gauacgcugucguauuugcu

SEQ ID NO: 37784 - RNA, 20 nt, Artificial Sequence
  MKO10037784_A_Olfr578
  gRNA
cgaugacuccacuaaagaca

SEQ ID NO: 37785 - RNA, 20 nt, Artificial Sequence
  MKO10037785_A_Olfr578
  gRNA
gagcacggaggcgcuccuga

SEQ ID NO: 37786 - RNA, 20 nt, Artificial Sequence
  MKO10037786_A_Olfr57
  gRNA
ugacagccguaacaccaaaa

SEQ ID NO: 37787 - RNA, 20 nt, Artificial Sequence
  MKO10037787_A_Olfr57
  gRNA
acuuaaucaaguuguacacc

SEQ ID NO: 37788 - RNA, 20 nt, Artificial Sequence
  MKO10037788_A_Olfr57
  gRNA
uucuaguuacacucccuaac

SEQ ID NO: 37789 - RNA, 20 nt, Artificial Sequence
  MKO10037789_A_Olfr582
  gRNA
gucuggggugcucauggaua

SEQ ID NO: 37790 - RNA, 20 nt, Artificial Sequence
  MKO10037790_A_Olfr582
  gRNA
aacucugucucugaucugcu

SEQ ID NO: 37791 - RNA, 20 nt, Artificial Sequence
  MKO10037791_A_Olfr582
  gRNA
caaacaugaugugaacaauu

SEQ ID NO: 37792 - RNA, 20 nt, Artificial Sequence
  MKO10037792_A_Olfr583
  gRNA
accagagacagacuaaacgu

SEQ ID NO: 37793 - RNA, 20 nt, Artificial Sequence
  MKO10037793_A_Olfr583
  gRNA
cccuacguuuagucugucuc

SEQ ID NO: 37794 - RNA, 20 nt, Artificial Sequence
  MKO10037794_A_Olfr583
  gRNA
guagagugugcauuaucacu

SEQ ID NO: 37795 - RNA, 20 nt, Artificial Sequence
  MKO10037795_A_Olfr584
  gRNA
acuggggaaugaucuuguug

SEQ ID NO: 37796 - RNA, 20 nt, Artificial Sequence
  MKO10037796_A_Olfr584
  gRNA
caaacaugaugugaacaacu

SEQ ID NO: 37797 - RNA, 20 nt, Artificial Sequence
  MKO10037797_A_Olfr584
  gRNA
aacccugucucugaucuguu

SEQ ID NO: 37798 - RNA, 20 nt, Artificial Sequence
  MKO10037798_A_Olfr585
  gRNA
cucaucugaagaacgacaca

SEQ ID NO: 37799 - RNA, 20 nt, Artificial Sequence
  MKO10037799_A_Olfr585
  gRNA
cauagcgaugcaccagagac

SEQ ID NO: 37800 - RNA, 20 nt, Artificial Sequence
  MKO10037800_A_Olfr585
  gRNA
guugaucucauucugacgac

SEQ ID NO: 37801 - RNA, 20 nt, Artificial Sequence
  MKO10037801_A_Olfr586
  gRNA
cuuagacgcacuagaguuac

SEQ ID NO: 37802 - RNA, 20 nt, Artificial Sequence
  MKO10037802_A_Olfr586
  gRNA
cacucguuaggagaaauguc

SEQ ID NO: 37803 - RNA, 20 nt, Artificial Sequence
  MKO10037803_A_Olfr586
  gRNA
aaaaagcaagcccgauuuga

SEQ ID NO: 37804 - RNA, 20 nt, Artificial Sequence
  MKO10037804_A_Olfr589
  gRNA
agaauggugcuguaccgaag

SEQ ID NO: 37805 - RNA, 20 nt, Artificial Sequence
  MKO10037805_A_Olfr589
  gRNA
aaucauagaaacgaccuuau

SEQ ID NO: 37806 - RNA, 20 nt, Artificial Sequence
  MKO10037806_A_Olfr589
  gRNA
uugagccgggcuucccgaga

SEQ ID NO: 37807 - RNA, 20 nt, Artificial Sequence
  MKO10037807_A_Olfr58
  gRNA
cgaagcuaccauacuuuccc

SEQ ID NO: 37808 - RNA, 20 nt, Artificial Sequence
  MKO10037808_A_Olfr58
  gRNA
auauaccugcucacuaugcu

SEQ ID NO: 37809 - RNA, 20 nt, Artificial Sequence
  MKO10037809_A_Olfr58
  gRNA
aaugaugcuugaaagaaaca

SEQ ID NO: 37810 - RNA, 20 nt, Artificial Sequence
  MKO10037810_A_Olfr591
  gRNA
ggccuggcuauuguacuucg

SEQ ID NO: 37811 - RNA, 20 nt, Artificial Sequence
  MKO10037811_A_Olfr591
  gRNA
cuccacgaaguacaauagcc

SEQ ID NO: 37812 - RNA, 20 nt, Artificial Sequence
  MKO10037812_A_Olfr591
  gRNA
ugaagucuaccccaccugug

SEQ ID NO: 37813 - RNA, 20 nt, Artificial Sequence
  MKO10037813_A_Olfr592
  gRNA
auccauaucaacgcugugua

SEQ ID NO: 37814 - RNA, 20 nt, Artificial Sequence
  MKO10037814_A_Olfr592
  gRNA
ucuuuccucacucaucgauu

SEQ ID NO: 37815 - RNA, 20 nt, Artificial Sequence
  MKO10037815_A_Olfr592
  gRNA
gagaaacgcuccuauuauua

SEQ ID NO: 37816 - RNA, 20 nt, Artificial Sequence
  MKO10037816_A_Olfr593
  gRNA
ugaagucuacuccgccugug

SEQ ID NO: 37817 - RNA, 20 nt, Artificial Sequence
  MKO10037817_A_Olfr593
  gRNA
uaaaacguagaccaugcaaa

SEQ ID NO: 37818 - RNA, 20 nt, Artificial Sequence
  MKO10037818_A_Olfr593
  gRNA
uaggucuagcuguugucauu

SEQ ID NO: 37819 - RNA, 20 nt, Artificial Sequence
  MKO10037819_A_Olfr594
  gRNA
aggauggugcuauaucgaag

SEQ ID NO: 37820 - RNA, 20 nt, Artificial Sequence
  MKO10037820_A_Olfr594
  gRNA
guucguaccccauauaugac

SEQ ID NO: 37821 - RNA, 20 nt, Artificial Sequence
  MKO10037821_A_Olfr594
  gRNA
uugauucgggcuucccgaga

SEQ ID NO: 37822 - RNA, 20 nt, Artificial Sequence
  MKO10037822_A_Olfr596
  gRNA
uguuuaucugauagcacuug

SEQ ID NO: 37823 - RNA, 20 nt, Artificial Sequence
  MKO10037823_A_Olfr596
  gRNA
agaauagagguauaccuaag

SEQ ID NO: 37824 - RNA, 20 nt, Artificial Sequence
  MKO10037824_A_Olfr596
  gRNA
ucauugcucucuccuaugcu

SEQ ID NO: 37825 - RNA, 20 nt, Artificial Sequence
  MKO10037825_A_Olfr597
  gRNA
ggguugguguaagcuacgcu

SEQ ID NO: 37826 - RNA, 20 nt, Artificial Sequence
  MKO10037826_A_Olfr597
  gRNA
guccggcauucuauuggcaa

SEQ ID NO: 37827 - RNA, 20 nt, Artificial Sequence
  MKO10037827_A_Olfr597
  gRNA
acuccaugcacuguaaggua

SEQ ID NO: 37828 - RNA, 20 nt, Artificial Sequence
  MKO10037828_A_Olfr598
  gRNA
caauuugaauggaccgaaaa

SEQ ID NO: 37829 - RNA, 20 nt, Artificial Sequence
  MKO10037829_A_Olfr598
  gRNA
cuucuucauccauacccuuc

SEQ ID NO: 37830 - RNA, 20 nt, Artificial Sequence
  MKO10037830_A_Olfr598
  gRNA
ggguugguguaagcuaugcu

SEQ ID NO: 37831 - RNA, 20 nt, Artificial Sequence
  MKO10037831_A_Olfr599
  gRNA
auucgggcaacuguacucgu

SEQ ID NO: 37832 - RNA, 20 nt, Artificial Sequence
  MKO10037832_A_Olfr599
  gRNA
aacccauuugcggaucuccu

SEQ ID NO: 37833 - RNA, 20 nt, Artificial Sequence
  MKO10037833_A_Olfr599
  gRNA
gugauucugauuggcauccc

SEQ ID NO: 37834 - RNA, 20 nt, Artificial Sequence
  MKO10037834_A_Olfr59
  gRNA
aacgguuguaaggguccaac

SEQ ID NO: 37835 - RNA, 20 nt, Artificial Sequence
  MKO10037835_A_Olfr59
  gRNA
ggugaagaggaugucaacac

SEQ ID NO: 37836 - RNA, 20 nt, Artificial Sequence
  MKO10037836_A_Olfr59
  gRNA
cacuagggccuugggcacug

SEQ ID NO: 37837 - RNA, 20 nt, Artificial Sequence
  MKO10037837_A_Olfr5
  gRNA
uucuaccacugcccgcuaca

SEQ ID NO: 37838 - RNA, 20 nt, Artificial Sequence
  MKO10037838_A_Olfr5
  gRNA
ucgugaggaagcaaccccaa

SEQ ID NO: 37839 - RNA, 20 nt, Artificial Sequence
  MKO10037839_A_Olfr5
  gRNA
cacgacuauggccuccuaug

SEQ ID NO: 37840 - RNA, 20 nt, Artificial Sequence
  MKO10037840_A_Olfr600
  gRNA
aucagucguggacuugugcc

SEQ ID NO: 37841 - RNA, 20 nt, Artificial Sequence
  MKO10037841_A_Olfr600
  gRNA
caguccgaaccaaacagaua

SEQ ID NO: 37842 - RNA, 20 nt, Artificial Sequence
  MKO10037842_A_Olfr600
  gRNA
gaagaaucaguguauacgac

SEQ ID NO: 37843 - RNA, 20 nt, Artificial Sequence
  MKO10037843_A_Olfr601
  gRNA
ccacagccgcaucgccguga

SEQ ID NO: 37844 - RNA, 20 nt, Artificial Sequence
  MKO10037844_A_Olfr601
  gRNA
cgaugccaaaagcaacacca

SEQ ID NO: 37845 - RNA, 20 nt, Artificial Sequence
  MKO10037845_A_Olfr601
  gRNA
gccuagaacaccuucaugug

SEQ ID NO: 37846 - RNA, 20 nt, Artificial Sequence
  MKO10037846_A_Olfr603
  gRNA
uguuuauccgauagcacuug

SEQ ID NO: 37847 - RNA, 20 nt, Artificial Sequence
  MKO10037847_A_Olfr603
  gRNA
agaacagagguauaccuaag

SEQ ID NO: 37848 - RNA, 20 nt, Artificial Sequence
  MKO10037848_A_Olfr603
  gRNA
cucuguucucaccaacaaag

SEQ ID NO: 37849 - RNA, 20 nt, Artificial Sequence
  MKO10037849_A_Olfr605
  gRNA
gccuagaacaccuccauguc

SEQ ID NO: 37850 - RNA, 20 nt, Artificial Sequence
  MKO10037850_A_Olfr605
  gRNA
uuagaaagggcgguaccaga

SEQ ID NO: 37851 - RNA, 20 nt, Artificial Sequence
  MKO10037851_A_Olfr605
  gRNA
caagcguuauagccucagug

SEQ ID NO: 37852 - RNA, 20 nt, Artificial Sequence
  MKO10037852_A_Olfr606
  gRNA
uaauguuauauacggaaugg

SEQ ID NO: 37853 - RNA, 20 nt, Artificial Sequence
  MKO10037853_A_Olfr606
  gRNA
uggaauagcacuccgaagua

SEQ ID NO: 37854 - RNA, 20 nt, Artificial Sequence
  MKO10037854_A_Olfr606
  gRNA
auuaaaccugaugucagcgc

SEQ ID NO: 37855 - RNA, 20 nt, Artificial Sequence
  MKO10037855_A_Olfr608
  gRNA
cguccaauguuauuacugaa

SEQ ID NO: 37856 - RNA, 20 nt, Artificial Sequence
  MKO10037856_A_Olfr608
  gRNA
gccccccacagucaauccgu

SEQ ID NO: 37857 - RNA, 20 nt, Artificial Sequence
  MKO10037857_A_Olfr608
  gRNA
uacacccagcuuaauaacca

SEQ ID NO: 37858 - RNA, 20 nt, Artificial Sequence
  MKO10037858_A_Olfr609
  gRNA
auuuggcguaucuuccggug

SEQ ID NO: 37859 - RNA, 20 nt, Artificial Sequence
  MKO10037859_A_Olfr609
  gRNA
caucauauagaucgucagca

SEQ ID NO: 37860 - RNA, 20 nt, Artificial Sequence
  MKO10037860_A_Olfr609
  gRNA
caugcugacgaucuauauga

SEQ ID NO: 37861 - RNA, 20 nt, Artificial Sequence
  MKO10037861_A_Olfr60
  gRNA
cauaaugcuguuuacguaug

SEQ ID NO: 37862 - RNA, 20 nt, Artificial Sequence
  MKO10037862_A_Olfr60
  gRNA
gcugguuggucuacuaucug

SEQ ID NO: 37863 - RNA, 20 nt, Artificial Sequence
  MKO10037863_A_Olfr60
  gRNA
aaagaugucaagcucgccau

SEQ ID NO: 37864 - RNA, 20 nt, Artificial Sequence
  MKO10037864_A_Olfr610
  gRNA
caucgagucagccguucucu

SEQ ID NO: 37865 - RNA, 20 nt, Artificial Sequence
  MKO10037865_A_Olfr610
  gRNA
auucucacaacaagacguau

SEQ ID NO: 37866 - RNA, 20 nt, Artificial Sequence
  MKO10037866_A_Olfr610
  gRNA
aaugcgaacucgaaucucuu

SEQ ID NO: 37867 - RNA, 20 nt, Artificial Sequence
  MKO10037867_A_Olfr611
  gRNA
ugccugccccuauccucuug

SEQ ID NO: 37868 - RNA, 20 nt, Artificial Sequence
  MKO10037868_A_Olfr611
  gRNA
aacaauagcuaacccuaucu

SEQ ID NO: 37869 - RNA, 20 nt, Artificial Sequence
  MKO10037869_A_Olfr611
  gRNA
uguacgaaccuuaacucugc

SEQ ID NO: 37870 - RNA, 20 nt, Artificial Sequence
  MKO10037870_A_Olfr612
  gRNA
uguacgaaccuuaacugugc

SEQ ID NO: 37871 - RNA, 20 nt, Artificial Sequence
  MKO10037871_A_Olfr612
  gRNA
caggauagcuuuaugauguc

SEQ ID NO: 37872 - RNA, 20 nt, Artificial Sequence
  MKO10037872_A_Olfr612
  gRNA
aacaauagccaagccuaucu

SEQ ID NO: 37873 - RNA, 20 nt, Artificial Sequence
  MKO10037873_A_Olfr613
  gRNA
uguaacgaugcaguacugca

SEQ ID NO: 37874 - RNA, 20 nt, Artificial Sequence
  MKO10037874_A_Olfr613
  gRNA
gcugccuugcacaagcgauu

SEQ ID NO: 37875 - RNA, 20 nt, Artificial Sequence
  MKO10037875_A_Olfr613
  gRNA
aguacugcaucguuacaccc

SEQ ID NO: 37876 - RNA, 20 nt, Artificial Sequence
  MKO10037876_A_Olfr615
  gRNA
ugacgaacucacgagucacc

SEQ ID NO: 37877 - RNA, 20 nt, Artificial Sequence
  MKO10037877_A_Olfr615
  gRNA
ucuucaggcuauacacaauu

SEQ ID NO: 37878 - RNA, 20 nt, Artificial Sequence
  MKO10037878_A_Olfr615
  gRNA
uccaauagcacaugcagucc

SEQ ID NO: 37879 - RNA, 20 nt, Artificial Sequence
  MKO10037879_A_Olfr616
  gRNA
uccuaucuuaauaauccgag

SEQ ID NO: 37880 - RNA, 20 nt, Artificial Sequence
  MKO10037880_A_Olfr616
  gRNA
ccgcuugagcaggauuggca

SEQ ID NO: 37881 - RNA, 20 nt, Artificial Sequence
  MKO10037881_A_Olfr616
  gRNA
aucugcacaucuucuagucc

SEQ ID NO: 37882 - RNA, 20 nt, Artificial Sequence
  MKO10037882_A_Olfr617
  gRNA
uucacaguaugagugacgaa

SEQ ID NO: 37883 - RNA, 20 nt, Artificial Sequence
  MKO10037883_A_Olfr617
  gRNA
aaaugccauagcuagcagua

SEQ ID NO: 37884 - RNA, 20 nt, Artificial Sequence
  MKO10037884_A_Olfr617
  gRNA
uauuuacuauggugugauag

SEQ ID NO: 37885 - RNA, 20 nt, Artificial Sequence
  MKO10037885_A_Olfr618
  gRNA
gucucaaaaugcucgacgca

SEQ ID NO: 37886 - RNA, 20 nt, Artificial Sequence
  MKO10037886_A_Olfr618
  gRNA
aaccgagucugccauacugc

SEQ ID NO: 37887 - RNA, 20 nt, Artificial Sequence
  MKO10037887_A_Olfr618
  gRNA
guuuaucgacucaauuauug

SEQ ID NO: 37888 - RNA, 20 nt, Artificial Sequence
  MKO10037888_A_Olfr619
  gRNA
guccacagugaccauuccaa

SEQ ID NO: 37889 - RNA, 20 nt, Artificial Sequence
  MKO10037889_A_Olfr619
  gRNA
agggugguagaacaacauag

SEQ ID NO: 37890 - RNA, 20 nt, Artificial Sequence
  MKO10037890_A_Olfr619
  gRNA
aaguacuacgucuagaaaua

SEQ ID NO: 37891 - RNA, 20 nt, Artificial Sequence
  MKO10037891_A_Olfr61
  gRNA
agaacgcaugcgcagaacac

SEQ ID NO: 37892 - RNA, 20 nt, Artificial Sequence
  MKO10037892_A_Olfr61
  gRNA
gcugaggaucgaguacagca

SEQ ID NO: 37893 - RNA, 20 nt, Artificial Sequence
  MKO10037893_A_Olfr61
  gRNA
ccauuagagcgauuguguag

SEQ ID NO: 37894 - RNA, 20 nt, Artificial Sequence
  MKO10037894_A_Olfr620
  gRNA
ggugaucagcaacuuguuag

SEQ ID NO: 37895 - RNA, 20 nt, Artificial Sequence
  MKO10037895_A_Olfr620
  gRNA
auccgcuucaauagcaucua

SEQ ID NO: 37896 - RNA, 20 nt, Artificial Sequence
  MKO10037896_A_Olfr620
  gRNA
acccauuaccgugugcacag

SEQ ID NO: 37897 - RNA, 20 nt, Artificial Sequence
  MKO10037897_A_Olfr622
  gRNA
accacuggauuaaccgcaga

SEQ ID NO: 37898 - RNA, 20 nt, Artificial Sequence
  MKO10037898_A_Olfr622
  gRNA
cacucgaucacgaauuugcu

SEQ ID NO: 37899 - RNA, 20 nt, Artificial Sequence
  MKO10037899_A_Olfr622
  gRNA
agcuuccuaucucaucguau

SEQ ID NO: 37900 - RNA, 20 nt, Artificial Sequence
  MKO10037900_A_Olfr623
  gRNA
cagagucgaguucuagaaua

SEQ ID NO: 37901 - RNA, 20 nt, Artificial Sequence
  MKO10037901_A_Olfr623
  gRNA
gagguguugagccaaauuac

SEQ ID NO: 37902 - RNA, 20 nt, Artificial Sequence
  MKO10037902_A_Olfr623
  gRNA
caauaaucauucgacugaau

SEQ ID NO: 37903 - RNA, 20 nt, Artificial Sequence
  MKO10037903_A_Olfr624
  gRNA
accucuagauuuguucuuac

SEQ ID NO: 37904 - RNA, 20 nt, Artificial Sequence
  MKO10037904_A_Olfr624
  gRNA
gucuacugugcacacggugc

SEQ ID NO: 37905 - RNA, 20 nt, Artificial Sequence
  MKO10037905_A_Olfr624
  gRNA
acagucucugaauucucacu

SEQ ID NO: 37906 - RNA, 20 nt, Artificial Sequence
  MKO10037906_A_Olfr628
  gRNA
agaugccugauucaauaccc

SEQ ID NO: 37907 - RNA, 20 nt, Artificial Sequence
  MKO10037907_A_Olfr628
  gRNA
accuuccaggguauugaauc

SEQ ID NO: 37908 - RNA, 20 nt, Artificial Sequence
  MKO10037908_A_Olfr628
  gRNA
gucuaguccaaguauacuga

SEQ ID NO: 37909 - RNA, 20 nt, Artificial Sequence
  MKO10037909_A_Olfr629
  gRNA
aguuuccuaacacaucguuu

SEQ ID NO: 37910 - RNA, 20 nt, Artificial Sequence
  MKO10037910_A_Olfr629
  gRNA
gauggcuagugguaacacuc

SEQ ID NO: 37911 - RNA, 20 nt, Artificial Sequence
  MKO10037911_A_Olfr629
  gRNA
aucaauccugacaacgccca

SEQ ID NO: 37912 - RNA, 20 nt, Artificial Sequence
  MKO10037912_A_Olfr62
  gRNA
cauguucuccaucccgugua

SEQ ID NO: 37913 - RNA, 20 nt, Artificial Sequence
  MKO10037913_A_Olfr62
  gRNA
gcgggaauccauguguauca

SEQ ID NO: 37914 - RNA, 20 nt, Artificial Sequence
  MKO10037914_A_Olfr62
  gRNA
gucuaccuggucauugagag

SEQ ID NO: 37915 - RNA, 20 nt, Artificial Sequence
  MKO10037915_A_Olfr630
  gRNA
aaggcuagacgggcuauaag

SEQ ID NO: 37916 - RNA, 20 nt, Artificial Sequence
  MKO10037916_A_Olfr630
  gRNA
ccgaaacuuauugccaagau

SEQ ID NO: 37917 - RNA, 20 nt, Artificial Sequence
  MKO10037917_A_Olfr630
  gRNA
aauaaguuucggcgugagaa

SEQ ID NO: 37918 - RNA, 20 nt, Artificial Sequence
  MKO10037918_A_Olfr631
  gRNA
ccuccauuauuaccguucag

SEQ ID NO: 37919 - RNA, 20 nt, Artificial Sequence
  MKO10037919_A_Olfr631
  gRNA
guuucccaaagcgguguacc

SEQ ID NO: 37920 - RNA, 20 nt, Artificial Sequence
  MKO10037920_A_Olfr631
  gRNA
accaccuucaacaaccuaua

SEQ ID NO: 37921 - RNA, 20 nt, Artificial Sequence
  MKO10037921_A_Olfr632
  gRNA
caucuuggccgugacagacc

SEQ ID NO: 37922 - RNA, 20 nt, Artificial Sequence
  MKO10037922_A_Olfr632
  gRNA
acccgcuucaacagacucua

SEQ ID NO: 37923 - RNA, 20 nt, Artificial Sequence
  MKO10037923_A_Olfr632
  gRNA
ucaagacccaacagauccgc

SEQ ID NO: 37924 - RNA, 20 nt, Artificial Sequence
  MKO10037924_A_Olfr633
  gRNA
cuaugugccuaugaucagcg

SEQ ID NO: 37925 - RNA, 20 nt, Artificial Sequence
  MKO10037925_A_Olfr633
  gRNA
uaauguuuaguaccguguac

SEQ ID NO: 37926 - RNA, 20 nt, Artificial Sequence
  MKO10037926_A_Olfr633
  gRNA
accagagccacgcugaucau

SEQ ID NO: 37927 - RNA, 20 nt, Artificial Sequence
  MKO10037927_A_Olfr635
  gRNA
cauccgagaaaucagcuuug

SEQ ID NO: 37928 - RNA, 20 nt, Artificial Sequence
  MKO10037928_A_Olfr635
  gRNA
cuacagucaugcagcuccuu

SEQ ID NO: 37929 - RNA, 20 nt, Artificial Sequence
  MKO10037929_A_Olfr635
  gRNA
uuucucggauguugaaccaa

SEQ ID NO: 37930 - RNA, 20 nt, Artificial Sequence
  MKO10037930_A_Olfr638
  gRNA
gagaagcaugcuucgcaaag

SEQ ID NO: 37931 - RNA, 20 nt, Artificial Sequence
  MKO10037931_A_Olfr638
  gRNA
agugcaccuuucuuugcaac

SEQ ID NO: 37932 - RNA, 20 nt, Artificial Sequence
  MKO10037932_A_Olfr638
  gRNA
cauggccaauaucuaucugc

SEQ ID NO: 37933 - RNA, 20 nt, Artificial Sequence
  MKO10037933_A_Olfr639
  gRNA
agaugcucgacauaagugug

SEQ ID NO: 37934 - RNA, 20 nt, Artificial Sequence
  MKO10037934_A_Olfr639
  gRNA
ccaggacaauggccaacccc

SEQ ID NO: 37935 - RNA, 20 nt, Artificial Sequence
  MKO10037935_A_Olfr639
  gRNA
gcugcacugcuaucauaauu

SEQ ID NO: 37936 - RNA, 20 nt, Artificial Sequence
  MKO10037936_A_Olfr63
  gRNA
ugguggaucgcuuauuggga

SEQ ID NO: 37937 - RNA, 20 nt, Artificial Sequence
  MKO10037937_A_Olfr63
  gRNA
gcuguaguucugaccgggca

SEQ ID NO: 37938 - RNA, 20 nt, Artificial Sequence
  MKO10037938_A_Olfr63
  gRNA
cucggcuuguggcauggucu

SEQ ID NO: 37939 - RNA, 20 nt, Artificial Sequence
  MKO10037939_A_Olfr640
  gRNA
aucacacgaacagcgacuca

SEQ ID NO: 37940 - RNA, 20 nt, Artificial Sequence
  MKO10037940_A_Olfr640
  gRNA
agcacaguggaauagcguag

SEQ ID NO: 37941 - RNA, 20 nt, Artificial Sequence
  MKO10037941_A_Olfr640
  gRNA
guacgguaggaaguguagau

SEQ ID NO: 37942 - RNA, 20 nt, Artificial Sequence
  MKO10037942_A_Olfr641
  gRNA
gucucuacaguucaccguuu

SEQ ID NO: 37943 - RNA, 20 nt, Artificial Sequence
  MKO10037943_A_Olfr641
  gRNA
acuguagagaccccuaucau

SEQ ID NO: 37944 - RNA, 20 nt, Artificial Sequence
  MKO10037944_A_Olfr641
  gRNA
gaaacaugcggaauauggca

SEQ ID NO: 37945 - RNA, 20 nt, Artificial Sequence
  MKO10037945_A_Olfr642
  gRNA
ccuucugucugucaacgacc

SEQ ID NO: 37946 - RNA, 20 nt, Artificial Sequence
  MKO10037946_A_Olfr642
  gRNA
gaccugauacgcuugcccug

SEQ ID NO: 37947 - RNA, 20 nt, Artificial Sequence
  MKO10037947_A_Olfr642
  gRNA
agugcuuacugaugcccgug

SEQ ID NO: 37948 - RNA, 20 nt, Artificial Sequence
  MKO10037948_A_Olfr643
  gRNA
cagggcaggcgaaucauguc

SEQ ID NO: 37949 - RNA, 20 nt, Artificial Sequence
  MKO10037949_A_Olfr643
  gRNA
gacaugauucgccugcccug

SEQ ID NO: 37950 - RNA, 20 nt, Artificial Sequence
  MKO10037950_A_Olfr643
  gRNA
ccucccauagcgagcagcca

SEQ ID NO: 37951 - RNA, 20 nt, Artificial Sequence
  MKO10037951_A_Olfr644
  gRNA
gaucugauucgacugccuug

SEQ ID NO: 37952 - RNA, 20 nt, Artificial Sequence
  MKO10037952_A_Olfr644
  gRNA
ucuuuacagcgucuccauag

SEQ ID NO: 37953 - RNA, 20 nt, Artificial Sequence
  MKO10037953_A_Olfr644
  gRNA
caaggcagucgaaucagauc

SEQ ID NO: 37954 - RNA, 20 nt, Artificial Sequence
  MKO10037954_A_Olfr645
  gRNA
acgcuccucccgagacgcaa

SEQ ID NO: 37955 - RNA, 20 nt, Artificial Sequence
  MKO10037955_A_Olfr645
  gRNA
gugucuauugugcaucgcuu

SEQ ID NO: 37956 - RNA, 20 nt, Artificial Sequence
  MKO10037956_A_Olfr645
  gRNA
gcucaccaaugcucgcauug

SEQ ID NO: 37957 - RNA, 20 nt, Artificial Sequence
  MKO10037957_A_Olfr646
  gRNA
cucgauugugaccaaagcga

SEQ ID NO: 37958 - RNA, 20 nt, Artificial Sequence
  MKO10037958_A_Olfr646
  gRNA
aucccgugaugcucaacaca

SEQ ID NO: 37959 - RNA, 20 nt, Artificial Sequence
  MKO10037959_A_Olfr646
  gRNA
gaaccaaggagauucggagu

SEQ ID NO: 37960 - RNA, 20 nt, Artificial Sequence
  MKO10037960_A_Olfr648
  gRNA
gacuaucgucaagauugcug

SEQ ID NO: 37961 - RNA, 20 nt, Artificial Sequence
  MKO10037961_A_Olfr648
  gRNA
cgugucaacaagaauacaac

SEQ ID NO: 37962 - RNA, 20 nt, Artificial Sequence
  MKO10037962_A_Olfr648
  gRNA
agcaaucuugacgauagucu

SEQ ID NO: 37963 - RNA, 20 nt, Artificial Sequence
  MKO10037963_A_Olfr649
  gRNA
caggugggaugauuacauac

SEQ ID NO: 37964 - RNA, 20 nt, Artificial Sequence
  MKO10037964_A_Olfr649
  gRNA
gacuguguuccacugcaaua

SEQ ID NO: 37965 - RNA, 20 nt, Artificial Sequence
  MKO10037965_A_Olfr649
  gRNA
uucacucucucgggcauccc

SEQ ID NO: 37966 - RNA, 20 nt, Artificial Sequence
  MKO10037966_A_Olfr64
  gRNA
aaguccuauagcuauaaccc

SEQ ID NO: 37967 - RNA, 20 nt, Artificial Sequence
  MKO10037967_A_Olfr64
  gRNA
cugugcccgccagcauggca

SEQ ID NO: 37968 - RNA, 20 nt, Artificial Sequence
  MKO10037968_A_Olfr64
  gRNA
gauguaggccuguaagaagc

SEQ ID NO: 37969 - RNA, 20 nt, Artificial Sequence
  MKO10037969_A_Olfr651
  gRNA
uagcaccauccugacuccgc

SEQ ID NO: 37970 - RNA, 20 nt, Artificial Sequence
  MKO10037970_A_Olfr651
  gRNA
augacacgggucuugcaaaa

SEQ ID NO: 37971 - RNA, 20 nt, Artificial Sequence
  MKO10037971_A_Olfr651
  gRNA
ccaaacugcucaguaaccuu

SEQ ID NO: 37972 - RNA, 20 nt, Artificial Sequence
  MKO10037972_A_Olfr652
  gRNA
ggauauugugaccaaaacga

SEQ ID NO: 37973 - RNA, 20 nt, Artificial Sequence
  MKO10037973_A_Olfr652
  gRNA
augacgagcucucggcagaa

SEQ ID NO: 37974 - RNA, 20 nt, Artificial Sequence
  MKO10037974_A_Olfr652
  gRNA
gagcaauuccacguauggau

SEQ ID NO: 37975 - RNA, 20 nt, Artificial Sequence
  MKO10037975_A_Olfr653
  gRNA
auugaacguuuacccuucug

SEQ ID NO: 37976 - RNA, 20 nt, Artificial Sequence
  MKO10037976_A_Olfr653
  gRNA
ggccacgagucacgcaugcc

SEQ ID NO: 37977 - RNA, 20 nt, Artificial Sequence
  MKO10037977_A_Olfr653
  gRNA
ggccuggcaugcgugacucg

SEQ ID NO: 37978 - RNA, 20 nt, Artificial Sequence
  MKO10037978_A_Olfr654
  gRNA
gaugacucgauuggcaugaa

SEQ ID NO: 37979 - RNA, 20 nt, Artificial Sequence
  MKO10037979_A_Olfr654
  gRNA
aaugaguccaaugcgacuau

SEQ ID NO: 37980 - RNA, 20 nt, Artificial Sequence
  MKO10037980_A_Olfr654
  gRNA
agagaugcaugauagcucgu

SEQ ID NO: 37981 - RNA, 20 nt, Artificial Sequence
  MKO10037981_A_Olfr655
  gRNA
aagagcccauaaauccgauu

SEQ ID NO: 37982 - RNA, 20 nt, Artificial Sequence
  MKO10037982_A_Olfr655
  gRNA
gaauaugguggccgaugcgg

SEQ ID NO: 37983 - RNA, 20 nt, Artificial Sequence
  MKO10037983_A_Olfr655
  gRNA
ugaggcguaccacacucugc

SEQ ID NO: 37984 - RNA, 20 nt, Artificial Sequence
  MKO10037984_A_Olfr656
  gRNA
accagaccuaaucgugugua

SEQ ID NO: 37985 - RNA, 20 nt, Artificial Sequence
  MKO10037985_A_Olfr656
  gRNA
gacaccaucauugcucguau

SEQ ID NO: 37986 - RNA, 20 nt, Artificial Sequence
  MKO10037986_A_Olfr656
  gRNA
gucagcccauacacacgauu

SEQ ID NO: 37987 - RNA, 20 nt, Artificial Sequence
  MKO10037987_A_Olfr657
  gRNA
uucuugaacaauaauuccgc

SEQ ID NO: 37988 - RNA, 20 nt, Artificial Sequence
  MKO10037988_A_Olfr657
  gRNA
augacaauauuaugagaccc

SEQ ID NO: 37989 - RNA, 20 nt, Artificial Sequence
  MKO10037989_A_Olfr657
  gRNA
agcuccgacaaaacaccuuu

SEQ ID NO: 37990 - RNA, 20 nt, Artificial Sequence
  MKO10037990_A_Olfr658
  gRNA
aagcgccuacccuacugucg

SEQ ID NO: 37991 - RNA, 20 nt, Artificial Sequence
  MKO10037991_A_Olfr658
  gRNA
uauuauauugccucgacagu

SEQ ID NO: 37992 - RNA, 20 nt, Artificial Sequence
  MKO10037992_A_Olfr658
  gRNA
agaaugguggaguaacgcag

SEQ ID NO: 37993 - RNA, 20 nt, Artificial Sequence
  MKO10037993_A_Olfr659
  gRNA
cauccauacuuucacagcga

SEQ ID NO: 37994 - RNA, 20 nt, Artificial Sequence
  MKO10037994_A_Olfr659
  gRNA
uugaagcacugcacaugaca

SEQ ID NO: 37995 - RNA, 20 nt, Artificial Sequence
  MKO10037995_A_Olfr659
  gRNA
acuccaucgcugugaaagua

SEQ ID NO: 37996 - RNA, 20 nt, Artificial Sequence
  MKO10037996_A_Olfr65
  gRNA
caaucgucucuauccuguug

SEQ ID NO: 37997 - RNA, 20 nt, Artificial Sequence
  MKO10037997_A_Olfr65
  gRNA
ggugccguugccaaguaaua

SEQ ID NO: 37998 - RNA, 20 nt, Artificial Sequence
  MKO10037998_A_Olfr65
  gRNA
caauaaucauucgccugcau

SEQ ID NO: 37999 - RNA, 20 nt, Artificial Sequence
  MKO10037999_A_Olfr661
  gRNA
auauccaucacucauagugu

SEQ ID NO: 38000 - RNA, 20 nt, Artificial Sequence
  MKO10038000_A_Olfr661
  gRNA
cuuauacaaggugcucaggc

SEQ ID NO: 38001 - RNA, 20 nt, Artificial Sequence
  MKO10038001_A_Olfr661
  gRNA
ugcagcacguucagcagaac

SEQ ID NO: 38002 - RNA, 20 nt, Artificial Sequence
  MKO10038002_A_Olfr663
  gRNA
aggcuagugacccccggguu

SEQ ID NO: 38003 - RNA, 20 nt, Artificial Sequence
  MKO10038003_A_Olfr663
  gRNA
uacccaugacugcccaugcc

SEQ ID NO: 38004 - RNA, 20 nt, Artificial Sequence
  MKO10038004_A_Olfr663
  gRNA
uucagcagaaguaggaugac

SEQ ID NO: 38005 - RNA, 20 nt, Artificial Sequence
  MKO10038005_A_Olfr665
  gRNA
aggcuggagguauugacccc

SEQ ID NO: 38006 - RNA, 20 nt, Artificial Sequence
  MKO10038006_A_Olfr665
  gRNA
auuaaucuuaauauugccac

SEQ ID NO: 38007 - RNA, 20 nt, Artificial Sequence
  MKO10038007_A_Olfr665
  gRNA
ugggagguagcaauagauac

SEQ ID NO: 38008 - RNA, 20 nt, Artificial Sequence
  MKO10038008_A_Olfr666
  gRNA
acuccauuccagucaacaug

SEQ ID NO: 38009 - RNA, 20 nt, Artificial Sequence
  MKO10038009_A_Olfr666
  gRNA
gauaagacugccucugcaau

SEQ ID NO: 38010 - RNA, 20 nt, Artificial Sequence
  MKO10038010_A_Olfr666
  gRNA
ugucuuacacuaugauauug

SEQ ID NO: 38011 - RNA, 20 nt, Artificial Sequence
  MKO10038011_A_Olfr667
  gRNA
aucugcuauccuuugcgcua

SEQ ID NO: 38012 - RNA, 20 nt, Artificial Sequence
  MKO10038012_A_Olfr667
  gRNA
uagcaggcaauaacagauag

SEQ ID NO: 38013 - RNA, 20 nt, Artificial Sequence
  MKO10038013_A_Olfr667
  gRNA
aagcgccugcccuauugccg

SEQ ID NO: 38014 - RNA, 20 nt, Artificial Sequence
  MKO10038014_A_Olfr668
  gRNA
gauaagaaugcuucuacaau

SEQ ID NO: 38015 - RNA, 20 nt, Artificial Sequence
  MKO10038015_A_Olfr668
  gRNA
ucuccuucacugauguuacc

SEQ ID NO: 38016 - RNA, 20 nt, Artificial Sequence
  MKO10038016_A_Olfr668
  gRNA
gaauguugcaagacaagccu

SEQ ID NO: 38017 - RNA, 20 nt, Artificial Sequence
  MKO10038017_A_Olfr669
  gRNA
ggcaaacguuuaaccaagaa

SEQ ID NO: 38018 - RNA, 20 nt, Artificial Sequence
  MKO10038018_A_Olfr669
  gRNA
acaggcugaccacugcccgg

SEQ ID NO: 38019 - RNA, 20 nt, Artificial Sequence
  MKO10038019_A_Olfr669
  gRNA
auaugcacugcuucgagacc

SEQ ID NO: 38020 - RNA, 20 nt, Artificial Sequence
  MKO10038020_A_Olfr66
  gRNA
caagacccccgauucuacaa

SEQ ID NO: 38021 - RNA, 20 nt, Artificial Sequence
  MKO10038021_A_Olfr66
  gRNA
guguccuggugcuaaaccag

SEQ ID NO: 38022 - RNA, 20 nt, Artificial Sequence
  MKO10038022_A_Olfr66
  gRNA
cucacuagccauuguagaau

SEQ ID NO: 38023 - RNA, 20 nt, Artificial Sequence
  MKO10038023_A_Olfr670
  gRNA
cgcucguaguauccgcauau

SEQ ID NO: 38024 - RNA, 20 nt, Artificial Sequence
  MKO10038024_A_Olfr670
  gRNA
uggguugauacuuauaucaa

SEQ ID NO: 38025 - RNA, 20 nt, Artificial Sequence
  MKO10038025_A_Olfr670
  gRNA
agaaucugacuguaccgcag

SEQ ID NO: 38026 - RNA, 20 nt, Artificial Sequence
  MKO10038026_A_Olfr671
  gRNA
auaaaacagcaccauucccc

SEQ ID NO: 38027 - RNA, 20 nt, Artificial Sequence
  MKO10038027_A_Olfr671
  gRNA
acucuaucucauugcagucc

SEQ ID NO: 38028 - RNA, 20 nt, Artificial Sequence
  MKO10038028_A_Olfr671
  gRNA
uacucgcucccgaaucugcu

SEQ ID NO: 38029 - RNA, 20 nt, Artificial Sequence
  MKO10038029_A_Olfr672
  gRNA
caaacagauucgagaucgug

SEQ ID NO: 38030 - RNA, 20 nt, Artificial Sequence
  MKO10038030_A_Olfr672
  gRNA
ccagaauauaccgagugcuc

SEQ ID NO: 38031 - RNA, 20 nt, Artificial Sequence
  MKO10038031_A_Olfr672
  gRNA
aggauaguguuauaucggag

SEQ ID NO: 38032 - RNA, 20 nt, Artificial Sequence
  MKO10038032_A_Olfr675
  gRNA
guacuacuuccuagccaugc

SEQ ID NO: 38033 - RNA, 20 nt, Artificial Sequence
  MKO10038033_A_Olfr675
  gRNA
ucucuaucucauugcaauuc

SEQ ID NO: 38034 - RNA, 20 nt, Artificial Sequence
  MKO10038034_A_Olfr675
  gRNA
uacuugcucccgaauuugcu

SEQ ID NO: 38035 - RNA, 20 nt, Artificial Sequence
  MKO10038035_A_Olfr676
  gRNA
guguaucugaccgcucuugu

SEQ ID NO: 38036 - RNA, 20 nt, Artificial Sequence
  MKO10038036_A_Olfr676
  gRNA
acaggcuucguauaaccacg

SEQ ID NO: 38037 - RNA, 20 nt, Artificial Sequence
  MKO10038037_A_Olfr676
  gRNA
gagcaucguacuccucgcca

SEQ ID NO: 38038 - RNA, 20 nt, Artificial Sequence
  MKO10038038_A_Olfr677
  gRNA
cagaucaauuaucgacaaug

SEQ ID NO: 38039 - RNA, 20 nt, Artificial Sequence
  MKO10038039_A_Olfr677
  gRNA
agcccccgaaacugaucucc

SEQ ID NO: 38040 - RNA, 20 nt, Artificial Sequence
  MKO10038040_A_Olfr677
  gRNA
aaguguuuagcgccuucaau

SEQ ID NO: 38041 - RNA, 20 nt, Artificial Sequence
  MKO10038041_A_Olfr678
  gRNA
acuucuagccaaccuauaug

SEQ ID NO: 38042 - RNA, 20 nt, Artificial Sequence
  MKO10038042_A_Olfr678
  gRNA
ugccuuaagccgagcauccc

SEQ ID NO: 38043 - RNA, 20 nt, Artificial Sequence
  MKO10038043_A_Olfr678
  gRNA
guccugacuccauagauaac

SEQ ID NO: 38044 - RNA, 20 nt, Artificial Sequence
  MKO10038044_A_Olfr679
  gRNA
cgucuuuaucaguuugcuau

SEQ ID NO: 38045 - RNA, 20 nt, Artificial Sequence
  MKO10038045_A_Olfr679
  gRNA
cuauagcaaacugauaaaga

SEQ ID NO: 38046 - RNA, 20 nt, Artificial Sequence
  MKO10038046_A_Olfr679
  gRNA
ucagcacagcucuuaguaua

SEQ ID NO: 38047 - RNA, 20 nt, Artificial Sequence
  MKO10038047_A_Olfr67
  gRNA
gacugcguucagucacuauc

SEQ ID NO: 38048 - RNA, 20 nt, Artificial Sequence
  MKO10038048_A_Olfr67
  gRNA
acuaccaaaggauauacccc

SEQ ID NO: 38049 - RNA, 20 nt, Artificial Sequence
  MKO10038049_A_Olfr67
  gRNA
caagcagauccaagaucgag

SEQ ID NO: 38050 - RNA, 20 nt, Artificial Sequence
  MKO10038050_A_Olfr681
  gRNA
uaagggcggcaggaaugaca

SEQ ID NO: 38051 - RNA, 20 nt, Artificial Sequence
  MKO10038051_A_Olfr681
  gRNA
aaccgucuuuaucaguuugc

SEQ ID NO: 38052 - RNA, 20 nt, Artificial Sequence
  MKO10038052_A_Olfr681
  gRNA
cuccagcaaacugauaaaga

SEQ ID NO: 38053 - RNA, 20 nt, Artificial Sequence
  MKO10038053_A_Olfr683
  gRNA
gaauacggaaccuucuuagg

SEQ ID NO: 38054 - RNA, 20 nt, Artificial Sequence
  MKO10038054_A_Olfr683
  gRNA
gauauugugcaagaauuauc

SEQ ID NO: 38055 - RNA, 20 nt, Artificial Sequence
  MKO10038055_A_Olfr683
  gRNA
uggugucagucaugaucaga

SEQ ID NO: 38056 - RNA, 20 nt, Artificial Sequence
  MKO10038056_A_Olfr684
  gRNA
gaugggagcuucagaaucgu

SEQ ID NO: 38057 - RNA, 20 nt, Artificial Sequence
  MKO10038057_A_Olfr684
  gRNA
uuaucuuccguguugugcuc

SEQ ID NO: 38058 - RNA, 20 nt, Artificial Sequence
  MKO10038058_A_Olfr684
  gRNA
cugcuaucuucauuauaagc

SEQ ID NO: 38059 - RNA, 20 nt, Artificial Sequence
  MKO10038059_A_Olfr685
  gRNA
agauucgccagcgagugcuc

SEQ ID NO: 38060 - RNA, 20 nt, Artificial Sequence
  MKO10038060_A_Olfr685
  gRNA
ccaaugcgcccuauaauccc

SEQ ID NO: 38061 - RNA, 20 nt, Artificial Sequence
  MKO10038061_A_Olfr685
  gRNA
gauuauagggcgcauugggc

SEQ ID NO: 38062 - RNA, 20 nt, Artificial Sequence
  MKO10038062_A_Olfr686
  gRNA
aauaagacagucgacaagcc

SEQ ID NO: 38063 - RNA, 20 nt, Artificial Sequence
  MKO10038063_A_Olfr686
  gRNA
ccugguggcacugcgaggug

SEQ ID NO: 38064 - RNA, 20 nt, Artificial Sequence
  MKO10038064_A_Olfr686
  gRNA
cacaaucuguccauaagagu

SEQ ID NO: 38065 - RNA, 20 nt, Artificial Sequence
  MKO10038065_A_Olfr688
  gRNA
cugagcuguugguuucaugc

SEQ ID NO: 38066 - RNA, 20 nt, Artificial Sequence
  MKO10038066_A_Olfr688
  gRNA
uccuagacacaaacucacuc

SEQ ID NO: 38067 - RNA, 20 nt, Artificial Sequence
  MKO10038067_A_Olfr688
  gRNA
gcagaaugaacucagacacg

SEQ ID NO: 38068 - RNA, 20 nt, Artificial Sequence
  MKO10038068_A_Olfr689
  gRNA
aucuuggcuguaguggauau

SEQ ID NO: 38069 - RNA, 20 nt, Artificial Sequence
  MKO10038069_A_Olfr689
  gRNA
acuugagucauuaugugucc

SEQ ID NO: 38070 - RNA, 20 nt, Artificial Sequence
  MKO10038070_A_Olfr689
  gRNA
gacucaagucaaaaaccuuc

SEQ ID NO: 38071 - RNA, 20 nt, Artificial Sequence
  MKO10038071_A_Olfr68
  gRNA
ugagccauugaacuugauca

SEQ ID NO: 38072 - RNA, 20 nt, Artificial Sequence
  MKO10038072_A_Olfr68
  gRNA
cccacuaguguuaacacaga

SEQ ID NO: 38073 - RNA, 20 nt, Artificial Sequence
  MKO10038073_A_Olfr68
  gRNA
cucaccaugaucaaguucaa

SEQ ID NO: 38074 - RNA, 20 nt, Artificial Sequence
  MKO10038074_A_Olfr690
  gRNA
uucuuauacguugauccucc

SEQ ID NO: 38075 - RNA, 20 nt, Artificial Sequence
  MKO10038075_A_Olfr690
  gRNA
cucagccgucuuaacaccua

SEQ ID NO: 38076 - RNA, 20 nt, Artificial Sequence
  MKO10038076_A_Olfr690
  gRNA
gucgggaauccuucuggcca

SEQ ID NO: 38077 - RNA, 20 nt, Artificial Sequence
  MKO10038077_A_Olfr691
  gRNA
ccgacacgugcauauccugc

SEQ ID NO: 38078 - RNA, 20 nt, Artificial Sequence
  MKO10038078_A_Olfr691
  gRNA
gauaugcaacagugcuaaca

SEQ ID NO: 38079 - RNA, 20 nt, Artificial Sequence
  MKO10038079_A_Olfr691
  gRNA
gucggccaucuuguuagcca

SEQ ID NO: 38080 - RNA, 20 nt, Artificial Sequence
  MKO10038080_A_Olfr692
  gRNA
uggugcggaccccauagaug

SEQ ID NO: 38081 - RNA, 20 nt, Artificial Sequence
  MKO10038081_A_Olfr692
  gRNA
guaugggcuagcacuuucac

SEQ ID NO: 38082 - RNA, 20 nt, Artificial Sequence
  MKO10038082_A_Olfr692
  gRNA
cgggcuuuaguuaccaagau

SEQ ID NO: 38083 - RNA, 20 nt, Artificial Sequence
  MKO10038083_A_Olfr693
  gRNA
gaacacaccuaauggagccc

SEQ ID NO: 38084 - RNA, 20 nt, Artificial Sequence
  MKO10038084_A_Olfr693
  gRNA
aguaccccuucugcaaaucc

SEQ ID NO: 38085 - RNA, 20 nt, Artificial Sequence
  MKO10038085_A_Olfr693
  gRNA
gcucaaaaugcccucaaacg

SEQ ID NO: 38086 - RNA, 20 nt, Artificial Sequence
  MKO10038086_A_Olfr694
  gRNA
ggaagucugcaacuccaccc

SEQ ID NO: 38087 - RNA, 20 nt, Artificial Sequence
  MKO10038087_A_Olfr694
  gRNA
aaaguacagggcugugauag

SEQ ID NO: 38088 - RNA, 20 nt, Artificial Sequence
  MKO10038088_A_Olfr694
  gRNA
ccaagaugaauccacuuccc

SEQ ID NO: 38089 - RNA, 20 nt, Artificial Sequence
  MKO10038089_A_Olfr695
  gRNA
cauguggagucgggcaucca

SEQ ID NO: 38090 - RNA, 20 nt, Artificial Sequence
  MKO10038090_A_Olfr695
  gRNA
gucaggauggccgcaagagc

SEQ ID NO: 38091 - RNA, 20 nt, Artificial Sequence
  MKO10038091_A_Olfr695
  gRNA
accaucaguuaucauuccca

SEQ ID NO: 38092 - RNA, 20 nt, Artificial Sequence
  MKO10038092_A_Olfr697
  gRNA
caccucuaguuauaagcuug

SEQ ID NO: 38093 - RNA, 20 nt, Artificial Sequence
  MKO10038093_A_Olfr697
  gRNA
acaugccuacaacagucaua

SEQ ID NO: 38094 - RNA, 20 nt, Artificial Sequence
  MKO10038094_A_Olfr697
  gRNA
cugggacuaccuuaaaugua

SEQ ID NO: 38095 - RNA, 20 nt, Artificial Sequence
  MKO10038095_A_Olfr698
  gRNA
gauagccaccucauggaucu

SEQ ID NO: 38096 - RNA, 20 nt, Artificial Sequence
  MKO10038096_A_Olfr698
  gRNA
ugcuauauccuagagcacug

SEQ ID NO: 38097 - RNA, 20 nt, Artificial Sequence
  MKO10038097_A_Olfr698
  gRNA
uaaugagucacaaagucugc

SEQ ID NO: 38098 - RNA, 20 nt, Artificial Sequence
  MKO10038098_A_Olfr699
  gRNA
ggcacagcccucuaaugaua

SEQ ID NO: 38099 - RNA, 20 nt, Artificial Sequence
  MKO10038099_A_Olfr699
  gRNA
auugggagguaccuucaucu

SEQ ID NO: 38100 - RNA, 20 nt, Artificial Sequence
  MKO10038100_A_Olfr699
  gRNA
cucuuguuugggacuaagau

SEQ ID NO: 38101 - RNA, 20 nt, Artificial Sequence
  MKO10038101_A_Olfr69
  gRNA
cauuugaugagcaauaucaa

SEQ ID NO: 38102 - RNA, 20 nt, Artificial Sequence
  MKO10038102_A_Olfr69
  gRNA
ugguaguucgaaaguacuua

SEQ ID NO: 38103 - RNA, 20 nt, Artificial Sequence
  MKO10038103_A_Olfr69
  gRNA
ugauguucacagggguuucu

SEQ ID NO: 38104 - RNA, 20 nt, Artificial Sequence
  MKO10038104_A_Olfr6
  gRNA
cggugcucuaccaccugcua

SEQ ID NO: 38105 - RNA, 20 nt, Artificial Sequence
  MKO10038105_A_Olfr6
  gRNA
auauaaggaugacgauggca

SEQ ID NO: 38106 - RNA, 20 nt, Artificial Sequence
  MKO10038106_A_Olfr6
  gRNA
ucuucauguauguccgaccu

SEQ ID NO: 38107 - RNA, 20 nt, Artificial Sequence
  MKO10038107_A_Olfr700
  gRNA
ggcuuggaguguucauauca

SEQ ID NO: 38108 - RNA, 20 nt, Artificial Sequence
  MKO10038108_A_Olfr700
  gRNA
aucuucacauaauggagcuu

SEQ ID NO: 38109 - RNA, 20 nt, Artificial Sequence
  MKO10038109_A_Olfr700
  gRNA
cagcaaugggauacugcucc

SEQ ID NO: 38110 - RNA, 20 nt, Artificial Sequence
  MKO10038110_A_Olfr701
  gRNA
gccagcacacgccacuguuu

SEQ ID NO: 38111 - RNA, 20 nt, Artificial Sequence
  MKO10038111_A_Olfr701
  gRNA
uccuaaacaguggcgugugc

SEQ ID NO: 38112 - RNA, 20 nt, Artificial Sequence
  MKO10038112_A_Olfr701
  gRNA
cuagcaucucuuagugcccu

SEQ ID NO: 38113 - RNA, 20 nt, Artificial Sequence
  MKO10038113_A_Olfr702
  gRNA
uacacuguguaucccuuauc

SEQ ID NO: 38114 - RNA, 20 nt, Artificial Sequence
  MKO10038114_A_Olfr702
  gRNA
uaugaagucgagagucaauu

SEQ ID NO: 38115 - RNA, 20 nt, Artificial Sequence
  MKO10038115_A_Olfr702
  gRNA
auauuccagacccauaguag

SEQ ID NO: 38116 - RNA, 20 nt, Artificial Sequence
  MKO10038116_A_Olfr703
  gRNA
auaaaccaucaacucguaug

SEQ ID NO: 38117 - RNA, 20 nt, Artificial Sequence
  MKO10038117_A_Olfr703
  gRNA
uacauccacauacgaguuga

SEQ ID NO: 38118 - RNA, 20 nt, Artificial Sequence
  MKO10038118_A_Olfr703
  gRNA
gauacaugggcacgcggagc

SEQ ID NO: 38119 - RNA, 20 nt, Artificial Sequence
  MKO10038119_A_Olfr704
  gRNA
cacguggagccggguaucca

SEQ ID NO: 38120 - RNA, 20 nt, Artificial Sequence
  MKO10038120_A_Olfr704
  gRNA
cauugcuugucaaagcuaaa

SEQ ID NO: 38121 - RNA, 20 nt, Artificial Sequence
  MKO10038121_A_Olfr704
  gRNA
agaugcaagacuccaugaag

SEQ ID NO: 38122 - RNA, 20 nt, Artificial Sequence
  MKO10038122_A_Olfr705
  gRNA
augaucccuuccuagagagu

SEQ ID NO: 38123 - RNA, 20 nt, Artificial Sequence
  MKO10038123_A_Olfr705
  gRNA
aguauuccuauugcaaaucc

SEQ ID NO: 38124 - RNA, 20 nt, Artificial Sequence
  MKO10038124_A_Olfr705
  gRNA
uaaguugaaaucaguuccua

SEQ ID NO: 38125 - RNA, 20 nt, Artificial Sequence
  MKO10038125_A_Olfr706
  gRNA
ucaugaguccuacaguaugc

SEQ ID NO: 38126 - RNA, 20 nt, Artificial Sequence
  MKO10038126_A_Olfr706
  gRNA
acuaucagccagcauacugu

SEQ ID NO: 38127 - RNA, 20 nt, Artificial Sequence
  MKO10038127_A_Olfr706
  gRNA
ugaauccuccuuaaagagua

SEQ ID NO: 38128 - RNA, 20 nt, Artificial Sequence
  MKO10038128_A_Olfr707
  gRNA
uucauucauuaucuuagagu

SEQ ID NO: 38129 - RNA, 20 nt, Artificial Sequence
  MKO10038129_A_Olfr707
  gRNA
cagcaauauuugccuacaug

SEQ ID NO: 38130 - RNA, 20 nt, Artificial Sequence
  MKO10038130_A_Olfr707
  gRNA
cucuaagauaaugaaugaaa

SEQ ID NO: 38131 - RNA, 20 nt, Artificial Sequence
  MKO10038131_A_Olfr70
  gRNA
cacguugcucuaugcgaucg

SEQ ID NO: 38132 - RNA, 20 nt, Artificial Sequence
  MKO10038132_A_Olfr70
  gRNA
cgugauaaucuuacccacgc

SEQ ID NO: 38133 - RNA, 20 nt, Artificial Sequence
  MKO10038133_A_Olfr70
  gRNA
gcacaaacagagcgaucucg

SEQ ID NO: 38134 - RNA, 20 nt, Artificial Sequence
  MKO10038134_A_Olfr710
  gRNA
uuacuuuaugcuugacguac

SEQ ID NO: 38135 - RNA, 20 nt, Artificial Sequence
  MKO10038135_A_Olfr710
  gRNA
gucgggagucaacaugaaug

SEQ ID NO: 38136 - RNA, 20 nt, Artificial Sequence
  MKO10038136_A_Olfr710
  gRNA
cacaaauauuccacuagucc

SEQ ID NO: 38137 - RNA, 20 nt, Artificial Sequence
  MKO10038137_A_Olfr711
  gRNA
gguagacacuauguagacgu

SEQ ID NO: 38138 - RNA, 20 nt, Artificial Sequence
  MKO10038138_A_Olfr711
  gRNA
gcuggauaugaacauuacuc

SEQ ID NO: 38139 - RNA, 20 nt, Artificial Sequence
  MKO10038139_A_Olfr711
  gRNA
ucggacguacaugaaaauca

SEQ ID NO: 38140 - RNA, 20 nt, Artificial Sequence
  MKO10038140_A_Olfr713
  gRNA
ccaguuugacacgugucucu

SEQ ID NO: 38141 - RNA, 20 nt, Artificial Sequence
  MKO10038141_A_Olfr713
  gRNA
acgguggcuacagggaaucc

SEQ ID NO: 38142 - RNA, 20 nt, Artificial Sequence
  MKO10038142_A_Olfr713
  gRNA
ccaagagacacgugucaaac

SEQ ID NO: 38143 - RNA, 20 nt, Artificial Sequence
  MKO10038143_A_Olfr714
  gRNA
guugaagccgaucuccauga

SEQ ID NO: 38144 - RNA, 20 nt, Artificial Sequence
  MKO10038144_A_Olfr714
  gRNA
agagacaacgacgagaugug

SEQ ID NO: 38145 - RNA, 20 nt, Artificial Sequence
  MKO10038145_A_Olfr714
  gRNA
gaagugauucaccuuguugu

SEQ ID NO: 38146 - RNA, 20 nt, Artificial Sequence
  MKO10038146_A_Olfr715
  gRNA
uaaucgcugauccauaaaag

SEQ ID NO: 38147 - RNA, 20 nt, Artificial Sequence
  MKO10038147_A_Olfr715
  gRNA
auuacucuagcaucaugaca

SEQ ID NO: 38148 - RNA, 20 nt, Artificial Sequence
  MKO10038148_A_Olfr715
  gRNA
ggagaaucacaacccccaug

SEQ ID NO: 38149 - RNA, 20 nt, Artificial Sequence
  MKO10038149_A_Olfr716
  gRNA
gacuauguucugcccucgau

SEQ ID NO: 38150 - RNA, 20 nt, Artificial Sequence
  MKO10038150_A_Olfr716
  gRNA
guuuacauucugacuguacu

SEQ ID NO: 38151 - RNA, 20 nt, Artificial Sequence
  MKO10038151_A_Olfr716
  gRNA
ccaacaacuaugccugcagu

SEQ ID NO: 38152 - RNA, 20 nt, Artificial Sequence
  MKO10038152_A_Olfr71
  gRNA
gaggaaagaguagccgcucg

SEQ ID NO: 38153 - RNA, 20 nt, Artificial Sequence
  MKO10038153_A_Olfr71
  gRNA
cuggcuacccggcccucgag

SEQ ID NO: 38154 - RNA, 20 nt, Artificial Sequence
  MKO10038154_A_Olfr71
  gRNA
caacaugcucaccgccacga

SEQ ID NO: 38155 - RNA, 20 nt, Artificial Sequence
  MKO10038155_A_Olfr720
  gRNA
cauaaccccauuugccaaua

SEQ ID NO: 38156 - RNA, 20 nt, Artificial Sequence
  MKO10038156_A_Olfr720
  gRNA
agccccaccgaaccaagagc

SEQ ID NO: 38157 - RNA, 20 nt, Artificial Sequence
  MKO10038157_A_Olfr720
  gRNA
agcagacccuccgacucaug

SEQ ID NO: 38158 - RNA, 20 nt, Artificial Sequence
  MKO10038158_A_Olfr722
  gRNA
gaucuauacacuucgcaacc

SEQ ID NO: 38159 - RNA, 20 nt, Artificial Sequence
  MKO10038159_A_Olfr722
  gRNA
uauagcgauauaacgaucaa

SEQ ID NO: 38160 - RNA, 20 nt, Artificial Sequence
  MKO10038160_A_Olfr722
  gRNA
uaucuauacccgccccuucc

SEQ ID NO: 38161 - RNA, 20 nt, Artificial Sequence
  MKO10038161_A_Olfr723
  gRNA
ugagucacaaguugcugaac

SEQ ID NO: 38162 - RNA, 20 nt, Artificial Sequence
  MKO10038162_A_Olfr723
  gRNA
ucuaugugcagcugacuugu

SEQ ID NO: 38163 - RNA, 20 nt, Artificial Sequence
  MKO10038163_A_Olfr723
  gRNA
caguggaaagacacaugucc

SEQ ID NO: 38164 - RNA, 20 nt, Artificial Sequence
  MKO10038164_A_Olfr724
  gRNA
ucuaucugcagcucacuugu

SEQ ID NO: 38165 - RNA, 20 nt, Artificial Sequence
  MKO10038165_A_Olfr724
  gRNA
ugagucacagguugcugaac

SEQ ID NO: 38166 - RNA, 20 nt, Artificial Sequence
  MKO10038166_A_Olfr724
  gRNA
caguggaaagacacaugucu

SEQ ID NO: 38167 - RNA, 20 nt, Artificial Sequence
  MKO10038167_A_Olfr725
  gRNA
ucaguauaugaaaccuaggc

SEQ ID NO: 38168 - RNA, 20 nt, Artificial Sequence
  MKO10038168_A_Olfr725
  gRNA
aguuaacagugaaugccaac

SEQ ID NO: 38169 - RNA, 20 nt, Artificial Sequence
  MKO10038169_A_Olfr725
  gRNA
cauccauacaaugagccagu

SEQ ID NO: 38170 - RNA, 20 nt, Artificial Sequence
  MKO10038170_A_Olfr726
  gRNA
uuucaccaccagcaaauuga

SEQ ID NO: 38171 - RNA, 20 nt, Artificial Sequence
  MKO10038171_A_Olfr726
  gRNA
guuguaucuagcaauacugc

SEQ ID NO: 38172 - RNA, 20 nt, Artificial Sequence
  MKO10038172_A_Olfr726
  gRNA
uucuguguccaucaauuugc

SEQ ID NO: 38173 - RNA, 20 nt, Artificial Sequence
  MKO10038173_A_Olfr727
  gRNA
augccaacugacuaguugua

SEQ ID NO: 38174 - RNA, 20 nt, Artificial Sequence
  MKO10038174_A_Olfr727
  gRNA
ucgcuaucugaaaccuggac

SEQ ID NO: 38175 - RNA, 20 nt, Artificial Sequence
  MKO10038175_A_Olfr727
  gRNA
cauccauacaacuagucagu

SEQ ID NO: 38176 - RNA, 20 nt, Artificial Sequence
  MKO10038176_A_Olfr728
  gRNA
acccacuagaggacugccgu

SEQ ID NO: 38177 - RNA, 20 nt, Artificial Sequence
  MKO10038177_A_Olfr728
  gRNA
ugccacaccgaagaugcuug

SEQ ID NO: 38178 - RNA, 20 nt, Artificial Sequence
  MKO10038178_A_Olfr728
  gRNA
guccaacggcaguccucuag

SEQ ID NO: 38179 - RNA, 20 nt, Artificial Sequence
  MKO10038179_A_Olfr729
  gRNA
agcccaagagauuacuacca

SEQ ID NO: 38180 - RNA, 20 nt, Artificial Sequence
  MKO10038180_A_Olfr729
  gRNA
acauguaguuugguucauga

SEQ ID NO: 38181 - RNA, 20 nt, Artificial Sequence
  MKO10038181_A_Olfr729
  gRNA
ggauaacaccaauuauucag

SEQ ID NO: 38182 - RNA, 20 nt, Artificial Sequence
  MKO10038182_A_Olfr730
  gRNA
caccuggggacuuaugauug

SEQ ID NO: 38183 - RNA, 20 nt, Artificial Sequence
  MKO10038183_A_Olfr730
  gRNA
ugccucaaucauaagucccc

SEQ ID NO: 38184 - RNA, 20 nt, Artificial Sequence
  MKO10038184_A_Olfr730
  gRNA
gagagucagauaugacgaug

SEQ ID NO: 38185 - RNA, 20 nt, Artificial Sequence
  MKO10038185_A_Olfr731
  gRNA
agccuuagaugauccaauug

SEQ ID NO: 38186 - RNA, 20 nt, Artificial Sequence
  MKO10038186_A_Olfr731
  gRNA
aucaggggccacuccucaau

SEQ ID NO: 38187 - RNA, 20 nt, Artificial Sequence
  MKO10038187_A_Olfr731
  gRNA
caagccaauuggaucaccaa

SEQ ID NO: 38188 - RNA, 20 nt, Artificial Sequence
  MKO10038188_A_Olfr732
  gRNA
aaacgacuuugucagcugau

SEQ ID NO: 38189 - RNA, 20 nt, Artificial Sequence
  MKO10038189_A_Olfr732
  gRNA
gucacaugacauucagcgcu

SEQ ID NO: 38190 - RNA, 20 nt, Artificial Sequence
  MKO10038190_A_Olfr732
  gRNA
ccaugaaaaaguuaaucauc

SEQ ID NO: 38191 - RNA, 20 nt, Artificial Sequence
  MKO10038191_A_Olfr733
  gRNA
uauuuauacccuucgaaacc

SEQ ID NO: 38192 - RNA, 20 nt, Artificial Sequence
  MKO10038192_A_Olfr733
  gRNA
gucacuugacauucaacgcu

SEQ ID NO: 38193 - RNA, 20 nt, Artificial Sequence
  MKO10038193_A_Olfr733
  gRNA
augacaguggaguaauacaa

SEQ ID NO: 38194 - RNA, 20 nt, Artificial Sequence
  MKO10038194_A_Olfr734
  gRNA
augcuaccaucaugaaccgc

SEQ ID NO: 38195 - RNA, 20 nt, Artificial Sequence
  MKO10038195_A_Olfr734
  gRNA
guaucuuaguggcccucucc

SEQ ID NO: 38196 - RNA, 20 nt, Artificial Sequence
  MKO10038196_A_Olfr734
  gRNA
auguacgaagcccccugucc

SEQ ID NO: 38197 - RNA, 20 nt, Artificial Sequence
  MKO10038197_A_Olfr735
  gRNA
ugaauaaccaccuacgacuu

SEQ ID NO: 38198 - RNA, 20 nt, Artificial Sequence
  MKO10038198_A_Olfr735
  gRNA
aagaguaucaagcgaccuag

SEQ ID NO: 38199 - RNA, 20 nt, Artificial Sequence
  MKO10038199_A_Olfr735
  gRNA
caaacaccaaccgaagucgu

SEQ ID NO: 38200 - RNA, 20 nt, Artificial Sequence
  MKO10038200_A_Olfr736
  gRNA
cccuuugcuuguccugaucc

SEQ ID NO: 38201 - RNA, 20 nt, Artificial Sequence
  MKO10038201_A_Olfr736
  gRNA
caauuguguaugcaguguac

SEQ ID NO: 38202 - RNA, 20 nt, Artificial Sequence
  MKO10038202_A_Olfr736
  gRNA
gucaugaccacuauguucug

SEQ ID NO: 38203 - RNA, 20 nt, Artificial Sequence
  MKO10038203_A_Olfr738
  gRNA
ggucuuaugcucuaguaaug

SEQ ID NO: 38204 - RNA, 20 nt, Artificial Sequence
  MKO10038204_A_Olfr738
  gRNA
aauuaaagaauuucucacac

SEQ ID NO: 38205 - RNA, 20 nt, Artificial Sequence
  MKO10038205_A_Olfr738
  gRNA
cacagucaagugugacccac

SEQ ID NO: 38206 - RNA, 20 nt, Artificial Sequence
  MKO10038206_A_Olfr739
  gRNA
agcuccaacaacaccaucac

SEQ ID NO: 38207 - RNA, 20 nt, Artificial Sequence
  MKO10038207_A_Olfr739
  gRNA
gaacaggugagggccaacag

SEQ ID NO: 38208 - RNA, 20 nt, Artificial Sequence
  MKO10038208_A_Olfr739
  gRNA
aggugacauaacagauuucc

SEQ ID NO: 38209 - RNA, 20 nt, Artificial Sequence
  MKO10038209_A_Olfr73
  gRNA
gcauaccaccccccaagcau

SEQ ID NO: 38210 - RNA, 20 nt, Artificial Sequence
  MKO10038210_A_Olfr73
  gRNA
uauugggauccuaugcuugg

SEQ ID NO: 38211 - RNA, 20 nt, Artificial Sequence
  MKO10038211_A_Olfr73
  gRNA
ugucagagcgugaaagugaa

SEQ ID NO: 38212 - RNA, 20 nt, Artificial Sequence
  MKO10038212_A_Olfr740
  gRNA
gaacaggugagggccaauag

SEQ ID NO: 38213 - RNA, 20 nt, Artificial Sequence
  MKO10038213_A_Olfr740
  gRNA
gcaucaucuuugcaguaugc

SEQ ID NO: 38214 - RNA, 20 nt, Artificial Sequence
  MKO10038214_A_Olfr740
  gRNA
ugaugcaaguguugcccaug

SEQ ID NO: 38215 - RNA, 20 nt, Artificial Sequence
  MKO10038215_A_Olfr741
  gRNA
gacauauccaaucuccauga

SEQ ID NO: 38216 - RNA, 20 nt, Artificial Sequence
  MKO10038216_A_Olfr741
  gRNA
ucuugggcuucgccuacccc

SEQ ID NO: 38217 - RNA, 20 nt, Artificial Sequence
  MKO10038217_A_Olfr741
  gRNA
caggagcauagacauuauaa

SEQ ID NO: 38218 - RNA, 20 nt, Artificial Sequence
  MKO10038218_A_Olfr742
  gRNA
gaguauguaaacaaugaaga

SEQ ID NO: 38219 - RNA, 20 nt, Artificial Sequence
  MKO10038219_A_Olfr742
  gRNA
aauuauaaugucuaugcucc

SEQ ID NO: 38220 - RNA, 20 nt, Artificial Sequence
  MKO10038220_A_Olfr742
  gRNA
aggugcccagucaugagaga

SEQ ID NO: 38221 - RNA, 20 nt, Artificial Sequence
  MKO10038221_A_Olfr743
  gRNA
ccagcuucguguccagauga

SEQ ID NO: 38222 - RNA, 20 nt, Artificial Sequence
  MKO10038222_A_Olfr743
  gRNA
auguauaugagcccaucauc

SEQ ID NO: 38223 - RNA, 20 nt, Artificial Sequence
  MKO10038223_A_Olfr743
  gRNA
cguugcccaugaggaugagu

SEQ ID NO: 38224 - RNA, 20 nt, Artificial Sequence
  MKO10038224_A_Olfr744
  gRNA
aaaaucuccccuaauugagc

SEQ ID NO: 38225 - RNA, 20 nt, Artificial Sequence
  MKO10038225_A_Olfr744
  gRNA
uagacccacagaacgacacc

SEQ ID NO: 38226 - RNA, 20 nt, Artificial Sequence
  MKO10038226_A_Olfr744
  gRNA
aucgauaccuugcuaucugc

SEQ ID NO: 38227 - RNA, 20 nt, Artificial Sequence
  MKO10038227_A_Olfr745
  gRNA
guaauggucgacagauagcc

SEQ ID NO: 38228 - RNA, 20 nt, Artificial Sequence
  MKO10038228_A_Olfr745
  gRNA
uuaguucgaccagcaccaga

SEQ ID NO: 38229 - RNA, 20 nt, Artificial Sequence
  MKO10038229_A_Olfr745
  gRNA
agcucugaguacuagaguau

SEQ ID NO: 38230 - RNA, 20 nt, Artificial Sequence
  MKO10038230_A_Olfr746
  gRNA
gucaacugaguugccagaug

SEQ ID NO: 38231 - RNA, 20 nt, Artificial Sequence
  MKO10038231_A_Olfr746
  gRNA
gcugacauacaucaccauua

SEQ ID NO: 38232 - RNA, 20 nt, Artificial Sequence
  MKO10038232_A_Olfr746
  gRNA
guacaggacagugcuauuag

SEQ ID NO: 38233 - RNA, 20 nt, Artificial Sequence
  MKO10038233_A_Olfr747
  gRNA
agccuccuagucaugauagu

SEQ ID NO: 38234 - RNA, 20 nt, Artificial Sequence
  MKO10038234_A_Olfr747
  gRNA
auguacaugaguccuacaua

SEQ ID NO: 38235 - RNA, 20 nt, Artificial Sequence
  MKO10038235_A_Olfr747
  gRNA
aaaguugaaaugccauaugu

SEQ ID NO: 38236 - RNA, 20 nt, Artificial Sequence
  MKO10038236_A_Olfr748
  gRNA
guacaggacaggaccauuag

SEQ ID NO: 38237 - RNA, 20 nt, Artificial Sequence
  MKO10038237_A_Olfr748
  gRNA
uucuucagauggacgacaaa

SEQ ID NO: 38238 - RNA, 20 nt, Artificial Sequence
  MKO10038238_A_Olfr748
  gRNA
agucacauacaucaccauua

SEQ ID NO: 38239 - RNA, 20 nt, Artificial Sequence
  MKO10038239_A_Olfr749
  gRNA
acucuucuaugguacaguaa

SEQ ID NO: 38240 - RNA, 20 nt, Artificial Sequence
  MKO10038240_A_Olfr749
  gRNA
auguaugugaguccuacaua

SEQ ID NO: 38241 - RNA, 20 nt, Artificial Sequence
  MKO10038241_A_Olfr749
  gRNA
aaaauuggaaugccauaugu

SEQ ID NO: 38242 - RNA, 20 nt, Artificial Sequence
  MKO10038242_A_Olfr74
  gRNA
gaaagccuuacgacgcccac

SEQ ID NO: 38243 - RNA, 20 nt, Artificial Sequence
  MKO10038243_A_Olfr74
  gRNA
uggugggauccuacgcaugg

SEQ ID NO: 38244 - RNA, 20 nt, Artificial Sequence
  MKO10038244_A_Olfr74
  gRNA
uugacugaugagaguaucag

SEQ ID NO: 38245 - RNA, 20 nt, Artificial Sequence
  MKO10038245_A_Olfr750
  gRNA
acuccguagugccgacacuc

SEQ ID NO: 38246 - RNA, 20 nt, Artificial Sequence
  MKO10038246_A_Olfr750
  gRNA
gccauaggacgcaccaguaa

SEQ ID NO: 38247 - RNA, 20 nt, Artificial Sequence
  MKO10038247_A_Olfr750
  gRNA
aaauggugugccgucucgag

SEQ ID NO: 38248 - RNA, 20 nt, Artificial Sequence
  MKO10038248_A_Olfr761
  gRNA
ugucagagaaccccacgagg

SEQ ID NO: 38249 - RNA, 20 nt, Artificial Sequence
  MKO10038249_A_Olfr761
  gRNA
uuguuaagugaagaauuagu

SEQ ID NO: 38250 - RNA, 20 nt, Artificial Sequence
  MKO10038250_A_Olfr761
  gRNA
aauggccuuugccugcuuua

SEQ ID NO: 38251 - RNA, 20 nt, Artificial Sequence
  MKO10038251_A_Olfr763
  gRNA
aauuuggucaguguccccaa

SEQ ID NO: 38252 - RNA, 20 nt, Artificial Sequence
  MKO10038252_A_Olfr763
  gRNA
ugcccccuucuuauugauug

SEQ ID NO: 38253 - RNA, 20 nt, Artificial Sequence
  MKO10038253_A_Olfr763
  gRNA
ccaccacagagaagugacgc

SEQ ID NO: 38254 - RNA, 20 nt, Artificial Sequence
  MKO10038254_A_Olfr765
  gRNA
ugaaaaaguugucuuucucg

SEQ ID NO: 38255 - RNA, 20 nt, Artificial Sequence
  MKO10038255_A_Olfr765
  gRNA
ucacaaacaucuucaucccc

SEQ ID NO: 38256 - RNA, 20 nt, Artificial Sequence
  MKO10038256_A_Olfr765
  gRNA
gagcaacugaaguaaugaaa

SEQ ID NO: 38257 - RNA, 20 nt, Artificial Sequence
  MKO10038257_A_Olfr767
  gRNA
ucacgaacaucuucauuccc

SEQ ID NO: 38258 - RNA, 20 nt, Artificial Sequence
  MKO10038258_A_Olfr767
  gRNA
gagcaacugaaguaaugaga

SEQ ID NO: 38259 - RNA, 20 nt, Artificial Sequence
  MKO10038259_A_Olfr767
  gRNA
uucucugcucuuggcuaggu

SEQ ID NO: 38260 - RNA, 20 nt, Artificial Sequence
  MKO10038260_A_Olfr768
  gRNA
accaauuacgcucaauaagu

SEQ ID NO: 38261 - RNA, 20 nt, Artificial Sequence
  MKO10038261_A_Olfr768
  gRNA
accuacuuauugagcguaau

SEQ ID NO: 38262 - RNA, 20 nt, Artificial Sequence
  MKO10038262_A_Olfr768
  gRNA
gccucuaucauaaagagcua

SEQ ID NO: 38263 - RNA, 20 nt, Artificial Sequence
  MKO10038263_A_Olfr769
  gRNA
accuauauauugagugugac

SEQ ID NO: 38264 - RNA, 20 nt, Artificial Sequence
  MKO10038264_A_Olfr769
  gRNA
cccugucacacucaauauau

SEQ ID NO: 38265 - RNA, 20 nt, Artificial Sequence
  MKO10038265_A_Olfr769
  gRNA
cuccuguggccaucauguac

SEQ ID NO: 38266 - RNA, 20 nt, Artificial Sequence
  MKO10038266_A_Olfr76
  gRNA
ugacauuuggcccgcaaaag

SEQ ID NO: 38267 - RNA, 20 nt, Artificial Sequence
  MKO10038267_A_Olfr76
  gRNA
caccuacugugaucacuaug

SEQ ID NO: 38268 - RNA, 20 nt, Artificial Sequence
  MKO10038268_A_Olfr76
  gRNA
agugucugucuucuauucgc

SEQ ID NO: 38269 - RNA, 20 nt, Artificial Sequence
  MKO10038269_A_Olfr770
  gRNA
gcuagauuauacaaguaucu

SEQ ID NO: 38270 - RNA, 20 nt, Artificial Sequence
  MKO10038270_A_Olfr770
  gRNA
guggauccucuguuaguccc

SEQ ID NO: 38271 - RNA, 20 nt, Artificial Sequence
  MKO10038271_A_Olfr770
  gRNA
aguaacgacauucauucucc

SEQ ID NO: 38272 - RNA, 20 nt, Artificial Sequence
  MKO10038272_A_Olfr771
  gRNA
ccaccgauuccuuugccgaa

SEQ ID NO: 38273 - RNA, 20 nt, Artificial Sequence
  MKO10038273_A_Olfr771
  gRNA
gccuacaugcucagcauaac

SEQ ID NO: 38274 - RNA, 20 nt, Artificial Sequence
  MKO10038274_A_Olfr771
  gRNA
ggucuugaugauauguacgu

SEQ ID NO: 38275 - RNA, 20 nt, Artificial Sequence
  MKO10038275_A_Olfr772
  gRNA
aacugucacacccuuguuga

SEQ ID NO: 38276 - RNA, 20 nt, Artificial Sequence
  MKO10038276_A_Olfr772
  gRNA
gauaaaaugaucaaugauau

SEQ ID NO: 38277 - RNA, 20 nt, Artificial Sequence
  MKO10038277_A_Olfr772
  gRNA
cuguucuucccacaugauug

SEQ ID NO: 38278 - RNA, 20 nt, Artificial Sequence
  MKO10038278_A_Olfr773
  gRNA
aaucaucacacccuuguuga

SEQ ID NO: 38279 - RNA, 20 nt, Artificial Sequence
  MKO10038279_A_Olfr773
  gRNA
gacaaaaugaucaauaauau

SEQ ID NO: 38280 - RNA, 20 nt, Artificial Sequence
  MKO10038280_A_Olfr773
  gRNA
cuguucuucccauaugauug

SEQ ID NO: 38281 - RNA, 20 nt, Artificial Sequence
  MKO10038281_A_Olfr774
  gRNA
acugagagucuagcaaugug

SEQ ID NO: 38282 - RNA, 20 nt, Artificial Sequence
  MKO10038282_A_Olfr774
  gRNA
uaaaaaccauguaucugagc

SEQ ID NO: 38283 - RNA, 20 nt, Artificial Sequence
  MKO10038283_A_Olfr774
  gRNA
uaucaccgaguuucugcucu

SEQ ID NO: 38284 - RNA, 20 nt, Artificial Sequence
  MKO10038284_A_Olfr775
  gRNA
uugagucaaacaguuguuau

SEQ ID NO: 38285 - RNA, 20 nt, Artificial Sequence
  MKO10038285_A_Olfr775
  gRNA
cagaaauccuaucagccaug

SEQ ID NO: 38286 - RNA, 20 nt, Artificial Sequence
  MKO10038286_A_Olfr775
  gRNA
agcugucuugcucagauacg

SEQ ID NO: 38287 - RNA, 20 nt, Artificial Sequence
  MKO10038287_A_Olfr776
  gRNA
caaacucaguaaccauagag

SEQ ID NO: 38288 - RNA, 20 nt, Artificial Sequence
  MKO10038288_A_Olfr776
  gRNA
uacauagcgaucguaagaca

SEQ ID NO: 38289 - RNA, 20 nt, Artificial Sequence
  MKO10038289_A_Olfr776
  gRNA
uuuauuaaucaaguccuuga

SEQ ID NO: 38290 - RNA, 20 nt, Artificial Sequence
  MKO10038290_A_Olfr777
  gRNA
agcuauaugcugaguaugac

SEQ ID NO: 38291 - RNA, 20 nt, Artificial Sequence
  MKO10038291_A_Olfr777
  gRNA
gcagauagugauaguuucug

SEQ ID NO: 38292 - RNA, 20 nt, Artificial Sequence
  MKO10038292_A_Olfr777
  gRNA
caagacuuauccucaguugc

SEQ ID NO: 38293 - RNA, 20 nt, Artificial Sequence
  MKO10038293_A_Olfr77
  gRNA
aucaugaacccucgaaucug

SEQ ID NO: 38294 - RNA, 20 nt, Artificial Sequence
  MKO10038294_A_Olfr77
  gRNA
auaguacauuuccuccuuau

SEQ ID NO: 38295 - RNA, 20 nt, Artificial Sequence
  MKO10038295_A_Olfr77
  gRNA
cucuguguaggauaucuuca

SEQ ID NO: 38296 - RNA, 20 nt, Artificial Sequence
  MKO10038296_A_Olfr780
  gRNA
aguuaccaguuacacucaau

SEQ ID NO: 38297 - RNA, 20 nt, Artificial Sequence
  MKO10038297_A_Olfr780
  gRNA
caugaaugcugccauccaac

SEQ ID NO: 38298 - RNA, 20 nt, Artificial Sequence
  MKO10038298_A_Olfr780
  gRNA
uaucauuacccucacuacag

SEQ ID NO: 38299 - RNA, 20 nt, Artificial Sequence
  MKO10038299_A_Olfr781
  gRNA
auugauagcuacaucguccu

SEQ ID NO: 38300 - RNA, 20 nt, Artificial Sequence
  MKO10038300_A_Olfr781
  gRNA
cccaaaccuagaccaauugg

SEQ ID NO: 38301 - RNA, 20 nt, Artificial Sequence
  MKO10038301_A_Olfr781
  gRNA
gaucagugcugcuacccaac

SEQ ID NO: 38302 - RNA, 20 nt, Artificial Sequence
  MKO10038302_A_Olfr782
  gRNA
ugacccacaacugcaaauug

SEQ ID NO: 38303 - RNA, 20 nt, Artificial Sequence
  MKO10038303_A_Olfr782
  gRNA
aaaaccacaauuugcaguug

SEQ ID NO: 38304 - RNA, 20 nt, Artificial Sequence
  MKO10038304_A_Olfr782
  gRNA
uguauacuaaaccaucugca

SEQ ID NO: 38305 - RNA, 20 nt, Artificial Sequence
  MKO10038305_A_Olfr784
  gRNA
agaauacucauuaagaaccg

SEQ ID NO: 38306 - RNA, 20 nt, Artificial Sequence
  MKO10038306_A_Olfr784
  gRNA
caucuuccccccuuuacucu

SEQ ID NO: 38307 - RNA, 20 nt, Artificial Sequence
  MKO10038307_A_Olfr784
  gRNA
uucucagcucuuggguuacu

SEQ ID NO: 38308 - RNA, 20 nt, Artificial Sequence
  MKO10038308_A_Olfr786
  gRNA
ccggcaagcguuuaugaaca

SEQ ID NO: 38309 - RNA, 20 nt, Artificial Sequence
  MKO10038309_A_Olfr786
  gRNA
ccauguucauaaacgcuugc

SEQ ID NO: 38310 - RNA, 20 nt, Artificial Sequence
  MKO10038310_A_Olfr786
  gRNA
gauguaccggucauaggaca

SEQ ID NO: 38311 - RNA, 20 nt, Artificial Sequence
  MKO10038311_A_Olfr787
  gRNA
aucagacgauccagaagucc

SEQ ID NO: 38312 - RNA, 20 nt, Artificial Sequence
  MKO10038312_A_Olfr787
  gRNA
uuucucaacgaguaaaugaa

SEQ ID NO: 38313 - RNA, 20 nt, Artificial Sequence
  MKO10038313_A_Olfr787
  gRNA
gauuacugaguuugugcucc

SEQ ID NO: 38314 - RNA, 20 nt, Artificial Sequence
  MKO10038314_A_Olfr788
  gRNA
auugagaauugccacgccuu

SEQ ID NO: 38315 - RNA, 20 nt, Artificial Sequence
  MKO10038315_A_Olfr788
  gRNA
uagaagcacaguaauccugc

SEQ ID NO: 38316 - RNA, 20 nt, Artificial Sequence
  MKO10038316_A_Olfr788
  gRNA
aggucaaaacaaugauaguc

SEQ ID NO: 38317 - RNA, 20 nt, Artificial Sequence
  MKO10038317_A_Olfr78
  gRNA
gcagaaccguucguaugauc

SEQ ID NO: 38318 - RNA, 20 nt, Artificial Sequence
  MKO10038318_A_Olfr78
  gRNA
gccagucgcuugaucaguag

SEQ ID NO: 38319 - RNA, 20 nt, Artificial Sequence
  MKO10038319_A_Olfr78
  gRNA
cugucaguggugcaccguuu

SEQ ID NO: 38320 - RNA, 20 nt, Artificial Sequence
  MKO10038320_A_Olfr790
  gRNA
accuacaugcuaagugugac

SEQ ID NO: 38321 - RNA, 20 nt, Artificial Sequence
  MKO10038321_A_Olfr790
  gRNA
ugauccacuguggcagauug

SEQ ID NO: 38322 - RNA, 20 nt, Artificial Sequence
  MKO10038322_A_Olfr790
  gRNA
uguccgaauaauauuugugu

SEQ ID NO: 38323 - RNA, 20 nt, Artificial Sequence
  MKO10038323_A_Olfr791
  gRNA
gauggggauccaccaacgua

SEQ ID NO: 38324 - RNA, 20 nt, Artificial Sequence
  MKO10038324_A_Olfr791
  gRNA
gagguggagugauaaucauu

SEQ ID NO: 38325 - RNA, 20 nt, Artificial Sequence
  MKO10038325_A_Olfr791
  gRNA
ucuuacuagucaucacaugu

SEQ ID NO: 38326 - RNA, 20 nt, Artificial Sequence
  MKO10038326_A_Olfr792
  gRNA
caaugaggguuaauacugcc

SEQ ID NO: 38327 - RNA, 20 nt, Artificial Sequence
  MKO10038327_A_Olfr792
  gRNA
caucuccuauagcucuugcc

SEQ ID NO: 38328 - RNA, 20 nt, Artificial Sequence
  MKO10038328_A_Olfr792
  gRNA
uuaccacaguuuccauuccu

SEQ ID NO: 38329 - RNA, 20 nt, Artificial Sequence
  MKO10038329_A_Olfr794
  gRNA
cuugcacuauaugaccauca

SEQ ID NO: 38330 - RNA, 20 nt, Artificial Sequence
  MKO10038330_A_Olfr794
  gRNA
ccccaguugauauacuguac

SEQ ID NO: 38331 - RNA, 20 nt, Artificial Sequence
  MKO10038331_A_Olfr794
  gRNA
auuguaguuuccaucaugua

SEQ ID NO: 38332 - RNA, 20 nt, Artificial Sequence
  MKO10038332_A_Olfr796
  gRNA
uucuagccagagccgccgca

SEQ ID NO: 38333 - RNA, 20 nt, Artificial Sequence
  MKO10038333_A_Olfr796
  gRNA
agaagaccuugcggcggcuc

SEQ ID NO: 38334 - RNA, 20 nt, Artificial Sequence
  MKO10038334_A_Olfr796
  gRNA
acucuacccuaaugaaccac

SEQ ID NO: 38335 - RNA, 20 nt, Artificial Sequence
  MKO10038335_A_Olfr798
  gRNA
caucuccuauaacuccugca

SEQ ID NO: 38336 - RNA, 20 nt, Artificial Sequence
  MKO10038336_A_Olfr798
  gRNA
ccaugagaguaaauacugcc

SEQ ID NO: 38337 - RNA, 20 nt, Artificial Sequence
  MKO10038337_A_Olfr798
  gRNA
gguguucuucuucauacucu

SEQ ID NO: 38338 - RNA, 20 nt, Artificial Sequence
  MKO10038338_A_Olfr799
  gRNA
cccaaaccuaggcuaauugg

SEQ ID NO: 38339 - RNA, 20 nt, Artificial Sequence
  MKO10038339_A_Olfr799
  gRNA
uugacugauacaagcagcau

SEQ ID NO: 38340 - RNA, 20 nt, Artificial Sequence
  MKO10038340_A_Olfr799
  gRNA
guucucccaccaauuagccu

SEQ ID NO: 38341 - RNA, 20 nt, Artificial Sequence
  MKO10038341_A_Olfr800
  gRNA
agcuacgugcugaguaugac

SEQ ID NO: 38342 - RNA, 20 nt, Artificial Sequence
  MKO10038342_A_Olfr800
  gRNA
caagacuuauccucuguugc

SEQ ID NO: 38343 - RNA, 20 nt, Artificial Sequence
  MKO10038343_A_Olfr800
  gRNA
caguaggaugaauguuguua

SEQ ID NO: 38344 - RNA, 20 nt, Artificial Sequence
  MKO10038344_A_Olfr801
  gRNA
caucuuacccccuuuagugu

SEQ ID NO: 38345 - RNA, 20 nt, Artificial Sequence
  MKO10038345_A_Olfr801
  gRNA
caacagaaugugucaccuac

SEQ ID NO: 38346 - RNA, 20 nt, Artificial Sequence
  MKO10038346_A_Olfr801
  gRNA
auuuaaagcuacccucuccu

SEQ ID NO: 38347 - RNA, 20 nt, Artificial Sequence
  MKO10038347_A_Olfr802
  gRNA
caaugcuggucuucgccucc

SEQ ID NO: 38348 - RNA, 20 nt, Artificial Sequence
  MKO10038348_A_Olfr802
  gRNA
uaagaacuuggguauaguga

SEQ ID NO: 38349 - RNA, 20 nt, Artificial Sequence
  MKO10038349_A_Olfr802
  gRNA
cuucuacagcuugauuauug

SEQ ID NO: 38350 - RNA, 20 nt, Artificial Sequence
  MKO10038350_A_Olfr803
  gRNA
gcugagaauagcuacuguuu

SEQ ID NO: 38351 - RNA, 20 nt, Artificial Sequence
  MKO10038351_A_Olfr803
  gRNA
acuuacauaguaagcaucac

SEQ ID NO: 38352 - RNA, 20 nt, Artificial Sequence
  MKO10038352_A_Olfr803
  gRNA
cauagaaaccaaucacuucu

SEQ ID NO: 38353 - RNA, 20 nt, Artificial Sequence
  MKO10038353_A_Olfr804
  gRNA
ucuccguaauuucuccuauc

SEQ ID NO: 38354 - RNA, 20 nt, Artificial Sequence
  MKO10038354_A_Olfr804
  gRNA
ucucaauuacaugaugagcu

SEQ ID NO: 38355 - RNA, 20 nt, Artificial Sequence
  MKO10038355_A_Olfr804
  gRNA
ugacccacaguugcaaauug

SEQ ID NO: 38356 - RNA, 20 nt, Artificial Sequence
  MKO10038356_A_Olfr805
  gRNA
uugaguuaaacaagauccau

SEQ ID NO: 38357 - RNA, 20 nt, Artificial Sequence
  MKO10038357_A_Olfr805
  gRNA
caagaagugaucuaucaguu

SEQ ID NO: 38358 - RNA, 20 nt, Artificial Sequence
  MKO10038358_A_Olfr805
  gRNA
ggauaaaaacccugucaccc

SEQ ID NO: 38359 - RNA, 20 nt, Artificial Sequence
  MKO10038359_A_Olfr806
  gRNA
caagaagugaucuacaguuu

SEQ ID NO: 38360 - RNA, 20 nt, Artificial Sequence
  MKO10038360_A_Olfr806
  gRNA
uagcaaagugugccacauac

SEQ ID NO: 38361 - RNA, 20 nt, Artificial Sequence
  MKO10038361_A_Olfr806
  gRNA
ggauaaaaacccugucaucc

SEQ ID NO: 38362 - RNA, 20 nt, Artificial Sequence
  MKO10038362_A_Olfr807
  gRNA
caugaaccuuguaucauugc

SEQ ID NO: 38363 - RNA, 20 nt, Artificial Sequence
  MKO10038363_A_Olfr807
  gRNA
gcaagucaaagaagcccuaa

SEQ ID NO: 38364 - RNA, 20 nt, Artificial Sequence
  MKO10038364_A_Olfr807
  gRNA
auaaugaaggggucuacaaa

SEQ ID NO: 38365 - RNA, 20 nt, Artificial Sequence
  MKO10038365_A_Olfr808
  gRNA
uacaaagauucucgagcuga

SEQ ID NO: 38366 - RNA, 20 nt, Artificial Sequence
  MKO10038366_A_Olfr808
  gRNA
uuucugaucagcaucauuac

SEQ ID NO: 38367 - RNA, 20 nt, Artificial Sequence
  MKO10038367_A_Olfr808
  gRNA
auucagcauaggagcuacag

SEQ ID NO: 38368 - RNA, 20 nt, Artificial Sequence
  MKO10038368_A_Olfr809
  gRNA
gaaaucuagaucuaagccca

SEQ ID NO: 38369 - RNA, 20 nt, Artificial Sequence
  MKO10038369_A_Olfr809
  gRNA
gagaauuaucagcaucagcg

SEQ ID NO: 38370 - RNA, 20 nt, Artificial Sequence
  MKO10038370_A_Olfr809
  gRNA
cagaauaguucugagaauac

SEQ ID NO: 38371 - RNA, 20 nt, Artificial Sequence
  MKO10038371_A_Olfr810
  gRNA
agauucaagccuaacagcag

SEQ ID NO: 38372 - RNA, 20 nt, Artificial Sequence
  MKO10038372_A_Olfr810
  gRNA
ggccaucauuacacucaccc

SEQ ID NO: 38373 - RNA, 20 nt, Artificial Sequence
  MKO10038373_A_Olfr810
  gRNA
agaugcagcugccauaugaa

SEQ ID NO: 38374 - RNA, 20 nt, Artificial Sequence
  MKO10038374_A_Olfr811
  gRNA
uugagucccaagagcaaacc

SEQ ID NO: 38375 - RNA, 20 nt, Artificial Sequence
  MKO10038375_A_Olfr811
  gRNA
ugaucauguaguuccccaug

SEQ ID NO: 38376 - RNA, 20 nt, Artificial Sequence
  MKO10038376_A_Olfr811
  gRNA
aacaaccaugugggagguac

SEQ ID NO: 38377 - RNA, 20 nt, Artificial Sequence
  MKO10038377_A_Olfr812
  gRNA
guuuagcaagggagccacgg

SEQ ID NO: 38378 - RNA, 20 nt, Artificial Sequence
  MKO10038378_A_Olfr812
  gRNA
ugaacucuaacucuccugac

SEQ ID NO: 38379 - RNA, 20 nt, Artificial Sequence
  MKO10038379_A_Olfr812
  gRNA
ucuugagguggggauccaac

SEQ ID NO: 38380 - RNA, 20 nt, Artificial Sequence
  MKO10038380_A_Olfr813
  gRNA
uauaaagcucaugagcucca

SEQ ID NO: 38381 - RNA, 20 nt, Artificial Sequence
  MKO10038381_A_Olfr813
  gRNA
gaaaucuagcucuaaaccca

SEQ ID NO: 38382 - RNA, 20 nt, Artificial Sequence
  MKO10038382_A_Olfr813
  gRNA
agugaaguggucaauaaugu

SEQ ID NO: 38383 - RNA, 20 nt, Artificial Sequence
  MKO10038383_A_Olfr814
  gRNA
cacaaguuuacuagaaguga

SEQ ID NO: 38384 - RNA, 20 nt, Artificial Sequence
  MKO10038384_A_Olfr814
  gRNA
ugacaaugugagcauaagaa

SEQ ID NO: 38385 - RNA, 20 nt, Artificial Sequence
  MKO10038385_A_Olfr814
  gRNA
uugacaaaaacagccauuau

SEQ ID NO: 38386 - RNA, 20 nt, Artificial Sequence
  MKO10038386_A_Olfr815
  gRNA
cacaaauuuacuagaccuga

SEQ ID NO: 38387 - RNA, 20 nt, Artificial Sequence
  MKO10038387_A_Olfr815
  gRNA
gagcuaagaugaaagccauc

SEQ ID NO: 38388 - RNA, 20 nt, Artificial Sequence
  MKO10038388_A_Olfr815
  gRNA
uguuugagcaagagagcugu

SEQ ID NO: 38389 - RNA, 20 nt, Artificial Sequence
  MKO10038389_A_Olfr816
  gRNA
aaauuccuucaaccgaacag

SEQ ID NO: 38390 - RNA, 20 nt, Artificial Sequence
  MKO10038390_A_Olfr816
  gRNA
accuaucugcuuagcgucac

SEQ ID NO: 38391 - RNA, 20 nt, Artificial Sequence
  MKO10038391_A_Olfr816
  gRNA
uccagugacgcuaagcagau

SEQ ID NO: 38392 - RNA, 20 nt, Artificial Sequence
  MKO10038392_A_Olfr818
  gRNA
cuccuaaaagaaugcuugug

SEQ ID NO: 38393 - RNA, 20 nt, Artificial Sequence
  MKO10038393_A_Olfr818
  gRNA
cgaacacuaccuccagagac

SEQ ID NO: 38394 - RNA, 20 nt, Artificial Sequence
  MKO10038394_A_Olfr818
  gRNA
guauguuaaaaccucagcca

SEQ ID NO: 38395 - RNA, 20 nt, Artificial Sequence
  MKO10038395_A_Olfr819
  gRNA
ucaagaaugucagaauaaug

SEQ ID NO: 38396 - RNA, 20 nt, Artificial Sequence
  MKO10038396_A_Olfr819
  gRNA
auccgcagaguguaauguag

SEQ ID NO: 38397 - RNA, 20 nt, Artificial Sequence
  MKO10038397_A_Olfr819
  gRNA
uaaauaucacaauuucauuc

SEQ ID NO: 38398 - RNA, 20 nt, Artificial Sequence
  MKO10038398_A_Olfr820
  gRNA
guuuaacagaggugcaacag

SEQ ID NO: 38399 - RNA, 20 nt, Artificial Sequence
  MKO10038399_A_Olfr820
  gRNA
aaaauucgguugcucccaga

SEQ ID NO: 38400 - RNA, 20 nt, Artificial Sequence
  MKO10038400_A_Olfr820
  gRNA
cccaagaugcuaaucaauau

SEQ ID NO: 38401 - RNA, 20 nt, Artificial Sequence
  MKO10038401_A_Olfr821
  gRNA
ugaauacugucaccguugug

SEQ ID NO: 38402 - RNA, 20 nt, Artificial Sequence
  MKO10038402_A_Olfr821
  gRNA
agaugaucuacaacugcaag

SEQ ID NO: 38403 - RNA, 20 nt, Artificial Sequence
  MKO10038403_A_Olfr821
  gRNA
uggcugcacagaaaucuagc

SEQ ID NO: 38404 - RNA, 20 nt, Artificial Sequence
  MKO10038404_A_Olfr822
  gRNA
ugaaaauugucacccuugua

SEQ ID NO: 38405 - RNA, 20 nt, Artificial Sequence
  MKO10038405_A_Olfr822
  gRNA
aucuuuccaccacuaguguu

SEQ ID NO: 38406 - RNA, 20 nt, Artificial Sequence
  MKO10038406_A_Olfr822
  gRNA
agauucaagccuaacacuag

SEQ ID NO: 38407 - RNA, 20 nt, Artificial Sequence
  MKO10038407_A_Olfr823
  gRNA
uaaugacaguuaacaugcug

SEQ ID NO: 38408 - RNA, 20 nt, Artificial Sequence
  MKO10038408_A_Olfr823
  gRNA
gaaacugaaagucagugcca

SEQ ID NO: 38409 - RNA, 20 nt, Artificial Sequence
  MKO10038409_A_Olfr823
  gRNA
cauugcugagaaaaauaccc

SEQ ID NO: 38410 - RNA, 20 nt, Artificial Sequence
  MKO10038410_A_Olfr824
  gRNA
gaaaauaguagcuagaguuu

SEQ ID NO: 38411 - RNA, 20 nt, Artificial Sequence
  MKO10038411_A_Olfr824
  gRNA
uaaugacaguuagcaugcug

SEQ ID NO: 38412 - RNA, 20 nt, Artificial Sequence
  MKO10038412_A_Olfr824
  gRNA
cauugcugagaaaaauaucc

SEQ ID NO: 38413 - RNA, 20 nt, Artificial Sequence
  MKO10038413_A_Olfr825
  gRNA
acagcacacucacgacaccc

SEQ ID NO: 38414 - RNA, 20 nt, Artificial Sequence
  MKO10038414_A_Olfr825
  gRNA
gccgacuaucacaguaaaag

SEQ ID NO: 38415 - RNA, 20 nt, Artificial Sequence
  MKO10038415_A_Olfr825
  gRNA
acaaugaugacugugauagu

SEQ ID NO: 38416 - RNA, 20 nt, Artificial Sequence
  MKO10038416_A_Olfr826
  gRNA
uuacaagauaaucucugaac

SEQ ID NO: 38417 - RNA, 20 nt, Artificial Sequence
  MKO10038417_A_Olfr826
  gRNA
acagcacacucacaacaccc

SEQ ID NO: 38418 - RNA, 20 nt, Artificial Sequence
  MKO10038418_A_Olfr826
  gRNA
aaugaugcuggauaaugaaa

SEQ ID NO: 38419 - RNA, 20 nt, Artificial Sequence
  MKO10038419_A_Olfr827
  gRNA
agguacaauaaccguggagu

SEQ ID NO: 38420 - RNA, 20 nt, Artificial Sequence
  MKO10038420_A_Olfr827
  gRNA
uuuacagcguucgaauguca

SEQ ID NO: 38421 - RNA, 20 nt, Artificial Sequence
  MKO10038421_A_Olfr827
  gRNA
uugacauucgaacgcuguaa

SEQ ID NO: 38422 - RNA, 20 nt, Artificial Sequence
  MKO10038422_A_Olfr828
  gRNA
cauguacuugaucaccaucu

SEQ ID NO: 38423 - RNA, 20 nt, Artificial Sequence
  MKO10038423_A_Olfr828
  gRNA
ucaugaucguuguguaguuc

SEQ ID NO: 38424 - RNA, 20 nt, Artificial Sequence
  MKO10038424_A_Olfr828
  gRNA
uaauagaauuagcagaccac

SEQ ID NO: 38425 - RNA, 20 nt, Artificial Sequence
  MKO10038425_A_Olfr829
  gRNA
ugaauccugacacaaccguu

SEQ ID NO: 38426 - RNA, 20 nt, Artificial Sequence
  MKO10038426_A_Olfr829
  gRNA
auaccauuagaccauugacc

SEQ ID NO: 38427 - RNA, 20 nt, Artificial Sequence
  MKO10038427_A_Olfr829
  gRNA
ugcccuggucaauggucuaa

SEQ ID NO: 38428 - RNA, 20 nt, Artificial Sequence
  MKO10038428_A_Olfr830
  gRNA
auauacuugauuaccguuuc

SEQ ID NO: 38429 - RNA, 20 nt, Artificial Sequence
  MKO10038429_A_Olfr830
  gRNA
gaggcccugaagaaaguuau

SEQ ID NO: 38430 - RNA, 20 nt, Artificial Sequence
  MKO10038430_A_Olfr830
  gRNA
cuuaagauucaugucuaaca

SEQ ID NO: 38431 - RNA, 20 nt, Artificial Sequence
  MKO10038431_A_Olfr832
  gRNA
auucgaaucuccauacccca

SEQ ID NO: 38432 - RNA, 20 nt, Artificial Sequence
  MKO10038432_A_Olfr832
  gRNA
gaacuacagccugucuuauu

SEQ ID NO: 38433 - RNA, 20 nt, Artificial Sequence
  MKO10038433_A_Olfr832
  gRNA
gagauucgaaucaaaaauug

SEQ ID NO: 38434 - RNA, 20 nt, Artificial Sequence
  MKO10038434_A_Olfr834
  gRNA
guauuuggugacaagccugu

SEQ ID NO: 38435 - RNA, 20 nt, Artificial Sequence
  MKO10038435_A_Olfr834
  gRNA
cuguagccaguauuaugaga

SEQ ID NO: 38436 - RNA, 20 nt, Artificial Sequence
  MKO10038436_A_Olfr834
  gRNA
gucaacucgaucaguuauac

SEQ ID NO: 38437 - RNA, 20 nt, Artificial Sequence
  MKO10038437_A_Olfr835
  gRNA
ugaguaguccguaacauauu

SEQ ID NO: 38438 - RNA, 20 nt, Artificial Sequence
  MKO10038438_A_Olfr835
  gRNA
gacuacaguguacauaaugc

SEQ ID NO: 38439 - RNA, 20 nt, Artificial Sequence
  MKO10038439_A_Olfr835
  gRNA
uaucuuuagccuucgaaaua

SEQ ID NO: 38440 - RNA, 20 nt, Artificial Sequence
  MKO10038440_A_Olfr836
  gRNA
cuuaagauucaugugcaaaa

SEQ ID NO: 38441 - RNA, 20 nt, Artificial Sequence
  MKO10038441_A_Olfr836
  gRNA
ugauaaaugagacccacacg

SEQ ID NO: 38442 - RNA, 20 nt, Artificial Sequence
  MKO10038442_A_Olfr836
  gRNA
uucaccaaagaagauugcca

SEQ ID NO: 38443 - RNA, 20 nt, Artificial Sequence
  MKO10038443_A_Olfr837
  gRNA
aguaguaauugauucaccga

SEQ ID NO: 38444 - RNA, 20 nt, Artificial Sequence
  MKO10038444_A_Olfr837
  gRNA
uaaaaacaagucgguuguuu

SEQ ID NO: 38445 - RNA, 20 nt, Artificial Sequence
  MKO10038445_A_Olfr837
  gRNA
caugauguaugauuaaucug

SEQ ID NO: 38446 - RNA, 20 nt, Artificial Sequence
  MKO10038446_A_Olfr843
  gRNA
aaaaggcuuuauuccguccc

SEQ ID NO: 38447 - RNA, 20 nt, Artificial Sequence
  MKO10038447_A_Olfr843
  gRNA
aaucagagcauuaccuauac

SEQ ID NO: 38448 - RNA, 20 nt, Artificial Sequence
  MKO10038448_A_Olfr843
  gRNA
ucuuaagauaucaucagucc

SEQ ID NO: 38449 - RNA, 20 nt, Artificial Sequence
  MKO10038449_A_Olfr845
  gRNA
caggaacaguccgaaaauaa

SEQ ID NO: 38450 - RNA, 20 nt, Artificial Sequence
  MKO10038450_A_Olfr845
  gRNA
ugcacuacugcucagucuca

SEQ ID NO: 38451 - RNA, 20 nt, Artificial Sequence
  MKO10038451_A_Olfr845
  gRNA
auugacagcacuaauagcca

SEQ ID NO: 38452 - RNA, 20 nt, Artificial Sequence
  MKO10038452_A_Olfr846
  gRNA
cuuagcaaugagcuuucgua

SEQ ID NO: 38453 - RNA, 20 nt, Artificial Sequence
  MKO10038453_A_Olfr846
  gRNA
gcuaaccagugauccuacaa

SEQ ID NO: 38454 - RNA, 20 nt, Artificial Sequence
  MKO10038454_A_Olfr846
  gRNA
aauaugaggagcuccauugu

SEQ ID NO: 38455 - RNA, 20 nt, Artificial Sequence
  MKO10038455_A_Olfr847
  gRNA
cacugcugcaccauagaaua

SEQ ID NO: 38456 - RNA, 20 nt, Artificial Sequence
  MKO10038456_A_Olfr847
  gRNA
acaguagagccccucaucuu

SEQ ID NO: 38457 - RNA, 20 nt, Artificial Sequence
  MKO10038457_A_Olfr847
  gRNA
guucgcagugcuaaugauca

SEQ ID NO: 38458 - RNA, 20 nt, Artificial Sequence
  MKO10038458_A_Olfr849
  gRNA
gggagucagagcuaacagcu

SEQ ID NO: 38459 - RNA, 20 nt, Artificial Sequence
  MKO10038459_A_Olfr849
  gRNA
auauaucugaucaccaccuu

SEQ ID NO: 38460 - RNA, 20 nt, Artificial Sequence
  MKO10038460_A_Olfr849
  gRNA
gcagcaauaucaucaaagug

SEQ ID NO: 38461 - RNA, 20 nt, Artificial Sequence
  MKO10038461_A_Olfr850
  gRNA
augacagucggagcaccaua

SEQ ID NO: 38462 - RNA, 20 nt, Artificial Sequence
  MKO10038462_A_Olfr850
  gRNA
uauauaucugaucaccaucc

SEQ ID NO: 38463 - RNA, 20 nt, Artificial Sequence
  MKO10038463_A_Olfr850
  gRNA
ugaugccacugcaguauucc

SEQ ID NO: 38464 - RNA, 20 nt, Artificial Sequence
  MKO10038464_A_Olfr851
  gRNA
uuacagccaguauaaugagu

SEQ ID NO: 38465 - RNA, 20 nt, Artificial Sequence
  MKO10038465_A_Olfr851
  gRNA
agccuauauaagugaugcuc

SEQ ID NO: 38466 - RNA, 20 nt, Artificial Sequence
  MKO10038466_A_Olfr851
  gRNA
ugcacuacuccauacacuuc

SEQ ID NO: 38467 - RNA, 20 nt, Artificial Sequence
  MKO10038467_A_Olfr853
  gRNA
aaagccuuaugccuaccgcc

SEQ ID NO: 38468 - RNA, 20 nt, Artificial Sequence
  MKO10038468_A_Olfr853
  gRNA
uaugucaugaguagugcauu

SEQ ID NO: 38469 - RNA, 20 nt, Artificial Sequence
  MKO10038469_A_Olfr853
  gRNA
auguaccuagugacagucuc

SEQ ID NO: 38470 - RNA, 20 nt, Artificial Sequence
  MKO10038470_A_Olfr854
  gRNA
gucccugcuaauuagcauug

SEQ ID NO: 38471 - RNA, 20 nt, Artificial Sequence
  MKO10038471_A_Olfr854
  gRNA
uauaagcauguucccgaaaa

SEQ ID NO: 38472 - RNA, 20 nt, Artificial Sequence
  MKO10038472_A_Olfr854
  gRNA
uucauccaggaagacugcgg

SEQ ID NO: 38473 - RNA, 20 nt, Artificial Sequence
  MKO10038473_A_Olfr855
  gRNA
uggugacuaaguauaugaac

SEQ ID NO: 38474 - RNA, 20 nt, Artificial Sequence
  MKO10038474_A_Olfr855
  gRNA
auauacuuagucaccauccu

SEQ ID NO: 38475 - RNA, 20 nt, Artificial Sequence
  MKO10038475_A_Olfr855
  gRNA
gagaguagaacacauaaguu

SEQ ID NO: 38476 - RNA, 20 nt, Artificial Sequence
  MKO10038476_A_Olfr857
  gRNA
uagccuauugcuggcuguga

SEQ ID NO: 38477 - RNA, 20 nt, Artificial Sequence
  MKO10038477_A_Olfr857
  gRNA
ugaagcgaccauacuuuccc

SEQ ID NO: 38478 - RNA, 20 nt, Artificial Sequence
  MKO10038478_A_Olfr857
  gRNA
aacucacaagacuaaugaaa

SEQ ID NO: 38479 - RNA, 20 nt, Artificial Sequence
  MKO10038479_A_Olfr859
  gRNA
caguauucuacuggcaguga

SEQ ID NO: 38480 - RNA, 20 nt, Artificial Sequence
  MKO10038480_A_Olfr859
  gRNA
cuuccucuacaaccuuucau

SEQ ID NO: 38481 - RNA, 20 nt, Artificial Sequence
  MKO10038481_A_Olfr859
  gRNA
cauaaguuauggaucuguug

SEQ ID NO: 38482 - RNA, 20 nt, Artificial Sequence
  MKO10038482_A_Olfr860
  gRNA
accaaauaucuacacagacg

SEQ ID NO: 38483 - RNA, 20 nt, Artificial Sequence
  MKO10038483_A_Olfr860
  gRNA
uuacauuuccccccagauga

SEQ ID NO: 38484 - RNA, 20 nt, Artificial Sequence
  MKO10038484_A_Olfr860
  gRNA
aauggccacccaucggucgu

SEQ ID NO: 38485 - RNA, 20 nt, Artificial Sequence
  MKO10038485_A_Olfr862
  gRNA
accaaacgucuacacaggcc

SEQ ID NO: 38486 - RNA, 20 nt, Artificial Sequence
  MKO10038486_A_Olfr862
  gRNA
cauacguuaucgauuuguua

SEQ ID NO: 38487 - RNA, 20 nt, Artificial Sequence
  MKO10038487_A_Olfr862
  gRNA
guaugcagccugccuaacuc

SEQ ID NO: 38488 - RNA, 20 nt, Artificial Sequence
  MKO10038488_A_Olfr866
  gRNA
ccaucucauggcacucuccg

SEQ ID NO: 38489 - RNA, 20 nt, Artificial Sequence
  MKO10038489_A_Olfr866
  gRNA
ucauaaggacuguguaauga

SEQ ID NO: 38490 - RNA, 20 nt, Artificial Sequence
  MKO10038490_A_Olfr866
  gRNA
cacaguccuuaugaacccuc

SEQ ID NO: 38491 - RNA, 20 nt, Artificial Sequence
  MKO10038491_A_Olfr867
  gRNA
cuauauagaaugccuuacac

SEQ ID NO: 38492 - RNA, 20 nt, Artificial Sequence
  MKO10038492_A_Olfr867
  gRNA
aucagaagugcacacagucg

SEQ ID NO: 38493 - RNA, 20 nt, Artificial Sequence
  MKO10038493_A_Olfr867
  gRNA
cauaggaaucacacccagua

SEQ ID NO: 38494 - RNA, 20 nt, Artificial Sequence
  MKO10038494_A_Olfr868
  gRNA
caguccagucauauccuacg

SEQ ID NO: 38495 - RNA, 20 nt, Artificial Sequence
  MKO10038495_A_Olfr868
  gRNA
aucaugaauccuugucgcug

SEQ ID NO: 38496 - RNA, 20 nt, Artificial Sequence
  MKO10038496_A_Olfr868
  gRNA
augauuauugcauaacgcaa

SEQ ID NO: 38497 - RNA, 20 nt, Artificial Sequence
  MKO10038497_A_Olfr869
  gRNA
cccuucgcugcagcuuccgu

SEQ ID NO: 38498 - RNA, 20 nt, Artificial Sequence
  MKO10038498_A_Olfr869
  gRNA
acagcuacugcaguauacau

SEQ ID NO: 38499 - RNA, 20 nt, Artificial Sequence
  MKO10038499_A_Olfr869
  gRNA
gcuuauucuuuguugaguca

SEQ ID NO: 38500 - RNA, 20 nt, Artificial Sequence
  MKO10038500_A_Olfr870
  gRNA
acuagcaaaccacuuaguug

SEQ ID NO: 38501 - RNA, 20 nt, Artificial Sequence
  MKO10038501_A_Olfr870
  gRNA
auuaugaauccucaacuaag

SEQ ID NO: 38502 - RNA, 20 nt, Artificial Sequence
  MKO10038502_A_Olfr870
  gRNA
cagaacuaagguacacacua

SEQ ID NO: 38503 - RNA, 20 nt, Artificial Sequence
  MKO10038503_A_Olfr871
  gRNA
gaaccagcaagccacuuagu

SEQ ID NO: 38504 - RNA, 20 nt, Artificial Sequence
  MKO10038504_A_Olfr871
  gRNA
auuaugaauccccaacuaag

SEQ ID NO: 38505 - RNA, 20 nt, Artificial Sequence
  MKO10038505_A_Olfr871
  gRNA
ucauaaugacugaauaguga

SEQ ID NO: 38506 - RNA, 20 nt, Artificial Sequence
  MKO10038506_A_Olfr872
  gRNA
acauccauuggaguauacau

SEQ ID NO: 38507 - RNA, 20 nt, Artificial Sequence
  MKO10038507_A_Olfr872
  gRNA
guaguucuacauucucugag

SEQ ID NO: 38508 - RNA, 20 nt, Artificial Sequence
  MKO10038508_A_Olfr872
  gRNA
uauuuaagcuuauucuuugc

SEQ ID NO: 38509 - RNA, 20 nt, Artificial Sequence
  MKO10038509_A_Olfr873
  gRNA
aucaugaauccucgccucug

SEQ ID NO: 38510 - RNA, 20 nt, Artificial Sequence
  MKO10038510_A_Olfr873
  gRNA
uuauaccucccaccuuucga

SEQ ID NO: 38511 - RNA, 20 nt, Artificial Sequence
  MKO10038511_A_Olfr873
  gRNA
auucugaaaauaccaucgaa

SEQ ID NO: 38512 - RNA, 20 nt, Artificial Sequence
  MKO10038512_A_Olfr874
  gRNA
gauuacgagcucauuuauga

SEQ ID NO: 38513 - RNA, 20 nt, Artificial Sequence
  MKO10038513_A_Olfr874
  gRNA
gcucguaaucuuuauuguug

SEQ ID NO: 38514 - RNA, 20 nt, Artificial Sequence
  MKO10038514_A_Olfr874
  gRNA
aaugggcacaccaauaucaa

SEQ ID NO: 38515 - RNA, 20 nt, Artificial Sequence
  MKO10038515_A_Olfr875
  gRNA
acgaauaucaucucacacuc

SEQ ID NO: 38516 - RNA, 20 nt, Artificial Sequence
  MKO10038516_A_Olfr875
  gRNA
ugccauggcugacagaauga

SEQ ID NO: 38517 - RNA, 20 nt, Artificial Sequence
  MKO10038517_A_Olfr875
  gRNA
ugcuacaggagagcucaaga

SEQ ID NO: 38518 - RNA, 20 nt, Artificial Sequence
  MKO10038518_A_Olfr876
  gRNA
gccuugccauggauauggug

SEQ ID NO: 38519 - RNA, 20 nt, Artificial Sequence
  MKO10038519_A_Olfr876
  gRNA
ggaauagcagaaaucgauua

SEQ ID NO: 38520 - RNA, 20 nt, Artificial Sequence
  MKO10038520_A_Olfr876
  gRNA
cauggcccacaccauaucca

SEQ ID NO: 38521 - RNA, 20 nt, Artificial Sequence
  MKO10038521_A_Olfr877
  gRNA
cuccacauuaguucuaaaga

SEQ ID NO: 38522 - RNA, 20 nt, Artificial Sequence
  MKO10038522_A_Olfr877
  gRNA
ugcagcgaacaccuccucag

SEQ ID NO: 38523 - RNA, 20 nt, Artificial Sequence
  MKO10038523_A_Olfr877
  gRNA
uagcucauacaucaauuugu

SEQ ID NO: 38524 - RNA, 20 nt, Artificial Sequence
  MKO10038524_A_Olfr878
  gRNA
caauucugaaugcuacgugc

SEQ ID NO: 38525 - RNA, 20 nt, Artificial Sequence
  MKO10038525_A_Olfr878
  gRNA
uugggacugaucaccuuaau

SEQ ID NO: 38526 - RNA, 20 nt, Artificial Sequence
  MKO10038526_A_Olfr878
  gRNA
aucuaugugcugacuguuau

SEQ ID NO: 38527 - RNA, 20 nt, Artificial Sequence
  MKO10038527_A_Olfr881
  gRNA
agucuauauauucuccgugg

SEQ ID NO: 38528 - RNA, 20 nt, Artificial Sequence
  MKO10038528_A_Olfr881
  gRNA
uauggcgcauacugccagua

SEQ ID NO: 38529 - RNA, 20 nt, Artificial Sequence
  MKO10038529_A_Olfr881
  gRNA
auucaacauugggcccauaa

SEQ ID NO: 38530 - RNA, 20 nt, Artificial Sequence
  MKO10038530_A_Olfr883
  gRNA
acaccccaacugucaucagc

SEQ ID NO: 38531 - RNA, 20 nt, Artificial Sequence
  MKO10038531_A_Olfr883
  gRNA
cauacuaccagugugugcaa

SEQ ID NO: 38532 - RNA, 20 nt, Artificial Sequence
  MKO10038532_A_Olfr883
  gRNA
uuugccugcugaugacaguu

SEQ ID NO: 38533 - RNA, 20 nt, Artificial Sequence
  MKO10038533_A_Olfr884
  gRNA
auucagcauuggacccaaaa

SEQ ID NO: 38534 - RNA, 20 nt, Artificial Sequence
  MKO10038534_A_Olfr884
  gRNA
ugucauaaccccuagaaugu

SEQ ID NO: 38535 - RNA, 20 nt, Artificial Sequence
  MKO10038535_A_Olfr884
  gRNA
aaaaacuaccaucucauuga

SEQ ID NO: 38536 - RNA, 20 nt, Artificial Sequence
  MKO10038536_A_Olfr885
  gRNA
aacauccucagcauccauuc

SEQ ID NO: 38537 - RNA, 20 nt, Artificial Sequence
  MKO10038537_A_Olfr885
  gRNA
uugaccuaccuuccccagaa

SEQ ID NO: 38538 - RNA, 20 nt, Artificial Sequence
  MKO10038538_A_Olfr885
  gRNA
aaucuacguggucucuguga

SEQ ID NO: 38539 - RNA, 20 nt, Artificial Sequence
  MKO10038539_A_Olfr887
  gRNA
gcugagucaugcacucugca

SEQ ID NO: 38540 - RNA, 20 nt, Artificial Sequence
  MKO10038540_A_Olfr887
  gRNA
ccacacccaucaucaugaag

SEQ ID NO: 38541 - RNA, 20 nt, Artificial Sequence
  MKO10038541_A_Olfr887
  gRNA
ggucugccacuucaugauga

SEQ ID NO: 38542 - RNA, 20 nt, Artificial Sequence
  MKO10038542_A_Olfr888
  gRNA
caugcuaccaguaugugcca

SEQ ID NO: 38543 - RNA, 20 nt, Artificial Sequence
  MKO10038543_A_Olfr888
  gRNA
ccucagcauucaaucugcag

SEQ ID NO: 38544 - RNA, 20 nt, Artificial Sequence
  MKO10038544_A_Olfr888
  gRNA
caaucagaacaaucaguccc

SEQ ID NO: 38545 - RNA, 20 nt, Artificial Sequence
  MKO10038545_A_Olfr889
  gRNA
acauguagugauuaauuaug

SEQ ID NO: 38546 - RNA, 20 nt, Artificial Sequence
  MKO10038546_A_Olfr889
  gRNA
auccuuucaucuauagcaua

SEQ ID NO: 38547 - RNA, 20 nt, Artificial Sequence
  MKO10038547_A_Olfr889
  gRNA
cauacacucugcaugagaga

SEQ ID NO: 38548 - RNA, 20 nt, Artificial Sequence
  MKO10038548_A_Olfr890
  gRNA
caggucugccucuugaugac

SEQ ID NO: 38549 - RNA, 20 nt, Artificial Sequence
  MKO10038549_A_Olfr890
  gRNA
acauccccccugucaucaag

SEQ ID NO: 38550 - RNA, 20 nt, Artificial Sequence
  MKO10038550_A_Olfr890
  gRNA
auccguuuauuuacaguuua

SEQ ID NO: 38551 - RNA, 20 nt, Artificial Sequence
  MKO10038551_A_Olfr891
  gRNA
gccugaucauacacccugua

SEQ ID NO: 38552 - RNA, 20 nt, Artificial Sequence
  MKO10038552_A_Olfr891
  gRNA
uccauacaggguguaugauc

SEQ ID NO: 38553 - RNA, 20 nt, Artificial Sequence
  MKO10038553_A_Olfr891
  gRNA
ugaugauauaaauggcaacg

SEQ ID NO: 38554 - RNA, 20 nt, Artificial Sequence
  MKO10038554_A_Olfr893
  gRNA
auuagcagggaacacauccg

SEQ ID NO: 38555 - RNA, 20 nt, Artificial Sequence
  MKO10038555_A_Olfr893
  gRNA
auccgcugaaucuguagauc

SEQ ID NO: 38556 - RNA, 20 nt, Artificial Sequence
  MKO10038556_A_Olfr893
  gRNA
cucauacuggcugcaugauu

SEQ ID NO: 38557 - RNA, 20 nt, Artificial Sequence
  MKO10038557_A_Olfr894
  gRNA
auugacauacgugcuacuac

SEQ ID NO: 38558 - RNA, 20 nt, Artificial Sequence
  MKO10038558_A_Olfr894
  gRNA
gcuuaugaguuauauugcag

SEQ ID NO: 38559 - RNA, 20 nt, Artificial Sequence
  MKO10038559_A_Olfr894
  gRNA
auuagugccacagcucacac

SEQ ID NO: 38560 - RNA, 20 nt, Artificial Sequence
  MKO10038560_A_Olfr895
  gRNA
guuagugccuuauuccauac

SEQ ID NO: 38561 - RNA, 20 nt, Artificial Sequence
  MKO10038561_A_Olfr895
  gRNA
guuagcuuguucuauguaac

SEQ ID NO: 38562 - RNA, 20 nt, Artificial Sequence
  MKO10038562_A_Olfr895
  gRNA
gccuuaucauaaaaccugua

SEQ ID NO: 38563 - RNA, 20 nt, Artificial Sequence
  MKO10038563_A_Olfr898
  gRNA
gaugcgagucaugaagcaaa

SEQ ID NO: 38564 - RNA, 20 nt, Artificial Sequence
  MKO10038564_A_Olfr898
  gRNA
acuuacaagcucguugacau

SEQ ID NO: 38565 - RNA, 20 nt, Artificial Sequence
  MKO10038565_A_Olfr898
  gRNA
cgagcuuguaaguucugcug

SEQ ID NO: 38566 - RNA, 20 nt, Artificial Sequence
  MKO10038566_A_Olfr899
  gRNA
guugacaugacugcuaccac

SEQ ID NO: 38567 - RNA, 20 nt, Artificial Sequence
  MKO10038567_A_Olfr899
  gRNA
uacaacauaagcacuucccu

SEQ ID NO: 38568 - RNA, 20 nt, Artificial Sequence
  MKO10038568_A_Olfr899
  gRNA
agugugcagcaagcauuaac

SEQ ID NO: 38569 - RNA, 20 nt, Artificial Sequence
  MKO10038569_A_Olfr8
  gRNA
ccaacaucucuguauacuga

SEQ ID NO: 38570 - RNA, 20 nt, Artificial Sequence
  MKO10038570_A_Olfr8
  gRNA
ccaucaguauacagagaugu

SEQ ID NO: 38571 - RNA, 20 nt, Artificial Sequence
  MKO10038571_A_Olfr8
  gRNA
acaaugaauguguaauacaa

SEQ ID NO: 38572 - RNA, 20 nt, Artificial Sequence
  MKO10038572_A_Olfr900
  gRNA
gcucacaagcucguugacau

SEQ ID NO: 38573 - RNA, 20 nt, Artificial Sequence
  MKO10038573_A_Olfr900
  gRNA
gcaauccagacccauaaaag

SEQ ID NO: 38574 - RNA, 20 nt, Artificial Sequence
  MKO10038574_A_Olfr900
  gRNA
cagaacaccauauccuauga

SEQ ID NO: 38575 - RNA, 20 nt, Artificial Sequence
  MKO10038575_A_Olfr901
  gRNA
agcuauuaugugcgagcuac

SEQ ID NO: 38576 - RNA, 20 nt, Artificial Sequence
  MKO10038576_A_Olfr901
  gRNA
ucacauauccguuccacuga

SEQ ID NO: 38577 - RNA, 20 nt, Artificial Sequence
  MKO10038577_A_Olfr901
  gRNA
guugugggugucaaugugau

SEQ ID NO: 38578 - RNA, 20 nt, Artificial Sequence
  MKO10038578_A_Olfr902
  gRNA
uacccuuagaggaacuuaug

SEQ ID NO: 38579 - RNA, 20 nt, Artificial Sequence
  MKO10038579_A_Olfr902
  gRNA
aacagggguauuuggcgauc

SEQ ID NO: 38580 - RNA, 20 nt, Artificial Sequence
  MKO10038580_A_Olfr902
  gRNA
augcuuugugcugacgucaa

SEQ ID NO: 38581 - RNA, 20 nt, Artificial Sequence
  MKO10038581_A_Olfr904
  gRNA
cuguaauccacucuuguaca

SEQ ID NO: 38582 - RNA, 20 nt, Artificial Sequence
  MKO10038582_A_Olfr904
  gRNA
uugcauauguaccaagcaua

SEQ ID NO: 38583 - RNA, 20 nt, Artificial Sequence
  MKO10038583_A_Olfr904
  gRNA
ggacuugaugugaaaaaugc

SEQ ID NO: 38584 - RNA, 20 nt, Artificial Sequence
  MKO10038584_A_Olfr905
  gRNA
caggguuugauuagcuuaau

SEQ ID NO: 38585 - RNA, 20 nt, Artificial Sequence
  MKO10038585_A_Olfr905
  gRNA
acuuguccuuuguugaccuc

SEQ ID NO: 38586 - RNA, 20 nt, Artificial Sequence
  MKO10038586_A_Olfr905
  gRNA
ccacauacaucauuagaaac

SEQ ID NO: 38587 - RNA, 20 nt, Artificial Sequence
  MKO10038587_A_Olfr906
  gRNA
uaucuuaaacccuccucagu

SEQ ID NO: 38588 - RNA, 20 nt, Artificial Sequence
  MKO10038588_A_Olfr906
  gRNA
aaagaauggcuuucggaaau

SEQ ID NO: 38589 - RNA, 20 nt, Artificial Sequence
  MKO10038589_A_Olfr906
  gRNA
uaguuacuauauacauuaca

SEQ ID NO: 38590 - RNA, 20 nt, Artificial Sequence
  MKO10038590_A_Olfr907
  gRNA
gauguacgugauagcuacau

SEQ ID NO: 38591 - RNA, 20 nt, Artificial Sequence
  MKO10038591_A_Olfr907
  gRNA
ggagaggauaaagccguaag

SEQ ID NO: 38592 - RNA, 20 nt, Artificial Sequence
  MKO10038592_A_Olfr907
  gRNA
cucaaaauaagcuccacagc

SEQ ID NO: 38593 - RNA, 20 nt, Artificial Sequence
  MKO10038593_A_Olfr908
  gRNA
auucaucauaggcaccaaua

SEQ ID NO: 38594 - RNA, 20 nt, Artificial Sequence
  MKO10038594_A_Olfr908
  gRNA
ugcccucaguagaucucauu

SEQ ID NO: 38595 - RNA, 20 nt, Artificial Sequence
  MKO10038595_A_Olfr908
  gRNA
caaucccugcagaaugaauu

SEQ ID NO: 38596 - RNA, 20 nt, Artificial Sequence
  MKO10038596_A_Olfr90
  gRNA
agaauccuuaugcucgagag

SEQ ID NO: 38597 - RNA, 20 nt, Artificial Sequence
  MKO10038597_A_Olfr90
  gRNA
acacaaagucgucaaccuga

SEQ ID NO: 38598 - RNA, 20 nt, Artificial Sequence
  MKO10038598_A_Olfr90
  gRNA
caggacagucgaaucaaagc

SEQ ID NO: 38599 - RNA, 20 nt, Artificial Sequence
  MKO10038599_A_Olfr910
  gRNA
uacuuaaaaccccccucagc

SEQ ID NO: 38600 - RNA, 20 nt, Artificial Sequence
  MKO10038600_A_Olfr910
  gRNA
agaagaauggucgugacaaa

SEQ ID NO: 38601 - RNA, 20 nt, Artificial Sequence
  MKO10038601_A_Olfr910
  gRNA
cucauucaaagauccagcug

SEQ ID NO: 38602 - RNA, 20 nt, Artificial Sequence
  MKO10038602_A_Olfr911-ps1
  gRNA
gaaauagagauucuaaucgu

SEQ ID NO: 38603 - RNA, 20 nt, Artificial Sequence
  MKO10038603_A_Olfr911-ps1
  gRNA
cuucaaaugagauccacugc

SEQ ID NO: 38604 - RNA, 20 nt, Artificial Sequence
  MKO10038604_A_Olfr911-ps1
  gRNA
auagugauguuauacaagag

SEQ ID NO: 38605 - RNA, 20 nt, Artificial Sequence
  MKO10038605_A_Olfr912
  gRNA
ggcuuuauaucugccccuag

SEQ ID NO: 38606 - RNA, 20 nt, Artificial Sequence
  MKO10038606_A_Olfr912
  gRNA
uuaccaaagagugauuuguc

SEQ ID NO: 38607 - RNA, 20 nt, Artificial Sequence
  MKO10038607_A_Olfr912
  gRNA
uccuccaaauaaaguccacu

SEQ ID NO: 38608 - RNA, 20 nt, Artificial Sequence
  MKO10038608_A_Olfr913
  gRNA
cucagcucuaucuaucaaua

SEQ ID NO: 38609 - RNA, 20 nt, Artificial Sequence
  MKO10038609_A_Olfr913
  gRNA
gaugcuugguucguauuuca

SEQ ID NO: 38610 - RNA, 20 nt, Artificial Sequence
  MKO10038610_A_Olfr913
  gRNA
cagcucuaucucauugauau

SEQ ID NO: 38611 - RNA, 20 nt, Artificial Sequence
  MKO10038611_A_Olfr914
  gRNA
gucucauuacacaaccugug

SEQ ID NO: 38612 - RNA, 20 nt, Artificial Sequence
  MKO10038612_A_Olfr914
  gRNA
uucagcuguaucuaugaaug

SEQ ID NO: 38613 - RNA, 20 nt, Artificial Sequence
  MKO10038613_A_Olfr914
  gRNA
auggcaacacuauacaagag

SEQ ID NO: 38614 - RNA, 20 nt, Artificial Sequence
  MKO10038614_A_Olfr915
  gRNA
cagcaucuaugucaacgagc

SEQ ID NO: 38615 - RNA, 20 nt, Artificial Sequence
  MKO10038615_A_Olfr915
  gRNA
uuauauaugagccaaguaug

SEQ ID NO: 38616 - RNA, 20 nt, Artificial Sequence
  MKO10038616_A_Olfr915
  gRNA
aucagcacuuucucuuacuc

SEQ ID NO: 38617 - RNA, 20 nt, Artificial Sequence
  MKO10038617_A_Olfr916
  gRNA
uacaagcuuguugauauaug

SEQ ID NO: 38618 - RNA, 20 nt, Artificial Sequence
  MKO10038618_A_Olfr916
  gRNA
guuaaauguuccucuugcuc

SEQ ID NO: 38619 - RNA, 20 nt, Artificial Sequence
  MKO10038619_A_Olfr916
  gRNA
aauuccccaaugcagugacu

SEQ ID NO: 38620 - RNA, 20 nt, Artificial Sequence
  MKO10038620_A_Olfr917
  gRNA
uacaaccucauugacacgug

SEQ ID NO: 38621 - RNA, 20 nt, Artificial Sequence
  MKO10038621_A_Olfr917
  gRNA
uacgaccacacgugucaaug

SEQ ID NO: 38622 - RNA, 20 nt, Artificial Sequence
  MKO10038622_A_Olfr917
  gRNA
agaacugaugcgaaagauac

SEQ ID NO: 38623 - RNA, 20 nt, Artificial Sequence
  MKO10038623_A_Olfr918
  gRNA
aacaacgacuucauuaacau

SEQ ID NO: 38624 - RNA, 20 nt, Artificial Sequence
  MKO10038624_A_Olfr918
  gRNA
aauaaucuacacugucacag

SEQ ID NO: 38625 - RNA, 20 nt, Artificial Sequence
  MKO10038625_A_Olfr918
  gRNA
agucguuguucucauaguug

SEQ ID NO: 38626 - RNA, 20 nt, Artificial Sequence
  MKO10038626_A_Olfr919
  gRNA
uauccuccguaucaaaucca

SEQ ID NO: 38627 - RNA, 20 nt, Artificial Sequence
  MKO10038627_A_Olfr919
  gRNA
uguuauuaccccgaagaugu

SEQ ID NO: 38628 - RNA, 20 nt, Artificial Sequence
  MKO10038628_A_Olfr919
  gRNA
auaaaacaugcaggugcaaa

SEQ ID NO: 38629 - RNA, 20 nt, Artificial Sequence
  MKO10038629_A_Olfr91
  gRNA
ucuuuaauucgacucuccug

SEQ ID NO: 38630 - RNA, 20 nt, Artificial Sequence
  MKO10038630_A_Olfr91
  gRNA
cgauuacugagcuguagaag

SEQ ID NO: 38631 - RNA, 20 nt, Artificial Sequence
  MKO10038631_A_Olfr91
  gRNA
ucauccacccucgccugugc

SEQ ID NO: 38632 - RNA, 20 nt, Artificial Sequence
  MKO10038632_A_Olfr920
  gRNA
ggccuuugacaugcccuuag

SEQ ID NO: 38633 - RNA, 20 nt, Artificial Sequence
  MKO10038633_A_Olfr920
  gRNA
uaucuuaaacccaacucaac

SEQ ID NO: 38634 - RNA, 20 nt, Artificial Sequence
  MKO10038634_A_Olfr920
  gRNA
caucacagaacgacagucuc

SEQ ID NO: 38635 - RNA, 20 nt, Artificial Sequence
  MKO10038635_A_Olfr921
  gRNA
ggcccaaaguggaucuuauu

SEQ ID NO: 38636 - RNA, 20 nt, Artificial Sequence
  MKO10038636_A_Olfr921
  gRNA
gucugagcaugcaaccagua

SEQ ID NO: 38637 - RNA, 20 nt, Artificial Sequence
  MKO10038637_A_Olfr921
  gRNA
ucugcuguaucuauugauca

SEQ ID NO: 38638 - RNA, 20 nt, Artificial Sequence
  MKO10038638_A_Olfr922
  gRNA
auuggugcaugggcccacac

SEQ ID NO: 38639 - RNA, 20 nt, Artificial Sequence
  MKO10038639_A_Olfr922
  gRNA
uauauucuguuaagccaacc

SEQ ID NO: 38640 - RNA, 20 nt, Artificial Sequence
  MKO10038640_A_Olfr922
  gRNA
acaugguaacaguguacaac

SEQ ID NO: 38641 - RNA, 20 nt, Artificial Sequence
  MKO10038641_A_Olfr923
  gRNA
gacauuuguguaaaauaccg

SEQ ID NO: 38642 - RNA, 20 nt, Artificial Sequence
  MKO10038642_A_Olfr923
  gRNA
ccuggcccauacacuuugca

SEQ ID NO: 38643 - RNA, 20 nt, Artificial Sequence
  MKO10038643_A_Olfr923
  gRNA
ccuggugacagaauuuaucc

SEQ ID NO: 38644 - RNA, 20 nt, Artificial Sequence
  MKO10038644_A_Olfr924
  gRNA
cucaagcacccauaucaacg

SEQ ID NO: 38645 - RNA, 20 nt, Artificial Sequence
  MKO10038645_A_Olfr924
  gRNA
acagcaguaccucguugaua

SEQ ID NO: 38646 - RNA, 20 nt, Artificial Sequence
  MKO10038646_A_Olfr924
  gRNA
cugagucaugcacuccaaaa

SEQ ID NO: 38647 - RNA, 20 nt, Artificial Sequence
  MKO10038647_A_Olfr926
  gRNA
cugagucaugcacuccuuaa

SEQ ID NO: 38648 - RNA, 20 nt, Artificial Sequence
  MKO10038648_A_Olfr926
  gRNA
cauacaugugauuacagugg

SEQ ID NO: 38649 - RNA, 20 nt, Artificial Sequence
  MKO10038649_A_Olfr926
  gRNA
agccuucugaaauagcuaaa

SEQ ID NO: 38650 - RNA, 20 nt, Artificial Sequence
  MKO10038650_A_Olfr92
  gRNA
cccaagcuauaccugccaac

SEQ ID NO: 38651 - RNA, 20 nt, Artificial Sequence
  MKO10038651_A_Olfr92
  gRNA
aaaaccuguaugcccgagag

SEQ ID NO: 38652 - RNA, 20 nt, Artificial Sequence
  MKO10038652_A_Olfr92
  gRNA
acauagguggggguugauuu

SEQ ID NO: 38653 - RNA, 20 nt, Artificial Sequence
  MKO10038653_A_Olfr930
  gRNA
gaucauacgccauaacaguc

SEQ ID NO: 38654 - RNA, 20 nt, Artificial Sequence
  MKO10038654_A_Olfr930
  gRNA
gugcuaguugccuucacccu

SEQ ID NO: 38655 - RNA, 20 nt, Artificial Sequence
  MKO10038655_A_Olfr930
  gRNA
ggguuaccuccugacuguua

SEQ ID NO: 38656 - RNA, 20 nt, Artificial Sequence
  MKO10038656_A_Olfr933
  gRNA
ugcuccagagaguuacuuga

SEQ ID NO: 38657 - RNA, 20 nt, Artificial Sequence
  MKO10038657_A_Olfr933
  gRNA
cuucuucuauucaucauugc

SEQ ID NO: 38658 - RNA, 20 nt, Artificial Sequence
  MKO10038658_A_Olfr933
  gRNA
auucagcuuuaugucagagc

SEQ ID NO: 38659 - RNA, 20 nt, Artificial Sequence
  MKO10038659_A_Olfr934
  gRNA
ucuucagauccgcucuacug

SEQ ID NO: 38660 - RNA, 20 nt, Artificial Sequence
  MKO10038660_A_Olfr934
  gRNA
caagccagcuucagcauuac

SEQ ID NO: 38661 - RNA, 20 nt, Artificial Sequence
  MKO10038661_A_Olfr934
  gRNA
uugaacugcugcauuaagcc

SEQ ID NO: 38662 - RNA, 20 nt, Artificial Sequence
  MKO10038662_A_Olfr935
  gRNA
caucagagcacgagagcuua

SEQ ID NO: 38663 - RNA, 20 nt, Artificial Sequence
  MKO10038663_A_Olfr935
  gRNA
cauaaugcuacuauaaagua

SEQ ID NO: 38664 - RNA, 20 nt, Artificial Sequence
  MKO10038664_A_Olfr935
  gRNA
guugagcaugggaacaauaa

SEQ ID NO: 38665 - RNA, 20 nt, Artificial Sequence
  MKO10038665_A_Olfr936
  gRNA
ccucaguagauuuaaugcgc

SEQ ID NO: 38666 - RNA, 20 nt, Artificial Sequence
  MKO10038666_A_Olfr936
  gRNA
uauuagagcaugagagcuua

SEQ ID NO: 38667 - RNA, 20 nt, Artificial Sequence
  MKO10038667_A_Olfr936
  gRNA
guugagcauaggcacaaaga

SEQ ID NO: 38668 - RNA, 20 nt, Artificial Sequence
  MKO10038668_A_Olfr937
  gRNA
aucuuacgcauucguucuac

SEQ ID NO: 38669 - RNA, 20 nt, Artificial Sequence
  MKO10038669_A_Olfr937
  gRNA
agaacgaaugcguaagaugu

SEQ ID NO: 38670 - RNA, 20 nt, Artificial Sequence
  MKO10038670_A_Olfr937
  gRNA
cugugaucuucuuccccugc

SEQ ID NO: 38671 - RNA, 20 nt, Artificial Sequence
  MKO10038671_A_Olfr938
  gRNA
gagcacgagagcuccaguaa

SEQ ID NO: 38672 - RNA, 20 nt, Artificial Sequence
  MKO10038672_A_Olfr938
  gRNA
guucuccacauucaauccac

SEQ ID NO: 38673 - RNA, 20 nt, Artificial Sequence
  MKO10038673_A_Olfr938
  gRNA
cacccauguauuauuuacuc

SEQ ID NO: 38674 - RNA, 20 nt, Artificial Sequence
  MKO10038674_A_Olfr93
  gRNA
cuggggaaggaugcggcuuc

SEQ ID NO: 38675 - RNA, 20 nt, Artificial Sequence
  MKO10038675_A_Olfr93
  gRNA
caagagagucggauuagaga

SEQ ID NO: 38676 - RNA, 20 nt, Artificial Sequence
  MKO10038676_A_Olfr93
  gRNA
ggucaaccagagcacccccg

SEQ ID NO: 38677 - RNA, 20 nt, Artificial Sequence
  MKO10038677_A_Olfr943
  gRNA
aaguaauaaccguuagcaau

SEQ ID NO: 38678 - RNA, 20 nt, Artificial Sequence
  MKO10038678_A_Olfr943
  gRNA
aaaugagguucuucuccauc

SEQ ID NO: 38679 - RNA, 20 nt, Artificial Sequence
  MKO10038679_A_Olfr943
  gRNA
uaucugugucccauugcuaa

SEQ ID NO: 38680 - RNA, 20 nt, Artificial Sequence
  MKO10038680_A_Olfr944
  gRNA
cagugauuagauagauucca

SEQ ID NO: 38681 - RNA, 20 nt, Artificial Sequence
  MKO10038681_A_Olfr944
  gRNA
gucuguucauccuuaaucac

SEQ ID NO: 38682 - RNA, 20 nt, Artificial Sequence
  MKO10038682_A_Olfr944
  gRNA
uucauugauauagauauuag

SEQ ID NO: 38683 - RNA, 20 nt, Artificial Sequence
  MKO10038683_A_Olfr945
  gRNA
uccaucgaauucacucguga

SEQ ID NO: 38684 - RNA, 20 nt, Artificial Sequence
  MKO10038684_A_Olfr945
  gRNA
accaucacgagugaauucga

SEQ ID NO: 38685 - RNA, 20 nt, Artificial Sequence
  MKO10038685_A_Olfr945
  gRNA
gcaucuuccacauucgcucc

SEQ ID NO: 38686 - RNA, 20 nt, Artificial Sequence
  MKO10038686_A_Olfr948
  gRNA
caaucaaugcaaucaucccc

SEQ ID NO: 38687 - RNA, 20 nt, Artificial Sequence
  MKO10038687_A_Olfr948
  gRNA
ucagauagauugcuacaaau

SEQ ID NO: 38688 - RNA, 20 nt, Artificial Sequence
  MKO10038688_A_Olfr948
  gRNA
guaacguaggggguuacaaa

SEQ ID NO: 38689 - RNA, 20 nt, Artificial Sequence
  MKO10038689_A_Olfr94
  gRNA
caacgcggcguuggugcugc

SEQ ID NO: 38690 - RNA, 20 nt, Artificial Sequence
  MKO10038690_A_Olfr94
  gRNA
ccagauguucgccgcgcgug

SEQ ID NO: 38691 - RNA, 20 nt, Artificial Sequence
  MKO10038691_A_Olfr94
  gRNA
cagcaccaacgccgcguugc

SEQ ID NO: 38692 - RNA, 20 nt, Artificial Sequence
  MKO10038692_A_Olfr951
  gRNA
gcauccuccgcauucacucu

SEQ ID NO: 38693 - RNA, 20 nt, Artificial Sequence
  MKO10038693_A_Olfr951
  gRNA
gccaucacaagugaguucaa

SEQ ID NO: 38694 - RNA, 20 nt, Artificial Sequence
  MKO10038694_A_Olfr951
  gRNA
aagaacuucaucaccuaccc

SEQ ID NO: 38695 - RNA, 20 nt, Artificial Sequence
  MKO10038695_A_Olfr952
  gRNA
agaauuaaaucauaccccag

SEQ ID NO: 38696 - RNA, 20 nt, Artificial Sequence
  MKO10038696_A_Olfr952
  gRNA
gcaagaaugaacucugccac

SEQ ID NO: 38697 - RNA, 20 nt, Artificial Sequence
  MKO10038697_A_Olfr952
  gRNA
caccuacagcucccauaucu

SEQ ID NO: 38698 - RNA, 20 nt, Artificial Sequence
  MKO10038698_A_Olfr954
  gRNA
ucuauugaacuuacucguga

SEQ ID NO: 38699 - RNA, 20 nt, Artificial Sequence
  MKO10038699_A_Olfr954
  gRNA
ccuccgcauuagcucuagug

SEQ ID NO: 38700 - RNA, 20 nt, Artificial Sequence
  MKO10038700_A_Olfr954
  gRNA
ugcccucacuagagcuaaug

SEQ ID NO: 38701 - RNA, 20 nt, Artificial Sequence
  MKO10038701_A_Olfr955
  gRNA
agguaaggaauagaggcaac

SEQ ID NO: 38702 - RNA, 20 nt, Artificial Sequence
  MKO10038702_A_Olfr955
  gRNA
aaccugcagcucccauaucu

SEQ ID NO: 38703 - RNA, 20 nt, Artificial Sequence
  MKO10038703_A_Olfr955
  gRNA
aaagauguuuccucaaaaca

SEQ ID NO: 38704 - RNA, 20 nt, Artificial Sequence
  MKO10038704_A_Olfr957
  gRNA
ucuuccuacaaccuuauaga

SEQ ID NO: 38705 - RNA, 20 nt, Artificial Sequence
  MKO10038705_A_Olfr957
  gRNA
ugucaaaguugccuucuaua

SEQ ID NO: 38706 - RNA, 20 nt, Artificial Sequence
  MKO10038706_A_Olfr957
  gRNA
cuccgcauuccuuccacuga

SEQ ID NO: 38707 - RNA, 20 nt, Artificial Sequence
  MKO10038707_A_Olfr958
  gRNA
augaugaccgaguaccgaag

SEQ ID NO: 38708 - RNA, 20 nt, Artificial Sequence
  MKO10038708_A_Olfr958
  gRNA
uaagucugcuaagucccaua

SEQ ID NO: 38709 - RNA, 20 nt, Artificial Sequence
  MKO10038709_A_Olfr958
  gRNA
gaacuuguccguauuugaua

SEQ ID NO: 38710 - RNA, 20 nt, Artificial Sequence
  MKO10038710_A_Olfr959
  gRNA
uacgacggcccucagcagau

SEQ ID NO: 38711 - RNA, 20 nt, Artificial Sequence
  MKO10038711_A_Olfr959
  gRNA
gaaguaguaguccaccucau

SEQ ID NO: 38712 - RNA, 20 nt, Artificial Sequence
  MKO10038712_A_Olfr959
  gRNA
ugugcaggucuuaaauaauc

SEQ ID NO: 38713 - RNA, 20 nt, Artificial Sequence
  MKO10038713_A_Olfr95
  gRNA
cgcagccagagcgcgagaug

SEQ ID NO: 38714 - RNA, 20 nt, Artificial Sequence
  MKO10038714_A_Olfr95
  gRNA
ggugaccaggauccguccgu

SEQ ID NO: 38715 - RNA, 20 nt, Artificial Sequence
  MKO10038715_A_Olfr95
  gRNA
cggcgccacaucucgcgcuc

SEQ ID NO: 38716 - RNA, 20 nt, Artificial Sequence
  MKO10038716_A_Olfr960
  gRNA
agcccaugucagagauagag

SEQ ID NO: 38717 - RNA, 20 nt, Artificial Sequence
  MKO10038717_A_Olfr960
  gRNA
ugagagauaugacaacaucu

SEQ ID NO: 38718 - RNA, 20 nt, Artificial Sequence
  MKO10038718_A_Olfr960
  gRNA
gaacaugacaaacaacacua

SEQ ID NO: 38719 - RNA, 20 nt, Artificial Sequence
  MKO10038719_A_Olfr961
  gRNA
auuguauccuacacucgaau

SEQ ID NO: 38720 - RNA, 20 nt, Artificial Sequence
  MKO10038720_A_Olfr961
  gRNA
gaaugagaaaguuucccagc

SEQ ID NO: 38721 - RNA, 20 nt, Artificial Sequence
  MKO10038721_A_Olfr961
  gRNA
ugaauaaucgcacuaagcaa

SEQ ID NO: 38722 - RNA, 20 nt, Artificial Sequence
  MKO10038722_A_Olfr963
  gRNA
caauucgaguguaggacaca

SEQ ID NO: 38723 - RNA, 20 nt, Artificial Sequence
  MKO10038723_A_Olfr963
  gRNA
gaaauaauaacccacauugc

SEQ ID NO: 38724 - RNA, 20 nt, Artificial Sequence
  MKO10038724_A_Olfr963
  gRNA
aguguuaccucuagccugug

SEQ ID NO: 38725 - RNA, 20 nt, Artificial Sequence
  MKO10038725_A_Olfr965
  gRNA
ucaguuagcuccgaagauca

SEQ ID NO: 38726 - RNA, 20 nt, Artificial Sequence
  MKO10038726_A_Olfr965
  gRNA
aaucuacuuguucacggagc

SEQ ID NO: 38727 - RNA, 20 nt, Artificial Sequence
  MKO10038727_A_Olfr965
  gRNA
ucuucggagcuaacugauga

SEQ ID NO: 38728 - RNA, 20 nt, Artificial Sequence
  MKO10038728_A_Olfr967
  gRNA
ucguuacugcauagauuccg

SEQ ID NO: 38729 - RNA, 20 nt, Artificial Sequence
  MKO10038729_A_Olfr967
  gRNA
aucuaugcaguaacgauggu

SEQ ID NO: 38730 - RNA, 20 nt, Artificial Sequence
  MKO10038730_A_Olfr967
  gRNA
uguccuaucaagucugcacc

SEQ ID NO: 38731 - RNA, 20 nt, Artificial Sequence
  MKO10038731_A_Olfr968
  gRNA
caaaacugugucauacauuc

SEQ ID NO: 38732 - RNA, 20 nt, Artificial Sequence
  MKO10038732_A_Olfr968
  gRNA
uguccuaucaaguuuguucc

SEQ ID NO: 38733 - RNA, 20 nt, Artificial Sequence
  MKO10038733_A_Olfr968
  gRNA
uccauggaguugauugauga

SEQ ID NO: 38734 - RNA, 20 nt, Artificial Sequence
  MKO10038734_A_Olfr969
  gRNA
uccauagaguugaccgaaga

SEQ ID NO: 38735 - RNA, 20 nt, Artificial Sequence
  MKO10038735_A_Olfr969
  gRNA
cauccaagaacagacucgau

SEQ ID NO: 38736 - RNA, 20 nt, Artificial Sequence
  MKO10038736_A_Olfr969
  gRNA
uugugauauuuauccacuac

SEQ ID NO: 38737 - RNA, 20 nt, Artificial Sequence
  MKO10038737_A_Olfr96
  gRNA
cccaugggaauccuuuccac

SEQ ID NO: 38738 - RNA, 20 nt, Artificial Sequence
  MKO10038738_A_Olfr96
  gRNA
gguauagacaaucucuauga

SEQ ID NO: 38739 - RNA, 20 nt, Artificial Sequence
  MKO10038739_A_Olfr96
  gRNA
caugaguguuccauagaacg

SEQ ID NO: 38740 - RNA, 20 nt, Artificial Sequence
  MKO10038740_A_Olfr970
  gRNA
guauauaguauagcuuuaau

SEQ ID NO: 38741 - RNA, 20 nt, Artificial Sequence
  MKO10038741_A_Olfr970
  gRNA
auauaccccaaauaucauug

SEQ ID NO: 38742 - RNA, 20 nt, Artificial Sequence
  MKO10038742_A_Olfr970
  gRNA
gucuguuccucaaugauauu

SEQ ID NO: 38743 - RNA, 20 nt, Artificial Sequence
  MKO10038743_A_Olfr971
  gRNA
uaaauucgauuaucaucgaa

SEQ ID NO: 38744 - RNA, 20 nt, Artificial Sequence
  MKO10038744_A_Olfr971
  gRNA
auaaucgaauuuaucuugac

SEQ ID NO: 38745 - RNA, 20 nt, Artificial Sequence
  MKO10038745_A_Olfr971
  gRNA
auccugaucgugcucagcuc

SEQ ID NO: 38746 - RNA, 20 nt, Artificial Sequence
  MKO10038746_A_Olfr972
  gRNA
gaauacaccaaauaucaucc

SEQ ID NO: 38747 - RNA, 20 nt, Artificial Sequence
  MKO10038747_A_Olfr972
  gRNA
aacagucugcauguuaagag

SEQ ID NO: 38748 - RNA, 20 nt, Artificial Sequence
  MKO10038748_A_Olfr972
  gRNA
uauugcagaaugucagaugu

SEQ ID NO: 38749 - RNA, 20 nt, Artificial Sequence
  MKO10038749_A_Olfr974
  gRNA
uguaugaacuguagccccga

SEQ ID NO: 38750 - RNA, 20 nt, Artificial Sequence
  MKO10038750_A_Olfr974
  gRNA
guauucgcagaaugcuugca

SEQ ID NO: 38751 - RNA, 20 nt, Artificial Sequence
  MKO10038751_A_Olfr974
  gRNA
ugauuaaaaagacuaagccc

SEQ ID NO: 38752 - RNA, 20 nt, Artificial Sequence
  MKO10038752_A_Olfr975
  gRNA
ucgugugacuauguccagug

SEQ ID NO: 38753 - RNA, 20 nt, Artificial Sequence
  MKO10038753_A_Olfr975
  gRNA
ggagaugacgaugcgagagu

SEQ ID NO: 38754 - RNA, 20 nt, Artificial Sequence
  MKO10038754_A_Olfr975
  gRNA
caucagaaugaguagguuuc

SEQ ID NO: 38755 - RNA, 20 nt, Artificial Sequence
  MKO10038755_A_Olfr976
  gRNA
augaugaccguauaucucau

SEQ ID NO: 38756 - RNA, 20 nt, Artificial Sequence
  MKO10038756_A_Olfr976
  gRNA
uaaaacucacagucugcgcu

SEQ ID NO: 38757 - RNA, 20 nt, Artificial Sequence
  MKO10038757_A_Olfr976
  gRNA
uuguuacccuaugagauaua

SEQ ID NO: 38758 - RNA, 20 nt, Artificial Sequence
  MKO10038758_A_Olfr978
  gRNA
cucacguauuauuuauccug

SEQ ID NO: 38759 - RNA, 20 nt, Artificial Sequence
  MKO10038759_A_Olfr978
  gRNA
aauccacccugaucaccguc

SEQ ID NO: 38760 - RNA, 20 nt, Artificial Sequence
  MKO10038760_A_Olfr978
  gRNA
uucucauccugacggugauc

SEQ ID NO: 38761 - RNA, 20 nt, Artificial Sequence
  MKO10038761_A_Olfr979
  gRNA
acccaaaauguugaugacgu

SEQ ID NO: 38762 - RNA, 20 nt, Artificial Sequence
  MKO10038762_A_Olfr979
  gRNA
aaccaacgucaucaacauuu

SEQ ID NO: 38763 - RNA, 20 nt, Artificial Sequence
  MKO10038763_A_Olfr979
  gRNA
cuacaaagagcauggugucc

SEQ ID NO: 38764 - RNA, 20 nt, Artificial Sequence
  MKO10038764_A_Olfr97
  gRNA
ccaucuaguucucguuccuc

SEQ ID NO: 38765 - RNA, 20 nt, Artificial Sequence
  MKO10038765_A_Olfr97
  gRNA
gauggauccaucucguucuc

SEQ ID NO: 38766 - RNA, 20 nt, Artificial Sequence
  MKO10038766_A_Olfr97
  gRNA
ccucaaugagagucuaauga

SEQ ID NO: 38767 - RNA, 20 nt, Artificial Sequence
  MKO10038767_A_Olfr980
  gRNA
cacaaagaugaccaucucga

SEQ ID NO: 38768 - RNA, 20 nt, Artificial Sequence
  MKO10038768_A_Olfr980
  gRNA
agacacaucugccaucgaga

SEQ ID NO: 38769 - RNA, 20 nt, Artificial Sequence
  MKO10038769_A_Olfr980
  gRNA
aauccacccugaucaccauc

SEQ ID NO: 38770 - RNA, 20 nt, Artificial Sequence
  MKO10038770_A_Olfr981
  gRNA
uggcugccauucugcgaauc

SEQ ID NO: 38771 - RNA, 20 nt, Artificial Sequence
  MKO10038771_A_Olfr981
  gRNA
ggcuccaccggcccauguac

SEQ ID NO: 38772 - RNA, 20 nt, Artificial Sequence
  MKO10038772_A_Olfr981
  gRNA
acagacgcugcgagucauga

SEQ ID NO: 38773 - RNA, 20 nt, Artificial Sequence
  MKO10038773_A_Olfr982
  gRNA
augaacaagcgggugugcgc

SEQ ID NO: 38774 - RNA, 20 nt, Artificial Sequence
  MKO10038774_A_Olfr982
  gRNA
gguguugcgcauucgcacag

SEQ ID NO: 38775 - RNA, 20 nt, Artificial Sequence
  MKO10038775_A_Olfr982
  gRNA
cuguagacagacacgcauca

SEQ ID NO: 38776 - RNA, 20 nt, Artificial Sequence
  MKO10038776_A_Olfr983
  gRNA
aggauguucaaauugcacug

SEQ ID NO: 38777 - RNA, 20 nt, Artificial Sequence
  MKO10038777_A_Olfr983
  gRNA
uacuuuaagucuucuccugu

SEQ ID NO: 38778 - RNA, 20 nt, Artificial Sequence
  MKO10038778_A_Olfr983
  gRNA
acaugaugaccuuauaaagc

SEQ ID NO: 38779 - RNA, 20 nt, Artificial Sequence
  MKO10038779_A_Olfr984
  gRNA
gcuccgaagucacucaaaag

SEQ ID NO: 38780 - RNA, 20 nt, Artificial Sequence
  MKO10038780_A_Olfr984
  gRNA
gauaaaaccacccacccacg

SEQ ID NO: 38781 - RNA, 20 nt, Artificial Sequence
  MKO10038781_A_Olfr984
  gRNA
gaauccagcaaaccauuccc

SEQ ID NO: 38782 - RNA, 20 nt, Artificial Sequence
  MKO10038782_A_Olfr985
  gRNA
aaguucgucaauguaagugc

SEQ ID NO: 38783 - RNA, 20 nt, Artificial Sequence
  MKO10038783_A_Olfr985
  gRNA
uaucugaaacccgcuucuaa

SEQ ID NO: 38784 - RNA, 20 nt, Artificial Sequence
  MKO10038784_A_Olfr985
  gRNA
augacggaaccauuagaagc

SEQ ID NO: 38785 - RNA, 20 nt, Artificial Sequence
  MKO10038785_A_Olfr986
  gRNA
gcaacgauucucgugauccc

SEQ ID NO: 38786 - RNA, 20 nt, Artificial Sequence
  MKO10038786_A_Olfr986
  gRNA
ggaucacgagaaucguugcc

SEQ ID NO: 38787 - RNA, 20 nt, Artificial Sequence
  MKO10038787_A_Olfr986
  gRNA
uaaugaguccauugcccgaa

SEQ ID NO: 38788 - RNA, 20 nt, Artificial Sequence
  MKO10038788_A_Olfr987
  gRNA
uugcugggcagcacaagucu

SEQ ID NO: 38789 - RNA, 20 nt, Artificial Sequence
  MKO10038789_A_Olfr987
  gRNA
caaccagcacaguacucaac

SEQ ID NO: 38790 - RNA, 20 nt, Artificial Sequence
  MKO10038790_A_Olfr987
  gRNA
caaccuguugaguacugugc

SEQ ID NO: 38791 - RNA, 20 nt, Artificial Sequence
  MKO10038791_A_Olfr988
  gRNA
uuuccggacagcacaaaucu

SEQ ID NO: 38792 - RNA, 20 nt, Artificial Sequence
  MKO10038792_A_Olfr988
  gRNA
agccauagcagcuaagauga

SEQ ID NO: 38793 - RNA, 20 nt, Artificial Sequence
  MKO10038793_A_Olfr988
  gRNA
caacaaguacagugcucacu

SEQ ID NO: 38794 - RNA, 20 nt, Artificial Sequence
  MKO10038794_A_Olfr98
  gRNA
agcugcugucauguauacuc

SEQ ID NO: 38795 - RNA, 20 nt, Artificial Sequence
  MKO10038795_A_Olfr98
  gRNA
ccucaaugagagucugauga

SEQ ID NO: 38796 - RNA, 20 nt, Artificial Sequence
  MKO10038796_A_Olfr98
  gRNA
aucuaguucucacuccucuc

SEQ ID NO: 38797 - RNA, 20 nt, Artificial Sequence
  MKO10038797_A_Olfr992
  gRNA
cuaaaugccacuguaaauac

SEQ ID NO: 38798 - RNA, 20 nt, Artificial Sequence
  MKO10038798_A_Olfr992
  gRNA
gacuaacagaucucaagaac

SEQ ID NO: 38799 - RNA, 20 nt, Artificial Sequence
  MKO10038799_A_Olfr992
  gRNA
uugucaguaccaugauauug

SEQ ID NO: 38800 - RNA, 20 nt, Artificial Sequence
  MKO10038800_A_Olfr993
  gRNA
augaguaugggauaacgaag

SEQ ID NO: 38801 - RNA, 20 nt, Artificial Sequence
  MKO10038801_A_Olfr993
  gRNA
guaucugucuucuacuacaa

SEQ ID NO: 38802 - RNA, 20 nt, Artificial Sequence
  MKO10038802_A_Olfr993
  gRNA
uaaccugauauucacugugc

SEQ ID NO: 38803 - RNA, 20 nt, Artificial Sequence
  MKO10038803_A_Olfr994
  gRNA
gcuaccccauaaucaugucu

SEQ ID NO: 38804 - RNA, 20 nt, Artificial Sequence
  MKO10038804_A_Olfr994
  gRNA
gacuugccgagacaugauua

SEQ ID NO: 38805 - RNA, 20 nt, Artificial Sequence
  MKO10038805_A_Olfr994
  gRNA
uucuccucggaauugucuga

SEQ ID NO: 38806 - RNA, 20 nt, Artificial Sequence
  MKO10038806_A_Olfr995
  gRNA
acagucacuggucgcaaaug

SEQ ID NO: 38807 - RNA, 20 nt, Artificial Sequence
  MKO10038807_A_Olfr995
  gRNA
ugaccaacacagugaacguc

SEQ ID NO: 38808 - RNA, 20 nt, Artificial Sequence
  MKO10038808_A_Olfr995
  gRNA
ccacugccauaacagcgagg

SEQ ID NO: 38809 - RNA, 20 nt, Artificial Sequence
  MKO10038809_A_Olfr996
  gRNA
gcucaguggacugauaaucc

SEQ ID NO: 38810 - RNA, 20 nt, Artificial Sequence
  MKO10038810_A_Olfr996
  gRNA
caacugucucuauccuguau

SEQ ID NO: 38811 - RNA, 20 nt, Artificial Sequence
  MKO10038811_A_Olfr996
  gRNA
uucuaucuuaagcaccaguu

SEQ ID NO: 38812 - RNA, 20 nt, Artificial Sequence
  MKO10038812_A_Olfr998
  gRNA
gcacacgccaaugauaaaag

SEQ ID NO: 38813 - RNA, 20 nt, Artificial Sequence
  MKO10038813_A_Olfr998
  gRNA
uucaagauucaaacugcuga

SEQ ID NO: 38814 - RNA, 20 nt, Artificial Sequence
  MKO10038814_A_Olfr998
  gRNA
cagaccacugaacacuccua

SEQ ID NO: 38815 - RNA, 20 nt, Artificial Sequence
  MKO10038815_A_Olfr99
  gRNA
uacucaccucaauaaaaucc

SEQ ID NO: 38816 - RNA, 20 nt, Artificial Sequence
  MKO10038816_A_Olfr99
  gRNA
augagagcugaguagcgcag

SEQ ID NO: 38817 - RNA, 20 nt, Artificial Sequence
  MKO10038817_A_Olfr99
  gRNA
uuccaaccaaaauuaucacc

SEQ ID NO: 38818 - RNA, 20 nt, Artificial Sequence
  MKO10038818_A_Olfr9
  gRNA
uguucccaaaugaaucagcc

SEQ ID NO: 38819 - RNA, 20 nt, Artificial Sequence
  MKO10038819_A_Olfr9
  gRNA
uguuuauagucugcgaaaca

SEQ ID NO: 38820 - RNA, 20 nt, Artificial Sequence
  MKO10038820_A_Olfr9
  gRNA
cucaugaagagauaccuuug

SEQ ID NO: 38821 - RNA, 20 nt, Artificial Sequence
  MKO10038821_A_Olig1
  gRNA
aacuucgcgcagcgcgucca

SEQ ID NO: 38822 - RNA, 20 nt, Artificial Sequence
  MKO10038822_A_Olig1
  gRNA
cgcccgggccgacgccaaag

SEQ ID NO: 38823 - RNA, 20 nt, Artificial Sequence
  MKO10038823_A_Olig1
  gRNA
gcuucggccuucucgcgcgc

SEQ ID NO: 38824 - RNA, 20 nt, Artificial Sequence
  MKO10038824_A_Olig2
  gRNA
cgcccauagccgacacgugg

SEQ ID NO: 38825 - RNA, 20 nt, Artificial Sequence
  MKO10038825_A_Olig2
  gRNA
cgcgcacgccgcgcaccacc

SEQ ID NO: 38826 - RNA, 20 nt, Artificial Sequence
  MKO10038826_A_Olig2
  gRNA
augcgcgccugacgcgccca

SEQ ID NO: 38827 - RNA, 20 nt, Artificial Sequence
  MKO10038827_A_Olig3
  gRNA
ucaacggacgcgaacgcaag

SEQ ID NO: 38828 - RNA, 20 nt, Artificial Sequence
  MKO10038828_A_Olig3
  gRNA
gcgaccucccugccgaccau

SEQ ID NO: 38829 - RNA, 20 nt, Artificial Sequence
  MKO10038829_A_Olig3
  gRNA
ggggcauucggccggccacc

SEQ ID NO: 38830 - RNA, 20 nt, Artificial Sequence
  MKO10038830_A_Olr1
  gRNA
ccaagcgaaccuuacucagc

SEQ ID NO: 38831 - RNA, 20 nt, Artificial Sequence
  MKO10038831_A_Olr1
  gRNA
cagugacccuuauuguacag

SEQ ID NO: 38832 - RNA, 20 nt, Artificial Sequence
  MKO10038832_A_Olr1
  gRNA
ggauacgauccugcugagua

SEQ ID NO: 38833 - RNA, 20 nt, Artificial Sequence
  MKO10038833_A_Oma1
  gRNA
ugagaucgcacacgcagucc

SEQ ID NO: 38834 - RNA, 20 nt, Artificial Sequence
  MKO10038834_A_Oma1
  gRNA
acagugcaaucgagacgucc

SEQ ID NO: 38835 - RNA, 20 nt, Artificial Sequence
  MKO10038835_A_Oma1
  gRNA
aacaaguggcggcugcuucu

SEQ ID NO: 38836 - RNA, 20 nt, Artificial Sequence
  MKO10038836_A_Omd
  gRNA
ggucauaaucgucaucccau

SEQ ID NO: 38837 - RNA, 20 nt, Artificial Sequence
  MKO10038837_A_Omd
  gRNA
gccaauaugaagcuuaccga

SEQ ID NO: 38838 - RNA, 20 nt, Artificial Sequence
  MKO10038838_A_Omd
  gRNA
ccauuuaacauaccuucgug

SEQ ID NO: 38839 - RNA, 20 nt, Artificial Sequence
  MKO10038839_A_Omg
  gRNA
gugacccucagcauagcucg

SEQ ID NO: 38840 - RNA, 20 nt, Artificial Sequence
  MKO10038840_A_Omg
  gRNA
uuucuucccuccguaaguug

SEQ ID NO: 38841 - RNA, 20 nt, Artificial Sequence
  MKO10038841_A_Omg
  gRNA
gugucagugaguuauuagac

SEQ ID NO: 38842 - RNA, 20 nt, Artificial Sequence
  MKO10038842_A_Omp
  gRNA
gucgggcguccaguucugcg

SEQ ID NO: 38843 - RNA, 20 nt, Artificial Sequence
  MKO10038843_A_Omp
  gRNA
aagacuccgacgccauggau

SEQ ID NO: 38844 - RNA, 20 nt, Artificial Sequence
  MKO10038844_A_Omp
  gRNA
aggcuccacgcccucgccaa

SEQ ID NO: 38845 - RNA, 20 nt, Artificial Sequence
  MKO10038845_A_Omt2a
  gRNA
cgaaagugcaccuggaaucg

SEQ ID NO: 38846 - RNA, 20 nt, Artificial Sequence
  MKO10038846_A_Omt2a
  gRNA
uucgauucuugaacuauuga

SEQ ID NO: 38847 - RNA, 20 nt, Artificial Sequence
  MKO10038847_A_Omt2a
  gRNA
cuuuguagacccacgauucc

SEQ ID NO: 38848 - RNA, 20 nt, Artificial Sequence
  MKO10038848_A_Omt2b
  gRNA
cacguucuuauuacaucuga

SEQ ID NO: 38849 - RNA, 20 nt, Artificial Sequence
  MKO10038849_A_Omt2b
  gRNA
ugauuguguaccuagagacc

SEQ ID NO: 38850 - RNA, 20 nt, Artificial Sequence
  MKO10038850_A_Omt2b
  gRNA
gguacacaaucacaaacucc

SEQ ID NO: 38851 - RNA, 20 nt, Artificial Sequence
  MKO10038851_A_Onecuu1
  gRNA
gucggugggcauagccgcgc

SEQ ID NO: 38852 - RNA, 20 nt, Artificial Sequence
  MKO10038852_A_Onecuu1
  gRNA
augucggcgcuccgcuuagc

SEQ ID NO: 38853 - RNA, 20 nt, Artificial Sequence
  MKO10038853_A_Onecuu1
  gRNA
uugcauguagaguucgacgu

SEQ ID NO: 38854 - RNA, 20 nt, Artificial Sequence
  MKO10038854_A_Onecuu2
  gRNA
aguguggugcgcgucgaaau

SEQ ID NO: 38855 - RNA, 20 nt, Artificial Sequence
  MKO10038855_A_Onecuu2
  gRNA
gagcggcgucagcguagugu

SEQ ID NO: 38856 - RNA, 20 nt, Artificial Sequence
  MKO10038856_A_Onecuu2
  gRNA
cucgcagaagaaaucccgcc

SEQ ID NO: 38857 - RNA, 20 nt, Artificial Sequence
  MKO10038857_A_Onecuu3
  gRNA
ccuugccauaaggcccguag

SEQ ID NO: 38858 - RNA, 20 nt, Artificial Sequence
  MKO10038858_A_Onecuu3
  gRNA
gcgcauccugugccgcucgc

SEQ ID NO: 38859 - RNA, 20 nt, Artificial Sequence
  MKO10038859_A_Onecuu3
  gRNA
gucgccgcugcaugaaccgc

SEQ ID NO: 38860 - RNA, 20 nt, Artificial Sequence
  MKO10038860_A_Ooep
  gRNA
uggcgucagcaucagccgug

SEQ ID NO: 38861 - RNA, 20 nt, Artificial Sequence
  MKO10038861_A_Ooep
  gRNA
uuucauucgcgucugugcac

SEQ ID NO: 38862 - RNA, 20 nt, Artificial Sequence
  MKO10038862_A_Ooep
  gRNA
cuauuucugagauuuccgcu

SEQ ID NO: 38863 - RNA, 20 nt, Artificial Sequence
  MKO10038863_A_Oog1
  gRNA
cuagagugcuaugaugacag

SEQ ID NO: 38864 - RNA, 20 nt, Artificial Sequence
  MKO10038864_A_Oog1
  gRNA
cugucaucauagcacucuag

SEQ ID NO: 38865 - RNA, 20 nt, Artificial Sequence
  MKO10038865_A_Oog1
  gRNA
uacuuaccugaucuggacaa

SEQ ID NO: 38866 - RNA, 20 nt, Artificial Sequence
  MKO10038866_A_Oog2
  gRNA
agugaacgaaaguacuucca

SEQ ID NO: 38867 - RNA, 20 nt, Artificial Sequence
  MKO10038867_A_Oog2
  gRNA
cuauucgccacccacucuga

SEQ ID NO: 38868 - RNA, 20 nt, Artificial Sequence
  MKO10038868_A_Oog2
  gRNA
uagcaagacagugucuacug

SEQ ID NO: 38869 - RNA, 20 nt, Artificial Sequence
  MKO10038869_A_Oog3
  gRNA
uugucagugcuccuacagaa

SEQ ID NO: 38870 - RNA, 20 nt, Artificial Sequence
  MKO10038870_A_Oog3
  gRNA
gacuuacuugaucuagacac

SEQ ID NO: 38871 - RNA, 20 nt, Artificial Sequence
  MKO10038871_A_Oog3
  gRNA
uguaacaaaggcaauauccu

SEQ ID NO: 38872 - RNA, 20 nt, Artificial Sequence
  MKO10038872_A_Oog4
  gRNA
cugacugcuacaaguuugcg

SEQ ID NO: 38873 - RNA, 20 nt, Artificial Sequence
  MKO10038873_A_Oog4
  gRNA
aacucagagugcucgauuua

SEQ ID NO: 38874 - RNA, 20 nt, Artificial Sequence
  MKO10038874_A_Oog4
  gRNA
gguggauccuaugaagguag

SEQ ID NO: 38875 - RNA, 20 nt, Artificial Sequence
  MKO10038875_A_Oosp1
  gRNA
uacuuuauuggcaaugccgc

SEQ ID NO: 38876 - RNA, 20 nt, Artificial Sequence
  MKO10038876_A_Oosp1
  gRNA
cuugggccucugaaacgagc

SEQ ID NO: 38877 - RNA, 20 nt, Artificial Sequence
  MKO10038877_A_Oosp1
  gRNA
agaugagcaaacuguuccga

SEQ ID NO: 38878 - RNA, 20 nt, Artificial Sequence
  MKO10038878_A_Oosp2
  gRNA
ccgagauguacuuucgucca

SEQ ID NO: 38879 - RNA, 20 nt, Artificial Sequence
  MKO10038879_A_Oosp2
  gRNA
cugccggaugggggucucua

SEQ ID NO: 38880 - RNA, 20 nt, Artificial Sequence
  MKO10038880_A_Oosp2
  gRNA
ggauccuccucaguagauag

SEQ ID NO: 38881 - RNA, 20 nt, Artificial Sequence
  MKO10038881_A_Oosp3
  gRNA
caaucaucugaugagugcgu

SEQ ID NO: 38882 - RNA, 20 nt, Artificial Sequence
  MKO10038882_A_Oosp3
  gRNA
ucucaacagcacgcauuuga

SEQ ID NO: 38883 - RNA, 20 nt, Artificial Sequence
  MKO10038883_A_Oosp3
  gRNA
cauuccguguuauagcuaaa

SEQ ID NO: 38884 - RNA, 20 nt, Artificial Sequence
  MKO10038884_A_Opa1
  gRNA
ucuggcgggauguggcgagc

SEQ ID NO: 38885 - RNA, 20 nt, Artificial Sequence
  MKO10038885_A_Opa1
  gRNA
ugccaguuuagcucccgacc

SEQ ID NO: 38886 - RNA, 20 nt, Artificial Sequence
  MKO10038886_A_Opa1
  gRNA
accgcuccaaaaacuccauc

SEQ ID NO: 38887 - RNA, 20 nt, Artificial Sequence
  MKO10038887_A_Opa3
  gRNA
caaguagaacagcuucgcca

SEQ ID NO: 38888 - RNA, 20 nt, Artificial Sequence
  MKO10038888_A_Opa3
  gRNA
gccgcuggccaaccguauca

SEQ ID NO: 38889 - RNA, 20 nt, Artificial Sequence
  MKO10038889_A_Opa3
  gRNA
ccagacucagcagcgcaaua

SEQ ID NO: 38890 - RNA, 20 nt, Artificial Sequence
  MKO10038890_A_Opalin
  gRNA
caucgaugaugagcccguag

SEQ ID NO: 38891 - RNA, 20 nt, Artificial Sequence
  MKO10038891_A_Opalin
  gRNA
acuccacucaccguauucga

SEQ ID NO: 38892 - RNA, 20 nt, Artificial Sequence
  MKO10038892_A_Opalin
  gRNA
cucuacgggcucaucaucga

SEQ ID NO: 38893 - RNA, 20 nt, Artificial Sequence
  MKO10038893_A_Opcml
  gRNA
gacaucaaacgugaccaguc

SEQ ID NO: 38894 - RNA, 20 nt, Artificial Sequence
  MKO10038894_A_Opcml
  gRNA
agacccucgagugaucauuu

SEQ ID NO: 38895 - RNA, 20 nt, Artificial Sequence
  MKO10038895_A_Opcml
  gRNA
cuccaugucaccguugguuc

SEQ ID NO: 38896 - RNA, 20 nt, Artificial Sequence
  MKO10038896_A_Ophn1
  gRNA
accgaugaugagauuaauau

SEQ ID NO: 38897 - RNA, 20 nt, Artificial Sequence
  MKO10038897_A_Ophn1
  gRNA
guuccuuccgaaaaguuucc

SEQ ID NO: 38898 - RNA, 20 nt, Artificial Sequence
  MKO10038898_A_Ophn1
  gRNA
cuuaucagcggaaucauuca

SEQ ID NO: 38899 - RNA, 20 nt, Artificial Sequence
  MKO10038899_A_Oplah
  gRNA
ccgaggaacaauccgcacca

SEQ ID NO: 38900 - RNA, 20 nt, Artificial Sequence
  MKO10038900_A_Oplah
  gRNA
gcgaugugacuggugucuag

SEQ ID NO: 38901 - RNA, 20 nt, Artificial Sequence
  MKO10038901_A_Oplah
  gRNA
ggugccggcucucccgucaa

SEQ ID NO: 38902 - RNA, 20 nt, Artificial Sequence
  MKO10038902_A_Opn1mw
  gRNA
gagguaccgcugaacacguc

SEQ ID NO: 38903 - RNA, 20 nt, Artificial Sequence
  MKO10038903_A_Opn1mw
  gRNA
uggacggccccaccaaucuu

SEQ ID NO: 38904 - RNA, 20 nt, Artificial Sequence
  MKO10038904_A_Opn1mw
  gRNA
cgggguucagucuuauauga

SEQ ID NO: 38905 - RNA, 20 nt, Artificial Sequence
  MKO10038905_A_Opn1sw
  gRNA
aucgaagcgaguacuacacc

SEQ ID NO: 38906 - RNA, 20 nt, Artificial Sequence
  MKO10038906_A_Opn1sw
  gRNA
guaguacucgcuucgauacu

SEQ ID NO: 38907 - RNA, 20 nt, Artificial Sequence
  MKO10038907_A_Opn1sw
  gRNA
cacgucagauucgucugcca

SEQ ID NO: 38908 - RNA, 20 nt, Artificial Sequence
  MKO10038908_A_Opn3
  gRNA
ccccaccgcguacgagcgcc

SEQ ID NO: 38909 - RNA, 20 nt, Artificial Sequence
  MKO10038909_A_Opn3
  gRNA
cuaugaacguuauauccgug

SEQ ID NO: 38910 - RNA, 20 nt, Artificial Sequence
  MKO10038910_A_Opn3
  gRNA
cagcgccaggcgcucguacg

SEQ ID NO: 38911 - RNA, 20 nt, Artificial Sequence
  MKO10038911_A_Opn4
  gRNA
cacucguccugcuaggcguc

SEQ ID NO: 38912 - RNA, 20 nt, Artificial Sequence
  MKO10038912_A_Opn4
  gRNA
ucuggugaucacacguccac

SEQ ID NO: 38913 - RNA, 20 nt, Artificial Sequence
  MKO10038913_A_Opn4
  gRNA
agucuugucaagcuuaacuc

SEQ ID NO: 38914 - RNA, 20 nt, Artificial Sequence
  MKO10038914_A_Opn5
  gRNA
gcucaggugcauaguccccc

SEQ ID NO: 38915 - RNA, 20 nt, Artificial Sequence
  MKO10038915_A_Opn5
  gRNA
uauggauucgacugucgaaa

SEQ ID NO: 38916 - RNA, 20 nt, Artificial Sequence
  MKO10038916_A_Opn5
  gRNA
ugcgucuagaagacauauaa

SEQ ID NO: 38917 - RNA, 20 nt, Artificial Sequence
  MKO10038917_A_Oprd1
  gRNA
cgacgcauuggcgcccgcgc

SEQ ID NO: 38918 - RNA, 20 nt, Artificial Sequence
  MKO10038918_A_Oprd1
  gRNA
caaucggcgcgacccacuug

SEQ ID NO: 38919 - RNA, 20 nt, Artificial Sequence
  MKO10038919_A_Oprd1
  gRNA
ccaugcgcgugaugcgccgc

SEQ ID NO: 38920 - RNA, 20 nt, Artificial Sequence
  MKO10038920_A_Oprk1
  gRNA
acaggagccggacacucuuc

SEQ ID NO: 38921 - RNA, 20 nt, Artificial Sequence
  MKO10038921_A_Oprk1
  gRNA
gguauaucagcgauaguccu

SEQ ID NO: 38922 - RNA, 20 nt, Artificial Sequence
  MKO10038922_A_Oprk1
  gRNA
cuucccuauuaagaugcgaa

SEQ ID NO: 38923 - RNA, 20 nt, Artificial Sequence
  MKO10038923_A_Oprl1
  gRNA
acgccuagucaugccggccg

SEQ ID NO: 38924 - RNA, 20 nt, Artificial Sequence
  MKO10038924_A_Oprl1
  gRNA
cucaugauucgacgacuucg

SEQ ID NO: 38925 - RNA, 20 nt, Artificial Sequence
  MKO10038925_A_Oprl1
  gRNA
auauggccacauuaacggcc

SEQ ID NO: 38926 - RNA, 20 nt, Artificial Sequence
  MKO10038926_A_Oprm1
  gRNA
uucgggggguacggaaaucc

SEQ ID NO: 38927 - RNA, 20 nt, Artificial Sequence
  MKO10038927_A_Oprm1
  gRNA
ucgauccacuguauuagccg

SEQ ID NO: 38928 - RNA, 20 nt, Artificial Sequence
  MKO10038928_A_Oprm1
  gRNA
cucgaauccgucaaaacacu

SEQ ID NO: 38929 - RNA, 20 nt, Artificial Sequence
  MKO10038929_A_Opuc
  gRNA
ugacucaccacgaaugccuc

SEQ ID NO: 38930 - RNA, 20 nt, Artificial Sequence
  MKO10038930_A_Opuc
  gRNA
uccuggacguccgccugaau

SEQ ID NO: 38931 - RNA, 20 nt, Artificial Sequence
  MKO10038931_A_Opuc
  gRNA
cgcacuuaccaugacugcuc

SEQ ID NO: 38932 - RNA, 20 nt, Artificial Sequence
  MKO10038932_A_Optn
  gRNA
gaugcgccuucgggcugaaa

SEQ ID NO: 38933 - RNA, 20 nt, Artificial Sequence
  MKO10038933_A_Optn
  gRNA
cagcccgaaggcgcaucacc

SEQ ID NO: 38934 - RNA, 20 nt, Artificial Sequence
  MKO10038934_A_Optn
  gRNA
gauuugaggagcuguccgcc

SEQ ID NO: 38935 - RNA, 20 nt, Artificial Sequence
  MKO10038935_A_Orai1
  gRNA
ggccgaguuugcccgcuugc

SEQ ID NO: 38936 - RNA, 20 nt, Artificial Sequence
  MKO10038936_A_Orai1
  gRNA
ccugcaucgagugcucguug

SEQ ID NO: 38937 - RNA, 20 nt, Artificial Sequence
  MKO10038937_A_Orai1
  gRNA
ccucaacgagcacucgaugc

SEQ ID NO: 38938 - RNA, 20 nt, Artificial Sequence
  MKO10038938_A_Orai2
  gRNA
cgcugauggaguugagguug

SEQ ID NO: 38939 - RNA, 20 nt, Artificial Sequence
  MKO10038939_A_Orai2
  gRNA
guugcucaccgcuuccacgu

SEQ ID NO: 38940 - RNA, 20 nt, Artificial Sequence
  MKO10038940_A_Orai2
  gRNA
ucaccauggcgaagccagac

SEQ ID NO: 38941 - RNA, 20 nt, Artificial Sequence
  MKO10038941_A_Orai3
  gRNA
ccacguaucugugcagucgu

SEQ ID NO: 38942 - RNA, 20 nt, Artificial Sequence
  MKO10038942_A_Orai3
  gRNA
ccgcgggcucagccacguac

SEQ ID NO: 38943 - RNA, 20 nt, Artificial Sequence
  MKO10038943_A_Orai3
  gRNA
ccaacgacugcacagauacg

SEQ ID NO: 38944 - RNA, 20 nt, Artificial Sequence
  MKO10038944_A_Oraov1
  gRNA
aguagcuuggggaucguuga

SEQ ID NO: 38945 - RNA, 20 nt, Artificial Sequence
  MKO10038945_A_Oraov1
  gRNA
aagcgguauggcaugguaca

SEQ ID NO: 38946 - RNA, 20 nt, Artificial Sequence
  MKO10038946_A_Oraov1
  gRNA
auucacagauuggaugcuac

SEQ ID NO: 38947 - RNA, 20 nt, Artificial Sequence
  MKO10038947_A_Orc1
  gRNA
uucuuugaccaccucguguu

SEQ ID NO: 38948 - RNA, 20 nt, Artificial Sequence
  MKO10038948_A_Orc1
  gRNA
auuaauguggagaccaucau

SEQ ID NO: 38949 - RNA, 20 nt, Artificial Sequence
  MKO10038949_A_Orc1
  gRNA
acaacacacuuagcccuauc

SEQ ID NO: 38950 - RNA, 20 nt, Artificial Sequence
  MKO10038950_A_Orc2
  gRNA
ggugccaagcgugcaguuug

SEQ ID NO: 38951 - RNA, 20 nt, Artificial Sequence
  MKO10038951_A_Orc2
  gRNA
ucucccacaaacugcacgcu

SEQ ID NO: 38952 - RNA, 20 nt, Artificial Sequence
  MKO10038952_A_Orc2
  gRNA
uuuagcagagccguuuccca

SEQ ID NO: 38953 - RNA, 20 nt, Artificial Sequence
  MKO10038953_A_Orc3
  gRNA
ggccaccuccuccgugucua

SEQ ID NO: 38954 - RNA, 20 nt, Artificial Sequence
  MKO10038954_A_Orc3
  gRNA
cccacguaccuuagacacgg

SEQ ID NO: 38955 - RNA, 20 nt, Artificial Sequence
  MKO10038955_A_Orc3
  gRNA
acggaugaaaucugaaacag

SEQ ID NO: 38956 - RNA, 20 nt, Artificial Sequence
  MKO10038956_A_Orc4
  gRNA
aguccacauagcaaccucuu

SEQ ID NO: 38957 - RNA, 20 nt, Artificial Sequence
  MKO10038957_A_Orc4
  gRNA
gugauacaaguucacuuaaa

SEQ ID NO: 38958 - RNA, 20 nt, Artificial Sequence
  MKO10038958_A_Orc4
  gRNA
cucaaaagaacugcuaucua

SEQ ID NO: 38959 - RNA, 20 nt, Artificial Sequence
  MKO10038959_A_Orc5
  gRNA
aacuuaccuaugcuauaguc

SEQ ID NO: 38960 - RNA, 20 nt, Artificial Sequence
  MKO10038960_A_Orc5
  gRNA
gaccagugcugaacaucuca

SEQ ID NO: 38961 - RNA, 20 nt, Artificial Sequence
  MKO10038961_A_Orc5
  gRNA
uacuuacaauauacacaguc

SEQ ID NO: 38962 - RNA, 20 nt, Artificial Sequence
  MKO10038962_A_Orc6
  gRNA
cugucuccuagcuacgaguc

SEQ ID NO: 38963 - RNA, 20 nt, Artificial Sequence
  MKO10038963_A_Orc6
  gRNA
gagcagaucuugacuugucc

SEQ ID NO: 38964 - RNA, 20 nt, Artificial Sequence
  MKO10038964_A_Orc6
  gRNA
uacagcugaacuguacagcu

SEQ ID NO: 38965 - RNA, 20 nt, Artificial Sequence
  MKO10038965_A_Orm1
  gRNA
cuuucagaaaacucgaguac

SEQ ID NO: 38966 - RNA, 20 nt, Artificial Sequence
  MKO10038966_A_Orm1
  gRNA
uugcccaccuuauagugcug

SEQ ID NO: 38967 - RNA, 20 nt, Artificial Sequence
  MKO10038967_A_Orm1
  gRNA
cauguuuccucagcacuaua

SEQ ID NO: 38968 - RNA, 20 nt, Artificial Sequence
  MKO10038968_A_Orm2
  gRNA
caucgugucauuuaucaagu

SEQ ID NO: 38969 - RNA, 20 nt, Artificial Sequence
  MKO10038969_A_Orm2
  gRNA
cuguccuaaacccugauuac

SEQ ID NO: 38970 - RNA, 20 nt, Artificial Sequence
  MKO10038970_A_Orm2
  gRNA
aacccuuaccauacuuggag

SEQ ID NO: 38971 - RNA, 20 nt, Artificial Sequence
  MKO10038971_A_Orm3
  gRNA
aaacggggacugucccugag

SEQ ID NO: 38972 - RNA, 20 nt, Artificial Sequence
  MKO10038972_A_Orm3
  gRNA
caccuucaccauacuugaag

SEQ ID NO: 38973 - RNA, 20 nt, Artificial Sequence
  MKO10038973_A_Orm3
  gRNA
aaugggacccucuucaagua

SEQ ID NO: 38974 - RNA, 20 nt, Artificial Sequence
  MKO10038974_A_Ormdl1
  gRNA
acucguguaaugaacagccg

SEQ ID NO: 38975 - RNA, 20 nt, Artificial Sequence
  MKO10038975_A_Ormdl1
  gRNA
gagcaaggcuccuaacucac

SEQ ID NO: 38976 - RNA, 20 nt, Artificial Sequence
  MKO10038976_A_Ormdl1
  gRNA
agccuugcucuacccugauc

SEQ ID NO: 38977 - RNA, 20 nt, Artificial Sequence
  MKO10038977_A_Ormdl2
  gRNA
gaagugagcagcaucguacu

SEQ ID NO: 38978 - RNA, 20 nt, Artificial Sequence
  MKO10038978_A_Ormdl2
  gRNA
acacucgagugaugaacagu

SEQ ID NO: 38979 - RNA, 20 nt, Artificial Sequence
  MKO10038979_A_Ormdl2
  gRNA
acuguucaucacucgagugu

SEQ ID NO: 38980 - RNA, 20 nt, Artificial Sequence
  MKO10038980_A_Ormdl3
  gRNA
ucacagcacuauaggcguga

SEQ ID NO: 38981 - RNA, 20 nt, Artificial Sequence
  MKO10038981_A_Ormdl3
  gRNA
acacgggugaugaacagucg

SEQ ID NO: 38982 - RNA, 20 nt, Artificial Sequence
  MKO10038982_A_Ormdl3
  gRNA
aucuuaccagguuguggaua

SEQ ID NO: 38983 - RNA, 20 nt, Artificial Sequence
  MKO10038983_A_Os9
  gRNA
acaccgcccgucagacgcgc

SEQ ID NO: 38984 - RNA, 20 nt, Artificial Sequence
  MKO10038984_A_Os9
  gRNA
aucccgggccccugguaagc

SEQ ID NO: 38985 - RNA, 20 nt, Artificial Sequence
  MKO10038985_A_Os9
  gRNA
ccuguuaccugcgcgucuga

SEQ ID NO: 38986 - RNA, 20 nt, Artificial Sequence
  MKO10038986_A_Osbp2
  gRNA
gcgggcucuaaauuaugagc

SEQ ID NO: 38987 - RNA, 20 nt, Artificial Sequence
  MKO10038987_A_Osbp2
  gRNA
uccuugccccguugcauaga

SEQ ID NO: 38988 - RNA, 20 nt, Artificial Sequence
  MKO10038988_A_Osbp2
  gRNA
cccgccagggguguugcaga

SEQ ID NO: 38989 - RNA, 20 nt, Artificial Sequence
  MKO10038989_A_Osbpl10
  gRNA
cgcccguacugagaugucuc

SEQ ID NO: 38990 - RNA, 20 nt, Artificial Sequence
  MKO10038990_A_Osbpl10
  gRNA
acgcgugacugagacaacac

SEQ ID NO: 38991 - RNA, 20 nt, Artificial Sequence
  MKO10038991_A_Osbpl10
  gRNA
uguggcuggguggcgccgcc

SEQ ID NO: 38992 - RNA, 20 nt, Artificial Sequence
  MKO10038992_A_Osbpl11
  gRNA
gaguuuauacugcuccccgc

SEQ ID NO: 38993 - RNA, 20 nt, Artificial Sequence
  MKO10038993_A_Osbpl11
  gRNA
ggugugcgaguccucaucgc

SEQ ID NO: 38994 - RNA, 20 nt, Artificial Sequence
  MKO10038994_A_Osbpl11
  gRNA
ccuuuccaauagcuuccgug

SEQ ID NO: 38995 - RNA, 20 nt, Artificial Sequence
  MKO10038995_A_Osbpl1a
  gRNA
uccggugcgcucccacugag

SEQ ID NO: 38996 - RNA, 20 nt, Artificial Sequence
  MKO10038996_A_Osbpl1a
  gRNA
uguauucaguuagccgcugc

SEQ ID NO: 38997 - RNA, 20 nt, Artificial Sequence
  MKO10038997_A_Osbpl1a
  gRNA
aaagcccuucaacccgcuuc

SEQ ID NO: 38998 - RNA, 20 nt, Artificial Sequence
  MKO10038998_A_Osbpl2
  gRNA
ccacacacugaagucgcuuc

SEQ ID NO: 38999 - RNA, 20 nt, Artificial Sequence
  MKO10038999_A_Osbpl2
  gRNA
uguacucugugauccgcugc

SEQ ID NO: 39000 - RNA, 20 nt, Artificial Sequence
  MKO10039000_A_Osbpl2
  gRNA
cucaagucagucccagccgc

SEQ ID NO: 39001 - RNA, 20 nt, Artificial Sequence
  MKO10039001_A_Osbpl3
  gRNA
aggggaaaugacuuacaccc

SEQ ID NO: 39002 - RNA, 20 nt, Artificial Sequence
  MKO10039002_A_Osbpl3
  gRNA
uaaguguaucgaccuagaca

SEQ ID NO: 39003 - RNA, 20 nt, Artificial Sequence
  MKO10039003_A_Osbpl3
  gRNA
agaugugcuccuccgugucu

SEQ ID NO: 39004 - RNA, 20 nt, Artificial Sequence
  MKO10039004_A_Osbpl5
  gRNA
aauguaccucuccaacgacc

SEQ ID NO: 39005 - RNA, 20 nt, Artificial Sequence
  MKO10039005_A_Osbpl5
  gRNA
cuccgccacgaaggugccac

SEQ ID NO: 39006 - RNA, 20 nt, Artificial Sequence
  MKO10039006_A_Osbpl5
  gRNA
ucuuaccaguggcaccuucg

SEQ ID NO: 39007 - RNA, 20 nt, Artificial Sequence
  MKO10039007_A_Osbpl6
  gRNA
acuuacaucaaguggcgccu

SEQ ID NO: 39008 - RNA, 20 nt, Artificial Sequence
  MKO10039008_A_Osbpl6
  gRNA
auaaaucccucgugccuguc

SEQ ID NO: 39009 - RNA, 20 nt, Artificial Sequence
  MKO10039009_A_Osbpl6
  gRNA
cagucggcaguugcuagagc

SEQ ID NO: 39010 - RNA, 20 nt, Artificial Sequence
  MKO10039010_A_Osbpl7
  gRNA
gacggauagccggacaucga

SEQ ID NO: 39011 - RNA, 20 nt, Artificial Sequence
  MKO10039011_A_Osbpl7
  gRNA
acucacaucuugucgagucg

SEQ ID NO: 39012 - RNA, 20 nt, Artificial Sequence
  MKO10039012_A_Osbpl7
  gRNA
uccacggcuccaucgauguc

SEQ ID NO: 39013 - RNA, 20 nt, Artificial Sequence
  MKO10039013_A_Osbpl8
  gRNA
uuggguuagcgucucugccu

SEQ ID NO: 39014 - RNA, 20 nt, Artificial Sequence
  MKO10039014_A_Osbpl8
  gRNA
ggaaagaugagucagcgcca

SEQ ID NO: 39015 - RNA, 20 nt, Artificial Sequence
  MKO10039015_A_Osbpl8
  gRNA
cacgaagaaagagucucuua

SEQ ID NO: 39016 - RNA, 20 nt, Artificial Sequence
  MKO10039016_A_Osbpl9
  gRNA
gaucuugauagaacaauuaa

SEQ ID NO: 39017 - RNA, 20 nt, Artificial Sequence
  MKO10039017_A_Osbpl9
  gRNA
uuucucuaggguuuggauuc

SEQ ID NO: 39018 - RNA, 20 nt, Artificial Sequence
  MKO10039018_A_Osbpl9
  gRNA
uaaagaugaugaacagagaa

SEQ ID NO: 39019 - RNA, 20 nt, Artificial Sequence
  MKO10039019_A_Osbp
  gRNA
aagagaccagcgaauccgac

SEQ ID NO: 39020 - RNA, 20 nt, Artificial Sequence
  MKO10039020_A_Osbp
  gRNA
guaggucugagcaccgccau

SEQ ID NO: 39021 - RNA, 20 nt, Artificial Sequence
  MKO10039021_A_Osbp
  gRNA
gugaagaugcuggccgaauc

SEQ ID NO: 39022 - RNA, 20 nt, Artificial Sequence
  MKO10039022_A_Oscar
  gRNA
gccgcuaccgcaagacagac

SEQ ID NO: 39023 - RNA, 20 nt, Artificial Sequence
  MKO10039023_A_Oscar
  gRNA
uugaggugcgcggcaaguca

SEQ ID NO: 39024 - RNA, 20 nt, Artificial Sequence
  MKO10039024_A_Oscar
  gRNA
aacguaagccugcgcugugc

SEQ ID NO: 39025 - RNA, 20 nt, Artificial Sequence
  MKO10039025_A_Oscp1
  gRNA
cucguccaccugauguauga

SEQ ID NO: 39026 - RNA, 20 nt, Artificial Sequence
  MKO10039026_A_Oscp1
  gRNA
gcggucauacacaguccgca

SEQ ID NO: 39027 - RNA, 20 nt, Artificial Sequence
  MKO10039027_A_Oscp1
  gRNA
cugguucagucgcaugaugg

SEQ ID NO: 39028 - RNA, 20 nt, Artificial Sequence
  MKO10039028_A_Oser1
  gRNA
uguacugcaauguaugaauu

SEQ ID NO: 39029 - RNA, 20 nt, Artificial Sequence
  MKO10039029_A_Oser1
  gRNA
cacaaugaaauccgaagcca

SEQ ID NO: 39030 - RNA, 20 nt, Artificial Sequence
  MKO10039030_A_Oser1
  gRNA
guccacucuuaauuucuuga

SEQ ID NO: 39031 - RNA, 20 nt, Artificial Sequence
  MKO10039031_A_Osgepl1
  gRNA
aggcucacgcacugacuauu

SEQ ID NO: 39032 - RNA, 20 nt, Artificial Sequence
  MKO10039032_A_Osgepl1
  gRNA
accuugucaagcaugucgcc

SEQ ID NO: 39033 - RNA, 20 nt, Artificial Sequence
  MKO10039033_A_Osgepl1
  gRNA
cuuacuaauacugcguuagc

SEQ ID NO: 39034 - RNA, 20 nt, Artificial Sequence
  MKO10039034_A_Osgep
  gRNA
agaaacuauugauaucgccg

SEQ ID NO: 39035 - RNA, 20 nt, Artificial Sequence
  MKO10039035_A_Osgep
  gRNA
uacgcugucagguccuggca

SEQ ID NO: 39036 - RNA, 20 nt, Artificial Sequence
  MKO10039036_A_Osgep
  gRNA
agaggcaggauugaccucca

SEQ ID NO: 39037 - RNA, 20 nt, Artificial Sequence
  MKO10039037_A_Osgin1
  gRNA
cgccgguccgugcaugaccc

SEQ ID NO: 39038 - RNA, 20 nt, Artificial Sequence
  MKO10039038_A_Osgin1
  gRNA
gaccuagaguaccuuuccga

SEQ ID NO: 39039 - RNA, 20 nt, Artificial Sequence
  MKO10039039_A_Osgin1
  gRNA
gugggcgaugucaccggcug

SEQ ID NO: 39040 - RNA, 20 nt, Artificial Sequence
  MKO10039040_A_Osgin2
  gRNA
ggggcgaucguccaauccag

SEQ ID NO: 39041 - RNA, 20 nt, Artificial Sequence
  MKO10039041_A_Osgin2
  gRNA
cuacagaccguauuuaucau

SEQ ID NO: 39042 - RNA, 20 nt, Artificial Sequence
  MKO10039042_A_Osgin2
  gRNA
auugcuuccgaugauaaaua

SEQ ID NO: 39043 - RNA, 20 nt, Artificial Sequence
  MKO10039043_A_Osmr
  gRNA
cuggacgucugauaucccuu

SEQ ID NO: 39044 - RNA, 20 nt, Artificial Sequence
  MKO10039044_A_Osmr
  gRNA
caucaauugucaagccacga

SEQ ID NO: 39045 - RNA, 20 nt, Artificial Sequence
  MKO10039045_A_Osmr
  gRNA
uguauggacagaagugcucg

SEQ ID NO: 39046 - RNA, 20 nt, Artificial Sequence
  MKO10039046_A_Osm
  gRNA
ggaaccuaggcccuggucgu

SEQ ID NO: 39047 - RNA, 20 nt, Artificial Sequence
  MKO10039047_A_Osm
  gRNA
gcacccagagcccgacgacc

SEQ ID NO: 39048 - RNA, 20 nt, Artificial Sequence
  MKO10039048_A_Osm
  gRNA
gugauucuguguuccccgug

SEQ ID NO: 39049 - RNA, 20 nt, Artificial Sequence
  MKO10039049_A_Osr1
  gRNA
caucagugugcguccgcucg

SEQ ID NO: 39050 - RNA, 20 nt, Artificial Sequence
  MKO10039050_A_Osr1
  gRNA
ucgcuuugauuucgcuaacc

SEQ ID NO: 39051 - RNA, 20 nt, Artificial Sequence
  MKO10039051_A_Osr1
  gRNA
cuugugaguguagcgucuug

SEQ ID NO: 39052 - RNA, 20 nt, Artificial Sequence
  MKO10039052_A_Osr2
  gRNA
gcaccgcacugagaccguag

SEQ ID NO: 39053 - RNA, 20 nt, Artificial Sequence
  MKO10039053_A_Osr2
  gRNA
gcgggugaucucgugcacac

SEQ ID NO: 39054 - RNA, 20 nt, Artificial Sequence
  MKO10039054_A_Osr2
  gRNA
ucaggcgaaacugcgaucug

SEQ ID NO: 39055 - RNA, 20 nt, Artificial Sequence
  MKO10039055_A_Ost4
  gRNA
cgccaucuucgccaacaugc

SEQ ID NO: 39056 - RNA, 20 nt, Artificial Sequence
  MKO10039056_A_Ost4
  gRNA
aagcgacacgcccagcaugu

SEQ ID NO: 39057 - RNA, 20 nt, Artificial Sequence
  MKO10039057_A_Ost4
  gRNA
ccacuuucauuccugcuucu

SEQ ID NO: 39058 - RNA, 20 nt, Artificial Sequence
  MKO10039058_A_Osuc
  gRNA
ccgaguuaccuccgguaaug

SEQ ID NO: 39059 - RNA, 20 nt, Artificial Sequence
  MKO10039059_A_Osuc
  gRNA
uuggugcauuggaucggucc

SEQ ID NO: 39060 - RNA, 20 nt, Artificial Sequence
  MKO10039060_A_Osuc
  gRNA
gcacaugccgucggcuauga

SEQ ID NO: 39061 - RNA, 20 nt, Artificial Sequence
  MKO10039061_A_Ostf1
  gRNA
ggccgcuuaccauaguugcu

SEQ ID NO: 39062 - RNA, 20 nt, Artificial Sequence
  MKO10039062_A_Ostf1
  gRNA
uuucaaucuaguggcugagc

SEQ ID NO: 39063 - RNA, 20 nt, Artificial Sequence
  MKO10039063_A_Ostf1
  gRNA
gcaugucccuuuccaccagc

SEQ ID NO: 39064 - RNA, 20 nt, Artificial Sequence
  MKO10039064_A_Ostm1
  gRNA
gacgcacuugugcaucgaug

SEQ ID NO: 39065 - RNA, 20 nt, Artificial Sequence
  MKO10039065_A_Ostm1
  gRNA
ucgaugcacaagugcgucuc

SEQ ID NO: 39066 - RNA, 20 nt, Artificial Sequence
  MKO10039066_A_Ostm1
  gRNA
gcuauugcagaauaccuccg

SEQ ID NO: 39067 - RNA, 20 nt, Artificial Sequence
  MKO10039067_A_Ostn
  gRNA
guuucuaccaauccgaucca

SEQ ID NO: 39068 - RNA, 20 nt, Artificial Sequence
  MKO10039068_A_Ostn
  gRNA
gguauucccauggaucggau

SEQ ID NO: 39069 - RNA, 20 nt, Artificial Sequence
  MKO10039069_A_Ostn
  gRNA
acaccagaucaucaagacgc

SEQ ID NO: 39070 - RNA, 20 nt, Artificial Sequence
  MKO10039070_A_Ouc
  gRNA
aaagucucacagacaccgcu

SEQ ID NO: 39071 - RNA, 20 nt, Artificial Sequence
  MKO10039071_A_Ouc
  gRNA
uaaucagccaggaucuggau

SEQ ID NO: 39072 - RNA, 20 nt, Artificial Sequence
  MKO10039072_A_Ouc
  gRNA
guaucauccuauccagaucc

SEQ ID NO: 39073 - RNA, 20 nt, Artificial Sequence
  MKO10039073_A_Otoa
  gRNA
uugcuugaaggucccauguc

SEQ ID NO: 39074 - RNA, 20 nt, Artificial Sequence
  MKO10039074_A_Otoa
  gRNA
cuaucugaacucaaagaaug

SEQ ID NO: 39075 - RNA, 20 nt, Artificial Sequence
  MKO10039075_A_Otoa
  gRNA
uggaucucacacuauuugaa

SEQ ID NO: 39076 - RNA, 20 nt, Artificial Sequence
  MKO10039076_A_Otof
  gRNA
agaggugaccgacacgcuga

SEQ ID NO: 39077 - RNA, 20 nt, Artificial Sequence
  MKO10039077_A_Otof
  gRNA
ucucuccccagacguuccgg

SEQ ID NO: 39078 - RNA, 20 nt, Artificial Sequence
  MKO10039078_A_Otof
  gRNA
caguggccagcagcaucgac

SEQ ID NO: 39079 - RNA, 20 nt, Artificial Sequence
  MKO10039079_A_Otogl
  gRNA
caccccaauuaauagcuucg

SEQ ID NO: 39080 - RNA, 20 nt, Artificial Sequence
  MKO10039080_A_Otogl
  gRNA
uagaacagaaagccccguua

SEQ ID NO: 39081 - RNA, 20 nt, Artificial Sequence
  MKO10039081_A_Otogl
  gRNA
cucgggacaaggugccagau

SEQ ID NO: 39082 - RNA, 20 nt, Artificial Sequence
  MKO10039082_A_Otog
  gRNA
cuuacacgacggugcacacu

SEQ ID NO: 39083 - RNA, 20 nt, Artificial Sequence
  MKO10039083_A_Otog
  gRNA
cacuggaccccguugccagu

SEQ ID NO: 39084 - RNA, 20 nt, Artificial Sequence
  MKO10039084_A_Otog
  gRNA
ccgucuuucccacgaagaca

SEQ ID NO: 39085 - RNA, 20 nt, Artificial Sequence
  MKO10039085_A_Otol1
  gRNA
ugggcuguaugucggccccg

SEQ ID NO: 39086 - RNA, 20 nt, Artificial Sequence
  MKO10039086_A_Otol1
  gRNA
cccgcagguccggugaaacc

SEQ ID NO: 39087 - RNA, 20 nt, Artificial Sequence
  MKO10039087_A_Otol1
  gRNA
uggagaagaaaccguccaua

SEQ ID NO: 39088 - RNA, 20 nt, Artificial Sequence
  MKO10039088_A_Otop1
  gRNA
guucuauuuguacgcuauca

SEQ ID NO: 39089 - RNA, 20 nt, Artificial Sequence
  MKO10039089_A_Otop1
  gRNA
ucaacauccagcuugcgcgc

SEQ ID NO: 39090 - RNA, 20 nt, Artificial Sequence
  MKO10039090_A_Otop1
  gRNA
ugauucauucaggacgcugu

SEQ ID NO: 39091 - RNA, 20 nt, Artificial Sequence
  MKO10039091_A_Otop2
  gRNA
gagcgaucaugaguagagcg

SEQ ID NO: 39092 - RNA, 20 nt, Artificial Sequence
  MKO10039092_A_Otop2
  gRNA
gauagcguauuggcccaggg

SEQ ID NO: 39093 - RNA, 20 nt, Artificial Sequence
  MKO10039093_A_Otop2
  gRNA
cacuacggcugccauccaga

SEQ ID NO: 39094 - RNA, 20 nt, Artificial Sequence
  MKO10039094_A_Otop3
  gRNA
gucggucucuccgcaacagc

SEQ ID NO: 39095 - RNA, 20 nt, Artificial Sequence
  MKO10039095_A_Otop3
  gRNA
ccuguaccgugauccccacg

SEQ ID NO: 39096 - RNA, 20 nt, Artificial Sequence
  MKO10039096_A_Otop3
  gRNA
cuccaugcaccgugagauug

SEQ ID NO: 39097 - RNA, 20 nt, Artificial Sequence
  MKO10039097_A_Otor
  gRNA
gaucuauguuuacuccaagc

SEQ ID NO: 39098 - RNA, 20 nt, Artificial Sequence
  MKO10039098_A_Otor
  gRNA
gaaggagcagcguguauacc

SEQ ID NO: 39099 - RNA, 20 nt, Artificial Sequence
  MKO10039099_A_Otor
  gRNA
acaucgaugaaccuacaguc

SEQ ID NO: 39100 - RNA, 20 nt, Artificial Sequence
  MKO10039100_A_Otos
  gRNA
cuacccacagaucgaggaca

SEQ ID NO: 39101 - RNA, 20 nt, Artificial Sequence
  MKO10039101_A_Otos
  gRNA
cgugcaauauuuccagaccc

SEQ ID NO: 39102 - RNA, 20 nt, Artificial Sequence
  MKO10039102_A_Otos
  gRNA
aggagccaagccaaugccag

SEQ ID NO: 39103 - RNA, 20 nt, Artificial Sequence
  MKO10039103_A_Otp
  gRNA
guaucgggcugaccgagucg

SEQ ID NO: 39104 - RNA, 20 nt, Artificial Sequence
  MKO10039104_A_Otp
  gRNA
uccacgccaacgacacccgc

SEQ ID NO: 39105 - RNA, 20 nt, Artificial Sequence
  MKO10039105_A_Otp
  gRNA
cgacugcagccccgcgccgu

SEQ ID NO: 39106 - RNA, 20 nt, Artificial Sequence
  MKO10039106_A_Ouu
  gRNA
uguacuuuaccucucccucg

SEQ ID NO: 39107 - RNA, 20 nt, Artificial Sequence
  MKO10039107_A_Ouu
  gRNA
uucugaagaagaauacaaug

SEQ ID NO: 39108 - RNA, 20 nt, Artificial Sequence
  MKO10039108_A_Ouu
  gRNA
ucacuuaccagaugaaguag

SEQ ID NO: 39109 - RNA, 20 nt, Artificial Sequence
  MKO10039109_A_Otub1
  gRNA
aacugcuucuaccgagcguu

SEQ ID NO: 39110 - RNA, 20 nt, Artificial Sequence
  MKO10039110_A_Otub1
  gRNA
ggcacugcuagaugacagca

SEQ ID NO: 39111 - RNA, 20 nt, Artificial Sequence
  MKO10039111_A_Otub1
  gRNA
agccauaauggcuucaucau

SEQ ID NO: 39112 - RNA, 20 nt, Artificial Sequence
  MKO10039112_A_Otub2
  gRNA
gcaaaagauucaccucgauc

SEQ ID NO: 39113 - RNA, 20 nt, Artificial Sequence
  MKO10039113_A_Otub2
  gRNA
guucuuacgccuccucacgu

SEQ ID NO: 39114 - RNA, 20 nt, Artificial Sequence
  MKO10039114_A_Otub2
  gRNA
ggcguaagaacugcacgauu

SEQ ID NO: 39115 - RNA, 20 nt, Artificial Sequence
  MKO10039115_A_Otud1
  gRNA
gaacgccguccgcgacgcuc

SEQ ID NO: 39116 - RNA, 20 nt, Artificial Sequence
  MKO10039116_A_Otud1
  gRNA
aguuccuguccggagcgucg

SEQ ID NO: 39117 - RNA, 20 nt, Artificial Sequence
  MKO10039117_A_Otud1
  gRNA
ccgucggagcgcgucagacc

SEQ ID NO: 39118 - RNA, 20 nt, Artificial Sequence
  MKO10039118_A_Otud3
  gRNA
aacacuaugacagcguccgg

SEQ ID NO: 39119 - RNA, 20 nt, Artificial Sequence
  MKO10039119_A_Otud3
  gRNA
ugugucgcagauucgaggca

SEQ ID NO: 39120 - RNA, 20 nt, Artificial Sequence
  MKO10039120_A_Otud3
  gRNA
ggaggacuuugagcccuucg

SEQ ID NO: 39121 - RNA, 20 nt, Artificial Sequence
  MKO10039121_A_Otud4
  gRNA
cgcgcccgacggcguggacc

SEQ ID NO: 39122 - RNA, 20 nt, Artificial Sequence
  MKO10039122_A_Otud4
  gRNA
gccgcccugguccacgccgu

SEQ ID NO: 39123 - RNA, 20 nt, Artificial Sequence
  MKO10039123_A_Otud4
  gRNA
gugcccuuucacuuauguac

SEQ ID NO: 39124 - RNA, 20 nt, Artificial Sequence
  MKO10039124_A_Otud5
  gRNA
ggccuaccgucauuuaagcc

SEQ ID NO: 39125 - RNA, 20 nt, Artificial Sequence
  MKO10039125_A_Otud5
  gRNA
ccauccgugucagcuaccac

SEQ ID NO: 39126 - RNA, 20 nt, Artificial Sequence
  MKO10039126_A_Otud5
  gRNA
acuucaccaccuauaucaac

SEQ ID NO: 39127 - RNA, 20 nt, Artificial Sequence
  MKO10039127_A_Otud6a
  gRNA
gucgccacuaucgcgaaaaa

SEQ ID NO: 39128 - RNA, 20 nt, Artificial Sequence
  MKO10039128_A_Otud6a
  gRNA
guagugcucuccgaagucgc

SEQ ID NO: 39129 - RNA, 20 nt, Artificial Sequence
  MKO10039129_A_Otud6a
  gRNA
cugcacuacgccugcgacuu

SEQ ID NO: 39130 - RNA, 20 nt, Artificial Sequence
  MKO10039130_A_Otud6b
  gRNA
cguguacauaucuccugugc

SEQ ID NO: 39131 - RNA, 20 nt, Artificial Sequence
  MKO10039131_A_Otud6b
  gRNA
acggcaggaagucgucugaa

SEQ ID NO: 39132 - RNA, 20 nt, Artificial Sequence
  MKO10039132_A_Otud6b
  gRNA
ugacgauauugugaacacag

SEQ ID NO: 39133 - RNA, 20 nt, Artificial Sequence
  MKO10039133_A_Otud7a
  gRNA
cucuuacaugccgccucgcu

SEQ ID NO: 39134 - RNA, 20 nt, Artificial Sequence
  MKO10039134_A_Otud7a
  gRNA
caauucucgcucggccugcu

SEQ ID NO: 39135 - RNA, 20 nt, Artificial Sequence
  MKO10039135_A_Otud7a
  gRNA
cgaacgggaccugaucgagc

SEQ ID NO: 39136 - RNA, 20 nt, Artificial Sequence
  MKO10039136_A_Otud7b
  gRNA
augggucgagaagggcgagu

SEQ ID NO: 39137 - RNA, 20 nt, Artificial Sequence
  MKO10039137_A_Otud7b
  gRNA
aaccuauccccacccuuuag

SEQ ID NO: 39138 - RNA, 20 nt, Artificial Sequence
  MKO10039138_A_Otud7b
  gRNA
gaaagcgcuguaugcacuga

SEQ ID NO: 39139 - RNA, 20 nt, Artificial Sequence
  MKO10039139_A_Otx1
  gRNA
uaccgagcgcugcaugcacg

SEQ ID NO: 39140 - RNA, 20 nt, Artificial Sequence
  MKO10039140_A_Otx1
  gRNA
cucagcgccgacauccguau

SEQ ID NO: 39141 - RNA, 20 nt, Artificial Sequence
  MKO10039141_A_Otx1
  gRNA
guccagcugugagcgcguga

SEQ ID NO: 39142 - RNA, 20 nt, Artificial Sequence
  MKO10039142_A_Otx2
  gRNA
uagggcacagcucgacguuc

SEQ ID NO: 39143 - RNA, 20 nt, Artificial Sequence
  MKO10039143_A_Otx2
  gRNA
caaccgccuuacgcagucaa

SEQ ID NO: 39144 - RNA, 20 nt, Artificial Sequence
  MKO10039144_A_Otx2
  gRNA
cucagcccauugacugcgua

SEQ ID NO: 39145 - RNA, 20 nt, Artificial Sequence
  MKO10039145_A_Ovca2
  gRNA
cggcuagacacagcacucgc

SEQ ID NO: 39146 - RNA, 20 nt, Artificial Sequence
  MKO10039146_A_Ovca2
  gRNA
cggucugcaguauggcggca

SEQ ID NO: 39147 - RNA, 20 nt, Artificial Sequence
  MKO10039147_A_Ovca2
  gRNA
guucuguccccgaggccuua

SEQ ID NO: 39148 - RNA, 20 nt, Artificial Sequence
  MKO10039148_A_Ovch2
  gRNA
cuccaacaaugcgacugaaa

SEQ ID NO: 39149 - RNA, 20 nt, Artificial Sequence
  MKO10039149_A_Ovch2
  gRNA
gaacugcggguguaugauga

SEQ ID NO: 39150 - RNA, 20 nt, Artificial Sequence
  MKO10039150_A_Ovch2
  gRNA
ccagcauuaaaguguucucc

SEQ ID NO: 39151 - RNA, 20 nt, Artificial Sequence
  MKO10039151_A_Ovgp1
  gRNA
gggggacugccucguagucc

SEQ ID NO: 39152 - RNA, 20 nt, Artificial Sequence
  MKO10039152_A_Ovgp1
  gRNA
gguggaacuucggcacauca

SEQ ID NO: 39153 - RNA, 20 nt, Artificial Sequence
  MKO10039153_A_Ovgp1
  gRNA
gccagguacugccuacaaac

SEQ ID NO: 39154 - RNA, 20 nt, Artificial Sequence
  MKO10039154_A_Ovol1
  gRNA
aucucgccgcgcucuucguc

SEQ ID NO: 39155 - RNA, 20 nt, Artificial Sequence
  MKO10039155_A_Ovol1
  gRNA
agugucacaacgacgucaag

SEQ ID NO: 39156 - RNA, 20 nt, Artificial Sequence
  MKO10039156_A_Ovol1
  gRNA
gaagaugccucgcgcguucc

SEQ ID NO: 39157 - RNA, 20 nt, Artificial Sequence
  MKO10039157_A_Ovol2
  gRNA
gcgugcguacgugccucuuc

SEQ ID NO: 39158 - RNA, 20 nt, Artificial Sequence
  MKO10039158_A_Ovol2
  gRNA
cccgaagacugccgcagcga

SEQ ID NO: 39159 - RNA, 20 nt, Artificial Sequence
  MKO10039159_A_Ovol2
  gRNA
uuugucgcgacgcugcuugu

SEQ ID NO: 39160 - RNA, 20 nt, Artificial Sequence
  MKO10039160_A_Ovol3
  gRNA
ggaauacggccauuccgcug

SEQ ID NO: 39161 - RNA, 20 nt, Artificial Sequence
  MKO10039161_A_Ovol3
  gRNA
cgcugcaacgcaugcugacu

SEQ ID NO: 39162 - RNA, 20 nt, Artificial Sequence
  MKO10039162_A_Ovol3
  gRNA
cgccacgugugccacuauug

SEQ ID NO: 39163 - RNA, 20 nt, Artificial Sequence
  MKO10039163_A_Oxa1l
  gRNA
cgaaccgagcuucacagaac

SEQ ID NO: 39164 - RNA, 20 nt, Artificial Sequence
  MKO10039164_A_Oxa1l
  gRNA
guggccgcccguuaccccgg

SEQ ID NO: 39165 - RNA, 20 nt, Artificial Sequence
  MKO10039165_A_Oxa1l
  gRNA
ucagggacacugcgacgcua

SEQ ID NO: 39166 - RNA, 20 nt, Artificial Sequence
  MKO10039166_A_Oxcu1
  gRNA
ucuagggcacacuugccgag

SEQ ID NO: 39167 - RNA, 20 nt, Artificial Sequence
  MKO10039167_A_Oxcu1
  gRNA
acgaaugaucuccucauaug

SEQ ID NO: 39168 - RNA, 20 nt, Artificial Sequence
  MKO10039168_A_Oxcu1
  gRNA
cauugccagcaagccacgag

SEQ ID NO: 39169 - RNA, 20 nt, Artificial Sequence
  MKO10039169_A_Oxcu2a
  gRNA
gccccugaagaucacguugc

SEQ ID NO: 39170 - RNA, 20 nt, Artificial Sequence
  MKO10039170_A_Oxcu2a
  gRNA
gcuccggcaacgugaucuuc

SEQ ID NO: 39171 - RNA, 20 nt, Artificial Sequence
  MKO10039171_A_Oxcu2a
  gRNA
cguggacgauggcggcgcug

SEQ ID NO: 39172 - RNA, 20 nt, Artificial Sequence
  MKO10039172_A_Oxcu2b
  gRNA
cgguggggcagcgcaggucg

SEQ ID NO: 39173 - RNA, 20 nt, Artificial Sequence
  MKO10039173_A_Oxcu2b
  gRNA
gccguauugagaaacuugca

SEQ ID NO: 39174 - RNA, 20 nt, Artificial Sequence
  MKO10039174_A_Oxcu2b
  gRNA
aaaugcaccaugccguugac

SEQ ID NO: 39175 - RNA, 20 nt, Artificial Sequence
  MKO10039175_A_Oxgr1
  gRNA
agcagaccuauugguccggg

SEQ ID NO: 39176 - RNA, 20 nt, Artificial Sequence
  MKO10039176_A_Oxgr1
  gRNA
augugcaaguucauccgcuu

SEQ ID NO: 39177 - RNA, 20 nt, Artificial Sequence
  MKO10039177_A_Oxgr1
  gRNA
uguaccacuugauaguagug

SEQ ID NO: 39178 - RNA, 20 nt, Artificial Sequence
  MKO10039178_A_Oxld1
  gRNA
cgcgaagccuuucgugcagc

SEQ ID NO: 39179 - RNA, 20 nt, Artificial Sequence
  MKO10039179_A_Oxld1
  gRNA
guuuccccguucggggaggc

SEQ ID NO: 39180 - RNA, 20 nt, Artificial Sequence
  MKO10039180_A_Oxld1
  gRNA
auuaugccgaagcucugcug

SEQ ID NO: 39181 - RNA, 20 nt, Artificial Sequence
  MKO10039181_A_Oxnad1
  gRNA
agcuacguccuuugucugcg

SEQ ID NO: 39182 - RNA, 20 nt, Artificial Sequence
  MKO10039182_A_Oxnad1
  gRNA
cccgguggagaucugccgag

SEQ ID NO: 39183 - RNA, 20 nt, Artificial Sequence
  MKO10039183_A_Oxnad1
  gRNA
agacacaaaccucccggcgg

SEQ ID NO: 39184 - RNA, 20 nt, Artificial Sequence
  MKO10039184_A_Oxr1
  gRNA
guaccguacacaagcgucca

SEQ ID NO: 39185 - RNA, 20 nt, Artificial Sequence
  MKO10039185_A_Oxr1
  gRNA
aaccugucauuguucgauaa

SEQ ID NO: 39186 - RNA, 20 nt, Artificial Sequence
  MKO10039186_A_Oxr1
  gRNA
acugccugaucagauugaaa

SEQ ID NO: 39187 - RNA, 20 nt, Artificial Sequence
  MKO10039187_A_Oxsm
  gRNA
gacaacucgucugcgcaaca

SEQ ID NO: 39188 - RNA, 20 nt, Artificial Sequence
  MKO10039188_A_Oxsm
  gRNA
ucggaucuacgcagaaauuu

SEQ ID NO: 39189 - RNA, 20 nt, Artificial Sequence
  MKO10039189_A_Oxsm
  gRNA
aguggcaugugcguugacau

SEQ ID NO: 39190 - RNA, 20 nt, Artificial Sequence
  MKO10039190_A_Oxsr1
  gRNA
ggcgaucaagcggauaaacc

SEQ ID NO: 39191 - RNA, 20 nt, Artificial Sequence
  MKO10039191_A_Oxsr1
  gRNA
gaaucugcccauucuuaugc

SEQ ID NO: 39192 - RNA, 20 nt, Artificial Sequence
  MKO10039192_A_Oxsr1
  gRNA
agggaguggagcaacugccg

SEQ ID NO: 39193 - RNA, 20 nt, Artificial Sequence
  MKO10039193_A_Oxtr
  gRNA
cggacggcgucuucgauugc

SEQ ID NO: 39194 - RNA, 20 nt, Artificial Sequence
  MKO10039194_A_Oxtr
  gRNA
cucguugcgucguggcggcc

SEQ ID NO: 39195 - RNA, 20 nt, Artificial Sequence
  MKO10039195_A_Oxtr
  gRNA
ccuauggcucaugccgagga

SEQ ID NO: 39196 - RNA, 20 nt, Artificial Sequence
  MKO10039196_A_Oxt
  gRNA
gacucaccuugcgcauaucc

SEQ ID NO: 39197 - RNA, 20 nt, Artificial Sequence
  MKO10039197_A_Oxt
  gRNA
gugggcucagcgcuccgaga

SEQ ID NO: 39198 - RNA, 20 nt, Artificial Sequence
  MKO10039198_A_Oxt
  gRNA
cagacucagggucgcaggcg

SEQ ID NO: 39199 - RNA, 20 nt, Artificial Sequence
  MKO10039199_A_P2rx1
  gRNA
cucccuacagguauucgcac

SEQ ID NO: 39200 - RNA, 20 nt, Artificial Sequence
  MKO10039200_A_P2rx1
  gRNA
aucuugucauccaccucuac

SEQ ID NO: 39201 - RNA, 20 nt, Artificial Sequence
  MKO10039201_A_P2rx1
  gRNA
uuucaucaugaccccucagc

SEQ ID NO: 39202 - RNA, 20 nt, Artificial Sequence
  MKO10039202_A_P2rx2
  gRNA
cgagacgcccaaggugaucg

SEQ ID NO: 39203 - RNA, 20 nt, Artificial Sequence
  MKO10039203_A_P2rx2
  gRNA
ccugggauucgugcaccgca

SEQ ID NO: 39204 - RNA, 20 nt, Artificial Sequence
  MKO10039204_A_P2rx2
  gRNA
ccggaccgguuucgcuaucc

SEQ ID NO: 39205 - RNA, 20 nt, Artificial Sequence
  MKO10039205_A_P2rx3
  gRNA
caauggccgugucccgcacu

SEQ ID NO: 39206 - RNA, 20 nt, Artificial Sequence
  MKO10039206_A_P2rx3
  gRNA
acgcuaugccaacagaguca

SEQ ID NO: 39207 - RNA, 20 nt, Artificial Sequence
  MKO10039207_A_P2rx3
  gRNA
gccugagcgcuucccgggug

SEQ ID NO: 39208 - RNA, 20 nt, Artificial Sequence
  MKO10039208_A_P2rx4
  gRNA
cgucaccgugaaccagacgc

SEQ ID NO: 39209 - RNA, 20 nt, Artificial Sequence
  MKO10039209_A_P2rx4
  gRNA
cugggacguggccgacuaug

SEQ ID NO: 39210 - RNA, 20 nt, Artificial Sequence
  MKO10039210_A_P2rx4
  gRNA
ucagacgccaacugcacucu

SEQ ID NO: 39211 - RNA, 20 nt, Artificial Sequence
  MKO10039211_A_P2rx5
  gRNA
gagucguuccccaagcaucg

SEQ ID NO: 39212 - RNA, 20 nt, Artificial Sequence
  MKO10039212_A_P2rx5
  gRNA
uauaccaacaccacgaugcu

SEQ ID NO: 39213 - RNA, 20 nt, Artificial Sequence
  MKO10039213_A_P2rx5
  gRNA
gaggacaccgacugucacgc

SEQ ID NO: 39214 - RNA, 20 nt, Artificial Sequence
  MKO10039214_A_P2rx6
  gRNA
guauguccccgucuccccuu

SEQ ID NO: 39215 - RNA, 20 nt, Artificial Sequence
  MKO10039215_A_P2rx6
  gRNA
gacgcccacccgacaguucc

SEQ ID NO: 39216 - RNA, 20 nt, Artificial Sequence
  MKO10039216_A_P2rx6
  gRNA
gcagugguagucuacgugau

SEQ ID NO: 39217 - RNA, 20 nt, Artificial Sequence
  MKO10039217_A_P2rx7
  gRNA
ugagcgauaagcuguaccag

SEQ ID NO: 39218 - RNA, 20 nt, Artificial Sequence
  MKO10039218_A_P2rx7
  gRNA
cauaauucgugcucuggauc

SEQ ID NO: 39219 - RNA, 20 nt, Artificial Sequence
  MKO10039219_A_P2rx7
  gRNA
ugauaacaggcucuuuccgc

SEQ ID NO: 39220 - RNA, 20 nt, Artificial Sequence
  MKO10039220_A_P2ry10
  gRNA
cucguucucgucucaugagc

SEQ ID NO: 39221 - RNA, 20 nt, Artificial Sequence
  MKO10039221_A_P2ry10
  gRNA
cgugaccaacuaucucguca

SEQ ID NO: 39222 - RNA, 20 nt, Artificial Sequence
  MKO10039222_A_P2ry10
  gRNA
agcuuccaugacgagauagu

SEQ ID NO: 39223 - RNA, 20 nt, Artificial Sequence
  MKO10039223_A_P2ry12
  gRNA
accgcuaccugaagaccacc

SEQ ID NO: 39224 - RNA, 20 nt, Artificial Sequence
  MKO10039224_A_P2ry12
  gRNA
auaagaccgauagaguucuu

SEQ ID NO: 39225 - RNA, 20 nt, Artificial Sequence
  MKO10039225_A_P2ry12
  gRNA
cguucagugacgucagccau

SEQ ID NO: 39226 - RNA, 20 nt, Artificial Sequence
  MKO10039226_A_P2ry13
  gRNA
ugggccucaucgcuuucgac

SEQ ID NO: 39227 - RNA, 20 nt, Artificial Sequence
  MKO10039227_A_P2ry13
  gRNA
aaacagucuccauuuccguc

SEQ ID NO: 39228 - RNA, 20 nt, Artificial Sequence
  MKO10039228_A_P2ry13
  gRNA
ccgacucacaccuugcgccc

SEQ ID NO: 39229 - RNA, 20 nt, Artificial Sequence
  MKO10039229_A_P2ry14
  gRNA
ucacuacagcugccggacga

SEQ ID NO: 39230 - RNA, 20 nt, Artificial Sequence
  MKO10039230_A_P2ry14
  gRNA
agaauuccaccuccgucaag

SEQ ID NO: 39231 - RNA, 20 nt, Artificial Sequence
  MKO10039231_A_P2ry14
  gRNA
cagaucauucccguguugua

SEQ ID NO: 39232 - RNA, 20 nt, Artificial Sequence
  MKO10039232_A_P2ry1
  gRNA
ugcuaccguagagauuuacg

SEQ ID NO: 39233 - RNA, 20 nt, Artificial Sequence
  MKO10039233_A_P2ry1
  gRNA
aaaggcagcauccgucccgu

SEQ ID NO: 39234 - RNA, 20 nt, Artificial Sequence
  MKO10039234_A_P2ry1
  gRNA
uguagaugaaauaacuucgc

SEQ ID NO: 39235 - RNA, 20 nt, Artificial Sequence
  MKO10039235_A_P2ry2
  gRNA
auauaagaucacccggccgc

SEQ ID NO: 39236 - RNA, 20 nt, Artificial Sequence
  MKO10039236_A_P2ry2
  gRNA
cccacaggcucgucgcaagc

SEQ ID NO: 39237 - RNA, 20 nt, Artificial Sequence
  MKO10039237_A_P2ry2
  gRNA
auacaagugucguuucaacg

SEQ ID NO: 39238 - RNA, 20 nt, Artificial Sequence
  MKO10039238_A_P2ry4
  gRNA
auccacugcgggcaauacgc

SEQ ID NO: 39239 - RNA, 20 nt, Artificial Sequence
  MKO10039239_A_P2ry4
  gRNA
gacuguugaacgccgaaugc

SEQ ID NO: 39240 - RNA, 20 nt, Artificial Sequence
  MKO10039240_A_P2ry4
  gRNA
ccccagcguauugcccgcag

SEQ ID NO: 39241 - RNA, 20 nt, Artificial Sequence
  MKO10039241_A_P2ry6
  gRNA
uccggcgggaugcgcagauc

SEQ ID NO: 39242 - RNA, 20 nt, Artificial Sequence
  MKO10039242_A_P2ry6
  gRNA
cccagaucugcgcaucccgc

SEQ ID NO: 39243 - RNA, 20 nt, Artificial Sequence
  MKO10039243_A_P2ry6
  gRNA
cuuaucuauaacuacgccag

SEQ ID NO: 39244 - RNA, 20 nt, Artificial Sequence
  MKO10039244_A_P4ha1
  gRNA
uuguugcuguacucguuagc

SEQ ID NO: 39245 - RNA, 20 nt, Artificial Sequence
  MKO10039245_A_P4ha1
  gRNA
gagcuaugcgguguaccagc

SEQ ID NO: 39246 - RNA, 20 nt, Artificial Sequence
  MKO10039246_A_P4ha1
  gRNA
gcugguacaccgcauagcuc

SEQ ID NO: 39247 - RNA, 20 nt, Artificial Sequence
  MKO10039247_A_P4ha2
  gRNA
cgaucugauuuacgcagaga

SEQ ID NO: 39248 - RNA, 20 nt, Artificial Sequence
  MKO10039248_A_P4ha2
  gRNA
cagaucagcugccgaccccg

SEQ ID NO: 39249 - RNA, 20 nt, Artificial Sequence
  MKO10039249_A_P4ha2
  gRNA
gauccggacacgauuuccag

SEQ ID NO: 39250 - RNA, 20 nt, Artificial Sequence
  MKO10039250_A_P4ha3
  gRNA
ucaaacgucugcaguccgac

SEQ ID NO: 39251 - RNA, 20 nt, Artificial Sequence
  MKO10039251_A_P4ha3
  gRNA
ggccagucuggaagacgccc

SEQ ID NO: 39252 - RNA, 20 nt, Artificial Sequence
  MKO10039252_A_P4ha3
  gRNA
acacauccugcagccgcauc

SEQ ID NO: 39253 - RNA, 20 nt, Artificial Sequence
  MKO10039253_A_P4hb
  gRNA
ucaagcgaagugacggucau

SEQ ID NO: 39254 - RNA, 20 nt, Artificial Sequence
  MKO10039254_A_P4hb
  gRNA
cucugagauucgacuagcaa

SEQ ID NO: 39255 - RNA, 20 nt, Artificial Sequence
  MKO10039255_A_P4hb
  gRNA
uuuacagaugccccguggug

SEQ ID NO: 39256 - RNA, 20 nt, Artificial Sequence
  MKO10039256_A_P4htm
  gRNA
gccgacacuccucgucacuc

SEQ ID NO: 39257 - RNA, 20 nt, Artificial Sequence
  MKO10039257_A_P4htm
  gRNA
ucaugcgugccauccgccag

SEQ ID NO: 39258 - RNA, 20 nt, Artificial Sequence
  MKO10039258_A_P4htm
  gRNA
gugucggcucaucauccacc

SEQ ID NO: 39259 - RNA, 20 nt, Artificial Sequence
  MKO10039259_A_Pa2g4
  gRNA
cccaggggugcuucgaucuu

SEQ ID NO: 39260 - RNA, 20 nt, Artificial Sequence
  MKO10039260_A_Pa2g4
  gRNA
uuacaggggacccagguaac

SEQ ID NO: 39261 - RNA, 20 nt, Artificial Sequence
  MKO10039261_A_Pa2g4
  gRNA
guaaggcagcuucagcacau

SEQ ID NO: 39262 - RNA, 20 nt, Artificial Sequence
  MKO10039262_A_Pabpc1l
  gRNA
gaagaaccugcacgcgaacg

SEQ ID NO: 39263 - RNA, 20 nt, Artificial Sequence
  MKO10039263_A_Pabpc1l
  gRNA
gcucguccacguucgcgugc

SEQ ID NO: 39264 - RNA, 20 nt, Artificial Sequence
  MKO10039264_A_Pabpc1l
  gRNA
gccagcccauccgaaucaug

SEQ ID NO: 39265 - RNA, 20 nt, Artificial Sequence
  MKO10039265_A_Pabpc1
  gRNA
ucuuguagcggaacgugcuu

SEQ ID NO: 39266 - RNA, 20 nt, Artificial Sequence
  MKO10039266_A_Pabpc1
  gRNA
gauccaucacuucgcaaaag

SEQ ID NO: 39267 - RNA, 20 nt, Artificial Sequence
  MKO10039267_A_Pabpc1
  gRNA
uuguuggacgauuuaaaucu

SEQ ID NO: 39268 - RNA, 20 nt, Artificial Sequence
  MKO10039268_A_Pabpc2
  gRNA
cgugaucacacgccguuccc

SEQ ID NO: 39269 - RNA, 20 nt, Artificial Sequence
  MKO10039269_A_Pabpc2
  gRNA
acaguagucaacgacgaucu

SEQ ID NO: 39270 - RNA, 20 nt, Artificial Sequence
  MKO10039270_A_Pabpc2
  gRNA
agcgugauccaucacuucgc

SEQ ID NO: 39271 - RNA, 20 nt, Artificial Sequence
  MKO10039271_A_Pabpc4l
  gRNA
cgaugaugaaacacugcgca

SEQ ID NO: 39272 - RNA, 20 nt, Artificial Sequence
  MKO10039272_A_Pabpc4l
  gRNA
uggccaaacuuugaguguua

SEQ ID NO: 39273 - RNA, 20 nt, Artificial Sequence
  MKO10039273_A_Pabpc4l
  gRNA
uugagaccacaugagacgaa

SEQ ID NO: 39274 - RNA, 20 nt, Artificial Sequence
  MKO10039274_A_Pabpc4
  gRNA
uuugacagcugagagggccu

SEQ ID NO: 39275 - RNA, 20 nt, Artificial Sequence
  MKO10039275_A_Pabpc4
  gRNA
acucaccgucagcuggcugc

SEQ ID NO: 39276 - RNA, 20 nt, Artificial Sequence
  MKO10039276_A_Pabpc4
  gRNA
aacuuccagcagccagcuga

SEQ ID NO: 39277 - RNA, 20 nt, Artificial Sequence
  MKO10039277_A_Pabpc5
  gRNA
caugugccagauagcccuau

SEQ ID NO: 39278 - RNA, 20 nt, Artificial Sequence
  MKO10039278_A_Pabpc5
  gRNA
aucuccgccuuaauucagcc

SEQ ID NO: 39279 - RNA, 20 nt, Artificial Sequence
  MKO10039279_A_Pabpc5
  gRNA
aaagucguaugugaugacaa

SEQ ID NO: 39280 - RNA, 20 nt, Artificial Sequence
  MKO10039280_A_Pabpc6
  gRNA
acgaugucguauagccugug

SEQ ID NO: 39281 - RNA, 20 nt, Artificial Sequence
  MKO10039281_A_Pabpc6
  gRNA
gcuuuaagucucguagagac

SEQ ID NO: 39282 - RNA, 20 nt, Artificial Sequence
  MKO10039282_A_Pabpc6
  gRNA
gcuuacgaauccgaauccuu

SEQ ID NO: 39283 - RNA, 20 nt, Artificial Sequence
  MKO10039283_A_Pabpn1l
  gRNA
gacccggugaaucuccccac

SEQ ID NO: 39284 - RNA, 20 nt, Artificial Sequence
  MKO10039284_A_Pabpn1l
  gRNA
agguuccuaccuacggucuc

SEQ ID NO: 39285 - RNA, 20 nt, Artificial Sequence
  MKO10039285_A_Pabpn1l
  gRNA
guccagagaacuugucgcac

SEQ ID NO: 39286 - RNA, 20 nt, Artificial Sequence
  MKO10039286_A_Pabpn1
  gRNA
aagcgaucaaagcucgaguc

SEQ ID NO: 39287 - RNA, 20 nt, Artificial Sequence
  MKO10039287_A_Pabpn1
  gRNA
gaugcccgcucuaucuacgu

SEQ ID NO: 39288 - RNA, 20 nt, Artificial Sequence
  MKO10039288_A_Pabpn1
  gRNA
gaucuacucaccauugccug

SEQ ID NO: 39289 - RNA, 20 nt, Artificial Sequence
  MKO10039289_A_Pacrgl
  gRNA
cugcaagaagggcucguccu

SEQ ID NO: 39290 - RNA, 20 nt, Artificial Sequence
  MKO10039290_A_Pacrgl
  gRNA
gcuucuaauuacguuagcug

SEQ ID NO: 39291 - RNA, 20 nt, Artificial Sequence
  MKO10039291_A_Pacrgl
  gRNA
ucagcuaacguaauuagaag

SEQ ID NO: 39292 - RNA, 20 nt, Artificial Sequence
  MKO10039292_A_Pacrg
  gRNA
cuccccuccguagcgcucga

SEQ ID NO: 39293 - RNA, 20 nt, Artificial Sequence
  MKO10039293_A_Pacrg
  gRNA
ucgccgagcaaaaaacucau

SEQ ID NO: 39294 - RNA, 20 nt, Artificial Sequence
  MKO10039294_A_Pacrg
  gRNA
guucagcaagcacgacucau

SEQ ID NO: 39295 - RNA, 20 nt, Artificial Sequence
  MKO10039295_A_Pacs1
  gRNA
agcugugggacucaucaaca

SEQ ID NO: 39296 - RNA, 20 nt, Artificial Sequence
  MKO10039296_A_Pacs1
  gRNA
guacaagaaccgaacuaucu

SEQ ID NO: 39297 - RNA, 20 nt, Artificial Sequence
  MKO10039297_A_Pacs1
  gRNA
aguacuaaagcgcccucauu

SEQ ID NO: 39298 - RNA, 20 nt, Artificial Sequence
  MKO10039298_A_Pacs2
  gRNA
cagaacuuggccgcccucag

SEQ ID NO: 39299 - RNA, 20 nt, Artificial Sequence
  MKO10039299_A_Pacs2
  gRNA
cugucaagguggccgagauc

SEQ ID NO: 39300 - RNA, 20 nt, Artificial Sequence
  MKO10039300_A_Pacs2
  gRNA
guacaagaacaggacgaucc

SEQ ID NO: 39301 - RNA, 20 nt, Artificial Sequence
  MKO10039301_A_Pacsin1
  gRNA
cgcguaugccuucucgaucu

SEQ ID NO: 39302 - RNA, 20 nt, Artificial Sequence
  MKO10039302_A_Pacsin1
  gRNA
acggugaagcgcaucgacga

SEQ ID NO: 39303 - RNA, 20 nt, Artificial Sequence
  MKO10039303_A_Pacsin1
  gRNA
gaugccguuugauauccagc

SEQ ID NO: 39304 - RNA, 20 nt, Artificial Sequence
  MKO10039304_A_Pacsin2
  gRNA
gggaacuuaccuagccacau

SEQ ID NO: 39305 - RNA, 20 nt, Artificial Sequence
  MKO10039305_A_Pacsin2
  gRNA
acugugaagcggauugacga

SEQ ID NO: 39306 - RNA, 20 nt, Artificial Sequence
  MKO10039306_A_Pacsin2
  gRNA
gcaccacacagcgugcaaag

SEQ ID NO: 39307 - RNA, 20 nt, Artificial Sequence
  MKO10039307_A_Pacsin3
  gRNA
ucucaaugcgggcacguucu

SEQ ID NO: 39308 - RNA, 20 nt, Artificial Sequence
  MKO10039308_A_Pacsin3
  gRNA
uguagcgauuuagcucggcc

SEQ ID NO: 39309 - RNA, 20 nt, Artificial Sequence
  MKO10039309_A_Pacsin3
  gRNA
ucgcuacaccccacgcuaca

SEQ ID NO: 39310 - RNA, 20 nt, Artificial Sequence
  MKO10039310_A_Padi1
  gRNA
ucgagaguggcagagcccgc

SEQ ID NO: 39311 - RNA, 20 nt, Artificial Sequence
  MKO10039311_A_Padi1
  gRNA
gugucccuugaugucgacac

SEQ ID NO: 39312 - RNA, 20 nt, Artificial Sequence
  MKO10039312_A_Padi1
  gRNA
cacuaccaccacguccacgu

SEQ ID NO: 39313 - RNA, 20 nt, Artificial Sequence
  MKO10039313_A_Padi2
  gRNA
aagguggaggucguacguga

SEQ ID NO: 39314 - RNA, 20 nt, Artificial Sequence
  MKO10039314_A_Padi2
  gRNA
ccaugguaccuugucgcugc

SEQ ID NO: 39315 - RNA, 20 nt, Artificial Sequence
  MKO10039315_A_Padi2
  gRNA
gggcucuuccucacggccau

SEQ ID NO: 39316 - RNA, 20 nt, Artificial Sequence
  MKO10039316_A_Padi3
  gRNA
guggugcuucaacaagggcc

SEQ ID NO: 39317 - RNA, 20 nt, Artificial Sequence
  MKO10039317_A_Padi3
  gRNA
aacucacauggcugucguug

SEQ ID NO: 39318 - RNA, 20 nt, Artificial Sequence
  MKO10039318_A_Padi3
  gRNA
cuugcaggcaacgcacauau

SEQ ID NO: 39319 - RNA, 20 nt, Artificial Sequence
  MKO10039319_A_Padi4
  gRNA
cggccguggcgccauccugu

SEQ ID NO: 39320 - RNA, 20 nt, Artificial Sequence
  MKO10039320_A_Padi4
  gRNA
agcgcagaugucacccgcac

SEQ ID NO: 39321 - RNA, 20 nt, Artificial Sequence
  MKO10039321_A_Padi4
  gRNA
uagguucgaguuucauacua

SEQ ID NO: 39322 - RNA, 20 nt, Artificial Sequence
  MKO10039322_A_Padi6
  gRNA
guccucuuugccagcgauga

SEQ ID NO: 39323 - RNA, 20 nt, Artificial Sequence
  MKO10039323_A_Padi6
  gRNA
caucuaucgagauggacaac

SEQ ID NO: 39324 - RNA, 20 nt, Artificial Sequence
  MKO10039324_A_Padi6
  gRNA
cucgauagaugucugccucc

SEQ ID NO: 39325 - RNA, 20 nt, Artificial Sequence
  MKO10039325_A_Paf1
  gRNA
guccuaccuguucuggucga

SEQ ID NO: 39326 - RNA, 20 nt, Artificial Sequence
  MKO10039326_A_Paf1
  gRNA
ccuaccccuucgaccagaac

SEQ ID NO: 39327 - RNA, 20 nt, Artificial Sequence
  MKO10039327_A_Paf1
  gRNA
accuaccgcauugaucccaa

SEQ ID NO: 39328 - RNA, 20 nt, Artificial Sequence
  MKO10039328_A_Pafah1b1
  gRNA
aaucgucauaucugcugaac

SEQ ID NO: 39329 - RNA, 20 nt, Artificial Sequence
  MKO10039329_A_Pafah1b1
  gRNA
uggaaaaugacucgaguaac

SEQ ID NO: 39330 - RNA, 20 nt, Artificial Sequence
  MKO10039330_A_Pafah1b1
  gRNA
uucagaggaugcuacaauua

SEQ ID NO: 39331 - RNA, 20 nt, Artificial Sequence
  MKO10039331_A_Pafah1b2
  gRNA
cgaagcccccgucuauauca

SEQ ID NO: 39332 - RNA, 20 nt, Artificial Sequence
  MKO10039332_A_Pafah1b2
  gRNA
cauuauaggucauuguuguc

SEQ ID NO: 39333 - RNA, 20 nt, Artificial Sequence
  MKO10039333_A_Pafah1b2
  gRNA
acagcuaaugcagcaguacg

SEQ ID NO: 39334 - RNA, 20 nt, Artificial Sequence
  MKO10039334_A_Pafah1b3
  gRNA
guccccgauaaagacuacuu

SEQ ID NO: 39335 - RNA, 20 nt, Artificial Sequence
  MKO10039335_A_Pafah1b3
  gRNA
gcagcaccaucgguuuguag

SEQ ID NO: 39336 - RNA, 20 nt, Artificial Sequence
  MKO10039336_A_Pafah1b3
  gRNA
uuaccuacaccugagccgcc

SEQ ID NO: 39337 - RNA, 20 nt, Artificial Sequence
  MKO10039337_A_Pafah2
  gRNA
cccagcgcuuguuauacugc

SEQ ID NO: 39338 - RNA, 20 nt, Artificial Sequence
  MKO10039338_A_Pafah2
  gRNA
gcuccccuuccgucgcauca

SEQ ID NO: 39339 - RNA, 20 nt, Artificial Sequence
  MKO10039339_A_Pafah2
  gRNA
gacccaugcuguacucguag

SEQ ID NO: 39340 - RNA, 20 nt, Artificial Sequence
  MKO10039340_A_Pag1
  gRNA
cgcgaacgcagagagcauuc

SEQ ID NO: 39341 - RNA, 20 nt, Artificial Sequence
  MKO10039341_A_Pag1
  gRNA
ugcucucugcguucgcgcug

SEQ ID NO: 39342 - RNA, 20 nt, Artificial Sequence
  MKO10039342_A_Pag1
  gRNA
gcagaacuuacugucgccau

SEQ ID NO: 39343 - RNA, 20 nt, Artificial Sequence
  MKO10039343_A_Pagr1a
  gRNA
ccagacgcgccucccguuuc

SEQ ID NO: 39344 - RNA, 20 nt, Artificial Sequence
  MKO10039344_A_Pagr1a
  gRNA
agguggagcugccggccaau

SEQ ID NO: 39345 - RNA, 20 nt, Artificial Sequence
  MKO10039345_A_Pagr1a
  gRNA
cagucaguacuuccgcuguc

SEQ ID NO: 39346 - RNA, 20 nt, Artificial Sequence
  MKO10039346_A_Pah
  gRNA
cuugcuacgcuuauccagau

SEQ ID NO: 39347 - RNA, 20 nt, Artificial Sequence
  MKO10039347_A_Pah
  gRNA
gacuuacuggcgguaguugu

SEQ ID NO: 39348 - RNA, 20 nt, Artificial Sequence
  MKO10039348_A_Pah
  gRNA
uaagcguagcaagcccgucc

SEQ ID NO: 39349 - RNA, 20 nt, Artificial Sequence
  MKO10039349_A_Paics
  gRNA
auucccgcaguagugaacau

SEQ ID NO: 39350 - RNA, 20 nt, Artificial Sequence
  MKO10039350_A_Paics
  gRNA
uaugaguuguuagacacccc

SEQ ID NO: 39351 - RNA, 20 nt, Artificial Sequence
  MKO10039351_A_Paics
  gRNA
uaucaaccagcguacagucc

SEQ ID NO: 39352 - RNA, 20 nt, Artificial Sequence
  MKO10039352_A_Paip1
  gRNA
guggacuaauugucagauga

SEQ ID NO: 39353 - RNA, 20 nt, Artificial Sequence
  MKO10039353_A_Paip1
  gRNA
gacucucucagaauacguuc

SEQ ID NO: 39354 - RNA, 20 nt, Artificial Sequence
  MKO10039354_A_Paip1
  gRNA
uccgccaauugcuacuucaa

SEQ ID NO: 39355 - RNA, 20 nt, Artificial Sequence
  MKO10039355_A_Paip2b
  gRNA
cagaugacgacgcugaacac

SEQ ID NO: 39356 - RNA, 20 nt, Artificial Sequence
  MKO10039356_A_Paip2b
  gRNA
ccucauguccauuuaauccu

SEQ ID NO: 39357 - RNA, 20 nt, Artificial Sequence
  MKO10039357_A_Paip2b
  gRNA
gugcugggaugaaccagucc

SEQ ID NO: 39358 - RNA, 20 nt, Artificial Sequence
  MKO10039358_A_Paip2
  gRNA
acaucgucauugaugaugcu

SEQ ID NO: 39359 - RNA, 20 nt, Artificial Sequence
  MKO10039359_A_Paip2
  gRNA
ucgagaucucccacaaacua

SEQ ID NO: 39360 - RNA, 20 nt, Artificial Sequence
  MKO10039360_A_Paip2
  gRNA
guuugugggagaucucgagc

SEQ ID NO: 39361 - RNA, 20 nt, Artificial Sequence
  MKO10039361_A_Pak1ip1
  gRNA
agagacuacauagcgacugu

SEQ ID NO: 39362 - RNA, 20 nt, Artificial Sequence
  MKO10039362_A_Pak1ip1
  gRNA
aacagucgcuauguagucuc

SEQ ID NO: 39363 - RNA, 20 nt, Artificial Sequence
  MKO10039363_A_Pak1ip1
  gRNA
aagacggccacaucugcauc

SEQ ID NO: 39364 - RNA, 20 nt, Artificial Sequence
  MKO10039364_A_Pak1
  gRNA
agcaagcgagcccacuguuc

SEQ ID NO: 39365 - RNA, 20 nt, Artificial Sequence
  MKO10039365_A_Pak1
  gRNA
ugcugucacaggggaguuua

SEQ ID NO: 39366 - RNA, 20 nt, Artificial Sequence
  MKO10039366_A_Pak1
  gRNA
acucauguacuucugacuau

SEQ ID NO: 39367 - RNA, 20 nt, Artificial Sequence
  MKO10039367_A_Pak2
  gRNA
aacagccgcgcccacuguuc

SEQ ID NO: 39368 - RNA, 20 nt, Artificial Sequence
  MKO10039368_A_Pak2
  gRNA
cuccucccgucauugccccu

SEQ ID NO: 39369 - RNA, 20 nt, Artificial Sequence
  MKO10039369_A_Pak2
  gRNA
guucuucuucugcucgaguu

SEQ ID NO: 39370 - RNA, 20 nt, Artificial Sequence
  MKO10039370_A_Pak3
  gRNA
aguagucgugcccauugcuc

SEQ ID NO: 39371 - RNA, 20 nt, Artificial Sequence
  MKO10039371_A_Pak3
  gRNA
aaauauaugagcuuuacguc

SEQ ID NO: 39372 - RNA, 20 nt, Artificial Sequence
  MKO10039372_A_Pak3
  gRNA
cuuugagcauacgauucaug

SEQ ID NO: 39373 - RNA, 20 nt, Artificial Sequence
  MKO10039373_A_Pak4
  gRNA
cgcgauaagcgcccacucuc

SEQ ID NO: 39374 - RNA, 20 nt, Artificial Sequence
  MKO10039374_A_Pak4
  gRNA
cuaccggcacgagaacgugg

SEQ ID NO: 39375 - RNA, 20 nt, Artificial Sequence
  MKO10039375_A_Pak4
  gRNA
acagaucgccgccgugugcc

SEQ ID NO: 39376 - RNA, 20 nt, Artificial Sequence
  MKO10039376_A_Pak6
  gRNA
ugccaagcauagcuccgaag

SEQ ID NO: 39377 - RNA, 20 nt, Artificial Sequence
  MKO10039377_A_Pak6
  gRNA
ggggaucagugugcuccgac

SEQ ID NO: 39378 - RNA, 20 nt, Artificial Sequence
  MKO10039378_A_Pak6
  gRNA
uguacaucuccaccacguug

SEQ ID NO: 39379 - RNA, 20 nt, Artificial Sequence
  MKO10039379_A_Pak7
  gRNA
uguguaguccgcagucguau

SEQ ID NO: 39380 - RNA, 20 nt, Artificial Sequence
  MKO10039380_A_Pak7
  gRNA
cagugaauccgauacgacug

SEQ ID NO: 39381 - RNA, 20 nt, Artificial Sequence
  MKO10039381_A_Pak7
  gRNA
gccaucgcuugucagaagaa

SEQ ID NO: 39382 - RNA, 20 nt, Artificial Sequence
  MKO10039382_A_Palb2
  gRNA
gacgaccgccuuaguagcuu

SEQ ID NO: 39383 - RNA, 20 nt, Artificial Sequence
  MKO10039383_A_Palb2
  gRNA
cuccuugguaagcaucgaaa

SEQ ID NO: 39384 - RNA, 20 nt, Artificial Sequence
  MKO10039384_A_Palb2
  gRNA
acugcugcgccuaacgacag

SEQ ID NO: 39385 - RNA, 20 nt, Artificial Sequence
  MKO10039385_A_Pald1
  gRNA
ucaccuugaguccguccguc

SEQ ID NO: 39386 - RNA, 20 nt, Artificial Sequence
  MKO10039386_A_Pald1
  gRNA
gucuuacacaccucgagaca

SEQ ID NO: 39387 - RNA, 20 nt, Artificial Sequence
  MKO10039387_A_Pald1
  gRNA
gcgcggggagccgcacaccg

SEQ ID NO: 39388 - RNA, 20 nt, Artificial Sequence
  MKO10039388_A_Palld
  gRNA
ccuaucugugcccguccaac

SEQ ID NO: 39389 - RNA, 20 nt, Artificial Sequence
  MKO10039389_A_Palld
  gRNA
cacaggucgcuacacguguc

SEQ ID NO: 39390 - RNA, 20 nt, Artificial Sequence
  MKO10039390_A_Palld
  gRNA
acguccguuuccuuaacgau

SEQ ID NO: 39391 - RNA, 20 nt, Artificial Sequence
  MKO10039391_A_Palm2
  gRNA
ucugcucuuuggcggauauc

SEQ ID NO: 39392 - RNA, 20 nt, Artificial Sequence
  MKO10039392_A_Palm2
  gRNA
gagacgacagcuugacgaac

SEQ ID NO: 39393 - RNA, 20 nt, Artificial Sequence
  MKO10039393_A_Palm2
  gRNA
cgccaaagagcagaucaucc

SEQ ID NO: 39394 - RNA, 20 nt, Artificial Sequence
  MKO10039394_A_Palm3
  gRNA
ccaggcucgaauucgcaacc

SEQ ID NO: 39395 - RNA, 20 nt, Artificial Sequence
  MKO10039395_A_Palm3
  gRNA
cuccuccagcucgcgacgcg

SEQ ID NO: 39396 - RNA, 20 nt, Artificial Sequence
  MKO10039396_A_Palm3
  gRNA
aggagaaacuccgcguggag

SEQ ID NO: 39397 - RNA, 20 nt, Artificial Sequence
  MKO10039397_A_Palmd
  gRNA
cuucagaauugccucuucgu

SEQ ID NO: 39398 - RNA, 20 nt, Artificial Sequence
  MKO10039398_A_Palmd
  gRNA
gcaaaucucagccaacgaag

SEQ ID NO: 39399 - RNA, 20 nt, Artificial Sequence
  MKO10039399_A_Palmd
  gRNA
uaucuuacaguccgugaagg

SEQ ID NO: 39400 - RNA, 20 nt, Artificial Sequence
  MKO10039400_A_Palm
  gRNA
uggcuugaagccgcuccugc

SEQ ID NO: 39401 - RNA, 20 nt, Artificial Sequence
  MKO10039401_A_Palm
  gRNA
accuggugauggauuccucc

SEQ ID NO: 39402 - RNA, 20 nt, Artificial Sequence
  MKO10039402_A_Palm
  gRNA
cauguccucgucgcccucug

SEQ ID NO: 39403 - RNA, 20 nt, Artificial Sequence
  MKO10039403_A_Pam16
  gRNA
uccucagguuguccgugcaa

SEQ ID NO: 39404 - RNA, 20 nt, Artificial Sequence
  MKO10039404_A_Pam16
  gRNA
uugcccacaggccaaguacc

SEQ ID NO: 39405 - RNA, 20 nt, Artificial Sequence
  MKO10039405_A_Pam16
  gRNA
ccucaccuucuggaccuccu

SEQ ID NO: 39406 - RNA, 20 nt, Artificial Sequence
  MKO10039406_A_Pamr1
  gRNA
ucuggaugacuucuacguga

SEQ ID NO: 39407 - RNA, 20 nt, Artificial Sequence
  MKO10039407_A_Pamr1
  gRNA
cucaccugggugaauuagac

SEQ ID NO: 39408 - RNA, 20 nt, Artificial Sequence
  MKO10039408_A_Pamr1
  gRNA
cucaaagggucagaucuugu

SEQ ID NO: 39409 - RNA, 20 nt, Artificial Sequence
  MKO10039409_A_Pam
  gRNA
acacuggauauucgcaugcc

SEQ ID NO: 39410 - RNA, 20 nt, Artificial Sequence
  MKO10039410_A_Pam
  gRNA
accucuuuaggugugacccc

SEQ ID NO: 39411 - RNA, 20 nt, Artificial Sequence
  MKO10039411_A_Pam
  gRNA
guccaccauaugcugcuguu

SEQ ID NO: 39412 - RNA, 20 nt, Artificial Sequence
  MKO10039412_A_Pan2
  gRNA
ggcuucuccagucgccuuac

SEQ ID NO: 39413 - RNA, 20 nt, Artificial Sequence
  MKO10039413_A_Pan2
  gRNA
ggagcgcuacucauccuuuc

SEQ ID NO: 39414 - RNA, 20 nt, Artificial Sequence
  MKO10039414_A_Pan2
  gRNA
ugcgcagaucguacacuuug

SEQ ID NO: 39415 - RNA, 20 nt, Artificial Sequence
  MKO10039415_A_Pan3
  gRNA
gcaagcgaauuuauaccuaa

SEQ ID NO: 39416 - RNA, 20 nt, Artificial Sequence
  MKO10039416_A_Pan3
  gRNA
gguauaaauucgcuugcagu

SEQ ID NO: 39417 - RNA, 20 nt, Artificial Sequence
  MKO10039417_A_Pan3
  gRNA
aucuuaccguggccugugua

SEQ ID NO: 39418 - RNA, 20 nt, Artificial Sequence
  MKO10039418_A_Pank1
  gRNA
caaccgagucaacguaaaga

SEQ ID NO: 39419 - RNA, 20 nt, Artificial Sequence
  MKO10039419_A_Pank1
  gRNA
cuucuuuacguugacucggu

SEQ ID NO: 39420 - RNA, 20 nt, Artificial Sequence
  MKO10039420_A_Pank1
  gRNA
ugggauccgggacguccauc

SEQ ID NO: 39421 - RNA, 20 nt, Artificial Sequence
  MKO10039421_A_Pank2
  gRNA
gugcacgucccgaaugccug

SEQ ID NO: 39422 - RNA, 20 nt, Artificial Sequence
  MKO10039422_A_Pank2
  gRNA
ugaccuucagcuucgaaaac

SEQ ID NO: 39423 - RNA, 20 nt, Artificial Sequence
  MKO10039423_A_Pank2
  gRNA
ggacgugcaccuugagcuga

SEQ ID NO: 39424 - RNA, 20 nt, Artificial Sequence
  MKO10039424_A_Pank3
  gRNA
cuagaugccaccgcccaacc

SEQ ID NO: 39425 - RNA, 20 nt, Artificial Sequence
  MKO10039425_A_Pank3
  gRNA
agcacucagcaccguuugua

SEQ ID NO: 39426 - RNA, 20 nt, Artificial Sequence
  MKO10039426_A_Pank3
  gRNA
uuggcaucgcucggguucug

SEQ ID NO: 39427 - RNA, 20 nt, Artificial Sequence
  MKO10039427_A_Pank4
  gRNA
acuugccuaccuuucccggg

SEQ ID NO: 39428 - RNA, 20 nt, Artificial Sequence
  MKO10039428_A_Pank4
  gRNA
gcugaagaacaucccgcaug

SEQ ID NO: 39429 - RNA, 20 nt, Artificial Sequence
  MKO10039429_A_Pank4
  gRNA
gacgcagcuucuccucgaug

SEQ ID NO: 39430 - RNA, 20 nt, Artificial Sequence
  MKO10039430_A_Panx1
  gRNA
agucuacaaccgcgccauca

SEQ ID NO: 39431 - RNA, 20 nt, Artificial Sequence
  MKO10039431_A_Panx1
  gRNA
acucguccgagagugaagag

SEQ ID NO: 39432 - RNA, 20 nt, Artificial Sequence
  MKO10039432_A_Panx1
  gRNA
ugccaagagugcucgagauu

SEQ ID NO: 39433 - RNA, 20 nt, Artificial Sequence
  MKO10039433_A_Panx2
  gRNA
gugcgcgaccuucggccgcu

SEQ ID NO: 39434 - RNA, 20 nt, Artificial Sequence
  MKO10039434_A_Panx2
  gRNA
gcgcuacccaccggcccguc

SEQ ID NO: 39435 - RNA, 20 nt, Artificial Sequence
  MKO10039435_A_Panx2
  gRNA
uucgaccgcguggucaccau

SEQ ID NO: 39436 - RNA, 20 nt, Artificial Sequence
  MKO10039436_A_Panx3
  gRNA
cucgcuggcucaccauacgc

SEQ ID NO: 39437 - RNA, 20 nt, Artificial Sequence
  MKO10039437_A_Panx3
  gRNA
uuacaaccguuccauccgcc

SEQ ID NO: 39438 - RNA, 20 nt, Artificial Sequence
  MKO10039438_A_Panx3
  gRNA
auucaaaguaccguuccuuc

SEQ ID NO: 39439 - RNA, 20 nt, Artificial Sequence
  MKO10039439_A_Paox
  gRNA
gucucuccuaguggcuacca

SEQ ID NO: 39440 - RNA, 20 nt, Artificial Sequence
  MKO10039440_A_Paox
  gRNA
ugcccuccuaggugguguag

SEQ ID NO: 39441 - RNA, 20 nt, Artificial Sequence
  MKO10039441_A_Paox
  gRNA
guggaguaccugucacucuc

SEQ ID NO: 39442 - RNA, 20 nt, Artificial Sequence
  MKO10039442_A_Papd4
  gRNA
cgcugccguuuaccaucaag

SEQ ID NO: 39443 - RNA, 20 nt, Artificial Sequence
  MKO10039443_A_Papd4
  gRNA
uacuuccuuccucgaaauaa

SEQ ID NO: 39444 - RNA, 20 nt, Artificial Sequence
  MKO10039444_A_Papd4
  gRNA
acauacgugggaagagcagc

SEQ ID NO: 39445 - RNA, 20 nt, Artificial Sequence
  MKO10039445_A_Papd5
  gRNA
cgccuccgagucuaccgacc

SEQ ID NO: 39446 - RNA, 20 nt, Artificial Sequence
  MKO10039446_A_Papd5
  gRNA
ucccucguccccgcgaccgg

SEQ ID NO: 39447 - RNA, 20 nt, Artificial Sequence
  MKO10039447_A_Papd5
  gRNA
cuacagugacaucgaucuug

SEQ ID NO: 39448 - RNA, 20 nt, Artificial Sequence
  MKO10039448_A_Papd7
  gRNA
agcccuccggaagcacaacg

SEQ ID NO: 39449 - RNA, 20 nt, Artificial Sequence
  MKO10039449_A_Papd7
  gRNA
gcuuguuccaacaacuguaa

SEQ ID NO: 39450 - RNA, 20 nt, Artificial Sequence
  MKO10039450_A_Papd7
  gRNA
cuccuacagccucauccuaa

SEQ ID NO: 39451 - RNA, 20 nt, Artificial Sequence
  MKO10039451_A_Papln
  gRNA
cggaagucccgcacgccguc

SEQ ID NO: 39452 - RNA, 20 nt, Artificial Sequence
  MKO10039452_A_Papln
  gRNA
gccaccgguagcgccgaccc

SEQ ID NO: 39453 - RNA, 20 nt, Artificial Sequence
  MKO10039453_A_Papln
  gRNA
gcaggggcuccauucgcccc

SEQ ID NO: 39454 - RNA, 20 nt, Artificial Sequence
  MKO10039454_A_Papl
  gRNA
accaggacaaugcucgcguu

SEQ ID NO: 39455 - RNA, 20 nt, Artificial Sequence
  MKO10039455_A_Papl
  gRNA
ccccaacgcgagcauugucc

SEQ ID NO: 39456 - RNA, 20 nt, Artificial Sequence
  MKO10039456_A_Papl
  gRNA
gguccauuggagcccccgcc

SEQ ID NO: 39457 - RNA, 20 nt, Artificial Sequence
  MKO10039457_A_Papola
  gRNA
ugugaucccugcguuguaac

SEQ ID NO: 39458 - RNA, 20 nt, Artificial Sequence
  MKO10039458_A_Papola
  gRNA
ucacuucgaucaacaugucu

SEQ ID NO: 39459 - RNA, 20 nt, Artificial Sequence
  MKO10039459_A_Papola
  gRNA
uugggggccgcuaagcugau

SEQ ID NO: 39460 - RNA, 20 nt, Artificial Sequence
  MKO10039460_A_Papolb
  gRNA
acguucggcucuuaccgauu

SEQ ID NO: 39461 - RNA, 20 nt, Artificial Sequence
  MKO10039461_A_Papolb
  gRNA
uaagaagccuuaacgguugc

SEQ ID NO: 39462 - RNA, 20 nt, Artificial Sequence
  MKO10039462_A_Papolb
  gRNA
gugcguugcaccaagacacg

SEQ ID NO: 39463 - RNA, 20 nt, Artificial Sequence
  MKO10039463_A_Papolg
  gRNA
cauaaugcuucuguugacgc

SEQ ID NO: 39464 - RNA, 20 nt, Artificial Sequence
  MKO10039464_A_Papolg
  gRNA
cagcgucaacagaagcauua

SEQ ID NO: 39465 - RNA, 20 nt, Artificial Sequence
  MKO10039465_A_Papolg
  gRNA
uauuauaggcugguuguucu

SEQ ID NO: 39466 - RNA, 20 nt, Artificial Sequence
  MKO10039466_A_Pappa2
  gRNA
ugggggcgauugccgccugc

SEQ ID NO: 39467 - RNA, 20 nt, Artificial Sequence
  MKO10039467_A_Pappa2
  gRNA
gcuaguagucgugaccaguu

SEQ ID NO: 39468 - RNA, 20 nt, Artificial Sequence
  MKO10039468_A_Pappa2
  gRNA
agcaaugcauccgggccacu

SEQ ID NO: 39469 - RNA, 20 nt, Artificial Sequence
  MKO10039469_A_Pappa
  gRNA
gggacaacgugaagcgcacu

SEQ ID NO: 39470 - RNA, 20 nt, Artificial Sequence
  MKO10039470_A_Pappa
  gRNA
ucuuauaccucacgugaucg

SEQ ID NO: 39471 - RNA, 20 nt, Artificial Sequence
  MKO10039471_A_Pappa
  gRNA
aacaacuucaugagcuacgc

SEQ ID NO: 39472 - RNA, 20 nt, Artificial Sequence
  MKO10039472_A_Papss1
  gRNA
gaacguucgccgcauagcug

SEQ ID NO: 39473 - RNA, 20 nt, Artificial Sequence
  MKO10039473_A_Papss1
  gRNA
cgucaacgacugcguccagc

SEQ ID NO: 39474 - RNA, 20 nt, Artificial Sequence
  MKO10039474_A_Papss1
  gRNA
ugaaggaucgcaacaacgca

SEQ ID NO: 39475 - RNA, 20 nt, Artificial Sequence
  MKO10039475_A_Papss2
  gRNA
ggucccccgcagagaauccc

SEQ ID NO: 39476 - RNA, 20 nt, Artificial Sequence
  MKO10039476_A_Papss2
  gRNA
ugugaaagccgagacguaaa

SEQ ID NO: 39477 - RNA, 20 nt, Artificial Sequence
  MKO10039477_A_Papss2
  gRNA
gauuccgaggauguaccgug

SEQ ID NO: 39478 - RNA, 20 nt, Artificial Sequence
  MKO10039478_A_Paqr3
  gRNA
cuaccuggaaaguaccguuc

SEQ ID NO: 39479 - RNA, 20 nt, Artificial Sequence
  MKO10039479_A_Paqr3
  gRNA
uguuuaccgucucauuagac

SEQ ID NO: 39480 - RNA, 20 nt, Artificial Sequence
  MKO10039480_A_Paqr3
  gRNA
ucauggcaagcacggugauc

SEQ ID NO: 39481 - RNA, 20 nt, Artificial Sequence
  MKO10039481_A_Paqr4
  gRNA
ggccuggucgcuucgacuac

SEQ ID NO: 39482 - RNA, 20 nt, Artificial Sequence
  MKO10039482_A_Paqr4
  gRNA
ccccaguagucgaagcgacc

SEQ ID NO: 39483 - RNA, 20 nt, Artificial Sequence
  MKO10039483_A_Paqr4
  gRNA
auacgaacuuauugaacugc

SEQ ID NO: 39484 - RNA, 20 nt, Artificial Sequence
  MKO10039484_A_Paqr5
  gRNA
ccaugagugcuacguagcac

SEQ ID NO: 39485 - RNA, 20 nt, Artificial Sequence
  MKO10039485_A_Paqr5
  gRNA
ccagugcuacguagcacuca

SEQ ID NO: 39486 - RNA, 20 nt, Artificial Sequence
  MKO10039486_A_Paqr5
  gRNA
gcucuauguccaagaacgcc

SEQ ID NO: 39487 - RNA, 20 nt, Artificial Sequence
  MKO10039487_A_Paqr6
  gRNA
uauggguccgcgcgaaagcc

SEQ ID NO: 39488 - RNA, 20 nt, Artificial Sequence
  MKO10039488_A_Paqr6
  gRNA
aauucgcucaccaggugggc

SEQ ID NO: 39489 - RNA, 20 nt, Artificial Sequence
  MKO10039489_A_Paqr6
  gRNA
cagaacccaccgcgaguagc

SEQ ID NO: 39490 - RNA, 20 nt, Artificial Sequence
  MKO10039490_A_Paqr7
  gRNA
acgagccucugcacgcccgu

SEQ ID NO: 39491 - RNA, 20 nt, Artificial Sequence
  MKO10039491_A_Paqr7
  gRNA
acaacgaggcugugaacgug

SEQ ID NO: 39492 - RNA, 20 nt, Artificial Sequence
  MKO10039492_A_Paqr7
  gRNA
aucggcgcuggccuaugugc

SEQ ID NO: 39493 - RNA, 20 nt, Artificial Sequence
  MKO10039493_A_Paqr8
  gRNA
guaacgccacucgugccccg

SEQ ID NO: 39494 - RNA, 20 nt, Artificial Sequence
  MKO10039494_A_Paqr8
  gRNA
aggccgucgguagcgauacu

SEQ ID NO: 39495 - RNA, 20 nt, Artificial Sequence
  MKO10039495_A_Paqr8
  gRNA
cgguagcccgcguggaugua

SEQ ID NO: 39496 - RNA, 20 nt, Artificial Sequence
  MKO10039496_A_Paqr9
  gRNA
ggccggcggucccuucacgc

SEQ ID NO: 39497 - RNA, 20 nt, Artificial Sequence
  MKO10039497_A_Paqr9
  gRNA
ccacgggcagcacgagcgcg

SEQ ID NO: 39498 - RNA, 20 nt, Artificial Sequence
  MKO10039498_A_Paqr9
  gRNA
ggacugcacccgccucaucg

SEQ ID NO: 39499 - RNA, 20 nt, Artificial Sequence
  MKO10039499_A_Pard3b
  gRNA
ccgauccgcaggguuuccac

SEQ ID NO: 39500 - RNA, 20 nt, Artificial Sequence
  MKO10039500_A_Pard3b
  gRNA
acuacgauuuccccaccgac

SEQ ID NO: 39501 - RNA, 20 nt, Artificial Sequence
  MKO10039501_A_Pard3b
  gRNA
ccaggauuccacccagaacg

SEQ ID NO: 39502 - RNA, 20 nt, Artificial Sequence
  MKO10039502_A_Pard3
  gRNA
cucguacaaguccccaacga

SEQ ID NO: 39503 - RNA, 20 nt, Artificial Sequence
  MKO10039503_A_Pard3
  gRNA
aggagcgggcguugucucgc

SEQ ID NO: 39504 - RNA, 20 nt, Artificial Sequence
  MKO10039504_A_Pard3
  gRNA
cugccgccucgagcacugaa

SEQ ID NO: 39505 - RNA, 20 nt, Artificial Sequence
  MKO10039505_A_Pard6a
  gRNA
cccguaccacauuauuacgc

SEQ ID NO: 39506 - RNA, 20 nt, Artificial Sequence
  MKO10039506_A_Pard6a
  gRNA
ugccaaccagcguaauaaug

SEQ ID NO: 39507 - RNA, 20 nt, Artificial Sequence
  MKO10039507_A_Pard6a
  gRNA
gagcauccguauagccaagc

SEQ ID NO: 39508 - RNA, 20 nt, Artificial Sequence
  MKO10039508_A_Pard6b
  gRNA
gucaacgguauagaaguguc

SEQ ID NO: 39509 - RNA, 20 nt, Artificial Sequence
  MKO10039509_A_Pard6b
  gRNA
gcccaccaacacgucgacau

SEQ ID NO: 39510 - RNA, 20 nt, Artificial Sequence
  MKO10039510_A_Pard6b
  gRNA
ccgggcgcacggugaugaug

SEQ ID NO: 39511 - RNA, 20 nt, Artificial Sequence
  MKO10039511_A_Pard6g
  gRNA
auggggcgucacccgcacgc

SEQ ID NO: 39512 - RNA, 20 nt, Artificial Sequence
  MKO10039512_A_Pard6g
  gRNA
aguuuggcgccgaguuccga

SEQ ID NO: 39513 - RNA, 20 nt, Artificial Sequence
  MKO10039513_A_Pard6g
  gRNA
uucgagauggcaccagcgug

SEQ ID NO: 39514 - RNA, 20 nt, Artificial Sequence
  MKO10039514_A_Parg
  gRNA
ggcaaauggaucccacaccg

SEQ ID NO: 39515 - RNA, 20 nt, Artificial Sequence
  MKO10039515_A_Parg
  gRNA
gacuuaaaugccaagccauc

SEQ ID NO: 39516 - RNA, 20 nt, Artificial Sequence
  MKO10039516_A_Parg
  gRNA
cagcuuaguaaugcuaacau

SEQ ID NO: 39517 - RNA, 20 nt, Artificial Sequence
  MKO10039517_A_Park2
  gRNA
ugucagaaucgaccuccacu

SEQ ID NO: 39518 - RNA, 20 nt, Artificial Sequence
  MKO10039518_A_Park2
  gRNA
guccaggagcuugacacgag

SEQ ID NO: 39519 - RNA, 20 nt, Artificial Sequence
  MKO10039519_A_Park2
  gRNA
ggagacucacuugaaccguc

SEQ ID NO: 39520 - RNA, 20 nt, Artificial Sequence
  MKO10039520_A_Park7
  gRNA
cucgcagggaccauacgaug

SEQ ID NO: 39521 - RNA, 20 nt, Artificial Sequence
  MKO10039521_A_Park7
  gRNA
ccuagguccuacggcucugu

SEQ ID NO: 39522 - RNA, 20 nt, Artificial Sequence
  MKO10039522_A_Park7
  gRNA
ucgugagccaacagagccgu

SEQ ID NO: 39523 - RNA, 20 nt, Artificial Sequence
  MKO10039523_A_Parl
  gRNA
acaaaccugucacaguccgc

SEQ ID NO: 39524 - RNA, 20 nt, Artificial Sequence
  MKO10039524_A_Parl
  gRNA
aucugaucaugguucgcugc

SEQ ID NO: 39525 - RNA, 20 nt, Artificial Sequence
  MKO10039525_A_Parl
  gRNA
ggacagcauacggccacaaa

SEQ ID NO: 39526 - RNA, 20 nt, Artificial Sequence
  MKO10039526_A_Parm1
  gRNA
cguuaagagucaucguagag

SEQ ID NO: 39527 - RNA, 20 nt, Artificial Sequence
  MKO10039527_A_Parm1
  gRNA
agucaucgccguaguguugc

SEQ ID NO: 39528 - RNA, 20 nt, Artificial Sequence
  MKO10039528_A_Parm1
  gRNA
aucccccgcaacuucccuau

SEQ ID NO: 39529 - RNA, 20 nt, Artificial Sequence
  MKO10039529_A_Parn
  gRNA
gcugacuucuucgccaucga

SEQ ID NO: 39530 - RNA, 20 nt, Artificial Sequence
  MKO10039530_A_Parn
  gRNA
accugaaaacuccccaucga

SEQ ID NO: 39531 - RNA, 20 nt, Artificial Sequence
  MKO10039531_A_Parn
  gRNA
agaugucaaguuuguuugcc

SEQ ID NO: 39532 - RNA, 20 nt, Artificial Sequence
  MKO10039532_A_Parp10
  gRNA
acgcccucagcgagcgcuuc

SEQ ID NO: 39533 - RNA, 20 nt, Artificial Sequence
  MKO10039533_A_Parp10
  gRNA
gucauuggucaugcgccuac

SEQ ID NO: 39534 - RNA, 20 nt, Artificial Sequence
  MKO10039534_A_Parp10
  gRNA
cuggaaaaugagcgucgcag

SEQ ID NO: 39535 - RNA, 20 nt, Artificial Sequence
  MKO10039535_A_Parp11
  gRNA
ccuaccugguagggaacguc

SEQ ID NO: 39536 - RNA, 20 nt, Artificial Sequence
  MKO10039536_A_Parp11
  gRNA
gacgcacgaguauaaugaag

SEQ ID NO: 39537 - RNA, 20 nt, Artificial Sequence
  MKO10039537_A_Parp11
  gRNA
cuucauuauacucgugcguc

SEQ ID NO: 39538 - RNA, 20 nt, Artificial Sequence
  MKO10039538_A_Parp12
  gRNA
uccaagaauugccaccgaua

SEQ ID NO: 39539 - RNA, 20 nt, Artificial Sequence
  MKO10039539_A_Parp12
  gRNA
agcuacaacucuuccgaaua

SEQ ID NO: 39540 - RNA, 20 nt, Artificial Sequence
  MKO10039540_A_Parp12
  gRNA
aaagugucuccuucucccgc

SEQ ID NO: 39541 - RNA, 20 nt, Artificial Sequence
  MKO10039541_A_Parp14
  gRNA
ggccgcuuauauucuccacc

SEQ ID NO: 39542 - RNA, 20 nt, Artificial Sequence
  MKO10039542_A_Parp14
  gRNA
uucaguucggcagaacguuc

SEQ ID NO: 39543 - RNA, 20 nt, Artificial Sequence
  MKO10039543_A_Parp14
  gRNA
acccuuccgcccccguugaa

SEQ ID NO: 39544 - RNA, 20 nt, Artificial Sequence
  MKO10039544_A_Parp16
  gRNA
aguucucuaggcggcuacca

SEQ ID NO: 39545 - RNA, 20 nt, Artificial Sequence
  MKO10039545_A_Parp16
  gRNA
gauuaggucucguucuccuu

SEQ ID NO: 39546 - RNA, 20 nt, Artificial Sequence
  MKO10039546_A_Parp16
  gRNA
gaaggcuauguugccacccg

SEQ ID NO: 39547 - RNA, 20 nt, Artificial Sequence
  MKO10039547_A_Parp1
  gRNA
cggaguacgccaaguccaac

SEQ ID NO: 39548 - RNA, 20 nt, Artificial Sequence
  MKO10039548_A_Parp1
  gRNA
gaugcgccuguccaagaaga

SEQ ID NO: 39549 - RNA, 20 nt, Artificial Sequence
  MKO10039549_A_Parp1
  gRNA
ggacaaggauaguaguaagc

SEQ ID NO: 39550 - RNA, 20 nt, Artificial Sequence
  MKO10039550_A_Parp2
  gRNA
cacgugcgcaucuucuugcc

SEQ ID NO: 39551 - RNA, 20 nt, Artificial Sequence
  MKO10039551_A_Parp2
  gRNA
caucuucuaacagcugaaua

SEQ ID NO: 39552 - RNA, 20 nt, Artificial Sequence
  MKO10039552_A_Parp2
  gRNA
augcgcacgugccagagaaa

SEQ ID NO: 39553 - RNA, 20 nt, Artificial Sequence
  MKO10039553_A_Parp3
  gRNA
cggcugcggccgaaguugug

SEQ ID NO: 39554 - RNA, 20 nt, Artificial Sequence
  MKO10039554_A_Parp3
  gRNA
ggguacagucauaguccucg

SEQ ID NO: 39555 - RNA, 20 nt, Artificial Sequence
  MKO10039555_A_Parp3
  gRNA
aggguagucgcuucuucugc

SEQ ID NO: 39556 - RNA, 20 nt, Artificial Sequence
  MKO10039556_A_Parp4
  gRNA
gaauuaugauccucugucgc

SEQ ID NO: 39557 - RNA, 20 nt, Artificial Sequence
  MKO10039557_A_Parp4
  gRNA
caaucugcacaucguucuuu

SEQ ID NO: 39558 - RNA, 20 nt, Artificial Sequence
  MKO10039558_A_Parp4
  gRNA
gguaggaggccccgagacug

SEQ ID NO: 39559 - RNA, 20 nt, Artificial Sequence
  MKO10039559_A_Parp6
  gRNA
auauggaacuaucgaugacg

SEQ ID NO: 39560 - RNA, 20 nt, Artificial Sequence
  MKO10039560_A_Parp6
  gRNA
gugagaacuccguguccauc

SEQ ID NO: 39561 - RNA, 20 nt, Artificial Sequence
  MKO10039561_A_Parp6
  gRNA
aaccguagccucaacacaau

SEQ ID NO: 39562 - RNA, 20 nt, Artificial Sequence
  MKO10039562_A_Parp8
  gRNA
accuuuacuuucaccuacgu

SEQ ID NO: 39563 - RNA, 20 nt, Artificial Sequence
  MKO10039563_A_Parp8
  gRNA
cacgucucagaagacuaccc

SEQ ID NO: 39564 - RNA, 20 nt, Artificial Sequence
  MKO10039564_A_Parp8
  gRNA
gaauugggucuguagugacu

SEQ ID NO: 39565 - RNA, 20 nt, Artificial Sequence
  MKO10039565_A_Parp9
  gRNA
ucaguaauucgauagcuguc

SEQ ID NO: 39566 - RNA, 20 nt, Artificial Sequence
  MKO10039566_A_Parp9
  gRNA
cuguucguaacuguccaccg

SEQ ID NO: 39567 - RNA, 20 nt, Artificial Sequence
  MKO10039567_A_Parp9
  gRNA
ccacaccucuugauaaucug

SEQ ID NO: 39568 - RNA, 20 nt, Artificial Sequence
  MKO10039568_A_Parpbp
  gRNA
ucgguaccugcucgucauuc

SEQ ID NO: 39569 - RNA, 20 nt, Artificial Sequence
  MKO10039569_A_Parpbp
  gRNA
auucucaacaucccugaucg

SEQ ID NO: 39570 - RNA, 20 nt, Artificial Sequence
  MKO10039570_A_Parpbp
  gRNA
agauggccacgucauuuauc

SEQ ID NO: 39571 - RNA, 20 nt, Artificial Sequence
  MKO10039571_A_Pars2
  gRNA
gcgcacgaugguaacacuug

SEQ ID NO: 39572 - RNA, 20 nt, Artificial Sequence
  MKO10039572_A_Pars2
  gRNA
aaguguuaccaucgugcgcc

SEQ ID NO: 39573 - RNA, 20 nt, Artificial Sequence
  MKO10039573_A_Pars2
  gRNA
ccccgguuuggucuucuccg

SEQ ID NO: 39574 - RNA, 20 nt, Artificial Sequence
  MKO10039574_A_Parva
  gRNA
gaucuccgacugcguaaccu

SEQ ID NO: 39575 - RNA, 20 nt, Artificial Sequence
  MKO10039575_A_Parva
  gRNA
cucugcaggugcucaucgac

SEQ ID NO: 39576 - RNA, 20 nt, Artificial Sequence
  MKO10039576_A_Parva
  gRNA
aguuuggaucgaccauuguc

SEQ ID NO: 39577 - RNA, 20 nt, Artificial Sequence
  MKO10039577_A_Parvb
  gRNA
gaggugacgcaguccgagau

SEQ ID NO: 39578 - RNA, 20 nt, Artificial Sequence
  MKO10039578_A_Parvb
  gRNA
ucuagaggugggaucgauca

SEQ ID NO: 39579 - RNA, 20 nt, Artificial Sequence
  MKO10039579_A_Parvb
  gRNA
cccauggcuggccgcugcgu

SEQ ID NO: 39580 - RNA, 20 nt, Artificial Sequence
  MKO10039580_A_Parvg
  gRNA
gaaguuggcaucgcucaagc

SEQ ID NO: 39581 - RNA, 20 nt, Artificial Sequence
  MKO10039581_A_Parvg
  gRNA
cugcggaccacgaugugcuc

SEQ ID NO: 39582 - RNA, 20 nt, Artificial Sequence
  MKO10039582_A_Parvg
  gRNA
acuccucccggagcacaucg

SEQ ID NO: 39583 - RNA, 20 nt, Artificial Sequence
  MKO10039583_A_Pask
  gRNA
guggacaucgucagccgaau

SEQ ID NO: 39584 - RNA, 20 nt, Artificial Sequence
  MKO10039584_A_Pask
  gRNA
gcuguagggucagcauacuc

SEQ ID NO: 39585 - RNA, 20 nt, Artificial Sequence
  MKO10039585_A_Pask
  gRNA
ugcacacaggggucgaaagc

SEQ ID NO: 39586 - RNA, 20 nt, Artificial Sequence
  MKO10039586_A_Paue2
  gRNA
cugucuaugauuugguacgc

SEQ ID NO: 39587 - RNA, 20 nt, Artificial Sequence
  MKO10039587_A_Paue2
  gRNA
guaaaaguucucagcagcgc

SEQ ID NO: 39588 - RNA, 20 nt, Artificial Sequence
  MKO10039588_A_Paue2
  gRNA
uaacuauugcaaccucccaa

SEQ ID NO: 39589 - RNA, 20 nt, Artificial Sequence
  MKO10039589_A_Paue4
  gRNA
aguaccguaucacacuuugu

SEQ ID NO: 39590 - RNA, 20 nt, Artificial Sequence
  MKO10039590_A_Paue4
  gRNA
agcagaugcguugcaaaacc

SEQ ID NO: 39591 - RNA, 20 nt, Artificial Sequence
  MKO10039591_A_Paue4
  gRNA
aaugugcucgccucagugca

SEQ ID NO: 39592 - RNA, 20 nt, Artificial Sequence
  MKO10039592_A_Paul1
  gRNA
cggucaacaucaccuaucau

SEQ ID NO: 39593 - RNA, 20 nt, Artificial Sequence
  MKO10039593_A_Paul1
  gRNA
gaaguucugaggcgaauccg

SEQ ID NO: 39594 - RNA, 20 nt, Artificial Sequence
  MKO10039594_A_Paul1
  gRNA
auaggugauguugaccgccu

SEQ ID NO: 39595 - RNA, 20 nt, Artificial Sequence
  MKO10039595_A_Paul2
  gRNA
gcuguugcgguccaaaauga

SEQ ID NO: 39596 - RNA, 20 nt, Artificial Sequence
  MKO10039596_A_Paul2
  gRNA
guuguugguaccugagcuua

SEQ ID NO: 39597 - RNA, 20 nt, Artificial Sequence
  MKO10039597_A_Paul2
  gRNA
gcacacacuaagccuucuuc

SEQ ID NO: 39598 - RNA, 20 nt, Artificial Sequence
  MKO10039598_A_Pauz1
  gRNA
ucucuaggcgcacaacgauu

SEQ ID NO: 39599 - RNA, 20 nt, Artificial Sequence
  MKO10039599_A_Pauz1
  gRNA
ugcgacgugcuccuacgagu

SEQ ID NO: 39600 - RNA, 20 nt, Artificial Sequence
  MKO10039600_A_Pauz1
  gRNA
caggcggucucgagucgcaa

SEQ ID NO: 39601 - RNA, 20 nt, Artificial Sequence
  MKO10039601_A_Pawr
  gRNA
gacccgucgagaacaguucc

SEQ ID NO: 39602 - RNA, 20 nt, Artificial Sequence
  MKO10039602_A_Pawr
  gRNA
aagaaaaccuucgacuugug

SEQ ID NO: 39603 - RNA, 20 nt, Artificial Sequence
  MKO10039603_A_Pawr
  gRNA
caacagagaugcaaaugcgc

SEQ ID NO: 39604 - RNA, 20 nt, Artificial Sequence
  MKO10039604_A_Pax1
  gRNA
ugccauccgccuacgaaucg

SEQ ID NO: 39605 - RNA, 20 nt, Artificial Sequence
  MKO10039605_A_Pax1
  gRNA
gugcuagcuccacgauucgu

SEQ ID NO: 39606 - RNA, 20 nt, Artificial Sequence
  MKO10039606_A_Pax1
  gRNA
gagcgcuguauacuccgugc

SEQ ID NO: 39607 - RNA, 20 nt, Artificial Sequence
  MKO10039607_A_Pax2
  gRNA
agaacccgacuauguucgcc

SEQ ID NO: 39608 - RNA, 20 nt, Artificial Sequence
  MKO10039608_A_Pax2
  gRNA
cagcgccucuaacgacccag

SEQ ID NO: 39609 - RNA, 20 nt, Artificial Sequence
  MKO10039609_A_Pax2
  gRNA
cucgcuccaacggugagaag

SEQ ID NO: 39610 - RNA, 20 nt, Artificial Sequence
  MKO10039610_A_Pax3
  gRNA
cgccagcuucgcguguccca

SEQ ID NO: 39611 - RNA, 20 nt, Artificial Sequence
  MKO10039611_A_Pax3
  gRNA
cuuggguuugcugccgccga

SEQ ID NO: 39612 - RNA, 20 nt, Artificial Sequence
  MKO10039612_A_Pax3
  gRNA
gggcagaauuacccacgcag

SEQ ID NO: 39613 - RNA, 20 nt, Artificial Sequence
  MKO10039613_A_Pax4
  gRNA
cugugcgguaguagcguccu

SEQ ID NO: 39614 - RNA, 20 nt, Artificial Sequence
  MKO10039614_A_Pax4
  gRNA
ccgaaguacucgauugauag

SEQ ID NO: 39615 - RNA, 20 nt, Artificial Sequence
  MKO10039615_A_Pax4
  gRNA
ugggggaagcaaaccacguc

SEQ ID NO: 39616 - RNA, 20 nt, Artificial Sequence
  MKO10039616_A_Pax5
  gRNA
gucuacaggcuccgugacgc

SEQ ID NO: 39617 - RNA, 20 nt, Artificial Sequence
  MKO10039617_A_Pax5
  gRNA
aucggugagcaccgacuccg

SEQ ID NO: 39618 - RNA, 20 nt, Artificial Sequence
  MKO10039618_A_Pax5
  gRNA
ucccagauguaguccgccaa

SEQ ID NO: 39619 - RNA, 20 nt, Artificial Sequence
  MKO10039619_A_Pax6
  gRNA
cgguugugugaguaaaauuc

SEQ ID NO: 39620 - RNA, 20 nt, Artificial Sequence
  MKO10039620_A_Pax6
  gRNA
ccgagacagauuauuauccg

SEQ ID NO: 39621 - RNA, 20 nt, Artificial Sequence
  MKO10039621_A_Pax6
  gRNA
uuaccuugcguggguugccc

SEQ ID NO: 39622 - RNA, 20 nt, Artificial Sequence
  MKO10039622_A_Pax7
  gRNA
gacgcgugccuccgugagcu

SEQ ID NO: 39623 - RNA, 20 nt, Artificial Sequence
  MKO10039623_A_Pax7
  gRNA
cugugaacgugguccgacug

SEQ ID NO: 39624 - RNA, 20 nt, Artificial Sequence
  MKO10039624_A_Pax7
  gRNA
caccugagggcaccgugcuu

SEQ ID NO: 39625 - RNA, 20 nt, Artificial Sequence
  MKO10039625_A_Pax8
  gRNA
aguuguacgucaacgcauug

SEQ ID NO: 39626 - RNA, 20 nt, Artificial Sequence
  MKO10039626_A_Pax8
  gRNA
uaggagcccguugauagagu

SEQ ID NO: 39627 - RNA, 20 nt, Artificial Sequence
  MKO10039627_A_Pax8
  gRNA
augcguugacguacaacuuc

SEQ ID NO: 39628 - RNA, 20 nt, Artificial Sequence
  MKO10039628_A_Pax9
  gRNA
cgacaaguacaacgugcccu

SEQ ID NO: 39629 - RNA, 20 nt, Artificial Sequence
  MKO10039629_A_Pax9
  gRNA
agccgugcgagacccguagc

SEQ ID NO: 39630 - RNA, 20 nt, Artificial Sequence
  MKO10039630_A_Pax9
  gRNA
gccgccccgcacgcagugaa

SEQ ID NO: 39631 - RNA, 20 nt, Artificial Sequence
  MKO10039631_A_Paxbp1
  gRNA
gacgaugacgcguuaguaac

SEQ ID NO: 39632 - RNA, 20 nt, Artificial Sequence
  MKO10039632_A_Paxbp1
  gRNA
caaaggccgccucguccgcg

SEQ ID NO: 39633 - RNA, 20 nt, Artificial Sequence
  MKO10039633_A_Paxbp1
  gRNA
cauucucguccucgcggacg

SEQ ID NO: 39634 - RNA, 20 nt, Artificial Sequence
  MKO10039634_A_Paxip1
  gRNA
gccuugguuacguuccacgg

SEQ ID NO: 39635 - RNA, 20 nt, Artificial Sequence
  MKO10039635_A_Paxip1
  gRNA
uuaguuggcaacugcccccg

SEQ ID NO: 39636 - RNA, 20 nt, Artificial Sequence
  MKO10039636_A_Paxip1
  gRNA
gugacucuguccgugcaaug

SEQ ID NO: 39637 - RNA, 20 nt, Artificial Sequence
  MKO10039637_A_Pbdc1
  gRNA
acgucguugccauaugacuc

SEQ ID NO: 39638 - RNA, 20 nt, Artificial Sequence
  MKO10039638_A_Pbdc1
  gRNA
ccaugcgcucucucacccuc

SEQ ID NO: 39639 - RNA, 20 nt, Artificial Sequence
  MKO10039639_A_Pbdc1
  gRNA
acugaagagaacaccaucuu

SEQ ID NO: 39640 - RNA, 20 nt, Artificial Sequence
  MKO10039640_A_Pbk
  gRNA
ucagcguuuaccuaaugaaa

SEQ ID NO: 39641 - RNA, 20 nt, Artificial Sequence
  MKO10039641_A_Pbk
  gRNA
gcagacuuaccuauaauguu

SEQ ID NO: 39642 - RNA, 20 nt, Artificial Sequence
  MKO10039642_A_Pbk
  gRNA
ccauuggaugaaaauaugac

SEQ ID NO: 39643 - RNA, 20 nt, Artificial Sequence
  MKO10039643_A_Pbld1
  gRNA
acgcccaucagcaaauugcg

SEQ ID NO: 39644 - RNA, 20 nt, Artificial Sequence
  MKO10039644_A_Pbld1
  gRNA
ucucccucgcaauuugcuga

SEQ ID NO: 39645 - RNA, 20 nt, Artificial Sequence
  MKO10039645_A_Pbld1
  gRNA
caguguggcguggccgcaca

SEQ ID NO: 39646 - RNA, 20 nt, Artificial Sequence
  MKO10039646_A_Pbld2
  gRNA
cuuguguggccacgccacgc

SEQ ID NO: 39647 - RNA, 20 nt, Artificial Sequence
  MKO10039647_A_Pbld2
  gRNA
uccuuguaagguucccguuu

SEQ ID NO: 39648 - RNA, 20 nt, Artificial Sequence
  MKO10039648_A_Pbld2
  gRNA
auuggaugaagaugcucauc

SEQ ID NO: 39649 - RNA, 20 nt, Artificial Sequence
  MKO10039649_A_Pbp2
  gRNA
cguggguuccggaccuccca

SEQ ID NO: 39650 - RNA, 20 nt, Artificial Sequence
  MKO10039650_A_Pbp2
  gRNA
gguggccggcacguguuacc

SEQ ID NO: 39651 - RNA, 20 nt, Artificial Sequence
  MKO10039651_A_Pbp2
  gRNA
gccgcugagccuccacgaag

SEQ ID NO: 39652 - RNA, 20 nt, Artificial Sequence
  MKO10039652_A_Pbrm1
  gRNA
caaacucauuucuuguucga

SEQ ID NO: 39653 - RNA, 20 nt, Artificial Sequence
  MKO10039653_A_Pbrm1
  gRNA
guuguagccacaaauccauc

SEQ ID NO: 39654 - RNA, 20 nt, Artificial Sequence
  MKO10039654_A_Pbrm1
  gRNA
acaucacuuaccacuuugga

SEQ ID NO: 39655 - RNA, 20 nt, Artificial Sequence
  MKO10039655_A_Pbsn
  gRNA
agagaauguacagcguauca

SEQ ID NO: 39656 - RNA, 20 nt, Artificial Sequence
  MKO10039656_A_Pbsn
  gRNA
gacggaguucaugaacuuag

SEQ ID NO: 39657 - RNA, 20 nt, Artificial Sequence
  MKO10039657_A_Pbsn
  gRNA
aagaaaugaugucacacgag

SEQ ID NO: 39658 - RNA, 20 nt, Artificial Sequence
  MKO10039658_A_Pbx1
  gRNA
cggccaucccgaccccagcg

SEQ ID NO: 39659 - RNA, 20 nt, Artificial Sequence
  MKO10039659_A_Pbx1
  gRNA
ucucuccgaaggagaucgag

SEQ ID NO: 39660 - RNA, 20 nt, Artificial Sequence
  MKO10039660_A_Pbx1
  gRNA
agacccccagcucaugcgac

SEQ ID NO: 39661 - RNA, 20 nt, Artificial Sequence
  MKO10039661_A_Pbx2
  gRNA
guccggggauacgccaccac

SEQ ID NO: 39662 - RNA, 20 nt, Artificial Sequence
  MKO10039662_A_Pbx2
  gRNA
cacucgcccggucgccccca

SEQ ID NO: 39663 - RNA, 20 nt, Artificial Sequence
  MKO10039663_A_Pbx2
  gRNA
gguguggcuggacccgagaa

SEQ ID NO: 39664 - RNA, 20 nt, Artificial Sequence
  MKO10039664_A_Pbx3
  gRNA
aaggcguaacuucaguaaac

SEQ ID NO: 39665 - RNA, 20 nt, Artificial Sequence
  MKO10039665_A_Pbx3
  gRNA
cacaagacgcugaagagcgc

SEQ ID NO: 39666 - RNA, 20 nt, Artificial Sequence
  MKO10039666_A_Pbx3
  gRNA
ugugauagauuugucugauc

SEQ ID NO: 39667 - RNA, 20 nt, Artificial Sequence
  MKO10039667_A_Pbx4
  gRNA
cugucuguaggcgcaagcgg

SEQ ID NO: 39668 - RNA, 20 nt, Artificial Sequence
  MKO10039668_A_Pbx4
  gRNA
auguguggugaacucacgac

SEQ ID NO: 39669 - RNA, 20 nt, Artificial Sequence
  MKO10039669_A_Pbx4
  gRNA
cugugaugacucuacgcuca

SEQ ID NO: 39670 - RNA, 20 nt, Artificial Sequence
  MKO10039670_A_Pbxip1
  gRNA
acccguagauguggaggacc

SEQ ID NO: 39671 - RNA, 20 nt, Artificial Sequence
  MKO10039671_A_Pbxip1
  gRNA
gguccgaggcucgucgccac

SEQ ID NO: 39672 - RNA, 20 nt, Artificial Sequence
  MKO10039672_A_Pbxip1
  gRNA
cuccacaucuacggguacca

SEQ ID NO: 39673 - RNA, 20 nt, Artificial Sequence
  MKO10039673_A_Pcbd1
  gRNA
uauaucccguuccgaaagac

SEQ ID NO: 39674 - RNA, 20 nt, Artificial Sequence
  MKO10039674_A_Pcbd1
  gRNA
uucggaacgggauauaaacc

SEQ ID NO: 39675 - RNA, 20 nt, Artificial Sequence
  MKO10039675_A_Pcbd1
  gRNA
agcuggaccaccaucccgag

SEQ ID NO: 39676 - RNA, 20 nt, Artificial Sequence
  MKO10039676_A_Pcbd2
  gRNA
acuucacaucccgcuugguc

SEQ ID NO: 39677 - RNA, 20 nt, Artificial Sequence
  MKO10039677_A_Pcbd2
  gRNA
uuguagacguugaaccauuc

SEQ ID NO: 39678 - RNA, 20 nt, Artificial Sequence
  MKO10039678_A_Pcbd2
  gRNA
auggccgcccugcucgcgcc

SEQ ID NO: 39679 - RNA, 20 nt, Artificial Sequence
  MKO10039679_A_Pcbp1
  gRNA
cgccaugaucaucgacaagc

SEQ ID NO: 39680 - RNA, 20 nt, Artificial Sequence
  MKO10039680_A_Pcbp1
  gRNA
gucggugaagaggauccgcg

SEQ ID NO: 39681 - RNA, 20 nt, Artificial Sequence
  MKO10039681_A_Pcbp1
  gRNA
ccgcgucgcugcagcgaucu

SEQ ID NO: 39682 - RNA, 20 nt, Artificial Sequence
  MKO10039682_A_Pcbp2
  gRNA
aucuguuaagaagaugcgcg

SEQ ID NO: 39683 - RNA, 20 nt, Artificial Sequence
  MKO10039683_A_Pcbp2
  gRNA
uccugagagaauuaucacuu

SEQ ID NO: 39684 - RNA, 20 nt, Artificial Sequence
  MKO10039684_A_Pcbp2
  gRNA
gccaaagugauaauucucuc

SEQ ID NO: 39685 - RNA, 20 nt, Artificial Sequence
  MKO10039685_A_Pcbp3
  gRNA
uaugaucgcguacaaguuug

SEQ ID NO: 39686 - RNA, 20 nt, Artificial Sequence
  MKO10039686_A_Pcbp3
  gRNA
gugauuguaacgauucucuc

SEQ ID NO: 39687 - RNA, 20 nt, Artificial Sequence
  MKO10039687_A_Pcbp3
  gRNA
uuguuccaggugacgccauc

SEQ ID NO: 39688 - RNA, 20 nt, Artificial Sequence
  MKO10039688_A_Pcbp4
  gRNA
gagagacuguaaagcgaauc

SEQ ID NO: 39689 - RNA, 20 nt, Artificial Sequence
  MKO10039689_A_Pcbp4
  gRNA
uacggcugccgucuuccacg

SEQ ID NO: 39690 - RNA, 20 nt, Artificial Sequence
  MKO10039690_A_Pcbp4
  gRNA
ggggcaggagcccuccgaga

SEQ ID NO: 39691 - RNA, 20 nt, Artificial Sequence
  MKO10039691_A_Pcca
  gRNA
cuauucauaccaaugccuag

SEQ ID NO: 39692 - RNA, 20 nt, Artificial Sequence
  MKO10039692_A_Pcca
  gRNA
aggcauugguaugaauagac

SEQ ID NO: 39693 - RNA, 20 nt, Artificial Sequence
  MKO10039693_A_Pcca
  gRNA
caguaaaagcuaccucaaca

SEQ ID NO: 39694 - RNA, 20 nt, Artificial Sequence
  MKO10039694_A_Pccb
  gRNA
gagucauugagcccgaucac

SEQ ID NO: 39695 - RNA, 20 nt, Artificial Sequence
  MKO10039695_A_Pccb
  gRNA
cagaugugccgacuucggaa

SEQ ID NO: 39696 - RNA, 20 nt, Artificial Sequence
  MKO10039696_A_Pccb
  gRNA
acuggacggggccgaaucaa

SEQ ID NO: 39697 - RNA, 20 nt, Artificial Sequence
  MKO10039697_A_Pcdh10
  gRNA
uucggacugucgccgcgcac

SEQ ID NO: 39698 - RNA, 20 nt, Artificial Sequence
  MKO10039698_A_Pcdh10
  gRNA
gagagcuccgcaccgcgcgc

SEQ ID NO: 39699 - RNA, 20 nt, Artificial Sequence
  MKO10039699_A_Pcdh10
  gRNA
acagaccucgccgaguuaac

SEQ ID NO: 39700 - RNA, 20 nt, Artificial Sequence
  MKO10039700_A_Pcdh11x
  gRNA
accauugauucgcauugaag

SEQ ID NO: 39701 - RNA, 20 nt, Artificial Sequence
  MKO10039701_A_Pcdh11x
  gRNA
uuguagugucgagccaaauc

SEQ ID NO: 39702 - RNA, 20 nt, Artificial Sequence
  MKO10039702_A_Pcdh11x
  gRNA
cuugcagucgacgaacuguc

SEQ ID NO: 39703 - RNA, 20 nt, Artificial Sequence
  MKO10039703_A_Pcdh12
  gRNA
cuucugacaccagcgacguc

SEQ ID NO: 39704 - RNA, 20 nt, Artificial Sequence
  MKO10039704_A_Pcdh12
  gRNA
ccccgaugcuacaacgucag

SEQ ID NO: 39705 - RNA, 20 nt, Artificial Sequence
  MKO10039705_A_Pcdh12
  gRNA
accaguggaagcugcguccg

SEQ ID NO: 39706 - RNA, 20 nt, Artificial Sequence
  MKO10039706_A_Pcdh15
  gRNA
cuaucaugaaguacgcaucg

SEQ ID NO: 39707 - RNA, 20 nt, Artificial Sequence
  MKO10039707_A_Pcdh15
  gRNA
aucacagaccucauucacgg

SEQ ID NO: 39708 - RNA, 20 nt, Artificial Sequence
  MKO10039708_A_Pcdh15
  gRNA
aggaccaccagcuacuaucg

SEQ ID NO: 39709 - RNA, 20 nt, Artificial Sequence
  MKO10039709_A_Pcdh17
  gRNA
gcucgaauuagucccuuguc

SEQ ID NO: 39710 - RNA, 20 nt, Artificial Sequence
  MKO10039710_A_Pcdh17
  gRNA
cucacggucgaugcgcuguu

SEQ ID NO: 39711 - RNA, 20 nt, Artificial Sequence
  MKO10039711_A_Pcdh17
  gRNA
gagccuugcgccucaacaaa

SEQ ID NO: 39712 - RNA, 20 nt, Artificial Sequence
  MKO10039712_A_Pcdh18
  gRNA
uuaauaucgaagugcgaacc

SEQ ID NO: 39713 - RNA, 20 nt, Artificial Sequence
  MKO10039713_A_Pcdh18
  gRNA
ggcgcgauucuccgauagac

SEQ ID NO: 39714 - RNA, 20 nt, Artificial Sequence
  MKO10039714_A_Pcdh18
  gRNA
gaaggacuccccuagcgacg

SEQ ID NO: 39715 - RNA, 20 nt, Artificial Sequence
  MKO10039715_A_Pcdh19
  gRNA
cggugcgcuagacuaugaag

SEQ ID NO: 39716 - RNA, 20 nt, Artificial Sequence
  MKO10039716_A_Pcdh19
  gRNA
caagcucgcuauugaccgac

SEQ ID NO: 39717 - RNA, 20 nt, Artificial Sequence
  MKO10039717_A_Pcdh19
  gRNA
gccgugcccauuuaaucaaa

SEQ ID NO: 39718 - RNA, 20 nt, Artificial Sequence
  MKO10039718_A_Pcdh1
  gRNA
cuggggcgugcuaagccgaa

SEQ ID NO: 39719 - RNA, 20 nt, Artificial Sequence
  MKO10039719_A_Pcdh1
  gRNA
guuacaccgccucgugguga

SEQ ID NO: 39720 - RNA, 20 nt, Artificial Sequence
  MKO10039720_A_Pcdh1
  gRNA
guagguaggccgcucgaauu

SEQ ID NO: 39721 - RNA, 20 nt, Artificial Sequence
  MKO10039721_A_Pcdh20
  gRNA
uagcacggcuguaacucgcg

SEQ ID NO: 39722 - RNA, 20 nt, Artificial Sequence
  MKO10039722_A_Pcdh20
  gRNA
uucaccuguaaauacccgau

SEQ ID NO: 39723 - RNA, 20 nt, Artificial Sequence
  MKO10039723_A_Pcdh20
  gRNA
cgcgcgcagcuugcuggucc

SEQ ID NO: 39724 - RNA, 20 nt, Artificial Sequence
  MKO10039724_A_Pcdh7
  gRNA
ucacuuccucgcggucgauc

SEQ ID NO: 39725 - RNA, 20 nt, Artificial Sequence
  MKO10039725_A_Pcdh7
  gRNA
ucggucgaugcgccgcucac

SEQ ID NO: 39726 - RNA, 20 nt, Artificial Sequence
  MKO10039726_A_Pcdh7
  gRNA
uugccggucagcgcuacauc

SEQ ID NO: 39727 - RNA, 20 nt, Artificial Sequence
  MKO10039727_A_Pcdh8
  gRNA
gacgcugccgaucccgacga

SEQ ID NO: 39728 - RNA, 20 nt, Artificial Sequence
  MKO10039728_A_Pcdh8
  gRNA
guccgcgaaaacaacccucc

SEQ ID NO: 39729 - RNA, 20 nt, Artificial Sequence
  MKO10039729_A_Pcdh8
  gRNA
gcgcagggacaauuacuauc

SEQ ID NO: 39730 - RNA, 20 nt, Artificial Sequence
  MKO10039730_A_Pcdh9
  gRNA
augaacggcaucaucggguu

SEQ ID NO: 39731 - RNA, 20 nt, Artificial Sequence
  MKO10039731_A_Pcdh9
  gRNA
acugcuuacggucauugaau

SEQ ID NO: 39732 - RNA, 20 nt, Artificial Sequence
  MKO10039732_A_Pcdh9
  gRNA
cgucauucaagagcucccgu

SEQ ID NO: 39733 - RNA, 20 nt, Artificial Sequence
  MKO10039733_A_Pcdha10
  gRNA
ugcgccgcgccaacgccugu

SEQ ID NO: 39734 - RNA, 20 nt, Artificial Sequence
  MKO10039734_A_Pcdha10
  gRNA
gaucaguaucacucgcgcuc

SEQ ID NO: 39735 - RNA, 20 nt, Artificial Sequence
  MKO10039735_A_Pcdha10
  gRNA
gaggcuggcauucuacgggc

SEQ ID NO: 39736 - RNA, 20 nt, Artificial Sequence
  MKO10039736_A_Pcdha11
  gRNA
gaucagcacgacgcgugccu

SEQ ID NO: 39737 - RNA, 20 nt, Artificial Sequence
  MKO10039737_A_Pcdha11
  gRNA
ugcaccuucgucuagauccg

SEQ ID NO: 39738 - RNA, 20 nt, Artificial Sequence
  MKO10039738_A_Pcdha11
  gRNA
gaggcuggcauucuacgggc

SEQ ID NO: 39739 - RNA, 20 nt, Artificial Sequence
  MKO10039739_A_Pcdha12
  gRNA
guccaaagcgaaauaaucgc

SEQ ID NO: 39740 - RNA, 20 nt, Artificial Sequence
  MKO10039740_A_Pcdha12
  gRNA
uuccgccuugaccuaccgau

SEQ ID NO: 39741 - RNA, 20 nt, Artificial Sequence
  MKO10039741_A_Pcdha12
  gRNA
gaggcuggcauucuacgggc

SEQ ID NO: 39742 - RNA, 20 nt, Artificial Sequence
  MKO10039742_A_Pcdha1
  gRNA
caacgccccacuguuugacc

SEQ ID NO: 39743 - RNA, 20 nt, Artificial Sequence
  MKO10039743_A_Pcdha1
  gRNA
ugcgcgcaacccguuucgcg

SEQ ID NO: 39744 - RNA, 20 nt, Artificial Sequence
  MKO10039744_A_Pcdha1
  gRNA
gaggcuggcauucuacgggc

SEQ ID NO: 39745 - RNA, 20 nt, Artificial Sequence
  MKO10039745_A_Pcdha2
  gRNA
caugcguagccuguuccgcg

SEQ ID NO: 39746 - RNA, 20 nt, Artificial Sequence
  MKO10039746_A_Pcdha2
  gRNA
gauuugaaacuuaguccgug

SEQ ID NO: 39747 - RNA, 20 nt, Artificial Sequence
  MKO10039747_A_Pcdha2
  gRNA
gaggcuggcauucuacgggc

SEQ ID NO: 39748 - RNA, 20 nt, Artificial Sequence
  MKO10039748_A_Pcdha3
  gRNA
ugccccgcgacagcgccuau

SEQ ID NO: 39749 - RNA, 20 nt, Artificial Sequence
  MKO10039749_A_Pcdha3
  gRNA
augcgcccucuagcgaaaac

SEQ ID NO: 39750 - RNA, 20 nt, Artificial Sequence
  MKO10039750_A_Pcdha3
  gRNA
ggcuccuaaagcuuugccgg

SEQ ID NO: 39751 - RNA, 20 nt, Artificial Sequence
  MKO10039751_A_Pcdha4-g
  gRNA
gauuaguacuacgcgcauac

SEQ ID NO: 39752 - RNA, 20 nt, Artificial Sequence
  MKO10039752_A_Pcdha4-g
  gRNA
uacacguucuggcgguaguc

SEQ ID NO: 39753 - RNA, 20 nt, Artificial Sequence
  MKO10039753_A_Pcdha4-g
  gRNA
cgcgcaccuuagccaccaca

SEQ ID NO: 39754 - RNA, 20 nt, Artificial Sequence
  MKO10039754_A_Pcdha4
  gRNA
gauuaguacuacgcgcauac

SEQ ID NO: 39755 - RNA, 20 nt, Artificial Sequence
  MKO10039755_A_Pcdha4
  gRNA
cgcgcaccuuagccaccaca

SEQ ID NO: 39756 - RNA, 20 nt, Artificial Sequence
  MKO10039756_A_Pcdha4
  gRNA
gaggcuggcauucuacgggc

SEQ ID NO: 39757 - RNA, 20 nt, Artificial Sequence
  MKO10039757_A_Pcdha5
  gRNA
caugccgcgucaacgcuugu

SEQ ID NO: 39758 - RNA, 20 nt, Artificial Sequence
  MKO10039758_A_Pcdha5
  gRNA
cacguugacaucuaucagcg

SEQ ID NO: 39759 - RNA, 20 nt, Artificial Sequence
  MKO10039759_A_Pcdha5
  gRNA
ggcuccuaaagcuuugccgg

SEQ ID NO: 39760 - RNA, 20 nt, Artificial Sequence
  MKO10039760_A_Pcdha6
  gRNA
ggcaccuugcgcucgcgaag

SEQ ID NO: 39761 - RNA, 20 nt, Artificial Sequence
  MKO10039761_A_Pcdha6
  gRNA
aaagccucuucgcgagcgca

SEQ ID NO: 39762 - RNA, 20 nt, Artificial Sequence
  MKO10039762_A_Pcdha6
  gRNA
ggcuccuaaagcuuugccgg

SEQ ID NO: 39763 - RNA, 20 nt, Artificial Sequence
  MKO10039763_A_Pcdha7
  gRNA
agcguauuugaccgugauuc

SEQ ID NO: 39764 - RNA, 20 nt, Artificial Sequence
  MKO10039764_A_Pcdha7
  gRNA
ggcuccuaaagcuuugccgg

SEQ ID NO: 39765 - RNA, 20 nt, Artificial Sequence
  MKO10039765_A_Pcdha7
  gRNA
uccuuucucccccgccgcaa

SEQ ID NO: 39766 - RNA, 20 nt, Artificial Sequence
  MKO10039766_A_Pcdha8
  gRNA
guucaagauccugcgcgaug

SEQ ID NO: 39767 - RNA, 20 nt, Artificial Sequence
  MKO10039767_A_Pcdha8
  gRNA
cguggauccuggucacgugg

SEQ ID NO: 39768 - RNA, 20 nt, Artificial Sequence
  MKO10039768_A_Pcdha8
  gRNA
ggcuccuaaagcuuugccgg

SEQ ID NO: 39769 - RNA, 20 nt, Artificial Sequence
  MKO10039769_A_Pcdha9
  gRNA
uuuaccgcgccagcgccuau

SEQ ID NO: 39770 - RNA, 20 nt, Artificial Sequence
  MKO10039770_A_Pcdha9
  gRNA
caaaccugaauuuacgggau

SEQ ID NO: 39771 - RNA, 20 nt, Artificial Sequence
  MKO10039771_A_Pcdha9
  gRNA
gaggcuggcauucuacgggc

SEQ ID NO: 39772 - RNA, 20 nt, Artificial Sequence
  MKO10039772_A_Pcdhac1
  gRNA
cgacccgcgaucccaugucc

SEQ ID NO: 39773 - RNA, 20 nt, Artificial Sequence
  MKO10039773_A_Pcdhac1
  gRNA
gcacuccguauacaguacua

SEQ ID NO: 39774 - RNA, 20 nt, Artificial Sequence
  MKO10039774_A_Pcdhac1
  gRNA
gaggcuggcauucuacgggc

SEQ ID NO: 39775 - RNA, 20 nt, Artificial Sequence
  MKO10039775_A_Pcdhac2
  gRNA
gagcgcucuucgucaacgag

SEQ ID NO: 39776 - RNA, 20 nt, Artificial Sequence
  MKO10039776_A_Pcdhac2
  gRNA
ccggcacggaguaucguagc

SEQ ID NO: 39777 - RNA, 20 nt, Artificial Sequence
  MKO10039777_A_Pcdhac2
  gRNA
gaggcuggcauucuacgggc

SEQ ID NO: 39778 - RNA, 20 nt, Artificial Sequence
  MKO10039778_A_Pcdhb10
  gRNA
cauguucgcgccacagaccg

SEQ ID NO: 39779 - RNA, 20 nt, Artificial Sequence
  MKO10039779_A_Pcdhb10
  gRNA
ugcuaagcgcgggugaacca

SEQ ID NO: 39780 - RNA, 20 nt, Artificial Sequence
  MKO10039780_A_Pcdhb10
  gRNA
ggcgcgaacaugaaacucga

SEQ ID NO: 39781 - RNA, 20 nt, Artificial Sequence
  MKO10039781_A_Pcdhb11
  gRNA
gggggugcuccgccucgguc

SEQ ID NO: 39782 - RNA, 20 nt, Artificial Sequence
  MKO10039782_A_Pcdhb11
  gRNA
acgcuccagaguugaugauc

SEQ ID NO: 39783 - RNA, 20 nt, Artificial Sequence
  MKO10039783_A_Pcdhb11
  gRNA
agcgacugugaguaaugacg

SEQ ID NO: 39784 - RNA, 20 nt, Artificial Sequence
  MKO10039784_A_Pcdhb12
  gRNA
uuugcacggacccucacgag

SEQ ID NO: 39785 - RNA, 20 nt, Artificial Sequence
  MKO10039785_A_Pcdhb12
  gRNA
cuagcacuaccacacgcacg

SEQ ID NO: 39786 - RNA, 20 nt, Artificial Sequence
  MKO10039786_A_Pcdhb12
  gRNA
gcuguaccuagucguugccu

SEQ ID NO: 39787 - RNA, 20 nt, Artificial Sequence
  MKO10039787_A_Pcdhb13
  gRNA
agaugcgcucacguuauacc

SEQ ID NO: 39788 - RNA, 20 nt, Artificial Sequence
  MKO10039788_A_Pcdhb13
  gRNA
aauucgacugaaaagcacgu

SEQ ID NO: 39789 - RNA, 20 nt, Artificial Sequence
  MKO10039789_A_Pcdhb13
  gRNA
uaucauucacguccaauacu

SEQ ID NO: 39790 - RNA, 20 nt, Artificial Sequence
  MKO10039790_A_Pcdhb14
  gRNA
aaaaucgcgacuauaguuuc

SEQ ID NO: 39791 - RNA, 20 nt, Artificial Sequence
  MKO10039791_A_Pcdhb14
  gRNA
caucacguauuccguucuag

SEQ ID NO: 39792 - RNA, 20 nt, Artificial Sequence
  MKO10039792_A_Pcdhb14
  gRNA
ggaaauucagucuuaccgca

SEQ ID NO: 39793 - RNA, 20 nt, Artificial Sequence
  MKO10039793_A_Pcdhb15
  gRNA
uuacugcucaguccgcuuac

SEQ ID NO: 39794 - RNA, 20 nt, Artificial Sequence
  MKO10039794_A_Pcdhb15
  gRNA
gugaggcagccgcaacgagu

SEQ ID NO: 39795 - RNA, 20 nt, Artificial Sequence
  MKO10039795_A_Pcdhb15
  gRNA
uccaagagaagcgucgcccc

SEQ ID NO: 39796 - RNA, 20 nt, Artificial Sequence
  MKO10039796_A_Pcdhb16
  gRNA
aguuccccugcagucguuag

SEQ ID NO: 39797 - RNA, 20 nt, Artificial Sequence
  MKO10039797_A_Pcdhb16
  gRNA
gauacuugucaauaccguuu

SEQ ID NO: 39798 - RNA, 20 nt, Artificial Sequence
  MKO10039798_A_Pcdhb16
  gRNA
ggcacgugauccugaucaug

SEQ ID NO: 39799 - RNA, 20 nt, Artificial Sequence
  MKO10039799_A_Pcdhb17
  gRNA
uagagcguccucaucgugcg

SEQ ID NO: 39800 - RNA, 20 nt, Artificial Sequence
  MKO10039800_A_Pcdhb17
  gRNA
ggagauucggcuacgaaaag

SEQ ID NO: 39801 - RNA, 20 nt, Artificial Sequence
  MKO10039801_A_Pcdhb17
  gRNA
aaugauccgagcccugcgau

SEQ ID NO: 39802 - RNA, 20 nt, Artificial Sequence
  MKO10039802_A_Pcdhb18
  gRNA
gaaccguacaucucgccgaa

SEQ ID NO: 39803 - RNA, 20 nt, Artificial Sequence
  MKO10039803_A_Pcdhb18
  gRNA
gggccuuucggcgagaugua

SEQ ID NO: 39804 - RNA, 20 nt, Artificial Sequence
  MKO10039804_A_Pcdhb18
  gRNA
auuuguggcgaaccuagcaa

SEQ ID NO: 39805 - RNA, 20 nt, Artificial Sequence
  MKO10039805_A_Pcdhb19
  gRNA
agugcgaucgauuuagaugu

SEQ ID NO: 39806 - RNA, 20 nt, Artificial Sequence
  MKO10039806_A_Pcdhb19
  gRNA
gacugcauugguccgagugg

SEQ ID NO: 39807 - RNA, 20 nt, Artificial Sequence
  MKO10039807_A_Pcdhb19
  gRNA
agcuuuaaugauuaucgagu

SEQ ID NO: 39808 - RNA, 20 nt, Artificial Sequence
  MKO10039808_A_Pcdhb1
  gRNA
cgcggccacaauccgcuauu

SEQ ID NO: 39809 - RNA, 20 nt, Artificial Sequence
  MKO10039809_A_Pcdhb1
  gRNA
ucagcgggccaugaccggau

SEQ ID NO: 39810 - RNA, 20 nt, Artificial Sequence
  MKO10039810_A_Pcdhb1
  gRNA
gaaucaugggagcugcgcgc

SEQ ID NO: 39811 - RNA, 20 nt, Artificial Sequence
  MKO10039811_A_Pcdhb20
  gRNA
accgacgacaugaucacuuc

SEQ ID NO: 39812 - RNA, 20 nt, Artificial Sequence
  MKO10039812_A_Pcdhb20
  gRNA
cacgauccagucgcucauuc

SEQ ID NO: 39813 - RNA, 20 nt, Artificial Sequence
  MKO10039813_A_Pcdhb20
  gRNA
uggaaagauauacccggagc

SEQ ID NO: 39814 - RNA, 20 nt, Artificial Sequence
  MKO10039814_A_Pcdhb21
  gRNA
uccaguucuaaccgcaaaua

SEQ ID NO: 39815 - RNA, 20 nt, Artificial Sequence
  MKO10039815_A_Pcdhb21
  gRNA
caccgucaugaucuccgacc

SEQ ID NO: 39816 - RNA, 20 nt, Artificial Sequence
  MKO10039816_A_Pcdhb21
  gRNA
guagagucgugcgcaaccuc

SEQ ID NO: 39817 - RNA, 20 nt, Artificial Sequence
  MKO10039817_A_Pcdhb22
  gRNA
cggauucgagaccgagacuc

SEQ ID NO: 39818 - RNA, 20 nt, Artificial Sequence
  MKO10039818_A_Pcdhb22
  gRNA
ggacaaggagcucgaucgcg

SEQ ID NO: 39819 - RNA, 20 nt, Artificial Sequence
  MKO10039819_A_Pcdhb22
  gRNA
cauguuuccauccgcaaccg

SEQ ID NO: 39820 - RNA, 20 nt, Artificial Sequence
  MKO10039820_A_Pcdhb2
  gRNA
ccgcgccgccaacaucuacc

SEQ ID NO: 39821 - RNA, 20 nt, Artificial Sequence
  MKO10039821_A_Pcdhb2
  gRNA
ggaccgcgagucauuuccaa

SEQ ID NO: 39822 - RNA, 20 nt, Artificial Sequence
  MKO10039822_A_Pcdhb2
  gRNA
aggcguaagcuauauuucca

SEQ ID NO: 39823 - RNA, 20 nt, Artificial Sequence
  MKO10039823_A_Pcdhb3
  gRNA
auguucacacccgccgucgc

SEQ ID NO: 39824 - RNA, 20 nt, Artificial Sequence
  MKO10039824_A_Pcdhb3
  gRNA
cgacuccguccaaaacgacg

SEQ ID NO: 39825 - RNA, 20 nt, Artificial Sequence
  MKO10039825_A_Pcdhb3
  gRNA
acggagucgcgugccaccuc

SEQ ID NO: 39826 - RNA, 20 nt, Artificial Sequence
  MKO10039826_A_Pcdhb4
  gRNA
gcgauuuccacauuauagua

SEQ ID NO: 39827 - RNA, 20 nt, Artificial Sequence
  MKO10039827_A_Pcdhb4
  gRNA
ucgccccgcaaagccccuca

SEQ ID NO: 39828 - RNA, 20 nt, Artificial Sequence
  MKO10039828_A_Pcdhb4
  gRNA
agcguagagaccgucaacuc

SEQ ID NO: 39829 - RNA, 20 nt, Artificial Sequence
  MKO10039829_A_Pcdhb5
  gRNA
cagaaucucuaucccguauu

SEQ ID NO: 39830 - RNA, 20 nt, Artificial Sequence
  MKO10039830_A_Pcdhb5
  gRNA
cgaauacgggauagagauuc

SEQ ID NO: 39831 - RNA, 20 nt, Artificial Sequence
  MKO10039831_A_Pcdhb5
  gRNA
augauagcgaccacaguuuc

SEQ ID NO: 39832 - RNA, 20 nt, Artificial Sequence
  MKO10039832_A_Pcdhb6
  gRNA
gaagagucgugcugcaccuc

SEQ ID NO: 39833 - RNA, 20 nt, Artificial Sequence
  MKO10039833_A_Pcdhb6
  gRNA
caccaucauagucuccgauu

SEQ ID NO: 39834 - RNA, 20 nt, Artificial Sequence
  MKO10039834_A_Pcdhb6
  gRNA
gagccugggugugcccaaau

SEQ ID NO: 39835 - RNA, 20 nt, Artificial Sequence
  MKO10039835_A_Pcdhb7
  gRNA
ucccagcgucuugaaccaac

SEQ ID NO: 39836 - RNA, 20 nt, Artificial Sequence
  MKO10039836_A_Pcdhb7
  gRNA
ucguggggauaaaguugugc

SEQ ID NO: 39837 - RNA, 20 nt, Artificial Sequence
  MKO10039837_A_Pcdhb7
  gRNA
ugcugagcgcagaugagccg

SEQ ID NO: 39838 - RNA, 20 nt, Artificial Sequence
  MKO10039838_A_Pcdhb8
  gRNA
gcagcaacgaguagauaaua

SEQ ID NO: 39839 - RNA, 20 nt, Artificial Sequence
  MKO10039839_A_Pcdhb8
  gRNA
cucgcccgcgcucagcucag

SEQ ID NO: 39840 - RNA, 20 nt, Artificial Sequence
  MKO10039840_A_Pcdhb8
  gRNA
cgguuagcuaagaguccuga

SEQ ID NO: 39841 - RNA, 20 nt, Artificial Sequence
  MKO10039841_A_Pcdhb9
  gRNA
aagauagaguaucgaauugu

SEQ ID NO: 39842 - RNA, 20 nt, Artificial Sequence
  MKO10039842_A_Pcdhb9
  gRNA
gcgggaucccgcgcuaccuc

SEQ ID NO: 39843 - RNA, 20 nt, Artificial Sequence
  MKO10039843_A_Pcdhb9
  gRNA
cuacccuaugcagaacgccu

SEQ ID NO: 39844 - RNA, 20 nt, Artificial Sequence
  MKO10039844_A_Pcdhga10
  gRNA
accggcgaaucuucugucac

SEQ ID NO: 39845 - RNA, 20 nt, Artificial Sequence
  MKO10039845_A_Pcdhga10
  gRNA
ggaccccgcguuccgccagc

SEQ ID NO: 39846 - RNA, 20 nt, Artificial Sequence
  MKO10039846_A_Pcdhga10
  gRNA
uacacguucuggcgguaguc

SEQ ID NO: 39847 - RNA, 20 nt, Artificial Sequence
  MKO10039847_A_Pcdhga11
  gRNA
uacacguucuggcgguaguc

SEQ ID NO: 39848 - RNA, 20 nt, Artificial Sequence
  MKO10039848_A_Pcdhga11
  gRNA
ucucggugaccgccauugau

SEQ ID NO: 39849 - RNA, 20 nt, Artificial Sequence
  MKO10039849_A_Pcdhga11
  gRNA
uccacgcccacaaagugcga

SEQ ID NO: 39850 - RNA, 20 nt, Artificial Sequence
  MKO10039850_A_Pcdhga12
  gRNA
augagcgaaaacgccgccgc

SEQ ID NO: 39851 - RNA, 20 nt, Artificial Sequence
  MKO10039851_A_Pcdhga12
  gRNA
uacacguucuggcgguaguc

SEQ ID NO: 39852 - RNA, 20 nt, Artificial Sequence
  MKO10039852_A_Pcdhga12
  gRNA
uacucggaccgagcaaacgc

SEQ ID NO: 39853 - RNA, 20 nt, Artificial Sequence
  MKO10039853_A_Pcdhga1
  gRNA
uacacguucuggcgguaguc

SEQ ID NO: 39854 - RNA, 20 nt, Artificial Sequence
  MKO10039854_A_Pcdhga1
  gRNA
ggcggcagcccaauacauuc

SEQ ID NO: 39855 - RNA, 20 nt, Artificial Sequence
  MKO10039855_A_Pcdhga1
  gRNA
cgccagaacguguacauccc

SEQ ID NO: 39856 - RNA, 20 nt, Artificial Sequence
  MKO10039856_A_Pcdhga2
  gRNA
acgugcgaacuggagcggau

SEQ ID NO: 39857 - RNA, 20 nt, Artificial Sequence
  MKO10039857_A_Pcdhga2
  gRNA
guaucccucauccgcgucag

SEQ ID NO: 39858 - RNA, 20 nt, Artificial Sequence
  MKO10039858_A_Pcdhga2
  gRNA
uacacguucuggcgguaguc

SEQ ID NO: 39859 - RNA, 20 nt, Artificial Sequence
  MKO10039859_A_Pcdhga3
  gRNA
uacacguucuggcgguaguc

SEQ ID NO: 39860 - RNA, 20 nt, Artificial Sequence
  MKO10039860_A_Pcdhga3
  gRNA
aguaccaacgucgaagccua

SEQ ID NO: 39861 - RNA, 20 nt, Artificial Sequence
  MKO10039861_A_Pcdhga3
  gRNA
cgccagaacguguacauccc

SEQ ID NO: 39862 - RNA, 20 nt, Artificial Sequence
  MKO10039862_A_Pcdhga4
  gRNA
aguaccggaucuguuccgcg

SEQ ID NO: 39863 - RNA, 20 nt, Artificial Sequence
  MKO10039863_A_Pcdhga4
  gRNA
uacacguucuggcgguaguc

SEQ ID NO: 39864 - RNA, 20 nt, Artificial Sequence
  MKO10039864_A_Pcdhga4
  gRNA
aacgugcacgacagcgacuc

SEQ ID NO: 39865 - RNA, 20 nt, Artificial Sequence
  MKO10039865_A_Pcdhga5
  gRNA
uacgccuaugacgcugacag

SEQ ID NO: 39866 - RNA, 20 nt, Artificial Sequence
  MKO10039866_A_Pcdhga5
  gRNA
uacacguucuggcgguaguc

SEQ ID NO: 39867 - RNA, 20 nt, Artificial Sequence
  MKO10039867_A_Pcdhga5
  gRNA
gugcuccccuucgcgagaga

SEQ ID NO: 39868 - RNA, 20 nt, Artificial Sequence
  MKO10039868_A_Pcdhga6
  gRNA
uacacguucuggcgguaguc

SEQ ID NO: 39869 - RNA, 20 nt, Artificial Sequence
  MKO10039869_A_Pcdhga6
  gRNA
gaauucgcgccaugccuguu

SEQ ID NO: 39870 - RNA, 20 nt, Artificial Sequence
  MKO10039870_A_Pcdhga6
  gRNA
uacagaacuggaucgcgaac

SEQ ID NO: 39871 - RNA, 20 nt, Artificial Sequence
  MKO10039871_A_Pcdhga7
  gRNA
aggacgacaccgguaccccc

SEQ ID NO: 39872 - RNA, 20 nt, Artificial Sequence
  MKO10039872_A_Pcdhga7
  gRNA
uacacguucuggcgguaguc

SEQ ID NO: 39873 - RNA, 20 nt, Artificial Sequence
  MKO10039873_A_Pcdhga7
  gRNA
auugaucgcucuaacuuaaa

SEQ ID NO: 39874 - RNA, 20 nt, Artificial Sequence
  MKO10039874_A_Pcdhga8
  gRNA
uacacguucuggcgguaguc

SEQ ID NO: 39875 - RNA, 20 nt, Artificial Sequence
  MKO10039875_A_Pcdhga8
  gRNA
cgccagaacguguacauccc

SEQ ID NO: 39876 - RNA, 20 nt, Artificial Sequence
  MKO10039876_A_Pcdhga8
  gRNA
agucaccuacccgcucgugc

SEQ ID NO: 39877 - RNA, 20 nt, Artificial Sequence
  MKO10039877_A_Pcdhga9
  gRNA
uacacguucuggcgguaguc

SEQ ID NO: 39878 - RNA, 20 nt, Artificial Sequence
  MKO10039878_A_Pcdhga9
  gRNA
cgcccaugacccugacgacg

SEQ ID NO: 39879 - RNA, 20 nt, Artificial Sequence
  MKO10039879_A_Pcdhga9
  gRNA
cgccagaacguguacauccc

SEQ ID NO: 39880 - RNA, 20 nt, Artificial Sequence
  MKO10039880_A_Pcdhgb1
  gRNA
uacacguucuggcgguaguc

SEQ ID NO: 39881 - RNA, 20 nt, Artificial Sequence
  MKO10039881_A_Pcdhgb1
  gRNA
cgccagaacguguacauccc

SEQ ID NO: 39882 - RNA, 20 nt, Artificial Sequence
  MKO10039882_A_Pcdhgb1
  gRNA
ugcuucacauucuacgacua

SEQ ID NO: 39883 - RNA, 20 nt, Artificial Sequence
  MKO10039883_A_Pcdhgb2
  gRNA
uacacguucuggcgguaguc

SEQ ID NO: 39884 - RNA, 20 nt, Artificial Sequence
  MKO10039884_A_Pcdhgb2
  gRNA
uguauuccgguaucgccucc

SEQ ID NO: 39885 - RNA, 20 nt, Artificial Sequence
  MKO10039885_A_Pcdhgb2
  gRNA
cccaagagucgucgccgcag

SEQ ID NO: 39886 - RNA, 20 nt, Artificial Sequence
  MKO10039886_A_Pcdhgb4
  gRNA
uacacguucuggcgguaguc

SEQ ID NO: 39887 - RNA, 20 nt, Artificial Sequence
  MKO10039887_A_Pcdhgb4
  gRNA
cacuccgcuuugcgcguuua

SEQ ID NO: 39888 - RNA, 20 nt, Artificial Sequence
  MKO10039888_A_Pcdhgb4
  gRNA
guucacaucgccuauaugca

SEQ ID NO: 39889 - RNA, 20 nt, Artificial Sequence
  MKO10039889_A_Pcdhgb5
  gRNA
uacacguucuggcgguaguc

SEQ ID NO: 39890 - RNA, 20 nt, Artificial Sequence
  MKO10039890_A_Pcdhgb5
  gRNA
gggaggauccccgccgucua

SEQ ID NO: 39891 - RNA, 20 nt, Artificial Sequence
  MKO10039891_A_Pcdhgb5
  gRNA
cgccagaacguguacauccc

SEQ ID NO: 39892 - RNA, 20 nt, Artificial Sequence
  MKO10039892_A_Pcdhgb6
  gRNA
uacacguucuggcgguaguc

SEQ ID NO: 39893 - RNA, 20 nt, Artificial Sequence
  MKO10039893_A_Pcdhgb6
  gRNA
cgccagaacguguacauccc

SEQ ID NO: 39894 - RNA, 20 nt, Artificial Sequence
  MKO10039894_A_Pcdhgb6
  gRNA
agucaccuacccgcucgugc

SEQ ID NO: 39895 - RNA, 20 nt, Artificial Sequence
  MKO10039895_A_Pcdhgb7
  gRNA
uacucagcuccgaauccgag

SEQ ID NO: 39896 - RNA, 20 nt, Artificial Sequence
  MKO10039896_A_Pcdhgb7
  gRNA
uacacguucuggcgguaguc

SEQ ID NO: 39897 - RNA, 20 nt, Artificial Sequence
  MKO10039897_A_Pcdhgb7
  gRNA
aggggaugggaugaucgacg

SEQ ID NO: 39898 - RNA, 20 nt, Artificial Sequence
  MKO10039898_A_Pcdhgb8
  gRNA
cgcugacgugaaaaacguuu

SEQ ID NO: 39899 - RNA, 20 nt, Artificial Sequence
  MKO10039899_A_Pcdhgb8
  gRNA
uucgcgaauuacuuccaacc

SEQ ID NO: 39900 - RNA, 20 nt, Artificial Sequence
  MKO10039900_A_Pcdhgb8
  gRNA
uacacguucuggcgguaguc

SEQ ID NO: 39901 - RNA, 20 nt, Artificial Sequence
  MKO10039901_A_Pcdhgc3
  gRNA
gagcgcgcacgaucccgaug

SEQ ID NO: 39902 - RNA, 20 nt, Artificial Sequence
  MKO10039902_A_Pcdhgc3
  gRNA
uacacguucuggcgguaguc

SEQ ID NO: 39903 - RNA, 20 nt, Artificial Sequence
  MKO10039903_A_Pcdhgc3
  gRNA
gauguucgucaacgaucgac

SEQ ID NO: 39904 - RNA, 20 nt, Artificial Sequence
  MKO10039904_A_Pcdhgc4
  gRNA
aucacgccccccgauuuccg

SEQ ID NO: 39905 - RNA, 20 nt, Artificial Sequence
  MKO10039905_A_Pcdhgc4
  gRNA
cguguuggagagcgcgccag

SEQ ID NO: 39906 - RNA, 20 nt, Artificial Sequence
  MKO10039906_A_Pcdhgc4
  gRNA
uacacguucuggcgguaguc

SEQ ID NO: 39907 - RNA, 20 nt, Artificial Sequence
  MKO10039907_A_Pcdhgc5
  gRNA
uacacguucuggcgguaguc

SEQ ID NO: 39908 - RNA, 20 nt, Artificial Sequence
  MKO10039908_A_Pcdhgc5
  gRNA
cgggcauuaucccccucguc

SEQ ID NO: 39909 - RNA, 20 nt, Artificial Sequence
  MKO10039909_A_Pcdhgc5
  gRNA
gagaugcgcaucucucgauc

SEQ ID NO: 39910 - RNA, 20 nt, Artificial Sequence
  MKO10039910_A_Pced1a
  gRNA
caacgggacacaguaccgcg

SEQ ID NO: 39911 - RNA, 20 nt, Artificial Sequence
  MKO10039911_A_Pced1a
  gRNA
accuggcagccggucauguu

SEQ ID NO: 39912 - RNA, 20 nt, Artificial Sequence
  MKO10039912_A_Pced1a
  gRNA
uucguacaaagacucguucc

SEQ ID NO: 39913 - RNA, 20 nt, Artificial Sequence
  MKO10039913_A_Pced1b
  gRNA
caaccgcacggacuaccgcg

SEQ ID NO: 39914 - RNA, 20 nt, Artificial Sequence
  MKO10039914_A_Pced1b
  gRNA
aggcaccaugguccgccugu

SEQ ID NO: 39915 - RNA, 20 nt, Artificial Sequence
  MKO10039915_A_Pced1b
  gRNA
ugccggauuggagcuccucu

SEQ ID NO: 39916 - RNA, 20 nt, Artificial Sequence
  MKO10039916_A_Pcf11
  gRNA
auaauuggugaccgagacuu

SEQ ID NO: 39917 - RNA, 20 nt, Artificial Sequence
  MKO10039917_A_Pcf11
  gRNA
accgggauccccgucuuaac

SEQ ID NO: 39918 - RNA, 20 nt, Artificial Sequence
  MKO10039918_A_Pcf11
  gRNA
uauuuaaauuacguuccaca

SEQ ID NO: 39919 - RNA, 20 nt, Artificial Sequence
  MKO10039919_A_Pcgf1
  gRNA
auaguguauaagcuagugcc

SEQ ID NO: 39920 - RNA, 20 nt, Artificial Sequence
  MKO10039920_A_Pcgf1
  gRNA
caaggacauaccuucaccac

SEQ ID NO: 39921 - RNA, 20 nt, Artificial Sequence
  MKO10039921_A_Pcgf1
  gRNA
gggagacucugucuaagccu

SEQ ID NO: 39922 - RNA, 20 nt, Artificial Sequence
  MKO10039922_A_Pcgf2
  gRNA
cuccaaguagcguacgaugc

SEQ ID NO: 39923 - RNA, 20 nt, Artificial Sequence
  MKO10039923_A_Pcgf2
  gRNA
aaccugcaucguacgcuacu

SEQ ID NO: 39924 - RNA, 20 nt, Artificial Sequence
  MKO10039924_A_Pcgf2
  gRNA
gacgccuucguagaacucaa

SEQ ID NO: 39925 - RNA, 20 nt, Artificial Sequence
  MKO10039925_A_Pcgf3
  gRNA
cugauggaucacgauccugc

SEQ ID NO: 39926 - RNA, 20 nt, Artificial Sequence
  MKO10039926_A_Pcgf3
  gRNA
acucacccgauauacuguaa

SEQ ID NO: 39927 - RNA, 20 nt, Artificial Sequence
  MKO10039927_A_Pcgf3
  gRNA
auuugaauugucgucugcuu

SEQ ID NO: 39928 - RNA, 20 nt, Artificial Sequence
  MKO10039928_A_Pcgf5
  gRNA
cugcaggcuggauaacacgu

SEQ ID NO: 39929 - RNA, 20 nt, Artificial Sequence
  MKO10039929_A_Pcgf5
  gRNA
aacucacguucucguagucc

SEQ ID NO: 39930 - RNA, 20 nt, Artificial Sequence
  MKO10039930_A_Pcgf5
  gRNA
cccgcaaauugcuaucuguc

SEQ ID NO: 39931 - RNA, 20 nt, Artificial Sequence
  MKO10039931_A_Pcgf6
  gRNA
aaccuuugcaaaucgaacac

SEQ ID NO: 39932 - RNA, 20 nt, Artificial Sequence
  MKO10039932_A_Pcgf6
  gRNA
uguagggggucagcucgaca

SEQ ID NO: 39933 - RNA, 20 nt, Artificial Sequence
  MKO10039933_A_Pcgf6
  gRNA
uggacaacuauguugcauuu

SEQ ID NO: 39934 - RNA, 20 nt, Artificial Sequence
  MKO10039934_A_Pcid2
  gRNA
gauauuggacuaucaccguc

SEQ ID NO: 39935 - RNA, 20 nt, Artificial Sequence
  MKO10039935_A_Pcid2
  gRNA
cgcaacaugagggugcuuaa

SEQ ID NO: 39936 - RNA, 20 nt, Artificial Sequence
  MKO10039936_A_Pcid2
  gRNA
acccucauguugcgaaccca

SEQ ID NO: 39937 - RNA, 20 nt, Artificial Sequence
  MKO10039937_A_Pcif1
  gRNA
ugaagcuccgccagcacuac

SEQ ID NO: 39938 - RNA, 20 nt, Artificial Sequence
  MKO10039938_A_Pcif1
  gRNA
cacgucgugcugacccagca

SEQ ID NO: 39939 - RNA, 20 nt, Artificial Sequence
  MKO10039939_A_Pcif1
  gRNA
ccuccuguagucggacccuc

SEQ ID NO: 39940 - RNA, 20 nt, Artificial Sequence
  MKO10039940_A_Pck1
  gRNA
guugcggaucgccagccguc

SEQ ID NO: 39941 - RNA, 20 nt, Artificial Sequence
  MKO10039941_A_Pck1
  gRNA
cugggcauaacuaaccccga

SEQ ID NO: 39942 - RNA, 20 nt, Artificial Sequence
  MKO10039942_A_Pck1
  gRNA
ccgagucaugauccgcaugc

SEQ ID NO: 39943 - RNA, 20 nt, Artificial Sequence
  MKO10039943_A_Pck2
  gRNA
uaugcguauuaugacccgcc

SEQ ID NO: 39944 - RNA, 20 nt, Artificial Sequence
  MKO10039944_A_Pck2
  gRNA
ucugauaggcuuagccggca

SEQ ID NO: 39945 - RNA, 20 nt, Artificial Sequence
  MKO10039945_A_Pck2
  gRNA
ccaggcgagaggcgaugcgc

SEQ ID NO: 39946 - RNA, 20 nt, Artificial Sequence
  MKO10039946_A_Pclo
  gRNA
ccgccgagccaugggcaacg

SEQ ID NO: 39947 - RNA, 20 nt, Artificial Sequence
  MKO10039947_A_Pclo
  gRNA
agguccgccuccaugccggc

SEQ ID NO: 39948 - RNA, 20 nt, Artificial Sequence
  MKO10039948_A_Pclo
  gRNA
aacgucugagguguggcgcc

SEQ ID NO: 39949 - RNA, 20 nt, Artificial Sequence
  MKO10039949_A_Pcm1
  gRNA
gguaacuaacgcuauuucuc

SEQ ID NO: 39950 - RNA, 20 nt, Artificial Sequence
  MKO10039950_A_Pcm1
  gRNA
augaguaagacgcucaacau

SEQ ID NO: 39951 - RNA, 20 nt, Artificial Sequence
  MKO10039951_A_Pcm1
  gRNA
gcgagcucugcagggccgac

SEQ ID NO: 39952 - RNA, 20 nt, Artificial Sequence
  MKO10039952_A_Pcmt1
  gRNA
caccagccgcacucgccccg

SEQ ID NO: 39953 - RNA, 20 nt, Artificial Sequence
  MKO10039953_A_Pcmt1
  gRNA
ucuuaccauccgugcaaaac

SEQ ID NO: 39954 - RNA, 20 nt, Artificial Sequence
  MKO10039954_A_Pcmt1
  gRNA
gaggggcacugauuguugcc

SEQ ID NO: 39955 - RNA, 20 nt, Artificial Sequence
  MKO10039955_A_Pcmtd1
  gRNA
caucgaagccaugaagcgcg

SEQ ID NO: 39956 - RNA, 20 nt, Artificial Sequence
  MKO10039956_A_Pcmtd1
  gRNA
aggugguuccucgcgcuuca

SEQ ID NO: 39957 - RNA, 20 nt, Artificial Sequence
  MKO10039957_A_Pcmtd1
  gRNA
auucugugaacccgcauuug

SEQ ID NO: 39958 - RNA, 20 nt, Artificial Sequence
  MKO10039958_A_Pcmtd2
  gRNA
ggcgcaauacccucugacga

SEQ ID NO: 39959 - RNA, 20 nt, Artificial Sequence
  MKO10039959_A_Pcmtd2
  gRNA
caucaagagggcuaugcgac

SEQ ID NO: 39960 - RNA, 20 nt, Artificial Sequence
  MKO10039960_A_Pcmtd2
  gRNA
ugaguacgcgaagcagaaac

SEQ ID NO: 39961 - RNA, 20 nt, Artificial Sequence
  MKO10039961_A_Pcna
  gRNA
cuguguaauaaagaugccgu

SEQ ID NO: 39962 - RNA, 20 nt, Artificial Sequence
  MKO10039962_A_Pcna
  gRNA
auacgugcaaauucacccga

SEQ ID NO: 39963 - RNA, 20 nt, Artificial Sequence
  MKO10039963_A_Pcna
  gRNA
agagcaaacguuaggugaac

SEQ ID NO: 39964 - RNA, 20 nt, Artificial Sequence
  MKO10039964_A_Pcnp
  gRNA
cacacuugcuccgagucuaa

SEQ ID NO: 39965 - RNA, 20 nt, Artificial Sequence
  MKO10039965_A_Pcnp
  gRNA
cagggacacaccaacaucag

SEQ ID NO: 39966 - RNA, 20 nt, Artificial Sequence
  MKO10039966_A_Pcnp
  gRNA
gaccaaacuccuuuaauaaa

SEQ ID NO: 39967 - RNA, 20 nt, Artificial Sequence
  MKO10039967_A_Pcnt
  gRNA
aaccacacaccucgaucguc

SEQ ID NO: 39968 - RNA, 20 nt, Artificial Sequence
  MKO10039968_A_Pcnt
  gRNA
agagcagcacgcccgcgaga

SEQ ID NO: 39969 - RNA, 20 nt, Artificial Sequence
  MKO10039969_A_Pcnt
  gRNA
gaaaaacgcccagacgaucg

SEQ ID NO: 39970 - RNA, 20 nt, Artificial Sequence
  MKO10039970_A_Pcnxl2
  gRNA
augucgccugaucguuguuc

SEQ ID NO: 39971 - RNA, 20 nt, Artificial Sequence
  MKO10039971_A_Pcnxl2
  gRNA
aguggucgacucagacggcg

SEQ ID NO: 39972 - RNA, 20 nt, Artificial Sequence
  MKO10039972_A_Pcnxl2
  gRNA
ccugcaccucauguucgaca

SEQ ID NO: 39973 - RNA, 20 nt, Artificial Sequence
  MKO10039973_A_Pcnxl3
  gRNA
guuucuccacaaucucgccc

SEQ ID NO: 39974 - RNA, 20 nt, Artificial Sequence
  MKO10039974_A_Pcnxl3
  gRNA
acugcagcguacagggggcg

SEQ ID NO: 39975 - RNA, 20 nt, Artificial Sequence
  MKO10039975_A_Pcnxl3
  gRNA
gcgauaguucacagucuuga

SEQ ID NO: 39976 - RNA, 20 nt, Artificial Sequence
  MKO10039976_A_Pcnxl4
  gRNA
ucuuccgguacggugugacc

SEQ ID NO: 39977 - RNA, 20 nt, Artificial Sequence
  MKO10039977_A_Pcnxl4
  gRNA
ccgaaacccuuucuauccga

SEQ ID NO: 39978 - RNA, 20 nt, Artificial Sequence
  MKO10039978_A_Pcnxl4
  gRNA
gacaacuuaccguaggugag

SEQ ID NO: 39979 - RNA, 20 nt, Artificial Sequence
  MKO10039979_A_Pcnx
  gRNA
ggaucuggauccucucgacu

SEQ ID NO: 39980 - RNA, 20 nt, Artificial Sequence
  MKO10039980_A_Pcnx
  gRNA
cagcgagccaaagccgaaca

SEQ ID NO: 39981 - RNA, 20 nt, Artificial Sequence
  MKO10039981_A_Pcnx
  gRNA
cacugcuacuauaaucaucg

SEQ ID NO: 39982 - RNA, 20 nt, Artificial Sequence
  MKO10039982_A_Pcolce2
  gRNA
ccacgaagucauagcgacac

SEQ ID NO: 39983 - RNA, 20 nt, Artificial Sequence
  MKO10039983_A_Pcolce2
  gRNA
cagcguaucgggcgcuucug

SEQ ID NO: 39984 - RNA, 20 nt, Artificial Sequence
  MKO10039984_A_Pcolce2
  gRNA
gccagaccgagauuaccccg

SEQ ID NO: 39985 - RNA, 20 nt, Artificial Sequence
  MKO10039985_A_Pcolce
  gRNA
auacucaccagugcccgaag

SEQ ID NO: 39986 - RNA, 20 nt, Artificial Sequence
  MKO10039986_A_Pcolce
  gRNA
ccugagucggauuacccacc

SEQ ID NO: 39987 - RNA, 20 nt, Artificial Sequence
  MKO10039987_A_Pcolce
  gRNA
cgcagaagcguccaagucgc

SEQ ID NO: 39988 - RNA, 20 nt, Artificial Sequence
  MKO10039988_A_Pcp2
  gRNA
ucaccuaccuuggggccgau

SEQ ID NO: 39989 - RNA, 20 nt, Artificial Sequence
  MKO10039989_A_Pcp2
  gRNA
gggaauuaacuguuacacgc

SEQ ID NO: 39990 - RNA, 20 nt, Artificial Sequence
  MKO10039990_A_Pcp2
  gRNA
ggagcagcgcuguuccuugc

SEQ ID NO: 39991 - RNA, 20 nt, Artificial Sequence
  MKO10039991_A_Pcp4l1
  gRNA
aacaccuccagcagccaacc

SEQ ID NO: 39992 - RNA, 20 nt, Artificial Sequence
  MKO10039992_A_Pcp4l1
  gRNA
uugcaauccagggcaaguuc

SEQ ID NO: 39993 - RNA, 20 nt, Artificial Sequence
  MKO10039993_A_Pcp4l1
  gRNA
ggaacuugcccuggauugca

SEQ ID NO: 39994 - RNA, 20 nt, Artificial Sequence
  MKO10039994_A_Pcp4
  gRNA
aacggaaaagacaagacguc

SEQ ID NO: 39995 - RNA, 20 nt, Artificial Sequence
  MKO10039995_A_Pcp4
  gRNA
acagcugcacgcucugucuc

SEQ ID NO: 39996 - RNA, 20 nt, Artificial Sequence
  MKO10039996_A_Pcp4
  gRNA
agaagaauuugauaucgaca

SEQ ID NO: 39997 - RNA, 20 nt, Artificial Sequence
  MKO10039997_A_Pcsk1n
  gRNA
ggccgggggcgucggcauuu

SEQ ID NO: 39998 - RNA, 20 nt, Artificial Sequence
  MKO10039998_A_Pcsk1n
  gRNA
acgcgcgcguuccugucucu

SEQ ID NO: 39999 - RNA, 20 nt, Artificial Sequence
  MKO10039999_A_Pcsk1n
  gRNA
cggcgacgagacuccugacg

SEQ ID NO: 40000 - RNA, 20 nt, Artificial Sequence
  MKO10040000_A_Pcsk1
  gRNA
ugauaugaagagcgcuucuu

SEQ ID NO: 40001 - RNA, 20 nt, Artificial Sequence
  MKO10040001_A_Pcsk1
  gRNA
guuauuacuguacuggauga

SEQ ID NO: 40002 - RNA, 20 nt, Artificial Sequence
  MKO10040002_A_Pcsk1
  gRNA
uaccacugcugauuccacau

SEQ ID NO: 40003 - RNA, 20 nt, Artificial Sequence
  MKO10040003_A_Pcsk2
  gRNA
uacuuacguaguuguaggcc

SEQ ID NO: 40004 - RNA, 20 nt, Artificial Sequence
  MKO10040004_A_Pcsk2
  gRNA
gacgcagccuacaccauaag

SEQ ID NO: 40005 - RNA, 20 nt, Artificial Sequence
  MKO10040005_A_Pcsk2
  gRNA
aagauggcgcugcaacaaga

SEQ ID NO: 40006 - RNA, 20 nt, Artificial Sequence
  MKO10040006_A_Pcsk4
  gRNA
ccgggugaaacgcucccugg

SEQ ID NO: 40007 - RNA, 20 nt, Artificial Sequence
  MKO10040007_A_Pcsk4
  gRNA
ccacaccccggugccgcaga

SEQ ID NO: 40008 - RNA, 20 nt, Artificial Sequence
  MKO10040008_A_Pcsk4
  gRNA
cuuucuucagucguagacga

SEQ ID NO: 40009 - RNA, 20 nt, Artificial Sequence
  MKO10040009_A_Pcsk5
  gRNA
guugaugaauccguacuugc

SEQ ID NO: 40010 - RNA, 20 nt, Artificial Sequence
  MKO10040010_A_Pcsk5
  gRNA
uagacgcgcguccggcauac

SEQ ID NO: 40011 - RNA, 20 nt, Artificial Sequence
  MKO10040011_A_Pcsk5
  gRNA
cccgcagaucggugcacuga

SEQ ID NO: 40012 - RNA, 20 nt, Artificial Sequence
  MKO10040012_A_Pcsk6
  gRNA
uccuuucuaugccgucaucg

SEQ ID NO: 40013 - RNA, 20 nt, Artificial Sequence
  MKO10040013_A_Pcsk6
  gRNA
gacauacuuguucucguugc

SEQ ID NO: 40014 - RNA, 20 nt, Artificial Sequence
  MKO10040014_A_Pcsk6
  gRNA
agccacgcuuccacgccgcc

SEQ ID NO: 40015 - RNA, 20 nt, Artificial Sequence
  MKO10040015_A_Pcsk7
  gRNA
gccuacgggagccgaauagc

SEQ ID NO: 40016 - RNA, 20 nt, Artificial Sequence
  MKO10040016_A_Pcsk7
  gRNA
accugcuauucggcucccgu

SEQ ID NO: 40017 - RNA, 20 nt, Artificial Sequence
  MKO10040017_A_Pcsk7
  gRNA
cggaguggaacacaccgucc

SEQ ID NO: 40018 - RNA, 20 nt, Artificial Sequence
  MKO10040018_A_Pcsk9
  gRNA
uggagcgaauuaucccagca

SEQ ID NO: 40019 - RNA, 20 nt, Artificial Sequence
  MKO10040019_A_Pcsk9
  gRNA
ccgccggggcuaugucauca

SEQ ID NO: 40020 - RNA, 20 nt, Artificial Sequence
  MKO10040020_A_Pcsk9
  gRNA
caccgacuucaacagcgugc

SEQ ID NO: 40021 - RNA, 20 nt, Artificial Sequence
  MKO10040021_A_Pcup
  gRNA
ugccgucacucucgaucgcc

SEQ ID NO: 40022 - RNA, 20 nt, Artificial Sequence
  MKO10040022_A_Pcup
  gRNA
ugcuucagaacucuacgaga

SEQ ID NO: 40023 - RNA, 20 nt, Artificial Sequence
  MKO10040023_A_Pcup
  gRNA
aguccauguaaacaucugcg

SEQ ID NO: 40024 - RNA, 20 nt, Artificial Sequence
  MKO10040024_A_Pcx
  gRNA
uaugcacgacccgcaugccg

SEQ ID NO: 40025 - RNA, 20 nt, Artificial Sequence
  MKO10040025_A_Pcx
  gRNA
cgggccauugccaucgcugc

SEQ ID NO: 40026 - RNA, 20 nt, Artificial Sequence
  MKO10040026_A_Pcx
  gRNA
auuaucuucaaggccgccua

SEQ ID NO: 40027 - RNA, 20 nt, Artificial Sequence
  MKO10040027_A_Pcyox1l
  gRNA
ugaugccguaguaccaccag

SEQ ID NO: 40028 - RNA, 20 nt, Artificial Sequence
  MKO10040028_A_Pcyox1l
  gRNA
cggcgaacauuucgugcugg

SEQ ID NO: 40029 - RNA, 20 nt, Artificial Sequence
  MKO10040029_A_Pcyox1l
  gRNA
ggccaccgugauccacgcca

SEQ ID NO: 40030 - RNA, 20 nt, Artificial Sequence
  MKO10040030_A_Pcyox1
  gRNA
cguauagcaauagucggugc

SEQ ID NO: 40031 - RNA, 20 nt, Artificial Sequence
  MKO10040031_A_Pcyox1
  gRNA
caucucguugagaaacgucu

SEQ ID NO: 40032 - RNA, 20 nt, Artificial Sequence
  MKO10040032_A_Pcyox1
  gRNA
caaggucaugacuacgaggc

SEQ ID NO: 40033 - RNA, 20 nt, Artificial Sequence
  MKO10040033_A_Pcyt1a
  gRNA
agguggugcggaacgccccc

SEQ ID NO: 40034 - RNA, 20 nt, Artificial Sequence
  MKO10040034_A_Pcyt1a
  gRNA
cgugcagcacugccgcuacg

SEQ ID NO: 40035 - RNA, 20 nt, Artificial Sequence
  MKO10040035_A_Pcyt1a
  gRNA
acuuuaguaagcccuauguc

SEQ ID NO: 40036 - RNA, 20 nt, Artificial Sequence
  MKO10040036_A_Pcyt1b
  gRNA
aagucaucagagacgcgcca

SEQ ID NO: 40037 - RNA, 20 nt, Artificial Sequence
  MKO10040037_A_Pcyt1b
  gRNA
ucucagacacugucgauacg

SEQ ID NO: 40038 - RNA, 20 nt, Artificial Sequence
  MKO10040038_A_Pcyt1b
  gRNA
ugaaaaacugaccguugccc

SEQ ID NO: 40039 - RNA, 20 nt, Artificial Sequence
  MKO10040039_A_Pcyt2
  gRNA
uggcccgugccugccguagc

SEQ ID NO: 40040 - RNA, 20 nt, Artificial Sequence
  MKO10040040_A_Pcyt2
  gRNA
ccguaugcacacccacgaug

SEQ ID NO: 40041 - RNA, 20 nt, Artificial Sequence
  MKO10040041_A_Pcyt2
  gRNA
ccagcagcaugcgacccacg

SEQ ID NO: 40042 - RNA, 20 nt, Artificial Sequence
  MKO10040042_A_Pdap1
  gRNA
ucgcccggcuggcaaucauc

SEQ ID NO: 40043 - RNA, 20 nt, Artificial Sequence
  MKO10040043_A_Pdap1
  gRNA
cauugagaaccccaaccgcg

SEQ ID NO: 40044 - RNA, 20 nt, Artificial Sequence
  MKO10040044_A_Pdap1
  gRNA
aacuaagaaggucacgcaac

SEQ ID NO: 40045 - RNA, 20 nt, Artificial Sequence
  MKO10040045_A_Pdcd10
  gRNA
agcaacuuacccugcgguuc

SEQ ID NO: 40046 - RNA, 20 nt, Artificial Sequence
  MKO10040046_A_Pdcd10
  gRNA
guaccucaccuuaaugaaag

SEQ ID NO: 40047 - RNA, 20 nt, Artificial Sequence
  MKO10040047_A_Pdcd10
  gRNA
uaucagaguacaugauugag

SEQ ID NO: 40048 - RNA, 20 nt, Artificial Sequence
  MKO10040048_A_Pdcd11
  gRNA
cagcacuuuguugacacguu

SEQ ID NO: 40049 - RNA, 20 nt, Artificial Sequence
  MKO10040049_A_Pdcd11
  gRNA
caccaacgccaauguccacu

SEQ ID NO: 40050 - RNA, 20 nt, Artificial Sequence
  MKO10040050_A_Pdcd11
  gRNA
cggucacuugcacaaacccu

SEQ ID NO: 40051 - RNA, 20 nt, Artificial Sequence
  MKO10040051_A_Pdcd1lg2
  gRNA
cacacugcugccgacgucua

SEQ ID NO: 40052 - RNA, 20 nt, Artificial Sequence
  MKO10040052_A_Pdcd1lg2
  gRNA
gaaguguacaccguagacgu

SEQ ID NO: 40053 - RNA, 20 nt, Artificial Sequence
  MKO10040053_A_Pdcd1lg2
  gRNA
ugaccugguagaggccuucg

SEQ ID NO: 40054 - RNA, 20 nt, Artificial Sequence
  MKO10040054_A_Pdcd1
  gRNA
agccccucgcccaaaccaga

SEQ ID NO: 40055 - RNA, 20 nt, Artificial Sequence
  MKO10040055_A_Pdcd1
  gRNA
cggaggaucuuaugcugaac

SEQ ID NO: 40056 - RNA, 20 nt, Artificial Sequence
  MKO10040056_A_Pdcd1
  gRNA
gugccucggccaugggacgu

SEQ ID NO: 40057 - RNA, 20 nt, Artificial Sequence
  MKO10040057_A_Pdcd2l
  gRNA
gccgcucacgcucgucgugc

SEQ ID NO: 40058 - RNA, 20 nt, Artificial Sequence
  MKO10040058_A_Pdcd2l
  gRNA
accugcacgacgagcgugag

SEQ ID NO: 40059 - RNA, 20 nt, Artificial Sequence
  MKO10040059_A_Pdcd2l
  gRNA
uccaccacccgccucagauu

SEQ ID NO: 40060 - RNA, 20 nt, Artificial Sequence
  MKO10040060_A_Pdcd2
  gRNA
gcccaucucugucggguuug

SEQ ID NO: 40061 - RNA, 20 nt, Artificial Sequence
  MKO10040061_A_Pdcd2
  gRNA
gaguagaaugcguuguuccu

SEQ ID NO: 40062 - RNA, 20 nt, Artificial Sequence
  MKO10040062_A_Pdcd2
  gRNA
cauggcaaagcacgaaucca

SEQ ID NO: 40063 - RNA, 20 nt, Artificial Sequence
  MKO10040063_A_Pdcd4
  gRNA
uccaaacuaugaugacgacc

SEQ ID NO: 40064 - RNA, 20 nt, Artificial Sequence
  MKO10040064_A_Pdcd4
  gRNA
accuggucgucaucauaguu

SEQ ID NO: 40065 - RNA, 20 nt, Artificial Sequence
  MKO10040065_A_Pdcd4
  gRNA
agagagucgcuuaaauuguc

SEQ ID NO: 40066 - RNA, 20 nt, Artificial Sequence
  MKO10040066_A_Pdcd5
  gRNA
aagaugcuuacaucuggccc

SEQ ID NO: 40067 - RNA, 20 nt, Artificial Sequence
  MKO10040067_A_Pdcd5
  gRNA
ugguuauaggugucagaaca

SEQ ID NO: 40068 - RNA, 20 nt, Artificial Sequence
  MKO10040068_A_Pdcd5
  gRNA
accuuugcuuugcuuccugu

SEQ ID NO: 40069 - RNA, 20 nt, Artificial Sequence
  MKO10040069_A_Pdcd6ip
  gRNA
ucaccauggcgucguucauc

SEQ ID NO: 40070 - RNA, 20 nt, Artificial Sequence
  MKO10040070_A_Pdcd6ip
  gRNA
cucggcgcucggucgcccgc

SEQ ID NO: 40071 - RNA, 20 nt, Artificial Sequence
  MKO10040071_A_Pdcd6ip
  gRNA
aaccgcugcuaagcaguacc

SEQ ID NO: 40072 - RNA, 20 nt, Artificial Sequence
  MKO10040072_A_Pdcd6
  gRNA
augucuuccggaccuacgac

SEQ ID NO: 40073 - RNA, 20 nt, Artificial Sequence
  MKO10040073_A_Pdcd6
  gRNA
uccucauccgaaaauuugac

SEQ ID NO: 40074 - RNA, 20 nt, Artificial Sequence
  MKO10040074_A_Pdcd6
  gRNA
ugaagucaucaaaugcgauc

SEQ ID NO: 40075 - RNA, 20 nt, Artificial Sequence
  MKO10040075_A_Pdcd7
  gRNA
cguugcccagaugucguugc

SEQ ID NO: 40076 - RNA, 20 nt, Artificial Sequence
  MKO10040076_A_Pdcd7
  gRNA
aauacugccggaauggcugc

SEQ ID NO: 40077 - RNA, 20 nt, Artificial Sequence
  MKO10040077_A_Pdcd7
  gRNA
gcccuccgaguuaugcuaga

SEQ ID NO: 40078 - RNA, 20 nt, Artificial Sequence
  MKO10040078_A_Pdcl2
  gRNA
acuuagagaaaagcgguuac

SEQ ID NO: 40079 - RNA, 20 nt, Artificial Sequence
  MKO10040079_A_Pdcl2
  gRNA
uucaaugcagcuauucacga

SEQ ID NO: 40080 - RNA, 20 nt, Artificial Sequence
  MKO10040080_A_Pdcl2
  gRNA
ugguuaaccaccaagcacau

SEQ ID NO: 40081 - RNA, 20 nt, Artificial Sequence
  MKO10040081_A_Pdcl3
  gRNA
aacgagcuaucgagauguac

SEQ ID NO: 40082 - RNA, 20 nt, Artificial Sequence
  MKO10040082_A_Pdcl3
  gRNA
agcccucaccgucuaugguc

SEQ ID NO: 40083 - RNA, 20 nt, Artificial Sequence
  MKO10040083_A_Pdcl3
  gRNA
aaugacauccuacguaaaaa

SEQ ID NO: 40084 - RNA, 20 nt, Artificial Sequence
  MKO10040084_A_Pdcl
  gRNA
guacuacuacagcaccagcg

SEQ ID NO: 40085 - RNA, 20 nt, Artificial Sequence
  MKO10040085_A_Pdcl
  gRNA
auuccggguaaaacgacuac

SEQ ID NO: 40086 - RNA, 20 nt, Artificial Sequence
  MKO10040086_A_Pdcl
  gRNA
accccgccgucaaauucugu

SEQ ID NO: 40087 - RNA, 20 nt, Artificial Sequence
  MKO10040087_A_Pdc
  gRNA
ggaaaagcggucccccgcuc

SEQ ID NO: 40088 - RNA, 20 nt, Artificial Sequence
  MKO10040088_A_Pdc
  gRNA
agacguacucccuacguugc

SEQ ID NO: 40089 - RNA, 20 nt, Artificial Sequence
  MKO10040089_A_Pdc
  gRNA
acauuaguuaccugugugcg

SEQ ID NO: 40090 - RNA, 20 nt, Artificial Sequence
  MKO10040090_A_Pddc1
  gRNA
agugcugcaguauucgagcc

SEQ ID NO: 40091 - RNA, 20 nt, Artificial Sequence
  MKO10040091_A_Pddc1
  gRNA
uuagaacccaucugcgccau

SEQ ID NO: 40092 - RNA, 20 nt, Artificial Sequence
  MKO10040092_A_Pddc1
  gRNA
ggcggaagucuuguacccau

SEQ ID NO: 40093 - RNA, 20 nt, Artificial Sequence
  MKO10040093_A_Pde10a
  gRNA
gguuguccccgcccgugucc

SEQ ID NO: 40094 - RNA, 20 nt, Artificial Sequence
  MKO10040094_A_Pde10a
  gRNA
cucccugcauauucguaucc

SEQ ID NO: 40095 - RNA, 20 nt, Artificial Sequence
  MKO10040095_A_Pde10a
  gRNA
ugcagguuugacggaugaaa

SEQ ID NO: 40096 - RNA, 20 nt, Artificial Sequence
  MKO10040096_A_Pde11a
  gRNA
cagggaccuuauuuaucgcc

SEQ ID NO: 40097 - RNA, 20 nt, Artificial Sequence
  MKO10040097_A_Pde11a
  gRNA
uguggcccaggcgauaaaua

SEQ ID NO: 40098 - RNA, 20 nt, Artificial Sequence
  MKO10040098_A_Pde11a
  gRNA
ucagcaucagcgcugcacuu

SEQ ID NO: 40099 - RNA, 20 nt, Artificial Sequence
  MKO10040099_A_Pde12
  gRNA
ucgcaggucgcaaccggcuc

SEQ ID NO: 40100 - RNA, 20 nt, Artificial Sequence
  MKO10040100_A_Pde12
  gRNA
ccacgaagcgcgcugcggcc

SEQ ID NO: 40101 - RNA, 20 nt, Artificial Sequence
  MKO10040101_A_Pde12
  gRNA
gccaccgacauaauuugugu

SEQ ID NO: 40102 - RNA, 20 nt, Artificial Sequence
  MKO10040102_A_Pde1a
  gRNA
gcgguugauaagaucauauc

SEQ ID NO: 40103 - RNA, 20 nt, Artificial Sequence
  MKO10040103_A_Pde1a
  gRNA
uggacaaugcugcgaaacuu

SEQ ID NO: 40104 - RNA, 20 nt, Artificial Sequence
  MKO10040104_A_Pde1a
  gRNA
aaguugaagccaaccaaucc

SEQ ID NO: 40105 - RNA, 20 nt, Artificial Sequence
  MKO10040105_A_Pde1b
  gRNA
gagcguggucaucggcugcc

SEQ ID NO: 40106 - RNA, 20 nt, Artificial Sequence
  MKO10040106_A_Pde1b
  gRNA
uagccucaucagccgcuuua

SEQ ID NO: 40107 - RNA, 20 nt, Artificial Sequence
  MKO10040107_A_Pde1b
  gRNA
ccggagaacguauaccucug

SEQ ID NO: 40108 - RNA, 20 nt, Artificial Sequence
  MKO10040108_A_Pde1c
  gRNA
cucccguagguuacggucuu

SEQ ID NO: 40109 - RNA, 20 nt, Artificial Sequence
  MKO10040109_A_Pde1c
  gRNA
uucaaugcaucgauuacagc

SEQ ID NO: 40110 - RNA, 20 nt, Artificial Sequence
  MKO10040110_A_Pde1c
  gRNA
ugaccuuaaaacggcugauc

SEQ ID NO: 40111 - RNA, 20 nt, Artificial Sequence
  MKO10040111_A_Pde2a
  gRNA
caaugucgauaacggcgccu

SEQ ID NO: 40112 - RNA, 20 nt, Artificial Sequence
  MKO10040112_A_Pde2a
  gRNA
ggcucagccggucgcgcugc

SEQ ID NO: 40113 - RNA, 20 nt, Artificial Sequence
  MKO10040113_A_Pde2a
  gRNA
cgacauugcuggccugcgac

SEQ ID NO: 40114 - RNA, 20 nt, Artificial Sequence
  MKO10040114_A_Pde3a
  gRNA
cgcacgaagccccuucaccc

SEQ ID NO: 40115 - RNA, 20 nt, Artificial Sequence
  MKO10040115_A_Pde3a
  gRNA
ugagaagagucucgucaacu

SEQ ID NO: 40116 - RNA, 20 nt, Artificial Sequence
  MKO10040116_A_Pde3a
  gRNA
uuggugagagucgucaaccc

SEQ ID NO: 40117 - RNA, 20 nt, Artificial Sequence
  MKO10040117_A_Pde3b
  gRNA
gcuaaaugaagcucgcaaua

SEQ ID NO: 40118 - RNA, 20 nt, Artificial Sequence
  MKO10040118_A_Pde3b
  gRNA
gggaucgcagcagugguaag

SEQ ID NO: 40119 - RNA, 20 nt, Artificial Sequence
  MKO10040119_A_Pde3b
  gRNA
gugucacugacgcaccaugc

SEQ ID NO: 40120 - RNA, 20 nt, Artificial Sequence
  MKO10040120_A_Pde4a
  gRNA
ggaccacuaccacgcugacg

SEQ ID NO: 40121 - RNA, 20 nt, Artificial Sequence
  MKO10040121_A_Pde4a
  gRNA
cacaccugucggaaaugagc

SEQ ID NO: 40122 - RNA, 20 nt, Artificial Sequence
  MKO10040122_A_Pde4a
  gRNA
guagcacaucggcugcgugc

SEQ ID NO: 40123 - RNA, 20 nt, Artificial Sequence
  MKO10040123_A_Pde4b
  gRNA
acuuguucggcgcuccauga

SEQ ID NO: 40124 - RNA, 20 nt, Artificial Sequence
  MKO10040124_A_Pde4b
  gRNA
ucccuacguaccugggcaaa

SEQ ID NO: 40125 - RNA, 20 nt, Artificial Sequence
  MKO10040125_A_Pde4b
  gRNA
uaccagucccgacgaagagc

SEQ ID NO: 40126 - RNA, 20 nt, Artificial Sequence
  MKO10040126_A_Pde4c
  gRNA
ggucgcuguccgaacgguac

SEQ ID NO: 40127 - RNA, 20 nt, Artificial Sequence
  MKO10040127_A_Pde4c
  gRNA
ggaacacccaccugggcgaa

SEQ ID NO: 40128 - RNA, 20 nt, Artificial Sequence
  MKO10040128_A_Pde4c
  gRNA
acucgcgccgcuggacauga

SEQ ID NO: 40129 - RNA, 20 nt, Artificial Sequence
  MKO10040129_A_Pde4dip
  gRNA
aucgcuugccauccgccagc

SEQ ID NO: 40130 - RNA, 20 nt, Artificial Sequence
  MKO10040130_A_Pde4dip
  gRNA
uguugcguggguaacccuuu

SEQ ID NO: 40131 - RNA, 20 nt, Artificial Sequence
  MKO10040131_A_Pde4dip
  gRNA
ugcagaauagagcgcucuga

SEQ ID NO: 40132 - RNA, 20 nt, Artificial Sequence
  MKO10040132_A_Pde4d
  gRNA
agaaagucgccguacgagau

SEQ ID NO: 40133 - RNA, 20 nt, Artificial Sequence
  MKO10040133_A_Pde4d
  gRNA
aggacucccggcguugacug

SEQ ID NO: 40134 - RNA, 20 nt, Artificial Sequence
  MKO10040134_A_Pde4d
  gRNA
gaauggagcccuaucucgua

SEQ ID NO: 40135 - RNA, 20 nt, Artificial Sequence
  MKO10040135_A_Pde5a
  gRNA
ucaacuucugcauugaaccg

SEQ ID NO: 40136 - RNA, 20 nt, Artificial Sequence
  MKO10040136_A_Pde5a
  gRNA
gcucuaugaaacgucauugc

SEQ ID NO: 40137 - RNA, 20 nt, Artificial Sequence
  MKO10040137_A_Pde5a
  gRNA
auaacuguauccguuuagag

SEQ ID NO: 40138 - RNA, 20 nt, Artificial Sequence
  MKO10040138_A_Pde6a
  gRNA
cacaacugugagacucgucg

SEQ ID NO: 40139 - RNA, 20 nt, Artificial Sequence
  MKO10040139_A_Pde6a
  gRNA
gguggaauaccuucaugauc

SEQ ID NO: 40140 - RNA, 20 nt, Artificial Sequence
  MKO10040140_A_Pde6a
  gRNA
ggucaugucuaagaguccua

SEQ ID NO: 40141 - RNA, 20 nt, Artificial Sequence
  MKO10040141_A_Pde6b
  gRNA
gggccuaucuaaacugcgaa

SEQ ID NO: 40142 - RNA, 20 nt, Artificial Sequence
  MKO10040142_A_Pde6b
  gRNA
auaccguucgcaguuuagau

SEQ ID NO: 40143 - RNA, 20 nt, Artificial Sequence
  MKO10040143_A_Pde6b
  gRNA
gccugacuuacccggccauc

SEQ ID NO: 40144 - RNA, 20 nt, Artificial Sequence
  MKO10040144_A_Pde6c
  gRNA
aacugcgaucgcuacuccau

SEQ ID NO: 40145 - RNA, 20 nt, Artificial Sequence
  MKO10040145_A_Pde6c
  gRNA
ucugcuagcagucccgaucg

SEQ ID NO: 40146 - RNA, 20 nt, Artificial Sequence
  MKO10040146_A_Pde6c
  gRNA
agccaucugcuccgcgcuuc

SEQ ID NO: 40147 - RNA, 20 nt, Artificial Sequence
  MKO10040147_A_Pde6d
  gRNA
ucagagugguucuucgaguu

SEQ ID NO: 40148 - RNA, 20 nt, Artificial Sequence
  MKO10040148_A_Pde6d
  gRNA
ccucacucacguuaggacgc

SEQ ID NO: 40149 - RNA, 20 nt, Artificial Sequence
  MKO10040149_A_Pde6d
  gRNA
uugucagcacauccaaagug

SEQ ID NO: 40150 - RNA, 20 nt, Artificial Sequence
  MKO10040150_A_Pde6g
  gRNA
ucaccuagagcugcacgagc

SEQ ID NO: 40151 - RNA, 20 nt, Artificial Sequence
  MKO10040151_A_Pde6g
  gRNA
gaccaccuaaguuuaagcag

SEQ ID NO: 40152 - RNA, 20 nt, Artificial Sequence
  MKO10040152_A_Pde6g
  gRNA
gugagauucggucagccacc

SEQ ID NO: 40153 - RNA, 20 nt, Artificial Sequence
  MKO10040153_A_Pde6h
  gRNA
gcccuacuaccccacgcaaa

SEQ ID NO: 40154 - RNA, 20 nt, Artificial Sequence
  MKO10040154_A_Pde6h
  gRNA
ggcccuuugcgugggguagu

SEQ ID NO: 40155 - RNA, 20 nt, Artificial Sequence
  MKO10040155_A_Pde6h
  gRNA
auaucacggucaucuguccc

SEQ ID NO: 40156 - RNA, 20 nt, Artificial Sequence
  MKO10040156_A_Pde7a
  gRNA
gugaggaucugagauaucgc

SEQ ID NO: 40157 - RNA, 20 nt, Artificial Sequence
  MKO10040157_A_Pde7a
  gRNA
gcguuauauauucguaugcu

SEQ ID NO: 40158 - RNA, 20 nt, Artificial Sequence
  MKO10040158_A_Pde7a
  gRNA
guccaggagauguccgcgug

SEQ ID NO: 40159 - RNA, 20 nt, Artificial Sequence
  MKO10040159_A_Pde7b
  gRNA
ucuccgggggauuauaccgc

SEQ ID NO: 40160 - RNA, 20 nt, Artificial Sequence
  MKO10040160_A_Pde7b
  gRNA
gggguuccugccgaacgccg

SEQ ID NO: 40161 - RNA, 20 nt, Artificial Sequence
  MKO10040161_A_Pde7b
  gRNA
uucuaggagauguacgacua

SEQ ID NO: 40162 - RNA, 20 nt, Artificial Sequence
  MKO10040162_A_Pde8a
  gRNA
ccacagauauccccgacaga

SEQ ID NO: 40163 - RNA, 20 nt, Artificial Sequence
  MKO10040163_A_Pde8a
  gRNA
auuucaucaagaccaacuuc

SEQ ID NO: 40164 - RNA, 20 nt, Artificial Sequence
  MKO10040164_A_Pde8a
  gRNA
uggucuugaugaaaucucau

SEQ ID NO: 40165 - RNA, 20 nt, Artificial Sequence
  MKO10040165_A_Pde8b
  gRNA
gguucugcuaaucuucgcaa

SEQ ID NO: 40166 - RNA, 20 nt, Artificial Sequence
  MKO10040166_A_Pde8b
  gRNA
acgcuugugaaacgacagcc

SEQ ID NO: 40167 - RNA, 20 nt, Artificial Sequence
  MKO10040167_A_Pde8b
  gRNA
aaauuauugugaucgaucac

SEQ ID NO: 40168 - RNA, 20 nt, Artificial Sequence
  MKO10040168_A_Pde9a
  gRNA
guaucgccaccggccugccu

SEQ ID NO: 40169 - RNA, 20 nt, Artificial Sequence
  MKO10040169_A_Pde9a
  gRNA
uuuaaccacagacgacgcca

SEQ ID NO: 40170 - RNA, 20 nt, Artificial Sequence
  MKO10040170_A_Pde9a
  gRNA
uggaaaauuguuccgccacc

SEQ ID NO: 40171 - RNA, 20 nt, Artificial Sequence
  MKO10040171_A_Pdf
  gRNA
gccauacgcgcacgugugcc

SEQ ID NO: 40172 - RNA, 20 nt, Artificial Sequence
  MKO10040172_A_Pdf
  gRNA
ggacccggugcugcgcgucg

SEQ ID NO: 40173 - RNA, 20 nt, Artificial Sequence
  MKO10040173_A_Pdf
  gRNA
ccagugguguggucggcaag

SEQ ID NO: 40174 - RNA, 20 nt, Artificial Sequence
  MKO10040174_A_Pdgfa
  gRNA
uaucucguaaaugaccgucc

SEQ ID NO: 40175 - RNA, 20 nt, Artificial Sequence
  MKO10040175_A_Pdgfa
  gRNA
ccagccgcucgaucaacucc

SEQ ID NO: 40176 - RNA, 20 nt, Artificial Sequence
  MKO10040176_A_Pdgfa
  gRNA
cggucauuuacgagauaccu

SEQ ID NO: 40177 - RNA, 20 nt, Artificial Sequence
  MKO10040177_A_Pdgfb
  gRNA
cgagugcaagacgcgcacag

SEQ ID NO: 40178 - RNA, 20 nt, Artificial Sequence
  MKO10040178_A_Pdgfb
  gRNA
cucugugcgcgucuugcacu

SEQ ID NO: 40179 - RNA, 20 nt, Artificial Sequence
  MKO10040179_A_Pdgfb
  gRNA
ugagcuuuccaacucgacuc

SEQ ID NO: 40180 - RNA, 20 nt, Artificial Sequence
  MKO10040180_A_Pdgfc
  gRNA
aaguccaccugccaucgauc

SEQ ID NO: 40181 - RNA, 20 nt, Artificial Sequence
  MKO10040181_A_Pdgfc
  gRNA
cacuugcauauaucgucuuc

SEQ ID NO: 40182 - RNA, 20 nt, Artificial Sequence
  MKO10040182_A_Pdgfc
  gRNA
gguaccuagagccagaucga

SEQ ID NO: 40183 - RNA, 20 nt, Artificial Sequence
  MKO10040183_A_Pdgfd
  gRNA
ugucgcagaauucgauaccg

SEQ ID NO: 40184 - RNA, 20 nt, Artificial Sequence
  MKO10040184_A_Pdgfd
  gRNA
gacaugguggcuccguuccc

SEQ ID NO: 40185 - RNA, 20 nt, Artificial Sequence
  MKO10040185_A_Pdgfd
  gRNA
ggguagcuguucgggaagcg

SEQ ID NO: 40186 - RNA, 20 nt, Artificial Sequence
  MKO10040186_A_Pdgfra
  gRNA
cgcacgccagacuguguaua

SEQ ID NO: 40187 - RNA, 20 nt, Artificial Sequence
  MKO10040187_A_Pdgfra
  gRNA
gaccgauuccuuagucaucg

SEQ ID NO: 40188 - RNA, 20 nt, Artificial Sequence
  MKO10040188_A_Pdgfra
  gRNA
guaugaaugugcugcccguc

SEQ ID NO: 40189 - RNA, 20 nt, Artificial Sequence
  MKO10040189_A_Pdgfrb
  gRNA
auggacguacccccgcauga

SEQ ID NO: 40190 - RNA, 20 nt, Artificial Sequence
  MKO10040190_A_Pdgfrb
  gRNA
aaguaccagugaaaccucgc

SEQ ID NO: 40191 - RNA, 20 nt, Artificial Sequence
  MKO10040191_A_Pdgfrb
  gRNA
gcuguagacguaguaaguau

SEQ ID NO: 40192 - RNA, 20 nt, Artificial Sequence
  MKO10040192_A_Pdgfrl
  gRNA
cgugaggcgggaguccuuga

SEQ ID NO: 40193 - RNA, 20 nt, Artificial Sequence
  MKO10040193_A_Pdgfrl
  gRNA
auggaguuaccccgccuacu

SEQ ID NO: 40194 - RNA, 20 nt, Artificial Sequence
  MKO10040194_A_Pdgfrl
  gRNA
cagcuugucuguccggguuc

SEQ ID NO: 40195 - RNA, 20 nt, Artificial Sequence
  MKO10040195_A_Pdha1
  gRNA
caacggcaucguuggagcuc

SEQ ID NO: 40196 - RNA, 20 nt, Artificial Sequence
  MKO10040196_A_Pdha1
  gRNA
ggaugaugcagacugugcgc

SEQ ID NO: 40197 - RNA, 20 nt, Artificial Sequence
  MKO10040197_A_Pdha1
  gRNA
ucugcaagaauugcucgcac

SEQ ID NO: 40198 - RNA, 20 nt, Artificial Sequence
  MKO10040198_A_Pdha2
  gRNA
aucacgucaucacguccuac

SEQ ID NO: 40199 - RNA, 20 nt, Artificial Sequence
  MKO10040199_A_Pdha2
  gRNA
caugcgccgaauuaccugca

SEQ ID NO: 40200 - RNA, 20 nt, Artificial Sequence
  MKO10040200_A_Pdha2
  gRNA
cugcagaccuaccguuauca

SEQ ID NO: 40201 - RNA, 20 nt, Artificial Sequence
  MKO10040201_A_Pdhb
  gRNA
accgguuaccugcaccgcug

SEQ ID NO: 40202 - RNA, 20 nt, Artificial Sequence
  MKO10040202_A_Pdhb
  gRNA
aauugcuguuggugcagcua

SEQ ID NO: 40203 - RNA, 20 nt, Artificial Sequence
  MKO10040203_A_Pdhb
  gRNA
guucgugaagcuauuaauca

SEQ ID NO: 40204 - RNA, 20 nt, Artificial Sequence
  MKO10040204_A_Pdhx
  gRNA
aauuucagcggauccuauua

SEQ ID NO: 40205 - RNA, 20 nt, Artificial Sequence
  MKO10040205_A_Pdhx
  gRNA
ucuuuagugaagaucccgcg

SEQ ID NO: 40206 - RNA, 20 nt, Artificial Sequence
  MKO10040206_A_Pdhx
  gRNA
accuuagaugcaaacgauga

SEQ ID NO: 40207 - RNA, 20 nt, Artificial Sequence
  MKO10040207_A_Pdia2
  gRNA
cucguaccugcguacucuuc

SEQ ID NO: 40208 - RNA, 20 nt, Artificial Sequence
  MKO10040208_A_Pdia2
  gRNA
acuagcucccgaguacagca

SEQ ID NO: 40209 - RNA, 20 nt, Artificial Sequence
  MKO10040209_A_Pdia2
  gRNA
cgucauacauagcaugcacc

SEQ ID NO: 40210 - RNA, 20 nt, Artificial Sequence
  MKO10040210_A_Pdia3
  gRNA
acugaccccauacuuauuac

SEQ ID NO: 40211 - RNA, 20 nt, Artificial Sequence
  MKO10040211_A_Pdia3
  gRNA
cuucaccagagacucaaugu

SEQ ID NO: 40212 - RNA, 20 nt, Artificial Sequence
  MKO10040212_A_Pdia3
  gRNA
gaagaagcgggugcuuauga

SEQ ID NO: 40213 - RNA, 20 nt, Artificial Sequence
  MKO10040213_A_Pdia4
  gRNA
cuguucgguggcguccacuu

SEQ ID NO: 40214 - RNA, 20 nt, Artificial Sequence
  MKO10040214_A_Pdia4
  gRNA
gccauaccauauuucucucg

SEQ ID NO: 40215 - RNA, 20 nt, Artificial Sequence
  MKO10040215_A_Pdia4
  gRNA
aucgaucuucgcuacagcaa

SEQ ID NO: 40216 - RNA, 20 nt, Artificial Sequence
  MKO10040216_A_Pdia5
  gRNA
caggacccgcaauaacgugc

SEQ ID NO: 40217 - RNA, 20 nt, Artificial Sequence
  MKO10040217_A_Pdia5
  gRNA
ugaccgagcugugacguuga

SEQ ID NO: 40218 - RNA, 20 nt, Artificial Sequence
  MKO10040218_A_Pdia5
  gRNA
aaagcaccagcacguuauug

SEQ ID NO: 40219 - RNA, 20 nt, Artificial Sequence
  MKO10040219_A_Pdia6
  gRNA
auccuugacgagcuggcgca

SEQ ID NO: 40220 - RNA, 20 nt, Artificial Sequence
  MKO10040220_A_Pdia6
  gRNA
ugccuugcgccagcucguca

SEQ ID NO: 40221 - RNA, 20 nt, Artificial Sequence
  MKO10040221_A_Pdia6
  gRNA
uccuuacccugauaaucuuc

SEQ ID NO: 40222 - RNA, 20 nt, Artificial Sequence
  MKO10040222_A_Pdik1l
  gRNA
agccaaaguacgaucuaaua

SEQ ID NO: 40223 - RNA, 20 nt, Artificial Sequence
  MKO10040223_A_Pdik1l
  gRNA
ucccguauuagaucguacuu

SEQ ID NO: 40224 - RNA, 20 nt, Artificial Sequence
  MKO10040224_A_Pdik1l
  gRNA
augcgggacggacuucuaca

SEQ ID NO: 40225 - RNA, 20 nt, Artificial Sequence
  MKO10040225_A_Pdilt
  gRNA
aucgcuccaaacguuaguuc

SEQ ID NO: 40226 - RNA, 20 nt, Artificial Sequence
  MKO10040226_A_Pdilt
  gRNA
guucaacaacagcgaugaag

SEQ ID NO: 40227 - RNA, 20 nt, Artificial Sequence
  MKO10040227_A_Pdilt
  gRNA
gcccuucccgaagaucucug

SEQ ID NO: 40228 - RNA, 20 nt, Artificial Sequence
  MKO10040228_A_Pdk1
  gRNA
cauaaauccaaacugcgacg

SEQ ID NO: 40229 - RNA, 20 nt, Artificial Sequence
  MKO10040229_A_Pdk1
  gRNA
accuccaccacgucgcaguu

SEQ ID NO: 40230 - RNA, 20 nt, Artificial Sequence
  MKO10040230_A_Pdk1
  gRNA
ccguacagcuggugcaaagu

SEQ ID NO: 40231 - RNA, 20 nt, Artificial Sequence
  MKO10040231_A_Pdk2
  gRNA
ccggaaccggcacaaugacg

SEQ ID NO: 40232 - RNA, 20 nt, Artificial Sequence
  MKO10040232_A_Pdk2
  gRNA
agugaaugacgucuucucgc

SEQ ID NO: 40233 - RNA, 20 nt, Artificial Sequence
  MKO10040233_A_Pdk2
  gRNA
gguccucggggucuuugucc

SEQ ID NO: 40234 - RNA, 20 nt, Artificial Sequence
  MKO10040234_A_Pdk3
  gRNA
cuuguugaaccgcccuuccg

SEQ ID NO: 40235 - RNA, 20 nt, Artificial Sequence
  MKO10040235_A_Pdk3
  gRNA
gggcgguucaacaaguuauc

SEQ ID NO: 40236 - RNA, 20 nt, Artificial Sequence
  MKO10040236_A_Pdk3
  gRNA
cccagaagacccacgaguuu

SEQ ID NO: 40237 - RNA, 20 nt, Artificial Sequence
  MKO10040237_A_Pdk4
  gRNA
uguucacuaagcggucaggc

SEQ ID NO: 40238 - RNA, 20 nt, Artificial Sequence
  MKO10040238_A_Pdk4
  gRNA
gcuuagguuuguagacacgc

SEQ ID NO: 40239 - RNA, 20 nt, Artificial Sequence
  MKO10040239_A_Pdk4
  gRNA
ccgcuuagugaacacuccuu

SEQ ID NO: 40240 - RNA, 20 nt, Artificial Sequence
  MKO10040240_A_Pdlim1
  gRNA
ucuccucuagugaccgagga

SEQ ID NO: 40241 - RNA, 20 nt, Artificial Sequence
  MKO10040241_A_Pdlim1
  gRNA
gcuguucgccuccuccccac

SEQ ID NO: 40242 - RNA, 20 nt, Artificial Sequence
  MKO10040242_A_Pdlim1
  gRNA
aaccaguacaacagcccaac

SEQ ID NO: 40243 - RNA, 20 nt, Artificial Sequence
  MKO10040243_A_Pdlim2
  gRNA
gcucaccacuugaccuaccc

SEQ ID NO: 40244 - RNA, 20 nt, Artificial Sequence
  MKO10040244_A_Pdlim2
  gRNA
ccacaaugaugucgccaggc

SEQ ID NO: 40245 - RNA, 20 nt, Artificial Sequence
  MKO10040245_A_Pdlim2
  gRNA
cgcucugucggaucuugcuu

SEQ ID NO: 40246 - RNA, 20 nt, Artificial Sequence
  MKO10040246_A_Pdlim3
  gRNA
cccgacuggcgaggagcggc

SEQ ID NO: 40247 - RNA, 20 nt, Artificial Sequence
  MKO10040247_A_Pdlim3
  gRNA
ugagaccccguagcuguccg

SEQ ID NO: 40248 - RNA, 20 nt, Artificial Sequence
  MKO10040248_A_Pdlim3
  gRNA
aauauccaagacgcgcucca

SEQ ID NO: 40249 - RNA, 20 nt, Artificial Sequence
  MKO10040249_A_Pdlim4
  gRNA
ccgagagcguaagaugaucg

SEQ ID NO: 40250 - RNA, 20 nt, Artificial Sequence
  MKO10040250_A_Pdlim4
  gRNA
acccugcagucccgguuccg

SEQ ID NO: 40251 - RNA, 20 nt, Artificial Sequence
  MKO10040251_A_Pdlim4
  gRNA
ucccucggaaccgggacugc

SEQ ID NO: 40252 - RNA, 20 nt, Artificial Sequence
  MKO10040252_A_Pdlim5
  gRNA
gagacugagucguuccaguc

SEQ ID NO: 40253 - RNA, 20 nt, Artificial Sequence
  MKO10040253_A_Pdlim5
  gRNA
uacaagccuuaaucuuguuc

SEQ ID NO: 40254 - RNA, 20 nt, Artificial Sequence
  MKO10040254_A_Pdlim5
  gRNA
cucaaucagccguuucuugc

SEQ ID NO: 40255 - RNA, 20 nt, Artificial Sequence
  MKO10040255_A_Pdlim7
  gRNA
cagaacaagauccgcgccug

SEQ ID NO: 40256 - RNA, 20 nt, Artificial Sequence
  MKO10040256_A_Pdlim7
  gRNA
gacuggccuguccccggccg

SEQ ID NO: 40257 - RNA, 20 nt, Artificial Sequence
  MKO10040257_A_Pdlim7
  gRNA
ucucuacagcucacgcccgg

SEQ ID NO: 40258 - RNA, 20 nt, Artificial Sequence
  MKO10040258_A_Pdp1
  gRNA
ugaauaccuaccaauucguc

SEQ ID NO: 40259 - RNA, 20 nt, Artificial Sequence
  MKO10040259_A_Pdp1
  gRNA
ccccaaugauuacuucagua

SEQ ID NO: 40260 - RNA, 20 nt, Artificial Sequence
  MKO10040260_A_Pdp1
  gRNA
aaaaugcuacccgaagcacc

SEQ ID NO: 40261 - RNA, 20 nt, Artificial Sequence
  MKO10040261_A_Pdp2
  gRNA
cccguacucguugcucccga

SEQ ID NO: 40262 - RNA, 20 nt, Artificial Sequence
  MKO10040262_A_Pdp2
  gRNA
caucugaucagacacgccau

SEQ ID NO: 40263 - RNA, 20 nt, Artificial Sequence
  MKO10040263_A_Pdp2
  gRNA
ccgggcuauccucggugucc

SEQ ID NO: 40264 - RNA, 20 nt, Artificial Sequence
  MKO10040264_A_Pdpk1
  gRNA
gagagaugugaugucacgcc

SEQ ID NO: 40265 - RNA, 20 nt, Artificial Sequence
  MKO10040265_A_Pdpk1
  gRNA
gguuguucuggcccgagaac

SEQ ID NO: 40266 - RNA, 20 nt, Artificial Sequence
  MKO10040266_A_Pdpk1
  gRNA
uccuagugguguuagcaggc

SEQ ID NO: 40267 - RNA, 20 nt, Artificial Sequence
  MKO10040267_A_Pdpn
  gRNA
gucccacgcucucucugcgu

SEQ ID NO: 40268 - RNA, 20 nt, Artificial Sequence
  MKO10040268_A_Pdpn
  gRNA
ggagacggcauggugccccc

SEQ ID NO: 40269 - RNA, 20 nt, Artificial Sequence
  MKO10040269_A_Pdpn
  gRNA
accaugccgucuccuguacc

SEQ ID NO: 40270 - RNA, 20 nt, Artificial Sequence
  MKO10040270_A_Pdpr
  gRNA
cggggccauguacguuccug

SEQ ID NO: 40271 - RNA, 20 nt, Artificial Sequence
  MKO10040271_A_Pdpr
  gRNA
uacgcuucagagagaucaac

SEQ ID NO: 40272 - RNA, 20 nt, Artificial Sequence
  MKO10040272_A_Pdpr
  gRNA
cgaccagaucaugcacauug

SEQ ID NO: 40273 - RNA, 20 nt, Artificial Sequence
  MKO10040273_A_Pdrg1
  gRNA
guagggcccucaggcccucu

SEQ ID NO: 40274 - RNA, 20 nt, Artificial Sequence
  MKO10040274_A_Pdrg1
  gRNA
cuuuaaccucauccgggcug

SEQ ID NO: 40275 - RNA, 20 nt, Artificial Sequence
  MKO10040275_A_Pdrg1
  gRNA
aaccgccucuuugaagccca

SEQ ID NO: 40276 - RNA, 20 nt, Artificial Sequence
  MKO10040276_A_Pds5a
  gRNA
gcauuuguacuuucguauug

SEQ ID NO: 40277 - RNA, 20 nt, Artificial Sequence
  MKO10040277_A_Pds5a
  gRNA
gaauucagaugcgagaugca

SEQ ID NO: 40278 - RNA, 20 nt, Artificial Sequence
  MKO10040278_A_Pds5a
  gRNA
ccaaacaacaugcuacgaga

SEQ ID NO: 40279 - RNA, 20 nt, Artificial Sequence
  MKO10040279_A_Pds5b
  gRNA
auuucacauaccuuaugggc

SEQ ID NO: 40280 - RNA, 20 nt, Artificial Sequence
  MKO10040280_A_Pds5b
  gRNA
cacgucucccgauaaacuaa

SEQ ID NO: 40281 - RNA, 20 nt, Artificial Sequence
  MKO10040281_A_Pds5b
  gRNA
ugauaaagauguucguuuac

SEQ ID NO: 40282 - RNA, 20 nt, Artificial Sequence
  MKO10040282_A_Pdss1
  gRNA
auguccgaauacuacuucga

SEQ ID NO: 40283 - RNA, 20 nt, Artificial Sequence
  MKO10040283_A_Pdss1
  gRNA
agccuuuagaccgauuauug

SEQ ID NO: 40284 - RNA, 20 nt, Artificial Sequence
  MKO10040284_A_Pdss1
  gRNA
ugacgacaacugcacauugc

SEQ ID NO: 40285 - RNA, 20 nt, Artificial Sequence
  MKO10040285_A_Pdss2
  gRNA
uaugccggcugucgugcacg

SEQ ID NO: 40286 - RNA, 20 nt, Artificial Sequence
  MKO10040286_A_Pdss2
  gRNA
gggcccucgugcacgacagc

SEQ ID NO: 40287 - RNA, 20 nt, Artificial Sequence
  MKO10040287_A_Pdss2
  gRNA
ccuggaggagcgcccgcgcc

SEQ ID NO: 40288 - RNA, 20 nt, Artificial Sequence
  MKO10040288_A_Pdx1
  gRNA
caucgcgccacugcgaccgc

SEQ ID NO: 40289 - RNA, 20 nt, Artificial Sequence
  MKO10040289_A_Pdx1
  gRNA
ggcgacacgcuaaggcccga

SEQ ID NO: 40290 - RNA, 20 nt, Artificial Sequence
  MKO10040290_A_Pdx1
  gRNA
cccgcucgccuccgacgacc

SEQ ID NO: 40291 - RNA, 20 nt, Artificial Sequence
  MKO10040291_A_Pdxdc1
  gRNA
uccuucauuaccgggugcuc

SEQ ID NO: 40292 - RNA, 20 nt, Artificial Sequence
  MKO10040292_A_Pdxdc1
  gRNA
uacuuucagacacuaccuua

SEQ ID NO: 40293 - RNA, 20 nt, Artificial Sequence
  MKO10040293_A_Pdxdc1
  gRNA
cggugccuauauuucaacuc

SEQ ID NO: 40294 - RNA, 20 nt, Artificial Sequence
  MKO10040294_A_Pdxk
  gRNA
ugagcuguacgagggucuca

SEQ ID NO: 40295 - RNA, 20 nt, Artificial Sequence
  MKO10040295_A_Pdxk
  gRNA
ccgcacaauguccaccacca

SEQ ID NO: 40296 - RNA, 20 nt, Artificial Sequence
  MKO10040296_A_Pdxk
  gRNA
cagaacucucgccuugugua

SEQ ID NO: 40297 - RNA, 20 nt, Artificial Sequence
  MKO10040297_A_Pdxp
  gRNA
gugccaagggucgcgaucgg

SEQ ID NO: 40298 - RNA, 20 nt, Artificial Sequence
  MKO10040298_A_Pdxp
  gRNA
ggaguccuguucgacugcga

SEQ ID NO: 40299 - RNA, 20 nt, Artificial Sequence
  MKO10040299_A_Pdxp
  gRNA
gaccaccgugcucacgcuca

SEQ ID NO: 40300 - RNA, 20 nt, Artificial Sequence
  MKO10040300_A_Pdyn
  gRNA
caaaaagccgccauagcguu

SEQ ID NO: 40301 - RNA, 20 nt, Artificial Sequence
  MKO10040301_A_Pdyn
  gRNA
gcaguccgccauaacauuag

SEQ ID NO: 40302 - RNA, 20 nt, Artificial Sequence
  MKO10040302_A_Pdyn
  gRNA
agcccccauagcguuuguac

SEQ ID NO: 40303 - RNA, 20 nt, Artificial Sequence
  MKO10040303_A_Pdzd11
  gRNA
gcucgaugugcauccgaguc

SEQ ID NO: 40304 - RNA, 20 nt, Artificial Sequence
  MKO10040304_A_Pdzd11
  gRNA
caguugggauuuaacauccg

SEQ ID NO: 40305 - RNA, 20 nt, Artificial Sequence
  MKO10040305_A_Pdzd11
  gRNA
gcuucuucaguguaacaauu

SEQ ID NO: 40306 - RNA, 20 nt, Artificial Sequence
  MKO10040306_A_Pdzd2
  gRNA
aacgguaccgacuccgaacu

SEQ ID NO: 40307 - RNA, 20 nt, Artificial Sequence
  MKO10040307_A_Pdzd2
  gRNA
accguucuccaacuccgagc

SEQ ID NO: 40308 - RNA, 20 nt, Artificial Sequence
  MKO10040308_A_Pdzd2
  gRNA
acuggucgggcucucccaug

SEQ ID NO: 40309 - RNA, 20 nt, Artificial Sequence
  MKO10040309_A_Pdzd3
  gRNA
ugauguggcgcguguucugc

SEQ ID NO: 40310 - RNA, 20 nt, Artificial Sequence
  MKO10040310_A_Pdzd3
  gRNA
ucccgcagaucuucgggaca

SEQ ID NO: 40311 - RNA, 20 nt, Artificial Sequence
  MKO10040311_A_Pdzd3
  gRNA
uauagguagugcgcuacauc

SEQ ID NO: 40312 - RNA, 20 nt, Artificial Sequence
  MKO10040312_A_Pdzd4
  gRNA
ugagacgcagcccccgucug

SEQ ID NO: 40313 - RNA, 20 nt, Artificial Sequence
  MKO10040313_A_Pdzd4
  gRNA
ccgcccuccaugaacuccgc

SEQ ID NO: 40314 - RNA, 20 nt, Artificial Sequence
  MKO10040314_A_Pdzd4
  gRNA
gaggaccuaggcaucuacgu

SEQ ID NO: 40315 - RNA, 20 nt, Artificial Sequence
  MKO10040315_A_Pdzd7
  gRNA
caucauccacgccguucgcg

SEQ ID NO: 40316 - RNA, 20 nt, Artificial Sequence
  MKO10040316_A_Pdzd7
  gRNA
cggcgcaugggccgagugcc

SEQ ID NO: 40317 - RNA, 20 nt, Artificial Sequence
  MKO10040317_A_Pdzd7
  gRNA
ucuucuccacgcgaacggcg

SEQ ID NO: 40318 - RNA, 20 nt, Artificial Sequence
  MKO10040318_A_Pdzd8
  gRNA
cagaucuucaacggggagau

SEQ ID NO: 40319 - RNA, 20 nt, Artificial Sequence
  MKO10040319_A_Pdzd8
  gRNA
accugugccaccgcgaccac

SEQ ID NO: 40320 - RNA, 20 nt, Artificial Sequence
  MKO10040320_A_Pdzd8
  gRNA
gccuucauugucugacguau

SEQ ID NO: 40321 - RNA, 20 nt, Artificial Sequence
  MKO10040321_A_Pdzd9
  gRNA
cagucuggaaucaccccgua

SEQ ID NO: 40322 - RNA, 20 nt, Artificial Sequence
  MKO10040322_A_Pdzd9
  gRNA
aaggagcgcacuauuagugu

SEQ ID NO: 40323 - RNA, 20 nt, Artificial Sequence
  MKO10040323_A_Pdzd9
  gRNA
caagcugcuuacagacgccu

SEQ ID NO: 40324 - RNA, 20 nt, Artificial Sequence
  MKO10040324_A_Pdzk1ip1
  gRNA
ucuucgccgucaaccacuuc

SEQ ID NO: 40325 - RNA, 20 nt, Artificial Sequence
  MKO10040325_A_Pdzk1ip1
  gRNA
cggcgaagacgauugcaaca

SEQ ID NO: 40326 - RNA, 20 nt, Artificial Sequence
  MKO10040326_A_Pdzk1ip1
  gRNA
ggccuucagucugcucgugc

SEQ ID NO: 40327 - RNA, 20 nt, Artificial Sequence
  MKO10040327_A_Pdzk1
  gRNA
uccaccgcuccguucauccc

SEQ ID NO: 40328 - RNA, 20 nt, Artificial Sequence
  MKO10040328_A_Pdzk1
  gRNA
cccugggaugaacggagcgg

SEQ ID NO: 40329 - RNA, 20 nt, Artificial Sequence
  MKO10040329_A_Pdzk1
  gRNA
agcucuugaucaugacggug

SEQ ID NO: 40330 - RNA, 20 nt, Artificial Sequence
  MKO10040330_A_Pdzrn3
  gRNA
ggcgugaacaucuugguucg

SEQ ID NO: 40331 - RNA, 20 nt, Artificial Sequence
  MKO10040331_A_Pdzrn3
  gRNA
cccgaugcaggacaagaguc

SEQ ID NO: 40332 - RNA, 20 nt, Artificial Sequence
  MKO10040332_A_Pdzrn3
  gRNA
gccugccucagagucgcagc

SEQ ID NO: 40333 - RNA, 20 nt, Artificial Sequence
  MKO10040333_A_Pdzrn4
  gRNA
ccccucagccggccaacaua

SEQ ID NO: 40334 - RNA, 20 nt, Artificial Sequence
  MKO10040334_A_Pdzrn4
  gRNA
uacgauccccuucucgaauc

SEQ ID NO: 40335 - RNA, 20 nt, Artificial Sequence
  MKO10040335_A_Pdzrn4
  gRNA
ugaguggccgaagcuucgcc

SEQ ID NO: 40336 - RNA, 20 nt, Artificial Sequence
  MKO10040336_A_Pea15a
  gRNA
acugggaauacggguuagcu

SEQ ID NO: 40337 - RNA, 20 nt, Artificial Sequence
  MKO10040337_A_Pea15a
  gRNA
uguagucaaccaccauagug

SEQ ID NO: 40338 - RNA, 20 nt, Artificial Sequence
  MKO10040338_A_Pea15a
  gRNA
uguuguuggucagguccuga

SEQ ID NO: 40339 - RNA, 20 nt, Artificial Sequence
  MKO10040339_A_Peak1
  gRNA
gcgcucgucacuaauuugga

SEQ ID NO: 40340 - RNA, 20 nt, Artificial Sequence
  MKO10040340_A_Peak1
  gRNA
ugauugcuacaaacgaucgu

SEQ ID NO: 40341 - RNA, 20 nt, Artificial Sequence
  MKO10040341_A_Peak1
  gRNA
gaagaucgcagugcgugacg

SEQ ID NO: 40342 - RNA, 20 nt, Artificial Sequence
  MKO10040342_A_Pear1
  gRNA
gcugcggcaggguugucuac

SEQ ID NO: 40343 - RNA, 20 nt, Artificial Sequence
  MKO10040343_A_Pear1
  gRNA
ucggagccacacagcgacca

SEQ ID NO: 40344 - RNA, 20 nt, Artificial Sequence
  MKO10040344_A_Pear1
  gRNA
cgggguggcgacugcuccag

SEQ ID NO: 40345 - RNA, 20 nt, Artificial Sequence
  MKO10040345_A_Pebp1
  gRNA
ccuuccuacagguuaugaac

SEQ ID NO: 40346 - RNA, 20 nt, Artificial Sequence
  MKO10040346_A_Pebp1
  gRNA
ccuuuacuuaccugugccac

SEQ ID NO: 40347 - RNA, 20 nt, Artificial Sequence
  MKO10040347_A_Pebp1
  gRNA
aaggguaaugacauuagcag

SEQ ID NO: 40348 - RNA, 20 nt, Artificial Sequence
  MKO10040348_A_Pebp4
  gRNA
auccguggcaauguacuauc

SEQ ID NO: 40349 - RNA, 20 nt, Artificial Sequence
  MKO10040349_A_Pebp4
  gRNA
cuugacuaucggcgccugcc

SEQ ID NO: 40350 - RNA, 20 nt, Artificial Sequence
  MKO10040350_A_Pebp4
  gRNA
gccgauagucaaguuccaca

SEQ ID NO: 40351 - RNA, 20 nt, Artificial Sequence
  MKO10040351_A_Pecam1
  gRNA
cuucaccucguacucaaucg

SEQ ID NO: 40352 - RNA, 20 nt, Artificial Sequence
  MKO10040352_A_Pecam1
  gRNA
aaaaaccacgauugaguacg

SEQ ID NO: 40353 - RNA, 20 nt, Artificial Sequence
  MKO10040353_A_Pecam1
  gRNA
gagugaauacgucaccgugc

SEQ ID NO: 40354 - RNA, 20 nt, Artificial Sequence
  MKO10040354_A_Pecr
  gRNA
gaucuuaccauacuuagcua

SEQ ID NO: 40355 - RNA, 20 nt, Artificial Sequence
  MKO10040355_A_Pecr
  gRNA
uuuccucuuaggguguaacg

SEQ ID NO: 40356 - RNA, 20 nt, Artificial Sequence
  MKO10040356_A_Pecr
  gRNA
ccgccauacagugcaacauc

SEQ ID NO: 40357 - RNA, 20 nt, Artificial Sequence
  MKO10040357_A_Pef1
  gRNA
ccauauggcgguauaccucc

SEQ ID NO: 40358 - RNA, 20 nt, Artificial Sequence
  MKO10040358_A_Pef1
  gRNA
uggguaccguagggaccccc

SEQ ID NO: 40359 - RNA, 20 nt, Artificial Sequence
  MKO10040359_A_Pef1
  gRNA
ggaaaaggauaccgcuguac

SEQ ID NO: 40360 - RNA, 20 nt, Artificial Sequence
  MKO10040360_A_Peg10
  gRNA
guuucccggcggcgaauucu

SEQ ID NO: 40361 - RNA, 20 nt, Artificial Sequence
  MKO10040361_A_Peg10
  gRNA
agccuccaagaauucgccgc

SEQ ID NO: 40362 - RNA, 20 nt, Artificial Sequence
  MKO10040362_A_Peg10
  gRNA
cagacgucugaucuugcguu

SEQ ID NO: 40363 - RNA, 20 nt, Artificial Sequence
  MKO10040363_A_Peg12
  gRNA
ucggagacccgcacgaguga

SEQ ID NO: 40364 - RNA, 20 nt, Artificial Sequence
  MKO10040364_A_Peg12
  gRNA
ccaaccccgccggcaccggc

SEQ ID NO: 40365 - RNA, 20 nt, Artificial Sequence
  MKO10040365_A_Peg12
  gRNA
ggggcucugccgacguggac

SEQ ID NO: 40366 - RNA, 20 nt, Artificial Sequence
  MKO10040366_A_Peg3
  gRNA
cugccuaggugagcgagacc

SEQ ID NO: 40367 - RNA, 20 nt, Artificial Sequence
  MKO10040367_A_Peg3
  gRNA
gacgacgacaugagccgaag

SEQ ID NO: 40368 - RNA, 20 nt, Artificial Sequence
  MKO10040368_A_Peg3
  gRNA
ggaucgagacucauaaucca

SEQ ID NO: 40369 - RNA, 20 nt, Artificial Sequence
  MKO10040369_A_Peli1
  gRNA
guaguaacugacaccguucc

SEQ ID NO: 40370 - RNA, 20 nt, Artificial Sequence
  MKO10040370_A_Peli1
  gRNA
uauauucaaccaccaccguc

SEQ ID NO: 40371 - RNA, 20 nt, Artificial Sequence
  MKO10040371_A_Peli1
  gRNA
cuugugaugcauccacguaa

SEQ ID NO: 40372 - RNA, 20 nt, Artificial Sequence
  MKO10040372_A_Peli2
  gRNA
uggcguagguccgcuuauag

SEQ ID NO: 40373 - RNA, 20 nt, Artificial Sequence
  MKO10040373_A_Peli2
  gRNA
uauacaccuugcgagagacc

SEQ ID NO: 40374 - RNA, 20 nt, Artificial Sequence
  MKO10040374_A_Peli2
  gRNA
gcauaucguacacguuguca

SEQ ID NO: 40375 - RNA, 20 nt, Artificial Sequence
  MKO10040375_A_Peli3
  gRNA
acugcccgaaucuacgcugc

SEQ ID NO: 40376 - RNA, 20 nt, Artificial Sequence
  MKO10040376_A_Peli3
  gRNA
agccgccggccacaugccaa

SEQ ID NO: 40377 - RNA, 20 nt, Artificial Sequence
  MKO10040377_A_Peli3
  gRNA
cauagcgggagaugguacuu

SEQ ID NO: 40378 - RNA, 20 nt, Artificial Sequence
  MKO10040378_A_Pelo
  gRNA
aacugcucucgcacgaaucc

SEQ ID NO: 40379 - RNA, 20 nt, Artificial Sequence
  MKO10040379_A_Pelo
  gRNA
ggcuuaccacaccaucgaac

SEQ ID NO: 40380 - RNA, 20 nt, Artificial Sequence
  MKO10040380_A_Pelo
  gRNA
ucgcuacaguagggucgcag

SEQ ID NO: 40381 - RNA, 20 nt, Artificial Sequence
  MKO10040381_A_Pelp1
  gRNA
ggggcucuccccuaucaaca

SEQ ID NO: 40382 - RNA, 20 nt, Artificial Sequence
  MKO10040382_A_Pelp1
  gRNA
ucaggacucaccguccacca

SEQ ID NO: 40383 - RNA, 20 nt, Artificial Sequence
  MKO10040383_A_Pelp1
  gRNA
ugguggagaugucccgaaac

SEQ ID NO: 40384 - RNA, 20 nt, Artificial Sequence
  MKO10040384_A_Pemt
  gRNA
gcuguccagcuucuaugcac

SEQ ID NO: 40385 - RNA, 20 nt, Artificial Sequence
  MKO10040385_A_Pemt
  gRNA
ccuucaugcagguagcgaga

SEQ ID NO: 40386 - RNA, 20 nt, Artificial Sequence
  MKO10040386_A_Pemt
  gRNA
ugaacauccuccgcucccac

SEQ ID NO: 40387 - RNA, 20 nt, Artificial Sequence
  MKO10040387_A_Penk
  gRNA
accaggaaauugaugucgcc

SEQ ID NO: 40388 - RNA, 20 nt, Artificial Sequence
  MKO10040388_A_Penk
  gRNA
cgcuaaaugcagcuaccgcc

SEQ ID NO: 40389 - RNA, 20 nt, Artificial Sequence
  MKO10040389_A_Penk
  gRNA
ggcuucaugaaacgguacgg

SEQ ID NO: 40390 - RNA, 20 nt, Artificial Sequence
  MKO10040390_A_Peo1
  gRNA
cacuuuggcugagccgaaaa

SEQ ID NO: 40391 - RNA, 20 nt, Artificial Sequence
  MKO10040391_A_Peo1
  gRNA
gucuccaucaaagcgauucu

SEQ ID NO: 40392 - RNA, 20 nt, Artificial Sequence
  MKO10040392_A_Peo1
  gRNA
ucggaaagaagacgacgaca

SEQ ID NO: 40393 - RNA, 20 nt, Artificial Sequence
  MKO10040393_A_Pepd
  gRNA
gccuucggugucgucgaguc

SEQ ID NO: 40394 - RNA, 20 nt, Artificial Sequence
  MKO10040394_A_Pepd
  gRNA
gccugacucgacgacaccga

SEQ ID NO: 40395 - RNA, 20 nt, Artificial Sequence
  MKO10040395_A_Pepd
  gRNA
uacguaccucauccguguac

SEQ ID NO: 40396 - RNA, 20 nt, Artificial Sequence
  MKO10040396_A_Per1
  gRNA
gucuauauuucggagcaggc

SEQ ID NO: 40397 - RNA, 20 nt, Artificial Sequence
  MKO10040397_A_Per1
  gRNA
agcguacugcaguguggcca

SEQ ID NO: 40398 - RNA, 20 nt, Artificial Sequence
  MKO10040398_A_Per1
  gRNA
cggcccuugccccgacgcuc

SEQ ID NO: 40399 - RNA, 20 nt, Artificial Sequence
  MKO10040399_A_Per2
  gRNA
cgcguucuucacgauauacu

SEQ ID NO: 40400 - RNA, 20 nt, Artificial Sequence
  MKO10040400_A_Per2
  gRNA
gagcacaaccccuccacgag

SEQ ID NO: 40401 - RNA, 20 nt, Artificial Sequence
  MKO10040401_A_Per2
  gRNA
ccccuuacaagcuuccgccc

SEQ ID NO: 40402 - RNA, 20 nt, Artificial Sequence
  MKO10040402_A_Per3
  gRNA
uagaacgcccucacgucuug

SEQ ID NO: 40403 - RNA, 20 nt, Artificial Sequence
  MKO10040403_A_Per3
  gRNA
cgacaaagugcacgcucuug

SEQ ID NO: 40404 - RNA, 20 nt, Artificial Sequence
  MKO10040404_A_Per3
  gRNA
cuccgcguggaccgagacuc

SEQ ID NO: 40405 - RNA, 20 nt, Artificial Sequence
  MKO10040405_A_Perp
  gRNA
cgccuucgacaucaucgcgc

SEQ ID NO: 40406 - RNA, 20 nt, Artificial Sequence
  MKO10040406_A_Perp
  gRNA
acauccagacaucgucgcuu

SEQ ID NO: 40407 - RNA, 20 nt, Artificial Sequence
  MKO10040407_A_Perp
  gRNA
caaaaggucauccucguagu

SEQ ID NO: 40408 - RNA, 20 nt, Artificial Sequence
  MKO10040408_A_Pes1
  gRNA
agaccauucaguugugccgu

SEQ ID NO: 40409 - RNA, 20 nt, Artificial Sequence
  MKO10040409_A_Pes1
  gRNA
agcucaccuugcgcagggcu

SEQ ID NO: 40410 - RNA, 20 nt, Artificial Sequence
  MKO10040410_A_Pes1
  gRNA
cucaccgcuccuugacaaug

SEQ ID NO: 40411 - RNA, 20 nt, Artificial Sequence
  MKO10040411_A_Pet100
  gRNA
ggacuauguuguccagcgua

SEQ ID NO: 40412 - RNA, 20 nt, Artificial Sequence
  MKO10040412_A_Pet100
  gRNA
agauccagaacauaaccacg

SEQ ID NO: 40413 - RNA, 20 nt, Artificial Sequence
  MKO10040413_A_Pet100
  gRNA
gcuuaaauucuucuagcucc

SEQ ID NO: 40414 - RNA, 20 nt, Artificial Sequence
  MKO10040414_A_Pet112
  gRNA
guggaagccgcggugaugac

SEQ ID NO: 40415 - RNA, 20 nt, Artificial Sequence
  MKO10040415_A_Pet112
  gRNA
caccuuaccgguaauguucc

SEQ ID NO: 40416 - RNA, 20 nt, Artificial Sequence
  MKO10040416_A_Pet112
  gRNA
aaagccuccaugacgaccug

SEQ ID NO: 40417 - RNA, 20 nt, Artificial Sequence
  MKO10040417_A_Pet117
  gRNA
agccuggcccguugcggcug

SEQ ID NO: 40418 - RNA, 20 nt, Artificial Sequence
  MKO10040418_A_Pet117
  gRNA
cuccucgacauucccgcucc

SEQ ID NO: 40419 - RNA, 20 nt, Artificial Sequence
  MKO10040419_A_Pet117
  gRNA
aaaagaaaacauucgucuuc

SEQ ID NO: 40420 - RNA, 20 nt, Artificial Sequence
  MKO10040420_A_Pet2
  gRNA
ccucuaagaacugaacgauc

SEQ ID NO: 40421 - RNA, 20 nt, Artificial Sequence
  MKO10040421_A_Pet2
  gRNA
cacccacaugacuaagcguu

SEQ ID NO: 40422 - RNA, 20 nt, Artificial Sequence
  MKO10040422_A_Pet2
  gRNA
gccuaucacgaagagcacua

SEQ ID NO: 40423 - RNA, 20 nt, Artificial Sequence
  MKO10040423_A_Pex10
  gRNA
cguagcuagugcgagccuuc

SEQ ID NO: 40424 - RNA, 20 nt, Artificial Sequence
  MKO10040424_A_Pex10
  gRNA
guacguugggaucauccaag

SEQ ID NO: 40425 - RNA, 20 nt, Artificial Sequence
  MKO10040425_A_Pex10
  gRNA
accgcaaucuaucccaccgc

SEQ ID NO: 40426 - RNA, 20 nt, Artificial Sequence
  MKO10040426_A_Pex11a
  gRNA
cuacaaguccaaucucggcg

SEQ ID NO: 40427 - RNA, 20 nt, Artificial Sequence
  MKO10040427_A_Pex11a
  gRNA
auuagccaaccucaaccgcg

SEQ ID NO: 40428 - RNA, 20 nt, Artificial Sequence
  MKO10040428_A_Pex11a
  gRNA
uuuacggccagugcucacac

SEQ ID NO: 40429 - RNA, 20 nt, Artificial Sequence
  MKO10040429_A_Pex11b
  gRNA
cuacuggcucguguccuucg

SEQ ID NO: 40430 - RNA, 20 nt, Artificial Sequence
  MKO10040430_A_Pex11b
  gRNA
uuuacuuacacuuucguccg

SEQ ID NO: 40431 - RNA, 20 nt, Artificial Sequence
  MKO10040431_A_Pex11b
  gRNA
aucucuacaagugcuacgcc

SEQ ID NO: 40432 - RNA, 20 nt, Artificial Sequence
  MKO10040432_A_Pex11g
  gRNA
cgaagugggaaggcgcuugc

SEQ ID NO: 40433 - RNA, 20 nt, Artificial Sequence
  MKO10040433_A_Pex11g
  gRNA
caguccugcaaugauugaac

SEQ ID NO: 40434 - RNA, 20 nt, Artificial Sequence
  MKO10040434_A_Pex11g
  gRNA
gcucacaaggauaguacagu

SEQ ID NO: 40435 - RNA, 20 nt, Artificial Sequence
  MKO10040435_A_Pex12
  gRNA
guugccuuaucccucucgac

SEQ ID NO: 40436 - RNA, 20 nt, Artificial Sequence
  MKO10040436_A_Pex12
  gRNA
uuucaucaaaccaccgccag

SEQ ID NO: 40437 - RNA, 20 nt, Artificial Sequence
  MKO10040437_A_Pex12
  gRNA
gaaucaaauccugcgcacua

SEQ ID NO: 40438 - RNA, 20 nt, Artificial Sequence
  MKO10040438_A_Pex13
  gRNA
ucucgcagaauucccggggc

SEQ ID NO: 40439 - RNA, 20 nt, Artificial Sequence
  MKO10040439_A_Pex13
  gRNA
gaagaaauuucuuuccgugc

SEQ ID NO: 40440 - RNA, 20 nt, Artificial Sequence
  MKO10040440_A_Pex13
  gRNA
cagaagccaaccacgcacuu

SEQ ID NO: 40441 - RNA, 20 nt, Artificial Sequence
  MKO10040441_A_Pex14
  gRNA
gccggacccgagaauucugu

SEQ ID NO: 40442 - RNA, 20 nt, Artificial Sequence
  MKO10040442_A_Pex14
  gRNA
ggcagagcccacuugcgacc

SEQ ID NO: 40443 - RNA, 20 nt, Artificial Sequence
  MKO10040443_A_Pex14
  gRNA
ugccgacgagccuucacccc

SEQ ID NO: 40444 - RNA, 20 nt, Artificial Sequence
  MKO10040444_A_Pex16
  gRNA
uguggggcgaaguaggccgu

SEQ ID NO: 40445 - RNA, 20 nt, Artificial Sequence
  MKO10040445_A_Pex16
  gRNA
guacucugccucgaaccugc

SEQ ID NO: 40446 - RNA, 20 nt, Artificial Sequence
  MKO10040446_A_Pex16
  gRNA
gcuucgaaaaaaguugccug

SEQ ID NO: 40447 - RNA, 20 nt, Artificial Sequence
  MKO10040447_A_Pex19
  gRNA
guguuggggucgaagacgac

SEQ ID NO: 40448 - RNA, 20 nt, Artificial Sequence
  MKO10040448_A_Pex19
  gRNA
cgagacgcccacagacagcg

SEQ ID NO: 40449 - RNA, 20 nt, Artificial Sequence
  MKO10040449_A_Pex19
  gRNA
uacucagagggcucgcuuug

SEQ ID NO: 40450 - RNA, 20 nt, Artificial Sequence
  MKO10040450_A_Pex1
  gRNA
gaucagcuccaaccgcagug

SEQ ID NO: 40451 - RNA, 20 nt, Artificial Sequence
  MKO10040451_A_Pex1
  gRNA
gcaccgcccacguauuuccu

SEQ ID NO: 40452 - RNA, 20 nt, Artificial Sequence
  MKO10040452_A_Pex1
  gRNA
accgaucuggauaaauaugu

SEQ ID NO: 40453 - RNA, 20 nt, Artificial Sequence
  MKO10040453_A_Pex26
  gRNA
ggucaaaccguagaaucaag

SEQ ID NO: 40454 - RNA, 20 nt, Artificial Sequence
  MKO10040454_A_Pex26
  gRNA
uacccgcugcuccucgcuga

SEQ ID NO: 40455 - RNA, 20 nt, Artificial Sequence
  MKO10040455_A_Pex26
  gRNA
guaggaccacucagucccgg

SEQ ID NO: 40456 - RNA, 20 nt, Artificial Sequence
  MKO10040456_A_Pex2
  gRNA
agccaacuucgcgcauguuc

SEQ ID NO: 40457 - RNA, 20 nt, Artificial Sequence
  MKO10040457_A_Pex2
  gRNA
uacuuuacgugcccgaagug

SEQ ID NO: 40458 - RNA, 20 nt, Artificial Sequence
  MKO10040458_A_Pex2
  gRNA
ccccagaacaugcgcgaagu

SEQ ID NO: 40459 - RNA, 20 nt, Artificial Sequence
  MKO10040459_A_Pex3
  gRNA
aaugguacugucgccgagcu

SEQ ID NO: 40460 - RNA, 20 nt, Artificial Sequence
  MKO10040460_A_Pex3
  gRNA
cagaauacauugcccaagcu

SEQ ID NO: 40461 - RNA, 20 nt, Artificial Sequence
  MKO10040461_A_Pex3
  gRNA
caccuccgaggacugugccc

SEQ ID NO: 40462 - RNA, 20 nt, Artificial Sequence
  MKO10040462_A_Pex5l
  gRNA
auuuagacauccgccgugug

SEQ ID NO: 40463 - RNA, 20 nt, Artificial Sequence
  MKO10040463_A_Pex5l
  gRNA
cagcuauugucgcccuccag

SEQ ID NO: 40464 - RNA, 20 nt, Artificial Sequence
  MKO10040464_A_Pex5l
  gRNA
gugaggacaaccugucaacu

SEQ ID NO: 40465 - RNA, 20 nt, Artificial Sequence
  MKO10040465_A_Pex5
  gRNA
gaauucaucgccgaaguuac

SEQ ID NO: 40466 - RNA, 20 nt, Artificial Sequence
  MKO10040466_A_Pex5
  gRNA
aagauuauaaugagaccgac

SEQ ID NO: 40467 - RNA, 20 nt, Artificial Sequence
  MKO10040467_A_Pex5
  gRNA
gccucagucccuccugccga

SEQ ID NO: 40468 - RNA, 20 nt, Artificial Sequence
  MKO10040468_A_Pex6
  gRNA
auguguaacucucgagcaaa

SEQ ID NO: 40469 - RNA, 20 nt, Artificial Sequence
  MKO10040469_A_Pex6
  gRNA
cggccuuaccagguauaaag

SEQ ID NO: 40470 - RNA, 20 nt, Artificial Sequence
  MKO10040470_A_Pex6
  gRNA
gccucacucacccgggcugc

SEQ ID NO: 40471 - RNA, 20 nt, Artificial Sequence
  MKO10040471_A_Pex7
  gRNA
gaugccguagugcugcgccg

SEQ ID NO: 40472 - RNA, 20 nt, Artificial Sequence
  MKO10040472_A_Pex7
  gRNA
agaacucggccgcauagccg

SEQ ID NO: 40473 - RNA, 20 nt, Artificial Sequence
  MKO10040473_A_Pex7
  gRNA
gaggcugaagcgaaacaacc

SEQ ID NO: 40474 - RNA, 20 nt, Artificial Sequence
  MKO10040474_A_Pf4
  gRNA
ucuugacaugagcgucgcug

SEQ ID NO: 40475 - RNA, 20 nt, Artificial Sequence
  MKO10040475_A_Pf4
  gRNA
cagcugauaccuaacucucc

SEQ ID NO: 40476 - RNA, 20 nt, Artificial Sequence
  MKO10040476_A_Pf4
  gRNA
gcuggucccgaagaaagcga

SEQ ID NO: 40477 - RNA, 20 nt, Artificial Sequence
  MKO10040477_A_Pfas
  gRNA
cacccgacguuaccgacuuu

SEQ ID NO: 40478 - RNA, 20 nt, Artificial Sequence
  MKO10040478_A_Pfas
  gRNA
uuaccgaaagucgguaacgu

SEQ ID NO: 40479 - RNA, 20 nt, Artificial Sequence
  MKO10040479_A_Pfas
  gRNA
cucugucauccggucgugca

SEQ ID NO: 40480 - RNA, 20 nt, Artificial Sequence
  MKO10040480_A_Pfdn1
  gRNA
ucaugaucuccguguccgua

SEQ ID NO: 40481 - RNA, 20 nt, Artificial Sequence
  MKO10040481_A_Pfdn1
  gRNA
cuccaauauggccgccuccg

SEQ ID NO: 40482 - RNA, 20 nt, Artificial Sequence
  MKO10040482_A_Pfdn1
  gRNA
gaugagacuaacauguacga

SEQ ID NO: 40483 - RNA, 20 nt, Artificial Sequence
  MKO10040483_A_Pfdn2
  gRNA
ccuucaguguaucgaucacc

SEQ ID NO: 40484 - RNA, 20 nt, Artificial Sequence
  MKO10040484_A_Pfdn2
  gRNA
aaagcacaacauucgucuca

SEQ ID NO: 40485 - RNA, 20 nt, Artificial Sequence
  MKO10040485_A_Pfdn2
  gRNA
uugcuggcuuuaaucgccuu

SEQ ID NO: 40486 - RNA, 20 nt, Artificial Sequence
  MKO10040486_A_Pfdn4
  gRNA
ucgcguauagcugcaccuuc

SEQ ID NO: 40487 - RNA, 20 nt, Artificial Sequence
  MKO10040487_A_Pfdn4
  gRNA
gcggguguuagccgaccuga

SEQ ID NO: 40488 - RNA, 20 nt, Artificial Sequence
  MKO10040488_A_Pfdn4
  gRNA
cgcacucaccgccuucuuca

SEQ ID NO: 40489 - RNA, 20 nt, Artificial Sequence
  MKO10040489_A_Pfdn5
  gRNA
aaccggcuacuacguggaga

SEQ ID NO: 40490 - RNA, 20 nt, Artificial Sequence
  MKO10040490_A_Pfdn5
  gRNA
aaggauacagaacucgucag

SEQ ID NO: 40491 - RNA, 20 nt, Artificial Sequence
  MKO10040491_A_Pfdn5
  gRNA
caccuucuccacguaguagc

SEQ ID NO: 40492 - RNA, 20 nt, Artificial Sequence
  MKO10040492_A_Pfkfb1
  gRNA
aaucaaugaucgucguucuc

SEQ ID NO: 40493 - RNA, 20 nt, Artificial Sequence
  MKO10040493_A_Pfkfb1
  gRNA
augguggguuuaccagcucg

SEQ ID NO: 40494 - RNA, 20 nt, Artificial Sequence
  MKO10040494_A_Pfkfb1
  gRNA
agcucacacgcuaucucaac

SEQ ID NO: 40495 - RNA, 20 nt, Artificial Sequence
  MKO10040495_A_Pfkfb2
  gRNA
cccacgccucaaaucugcga

SEQ ID NO: 40496 - RNA, 20 nt, Artificial Sequence
  MKO10040496_A_Pfkfb2
  gRNA
cccugcccuucgcagauuug

SEQ ID NO: 40497 - RNA, 20 nt, Artificial Sequence
  MKO10040497_A_Pfkfb2
  gRNA
uggguacuccaauccaguug

SEQ ID NO: 40498 - RNA, 20 nt, Artificial Sequence
  MKO10040498_A_Pfkfb3
  gRNA
guuggucagcuucggcccac

SEQ ID NO: 40499 - RNA, 20 nt, Artificial Sequence
  MKO10040499_A_Pfkfb3
  gRNA
ggcuuacuuucggacucuca

SEQ ID NO: 40500 - RNA, 20 nt, Artificial Sequence
  MKO10040500_A_Pfkfb3
  gRNA
gcacucacaucugggcaacg

SEQ ID NO: 40501 - RNA, 20 nt, Artificial Sequence
  MKO10040501_A_Pfkfb4
  gRNA
caaccaauacgacccgagag

SEQ ID NO: 40502 - RNA, 20 nt, Artificial Sequence
  MKO10040502_A_Pfkfb4
  gRNA
acuggauuggcgugccuacu

SEQ ID NO: 40503 - RNA, 20 nt, Artificial Sequence
  MKO10040503_A_Pfkfb4
  gRNA
ucccccccagaauucaacgu

SEQ ID NO: 40504 - RNA, 20 nt, Artificial Sequence
  MKO10040504_A_Pfkl
  gRNA
cgucgccaccgaugacacac

SEQ ID NO: 40505 - RNA, 20 nt, Artificial Sequence
  MKO10040505_A_Pfkl
  gRNA
gcggccuucccucguaguga

SEQ ID NO: 40506 - RNA, 20 nt, Artificial Sequence
  MKO10040506_A_Pfkl
  gRNA
gccacagaagucguuaucga

SEQ ID NO: 40507 - RNA, 20 nt, Artificial Sequence
  MKO10040507_A_Pfkm
  gRNA
guccagcuaccugaacaucg

SEQ ID NO: 40508 - RNA, 20 nt, Artificial Sequence
  MKO10040508_A_Pfkm
  gRNA
cgcccgugaagauaccaacu

SEQ ID NO: 40509 - RNA, 20 nt, Artificial Sequence
  MKO10040509_A_Pfkm
  gRNA
uggacgguggcgagcacauc

SEQ ID NO: 40510 - RNA, 20 nt, Artificial Sequence
  MKO10040510_A_Pfkp
  gRNA
gcccaagcgcgccaaguuac

SEQ ID NO: 40511 - RNA, 20 nt, Artificial Sequence
  MKO10040511_A_Pfkp
  gRNA
cccgccgaucacgcacagau

SEQ ID NO: 40512 - RNA, 20 nt, Artificial Sequence
  MKO10040512_A_Pfkp
  gRNA
gaaugcugcuguccgcgcug

SEQ ID NO: 40513 - RNA, 20 nt, Artificial Sequence
  MKO10040513_A_Pfn1
  gRNA
gacaggucccguccgccaua

SEQ ID NO: 40514 - RNA, 20 nt, Artificial Sequence
  MKO10040514_A_Pfn1
  gRNA
cgccuacaucgacagccuua

SEQ ID NO: 40515 - RNA, 20 nt, Artificial Sequence
  MKO10040515_A_Pfn1
  gRNA
cuucguaccaagagcaccgg

SEQ ID NO: 40516 - RNA, 20 nt, Artificial Sequence
  MKO10040516_A_Pfn2
  gRNA
acugcgacgccaaauacguc

SEQ ID NO: 40517 - RNA, 20 nt, Artificial Sequence
  MKO10040517_A_Pfn2
  gRNA
gucgcaguagccgacaaugg

SEQ ID NO: 40518 - RNA, 20 nt, Artificial Sequence
  MKO10040518_A_Pfn2
  gRNA
ccaacagcaacguuguaugu

SEQ ID NO: 40519 - RNA, 20 nt, Artificial Sequence
  MKO10040519_A_Pfn3
  gRNA
cguacuggaugcgcgcacca

SEQ ID NO: 40520 - RNA, 20 nt, Artificial Sequence
  MKO10040520_A_Pfn3
  gRNA
gaucgaugacguggcuaucg

SEQ ID NO: 40521 - RNA, 20 nt, Artificial Sequence
  MKO10040521_A_Pfn3
  gRNA
auccaguacgccgucacccu

SEQ ID NO: 40522 - RNA, 20 nt, Artificial Sequence
  MKO10040522_A_Pfn4
  gRNA
cauguauccuagcgucugcg

SEQ ID NO: 40523 - RNA, 20 nt, Artificial Sequence
  MKO10040523_A_Pfn4
  gRNA
ccuucccuucgcguuaauaa

SEQ ID NO: 40524 - RNA, 20 nt, Artificial Sequence
  MKO10040524_A_Pfn4
  gRNA
aaaacccauuauuaacgcga

SEQ ID NO: 40525 - RNA, 20 nt, Artificial Sequence
  MKO10040525_A_Pfpl
  gRNA
caaugaucgcagcgagcugu

SEQ ID NO: 40526 - RNA, 20 nt, Artificial Sequence
  MKO10040526_A_Pfpl
  gRNA
aaacuggucaacgcucccuu

SEQ ID NO: 40527 - RNA, 20 nt, Artificial Sequence
  MKO10040527_A_Pfpl
  gRNA
gauuaucgucccagagucaa

SEQ ID NO: 40528 - RNA, 20 nt, Artificial Sequence
  MKO10040528_A_Pga5
  gRNA
acgucuagguaguuccucau

SEQ ID NO: 40529 - RNA, 20 nt, Artificial Sequence
  MKO10040529_A_Pga5
  gRNA
acaaagccuucaacccgcuu

SEQ ID NO: 40530 - RNA, 20 nt, Artificial Sequence
  MKO10040530_A_Pga5
  gRNA
acgugcuucuugagcagcgc

SEQ ID NO: 40531 - RNA, 20 nt, Artificial Sequence
  MKO10040531_A_Pgam1
  gRNA
cgccgcgcuucgccuccucg

SEQ ID NO: 40532 - RNA, 20 nt, Artificial Sequence
  MKO10040532_A_Pgam1
  gRNA
cgccauggcugccuacaagc

SEQ ID NO: 40533 - RNA, 20 nt, Artificial Sequence
  MKO10040533_A_Pgam1
  gRNA
cuugcugauguugcuguaga

SEQ ID NO: 40534 - RNA, 20 nt, Artificial Sequence
  MKO10040534_A_Pgam2
  gRNA
gauagcgguggccccccgcu

SEQ ID NO: 40535 - RNA, 20 nt, Artificial Sequence
  MKO10040535_A_Pgam2
  gRNA
gaccacccaccgccuaguaa

SEQ ID NO: 40536 - RNA, 20 nt, Artificial Sequence
  MKO10040536_A_Pgam2
  gRNA
ggagaucgcaccuaagauua

SEQ ID NO: 40537 - RNA, 20 nt, Artificial Sequence
  MKO10040537_A_Pgam5
  gRNA
cacgcgcgcgaccgagccgc

SEQ ID NO: 40538 - RNA, 20 nt, Artificial Sequence
  MKO10040538_A_Pgam5
  gRNA
gcggcgucugggacaccaac

SEQ ID NO: 40539 - RNA, 20 nt, Artificial Sequence
  MKO10040539_A_Pgam5
  gRNA
uuugcuuccaggucgggaac

SEQ ID NO: 40540 - RNA, 20 nt, Artificial Sequence
  MKO10040540_A_Pgap1
  gRNA
cgggauuaccaaguucguuc

SEQ ID NO: 40541 - RNA, 20 nt, Artificial Sequence
  MKO10040541_A_Pgap1
  gRNA
ccauuagaucguuucauuac

SEQ ID NO: 40542 - RNA, 20 nt, Artificial Sequence
  MKO10040542_A_Pgap1
  gRNA
uacucugcaguucgaucuau

SEQ ID NO: 40543 - RNA, 20 nt, Artificial Sequence
  MKO10040543_A_Pgap2
  gRNA
ccggcacaacauguauugug

SEQ ID NO: 40544 - RNA, 20 nt, Artificial Sequence
  MKO10040544_A_Pgap2
  gRNA
agaagcggggugccgagugc

SEQ ID NO: 40545 - RNA, 20 nt, Artificial Sequence
  MKO10040545_A_Pgap2
  gRNA
ccucacaauacauguugugc

SEQ ID NO: 40546 - RNA, 20 nt, Artificial Sequence
  MKO10040546_A_Pgap3
  gRNA
auacuugcagucgucccgac

SEQ ID NO: 40547 - RNA, 20 nt, Artificial Sequence
  MKO10040547_A_Pgap3
  gRNA
gauagcggcagagcaucacc

SEQ ID NO: 40548 - RNA, 20 nt, Artificial Sequence
  MKO10040548_A_Pgap3
  gRNA
gguccacagucuuccauacc

SEQ ID NO: 40549 - RNA, 20 nt, Artificial Sequence
  MKO10040549_A_Pgbd1
  gRNA
aacagaagugccgaaaucgc

SEQ ID NO: 40550 - RNA, 20 nt, Artificial Sequence
  MKO10040550_A_Pgbd1
  gRNA
aacuuuaccgccugcgauuu

SEQ ID NO: 40551 - RNA, 20 nt, Artificial Sequence
  MKO10040551_A_Pgbd1
  gRNA
gugguacaacuaacuacgca

SEQ ID NO: 40552 - RNA, 20 nt, Artificial Sequence
  MKO10040552_A_Pgbd5
  gRNA
guccgccagugcucuucaac

SEQ ID NO: 40553 - RNA, 20 nt, Artificial Sequence
  MKO10040553_A_Pgbd5
  gRNA
aagagcacuggcggacccac

SEQ ID NO: 40554 - RNA, 20 nt, Artificial Sequence
  MKO10040554_A_Pgbd5
  gRNA
caagaucuacguccaccuaa

SEQ ID NO: 40555 - RNA, 20 nt, Artificial Sequence
  MKO10040555_A_Pgc
  gRNA
gcguagacaaaauuggugcc

SEQ ID NO: 40556 - RNA, 20 nt, Artificial Sequence
  MKO10040556_A_Pgc
  gRNA
uucugucuacugccagagcg

SEQ ID NO: 40557 - RNA, 20 nt, Artificial Sequence
  MKO10040557_A_Pgc
  gRNA
ggcugccggugccguacugc

SEQ ID NO: 40558 - RNA, 20 nt, Artificial Sequence
  MKO10040558_A_Pgd
  gRNA
acgggugacaucaucaucga

SEQ ID NO: 40559 - RNA, 20 nt, Artificial Sequence
  MKO10040559_A_Pgd
  gRNA
ccaaacuaaagaagccccgc

SEQ ID NO: 40560 - RNA, 20 nt, Artificial Sequence
  MKO10040560_A_Pgd
  gRNA
caacgaggcgaagggcacca

SEQ ID NO: 40561 - RNA, 20 nt, Artificial Sequence
  MKO10040561_A_Pgf
  gRNA
cgaccccacacuucguugaa

SEQ ID NO: 40562 - RNA, 20 nt, Artificial Sequence
  MKO10040562_A_Pgf
  gRNA
ucgcagcuacugucggccca

SEQ ID NO: 40563 - RNA, 20 nt, Artificial Sequence
  MKO10040563_A_Pgf
  gRNA
accuauucuggagacgacaa

SEQ ID NO: 40564 - RNA, 20 nt, Artificial Sequence
  MKO10040564_A_Pggu1b
  gRNA
cuuaggccguguggauaaag

SEQ ID NO: 40565 - RNA, 20 nt, Artificial Sequence
  MKO10040565_A_Pggu1b
  gRNA
gcuauguguccacugucgua

SEQ ID NO: 40566 - RNA, 20 nt, Artificial Sequence
  MKO10040566_A_Pggu1b
  gRNA
gggucaaaucugagucgcug

SEQ ID NO: 40567 - RNA, 20 nt, Artificial Sequence
  MKO10040567_A_Pgk1
  gRNA
ucugcagguuaaagcugagc

SEQ ID NO: 40568 - RNA, 20 nt, Artificial Sequence
  MKO10040568_A_Pgk1
  gRNA
cagggauguucuguucuuga

SEQ ID NO: 40569 - RNA, 20 nt, Artificial Sequence
  MKO10040569_A_Pgk1
  gRNA
accuuugguuguuuguuauc

SEQ ID NO: 40570 - RNA, 20 nt, Artificial Sequence
  MKO10040570_A_Pgk2
  gRNA
aguaucuccgccuccuauaa

SEQ ID NO: 40571 - RNA, 20 nt, Artificial Sequence
  MKO10040571_A_Pgk2
  gRNA
caugaucucuuuaacaaucg

SEQ ID NO: 40572 - RNA, 20 nt, Artificial Sequence
  MKO10040572_A_Pgk2
  gRNA
gucuaugucaacgaugcauu

SEQ ID NO: 40573 - RNA, 20 nt, Artificial Sequence
  MKO10040573_A_Pgls
  gRNA
ggccgucagggcccacuccc

SEQ ID NO: 40574 - RNA, 20 nt, Artificial Sequence
  MKO10040574_A_Pgls
  gRNA
caauguggaaugcuucucga

SEQ ID NO: 40575 - RNA, 20 nt, Artificial Sequence
  MKO10040575_A_Pgls
  gRNA
agcguuagggucacccucug

SEQ ID NO: 40576 - RNA, 20 nt, Artificial Sequence
  MKO10040576_A_Pglyrp1
  gRNA
cagaccggguacccgcaaag

SEQ ID NO: 40577 - RNA, 20 nt, Artificial Sequence
  MKO10040577_A_Pglyrp1
  gRNA
gagaucaccacguagcgaac

SEQ ID NO: 40578 - RNA, 20 nt, Artificial Sequence
  MKO10040578_A_Pglyrp1
  gRNA
ucaucgugccccgcagugag

SEQ ID NO: 40579 - RNA, 20 nt, Artificial Sequence
  MKO10040579_A_Pglyrp2
  gRNA
cccuuccgcaguuucguggu

SEQ ID NO: 40580 - RNA, 20 nt, Artificial Sequence
  MKO10040580_A_Pglyrp2
  gRNA
gagccgcuccccaacggcag

SEQ ID NO: 40581 - RNA, 20 nt, Artificial Sequence
  MKO10040581_A_Pglyrp2
  gRNA
acgcugcauggagcgcauau

SEQ ID NO: 40582 - RNA, 20 nt, Artificial Sequence
  MKO10040582_A_Pglyrp3
  gRNA
augcaaugucgcagaaaucu

SEQ ID NO: 40583 - RNA, 20 nt, Artificial Sequence
  MKO10040583_A_Pglyrp3
  gRNA
agcagaccguggugugauau

SEQ ID NO: 40584 - RNA, 20 nt, Artificial Sequence
  MKO10040584_A_Pglyrp3
  gRNA
ucaucauagagcaaguuacc

SEQ ID NO: 40585 - RNA, 20 nt, Artificial Sequence
  MKO10040585_A_Pglyrp4
  gRNA
uguccaaggcucucacgacc

SEQ ID NO: 40586 - RNA, 20 nt, Artificial Sequence
  MKO10040586_A_Pglyrp4
  gRNA
uuguuguggcacucuagucc

SEQ ID NO: 40587 - RNA, 20 nt, Artificial Sequence
  MKO10040587_A_Pglyrp4
  gRNA
ucugacaccugaucaguuug

SEQ ID NO: 40588 - RNA, 20 nt, Artificial Sequence
  MKO10040588_A_Pgm1
  gRNA
ucgcaccugaaacucugcgc

SEQ ID NO: 40589 - RNA, 20 nt, Artificial Sequence
  MKO10040589_A_Pgm1
  gRNA
cuucgagcgccuaugggagc

SEQ ID NO: 40590 - RNA, 20 nt, Artificial Sequence
  MKO10040590_A_Pgm1
  gRNA
gcgagagcucaccccgccag

SEQ ID NO: 40591 - RNA, 20 nt, Artificial Sequence
  MKO10040591_A_Pgm2l1
  gRNA
ugcgugaucgucuuuguugc

SEQ ID NO: 40592 - RNA, 20 nt, Artificial Sequence
  MKO10040592_A_Pgm2l1
  gRNA
ugcaucucauaaccgcaaag

SEQ ID NO: 40593 - RNA, 20 nt, Artificial Sequence
  MKO10040593_A_Pgm2l1
  gRNA
auacuuacuacgaaaggugu

SEQ ID NO: 40594 - RNA, 20 nt, Artificial Sequence
  MKO10040594_A_Pgm2
  gRNA
ccagcgcguaccuccgugca

SEQ ID NO: 40595 - RNA, 20 nt, Artificial Sequence
  MKO10040595_A_Pgm2
  gRNA
ccuauccuagauuggucgcc

SEQ ID NO: 40596 - RNA, 20 nt, Artificial Sequence
  MKO10040596_A_Pgm2
  gRNA
cuucgauuucaacgcacuga

SEQ ID NO: 40597 - RNA, 20 nt, Artificial Sequence
  MKO10040597_A_Pgm3
  gRNA
uuucguagaccuuacgaauc

SEQ ID NO: 40598 - RNA, 20 nt, Artificial Sequence
  MKO10040598_A_Pgm3
  gRNA
cgaucauaucauguuucgaa

SEQ ID NO: 40599 - RNA, 20 nt, Artificial Sequence
  MKO10040599_A_Pgm3
  gRNA
uacggccucacauaacccug

SEQ ID NO: 40600 - RNA, 20 nt, Artificial Sequence
  MKO10040600_A_Pgm5
  gRNA
ucgaauugaccuaucucgac

SEQ ID NO: 40601 - RNA, 20 nt, Artificial Sequence
  MKO10040601_A_Pgm5
  gRNA
gacacaguuuauugcggagu

SEQ ID NO: 40602 - RNA, 20 nt, Artificial Sequence
  MKO10040602_A_Pgm5
  gRNA
ugcccuccgaagucuucuag

SEQ ID NO: 40603 - RNA, 20 nt, Artificial Sequence
  MKO10040603_A_Pgpep1l
  gRNA
gccgagagccagugcgacag

SEQ ID NO: 40604 - RNA, 20 nt, Artificial Sequence
  MKO10040604_A_Pgpep1l
  gRNA
ugaaguaccugcccgcaucu

SEQ ID NO: 40605 - RNA, 20 nt, Artificial Sequence
  MKO10040605_A_Pgpep1l
  gRNA
caucugaaucccgauagccu

SEQ ID NO: 40606 - RNA, 20 nt, Artificial Sequence
  MKO10040606_A_Pgpep1
  gRNA
cgaugauagcucguagcgcc

SEQ ID NO: 40607 - RNA, 20 nt, Artificial Sequence
  MKO10040607_A_Pgpep1
  gRNA
ggcgcuacgagcuaucaucg

SEQ ID NO: 40608 - RNA, 20 nt, Artificial Sequence
  MKO10040608_A_Pgpep1
  gRNA
cacggcguccaugucgauga

SEQ ID NO: 40609 - RNA, 20 nt, Artificial Sequence
  MKO10040609_A_Pgp
  gRNA
gcucgaacccgacgugcgcg

SEQ ID NO: 40610 - RNA, 20 nt, Artificial Sequence
  MKO10040610_A_Pgp
  gRNA
gcagcgggcuucgucgccac

SEQ ID NO: 40611 - RNA, 20 nt, Artificial Sequence
  MKO10040611_A_Pgp
  gRNA
cccaccaugacggugcgcuc

SEQ ID NO: 40612 - RNA, 20 nt, Artificial Sequence
  MKO10040612_A_Pgr15l
  gRNA
caguugcuauggaccggcac

SEQ ID NO: 40613 - RNA, 20 nt, Artificial Sequence
  MKO10040613_A_Pgr15l
  gRNA
ggggggcaauccccacauca

SEQ ID NO: 40614 - RNA, 20 nt, Artificial Sequence
  MKO10040614_A_Pgr15l
  gRNA
acugggcaaaccgacugaca

SEQ ID NO: 40615 - RNA, 20 nt, Artificial Sequence
  MKO10040615_A_Pgrmc1
  gRNA
cgcgaacgaucuuguagagc

SEQ ID NO: 40616 - RNA, 20 nt, Artificial Sequence
  MKO10040616_A_Pgrmc1
  gRNA
cugcucuacaagaucguucg

SEQ ID NO: 40617 - RNA, 20 nt, Artificial Sequence
  MKO10040617_A_Pgrmc1
  gRNA
uuccgagcugucucgucuuu

SEQ ID NO: 40618 - RNA, 20 nt, Artificial Sequence
  MKO10040618_A_Pgrmc2
  gRNA
gcgugcgcgccccgucguac

SEQ ID NO: 40619 - RNA, 20 nt, Artificial Sequence
  MKO10040619_A_Pgrmc2
  gRNA
aagucccgcuucuucaugcg

SEQ ID NO: 40620 - RNA, 20 nt, Artificial Sequence
  MKO10040620_A_Pgrmc2
  gRNA
ucucuuucagcggguccaua

SEQ ID NO: 40621 - RNA, 20 nt, Artificial Sequence
  MKO10040621_A_Pgr
  gRNA
gcaguugucucucgccuagu

SEQ ID NO: 40622 - RNA, 20 nt, Artificial Sequence
  MKO10040622_A_Pgr
  gRNA
cguuaggaaggcccaccgac

SEQ ID NO: 40623 - RNA, 20 nt, Artificial Sequence
  MKO10040623_A_Pgr
  gRNA
gcuuguacgaccuccacccc

SEQ ID NO: 40624 - RNA, 20 nt, Artificial Sequence
  MKO10040624_A_Pgs1
  gRNA
agggagacgcgcacgcgcuc

SEQ ID NO: 40625 - RNA, 20 nt, Artificial Sequence
  MKO10040625_A_Pgs1
  gRNA
gcuguccccaaccguuccuc

SEQ ID NO: 40626 - RNA, 20 nt, Artificial Sequence
  MKO10040626_A_Pgs1
  gRNA
gagcgcuucaaugagaccau

SEQ ID NO: 40627 - RNA, 20 nt, Artificial Sequence
  MKO10040627_A_Phacur1
  gRNA
agccaugcguuccgacucgc

SEQ ID NO: 40628 - RNA, 20 nt, Artificial Sequence
  MKO10040628_A_Phacur1
  gRNA
cgacacgccauaucucgcag

SEQ ID NO: 40629 - RNA, 20 nt, Artificial Sequence
  MKO10040629_A_Phacur1
  gRNA
guacgcacaccccgcccauc

SEQ ID NO: 40630 - RNA, 20 nt, Artificial Sequence
  MKO10040630_A_Phacur2
  gRNA
ucgaugguucuucaguccaa

SEQ ID NO: 40631 - RNA, 20 nt, Artificial Sequence
  MKO10040631_A_Phacur2
  gRNA
gcacaugauacacaucggag

SEQ ID NO: 40632 - RNA, 20 nt, Artificial Sequence
  MKO10040632_A_Phacur2
  gRNA
ggacggugaggcugacgcuu

SEQ ID NO: 40633 - RNA, 20 nt, Artificial Sequence
  MKO10040633_A_Phacur3
  gRNA
gugcagagugagccgcccgc

SEQ ID NO: 40634 - RNA, 20 nt, Artificial Sequence
  MKO10040634_A_Phacur3
  gRNA
aaacugaagcagacgacguc

SEQ ID NO: 40635 - RNA, 20 nt, Artificial Sequence
  MKO10040635_A_Phacur3
  gRNA
gagcccucucaagccuuagc

SEQ ID NO: 40636 - RNA, 20 nt, Artificial Sequence
  MKO10040636_A_Phacur4
  gRNA
guccguucuuuaaugcagca

SEQ ID NO: 40637 - RNA, 20 nt, Artificial Sequence
  MKO10040637_A_Phacur4
  gRNA
agaucuucaagccguggaaa

SEQ ID NO: 40638 - RNA, 20 nt, Artificial Sequence
  MKO10040638_A_Phacur4
  gRNA
uuccggcuggcaguacagca

SEQ ID NO: 40639 - RNA, 20 nt, Artificial Sequence
  MKO10040639_A_Phax
  gRNA
uagccgaugagaucgccuuc

SEQ ID NO: 40640 - RNA, 20 nt, Artificial Sequence
  MKO10040640_A_Phax
  gRNA
ccgaugacgauugcucucuu

SEQ ID NO: 40641 - RNA, 20 nt, Artificial Sequence
  MKO10040641_A_Phax
  gRNA
accugauagcccgaguagug

SEQ ID NO: 40642 - RNA, 20 nt, Artificial Sequence
  MKO10040642_A_Phb2
  gRNA
cauaguccagcccuagacgc

SEQ ID NO: 40643 - RNA, 20 nt, Artificial Sequence
  MKO10040643_A_Phb2
  gRNA
cgaaaaaucuccucccccac

SEQ ID NO: 40644 - RNA, 20 nt, Artificial Sequence
  MKO10040644_A_Phb2
  gRNA
cgugcagcaggacacgaucc

SEQ ID NO: 40645 - RNA, 20 nt, Artificial Sequence
  MKO10040645_A_Phb
  gRNA
ggccaggcucgauucgaugc

SEQ ID NO: 40646 - RNA, 20 nt, Artificial Sequence
  MKO10040646_A_Phb
  gRNA
uauccuggaugacguguccc

SEQ ID NO: 40647 - RNA, 20 nt, Artificial Sequence
  MKO10040647_A_Phb
  gRNA
cacucaccaccaccgacuug

SEQ ID NO: 40648 - RNA, 20 nt, Artificial Sequence
  MKO10040648_A_Phc1
  gRNA
cacgauugcugccagucgac

SEQ ID NO: 40649 - RNA, 20 nt, Artificial Sequence
  MKO10040649_A_Phc1
  gRNA
cugucgacuggcagcaaucg

SEQ ID NO: 40650 - RNA, 20 nt, Artificial Sequence
  MKO10040650_A_Phc1
  gRNA
cagaacucuaguucgaccaa

SEQ ID NO: 40651 - RNA, 20 nt, Artificial Sequence
  MKO10040651_A_Phc2
  gRNA
ccgucggcgguuguggguug

SEQ ID NO: 40652 - RNA, 20 nt, Artificial Sequence
  MKO10040652_A_Phc2
  gRNA
acccuucgauaacaugcguc

SEQ ID NO: 40653 - RNA, 20 nt, Artificial Sequence
  MKO10040653_A_Phc2
  gRNA
auccugacgcauguuaucga

SEQ ID NO: 40654 - RNA, 20 nt, Artificial Sequence
  MKO10040654_A_Phc3
  gRNA
ucccgaguagcauagucugc

SEQ ID NO: 40655 - RNA, 20 nt, Artificial Sequence
  MKO10040655_A_Phc3
  gRNA
cuugcaucggccccccagcu

SEQ ID NO: 40656 - RNA, 20 nt, Artificial Sequence
  MKO10040656_A_Phc3
  gRNA
auggauagugagccgagcuc

SEQ ID NO: 40657 - RNA, 20 nt, Artificial Sequence
  MKO10040657_A_Phex
  gRNA
cagaauugcuguauugaccg

SEQ ID NO: 40658 - RNA, 20 nt, Artificial Sequence
  MKO10040658_A_Phex
  gRNA
uuaccggcuucuaugcauuc

SEQ ID NO: 40659 - RNA, 20 nt, Artificial Sequence
  MKO10040659_A_Phex
  gRNA
gaaacuuacccuucaacuug

SEQ ID NO: 40660 - RNA, 20 nt, Artificial Sequence
  MKO10040660_A_Phf10
  gRNA
accuggauauuuccgcuuga

SEQ ID NO: 40661 - RNA, 20 nt, Artificial Sequence
  MKO10040661_A_Phf10
  gRNA
gcgacgagauuuaucucaca

SEQ ID NO: 40662 - RNA, 20 nt, Artificial Sequence
  MKO10040662_A_Phf10
  gRNA
gaauauucagcguguuuagc

SEQ ID NO: 40663 - RNA, 20 nt, Artificial Sequence
  MKO10040663_A_Phf11a
  gRNA
ugagcaacuauauucgcuga

SEQ ID NO: 40664 - RNA, 20 nt, Artificial Sequence
  MKO10040664_A_Phf11a
  gRNA
ggacuguaaaucauauccca

SEQ ID NO: 40665 - RNA, 20 nt, Artificial Sequence
  MKO10040665_A_Phf11a
  gRNA
cuguccaaucauagagaaga

SEQ ID NO: 40666 - RNA, 20 nt, Artificial Sequence
  MKO10040666_A_Phf11b
  gRNA
ucaaaguuucuaauuguauu

SEQ ID NO: 40667 - RNA, 20 nt, Artificial Sequence
  MKO10040667_A_Phf11b
  gRNA
cuguccaaucauagaaaaga

SEQ ID NO: 40668 - RNA, 20 nt, Artificial Sequence
  MKO10040668_A_Phf11b
  gRNA
ugagcaacuauauuuccuga

SEQ ID NO: 40669 - RNA, 20 nt, Artificial Sequence
  MKO10040669_A_Phf11c
  gRNA
gacuacgcaguucuacaagg

SEQ ID NO: 40670 - RNA, 20 nt, Artificial Sequence
  MKO10040670_A_Phf11c
  gRNA
uguuucaccacaccuuacga

SEQ ID NO: 40671 - RNA, 20 nt, Artificial Sequence
  MKO10040671_A_Phf11c
  gRNA
uguugaugugaaaucaguac

SEQ ID NO: 40672 - RNA, 20 nt, Artificial Sequence
  MKO10040672_A_Phf11d
  gRNA
ccacuaugucugugccaaaa

SEQ ID NO: 40673 - RNA, 20 nt, Artificial Sequence
  MKO10040673_A_Phf11d
  gRNA
ccaccguggggugugauuua

SEQ ID NO: 40674 - RNA, 20 nt, Artificial Sequence
  MKO10040674_A_Phf11d
  gRNA
aguauauuugacuccacucg

SEQ ID NO: 40675 - RNA, 20 nt, Artificial Sequence
  MKO10040675_A_Phf12
  gRNA
ccgguguacuguccgccgaa

SEQ ID NO: 40676 - RNA, 20 nt, Artificial Sequence
  MKO10040676_A_Phf12
  gRNA
ugagcauaaugacgucgaug

SEQ ID NO: 40677 - RNA, 20 nt, Artificial Sequence
  MKO10040677_A_Phf12
  gRNA
ccuuucggcggacaguacac

SEQ ID NO: 40678 - RNA, 20 nt, Artificial Sequence
  MKO10040678_A_Phf13
  gRNA
uucgggaccgguuggagcga

SEQ ID NO: 40679 - RNA, 20 nt, Artificial Sequence
  MKO10040679_A_Phf13
  gRNA
gcacucguuacacucgauca

SEQ ID NO: 40680 - RNA, 20 nt, Artificial Sequence
  MKO10040680_A_Phf13
  gRNA
ucccggcagugcuguuggcg

SEQ ID NO: 40681 - RNA, 20 nt, Artificial Sequence
  MKO10040681_A_Phf14
  gRNA
caguggaucgcagcuccaag

SEQ ID NO: 40682 - RNA, 20 nt, Artificial Sequence
  MKO10040682_A_Phf14
  gRNA
ucgucggaaccguccccugu

SEQ ID NO: 40683 - RNA, 20 nt, Artificial Sequence
  MKO10040683_A_Phf14
  gRNA
ccgacgaagauuccauuucu

SEQ ID NO: 40684 - RNA, 20 nt, Artificial Sequence
  MKO10040684_A_Phf19
  gRNA
cgccaucgccaagacgcugc

SEQ ID NO: 40685 - RNA, 20 nt, Artificial Sequence
  MKO10040685_A_Phf19
  gRNA
ccagugcgaaaaugcagcgu

SEQ ID NO: 40686 - RNA, 20 nt, Artificial Sequence
  MKO10040686_A_Phf19
  gRNA
gagucccaaucgaguuccuc

SEQ ID NO: 40687 - RNA, 20 nt, Artificial Sequence
  MKO10040687_A_Phf1
  gRNA
ugucuuugcaaucgccacua

SEQ ID NO: 40688 - RNA, 20 nt, Artificial Sequence
  MKO10040688_A_Phf1
  gRNA
ugugugucgcucugagaccg

SEQ ID NO: 40689 - RNA, 20 nt, Artificial Sequence
  MKO10040689_A_Phf1
  gRNA
cccugggaacgugacagucc

SEQ ID NO: 40690 - RNA, 20 nt, Artificial Sequence
  MKO10040690_A_Phf20l1
  gRNA
cacgauccagcugggucgau

SEQ ID NO: 40691 - RNA, 20 nt, Artificial Sequence
  MKO10040691_A_Phf20l1
  gRNA
gauaugaugaguggauuuac

SEQ ID NO: 40692 - RNA, 20 nt, Artificial Sequence
  MKO10040692_A_Phf20l1
  gRNA
uguuguccuaucgacccagc

SEQ ID NO: 40693 - RNA, 20 nt, Artificial Sequence
  MKO10040693_A_Phf20
  gRNA
ggaguacucccgcucguucu

SEQ ID NO: 40694 - RNA, 20 nt, Artificial Sequence
  MKO10040694_A_Phf20
  gRNA
uucucuaaagggcgcagaua

SEQ ID NO: 40695 - RNA, 20 nt, Artificial Sequence
  MKO10040695_A_Phf20
  gRNA
agacucacccguaggaguua

SEQ ID NO: 40696 - RNA, 20 nt, Artificial Sequence
  MKO10040696_A_Phf21a
  gRNA
gccuagucuaacugcaucac

SEQ ID NO: 40697 - RNA, 20 nt, Artificial Sequence
  MKO10040697_A_Phf21a
  gRNA
gauggaguugcagacucuac

SEQ ID NO: 40698 - RNA, 20 nt, Artificial Sequence
  MKO10040698_A_Phf21a
  gRNA
acugguugcccaaaugaagc

SEQ ID NO: 40699 - RNA, 20 nt, Artificial Sequence
  MKO10040699_A_Phf21b
  gRNA
ucgcugagcgcugcgauccg

SEQ ID NO: 40700 - RNA, 20 nt, Artificial Sequence
  MKO10040700_A_Phf21b
  gRNA
cggucccugcccggggugac

SEQ ID NO: 40701 - RNA, 20 nt, Artificial Sequence
  MKO10040701_A_Phf21b
  gRNA
cugcacuuugaugccgucgc

SEQ ID NO: 40702 - RNA, 20 nt, Artificial Sequence
  MKO10040702_A_Phf23
  gRNA
aaucaugggccgccccgcaa

SEQ ID NO: 40703 - RNA, 20 nt, Artificial Sequence
  MKO10040703_A_Phf23
  gRNA
aacuucggccagaggcccgg

SEQ ID NO: 40704 - RNA, 20 nt, Artificial Sequence
  MKO10040704_A_Phf23
  gRNA
ccuucagagugcacuguaac

SEQ ID NO: 40705 - RNA, 20 nt, Artificial Sequence
  MKO10040705_A_Phf2
  gRNA
ucacguugagaacacgcuug

SEQ ID NO: 40706 - RNA, 20 nt, Artificial Sequence
  MKO10040706_A_Phf2
  gRNA
uucacguccgguguuggccc

SEQ ID NO: 40707 - RNA, 20 nt, Artificial Sequence
  MKO10040707_A_Phf2
  gRNA
gccagguagccagcucaccg

SEQ ID NO: 40708 - RNA, 20 nt, Artificial Sequence
  MKO10040708_A_Phf3
  gRNA
ggccgucuggucaccuucgc

SEQ ID NO: 40709 - RNA, 20 nt, Artificial Sequence
  MKO10040709_A_Phf3
  gRNA
gguuggcucaacuugcgaag

SEQ ID NO: 40710 - RNA, 20 nt, Artificial Sequence
  MKO10040710_A_Phf3
  gRNA
uucuccuuuggcgaggcugc

SEQ ID NO: 40711 - RNA, 20 nt, Artificial Sequence
  MKO10040711_A_Phf5a
  gRNA
ggccgccacagauuacacac

SEQ ID NO: 40712 - RNA, 20 nt, Artificial Sequence
  MKO10040712_A_Phf5a
  gRNA
cagggccgguguguaaucug

SEQ ID NO: 40713 - RNA, 20 nt, Artificial Sequence
  MKO10040713_A_Phf5a
  gRNA
uucuaugaacgcaaaaaaua

SEQ ID NO: 40714 - RNA, 20 nt, Artificial Sequence
  MKO10040714_A_Phf6
  gRNA
uacauguaaaucccuugcga

SEQ ID NO: 40715 - RNA, 20 nt, Artificial Sequence
  MKO10040715_A_Phf6
  gRNA
auccgagagaaaccuucgca

SEQ ID NO: 40716 - RNA, 20 nt, Artificial Sequence
  MKO10040716_A_Phf6
  gRNA
ccgagaaaaacuaaccuuaa

SEQ ID NO: 40717 - RNA, 20 nt, Artificial Sequence
  MKO10040717_A_Phf7
  gRNA
ggcaguacgggcuucuaaga

SEQ ID NO: 40718 - RNA, 20 nt, Artificial Sequence
  MKO10040718_A_Phf7
  gRNA
cuucuaugccuucaagaacc

SEQ ID NO: 40719 - RNA, 20 nt, Artificial Sequence
  MKO10040719_A_Phf7
  gRNA
cagguucuugaaggcauaga

SEQ ID NO: 40720 - RNA, 20 nt, Artificial Sequence
  MKO10040720_A_Phf8
  gRNA
gguuuagugaaaaaacgucg

SEQ ID NO: 40721 - RNA, 20 nt, Artificial Sequence
  MKO10040721_A_Phf8
  gRNA
gaucgagugugacaugugcc

SEQ ID NO: 40722 - RNA, 20 nt, Artificial Sequence
  MKO10040722_A_Phf8
  gRNA
caucauaaggcagucgacag

SEQ ID NO: 40723 - RNA, 20 nt, Artificial Sequence
  MKO10040723_A_Phgdh
  gRNA
ugggucuuuagcacccccaa

SEQ ID NO: 40724 - RNA, 20 nt, Artificial Sequence
  MKO10040724_A_Phgdh
  gRNA
uucuuacaggcagauucccc

SEQ ID NO: 40725 - RNA, 20 nt, Artificial Sequence
  MKO10040725_A_Phgdh
  gRNA
ccagaacuuacuucaugacu

SEQ ID NO: 40726 - RNA, 20 nt, Artificial Sequence
  MKO10040726_A_Phgr1
  gRNA
uggccaggguguggaccacc

SEQ ID NO: 40727 - RNA, 20 nt, Artificial Sequence
  MKO10040727_A_Phgr1
  gRNA
gcuuuccacaggggcauugu

SEQ ID NO: 40728 - RNA, 20 nt, Artificial Sequence
  MKO10040728_A_Phgr1
  gRNA
caugagggacaucacccucc

SEQ ID NO: 40729 - RNA, 20 nt, Artificial Sequence
  MKO10040729_A_Phip
  gRNA
gcaggugcugauccgcgaag

SEQ ID NO: 40730 - RNA, 20 nt, Artificial Sequence
  MKO10040730_A_Phip
  gRNA
gugcuccuucccgguccagu

SEQ ID NO: 40731 - RNA, 20 nt, Artificial Sequence
  MKO10040731_A_Phip
  gRNA
cuuccaggaaccgggcgaug

SEQ ID NO: 40732 - RNA, 20 nt, Artificial Sequence
  MKO10040732_A_Phka1
  gRNA
uccgccuggacggcuaugcu

SEQ ID NO: 40733 - RNA, 20 nt, Artificial Sequence
  MKO10040733_A_Phka1
  gRNA
caugaggagccgcaguaacu

SEQ ID NO: 40734 - RNA, 20 nt, Artificial Sequence
  MKO10040734_A_Phka1
  gRNA
caaggcaaaggccuaugaac

SEQ ID NO: 40735 - RNA, 20 nt, Artificial Sequence
  MKO10040735_A_Phka2
  gRNA
ccagccucgcguacccgucc

SEQ ID NO: 40736 - RNA, 20 nt, Artificial Sequence
  MKO10040736_A_Phka2
  gRNA
aacguagugaagcugaugcg

SEQ ID NO: 40737 - RNA, 20 nt, Artificial Sequence
  MKO10040737_A_Phka2
  gRNA
auagauauugucccguaccc

SEQ ID NO: 40738 - RNA, 20 nt, Artificial Sequence
  MKO10040738_A_Phkb
  gRNA
gggccuuggcgcuagcauac

SEQ ID NO: 40739 - RNA, 20 nt, Artificial Sequence
  MKO10040739_A_Phkb
  gRNA
guacagacucucgugcacuu

SEQ ID NO: 40740 - RNA, 20 nt, Artificial Sequence
  MKO10040740_A_Phkb
  gRNA
caggcgcauugaugaugaca

SEQ ID NO: 40741 - RNA, 20 nt, Artificial Sequence
  MKO10040741_A_Phkg1
  gRNA
ggugucccgagaccuucugc

SEQ ID NO: 40742 - RNA, 20 nt, Artificial Sequence
  MKO10040742_A_Phkg1
  gRNA
uuccguuucaguacagcuga

SEQ ID NO: 40743 - RNA, 20 nt, Artificial Sequence
  MKO10040743_A_Phkg1
  gRNA
ccuuaaccgagaaggaaacc

SEQ ID NO: 40744 - RNA, 20 nt, Artificial Sequence
  MKO10040744_A_Phkg2
  gRNA
aaugugcaucucucgccgug

SEQ ID NO: 40745 - RNA, 20 nt, Artificial Sequence
  MKO10040745_A_Phkg2
  gRNA
uagcucgauggacacagcgg

SEQ ID NO: 40746 - RNA, 20 nt, Artificial Sequence
  MKO10040746_A_Phkg2
  gRNA
gucucgauguacaauguugu

SEQ ID NO: 40747 - RNA, 20 nt, Artificial Sequence
  MKO10040747_A_Phlda1
  gRNA
gcccauugaaaagcgccgcg

SEQ ID NO: 40748 - RNA, 20 nt, Artificial Sequence
  MKO10040748_A_Phlda1
  gRNA
caaguuaaugaggcguacgc

SEQ ID NO: 40749 - RNA, 20 nt, Artificial Sequence
  MKO10040749_A_Phlda1
  gRNA
ccgggaucuuguggcgaguc

SEQ ID NO: 40750 - RNA, 20 nt, Artificial Sequence
  MKO10040750_A_Phlda2
  gRNA
gaucgacuuccgcugcacgg

SEQ ID NO: 40751 - RNA, 20 nt, Artificial Sequence
  MKO10040751_A_Phlda2
  gRNA
gaaagucuugcagcgcccga

SEQ ID NO: 40752 - RNA, 20 nt, Artificial Sequence
  MKO10040752_A_Phlda2
  gRNA
ucuccagcucgcccucgcaa

SEQ ID NO: 40753 - RNA, 20 nt, Artificial Sequence
  MKO10040753_A_Phlda3
  gRNA
cgcugcgugcucaccgagcg

SEQ ID NO: 40754 - RNA, 20 nt, Artificial Sequence
  MKO10040754_A_Phlda3
  gRNA
ggugcucucuacgcacucca

SEQ ID NO: 40755 - RNA, 20 nt, Artificial Sequence
  MKO10040755_A_Phlda3
  gRNA
cgcugcccccucgaagaccc

SEQ ID NO: 40756 - RNA, 20 nt, Artificial Sequence
  MKO10040756_A_Phldb1
  gRNA
uagcgcccgccguuagccau

SEQ ID NO: 40757 - RNA, 20 nt, Artificial Sequence
  MKO10040757_A_Phldb1
  gRNA
caguccugccgcuaccgucu

SEQ ID NO: 40758 - RNA, 20 nt, Artificial Sequence
  MKO10040758_A_Phldb1
  gRNA
cggcuggaugguuaaagcgc

SEQ ID NO: 40759 - RNA, 20 nt, Artificial Sequence
  MKO10040759_A_Phldb2
  gRNA
caggucgucgcgucccgaga

SEQ ID NO: 40760 - RNA, 20 nt, Artificial Sequence
  MKO10040760_A_Phldb2
  gRNA
aggauuugugguacguuccc

SEQ ID NO: 40761 - RNA, 20 nt, Artificial Sequence
  MKO10040761_A_Phldb2
  gRNA
augaugggggcguccuagug

SEQ ID NO: 40762 - RNA, 20 nt, Artificial Sequence
  MKO10040762_A_Phldb3
  gRNA
gggaacgaguggccgcucgc

SEQ ID NO: 40763 - RNA, 20 nt, Artificial Sequence
  MKO10040763_A_Phldb3
  gRNA
ugcagcccaacgcaccuaug

SEQ ID NO: 40764 - RNA, 20 nt, Artificial Sequence
  MKO10040764_A_Phldb3
  gRNA
cugcgcggcaggcguagccu

SEQ ID NO: 40765 - RNA, 20 nt, Artificial Sequence
  MKO10040765_A_Phlpp1
  gRNA
agcugaacgcuaaacagugc

SEQ ID NO: 40766 - RNA, 20 nt, Artificial Sequence
  MKO10040766_A_Phlpp1
  gRNA
uccgugaaagacagcgugag

SEQ ID NO: 40767 - RNA, 20 nt, Artificial Sequence
  MKO10040767_A_Phlpp1
  gRNA
ucugagcggauucagcucuc

SEQ ID NO: 40768 - RNA, 20 nt, Artificial Sequence
  MKO10040768_A_Phlpp2
  gRNA
ugaagaucccgugcgcauac

SEQ ID NO: 40769 - RNA, 20 nt, Artificial Sequence
  MKO10040769_A_Phlpp2
  gRNA
uucgauccagaugauccauc

SEQ ID NO: 40770 - RNA, 20 nt, Artificial Sequence
  MKO10040770_A_Phlpp2
  gRNA
ccagcacauauuucugacgc

SEQ ID NO: 40771 - RNA, 20 nt, Artificial Sequence
  MKO10040771_A_Phospho1
  gRNA
cgucagcaguccccgcgcgu

SEQ ID NO: 40772 - RNA, 20 nt, Artificial Sequence
  MKO10040772_A_Phospho1
  gRNA
uggucucguagacagcgcgc

SEQ ID NO: 40773 - RNA, 20 nt, Artificial Sequence
  MKO10040773_A_Phospho1
  gRNA
aggcaucguaguccaacagc

SEQ ID NO: 40774 - RNA, 20 nt, Artificial Sequence
  MKO10040774_A_Phospho2
  gRNA
uauacacggauuguuuauau

SEQ ID NO: 40775 - RNA, 20 nt, Artificial Sequence
  MKO10040775_A_Phospho2
  gRNA
gagacgaccacugcuaucaa

SEQ ID NO: 40776 - RNA, 20 nt, Artificial Sequence
  MKO10040776_A_Phospho2
  gRNA
uguaaaguauauccuucccg

SEQ ID NO: 40777 - RNA, 20 nt, Artificial Sequence
  MKO10040777_A_Phox2a
  gRNA
caauucguacgauucgugcg

SEQ ID NO: 40778 - RNA, 20 nt, Artificial Sequence
  MKO10040778_A_Phox2a
  gRNA
cgcacgaaucguacgaauug

SEQ ID NO: 40779 - RNA, 20 nt, Artificial Sequence
  MKO10040779_A_Phox2a
  gRNA
gggcgaggcgcguugcucgu

SEQ ID NO: 40780 - RNA, 20 nt, Artificial Sequence
  MKO10040780_A_Phox2b
  gRNA
cagagcaguccguacgccgc

SEQ ID NO: 40781 - RNA, 20 nt, Artificial Sequence
  MKO10040781_A_Phox2b
  gRNA
cgaacccggcaagggcggug

SEQ ID NO: 40782 - RNA, 20 nt, Artificial Sequence
  MKO10040782_A_Phox2b
  gRNA
cgguccuuaccugcggcgua

SEQ ID NO: 40783 - RNA, 20 nt, Artificial Sequence
  MKO10040783_A_Phpt1
  gRNA
acacguguauggcuacucua

SEQ ID NO: 40784 - RNA, 20 nt, Artificial Sequence
  MKO10040784_A_Phpt1
  gRNA
gggaacauggcggcggaccu

SEQ ID NO: 40785 - RNA, 20 nt, Artificial Sequence
  MKO10040785_A_Phpt1
  gRNA
ggauccggcgaaggagugca

SEQ ID NO: 40786 - RNA, 20 nt, Artificial Sequence
  MKO10040786_A_Phrf1
  gRNA
uguauucgugcccaguuuaa

SEQ ID NO: 40787 - RNA, 20 nt, Artificial Sequence
  MKO10040787_A_Phrf1
  gRNA
cugugugacggcugcgaugc

SEQ ID NO: 40788 - RNA, 20 nt, Artificial Sequence
  MKO10040788_A_Phrf1
  gRNA
uuaaauacuguucgaucaac

SEQ ID NO: 40789 - RNA, 20 nt, Artificial Sequence
  MKO10040789_A_Phtf1
  gRNA
caguucccaugaguagcaua

SEQ ID NO: 40790 - RNA, 20 nt, Artificial Sequence
  MKO10040790_A_Phtf1
  gRNA
aaucgaacagacucagauua

SEQ ID NO: 40791 - RNA, 20 nt, Artificial Sequence
  MKO10040791_A_Phtf1
  gRNA
gagucgacacaaucugacag

SEQ ID NO: 40792 - RNA, 20 nt, Artificial Sequence
  MKO10040792_A_Phtf2
  gRNA
aucgauguugaucuugugag

SEQ ID NO: 40793 - RNA, 20 nt, Artificial Sequence
  MKO10040793_A_Phtf2
  gRNA
ucacaagaucaacaucgaug

SEQ ID NO: 40794 - RNA, 20 nt, Artificial Sequence
  MKO10040794_A_Phtf2
  gRNA
guguucuuguugaaacaauc

SEQ ID NO: 40795 - RNA, 20 nt, Artificial Sequence
  MKO10040795_A_Phyhd1
  gRNA
cccuaccuucuugaguugug

SEQ ID NO: 40796 - RNA, 20 nt, Artificial Sequence
  MKO10040796_A_Phyhd1
  gRNA
acagacuacuucuugagcag

SEQ ID NO: 40797 - RNA, 20 nt, Artificial Sequence
  MKO10040797_A_Phyhd1
  gRNA
cucaccgauccucugcugca

SEQ ID NO: 40798 - RNA, 20 nt, Artificial Sequence
  MKO10040798_A_Phyhipl
  gRNA
gcguccgacacugauguuac

SEQ ID NO: 40799 - RNA, 20 nt, Artificial Sequence
  MKO10040799_A_Phyhipl
  gRNA
cccaauacuaacuuauacuu

SEQ ID NO: 40800 - RNA, 20 nt, Artificial Sequence
  MKO10040800_A_Phyhipl
  gRNA
ccuuugccaaugacuguucg

SEQ ID NO: 40801 - RNA, 20 nt, Artificial Sequence
  MKO10040801_A_Phyhip
  gRNA
gcugaucuuccgccacgcuc

SEQ ID NO: 40802 - RNA, 20 nt, Artificial Sequence
  MKO10040802_A_Phyhip
  gRNA
gggaccgcuucugucgugac

SEQ ID NO: 40803 - RNA, 20 nt, Artificial Sequence
  MKO10040803_A_Phyhip
  gRNA
gugacucuuuccguaucucc

SEQ ID NO: 40804 - RNA, 20 nt, Artificial Sequence
  MKO10040804_A_Phyh
  gRNA
ggauaauaauguccucaccc

SEQ ID NO: 40805 - RNA, 20 nt, Artificial Sequence
  MKO10040805_A_Phyh
  gRNA
uuucacuggacccaauauua

SEQ ID NO: 40806 - RNA, 20 nt, Artificial Sequence
  MKO10040806_A_Phyh
  gRNA
uagguagcccagccuguauc

SEQ ID NO: 40807 - RNA, 20 nt, Artificial Sequence
  MKO10040807_A_Phykpl
  gRNA
cuaccugcaugacaacaucg

SEQ ID NO: 40808 - RNA, 20 nt, Artificial Sequence
  MKO10040808_A_Phykpl
  gRNA
ccacguuguugauacagucc

SEQ ID NO: 40809 - RNA, 20 nt, Artificial Sequence
  MKO10040809_A_Phykpl
  gRNA
guuaagauuauccgaggcca

SEQ ID NO: 40810 - RNA, 20 nt, Artificial Sequence
  MKO10040810_A_Pi15
  gRNA
cggugucccaugcgaugcuu

SEQ ID NO: 40811 - RNA, 20 nt, Artificial Sequence
  MKO10040811_A_Pi15
  gRNA
aagcaucgcaugggacaccg

SEQ ID NO: 40812 - RNA, 20 nt, Artificial Sequence
  MKO10040812_A_Pi15
  gRNA
ugggccacuucuaaucgaau

SEQ ID NO: 40813 - RNA, 20 nt, Artificial Sequence
  MKO10040813_A_Pi16
  gRNA
gccacaacaaagaacgcggg

SEQ ID NO: 40814 - RNA, 20 nt, Artificial Sequence
  MKO10040814_A_Pi16
  gRNA
ccacuucugcgagacgcucc

SEQ ID NO: 40815 - RNA, 20 nt, Artificial Sequence
  MKO10040815_A_Pi16
  gRNA
gccgcccgcguucuuuguug

SEQ ID NO: 40816 - RNA, 20 nt, Artificial Sequence
  MKO10040816_A_Pi4k2a
  gRNA
ccgaaucggccugccaccaa

SEQ ID NO: 40817 - RNA, 20 nt, Artificial Sequence
  MKO10040817_A_Pi4k2a
  gRNA
uuaaaccgcugcccaacuuu

SEQ ID NO: 40818 - RNA, 20 nt, Artificial Sequence
  MKO10040818_A_Pi4k2a
  gRNA
gacuacaucauccgcaacac

SEQ ID NO: 40819 - RNA, 20 nt, Artificial Sequence
  MKO10040819_A_Pi4k2b
  gRNA
gcccgcuaccgacgagccgc

SEQ ID NO: 40820 - RNA, 20 nt, Artificial Sequence
  MKO10040820_A_Pi4k2b
  gRNA
guggaccaaguacguccaua

SEQ ID NO: 40821 - RNA, 20 nt, Artificial Sequence
  MKO10040821_A_Pi4k2b
  gRNA
auugaccgugcaaaaucaag

SEQ ID NO: 40822 - RNA, 20 nt, Artificial Sequence
  MKO10040822_A_Pi4ka
  gRNA
augggaucgcauacuugcaa

SEQ ID NO: 40823 - RNA, 20 nt, Artificial Sequence
  MKO10040823_A_Pi4ka
  gRNA
uaugcgaucccaugccugau

SEQ ID NO: 40824 - RNA, 20 nt, Artificial Sequence
  MKO10040824_A_Pi4ka
  gRNA
gcuuaccucaucccuaagug

SEQ ID NO: 40825 - RNA, 20 nt, Artificial Sequence
  MKO10040825_A_Pi4kb
  gRNA
cagaccguguacuccgaauu

SEQ ID NO: 40826 - RNA, 20 nt, Artificial Sequence
  MKO10040826_A_Pi4kb
  gRNA
ggcucccuaccugaucuacg

SEQ ID NO: 40827 - RNA, 20 nt, Artificial Sequence
  MKO10040827_A_Pi4kb
  gRNA
auaagcucccugcccgaguc

SEQ ID NO: 40828 - RNA, 20 nt, Artificial Sequence
  MKO10040828_A_Pianp
  gRNA
acaaccugccgacgugaucu

SEQ ID NO: 40829 - RNA, 20 nt, Artificial Sequence
  MKO10040829_A_Pianp
  gRNA
aucgcccucaccgguucaac

SEQ ID NO: 40830 - RNA, 20 nt, Artificial Sequence
  MKO10040830_A_Pianp
  gRNA
aaauccaggauugaccgagu

SEQ ID NO: 40831 - RNA, 20 nt, Artificial Sequence
  MKO10040831_A_Pias1
  gRNA
uuggggauagacaaguccgc

SEQ ID NO: 40832 - RNA, 20 nt, Artificial Sequence
  MKO10040832_A_Pias1
  gRNA
cagcguagcccaacaguacu

SEQ ID NO: 40833 - RNA, 20 nt, Artificial Sequence
  MKO10040833_A_Pias1
  gRNA
cagacaacagccagcgcuuu

SEQ ID NO: 40834 - RNA, 20 nt, Artificial Sequence
  MKO10040834_A_Pias2
  gRNA
ugagguguaauugaagucga

SEQ ID NO: 40835 - RNA, 20 nt, Artificial Sequence
  MKO10040835_A_Pias2
  gRNA
uauauagacgccgauaccca

SEQ ID NO: 40836 - RNA, 20 nt, Artificial Sequence
  MKO10040836_A_Pias2
  gRNA
guuaucuucuugagggcaac

SEQ ID NO: 40837 - RNA, 20 nt, Artificial Sequence
  MKO10040837_A_Pias3
  gRNA
ugggcggaaacacgagcugc

SEQ ID NO: 40838 - RNA, 20 nt, Artificial Sequence
  MKO10040838_A_Pias3
  gRNA
ugcagcagauucucacgucc

SEQ ID NO: 40839 - RNA, 20 nt, Artificial Sequence
  MKO10040839_A_Pias3
  gRNA
agaucaaagaacuuuaucgc

SEQ ID NO: 40840 - RNA, 20 nt, Artificial Sequence
  MKO10040840_A_Pias4
  gRNA
gcaucuucgcgcuaacaccu

SEQ ID NO: 40841 - RNA, 20 nt, Artificial Sequence
  MKO10040841_A_Pias4
  gRNA
agcuuaaccaggcguaccuc

SEQ ID NO: 40842 - RNA, 20 nt, Artificial Sequence
  MKO10040842_A_Pias4
  gRNA
gguguuagcgcgaagaugca

SEQ ID NO: 40843 - RNA, 20 nt, Artificial Sequence
  MKO10040843_A_Pibf1
  gRNA
uugcuucugucgcaauaaaa

SEQ ID NO: 40844 - RNA, 20 nt, Artificial Sequence
  MKO10040844_A_Pibf1
  gRNA
acaaaacaguuaguucagca

SEQ ID NO: 40845 - RNA, 20 nt, Artificial Sequence
  MKO10040845_A_Pibf1
  gRNA
gcucgugaacccauuaagaa

SEQ ID NO: 40846 - RNA, 20 nt, Artificial Sequence
  MKO10040846_A_Picalm
  gRNA
aacaaacuguccgccaacug

SEQ ID NO: 40847 - RNA, 20 nt, Artificial Sequence
  MKO10040847_A_Picalm
  gRNA
ccagcguuucauucaguauu

SEQ ID NO: 40848 - RNA, 20 nt, Artificial Sequence
  MKO10040848_A_Picalm
  gRNA
cauuacaacucaucauuuga

SEQ ID NO: 40849 - RNA, 20 nt, Artificial Sequence
  MKO10040849_A_Pick1
  gRNA
cuccgaugcugaucccaauc

SEQ ID NO: 40850 - RNA, 20 nt, Artificial Sequence
  MKO10040850_A_Pick1
  gRNA
agccgcgccauccuguguaa

SEQ ID NO: 40851 - RNA, 20 nt, Artificial Sequence
  MKO10040851_A_Pick1
  gRNA
ggacuuaccguuacacagga

SEQ ID NO: 40852 - RNA, 20 nt, Artificial Sequence
  MKO10040852_A_Pid1
  gRNA
ccggaucucuaggagggcgu

SEQ ID NO: 40853 - RNA, 20 nt, Artificial Sequence
  MKO10040853_A_Pid1
  gRNA
ugagccccaacaucuucgcc

SEQ ID NO: 40854 - RNA, 20 nt, Artificial Sequence
  MKO10040854_A_Pid1
  gRNA
uaugaguccuugccuucauc

SEQ ID NO: 40855 - RNA, 20 nt, Artificial Sequence
  MKO10040855_A_Piezo1
  gRNA
agagagcauugaagcguaac

SEQ ID NO: 40856 - RNA, 20 nt, Artificial Sequence
  MKO10040856_A_Piezo1
  gRNA
acgcuucaaugcucucucgc

SEQ ID NO: 40857 - RNA, 20 nt, Artificial Sequence
  MKO10040857_A_Piezo1
  gRNA
uccucgugaggcguccacag

SEQ ID NO: 40858 - RNA, 20 nt, Artificial Sequence
  MKO10040858_A_Piezo2
  gRNA
gcaaugaacaucccgauauc

SEQ ID NO: 40859 - RNA, 20 nt, Artificial Sequence
  MKO10040859_A_Piezo2
  gRNA
caaucacagcaugugcguuc

SEQ ID NO: 40860 - RNA, 20 nt, Artificial Sequence
  MKO10040860_A_Piezo2
  gRNA
gaaaagaccuuccggcagau

SEQ ID NO: 40861 - RNA, 20 nt, Artificial Sequence
  MKO10040861_A_Pif1
  gRNA
ucucgucaaugaccaaacgu

SEQ ID NO: 40862 - RNA, 20 nt, Artificial Sequence
  MKO10040862_A_Pif1
  gRNA
ucacucauaggcaucggcuc

SEQ ID NO: 40863 - RNA, 20 nt, Artificial Sequence
  MKO10040863_A_Pif1
  gRNA
accacccuucaugccuuugc

SEQ ID NO: 40864 - RNA, 20 nt, Artificial Sequence
  MKO10040864_A_Pifo
  gRNA
ccucgcuugacguguuccaa

SEQ ID NO: 40865 - RNA, 20 nt, Artificial Sequence
  MKO10040865_A_Pifo
  gRNA
aauagcauagccuuucguac

SEQ ID NO: 40866 - RNA, 20 nt, Artificial Sequence
  MKO10040866_A_Pifo
  gRNA
uuugcugcacuccuaaaucg

SEQ ID NO: 40867 - RNA, 20 nt, Artificial Sequence
  MKO10040867_A_Piga
  gRNA
gguguaugagcgagugucga

SEQ ID NO: 40868 - RNA, 20 nt, Artificial Sequence
  MKO10040868_A_Piga
  gRNA
gcaaacauguagcccgucac

SEQ ID NO: 40869 - RNA, 20 nt, Artificial Sequence
  MKO10040869_A_Piga
  gRNA
ucuuaaggucgucagcacaa

SEQ ID NO: 40870 - RNA, 20 nt, Artificial Sequence
  MKO10040870_A_Pigb
  gRNA
aaggcucgagguccgugaac

SEQ ID NO: 40871 - RNA, 20 nt, Artificial Sequence
  MKO10040871_A_Pigb
  gRNA
ccucgaaguugcacaccgca

SEQ ID NO: 40872 - RNA, 20 nt, Artificial Sequence
  MKO10040872_A_Pigb
  gRNA
guuaaguauucgcagagcga

SEQ ID NO: 40873 - RNA, 20 nt, Artificial Sequence
  MKO10040873_A_Pigc
  gRNA
uacagacacuaucuacgcca

SEQ ID NO: 40874 - RNA, 20 nt, Artificial Sequence
  MKO10040874_A_Pigc
  gRNA
uacaccccgcgaagcuaugu

SEQ ID NO: 40875 - RNA, 20 nt, Artificial Sequence
  MKO10040875_A_Pigc
  gRNA
gucacuccacgccuucauua

SEQ ID NO: 40876 - RNA, 20 nt, Artificial Sequence
  MKO10040876_A_Pigf
  gRNA
gcgaccuuuggcuacguggc

SEQ ID NO: 40877 - RNA, 20 nt, Artificial Sequence
  MKO10040877_A_Pigf
  gRNA
cacggucuuucccaauccag

SEQ ID NO: 40878 - RNA, 20 nt, Artificial Sequence
  MKO10040878_A_Pigf
  gRNA
cuugcagaguuacaucuauu

SEQ ID NO: 40879 - RNA, 20 nt, Artificial Sequence
  MKO10040879_A_Pigg
  gRNA
uaugcccuacacaacguauc

SEQ ID NO: 40880 - RNA, 20 nt, Artificial Sequence
  MKO10040880_A_Pigg
  gRNA
uucuaccagauacguugugu

SEQ ID NO: 40881 - RNA, 20 nt, Artificial Sequence
  MKO10040881_A_Pigg
  gRNA
gacucucuuacccaguuugc

SEQ ID NO: 40882 - RNA, 20 nt, Artificial Sequence
  MKO10040882_A_Pigh
  gRNA
ucaccguacugccgcgaguu

SEQ ID NO: 40883 - RNA, 20 nt, Artificial Sequence
  MKO10040883_A_Pigh
  gRNA
uaggcggccgccgcagauau

SEQ ID NO: 40884 - RNA, 20 nt, Artificial Sequence
  MKO10040884_A_Pigh
  gRNA
cuacuaaucaucgacucacu

SEQ ID NO: 40885 - RNA, 20 nt, Artificial Sequence
  MKO10040885_A_Pigk
  gRNA
aggugugcacaucccgauuc

SEQ ID NO: 40886 - RNA, 20 nt, Artificial Sequence
  MKO10040886_A_Pigk
  gRNA
gccuaccucgauguguccag

SEQ ID NO: 40887 - RNA, 20 nt, Artificial Sequence
  MKO10040887_A_Pigk
  gRNA
cucugccgcuggacacaucg

SEQ ID NO: 40888 - RNA, 20 nt, Artificial Sequence
  MKO10040888_A_Pigl
  gRNA
uccgugucccacugcacuuc

SEQ ID NO: 40889 - RNA, 20 nt, Artificial Sequence
  MKO10040889_A_Pigl
  gRNA
guguaaugauuauugacaag

SEQ ID NO: 40890 - RNA, 20 nt, Artificial Sequence
  MKO10040890_A_Pigl
  gRNA
ucuugucaauaaucauuaca

SEQ ID NO: 40891 - RNA, 20 nt, Artificial Sequence
  MKO10040891_A_Pigm
  gRNA
gcgugcgccgcgguguucua

SEQ ID NO: 40892 - RNA, 20 nt, Artificial Sequence
  MKO10040892_A_Pigm
  gRNA
acgcucgucaucgucgcgcu

SEQ ID NO: 40893 - RNA, 20 nt, Artificial Sequence
  MKO10040893_A_Pigm
  gRNA
gcgacgaugacgagcgucuc

SEQ ID NO: 40894 - RNA, 20 nt, Artificial Sequence
  MKO10040894_A_Pign
  gRNA
augcucaucgaccaucguca

SEQ ID NO: 40895 - RNA, 20 nt, Artificial Sequence
  MKO10040895_A_Pign
  gRNA
ugcccacgaugccacaaaac

SEQ ID NO: 40896 - RNA, 20 nt, Artificial Sequence
  MKO10040896_A_Pign
  gRNA
uggccaggccgagauucugu

SEQ ID NO: 40897 - RNA, 20 nt, Artificial Sequence
  MKO10040897_A_Pigo
  gRNA
ccacaguggacggcgguucg

SEQ ID NO: 40898 - RNA, 20 nt, Artificial Sequence
  MKO10040898_A_Pigo
  gRNA
cgagacuugggcuagcgcag

SEQ ID NO: 40899 - RNA, 20 nt, Artificial Sequence
  MKO10040899_A_Pigo
  gRNA
cuuacucacggguaggauag

SEQ ID NO: 40900 - RNA, 20 nt, Artificial Sequence
  MKO10040900_A_Pigp
  gRNA
uccucgccucagaggguccg

SEQ ID NO: 40901 - RNA, 20 nt, Artificial Sequence
  MKO10040901_A_Pigp
  gRNA
gacuccauucauacgaucac

SEQ ID NO: 40902 - RNA, 20 nt, Artificial Sequence
  MKO10040902_A_Pigp
  gRNA
cguaccugugaucguaugaa

SEQ ID NO: 40903 - RNA, 20 nt, Artificial Sequence
  MKO10040903_A_Pigq
  gRNA
cuccacagcaauaaccgaau

SEQ ID NO: 40904 - RNA, 20 nt, Artificial Sequence
  MKO10040904_A_Pigq
  gRNA
cgauucaucuugagcccagc

SEQ ID NO: 40905 - RNA, 20 nt, Artificial Sequence
  MKO10040905_A_Pigq
  gRNA
ggcgaugauauccgaaaaga

SEQ ID NO: 40906 - RNA, 20 nt, Artificial Sequence
  MKO10040906_A_Pigr
  gRNA
cuucacaacagagcgacgau

SEQ ID NO: 40907 - RNA, 20 nt, Artificial Sequence
  MKO10040907_A_Pigr
  gRNA
gacccugaacccggucagua

SEQ ID NO: 40908 - RNA, 20 nt, Artificial Sequence
  MKO10040908_A_Pigr
  gRNA
aguagaauuugcacggauag

SEQ ID NO: 40909 - RNA, 20 nt, Artificial Sequence
  MKO10040909_A_Pigs
  gRNA
aaagcgcggaacgcuugccc

SEQ ID NO: 40910 - RNA, 20 nt, Artificial Sequence
  MKO10040910_A_Pigs
  gRNA
ggaagacgacggagacuuac

SEQ ID NO: 40911 - RNA, 20 nt, Artificial Sequence
  MKO10040911_A_Pigs
  gRNA
gaucucucgcucaugcacaa

SEQ ID NO: 40912 - RNA, 20 nt, Artificial Sequence
  MKO10040912_A_Pigu
  gRNA
aaaagccuugcgugaacgac

SEQ ID NO: 40913 - RNA, 20 nt, Artificial Sequence
  MKO10040913_A_Pigu
  gRNA
cuccaccugucguucacgca

SEQ ID NO: 40914 - RNA, 20 nt, Artificial Sequence
  MKO10040914_A_Pigu
  gRNA
ucaccauuggccagucccag

SEQ ID NO: 40915 - RNA, 20 nt, Artificial Sequence
  MKO10040915_A_Pigu
  gRNA
ccuaauugacuaugcagaau

SEQ ID NO: 40916 - RNA, 20 nt, Artificial Sequence
  MKO10040916_A_Pigu
  gRNA
gguugaaggccuugcacugu

SEQ ID NO: 40917 - RNA, 20 nt, Artificial Sequence
  MKO10040917_A_Pigu
  gRNA
cugggagugucuccauauuc

SEQ ID NO: 40918 - RNA, 20 nt, Artificial Sequence
  MKO10040918_A_Pigv
  gRNA
agccgugcucagcgauaaac

SEQ ID NO: 40919 - RNA, 20 nt, Artificial Sequence
  MKO10040919_A_Pigv
  gRNA
gccccauggcgcugaacguc

SEQ ID NO: 40920 - RNA, 20 nt, Artificial Sequence
  MKO10040920_A_Pigv
  gRNA
ucaugaaacucuucuacgau

SEQ ID NO: 40921 - RNA, 20 nt, Artificial Sequence
  MKO10040921_A_Pigw
  gRNA
uacuaaucgcacaacuauga

SEQ ID NO: 40922 - RNA, 20 nt, Artificial Sequence
  MKO10040922_A_Pigw
  gRNA
cuucuuaaaugcuaaccgag

SEQ ID NO: 40923 - RNA, 20 nt, Artificial Sequence
  MKO10040923_A_Pigw
  gRNA
guuccagugaaugccguacu

SEQ ID NO: 40924 - RNA, 20 nt, Artificial Sequence
  MKO10040924_A_Pigx
  gRNA
agcgacgccccuuucagcgc

SEQ ID NO: 40925 - RNA, 20 nt, Artificial Sequence
  MKO10040925_A_Pigx
  gRNA
cggugauagcgauagugcac

SEQ ID NO: 40926 - RNA, 20 nt, Artificial Sequence
  MKO10040926_A_Pigx
  gRNA
ggcgagccugccgaccagcc

SEQ ID NO: 40927 - RNA, 20 nt, Artificial Sequence
  MKO10040927_A_Pigyl
  gRNA
agauggaagaacacguacac

SEQ ID NO: 40928 - RNA, 20 nt, Artificial Sequence
  MKO10040928_A_Pigyl
  gRNA
gaagccuuccuccacggagg

SEQ ID NO: 40929 - RNA, 20 nt, Artificial Sequence
  MKO10040929_A_Pigyl
  gRNA
caugaccguccucaucccac

SEQ ID NO: 40930 - RNA, 20 nt, Artificial Sequence
  MKO10040930_A_Pigz
  gRNA
cgguggcacagauaucuucu

SEQ ID NO: 40931 - RNA, 20 nt, Artificial Sequence
  MKO10040931_A_Pigz
  gRNA
ccgugcgugugugccgugcc

SEQ ID NO: 40932 - RNA, 20 nt, Artificial Sequence
  MKO10040932_A_Pigz
  gRNA
gacaccauaagacacgaagc

SEQ ID NO: 40933 - RNA, 20 nt, Artificial Sequence
  MKO10040933_A_Pih1d1
  gRNA
cuugcauccagcuccgcgug

SEQ ID NO: 40934 - RNA, 20 nt, Artificial Sequence
  MKO10040934_A_Pih1d1
  gRNA
gcuauugacagcgacgucau

SEQ ID NO: 40935 - RNA, 20 nt, Artificial Sequence
  MKO10040935_A_Pih1d1
  gRNA
aaccuuuccuuccgaugagu

SEQ ID NO: 40936 - RNA, 20 nt, Artificial Sequence
  MKO10040936_A_Pih1d2
  gRNA
acaaccuuuaauucguacgc

SEQ ID NO: 40937 - RNA, 20 nt, Artificial Sequence
  MKO10040937_A_Pih1d2
  gRNA
gagcugaaagucgaguuacc

SEQ ID NO: 40938 - RNA, 20 nt, Artificial Sequence
  MKO10040938_A_Pih1d2
  gRNA
cuaaaagcgaugacgagaac

SEQ ID NO: 40939 - RNA, 20 nt, Artificial Sequence
  MKO10040939_A_Pih1d3
  gRNA
ucuccucaaucccgaagaag

SEQ ID NO: 40940 - RNA, 20 nt, Artificial Sequence
  MKO10040940_A_Pih1d3
  gRNA
cucauuuacuauuggagcca

SEQ ID NO: 40941 - RNA, 20 nt, Artificial Sequence
  MKO10040941_A_Pih1d3
  gRNA
ggagacuggauagugcuuga

SEQ ID NO: 40942 - RNA, 20 nt, Artificial Sequence
  MKO10040942_A_Pik3ap1
  gRNA
cagccggaccgcauucgcug

SEQ ID NO: 40943 - RNA, 20 nt, Artificial Sequence
  MKO10040943_A_Pik3ap1
  gRNA
cagggaugcgcgaugcgugc

SEQ ID NO: 40944 - RNA, 20 nt, Artificial Sequence
  MKO10040944_A_Pik3ap1
  gRNA
cgucagcuauuauaccgaca

SEQ ID NO: 40945 - RNA, 20 nt, Artificial Sequence
  MKO10040945_A_Pik3c2a
  gRNA
uuacuguucgagccagauuc

SEQ ID NO: 40946 - RNA, 20 nt, Artificial Sequence
  MKO10040946_A_Pik3c2a
  gRNA
ccaucacauguaaaaguaac

SEQ ID NO: 40947 - RNA, 20 nt, Artificial Sequence
  MKO10040947_A_Pik3c2a
  gRNA
auauucaaaauugucgaaaa

SEQ ID NO: 40948 - RNA, 20 nt, Artificial Sequence
  MKO10040948_A_Pik3c2b
  gRNA
ggauaucagagcccguucga

SEQ ID NO: 40949 - RNA, 20 nt, Artificial Sequence
  MKO10040949_A_Pik3c2b
  gRNA
uaucaaacuugcggcaauau

SEQ ID NO: 40950 - RNA, 20 nt, Artificial Sequence
  MKO10040950_A_Pik3c2b
  gRNA
cgacacguaccguccgggcc

SEQ ID NO: 40951 - RNA, 20 nt, Artificial Sequence
  MKO10040951_A_Pik3c2g
  gRNA
auccugccgaagaucaucuc

SEQ ID NO: 40952 - RNA, 20 nt, Artificial Sequence
  MKO10040952_A_Pik3c2g
  gRNA
uacaggccggagaugaucuu

SEQ ID NO: 40953 - RNA, 20 nt, Artificial Sequence
  MKO10040953_A_Pik3c2g
  gRNA
aggcugcuacgggaugccca

SEQ ID NO: 40954 - RNA, 20 nt, Artificial Sequence
  MKO10040954_A_Pik3c3
  gRNA
ucucguagcauguuucgcca

SEQ ID NO: 40955 - RNA, 20 nt, Artificial Sequence
  MKO10040955_A_Pik3c3
  gRNA
ggaacaaccgugucgcucuu

SEQ ID NO: 40956 - RNA, 20 nt, Artificial Sequence
  MKO10040956_A_Pik3c3
  gRNA
ucuuguacuaaacgccuugu

SEQ ID NO: 40957 - RNA, 20 nt, Artificial Sequence
  MKO10040957_A_Pik3ca
  gRNA
gcgcacuauuuaugacccag

SEQ ID NO: 40958 - RNA, 20 nt, Artificial Sequence
  MKO10040958_A_Pik3ca
  gRNA
ucaccaugccgucauacucc

SEQ ID NO: 40959 - RNA, 20 nt, Artificial Sequence
  MKO10040959_A_Pik3ca
  gRNA
cagaaguccaagacuuucga

SEQ ID NO: 40960 - RNA, 20 nt, Artificial Sequence
  MKO10040960_A_Pik3cb
  gRNA
acggacggcucgugcucagg

SEQ ID NO: 40961 - RNA, 20 nt, Artificial Sequence
  MKO10040961_A_Pik3cb
  gRNA
ugagcacgagccguccgucc

SEQ ID NO: 40962 - RNA, 20 nt, Artificial Sequence
  MKO10040962_A_Pik3cb
  gRNA
cagaaacgccucacuauucg

SEQ ID NO: 40963 - RNA, 20 nt, Artificial Sequence
  MKO10040963_A_Pik3cd
  gRNA
gugcggaagucguuuacuuc

SEQ ID NO: 40964 - RNA, 20 nt, Artificial Sequence
  MKO10040964_A_Pik3cd
  gRNA
ucgggccacgaggcgcagca

SEQ ID NO: 40965 - RNA, 20 nt, Artificial Sequence
  MKO10040965_A_Pik3cd
  gRNA
aguuaaugagcuucuucacg

SEQ ID NO: 40966 - RNA, 20 nt, Artificial Sequence
  MKO10040966_A_Pik3cg
  gRNA
accguaccacgacagugcgc

SEQ ID NO: 40967 - RNA, 20 nt, Artificial Sequence
  MKO10040967_A_Pik3cg
  gRNA
auccuggaggcguaccugcg

SEQ ID NO: 40968 - RNA, 20 nt, Artificial Sequence
  MKO10040968_A_Pik3cg
  gRNA
aucuggccagcgcacugucg

SEQ ID NO: 40969 - RNA, 20 nt, Artificial Sequence
  MKO10040969_A_Pik3ip1
  gRNA
cuugcgcggccaaccaguug

SEQ ID NO: 40970 - RNA, 20 nt, Artificial Sequence
  MKO10040970_A_Pik3ip1
  gRNA
ugggcucggugagcgacucg

SEQ ID NO: 40971 - RNA, 20 nt, Artificial Sequence
  MKO10040971_A_Pik3ip1
  gRNA
ugggcaacucacguccucgc

SEQ ID NO: 40972 - RNA, 20 nt, Artificial Sequence
  MKO10040972_A_Pik3r1
  gRNA
agaugcgucucguaccaaaa

SEQ ID NO: 40973 - RNA, 20 nt, Artificial Sequence
  MKO10040973_A_Pik3r1
  gRNA
ggaguacacccguacuuccc

SEQ ID NO: 40974 - RNA, 20 nt, Artificial Sequence
  MKO10040974_A_Pik3r1
  gRNA
gugaauuaccugcugguauu

SEQ ID NO: 40975 - RNA, 20 nt, Artificial Sequence
  MKO10040975_A_Pik3r2
  gRNA
cugcugcgcauaccuccguc

SEQ ID NO: 40976 - RNA, 20 nt, Artificial Sequence
  MKO10040976_A_Pik3r2
  gRNA
cucugcgggccacacgaccc

SEQ ID NO: 40977 - RNA, 20 nt, Artificial Sequence
  MKO10040977_A_Pik3r2
  gRNA
ucccuaaccuguccguguug

SEQ ID NO: 40978 - RNA, 20 nt, Artificial Sequence
  MKO10040978_A_Pik3r3
  gRNA
cgucagcuucacgucgaguu

SEQ ID NO: 40979 - RNA, 20 nt, Artificial Sequence
  MKO10040979_A_Pik3r3
  gRNA
uggucguaccuguuggaauc

SEQ ID NO: 40980 - RNA, 20 nt, Artificial Sequence
  MKO10040980_A_Pik3r3
  gRNA
ugaugccucaacgaaaaugc

SEQ ID NO: 40981 - RNA, 20 nt, Artificial Sequence
  MKO10040981_A_Pik3r4
  gRNA
uagauauugacaucguugcg

SEQ ID NO: 40982 - RNA, 20 nt, Artificial Sequence
  MKO10040982_A_Pik3r4
  gRNA
uaucgugaaacagacgcuga

SEQ ID NO: 40983 - RNA, 20 nt, Artificial Sequence
  MKO10040983_A_Pik3r4
  gRNA
ugacgcuaccaucgucagac

SEQ ID NO: 40984 - RNA, 20 nt, Artificial Sequence
  MKO10040984_A_Pik3r5
  gRNA
cuaugaccuccucgccccgc

SEQ ID NO: 40985 - RNA, 20 nt, Artificial Sequence
  MKO10040985_A_Pik3r5
  gRNA
cugagcagggccugcccguc

SEQ ID NO: 40986 - RNA, 20 nt, Artificial Sequence
  MKO10040986_A_Pik3r5
  gRNA
gcucagcccucaccagccgc

SEQ ID NO: 40987 - RNA, 20 nt, Artificial Sequence
  MKO10040987_A_Pik3r6
  gRNA
ucuaauguccgugcucacua

SEQ ID NO: 40988 - RNA, 20 nt, Artificial Sequence
  MKO10040988_A_Pik3r6
  gRNA
gcacagccuguacacuccuc

SEQ ID NO: 40989 - RNA, 20 nt, Artificial Sequence
  MKO10040989_A_Pik3r6
  gRNA
ccgaauucugcucagagagc

SEQ ID NO: 40990 - RNA, 20 nt, Artificial Sequence
  MKO10040990_A_Pikfyve
  gRNA
cgaagcugaacagcuguacg

SEQ ID NO: 40991 - RNA, 20 nt, Artificial Sequence
  MKO10040991_A_Pikfyve
  gRNA
caccggcgcucuucaguguu

SEQ ID NO: 40992 - RNA, 20 nt, Artificial Sequence
  MKO10040992_A_Pikfyve
  gRNA
uaccuaacacugaagagcgc

SEQ ID NO: 40993 - RNA, 20 nt, Artificial Sequence
  MKO10040993_A_Pilra
  gRNA
ucugaccagacccgguacuu

SEQ ID NO: 40994 - RNA, 20 nt, Artificial Sequence
  MKO10040994_A_Pilra
  gRNA
caccauuggucacauugagu

SEQ ID NO: 40995 - RNA, 20 nt, Artificial Sequence
  MKO10040995_A_Pilra
  gRNA
agccguugccaacccaacug

SEQ ID NO: 40996 - RNA, 20 nt, Artificial Sequence
  MKO10040996_A_Pilrb1
  gRNA
gauuaacucgacuaaaguac

SEQ ID NO: 40997 - RNA, 20 nt, Artificial Sequence
  MKO10040997_A_Pilrb1
  gRNA
caccuugggucacguugagu

SEQ ID NO: 40998 - RNA, 20 nt, Artificial Sequence
  MKO10040998_A_Pilrb1
  gRNA
ucaucagugaaggauuccuc

SEQ ID NO: 40999 - RNA, 20 nt, Artificial Sequence
  MKO10040999_A_Pilrb2
  gRNA
guagucauaauccuagucua

SEQ ID NO: 41000 - RNA, 20 nt, Artificial Sequence
  MKO10041000_A_Pilrb2
  gRNA
uuaugacuacaacuuuagcc

SEQ ID NO: 41001 - RNA, 20 nt, Artificial Sequence
  MKO10041001_A_Pilrb2
  gRNA
ggucagacuccuuaaaguuc

SEQ ID NO: 41002 - RNA, 20 nt, Artificial Sequence
  MKO10041002_A_Pim1
  gRNA
ccgcgucgccgacaacuugc

SEQ ID NO: 41003 - RNA, 20 nt, Artificial Sequence
  MKO10041003_A_Pim1
  gRNA
cgaugaguuugauuucgccg

SEQ ID NO: 41004 - RNA, 20 nt, Artificial Sequence
  MKO10041004_A_Pim1
  gRNA
cccacucaccggcaaguugu

SEQ ID NO: 41005 - RNA, 20 nt, Artificial Sequence
  MKO10041005_A_Pim2
  gRNA
ccugacgucuauccgugacg

SEQ ID NO: 41006 - RNA, 20 nt, Artificial Sequence
  MKO10041006_A_Pim2
  gRNA
uucgaggccgaauaccgacu

SEQ ID NO: 41007 - RNA, 20 nt, Artificial Sequence
  MKO10041007_A_Pim2
  gRNA
guccagcacugccacgcccg

SEQ ID NO: 41008 - RNA, 20 nt, Artificial Sequence
  MKO10041008_A_Pim3
  gRNA
acgacucaccgggaguccgu

SEQ ID NO: 41009 - RNA, 20 nt, Artificial Sequence
  MKO10041009_A_Pim3
  gRNA
gcgaagaagcgacgcgccag

SEQ ID NO: 41010 - RNA, 20 nt, Artificial Sequence
  MKO10041010_A_Pim3
  gRNA
ggcgcgucgcuucuucgcgc

SEQ ID NO: 41011 - RNA, 20 nt, Artificial Sequence
  MKO10041011_A_Pin1rt1
  gRNA
agguuacuccugagcgaaga

SEQ ID NO: 41012 - RNA, 20 nt, Artificial Sequence
  MKO10041012_A_Pin1rt1
  gRNA
cucgucugccaucuucgcuc

SEQ ID NO: 41013 - RNA, 20 nt, Artificial Sequence
  MKO10041013_A_Pin1rt1
  gRNA
aucuagucaguguauuaagc

SEQ ID NO: 41014 - RNA, 20 nt, Artificial Sequence
  MKO10041014_A_Pin1
  gRNA
uccaacagugcugccgccgc

SEQ ID NO: 41015 - RNA, 20 nt, Artificial Sequence
  MKO10041015_A_Pin1
  gRNA
aagcguaugagucgcagcuc

SEQ ID NO: 41016 - RNA, 20 nt, Artificial Sequence
  MKO10041016_A_Pin1
  gRNA
cccagcggcggcagcacugu

SEQ ID NO: 41017 - RNA, 20 nt, Artificial Sequence
  MKO10041017_A_Pin4
  gRNA
ucuaaaggaggugcagccuc

SEQ ID NO: 41018 - RNA, 20 nt, Artificial Sequence
  MKO10041018_A_Pin4
  gRNA
agcuuaagagaugccgccga

SEQ ID NO: 41019 - RNA, 20 nt, Artificial Sequence
  MKO10041019_A_Pin4
  gRNA
aaaagugguucuggaaaagg

SEQ ID NO: 41020 - RNA, 20 nt, Artificial Sequence
  MKO10041020_A_Pink1
  gRNA
gcuggucccggcaagccgcg

SEQ ID NO: 41021 - RNA, 20 nt, Artificial Sequence
  MKO10041021_A_Pink1
  gRNA
caagcgcgugucugacccac

SEQ ID NO: 41022 - RNA, 20 nt, Artificial Sequence
  MKO10041022_A_Pink1
  gRNA
ugucggacuugagaucccga

SEQ ID NO: 41023 - RNA, 20 nt, Artificial Sequence
  MKO10041023_A_Pinlyp
  gRNA
uccacacgaaauuugccacg

SEQ ID NO: 41024 - RNA, 20 nt, Artificial Sequence
  MKO10041024_A_Pinlyp
  gRNA
aacccaggcagcucgcugcg

SEQ ID NO: 41025 - RNA, 20 nt, Artificial Sequence
  MKO10041025_A_Pinlyp
  gRNA
uugugcuggacucgcucacu

SEQ ID NO: 41026 - RNA, 20 nt, Artificial Sequence
  MKO10041026_A_Pinx1
  gRNA
ggaaucaucguuacuccacg

SEQ ID NO: 41027 - RNA, 20 nt, Artificial Sequence
  MKO10041027_A_Pinx1
  gRNA
uggaucccagaaacaccgcg

SEQ ID NO: 41028 - RNA, 20 nt, Artificial Sequence
  MKO10041028_A_Pinx1
  gRNA
ggacaacuggauugcucacc

SEQ ID NO: 41029 - RNA, 20 nt, Artificial Sequence
  MKO10041029_A_Pip4k2a
  gRNA
auguaccggcuuaaugucga

SEQ ID NO: 41030 - RNA, 20 nt, Artificial Sequence
  MKO10041030_A_Pip4k2a
  gRNA
aaucgacgaccaagauuucc

SEQ ID NO: 41031 - RNA, 20 nt, Artificial Sequence
  MKO10041031_A_Pip4k2a
  gRNA
caaaccucucccgcagauuc

SEQ ID NO: 41032 - RNA, 20 nt, Artificial Sequence
  MKO10041032_A_Pip4k2b
  gRNA
gcaucgcaaauacgaccuga

SEQ ID NO: 41033 - RNA, 20 nt, Artificial Sequence
  MKO10041033_A_Pip4k2b
  gRNA
cagucuugaugacgaaacgc

SEQ ID NO: 41034 - RNA, 20 nt, Artificial Sequence
  MKO10041034_A_Pip4k2b
  gRNA
gagguucggcaucgaugacc

SEQ ID NO: 41035 - RNA, 20 nt, Artificial Sequence
  MKO10041035_A_Pip4k2c
  gRNA
caucgaugaucacgauuacu

SEQ ID NO: 41036 - RNA, 20 nt, Artificial Sequence
  MKO10041036_A_Pip4k2c
  gRNA
uaucuccuaugaccgcacuc

SEQ ID NO: 41037 - RNA, 20 nt, Artificial Sequence
  MKO10041037_A_Pip4k2c
  gRNA
caaguaaucgugaucaucga

SEQ ID NO: 41038 - RNA, 20 nt, Artificial Sequence
  MKO10041038_A_Pip5k1a
  gRNA
cauccggccugaugauuacu

SEQ ID NO: 41039 - RNA, 20 nt, Artificial Sequence
  MKO10041039_A_Pip5k1a
  gRNA
cagugugagugaugccuaac

SEQ ID NO: 41040 - RNA, 20 nt, Artificial Sequence
  MKO10041040_A_Pip5k1a
  gRNA
ugaaucgaaagucauuguaa

SEQ ID NO: 41041 - RNA, 20 nt, Artificial Sequence
  MKO10041041_A_Pip5k1b
  gRNA
caucaaaaccguucagcaua

SEQ ID NO: 41042 - RNA, 20 nt, Artificial Sequence
  MKO10041042_A_Pip5k1b
  gRNA
uaucaagcccgaugauuacu

SEQ ID NO: 41043 - RNA, 20 nt, Artificial Sequence
  MKO10041043_A_Pip5k1b
  gRNA
ccccuuaccauguaauagcc

SEQ ID NO: 41044 - RNA, 20 nt, Artificial Sequence
  MKO10041044_A_Pip5k1c
  gRNA
gcguucggccauggagcuag

SEQ ID NO: 41045 - RNA, 20 nt, Artificial Sequence
  MKO10041045_A_Pip5k1c
  gRNA
cgaggcggagagcgccgaag

SEQ ID NO: 41046 - RNA, 20 nt, Artificial Sequence
  MKO10041046_A_Pip5k1c
  gRNA
ccaccgaggcguggaugcgu

SEQ ID NO: 41047 - RNA, 20 nt, Artificial Sequence
  MKO10041047_A_Pip5kl1
  gRNA
uccccuacagggcuucgagc

SEQ ID NO: 41048 - RNA, 20 nt, Artificial Sequence
  MKO10041048_A_Pip5kl1
  gRNA
caugacccaaguucacgaag

SEQ ID NO: 41049 - RNA, 20 nt, Artificial Sequence
  MKO10041049_A_Pip5kl1
  gRNA
ugcccaccugccccgcuaug

SEQ ID NO: 41050 - RNA, 20 nt, Artificial Sequence
  MKO10041050_A_Pipox
  gRNA
aagccggaacccaguuacac

SEQ ID NO: 41051 - RNA, 20 nt, Artificial Sequence
  MKO10041051_A_Pipox
  gRNA
ccaugaguaucuuucgucag

SEQ ID NO: 41052 - RNA, 20 nt, Artificial Sequence
  MKO10041052_A_Pipox
  gRNA
acagagccgcauaaucagaa

SEQ ID NO: 41053 - RNA, 20 nt, Artificial Sequence
  MKO10041053_A_Pip
  gRNA
gaauaucuguccuaaugaua

SEQ ID NO: 41054 - RNA, 20 nt, Artificial Sequence
  MKO10041054_A_Pip
  gRNA
uaguugaaggcaccuuccau

SEQ ID NO: 41055 - RNA, 20 nt, Artificial Sequence
  MKO10041055_A_Pip
  gRNA
caguauuauaaguauaguac

SEQ ID NO: 41056 - RNA, 20 nt, Artificial Sequence
  MKO10041056_A_Pira11
  gRNA
gaaccugugauuguugugcc

SEQ ID NO: 41057 - RNA, 20 nt, Artificial Sequence
  MKO10041057_A_Pira11
  gRNA
ugcauccaugagagcuucug

SEQ ID NO: 41058 - RNA, 20 nt, Artificial Sequence
  MKO10041058_A_Pira11
  gRNA
cagaguacagccacacucug

SEQ ID NO: 41059 - RNA, 20 nt, Artificial Sequence
  MKO10041059_A_Pira1
  gRNA
gaaccugugauuguugugcc

SEQ ID NO: 41060 - RNA, 20 nt, Artificial Sequence
  MKO10041060_A_Pira1
  gRNA
ugcauccaugagagcuucug

SEQ ID NO: 41061 - RNA, 20 nt, Artificial Sequence
  MKO10041061_A_Pira1
  gRNA
cagaguacagccacacucug

SEQ ID NO: 41062 - RNA, 20 nt, Artificial Sequence
  MKO10041062_A_Pira2
  gRNA
cuacagugacccccugaagc

SEQ ID NO: 41063 - RNA, 20 nt, Artificial Sequence
  MKO10041063_A_Pira2
  gRNA
caccugucaccaccagcuuc

SEQ ID NO: 41064 - RNA, 20 nt, Artificial Sequence
  MKO10041064_A_Pira2
  gRNA
caggacugacucugagccuc

SEQ ID NO: 41065 - RNA, 20 nt, Artificial Sequence
  MKO10041065_A_Pira4
  gRNA
gaaccugugauuguugugcc

SEQ ID NO: 41066 - RNA, 20 nt, Artificial Sequence
  MKO10041066_A_Pira4
  gRNA
ugcauccaugagagcuucug

SEQ ID NO: 41067 - RNA, 20 nt, Artificial Sequence
  MKO10041067_A_Pira4
  gRNA
cagaguacagccacacucug

SEQ ID NO: 41068 - RNA, 20 nt, Artificial Sequence
  MKO10041068_A_Pira6
  gRNA
ucagagcagcuucuuccugc

SEQ ID NO: 41069 - RNA, 20 nt, Artificial Sequence
  MKO10041069_A_Pira6
  gRNA
cauaaguucccaucuccugc

SEQ ID NO: 41070 - RNA, 20 nt, Artificial Sequence
  MKO10041070_A_Pira6
  gRNA
auuacugucccuccacauac

SEQ ID NO: 41071 - RNA, 20 nt, Artificial Sequence
  MKO10041071_A_Pira7
  gRNA
gaaccugugauuguugugcc

SEQ ID NO: 41072 - RNA, 20 nt, Artificial Sequence
  MKO10041072_A_Pira7
  gRNA
ugcauccaugagagcuucug

SEQ ID NO: 41073 - RNA, 20 nt, Artificial Sequence
  MKO10041073_A_Pira7
  gRNA
cagaguacagccacacucug

SEQ ID NO: 41074 - RNA, 20 nt, Artificial Sequence
  MKO10041074_A_Pirb
  gRNA
uguguccacgagagcuucug

SEQ ID NO: 41075 - RNA, 20 nt, Artificial Sequence
  MKO10041075_A_Pirb
  gRNA
gcuggcuugggcuaaaaggc

SEQ ID NO: 41076 - RNA, 20 nt, Artificial Sequence
  MKO10041076_A_Pirb
  gRNA
ucugugacacuacaacaugc

SEQ ID NO: 41077 - RNA, 20 nt, Artificial Sequence
  MKO10041077_A_Pirt
  gRNA
caaccagucaucagcgguuc

SEQ ID NO: 41078 - RNA, 20 nt, Artificial Sequence
  MKO10041078_A_Pirt
  gRNA
ugccauucugcucuuuggcg

SEQ ID NO: 41079 - RNA, 20 nt, Artificial Sequence
  MKO10041079_A_Pirt
  gRNA
aacaauggaggugcucccca

SEQ ID NO: 41080 - RNA, 20 nt, Artificial Sequence
  MKO10041080_A_Pir
  gRNA
uuuccugaucauccacaccg

SEQ ID NO: 41081 - RNA, 20 nt, Artificial Sequence
  MKO10041081_A_Pir
  gRNA
aucccgaaacccaccaaaga

SEQ ID NO: 41082 - RNA, 20 nt, Artificial Sequence
  MKO10041082_A_Pir
  gRNA
ggaugaucaggaaauccucc

SEQ ID NO: 41083 - RNA, 20 nt, Artificial Sequence
  MKO10041083_A_Pisd
  gRNA
cgcccaaacuugcuagucac

SEQ ID NO: 41084 - RNA, 20 nt, Artificial Sequence
  MKO10041084_A_Pisd
  gRNA
gggcccucgagccaauacag

SEQ ID NO: 41085 - RNA, 20 nt, Artificial Sequence
  MKO10041085_A_Pisd
  gRNA
cucccagugacuagcaaguu

SEQ ID NO: 41086 - RNA, 20 nt, Artificial Sequence
  MKO10041086_A_Pithd1
  gRNA
ggaugaugacucgcaccccu

SEQ ID NO: 41087 - RNA, 20 nt, Artificial Sequence
  MKO10041087_A_Pithd1
  gRNA
auacuuacggaauauuaaac

SEQ ID NO: 41088 - RNA, 20 nt, Artificial Sequence
  MKO10041088_A_Pithd1
  gRNA
acgggcaaugucaagcugaa

SEQ ID NO: 41089 - RNA, 20 nt, Artificial Sequence
  MKO10041089_A_Pitpna
  gRNA
gagcccuacgagaaggacga

SEQ ID NO: 41090 - RNA, 20 nt, Artificial Sequence
  MKO10041090_A_Pitpna
  gRNA
cucgccaucguccuucucgu

SEQ ID NO: 41091 - RNA, 20 nt, Artificial Sequence
  MKO10041091_A_Pitpna
  gRNA
acccaccuuuguucgaaugc

SEQ ID NO: 41092 - RNA, 20 nt, Artificial Sequence
  MKO10041092_A_Pitpnb
  gRNA
uuugccguguucuguucaag

SEQ ID NO: 41093 - RNA, 20 nt, Artificial Sequence
  MKO10041093_A_Pitpnb
  gRNA
cagcuuacuuguucugcagu

SEQ ID NO: 41094 - RNA, 20 nt, Artificial Sequence
  MKO10041094_A_Pitpnb
  gRNA
aaugaaccuuaugaaaacga

SEQ ID NO: 41095 - RNA, 20 nt, Artificial Sequence
  MKO10041095_A_Pitpnc1
  gRNA
agaagcgaguguaucucaac

SEQ ID NO: 41096 - RNA, 20 nt, Artificial Sequence
  MKO10041096_A_Pitpnc1
  gRNA
uauuacccauacaccaucac

SEQ ID NO: 41097 - RNA, 20 nt, Artificial Sequence
  MKO10041097_A_Pitpnc1
  gRNA
guaauaauuccacgccuucu

SEQ ID NO: 41098 - RNA, 20 nt, Artificial Sequence
  MKO10041098_A_Pitpnm1
  gRNA
ugcaucccgcacgaugucga

SEQ ID NO: 41099 - RNA, 20 nt, Artificial Sequence
  MKO10041099_A_Pitpnm1
  gRNA
gaugcuucgcgcccaucgcc

SEQ ID NO: 41100 - RNA, 20 nt, Artificial Sequence
  MKO10041100_A_Pitpnm1
  gRNA
cagauaccaucgacaucgug

SEQ ID NO: 41101 - RNA, 20 nt, Artificial Sequence
  MKO10041101_A_Pitpnm2
  gRNA
gacgcaccuuguucggguau

SEQ ID NO: 41102 - RNA, 20 nt, Artificial Sequence
  MKO10041102_A_Pitpnm2
  gRNA
guguauugcccggagccgcc

SEQ ID NO: 41103 - RNA, 20 nt, Artificial Sequence
  MKO10041103_A_Pitpnm2
  gRNA
gcucaugcugucccgcaaaa

SEQ ID NO: 41104 - RNA, 20 nt, Artificial Sequence
  MKO10041104_A_Pitpnm3
  gRNA
ugccagggggcaccgccacc

SEQ ID NO: 41105 - RNA, 20 nt, Artificial Sequence
  MKO10041105_A_Pitpnm3
  gRNA
acgcucauccagcuucccua

SEQ ID NO: 41106 - RNA, 20 nt, Artificial Sequence
  MKO10041106_A_Pitpnm3
  gRNA
gcggugcccccuggcaccuu

SEQ ID NO: 41107 - RNA, 20 nt, Artificial Sequence
  MKO10041107_A_Pitrm1
  gRNA
cggauauaucguguaaucgc

SEQ ID NO: 41108 - RNA, 20 nt, Artificial Sequence
  MKO10041108_A_Pitrm1
  gRNA
accguaugcucgagaacaug

SEQ ID NO: 41109 - RNA, 20 nt, Artificial Sequence
  MKO10041109_A_Pitrm1
  gRNA
gcaguuccgcacaaccccaa

SEQ ID NO: 41110 - RNA, 20 nt, Artificial Sequence
  MKO10041110_A_Pitx1
  gRNA
ucguccgacgcugaucugcc

SEQ ID NO: 41111 - RNA, 20 nt, Artificial Sequence
  MKO10041111_A_Pitx1
  gRNA
ggcagcguacacguccucgu

SEQ ID NO: 41112 - RNA, 20 nt, Artificial Sequence
  MKO10041112_A_Pitx1
  gRNA
caagcguugagccccgacgc

SEQ ID NO: 41113 - RNA, 20 nt, Artificial Sequence
  MKO10041113_A_Pitx2
  gRNA
agucggcggcgcguaaggac

SEQ ID NO: 41114 - RNA, 20 nt, Artificial Sequence
  MKO10041114_A_Pitx2
  gRNA
cgacuccuccguacguuuau

SEQ ID NO: 41115 - RNA, 20 nt, Artificial Sequence
  MKO10041115_A_Pitx2
  gRNA
accuuacggaagcccgaguc

SEQ ID NO: 41116 - RNA, 20 nt, Artificial Sequence
  MKO10041116_A_Pitx3
  gRNA
cugcggcggccgaggcguaa

SEQ ID NO: 41117 - RNA, 20 nt, Artificial Sequence
  MKO10041117_A_Pitx3
  gRNA
guguacccgggcuacucgua

SEQ ID NO: 41118 - RNA, 20 nt, Artificial Sequence
  MKO10041118_A_Pitx3
  gRNA
gagcacccgcgaagagaucg

SEQ ID NO: 41119 - RNA, 20 nt, Artificial Sequence
  MKO10041119_A_Piwil1
  gRNA
cgaggugggcggcagcucgu

SEQ ID NO: 41120 - RNA, 20 nt, Artificial Sequence
  MKO10041120_A_Piwil1
  gRNA
cccgcacuuaccuugugacu

SEQ ID NO: 41121 - RNA, 20 nt, Artificial Sequence
  MKO10041121_A_Piwil1
  gRNA
ccaucccccucugucguccu

SEQ ID NO: 41122 - RNA, 20 nt, Artificial Sequence
  MKO10041122_A_Piwil2
  gRNA
aaacugcuucguuaugacac

SEQ ID NO: 41123 - RNA, 20 nt, Artificial Sequence
  MKO10041123_A_Piwil2
  gRNA
ucgaggcuugucugcuaaca

SEQ ID NO: 41124 - RNA, 20 nt, Artificial Sequence
  MKO10041124_A_Piwil2
  gRNA
cauuccucugccuauacuac

SEQ ID NO: 41125 - RNA, 20 nt, Artificial Sequence
  MKO10041125_A_Piwil4
  gRNA
uugggaagagcuugcucguu

SEQ ID NO: 41126 - RNA, 20 nt, Artificial Sequence
  MKO10041126_A_Piwil4
  gRNA
agauuuguaaccagccgcac

SEQ ID NO: 41127 - RNA, 20 nt, Artificial Sequence
  MKO10041127_A_Piwil4
  gRNA
ugaugguggacguaccuuca

SEQ ID NO: 41128 - RNA, 20 nt, Artificial Sequence
  MKO10041128_A_Pja1
  gRNA
gccaugguucgccgccgucu

SEQ ID NO: 41129 - RNA, 20 nt, Artificial Sequence
  MKO10041129_A_Pja1
  gRNA
cgauuacuaccgauacuacg

SEQ ID NO: 41130 - RNA, 20 nt, Artificial Sequence
  MKO10041130_A_Pja1
  gRNA
aucccagcgacgacgugugc

SEQ ID NO: 41131 - RNA, 20 nt, Artificial Sequence
  MKO10041131_A_Pja2
  gRNA
ucacgcucgagucguccuca

SEQ ID NO: 41132 - RNA, 20 nt, Artificial Sequence
  MKO10041132_A_Pja2
  gRNA
gcgacaagacgauacugauc

SEQ ID NO: 41133 - RNA, 20 nt, Artificial Sequence
  MKO10041133_A_Pja2
  gRNA
cucgagcgugagugaagacu

SEQ ID NO: 41134 - RNA, 20 nt, Artificial Sequence
  MKO10041134_A_Pkd1l2
  gRNA
agcugcggcuacaucgggag

SEQ ID NO: 41135 - RNA, 20 nt, Artificial Sequence
  MKO10041135_A_Pkd1l2
  gRNA
ggugcccguagaaagcaucc

SEQ ID NO: 41136 - RNA, 20 nt, Artificial Sequence
  MKO10041136_A_Pkd1l2
  gRNA
ugcagggguuggucgcagcc

SEQ ID NO: 41137 - RNA, 20 nt, Artificial Sequence
  MKO10041137_A_Pkd1l3
  gRNA
caggaggugaugacgucuua

SEQ ID NO: 41138 - RNA, 20 nt, Artificial Sequence
  MKO10041138_A_Pkd1l3
  gRNA
gccuggcgagugcccuuccg

SEQ ID NO: 41139 - RNA, 20 nt, Artificial Sequence
  MKO10041139_A_Pkd1l3
  gRNA
ugugggcuaggcguccucuc

SEQ ID NO: 41140 - RNA, 20 nt, Artificial Sequence
  MKO10041140_A_Pkd1
  gRNA
ucuggcguggcugccacgcu

SEQ ID NO: 41141 - RNA, 20 nt, Artificial Sequence
  MKO10041141_A_Pkd1
  gRNA
uggaaugggcccccugcacg

SEQ ID NO: 41142 - RNA, 20 nt, Artificial Sequence
  MKO10041142_A_Pkd1
  gRNA
gcuacccugguggggcccca

SEQ ID NO: 41143 - RNA, 20 nt, Artificial Sequence
  MKO10041143_A_Pkd2l1
  gRNA
acucacgcugugccguucug

SEQ ID NO: 41144 - RNA, 20 nt, Artificial Sequence
  MKO10041144_A_Pkd2l1
  gRNA
cuacacaccccauccgacuc

SEQ ID NO: 41145 - RNA, 20 nt, Artificial Sequence
  MKO10041145_A_Pkd2l1
  gRNA
cuguuaugauguguacucgc

SEQ ID NO: 41146 - RNA, 20 nt, Artificial Sequence
  MKO10041146_A_Pkd2l2
  gRNA
acucgcaguugccgcacucu

SEQ ID NO: 41147 - RNA, 20 nt, Artificial Sequence
  MKO10041147_A_Pkd2l2
  gRNA
cccaguacaagccgucgaug

SEQ ID NO: 41148 - RNA, 20 nt, Artificial Sequence
  MKO10041148_A_Pkd2l2
  gRNA
uuuguuggcguauaccgaga

SEQ ID NO: 41149 - RNA, 20 nt, Artificial Sequence
  MKO10041149_A_Pkd2
  gRNA
gggaucauugcgucguacag

SEQ ID NO: 41150 - RNA, 20 nt, Artificial Sequence
  MKO10041150_A_Pkd2
  gRNA
uaaaagcugcccgcgugccc

SEQ ID NO: 41151 - RNA, 20 nt, Artificial Sequence
  MKO10041151_A_Pkd2
  gRNA
acgcacgcaguuccauuccg

SEQ ID NO: 41152 - RNA, 20 nt, Artificial Sequence
  MKO10041152_A_Pkdcc
  gRNA
gcgcuacacuuguuccgaag

SEQ ID NO: 41153 - RNA, 20 nt, Artificial Sequence
  MKO10041153_A_Pkdcc
  gRNA
uggcauugacgaugcuaucc

SEQ ID NO: 41154 - RNA, 20 nt, Artificial Sequence
  MKO10041154_A_Pkdcc
  gRNA
uacucggaaucgauccuccc

SEQ ID NO: 41155 - RNA, 20 nt, Artificial Sequence
  MKO10041155_A_Pkdrej
  gRNA
gcaugauacagggggccguc

SEQ ID NO: 41156 - RNA, 20 nt, Artificial Sequence
  MKO10041156_A_Pkdrej
  gRNA
ucaucugucaccguaccgac

SEQ ID NO: 41157 - RNA, 20 nt, Artificial Sequence
  MKO10041157_A_Pkdrej
  gRNA
accguaagguuaaaacucga

SEQ ID NO: 41158 - RNA, 20 nt, Artificial Sequence
  MKO10041158_A_Pkhd1l1
  gRNA
ccacaucacaaguaaucgac

SEQ ID NO: 41159 - RNA, 20 nt, Artificial Sequence
  MKO10041159_A_Pkhd1l1
  gRNA
ccagucgauuacuugugaug

SEQ ID NO: 41160 - RNA, 20 nt, Artificial Sequence
  MKO10041160_A_Pkhd1l1
  gRNA
ccguuuaugcugccauauuu

SEQ ID NO: 41161 - RNA, 20 nt, Artificial Sequence
  MKO10041161_A_Pkhd1
  gRNA
ugacgucucuccggccuucg

SEQ ID NO: 41162 - RNA, 20 nt, Artificial Sequence
  MKO10041162_A_Pkhd1
  gRNA
uaccuucugcggguucaaac

SEQ ID NO: 41163 - RNA, 20 nt, Artificial Sequence
  MKO10041163_A_Pkhd1
  gRNA
guacagcuaucuagugaucc

SEQ ID NO: 41164 - RNA, 20 nt, Artificial Sequence
  MKO10041164_A_Pkia
  gRNA
agaagcuccaccgaacaaag

SEQ ID NO: 41165 - RNA, 20 nt, Artificial Sequence
  MKO10041165_A_Pkia
  gRNA
caccugucuuguugauauca

SEQ ID NO: 41166 - RNA, 20 nt, Artificial Sequence
  MKO10041166_A_Pkia
  gRNA
cugggcuucuccacuuuguu

SEQ ID NO: 41167 - RNA, 20 nt, Artificial Sequence
  MKO10041167_A_Pkib
  gRNA
ugucggguaaggcauugcgg

SEQ ID NO: 41168 - RNA, 20 nt, Artificial Sequence
  MKO10041168_A_Pkib
  gRNA
gauaagcacgcugaugcccc

SEQ ID NO: 41169 - RNA, 20 nt, Artificial Sequence
  MKO10041169_A_Pkib
  gRNA
ggcaucagcgugcuuaucca

SEQ ID NO: 41170 - RNA, 20 nt, Artificial Sequence
  MKO10041170_A_Pkig
  gRNA
agcgagcuuccgcacacuca

SEQ ID NO: 41171 - RNA, 20 nt, Artificial Sequence
  MKO10041171_A_Pkig
  gRNA
acucggaggccgugagugug

SEQ ID NO: 41172 - RNA, 20 nt, Artificial Sequence
  MKO10041172_A_Pkig
  gRNA
cccugcagaaggacaggcag

SEQ ID NO: 41173 - RNA, 20 nt, Artificial Sequence
  MKO10041173_A_Pklr
  gRNA
ggccgcaucuacauugacga

SEQ ID NO: 41174 - RNA, 20 nt, Artificial Sequence
  MKO10041174_A_Pklr
  gRNA
gcccgucgucaauguagaug

SEQ ID NO: 41175 - RNA, 20 nt, Artificial Sequence
  MKO10041175_A_Pklr
  gRNA
aagggucccgagauacgcac

SEQ ID NO: 41176 - RNA, 20 nt, Artificial Sequence
  MKO10041176_A_Pkmyt1
  gRNA
caaagaccgaacucguaaac

SEQ ID NO: 41177 - RNA, 20 nt, Artificial Sequence
  MKO10041177_A_Pkmyt1
  gRNA
gcauccacacugcgugagac

SEQ ID NO: 41178 - RNA, 20 nt, Artificial Sequence
  MKO10041178_A_Pkmyt1
  gRNA
acagggcccagccucgacuu

SEQ ID NO: 41179 - RNA, 20 nt, Artificial Sequence
  MKO10041179_A_Pkm
  gRNA
uccauagagcggcaccgcug

SEQ ID NO: 41180 - RNA, 20 nt, Artificial Sequence
  MKO10041180_A_Pkm
  gRNA
cauugacucugcccccauca

SEQ ID NO: 41181 - RNA, 20 nt, Artificial Sequence
  MKO10041181_A_Pkm
  gRNA
cgcccuugaugaguccaguc

SEQ ID NO: 41182 - RNA, 20 nt, Artificial Sequence
  MKO10041182_A_Pkn1
  gRNA
caguaagucuaggcgucgag

SEQ ID NO: 41183 - RNA, 20 nt, Artificial Sequence
  MKO10041183_A_Pkn1
  gRNA
agccguagagcuacgcauug

SEQ ID NO: 41184 - RNA, 20 nt, Artificial Sequence
  MKO10041184_A_Pkn1
  gRNA
gcagcuucgaagagcgcucc

SEQ ID NO: 41185 - RNA, 20 nt, Artificial Sequence
  MKO10041185_A_Pkn2
  gRNA
uacagcgcagcaacugcuac

SEQ ID NO: 41186 - RNA, 20 nt, Artificial Sequence
  MKO10041186_A_Pkn2
  gRNA
ggccguccagaccaaugagc

SEQ ID NO: 41187 - RNA, 20 nt, Artificial Sequence
  MKO10041187_A_Pkn2
  gRNA
gaacuacgagagucacuauu

SEQ ID NO: 41188 - RNA, 20 nt, Artificial Sequence
  MKO10041188_A_Pkn3
  gRNA
gguccgccgagccauccaga

SEQ ID NO: 41189 - RNA, 20 nt, Artificial Sequence
  MKO10041189_A_Pkn3
  gRNA
ggccacagaccgacgccacc

SEQ ID NO: 41190 - RNA, 20 nt, Artificial Sequence
  MKO10041190_A_Pkn3
  gRNA
ggaccgaaaggcacuggccg

SEQ ID NO: 41191 - RNA, 20 nt, Artificial Sequence
  MKO10041191_A_Pknox1
  gRNA
ccgacaagcaggccauuuau

SEQ ID NO: 41192 - RNA, 20 nt, Artificial Sequence
  MKO10041192_A_Pknox1
  gRNA
gacgucugccagcuucgaug

SEQ ID NO: 41193 - RNA, 20 nt, Artificial Sequence
  MKO10041193_A_Pknox1
  gRNA
ccuauaaauggccugcuugu

SEQ ID NO: 41194 - RNA, 20 nt, Artificial Sequence
  MKO10041194_A_Pknox2
  gRNA
ucauggcgauguugcccugc

SEQ ID NO: 41195 - RNA, 20 nt, Artificial Sequence
  MKO10041195_A_Pknox2
  gRNA
aggugaugcacucggagccc

SEQ ID NO: 41196 - RNA, 20 nt, Artificial Sequence
  MKO10041196_A_Pknox2
  gRNA
ugacacgacuugagaauuga

SEQ ID NO: 41197 - RNA, 20 nt, Artificial Sequence
  MKO10041197_A_Pkp1
  gRNA
uguugucgggcucccgcuug

SEQ ID NO: 41198 - RNA, 20 nt, Artificial Sequence
  MKO10041198_A_Pkp1
  gRNA
uggagccggcacuauccccg

SEQ ID NO: 41199 - RNA, 20 nt, Artificial Sequence
  MKO10041199_A_Pkp1
  gRNA
gaauggcucguggggauauc

SEQ ID NO: 41200 - RNA, 20 nt, Artificial Sequence
  MKO10041200_A_Pkp2
  gRNA
cccuaggucaaucaacuucg

SEQ ID NO: 41201 - RNA, 20 nt, Artificial Sequence
  MKO10041201_A_Pkp2
  gRNA
ucgcugaaugacccgcaccc

SEQ ID NO: 41202 - RNA, 20 nt, Artificial Sequence
  MKO10041202_A_Pkp2
  gRNA
agcgaugcugucuucgacaa

SEQ ID NO: 41203 - RNA, 20 nt, Artificial Sequence
  MKO10041203_A_Pkp3
  gRNA
gccagcagucgcggcacaau

SEQ ID NO: 41204 - RNA, 20 nt, Artificial Sequence
  MKO10041204_A_Pkp3
  gRNA
cuguccagcccgcguacauc

SEQ ID NO: 41205 - RNA, 20 nt, Artificial Sequence
  MKO10041205_A_Pkp3
  gRNA
cuuccggcccaucgccaagc

SEQ ID NO: 41206 - RNA, 20 nt, Artificial Sequence
  MKO10041206_A_Pkp4
  gRNA
cgccaagcaucgccagcacc

SEQ ID NO: 41207 - RNA, 20 nt, Artificial Sequence
  MKO10041207_A_Pkp4
  gRNA
ucaacgacucacccgagaac

SEQ ID NO: 41208 - RNA, 20 nt, Artificial Sequence
  MKO10041208_A_Pkp4
  gRNA
aggaaugcccgccccugaac

SEQ ID NO: 41209 - RNA, 20 nt, Artificial Sequence
  MKO10041209_A_Pla1a
  gRNA
auaaacuugucgauccaaga

SEQ ID NO: 41210 - RNA, 20 nt, Artificial Sequence
  MKO10041210_A_Pla1a
  gRNA
cauuagcauccgcagcccgc

SEQ ID NO: 41211 - RNA, 20 nt, Artificial Sequence
  MKO10041211_A_Pla1a
  gRNA
acucugaaaguccgugcacu

SEQ ID NO: 41212 - RNA, 20 nt, Artificial Sequence
  MKO10041212_A_Pla2g10
  gRNA
ccuggacccggauucagcga

SEQ ID NO: 41213 - RNA, 20 nt, Artificial Sequence
  MKO10041213_A_Pla2g10
  gRNA
cuaaguuagaccgcuaccca

SEQ ID NO: 41214 - RNA, 20 nt, Artificial Sequence
  MKO10041214_A_Pla2g10
  gRNA
ucacuuaccuucgcugaauc

SEQ ID NO: 41215 - RNA, 20 nt, Artificial Sequence
  MKO10041215_A_Pla2g12a
  gRNA
ucucguagcaucugucgugc

SEQ ID NO: 41216 - RNA, 20 nt, Artificial Sequence
  MKO10041216_A_Pla2g12a
  gRNA
ucgaagccuguuccacgcua

SEQ ID NO: 41217 - RNA, 20 nt, Artificial Sequence
  MKO10041217_A_Pla2g12a
  gRNA
gguauggcuugcagccuaaa

SEQ ID NO: 41218 - RNA, 20 nt, Artificial Sequence
  MKO10041218_A_Pla2g12b
  gRNA
ugcgucacagcgguauuugu

SEQ ID NO: 41219 - RNA, 20 nt, Artificial Sequence
  MKO10041219_A_Pla2g12b
  gRNA
gcugugacgcaaaauuccga

SEQ ID NO: 41220 - RNA, 20 nt, Artificial Sequence
  MKO10041220_A_Pla2g12b
  gRNA
aaggcgccgaugcccagacc

SEQ ID NO: 41221 - RNA, 20 nt, Artificial Sequence
  MKO10041221_A_Pla2g15
  gRNA
ucuccucgaucaucucucgc

SEQ ID NO: 41222 - RNA, 20 nt, Artificial Sequence
  MKO10041222_A_Pla2g15
  gRNA
ccacggggcccccauacauc

SEQ ID NO: 41223 - RNA, 20 nt, Artificial Sequence
  MKO10041223_A_Pla2g15
  gRNA
cacccaguuucccgauggug

SEQ ID NO: 41224 - RNA, 20 nt, Artificial Sequence
  MKO10041224_A_Pla2g16
  gRNA
uuugugaaugaacuacgcua

SEQ ID NO: 41225 - RNA, 20 nt, Artificial Sequence
  MKO10041225_A_Pla2g16
  gRNA
ggcgguaggcaucgcuggag

SEQ ID NO: 41226 - RNA, 20 nt, Artificial Sequence
  MKO10041226_A_Pla2g16
  gRNA
cgucauguuuguuauugacc

SEQ ID NO: 41227 - RNA, 20 nt, Artificial Sequence
  MKO10041227_A_Pla2g1b
  gRNA
caccugucuaagucguccac

SEQ ID NO: 41228 - RNA, 20 nt, Artificial Sequence
  MKO10041228_A_Pla2g1b
  gRNA
cuccaaggucccguacaaca

SEQ ID NO: 41229 - RNA, 20 nt, Artificial Sequence
  MKO10041229_A_Pla2g1b
  gRNA
gcugcaggugaucucgcucc

SEQ ID NO: 41230 - RNA, 20 nt, Artificial Sequence
  MKO10041230_A_Pla2g2a
  gRNA
caagggaacauugcgcaguu

SEQ ID NO: 41231 - RNA, 20 nt, Artificial Sequence
  MKO10041231_A_Pla2g2a
  gRNA
gcugcuagcagccucgauca

SEQ ID NO: 41232 - RNA, 20 nt, Artificial Sequence
  MKO10041232_A_Pla2g2a
  gRNA
gggggaauccuuugccaccc

SEQ ID NO: 41233 - RNA, 20 nt, Artificial Sequence
  MKO10041233_A_Pla2g2c
  gRNA
ucaagcagcucuucccgacc

SEQ ID NO: 41234 - RNA, 20 nt, Artificial Sequence
  MKO10041234_A_Pla2g2c
  gRNA
aggauggucaaacacgucac

SEQ ID NO: 41235 - RNA, 20 nt, Artificial Sequence
  MKO10041235_A_Pla2g2c
  gRNA
guagcagccauauccguaau

SEQ ID NO: 41236 - RNA, 20 nt, Artificial Sequence
  MKO10041236_A_Pla2g2d
  gRNA
auaagcgccugcguuacuac

SEQ ID NO: 41237 - RNA, 20 nt, Artificial Sequence
  MKO10041237_A_Pla2g2d
  gRNA
ggggccgccaguaguaacgc

SEQ ID NO: 41238 - RNA, 20 nt, Artificial Sequence
  MKO10041238_A_Pla2g2d
  gRNA
ucuugcauccaucgaucuuc

SEQ ID NO: 41239 - RNA, 20 nt, Artificial Sequence
  MKO10041239_A_Pla2g2e
  gRNA
caccaauccgucucguccac

SEQ ID NO: 41240 - RNA, 20 nt, Artificial Sequence
  MKO10041240_A_Pla2g2e
  gRNA
ggcucucuugucacacucgc

SEQ ID NO: 41241 - RNA, 20 nt, Artificial Sequence
  MKO10041241_A_Pla2g2e
  gRNA
acuugcgguuguaaguguuc

SEQ ID NO: 41242 - RNA, 20 nt, Artificial Sequence
  MKO10041242_A_Pla2g2f
  gRNA
cuacggcugcuacugcgggc

SEQ ID NO: 41243 - RNA, 20 nt, Artificial Sequence
  MKO10041243_A_Pla2g2f
  gRNA
acguggaccacuaugaccac

SEQ ID NO: 41244 - RNA, 20 nt, Artificial Sequence
  MKO10041244_A_Pla2g2f
  gRNA
ccauacaggaacaaguaccg

SEQ ID NO: 41245 - RNA, 20 nt, Artificial Sequence
  MKO10041245_A_Pla2g3
  gRNA
accggcgggugcaaucgcag

SEQ ID NO: 41246 - RNA, 20 nt, Artificial Sequence
  MKO10041246_A_Pla2g3
  gRNA
ucgcccuugcaguauaacua

SEQ ID NO: 41247 - RNA, 20 nt, Artificial Sequence
  MKO10041247_A_Pla2g3
  gRNA
cguggccuucuucaacgugc

SEQ ID NO: 41248 - RNA, 20 nt, Artificial Sequence
  MKO10041248_A_Pla2g4a
  gRNA
guacucacgcauaucgccaa

SEQ ID NO: 41249 - RNA, 20 nt, Artificial Sequence
  MKO10041249_A_Pla2g4a
  gRNA
gguuucauccaugacguagu

SEQ ID NO: 41250 - RNA, 20 nt, Artificial Sequence
  MKO10041250_A_Pla2g4a
  gRNA
ggacacuccagauccuuaug

SEQ ID NO: 41251 - RNA, 20 nt, Artificial Sequence
  MKO10041251_A_Pla2g4b
  gRNA
ugcucacuguacgcguccuc

SEQ ID NO: 41252 - RNA, 20 nt, Artificial Sequence
  MKO10041252_A_Pla2g4b
  gRNA
ggcgcugagucccaauuugc

SEQ ID NO: 41253 - RNA, 20 nt, Artificial Sequence
  MKO10041253_A_Pla2g4b
  gRNA
aaggcaagccacuggcccgg

SEQ ID NO: 41254 - RNA, 20 nt, Artificial Sequence
  MKO10041254_A_Pla2g4c
  gRNA
gaugcugucacauaccucgc

SEQ ID NO: 41255 - RNA, 20 nt, Artificial Sequence
  MKO10041255_A_Pla2g4c
  gRNA
gcacaccaagacaagcgaug

SEQ ID NO: 41256 - RNA, 20 nt, Artificial Sequence
  MKO10041256_A_Pla2g4c
  gRNA
ucguagagccuccaaaaccu

SEQ ID NO: 41257 - RNA, 20 nt, Artificial Sequence
  MKO10041257_A_Pla2g4d
  gRNA
cauuuaccuugaccugacuc

SEQ ID NO: 41258 - RNA, 20 nt, Artificial Sequence
  MKO10041258_A_Pla2g4d
  gRNA
cuaacuccagucauccugug

SEQ ID NO: 41259 - RNA, 20 nt, Artificial Sequence
  MKO10041259_A_Pla2g4d
  gRNA
agcuccacaucuaacucuuc

SEQ ID NO: 41260 - RNA, 20 nt, Artificial Sequence
  MKO10041260_A_Pla2g4e
  gRNA
acuuacguauaucagccugc

SEQ ID NO: 41261 - RNA, 20 nt, Artificial Sequence
  MKO10041261_A_Pla2g4e
  gRNA
ucauuggcaugaaaaacguc

SEQ ID NO: 41262 - RNA, 20 nt, Artificial Sequence
  MKO10041262_A_Pla2g4e
  gRNA
gugaagcuuucgucccacuc

SEQ ID NO: 41263 - RNA, 20 nt, Artificial Sequence
  MKO10041263_A_Pla2g4f
  gRNA
cccacaccuucacagcgccg

SEQ ID NO: 41264 - RNA, 20 nt, Artificial Sequence
  MKO10041264_A_Pla2g4f
  gRNA
auacuacgaccuucaaguga

SEQ ID NO: 41265 - RNA, 20 nt, Artificial Sequence
  MKO10041265_A_Pla2g4f
  gRNA
ccgacugcuauguucgacug

SEQ ID NO: 41266 - RNA, 20 nt, Artificial Sequence
  MKO10041266_A_Pla2g5
  gRNA
cagaugcacgaccguuguua

SEQ ID NO: 41267 - RNA, 20 nt, Artificial Sequence
  MKO10041267_A_Pla2g5
  gRNA
ggucgcgggacacccaagga

SEQ ID NO: 41268 - RNA, 20 nt, Artificial Sequence
  MKO10041268_A_Pla2g5
  gRNA
acugccugcggagaaaccuc

SEQ ID NO: 41269 - RNA, 20 nt, Artificial Sequence
  MKO10041269_A_Pla2g6
  gRNA
gguuccggaugaggucgguc

SEQ ID NO: 41270 - RNA, 20 nt, Artificial Sequence
  MKO10041270_A_Pla2g6
  gRNA
agaaugucuccaaucgcacc

SEQ ID NO: 41271 - RNA, 20 nt, Artificial Sequence
  MKO10041271_A_Pla2g6
  gRNA
acgucucaagugaacguguc

SEQ ID NO: 41272 - RNA, 20 nt, Artificial Sequence
  MKO10041272_A_Pla2g7
  gRNA
caucagaucuguacaaccga

SEQ ID NO: 41273 - RNA, 20 nt, Artificial Sequence
  MKO10041273_A_Pla2g7
  gRNA
cggcagcagacaucaccgau

SEQ ID NO: 41274 - RNA, 20 nt, Artificial Sequence
  MKO10041274_A_Pla2g7
  gRNA
ggcaucuaauggguuuauag

SEQ ID NO: 41275 - RNA, 20 nt, Artificial Sequence
  MKO10041275_A_Pla2r1
  gRNA
acguguaggcgauccaccua

SEQ ID NO: 41276 - RNA, 20 nt, Artificial Sequence
  MKO10041276_A_Pla2r1
  gRNA
aucgccuacacguccagugg

SEQ ID NO: 41277 - RNA, 20 nt, Artificial Sequence
  MKO10041277_A_Pla2r1
  gRNA
ucugugaugcuacguggcaa

SEQ ID NO: 41278 - RNA, 20 nt, Artificial Sequence
  MKO10041278_A_Plaa
  gRNA
gggacaccacugcuaaaguc

SEQ ID NO: 41279 - RNA, 20 nt, Artificial Sequence
  MKO10041279_A_Plaa
  gRNA
caaacgaugcuaguauuaga

SEQ ID NO: 41280 - RNA, 20 nt, Artificial Sequence
  MKO10041280_A_Plaa
  gRNA
aauacuagcaucguuugcac

SEQ ID NO: 41281 - RNA, 20 nt, Artificial Sequence
  MKO10041281_A_Plac1
  gRNA
cacuaccgcguuaccgaaug

SEQ ID NO: 41282 - RNA, 20 nt, Artificial Sequence
  MKO10041282_A_Plac1
  gRNA
gagcuauagaugacgacauc

SEQ ID NO: 41283 - RNA, 20 nt, Artificial Sequence
  MKO10041283_A_Plac1
  gRNA
augugcugugcucgacagau

SEQ ID NO: 41284 - RNA, 20 nt, Artificial Sequence
  MKO10041284_A_Plac8l1
  gRNA
aagacacucuccguaaugcc

SEQ ID NO: 41285 - RNA, 20 nt, Artificial Sequence
  MKO10041285_A_Plac8l1
  gRNA
ccaugugccagcucgugucg

SEQ ID NO: 41286 - RNA, 20 nt, Artificial Sequence
  MKO10041286_A_Plac8l1
  gRNA
cagccgauccguggagccau

SEQ ID NO: 41287 - RNA, 20 nt, Artificial Sequence
  MKO10041287_A_Plac8
  gRNA
acucucuaccgaacccgaua

SEQ ID NO: 41288 - RNA, 20 nt, Artificial Sequence
  MKO10041288_A_Plac8
  gRNA
acaguuaucgugacucaacc

SEQ ID NO: 41289 - RNA, 20 nt, Artificial Sequence
  MKO10041289_A_Plac8
  gRNA
gacucacaggaaugccguau

SEQ ID NO: 41290 - RNA, 20 nt, Artificial Sequence
  MKO10041290_A_Plac9a
  gRNA
gcgcugcucugcgcgcuagc

SEQ ID NO: 41291 - RNA, 20 nt, Artificial Sequence
  MKO10041291_A_Plac9a
  gRNA
cucauucuuaccucgccguc

SEQ ID NO: 41292 - RNA, 20 nt, Artificial Sequence
  MKO10041292_A_Plac9a
  gRNA
gccgagucccccaguucccc

SEQ ID NO: 41293 - RNA, 20 nt, Artificial Sequence
  MKO10041293_A_Plac9b
  gRNA
gcgcugcucugcgcgcuagc

SEQ ID NO: 41294 - RNA, 20 nt, Artificial Sequence
  MKO10041294_A_Plac9b
  gRNA
cucauucuuaccucgccguc

SEQ ID NO: 41295 - RNA, 20 nt, Artificial Sequence
  MKO10041295_A_Plac9b
  gRNA
gccgagucccccaguucccc

SEQ ID NO: 41296 - RNA, 20 nt, Artificial Sequence
  MKO10041296_A_Plag1
  gRNA
aaugugagcacugcgaacgc

SEQ ID NO: 41297 - RNA, 20 nt, Artificial Sequence
  MKO10041297_A_Plag1
  gRNA
acuugcccgcgugagauuuc

SEQ ID NO: 41298 - RNA, 20 nt, Artificial Sequence
  MKO10041298_A_Plag1
  gRNA
gcgauggccacugucauucc

SEQ ID NO: 41299 - RNA, 20 nt, Artificial Sequence
  MKO10041299_A_Plagl1
  gRNA
gcgcccauucaagugcucga

SEQ ID NO: 41300 - RNA, 20 nt, Artificial Sequence
  MKO10041300_A_Plagl1
  gRNA
gcucccgagaacgggcuuga

SEQ ID NO: 41301 - RNA, 20 nt, Artificial Sequence
  MKO10041301_A_Plagl1
  gRNA
gccgcaaucgucacacgcgu

SEQ ID NO: 41302 - RNA, 20 nt, Artificial Sequence
  MKO10041302_A_Plagl2
  gRNA
ucugcaagugguuccgcaga

SEQ ID NO: 41303 - RNA, 20 nt, Artificial Sequence
  MKO10041303_A_Plagl2
  gRNA
cuacccccauguaacccacc

SEQ ID NO: 41304 - RNA, 20 nt, Artificial Sequence
  MKO10041304_A_Plagl2
  gRNA
agggacgcuggugaaaaaug

SEQ ID NO: 41305 - RNA, 20 nt, Artificial Sequence
  MKO10041305_A_Plau
  gRNA
gaauauugccggugcaacag

SEQ ID NO: 41306 - RNA, 20 nt, Artificial Sequence
  MKO10041306_A_Plau
  gRNA
guaccaggccgcuguugcac

SEQ ID NO: 41307 - RNA, 20 nt, Artificial Sequence
  MKO10041307_A_Plau
  gRNA
guggggcugagugcaucaac

SEQ ID NO: 41308 - RNA, 20 nt, Artificial Sequence
  MKO10041308_A_Plaur
  gRNA
aggacgcacacucgagguaa

SEQ ID NO: 41309 - RNA, 20 nt, Artificial Sequence
  MKO10041309_A_Plaur
  gRNA
accuugccauucccgaagca

SEQ ID NO: 41310 - RNA, 20 nt, Artificial Sequence
  MKO10041310_A_Plaur
  gRNA
gugugcguccugcaccucuu

SEQ ID NO: 41311 - RNA, 20 nt, Artificial Sequence
  MKO10041311_A_Plau
  gRNA
ggccaggcagggccgaccuu

SEQ ID NO: 41312 - RNA, 20 nt, Artificial Sequence
  MKO10041312_A_Plau
  gRNA
gccaaucugcacauagcacc

SEQ ID NO: 41313 - RNA, 20 nt, Artificial Sequence
  MKO10041313_A_Plau
  gRNA
uucgccgaugcagcugccca

SEQ ID NO: 41314 - RNA, 20 nt, Artificial Sequence
  MKO10041314_A_Plb1
  gRNA
auguugaucgugccagaccc

SEQ ID NO: 41315 - RNA, 20 nt, Artificial Sequence
  MKO10041315_A_Plb1
  gRNA
uacaauuucuggguugccga

SEQ ID NO: 41316 - RNA, 20 nt, Artificial Sequence
  MKO10041316_A_Plb1
  gRNA
ugccacgaguuuaaugucug

SEQ ID NO: 41317 - RNA, 20 nt, Artificial Sequence
  MKO10041317_A_Plbd1
  gRNA
caagauacagcccgucgagc

SEQ ID NO: 41318 - RNA, 20 nt, Artificial Sequence
  MKO10041318_A_Plbd1
  gRNA
auucaguuccugaacgccgu

SEQ ID NO: 41319 - RNA, 20 nt, Artificial Sequence
  MKO10041319_A_Plbd1
  gRNA
cggcguucaggaacugaauu

SEQ ID NO: 41320 - RNA, 20 nt, Artificial Sequence
  MKO10041320_A_Plbd2
  gRNA
guagccgacuucguauucga

SEQ ID NO: 41321 - RNA, 20 nt, Artificial Sequence
  MKO10041321_A_Plbd2
  gRNA
uuaacccggacucuccguac

SEQ ID NO: 41322 - RNA, 20 nt, Artificial Sequence
  MKO10041322_A_Plbd2
  gRNA
uccacguguugugcgccacc

SEQ ID NO: 41323 - RNA, 20 nt, Artificial Sequence
  MKO10041323_A_Plcb1
  gRNA
auccagaaguucacgcaacu

SEQ ID NO: 41324 - RNA, 20 nt, Artificial Sequence
  MKO10041324_A_Plcb1
  gRNA
ccccaaguugcgugaacuuc

SEQ ID NO: 41325 - RNA, 20 nt, Artificial Sequence
  MKO10041325_A_Plcb1
  gRNA
cguguccgacagccucaaga

SEQ ID NO: 41326 - RNA, 20 nt, Artificial Sequence
  MKO10041326_A_Plcb2
  gRNA
aguauccgagauacucgcuu

SEQ ID NO: 41327 - RNA, 20 nt, Artificial Sequence
  MKO10041327_A_Plcb2
  gRNA
ccaguauaaguaauagcccu

SEQ ID NO: 41328 - RNA, 20 nt, Artificial Sequence
  MKO10041328_A_Plcb2
  gRNA
ccaagggcuauuacuuauac

SEQ ID NO: 41329 - RNA, 20 nt, Artificial Sequence
  MKO10041329_A_Plcb3
  gRNA
cgcaggcucacgcuuuccgc

SEQ ID NO: 41330 - RNA, 20 nt, Artificial Sequence
  MKO10041330_A_Plcb3
  gRNA
acccugcguguggacccuaa

SEQ ID NO: 41331 - RNA, 20 nt, Artificial Sequence
  MKO10041331_A_Plcb3
  gRNA
ucguuaugcccgccugccca

SEQ ID NO: 41332 - RNA, 20 nt, Artificial Sequence
  MKO10041332_A_Plcb4
  gRNA
aguugugaaugaucgaucuc

SEQ ID NO: 41333 - RNA, 20 nt, Artificial Sequence
  MKO10041333_A_Plcb4
  gRNA
gaucgaucauucacaacuuc

SEQ ID NO: 41334 - RNA, 20 nt, Artificial Sequence
  MKO10041334_A_Plcb4
  gRNA
ugccuucacucuuccacguc

SEQ ID NO: 41335 - RNA, 20 nt, Artificial Sequence
  MKO10041335_A_Plcd1
  gRNA
gcgcaagaucaucgaccgcu

SEQ ID NO: 41336 - RNA, 20 nt, Artificial Sequence
  MKO10041336_A_Plcd1
  gRNA
gcguucucuacgccacgagc

SEQ ID NO: 41337 - RNA, 20 nt, Artificial Sequence
  MKO10041337_A_Plcd1
  gRNA
agcggucgaugaucuugcgc

SEQ ID NO: 41338 - RNA, 20 nt, Artificial Sequence
  MKO10041338_A_Plcd3
  gRNA
gagaucuuccgccgguacuc

SEQ ID NO: 41339 - RNA, 20 nt, Artificial Sequence
  MKO10041339_A_Plcd3
  gRNA
ucaagauccgcucacgcacg

SEQ ID NO: 41340 - RNA, 20 nt, Artificial Sequence
  MKO10041340_A_Plcd3
  gRNA
ccccucuagacgcucguugu

SEQ ID NO: 41341 - RNA, 20 nt, Artificial Sequence
  MKO10041341_A_Plcd4
  gRNA
ucaugggcgccgccccaacc

SEQ ID NO: 41342 - RNA, 20 nt, Artificial Sequence
  MKO10041342_A_Plcd4
  gRNA
uucugaguuguugcgcuauc

SEQ ID NO: 41343 - RNA, 20 nt, Artificial Sequence
  MKO10041343_A_Plcd4
  gRNA
gcuucugaugaacguggaaa

SEQ ID NO: 41344 - RNA, 20 nt, Artificial Sequence
  MKO10041344_A_Plce1
  gRNA
acuggacgaauaaugcugaa

SEQ ID NO: 41345 - RNA, 20 nt, Artificial Sequence
  MKO10041345_A_Plce1
  gRNA
gggcaacuacaacgcuguca

SEQ ID NO: 41346 - RNA, 20 nt, Artificial Sequence
  MKO10041346_A_Plce1
  gRNA
uuucagcauuauucguccag

SEQ ID NO: 41347 - RNA, 20 nt, Artificial Sequence
  MKO10041347_A_Plcg1
  gRNA
auaugcgcuuccuccgagag

SEQ ID NO: 41348 - RNA, 20 nt, Artificial Sequence
  MKO10041348_A_Plcg1
  gRNA
agcggaauuccauuccauag

SEQ ID NO: 41349 - RNA, 20 nt, Artificial Sequence
  MKO10041349_A_Plcg1
  gRNA
ccauuaccgucagccgcucu

SEQ ID NO: 41350 - RNA, 20 nt, Artificial Sequence
  MKO10041350_A_Plcg2
  gRNA
agauaaaggaaauccguccg

SEQ ID NO: 41351 - RNA, 20 nt, Artificial Sequence
  MKO10041351_A_Plcg2
  gRNA
ccacccccacaaugauugag

SEQ ID NO: 41352 - RNA, 20 nt, Artificial Sequence
  MKO10041352_A_Plcg2
  gRNA
uggaugcacucaucgcuucc

SEQ ID NO: 41353 - RNA, 20 nt, Artificial Sequence
  MKO10041353_A_Plch1
  gRNA
gucgccaucggaggcggguc

SEQ ID NO: 41354 - RNA, 20 nt, Artificial Sequence
  MKO10041354_A_Plch1
  gRNA
agcaccggacccgccuccga

SEQ ID NO: 41355 - RNA, 20 nt, Artificial Sequence
  MKO10041355_A_Plch1
  gRNA
auccaggugcgugccuccuc

SEQ ID NO: 41356 - RNA, 20 nt, Artificial Sequence
  MKO10041356_A_Plch2
  gRNA
uagcccgucgccagcguacc

SEQ ID NO: 41357 - RNA, 20 nt, Artificial Sequence
  MKO10041357_A_Plch2
  gRNA
ccguagucccccaagccaaa

SEQ ID NO: 41358 - RNA, 20 nt, Artificial Sequence
  MKO10041358_A_Plch2
  gRNA
gauauuggucccugguacgc

SEQ ID NO: 41359 - RNA, 20 nt, Artificial Sequence
  MKO10041359_A_Plcl1
  gRNA
caagggaacgugccgguacc

SEQ ID NO: 41360 - RNA, 20 nt, Artificial Sequence
  MKO10041360_A_Plcl1
  gRNA
ugacauccuccgcgacaucu

SEQ ID NO: 41361 - RNA, 20 nt, Artificial Sequence
  MKO10041361_A_Plcl1
  gRNA
gagcuucgcuuggaauauua

SEQ ID NO: 41362 - RNA, 20 nt, Artificial Sequence
  MKO10041362_A_Plcl2
  gRNA
cguccagcagaaaauaccga

SEQ ID NO: 41363 - RNA, 20 nt, Artificial Sequence
  MKO10041363_A_Plcl2
  gRNA
acaaacggggccuuuccgug

SEQ ID NO: 41364 - RNA, 20 nt, Artificial Sequence
  MKO10041364_A_Plcl2
  gRNA
aaagaucgugcacugucaga

SEQ ID NO: 41365 - RNA, 20 nt, Artificial Sequence
  MKO10041365_A_Plcxd1
  gRNA
cgggucgugccauucaucac

SEQ ID NO: 41366 - RNA, 20 nt, Artificial Sequence
  MKO10041366_A_Plcxd1
  gRNA
ugaguugcacgacuaucucg

SEQ ID NO: 41367 - RNA, 20 nt, Artificial Sequence
  MKO10041367_A_Plcxd1
  gRNA
cggugaugaauggcacgacc

SEQ ID NO: 41368 - RNA, 20 nt, Artificial Sequence
  MKO10041368_A_Plcxd2
  gRNA
cggaggucugcaaugccgac

SEQ ID NO: 41369 - RNA, 20 nt, Artificial Sequence
  MKO10041369_A_Plcxd2
  gRNA
cacguggagcucgcucacuc

SEQ ID NO: 41370 - RNA, 20 nt, Artificial Sequence
  MKO10041370_A_Plcxd2
  gRNA
gucggcauugcagaccuccg

SEQ ID NO: 41371 - RNA, 20 nt, Artificial Sequence
  MKO10041371_A_Plcxd3
  gRNA
gguacggauccacugcauca

SEQ ID NO: 41372 - RNA, 20 nt, Artificial Sequence
  MKO10041372_A_Plcxd3
  gRNA
acgagcugaaauucgccgac

SEQ ID NO: 41373 - RNA, 20 nt, Artificial Sequence
  MKO10041373_A_Plcxd3
  gRNA
ugggcuugguggaaauucga

SEQ ID NO: 41374 - RNA, 20 nt, Artificial Sequence
  MKO10041374_A_Plcz1
  gRNA
ucaacacguauacugaaaau

SEQ ID NO: 41375 - RNA, 20 nt, Artificial Sequence
  MKO10041375_A_Plcz1
  gRNA
uuugauauccgaucaaauau

SEQ ID NO: 41376 - RNA, 20 nt, Artificial Sequence
  MKO10041376_A_Plcz1
  gRNA
gagcgacagaugucaauuga

SEQ ID NO: 41377 - RNA, 20 nt, Artificial Sequence
  MKO10041377_A_Pld1
  gRNA
gcguuaacucgaucguguac

SEQ ID NO: 41378 - RNA, 20 nt, Artificial Sequence
  MKO10041378_A_Pld1
  gRNA
uacacgaucgaguuaacgca

SEQ ID NO: 41379 - RNA, 20 nt, Artificial Sequence
  MKO10041379_A_Pld1
  gRNA
agcgcuucacaucgaccuca

SEQ ID NO: 41380 - RNA, 20 nt, Artificial Sequence
  MKO10041380_A_Pld2
  gRNA
cuaucgcaauuaccacgcca

SEQ ID NO: 41381 - RNA, 20 nt, Artificial Sequence
  MKO10041381_A_Pld2
  gRNA
ugaucgaaugcaucccuauc

SEQ ID NO: 41382 - RNA, 20 nt, Artificial Sequence
  MKO10041382_A_Pld2
  gRNA
uagggaggguauauccucgg

SEQ ID NO: 41383 - RNA, 20 nt, Artificial Sequence
  MKO10041383_A_Pld3
  gRNA
augcgaaccuuuacaccucg

SEQ ID NO: 41384 - RNA, 20 nt, Artificial Sequence
  MKO10041384_A_Pld3
  gRNA
acuggcaccucgagguguaa

SEQ ID NO: 41385 - RNA, 20 nt, Artificial Sequence
  MKO10041385_A_Pld3
  gRNA
caccgaagcccacuaccgcc

SEQ ID NO: 41386 - RNA, 20 nt, Artificial Sequence
  MKO10041386_A_Pld4
  gRNA
uccacauugccucguacuac

SEQ ID NO: 41387 - RNA, 20 nt, Artificial Sequence
  MKO10041387_A_Pld4
  gRNA
accaguaguacgaggcaaug

SEQ ID NO: 41388 - RNA, 20 nt, Artificial Sequence
  MKO10041388_A_Pld4
  gRNA
accaugccaaguccgcuaug

SEQ ID NO: 41389 - RNA, 20 nt, Artificial Sequence
  MKO10041389_A_Pld5
  gRNA
cgacgugaccgcagauucaa

SEQ ID NO: 41390 - RNA, 20 nt, Artificial Sequence
  MKO10041390_A_Pld5
  gRNA
ggcuuagacuggcgaucgcu

SEQ ID NO: 41391 - RNA, 20 nt, Artificial Sequence
  MKO10041391_A_Pld5
  gRNA
gugcaucgugaucuucgcuc

SEQ ID NO: 41392 - RNA, 20 nt, Artificial Sequence
  MKO10041392_A_Pld6
  gRNA
cggccauggggcgcucgagu

SEQ ID NO: 41393 - RNA, 20 nt, Artificial Sequence
  MKO10041393_A_Pld6
  gRNA
cagacacgucaggagccgca

SEQ ID NO: 41394 - RNA, 20 nt, Artificial Sequence
  MKO10041394_A_Pld6
  gRNA
cgcuggugggcacuacccau

SEQ ID NO: 41395 - RNA, 20 nt, Artificial Sequence
  MKO10041395_A_Plec
  gRNA
uccuccuagccccgcgagaa

SEQ ID NO: 41396 - RNA, 20 nt, Artificial Sequence
  MKO10041396_A_Plec
  gRNA
caucacggaggucuucguac

SEQ ID NO: 41397 - RNA, 20 nt, Artificial Sequence
  MKO10041397_A_Plec
  gRNA
agcgcauccucccuuucucg

SEQ ID NO: 41398 - RNA, 20 nt, Artificial Sequence
  MKO10041398_A_Plek2
  gRNA
ccggcgaguaaccccgccca

SEQ ID NO: 41399 - RNA, 20 nt, Artificial Sequence
  MKO10041399_A_Plek2
  gRNA
ccuugggcgggguuacucgc

SEQ ID NO: 41400 - RNA, 20 nt, Artificial Sequence
  MKO10041400_A_Plek2
  gRNA
agcaugggagcuauucgcuc

SEQ ID NO: 41401 - RNA, 20 nt, Artificial Sequence
  MKO10041401_A_Plekha1
  gRNA
gcccaucaucacgccgacgc

SEQ ID NO: 41402 - RNA, 20 nt, Artificial Sequence
  MKO10041402_A_Plekha1
  gRNA
ccaacccgugacgauccuga

SEQ ID NO: 41403 - RNA, 20 nt, Artificial Sequence
  MKO10041403_A_Plekha1
  gRNA
uaccugcgucggcgugauga

SEQ ID NO: 41404 - RNA, 20 nt, Artificial Sequence
  MKO10041404_A_Plekha2
  gRNA
gguacaaacgccuaucagcc

SEQ ID NO: 41405 - RNA, 20 nt, Artificial Sequence
  MKO10041405_A_Plekha2
  gRNA
ccuaaaacgccauucugcuu

SEQ ID NO: 41406 - RNA, 20 nt, Artificial Sequence
  MKO10041406_A_Plekha2
  gRNA
caacauuaccuucgagaugu

SEQ ID NO: 41407 - RNA, 20 nt, Artificial Sequence
  MKO10041407_A_Plekha3
  gRNA
gaaagcgguaccuccacacu

SEQ ID NO: 41408 - RNA, 20 nt, Artificial Sequence
  MKO10041408_A_Plekha3
  gRNA
aauucguccaccgugaugag

SEQ ID NO: 41409 - RNA, 20 nt, Artificial Sequence
  MKO10041409_A_Plekha3
  gRNA
uaaaugccgccgagagacag

SEQ ID NO: 41410 - RNA, 20 nt, Artificial Sequence
  MKO10041410_A_Plekha4
  gRNA
gaugggcccggagccccucg

SEQ ID NO: 41411 - RNA, 20 nt, Artificial Sequence
  MKO10041411_A_Plekha4
  gRNA
cgccguugguucguccuuuc

SEQ ID NO: 41412 - RNA, 20 nt, Artificial Sequence
  MKO10041412_A_Plekha4
  gRNA
ggagggccucucgugcggag

SEQ ID NO: 41413 - RNA, 20 nt, Artificial Sequence
  MKO10041413_A_Plekha5
  gRNA
gaagaagcauauacguucga

SEQ ID NO: 41414 - RNA, 20 nt, Artificial Sequence
  MKO10041414_A_Plekha5
  gRNA
cccggugaccacggccucgc

SEQ ID NO: 41415 - RNA, 20 nt, Artificial Sequence
  MKO10041415_A_Plekha5
  gRNA
accugcaagcauccgguuac

SEQ ID NO: 41416 - RNA, 20 nt, Artificial Sequence
  MKO10041416_A_Plekha6
  gRNA
gcugggcuuacccggauguu

SEQ ID NO: 41417 - RNA, 20 nt, Artificial Sequence
  MKO10041417_A_Plekha6
  gRNA
ugcgcguuuaccaaaggcaa

SEQ ID NO: 41418 - RNA, 20 nt, Artificial Sequence
  MKO10041418_A_Plekha6
  gRNA
ugcauugggguuccgcuuca

SEQ ID NO: 41419 - RNA, 20 nt, Artificial Sequence
  MKO10041419_A_Plekha7
  gRNA
ccggcguuccaugcccucca

SEQ ID NO: 41420 - RNA, 20 nt, Artificial Sequence
  MKO10041420_A_Plekha7
  gRNA
ucgagagacuguccucgucg

SEQ ID NO: 41421 - RNA, 20 nt, Artificial Sequence
  MKO10041421_A_Plekha7
  gRNA
ggaacgccgguccacgugag

SEQ ID NO: 41422 - RNA, 20 nt, Artificial Sequence
  MKO10041422_A_Plekha8
  gRNA
gacuuaagcaccgcuaguug

SEQ ID NO: 41423 - RNA, 20 nt, Artificial Sequence
  MKO10041423_A_Plekha8
  gRNA
cagucuuagcuccgacauuu

SEQ ID NO: 41424 - RNA, 20 nt, Artificial Sequence
  MKO10041424_A_Plekha8
  gRNA
agcggugcuuaaguccagca

SEQ ID NO: 41425 - RNA, 20 nt, Artificial Sequence
  MKO10041425_A_Plekhb1
  gRNA
agcggaauugguucgcucug

SEQ ID NO: 41426 - RNA, 20 nt, Artificial Sequence
  MKO10041426_A_Plekhb1
  gRNA
cgaaccaauuccgcuuccag

SEQ ID NO: 41427 - RNA, 20 nt, Artificial Sequence
  MKO10041427_A_Plekhb1
  gRNA
cccgcagguucacugucagc

SEQ ID NO: 41428 - RNA, 20 nt, Artificial Sequence
  MKO10041428_A_Plekhb2
  gRNA
guagcauaggcugcguaggg

SEQ ID NO: 41429 - RNA, 20 nt, Artificial Sequence
  MKO10041429_A_Plekhb2
  gRNA
cugcagaucguuugccgaga

SEQ ID NO: 41430 - RNA, 20 nt, Artificial Sequence
  MKO10041430_A_Plekhb2
  gRNA
ugaugcaguccacgggcaug

SEQ ID NO: 41431 - RNA, 20 nt, Artificial Sequence
  MKO10041431_A_Plekhd1
  gRNA
ugaucauagcuuccccuagc

SEQ ID NO: 41432 - RNA, 20 nt, Artificial Sequence
  MKO10041432_A_Plekhd1
  gRNA
ugccaugaagaucucacacc

SEQ ID NO: 41433 - RNA, 20 nt, Artificial Sequence
  MKO10041433_A_Plekhd1
  gRNA
guacuucaauauucauccua

SEQ ID NO: 41434 - RNA, 20 nt, Artificial Sequence
  MKO10041434_A_Plekhf1
  gRNA
agaccacaaacccgcauuug

SEQ ID NO: 41435 - RNA, 20 nt, Artificial Sequence
  MKO10041435_A_Plekhf1
  gRNA
gcagcgcaugcaaauguccg

SEQ ID NO: 41436 - RNA, 20 nt, Artificial Sequence
  MKO10041436_A_Plekhf1
  gRNA
cgucaccacugccgcaaaug

SEQ ID NO: 41437 - RNA, 20 nt, Artificial Sequence
  MKO10041437_A_Plekhf2
  gRNA
caauggugccgccgauugac

SEQ ID NO: 41438 - RNA, 20 nt, Artificial Sequence
  MKO10041438_A_Plekhf2
  gRNA
acacgcggccaugucccccg

SEQ ID NO: 41439 - RNA, 20 nt, Artificial Sequence
  MKO10041439_A_Plekhf2
  gRNA
uacuagacgcauaaguauug

SEQ ID NO: 41440 - RNA, 20 nt, Artificial Sequence
  MKO10041440_A_Plekhg1
  gRNA
gaugauauuugagaauccgc

SEQ ID NO: 41441 - RNA, 20 nt, Artificial Sequence
  MKO10041441_A_Plekhg1
  gRNA
uuccccuggugaccgaagac

SEQ ID NO: 41442 - RNA, 20 nt, Artificial Sequence
  MKO10041442_A_Plekhg1
  gRNA
ccgugcuaacugagugcaug

SEQ ID NO: 41443 - RNA, 20 nt, Artificial Sequence
  MKO10041443_A_Plekhg2
  gRNA
ucgcgaccuucgcagcaucg

SEQ ID NO: 41444 - RNA, 20 nt, Artificial Sequence
  MKO10041444_A_Plekhg2
  gRNA
aggguucggugaaacccucc

SEQ ID NO: 41445 - RNA, 20 nt, Artificial Sequence
  MKO10041445_A_Plekhg2
  gRNA
gcagugagugacacuccaac

SEQ ID NO: 41446 - RNA, 20 nt, Artificial Sequence
  MKO10041446_A_Plekhg3
  gRNA
uacuucaggacgcgcuggac

SEQ ID NO: 41447 - RNA, 20 nt, Artificial Sequence
  MKO10041447_A_Plekhg3
  gRNA
gagcaagucagcgcccucuu

SEQ ID NO: 41448 - RNA, 20 nt, Artificial Sequence
  MKO10041448_A_Plekhg3
  gRNA
gagugucaaugaucuucaag

SEQ ID NO: 41449 - RNA, 20 nt, Artificial Sequence
  MKO10041449_A_Plekhg4
  gRNA
gacucgggcaucgacuagua

SEQ ID NO: 41450 - RNA, 20 nt, Artificial Sequence
  MKO10041450_A_Plekhg4
  gRNA
acagggacacgggaugucga

SEQ ID NO: 41451 - RNA, 20 nt, Artificial Sequence
  MKO10041451_A_Plekhg4
  gRNA
cccaggcgaggucucgagcu

SEQ ID NO: 41452 - RNA, 20 nt, Artificial Sequence
  MKO10041452_A_Plekhg5
  gRNA
cgauuugaccugcccccgca

SEQ ID NO: 41453 - RNA, 20 nt, Artificial Sequence
  MKO10041453_A_Plekhg5
  gRNA
uacagggaccggaagagcgc

SEQ ID NO: 41454 - RNA, 20 nt, Artificial Sequence
  MKO10041454_A_Plekhg5
  gRNA
cuugaaauucgaccugaacg

SEQ ID NO: 41455 - RNA, 20 nt, Artificial Sequence
  MKO10041455_A_Plekhg6
  gRNA
ucugguucccgaagcaccag

SEQ ID NO: 41456 - RNA, 20 nt, Artificial Sequence
  MKO10041456_A_Plekhg6
  gRNA
gacccgaggcaugucuccuc

SEQ ID NO: 41457 - RNA, 20 nt, Artificial Sequence
  MKO10041457_A_Plekhg6
  gRNA
aggcgauagugcccugacca

SEQ ID NO: 41458 - RNA, 20 nt, Artificial Sequence
  MKO10041458_A_Plekhh1
  gRNA
gaauugcugagagccguuca

SEQ ID NO: 41459 - RNA, 20 nt, Artificial Sequence
  MKO10041459_A_Plekhh1
  gRNA
gagcucguccuugccuugaa

SEQ ID NO: 41460 - RNA, 20 nt, Artificial Sequence
  MKO10041460_A_Plekhh1
  gRNA
gacuuguaaccagcagcuag

SEQ ID NO: 41461 - RNA, 20 nt, Artificial Sequence
  MKO10041461_A_Plekhh2
  gRNA
gagccgugucuccgacucac

SEQ ID NO: 41462 - RNA, 20 nt, Artificial Sequence
  MKO10041462_A_Plekhh2
  gRNA
acggcucuauaagaaguguc

SEQ ID NO: 41463 - RNA, 20 nt, Artificial Sequence
  MKO10041463_A_Plekhh2
  gRNA
aauaaucauaccuugcaacu

SEQ ID NO: 41464 - RNA, 20 nt, Artificial Sequence
  MKO10041464_A_Plekhh3
  gRNA
gcugagucagaguaacgucc

SEQ ID NO: 41465 - RNA, 20 nt, Artificial Sequence
  MKO10041465_A_Plekhh3
  gRNA
gguuacucccacgcagagcc

SEQ ID NO: 41466 - RNA, 20 nt, Artificial Sequence
  MKO10041466_A_Plekhh3
  gRNA
ucuuccggaagucccuuguc

SEQ ID NO: 41467 - RNA, 20 nt, Artificial Sequence
  MKO10041467_A_Plekhj1
  gRNA
cagcuucaccagucgccgcu

SEQ ID NO: 41468 - RNA, 20 nt, Artificial Sequence
  MKO10041468_A_Plekhj1
  gRNA
uacaguggccaagcggcgac

SEQ ID NO: 41469 - RNA, 20 nt, Artificial Sequence
  MKO10041469_A_Plekhj1
  gRNA
gcuucgucgaagaccucagc

SEQ ID NO: 41470 - RNA, 20 nt, Artificial Sequence
  MKO10041470_A_Plekhm1
  gRNA
ugccaagcacauccgcgccg

SEQ ID NO: 41471 - RNA, 20 nt, Artificial Sequence
  MKO10041471_A_Plekhm1
  gRNA
caaacaccgaugaccccgac

SEQ ID NO: 41472 - RNA, 20 nt, Artificial Sequence
  MKO10041472_A_Plekhm1
  gRNA
uaguacucgcacaaccgugc

SEQ ID NO: 41473 - RNA, 20 nt, Artificial Sequence
  MKO10041473_A_Plekhm2
  gRNA
gcaggaccuugucgugguuc

SEQ ID NO: 41474 - RNA, 20 nt, Artificial Sequence
  MKO10041474_A_Plekhm2
  gRNA
ugccauccggaaccacgaca

SEQ ID NO: 41475 - RNA, 20 nt, Artificial Sequence
  MKO10041475_A_Plekhm2
  gRNA
gguucuccuggaacagacgc

SEQ ID NO: 41476 - RNA, 20 nt, Artificial Sequence
  MKO10041476_A_Plekhm3
  gRNA
ccguuguacggcuucgacag

SEQ ID NO: 41477 - RNA, 20 nt, Artificial Sequence
  MKO10041477_A_Plekhm3
  gRNA
acagggugccagcgaucuau

SEQ ID NO: 41478 - RNA, 20 nt, Artificial Sequence
  MKO10041478_A_Plekhm3
  gRNA
uggcggaggaucugcgccgc

SEQ ID NO: 41479 - RNA, 20 nt, Artificial Sequence
  MKO10041479_A_Plekhn1
  gRNA
uugaacaucugcccgacuga

SEQ ID NO: 41480 - RNA, 20 nt, Artificial Sequence
  MKO10041480_A_Plekhn1
  gRNA
uuagccgcgguguccccauc

SEQ ID NO: 41481 - RNA, 20 nt, Artificial Sequence
  MKO10041481_A_Plekhn1
  gRNA
cagauguucaauuccgucag

SEQ ID NO: 41482 - RNA, 20 nt, Artificial Sequence
  MKO10041482_A_Plekho1
  gRNA
ucagucugcggcgcccgaga

SEQ ID NO: 41483 - RNA, 20 nt, Artificial Sequence
  MKO10041483_A_Plekho1
  gRNA
ggcgagccuaccguggugcc

SEQ ID NO: 41484 - RNA, 20 nt, Artificial Sequence
  MKO10041484_A_Plekho1
  gRNA
aucucuucaggucaccguug

SEQ ID NO: 41485 - RNA, 20 nt, Artificial Sequence
  MKO10041485_A_Plekho2
  gRNA
cucaacgaagggaucaaccg

SEQ ID NO: 41486 - RNA, 20 nt, Artificial Sequence
  MKO10041486_A_Plekho2
  gRNA
agcggugauguuuccgcuug

SEQ ID NO: 41487 - RNA, 20 nt, Artificial Sequence
  MKO10041487_A_Plekho2
  gRNA
ucugcaguccgugcuccacg

SEQ ID NO: 41488 - RNA, 20 nt, Artificial Sequence
  MKO10041488_A_Plekhs1
  gRNA
uacacacccgucaauuucga

SEQ ID NO: 41489 - RNA, 20 nt, Artificial Sequence
  MKO10041489_A_Plekhs1
  gRNA
uaaugaaguaaucccguuua

SEQ ID NO: 41490 - RNA, 20 nt, Artificial Sequence
  MKO10041490_A_Plekhs1
  gRNA
cuuaccugucauggccaaua

SEQ ID NO: 41491 - RNA, 20 nt, Artificial Sequence
  MKO10041491_A_Plek
  gRNA
caggcgaauggaccgucuug

SEQ ID NO: 41492 - RNA, 20 nt, Artificial Sequence
  MKO10041492_A_Plek
  gRNA
ugguuucuaacaagcuaguu

SEQ ID NO: 41493 - RNA, 20 nt, Artificial Sequence
  MKO10041493_A_Plek
  gRNA
cguuugccaaagucuugaca

SEQ ID NO: 41494 - RNA, 20 nt, Artificial Sequence
  MKO10041494_A_Plet1
  gRNA
cugugcgauugacgacgaug

SEQ ID NO: 41495 - RNA, 20 nt, Artificial Sequence
  MKO10041495_A_Plet1
  gRNA
agcacuauggcuaacgucuc

SEQ ID NO: 41496 - RNA, 20 nt, Artificial Sequence
  MKO10041496_A_Plet1
  gRNA
gauguuaucaaggaccacgc

SEQ ID NO: 41497 - RNA, 20 nt, Artificial Sequence
  MKO10041497_A_Plgrkt
  gRNA
aaauggcuaugcagaucgcc

SEQ ID NO: 41498 - RNA, 20 nt, Artificial Sequence
  MKO10041498_A_Plgrkt
  gRNA
aguucaugguuacgcaugcu

SEQ ID NO: 41499 - RNA, 20 nt, Artificial Sequence
  MKO10041499_A_Plgrkt
  gRNA
gcguaaccaugaacuccugu

SEQ ID NO: 41500 - RNA, 20 nt, Artificial Sequence
  MKO10041500_A_Plg
  gRNA
gcagagcuuacuuggguacg

SEQ ID NO: 41501 - RNA, 20 nt, Artificial Sequence
  MKO10041501_A_Plg
  gRNA
uuggugcuacacuacagauc

SEQ ID NO: 41502 - RNA, 20 nt, Artificial Sequence
  MKO10041502_A_Plg
  gRNA
ucuguagccguugccgaugc

SEQ ID NO: 41503 - RNA, 20 nt, Artificial Sequence
  MKO10041503_A_Plin1
  gRNA
cuacccgccuucgaagcgcc

SEQ ID NO: 41504 - RNA, 20 nt, Artificial Sequence
  MKO10041504_A_Plin1
  gRNA
cagucggccaacccgggugu

SEQ ID NO: 41505 - RNA, 20 nt, Artificial Sequence
  MKO10041505_A_Plin1
  gRNA
guccucugccguccggaaga

SEQ ID NO: 41506 - RNA, 20 nt, Artificial Sequence
  MKO10041506_A_Plin2
  gRNA
ucugaaccagccaacguccg

SEQ ID NO: 41507 - RNA, 20 nt, Artificial Sequence
  MKO10041507_A_Plin2
  gRNA
cuccgcuuaugucaguacaa

SEQ ID NO: 41508 - RNA, 20 nt, Artificial Sequence
  MKO10041508_A_Plin2
  gRNA
cccaagcucaccucggacgu

SEQ ID NO: 41509 - RNA, 20 nt, Artificial Sequence
  MKO10041509_A_Plin3
  gRNA
gcagaacuacuuuguccggu

SEQ ID NO: 41510 - RNA, 20 nt, Artificial Sequence
  MKO10041510_A_Plin3
  gRNA
ggcgcucaccaucccauacg

SEQ ID NO: 41511 - RNA, 20 nt, Artificial Sequence
  MKO10041511_A_Plin3
  gRNA
ggcaacacgauccaccacgc

SEQ ID NO: 41512 - RNA, 20 nt, Artificial Sequence
  MKO10041512_A_Plin4
  gRNA
gaauguccucaccaauacga

SEQ ID NO: 41513 - RNA, 20 nt, Artificial Sequence
  MKO10041513_A_Plin4
  gRNA
cugccuccuuaguuccgaca

SEQ ID NO: 41514 - RNA, 20 nt, Artificial Sequence
  MKO10041514_A_Plin4
  gRNA
agggucccccccaaauccaa

SEQ ID NO: 41515 - RNA, 20 nt, Artificial Sequence
  MKO10041515_A_Plin5
  gRNA
guccggugaucagacagcuc

SEQ ID NO: 41516 - RNA, 20 nt, Artificial Sequence
  MKO10041516_A_Plin5
  gRNA
gcagaauguggugaaucgag

SEQ ID NO: 41517 - RNA, 20 nt, Artificial Sequence
  MKO10041517_A_Plin5
  gRNA
caauuugucuaguccccugc

SEQ ID NO: 41518 - RNA, 20 nt, Artificial Sequence
  MKO10041518_A_Plk1s1
  gRNA
cggcccauaaagauuguugc

SEQ ID NO: 41519 - RNA, 20 nt, Artificial Sequence
  MKO10041519_A_Plk1s1
  gRNA
cgucuucgucacucauuccc

SEQ ID NO: 41520 - RNA, 20 nt, Artificial Sequence
  MKO10041520_A_Plk1s1
  gRNA
cggcccgcugguccccauga

SEQ ID NO: 41521 - RNA, 20 nt, Artificial Sequence
  MKO10041521_A_Plk1
  gRNA
agcccaggacuaucugucgc

SEQ ID NO: 41522 - RNA, 20 nt, Artificial Sequence
  MKO10041522_A_Plk1
  gRNA
gucauugagcaacucgugaa

SEQ ID NO: 41523 - RNA, 20 nt, Artificial Sequence
  MKO10041523_A_Plk1
  gRNA
cuaccugcgacagauagucc

SEQ ID NO: 41524 - RNA, 20 nt, Artificial Sequence
  MKO10041524_A_Plk2
  gRNA
cagaaguccgauacuaccuc

SEQ ID NO: 41525 - RNA, 20 nt, Artificial Sequence
  MKO10041525_A_Plk2
  gRNA
aaaacugcacgacaugcuua

SEQ ID NO: 41526 - RNA, 20 nt, Artificial Sequence
  MKO10041526_A_Plk2
  gRNA
acgaacaagaaaucuugcac

SEQ ID NO: 41527 - RNA, 20 nt, Artificial Sequence
  MKO10041527_A_Plk3
  gRNA
gaugugaaaagcgaacgaua

SEQ ID NO: 41528 - RNA, 20 nt, Artificial Sequence
  MKO10041528_A_Plk3
  gRNA
caagccgcaucagcgcgaga

SEQ ID NO: 41529 - RNA, 20 nt, Artificial Sequence
  MKO10041529_A_Plk3
  gRNA
cccaccuucucgcgcugaug

SEQ ID NO: 41530 - RNA, 20 nt, Artificial Sequence
  MKO10041530_A_Plk4
  gRNA
gggaacauggcggcgugcau

SEQ ID NO: 41531 - RNA, 20 nt, Artificial Sequence
  MKO10041531_A_Plk4
  gRNA
guugaaacaccccucugucu

SEQ ID NO: 41532 - RNA, 20 nt, Artificial Sequence
  MKO10041532_A_Plk4
  gRNA
cucgguaaaggaucauuugc

SEQ ID NO: 41533 - RNA, 20 nt, Artificial Sequence
  MKO10041533_A_Plk5
  gRNA
cgaagguaauagcgcacuuc

SEQ ID NO: 41534 - RNA, 20 nt, Artificial Sequence
  MKO10041534_A_Plk5
  gRNA
ugaccgcgaucacguguaca

SEQ ID NO: 41535 - RNA, 20 nt, Artificial Sequence
  MKO10041535_A_Plk5
  gRNA
ccugcgccaccgcaacaucg

SEQ ID NO: 41536 - RNA, 20 nt, Artificial Sequence
  MKO10041536_A_Pllp
  gRNA
ucccgucgaaagugagcacg

SEQ ID NO: 41537 - RNA, 20 nt, Artificial Sequence
  MKO10041537_A_Pllp
  gRNA
ggcuucgugcgcuccgcucu

SEQ ID NO: 41538 - RNA, 20 nt, Artificial Sequence
  MKO10041538_A_Pllp
  gRNA
gcgaggaguggguagcaacg

SEQ ID NO: 41539 - RNA, 20 nt, Artificial Sequence
  MKO10041539_A_Pln
  gRNA
uccugauagccgagcgagug

SEQ ID NO: 41540 - RNA, 20 nt, Artificial Sequence
  MKO10041540_A_Pln
  gRNA
agugcaauaccucacucgcu

SEQ ID NO: 41541 - RNA, 20 nt, Artificial Sequence
  MKO10041541_A_Pln
  gRNA
agaaauugauaaauagguuc

SEQ ID NO: 41542 - RNA, 20 nt, Artificial Sequence
  MKO10041542_A_Plod1
  gRNA
agcauaucuacccggaccgg

SEQ ID NO: 41543 - RNA, 20 nt, Artificial Sequence
  MKO10041543_A_Plod1
  gRNA
ccgcuugccgucggggacug

SEQ ID NO: 41544 - RNA, 20 nt, Artificial Sequence
  MKO10041544_A_Plod1
  gRNA
acugagcugaacgcuugaag

SEQ ID NO: 41545 - RNA, 20 nt, Artificial Sequence
  MKO10041545_A_Plod2
  gRNA
acgcccgggcgcaucccugc

SEQ ID NO: 41546 - RNA, 20 nt, Artificial Sequence
  MKO10041546_A_Plod2
  gRNA
uugucugccagccgcuuauc

SEQ ID NO: 41547 - RNA, 20 nt, Artificial Sequence
  MKO10041547_A_Plod2
  gRNA
aaacgcuaccugaauucugg

SEQ ID NO: 41548 - RNA, 20 nt, Artificial Sequence
  MKO10041548_A_Plod3
  gRNA
gcccagcuacgacgugauuc

SEQ ID NO: 41549 - RNA, 20 nt, Artificial Sequence
  MKO10041549_A_Plod3
  gRNA
uccaucagauuguccgccag

SEQ ID NO: 41550 - RNA, 20 nt, Artificial Sequence
  MKO10041550_A_Plod3
  gRNA
cgucgucuuuguaguuccac

SEQ ID NO: 41551 - RNA, 20 nt, Artificial Sequence
  MKO10041551_A_Plp1
  gRNA
ccccuguuaccguugcgcuc

SEQ ID NO: 41552 - RNA, 20 nt, Artificial Sequence
  MKO10041552_A_Plp1
  gRNA
ggccugagcgcaacgguaac

SEQ ID NO: 41553 - RNA, 20 nt, Artificial Sequence
  MKO10041553_A_Plp1
  gRNA
ugcgcugaugccagaaugua

SEQ ID NO: 41554 - RNA, 20 nt, Artificial Sequence
  MKO10041554_A_Plp2
  gRNA
ccuuaccccagcgacaacuc

SEQ ID NO: 41555 - RNA, 20 nt, Artificial Sequence
  MKO10041555_A_Plp2
  gRNA
ccccucucagauacugugcc

SEQ ID NO: 41556 - RNA, 20 nt, Artificial Sequence
  MKO10041556_A_Plp2
  gRNA
agacauacagcagcucccac

SEQ ID NO: 41557 - RNA, 20 nt, Artificial Sequence
  MKO10041557_A_Plrg1
  gRNA
acauagucacaagcggaaaa

SEQ ID NO: 41558 - RNA, 20 nt, Artificial Sequence
  MKO10041558_A_Plrg1
  gRNA
aucaagcuucgcaaugagua

SEQ ID NO: 41559 - RNA, 20 nt, Artificial Sequence
  MKO10041559_A_Plrg1
  gRNA
agcugcacagucccucgcug

SEQ ID NO: 41560 - RNA, 20 nt, Artificial Sequence
  MKO10041560_A_Pls1
  gRNA
guacaaggugcgcgagauug

SEQ ID NO: 41561 - RNA, 20 nt, Artificial Sequence
  MKO10041561_A_Pls1
  gRNA
cugccgucguugggguucau

SEQ ID NO: 41562 - RNA, 20 nt, Artificial Sequence
  MKO10041562_A_Pls1
  gRNA
gauggaugacguccccccga

SEQ ID NO: 41563 - RNA, 20 nt, Artificial Sequence
  MKO10041563_A_Pls3
  gRNA
accgcgcaccugaaugauga

SEQ ID NO: 41564 - RNA, 20 nt, Artificial Sequence
  MKO10041564_A_Pls3
  gRNA
uaucgcuaaaaccuuccgaa

SEQ ID NO: 41565 - RNA, 20 nt, Artificial Sequence
  MKO10041565_A_Pls3
  gRNA
gcucucucgucaauuguauc

SEQ ID NO: 41566 - RNA, 20 nt, Artificial Sequence
  MKO10041566_A_Plscr1
  gRNA
guaacagauugaucagcuuc

SEQ ID NO: 41567 - RNA, 20 nt, Artificial Sequence
  MKO10041567_A_Plscr1
  gRNA
ccaccuggaugauuauaugc

SEQ ID NO: 41568 - RNA, 20 nt, Artificial Sequence
  MKO10041568_A_Plscr1
  gRNA
ccgggaacauauaugccagc

SEQ ID NO: 41569 - RNA, 20 nt, Artificial Sequence
  MKO10041569_A_Plscr2
  gRNA
ucacucuucagaacgacaag

SEQ ID NO: 41570 - RNA, 20 nt, Artificial Sequence
  MKO10041570_A_Plscr2
  gRNA
guggggcguccaguaugcuc

SEQ ID NO: 41571 - RNA, 20 nt, Artificial Sequence
  MKO10041571_A_Plscr2
  gRNA
ugauuuaaguauucuagccc

SEQ ID NO: 41572 - RNA, 20 nt, Artificial Sequence
  MKO10041572_A_Plscr3
  gRNA
uccgcuaggcggauucgaaa

SEQ ID NO: 41573 - RNA, 20 nt, Artificial Sequence
  MKO10041573_A_Plscr3
  gRNA
accauuucgaauccgccuag

SEQ ID NO: 41574 - RNA, 20 nt, Artificial Sequence
  MKO10041574_A_Plscr3
  gRNA
acuggagcuugucccggucc

SEQ ID NO: 41575 - RNA, 20 nt, Artificial Sequence
  MKO10041575_A_Plscr4
  gRNA
caguuacgauauagaccauc

SEQ ID NO: 41576 - RNA, 20 nt, Artificial Sequence
  MKO10041576_A_Plscr4
  gRNA
uagguuccgauaggcauucc

SEQ ID NO: 41577 - RNA, 20 nt, Artificial Sequence
  MKO10041577_A_Plscr4
  gRNA
augguacaaggggauggcac

SEQ ID NO: 41578 - RNA, 20 nt, Artificial Sequence
  MKO10041578_A_Plscr5
  gRNA
cacagacaacucgggucgag

SEQ ID NO: 41579 - RNA, 20 nt, Artificial Sequence
  MKO10041579_A_Plscr5
  gRNA
acaaagaauuuacuuugcgg

SEQ ID NO: 41580 - RNA, 20 nt, Artificial Sequence
  MKO10041580_A_Plscr5
  gRNA
ccugauaaucauccaucagc

SEQ ID NO: 41581 - RNA, 20 nt, Artificial Sequence
  MKO10041581_A_Pltp
  gRNA
gaacaucuccaacgcauccu

SEQ ID NO: 41582 - RNA, 20 nt, Artificial Sequence
  MKO10041582_A_Pltp
  gRNA
cuacaucaaugccucggcgg

SEQ ID NO: 41583 - RNA, 20 nt, Artificial Sequence
  MKO10041583_A_Pltp
  gRNA
gcgguuccuccucaaccagc

SEQ ID NO: 41584 - RNA, 20 nt, Artificial Sequence
  MKO10041584_A_Plvap
  gRNA
gcgcgcacuccgcccguagc

SEQ ID NO: 41585 - RNA, 20 nt, Artificial Sequence
  MKO10041585_A_Plvap
  gRNA
caaccuagagcgcgaacugg

SEQ ID NO: 41586 - RNA, 20 nt, Artificial Sequence
  MKO10041586_A_Plvap
  gRNA
gccgucccgccgagagucuc

SEQ ID NO: 41587 - RNA, 20 nt, Artificial Sequence
  MKO10041587_A_Plxdc1
  gRNA
cacgggacacguaguaguua

SEQ ID NO: 41588 - RNA, 20 nt, Artificial Sequence
  MKO10041588_A_Plxdc1
  gRNA
uacuacgugucccgugucua

SEQ ID NO: 41589 - RNA, 20 nt, Artificial Sequence
  MKO10041589_A_Plxdc1
  gRNA
accccgagagagccccgcgc

SEQ ID NO: 41590 - RNA, 20 nt, Artificial Sequence
  MKO10041590_A_Plxdc2
  gRNA
ugcagcuugccgaugagugu

SEQ ID NO: 41591 - RNA, 20 nt, Artificial Sequence
  MKO10041591_A_Plxdc2
  gRNA
guccagcggauucugccagc

SEQ ID NO: 41592 - RNA, 20 nt, Artificial Sequence
  MKO10041592_A_Plxdc2
  gRNA
ggacaauaacacccagauag

SEQ ID NO: 41593 - RNA, 20 nt, Artificial Sequence
  MKO10041593_A_Plxna1
  gRNA
ugacugacacauugcgcggc

SEQ ID NO: 41594 - RNA, 20 nt, Artificial Sequence
  MKO10041594_A_Plxna1
  gRNA
caacccuauccugcgugacc

SEQ ID NO: 41595 - RNA, 20 nt, Artificial Sequence
  MKO10041595_A_Plxna1
  gRNA
caggccugaccuugcggaug

SEQ ID NO: 41596 - RNA, 20 nt, Artificial Sequence
  MKO10041596_A_Plxna2
  gRNA
ccgcagaaguuaucaucgau

SEQ ID NO: 41597 - RNA, 20 nt, Artificial Sequence
  MKO10041597_A_Plxna2
  gRNA
ccaaucgaugauaacuucug

SEQ ID NO: 41598 - RNA, 20 nt, Artificial Sequence
  MKO10041598_A_Plxna2
  gRNA
ucuuugcagauucgagcuga

SEQ ID NO: 41599 - RNA, 20 nt, Artificial Sequence
  MKO10041599_A_Plxna3
  gRNA
agcacgauuggauucggcgc

SEQ ID NO: 41600 - RNA, 20 nt, Artificial Sequence
  MKO10041600_A_Plxna3
  gRNA
guagccccucaaucacgugu

SEQ ID NO: 41601 - RNA, 20 nt, Artificial Sequence
  MKO10041601_A_Plxna3
  gRNA
caacguuaagaaguacacga

SEQ ID NO: 41602 - RNA, 20 nt, Artificial Sequence
  MKO10041602_A_Plxna4
  gRNA
agcguucacaccguuccuuc

SEQ ID NO: 41603 - RNA, 20 nt, Artificial Sequence
  MKO10041603_A_Plxna4
  gRNA
ugucucucaguacaacgugc

SEQ ID NO: 41604 - RNA, 20 nt, Artificial Sequence
  MKO10041604_A_Plxna4
  gRNA
acaugauguagaguugcucg

SEQ ID NO: 41605 - RNA, 20 nt, Artificial Sequence
  MKO10041605_A_Plxnb1
  gRNA
acugggcugucuucgagugg

SEQ ID NO: 41606 - RNA, 20 nt, Artificial Sequence
  MKO10041606_A_Plxnb1
  gRNA
agcacacaccauccgcaaua

SEQ ID NO: 41607 - RNA, 20 nt, Artificial Sequence
  MKO10041607_A_Plxnb1
  gRNA
ucuuaggucuacuuaggccc

SEQ ID NO: 41608 - RNA, 20 nt, Artificial Sequence
  MKO10041608_A_Plxnb2
  gRNA
cucagauggccggauccuua

SEQ ID NO: 41609 - RNA, 20 nt, Artificial Sequence
  MKO10041609_A_Plxnb2
  gRNA
uacucugcagaagugccguc

SEQ ID NO: 41610 - RNA, 20 nt, Artificial Sequence
  MKO10041610_A_Plxnb2
  gRNA
ggagucacgacacugagcgc

SEQ ID NO: 41611 - RNA, 20 nt, Artificial Sequence
  MKO10041611_A_Plxnb3
  gRNA
cuucgcagguguacucggag

SEQ ID NO: 41612 - RNA, 20 nt, Artificial Sequence
  MKO10041612_A_Plxnb3
  gRNA
ccagguagaccggauacuug

SEQ ID NO: 41613 - RNA, 20 nt, Artificial Sequence
  MKO10041613_A_Plxnb3
  gRNA
gguauaccauucccagcaag

SEQ ID NO: 41614 - RNA, 20 nt, Artificial Sequence
  MKO10041614_A_Plxnc1
  gRNA
gcuggugccucccguuacaa

SEQ ID NO: 41615 - RNA, 20 nt, Artificial Sequence
  MKO10041615_A_Plxnc1
  gRNA
aucaguguagacgaugcaau

SEQ ID NO: 41616 - RNA, 20 nt, Artificial Sequence
  MKO10041616_A_Plxnc1
  gRNA
cgcugcuaagcacucugaac

SEQ ID NO: 41617 - RNA, 20 nt, Artificial Sequence
  MKO10041617_A_Plxnd1
  gRNA
aacugcaugacgugaugcac

SEQ ID NO: 41618 - RNA, 20 nt, Artificial Sequence
  MKO10041618_A_Plxnd1
  gRNA
gcuccgcaauccaguugcuc

SEQ ID NO: 41619 - RNA, 20 nt, Artificial Sequence
  MKO10041619_A_Plxnd1
  gRNA
ucgcccguguuccgugcucc

SEQ ID NO: 41620 - RNA, 20 nt, Artificial Sequence
  MKO10041620_A_Pm20d1
  gRNA
ccuuguccaacaugaagucg

SEQ ID NO: 41621 - RNA, 20 nt, Artificial Sequence
  MKO10041621_A_Pm20d1
  gRNA
ugggaggugcccccguucuc

SEQ ID NO: 41622 - RNA, 20 nt, Artificial Sequence
  MKO10041622_A_Pm20d1
  gRNA
ucuacagguguccggggaaa

SEQ ID NO: 41623 - RNA, 20 nt, Artificial Sequence
  MKO10041623_A_Pm20d2
  gRNA
ucuccguauacgcacugcac

SEQ ID NO: 41624 - RNA, 20 nt, Artificial Sequence
  MKO10041624_A_Pm20d2
  gRNA
ggagaacgcugccuaucucc

SEQ ID NO: 41625 - RNA, 20 nt, Artificial Sequence
  MKO10041625_A_Pm20d2
  gRNA
gacccugugcagugcguaua

SEQ ID NO: 41626 - RNA, 20 nt, Artificial Sequence
  MKO10041626_A_Pmaip1
  gRNA
guuccgacgcgccuuucucc

SEQ ID NO: 41627 - RNA, 20 nt, Artificial Sequence
  MKO10041627_A_Pmaip1
  gRNA
acgcgccagugaacccaacg

SEQ ID NO: 41628 - RNA, 20 nt, Artificial Sequence
  MKO10041628_A_Pmaip1
  gRNA
cugaguugagcugcgaacuc

SEQ ID NO: 41629 - RNA, 20 nt, Artificial Sequence
  MKO10041629_A_Pmch
  gRNA
cuacggauccuuucagagcg

SEQ ID NO: 41630 - RNA, 20 nt, Artificial Sequence
  MKO10041630_A_Pmch
  gRNA
auccguugucgccccuucuc

SEQ ID NO: 41631 - RNA, 20 nt, Artificial Sequence
  MKO10041631_A_Pmch
  gRNA
gaagagucuaccgaccaugu

SEQ ID NO: 41632 - RNA, 20 nt, Artificial Sequence
  MKO10041632_A_Pmel
  gRNA
gagcaaggggcacguagcuc

SEQ ID NO: 41633 - RNA, 20 nt, Artificial Sequence
  MKO10041633_A_Pmel
  gRNA
agucaaaagguacuaccgga

SEQ ID NO: 41634 - RNA, 20 nt, Artificial Sequence
  MKO10041634_A_Pmel
  gRNA
uccaccgucagggaagacac

SEQ ID NO: 41635 - RNA, 20 nt, Artificial Sequence
  MKO10041635_A_Pmepa1
  gRNA
gcuggaguucgugcaaaucg

SEQ ID NO: 41636 - RNA, 20 nt, Artificial Sequence
  MKO10041636_A_Pmepa1
  gRNA
gaccgcuugaugggggucaa

SEQ ID NO: 41637 - RNA, 20 nt, Artificial Sequence
  MKO10041637_A_Pmepa1
  gRNA
cugugcgcgcacccccuaac

SEQ ID NO: 41638 - RNA, 20 nt, Artificial Sequence
  MKO10041638_A_Pmf1
  gRNA
uagauccucugcgucaccuc

SEQ ID NO: 41639 - RNA, 20 nt, Artificial Sequence
  MKO10041639_A_Pmf1
  gRNA
cugccccccaggcgacccag

SEQ ID NO: 41640 - RNA, 20 nt, Artificial Sequence
  MKO10041640_A_Pmf1
  gRNA
acgcuguccuggccgggcgc

SEQ ID NO: 41641 - RNA, 20 nt, Artificial Sequence
  MKO10041641_A_Pmfbp1
  gRNA
ugaugcucuugaaucacgca

SEQ ID NO: 41642 - RNA, 20 nt, Artificial Sequence
  MKO10041642_A_Pmfbp1
  gRNA
uguccgugaauacuaacguc

SEQ ID NO: 41643 - RNA, 20 nt, Artificial Sequence
  MKO10041643_A_Pmfbp1
  gRNA
caagcugcucuugcgccaga

SEQ ID NO: 41644 - RNA, 20 nt, Artificial Sequence
  MKO10041644_A_Pml
  gRNA
ucucaaugucugcgcgugcg

SEQ ID NO: 41645 - RNA, 20 nt, Artificial Sequence
  MKO10041645_A_Pml
  gRNA
cugcagcgcauccgcacuag

SEQ ID NO: 41646 - RNA, 20 nt, Artificial Sequence
  MKO10041646_A_Pml
  gRNA
gcugcgugcacccgcugcaa

SEQ ID NO: 41647 - RNA, 20 nt, Artificial Sequence
  MKO10041647_A_Pmm1
  gRNA
augcugaacgucucgcccau

SEQ ID NO: 41648 - RNA, 20 nt, Artificial Sequence
  MKO10041648_A_Pmm1
  gRNA
agacguucagcaugccauuc

SEQ ID NO: 41649 - RNA, 20 nt, Artificial Sequence
  MKO10041649_A_Pmm1
  gRNA
cucuaagaucgccgagcagc

SEQ ID NO: 41650 - RNA, 20 nt, Artificial Sequence
  MKO10041650_A_Pmm2
  gRNA
auguugaauguguccccaau

SEQ ID NO: 41651 - RNA, 20 nt, Artificial Sequence
  MKO10041651_A_Pmm2
  gRNA
agcucagacaguaguugauc

SEQ ID NO: 41652 - RNA, 20 nt, Artificial Sequence
  MKO10041652_A_Pmm2
  gRNA
uacgcuaccaagccauucuc

SEQ ID NO: 41653 - RNA, 20 nt, Artificial Sequence
  MKO10041653_A_Pmp22
  gRNA
cgcacucacgcugacgaugg

SEQ ID NO: 41654 - RNA, 20 nt, Artificial Sequence
  MKO10041654_A_Pmp22
  gRNA
acacuagcaccgcgaugugc

SEQ ID NO: 41655 - RNA, 20 nt, Artificial Sequence
  MKO10041655_A_Pmp22
  gRNA
auccugcggaaacgcgaaug

SEQ ID NO: 41656 - RNA, 20 nt, Artificial Sequence
  MKO10041656_A_Pmp2
  gRNA
aaaggcacuuuccguucuaa

SEQ ID NO: 41657 - RNA, 20 nt, Artificial Sequence
  MKO10041657_A_Pmp2
  gRNA
ggauuauaucaccauuagaa

SEQ ID NO: 41658 - RNA, 20 nt, Artificial Sequence
  MKO10041658_A_Pmp2
  gRNA
auccagcagcguucuccuua

SEQ ID NO: 41659 - RNA, 20 nt, Artificial Sequence
  MKO10041659_A_Pmpca
  gRNA
agacgaaauccugcuuacgc

SEQ ID NO: 41660 - RNA, 20 nt, Artificial Sequence
  MKO10041660_A_Pmpca
  gRNA
guucugcacccccgacugac

SEQ ID NO: 41661 - RNA, 20 nt, Artificial Sequence
  MKO10041661_A_Pmpca
  gRNA
uuugcugucaaaucgagcag

SEQ ID NO: 41662 - RNA, 20 nt, Artificial Sequence
  MKO10041662_A_Pmpcb
  gRNA
ucccgucagccguuguacuu

SEQ ID NO: 41663 - RNA, 20 nt, Artificial Sequence
  MKO10041663_A_Pmpcb
  gRNA
caaaucucucgagaaugcuu

SEQ ID NO: 41664 - RNA, 20 nt, Artificial Sequence
  MKO10041664_A_Pmpcb
  gRNA
ggaccgacuaagaagcacac

SEQ ID NO: 41665 - RNA, 20 nt, Artificial Sequence
  MKO10041665_A_Pms1
  gRNA
ucuaggugguaguuacaaca

SEQ ID NO: 41666 - RNA, 20 nt, Artificial Sequence
  MKO10041666_A_Pms1
  gRNA
ggggucaauauguaauguug

SEQ ID NO: 41667 - RNA, 20 nt, Artificial Sequence
  MKO10041667_A_Pms1
  gRNA
gcagcacugugaacagucgc

SEQ ID NO: 41668 - RNA, 20 nt, Artificial Sequence
  MKO10041668_A_Pms2
  gRNA
agaguuugccgaccucacgc

SEQ ID NO: 41669 - RNA, 20 nt, Artificial Sequence
  MKO10041669_A_Pms2
  gRNA
ugcaagcguugggacucgac

SEQ ID NO: 41670 - RNA, 20 nt, Artificial Sequence
  MKO10041670_A_Pms2
  gRNA
ucccaacgcuugcagacccg

SEQ ID NO: 41671 - RNA, 20 nt, Artificial Sequence
  MKO10041671_A_Pmvk
  gRNA
acagaucaugucccuccgau

SEQ ID NO: 41672 - RNA, 20 nt, Artificial Sequence
  MKO10041672_A_Pmvk
  gRNA
aucggagggacaugaucugu

SEQ ID NO: 41673 - RNA, 20 nt, Artificial Sequence
  MKO10041673_A_Pmvk
  gRNA
cgagcauacuccuccuugag

SEQ ID NO: 41674 - RNA, 20 nt, Artificial Sequence
  MKO10041674_A_Pnck
  gRNA
ugaacuguuugaccgcauca

SEQ ID NO: 41675 - RNA, 20 nt, Artificial Sequence
  MKO10041675_A_Pnck
  gRNA
cgccagccaccuuguagggc

SEQ ID NO: 41676 - RNA, 20 nt, Artificial Sequence
  MKO10041676_A_Pnck
  gRNA
cuugccccgaagugcuuucu

SEQ ID NO: 41677 - RNA, 20 nt, Artificial Sequence
  MKO10041677_A_Pnkd
  gRNA
auagccuguacacccgaacc

SEQ ID NO: 41678 - RNA, 20 nt, Artificial Sequence
  MKO10041678_A_Pnkd
  gRNA
gcucggaaucgcuaucccaa

SEQ ID NO: 41679 - RNA, 20 nt, Artificial Sequence
  MKO10041679_A_Pnkd
  gRNA
cgauucggaagagcagccgc

SEQ ID NO: 41680 - RNA, 20 nt, Artificial Sequence
  MKO10041680_A_Pnkp
  gRNA
gguguuaacccgucaacugu

SEQ ID NO: 41681 - RNA, 20 nt, Artificial Sequence
  MKO10041681_A_Pnkp
  gRNA
uggugaugagggucccaucu

SEQ ID NO: 41682 - RNA, 20 nt, Artificial Sequence
  MKO10041682_A_Pnkp
  gRNA
uccccacuagcccuagugac

SEQ ID NO: 41683 - RNA, 20 nt, Artificial Sequence
  MKO10041683_A_Pnldc1
  gRNA
guuugacucuccuucgaugc

SEQ ID NO: 41684 - RNA, 20 nt, Artificial Sequence
  MKO10041684_A_Pnldc1
  gRNA
gaaacugcacacuagaugcc

SEQ ID NO: 41685 - RNA, 20 nt, Artificial Sequence
  MKO10041685_A_Pnldc1
  gRNA
ugucucggccccaacagauc

SEQ ID NO: 41686 - RNA, 20 nt, Artificial Sequence
  MKO10041686_A_Pnliprp1
  gRNA
acccacuacucgcacauugu

SEQ ID NO: 41687 - RNA, 20 nt, Artificial Sequence
  MKO10041687_A_Pnliprp1
  gRNA
aagcgaguguugaucuucuc

SEQ ID NO: 41688 - RNA, 20 nt, Artificial Sequence
  MKO10041688_A_Pnliprp1
  gRNA
cucucagacuaccuacacgc

SEQ ID NO: 41689 - RNA, 20 nt, Artificial Sequence
  MKO10041689_A_Pnliprp2
  gRNA
ccgaugaggugcacguucuc

SEQ ID NO: 41690 - RNA, 20 nt, Artificial Sequence
  MKO10041690_A_Pnliprp2
  gRNA
ggccuucgaagauauucccu

SEQ ID NO: 41691 - RNA, 20 nt, Artificial Sequence
  MKO10041691_A_Pnliprp2
  gRNA
aacgugucuugcgguccagu

SEQ ID NO: 41692 - RNA, 20 nt, Artificial Sequence
  MKO10041692_A_Pnlip
  gRNA
uacccagaacguccgggucg

SEQ ID NO: 41693 - RNA, 20 nt, Artificial Sequence
  MKO10041693_A_Pnlip
  gRNA
uagccuggguauaugucguu

SEQ ID NO: 41694 - RNA, 20 nt, Artificial Sequence
  MKO10041694_A_Pnlip
  gRNA
gaaguuugcuucgacaaacu

SEQ ID NO: 41695 - RNA, 20 nt, Artificial Sequence
  MKO10041695_A_Pnma1
  gRNA
ggacauucccgggccuggcg

SEQ ID NO: 41696 - RNA, 20 nt, Artificial Sequence
  MKO10041696_A_Pnma1
  gRNA
aucuucguauguuauccguc

SEQ ID NO: 41697 - RNA, 20 nt, Artificial Sequence
  MKO10041697_A_Pnma1
  gRNA
ggucguuauggcggcguugu

SEQ ID NO: 41698 - RNA, 20 nt, Artificial Sequence
  MKO10041698_A_Pnma2
  gRNA
ccaaccucggcaacguucug

SEQ ID NO: 41699 - RNA, 20 nt, Artificial Sequence
  MKO10041699_A_Pnma2
  gRNA
ugcaccacagaacguugccg

SEQ ID NO: 41700 - RNA, 20 nt, Artificial Sequence
  MKO10041700_A_Pnma2
  gRNA
cccccggaacauugcugacc

SEQ ID NO: 41701 - RNA, 20 nt, Artificial Sequence
  MKO10041701_A_Pnma3
  gRNA
gaagauacaggaucaucggc

SEQ ID NO: 41702 - RNA, 20 nt, Artificial Sequence
  MKO10041702_A_Pnma3
  gRNA
agaugcugaaacagcguaga

SEQ ID NO: 41703 - RNA, 20 nt, Artificial Sequence
  MKO10041703_A_Pnma3
  gRNA
cagagccaaauaccugccgc

SEQ ID NO: 41704 - RNA, 20 nt, Artificial Sequence
  MKO10041704_A_Pnma5
  gRNA
uagcaaugacucccuaaccg

SEQ ID NO: 41705 - RNA, 20 nt, Artificial Sequence
  MKO10041705_A_Pnma5
  gRNA
gaccgcaguugggauacuag

SEQ ID NO: 41706 - RNA, 20 nt, Artificial Sequence
  MKO10041706_A_Pnma5
  gRNA
aaugaaacuuacucgagacg

SEQ ID NO: 41707 - RNA, 20 nt, Artificial Sequence
  MKO10041707_A_Pnmal1
  gRNA
ggcugguuugaauucgguag

SEQ ID NO: 41708 - RNA, 20 nt, Artificial Sequence
  MKO10041708_A_Pnmal1
  gRNA
cuccaaaaccucuaguucgc

SEQ ID NO: 41709 - RNA, 20 nt, Artificial Sequence
  MKO10041709_A_Pnmal1
  gRNA
uuccccaaaucauagcuucc

SEQ ID NO: 41710 - RNA, 20 nt, Artificial Sequence
  MKO10041710_A_Pnmal2
  gRNA
aucggcgcuugccuccccga

SEQ ID NO: 41711 - RNA, 20 nt, Artificial Sequence
  MKO10041711_A_Pnmal2
  gRNA
gccaguagcgcgacuaaauc

SEQ ID NO: 41712 - RNA, 20 nt, Artificial Sequence
  MKO10041712_A_Pnmal2
  gRNA
cuugcccgcgguccuuacuc

SEQ ID NO: 41713 - RNA, 20 nt, Artificial Sequence
  MKO10041713_A_Pnmt
  gRNA
aacaacuacgcgccuccucg

SEQ ID NO: 41714 - RNA, 20 nt, Artificial Sequence
  MKO10041714_A_Pnmt
  gRNA
aagaacgccagcuucgagcg

SEQ ID NO: 41715 - RNA, 20 nt, Artificial Sequence
  MKO10041715_A_Pnmt
  gRNA
ugaugugaugcaaagcccgc

SEQ ID NO: 41716 - RNA, 20 nt, Artificial Sequence
  MKO10041716_A_Pnn
  gRNA
cacgcgcagagaccuuaucc

SEQ ID NO: 41717 - RNA, 20 nt, Artificial Sequence
  MKO10041717_A_Pnn
  gRNA
gcccauccaagccagauugc

SEQ ID NO: 41718 - RNA, 20 nt, Artificial Sequence
  MKO10041718_A_Pnn
  gRNA
acaacggaagauugcagugc

SEQ ID NO: 41719 - RNA, 20 nt, Artificial Sequence
  MKO10041719_A_Pno1
  gRNA
agaggucaucuagucggaua

SEQ ID NO: 41720 - RNA, 20 nt, Artificial Sequence
  MKO10041720_A_Pno1
  gRNA
uguccguguuacguucucua

SEQ ID NO: 41721 - RNA, 20 nt, Artificial Sequence
  MKO10041721_A_Pno1
  gRNA
uacgcuuuaaccugaaauca

SEQ ID NO: 41722 - RNA, 20 nt, Artificial Sequence
  MKO10041722_A_Pnoc
  gRNA
ugaagagaaugccgcguguc

SEQ ID NO: 41723 - RNA, 20 nt, Artificial Sequence
  MKO10041723_A_Pnoc
  gRNA
gcaugcagucaagucaacgc

SEQ ID NO: 41724 - RNA, 20 nt, Artificial Sequence
  MKO10041724_A_Pnoc
  gRNA
gcagcagaacgucacaaaag

SEQ ID NO: 41725 - RNA, 20 nt, Artificial Sequence
  MKO10041725_A_Pnp2
  gRNA
ccggccuugcaucaucacac

SEQ ID NO: 41726 - RNA, 20 nt, Artificial Sequence
  MKO10041726_A_Pnp2
  gRNA
aggucccaacuuugagacug

SEQ ID NO: 41727 - RNA, 20 nt, Artificial Sequence
  MKO10041727_A_Pnp2
  gRNA
agauccugugugaugaugca

SEQ ID NO: 41728 - RNA, 20 nt, Artificial Sequence
  MKO10041728_A_Pnpla1
  gRNA
cucaccucuccccgauacgu

SEQ ID NO: 41729 - RNA, 20 nt, Artificial Sequence
  MKO10041729_A_Pnpla1
  gRNA
cuucauccccccaacguauc

SEQ ID NO: 41730 - RNA, 20 nt, Artificial Sequence
  MKO10041730_A_Pnpla1
  gRNA
gguuuccgaguaccgaucca

SEQ ID NO: 41731 - RNA, 20 nt, Artificial Sequence
  MKO10041731_A_Pnpla2
  gRNA
gauugccaugagcgcgccaa

SEQ ID NO: 41732 - RNA, 20 nt, Artificial Sequence
  MKO10041732_A_Pnpla2
  gRNA
uguuggugacgcgaagcucg

SEQ ID NO: 41733 - RNA, 20 nt, Artificial Sequence
  MKO10041733_A_Pnpla2
  gRNA
aucgagucacgauguucccg

SEQ ID NO: 41734 - RNA, 20 nt, Artificial Sequence
  MKO10041734_A_Pnpla3
  gRNA
gagcgacaacgucccugugc

SEQ ID NO: 41735 - RNA, 20 nt, Artificial Sequence
  MKO10041735_A_Pnpla3
  gRNA
ggugccgauguugcggcucc

SEQ ID NO: 41736 - RNA, 20 nt, Artificial Sequence
  MKO10041736_A_Pnpla3
  gRNA
uacauccacgacuucgucuu

SEQ ID NO: 41737 - RNA, 20 nt, Artificial Sequence
  MKO10041737_A_Pnpla5
  gRNA
acggacccgcugaacacauc

SEQ ID NO: 41738 - RNA, 20 nt, Artificial Sequence
  MKO10041738_A_Pnpla5
  gRNA
guagcugaccauugccgaca

SEQ ID NO: 41739 - RNA, 20 nt, Artificial Sequence
  MKO10041739_A_Pnpla5
  gRNA
gggcguccagguaaccuugu

SEQ ID NO: 41740 - RNA, 20 nt, Artificial Sequence
  MKO10041740_A_Pnpla6
  gRNA
aggguccccgguaucgguuc

SEQ ID NO: 41741 - RNA, 20 nt, Artificial Sequence
  MKO10041741_A_Pnpla6
  gRNA
caggaucuuacguauccaaa

SEQ ID NO: 41742 - RNA, 20 nt, Artificial Sequence
  MKO10041742_A_Pnpla6
  gRNA
aaccgauaccggggacccuc

SEQ ID NO: 41743 - RNA, 20 nt, Artificial Sequence
  MKO10041743_A_Pnpla7
  gRNA
cuccuuacccuagccuucgu

SEQ ID NO: 41744 - RNA, 20 nt, Artificial Sequence
  MKO10041744_A_Pnpla7
  gRNA
uccucaggcuggcuacuguu

SEQ ID NO: 41745 - RNA, 20 nt, Artificial Sequence
  MKO10041745_A_Pnpla7
  gRNA
uaccaacgaaggcuagggua

SEQ ID NO: 41746 - RNA, 20 nt, Artificial Sequence
  MKO10041746_A_Pnpla8
  gRNA
ugucucagccguaauaaaua

SEQ ID NO: 41747 - RNA, 20 nt, Artificial Sequence
  MKO10041747_A_Pnpla8
  gRNA
auccgaauccucaccauuga

SEQ ID NO: 41748 - RNA, 20 nt, Artificial Sequence
  MKO10041748_A_Pnpla8
  gRNA
ggccauauuagcauuuaugc

SEQ ID NO: 41749 - RNA, 20 nt, Artificial Sequence
  MKO10041749_A_Pnpo
  gRNA
ucuucacuaacuacgagagc

SEQ ID NO: 41750 - RNA, 20 nt, Artificial Sequence
  MKO10041750_A_Pnpo
  gRNA
gaccacucaccugacgguuc

SEQ ID NO: 41751 - RNA, 20 nt, Artificial Sequence
  MKO10041751_A_Pnpo
  gRNA
guccuacuuaccucccgguc

SEQ ID NO: 41752 - RNA, 20 nt, Artificial Sequence
  MKO10041752_A_Pnpt1
  gRNA
gccuucccaauucaugccgu

SEQ ID NO: 41753 - RNA, 20 nt, Artificial Sequence
  MKO10041753_A_Pnpt1
  gRNA
gucaggcgauacugcaguaa

SEQ ID NO: 41754 - RNA, 20 nt, Artificial Sequence
  MKO10041754_A_Pnpt1
  gRNA
ucagguggacuaccgacaga

SEQ ID NO: 41755 - RNA, 20 nt, Artificial Sequence
  MKO10041755_A_Pnp
  gRNA
ugaaggauacucacugucaa

SEQ ID NO: 41756 - RNA, 20 nt, Artificial Sequence
  MKO10041756_A_Pnp
  gRNA
aggccccaacuuugagacug

SEQ ID NO: 41757 - RNA, 20 nt, Artificial Sequence
  MKO10041757_A_Pnp
  gRNA
agaugcugugugaugaugca

SEQ ID NO: 41758 - RNA, 20 nt, Artificial Sequence
  MKO10041758_A_Pnrc1
  gRNA
cgcuccuccugcgcgacgau

SEQ ID NO: 41759 - RNA, 20 nt, Artificial Sequence
  MKO10041759_A_Pnrc1
  gRNA
cagacagcccccacucgcga

SEQ ID NO: 41760 - RNA, 20 nt, Artificial Sequence
  MKO10041760_A_Pnrc1
  gRNA
cuccgaucgaaugcagaagc

SEQ ID NO: 41761 - RNA, 20 nt, Artificial Sequence
  MKO10041761_A_Pnrc2
  gRNA
ugauggugguucacuaaauu

SEQ ID NO: 41762 - RNA, 20 nt, Artificial Sequence
  MKO10041762_A_Pnrc2
  gRNA
ucuuaugagcaaucuucguc

SEQ ID NO: 41763 - RNA, 20 nt, Artificial Sequence
  MKO10041763_A_Pnrc2
  gRNA
gccuuucuaacaacuccaac

SEQ ID NO: 41764 - RNA, 20 nt, Artificial Sequence
  MKO10041764_A_Poc1a
  gRNA
gacacgaugagccgcccguc

SEQ ID NO: 41765 - RNA, 20 nt, Artificial Sequence
  MKO10041765_A_Poc1a
  gRNA
gucacgugccuaccgcuuca

SEQ ID NO: 41766 - RNA, 20 nt, Artificial Sequence
  MKO10041766_A_Poc1a
  gRNA
cgccgugcucacaguaugag

SEQ ID NO: 41767 - RNA, 20 nt, Artificial Sequence
  MKO10041767_A_Poc1b
  gRNA
gacacgaucaaccuuccguc

SEQ ID NO: 41768 - RNA, 20 nt, Artificial Sequence
  MKO10041768_A_Poc1b
  gRNA
auccuaggaggauccgauuc

SEQ ID NO: 41769 - RNA, 20 nt, Artificial Sequence
  MKO10041769_A_Poc1b
  gRNA
cgcuagagcuuacagauacg

SEQ ID NO: 41770 - RNA, 20 nt, Artificial Sequence
  MKO10041770_A_Poc5
  gRNA
gauagauucccuacgcuagc

SEQ ID NO: 41771 - RNA, 20 nt, Artificial Sequence
  MKO10041771_A_Poc5
  gRNA
cuuuaucgacuggcaccgaa

SEQ ID NO: 41772 - RNA, 20 nt, Artificial Sequence
  MKO10041772_A_Poc5
  gRNA
gaccucauccuuucucccga

SEQ ID NO: 41773 - RNA, 20 nt, Artificial Sequence
  MKO10041773_A_Podnl1
  gRNA
cagccagaucggcgacacgc

SEQ ID NO: 41774 - RNA, 20 nt, Artificial Sequence
  MKO10041774_A_Podnl1
  gRNA
cucccugcgugucgccgauc

SEQ ID NO: 41775 - RNA, 20 nt, Artificial Sequence
  MKO10041775_A_Podnl1
  gRNA
ccagggugcgcaagccgcug

SEQ ID NO: 41776 - RNA, 20 nt, Artificial Sequence
  MKO10041776_A_Podn
  gRNA
aacaaccgccugacaucccg

SEQ ID NO: 41777 - RNA, 20 nt, Artificial Sequence
  MKO10041777_A_Podn
  gRNA
cgggguagaucuucuccagc

SEQ ID NO: 41778 - RNA, 20 nt, Artificial Sequence
  MKO10041778_A_Podn
  gRNA
gccaaacgcccugaucagug

SEQ ID NO: 41779 - RNA, 20 nt, Artificial Sequence
  MKO10041779_A_Podxl2
  gRNA
guacugccacgccaccgcag

SEQ ID NO: 41780 - RNA, 20 nt, Artificial Sequence
  MKO10041780_A_Podxl2
  gRNA
ugauguagcucuucccggcc

SEQ ID NO: 41781 - RNA, 20 nt, Artificial Sequence
  MKO10041781_A_Podxl2
  gRNA
cuuaccugaguagaguccca

SEQ ID NO: 41782 - RNA, 20 nt, Artificial Sequence
  MKO10041782_A_Podxl
  gRNA
gccaccgcuuugauugcucg

SEQ ID NO: 41783 - RNA, 20 nt, Artificial Sequence
  MKO10041783_A_Podxl
  gRNA
ggcuguuuguccacugcuac

SEQ ID NO: 41784 - RNA, 20 nt, Artificial Sequence
  MKO10041784_A_Podxl
  gRNA
cgccauagacuguugcagug

SEQ ID NO: 41785 - RNA, 20 nt, Artificial Sequence
  MKO10041785_A_Pof1b
  gRNA
gucuuaccuguucguguauu

SEQ ID NO: 41786 - RNA, 20 nt, Artificial Sequence
  MKO10041786_A_Pof1b
  gRNA
cauauccacaaaccaccauu

SEQ ID NO: 41787 - RNA, 20 nt, Artificial Sequence
  MKO10041787_A_Pof1b
  gRNA
gccaagccaaauacacgaac

SEQ ID NO: 41788 - RNA, 20 nt, Artificial Sequence
  MKO10041788_A_Pofuu1
  gRNA
ugaucagugcccaccucguc

SEQ ID NO: 41789 - RNA, 20 nt, Artificial Sequence
  MKO10041789_A_Pofuu1
  gRNA
ugacaacccgaugguaggcu

SEQ ID NO: 41790 - RNA, 20 nt, Artificial Sequence
  MKO10041790_A_Pofuu1
  gRNA
gcgcagaugaaugcccacau

SEQ ID NO: 41791 - RNA, 20 nt, Artificial Sequence
  MKO10041791_A_Pofuu2
  gRNA
cguccuacaagguuacgccg

SEQ ID NO: 41792 - RNA, 20 nt, Artificial Sequence
  MKO10041792_A_Pofuu2
  gRNA
cggcgggcccuuuaucgacc

SEQ ID NO: 41793 - RNA, 20 nt, Artificial Sequence
  MKO10041793_A_Pofuu2
  gRNA
cgacgauggaagccgacccc

SEQ ID NO: 41794 - RNA, 20 nt, Artificial Sequence
  MKO10041794_A_Pogk
  gRNA
gccucggaaugcccgccgca

SEQ ID NO: 41795 - RNA, 20 nt, Artificial Sequence
  MKO10041795_A_Pogk
  gRNA
uccaaccgauugaucauauc

SEQ ID NO: 41796 - RNA, 20 nt, Artificial Sequence
  MKO10041796_A_Pogk
  gRNA
gagauccgcugccaccgcua

SEQ ID NO: 41797 - RNA, 20 nt, Artificial Sequence
  MKO10041797_A_Pogluu1
  gRNA
ccuucccaaaauguccacgc

SEQ ID NO: 41798 - RNA, 20 nt, Artificial Sequence
  MKO10041798_A_Pogluu1
  gRNA
ggcuaacagguguaguggcg

SEQ ID NO: 41799 - RNA, 20 nt, Artificial Sequence
  MKO10041799_A_Pogluu1
  gRNA
ucccaccguccaagaccugu

SEQ ID NO: 41800 - RNA, 20 nt, Artificial Sequence
  MKO10041800_A_Pogz
  gRNA
ggcggacaccgaccuguuua

SEQ ID NO: 41801 - RNA, 20 nt, Artificial Sequence
  MKO10041801_A_Pogz
  gRNA
accuggacaggucucaauac

SEQ ID NO: 41802 - RNA, 20 nt, Artificial Sequence
  MKO10041802_A_Pogz
  gRNA
aggggagcuagucacaugau

SEQ ID NO: 41803 - RNA, 20 nt, Artificial Sequence
  MKO10041803_A_Pola1
  gRNA
ugaagagcaguauucgaaac

SEQ ID NO: 41804 - RNA, 20 nt, Artificial Sequence
  MKO10041804_A_Pola1
  gRNA
aggcccgucaggaugaugac

SEQ ID NO: 41805 - RNA, 20 nt, Artificial Sequence
  MKO10041805_A_Pola1
  gRNA
caauguucauugcuagugcc

SEQ ID NO: 41806 - RNA, 20 nt, Artificial Sequence
  MKO10041806_A_Pola2
  gRNA
ggaacuacagaucuucggcc

SEQ ID NO: 41807 - RNA, 20 nt, Artificial Sequence
  MKO10041807_A_Pola2
  gRNA
aaggcaugucuuccccgcac

SEQ ID NO: 41808 - RNA, 20 nt, Artificial Sequence
  MKO10041808_A_Pola2
  gRNA
uguucuauaccgacagacug

SEQ ID NO: 41809 - RNA, 20 nt, Artificial Sequence
  MKO10041809_A_Polb
  gRNA
uccacaaguacaaugcguac

SEQ ID NO: 41810 - RNA, 20 nt, Artificial Sequence
  MKO10041810_A_Polb
  gRNA
caaugccaguaacucgaguc

SEQ ID NO: 41811 - RNA, 20 nt, Artificial Sequence
  MKO10041811_A_Polb
  gRNA
accuguacgcauuguacuug

SEQ ID NO: 41812 - RNA, 20 nt, Artificial Sequence
  MKO10041812_A_Pold1
  gRNA
cgcacccuacgaagccaacg

SEQ ID NO: 41813 - RNA, 20 nt, Artificial Sequence
  MKO10041813_A_Pold1
  gRNA
cuucguagggugcgaagcuc

SEQ ID NO: 41814 - RNA, 20 nt, Artificial Sequence
  MKO10041814_A_Pold1
  gRNA
gcggcccacccuacgugccc

SEQ ID NO: 41815 - RNA, 20 nt, Artificial Sequence
  MKO10041815_A_Pold2
  gRNA
uauccacccggaugacgagc

SEQ ID NO: 41816 - RNA, 20 nt, Artificial Sequence
  MKO10041816_A_Pold2
  gRNA
ucuaagaccagcucgucauc

SEQ ID NO: 41817 - RNA, 20 nt, Artificial Sequence
  MKO10041817_A_Pold2
  gRNA
gucucucgagucauccucgc

SEQ ID NO: 41818 - RNA, 20 nt, Artificial Sequence
  MKO10041818_A_Pold3
  gRNA
uguuucaggugacuuacaag

SEQ ID NO: 41819 - RNA, 20 nt, Artificial Sequence
  MKO10041819_A_Pold3
  gRNA
uguccuuuagcauagcuuuc

SEQ ID NO: 41820 - RNA, 20 nt, Artificial Sequence
  MKO10041820_A_Pold3
  gRNA
ucuggcagucuuauacagaa

SEQ ID NO: 41821 - RNA, 20 nt, Artificial Sequence
  MKO10041821_A_Pold4
  gRNA
gaugaaccgcuuccgaccca

SEQ ID NO: 41822 - RNA, 20 nt, Artificial Sequence
  MKO10041822_A_Pold4
  gRNA
uguacaaggcccauacugcc

SEQ ID NO: 41823 - RNA, 20 nt, Artificial Sequence
  MKO10041823_A_Pold4
  gRNA
uggccgccaugggucggaag

SEQ ID NO: 41824 - RNA, 20 nt, Artificial Sequence
  MKO10041824_A_Poldip2
  gRNA
cgggcgcucuaugcuauccc

SEQ ID NO: 41825 - RNA, 20 nt, Artificial Sequence
  MKO10041825_A_Poldip2
  gRNA
cugggauagcauagagcgcc

SEQ ID NO: 41826 - RNA, 20 nt, Artificial Sequence
  MKO10041826_A_Poldip2
  gRNA
cccacucaggaaccgugcag

SEQ ID NO: 41827 - RNA, 20 nt, Artificial Sequence
  MKO10041827_A_Poldip3
  gRNA
gcgggcuugugaacgcagca

SEQ ID NO: 41828 - RNA, 20 nt, Artificial Sequence
  MKO10041828_A_Poldip3
  gRNA
ggagguguccggucucgagu

SEQ ID NO: 41829 - RNA, 20 nt, Artificial Sequence
  MKO10041829_A_Poldip3
  gRNA
caaggcuuugguucgaacag

SEQ ID NO: 41830 - RNA, 20 nt, Artificial Sequence
  MKO10041830_A_Pole2
  gRNA
caugaucgaacgaucugucg

SEQ ID NO: 41831 - RNA, 20 nt, Artificial Sequence
  MKO10041831_A_Pole2
  gRNA
agaucguucgaucauguucg

SEQ ID NO: 41832 - RNA, 20 nt, Artificial Sequence
  MKO10041832_A_Pole2
  gRNA
caugcugcaccaaccuuauu

SEQ ID NO: 41833 - RNA, 20 nt, Artificial Sequence
  MKO10041833_A_Pole3
  gRNA
uuggagauguugacaccguc

SEQ ID NO: 41834 - RNA, 20 nt, Artificial Sequence
  MKO10041834_A_Pole3
  gRNA
cggcgcgggagauggcgcuu

SEQ ID NO: 41835 - RNA, 20 nt, Artificial Sequence
  MKO10041835_A_Pole3
  gRNA
ugcccaacgccgucaucacc

SEQ ID NO: 41836 - RNA, 20 nt, Artificial Sequence
  MKO10041836_A_Pole4
  gRNA
ugucccgccagcguuacguc

SEQ ID NO: 41837 - RNA, 20 nt, Artificial Sequence
  MKO10041837_A_Pole4
  gRNA
gucgcaccgcggcacgcgcc

SEQ ID NO: 41838 - RNA, 20 nt, Artificial Sequence
  MKO10041838_A_Pole4
  gRNA
uuuguugcaggaacuguucg

SEQ ID NO: 41839 - RNA, 20 nt, Artificial Sequence
  MKO10041839_A_Pole
  gRNA
acuuacgguuugguuucgaa

SEQ ID NO: 41840 - RNA, 20 nt, Artificial Sequence
  MKO10041840_A_Pole
  gRNA
agacaaacgcuuagucagcg

SEQ ID NO: 41841 - RNA, 20 nt, Artificial Sequence
  MKO10041841_A_Pole
  gRNA
cucgcugcaauguagaaaua

SEQ ID NO: 41842 - RNA, 20 nt, Artificial Sequence
  MKO10041842_A_Polg2
  gRNA
cuucuaugaagggucgagau

SEQ ID NO: 41843 - RNA, 20 nt, Artificial Sequence
  MKO10041843_A_Polg2
  gRNA
gucugauugcuguucgaaac

SEQ ID NO: 41844 - RNA, 20 nt, Artificial Sequence
  MKO10041844_A_Polg2
  gRNA
ggacguagaccugggcacgc

SEQ ID NO: 41845 - RNA, 20 nt, Artificial Sequence
  MKO10041845_A_Polg
  gRNA
uuaggucagccggcgauagc

SEQ ID NO: 41846 - RNA, 20 nt, Artificial Sequence
  MKO10041846_A_Polg
  gRNA
gccggcugaccuaaucccuu

SEQ ID NO: 41847 - RNA, 20 nt, Artificial Sequence
  MKO10041847_A_Polg
  gRNA
agggagguccccccacauaa

SEQ ID NO: 41848 - RNA, 20 nt, Artificial Sequence
  MKO10041848_A_Polh
  gRNA
uauauaagccucaucgaugc

SEQ ID NO: 41849 - RNA, 20 nt, Artificial Sequence
  MKO10041849_A_Polh
  gRNA
agcuaugaagcccgagcauu

SEQ ID NO: 41850 - RNA, 20 nt, Artificial Sequence
  MKO10041850_A_Polh
  gRNA
gcacugacccaugugagacc

SEQ ID NO: 41851 - RNA, 20 nt, Artificial Sequence
  MKO10041851_A_Poli
  gRNA
gagcccgagcugauuauaca

SEQ ID NO: 41852 - RNA, 20 nt, Artificial Sequence
  MKO10041852_A_Poli
  gRNA
ccucagcugguccucgugaa

SEQ ID NO: 41853 - RNA, 20 nt, Artificial Sequence
  MKO10041853_A_Poli
  gRNA
uaugaaugugagagaugcga

SEQ ID NO: 41854 - RNA, 20 nt, Artificial Sequence
  MKO10041854_A_Polk
  gRNA
aaauuaccagccagcaacua

SEQ ID NO: 41855 - RNA, 20 nt, Artificial Sequence
  MKO10041855_A_Polk
  gRNA
agccucuuagcaauaaaucc

SEQ ID NO: 41856 - RNA, 20 nt, Artificial Sequence
  MKO10041856_A_Polk
  gRNA
gguguccgugcagccaugcc

SEQ ID NO: 41857 - RNA, 20 nt, Artificial Sequence
  MKO10041857_A_Poll
  gRNA
gccauccgcuugccaauucc

SEQ ID NO: 41858 - RNA, 20 nt, Artificial Sequence
  MKO10041858_A_Poll
  gRNA
agagcccacauuaugcccgc

SEQ ID NO: 41859 - RNA, 20 nt, Artificial Sequence
  MKO10041859_A_Poll
  gRNA
ugguccuggguaaaucccgc

SEQ ID NO: 41860 - RNA, 20 nt, Artificial Sequence
  MKO10041860_A_Polm
  gRNA
cuugagcaccgaggccgcuc

SEQ ID NO: 41861 - RNA, 20 nt, Artificial Sequence
  MKO10041861_A_Polm
  gRNA
agcgggcuucgaagccaacg

SEQ ID NO: 41862 - RNA, 20 nt, Artificial Sequence
  MKO10041862_A_Polm
  gRNA
gcuggcaucgacgcugagac

SEQ ID NO: 41863 - RNA, 20 nt, Artificial Sequence
  MKO10041863_A_Poln
  gRNA
uuccacacagcugagcgcca

SEQ ID NO: 41864 - RNA, 20 nt, Artificial Sequence
  MKO10041864_A_Poln
  gRNA
gcugugugauguuagauauu

SEQ ID NO: 41865 - RNA, 20 nt, Artificial Sequence
  MKO10041865_A_Poln
  gRNA
cucaguauuagcugaacaug

SEQ ID NO: 41866 - RNA, 20 nt, Artificial Sequence
  MKO10041866_A_Polq
  gRNA
aaacggcggcguucaucguc

SEQ ID NO: 41867 - RNA, 20 nt, Artificial Sequence
  MKO10041867_A_Polq
  gRNA
aacgccgccguuuccuacuc

SEQ ID NO: 41868 - RNA, 20 nt, Artificial Sequence
  MKO10041868_A_Polq
  gRNA
gcuggucaaucgccucauug

SEQ ID NO: 41869 - RNA, 20 nt, Artificial Sequence
  MKO10041869_A_Polr1a
  gRNA
cauuacaaauccucgauacg

SEQ ID NO: 41870 - RNA, 20 nt, Artificial Sequence
  MKO10041870_A_Polr1a
  gRNA
cccagguaguccacguaucg

SEQ ID NO: 41871 - RNA, 20 nt, Artificial Sequence
  MKO10041871_A_Polr1a
  gRNA
aacagguaaauugcagcccg

SEQ ID NO: 41872 - RNA, 20 nt, Artificial Sequence
  MKO10041872_A_Polr1b
  gRNA
gcgcauaucucuuaccauug

SEQ ID NO: 41873 - RNA, 20 nt, Artificial Sequence
  MKO10041873_A_Polr1b
  gRNA
ugcucaaugaggacucgagg

SEQ ID NO: 41874 - RNA, 20 nt, Artificial Sequence
  MKO10041874_A_Polr1b
  gRNA
gaacaugaaccugcacuaug

SEQ ID NO: 41875 - RNA, 20 nt, Artificial Sequence
  MKO10041875_A_Polr1c
  gRNA
guaguuaccgggaaaguccg

SEQ ID NO: 41876 - RNA, 20 nt, Artificial Sequence
  MKO10041876_A_Polr1c
  gRNA
ucuccggaaagcauuggcga

SEQ ID NO: 41877 - RNA, 20 nt, Artificial Sequence
  MKO10041877_A_Polr1c
  gRNA
cugccaucgccaaugcuuuc

SEQ ID NO: 41878 - RNA, 20 nt, Artificial Sequence
  MKO10041878_A_Polr1d
  gRNA
ugugacauuuguccugcacg

SEQ ID NO: 41879 - RNA, 20 nt, Artificial Sequence
  MKO10041879_A_Polr1d
  gRNA
ugcacgagggacuagaaugu

SEQ ID NO: 41880 - RNA, 20 nt, Artificial Sequence
  MKO10041880_A_Polr1d
  gRNA
ucccaacaggaaagccauag

SEQ ID NO: 41881 - RNA, 20 nt, Artificial Sequence
  MKO10041881_A_Polr1e
  gRNA
cccaaaauuguuuccgacau

SEQ ID NO: 41882 - RNA, 20 nt, Artificial Sequence
  MKO10041882_A_Polr1e
  gRNA
cggcaucauagacuuccauc

SEQ ID NO: 41883 - RNA, 20 nt, Artificial Sequence
  MKO10041883_A_Polr1e
  gRNA
uaagucggugcuguuguaca

SEQ ID NO: 41884 - RNA, 20 nt, Artificial Sequence
  MKO10041884_A_Polr2a
  gRNA
caaccccgaauccggcgcuc

SEQ ID NO: 41885 - RNA, 20 nt, Artificial Sequence
  MKO10041885_A_Polr2a
  gRNA
gcauggagccucgcuaugcc

SEQ ID NO: 41886 - RNA, 20 nt, Artificial Sequence
  MKO10041886_A_Polr2a
  gRNA
acaugcguaagccguuucuu

SEQ ID NO: 41887 - RNA, 20 nt, Artificial Sequence
  MKO10041887_A_Polr2b
  gRNA
cgugcugagcuucggccugu

SEQ ID NO: 41888 - RNA, 20 nt, Artificial Sequence
  MKO10041888_A_Polr2b
  gRNA
uagguggagcgcagcauaau

SEQ ID NO: 41889 - RNA, 20 nt, Artificial Sequence
  MKO10041889_A_Polr2b
  gRNA
uuuguuaugucaacguaaag

SEQ ID NO: 41890 - RNA, 20 nt, Artificial Sequence
  MKO10041890_A_Polr2c
  gRNA
aucgcagaggugcccauaau

SEQ ID NO: 41891 - RNA, 20 nt, Artificial Sequence
  MKO10041891_A_Polr2c
  gRNA
agacacuaaccggaauaacc

SEQ ID NO: 41892 - RNA, 20 nt, Artificial Sequence
  MKO10041892_A_Polr2c
  gRNA
guaggguggccaauuccauu

SEQ ID NO: 41893 - RNA, 20 nt, Artificial Sequence
  MKO10041893_A_Polr2d
  gRNA
uaguacucaccugcgcacac

SEQ ID NO: 41894 - RNA, 20 nt, Artificial Sequence
  MKO10041894_A_Polr2d
  gRNA
ccuaaaguaauggcggcggg

SEQ ID NO: 41895 - RNA, 20 nt, Artificial Sequence
  MKO10041895_A_Polr2d
  gRNA
ugaagcgggccguguaguug

SEQ ID NO: 41896 - RNA, 20 nt, Artificial Sequence
  MKO10041896_A_Polr2e
  gRNA
caucacacgggcgcugauug

SEQ ID NO: 41897 - RNA, 20 nt, Artificial Sequence
  MKO10041897_A_Polr2e
  gRNA
gcgccuuggccguccuucgc

SEQ ID NO: 41898 - RNA, 20 nt, Artificial Sequence
  MKO10041898_A_Polr2e
  gRNA
aucccaaaguaccgugccac

SEQ ID NO: 41899 - RNA, 20 nt, Artificial Sequence
  MKO10041899_A_Polr2f
  gRNA
cuuacgcgaucugaagagcc

SEQ ID NO: 41900 - RNA, 20 nt, Artificial Sequence
  MKO10041900_A_Polr2f
  gRNA
ggacgaaggacuugacgacu

SEQ ID NO: 41901 - RNA, 20 nt, Artificial Sequence
  MKO10041901_A_Polr2f
  gRNA
cagguaccggcgaaugauga

SEQ ID NO: 41902 - RNA, 20 nt, Artificial Sequence
  MKO10041902_A_Polr2g
  gRNA
gucaccaccaucgacaauau

SEQ ID NO: 41903 - RNA, 20 nt, Artificial Sequence
  MKO10041903_A_Polr2g
  gRNA
cgaaguaucgugggugcagg

SEQ ID NO: 41904 - RNA, 20 nt, Artificial Sequence
  MKO10041904_A_Polr2g
  gRNA
ccccccuugcuauaagacca

SEQ ID NO: 41905 - RNA, 20 nt, Artificial Sequence
  MKO10041905_A_Polr2h
  gRNA
agcucugcguacguguccua

SEQ ID NO: 41906 - RNA, 20 nt, Artificial Sequence
  MKO10041906_A_Polr2h
  gRNA
caauacuuaccuaaguccac

SEQ ID NO: 41907 - RNA, 20 nt, Artificial Sequence
  MKO10041907_A_Polr2h
  gRNA
aaguacuagcuauaaccaac

SEQ ID NO: 41908 - RNA, 20 nt, Artificial Sequence
  MKO10041908_A_Polr2i
  gRNA
guccuccguccggggcaacg

SEQ ID NO: 41909 - RNA, 20 nt, Artificial Sequence
  MKO10041909_A_Polr2i
  gRNA
ccggaauugcgauuaccagc

SEQ ID NO: 41910 - RNA, 20 nt, Artificial Sequence
  MKO10041910_A_Polr2i
  gRNA
ccccacguugccccggacgg

SEQ ID NO: 41911 - RNA, 20 nt, Artificial Sequence
  MKO10041911_A_Polr2j
  gRNA
cgcuaggaugaacgcuccuc

SEQ ID NO: 41912 - RNA, 20 nt, Artificial Sequence
  MKO10041912_A_Polr2j
  gRNA
cgagucguucuugcucuucg

SEQ ID NO: 41913 - RNA, 20 nt, Artificial Sequence
  MKO10041913_A_Polr2j
  gRNA
cccggaaucgcuccuccaga

SEQ ID NO: 41914 - RNA, 20 nt, Artificial Sequence
  MKO10041914_A_Polr2k
  gRNA
ucugcuuccaagcgcucaaa

SEQ ID NO: 41915 - RNA, 20 nt, Artificial Sequence
  MKO10041915_A_Polr2k
  gRNA
acuuggcuuuaaaaucuuug

SEQ ID NO: 41916 - RNA, 20 nt, Artificial Sequence
  MKO10041916_A_Polr2k
  gRNA
ccuccacaaauauauaucau

SEQ ID NO: 41917 - RNA, 20 nt, Artificial Sequence
  MKO10041917_A_Polr2l
  gRNA
gucucaccccuccguguacu

SEQ ID NO: 41918 - RNA, 20 nt, Artificial Sequence
  MKO10041918_A_Polr2l
  gRNA
cagggaugcccuggacgcuc

SEQ ID NO: 41919 - RNA, 20 nt, Artificial Sequence
  MKO10041919_A_Polr2l
  gRNA
agacgccgccaugaucaucc

SEQ ID NO: 41920 - RNA, 20 nt, Artificial Sequence
  MKO10041920_A_Polr2m
  gRNA
cguugcgcaaaagucucucc

SEQ ID NO: 41921 - RNA, 20 nt, Artificial Sequence
  MKO10041921_A_Polr2m
  gRNA
gcuuuccauagaagagucgc

SEQ ID NO: 41922 - RNA, 20 nt, Artificial Sequence
  MKO10041922_A_Polr2m
  gRNA
augcuccuuaacuucggaug

SEQ ID NO: 41923 - RNA, 20 nt, Artificial Sequence
  MKO10041923_A_Polr3a
  gRNA
aaccacgcccccuuguugua

SEQ ID NO: 41924 - RNA, 20 nt, Artificial Sequence
  MKO10041924_A_Polr3a
  gRNA
cucgcuucugcagguagguu

SEQ ID NO: 41925 - RNA, 20 nt, Artificial Sequence
  MKO10041925_A_Polr3a
  gRNA
cuaaccuaccugcagaagcg

SEQ ID NO: 41926 - RNA, 20 nt, Artificial Sequence
  MKO10041926_A_Polr3b
  gRNA
caagugaugcugaccccaug

SEQ ID NO: 41927 - RNA, 20 nt, Artificial Sequence
  MKO10041927_A_Polr3b
  gRNA
uugaagcuuucuucaacauc

SEQ ID NO: 41928 - RNA, 20 nt, Artificial Sequence
  MKO10041928_A_Polr3b
  gRNA
agucuaugugcuguuucacc

SEQ ID NO: 41929 - RNA, 20 nt, Artificial Sequence
  MKO10041929_A_Polr3c
  gRNA
ccacugcgcucacgauugcu

SEQ ID NO: 41930 - RNA, 20 nt, Artificial Sequence
  MKO10041930_A_Polr3c
  gRNA
ccaagcaaucgugagcgcag

SEQ ID NO: 41931 - RNA, 20 nt, Artificial Sequence
  MKO10041931_A_Polr3c
  gRNA
aucaaaugcauuugugcgac

SEQ ID NO: 41932 - RNA, 20 nt, Artificial Sequence
  MKO10041932_A_Polr3d
  gRNA
guggacgugccugccgucaa

SEQ ID NO: 41933 - RNA, 20 nt, Artificial Sequence
  MKO10041933_A_Polr3d
  gRNA
uuggcaguucaucgaugacc

SEQ ID NO: 41934 - RNA, 20 nt, Artificial Sequence
  MKO10041934_A_Polr3d
  gRNA
gucccauucuaucuucgagc

SEQ ID NO: 41935 - RNA, 20 nt, Artificial Sequence
  MKO10041935_A_Polr3e
  gRNA
ggagcagaucgcacugaacg

SEQ ID NO: 41936 - RNA, 20 nt, Artificial Sequence
  MKO10041936_A_Polr3e
  gRNA
guuaugccgcugcacucuac

SEQ ID NO: 41937 - RNA, 20 nt, Artificial Sequence
  MKO10041937_A_Polr3e
  gRNA
ugugcuagucucgucagcac

SEQ ID NO: 41938 - RNA, 20 nt, Artificial Sequence
  MKO10041938_A_Polr3f
  gRNA
guccgauaaccaggaaaaac

SEQ ID NO: 41939 - RNA, 20 nt, Artificial Sequence
  MKO10041939_A_Polr3f
  gRNA
cauggauaacagucuauuga

SEQ ID NO: 41940 - RNA, 20 nt, Artificial Sequence
  MKO10041940_A_Polr3f
  gRNA
caucaauagacuguuaucca

SEQ ID NO: 41941 - RNA, 20 nt, Artificial Sequence
  MKO10041941_A_Polr3gl
  gRNA
cuauugacaacgccaucgau

SEQ ID NO: 41942 - RNA, 20 nt, Artificial Sequence
  MKO10041942_A_Polr3gl
  gRNA
cuuaccaggguuccaaucga

SEQ ID NO: 41943 - RNA, 20 nt, Artificial Sequence
  MKO10041943_A_Polr3gl
  gRNA
gugagcucaagauucgagug

SEQ ID NO: 41944 - RNA, 20 nt, Artificial Sequence
  MKO10041944_A_Polr3g
  gRNA
agauguguugaaaacgauug

SEQ ID NO: 41945 - RNA, 20 nt, Artificial Sequence
  MKO10041945_A_Polr3g
  gRNA
auaggauacagacuacaagc

SEQ ID NO: 41946 - RNA, 20 nt, Artificial Sequence
  MKO10041946_A_Polr3g
  gRNA
gaaccacccgaagaaaaaca

SEQ ID NO: 41947 - RNA, 20 nt, Artificial Sequence
  MKO10041947_A_Polr3h
  gRNA
ugcacaggucguauacaacg

SEQ ID NO: 41948 - RNA, 20 nt, Artificial Sequence
  MKO10041948_A_Polr3h
  gRNA
cgaggcugccucuucaagcg

SEQ ID NO: 41949 - RNA, 20 nt, Artificial Sequence
  MKO10041949_A_Polr3h
  gRNA
ucuaguccauuuccgcuacg

SEQ ID NO: 41950 - RNA, 20 nt, Artificial Sequence
  MKO10041950_A_Polr3k
  gRNA
cguccauaauaucacccgua

SEQ ID NO: 41951 - RNA, 20 nt, Artificial Sequence
  MKO10041951_A_Polr3k
  gRNA
cugcgggaacggacucauug

SEQ ID NO: 41952 - RNA, 20 nt, Artificial Sequence
  MKO10041952_A_Polr3k
  gRNA
gagaauguggacucuacugc

SEQ ID NO: 41953 - RNA, 20 nt, Artificial Sequence
  MKO10041953_A_Polrmt
  gRNA
auguacaacaccgugaugcu

SEQ ID NO: 41954 - RNA, 20 nt, Artificial Sequence
  MKO10041954_A_Polrmt
  gRNA
auauauguccuugagcagcg

SEQ ID NO: 41955 - RNA, 20 nt, Artificial Sequence
  MKO10041955_A_Polrmt
  gRNA
aggauguucgcaccauccag

SEQ ID NO: 41956 - RNA, 20 nt, Artificial Sequence
  MKO10041956_A_Pom121l12
  gRNA
cuugggcccagggggucgac

SEQ ID NO: 41957 - RNA, 20 nt, Artificial Sequence
  MKO10041957_A_Pom121l12
  gRNA
gacgauuugauggaccucug

SEQ ID NO: 41958 - RNA, 20 nt, Artificial Sequence
  MKO10041958_A_Pom121l12
  gRNA
ugugaccccugucgaccccc

SEQ ID NO: 41959 - RNA, 20 nt, Artificial Sequence
  MKO10041959_A_Pom121l2
  gRNA
cugcgagccgccgacccgcu

SEQ ID NO: 41960 - RNA, 20 nt, Artificial Sequence
  MKO10041960_A_Pom121l2
  gRNA
ccucacugacgaaagcggua

SEQ ID NO: 41961 - RNA, 12 nt, Artificial Sequence
  MKO10041961_A_Pom121l2
  gRNA
aaagugucuguc

SEQ ID NO: 41962 - RNA, 20 nt, Artificial Sequence
  MKO10041962_A_Pom121
  gRNA
gcugaaugggauaucgucuu

SEQ ID NO: 41963 - RNA, 20 nt, Artificial Sequence
  MKO10041963_A_Pom121
  gRNA
ugcgagaccguuuguucaag

SEQ ID NO: 41964 - RNA, 20 nt, Artificial Sequence
  MKO10041964_A_Pom121
  gRNA
uucagcauucgagccccuug

SEQ ID NO: 41965 - RNA, 20 nt, Artificial Sequence
  MKO10041965_A_Pomc
  gRNA
acgucaugggucacuuccgc

SEQ ID NO: 41966 - RNA, 20 nt, Artificial Sequence
  MKO10041966_A_Pomc
  gRNA
uugcaaacucgaccucucgc

SEQ ID NO: 41967 - RNA, 20 nt, Artificial Sequence
  MKO10041967_A_Pomc
  gRNA
gagcgacuguagcagaaucu

SEQ ID NO: 41968 - RNA, 20 nt, Artificial Sequence
  MKO10041968_A_Pomgnt1
  gRNA
cuuccacauccagcacccgu

SEQ ID NO: 41969 - RNA, 20 nt, Artificial Sequence
  MKO10041969_A_Pomgnt1
  gRNA
ggacugcugccucugcgccg

SEQ ID NO: 41970 - RNA, 20 nt, Artificial Sequence
  MKO10041970_A_Pomgnt1
  gRNA
ugauugcucuccgagugucc

SEQ ID NO: 41971 - RNA, 20 nt, Artificial Sequence
  MKO10041971_A_Pomgnt2
  gRNA
cuacacccccuauaagacgc

SEQ ID NO: 41972 - RNA, 20 nt, Artificial Sequence
  MKO10041972_A_Pomgnt2
  gRNA
acugaagaucgacuacccga

SEQ ID NO: 41973 - RNA, 20 nt, Artificial Sequence
  MKO10041973_A_Pomgnt2
  gRNA
guucaaccacgguagccccg

SEQ ID NO: 41974 - RNA, 20 nt, Artificial Sequence
  MKO10041974_A_Pomk
  gRNA
cgccccauucugaaguagcc

SEQ ID NO: 41975 - RNA, 20 nt, Artificial Sequence
  MKO10041975_A_Pomk
  gRNA
cucaccgaauaucaccccuu

SEQ ID NO: 41976 - RNA, 20 nt, Artificial Sequence
  MKO10041976_A_Pomk
  gRNA
aggacagcgccuagaguccg

SEQ ID NO: 41977 - RNA, 20 nt, Artificial Sequence
  MKO10041977_A_Pomp
  gRNA
agaagaucgugacucucgaa

SEQ ID NO: 41978 - RNA, 20 nt, Artificial Sequence
  MKO10041978_A_Pomp
  gRNA
cuggcugagagcuccgcgac

SEQ ID NO: 41979 - RNA, 20 nt, Artificial Sequence
  MKO10041979_A_Pomp
  gRNA
ucaucuuguccugguugagc

SEQ ID NO: 41980 - RNA, 20 nt, Artificial Sequence
  MKO10041980_A_Pomt1
  gRNA
ugggacuacuuacccgacua

SEQ ID NO: 41981 - RNA, 20 nt, Artificial Sequence
  MKO10041981_A_Pomt1
  gRNA
gccgcccugcugaugcucau

SEQ ID NO: 41982 - RNA, 20 nt, Artificial Sequence
  MKO10041982_A_Pomt1
  gRNA
aagcgcuggcagcaggcgua

SEQ ID NO: 41983 - RNA, 20 nt, Artificial Sequence
  MKO10041983_A_Pomt2
  gRNA
agguaccaucauacccgcuc

SEQ ID NO: 41984 - RNA, 20 nt, Artificial Sequence
  MKO10041984_A_Pomt2
  gRNA
cuuugccuaccucaccguac

SEQ ID NO: 41985 - RNA, 20 nt, Artificial Sequence
  MKO10041985_A_Pomt2
  gRNA
aguacaacuccugugcuaac

SEQ ID NO: 41986 - RNA, 20 nt, Artificial Sequence
  MKO10041986_A_Pon1
  gRNA
aguuucgaucccaguaagcc

SEQ ID NO: 41987 - RNA, 20 nt, Artificial Sequence
  MKO10041987_A_Pon1
  gRNA
guucuacuggcguuacuuca

SEQ ID NO: 41988 - RNA, 20 nt, Artificial Sequence
  MKO10041988_A_Pon1
  gRNA
uucaaggggcuaaaguaucc

SEQ ID NO: 41989 - RNA, 20 nt, Artificial Sequence
  MKO10041989_A_Pon2
  gRNA
agcuuugcaccggauaagcc

SEQ ID NO: 41990 - RNA, 20 nt, Artificial Sequence
  MKO10041990_A_Pon2
  gRNA
aucucaaagacgagagaccg

SEQ ID NO: 41991 - RNA, 20 nt, Artificial Sequence
  MKO10041991_A_Pon2
  gRNA
acauaccgauuccuuuaaug

SEQ ID NO: 41992 - RNA, 20 nt, Artificial Sequence
  MKO10041992_A_Pon3
  gRNA
gcguuugcaccggacaaacc

SEQ ID NO: 41993 - RNA, 20 nt, Artificial Sequence
  MKO10041993_A_Pon3
  gRNA
acuuaccgaggcccucaauc

SEQ ID NO: 41994 - RNA, 20 nt, Artificial Sequence
  MKO10041994_A_Pon3
  gRNA
auuuccagugcuugcgccuc

SEQ ID NO: 41995 - RNA, 20 nt, Artificial Sequence
  MKO10041995_A_Pop1
  gRNA
cucacaucuggcacgccaaa

SEQ ID NO: 41996 - RNA, 20 nt, Artificial Sequence
  MKO10041996_A_Pop1
  gRNA
gccaucuccugcaaccgucu

SEQ ID NO: 41997 - RNA, 20 nt, Artificial Sequence
  MKO10041997_A_Pop1
  gRNA
acagagucacguuacugggc

SEQ ID NO: 41998 - RNA, 20 nt, Artificial Sequence
  MKO10041998_A_Pop4
  gRNA
ccggcuugagcccauugcac

SEQ ID NO: 41999 - RNA, 20 nt, Artificial Sequence
  MKO10041999_A_Pop4
  gRNA
gcacaaaggccucagcccgc

SEQ ID NO: 42000 - RNA, 20 nt, Artificial Sequence
  MKO10042000_A_Pop4
  gRNA
auuucacucgccuaaagcca

SEQ ID NO: 42001 - RNA, 20 nt, Artificial Sequence
  MKO10042001_A_Pop5
  gRNA
caaacggcagcgcgcguccu

SEQ ID NO: 42002 - RNA, 20 nt, Artificial Sequence
  MKO10042002_A_Pop5
  gRNA
cgugcuacugcgaugccgga

SEQ ID NO: 42003 - RNA, 20 nt, Artificial Sequence
  MKO10042003_A_Pop5
  gRNA
cgccgaaggccccgugcacc

SEQ ID NO: 42004 - RNA, 20 nt, Artificial Sequence
  MKO10042004_A_Pop7
  gRNA
ggccgccaauaccuccaccg

SEQ ID NO: 42005 - RNA, 20 nt, Artificial Sequence
  MKO10042005_A_Pop7
  gRNA
agaaccccgcugugccaucg

SEQ ID NO: 42006 - RNA, 20 nt, Artificial Sequence
  MKO10042006_A_Pop7
  gRNA
gguggggaagucgcuuccga

SEQ ID NO: 42007 - RNA, 20 nt, Artificial Sequence
  MKO10042007_A_Popdc2
  gRNA
ccuccgggaggguauucacc

SEQ ID NO: 42008 - RNA, 20 nt, Artificial Sequence
  MKO10042008_A_Popdc2
  gRNA
guugcuggaggcgcggaaca

SEQ ID NO: 42009 - RNA, 20 nt, Artificial Sequence
  MKO10042009_A_Popdc2
  gRNA
gucgaagcguaacccaaacu

SEQ ID NO: 42010 - RNA, 20 nt, Artificial Sequence
  MKO10042010_A_Popdc3
  gRNA
ggauucgcuaagacccacag

SEQ ID NO: 42011 - RNA, 20 nt, Artificial Sequence
  MKO10042011_A_Popdc3
  gRNA
aucuacucuuugcgcagcau

SEQ ID NO: 42012 - RNA, 20 nt, Artificial Sequence
  MKO10042012_A_Popdc3
  gRNA
ggagcacugcuacgccaugc

SEQ ID NO: 42013 - RNA, 20 nt, Artificial Sequence
  MKO10042013_A_Porcn
  gRNA
cgacccaaaccaugugcagc

SEQ ID NO: 42014 - RNA, 20 nt, Artificial Sequence
  MKO10042014_A_Porcn
  gRNA
gcuucgccugccgccuccuu

SEQ ID NO: 42015 - RNA, 20 nt, Artificial Sequence
  MKO10042015_A_Porcn
  gRNA
gcaccaucgucuuugggccc

SEQ ID NO: 42016 - RNA, 20 nt, Artificial Sequence
  MKO10042016_A_Por
  gRNA
cucccagacgggaaccgcgg

SEQ ID NO: 42017 - RNA, 20 nt, Artificial Sequence
  MKO10042017_A_Por
  gRNA
ggggucgccuucuccguaug

SEQ ID NO: 42018 - RNA, 20 nt, Artificial Sequence
  MKO10042018_A_Por
  gRNA
cgaccccaccgacaacgcgc

SEQ ID NO: 42019 - RNA, 20 nt, Artificial Sequence
  MKO10042019_A_Postn
  gRNA
guacuucgcgccgaguaacg

SEQ ID NO: 42020 - RNA, 20 nt, Artificial Sequence
  MKO10042020_A_Postn
  gRNA
ccugaucccgaccccugaug

SEQ ID NO: 42021 - RNA, 20 nt, Artificial Sequence
  MKO10042021_A_Postn
  gRNA
uucucccaagccucguuacu

SEQ ID NO: 42022 - RNA, 20 nt, Artificial Sequence
  MKO10042022_A_Pot1a
  gRNA
cuacgauaaccacguucaag

SEQ ID NO: 42023 - RNA, 20 nt, Artificial Sequence
  MKO10042023_A_Pot1a
  gRNA
aagccuccguauguuagcaa

SEQ ID NO: 42024 - RNA, 20 nt, Artificial Sequence
  MKO10042024_A_Pot1a
  gRNA
caucgaacggcuacagaguc

SEQ ID NO: 42025 - RNA, 20 nt, Artificial Sequence
  MKO10042025_A_Pot1b
  gRNA
uguggaugcccacguucgca

SEQ ID NO: 42026 - RNA, 20 nt, Artificial Sequence
  MKO10042026_A_Pot1b
  gRNA
aagccuccguacuuaagcaa

SEQ ID NO: 42027 - RNA, 20 nt, Artificial Sequence
  MKO10042027_A_Pot1b
  gRNA
ugguagaagccuugcgaacg

SEQ ID NO: 42028 - RNA, 20 nt, Artificial Sequence
  MKO10042028_A_Poteg
  gRNA
gaaaugugcgaccgugcugc

SEQ ID NO: 42029 - RNA, 20 nt, Artificial Sequence
  MKO10042029_A_Poteg
  gRNA
guuguacacagcguagugca

SEQ ID NO: 42030 - RNA, 20 nt, Artificial Sequence
  MKO10042030_A_Poteg
  gRNA
gcauuacgcuacgcuauuga

SEQ ID NO: 42031 - RNA, 20 nt, Artificial Sequence
  MKO10042031_A_Pou1f1
  gRNA
gcgcuucgcccacguuuguc

SEQ ID NO: 42032 - RNA, 20 nt, Artificial Sequence
  MKO10042032_A_Pou1f1
  gRNA
cgcggccucugaguuuaagc

SEQ ID NO: 42033 - RNA, 20 nt, Artificial Sequence
  MKO10042033_A_Pou1f1
  gRNA
cuccccagaaauccgagaac

SEQ ID NO: 42034 - RNA, 20 nt, Artificial Sequence
  MKO10042034_A_Pou2af1
  gRNA
uagcuccucaccgcggucgg

SEQ ID NO: 42035 - RNA, 20 nt, Artificial Sequence
  MKO10042035_A_Pou2af1
  gRNA
auaccaggguguucgaguca

SEQ ID NO: 42036 - RNA, 20 nt, Artificial Sequence
  MKO10042036_A_Pou2af1
  gRNA
cgccccucacuuauuucccg

SEQ ID NO: 42037 - RNA, 20 nt, Artificial Sequence
  MKO10042037_A_Pou2f1
  gRNA
cgaaucucccgacucuucac

SEQ ID NO: 42038 - RNA, 20 nt, Artificial Sequence
  MKO10042038_A_Pou2f1
  gRNA
cagaaacagcccgugcccgu

SEQ ID NO: 42039 - RNA, 20 nt, Artificial Sequence
  MKO10042039_A_Pou2f1
  gRNA
cuaccuggugaagauguccg

SEQ ID NO: 42040 - RNA, 20 nt, Artificial Sequence
  MKO10042040_A_Pou2f2
  gRNA
cgggugcuuaccuuggugcu

SEQ ID NO: 42041 - RNA, 20 nt, Artificial Sequence
  MKO10042041_A_Pou2f2
  gRNA
gacuccccgucagagcacac

SEQ ID NO: 42042 - RNA, 20 nt, Artificial Sequence
  MKO10042042_A_Pou2f2
  gRNA
ccugaccugaugguuaaugu

SEQ ID NO: 42043 - RNA, 20 nt, Artificial Sequence
  MKO10042043_A_Pou2f3
  gRNA
acggacacccgcagcacuuu

SEQ ID NO: 42044 - RNA, 20 nt, Artificial Sequence
  MKO10042044_A_Pou2f3
  gRNA
cuacuugcagauuaagacgg

SEQ ID NO: 42045 - RNA, 20 nt, Artificial Sequence
  MKO10042045_A_Pou2f3
  gRNA
uggcaccuaccccagacauu

SEQ ID NO: 42046 - RNA, 20 nt, Artificial Sequence
  MKO10042046_A_Pou3f1
  gRNA
ccaccgcgcaguaucugccg

SEQ ID NO: 42047 - RNA, 20 nt, Artificial Sequence
  MKO10042047_A_Pou3f1
  gRNA
gccccgcggcagauacugcg

SEQ ID NO: 42048 - RNA, 20 nt, Artificial Sequence
  MKO10042048_A_Pou3f1
  gRNA
aggcgcauaaacgucgucca

SEQ ID NO: 42049 - RNA, 20 nt, Artificial Sequence
  MKO10042049_A_Pou3f2
  gRNA
augccguucaccgugaagcu

SEQ ID NO: 42050 - RNA, 20 nt, Artificial Sequence
  MKO10042050_A_Pou3f2
  gRNA
cgaauagagcaaaccgccgu

SEQ ID NO: 42051 - RNA, 20 nt, Artificial Sequence
  MKO10042051_A_Pou3f2
  gRNA
cgccguagucgcccugcacc

SEQ ID NO: 42052 - RNA, 20 nt, Artificial Sequence
  MKO10042052_A_Pou3f3
  gRNA
accugcgaguagacaucguc

SEQ ID NO: 42053 - RNA, 20 nt, Artificial Sequence
  MKO10042053_A_Pou3f3
  gRNA
cuaccggggggacccguccu

SEQ ID NO: 42054 - RNA, 20 nt, Artificial Sequence
  MKO10042054_A_Pou3f3
  gRNA
cggcaugcugagcgcgcccc

SEQ ID NO: 42055 - RNA, 20 nt, Artificial Sequence
  MKO10042055_A_Pou3f4
  gRNA
gcuucacgcaagccgacgug

SEQ ID NO: 42056 - RNA, 20 nt, Artificial Sequence
  MKO10042056_A_Pou3f4
  gRNA
gugugcgaauaaaccucgug

SEQ ID NO: 42057 - RNA, 20 nt, Artificial Sequence
  MKO10042057_A_Pou3f4
  gRNA
gguuagugugcggcgagugg

SEQ ID NO: 42058 - RNA, 20 nt, Artificial Sequence
  MKO10042058_A_Pou4f1
  gRNA
cgagcgacggcgacgagaug

SEQ ID NO: 42059 - RNA, 20 nt, Artificial Sequence
  MKO10042059_A_Pou4f1
  gRNA
gcggccaugaacaugccguc

SEQ ID NO: 42060 - RNA, 20 nt, Artificial Sequence
  MKO10042060_A_Pou4f1
  gRNA
agcgacggguacuugugcuc

SEQ ID NO: 42061 - RNA, 20 nt, Artificial Sequence
  MKO10042061_A_Pou4f2
  gRNA
cuuagugagcuucucgcggu

SEQ ID NO: 42062 - RNA, 20 nt, Artificial Sequence
  MKO10042062_A_Pou4f2
  gRNA
caucucgcacccguccgcuc

SEQ ID NO: 42063 - RNA, 20 nt, Artificial Sequence
  MKO10042063_A_Pou4f2
  gRNA
gacauacgcaccgguggggu

SEQ ID NO: 42064 - RNA, 20 nt, Artificial Sequence
  MKO10042064_A_Pou4f3
  gRNA
gcucaaguaagucgcccucg

SEQ ID NO: 42065 - RNA, 20 nt, Artificial Sequence
  MKO10042065_A_Pou4f3
  gRNA
cccugauguaccgcgugaug

SEQ ID NO: 42066 - RNA, 20 nt, Artificial Sequence
  MKO10042066_A_Pou4f3
  gRNA
ucggcgcauggccucagagc

SEQ ID NO: 42067 - RNA, 20 nt, Artificial Sequence
  MKO10042067_A_Pou5f1
  gRNA
cauccuaggugguucgagua

SEQ ID NO: 42068 - RNA, 20 nt, Artificial Sequence
  MKO10042068_A_Pou5f1
  gRNA
cuagcauugagaaccgugug

SEQ ID NO: 42069 - RNA, 20 nt, Artificial Sequence
  MKO10042069_A_Pou5f1
  gRNA
caaggccucgaagcgacaga

SEQ ID NO: 42070 - RNA, 20 nt, Artificial Sequence
  MKO10042070_A_Pou5f2
  gRNA
gacguuugaagaccuccgcc

SEQ ID NO: 42071 - RNA, 20 nt, Artificial Sequence
  MKO10042071_A_Pou5f2
  gRNA
auguaucucaaggcgaugua

SEQ ID NO: 42072 - RNA, 20 nt, Artificial Sequence
  MKO10042072_A_Pou5f2
  gRNA
ugguuggccaacugcccauc

SEQ ID NO: 42073 - RNA, 20 nt, Artificial Sequence
  MKO10042073_A_Pou6f1
  gRNA
agugcgccgcuugcguuucu

SEQ ID NO: 42074 - RNA, 20 nt, Artificial Sequence
  MKO10042074_A_Pou6f1
  gRNA
gaacgucuuucagaucccgu

SEQ ID NO: 42075 - RNA, 20 nt, Artificial Sequence
  MKO10042075_A_Pou6f1
  gRNA
gcagcugacggcuugagcgc

SEQ ID NO: 42076 - RNA, 20 nt, Artificial Sequence
  MKO10042076_A_Pou6f2
  gRNA
uagcugucccgccauguuga

SEQ ID NO: 42077 - RNA, 20 nt, Artificial Sequence
  MKO10042077_A_Pou6f2
  gRNA
auguuugugagauucgcggu

SEQ ID NO: 42078 - RNA, 20 nt, Artificial Sequence
  MKO10042078_A_Pou6f2
  gRNA
cggugacggaaggcuauguc

SEQ ID NO: 42079 - RNA, 20 nt, Artificial Sequence
  MKO10042079_A_Pp2d1
  gRNA
uccaggucgauggagcgcuu

SEQ ID NO: 42080 - RNA, 20 nt, Artificial Sequence
  MKO10042080_A_Pp2d1
  gRNA
cugcugcugcauaaccguaa

SEQ ID NO: 42081 - RNA, 20 nt, Artificial Sequence
  MKO10042081_A_Pp2d1
  gRNA
aacuugccaaaguccauuag

SEQ ID NO: 42082 - RNA, 20 nt, Artificial Sequence
  MKO10042082_A_Ppa1
  gRNA
ccgauuucacaaacaucgau

SEQ ID NO: 42083 - RNA, 20 nt, Artificial Sequence
  MKO10042083_A_Ppa1
  gRNA
acgcugguccaacgccaaaa

SEQ ID NO: 42084 - RNA, 20 nt, Artificial Sequence
  MKO10042084_A_Ppa1
  gRNA
cuuaccuugucugcauaaau

SEQ ID NO: 42085 - RNA, 20 nt, Artificial Sequence
  MKO10042085_A_Ppa2
  gRNA
gaauuacggggcccucccuc

SEQ ID NO: 42086 - RNA, 20 nt, Artificial Sequence
  MKO10042086_A_Ppa2
  gRNA
aucuuggcauuuguccaccg

SEQ ID NO: 42087 - RNA, 20 nt, Artificial Sequence
  MKO10042087_A_Ppa2
  gRNA
ggcacgaaaugaugaauaug

SEQ ID NO: 42088 - RNA, 20 nt, Artificial Sequence
  MKO10042088_A_Ppan
  gRNA
cgcgugaacacgaacgagug

SEQ ID NO: 42089 - RNA, 20 nt, Artificial Sequence
  MKO10042089_A_Ppan
  gRNA
cgcgauugcgcuucugaugu

SEQ ID NO: 42090 - RNA, 20 nt, Artificial Sequence
  MKO10042090_A_Ppan
  gRNA
gcucaacagcuucggccccc

SEQ ID NO: 42091 - RNA, 20 nt, Artificial Sequence
  MKO10042091_A_Ppap2a
  gRNA
gcaacacgcaaaucacaucg

SEQ ID NO: 42092 - RNA, 20 nt, Artificial Sequence
  MKO10042092_A_Ppap2a
  gRNA
ugaccauguucgacaagacg

SEQ ID NO: 42093 - RNA, 20 nt, Artificial Sequence
  MKO10042093_A_Ppap2a
  gRNA
uccgacggcuuuguaaaugg

SEQ ID NO: 42094 - RNA, 20 nt, Artificial Sequence
  MKO10042094_A_Ppap2b
  gRNA
ggggaucgucaucgccaucc

SEQ ID NO: 42095 - RNA, 20 nt, Artificial Sequence
  MKO10042095_A_Ppap2b
  gRNA
accauuaagccuuaccgucg

SEQ ID NO: 42096 - RNA, 20 nt, Artificial Sequence
  MKO10042096_A_Ppap2b
  gRNA
cuaccggaucuauuaccuca

SEQ ID NO: 42097 - RNA, 20 nt, Artificial Sequence
  MKO10042097_A_Ppap2c
  gRNA
gugaucgugucuggacggua

SEQ ID NO: 42098 - RNA, 20 nt, Artificial Sequence
  MKO10042098_A_Ppap2c
  gRNA
caguagaacccccgcuuaua

SEQ ID NO: 42099 - RNA, 20 nt, Artificial Sequence
  MKO10042099_A_Ppap2c
  gRNA
cucauugggagaagccuacc

SEQ ID NO: 42100 - RNA, 20 nt, Artificial Sequence
  MKO10042100_A_Ppapdc1a
  gRNA
aauucggagaugcgcugcac

SEQ ID NO: 42101 - RNA, 20 nt, Artificial Sequence
  MKO10042101_A_Ppapdc1a
  gRNA
uccgaauucaucaccccauc

SEQ ID NO: 42102 - RNA, 20 nt, Artificial Sequence
  MKO10042102_A_Ppapdc1a
  gRNA
uuugcguggugaaaauuauc

SEQ ID NO: 42103 - RNA, 20 nt, Artificial Sequence
  MKO10042103_A_Ppapdc1b
  gRNA
aaguauuccgccuccacgua

SEQ ID NO: 42104 - RNA, 20 nt, Artificial Sequence
  MKO10042104_A_Ppapdc1b
  gRNA
cuacaggaacccguacgugg

SEQ ID NO: 42105 - RNA, 20 nt, Artificial Sequence
  MKO10042105_A_Ppapdc1b
  gRNA
ccauucugaucugacgugca

SEQ ID NO: 42106 - RNA, 20 nt, Artificial Sequence
  MKO10042106_A_Ppapdc2
  gRNA
ccgacccgcgcacaaucaaa

SEQ ID NO: 42107 - RNA, 20 nt, Artificial Sequence
  MKO10042107_A_Ppapdc2
  gRNA
aucgcugcugaacugccgcg

SEQ ID NO: 42108 - RNA, 20 nt, Artificial Sequence
  MKO10042108_A_Ppapdc2
  gRNA
aaguucaugcgggcguccuc

SEQ ID NO: 42109 - RNA, 20 nt, Artificial Sequence
  MKO10042109_A_Ppapdc3
  gRNA
acgcucccgugccccgucgc

SEQ ID NO: 42110 - RNA, 20 nt, Artificial Sequence
  MKO10042110_A_Ppapdc3
  gRNA
cagaagcucaucaagcgccg

SEQ ID NO: 42111 - RNA, 20 nt, Artificial Sequence
  MKO10042111_A_Ppapdc3
  gRNA
aggauggugcccccgaucca

SEQ ID NO: 42112 - RNA, 20 nt, Artificial Sequence
  MKO10042112_A_Ppara
  gRNA
gccgggggacucguccgugc

SEQ ID NO: 42113 - RNA, 20 nt, Artificial Sequence
  MKO10042113_A_Ppara
  gRNA
caaggcccgggucauacucg

SEQ ID NO: 42114 - RNA, 20 nt, Artificial Sequence
  MKO10042114_A_Ppara
  gRNA
auauucgacacucgauguuc

SEQ ID NO: 42115 - RNA, 20 nt, Artificial Sequence
  MKO10042115_A_Ppard
  gRNA
ucgaguaugagaagugcgau

SEQ ID NO: 42116 - RNA, 20 nt, Artificial Sequence
  MKO10042116_A_Ppard
  gRNA
ccuccggcauccguccaaag

SEQ ID NO: 42117 - RNA, 20 nt, Artificial Sequence
  MKO10042117_A_Ppard
  gRNA
ccucgugcacgccauacuug

SEQ ID NO: 42118 - RNA, 20 nt, Artificial Sequence
  MKO10042118_A_Ppargc1a
  gRNA
gcaauccgucuucauccacg

SEQ ID NO: 42119 - RNA, 20 nt, Artificial Sequence
  MKO10042119_A_Ppargc1a
  gRNA
cuuaccucaaauauguucgc

SEQ ID NO: 42120 - RNA, 20 nt, Artificial Sequence
  MKO10042120_A_Ppargc1a
  gRNA
gguuggauaugauuuccgau

SEQ ID NO: 42121 - RNA, 20 nt, Artificial Sequence
  MKO10042121_A_Ppargc1b
  gRNA
uguuagcaagcccuaccgcc

SEQ ID NO: 42122 - RNA, 20 nt, Artificial Sequence
  MKO10042122_A_Ppargc1b
  gRNA
agcucguccacgucagacgc

SEQ ID NO: 42123 - RNA, 20 nt, Artificial Sequence
  MKO10042123_A_Ppargc1b
  gRNA
gacagggcagcaccgaagug

SEQ ID NO: 42124 - RNA, 20 nt, Artificial Sequence
  MKO10042124_A_Pparg
  gRNA
ugucaagaucgcccucgccu

SEQ ID NO: 42125 - RNA, 20 nt, Artificial Sequence
  MKO10042125_A_Pparg
  gRNA
uggcauccgcccaaaccuga

SEQ ID NO: 42126 - RNA, 20 nt, Artificial Sequence
  MKO10042126_A_Pparg
  gRNA
cacagagcugauuccgaagu

SEQ ID NO: 42127 - RNA, 20 nt, Artificial Sequence
  MKO10042127_A_Ppau
  gRNA
cguucaccaguuccccguua

SEQ ID NO: 42128 - RNA, 20 nt, Artificial Sequence
  MKO10042128_A_Ppau
  gRNA
uggugaacgccgcucgguug

SEQ ID NO: 42129 - RNA, 20 nt, Artificial Sequence
  MKO10042129_A_Ppau
  gRNA
auaagacgcccgaugcagag

SEQ ID NO: 42130 - RNA, 20 nt, Artificial Sequence
  MKO10042130_A_Ppbp
  gRNA
augacgauucucuugacgcc

SEQ ID NO: 42131 - RNA, 20 nt, Artificial Sequence
  MKO10042131_A_Ppbp
  gRNA
cugcagcgcaguucgauaua

SEQ ID NO: 42132 - RNA, 20 nt, Artificial Sequence
  MKO10042132_A_Ppbp
  gRNA
gagccagcgcaacaaggauc

SEQ ID NO: 42133 - RNA, 20 nt, Artificial Sequence
  MKO10042133_A_Ppcdc
  gRNA
guggaagcgccguucugacc

SEQ ID NO: 42134 - RNA, 20 nt, Artificial Sequence
  MKO10042134_A_Ppcdc
  gRNA
uucuccacauugaccugcgg

SEQ ID NO: 42135 - RNA, 20 nt, Artificial Sequence
  MKO10042135_A_Ppcdc
  gRNA
gcucaaggccuuuggcuacg

SEQ ID NO: 42136 - RNA, 20 nt, Artificial Sequence
  MKO10042136_A_Ppcs
  gRNA
agcgcgagccgugcgcuuuc

SEQ ID NO: 42137 - RNA, 20 nt, Artificial Sequence
  MKO10042137_A_Ppcs
  gRNA
guucuuguaccgagcgcgcu

SEQ ID NO: 42138 - RNA, 20 nt, Artificial Sequence
  MKO10042138_A_Ppcs
  gRNA
gccaaagaugcuuuccccuc

SEQ ID NO: 42139 - RNA, 20 nt, Artificial Sequence
  MKO10042139_A_Ppdpf
  gRNA
acuuacgccgauaguaguca

SEQ ID NO: 42140 - RNA, 20 nt, Artificial Sequence
  MKO10042140_A_Ppdpf
  gRNA
cagcucggcagaaucccccc

SEQ ID NO: 42141 - RNA, 20 nt, Artificial Sequence
  MKO10042141_A_Ppdpf
  gRNA
cuuacccggggacuggagca

SEQ ID NO: 42142 - RNA, 20 nt, Artificial Sequence
  MKO10042142_A_Ppef1
  gRNA
ucagucgagcucuguaccgc

SEQ ID NO: 42143 - RNA, 20 nt, Artificial Sequence
  MKO10042143_A_Ppef1
  gRNA
ccgcguuagucauccaaaau

SEQ ID NO: 42144 - RNA, 20 nt, Artificial Sequence
  MKO10042144_A_Ppef1
  gRNA
ucaugcucacuacgucuuag

SEQ ID NO: 42145 - RNA, 20 nt, Artificial Sequence
  MKO10042145_A_Ppef2
  gRNA
gauucaagacguaucgagca

SEQ ID NO: 42146 - RNA, 20 nt, Artificial Sequence
  MKO10042146_A_Ppef2
  gRNA
caccgaagagagauucgccc

SEQ ID NO: 42147 - RNA, 20 nt, Artificial Sequence
  MKO10042147_A_Ppef2
  gRNA
uguagcgccgguaccaucuc

SEQ ID NO: 42148 - RNA, 20 nt, Artificial Sequence
  MKO10042148_A_Ppfia1
  gRNA
gguacgagagcgacuacgag

SEQ ID NO: 42149 - RNA, 20 nt, Artificial Sequence
  MKO10042149_A_Ppfia1
  gRNA
gcgcucucuccggaugacag

SEQ ID NO: 42150 - RNA, 20 nt, Artificial Sequence
  MKO10042150_A_Ppfia1
  gRNA
ggaguuugcugcgcucacga

SEQ ID NO: 42151 - RNA, 20 nt, Artificial Sequence
  MKO10042151_A_Ppfia2
  gRNA
gccuugugucccgacaugaa

SEQ ID NO: 42152 - RNA, 20 nt, Artificial Sequence
  MKO10042152_A_Ppfia2
  gRNA
caggacaucgaaucccuaac

SEQ ID NO: 42153 - RNA, 20 nt, Artificial Sequence
  MKO10042153_A_Ppfia2
  gRNA
uucuuagugaccguucaugu

SEQ ID NO: 42154 - RNA, 20 nt, Artificial Sequence
  MKO10042154_A_Ppfia3
  gRNA
acguucccugcgaaugacug

SEQ ID NO: 42155 - RNA, 20 nt, Artificial Sequence
  MKO10042155_A_Ppfia3
  gRNA
aacguucgugccuggacacc

SEQ ID NO: 42156 - RNA, 20 nt, Artificial Sequence
  MKO10042156_A_Ppfia3
  gRNA
ugcagguccgggaaagauug

SEQ ID NO: 42157 - RNA, 20 nt, Artificial Sequence
  MKO10042157_A_Ppfia4
  gRNA
ucauccgcaaugaccgcuca

SEQ ID NO: 42158 - RNA, 20 nt, Artificial Sequence
  MKO10042158_A_Ppfia4
  gRNA
ucuagagcgcguuacuaccu

SEQ ID NO: 42159 - RNA, 20 nt, Artificial Sequence
  MKO10042159_A_Ppfia4
  gRNA
gccucgugucccgccaugag

SEQ ID NO: 42160 - RNA, 20 nt, Artificial Sequence
  MKO10042160_A_Ppfibp1
  gRNA
gcgcgcaagcuucccauaaa

SEQ ID NO: 42161 - RNA, 20 nt, Artificial Sequence
  MKO10042161_A_Ppfibp1
  gRNA
ucaucuccaacaauccacgc

SEQ ID NO: 42162 - RNA, 20 nt, Artificial Sequence
  MKO10042162_A_Ppfibp1
  gRNA
ggcacgucuagaaaacgaca

SEQ ID NO: 42163 - RNA, 20 nt, Artificial Sequence
  MKO10042163_A_Ppfibp2
  gRNA
uucugacgcuagucauaugc

SEQ ID NO: 42164 - RNA, 20 nt, Artificial Sequence
  MKO10042164_A_Ppfibp2
  gRNA
uaaagagucccucauacuac

SEQ ID NO: 42165 - RNA, 20 nt, Artificial Sequence
  MKO10042165_A_Ppfibp2
  gRNA
gagaacucaccuguaguaug

SEQ ID NO: 42166 - RNA, 20 nt, Artificial Sequence
  MKO10042166_A_Pphln1
  gRNA
ugagggugacgcaucucucg

SEQ ID NO: 42167 - RNA, 20 nt, Artificial Sequence
  MKO10042167_A_Pphln1
  gRNA
gcacgcguucucucggaagu

SEQ ID NO: 42168 - RNA, 20 nt, Artificial Sequence
  MKO10042168_A_Pphln1
  gRNA
cuucacauuauucgagagau

SEQ ID NO: 42169 - RNA, 20 nt, Artificial Sequence
  MKO10042169_A_Ppia
  gRNA
ugaaaccaaccugcugucuu

SEQ ID NO: 42170 - RNA, 20 nt, Artificial Sequence
  MKO10042170_A_Ppia
  gRNA
uguuucuuaccauucagucu

SEQ ID NO: 42171 - RNA, 20 nt, Artificial Sequence
  MKO10042171_A_Ppia
  gRNA
aauaccuggcacaugaaucc

SEQ ID NO: 42172 - RNA, 20 nt, Artificial Sequence
  MKO10042172_A_Ppib
  gRNA
gaugucaucauugucgacuc

SEQ ID NO: 42173 - RNA, 20 nt, Artificial Sequence
  MKO10042173_A_Ppib
  gRNA
ucuguaggacgagucgucuu

SEQ ID NO: 42174 - RNA, 20 nt, Artificial Sequence
  MKO10042174_A_Ppib
  gRNA
acuuaccucuccuguagcua

SEQ ID NO: 42175 - RNA, 20 nt, Artificial Sequence
  MKO10042175_A_Ppic
  gRNA
agucggugagugggcgguca

SEQ ID NO: 42176 - RNA, 20 nt, Artificial Sequence
  MKO10042176_A_Ppic
  gRNA
uggaaacguuguacccaaga

SEQ ID NO: 42177 - RNA, 20 nt, Artificial Sequence
  MKO10042177_A_Ppic
  gRNA
aacuucguggcucuggcaac

SEQ ID NO: 42178 - RNA, 20 nt, Artificial Sequence
  MKO10042178_A_Ppid
  gRNA
guauacguacuucgguggaa

SEQ ID NO: 42179 - RNA, 20 nt, Artificial Sequence
  MKO10042179_A_Ppid
  gRNA
aucucugcagcaugaucggg

SEQ ID NO: 42180 - RNA, 20 nt, Artificial Sequence
  MKO10042180_A_Ppid
  gRNA
gaacugagagccauucguau

SEQ ID NO: 42181 - RNA, 20 nt, Artificial Sequence
  MKO10042181_A_Ppie
  gRNA
acggacgauucgugucaauu

SEQ ID NO: 42182 - RNA, 20 nt, Artificial Sequence
  MKO10042182_A_Ppie
  gRNA
ggcagcagcuaucgacaaca

SEQ ID NO: 42183 - RNA, 20 nt, Artificial Sequence
  MKO10042183_A_Ppie
  gRNA
caugcugcauuuauccccuu

SEQ ID NO: 42184 - RNA, 20 nt, Artificial Sequence
  MKO10042184_A_Ppif
  gRNA
guuggggccugcguucgcca

SEQ ID NO: 42185 - RNA, 20 nt, Artificial Sequence
  MKO10042185_A_Ppif
  gRNA
gaugucgugccaaagacugc

SEQ ID NO: 42186 - RNA, 20 nt, Artificial Sequence
  MKO10042186_A_Ppif
  gRNA
agcccuucucaccagugcau

SEQ ID NO: 42187 - RNA, 20 nt, Artificial Sequence
  MKO10042187_A_Ppig
  gRNA
gcgaaaguucucacacguuu

SEQ ID NO: 42188 - RNA, 20 nt, Artificial Sequence
  MKO10042188_A_Ppig
  gRNA
ucuccaggugaaaaagggac

SEQ ID NO: 42189 - RNA, 20 nt, Artificial Sequence
  MKO10042189_A_Ppig
  gRNA
auuuauggaggauucuuuga

SEQ ID NO: 42190 - RNA, 20 nt, Artificial Sequence
  MKO10042190_A_Ppih
  gRNA
ugagacugaccugaacucuc

SEQ ID NO: 42191 - RNA, 20 nt, Artificial Sequence
  MKO10042191_A_Ppih
  gRNA
cccuuuaggcaauucugcac

SEQ ID NO: 42192 - RNA, 20 nt, Artificial Sequence
  MKO10042192_A_Ppih
  gRNA
uucaaguccagucaauccag

SEQ ID NO: 42193 - RNA, 20 nt, Artificial Sequence
  MKO10042193_A_Ppil1
  gRNA
cuugccguccagccauugcg

SEQ ID NO: 42194 - RNA, 20 nt, Artificial Sequence
  MKO10042194_A_Ppil1
  gRNA
cgagguggcgcaucuauuua

SEQ ID NO: 42195 - RNA, 20 nt, Artificial Sequence
  MKO10042195_A_Ppil1
  gRNA
agaaucuucacgucguccac

SEQ ID NO: 42196 - RNA, 20 nt, Artificial Sequence
  MKO10042196_A_Ppil2
  gRNA
aagucaaagacgacaccuuc

SEQ ID NO: 42197 - RNA, 20 nt, Artificial Sequence
  MKO10042197_A_Ppil2
  gRNA
ccaucaggaacauuguuccc

SEQ ID NO: 42198 - RNA, 20 nt, Artificial Sequence
  MKO10042198_A_Ppil2
  gRNA
uacccagucugcaccccaga

SEQ ID NO: 42199 - RNA, 20 nt, Artificial Sequence
  MKO10042199_A_Ppil3
  gRNA
acagccguuguaguaauuac

SEQ ID NO: 42200 - RNA, 20 nt, Artificial Sequence
  MKO10042200_A_Ppil3
  gRNA
uguuauacagguacuggaag

SEQ ID NO: 42201 - RNA, 20 nt, Artificial Sequence
  MKO10042201_A_Ppil3
  gRNA
ugugccaguaauuacuacaa

SEQ ID NO: 42202 - RNA, 20 nt, Artificial Sequence
  MKO10042202_A_Ppil4
  gRNA
acacuguaugaacaccguca

SEQ ID NO: 42203 - RNA, 20 nt, Artificial Sequence
  MKO10042203_A_Ppil4
  gRNA
gaucccacggggacuggccg

SEQ ID NO: 42204 - RNA, 20 nt, Artificial Sequence
  MKO10042204_A_Ppil4
  gRNA
gaaaacuuagauuaccuuga

SEQ ID NO: 42205 - RNA, 20 nt, Artificial Sequence
  MKO10042205_A_Ppil6
  gRNA
ugugggaugugaucgauguc

SEQ ID NO: 42206 - RNA, 20 nt, Artificial Sequence
  MKO10042206_A_Ppil6
  gRNA
cccguacagauuugaagauc

SEQ ID NO: 42207 - RNA, 20 nt, Artificial Sequence
  MKO10042207_A_Ppil6
  gRNA
accggaucuucaaaucugua

SEQ ID NO: 42208 - RNA, 20 nt, Artificial Sequence
  MKO10042208_A_Ppip5k1
  gRNA
uaagccacagcuuugucgag

SEQ ID NO: 42209 - RNA, 20 nt, Artificial Sequence
  MKO10042209_A_Ppip5k1
  gRNA
aucuucccaccuuacggaag

SEQ ID NO: 42210 - RNA, 20 nt, Artificial Sequence
  MKO10042210_A_Ppip5k1
  gRNA
aagccagcgccucuuccgua

SEQ ID NO: 42211 - RNA, 20 nt, Artificial Sequence
  MKO10042211_A_Ppip5k2
  gRNA
cgguucaggauugcauaccg

SEQ ID NO: 42212 - RNA, 20 nt, Artificial Sequence
  MKO10042212_A_Ppip5k2
  gRNA
gucagcacauuucaugcgau

SEQ ID NO: 42213 - RNA, 20 nt, Artificial Sequence
  MKO10042213_A_Ppip5k2
  gRNA
uucgggcccaacaaagaauc

SEQ ID NO: 42214 - RNA, 20 nt, Artificial Sequence
  MKO10042214_A_Ppl
  gRNA
aggccgacccgagagucaac

SEQ ID NO: 42215 - RNA, 20 nt, Artificial Sequence
  MKO10042215_A_Ppl
  gRNA
uggucacgcgcucuuucagc

SEQ ID NO: 42216 - RNA, 20 nt, Artificial Sequence
  MKO10042216_A_Ppl
  gRNA
ucggcgaucaugucccccug

SEQ ID NO: 42217 - RNA, 20 nt, Artificial Sequence
  MKO10042217_A_Ppm1a
  gRNA
cugcgucaaccgaugauaug

SEQ ID NO: 42218 - RNA, 20 nt, Artificial Sequence
  MKO10042218_A_Ppm1a
  gRNA
gcggcuuuaccacauaucau

SEQ ID NO: 42219 - RNA, 20 nt, Artificial Sequence
  MKO10042219_A_Ppm1a
  gRNA
caccgccucugccgagacuu

SEQ ID NO: 42220 - RNA, 20 nt, Artificial Sequence
  MKO10042220_A_Ppm1b
  gRNA
cacuuggaaucacggguuga

SEQ ID NO: 42221 - RNA, 20 nt, Artificial Sequence
  MKO10042221_A_Ppm1b
  gRNA
gaccaguuguccaagccgug

SEQ ID NO: 42222 - RNA, 20 nt, Artificial Sequence
  MKO10042222_A_Ppm1b
  gRNA
aauaucccgaauuuaccucc

SEQ ID NO: 42223 - RNA, 20 nt, Artificial Sequence
  MKO10042223_A_Ppm1d
  gRNA
aagauguauguagcgcaugu

SEQ ID NO: 42224 - RNA, 20 nt, Artificial Sequence
  MKO10042224_A_Ppm1d
  gRNA
ugaaccgaguaguuuggaaa

SEQ ID NO: 42225 - RNA, 20 nt, Artificial Sequence
  MKO10042225_A_Ppm1d
  gRNA
gccccguauuauaaccacac

SEQ ID NO: 42226 - RNA, 20 nt, Artificial Sequence
  MKO10042226_A_Ppm1e
  gRNA
acacguuaacuuagugcgcc

SEQ ID NO: 42227 - RNA, 20 nt, Artificial Sequence
  MKO10042227_A_Ppm1e
  gRNA
gacgucucauaauaaaucug

SEQ ID NO: 42228 - RNA, 20 nt, Artificial Sequence
  MKO10042228_A_Ppm1e
  gRNA
aaucgcccacccaugccacg

SEQ ID NO: 42229 - RNA, 20 nt, Artificial Sequence
  MKO10042229_A_Ppm1f
  gRNA
ccaucuugcgucguguguuc

SEQ ID NO: 42230 - RNA, 20 nt, Artificial Sequence
  MKO10042230_A_Ppm1f
  gRNA
gccgcacaaaccggagcgac

SEQ ID NO: 42231 - RNA, 20 nt, Artificial Sequence
  MKO10042231_A_Ppm1f
  gRNA
cgcucccccaucguuugcug

SEQ ID NO: 42232 - RNA, 20 nt, Artificial Sequence
  MKO10042232_A_Ppm1g
  gRNA
gaagagcugcugacgcgaua

SEQ ID NO: 42233 - RNA, 20 nt, Artificial Sequence
  MKO10042233_A_Ppm1g
  gRNA
caguaccgggcucacuaauu

SEQ ID NO: 42234 - RNA, 20 nt, Artificial Sequence
  MKO10042234_A_Ppm1g
  gRNA
ucacaacuguauuccugagc

SEQ ID NO: 42235 - RNA, 20 nt, Artificial Sequence
  MKO10042235_A_Ppm1h
  gRNA
accuucaaaucgaacgcgag

SEQ ID NO: 42236 - RNA, 20 nt, Artificial Sequence
  MKO10042236_A_Ppm1h
  gRNA
cacucgagugaaaucugccg

SEQ ID NO: 42237 - RNA, 20 nt, Artificial Sequence
  MKO10042237_A_Ppm1h
  gRNA
gccgcccguacgggaagcgc

SEQ ID NO: 42238 - RNA, 20 nt, Artificial Sequence
  MKO10042238_A_Ppm1j
  gRNA
caccagcgugcccaucaaac

SEQ ID NO: 42239 - RNA, 20 nt, Artificial Sequence
  MKO10042239_A_Ppm1j
  gRNA
ggagaucauuccgauguccc

SEQ ID NO: 42240 - RNA, 20 nt, Artificial Sequence
  MKO10042240_A_Ppm1j
  gRNA
ucugguagggucaucaaugc

SEQ ID NO: 42241 - RNA, 20 nt, Artificial Sequence
  MKO10042241_A_Ppm1k
  gRNA
ccaugcugacgacaguuucc

SEQ ID NO: 42242 - RNA, 20 nt, Artificial Sequence
  MKO10042242_A_Ppm1k
  gRNA
guucaacaccaucucucaac

SEQ ID NO: 42243 - RNA, 20 nt, Artificial Sequence
  MKO10042243_A_Ppm1k
  gRNA
guuuguagcuuggaauaguu

SEQ ID NO: 42244 - RNA, 20 nt, Artificial Sequence
  MKO10042244_A_Ppm1l
  gRNA
cuuugaugggcacggcggcg

SEQ ID NO: 42245 - RNA, 20 nt, Artificial Sequence
  MKO10042245_A_Ppm1l
  gRNA
ucgauucaucaaggagcgcu

SEQ ID NO: 42246 - RNA, 20 nt, Artificial Sequence
  MKO10042246_A_Ppm1l
  gRNA
auuaugcagaacgaucgucu

SEQ ID NO: 42247 - RNA, 20 nt, Artificial Sequence
  MKO10042247_A_Ppm1m
  gRNA
gugcccaguagugacccguc

SEQ ID NO: 42248 - RNA, 20 nt, Artificial Sequence
  MKO10042248_A_Ppm1m
  gRNA
cuugcgggaagcuaugcauc

SEQ ID NO: 42249 - RNA, 20 nt, Artificial Sequence
  MKO10042249_A_Ppm1m
  gRNA
ccccagugacccccaguucg

SEQ ID NO: 42250 - RNA, 20 nt, Artificial Sequence
  MKO10042250_A_Ppm1n
  gRNA
ggguccugaaaaccguguuu

SEQ ID NO: 42251 - RNA, 20 nt, Artificial Sequence
  MKO10042251_A_Ppm1n
  gRNA
cuuaccucuugacauucccc

SEQ ID NO: 42252 - RNA, 20 nt, Artificial Sequence
  MKO10042252_A_Ppm1n
  gRNA
uugugaggaggcaauuagca

SEQ ID NO: 42253 - RNA, 20 nt, Artificial Sequence
  MKO10042253_A_Ppme1
  gRNA
gaggccauuccgcccuuucc

SEQ ID NO: 42254 - RNA, 20 nt, Artificial Sequence
  MKO10042254_A_Ppme1
  gRNA
guaaagucccgcuuccgucc

SEQ ID NO: 42255 - RNA, 20 nt, Artificial Sequence
  MKO10042255_A_Ppme1
  gRNA
gagucaguacuuugagucaa

SEQ ID NO: 42256 - RNA, 20 nt, Artificial Sequence
  MKO10042256_A_Ppox
  gRNA
cuuugccgaggaguauuugc

SEQ ID NO: 42257 - RNA, 20 nt, Artificial Sequence
  MKO10042257_A_Ppox
  gRNA
ccagccggccuaaucccucg

SEQ ID NO: 42258 - RNA, 20 nt, Artificial Sequence
  MKO10042258_A_Ppox
  gRNA
accgguggguuuguucagcu

SEQ ID NO: 42259 - RNA, 20 nt, Artificial Sequence
  MKO10042259_A_Ppp1ca
  gRNA
cugacagagaacgagauccg

SEQ ID NO: 42260 - RNA, 20 nt, Artificial Sequence
  MKO10042260_A_Ppp1ca
  gRNA
agcagauuaggcguauuaug

SEQ ID NO: 42261 - RNA, 20 nt, Artificial Sequence
  MKO10042261_A_Ppp1ca
  gRNA
cauacucaaacagccguaga

SEQ ID NO: 42262 - RNA, 20 nt, Artificial Sequence
  MKO10042262_A_Ppp1cb
  gRNA
ccaguacgaggaugucgucc

SEQ ID NO: 42263 - RNA, 20 nt, Artificial Sequence
  MKO10042263_A_Ppp1cb
  gRNA
accuguaucagguacgucag

SEQ ID NO: 42264 - RNA, 20 nt, Artificial Sequence
  MKO10042264_A_Ppp1cb
  gRNA
cccacugacguaccugauac

SEQ ID NO: 42265 - RNA, 20 nt, Artificial Sequence
  MKO10042265_A_Ppp1cc
  gRNA
cacucaccacauaucuugag

SEQ ID NO: 42266 - RNA, 20 nt, Artificial Sequence
  MKO10042266_A_Ppp1cc
  gRNA
ucacccuuaggugacaucca

SEQ ID NO: 42267 - RNA, 20 nt, Artificial Sequence
  MKO10042267_A_Ppp1cc
  gRNA
acagugagaggguccaagcc

SEQ ID NO: 42268 - RNA, 20 nt, Artificial Sequence
  MKO10042268_A_Ppp1r10
  gRNA
acuuacuugacgagcacuuc

SEQ ID NO: 42269 - RNA, 20 nt, Artificial Sequence
  MKO10042269_A_Ppp1r10
  gRNA
accuucagagcuccggaaau

SEQ ID NO: 42270 - RNA, 20 nt, Artificial Sequence
  MKO10042270_A_Ppp1r10
  gRNA
gcuacaagcuucugaacaac

SEQ ID NO: 42271 - RNA, 20 nt, Artificial Sequence
  MKO10042271_A_Ppp1r11
  gRNA
uuguaggacgccguccuuug

SEQ ID NO: 42272 - RNA, 20 nt, Artificial Sequence
  MKO10042272_A_Ppp1r11
  gRNA
aguaaccguugucucaguga

SEQ ID NO: 42273 - RNA, 20 nt, Artificial Sequence
  MKO10042273_A_Ppp1r11
  gRNA
gcuuuagccauggcggagac

SEQ ID NO: 42274 - RNA, 20 nt, Artificial Sequence
  MKO10042274_A_Ppp1r12a
  gRNA
caugccggacgucacugaug

SEQ ID NO: 42275 - RNA, 20 nt, Artificial Sequence
  MKO10042275_A_Ppp1r12a
  gRNA
ugcaauaucgagauauccac

SEQ ID NO: 42276 - RNA, 20 nt, Artificial Sequence
  MKO10042276_A_Ppp1r12a
  gRNA
ggguaaugcuaagagacgcg

SEQ ID NO: 42277 - RNA, 20 nt, Artificial Sequence
  MKO10042277_A_Ppp1r12b
  gRNA
gcguugaucuagagcaguca

SEQ ID NO: 42278 - RNA, 20 nt, Artificial Sequence
  MKO10042278_A_Ppp1r12b
  gRNA
uccagcccucguuguccugc

SEQ ID NO: 42279 - RNA, 20 nt, Artificial Sequence
  MKO10042279_A_Ppp1r12b
  gRNA
uucuuccgcuguugagccac

SEQ ID NO: 42280 - RNA, 20 nt, Artificial Sequence
  MKO10042280_A_Ppp1r12c
  gRNA
aaggcagagaucacucgccg

SEQ ID NO: 42281 - RNA, 20 nt, Artificial Sequence
  MKO10042281_A_Ppp1r12c
  gRNA
cauggauucgcugacccacg

SEQ ID NO: 42282 - RNA, 20 nt, Artificial Sequence
  MKO10042282_A_Ppp1r12c
  gRNA
uccagcccucguugucugcc

SEQ ID NO: 42283 - RNA, 20 nt, Artificial Sequence
  MKO10042283_A_Ppp1r13b
  gRNA
gaauucuacgacaucucgac

SEQ ID NO: 42284 - RNA, 20 nt, Artificial Sequence
  MKO10042284_A_Ppp1r13b
  gRNA
uggagagggcgguugccacc

SEQ ID NO: 42285 - RNA, 20 nt, Artificial Sequence
  MKO10042285_A_Ppp1r13b
  gRNA
uggcaaccaacauuugcugc

SEQ ID NO: 42286 - RNA, 20 nt, Artificial Sequence
  MKO10042286_A_Ppp1r13l
  gRNA
cucgacccccuuugacuauc

SEQ ID NO: 42287 - RNA, 20 nt, Artificial Sequence
  MKO10042287_A_Ppp1r13l
  gRNA
ugggcgauggcgcccgaucu

SEQ ID NO: 42288 - RNA, 20 nt, Artificial Sequence
  MKO10042288_A_Ppp1r13l
  gRNA
cagaugacucgacgcugcgc

SEQ ID NO: 42289 - RNA, 20 nt, Artificial Sequence
  MKO10042289_A_Ppp1r14a
  gRNA
gaagcggcacgcgcgaguca

SEQ ID NO: 42290 - RNA, 20 nt, Artificial Sequence
  MKO10042290_A_Ppp1r14a
  gRNA
ggucaacaucgaugagcuau

SEQ ID NO: 42291 - RNA, 20 nt, Artificial Sequence
  MKO10042291_A_Ppp1r14a
  gRNA
gcaagcugcaguccccgucg

SEQ ID NO: 42292 - RNA, 20 nt, Artificial Sequence
  MKO10042292_A_Ppp1r14b
  gRNA
accccaggaggaggagaucc

SEQ ID NO: 42293 - RNA, 20 nt, Artificial Sequence
  MKO10042293_A_Ppp1r14b
  gRNA
uuaccuugacccuagcagcc

SEQ ID NO: 42294 - RNA, 20 nt, Artificial Sequence
  MKO10042294_A_Ppp1r14b
  gRNA
gucaggacccucauuucuuc

SEQ ID NO: 42295 - RNA, 20 nt, Artificial Sequence
  MKO10042295_A_Ppp1r14c
  gRNA
cggcgccgaguccucccuug

SEQ ID NO: 42296 - RNA, 20 nt, Artificial Sequence
  MKO10042296_A_Ppp1r14c
  gRNA
cucaagggaggacucggcgc

SEQ ID NO: 42297 - RNA, 20 nt, Artificial Sequence
  MKO10042297_A_Ppp1r14c
  gRNA
ucuucuugaugccaacagcg

SEQ ID NO: 42298 - RNA, 20 nt, Artificial Sequence
  MKO10042298_A_Ppp1r14d
  gRNA
ggcugacggugaaguaugac

SEQ ID NO: 42299 - RNA, 20 nt, Artificial Sequence
  MKO10042299_A_Ppp1r14d
  gRNA
ucccuccaggauuauuucga

SEQ ID NO: 42300 - RNA, 20 nt, Artificial Sequence
  MKO10042300_A_Ppp1r14d
  gRNA
auacuucaccgucagccggc

SEQ ID NO: 42301 - RNA, 20 nt, Artificial Sequence
  MKO10042301_A_Ppp1r15a
  gRNA
ccagcccaagcugcccgucg

SEQ ID NO: 42302 - RNA, 20 nt, Artificial Sequence
  MKO10042302_A_Ppp1r15a
  gRNA
cuuugcucgacgcauugccc

SEQ ID NO: 42303 - RNA, 20 nt, Artificial Sequence
  MKO10042303_A_Ppp1r15a
  gRNA
ugagccgccucugcagucga

SEQ ID NO: 42304 - RNA, 20 nt, Artificial Sequence
  MKO10042304_A_Ppp1r15b
  gRNA
gccgacaucucugcccgcaa

SEQ ID NO: 42305 - RNA, 20 nt, Artificial Sequence
  MKO10042305_A_Ppp1r15b
  gRNA
ccaguaccugguccgacgcu

SEQ ID NO: 42306 - RNA, 20 nt, Artificial Sequence
  MKO10042306_A_Ppp1r15b
  gRNA
cuguuucuugaauucguuuc

SEQ ID NO: 42307 - RNA, 20 nt, Artificial Sequence
  MKO10042307_A_Ppp1r16a
  gRNA
guagguccuaccgugaaaua

SEQ ID NO: 42308 - RNA, 20 nt, Artificial Sequence
  MKO10042308_A_Ppp1r16a
  gRNA
cagguuggggcuaaccccac

SEQ ID NO: 42309 - RNA, 20 nt, Artificial Sequence
  MKO10042309_A_Ppp1r16a
  gRNA
cuccuugcagucaauuccga

SEQ ID NO: 42310 - RNA, 20 nt, Artificial Sequence
  MKO10042310_A_Ppp1r16b
  gRNA
ugggcacguacuacugaacg

SEQ ID NO: 42311 - RNA, 20 nt, Artificial Sequence
  MKO10042311_A_Ppp1r16b
  gRNA
caggaucucgacuggaucga

SEQ ID NO: 42312 - RNA, 20 nt, Artificial Sequence
  MKO10042312_A_Ppp1r16b
  gRNA
caucgauccagucgagaucc

SEQ ID NO: 42313 - RNA, 20 nt, Artificial Sequence
  MKO10042313_A_Ppp1r17
  gRNA
caccgagccagugccgccuc

SEQ ID NO: 42314 - RNA, 20 nt, Artificial Sequence
  MKO10042314_A_Ppp1r17
  gRNA
auaucagaguuaugaagagc

SEQ ID NO: 42315 - RNA, 20 nt, Artificial Sequence
  MKO10042315_A_Ppp1r17
  gRNA
augucgucugaaagcuccag

SEQ ID NO: 42316 - RNA, 20 nt, Artificial Sequence
  MKO10042316_A_Ppp1r18
  gRNA
augaaucgauucugauguac

SEQ ID NO: 42317 - RNA, 20 nt, Artificial Sequence
  MKO10042317_A_Ppp1r18
  gRNA
cagggggcgcacaccuccgu

SEQ ID NO: 42318 - RNA, 20 nt, Artificial Sequence
  MKO10042318_A_Ppp1r18
  gRNA
ggaagauggucaccgccggc

SEQ ID NO: 42319 - RNA, 20 nt, Artificial Sequence
  MKO10042319_A_Ppp1r1a
  gRNA
gucaucuucuuccguugccg

SEQ ID NO: 42320 - RNA, 20 nt, Artificial Sequence
  MKO10042320_A_Ppp1r1a
  gRNA
cuugacgccgagccuguguc

SEQ ID NO: 42321 - RNA, 20 nt, Artificial Sequence
  MKO10042321_A_Ppp1r1a
  gRNA
cagacacaggcucggcguca

SEQ ID NO: 42322 - RNA, 20 nt, Artificial Sequence
  MKO10042322_A_Ppp1r1b
  gRNA
uauacgcccccaucacugaa

SEQ ID NO: 42323 - RNA, 20 nt, Artificial Sequence
  MKO10042323_A_Ppp1r1b
  gRNA
caucucucuagauccggcgc

SEQ ID NO: 42324 - RNA, 20 nt, Artificial Sequence
  MKO10042324_A_Ppp1r1b
  gRNA
ggauuaguaccuuucaguga

SEQ ID NO: 42325 - RNA, 20 nt, Artificial Sequence
  MKO10042325_A_Ppp1r1c
  gRNA
agaaugcaucgccuaagcaa

SEQ ID NO: 42326 - RNA, 20 nt, Artificial Sequence
  MKO10042326_A_Ppp1r1c
  gRNA
cuagcaguaccuuucauggc

SEQ ID NO: 42327 - RNA, 20 nt, Artificial Sequence
  MKO10042327_A_Ppp1r1c
  gRNA
cucaaugaacauaauucccc

SEQ ID NO: 42328 - RNA, 20 nt, Artificial Sequence
  MKO10042328_A_Ppp1r21
  gRNA
gaacgaacggcugcacauac

SEQ ID NO: 42329 - RNA, 20 nt, Artificial Sequence
  MKO10042329_A_Ppp1r21
  gRNA
cuagcacuaagugaaccucg

SEQ ID NO: 42330 - RNA, 20 nt, Artificial Sequence
  MKO10042330_A_Ppp1r21
  gRNA
ucaggccgucgaucacagcu

SEQ ID NO: 42331 - RNA, 20 nt, Artificial Sequence
  MKO10042331_A_Ppp1r26
  gRNA
caacccugugccgauaucuc

SEQ ID NO: 42332 - RNA, 20 nt, Artificial Sequence
  MKO10042332_A_Ppp1r26
  gRNA
ggcgcuccaguccagauggg

SEQ ID NO: 42333 - RNA, 20 nt, Artificial Sequence
  MKO10042333_A_Ppp1r26
  gRNA
cccacgggcuuccuguaaga

SEQ ID NO: 42334 - RNA, 20 nt, Artificial Sequence
  MKO10042334_A_Ppp1r27
  gRNA
agcgagcauagcggaccguu

SEQ ID NO: 42335 - RNA, 20 nt, Artificial Sequence
  MKO10042335_A_Ppp1r27
  gRNA
ccacauucgacaaggcgacc

SEQ ID NO: 42336 - RNA, 20 nt, Artificial Sequence
  MKO10042336_A_Ppp1r27
  gRNA
gcccuccgaccuuauugacc

SEQ ID NO: 42337 - RNA, 20 nt, Artificial Sequence
  MKO10042337_A_Ppp1r2
  gRNA
aaugaccuaccucgcuccuc

SEQ ID NO: 42338 - RNA, 20 nt, Artificial Sequence
  MKO10042338_A_Ppp1r2
  gRNA
cgucacguuacuugugauau

SEQ ID NO: 42339 - RNA, 20 nt, Artificial Sequence
  MKO10042339_A_Ppp1r2
  gRNA
cguagauuagcugcugcuga

SEQ ID NO: 42340 - RNA, 20 nt, Artificial Sequence
  MKO10042340_A_Ppp1r32
  gRNA
gugcgaguucucccacuccg

SEQ ID NO: 42341 - RNA, 20 nt, Artificial Sequence
  MKO10042341_A_Ppp1r32
  gRNA
ucuccccuagaagugcccga

SEQ ID NO: 42342 - RNA, 20 nt, Artificial Sequence
  MKO10042342_A_Ppp1r32
  gRNA
gaagguccacuucgacaccc

SEQ ID NO: 42343 - RNA, 20 nt, Artificial Sequence
  MKO10042343_A_Ppp1r35
  gRNA
cccgcugcccgaaaguccga

SEQ ID NO: 42344 - RNA, 20 nt, Artificial Sequence
  MKO10042344_A_Ppp1r35
  gRNA
uccagcucaugaucgucgcc

SEQ ID NO: 42345 - RNA, 20 nt, Artificial Sequence
  MKO10042345_A_Ppp1r35
  gRNA
cuuccgcgccuucggacuuu

SEQ ID NO: 42346 - RNA, 20 nt, Artificial Sequence
  MKO10042346_A_Ppp1r36
  gRNA
cagcaauguggauuacgacu

SEQ ID NO: 42347 - RNA, 20 nt, Artificial Sequence
  MKO10042347_A_Ppp1r36
  gRNA
agccgccuucucaucccuug

SEQ ID NO: 42348 - RNA, 20 nt, Artificial Sequence
  MKO10042348_A_Ppp1r36
  gRNA
cagcuuguaccucaaaaacg

SEQ ID NO: 42349 - RNA, 20 nt, Artificial Sequence
  MKO10042349_A_Ppp1r37
  gRNA
caugauugaguacuacgagu

SEQ ID NO: 42350 - RNA, 20 nt, Artificial Sequence
  MKO10042350_A_Ppp1r37
  gRNA
ugagcaacgcaucaacugcc

SEQ ID NO: 42351 - RNA, 20 nt, Artificial Sequence
  MKO10042351_A_Ppp1r37
  gRNA
uacccaccuugcgcaucaug

SEQ ID NO: 42352 - RNA, 20 nt, Artificial Sequence
  MKO10042352_A_Ppp1r3a
  gRNA
gucucaccgucgcacgaguu

SEQ ID NO: 42353 - RNA, 20 nt, Artificial Sequence
  MKO10042353_A_Ppp1r3a
  gRNA
ccucuagcagacgcgcuuuc

SEQ ID NO: 42354 - RNA, 20 nt, Artificial Sequence
  MKO10042354_A_Ppp1r3a
  gRNA
uauguuccuaacucgugcga

SEQ ID NO: 42355 - RNA, 20 nt, Artificial Sequence
  MKO10042355_A_Ppp1r3b
  gRNA
ggccaucgcgggcaccguga

SEQ ID NO: 42356 - RNA, 20 nt, Artificial Sequence
  MKO10042356_A_Ppp1r3b
  gRNA
gaccuucacggugcccgcga

SEQ ID NO: 42357 - RNA, 20 nt, Artificial Sequence
  MKO10042357_A_Ppp1r3b
  gRNA
gccgugugcuacgaguguaa

SEQ ID NO: 42358 - RNA, 20 nt, Artificial Sequence
  MKO10042358_A_Ppp1r3c
  gRNA
gaaacuuaaguagucgguug

SEQ ID NO: 42359 - RNA, 20 nt, Artificial Sequence
  MKO10042359_A_Ppp1r3c
  gRNA
cgcaaacacgacccgcuucu

SEQ ID NO: 42360 - RNA, 20 nt, Artificial Sequence
  MKO10042360_A_Ppp1r3c
  gRNA
ucgguccaaugagcugcacc

SEQ ID NO: 42361 - RNA, 20 nt, Artificial Sequence
  MKO10042361_A_Ppp1r3d
  gRNA
gcagcgagcgcgagcgucgu

SEQ ID NO: 42362 - RNA, 20 nt, Artificial Sequence
  MKO10042362_A_Ppp1r3d
  gRNA
gucgucgauccauguccgag

SEQ ID NO: 42363 - RNA, 20 nt, Artificial Sequence
  MKO10042363_A_Ppp1r3d
  gRNA
aggcgcgacaacacgugcag

SEQ ID NO: 42364 - RNA, 20 nt, Artificial Sequence
  MKO10042364_A_Ppp1r3e
  gRNA
uugcgggguauauccgugcg

SEQ ID NO: 42365 - RNA, 20 nt, Artificial Sequence
  MKO10042365_A_Ppp1r3e
  gRNA
aagagcagcguuccgccgac

SEQ ID NO: 42366 - RNA, 20 nt, Artificial Sequence
  MKO10042366_A_Ppp1r3e
  gRNA
aggaggcgggcgauucccgc

SEQ ID NO: 42367 - RNA, 20 nt, Artificial Sequence
  MKO10042367_A_Ppp1r3f
  gRNA
cauagcgcaccacgaagucg

SEQ ID NO: 42368 - RNA, 20 nt, Artificial Sequence
  MKO10042368_A_Ppp1r3f
  gRNA
gcggacgauaauacccuagc

SEQ ID NO: 42369 - RNA, 20 nt, Artificial Sequence
  MKO10042369_A_Ppp1r3f
  gRNA
cacgcugcacuaugcgcgcc

SEQ ID NO: 42370 - RNA, 20 nt, Artificial Sequence
  MKO10042370_A_Ppp1r3g
  gRNA
cgucugcuaccgcugcgaac

SEQ ID NO: 42371 - RNA, 20 nt, Artificial Sequence
  MKO10042371_A_Ppp1r3g
  gRNA
agacgggaaaguacggccgg

SEQ ID NO: 42372 - RNA, 20 nt, Artificial Sequence
  MKO10042372_A_Ppp1r3g
  gRNA
uuccggagacccucaauccg

SEQ ID NO: 42373 - RNA, 20 nt, Artificial Sequence
  MKO10042373_A_Ppp1r42
  gRNA
gauacugacguccaagucac

SEQ ID NO: 42374 - RNA, 20 nt, Artificial Sequence
  MKO10042374_A_Ppp1r42
  gRNA
uuaccuucacgugcaucagc

SEQ ID NO: 42375 - RNA, 20 nt, Artificial Sequence
  MKO10042375_A_Ppp1r42
  gRNA
caaccagcugaugcacguga

SEQ ID NO: 42376 - RNA, 20 nt, Artificial Sequence
  MKO10042376_A_Ppp1r7
  gRNA
gaucugacucacuaucgaau

SEQ ID NO: 42377 - RNA, 20 nt, Artificial Sequence
  MKO10042377_A_Ppp1r7
  gRNA
acugcagagucuucgagaac

SEQ ID NO: 42378 - RNA, 20 nt, Artificial Sequence
  MKO10042378_A_Ppp1r7
  gRNA
cccgaucuacuccauccuuc

SEQ ID NO: 42379 - RNA, 20 nt, Artificial Sequence
  MKO10042379_A_Ppp1r8
  gRNA
ucucauuuggcgcguccacg

SEQ ID NO: 42380 - RNA, 20 nt, Artificial Sequence
  MKO10042380_A_Ppp1r8
  gRNA
ugugguacaccagcgcugcg

SEQ ID NO: 42381 - RNA, 20 nt, Artificial Sequence
  MKO10042381_A_Ppp1r8
  gRNA
cuuguugggacuucccgaag

SEQ ID NO: 42382 - RNA, 20 nt, Artificial Sequence
  MKO10042382_A_Ppp1r9a
  gRNA
ucccauagacgaggacgggc

SEQ ID NO: 42383 - RNA, 20 nt, Artificial Sequence
  MKO10042383_A_Ppp1r9a
  gRNA
ccuucccgcagauucguuau

SEQ ID NO: 42384 - RNA, 20 nt, Artificial Sequence
  MKO10042384_A_Ppp1r9a
  gRNA
gcugucgccgcucuuguucc

SEQ ID NO: 42385 - RNA, 20 nt, Artificial Sequence
  MKO10042385_A_Ppp1r9b
  gRNA
gauccacauccucauugcgu

SEQ ID NO: 42386 - RNA, 20 nt, Artificial Sequence
  MKO10042386_A_Ppp1r9b
  gRNA
gauccaagugaacgaccugc

SEQ ID NO: 42387 - RNA, 20 nt, Artificial Sequence
  MKO10042387_A_Ppp1r9b
  gRNA
gagauacgcccaguauggag

SEQ ID NO: 42388 - RNA, 20 nt, Artificial Sequence
  MKO10042388_A_Ppp2ca
  gRNA
ccgagcacucgaucgccuac

SEQ ID NO: 42389 - RNA, 20 nt, Artificial Sequence
  MKO10042389_A_Ppp2ca
  gRNA
acaucgaaccucuugaacgu

SEQ ID NO: 42390 - RNA, 20 nt, Artificial Sequence
  MKO10042390_A_Ppp2ca
  gRNA
gggauaucuccucggggagc

SEQ ID NO: 42391 - RNA, 20 nt, Artificial Sequence
  MKO10042391_A_Ppp2cb
  gRNA
gagcgcaucacaauauugcg

SEQ ID NO: 42392 - RNA, 20 nt, Artificial Sequence
  MKO10042392_A_Ppp2cb
  gRNA
cgcaauauugugaugcgcuc

SEQ ID NO: 42393 - RNA, 20 nt, Artificial Sequence
  MKO10042393_A_Ppp2cb
  gRNA
gaacuucuugcaagcgaucc

SEQ ID NO: 42394 - RNA, 20 nt, Artificial Sequence
  MKO10042394_A_Ppp2r1a
  gRNA
gcacucaccuuccgaucuag

SEQ ID NO: 42395 - RNA, 20 nt, Artificial Sequence
  MKO10042395_A_Ppp2r1a
  gRNA
cccgccagccgcuuuaccag

SEQ ID NO: 42396 - RNA, 20 nt, Artificial Sequence
  MKO10042396_A_Ppp2r1a
  gRNA
cugacuuaccugcucgucag

SEQ ID NO: 42397 - RNA, 20 nt, Artificial Sequence
  MKO10042397_A_Ppp2r1b
  gRNA
ucgucgauuaaaaccgcgau

SEQ ID NO: 42398 - RNA, 20 nt, Artificial Sequence
  MKO10042398_A_Ppp2r1b
  gRNA
acgucgcgcacgucugcaug

SEQ ID NO: 42399 - RNA, 20 nt, Artificial Sequence
  MKO10042399_A_Ppp2r1b
  gRNA
cgauucgcucuacccgaucg

SEQ ID NO: 42400 - RNA, 20 nt, Artificial Sequence
  MKO10042400_A_Ppp2r2a
  gRNA
guagaugaugacguagcaga

SEQ ID NO: 42401 - RNA, 20 nt, Artificial Sequence
  MKO10042401_A_Ppp2r2a
  gRNA
cguugguagacaauaaaaac

SEQ ID NO: 42402 - RNA, 20 nt, Artificial Sequence
  MKO10042402_A_Ppp2r2a
  gRNA
cuucuuccaggagcuggagg

SEQ ID NO: 42403 - RNA, 20 nt, Artificial Sequence
  MKO10042403_A_Ppp2r2b
  gRNA
ucgcuaguaacucucccgug

SEQ ID NO: 42404 - RNA, 20 nt, Artificial Sequence
  MKO10042404_A_Ppp2r2b
  gRNA
cgaacucggguucauggcuc

SEQ ID NO: 42405 - RNA, 20 nt, Artificial Sequence
  MKO10042405_A_Ppp2r2b
  gRNA
cguaauauuucagcgagaac

SEQ ID NO: 42406 - RNA, 20 nt, Artificial Sequence
  MKO10042406_A_Ppp2r2c
  gRNA
acgaccuacgcaucaaccuc

SEQ ID NO: 42407 - RNA, 20 nt, Artificial Sequence
  MKO10042407_A_Ppp2r2c
  gRNA
agugugguugaacucgacag

SEQ ID NO: 42408 - RNA, 20 nt, Artificial Sequence
  MKO10042408_A_Ppp2r2c
  gRNA
cgucucacagucgcuguuga

SEQ ID NO: 42409 - RNA, 20 nt, Artificial Sequence
  MKO10042409_A_Ppp2r2d
  gRNA
cgggcggcaacgacuuccag

SEQ ID NO: 42410 - RNA, 20 nt, Artificial Sequence
  MKO10042410_A_Ppp2r2d
  gRNA
cguagugccguaauucuaaa

SEQ ID NO: 42411 - RNA, 20 nt, Artificial Sequence
  MKO10042411_A_Ppp2r2d
  gRNA
ggugaagggcgcugucgacg

SEQ ID NO: 42412 - RNA, 20 nt, Artificial Sequence
  MKO10042412_A_Ppp2r3a
  gRNA
auccuaccguggugauguag

SEQ ID NO: 42413 - RNA, 20 nt, Artificial Sequence
  MKO10042413_A_Ppp2r3a
  gRNA
gaugugguagauacccaccc

SEQ ID NO: 42414 - RNA, 20 nt, Artificial Sequence
  MKO10042414_A_Ppp2r3a
  gRNA
gaggccggcuggggacuacu

SEQ ID NO: 42415 - RNA, 20 nt, Artificial Sequence
  MKO10042415_A_Ppp2r3c
  gRNA
caccagauaccaccuaugau

SEQ ID NO: 42416 - RNA, 20 nt, Artificial Sequence
  MKO10042416_A_Ppp2r3c
  gRNA
uuuaacuacgucaugcgaaa

SEQ ID NO: 42417 - RNA, 20 nt, Artificial Sequence
  MKO10042417_A_Ppp2r3c
  gRNA
cuuagauaacgaagaguugc

SEQ ID NO: 42418 - RNA, 20 nt, Artificial Sequence
  MKO10042418_A_Ppp2r3d
  gRNA
cgucgcaguccucgucagca

SEQ ID NO: 42419 - RNA, 20 nt, Artificial Sequence
  MKO10042419_A_Ppp2r3d
  gRNA
cgcuggaccgaguugucaaa

SEQ ID NO: 42420 - RNA, 20 nt, Artificial Sequence
  MKO10042420_A_Ppp2r3d
  gRNA
cuaagugucgaccauucuuc

SEQ ID NO: 42421 - RNA, 20 nt, Artificial Sequence
  MKO10042421_A_Ppp2r4
  gRNA
cacuucuugauacgcuggau

SEQ ID NO: 42422 - RNA, 20 nt, Artificial Sequence
  MKO10042422_A_Ppp2r4
  gRNA
ugugccauagucaauucgug

SEQ ID NO: 42423 - RNA, 20 nt, Artificial Sequence
  MKO10042423_A_Ppp2r4
  gRNA
cucagagacuuuguagucga

SEQ ID NO: 42424 - RNA, 20 nt, Artificial Sequence
  MKO10042424_A_Ppp2r5a
  gRNA
acuugccguaaauccgaugc

SEQ ID NO: 42425 - RNA, 20 nt, Artificial Sequence
  MKO10042425_A_Ppp2r5a
  gRNA
ugaucagaaguuuguccaac

SEQ ID NO: 42426 - RNA, 20 nt, Artificial Sequence
  MKO10042426_A_Ppp2r5a
  gRNA
auagcucauaccuguaugug

SEQ ID NO: 42427 - RNA, 20 nt, Artificial Sequence
  MKO10042427_A_Ppp2r5b
  gRNA
cgggcucgaugagcacaccc

SEQ ID NO: 42428 - RNA, 20 nt, Artificial Sequence
  MKO10042428_A_Ppp2r5b
  gRNA
gccguacacccgaugcaaga

SEQ ID NO: 42429 - RNA, 20 nt, Artificial Sequence
  MKO10042429_A_Ppp2r5b
  gRNA
cuuaccaugcggaugauguc

SEQ ID NO: 42430 - RNA, 20 nt, Artificial Sequence
  MKO10042430_A_Ppp2r5c
  gRNA
ugggcuccgugaucacguuc

SEQ ID NO: 42431 - RNA, 20 nt, Artificial Sequence
  MKO10042431_A_Ppp2r5c
  gRNA
caacgggccuuuccagcccg

SEQ ID NO: 42432 - RNA, 20 nt, Artificial Sequence
  MKO10042432_A_Ppp2r5c
  gRNA
aaaagcuucucuugauccgc

SEQ ID NO: 42433 - RNA, 20 nt, Artificial Sequence
  MKO10042433_A_Ppp2r5d
  gRNA
acuguugcugggucgcuugu

SEQ ID NO: 42434 - RNA, 20 nt, Artificial Sequence
  MKO10042434_A_Ppp2r5d
  gRNA
uaaacagcuccucacguucc

SEQ ID NO: 42435 - RNA, 20 nt, Artificial Sequence
  MKO10042435_A_Ppp2r5d
  gRNA
uggaggggagaacaccgaug

SEQ ID NO: 42436 - RNA, 20 nt, Artificial Sequence
  MKO10042436_A_Ppp2r5e
  gRNA
uuuaaauagucccguucucg

SEQ ID NO: 42437 - RNA, 20 nt, Artificial Sequence
  MKO10042437_A_Ppp2r5e
  gRNA
gcgcuccacucuuaaugaac

SEQ ID NO: 42438 - RNA, 20 nt, Artificial Sequence
  MKO10042438_A_Ppp2r5e
  gRNA
acagugaagacccucgagaa

SEQ ID NO: 42439 - RNA, 20 nt, Artificial Sequence
  MKO10042439_A_Ppp3ca
  gRNA
gcugguucauuagcgcagcc

SEQ ID NO: 42440 - RNA, 20 nt, Artificial Sequence
  MKO10042440_A_Ppp3ca
  gRNA
gcagucgaaggcauccauac

SEQ ID NO: 42441 - RNA, 20 nt, Artificial Sequence
  MKO10042441_A_Ppp3ca
  gRNA
ccgacaggaaaaaaacuugc

SEQ ID NO: 42442 - RNA, 20 nt, Artificial Sequence
  MKO10042442_A_Ppp3cb
  gRNA
ucagaugucagccgaugagu

SEQ ID NO: 42443 - RNA, 20 nt, Artificial Sequence
  MKO10042443_A_Ppp3cb
  gRNA
gaaguagaagcuccaauuac

SEQ ID NO: 42444 - RNA, 20 nt, Artificial Sequence
  MKO10042444_A_Ppp3cb
  gRNA
aagagucuaugaagcuugua

SEQ ID NO: 42445 - RNA, 20 nt, Artificial Sequence
  MKO10042445_A_Ppp3cc
  gRNA
cuuccuucaaaguuagccgu

SEQ ID NO: 42446 - RNA, 20 nt, Artificial Sequence
  MKO10042446_A_Ppp3cc
  gRNA
uaauacucgcuaccucuucc

SEQ ID NO: 42447 - RNA, 20 nt, Artificial Sequence
  MKO10042447_A_Ppp3cc
  gRNA
cggagccuccaccucuauca

SEQ ID NO: 42448 - RNA, 20 nt, Artificial Sequence
  MKO10042448_A_Ppp3r1
  gRNA
ucuauuacccgcuguacuaa

SEQ ID NO: 42449 - RNA, 20 nt, Artificial Sequence
  MKO10042449_A_Ppp3r1
  gRNA
aaaugaggcgaguuacccuu

SEQ ID NO: 42450 - RNA, 20 nt, Artificial Sequence
  MKO10042450_A_Ppp3r1
  gRNA
agcagaacccuuuaguacag

SEQ ID NO: 42451 - RNA, 20 nt, Artificial Sequence
  MKO10042451_A_Ppp3r2
  gRNA
ugucgaagaugucgaucacu

SEQ ID NO: 42452 - RNA, 20 nt, Artificial Sequence
  MKO10042452_A_Ppp3r2
  gRNA
cgccuucagaaucuacgaca

SEQ ID NO: 42453 - RNA, 20 nt, Artificial Sequence
  MKO10042453_A_Ppp3r2
  gRNA
gcugugcaaccacuucgacc

SEQ ID NO: 42454 - RNA, 20 nt, Artificial Sequence
  MKO10042454_A_Ppp4c
  gRNA
ugagagucgccagauuaccc

SEQ ID NO: 42455 - RNA, 20 nt, Artificial Sequence
  MKO10042455_A_Ppp4c
  gRNA
ggcgacucucaugauugccc

SEQ ID NO: 42456 - RNA, 20 nt, Artificial Sequence
  MKO10042456_A_Ppp4c
  gRNA
uccucaccuuaagagccagc

SEQ ID NO: 42457 - RNA, 20 nt, Artificial Sequence
  MKO10042457_A_Ppp4r1
  gRNA
ucacguccguccgcguccuc

SEQ ID NO: 42458 - RNA, 20 nt, Artificial Sequence
  MKO10042458_A_Ppp4r1
  gRNA
agccgauuagcugaugacuc

SEQ ID NO: 42459 - RNA, 20 nt, Artificial Sequence
  MKO10042459_A_Ppp4r1
  gRNA
gaccugccggaggacgcgga

SEQ ID NO: 42460 - RNA, 20 nt, Artificial Sequence
  MKO10042460_A_Ppp4r2
  gRNA
gauccgagaagaaacuauac

SEQ ID NO: 42461 - RNA, 20 nt, Artificial Sequence
  MKO10042461_A_Ppp4r2
  gRNA
guuccuguauaguuucuucu

SEQ ID NO: 42462 - RNA, 20 nt, Artificial Sequence
  MKO10042462_A_Ppp4r2
  gRNA
cagagaaacugauccaguac

SEQ ID NO: 42463 - RNA, 20 nt, Artificial Sequence
  MKO10042463_A_Ppp4r4
  gRNA
aguccugcaugucgcaagcg

SEQ ID NO: 42464 - RNA, 20 nt, Artificial Sequence
  MKO10042464_A_Ppp4r4
  gRNA
ucuccacgcuugcgacaugc

SEQ ID NO: 42465 - RNA, 20 nt, Artificial Sequence
  MKO10042465_A_Ppp4r4
  gRNA
cauuaggugucagcaaugca

SEQ ID NO: 42466 - RNA, 20 nt, Artificial Sequence
  MKO10042466_A_Ppp5c
  gRNA
gaucgcguucucguaguccu

SEQ ID NO: 42467 - RNA, 20 nt, Artificial Sequence
  MKO10042467_A_Ppp5c
  gRNA
ucaccgucucguagucacgc

SEQ ID NO: 42468 - RNA, 20 nt, Artificial Sequence
  MKO10042468_A_Ppp5c
  gRNA
ucugugcucgucacccgcaa

SEQ ID NO: 42469 - RNA, 20 nt, Artificial Sequence
  MKO10042469_A_Ppp6c
  gRNA
ucaacgccaguaacagugug

SEQ ID NO: 42470 - RNA, 20 nt, Artificial Sequence
  MKO10042470_A_Ppp6c
  gRNA
gaugagugccaaaccaaaua

SEQ ID NO: 42471 - RNA, 20 nt, Artificial Sequence
  MKO10042471_A_Ppp6c
  gRNA
augucaccacacacuguuac

SEQ ID NO: 42472 - RNA, 20 nt, Artificial Sequence
  MKO10042472_A_Ppp6r1
  gRNA
agccgcgagcagaugaucca

SEQ ID NO: 42473 - RNA, 20 nt, Artificial Sequence
  MKO10042473_A_Ppp6r1
  gRNA
cacccagggcaucguugauc

SEQ ID NO: 42474 - RNA, 20 nt, Artificial Sequence
  MKO10042474_A_Ppp6r1
  gRNA
uaucaaucgcaagacagacc

SEQ ID NO: 42475 - RNA, 20 nt, Artificial Sequence
  MKO10042475_A_Ppp6r2
  gRNA
cucacgacuccaauguuaug

SEQ ID NO: 42476 - RNA, 20 nt, Artificial Sequence
  MKO10042476_A_Ppp6r2
  gRNA
agacccccuccucauaacau

SEQ ID NO: 42477 - RNA, 20 nt, Artificial Sequence
  MKO10042477_A_Ppp6r2
  gRNA
ccacagaucagcgacagacu

SEQ ID NO: 42478 - RNA, 20 nt, Artificial Sequence
  MKO10042478_A_Ppp6r3
  gRNA
cuuacaucuucuucuugcga

SEQ ID NO: 42479 - RNA, 20 nt, Artificial Sequence
  MKO10042479_A_Ppp6r3
  gRNA
guauugagccuccacaaccc

SEQ ID NO: 42480 - RNA, 20 nt, Artificial Sequence
  MKO10042480_A_Ppp6r3
  gRNA
gcuauacaauuucauuagca

SEQ ID NO: 42481 - RNA, 20 nt, Artificial Sequence
  MKO10042481_A_Pprc1
  gRNA
gcaccacgacugggaucucg

SEQ ID NO: 42482 - RNA, 20 nt, Artificial Sequence
  MKO10042482_A_Pprc1
  gRNA
uggacacuuuguguuucggc

SEQ ID NO: 42483 - RNA, 20 nt, Artificial Sequence
  MKO10042483_A_Pprc1
  gRNA
cacccgacuacuuccugugc

SEQ ID NO: 42484 - RNA, 20 nt, Artificial Sequence
  MKO10042484_A_Ppt1
  gRNA
uuuggacucccccgaugccc

SEQ ID NO: 42485 - RNA, 20 nt, Artificial Sequence
  MKO10042485_A_Ppt1
  gRNA
ucaccguucuugcacaaguu

SEQ ID NO: 42486 - RNA, 20 nt, Artificial Sequence
  MKO10042486_A_Ppt1
  gRNA
uacguccugucucuagagau

SEQ ID NO: 42487 - RNA, 20 nt, Artificial Sequence
  MKO10042487_A_Ppt2
  gRNA
ccaugcggucuaaccucuau

SEQ ID NO: 42488 - RNA, 20 nt, Artificial Sequence
  MKO10042488_A_Ppt2
  gRNA
gacuauagcagacccgauag

SEQ ID NO: 42489 - RNA, 20 nt, Artificial Sequence
  MKO10042489_A_Ppt2
  gRNA
ggcggucuuaccaguggcau

SEQ ID NO: 42490 - RNA, 20 nt, Artificial Sequence
  MKO10042490_A_Ppuc7
  gRNA
gaugugcuaucagcagcguc

SEQ ID NO: 42491 - RNA, 20 nt, Artificial Sequence
  MKO10042491_A_Ppuc7
  gRNA
ccgcuugcacacagcgaacc

SEQ ID NO: 42492 - RNA, 20 nt, Artificial Sequence
  MKO10042492_A_Ppuc7
  gRNA
gccugauuacaugauccucc

SEQ ID NO: 42493 - RNA, 20 nt, Artificial Sequence
  MKO10042493_A_Ppwd1
  gRNA
aauccgggaugauugaguac

SEQ ID NO: 42494 - RNA, 20 nt, Artificial Sequence
  MKO10042494_A_Ppwd1
  gRNA
cggugaugauaaagcgauga

SEQ ID NO: 42495 - RNA, 20 nt, Artificial Sequence
  MKO10042495_A_Ppwd1
  gRNA
aguccaguacucaaucaucc

SEQ ID NO: 42496 - RNA, 20 nt, Artificial Sequence
  MKO10042496_A_Ppy
  gRNA
cccuguuucucguauccacu

SEQ ID NO: 42497 - RNA, 20 nt, Artificial Sequence
  MKO10042497_A_Ppy
  gRNA
gcauagucgccuggguacau

SEQ ID NO: 42498 - RNA, 20 nt, Artificial Sequence
  MKO10042498_A_Ppy
  gRNA
cccugcaccagccccccagu

SEQ ID NO: 42499 - RNA, 20 nt, Artificial Sequence
  MKO10042499_A_Pqbp1
  gRNA
agagcgcaacuacgacaaag

SEQ ID NO: 42500 - RNA, 20 nt, Artificial Sequence
  MKO10042500_A_Pqbp1
  gRNA
gauuugguaacgacaaaguu

SEQ ID NO: 42501 - RNA, 20 nt, Artificial Sequence
  MKO10042501_A_Pqbp1
  gRNA
uggcagacccucuauccggg

SEQ ID NO: 42502 - RNA, 20 nt, Artificial Sequence
  MKO10042502_A_Pqlc1
  gRNA
cacaaacagagccgagucga

SEQ ID NO: 42503 - RNA, 20 nt, Artificial Sequence
  MKO10042503_A_Pqlc1
  gRNA
caguaguuucgguacagcug

SEQ ID NO: 42504 - RNA, 20 nt, Artificial Sequence
  MKO10042504_A_Pqlc1
  gRNA
ugcgccguugagcaagaagu

SEQ ID NO: 42505 - RNA, 20 nt, Artificial Sequence
  MKO10042505_A_Pqlc2
  gRNA
gacauaauacacagccgugu

SEQ ID NO: 42506 - RNA, 20 nt, Artificial Sequence
  MKO10042506_A_Pqlc2
  gRNA
cacggcuguguauuaugucc

SEQ ID NO: 42507 - RNA, 20 nt, Artificial Sequence
  MKO10042507_A_Pqlc2
  gRNA
cucacauuggugcgaaucug

SEQ ID NO: 42508 - RNA, 20 nt, Artificial Sequence
  MKO10042508_A_Pqlc3
  gRNA
cauaguaaugcugauaacga

SEQ ID NO: 42509 - RNA, 20 nt, Artificial Sequence
  MKO10042509_A_Pqlc3
  gRNA
guuaccuugugcgaugagaa

SEQ ID NO: 42510 - RNA, 20 nt, Artificial Sequence
  MKO10042510_A_Pqlc3
  gRNA
agucgaugauccauuucugc

SEQ ID NO: 42511 - RNA, 20 nt, Artificial Sequence
  MKO10042511_A_Pradc1
  gRNA
aagauguaucgaauaucccc

SEQ ID NO: 42512 - RNA, 20 nt, Artificial Sequence
  MKO10042512_A_Pradc1
  gRNA
cuacaugauccgccguucuc

SEQ ID NO: 42513 - RNA, 20 nt, Artificial Sequence
  MKO10042513_A_Pradc1
  gRNA
cccacgugcgucgcggccca

SEQ ID NO: 42514 - RNA, 20 nt, Artificial Sequence
  MKO10042514_A_Praf2
  gRNA
cgccuggaucaggagccgcc

SEQ ID NO: 42515 - RNA, 20 nt, Artificial Sequence
  MKO10042515_A_Praf2
  gRNA
cgccuggcggcuccugaucc

SEQ ID NO: 42516 - RNA, 20 nt, Artificial Sequence
  MKO10042516_A_Praf2
  gRNA
gcacacccuccugagugcac

SEQ ID NO: 42517 - RNA, 20 nt, Artificial Sequence
  MKO10042517_A_Pram1
  gRNA
ccgaguucaacucgcucccg

SEQ ID NO: 42518 - RNA, 20 nt, Artificial Sequence
  MKO10042518_A_Pram1
  gRNA
gauuguuaggcucgggcuuc

SEQ ID NO: 42519 - RNA, 20 nt, Artificial Sequence
  MKO10042519_A_Pram1
  gRNA
uacaguucguagaucucauc

SEQ ID NO: 42520 - RNA, 20 nt, Artificial Sequence
  MKO10042520_A_Pramef12
  gRNA
acgacaacaucuugcgcucc

SEQ ID NO: 42521 - RNA, 20 nt, Artificial Sequence
  MKO10042521_A_Pramef12
  gRNA
uguuugagcugucggaugcc

SEQ ID NO: 42522 - RNA, 20 nt, Artificial Sequence
  MKO10042522_A_Pramef12
  gRNA
aucuugcaaaccguacugga

SEQ ID NO: 42523 - RNA, 20 nt, Artificial Sequence
  MKO10042523_A_Pramef17
  gRNA
ugcgauacacauuguaucua

SEQ ID NO: 42524 - RNA, 20 nt, Artificial Sequence
  MKO10042524_A_Pramef17
  gRNA
auguguaucgcagucauaac

SEQ ID NO: 42525 - RNA, 20 nt, Artificial Sequence
  MKO10042525_A_Pramef17
  gRNA
uggagcauuaggagugucca

SEQ ID NO: 42526 - RNA, 20 nt, Artificial Sequence
  MKO10042526_A_Pramef25
  gRNA
aucuuccugacagugugaau

SEQ ID NO: 42527 - RNA, 20 nt, Artificial Sequence
  MKO10042527_A_Pramef25
  gRNA
gcuugcaauauugacauguc

SEQ ID NO: 42528 - RNA, 20 nt, Artificial Sequence
  MKO10042528_A_Pramef25
  gRNA
guauuucaagaugcuucaac

SEQ ID NO: 42529 - RNA, 20 nt, Artificial Sequence
  MKO10042529_A_Pramef6
  gRNA
cgccaggggcuagugaugca

SEQ ID NO: 42530 - RNA, 20 nt, Artificial Sequence
  MKO10042530_A_Pramef6
  gRNA
guguguuuaucgccaauucc

SEQ ID NO: 42531 - RNA, 20 nt, Artificial Sequence
  MKO10042531_A_Pramef6
  gRNA
gugugcagugaguaauagca

SEQ ID NO: 42532 - RNA, 20 nt, Artificial Sequence
  MKO10042532_A_Pramef8
  gRNA
uagguaccugaagaccccgu

SEQ ID NO: 42533 - RNA, 20 nt, Artificial Sequence
  MKO10042533_A_Pramef8
  gRNA
ucuugugaauccguguuaaa

SEQ ID NO: 42534 - RNA, 20 nt, Artificial Sequence
  MKO10042534_A_Pramef8
  gRNA
cuucacacagcauagccgua

SEQ ID NO: 42535 - RNA, 20 nt, Artificial Sequence
  MKO10042535_A_Pramel1
  gRNA
gaccuucucgaugaccccgg

SEQ ID NO: 42536 - RNA, 20 nt, Artificial Sequence
  MKO10042536_A_Pramel1
  gRNA
uguuauccacccacugaacg

SEQ ID NO: 42537 - RNA, 20 nt, Artificial Sequence
  MKO10042537_A_Pramel1
  gRNA
gcaaggcaucaagcccauac

SEQ ID NO: 42538 - RNA, 20 nt, Artificial Sequence
  MKO10042538_A_Pramel3
  gRNA
cagaguacuaucuacugauu

SEQ ID NO: 42539 - RNA, 20 nt, Artificial Sequence
  MKO10042539_A_Pramel3
  gRNA
gagucauaugaaccaccuga

SEQ ID NO: 42540 - RNA, 20 nt, Artificial Sequence
  MKO10042540_A_Pramel3
  gRNA
ugacagcaauugugaaagcu

SEQ ID NO: 42541 - RNA, 20 nt, Artificial Sequence
  MKO10042541_A_Pramel4
  gRNA
cucucaaaauagaccugcuu

SEQ ID NO: 42542 - RNA, 20 nt, Artificial Sequence
  MKO10042542_A_Pramel4
  gRNA
uuugugacaucagcaaauca

SEQ ID NO: 42543 - RNA, 20 nt, Artificial Sequence
  MKO10042543_A_Pramel4
  gRNA
gaaagcuacaaugagcuuca

SEQ ID NO: 42544 - RNA, 20 nt, Artificial Sequence
  MKO10042544_A_Pramel5
  gRNA
uagaaugucggcaguacuug

SEQ ID NO: 42545 - RNA, 20 nt, Artificial Sequence
  MKO10042545_A_Pramel5
  gRNA
gcccucacugucccgaacug

SEQ ID NO: 42546 - RNA, 20 nt, Artificial Sequence
  MKO10042546_A_Pramel5
  gRNA
aauucauaauuacguaaaca

SEQ ID NO: 42547 - RNA, 20 nt, Artificial Sequence
  MKO10042547_A_Pramel6
  gRNA
ugcuuugccacucgucuucc

SEQ ID NO: 42548 - RNA, 20 nt, Artificial Sequence
  MKO10042548_A_Pramel6
  gRNA
ucuucacacacucauguuag

SEQ ID NO: 42549 - RNA, 20 nt, Artificial Sequence
  MKO10042549_A_Pramel6
  gRNA
uuaaguauguucagcaguuc

SEQ ID NO: 42550 - RNA, 20 nt, Artificial Sequence
  MKO10042550_A_Pramel7
  gRNA
guacuagcaugaguuucuga

SEQ ID NO: 42551 - RNA, 20 nt, Artificial Sequence
  MKO10042551_A_Pramel7
  gRNA
cccacuccaauaacaguguu

SEQ ID NO: 42552 - RNA, 20 nt, Artificial Sequence
  MKO10042552_A_Pramel7
  gRNA
uaucucuacuauaacauagu

SEQ ID NO: 42553 - RNA, 20 nt, Artificial Sequence
  MKO10042553_A_Prame
  gRNA
ucauccgcccaagauaguug

SEQ ID NO: 42554 - RNA, 20 nt, Artificial Sequence
  MKO10042554_A_Prame
  gRNA
aagagacccauccucgcuuu

SEQ ID NO: 42555 - RNA, 20 nt, Artificial Sequence
  MKO10042555_A_Prame
  gRNA
cgaguguuccucaacuaucu

SEQ ID NO: 42556 - RNA, 20 nt, Artificial Sequence
  MKO10042556_A_Prap1
  gRNA
ccugcagcaccugacgauac

SEQ ID NO: 42557 - RNA, 20 nt, Artificial Sequence
  MKO10042557_A_Prap1
  gRNA
ucccaugucugacgaugucc

SEQ ID NO: 42558 - RNA, 20 nt, Artificial Sequence
  MKO10042558_A_Prap1
  gRNA
cagcagugcagccaccaaac

SEQ ID NO: 42559 - RNA, 20 nt, Artificial Sequence
  MKO10042559_A_Prb1
  gRNA
cucugaggaccuccauguag

SEQ ID NO: 42560 - RNA, 20 nt, Artificial Sequence
  MKO10042560_A_Prb1
  gRNA
cccacaaggcccguccccac

SEQ ID NO: 42561 - RNA, 20 nt, Artificial Sequence
  MKO10042561_A_Prb1
  gRNA
ccugcucacagcagcuuugc

SEQ ID NO: 42562 - RNA, 20 nt, Artificial Sequence
  MKO10042562_A_Prc1
  gRNA
gcuacaagugaagccauuuc

SEQ ID NO: 42563 - RNA, 20 nt, Artificial Sequence
  MKO10042563_A_Prc1
  gRNA
gaagcuauuccgacagcgug

SEQ ID NO: 42564 - RNA, 20 nt, Artificial Sequence
  MKO10042564_A_Prc1
  gRNA
ucucuuucaaagcuuguauc

SEQ ID NO: 42565 - RNA, 20 nt, Artificial Sequence
  MKO10042565_A_Prcc
  gRNA
ggcucacuagggauccggcg

SEQ ID NO: 42566 - RNA, 20 nt, Artificial Sequence
  MKO10042566_A_Prcc
  gRNA
ggucuuagaagccaaucuag

SEQ ID NO: 42567 - RNA, 20 nt, Artificial Sequence
  MKO10042567_A_Prcc
  gRNA
cuacuauccugcaccggacc

SEQ ID NO: 42568 - RNA, 20 nt, Artificial Sequence
  MKO10042568_A_Prcp
  gRNA
gccaccauaagagcccccga

SEQ ID NO: 42569 - RNA, 20 nt, Artificial Sequence
  MKO10042569_A_Prcp
  gRNA
uucgcugagcaucgauacua

SEQ ID NO: 42570 - RNA, 20 nt, Artificial Sequence
  MKO10042570_A_Prcp
  gRNA
ucaaccugucaucgccaucg

SEQ ID NO: 42571 - RNA, 20 nt, Artificial Sequence
  MKO10042571_A_Prdm10
  gRNA
gcgcuugggaauccgucuuu

SEQ ID NO: 42572 - RNA, 20 nt, Artificial Sequence
  MKO10042572_A_Prdm10
  gRNA
caguggaggggccgcugguc

SEQ ID NO: 42573 - RNA, 20 nt, Artificial Sequence
  MKO10042573_A_Prdm10
  gRNA
ggccauauugguaagcuacc

SEQ ID NO: 42574 - RNA, 20 nt, Artificial Sequence
  MKO10042574_A_Prdm11
  gRNA
cgacgugcgguguauaaacg

SEQ ID NO: 42575 - RNA, 20 nt, Artificial Sequence
  MKO10042575_A_Prdm11
  gRNA
ggucucauccgacccaucua

SEQ ID NO: 42576 - RNA, 20 nt, Artificial Sequence
  MKO10042576_A_Prdm11
  gRNA
gcaugccgagacauccggcc

SEQ ID NO: 42577 - RNA, 20 nt, Artificial Sequence
  MKO10042577_A_Prdm12
  gRNA
gccgguggcgcgcgcucuuc

SEQ ID NO: 42578 - RNA, 20 nt, Artificial Sequence
  MKO10042578_A_Prdm12
  gRNA
ccagagcgccuacucgcagc

SEQ ID NO: 42579 - RNA, 20 nt, Artificial Sequence
  MKO10042579_A_Prdm12
  gRNA
ggugcagaagcuaucuagcc

SEQ ID NO: 42580 - RNA, 20 nt, Artificial Sequence
  MKO10042580_A_Prdm13
  gRNA
cgacgugcgucuucuguccg

SEQ ID NO: 42581 - RNA, 20 nt, Artificial Sequence
  MKO10042581_A_Prdm13
  gRNA
gcacauccgacuccacgccg

SEQ ID NO: 42582 - RNA, 20 nt, Artificial Sequence
  MKO10042582_A_Prdm13
  gRNA
cccgucgccgccacuacggc

SEQ ID NO: 42583 - RNA, 20 nt, Artificial Sequence
  MKO10042583_A_Prdm14
  gRNA
uugaaaagcgcgaccgccuc

SEQ ID NO: 42584 - RNA, 20 nt, Artificial Sequence
  MKO10042584_A_Prdm14
  gRNA
ccugaaguacacgcccugug

SEQ ID NO: 42585 - RNA, 20 nt, Artificial Sequence
  MKO10042585_A_Prdm14
  gRNA
ggucaaugccagcgaaguga

SEQ ID NO: 42586 - RNA, 20 nt, Artificial Sequence
  MKO10042586_A_Prdm15
  gRNA
gugcuucgacacuuccaaug

SEQ ID NO: 42587 - RNA, 20 nt, Artificial Sequence
  MKO10042587_A_Prdm15
  gRNA
agaucaggcgccuggaugac

SEQ ID NO: 42588 - RNA, 20 nt, Artificial Sequence
  MKO10042588_A_Prdm15
  gRNA
cgccuucagccccgucaucc

SEQ ID NO: 42589 - RNA, 20 nt, Artificial Sequence
  MKO10042589_A_Prdm16
  gRNA
cuacgagaguccuccauacc

SEQ ID NO: 42590 - RNA, 20 nt, Artificial Sequence
  MKO10042590_A_Prdm16
  gRNA
cccgauuuccaucuuccgcu

SEQ ID NO: 42591 - RNA, 20 nt, Artificial Sequence
  MKO10042591_A_Prdm16
  gRNA
agccgacaccaugcgaucca

SEQ ID NO: 42592 - RNA, 20 nt, Artificial Sequence
  MKO10042592_A_Prdm1
  gRNA
ucccgccguuggagauccgc

SEQ ID NO: 42593 - RNA, 20 nt, Artificial Sequence
  MKO10042593_A_Prdm1
  gRNA
agaaguacccccgucagcgc

SEQ ID NO: 42594 - RNA, 20 nt, Artificial Sequence
  MKO10042594_A_Prdm1
  gRNA
acacgcuuuggaccccucau

SEQ ID NO: 42595 - RNA, 20 nt, Artificial Sequence
  MKO10042595_A_Prdm2
  gRNA
cgagucuugucgaccgcaga

SEQ ID NO: 42596 - RNA, 20 nt, Artificial Sequence
  MKO10042596_A_Prdm2
  gRNA
cuuugguagccaaucgcgcc

SEQ ID NO: 42597 - RNA, 20 nt, Artificial Sequence
  MKO10042597_A_Prdm2
  gRNA
aguccucgaagcacguguuc

SEQ ID NO: 42598 - RNA, 20 nt, Artificial Sequence
  MKO10042598_A_Prdm4
  gRNA
uguucuccgccaguccaucg

SEQ ID NO: 42599 - RNA, 20 nt, Artificial Sequence
  MKO10042599_A_Prdm4
  gRNA
gcaguccauacaccuaucaa

SEQ ID NO: 42600 - RNA, 20 nt, Artificial Sequence
  MKO10042600_A_Prdm4
  gRNA
accaacaucuguucccacga

SEQ ID NO: 42601 - RNA, 20 nt, Artificial Sequence
  MKO10042601_A_Prdm5
  gRNA
gcucgauucacacuguggac

SEQ ID NO: 42602 - RNA, 20 nt, Artificial Sequence
  MKO10042602_A_Prdm5
  gRNA
uguucacgaggcaccaucuc

SEQ ID NO: 42603 - RNA, 20 nt, Artificial Sequence
  MKO10042603_A_Prdm5
  gRNA
cauucgcuucuccccagcga

SEQ ID NO: 42604 - RNA, 20 nt, Artificial Sequence
  MKO10042604_A_Prdm6
  gRNA
ugagguauauccgaugugca

SEQ ID NO: 42605 - RNA, 20 nt, Artificial Sequence
  MKO10042605_A_Prdm6
  gRNA
cucauccagcucgacuuacu

SEQ ID NO: 42606 - RNA, 20 nt, Artificial Sequence
  MKO10042606_A_Prdm6
  gRNA
cggcacagaugccauacgcc

SEQ ID NO: 42607 - RNA, 20 nt, Artificial Sequence
  MKO10042607_A_Prdm8
  gRNA
gcucuuccgcucguccgaug

SEQ ID NO: 42608 - RNA, 20 nt, Artificial Sequence
  MKO10042608_A_Prdm8
  gRNA
ccacaacuuggcucgggaac

SEQ ID NO: 42609 - RNA, 20 nt, Artificial Sequence
  MKO10042609_A_Prdm8
  gRNA
ggcguucucugggaugucgc

SEQ ID NO: 42610 - RNA, 20 nt, Artificial Sequence
  MKO10042610_A_Prdm9
  gRNA
acauuagauucaccacuaaa

SEQ ID NO: 42611 - RNA, 20 nt, Artificial Sequence
  MKO10042611_A_Prdm9
  gRNA
ucaucuagaaugccauuuag

SEQ ID NO: 42612 - RNA, 20 nt, Artificial Sequence
  MKO10042612_A_Prdm9
  gRNA
cagcuuucauguguuaccaa

SEQ ID NO: 42613 - RNA, 20 nt, Artificial Sequence
  MKO10042613_A_Prdx1
  gRNA
cucuuggcaguguguccagc

SEQ ID NO: 42614 - RNA, 20 nt, Artificial Sequence
  MKO10042614_A_Prdx1
  gRNA
ccacagaagcgccaaucacu

SEQ ID NO: 42615 - RNA, 20 nt, Artificial Sequence
  MKO10042615_A_Prdx1
  gRNA
cguuuauuguuaucugucga

SEQ ID NO: 42616 - RNA, 20 nt, Artificial Sequence
  MKO10042616_A_Prdx2
  gRNA
cucuucccuagggaaguacg

SEQ ID NO: 42617 - RNA, 20 nt, Artificial Sequence
  MKO10042617_A_Prdx2
  gRNA
cagccccuuaccacgccagg

SEQ ID NO: 42618 - RNA, 20 nt, Artificial Sequence
  MKO10042618_A_Prdx2
  gRNA
ccuucaggaucaauacccca

SEQ ID NO: 42619 - RNA, 20 nt, Artificial Sequence
  MKO10042619_A_Prdx3
  gRNA
ccaacagcacuccguagucu

SEQ ID NO: 42620 - RNA, 20 nt, Artificial Sequence
  MKO10042620_A_Prdx3
  gRNA
gcugagucucgacgacuuua

SEQ ID NO: 42621 - RNA, 20 nt, Artificial Sequence
  MKO10042621_A_Prdx3
  gRNA
guaacacuuacuggugcuaa

SEQ ID NO: 42622 - RNA, 20 nt, Artificial Sequence
  MKO10042622_A_Prdx4
  gRNA
ccaacugaaaucaucgcuuu

SEQ ID NO: 42623 - RNA, 20 nt, Artificial Sequence
  MKO10042623_A_Prdx4
  gRNA
ucguccacugaucuuccgac

SEQ ID NO: 42624 - RNA, 20 nt, Artificial Sequence
  MKO10042624_A_Prdx4
  gRNA
aguggacgagacacugcguu

SEQ ID NO: 42625 - RNA, 20 nt, Artificial Sequence
  MKO10042625_A_Prdx5
  gRNA
gacgucauuaacgcucagac

SEQ ID NO: 42626 - RNA, 20 nt, Artificial Sequence
  MKO10042626_A_Prdx5
  gRNA
cuaggcgacagacuuauuau

SEQ ID NO: 42627 - RNA, 20 nt, Artificial Sequence
  MKO10042627_A_Prdx5
  gRNA
acgucuuugugauugaagag

SEQ ID NO: 42628 - RNA, 20 nt, Artificial Sequence
  MKO10042628_A_Prdx6b
  gRNA
gccaaaaaugaacacccccc

SEQ ID NO: 42629 - RNA, 20 nt, Artificial Sequence
  MKO10042629_A_Prdx6b
  gRNA
ggaagaagcccccgacuuug

SEQ ID NO: 42630 - RNA, 20 nt, Artificial Sequence
  MKO10042630_A_Prdx6b
  gRNA
gcaugccccaugaauuuccc

SEQ ID NO: 42631 - RNA, 20 nt, Artificial Sequence
  MKO10042631_A_Prdx6
  gRNA
uuguuagcguccuucucgac

SEQ ID NO: 42632 - RNA, 20 nt, Artificial Sequence
  MKO10042632_A_Prdx6
  gRNA
cucaccacacgggccgucac

SEQ ID NO: 42633 - RNA, 20 nt, Artificial Sequence
  MKO10042633_A_Prdx6
  gRNA
aguucccacccucuccgaag

SEQ ID NO: 42634 - RNA, 20 nt, Artificial Sequence
  MKO10042634_A_Preb
  gRNA
uaauacaccauaccgcuacc

SEQ ID NO: 42635 - RNA, 20 nt, Artificial Sequence
  MKO10042635_A_Preb
  gRNA
gagcacaaguucaccccgaa

SEQ ID NO: 42636 - RNA, 20 nt, Artificial Sequence
  MKO10042636_A_Preb
  gRNA
uuggcuguagguaccuagcc

SEQ ID NO: 42637 - RNA, 20 nt, Artificial Sequence
  MKO10042637_A_Prelid1
  gRNA
gucucaccaucagccgggca

SEQ ID NO: 42638 - RNA, 20 nt, Artificial Sequence
  MKO10042638_A_Prelid1
  gRNA
gccucuuaccuggacagcuc

SEQ ID NO: 42639 - RNA, 20 nt, Artificial Sequence
  MKO10042639_A_Prelid1
  gRNA
uaaccgaagacauagugcac

SEQ ID NO: 42640 - RNA, 20 nt, Artificial Sequence
  MKO10042640_A_Prelid2
  gRNA
cagcccccgugauugaaauu

SEQ ID NO: 42641 - RNA, 20 nt, Artificial Sequence
  MKO10042641_A_Prelid2
  gRNA
cgaauuucaaucacgggggc

SEQ ID NO: 42642 - RNA, 20 nt, Artificial Sequence
  MKO10042642_A_Prelid2
  gRNA
gauugcuaucugucagaaug

SEQ ID NO: 42643 - RNA, 20 nt, Artificial Sequence
  MKO10042643_A_Prelp
  gRNA
gaaguccuugaaguacccgu

SEQ ID NO: 42644 - RNA, 20 nt, Artificial Sequence
  MKO10042644_A_Prelp
  gRNA
ggacaacaaccgaauucgca

SEQ ID NO: 42645 - RNA, 20 nt, Artificial Sequence
  MKO10042645_A_Prelp
  gRNA
gauuugccccaacaaccuag

SEQ ID NO: 42646 - RNA, 20 nt, Artificial Sequence
  MKO10042646_A_Prepl
  gRNA
gauacacaucguggcagcga

SEQ ID NO: 42647 - RNA, 20 nt, Artificial Sequence
  MKO10042647_A_Prepl
  gRNA
gauguguaucgagccacauu

SEQ ID NO: 42648 - RNA, 20 nt, Artificial Sequence
  MKO10042648_A_Prepl
  gRNA
uuaccgaaacuggacacguu

SEQ ID NO: 42649 - RNA, 20 nt, Artificial Sequence
  MKO10042649_A_Prep
  gRNA
aaauuugugacccguauucu

SEQ ID NO: 42650 - RNA, 20 nt, Artificial Sequence
  MKO10042650_A_Prep
  gRNA
cuugcacauauaacacgcgu

SEQ ID NO: 42651 - RNA, 20 nt, Artificial Sequence
  MKO10042651_A_Prep
  gRNA
cuauaacucauacccgcagc

SEQ ID NO: 42652 - RNA, 20 nt, Artificial Sequence
  MKO10042652_A_Prex1
  gRNA
uuccguaggccuuccuacag

SEQ ID NO: 42653 - RNA, 20 nt, Artificial Sequence
  MKO10042653_A_Prex1
  gRNA
ccucagucucagcacgaacu

SEQ ID NO: 42654 - RNA, 20 nt, Artificial Sequence
  MKO10042654_A_Prex1
  gRNA
ccuguugguggagcucaaca

SEQ ID NO: 42655 - RNA, 20 nt, Artificial Sequence
  MKO10042655_A_Prex2
  gRNA
gaagaauacagacguucccc

SEQ ID NO: 42656 - RNA, 20 nt, Artificial Sequence
  MKO10042656_A_Prex2
  gRNA
auuuagugacaccaauucag

SEQ ID NO: 42657 - RNA, 20 nt, Artificial Sequence
  MKO10042657_A_Prex2
  gRNA
agaacuccuuaugaacgaug

SEQ ID NO: 42658 - RNA, 20 nt, Artificial Sequence
  MKO10042658_A_Prf1
  gRNA
gagcgucacgucgaaguacu

SEQ ID NO: 42659 - RNA, 20 nt, Artificial Sequence
  MKO10042659_A_Prf1
  gRNA
cgugauaaagugcgugccau

SEQ ID NO: 42660 - RNA, 20 nt, Artificial Sequence
  MKO10042660_A_Prf1
  gRNA
gugacuacccuccgccgcuc

SEQ ID NO: 42661 - RNA, 20 nt, Artificial Sequence
  MKO10042661_A_Prg2
  gRNA
gccgaugcaaacgcuuucga

SEQ ID NO: 42662 - RNA, 20 nt, Artificial Sequence
  MKO10042662_A_Prg2
  gRNA
cgcugucaggggaaucaacc

SEQ ID NO: 42663 - RNA, 20 nt, Artificial Sequence
  MKO10042663_A_Prg2
  gRNA
ugauuccccugacagcggac

SEQ ID NO: 42664 - RNA, 20 nt, Artificial Sequence
  MKO10042664_A_Prg3
  gRNA
agaucaaucaguccaucguc

SEQ ID NO: 42665 - RNA, 20 nt, Artificial Sequence
  MKO10042665_A_Prg3
  gRNA
uaguugcagcucuugcaccc

SEQ ID NO: 42666 - RNA, 20 nt, Artificial Sequence
  MKO10042666_A_Prg3
  gRNA
gacucccgagacauuugaua

SEQ ID NO: 42667 - RNA, 20 nt, Artificial Sequence
  MKO10042667_A_Prg4
  gRNA
acacucccucccucgagcga

SEQ ID NO: 42668 - RNA, 20 nt, Artificial Sequence
  MKO10042668_A_Prg4
  gRNA
uuagauuuaucaagcugugc

SEQ ID NO: 42669 - RNA, 20 nt, Artificial Sequence
  MKO10042669_A_Prg4
  gRNA
ugcuucgaguccuucgcucg

SEQ ID NO: 42670 - RNA, 20 nt, Artificial Sequence
  MKO10042670_A_Prh1
  gRNA
ggucucggcugugguacucc

SEQ ID NO: 42671 - RNA, 20 nt, Artificial Sequence
  MKO10042671_A_Prh1
  gRNA
ccacaaccaagaccuacuca

SEQ ID NO: 42672 - RNA, 20 nt, Artificial Sequence
  MKO10042672_A_Prh1
  gRNA
gggguuccugagcagagcuc

SEQ ID NO: 42673 - RNA, 20 nt, Artificial Sequence
  MKO10042673_A_Prickle1
  gRNA
guugccuccacacgauaacg

SEQ ID NO: 42674 - RNA, 20 nt, Artificial Sequence
  MKO10042674_A_Prickle1
  gRNA
gccguguucgccucccgugc

SEQ ID NO: 42675 - RNA, 20 nt, Artificial Sequence
  MKO10042675_A_Prickle1
  gRNA
uacuauaccucguuaucgug

SEQ ID NO: 42676 - RNA, 20 nt, Artificial Sequence
  MKO10042676_A_Prickle2
  gRNA
caugguaacagugaugccgc

SEQ ID NO: 42677 - RNA, 20 nt, Artificial Sequence
  MKO10042677_A_Prickle2
  gRNA
ucaaccucagaugacgacuc

SEQ ID NO: 42678 - RNA, 20 nt, Artificial Sequence
  MKO10042678_A_Prickle2
  gRNA
gcuguguuugcaucacgugc

SEQ ID NO: 42679 - RNA, 20 nt, Artificial Sequence
  MKO10042679_A_Prickle3
  gRNA
cgccaugcggaauacuguga

SEQ ID NO: 42680 - RNA, 20 nt, Artificial Sequence
  MKO10042680_A_Prickle3
  gRNA
uucgagugugaagcuucguu

SEQ ID NO: 42681 - RNA, 20 nt, Artificial Sequence
  MKO10042681_A_Prickle3
  gRNA
gcagucuuugccagccgcgc

SEQ ID NO: 42682 - RNA, 20 nt, Artificial Sequence
  MKO10042682_A_Prim1
  gRNA
ugacagacuacgaugacgua

SEQ ID NO: 42683 - RNA, 20 nt, Artificial Sequence
  MKO10042683_A_Prim1
  gRNA
acucaaguacuccacgaucc

SEQ ID NO: 42684 - RNA, 20 nt, Artificial Sequence
  MKO10042684_A_Prim1
  gRNA
gcgccuauaucaaucuuaua

SEQ ID NO: 42685 - RNA, 20 nt, Artificial Sequence
  MKO10042685_A_Prim2
  gRNA
cucacgacuggcaguacgcg

SEQ ID NO: 42686 - RNA, 20 nt, Artificial Sequence
  MKO10042686_A_Prim2
  gRNA
augaguaugagccacggcga

SEQ ID NO: 42687 - RNA, 20 nt, Artificial Sequence
  MKO10042687_A_Prim2
  gRNA
ccaugauauccuguucccga

SEQ ID NO: 42688 - RNA, 20 nt, Artificial Sequence
  MKO10042688_A_Prima1
  gRNA
caugggguacucagcgacac

SEQ ID NO: 42689 - RNA, 20 nt, Artificial Sequence
  MKO10042689_A_Prima1
  gRNA
cgcaggccgagaugcuacuc

SEQ ID NO: 42690 - RNA, 20 nt, Artificial Sequence
  MKO10042690_A_Prima1
  gRNA
ucuggugaucauugucgcug

SEQ ID NO: 42691 - RNA, 20 nt, Artificial Sequence
  MKO10042691_A_Primpol
  gRNA
ugcucuucacuugauugccg

SEQ ID NO: 42692 - RNA, 20 nt, Artificial Sequence
  MKO10042692_A_Primpol
  gRNA
uaacguccuaugcccaacuu

SEQ ID NO: 42693 - RNA, 20 nt, Artificial Sequence
  MKO10042693_A_Primpol
  gRNA
cagaaaaaccggaggcgucc

SEQ ID NO: 42694 - RNA, 20 nt, Artificial Sequence
  MKO10042694_A_Prkaa1
  gRNA
gugggcaagcacgaguugac

SEQ ID NO: 42695 - RNA, 20 nt, Artificial Sequence
  MKO10042695_A_Prkaa1
  gRNA
gaagauucggagccuugacg

SEQ ID NO: 42696 - RNA, 20 nt, Artificial Sequence
  MKO10042696_A_Prkaa1
  gRNA
gccgcaccagaagucauuuc

SEQ ID NO: 42697 - RNA, 20 nt, Artificial Sequence
  MKO10042697_A_Prkaa2
  gRNA
cagcuaucuuagcguucauc

SEQ ID NO: 42698 - RNA, 20 nt, Artificial Sequence
  MKO10042698_A_Prkaa2
  gRNA
gaauuucuacgaacuagcug

SEQ ID NO: 42699 - RNA, 20 nt, Artificial Sequence
  MKO10042699_A_Prkaa2
  gRNA
uucgacuacaucugcaaaca

SEQ ID NO: 42700 - RNA, 20 nt, Artificial Sequence
  MKO10042700_A_Prkab1
  gRNA
gcaagcuuccccucacgaga

SEQ ID NO: 42701 - RNA, 20 nt, Artificial Sequence
  MKO10042701_A_Prkab1
  gRNA
gagauccuuaccuucucgug

SEQ ID NO: 42702 - RNA, 20 nt, Artificial Sequence
  MKO10042702_A_Prkab1
  gRNA
uguuguuaacugugccaagc

SEQ ID NO: 42703 - RNA, 20 nt, Artificial Sequence
  MKO10042703_A_Prkab2
  gRNA
cccggcccaccguuauccgc

SEQ ID NO: 42704 - RNA, 20 nt, Artificial Sequence
  MKO10042704_A_Prkab2
  gRNA
agcucggagacgucaugucg

SEQ ID NO: 42705 - RNA, 20 nt, Artificial Sequence
  MKO10042705_A_Prkab2
  gRNA
acauacauuucuugaccgua

SEQ ID NO: 42706 - RNA, 20 nt, Artificial Sequence
  MKO10042706_A_Prkaca
  gRNA
ugaaccuuccaauccgccgu

SEQ ID NO: 42707 - RNA, 20 nt, Artificial Sequence
  MKO10042707_A_Prkaca
  gRNA
cuccuuugggcgagugaugc

SEQ ID NO: 42708 - RNA, 20 nt, Artificial Sequence
  MKO10042708_A_Prkaca
  gRNA
aaaaugggagaccccuucuc

SEQ ID NO: 42709 - RNA, 20 nt, Artificial Sequence
  MKO10042709_A_Prkacb
  gRNA
acgggaacuccacggccugc

SEQ ID NO: 42710 - RNA, 20 nt, Artificial Sequence
  MKO10042710_A_Prkacb
  gRNA
aagaguacuccagccgcaca

SEQ ID NO: 42711 - RNA, 20 nt, Artificial Sequence
  MKO10042711_A_Prkacb
  gRNA
uuccuuuggaagagucaugu

SEQ ID NO: 42712 - RNA, 20 nt, Artificial Sequence
  MKO10042712_A_Prkag1
  gRNA
guguucgugccgccccuuug

SEQ ID NO: 42713 - RNA, 20 nt, Artificial Sequence
  MKO10042713_A_Prkag1
  gRNA
cacgaacaccauuggucacc

SEQ ID NO: 42714 - RNA, 20 nt, Artificial Sequence
  MKO10042714_A_Prkag1
  gRNA
gguauuugacacuucgcuac

SEQ ID NO: 42715 - RNA, 20 nt, Artificial Sequence
  MKO10042715_A_Prkag2
  gRNA
gaguccgugcagcgccgcug

SEQ ID NO: 42716 - RNA, 20 nt, Artificial Sequence
  MKO10042716_A_Prkag2
  gRNA
acggacuccguuggcuacca

SEQ ID NO: 42717 - RNA, 20 nt, Artificial Sequence
  MKO10042717_A_Prkag2
  gRNA
gaagacaacaagcuuugaac

SEQ ID NO: 42718 - RNA, 20 nt, Artificial Sequence
  MKO10042718_A_Prkag3
  gRNA
cuugacuccccguauggcac

SEQ ID NO: 42719 - RNA, 20 nt, Artificial Sequence
  MKO10042719_A_Prkag3
  gRNA
ggucaucuuugacaccacgu

SEQ ID NO: 42720 - RNA, 20 nt, Artificial Sequence
  MKO10042720_A_Prkag3
  gRNA
ggccuccugucucguccauc

SEQ ID NO: 42721 - RNA, 20 nt, Artificial Sequence
  MKO10042721_A_Prkar1a
  gRNA
ccacgcuaccuuucuaacgu

SEQ ID NO: 42722 - RNA, 20 nt, Artificial Sequence
  MKO10042722_A_Prkar1a
  gRNA
ugcugccuccuacguuagaa

SEQ ID NO: 42723 - RNA, 20 nt, Artificial Sequence
  MKO10042723_A_Prkar1a
  gRNA
accuugaugauaacgagaga

SEQ ID NO: 42724 - RNA, 20 nt, Artificial Sequence
  MKO10042724_A_Prkar1b
  gRNA
cuauaagaccaugaccgcgc

SEQ ID NO: 42725 - RNA, 20 nt, Artificial Sequence
  MKO10042725_A_Prkar1b
  gRNA
cgcgccuugaccacgggguu

SEQ ID NO: 42726 - RNA, 20 nt, Artificial Sequence
  MKO10042726_A_Prkar1b
  gRNA
uuggggagaucuccucaucg

SEQ ID NO: 42727 - RNA, 20 nt, Artificial Sequence
  MKO10042727_A_Prkar2a
  gRNA
aguuguccccgucgucgccu

SEQ ID NO: 42728 - RNA, 20 nt, Artificial Sequence
  MKO10042728_A_Prkar2a
  gRNA
aaauuuacuagacgaguauc

SEQ ID NO: 42729 - RNA, 20 nt, Artificial Sequence
  MKO10042729_A_Prkar2a
  gRNA
acucgucuaguaaauuugcu

SEQ ID NO: 42730 - RNA, 20 nt, Artificial Sequence
  MKO10042730_A_Prkar2b
  gRNA
ggggaacacguaauugacca

SEQ ID NO: 42731 - RNA, 20 nt, Artificial Sequence
  MKO10042731_A_Prkar2b
  gRNA
ccgaggcacgccuugugaac

SEQ ID NO: 42732 - RNA, 20 nt, Artificial Sequence
  MKO10042732_A_Prkar2b
  gRNA
aguugucaccgucaucaccu

SEQ ID NO: 42733 - RNA, 20 nt, Artificial Sequence
  MKO10042733_A_Prkca
  gRNA
guucguuacguucucuuguc

SEQ ID NO: 42734 - RNA, 20 nt, Artificial Sequence
  MKO10042734_A_Prkca
  gRNA
cuugugaacauucaugucgc

SEQ ID NO: 42735 - RNA, 20 nt, Artificial Sequence
  MKO10042735_A_Prkca
  gRNA
ugaugaaaagcuccacguca

SEQ ID NO: 42736 - RNA, 20 nt, Artificial Sequence
  MKO10042736_A_Prkcb
  gRNA
acugaccacacggaacgccg

SEQ ID NO: 42737 - RNA, 20 nt, Artificial Sequence
  MKO10042737_A_Prkcb
  gRNA
ccuggauauagaugcggccg

SEQ ID NO: 42738 - RNA, 20 nt, Artificial Sequence
  MKO10042738_A_Prkcb
  gRNA
gcuguauggacuuauucacc

SEQ ID NO: 42739 - RNA, 20 nt, Artificial Sequence
  MKO10042739_A_Prkcdbp
  gRNA
uccggugcacgcagucaccg

SEQ ID NO: 42740 - RNA, 20 nt, Artificial Sequence
  MKO10042740_A_Prkcdbp
  gRNA
cuccggacaggcccuacgcg

SEQ ID NO: 42741 - RNA, 20 nt, Artificial Sequence
  MKO10042741_A_Prkcdbp
  gRNA
ugcgacgcacggagcccgcc

SEQ ID NO: 42742 - RNA, 20 nt, Artificial Sequence
  MKO10042742_A_Prkcd
  gRNA
uucgacgcccacaucuauga

SEQ ID NO: 42743 - RNA, 20 nt, Artificial Sequence
  MKO10042743_A_Prkcd
  gRNA
caaacagucuaugcguagug

SEQ ID NO: 42744 - RNA, 20 nt, Artificial Sequence
  MKO10042744_A_Prkcd
  gRNA
cacggugggcgugucaguac

SEQ ID NO: 42745 - RNA, 20 nt, Artificial Sequence
  MKO10042745_A_Prkce
  gRNA
guacgugaucaucgaucucu

SEQ ID NO: 42746 - RNA, 20 nt, Artificial Sequence
  MKO10042746_A_Prkce
  gRNA
cucauuauuacaaagugcgc

SEQ ID NO: 42747 - RNA, 20 nt, Artificial Sequence
  MKO10042747_A_Prkce
  gRNA
ugagcucaugacaucgcuug

SEQ ID NO: 42748 - RNA, 20 nt, Artificial Sequence
  MKO10042748_A_Prkcg
  gRNA
auauggaucucauccgacgu

SEQ ID NO: 42749 - RNA, 20 nt, Artificial Sequence
  MKO10042749_A_Prkcg
  gRNA
ugggcacucacguccgucug

SEQ ID NO: 42750 - RNA, 20 nt, Artificial Sequence
  MKO10042750_A_Prkcg
  gRNA
uccagcgccuggacacucga

SEQ ID NO: 42751 - RNA, 20 nt, Artificial Sequence
  MKO10042751_A_Prkch
  gRNA
cucgucuucgcauagcccuu

SEQ ID NO: 42752 - RNA, 20 nt, Artificial Sequence
  MKO10042752_A_Prkch
  gRNA
gucuugaacaggggaguauu

SEQ ID NO: 42753 - RNA, 20 nt, Artificial Sequence
  MKO10042753_A_Prkch
  gRNA
agacgaguccaucaagugaa

SEQ ID NO: 42754 - RNA, 20 nt, Artificial Sequence
  MKO10042754_A_Prkci
  gRNA
guuuacccuauugaaacguu

SEQ ID NO: 42755 - RNA, 20 nt, Artificial Sequence
  MKO10042755_A_Prkci
  gRNA
uucaagccaaacguuucaau

SEQ ID NO: 42756 - RNA, 20 nt, Artificial Sequence
  MKO10042756_A_Prkci
  gRNA
ccauguguaccagagcgucc

SEQ ID NO: 42757 - RNA, 20 nt, Artificial Sequence
  MKO10042757_A_Prkcq
  gRNA
cuuugacgcccacauuaaca

SEQ ID NO: 42758 - RNA, 20 nt, Artificial Sequence
  MKO10042758_A_Prkcq
  gRNA
gcgucaaaggugcuguccca

SEQ ID NO: 42759 - RNA, 20 nt, Artificial Sequence
  MKO10042759_A_Prkcq
  gRNA
uuugcacugcaucagcgccg

SEQ ID NO: 42760 - RNA, 20 nt, Artificial Sequence
  MKO10042760_A_Prkcsh
  gRNA
ucgucguucaccugaucgaa

SEQ ID NO: 42761 - RNA, 20 nt, Artificial Sequence
  MKO10042761_A_Prkcsh
  gRNA
cgacgacuacugcgacugua

SEQ ID NO: 42762 - RNA, 20 nt, Artificial Sequence
  MKO10042762_A_Prkcsh
  gRNA
agacgaguacaacagcggca

SEQ ID NO: 42763 - RNA, 20 nt, Artificial Sequence
  MKO10042763_A_Prkcz
  gRNA
gcgugcuuaccucgucgucg

SEQ ID NO: 42764 - RNA, 20 nt, Artificial Sequence
  MKO10042764_A_Prkcz
  gRNA
ggagcuuguccacgacgacg

SEQ ID NO: 42765 - RNA, 20 nt, Artificial Sequence
  MKO10042765_A_Prkcz
  gRNA
cuuccaucaguuucuucuga

SEQ ID NO: 42766 - RNA, 20 nt, Artificial Sequence
  MKO10042766_A_Prkd1
  gRNA
caggaucgugccgaaaaagc

SEQ ID NO: 42767 - RNA, 20 nt, Artificial Sequence
  MKO10042767_A_Prkd1
  gRNA
cgguacuguccgcacagcau

SEQ ID NO: 42768 - RNA, 20 nt, Artificial Sequence
  MKO10042768_A_Prkd1
  gRNA
cuccgacaacauccuucagc

SEQ ID NO: 42769 - RNA, 20 nt, Artificial Sequence
  MKO10042769_A_Prkd2
  gRNA
gcucuucggccucgugcgcc

SEQ ID NO: 42770 - RNA, 20 nt, Artificial Sequence
  MKO10042770_A_Prkd2
  gRNA
acccugcaccgccgaagagc

SEQ ID NO: 42771 - RNA, 20 nt, Artificial Sequence
  MKO10042771_A_Prkd2
  gRNA
ucggaucuggaaauccucga

SEQ ID NO: 42772 - RNA, 20 nt, Artificial Sequence
  MKO10042772_A_Prkd3
  gRNA
ccacgacgggauucucuuac

SEQ ID NO: 42773 - RNA, 20 nt, Artificial Sequence
  MKO10042773_A_Prkd3
  gRNA
ccaguaagagaaucccgucg

SEQ ID NO: 42774 - RNA, 20 nt, Artificial Sequence
  MKO10042774_A_Prkd3
  gRNA
cucuggggacugguacguca

SEQ ID NO: 42775 - RNA, 20 nt, Artificial Sequence
  MKO10042775_A_Prkdc
  gRNA
ccggaagucgcuuagcauug

SEQ ID NO: 42776 - RNA, 20 nt, Artificial Sequence
  MKO10042776_A_Prkdc
  gRNA
ccucaaugcuaagcgacuuc

SEQ ID NO: 42777 - RNA, 20 nt, Artificial Sequence
  MKO10042777_A_Prkdc
  gRNA
cuuaaauucauccaugaguc

SEQ ID NO: 42778 - RNA, 20 nt, Artificial Sequence
  MKO10042778_A_Prkg1
  gRNA
uacucuugacggucgcuguc

SEQ ID NO: 42779 - RNA, 20 nt, Artificial Sequence
  MKO10042779_A_Prkg1
  gRNA
uugaaaacauugucgaucga

SEQ ID NO: 42780 - RNA, 20 nt, Artificial Sequence
  MKO10042780_A_Prkg1
  gRNA
uaggucgaaggaucucauaa

SEQ ID NO: 42781 - RNA, 20 nt, Artificial Sequence
  MKO10042781_A_Prkg2
  gRNA
guacgggagaaacuaucaac

SEQ ID NO: 42782 - RNA, 20 nt, Artificial Sequence
  MKO10042782_A_Prkg2
  gRNA
gcagcuacgucauuaagcag

SEQ ID NO: 42783 - RNA, 20 nt, Artificial Sequence
  MKO10042783_A_Prkg2
  gRNA
aauagccaguuccccaaacg

SEQ ID NO: 42784 - RNA, 20 nt, Artificial Sequence
  MKO10042784_A_Prkra
  gRNA
uacucgugcaauaccugaau

SEQ ID NO: 42785 - RNA, 20 nt, Artificial Sequence
  MKO10042785_A_Prkra
  gRNA
auucagguauugcacgagua

SEQ ID NO: 42786 - RNA, 20 nt, Artificial Sequence
  MKO10042786_A_Prkra
  gRNA
aaggaggaccggcucauaag

SEQ ID NO: 42787 - RNA, 20 nt, Artificial Sequence
  MKO10042787_A_Prkrip1
  gRNA
gccguaggugccuauacacg

SEQ ID NO: 42788 - RNA, 20 nt, Artificial Sequence
  MKO10042788_A_Prkrip1
  gRNA
cugcaaagcgccggaaaaag

SEQ ID NO: 42789 - RNA, 20 nt, Artificial Sequence
  MKO10042789_A_Prkrip1
  gRNA
guggagaguuccacguguau

SEQ ID NO: 42790 - RNA, 20 nt, Artificial Sequence
  MKO10042790_A_Prkrir
  gRNA
gccacggacaccccgaucac

SEQ ID NO: 42791 - RNA, 20 nt, Artificial Sequence
  MKO10042791_A_Prkrir
  gRNA
ucucgaaggacuguccgaua

SEQ ID NO: 42792 - RNA, 20 nt, Artificial Sequence
  MKO10042792_A_Prkrir
  gRNA
gaauaauguguugaccgcug

SEQ ID NO: 42793 - RNA, 20 nt, Artificial Sequence
  MKO10042793_A_Prkx
  gRNA
uucaccuaccugcguaaucg

SEQ ID NO: 42794 - RNA, 20 nt, Artificial Sequence
  MKO10042794_A_Prkx
  gRNA
agaaucggccacgauuacgc

SEQ ID NO: 42795 - RNA, 20 nt, Artificial Sequence
  MKO10042795_A_Prkx
  gRNA
cuuauauucgagaugcuguc

SEQ ID NO: 42796 - RNA, 20 nt, Artificial Sequence
  MKO10042796_A_Prl2a1
  gRNA
uuauaacaugauccgcugug

SEQ ID NO: 42797 - RNA, 20 nt, Artificial Sequence
  MKO10042797_A_Prl2a1
  gRNA
auggcagguuguucacuaga

SEQ ID NO: 42798 - RNA, 20 nt, Artificial Sequence
  MKO10042798_A_Prl2a1
  gRNA
caagcaaauuauugagagcc

SEQ ID NO: 42799 - RNA, 20 nt, Artificial Sequence
  MKO10042799_A_Prl2b1
  gRNA
aaauuugaugaacucacgac

SEQ ID NO: 42800 - RNA, 20 nt, Artificial Sequence
  MKO10042800_A_Prl2b1
  gRNA
ggcaucaucacgccuguucc

SEQ ID NO: 42801 - RNA, 20 nt, Artificial Sequence
  MKO10042801_A_Prl2b1
  gRNA
auauugcgaccuacucugcc

SEQ ID NO: 42802 - RNA, 20 nt, Artificial Sequence
  MKO10042802_A_Prl2c1
  gRNA
ucauugucagauugcaagag

SEQ ID NO: 42803 - RNA, 20 nt, Artificial Sequence
  MKO10042803_A_Prl2c1
  gRNA
aaagaucgacgcaguccaga

SEQ ID NO: 42804 - RNA, 20 nt, Artificial Sequence
  MKO10042804_A_Prl2c1
  gRNA
ugaugaccaacuuguuauug

SEQ ID NO: 42805 - RNA, 20 nt, Artificial Sequence
  MKO10042805_A_Prl2c2
  gRNA
uauucagcucuucugaaauc

SEQ ID NO: 42806 - RNA, 20 nt, Artificial Sequence
  MKO10042806_A_Prl2c2
  gRNA
agggauacugcuccuacuac

SEQ ID NO: 42807 - RNA, 20 nt, Artificial Sequence
  MKO10042807_A_Prl2c2
  gRNA
gauauuaugagacaaacugc

SEQ ID NO: 42808 - RNA, 20 nt, Artificial Sequence
  MKO10042808_A_Prl2c3
  gRNA
agggauacugcuccuacuac

SEQ ID NO: 42809 - RNA, 20 nt, Artificial Sequence
  MKO10042809_A_Prl2c3
  gRNA
gauauuaugagacaaacugc

SEQ ID NO: 42810 - RNA, 20 nt, Artificial Sequence
  MKO10042810_A_Prl2c3
  gRNA
aaacauuauucuaacguguc

SEQ ID NO: 42811 - RNA, 20 nt, Artificial Sequence
  MKO10042811_A_Prl2c4
  gRNA
agggauacugcuccuacuac

SEQ ID NO: 42812 - RNA, 20 nt, Artificial Sequence
  MKO10042812_A_Prl2c4
  gRNA
gauauuaugagacaaacugc

SEQ ID NO: 42813 - RNA, 20 nt, Artificial Sequence
  MKO10042813_A_Prl2c4
  gRNA
aaacauuauucuaacguguc

SEQ ID NO: 42814 - RNA, 20 nt, Artificial Sequence
  MKO10042814_A_Prl2c5
  gRNA
caaacucacgcguaugugcc

SEQ ID NO: 42815 - RNA, 20 nt, Artificial Sequence
  MKO10042815_A_Prl2c5
  gRNA
ucacucacuagauaguccag

SEQ ID NO: 42816 - RNA, 20 nt, Artificial Sequence
  MKO10042816_A_Prl2c5
  gRNA
aaacauuauucuaacgugcc

SEQ ID NO: 42817 - RNA, 20 nt, Artificial Sequence
  MKO10042817_A_Prl3a1
  gRNA
gaaacaacuugugcgugcau

SEQ ID NO: 42818 - RNA, 20 nt, Artificial Sequence
  MKO10042818_A_Prl3a1
  gRNA
gcacgcacaaguuguuucag

SEQ ID NO: 42819 - RNA, 20 nt, Artificial Sequence
  MKO10042819_A_Prl3a1
  gRNA
ugaagugguguggcaguugc

SEQ ID NO: 42820 - RNA, 20 nt, Artificial Sequence
  MKO10042820_A_Prl3b1
  gRNA
ucaguggguaaucgauaauu

SEQ ID NO: 42821 - RNA, 20 nt, Artificial Sequence
  MKO10042821_A_Prl3b1
  gRNA
ccugcgcacgcaccgccaua

SEQ ID NO: 42822 - RNA, 20 nt, Artificial Sequence
  MKO10042822_A_Prl3b1
  gRNA
ccuauaccaacgugugauug

SEQ ID NO: 42823 - RNA, 20 nt, Artificial Sequence
  MKO10042823_A_Prl3c1
  gRNA
ugacugccacacgauaugac

SEQ ID NO: 42824 - RNA, 20 nt, Artificial Sequence
  MKO10042824_A_Prl3c1
  gRNA
ucuauggaugugacgagaag

SEQ ID NO: 42825 - RNA, 20 nt, Artificial Sequence
  MKO10042825_A_Prl3c1
  gRNA
auucuucuacugucuacgca

SEQ ID NO: 42826 - RNA, 20 nt, Artificial Sequence
  MKO10042826_A_Prl3d1
  gRNA
gaaaaccuacuuuaguuucg

SEQ ID NO: 42827 - RNA, 20 nt, Artificial Sequence
  MKO10042827_A_Prl3d1
  gRNA
gcagcggcauagauuauaaa

SEQ ID NO: 42828 - RNA, 20 nt, Artificial Sequence
  MKO10042828_A_Prl3d1
  gRNA
acaccuggugucugcacuga

SEQ ID NO: 42829 - RNA, 20 nt, Artificial Sequence
  MKO10042829_A_Prl3d2
  gRNA
ugacgaccuguauacacguu

SEQ ID NO: 42830 - RNA, 20 nt, Artificial Sequence
  MKO10042830_A_Prl3d2
  gRNA
guucagccaaacguguauac

SEQ ID NO: 42831 - RNA, 20 nt, Artificial Sequence
  MKO10042831_A_Prl3d2
  gRNA
ucuucgaguccaguccaagc

SEQ ID NO: 42832 - RNA, 20 nt, Artificial Sequence
  MKO10042832_A_Prl3d3
  gRNA
gucucauaguacauuuaucu

SEQ ID NO: 42833 - RNA, 20 nt, Artificial Sequence
  MKO10042833_A_Prl3d3
  gRNA
aaauucccuauacacaucug

SEQ ID NO: 42834 - RNA, 20 nt, Artificial Sequence
  MKO10042834_A_Prl3d3
  gRNA
gaaaaccuacuuuaauuuca

SEQ ID NO: 42835 - RNA, 20 nt, Artificial Sequence
  MKO10042835_A_Prl4a1
  gRNA
guccacgacuacacaaccuu

SEQ ID NO: 42836 - RNA, 20 nt, Artificial Sequence
  MKO10042836_A_Prl4a1
  gRNA
ugcuuagcuggaaguacugc

SEQ ID NO: 42837 - RNA, 20 nt, Artificial Sequence
  MKO10042837_A_Prl4a1
  gRNA
cacacagucuacugcaagcc

SEQ ID NO: 42838 - RNA, 20 nt, Artificial Sequence
  MKO10042838_A_Prl5a1
  gRNA
cauuaagacuauacucagcc

SEQ ID NO: 42839 - RNA, 20 nt, Artificial Sequence
  MKO10042839_A_Prl5a1
  gRNA
ugcugucaaacuugcucaug

SEQ ID NO: 42840 - RNA, 20 nt, Artificial Sequence
  MKO10042840_A_Prl5a1
  gRNA
cucugugcccagauguauca

SEQ ID NO: 42841 - RNA, 20 nt, Artificial Sequence
  MKO10042841_A_Prl6a1
  gRNA
gaggaugugcgauauaaacc

SEQ ID NO: 42842 - RNA, 20 nt, Artificial Sequence
  MKO10042842_A_Prl6a1
  gRNA
guagacucaccggcaucugu

SEQ ID NO: 42843 - RNA, 20 nt, Artificial Sequence
  MKO10042843_A_Prl6a1
  gRNA
gugaauccuugaccaagcac

SEQ ID NO: 42844 - RNA, 20 nt, Artificial Sequence
  MKO10042844_A_Prl7a1
  gRNA
uccugcgcaacuccauguug

SEQ ID NO: 42845 - RNA, 20 nt, Artificial Sequence
  MKO10042845_A_Prl7a1
  gRNA
ugaugauccacuauccauca

SEQ ID NO: 42846 - RNA, 20 nt, Artificial Sequence
  MKO10042846_A_Prl7a1
  gRNA
gguacuuacaaauugaucau

SEQ ID NO: 42847 - RNA, 20 nt, Artificial Sequence
  MKO10042847_A_Prl7a2
  gRNA
gaaucuguugagcuucgucc

SEQ ID NO: 42848 - RNA, 20 nt, Artificial Sequence
  MKO10042848_A_Prl7a2
  gRNA
cacccagaguauacucaacu

SEQ ID NO: 42849 - RNA, 20 nt, Artificial Sequence
  MKO10042849_A_Prl7a2
  gRNA
ucaccgaguugaguauacuc

SEQ ID NO: 42850 - RNA, 20 nt, Artificial Sequence
  MKO10042850_A_Prl7b1
  gRNA
uacuaaguauacuacgagcc

SEQ ID NO: 42851 - RNA, 20 nt, Artificial Sequence
  MKO10042851_A_Prl7b1
  gRNA
gccuugcuauagagacacgc

SEQ ID NO: 42852 - RNA, 20 nt, Artificial Sequence
  MKO10042852_A_Prl7b1
  gRNA
accugauccacugccaauug

SEQ ID NO: 42853 - RNA, 20 nt, Artificial Sequence
  MKO10042853_A_Prl7c1
  gRNA
uaauaagagccaacgccauc

SEQ ID NO: 42854 - RNA, 20 nt, Artificial Sequence
  MKO10042854_A_Prl7c1
  gRNA
caccauagucauccucaaug

SEQ ID NO: 42855 - RNA, 20 nt, Artificial Sequence
  MKO10042855_A_Prl7c1
  gRNA
ugcuuccauucaccacauug

SEQ ID NO: 42856 - RNA, 20 nt, Artificial Sequence
  MKO10042856_A_Prl7d1
  gRNA
aacuguuucaggaacguuga

SEQ ID NO: 42857 - RNA, 20 nt, Artificial Sequence
  MKO10042857_A_Prl7d1
  gRNA
cuuugccagaaugcccuuau

SEQ ID NO: 42858 - RNA, 20 nt, Artificial Sequence
  MKO10042858_A_Prl7d1
  gRNA
caacguuccugaaacaguug

SEQ ID NO: 42859 - RNA, 20 nt, Artificial Sequence
  MKO10042859_A_Prl8a1
  gRNA
agcuccugaaugaccuuagg

SEQ ID NO: 42860 - RNA, 20 nt, Artificial Sequence
  MKO10042860_A_Prl8a1
  gRNA
aaggguuugugauaguagag

SEQ ID NO: 42861 - RNA, 20 nt, Artificial Sequence
  MKO10042861_A_Prl8a1
  gRNA
guuguucucuucaaucucau

SEQ ID NO: 42862 - RNA, 20 nt, Artificial Sequence
  MKO10042862_A_Prl8a2
  gRNA
aaauccaugaugaccuuacg

SEQ ID NO: 42863 - RNA, 20 nt, Artificial Sequence
  MKO10042863_A_Prl8a2
  gRNA
acgcauguauagacgugaug

SEQ ID NO: 42864 - RNA, 20 nt, Artificial Sequence
  MKO10042864_A_Prl8a2
  gRNA
cacuccuguauacuaucuag

SEQ ID NO: 42865 - RNA, 20 nt, Artificial Sequence
  MKO10042865_A_Prl8a6
  gRNA
cucacgaaccccccaaauac

SEQ ID NO: 42866 - RNA, 20 nt, Artificial Sequence
  MKO10042866_A_Prl8a6
  gRNA
gaguucucaaauaauuagac

SEQ ID NO: 42867 - RNA, 20 nt, Artificial Sequence
  MKO10042867_A_Prl8a6
  gRNA
gacaaauccugagugaccuu

SEQ ID NO: 42868 - RNA, 20 nt, Artificial Sequence
  MKO10042868_A_Prl8a8
  gRNA
cucaucccgccgaaccaguu

SEQ ID NO: 42869 - RNA, 20 nt, Artificial Sequence
  MKO10042869_A_Prl8a8
  gRNA
auuguuuagaaacuguacga

SEQ ID NO: 42870 - RNA, 20 nt, Artificial Sequence
  MKO10042870_A_Prl8a8
  gRNA
gacaaauucugcgugaccuu

SEQ ID NO: 42871 - RNA, 20 nt, Artificial Sequence
  MKO10042871_A_Prl8a9
  gRNA
gcaugcucaguuccccuauc

SEQ ID NO: 42872 - RNA, 20 nt, Artificial Sequence
  MKO10042872_A_Prl8a9
  gRNA
cucucucaaaccccccugau

SEQ ID NO: 42873 - RNA, 20 nt, Artificial Sequence
  MKO10042873_A_Prl8a9
  gRNA
cggcugcuggaacccucucg

SEQ ID NO: 42874 - RNA, 20 nt, Artificial Sequence
  MKO10042874_A_Prlhr
  gRNA
agugaaaugcgccgacguag

SEQ ID NO: 42875 - RNA, 20 nt, Artificial Sequence
  MKO10042875_A_Prlhr
  gRNA
gccaucgaccccuacgccuu

SEQ ID NO: 42876 - RNA, 20 nt, Artificial Sequence
  MKO10042876_A_Prlhr
  gRNA
uucuggugcacccgcuacgu

SEQ ID NO: 42877 - RNA, 20 nt, Artificial Sequence
  MKO10042877_A_Prlh
  gRNA
gaucccacgacccguguacc

SEQ ID NO: 42878 - RNA, 20 nt, Artificial Sequence
  MKO10042878_A_Prlh
  gRNA
aagccggaagcauggcaccg

SEQ ID NO: 42879 - RNA, 20 nt, Artificial Sequence
  MKO10042879_A_Prlh
  gRNA
cagguccggugacaucccuc

SEQ ID NO: 42880 - RNA, 20 nt, Artificial Sequence
  MKO10042880_A_Prlr
  gRNA
uaccucggauccacuuuaug

SEQ ID NO: 42881 - RNA, 20 nt, Artificial Sequence
  MKO10042881_A_Prlr
  gRNA
acugcuucccauuucguucg

SEQ ID NO: 42882 - RNA, 20 nt, Artificial Sequence
  MKO10042882_A_Prlr
  gRNA
gaacgacauuuguggauuuc

SEQ ID NO: 42883 - RNA, 20 nt, Artificial Sequence
  MKO10042883_A_Prl
  gRNA
acaccauucgcugccugcgc

SEQ ID NO: 42884 - RNA, 20 nt, Artificial Sequence
  MKO10042884_A_Prl
  gRNA
ccgagagcuguuugaccgug

SEQ ID NO: 42885 - RNA, 20 nt, Artificial Sequence
  MKO10042885_A_Prl
  gRNA
ccucugccaaucuguuccgc

SEQ ID NO: 42886 - RNA, 20 nt, Artificial Sequence
  MKO10042886_A_Prm1
  gRNA
ugcgacaucuucgccugcga

SEQ ID NO: 42887 - RNA, 20 nt, Artificial Sequence
  MKO10042887_A_Prm1
  gRNA
gcaggcgaagaugucgcaga

SEQ ID NO: 42888 - RNA, 20 nt, Artificial Sequence
  MKO10042888_A_Prm1
  gRNA
gccgccgcucauacaccaua

SEQ ID NO: 42889 - RNA, 20 nt, Artificial Sequence
  MKO10042889_A_Prm2
  gRNA
ugcaugaccgacgccucuug

SEQ ID NO: 42890 - RNA, 20 nt, Artificial Sequence
  MKO10042890_A_Prm2
  gRNA
ccauaguccucuacgcgcuc

SEQ ID NO: 42891 - RNA, 20 nt, Artificial Sequence
  MKO10042891_A_Prm2
  gRNA
caggcugcagaagaucccga

SEQ ID NO: 42892 - RNA, 20 nt, Artificial Sequence
  MKO10042892_A_Prm3
  gRNA
agaggagcaaaucccgguga

SEQ ID NO: 42893 - RNA, 20 nt, Artificial Sequence
  MKO10042893_A_Prm3
  gRNA
cgaaaagcaagagagcgccg

SEQ ID NO: 42894 - RNA, 20 nt, Artificial Sequence
  MKO10042894_A_Prm3
  gRNA
guccuccaugaagaagcucg

SEQ ID NO: 42895 - RNA, 20 nt, Artificial Sequence
  MKO10042895_A_Prmt10
  gRNA
ccccgugccgauauccagaa

SEQ ID NO: 42896 - RNA, 20 nt, Artificial Sequence
  MKO10042896_A_Prmt10
  gRNA
uagaaugggcuuucgagaug

SEQ ID NO: 42897 - RNA, 20 nt, Artificial Sequence
  MKO10042897_A_Prmt10
  gRNA
agccgaauacaagacuuacu

SEQ ID NO: 42898 - RNA, 20 nt, Artificial Sequence
  MKO10042898_A_Prmt1
  gRNA
cgggggcccgcaagguuauu

SEQ ID NO: 42899 - RNA, 20 nt, Artificial Sequence
  MKO10042899_A_Prmt1
  gRNA
caccuccaugaugcaguucg

SEQ ID NO: 42900 - RNA, 20 nt, Artificial Sequence
  MKO10042900_A_Prmt1
  gRNA
cucaccauggucuaacuugu

SEQ ID NO: 42901 - RNA, 20 nt, Artificial Sequence
  MKO10042901_A_Prmt2
  gRNA
gaggaguacuucgacagcua

SEQ ID NO: 42902 - RNA, 20 nt, Artificial Sequence
  MKO10042902_A_Prmt2
  gRNA
gcaacuggaggaauacgacc

SEQ ID NO: 42903 - RNA, 20 nt, Artificial Sequence
  MKO10042903_A_Prmt2
  gRNA
cguggccauugcagacuaua

SEQ ID NO: 42904 - RNA, 20 nt, Artificial Sequence
  MKO10042904_A_Prmt3
  gRNA
ugugugcugccggccgugcg

SEQ ID NO: 42905 - RNA, 20 nt, Artificial Sequence
  MKO10042905_A_Prmt3
  gRNA
gcggacacugagcccgcgca

SEQ ID NO: 42906 - RNA, 20 nt, Artificial Sequence
  MKO10042906_A_Prmt3
  gRNA
gaauucauauauucaaccgu

SEQ ID NO: 42907 - RNA, 20 nt, Artificial Sequence
  MKO10042907_A_Prmt5
  gRNA
agacuggaauacgcuaauug

SEQ ID NO: 42908 - RNA, 20 nt, Artificial Sequence
  MKO10042908_A_Prmt5
  gRNA
cgaucagaccuacugcuguc

SEQ ID NO: 42909 - RNA, 20 nt, Artificial Sequence
  MKO10042909_A_Prmt5
  gRNA
ucuuccacccgcguuucaag

SEQ ID NO: 42910 - RNA, 20 nt, Artificial Sequence
  MKO10042910_A_Prmt6
  gRNA
gcccauccacucgcugacga

SEQ ID NO: 42911 - RNA, 20 nt, Artificial Sequence
  MKO10042911_A_Prmt6
  gRNA
cgaggagaugaucgccgacc

SEQ ID NO: 42912 - RNA, 20 nt, Artificial Sequence
  MKO10042912_A_Prmt6
  gRNA
ccauucggagaucguggugc

SEQ ID NO: 42913 - RNA, 20 nt, Artificial Sequence
  MKO10042913_A_Prmt7
  gRNA
aucagaauguuagcacgaca

SEQ ID NO: 42914 - RNA, 20 nt, Artificial Sequence
  MKO10042914_A_Prmt7
  gRNA
ugacuucugcuaugcuaucg

SEQ ID NO: 42915 - RNA, 20 nt, Artificial Sequence
  MKO10042915_A_Prmt7
  gRNA
ucaaugauggcaguuacugc

SEQ ID NO: 42916 - RNA, 20 nt, Artificial Sequence
  MKO10042916_A_Prmt8
  gRNA
ucaacaccgugaucuuugcc

SEQ ID NO: 42917 - RNA, 20 nt, Artificial Sequence
  MKO10042917_A_Prmt8
  gRNA
cccugcuuuggcggcaaaca

SEQ ID NO: 42918 - RNA, 20 nt, Artificial Sequence
  MKO10042918_A_Prmt8
  gRNA
uccauguuugccgccaaagc

SEQ ID NO: 42919 - RNA, 20 nt, Artificial Sequence
  MKO10042919_A_Prnd
  gRNA
cgccguggaccaaccggcga

SEQ ID NO: 42920 - RNA, 20 nt, Artificial Sequence
  MKO10042920_A_Prnd
  gRNA
gaccaucgccgguuggucca

SEQ ID NO: 42921 - RNA, 20 nt, Artificial Sequence
  MKO10042921_A_Prnd
  gRNA
guucucagcuacccgagcuu

SEQ ID NO: 42922 - RNA, 20 nt, Artificial Sequence
  MKO10042922_A_Prnp
  gRNA
agucgugcacgaaguuguuc

SEQ ID NO: 42923 - RNA, 20 nt, Artificial Sequence
  MKO10042923_A_Prnp
  gRNA
ggaucuucucccgucguaau

SEQ ID NO: 42924 - RNA, 20 nt, Artificial Sequence
  MKO10042924_A_Prnp
  gRNA
ucagucaucauggcgaaccu

SEQ ID NO: 42925 - RNA, 20 nt, Artificial Sequence
  MKO10042925_A_Prn
  gRNA
cgccguggaccaaccggcga

SEQ ID NO: 42926 - RNA, 20 nt, Artificial Sequence
  MKO10042926_A_Prn
  gRNA
gaccaucgccgguuggucca

SEQ ID NO: 42927 - RNA, 20 nt, Artificial Sequence
  MKO10042927_A_Prn
  gRNA
ggaguggaggucgcuucgag

SEQ ID NO: 42928 - RNA, 20 nt, Artificial Sequence
  MKO10042928_A_Prob1
  gRNA
cgucuccugagaguucgucg

SEQ ID NO: 42929 - RNA, 20 nt, Artificial Sequence
  MKO10042929_A_Prob1
  gRNA
cgcgucccugucgacucuaa

SEQ ID NO: 42930 - RNA, 20 nt, Artificial Sequence
  MKO10042930_A_Prob1
  gRNA
accaucuugcgcacgucucg

SEQ ID NO: 42931 - RNA, 20 nt, Artificial Sequence
  MKO10042931_A_Proca1
  gRNA
gaucugagccaauccguaag

SEQ ID NO: 42932 - RNA, 20 nt, Artificial Sequence
  MKO10042932_A_Proca1
  gRNA
uaucagugcccaucacuauc

SEQ ID NO: 42933 - RNA, 20 nt, Artificial Sequence
  MKO10042933_A_Proca1
  gRNA
gccaaugcgacugugaaucu

SEQ ID NO: 42934 - RNA, 20 nt, Artificial Sequence
  MKO10042934_A_Procr
  gRNA
gcugguauaucgcgagcgca

SEQ ID NO: 42935 - RNA, 20 nt, Artificial Sequence
  MKO10042935_A_Procr
  gRNA
cgauuaugaaacagcccauc

SEQ ID NO: 42936 - RNA, 20 nt, Artificial Sequence
  MKO10042936_A_Procr
  gRNA
ugcgcccuuuguaacuccga

SEQ ID NO: 42937 - RNA, 20 nt, Artificial Sequence
  MKO10042937_A_Proc
  gRNA
ggcacuugcaucgacggcau

SEQ ID NO: 42938 - RNA, 20 nt, Artificial Sequence
  MKO10042938_A_Proc
  gRNA
cauuguucacccgacagucc

SEQ ID NO: 42939 - RNA, 20 nt, Artificial Sequence
  MKO10042939_A_Proc
  gRNA
ucucgcagaguugcgcuucc

SEQ ID NO: 42940 - RNA, 20 nt, Artificial Sequence
  MKO10042940_A_Prodh2
  gRNA
cgagcccucguggacgccca

SEQ ID NO: 42941 - RNA, 20 nt, Artificial Sequence
  MKO10042941_A_Prodh2
  gRNA
ccucagccgcuugcaccgag

SEQ ID NO: 42942 - RNA, 20 nt, Artificial Sequence
  MKO10042942_A_Prodh2
  gRNA
acuuacacaaagccgagugc

SEQ ID NO: 42943 - RNA, 20 nt, Artificial Sequence
  MKO10042943_A_Prodh
  gRNA
uaucaggugcaccccgccuu

SEQ ID NO: 42944 - RNA, 20 nt, Artificial Sequence
  MKO10042944_A_Prodh
  gRNA
agucuaucaggccucugauc

SEQ ID NO: 42945 - RNA, 20 nt, Artificial Sequence
  MKO10042945_A_Prodh
  gRNA
agccauuaagcucacugcac

SEQ ID NO: 42946 - RNA, 20 nt, Artificial Sequence
  MKO10042946_A_Prok1
  gRNA
aagcagcgguaccugccguc

SEQ ID NO: 42947 - RNA, 20 nt, Artificial Sequence
  MKO10042947_A_Prok1
  gRNA
ccacagacugauagcgcagc

SEQ ID NO: 42948 - RNA, 20 nt, Artificial Sequence
  MKO10042948_A_Prok1
  gRNA
uccgacugugcggucaucac

SEQ ID NO: 42949 - RNA, 20 nt, Artificial Sequence
  MKO10042949_A_Prok2
  gRNA
gcuuaccccggugaugaccg

SEQ ID NO: 42950 - RNA, 20 nt, Artificial Sequence
  MKO10042950_A_Prok2
  gRNA
agacacuaacuuuccgaguc

SEQ ID NO: 42951 - RNA, 20 nt, Artificial Sequence
  MKO10042951_A_Prok2
  gRNA
ggaugccgcggucaucaccg

SEQ ID NO: 42952 - RNA, 20 nt, Artificial Sequence
  MKO10042952_A_Prokr1
  gRNA
cuacagggcccacgaacucg

SEQ ID NO: 42953 - RNA, 20 nt, Artificial Sequence
  MKO10042953_A_Prokr1
  gRNA
uccggcggaucugcucuguc

SEQ ID NO: 42954 - RNA, 20 nt, Artificial Sequence
  MKO10042954_A_Prokr1
  gRNA
cgucuccacuaacgcccuac

SEQ ID NO: 42955 - RNA, 20 nt, Artificial Sequence
  MKO10042955_A_Prokr2
  gRNA
cuccgucaacuaccuucgua

SEQ ID NO: 42956 - RNA, 20 nt, Artificial Sequence
  MKO10042956_A_Prokr2
  gRNA
gcggucugauaauucauccg

SEQ ID NO: 42957 - RNA, 20 nt, Artificial Sequence
  MKO10042957_A_Prokr2
  gRNA
cuugauucuugacgauaacg

SEQ ID NO: 42958 - RNA, 20 nt, Artificial Sequence
  MKO10042958_A_Prol1
  gRNA
gcuguagaggugcuaggcuu

SEQ ID NO: 42959 - RNA, 20 nt, Artificial Sequence
  MKO10042959_A_Prol1
  gRNA
caaaacacuuccgcaaaugu

SEQ ID NO: 42960 - RNA, 20 nt, Artificial Sequence
  MKO10042960_A_Prol1
  gRNA
ggcucuuacuucauauuuca

SEQ ID NO: 42961 - RNA, 20 nt, Artificial Sequence
  MKO10042961_A_Prom1
  gRNA
uaaggacuccgaucucauag

SEQ ID NO: 42962 - RNA, 20 nt, Artificial Sequence
  MKO10042962_A_Prom1
  gRNA
aguccuuaucugcgccaucc

SEQ ID NO: 42963 - RNA, 20 nt, Artificial Sequence
  MKO10042963_A_Prom1
  gRNA
ucaccuagagggaagucauu

SEQ ID NO: 42964 - RNA, 20 nt, Artificial Sequence
  MKO10042964_A_Prom2
  gRNA
ggccccgacgcgcgaacaag

SEQ ID NO: 42965 - RNA, 20 nt, Artificial Sequence
  MKO10042965_A_Prom2
  gRNA
ccccucuuguucgcgcgucg

SEQ ID NO: 42966 - RNA, 20 nt, Artificial Sequence
  MKO10042966_A_Prom2
  gRNA
ugcccaggugguucgauaug

SEQ ID NO: 42967 - RNA, 20 nt, Artificial Sequence
  MKO10042967_A_Prop1
  gRNA
gccgauagcccaucuaucua

SEQ ID NO: 42968 - RNA, 20 nt, Artificial Sequence
  MKO10042968_A_Prop1
  gRNA
gcuuccguugcuuagcccug

SEQ ID NO: 42969 - RNA, 20 nt, Artificial Sequence
  MKO10042969_A_Prop1
  gRNA
cccucucgagcccagauguc

SEQ ID NO: 42970 - RNA, 20 nt, Artificial Sequence
  MKO10042970_A_Prorsd1
  gRNA
cggcgcccucgccauucgca

SEQ ID NO: 42971 - RNA, 20 nt, Artificial Sequence
  MKO10042971_A_Prorsd1
  gRNA
cuccacgaccuccgugcgaa

SEQ ID NO: 42972 - RNA, 20 nt, Artificial Sequence
  MKO10042972_A_Prorsd1
  gRNA
aagcgggagcgggccaaaag

SEQ ID NO: 42973 - RNA, 20 nt, Artificial Sequence
  MKO10042973_A_Pros1
  gRNA
uuggcucauuccaugcugcg

SEQ ID NO: 42974 - RNA, 20 nt, Artificial Sequence
  MKO10042974_A_Pros1
  gRNA
cuucaaugcacucucguuca

SEQ ID NO: 42975 - RNA, 20 nt, Artificial Sequence
  MKO10042975_A_Pros1
  gRNA
agagcgugcuucacaagucc

SEQ ID NO: 42976 - RNA, 20 nt, Artificial Sequence
  MKO10042976_A_Prosc
  gRNA
aguucucuccaaaagugcgc

SEQ ID NO: 42977 - RNA, 20 nt, Artificial Sequence
  MKO10042977_A_Prosc
  gRNA
ggccacggccagcgcacuuu

SEQ ID NO: 42978 - RNA, 20 nt, Artificial Sequence
  MKO10042978_A_Prosc
  gRNA
aaugaagugccacuugaucu

SEQ ID NO: 42979 - RNA, 20 nt, Artificial Sequence
  MKO10042979_A_Proser1
  gRNA
ugcaggugguugaucugcua

SEQ ID NO: 42980 - RNA, 20 nt, Artificial Sequence
  MKO10042980_A_Proser1
  gRNA
cuucagcuguggcucggccc

SEQ ID NO: 42981 - RNA, 20 nt, Artificial Sequence
  MKO10042981_A_Proser1
  gRNA
gagcuguuucaccuuuagua

SEQ ID NO: 42982 - RNA, 20 nt, Artificial Sequence
  MKO10042982_A_Proser2
  gRNA
ugugucgcccgcagcgauga

SEQ ID NO: 42983 - RNA, 20 nt, Artificial Sequence
  MKO10042983_A_Proser2
  gRNA
gucgaugccacacgccgaca

SEQ ID NO: 42984 - RNA, 20 nt, Artificial Sequence
  MKO10042984_A_Proser2
  gRNA
uacggcucaccuguuacuug

SEQ ID NO: 42985 - RNA, 20 nt, Artificial Sequence
  MKO10042985_A_Prox1
  gRNA
aacaucuuugcccgcgauga

SEQ ID NO: 42986 - RNA, 20 nt, Artificial Sequence
  MKO10042986_A_Prox1
  gRNA
uuccccguugacugcgaauc

SEQ ID NO: 42987 - RNA, 20 nt, Artificial Sequence
  MKO10042987_A_Prox1
  gRNA
cccgaaugauauucucaacc

SEQ ID NO: 42988 - RNA, 20 nt, Artificial Sequence
  MKO10042988_A_Prox2
  gRNA
uaucacgaacgcccaagcac

SEQ ID NO: 42989 - RNA, 20 nt, Artificial Sequence
  MKO10042989_A_Prox2
  gRNA
agaguagagaccauuguccg

SEQ ID NO: 42990 - RNA, 20 nt, Artificial Sequence
  MKO10042990_A_Prox2
  gRNA
cugccugacaccgacgagcu

SEQ ID NO: 42991 - RNA, 20 nt, Artificial Sequence
  MKO10042991_A_Proz
  gRNA
ccucgcaugucccguuguug

SEQ ID NO: 42992 - RNA, 20 nt, Artificial Sequence
  MKO10042992_A_Proz
  gRNA
gcgggguaguucguacuucc

SEQ ID NO: 42993 - RNA, 20 nt, Artificial Sequence
  MKO10042993_A_Proz
  gRNA
uggagccucacccauugcac

SEQ ID NO: 42994 - RNA, 20 nt, Artificial Sequence
  MKO10042994_A_Prp2
  gRNA
aaauccagaucccgaaucaa

SEQ ID NO: 42995 - RNA, 20 nt, Artificial Sequence
  MKO10042995_A_Prp2
  gRNA
ggucucggcuguggaccugc

SEQ ID NO: 42996 - RNA, 20 nt, Artificial Sequence
  MKO10042996_A_Prp2
  gRNA
gggguuccugagcagagcuc

SEQ ID NO: 42997 - RNA, 20 nt, Artificial Sequence
  MKO10042997_A_Prpf18
  gRNA
agagccgauuagacuguuug

SEQ ID NO: 42998 - RNA, 20 nt, Artificial Sequence
  MKO10042998_A_Prpf18
  gRNA
ucucuaucuuccuuaaacgc

SEQ ID NO: 42999 - RNA, 20 nt, Artificial Sequence
  MKO10042999_A_Prpf18
  gRNA
aacaucgucaaauccagugc

SEQ ID NO: 43000 - RNA, 20 nt, Artificial Sequence
  MKO10043000_A_Prpf19
  gRNA
cuaggguuggccgaauucuc

SEQ ID NO: 43001 - RNA, 20 nt, Artificial Sequence
  MKO10043001_A_Prpf19
  gRNA
cugccugccgagucauugcc

SEQ ID NO: 43002 - RNA, 20 nt, Artificial Sequence
  MKO10043002_A_Prpf19
  gRNA
ggaacacuuaccacaacacu

SEQ ID NO: 43003 - RNA, 20 nt, Artificial Sequence
  MKO10043003_A_Prpf31
  gRNA
ggauuacauccgcacaguca

SEQ ID NO: 43004 - RNA, 20 nt, Artificial Sequence
  MKO10043004_A_Prpf31
  gRNA
uccugaguaccgagucauug

SEQ ID NO: 43005 - RNA, 20 nt, Artificial Sequence
  MKO10043005_A_Prpf31
  gRNA
ggaggcaccuuccgacacgu

SEQ ID NO: 43006 - RNA, 20 nt, Artificial Sequence
  MKO10043006_A_Prpf38a
  gRNA
ugguagguauguccggaugc

SEQ ID NO: 43007 - RNA, 20 nt, Artificial Sequence
  MKO10043007_A_Prpf38a
  gRNA
ccuguagaaacgguaugugc

SEQ ID NO: 43008 - RNA, 20 nt, Artificial Sequence
  MKO10043008_A_Prpf38a
  gRNA
ucauaccuccauuucgguuc

SEQ ID NO: 43009 - RNA, 20 nt, Artificial Sequence
  MKO10043009_A_Prpf38b
  gRNA
agcagauuaaaacucgaccu

SEQ ID NO: 43010 - RNA, 20 nt, Artificial Sequence
  MKO10043010_A_Prpf38b
  gRNA
aggucacgcauguugagcca

SEQ ID NO: 43011 - RNA, 20 nt, Artificial Sequence
  MKO10043011_A_Prpf38b
  gRNA
ccccuccgcacauccccguc

SEQ ID NO: 43012 - RNA, 20 nt, Artificial Sequence
  MKO10043012_A_Prpf39
  gRNA
guacacuacccguauugcua

SEQ ID NO: 43013 - RNA, 20 nt, Artificial Sequence
  MKO10043013_A_Prpf39
  gRNA
gcuguauacgaucguauucu

SEQ ID NO: 43014 - RNA, 20 nt, Artificial Sequence
  MKO10043014_A_Prpf39
  gRNA
uuucuucuuagguuuaucga

SEQ ID NO: 43015 - RNA, 20 nt, Artificial Sequence
  MKO10043015_A_Prpf3
  gRNA
cgagcugcaagcccgaaucc

SEQ ID NO: 43016 - RNA, 20 nt, Artificial Sequence
  MKO10043016_A_Prpf3
  gRNA
agcagcaacacgacaaaucg

SEQ ID NO: 43017 - RNA, 20 nt, Artificial Sequence
  MKO10043017_A_Prpf3
  gRNA
cguucauaaagguagcggcc

SEQ ID NO: 43018 - RNA, 20 nt, Artificial Sequence
  MKO10043018_A_Prpf40a
  gRNA
gccacagaugaugcccccua

SEQ ID NO: 43019 - RNA, 20 nt, Artificial Sequence
  MKO10043019_A_Prpf40a
  gRNA
cccauagggggcaucaucug

SEQ ID NO: 43020 - RNA, 20 nt, Artificial Sequence
  MKO10043020_A_Prpf40a
  gRNA
augaugucuucaguaauguc

SEQ ID NO: 43021 - RNA, 20 nt, Artificial Sequence
  MKO10043021_A_Prpf40b
  gRNA
ucggcagacggcuccgggug

SEQ ID NO: 43022 - RNA, 20 nt, Artificial Sequence
  MKO10043022_A_Prpf40b
  gRNA
ggcaccgccaccacuuacac

SEQ ID NO: 43023 - RNA, 20 nt, Artificial Sequence
  MKO10043023_A_Prpf40b
  gRNA
cagcuggcgguguccgcacc

SEQ ID NO: 43024 - RNA, 20 nt, Artificial Sequence
  MKO10043024_A_Prpf4b
  gRNA
cucgaucacgggguggucau

SEQ ID NO: 43025 - RNA, 20 nt, Artificial Sequence
  MKO10043025_A_Prpf4b
  gRNA
guuccccauugagacgcagc

SEQ ID NO: 43026 - RNA, 20 nt, Artificial Sequence
  MKO10043026_A_Prpf4b
  gRNA
uugaccguucacaucuacca

SEQ ID NO: 43027 - RNA, 20 nt, Artificial Sequence
  MKO10043027_A_Prpf4
  gRNA
acgggagcaacuaaaucguc

SEQ ID NO: 43028 - RNA, 20 nt, Artificial Sequence
  MKO10043028_A_Prpf4
  gRNA
cccucuccaaaaagcgugau

SEQ ID NO: 43029 - RNA, 20 nt, Artificial Sequence
  MKO10043029_A_Prpf4
  gRNA
ugaagggccaaauagccuga

SEQ ID NO: 43030 - RNA, 20 nt, Artificial Sequence
  MKO10043030_A_Prpf6
  gRNA
guuccguugacguuuguuuc

SEQ ID NO: 43031 - RNA, 20 nt, Artificial Sequence
  MKO10043031_A_Prpf6
  gRNA
caaaaucaccucaucguagu

SEQ ID NO: 43032 - RNA, 20 nt, Artificial Sequence
  MKO10043032_A_Prpf6
  gRNA
gaaugauaccaacuacgaug

SEQ ID NO: 43033 - RNA, 20 nt, Artificial Sequence
  MKO10043033_A_Prpf8
  gRNA
ggcgguuccucgucaucgaa

SEQ ID NO: 43034 - RNA, 20 nt, Artificial Sequence
  MKO10043034_A_Prpf8
  gRNA
uuuccccccuuucgaugacg

SEQ ID NO: 43035 - RNA, 20 nt, Artificial Sequence
  MKO10043035_A_Prpf8
  gRNA
ccgcuucucugcauaucgcu

SEQ ID NO: 43036 - RNA, 20 nt, Artificial Sequence
  MKO10043036_A_Prph2
  gRNA
cauucuugaguccguaagcc

SEQ ID NO: 43037 - RNA, 20 nt, Artificial Sequence
  MKO10043037_A_Prph2
  gRNA
gcuguagugcgccgaguugu

SEQ ID NO: 43038 - RNA, 20 nt, Artificial Sequence
  MKO10043038_A_Prph2
  gRNA
acccggccaaguacgccaag

SEQ ID NO: 43039 - RNA, 20 nt, Artificial Sequence
  MKO10043039_A_Prph
  gRNA
caaagcuggucggcgcgcgc

SEQ ID NO: 43040 - RNA, 20 nt, Artificial Sequence
  MKO10043040_A_Prph
  gRNA
ggagaaaucgaggcgcuccg

SEQ ID NO: 43041 - RNA, 20 nt, Artificial Sequence
  MKO10043041_A_Prph
  gRNA
ucaccuuacggaagagcacc

SEQ ID NO: 43042 - RNA, 20 nt, Artificial Sequence
  MKO10043042_A_Prpmp5
  gRNA
ggugguccuucaugguuccc

SEQ ID NO: 43043 - RNA, 20 nt, Artificial Sequence
  MKO10043043_A_Prpmp5
  gRNA
gaggcccacagaguccccuu

SEQ ID NO: 43044 - RNA, 20 nt, Artificial Sequence
  MKO10043044_A_Prpmp5
  gRNA
ccugcucacagcagcuuugc

SEQ ID NO: 43045 - RNA, 20 nt, Artificial Sequence
  MKO10043045_A_Prps1l1
  gRNA
cacauucaaaugguccgcga

SEQ ID NO: 43046 - RNA, 20 nt, Artificial Sequence
  MKO10043046_A_Prps1l1
  gRNA
ugcuacgagcuucgcagaga

SEQ ID NO: 43047 - RNA, 20 nt, Artificial Sequence
  MKO10043047_A_Prps1l1
  gRNA
acaaggguacgugacugaac

SEQ ID NO: 43048 - RNA, 20 nt, Artificial Sequence
  MKO10043048_A_Prps1l3
  gRNA
ugcauuguugaugcgagaaa

SEQ ID NO: 43049 - RNA, 20 nt, Artificial Sequence
  MKO10043049_A_Prps1l3
  gRNA
gaugucaaucaccuguauuu

SEQ ID NO: 43050 - RNA, 20 nt, Artificial Sequence
  MKO10043050_A_Prps1l3
  gRNA
aggagaugugaaggaucgug

SEQ ID NO: 43051 - RNA, 20 nt, Artificial Sequence
  MKO10043051_A_Prps1
  gRNA
cauccacaaguauagccaca

SEQ ID NO: 43052 - RNA, 20 nt, Artificial Sequence
  MKO10043052_A_Prps1
  gRNA
cuaccuuauccuucuuaucu

SEQ ID NO: 43053 - RNA, 20 nt, Artificial Sequence
  MKO10043053_A_Prps1
  gRNA
augggaugacugcaguaacc

SEQ ID NO: 43054 - RNA, 20 nt, Artificial Sequence
  MKO10043054_A_Prps2
  gRNA
uaucggccaugucgucuacc

SEQ ID NO: 43055 - RNA, 20 nt, Artificial Sequence
  MKO10043055_A_Prps2
  gRNA
cuacguacuuaucugcagca

SEQ ID NO: 43056 - RNA, 20 nt, Artificial Sequence
  MKO10043056_A_Prps2
  gRNA
uacccugcuuccccuacgcc

SEQ ID NO: 43057 - RNA, 20 nt, Artificial Sequence
  MKO10043057_A_Prpsap1
  gRNA
uaggcgucuuggugcugaau

SEQ ID NO: 43058 - RNA, 20 nt, Artificial Sequence
  MKO10043058_A_Prpsap1
  gRNA
cacugaagaccgccugcgcc

SEQ ID NO: 43059 - RNA, 20 nt, Artificial Sequence
  MKO10043059_A_Prpsap1
  gRNA
guuguauaucaggagaccaa

SEQ ID NO: 43060 - RNA, 20 nt, Artificial Sequence
  MKO10043060_A_Prpsap2
  gRNA
gcucaccucuguuagguucc

SEQ ID NO: 43061 - RNA, 20 nt, Artificial Sequence
  MKO10043061_A_Prpsap2
  gRNA
gcacuuacuuugagaugguu

SEQ ID NO: 43062 - RNA, 20 nt, Artificial Sequence
  MKO10043062_A_Prpsap2
  gRNA
guuacaauauauucaagaag

SEQ ID NO: 43063 - RNA, 20 nt, Artificial Sequence
  MKO10043063_A_Prr11
  gRNA
ugggauuccccauucgucgu

SEQ ID NO: 43064 - RNA, 20 nt, Artificial Sequence
  MKO10043064_A_Prr11
  gRNA
gccugugcuccaacgacgaa

SEQ ID NO: 43065 - RNA, 20 nt, Artificial Sequence
  MKO10043065_A_Prr11
  gRNA
accguauaccugggcuacac

SEQ ID NO: 43066 - RNA, 20 nt, Artificial Sequence
  MKO10043066_A_Prr12
  gRNA
acgggguggcgaaacucccg

SEQ ID NO: 43067 - RNA, 20 nt, Artificial Sequence
  MKO10043067_A_Prr12
  gRNA
ccacggcgacgcgggccguc

SEQ ID NO: 43068 - RNA, 20 nt, Artificial Sequence
  MKO10043068_A_Prr12
  gRNA
cgagaugagguucaugacgg

SEQ ID NO: 43069 - RNA, 20 nt, Artificial Sequence
  MKO10043069_A_Prr13
  gRNA
acaggauaagggggacgaca

SEQ ID NO: 43070 - RNA, 20 nt, Artificial Sequence
  MKO10043070_A_Prr13
  gRNA
ccuuauccuguaccacaacc

SEQ ID NO: 43071 - RNA, 20 nt, Artificial Sequence
  MKO10043071_A_Prr13
  gRNA
gacauguggaauccuaaugc

SEQ ID NO: 43072 - RNA, 20 nt, Artificial Sequence
  MKO10043072_A_Prr14l
  gRNA
uucaguagaagaauuacgca

SEQ ID NO: 43073 - RNA, 20 nt, Artificial Sequence
  MKO10043073_A_Prr14l
  gRNA
acguucuccuaaccgagccc

SEQ ID NO: 43074 - RNA, 20 nt, Artificial Sequence
  MKO10043074_A_Prr14l
  gRNA
cuuugcuggauugucucggg

SEQ ID NO: 43075 - RNA, 20 nt, Artificial Sequence
  MKO10043075_A_Prr14
  gRNA
ggacuggcgggcucgaguca

SEQ ID NO: 43076 - RNA, 20 nt, Artificial Sequence
  MKO10043076_A_Prr14
  gRNA
ccaggagcccgaaaagaccg

SEQ ID NO: 43077 - RNA, 20 nt, Artificial Sequence
  MKO10043077_A_Prr14
  gRNA
ucccaugaugcucgagauag

SEQ ID NO: 43078 - RNA, 20 nt, Artificial Sequence
  MKO10043078_A_Prr15l
  gRNA
cgggauuucguagagcacuu

SEQ ID NO: 43079 - RNA, 20 nt, Artificial Sequence
  MKO10043079_A_Prr15l
  gRNA
cagcgacuuuaacagccguc

SEQ ID NO: 43080 - RNA, 20 nt, Artificial Sequence
  MKO10043080_A_Prr15l
  gRNA
cugugagggucuccugcguc

SEQ ID NO: 43081 - RNA, 20 nt, Artificial Sequence
  MKO10043081_A_Prr15
  gRNA
cugcuaguccgaucugagug

SEQ ID NO: 43082 - RNA, 20 nt, Artificial Sequence
  MKO10043082_A_Prr15
  gRNA
aauuugaagaucucacgcuc

SEQ ID NO: 43083 - RNA, 20 nt, Artificial Sequence
  MKO10043083_A_Prr15
  gRNA
cuaugggccauggcggacag

SEQ ID NO: 43084 - RNA, 20 nt, Artificial Sequence
  MKO10043084_A_Prr16
  gRNA
uuaaaccgaacucguucccg

SEQ ID NO: 43085 - RNA, 20 nt, Artificial Sequence
  MKO10043085_A_Prr16
  gRNA
ccacguccuucaggucgccc

SEQ ID NO: 43086 - RNA, 20 nt, Artificial Sequence
  MKO10043086_A_Prr16
  gRNA
ggaggcugccggcggucccu

SEQ ID NO: 43087 - RNA, 20 nt, Artificial Sequence
  MKO10043087_A_Prr18
  gRNA
uaccagugggagccgcgggu

SEQ ID NO: 43088 - RNA, 20 nt, Artificial Sequence
  MKO10043088_A_Prr18
  gRNA
agcagcgacaccuuaagcac

SEQ ID NO: 43089 - RNA, 20 nt, Artificial Sequence
  MKO10043089_A_Prr18
  gRNA
ucgugcgcaagugcaccgag

SEQ ID NO: 43090 - RNA, 20 nt, Artificial Sequence
  MKO10043090_A_Prr19
  gRNA
uugcgacggcgaauucggcc

SEQ ID NO: 43091 - RNA, 20 nt, Artificial Sequence
  MKO10043091_A_Prr19
  gRNA
gaauucgccgucgcaagacc

SEQ ID NO: 43092 - RNA, 20 nt, Artificial Sequence
  MKO10043092_A_Prr19
  gRNA
cugaggugggcggacauccc

SEQ ID NO: 43093 - RNA, 20 nt, Artificial Sequence
  MKO10043093_A_Prr22
  gRNA
ccaccgcaucuaggaucucg

SEQ ID NO: 43094 - RNA, 20 nt, Artificial Sequence
  MKO10043094_A_Prr22
  gRNA
cccacucgaugcgguagauu

SEQ ID NO: 43095 - RNA, 20 nt, Artificial Sequence
  MKO10043095_A_Prr22
  gRNA
ccaucguaccuacgguggga

SEQ ID NO: 43096 - RNA, 20 nt, Artificial Sequence
  MKO10043096_A_Prr23a
  gRNA
ggaggugagcgcgcugcuag

SEQ ID NO: 43097 - RNA, 20 nt, Artificial Sequence
  MKO10043097_A_Prr23a
  gRNA
uagcagcgcgcucaccuccg

SEQ ID NO: 43098 - RNA, 20 nt, Artificial Sequence
  MKO10043098_A_Prr23a
  gRNA
ucggcgggcgcuuccagcuc

SEQ ID NO: 43099 - RNA, 20 nt, Artificial Sequence
  MKO10043099_A_Prr24
  gRNA
uggcugcggucguggcccgc

SEQ ID NO: 43100 - RNA, 20 nt, Artificial Sequence
  MKO10043100_A_Prr24
  gRNA
ggccagacuauccaggcgcu

SEQ ID NO: 43101 - RNA, 20 nt, Artificial Sequence
  MKO10043101_A_Prr24
  gRNA
gcggucucccgcgucgcucc

SEQ ID NO: 43102 - RNA, 20 nt, Artificial Sequence
  MKO10043102_A_Prr3
  gRNA
uucugugaacuacucccccg

SEQ ID NO: 43103 - RNA, 20 nt, Artificial Sequence
  MKO10043103_A_Prr3
  gRNA
gcccuccccccauggcuaac

SEQ ID NO: 43104 - RNA, 20 nt, Artificial Sequence
  MKO10043104_A_Prr3
  gRNA
uaugccgaaacgaaagaagc

SEQ ID NO: 43105 - RNA, 20 nt, Artificial Sequence
  MKO10043105_A_Prr5l
  gRNA
uguaggugacaaucggauug

SEQ ID NO: 43106 - RNA, 20 nt, Artificial Sequence
  MKO10043106_A_Prr5l
  gRNA
ccggauaaaauauugccugc

SEQ ID NO: 43107 - RNA, 20 nt, Artificial Sequence
  MKO10043107_A_Prr5l
  gRNA
augcacugaacgaaagcauc

SEQ ID NO: 43108 - RNA, 20 nt, Artificial Sequence
  MKO10043108_A_Prr5
  gRNA
agaccgcgaucacuccguua

SEQ ID NO: 43109 - RNA, 20 nt, Artificial Sequence
  MKO10043109_A_Prr5
  gRNA
gacaagauucgcuucuacga

SEQ ID NO: 43110 - RNA, 20 nt, Artificial Sequence
  MKO10043110_A_Prr5
  gRNA
gaucgcggucuuccagcgca

SEQ ID NO: 43111 - RNA, 20 nt, Artificial Sequence
  MKO10043111_A_Prr7
  gRNA
gcagcgccgaaguauagccc

SEQ ID NO: 43112 - RNA, 20 nt, Artificial Sequence
  MKO10043112_A_Prr7
  gRNA
agcaccgccuccucguagca

SEQ ID NO: 43113 - RNA, 20 nt, Artificial Sequence
  MKO10043113_A_Prr7
  gRNA
cccuggagcuauccgcgcca

SEQ ID NO: 43114 - RNA, 20 nt, Artificial Sequence
  MKO10043114_A_Prr9
  gRNA
uaaauguccacaacaagcuc

SEQ ID NO: 43115 - RNA, 20 nt, Artificial Sequence
  MKO10043115_A_Prr9
  gRNA
gcagcuacuuccccuugcuc

SEQ ID NO: 43116 - RNA, 20 nt, Artificial Sequence
  MKO10043116_A_Prr9
  gRNA
ggaguucccacagaagguac

SEQ ID NO: 43117 - RNA, 20 nt, Artificial Sequence
  MKO10043117_A_Prrc1
  gRNA
uacaaccuacgacaucacga

SEQ ID NO: 43118 - RNA, 20 nt, Artificial Sequence
  MKO10043118_A_Prrc1
  gRNA
agacuccauucccgacacgu

SEQ ID NO: 43119 - RNA, 20 nt, Artificial Sequence
  MKO10043119_A_Prrc1
  gRNA
aauccagcugcauacccgac

SEQ ID NO: 43120 - RNA, 20 nt, Artificial Sequence
  MKO10043120_A_Prrc2a
  gRNA
gagucugccgaacagucguc

SEQ ID NO: 43121 - RNA, 20 nt, Artificial Sequence
  MKO10043121_A_Prrc2a
  gRNA
cucgagagaaucgcgacagu

SEQ ID NO: 43122 - RNA, 20 nt, Artificial Sequence
  MKO10043122_A_Prrc2a
  gRNA
ggguggcaugcgccgggcaa

SEQ ID NO: 43123 - RNA, 20 nt, Artificial Sequence
  MKO10043123_A_Prrc2b
  gRNA
accgacacagucuaucaguc

SEQ ID NO: 43124 - RNA, 20 nt, Artificial Sequence
  MKO10043124_A_Prrc2b
  gRNA
uuaccaccuucguguccgac

SEQ ID NO: 43125 - RNA, 20 nt, Artificial Sequence
  MKO10043125_A_Prrc2b
  gRNA
aagccagucggacacgaagg

SEQ ID NO: 43126 - RNA, 20 nt, Artificial Sequence
  MKO10043126_A_Prrc2c
  gRNA
cuuacuuggagggcguaaac

SEQ ID NO: 43127 - RNA, 20 nt, Artificial Sequence
  MKO10043127_A_Prrc2c
  gRNA
gcugaaauugacuauucacu

SEQ ID NO: 43128 - RNA, 20 nt, Artificial Sequence
  MKO10043128_A_Prrc2c
  gRNA
uuauagccgugcuuucaucc

SEQ ID NO: 43129 - RNA, 20 nt, Artificial Sequence
  MKO10043129_A_Prrg1
  gRNA
gugggggaucacaguuggaa

SEQ ID NO: 43130 - RNA, 20 nt, Artificial Sequence
  MKO10043130_A_Prrg1
  gRNA
uguuguugggcguucagauu

SEQ ID NO: 43131 - RNA, 20 nt, Artificial Sequence
  MKO10043131_A_Prrg1
  gRNA
uauuucuucaaaaagcccau

SEQ ID NO: 43132 - RNA, 20 nt, Artificial Sequence
  MKO10043132_A_Prrg2
  gRNA
ucuaacccuaggagcgcuuc

SEQ ID NO: 43133 - RNA, 20 nt, Artificial Sequence
  MKO10043133_A_Prrg2
  gRNA
uagcacgaggaaaacgccug

SEQ ID NO: 43134 - RNA, 20 nt, Artificial Sequence
  MKO10043134_A_Prrg2
  gRNA
cggaggugcgucgugcaccc

SEQ ID NO: 43135 - RNA, 20 nt, Artificial Sequence
  MKO10043135_A_Prrg3
  gRNA
cgauaccuagccagucgugc

SEQ ID NO: 43136 - RNA, 20 nt, Artificial Sequence
  MKO10043136_A_Prrg3
  gRNA
gcacaaccucccccguguca

SEQ ID NO: 43137 - RNA, 20 nt, Artificial Sequence
  MKO10043137_A_Prrg3
  gRNA
uggcacgaggaaaccguuuc

SEQ ID NO: 43138 - RNA, 20 nt, Artificial Sequence
  MKO10043138_A_Prrg4
  gRNA
accgccgccuccugaacaau

SEQ ID NO: 43139 - RNA, 20 nt, Artificial Sequence
  MKO10043139_A_Prrg4
  gRNA
cuagaucaaaccuauuguuc

SEQ ID NO: 43140 - RNA, 20 nt, Artificial Sequence
  MKO10043140_A_Prrg4
  gRNA
aggacuaccuuccuaugaac

SEQ ID NO: 43141 - RNA, 20 nt, Artificial Sequence
  MKO10043141_A_Prrt1
  gRNA
cgucuuccgccacgcuaccg

SEQ ID NO: 43142 - RNA, 20 nt, Artificial Sequence
  MKO10043142_A_Prrt1
  gRNA
agaucgcuucacgcgaagcc

SEQ ID NO: 43143 - RNA, 20 nt, Artificial Sequence
  MKO10043143_A_Prrt1
  gRNA
gguagcguggcggaagacga

SEQ ID NO: 43144 - RNA, 20 nt, Artificial Sequence
  MKO10043144_A_Prrt2
  gRNA
accgccuaaguugaugacgc

SEQ ID NO: 43145 - RNA, 20 nt, Artificial Sequence
  MKO10043145_A_Prrt2
  gRNA
uggcucuuggcgugccucgc

SEQ ID NO: 43146 - RNA, 20 nt, Artificial Sequence
  MKO10043146_A_Prrt2
  gRNA
caccaugacggcauaagcga

SEQ ID NO: 43147 - RNA, 20 nt, Artificial Sequence
  MKO10043147_A_Prrt3
  gRNA
cgcuggacuugcaacgcgac

SEQ ID NO: 43148 - RNA, 20 nt, Artificial Sequence
  MKO10043148_A_Prrt3
  gRNA
ccagcaggcgucgacggcac

SEQ ID NO: 43149 - RNA, 20 nt, Artificial Sequence
  MKO10043149_A_Prrt3
  gRNA
aucuccccacaacgugugag

SEQ ID NO: 43150 - RNA, 20 nt, Artificial Sequence
  MKO10043150_A_Prrt4
  gRNA
aucggcugccgacucucguc

SEQ ID NO: 43151 - RNA, 20 nt, Artificial Sequence
  MKO10043151_A_Prrt4
  gRNA
cacgcgcgaucgcgcuaccc

SEQ ID NO: 43152 - RNA, 20 nt, Artificial Sequence
  MKO10043152_A_Prrt4
  gRNA
gguccugcuugccguaccug

SEQ ID NO: 43153 - RNA, 20 nt, Artificial Sequence
  MKO10043153_A_Prrx1
  gRNA
cuccagaacgugcccguagc

SEQ ID NO: 43154 - RNA, 20 nt, Artificial Sequence
  MKO10043154_A_Prrx1
  gRNA
uucgagaagaucucgcacgu

SEQ ID NO: 43155 - RNA, 20 nt, Artificial Sequence
  MKO10043155_A_Prrx1
  gRNA
agucauucaccuguacggag

SEQ ID NO: 43156 - RNA, 20 nt, Artificial Sequence
  MKO10043156_A_Prrx2
  gRNA
gcccguuucggggcccgccg

SEQ ID NO: 43157 - RNA, 20 nt, Artificial Sequence
  MKO10043157_A_Prrx2
  gRNA
ucgccgugucaaccucagug

SEQ ID NO: 43158 - RNA, 20 nt, Artificial Sequence
  MKO10043158_A_Prrx2
  gRNA
gcgcaaucgccgggugcggg

SEQ ID NO: 43159 - RNA, 20 nt, Artificial Sequence
  MKO10043159_A_Prrxl1
  gRNA
aacgaccuucacucuucagc

SEQ ID NO: 43160 - RNA, 20 nt, Artificial Sequence
  MKO10043160_A_Prrxl1
  gRNA
aggugacaccaccgccagug

SEQ ID NO: 43161 - RNA, 20 nt, Artificial Sequence
  MKO10043161_A_Prrxl1
  gRNA
ccugcaggcacugcgccuuu

SEQ ID NO: 43162 - RNA, 20 nt, Artificial Sequence
  MKO10043162_A_Prss12
  gRNA
uugcccgucauucgccuugu

SEQ ID NO: 43163 - RNA, 20 nt, Artificial Sequence
  MKO10043163_A_Prss12
  gRNA
accugcuauccugacagcga

SEQ ID NO: 43164 - RNA, 20 nt, Artificial Sequence
  MKO10043164_A_Prss12
  gRNA
uuggaugaaguacgcugcac

SEQ ID NO: 43165 - RNA, 20 nt, Artificial Sequence
  MKO10043165_A_Prss16
  gRNA
ugcuucggaggcuccuacgc

SEQ ID NO: 43166 - RNA, 20 nt, Artificial Sequence
  MKO10043166_A_Prss16
  gRNA
uccgcucgccaggcgcucuc

SEQ ID NO: 43167 - RNA, 20 nt, Artificial Sequence
  MKO10043167_A_Prss16
  gRNA
ccccacucacgcauggcggc

SEQ ID NO: 43168 - RNA, 20 nt, Artificial Sequence
  MKO10043168_A_Prss1
  gRNA
ggagcacaauaucaaugucc

SEQ ID NO: 43169 - RNA, 20 nt, Artificial Sequence
  MKO10043169_A_Prss1
  gRNA
ucaacaugaugucauuguuc

SEQ ID NO: 43170 - RNA, 20 nt, Artificial Sequence
  MKO10043170_A_Prss1
  gRNA
gaagccucacagucagccug

SEQ ID NO: 43171 - RNA, 20 nt, Artificial Sequence
  MKO10043171_A_Prss21
  gRNA
caaccuugcucaaccgccgc

SEQ ID NO: 43172 - RNA, 20 nt, Artificial Sequence
  MKO10043172_A_Prss21
  gRNA
gcaagguugcgccacauaag

SEQ ID NO: 43173 - RNA, 20 nt, Artificial Sequence
  MKO10043173_A_Prss21
  gRNA
cagacuuccgcacgaacauc

SEQ ID NO: 43174 - RNA, 20 nt, Artificial Sequence
  MKO10043174_A_Prss22
  gRNA
aucacacucaccucggaugg

SEQ ID NO: 43175 - RNA, 20 nt, Artificial Sequence
  MKO10043175_A_Prss22
  gRNA
cagccgcgcacugcuuuaag

SEQ ID NO: 43176 - RNA, 20 nt, Artificial Sequence
  MKO10043176_A_Prss22
  gRNA
ucagcagcugaaccggauug

SEQ ID NO: 43177 - RNA, 20 nt, Artificial Sequence
  MKO10043177_A_Prss23
  gRNA
cuucgacgccaaagcgaaau

SEQ ID NO: 43178 - RNA, 20 nt, Artificial Sequence
  MKO10043178_A_Prss23
  gRNA
gaggcgauaagccggccaug

SEQ ID NO: 43179 - RNA, 20 nt, Artificial Sequence
  MKO10043179_A_Prss23
  gRNA
ugagucccuacaccguuccg

SEQ ID NO: 43180 - RNA, 20 nt, Artificial Sequence
  MKO10043180_A_Prss27
  gRNA
gcccgacucaaagaugaccg

SEQ ID NO: 43181 - RNA, 20 nt, Artificial Sequence
  MKO10043181_A_Prss27
  gRNA
gcagucucaucgcaccaaca

SEQ ID NO: 43182 - RNA, 20 nt, Artificial Sequence
  MKO10043182_A_Prss27
  gRNA
cauggccuccagugccgacg

SEQ ID NO: 43183 - RNA, 20 nt, Artificial Sequence
  MKO10043183_A_Prss28
  gRNA
acgccgacccagccguauac

SEQ ID NO: 43184 - RNA, 20 nt, Artificial Sequence
  MKO10043184_A_Prss28
  gRNA
ccuaagaauguacaguuacg

SEQ ID NO: 43185 - RNA, 20 nt, Artificial Sequence
  MKO10043185_A_Prss28
  gRNA
uggggcaaccuucuccaacg

SEQ ID NO: 43186 - RNA, 20 nt, Artificial Sequence
  MKO10043186_A_Prss29
  gRNA
gaacucacucacgaaugcag

SEQ ID NO: 43187 - RNA, 20 nt, Artificial Sequence
  MKO10043187_A_Prss29
  gRNA
gcguucugaugggcaucgug

SEQ ID NO: 43188 - RNA, 20 nt, Artificial Sequence
  MKO10043188_A_Prss29
  gRNA
uguacacgugcauagacccc

SEQ ID NO: 43189 - RNA, 20 nt, Artificial Sequence
  MKO10043189_A_Prss2
  gRNA
caauuauaauucauggaccc

SEQ ID NO: 43190 - RNA, 20 nt, Artificial Sequence
  MKO10043190_A_Prss2
  gRNA
agcauuuagggacaccugau

SEQ ID NO: 43191 - RNA, 20 nt, Artificial Sequence
  MKO10043191_A_Prss2
  gRNA
agagaguucuguccccuauc

SEQ ID NO: 43192 - RNA, 20 nt, Artificial Sequence
  MKO10043192_A_Prss30
  gRNA
acucaacuuuaguggccgug

SEQ ID NO: 43193 - RNA, 20 nt, Artificial Sequence
  MKO10043193_A_Prss30
  gRNA
gcucccucauccacgaggug

SEQ ID NO: 43194 - RNA, 20 nt, Artificial Sequence
  MKO10043194_A_Prss30
  gRNA
cugcacagagcauguccgac

SEQ ID NO: 43195 - RNA, 20 nt, Artificial Sequence
  MKO10043195_A_Prss32
  gRNA
acaucaggccgcaucguguc

SEQ ID NO: 43196 - RNA, 20 nt, Artificial Sequence
  MKO10043196_A_Prss32
  gRNA
gacuggcuccgugccgggaa

SEQ ID NO: 43197 - RNA, 20 nt, Artificial Sequence
  MKO10043197_A_Prss32
  gRNA
caucuuguccugacacgaug

SEQ ID NO: 43198 - RNA, 20 nt, Artificial Sequence
  MKO10043198_A_Prss33
  gRNA
uagcacuaugcguucacccu

SEQ ID NO: 43199 - RNA, 20 nt, Artificial Sequence
  MKO10043199_A_Prss33
  gRNA
caacgauccggcuggacaug

SEQ ID NO: 43200 - RNA, 20 nt, Artificial Sequence
  MKO10043200_A_Prss33
  gRNA
cugugaccgccucuaccacg

SEQ ID NO: 43201 - RNA, 20 nt, Artificial Sequence
  MKO10043201_A_Prss34
  gRNA
gggugaugagcuacgugucc

SEQ ID NO: 43202 - RNA, 20 nt, Artificial Sequence
  MKO10043202_A_Prss34
  gRNA
ggaccgccacuucccucagg

SEQ ID NO: 43203 - RNA, 20 nt, Artificial Sequence
  MKO10043203_A_Prss34
  gRNA
cacguuccuagaaccuuuga

SEQ ID NO: 43204 - RNA, 20 nt, Artificial Sequence
  MKO10043204_A_Prss35
  gRNA
caagaucgucgcggucuacu

SEQ ID NO: 43205 - RNA, 20 nt, Artificial Sequence
  MKO10043205_A_Prss35
  gRNA
aacgaggguaccgcugcagc

SEQ ID NO: 43206 - RNA, 20 nt, Artificial Sequence
  MKO10043206_A_Prss35
  gRNA
ucgggugccauucucgaaga

SEQ ID NO: 43207 - RNA, 20 nt, Artificial Sequence
  MKO10043207_A_Prss36
  gRNA
gccucgcaccucuucgcuca

SEQ ID NO: 43208 - RNA, 20 nt, Artificial Sequence
  MKO10043208_A_Prss36
  gRNA
cagaacugacaauucguccg

SEQ ID NO: 43209 - RNA, 20 nt, Artificial Sequence
  MKO10043209_A_Prss36
  gRNA
cguccgagccccccacaaug

SEQ ID NO: 43210 - RNA, 20 nt, Artificial Sequence
  MKO10043210_A_Prss37
  gRNA
ccauccagauuauccgcuac

SEQ ID NO: 43211 - RNA, 20 nt, Artificial Sequence
  MKO10043211_A_Prss37
  gRNA
ccauagccaccacuaauguc

SEQ ID NO: 43212 - RNA, 20 nt, Artificial Sequence
  MKO10043212_A_Prss37
  gRNA
uccagguucugccguaaguc

SEQ ID NO: 43213 - RNA, 20 nt, Artificial Sequence
  MKO10043213_A_Prss38
  gRNA
cgaaaccgggaacgagcuau

SEQ ID NO: 43214 - RNA, 20 nt, Artificial Sequence
  MKO10043214_A_Prss38
  gRNA
uggcgagaucauuccccauc

SEQ ID NO: 43215 - RNA, 20 nt, Artificial Sequence
  MKO10043215_A_Prss38
  gRNA
guggagaguuugcucgugau

SEQ ID NO: 43216 - RNA, 20 nt, Artificial Sequence
  MKO10043216_A_Prss39
  gRNA
cuauagcaagcucagccguc

SEQ ID NO: 43217 - RNA, 20 nt, Artificial Sequence
  MKO10043217_A_Prss39
  gRNA
gaaaccuucguggugccguc

SEQ ID NO: 43218 - RNA, 20 nt, Artificial Sequence
  MKO10043218_A_Prss39
  gRNA
uccugagccaaaucgauugc

SEQ ID NO: 43219 - RNA, 20 nt, Artificial Sequence
  MKO10043219_A_Prss3
  gRNA
ggucugcaauagagaacucc

SEQ ID NO: 43220 - RNA, 20 nt, Artificial Sequence
  MKO10043220_A_Prss3
  gRNA
ggggacagaauucucuuggc

SEQ ID NO: 43221 - RNA, 20 nt, Artificial Sequence
  MKO10043221_A_Prss3
  gRNA
aguucucuauugcagaccac

SEQ ID NO: 43222 - RNA, 20 nt, Artificial Sequence
  MKO10043222_A_Prss40
  gRNA
aucuauggcggucagauugc

SEQ ID NO: 43223 - RNA, 20 nt, Artificial Sequence
  MKO10043223_A_Prss40
  gRNA
ccugccauauaagcgcagac

SEQ ID NO: 43224 - RNA, 20 nt, Artificial Sequence
  MKO10043224_A_Prss40
  gRNA
cccugagaaugaaaaucccg

SEQ ID NO: 43225 - RNA, 20 nt, Artificial Sequence
  MKO10043225_A_Prss41
  gRNA
agugucauuccggcggccac

SEQ ID NO: 43226 - RNA, 20 nt, Artificial Sequence
  MKO10043226_A_Prss41
  gRNA
ugacacucggucccggauag

SEQ ID NO: 43227 - RNA, 20 nt, Artificial Sequence
  MKO10043227_A_Prss41
  gRNA
uuacauccaagccgucuuac

SEQ ID NO: 43228 - RNA, 20 nt, Artificial Sequence
  MKO10043228_A_Prss42
  gRNA
cgcccaccuugacguuguac

SEQ ID NO: 43229 - RNA, 20 nt, Artificial Sequence
  MKO10043229_A_Prss42
  gRNA
ccgaauccaguacaacguca

SEQ ID NO: 43230 - RNA, 20 nt, Artificial Sequence
  MKO10043230_A_Prss42
  gRNA
cugccgcccauuguauuuac

SEQ ID NO: 43231 - RNA, 20 nt, Artificial Sequence
  MKO10043231_A_Prss43
  gRNA
gaaugcguugcugaaccucc

SEQ ID NO: 43232 - RNA, 20 nt, Artificial Sequence
  MKO10043232_A_Prss43
  gRNA
ccgcagucaacacccaucgg

SEQ ID NO: 43233 - RNA, 20 nt, Artificial Sequence
  MKO10043233_A_Prss43
  gRNA
cugaagggugcgaaauacuc

SEQ ID NO: 43234 - RNA, 20 nt, Artificial Sequence
  MKO10043234_A_Prss44
  gRNA
uaggucgucgagaauacugc

SEQ ID NO: 43235 - RNA, 20 nt, Artificial Sequence
  MKO10043235_A_Prss44
  gRNA
ccucgucuuaagcguguguc

SEQ ID NO: 43236 - RNA, 20 nt, Artificial Sequence
  MKO10043236_A_Prss44
  gRNA
uacaaccugggacgcuaugc

SEQ ID NO: 43237 - RNA, 20 nt, Artificial Sequence
  MKO10043237_A_Prss45
  gRNA
gagcccucauugaucgaagc

SEQ ID NO: 43238 - RNA, 20 nt, Artificial Sequence
  MKO10043238_A_Prss45
  gRNA
ccacccagcuucgaucaaug

SEQ ID NO: 43239 - RNA, 20 nt, Artificial Sequence
  MKO10043239_A_Prss45
  gRNA
aaugagaacuacaccgaacc

SEQ ID NO: 43240 - RNA, 20 nt, Artificial Sequence
  MKO10043240_A_Prss46
  gRNA
ccaugugcugggucgucggg

SEQ ID NO: 43241 - RNA, 20 nt, Artificial Sequence
  MKO10043241_A_Prss46
  gRNA
ccacccgacgacccagcaca

SEQ ID NO: 43242 - RNA, 20 nt, Artificial Sequence
  MKO10043242_A_Prss46
  gRNA
uccagcucaccacgcccauc

SEQ ID NO: 43243 - RNA, 20 nt, Artificial Sequence
  MKO10043243_A_Prss48
  gRNA
gcuugaguacucucuaucga

SEQ ID NO: 43244 - RNA, 20 nt, Artificial Sequence
  MKO10043244_A_Prss48
  gRNA
uuugucggggauggcgauuc

SEQ ID NO: 43245 - RNA, 20 nt, Artificial Sequence
  MKO10043245_A_Prss48
  gRNA
uguggacgaccuguacacac

SEQ ID NO: 43246 - RNA, 20 nt, Artificial Sequence
  MKO10043246_A_Prss50
  gRNA
caugguuuaugaugacucga

SEQ ID NO: 43247 - RNA, 20 nt, Artificial Sequence
  MKO10043247_A_Prss50
  gRNA
guuggccgggcccaugacau

SEQ ID NO: 43248 - RNA, 20 nt, Artificial Sequence
  MKO10043248_A_Prss50
  gRNA
ggagauaacuggcgagcccc

SEQ ID NO: 43249 - RNA, 20 nt, Artificial Sequence
  MKO10043249_A_Prss51
  gRNA
acgagcccuugcccucucaa

SEQ ID NO: 43250 - RNA, 20 nt, Artificial Sequence
  MKO10043250_A_Prss51
  gRNA
gggcaccaacggcaagugcc

SEQ ID NO: 43251 - RNA, 20 nt, Artificial Sequence
  MKO10043251_A_Prss51
  gRNA
agaacuccugggaccggugc

SEQ ID NO: 43252 - RNA, 20 nt, Artificial Sequence
  MKO10043252_A_Prss52
  gRNA
gcaaagcuaugucguugucc

SEQ ID NO: 43253 - RNA, 20 nt, Artificial Sequence
  MKO10043253_A_Prss52
  gRNA
cauguggggauuaugaauca

SEQ ID NO: 43254 - RNA, 20 nt, Artificial Sequence
  MKO10043254_A_Prss52
  gRNA
caaaccugcuucugcuaucg

SEQ ID NO: 43255 - RNA, 20 nt, Artificial Sequence
  MKO10043255_A_Prss53
  gRNA
gacggaggcgcagauuccgu

SEQ ID NO: 43256 - RNA, 20 nt, Artificial Sequence
  MKO10043256_A_Prss53
  gRNA
ucuacagcaugcgggcagcg

SEQ ID NO: 43257 - RNA, 20 nt, Artificial Sequence
  MKO10043257_A_Prss53
  gRNA
uacacccugucgccucacac

SEQ ID NO: 43258 - RNA, 20 nt, Artificial Sequence
  MKO10043258_A_Prss54
  gRNA
cgccaugcauuucaacgacc

SEQ ID NO: 43259 - RNA, 20 nt, Artificial Sequence
  MKO10043259_A_Prss54
  gRNA
accguaguagucguaguaca

SEQ ID NO: 43260 - RNA, 20 nt, Artificial Sequence
  MKO10043260_A_Prss54
  gRNA
cuccuuuaacuuguccgcga

SEQ ID NO: 43261 - RNA, 20 nt, Artificial Sequence
  MKO10043261_A_Prss55
  gRNA
cgucagcucauugaacguca

SEQ ID NO: 43262 - RNA, 20 nt, Artificial Sequence
  MKO10043262_A_Prss55
  gRNA
cucccacucuaugauacgca

SEQ ID NO: 43263 - RNA, 20 nt, Artificial Sequence
  MKO10043263_A_Prss55
  gRNA
ugcccaugcguaucauagag

SEQ ID NO: 43264 - RNA, 20 nt, Artificial Sequence
  MKO10043264_A_Prss56
  gRNA
cuccaucaacacgcgcuuua

SEQ ID NO: 43265 - RNA, 20 nt, Artificial Sequence
  MKO10043265_A_Prss56
  gRNA
gccaacacgacccgggcuca

SEQ ID NO: 43266 - RNA, 20 nt, Artificial Sequence
  MKO10043266_A_Prss56
  gRNA
ccgugcugccaccgacuaug

SEQ ID NO: 43267 - RNA, 20 nt, Artificial Sequence
  MKO10043267_A_Prss57
  gRNA
ggaagucgaggugcgcauac

SEQ ID NO: 43268 - RNA, 20 nt, Artificial Sequence
  MKO10043268_A_Prss57
  gRNA
cgcguugccauguauccggc

SEQ ID NO: 43269 - RNA, 20 nt, Artificial Sequence
  MKO10043269_A_Prss57
  gRNA
ccacccaauggguaugaauc

SEQ ID NO: 43270 - RNA, 20 nt, Artificial Sequence
  MKO10043270_A_Prss58
  gRNA
aguaccccguugcagacugc

SEQ ID NO: 43271 - RNA, 20 nt, Artificial Sequence
  MKO10043271_A_Prss58
  gRNA
acagaaaacaugaucugcgu

SEQ ID NO: 43272 - RNA, 20 nt, Artificial Sequence
  MKO10043272_A_Prss58
  gRNA
acugacgucacauagauugu

SEQ ID NO: 43273 - RNA, 20 nt, Artificial Sequence
  MKO10043273_A_Prss8
  gRNA
cgagcgacccgccacaaaca

SEQ ID NO: 43274 - RNA, 20 nt, Artificial Sequence
  MKO10043274_A_Prss8
  gRNA
ggucgcucgugucaaauaaa

SEQ ID NO: 43275 - RNA, 20 nt, Artificial Sequence
  MKO10043275_A_Prss8
  gRNA
gcaccgcauuaauguuguac

SEQ ID NO: 43276 - RNA, 20 nt, Artificial Sequence
  MKO10043276_A_Prug
  gRNA
cgccgccugcagucauaaca

SEQ ID NO: 43277 - RNA, 20 nt, Artificial Sequence
  MKO10043277_A_Prug
  gRNA
cgacuuaccaagacggcucc

SEQ ID NO: 43278 - RNA, 20 nt, Artificial Sequence
  MKO10043278_A_Prug
  gRNA
gccuggcaaucuaaaacgac

SEQ ID NO: 43279 - RNA, 20 nt, Artificial Sequence
  MKO10043279_A_Prtn3
  gRNA
gcggcugucagcacgaaucu

SEQ ID NO: 43280 - RNA, 20 nt, Artificial Sequence
  MKO10043280_A_Prtn3
  gRNA
ccagaacaauuacaaccccg

SEQ ID NO: 43281 - RNA, 20 nt, Artificial Sequence
  MKO10043281_A_Prtn3
  gRNA
acccacgccccgugugcugc

SEQ ID NO: 43282 - RNA, 20 nt, Artificial Sequence
  MKO10043282_A_Prune2
  gRNA
gaaacugucgauaacgcucg

SEQ ID NO: 43283 - RNA, 20 nt, Artificial Sequence
  MKO10043283_A_Prune2
  gRNA
ccauacucauccacgugaac

SEQ ID NO: 43284 - RNA, 20 nt, Artificial Sequence
  MKO10043284_A_Prune2
  gRNA
gcaggaucgaaguaaacaau

SEQ ID NO: 43285 - RNA, 20 nt, Artificial Sequence
  MKO10043285_A_Prune
  gRNA
caggccucuacaugucgugc

SEQ ID NO: 43286 - RNA, 20 nt, Artificial Sequence
  MKO10043286_A_Prune
  gRNA
uuucccagcacgacauguag

SEQ ID NO: 43287 - RNA, 20 nt, Artificial Sequence
  MKO10043287_A_Prune
  gRNA
cauaccugagacgucaaacu

SEQ ID NO: 43288 - RNA, 20 nt, Artificial Sequence
  MKO10043288_A_Prx
  gRNA
cgugccggauguacgacucc

SEQ ID NO: 43289 - RNA, 20 nt, Artificial Sequence
  MKO10043289_A_Prx
  gRNA
aaagagaacucgacgucaac

SEQ ID NO: 43290 - RNA, 20 nt, Artificial Sequence
  MKO10043290_A_Prx
  gRNA
guagcaggcggcggcaaaga

SEQ ID NO: 43291 - RNA, 20 nt, Artificial Sequence
  MKO10043291_A_Psapl1
  gRNA
ucaagcacacgucgcacguc

SEQ ID NO: 43292 - RNA, 20 nt, Artificial Sequence
  MKO10043292_A_Psapl1
  gRNA
cugcaaagugucgggccgug

SEQ ID NO: 43293 - RNA, 20 nt, Artificial Sequence
  MKO10043293_A_Psapl1
  gRNA
cgguugcacugcaucacaua

SEQ ID NO: 43294 - RNA, 20 nt, Artificial Sequence
  MKO10043294_A_Psap
  gRNA
gucaaccaccuccuugcacg

SEQ ID NO: 43295 - RNA, 20 nt, Artificial Sequence
  MKO10043295_A_Psap
  gRNA
caagacccgaagacaugcuc

SEQ ID NO: 43296 - RNA, 20 nt, Artificial Sequence
  MKO10043296_A_Psap
  gRNA
ucucgcccuuaaucaugucc

SEQ ID NO: 43297 - RNA, 20 nt, Artificial Sequence
  MKO10043297_A_Psau1
  gRNA
uggaaggagugcugacuacg

SEQ ID NO: 43298 - RNA, 20 nt, Artificial Sequence
  MKO10043298_A_Psau1
  gRNA
guucaccguuccaaacuucu

SEQ ID NO: 43299 - RNA, 20 nt, Artificial Sequence
  MKO10043299_A_Psau1
  gRNA
uguagucuaguagcugcuuc

SEQ ID NO: 43300 - RNA, 20 nt, Artificial Sequence
  MKO10043300_A_Psca
  gRNA
gauaacugucacgaguccaa

SEQ ID NO: 43301 - RNA, 20 nt, Artificial Sequence
  MKO10043301_A_Psca
  gRNA
gggccccguugacauugcac

SEQ ID NO: 43302 - RNA, 20 nt, Artificial Sequence
  MKO10043302_A_Psca
  gRNA
gcgauguaaagcaacugugc

SEQ ID NO: 43303 - RNA, 20 nt, Artificial Sequence
  MKO10043303_A_Psd2
  gRNA
gggucagcgaagccgcucgc

SEQ ID NO: 43304 - RNA, 20 nt, Artificial Sequence
  MKO10043304_A_Psd2
  gRNA
uggccugucggacucggacu

SEQ ID NO: 43305 - RNA, 20 nt, Artificial Sequence
  MKO10043305_A_Psd2
  gRNA
gcucgagauagccccgaggc

SEQ ID NO: 43306 - RNA, 20 nt, Artificial Sequence
  MKO10043306_A_Psd3
  gRNA
ccaauacgacugauagucuu

SEQ ID NO: 43307 - RNA, 20 nt, Artificial Sequence
  MKO10043307_A_Psd3
  gRNA
ccaaagacuaucagucguau

SEQ ID NO: 43308 - RNA, 20 nt, Artificial Sequence
  MKO10043308_A_Psd3
  gRNA
gcaccacgcucuggcgucca

SEQ ID NO: 43309 - RNA, 20 nt, Artificial Sequence
  MKO10043309_A_Psd4
  gRNA
aagucccuuacuucuugcgu

SEQ ID NO: 43310 - RNA, 20 nt, Artificial Sequence
  MKO10043310_A_Psd4
  gRNA
cugcgccucuaucaacugaa

SEQ ID NO: 43311 - RNA, 20 nt, Artificial Sequence
  MKO10043311_A_Psd4
  gRNA
ccugacucaacccauacuug

SEQ ID NO: 43312 - RNA, 20 nt, Artificial Sequence
  MKO10043312_A_Psd
  gRNA
uauaccgacucgauggcuuc

SEQ ID NO: 43313 - RNA, 20 nt, Artificial Sequence
  MKO10043313_A_Psd
  gRNA
ggccgauguggcacggcauc

SEQ ID NO: 43314 - RNA, 20 nt, Artificial Sequence
  MKO10043314_A_Psd
  gRNA
ccgagagacugacaucgaug

SEQ ID NO: 43315 - RNA, 20 nt, Artificial Sequence
  MKO10043315_A_Psen1
  gRNA
uuacaguagcacuccuaauc

SEQ ID NO: 43316 - RNA, 20 nt, Artificial Sequence
  MKO10043316_A_Psen1
  gRNA
ccacgacgacgaccaugcag

SEQ ID NO: 43317 - RNA, 20 nt, Artificial Sequence
  MKO10043317_A_Psen1
  gRNA
ugcuacuguaacguagucca

SEQ ID NO: 43318 - RNA, 20 nt, Artificial Sequence
  MKO10043318_A_Psen2
  gRNA
acgaucauacacagcgugac

SEQ ID NO: 43319 - RNA, 20 nt, Artificial Sequence
  MKO10043319_A_Psen2
  gRNA
ccggaccgcuacgcaugcag

SEQ ID NO: 43320 - RNA, 20 nt, Artificial Sequence
  MKO10043320_A_Psen2
  gRNA
acacgcccucggugggccag

SEQ ID NO: 43321 - RNA, 20 nt, Artificial Sequence
  MKO10043321_A_Psenen
  gRNA
agauguuuggcgcucagcug

SEQ ID NO: 43322 - RNA, 20 nt, Artificial Sequence
  MKO10043322_A_Psenen
  gRNA
agaacucacagccuuugauu

SEQ ID NO: 43323 - RNA, 20 nt, Artificial Sequence
  MKO10043323_A_Psenen
  gRNA
ccuuaccaagauaguacuuc

SEQ ID NO: 43324 - RNA, 20 nt, Artificial Sequence
  MKO10043324_A_Psg16
  gRNA
gauccacagggacccguugc

SEQ ID NO: 43325 - RNA, 20 nt, Artificial Sequence
  MKO10043325_A_Psg16
  gRNA
auaagcuucgagggcuuucc

SEQ ID NO: 43326 - RNA, 20 nt, Artificial Sequence
  MKO10043326_A_Psg16
  gRNA
aacuacguauaaauccuguc

SEQ ID NO: 43327 - RNA, 20 nt, Artificial Sequence
  MKO10043327_A_Psg17
  gRNA
cuucgaaccguaagucaacg

SEQ ID NO: 43328 - RNA, 20 nt, Artificial Sequence
  MKO10043328_A_Psg17
  gRNA
agacagcacaguacgaguac

SEQ ID NO: 43329 - RNA, 20 nt, Artificial Sequence
  MKO10043329_A_Psg17
  gRNA
ccgugcauagcccaugauga

SEQ ID NO: 43330 - RNA, 20 nt, Artificial Sequence
  MKO10043330_A_Psg18
  gRNA
auucaauagucggagauaua

SEQ ID NO: 43331 - RNA, 20 nt, Artificial Sequence
  MKO10043331_A_Psg18
  gRNA
gcuguacuacuauaguguaa

SEQ ID NO: 43332 - RNA, 20 nt, Artificial Sequence
  MKO10043332_A_Psg18
  gRNA
ccucccucagcagcgugccg

SEQ ID NO: 43333 - RNA, 20 nt, Artificial Sequence
  MKO10043333_A_Psg19
  gRNA
caaaggcgucuauagcacuc

SEQ ID NO: 43334 - RNA, 20 nt, Artificial Sequence
  MKO10043334_A_Psg19
  gRNA
guacggauucgauggugacu

SEQ ID NO: 43335 - RNA, 20 nt, Artificial Sequence
  MKO10043335_A_Psg19
  gRNA
cgccaagaauucaauugaaa

SEQ ID NO: 43336 - RNA, 20 nt, Artificial Sequence
  MKO10043336_A_Psg20
  gRNA
gccuggaucgcuuaaauucu

SEQ ID NO: 43337 - RNA, 20 nt, Artificial Sequence
  MKO10043337_A_Psg20
  gRNA
cggugaauggauagugaccu

SEQ ID NO: 43338 - RNA, 20 nt, Artificial Sequence
  MKO10043338_A_Psg20
  gRNA
acgaguugacaaucugccag

SEQ ID NO: 43339 - RNA, 20 nt, Artificial Sequence
  MKO10043339_A_Psg21
  gRNA
ucuccuucaacuacguguuu

SEQ ID NO: 43340 - RNA, 20 nt, Artificial Sequence
  MKO10043340_A_Psg21
  gRNA
ucaccaaaacacguaguuga

SEQ ID NO: 43341 - RNA, 20 nt, Artificial Sequence
  MKO10043341_A_Psg21
  gRNA
gcguccuccuucagcaacuc

SEQ ID NO: 43342 - RNA, 20 nt, Artificial Sequence
  MKO10043342_A_Psg22
  gRNA
auaaucuucaaucgcuucuc

SEQ ID NO: 43343 - RNA, 20 nt, Artificial Sequence
  MKO10043343_A_Psg22
  gRNA
agaagcgauugaagauuauc

SEQ ID NO: 43344 - RNA, 20 nt, Artificial Sequence
  MKO10043344_A_Psg22
  gRNA
uguucacauugacuugcaca

SEQ ID NO: 43345 - RNA, 20 nt, Artificial Sequence
  MKO10043345_A_Psg23
  gRNA
ucuccuucaacuacguguug

SEQ ID NO: 43346 - RNA, 20 nt, Artificial Sequence
  MKO10043346_A_Psg23
  gRNA
guuuccgagacucucaugac

SEQ ID NO: 43347 - RNA, 20 nt, Artificial Sequence
  MKO10043347_A_Psg23
  gRNA
ugggagacuggucuuagagu

SEQ ID NO: 43348 - RNA, 20 nt, Artificial Sequence
  MKO10043348_A_Psg25
  gRNA
cccccuucgacagcauaccg

SEQ ID NO: 43349 - RNA, 20 nt, Artificial Sequence
  MKO10043349_A_Psg25
  gRNA
ccauucuuuaccacuccaag

SEQ ID NO: 43350 - RNA, 20 nt, Artificial Sequence
  MKO10043350_A_Psg25
  gRNA
cuaccacugugagcaugacc

SEQ ID NO: 43351 - RNA, 20 nt, Artificial Sequence
  MKO10043351_A_Psg26
  gRNA
gugggaccuacaaguguagu

SEQ ID NO: 43352 - RNA, 20 nt, Artificial Sequence
  MKO10043352_A_Psg26
  gRNA
uucgcuguacuauaguguaa

SEQ ID NO: 43353 - RNA, 20 nt, Artificial Sequence
  MKO10043353_A_Psg26
  gRNA
gaaucugguccagcccacag

SEQ ID NO: 43354 - RNA, 20 nt, Artificial Sequence
  MKO10043354_A_Psg27
  gRNA
gacguugauuugcacgugca

SEQ ID NO: 43355 - RNA, 20 nt, Artificial Sequence
  MKO10043355_A_Psg27
  gRNA
ugcaauugcacuacauuuac

SEQ ID NO: 43356 - RNA, 20 nt, Artificial Sequence
  MKO10043356_A_Psg27
  gRNA
aggggugauuaugacuaaca

SEQ ID NO: 43357 - RNA, 20 nt, Artificial Sequence
  MKO10043357_A_Psg28
  gRNA
guacuauaguuuaacagcga

SEQ ID NO: 43358 - RNA, 20 nt, Artificial Sequence
  MKO10043358_A_Psg28
  gRNA
auucaauagugggaccuuca

SEQ ID NO: 43359 - RNA, 20 nt, Artificial Sequence
  MKO10043359_A_Psg28
  gRNA
caggucuauaaucugccaga

SEQ ID NO: 43360 - RNA, 20 nt, Artificial Sequence
  MKO10043360_A_Psg29
  gRNA
uccccuucagcaacauaucg

SEQ ID NO: 43361 - RNA, 20 nt, Artificial Sequence
  MKO10043361_A_Psg29
  gRNA
uguguggucgucaaccgaaa

SEQ ID NO: 43362 - RNA, 20 nt, Artificial Sequence
  MKO10043362_A_Psg29
  gRNA
ggaaugauucaauacggggc

SEQ ID NO: 43363 - RNA, 20 nt, Artificial Sequence
  MKO10043363_A_Psip1
  gRNA
uucaacaucagacgaugcau

SEQ ID NO: 43364 - RNA, 20 nt, Artificial Sequence
  MKO10043364_A_Psip1
  gRNA
uaaccacuccaaaagcugcc

SEQ ID NO: 43365 - RNA, 20 nt, Artificial Sequence
  MKO10043365_A_Psip1
  gRNA
aaaagagacuaacguuucaa

SEQ ID NO: 43366 - RNA, 20 nt, Artificial Sequence
  MKO10043366_A_Pskh1
  gRNA
gcaguucgcgcucccgaaca

SEQ ID NO: 43367 - RNA, 20 nt, Artificial Sequence
  MKO10043367_A_Pskh1
  gRNA
guacucaggugugccgcacg

SEQ ID NO: 43368 - RNA, 20 nt, Artificial Sequence
  MKO10043368_A_Pskh1
  gRNA
cuggccuaguguaucuaauc

SEQ ID NO: 43369 - RNA, 20 nt, Artificial Sequence
  MKO10043369_A_Psma1
  gRNA
aucaaaaacgcacgcagugc

SEQ ID NO: 43370 - RNA, 20 nt, Artificial Sequence
  MKO10043370_A_Psma1
  gRNA
cagugacaucauugucauac

SEQ ID NO: 43371 - RNA, 20 nt, Artificial Sequence
  MKO10043371_A_Psma1
  gRNA
cugcugaugccagacuguua

SEQ ID NO: 43372 - RNA, 20 nt, Artificial Sequence
  MKO10043372_A_Psma2
  gRNA
guggcaugggccccgauuac

SEQ ID NO: 43373 - RNA, 20 nt, Artificial Sequence
  MKO10043373_A_Psma2
  gRNA
uauagugguguucguccauu

SEQ ID NO: 43374 - RNA, 20 nt, Artificial Sequence
  MKO10043374_A_Psma2
  gRNA
guacaccaaaccgaugugcu

SEQ ID NO: 43375 - RNA, 20 nt, Artificial Sequence
  MKO10043375_A_Psma3
  gRNA
ucuuguuucaguacagcuau

SEQ ID NO: 43376 - RNA, 20 nt, Artificial Sequence
  MKO10043376_A_Psma3
  gRNA
auuucauaccugcagccaaa

SEQ ID NO: 43377 - RNA, 20 nt, Artificial Sequence
  MKO10043377_A_Psma3
  gRNA
ccaggcaguugcagguuugc

SEQ ID NO: 43378 - RNA, 20 nt, Artificial Sequence
  MKO10043378_A_Psma4
  gRNA
acguucugacuaacgagcua

SEQ ID NO: 43379 - RNA, 20 nt, Artificial Sequence
  MKO10043379_A_Psma4
  gRNA
cuuccauggcauacuccacu

SEQ ID NO: 43380 - RNA, 20 nt, Artificial Sequence
  MKO10043380_A_Psma4
  gRNA
uagguacuuauuacaguauc

SEQ ID NO: 43381 - RNA, 20 nt, Artificial Sequence
  MKO10043381_A_Psma5
  gRNA
cuauaccuugauagccucaa

SEQ ID NO: 43382 - RNA, 20 nt, Artificial Sequence
  MKO10043382_A_Psma5
  gRNA
agaugcagauccaggugcua

SEQ ID NO: 43383 - RNA, 20 nt, Artificial Sequence
  MKO10043383_A_Psma5
  gRNA
auugcagguugugccaugag

SEQ ID NO: 43384 - RNA, 20 nt, Artificial Sequence
  MKO10043384_A_Psma6
  gRNA
gcauacuuacaacaaccgag

SEQ ID NO: 43385 - RNA, 20 nt, Artificial Sequence
  MKO10043385_A_Psma6
  gRNA
uuguuuaacuccugccgccg

SEQ ID NO: 43386 - RNA, 20 nt, Artificial Sequence
  MKO10043386_A_Psma6
  gRNA
caacagauguaaguccaccc

SEQ ID NO: 43387 - RNA, 20 nt, Artificial Sequence
  MKO10043387_A_Psma7
  gRNA
aguacgaaaaaucugcgccu

SEQ ID NO: 43388 - RNA, 20 nt, Artificial Sequence
  MKO10043388_A_Psma7
  gRNA
cauacagacguuaucgucca

SEQ ID NO: 43389 - RNA, 20 nt, Artificial Sequence
  MKO10043389_A_Psma7
  gRNA
caagucagugcgugaauuuc

SEQ ID NO: 43390 - RNA, 20 nt, Artificial Sequence
  MKO10043390_A_Psma8
  gRNA
cuucauagcgacgcuaaagc

SEQ ID NO: 43391 - RNA, 20 nt, Artificial Sequence
  MKO10043391_A_Psma8
  gRNA
ccgaagugcuaaaacugucc

SEQ ID NO: 43392 - RNA, 20 nt, Artificial Sequence
  MKO10043392_A_Psma8
  gRNA
uguuacucacuuuccaagcg

SEQ ID NO: 43393 - RNA, 20 nt, Artificial Sequence
  MKO10043393_A_Psmb10
  gRNA
cacgcgggccacuaacgauu

SEQ ID NO: 43394 - RNA, 20 nt, Artificial Sequence
  MKO10043394_A_Psmb10
  gRNA
cgccacaaccgaaucguuag

SEQ ID NO: 43395 - RNA, 20 nt, Artificial Sequence
  MKO10043395_A_Psmb10
  gRNA
cgaccagugaugcccccacg

SEQ ID NO: 43396 - RNA, 20 nt, Artificial Sequence
  MKO10043396_A_Psmb11
  gRNA
auuauuaucgcgcagucuuc

SEQ ID NO: 43397 - RNA, 20 nt, Artificial Sequence
  MKO10043397_A_Psmb11
  gRNA
ucgucacggugucaucgcug

SEQ ID NO: 43398 - RNA, 20 nt, Artificial Sequence
  MKO10043398_A_Psmb11
  gRNA
cccauccgcucucccgaacg

SEQ ID NO: 43399 - RNA, 20 nt, Artificial Sequence
  MKO10043399_A_Psmb1
  gRNA
agcaaucgcccccguuguca

SEQ ID NO: 43400 - RNA, 20 nt, Artificial Sequence
  MKO10043400_A_Psmb1
  gRNA
auuaccugguugucgagcag

SEQ ID NO: 43401 - RNA, 20 nt, Artificial Sequence
  MKO10043401_A_Psmb1
  gRNA
gcagccucugcucgacaacc

SEQ ID NO: 43402 - RNA, 20 nt, Artificial Sequence
  MKO10043402_A_Psmb2
  gRNA
uuucagccaucucacgugag

SEQ ID NO: 43403 - RNA, 20 nt, Artificial Sequence
  MKO10043403_A_Psmb2
  gRNA
cuggcuaugacgagcaugaa

SEQ ID NO: 43404 - RNA, 20 nt, Artificial Sequence
  MKO10043404_A_Psmb2
  gRNA
cacugcccucucacgugaga

SEQ ID NO: 43405 - RNA, 20 nt, Artificial Sequence
  MKO10043405_A_Psmb3
  gRNA
uuacacugucuggacgucag

SEQ ID NO: 43406 - RNA, 20 nt, Artificial Sequence
  MKO10043406_A_Psmb3
  gRNA
ccacucaccgcuucucauac

SEQ ID NO: 43407 - RNA, 20 nt, Artificial Sequence
  MKO10043407_A_Psmb3
  gRNA
aucgcugcagacagacguuu

SEQ ID NO: 43408 - RNA, 20 nt, Artificial Sequence
  MKO10043408_A_Psmb4
  gRNA
uucucacccgguuauacgaa

SEQ ID NO: 43409 - RNA, 20 nt, Artificial Sequence
  MKO10043409_A_Psmb4
  gRNA
caccccgaguaccgaugucc

SEQ ID NO: 43410 - RNA, 20 nt, Artificial Sequence
  MKO10043410_A_Psmb4
  gRNA
gagaugcccguucguauaac

SEQ ID NO: 43411 - RNA, 20 nt, Artificial Sequence
  MKO10043411_A_Psmb5
  gRNA
agagaucaacccguaccuuc

SEQ ID NO: 43412 - RNA, 20 nt, Artificial Sequence
  MKO10043412_A_Psmb5
  gRNA
gucugagcaccuugaaggcc

SEQ ID NO: 43413 - RNA, 20 nt, Artificial Sequence
  MKO10043413_A_Psmb5
  gRNA
cuauuacuuucuucaccguc

SEQ ID NO: 43414 - RNA, 20 nt, Artificial Sequence
  MKO10043414_A_Psmb6
  gRNA
uccgggagcucguacaucua

SEQ ID NO: 43415 - RNA, 20 nt, Artificial Sequence
  MKO10043415_A_Psmb6
  gRNA
gccauagauguacgagcucc

SEQ ID NO: 43416 - RNA, 20 nt, Artificial Sequence
  MKO10043416_A_Psmb6
  gRNA
uucuucccagaccacgauca

SEQ ID NO: 43417 - RNA, 20 nt, Artificial Sequence
  MKO10043417_A_Psmb7
  gRNA
cuuauacaccacccccgcga

SEQ ID NO: 43418 - RNA, 20 nt, Artificial Sequence
  MKO10043418_A_Psmb7
  gRNA
aagcggauuucgcaaaaaag

SEQ ID NO: 43419 - RNA, 20 nt, Artificial Sequence
  MKO10043419_A_Psmb7
  gRNA
cacucacccauggugacaua

SEQ ID NO: 43420 - RNA, 20 nt, Artificial Sequence
  MKO10043420_A_Psmb8
  gRNA
ccaaggucguaggccucuuc

SEQ ID NO: 43421 - RNA, 20 nt, Artificial Sequence
  MKO10043421_A_Psmb8
  gRNA
cguacagguuguauuaucuu

SEQ ID NO: 43422 - RNA, 20 nt, Artificial Sequence
  MKO10043422_A_Psmb8
  gRNA
gugcagccgacugccaguac

SEQ ID NO: 43423 - RNA, 20 nt, Artificial Sequence
  MKO10043423_A_Psmb9
  gRNA
uccggaaccgccgaugguaa

SEQ ID NO: 43424 - RNA, 20 nt, Artificial Sequence
  MKO10043424_A_Psmb9
  gRNA
uuagcgcaucucauaguagc

SEQ ID NO: 43425 - RNA, 20 nt, Artificial Sequence
  MKO10043425_A_Psmb9
  gRNA
gaugcgcuaacaaguccuca

SEQ ID NO: 43426 - RNA, 20 nt, Artificial Sequence
  MKO10043426_A_Psmc1
  gRNA
gauccuugucuacaaacgac

SEQ ID NO: 43427 - RNA, 20 nt, Artificial Sequence
  MKO10043427_A_Psmc1
  gRNA
guuacccaguggcaguuugc

SEQ ID NO: 43428 - RNA, 20 nt, Artificial Sequence
  MKO10043428_A_Psmc1
  gRNA
ggcucaccuugugguugagc

SEQ ID NO: 43429 - RNA, 20 nt, Artificial Sequence
  MKO10043429_A_Psmc2
  gRNA
acugagauccaccacgaacu

SEQ ID NO: 43430 - RNA, 20 nt, Artificial Sequence
  MKO10043430_A_Psmc2
  gRNA
guuggcaccuccggcccucu

SEQ ID NO: 43431 - RNA, 20 nt, Artificial Sequence
  MKO10043431_A_Psmc2
  gRNA
gaagauaaucaacgcugauu

SEQ ID NO: 43432 - RNA, 20 nt, Artificial Sequence
  MKO10043432_A_Psmc3ip
  gRNA
aaaccggcccuacagcgccc

SEQ ID NO: 43433 - RNA, 20 nt, Artificial Sequence
  MKO10043433_A_Psmc3ip
  gRNA
cggccuggaugccaguaucg

SEQ ID NO: 43434 - RNA, 20 nt, Artificial Sequence
  MKO10043434_A_Psmc3ip
  gRNA
gggccacgauacuggcaucc

SEQ ID NO: 43435 - RNA, 20 nt, Artificial Sequence
  MKO10043435_A_Psmc3
  gRNA
gaucaaaacuucuacccgac

SEQ ID NO: 43436 - RNA, 20 nt, Artificial Sequence
  MKO10043436_A_Psmc3
  gRNA
ugucuaacagccgugugcgc

SEQ ID NO: 43437 - RNA, 20 nt, Artificial Sequence
  MKO10043437_A_Psmc3
  gRNA
gacacacaccucgaugacau

SEQ ID NO: 43438 - RNA, 20 nt, Artificial Sequence
  MKO10043438_A_Psmc4
  gRNA
acaccuuguagcggcuguac

SEQ ID NO: 43439 - RNA, 20 nt, Artificial Sequence
  MKO10043439_A_Psmc4
  gRNA
auaucggcauacaucacauc

SEQ ID NO: 43440 - RNA, 20 nt, Artificial Sequence
  MKO10043440_A_Psmc4
  gRNA
acacuucgagcuguacaagc

SEQ ID NO: 43441 - RNA, 20 nt, Artificial Sequence
  MKO10043441_A_Psmc5
  gRNA
acgaugugacgcccaauugu

SEQ ID NO: 43442 - RNA, 20 nt, Artificial Sequence
  MKO10043442_A_Psmc5
  gRNA
ucuuagagcgacccgacaau

SEQ ID NO: 43443 - RNA, 20 nt, Artificial Sequence
  MKO10043443_A_Psmc5
  gRNA
ccuacguuggagaagucgug

SEQ ID NO: 43444 - RNA, 20 nt, Artificial Sequence
  MKO10043444_A_Psmc6
  gRNA
cgacaaccuacaacguaucu

SEQ ID NO: 43445 - RNA, 20 nt, Artificial Sequence
  MKO10043445_A_Psmc6
  gRNA
cguuguagguugucgucguc

SEQ ID NO: 43446 - RNA, 20 nt, Artificial Sequence
  MKO10043446_A_Psmc6
  gRNA
ugaccacacuaaccaucaug

SEQ ID NO: 43447 - RNA, 20 nt, Artificial Sequence
  MKO10043447_A_Psmd10
  gRNA
uggggcuaacccagaugcga

SEQ ID NO: 43448 - RNA, 20 nt, Artificial Sequence
  MKO10043448_A_Psmd10
  gRNA
gcauugcuguagcaucguaa

SEQ ID NO: 43449 - RNA, 20 nt, Artificial Sequence
  MKO10043449_A_Psmd10
  gRNA
uacaaucucaucccggccag

SEQ ID NO: 43450 - RNA, 20 nt, Artificial Sequence
  MKO10043450_A_Psmd11
  gRNA
uaaagcuaaagcagcucguc

SEQ ID NO: 43451 - RNA, 20 nt, Artificial Sequence
  MKO10043451_A_Psmd11
  gRNA
agcugcuuuagcuuuacuga

SEQ ID NO: 43452 - RNA, 20 nt, Artificial Sequence
  MKO10043452_A_Psmd11
  gRNA
gcgaagacuggacaagcugc

SEQ ID NO: 43453 - RNA, 20 nt, Artificial Sequence
  MKO10043453_A_Psmd12
  gRNA
auguugaaauugagcgugcu

SEQ ID NO: 43454 - RNA, 20 nt, Artificial Sequence
  MKO10043454_A_Psmd12
  gRNA
ucagcagugcuguacuuacg

SEQ ID NO: 43455 - RNA, 20 nt, Artificial Sequence
  MKO10043455_A_Psmd12
  gRNA
ugcgauugauugauacucug

SEQ ID NO: 43456 - RNA, 20 nt, Artificial Sequence
  MKO10043456_A_Psmd13
  gRNA
ccuuaaugagaccaucuccu

SEQ ID NO: 43457 - RNA, 20 nt, Artificial Sequence
  MKO10043457_A_Psmd13
  gRNA
cggucaucugucuaaccaca

SEQ ID NO: 43458 - RNA, 20 nt, Artificial Sequence
  MKO10043458_A_Psmd13
  gRNA
caggguaaacccucuguccc

SEQ ID NO: 43459 - RNA, 20 nt, Artificial Sequence
  MKO10043459_A_Psmd14
  gRNA
uucaggcccgagaugguugu

SEQ ID NO: 43460 - RNA, 20 nt, Artificial Sequence
  MKO10043460_A_Psmd14
  gRNA
ugccacagcucucuccgaca

SEQ ID NO: 43461 - RNA, 20 nt, Artificial Sequence
  MKO10043461_A_Psmd14
  gRNA
accuacagaugcuccugccg

SEQ ID NO: 43462 - RNA, 20 nt, Artificial Sequence
  MKO10043462_A_Psmd1
  gRNA
ugugaucaucgagacaucgc

SEQ ID NO: 43463 - RNA, 20 nt, Artificial Sequence
  MKO10043463_A_Psmd1
  gRNA
ucacgaugccuuccaaucgc

SEQ ID NO: 43464 - RNA, 20 nt, Artificial Sequence
  MKO10043464_A_Psmd1
  gRNA
aguuaucauugacguugaag

SEQ ID NO: 43465 - RNA, 20 nt, Artificial Sequence
  MKO10043465_A_Psmd2
  gRNA
agaugcucguggagcgacuc

SEQ ID NO: 43466 - RNA, 20 nt, Artificial Sequence
  MKO10043466_A_Psmd2
  gRNA
ugccuuaccugacguauuca

SEQ ID NO: 43467 - RNA, 20 nt, Artificial Sequence
  MKO10043467_A_Psmd2
  gRNA
ugaauuaccuuauucucccc

SEQ ID NO: 43468 - RNA, 20 nt, Artificial Sequence
  MKO10043468_A_Psmd3
  gRNA
agcgcccucagcacgaaccg

SEQ ID NO: 43469 - RNA, 20 nt, Artificial Sequence
  MKO10043469_A_Psmd3
  gRNA
guccgucagcaucgugccgc

SEQ ID NO: 43470 - RNA, 20 nt, Artificial Sequence
  MKO10043470_A_Psmd3
  gRNA
gaagucucgaguggcguuau

SEQ ID NO: 43471 - RNA, 20 nt, Artificial Sequence
  MKO10043471_A_Psmd4
  gRNA
cuucugcacuggcauccgcg

SEQ ID NO: 43472 - RNA, 20 nt, Artificial Sequence
  MKO10043472_A_Psmd4
  gRNA
cguacuuggccagugugauc

SEQ ID NO: 43473 - RNA, 20 nt, Artificial Sequence
  MKO10043473_A_Psmd4
  gRNA
augcgcaucaucgccuuugu

SEQ ID NO: 43474 - RNA, 20 nt, Artificial Sequence
  MKO10043474_A_Psmd5
  gRNA
caaacgacguuguucgauac

SEQ ID NO: 43475 - RNA, 20 nt, Artificial Sequence
  MKO10043475_A_Psmd5
  gRNA
aaaaacccucacucugucgc

SEQ ID NO: 43476 - RNA, 20 nt, Artificial Sequence
  MKO10043476_A_Psmd5
  gRNA
ggguuagugauauucucgac

SEQ ID NO: 43477 - RNA, 20 nt, Artificial Sequence
  MKO10043477_A_Psmd6
  gRNA
aacagauacugccgaacugc

SEQ ID NO: 43478 - RNA, 20 nt, Artificial Sequence
  MKO10043478_A_Psmd6
  gRNA
ccacguccaucugccagucg

SEQ ID NO: 43479 - RNA, 20 nt, Artificial Sequence
  MKO10043479_A_Psmd6
  gRNA
guaccagggcuuauauugug

SEQ ID NO: 43480 - RNA, 20 nt, Artificial Sequence
  MKO10043480_A_Psmd7
  gRNA
gcacaccaacuacccgcuuc

SEQ ID NO: 43481 - RNA, 20 nt, Artificial Sequence
  MKO10043481_A_Psmd7
  gRNA
gcggguaguuggugugcuuu

SEQ ID NO: 43482 - RNA, 20 nt, Artificial Sequence
  MKO10043482_A_Psmd7
  gRNA
cauuaucgacgugaagccaa

SEQ ID NO: 43483 - RNA, 20 nt, Artificial Sequence
  MKO10043483_A_Psmd8
  gRNA
ucccuccuucgagcgcuaca

SEQ ID NO: 43484 - RNA, 20 nt, Artificial Sequence
  MKO10043484_A_Psmd8
  gRNA
gccauguagcgcucgaagga

SEQ ID NO: 43485 - RNA, 20 nt, Artificial Sequence
  MKO10043485_A_Psmd8
  gRNA
cuuacuugcucgagggaaac

SEQ ID NO: 43486 - RNA, 20 nt, Artificial Sequence
  MKO10043486_A_Psmd9
  gRNA
ucagacugauuccaacccgc

SEQ ID NO: 43487 - RNA, 20 nt, Artificial Sequence
  MKO10043487_A_Psmd9
  gRNA
aagauuaccgcaauacuggc

SEQ ID NO: 43488 - RNA, 20 nt, Artificial Sequence
  MKO10043488_A_Psmd9
  gRNA
cuuugucccgagcgugcagc

SEQ ID NO: 43489 - RNA, 20 nt, Artificial Sequence
  MKO10043489_A_Psme1
  gRNA
uaggucuuaccuugcuacac

SEQ ID NO: 43490 - RNA, 20 nt, Artificial Sequence
  MKO10043490_A_Psme1
  gRNA
aaaggggacgaagacgacaa

SEQ ID NO: 43491 - RNA, 20 nt, Artificial Sequence
  MKO10043491_A_Psme1
  gRNA
ccgugaagaccuguguagca

SEQ ID NO: 43492 - RNA, 20 nt, Artificial Sequence
  MKO10043492_A_Psme2b
  gRNA
cccucguucugagaaguacu

SEQ ID NO: 43493 - RNA, 20 nt, Artificial Sequence
  MKO10043493_A_Psme2b
  gRNA
auacccauguaauggauuac

SEQ ID NO: 43494 - RNA, 20 nt, Artificial Sequence
  MKO10043494_A_Psme2b
  gRNA
uguuuccaucucgucauccu

SEQ ID NO: 43495 - RNA, 20 nt, Artificial Sequence
  MKO10043495_A_Psme2
  gRNA
augccuuaccucgucauccu

SEQ ID NO: 43496 - RNA, 20 nt, Artificial Sequence
  MKO10043496_A_Psme2
  gRNA
ucaccugcaagagcugacuc

SEQ ID NO: 43497 - RNA, 20 nt, Artificial Sequence
  MKO10043497_A_Psme2
  gRNA
acaggaggauucccucaaug

SEQ ID NO: 43498 - RNA, 20 nt, Artificial Sequence
  MKO10043498_A_Psme3
  gRNA
caaccugcgcuucuuguaag

SEQ ID NO: 43499 - RNA, 20 nt, Artificial Sequence
  MKO10043499_A_Psme3
  gRNA
agcccacuuacaagaagcgc

SEQ ID NO: 43500 - RNA, 20 nt, Artificial Sequence
  MKO10043500_A_Psme3
  gRNA
ucacaccauccaguccaucg

SEQ ID NO: 43501 - RNA, 20 nt, Artificial Sequence
  MKO10043501_A_Psme4
  gRNA
ugcaguuauauccgacuuua

SEQ ID NO: 43502 - RNA, 20 nt, Artificial Sequence
  MKO10043502_A_Psme4
  gRNA
ccuccagaacugcaucauaa

SEQ ID NO: 43503 - RNA, 20 nt, Artificial Sequence
  MKO10043503_A_Psme4
  gRNA
cuuucuaccaagucauaaag

SEQ ID NO: 43504 - RNA, 20 nt, Artificial Sequence
  MKO10043504_A_Psmf1
  gRNA
cucgugcaaacaguccuccg

SEQ ID NO: 43505 - RNA, 20 nt, Artificial Sequence
  MKO10043505_A_Psmf1
  gRNA
cacaccguccucauacuagc

SEQ ID NO: 43506 - RNA, 20 nt, Artificial Sequence
  MKO10043506_A_Psmf1
  gRNA
cggcaugaucaucaacgugc

SEQ ID NO: 43507 - RNA, 20 nt, Artificial Sequence
  MKO10043507_A_Psmg1
  gRNA
auguucggcuguuccagcag

SEQ ID NO: 43508 - RNA, 20 nt, Artificial Sequence
  MKO10043508_A_Psmg1
  gRNA
gucagcguuuguuaugaacu

SEQ ID NO: 43509 - RNA, 20 nt, Artificial Sequence
  MKO10043509_A_Psmg1
  gRNA
aguucauaacaaacgcugac

SEQ ID NO: 43510 - RNA, 20 nt, Artificial Sequence
  MKO10043510_A_Psmg2
  gRNA
caucguugcggugauacgaa

SEQ ID NO: 43511 - RNA, 20 nt, Artificial Sequence
  MKO10043511_A_Psmg2
  gRNA
ccaggacuuaccugcgcagc

SEQ ID NO: 43512 - RNA, 20 nt, Artificial Sequence
  MKO10043512_A_Psmg2
  gRNA
cuuaccgucaaagaagcuag

SEQ ID NO: 43513 - RNA, 20 nt, Artificial Sequence
  MKO10043513_A_Psmg3
  gRNA
gcguacccaucuucccgaac

SEQ ID NO: 43514 - RNA, 20 nt, Artificial Sequence
  MKO10043514_A_Psmg3
  gRNA
aggacucucguggugagcac

SEQ ID NO: 43515 - RNA, 20 nt, Artificial Sequence
  MKO10043515_A_Psmg3
  gRNA
gcauuugugucgcaagaagc

SEQ ID NO: 43516 - RNA, 20 nt, Artificial Sequence
  MKO10043516_A_Psmg4
  gRNA
cgacacguccgcguccgcag

SEQ ID NO: 43517 - RNA, 20 nt, Artificial Sequence
  MKO10043517_A_Psmg4
  gRNA
gcaucuacgcaaccucgcag

SEQ ID NO: 43518 - RNA, 20 nt, Artificial Sequence
  MKO10043518_A_Psmg4
  gRNA
acauaccuaagcgcugagca

SEQ ID NO: 43519 - RNA, 20 nt, Artificial Sequence
  MKO10043519_A_Psors1c2
  gRNA
uuugaugaaccuccgccucc

SEQ ID NO: 43520 - RNA, 20 nt, Artificial Sequence
  MKO10043520_A_Psors1c2
  gRNA
uuuagggggaucagugcuug

SEQ ID NO: 43521 - RNA, 20 nt, Artificial Sequence
  MKO10043521_A_Psors1c2
  gRNA
acgacucaccuccugcacac

SEQ ID NO: 43522 - RNA, 20 nt, Artificial Sequence
  MKO10043522_A_Pspc1
  gRNA
cgaauucgcuuugcuacaca

SEQ ID NO: 43523 - RNA, 20 nt, Artificial Sequence
  MKO10043523_A_Pspc1
  gRNA
agcgaaaccuccugcacgaa

SEQ ID NO: 43524 - RNA, 20 nt, Artificial Sequence
  MKO10043524_A_Pspc1
  gRNA
aauuugaauaugcgucucga

SEQ ID NO: 43525 - RNA, 20 nt, Artificial Sequence
  MKO10043525_A_Psph
  gRNA
agacgcgcucacucagcgcc

SEQ ID NO: 43526 - RNA, 20 nt, Artificial Sequence
  MKO10043526_A_Psph
  gRNA
ugagugagcgcgucuuuaaa

SEQ ID NO: 43527 - RNA, 20 nt, Artificial Sequence
  MKO10043527_A_Psph
  gRNA
aucucuucaggugaguacgc

SEQ ID NO: 43528 - RNA, 20 nt, Artificial Sequence
  MKO10043528_A_Pspn
  gRNA
cucgaccccgcccucgaagc

SEQ ID NO: 43529 - RNA, 20 nt, Artificial Sequence
  MKO10043529_A_Pspn
  gRNA
uacuggcccggcuucgaggg

SEQ ID NO: 43530 - RNA, 20 nt, Artificial Sequence
  MKO10043530_A_Pspn
  gRNA
cuuacccugauggggcgucc

SEQ ID NO: 43531 - RNA, 20 nt, Artificial Sequence
  MKO10043531_A_Psrc1
  gRNA
aggacgaaggucucccgccg

SEQ ID NO: 43532 - RNA, 20 nt, Artificial Sequence
  MKO10043532_A_Psrc1
  gRNA
ugggcgaggccccgucgaag

SEQ ID NO: 43533 - RNA, 20 nt, Artificial Sequence
  MKO10043533_A_Psrc1
  gRNA
gccacccgagugccacucau

SEQ ID NO: 43534 - RNA, 20 nt, Artificial Sequence
  MKO10043534_A_Pstk
  gRNA
ccccacuaaugaccgccacg

SEQ ID NO: 43535 - RNA, 20 nt, Artificial Sequence
  MKO10043535_A_Pstk
  gRNA
uuccucguggcggucauuag

SEQ ID NO: 43536 - RNA, 20 nt, Artificial Sequence
  MKO10043536_A_Pstk
  gRNA
ugacgagaccauccagcuca

SEQ ID NO: 43537 - RNA, 20 nt, Artificial Sequence
  MKO10043537_A_Pstpip1
  gRNA
uuggaacuuacgcugcuuca

SEQ ID NO: 43538 - RNA, 20 nt, Artificial Sequence
  MKO10043538_A_Pstpip1
  gRNA
guagcaccucauacccugug

SEQ ID NO: 43539 - RNA, 20 nt, Artificial Sequence
  MKO10043539_A_Pstpip1
  gRNA
uccuuacagggcccaggcgg

SEQ ID NO: 43540 - RNA, 20 nt, Artificial Sequence
  MKO10043540_A_Pstpip2
  gRNA
gauaaugcugucguagccaa

SEQ ID NO: 43541 - RNA, 20 nt, Artificial Sequence
  MKO10043541_A_Pstpip2
  gRNA
uacgcugcuugaagaccuca

SEQ ID NO: 43542 - RNA, 20 nt, Artificial Sequence
  MKO10043542_A_Pstpip2
  gRNA
auuauccagcaccugaacaa

SEQ ID NO: 43543 - RNA, 20 nt, Artificial Sequence
  MKO10043543_A_Puafr
  gRNA
gacccauagcacauagccgu

SEQ ID NO: 43544 - RNA, 20 nt, Artificial Sequence
  MKO10043544_A_Puafr
  gRNA
cacgagugacacgugcaccg

SEQ ID NO: 43545 - RNA, 20 nt, Artificial Sequence
  MKO10043545_A_Puafr
  gRNA
caucacuuauaaccgcuacc

SEQ ID NO: 43546 - RNA, 20 nt, Artificial Sequence
  MKO10043546_A_Puar1
  gRNA
cuccgguuauaucuugcuuc

SEQ ID NO: 43547 - RNA, 20 nt, Artificial Sequence
  MKO10043547_A_Puar1
  gRNA
gcuuucucguucuguacaaa

SEQ ID NO: 43548 - RNA, 20 nt, Artificial Sequence
  MKO10043548_A_Puar1
  gRNA
gaccaggcauuguaguugcu

SEQ ID NO: 43549 - RNA, 20 nt, Artificial Sequence
  MKO10043549_A_Ptbp1
  gRNA
agcagacauacugccugguu

SEQ ID NO: 43550 - RNA, 20 nt, Artificial Sequence
  MKO10043550_A_Ptbp1
  gRNA
uaccaaccuucucaugcuga

SEQ ID NO: 43551 - RNA, 20 nt, Artificial Sequence
  MKO10043551_A_Ptbp1
  gRNA
augagcagcucugccucagc

SEQ ID NO: 43552 - RNA, 20 nt, Artificial Sequence
  MKO10043552_A_Ptbp2
  gRNA
ucgaaugugaaguacacgag

SEQ ID NO: 43553 - RNA, 20 nt, Artificial Sequence
  MKO10043553_A_Ptbp2
  gRNA
ggaucugacgagcuacucuc

SEQ ID NO: 43554 - RNA, 20 nt, Artificial Sequence
  MKO10043554_A_Ptbp2
  gRNA
uuucuuacuaucguuaccgu

SEQ ID NO: 43555 - RNA, 20 nt, Artificial Sequence
  MKO10043555_A_Ptbp3
  gRNA
gacugacaaucugccuaauc

SEQ ID NO: 43556 - RNA, 20 nt, Artificial Sequence
  MKO10043556_A_Ptbp3
  gRNA
augaacagcucgacuucugc

SEQ ID NO: 43557 - RNA, 20 nt, Artificial Sequence
  MKO10043557_A_Ptbp3
  gRNA
auaucauuaggucuaccauu

SEQ ID NO: 43558 - RNA, 20 nt, Artificial Sequence
  MKO10043558_A_Pucd1
  gRNA
accguguaguugcacuccag

SEQ ID NO: 43559 - RNA, 20 nt, Artificial Sequence
  MKO10043559_A_Pucd1
  gRNA
aucaacgccagccuaucagc

SEQ ID NO: 43560 - RNA, 20 nt, Artificial Sequence
  MKO10043560_A_Pucd1
  gRNA
aaccuucucagaaacucgag

SEQ ID NO: 43561 - RNA, 20 nt, Artificial Sequence
  MKO10043561_A_Pucd2
  gRNA
gcuauugcauauaaccuacc

SEQ ID NO: 43562 - RNA, 20 nt, Artificial Sequence
  MKO10043562_A_Pucd2
  gRNA
uggcgaaagccgucauuuau

SEQ ID NO: 43563 - RNA, 20 nt, Artificial Sequence
  MKO10043563_A_Pucd2
  gRNA
cuuacguucauauuugccuu

SEQ ID NO: 43564 - RNA, 20 nt, Artificial Sequence
  MKO10043564_A_Pucd3
  gRNA
ggaucaucgugaaauacaua

SEQ ID NO: 43565 - RNA, 20 nt, Artificial Sequence
  MKO10043565_A_Pucd3
  gRNA
ggauaaaguggcuguucuuc

SEQ ID NO: 43566 - RNA, 20 nt, Artificial Sequence
  MKO10043566_A_Pucd3
  gRNA
auaucugauccuucaaccuu

SEQ ID NO: 43567 - RNA, 20 nt, Artificial Sequence
  MKO10043567_A_Puch1
  gRNA
agcuaaucucgagaccaacg

SEQ ID NO: 43568 - RNA, 20 nt, Artificial Sequence
  MKO10043568_A_Puch1
  gRNA
cauguagacgugcacacgac

SEQ ID NO: 43569 - RNA, 20 nt, Artificial Sequence
  MKO10043569_A_Puch1
  gRNA
aauuauacccgucagaagau

SEQ ID NO: 43570 - RNA, 20 nt, Artificial Sequence
  MKO10043570_A_Puch2
  gRNA
guugauucagacugcgcacc

SEQ ID NO: 43571 - RNA, 20 nt, Artificial Sequence
  MKO10043571_A_Puch2
  gRNA
gcgcagucugaaucaacauc

SEQ ID NO: 43572 - RNA, 20 nt, Artificial Sequence
  MKO10043572_A_Puch2
  gRNA
ucaccccgcuugacugcuuc

SEQ ID NO: 43573 - RNA, 20 nt, Artificial Sequence
  MKO10043573_A_Puchd1
  gRNA
cagauucgcugaucaacguc

SEQ ID NO: 43574 - RNA, 20 nt, Artificial Sequence
  MKO10043574_A_Puchd1
  gRNA
agucacaguaauagcguuug

SEQ ID NO: 43575 - RNA, 20 nt, Artificial Sequence
  MKO10043575_A_Puchd1
  gRNA
cgccagcuucagccgcuacc

SEQ ID NO: 43576 - RNA, 20 nt, Artificial Sequence
  MKO10043576_A_Puchd2
  gRNA
gaccaccgccgccgcuuaug

SEQ ID NO: 43577 - RNA, 20 nt, Artificial Sequence
  MKO10043577_A_Puchd2
  gRNA
ggcguaccucauagucgaag

SEQ ID NO: 43578 - RNA, 20 nt, Artificial Sequence
  MKO10043578_A_Puchd2
  gRNA
gacagaccucuucgacuaug

SEQ ID NO: 43579 - RNA, 20 nt, Artificial Sequence
  MKO10043579_A_Puchd3
  gRNA
cguuggaagccccgcgacag

SEQ ID NO: 43580 - RNA, 20 nt, Artificial Sequence
  MKO10043580_A_Puchd3
  gRNA
uggaaaaagucaacgacucg

SEQ ID NO: 43581 - RNA, 20 nt, Artificial Sequence
  MKO10043581_A_Puchd3
  gRNA
uugcaguuguaucaugcucc

SEQ ID NO: 43582 - RNA, 20 nt, Artificial Sequence
  MKO10043582_A_Puchd4
  gRNA
uguguaaguccgaauagagc

SEQ ID NO: 43583 - RNA, 20 nt, Artificial Sequence
  MKO10043583_A_Puchd4
  gRNA
gugcagaagcgugcaacccc

SEQ ID NO: 43584 - RNA, 20 nt, Artificial Sequence
  MKO10043584_A_Puchd4
  gRNA
auucuacgucuaugaacccc

SEQ ID NO: 43585 - RNA, 20 nt, Artificial Sequence
  MKO10043585_A_Pucra
  gRNA
gacuuacccccgagaggcuc

SEQ ID NO: 43586 - RNA, 20 nt, Artificial Sequence
  MKO10043586_A_Pucra
  gRNA
ggccagggggugccgcaucg

SEQ ID NO: 43587 - RNA, 20 nt, Artificial Sequence
  MKO10043587_A_Pucra
  gRNA
gggucaugcuucuccacgag

SEQ ID NO: 43588 - RNA, 20 nt, Artificial Sequence
  MKO10043588_A_Ptdss1
  gRNA
ucguguagcauaucgaagau

SEQ ID NO: 43589 - RNA, 20 nt, Artificial Sequence
  MKO10043589_A_Ptdss1
  gRNA
ucgauaugcuacacgagaag

SEQ ID NO: 43590 - RNA, 20 nt, Artificial Sequence
  MKO10043590_A_Ptdss1
  gRNA
accaaaaaccauucgccaua

SEQ ID NO: 43591 - RNA, 20 nt, Artificial Sequence
  MKO10043591_A_Ptdss2
  gRNA
uuguagcuuacuggcgguuu

SEQ ID NO: 43592 - RNA, 20 nt, Artificial Sequence
  MKO10043592_A_Ptdss2
  gRNA
agucacguagcccagcgcac

SEQ ID NO: 43593 - RNA, 20 nt, Artificial Sequence
  MKO10043593_A_Ptdss2
  gRNA
uugcccccguagucccucuc

SEQ ID NO: 43594 - RNA, 20 nt, Artificial Sequence
  MKO10043594_A_Pten
  gRNA
accgccaaauuuaacugcag

SEQ ID NO: 43595 - RNA, 20 nt, Artificial Sequence
  MKO10043595_A_Pten
  gRNA
gcagcaauucacuguaaagc

SEQ ID NO: 43596 - RNA, 20 nt, Artificial Sequence
  MKO10043596_A_Pten
  gRNA
ugucaucuucacuuagccau

SEQ ID NO: 43597 - RNA, 20 nt, Artificial Sequence
  MKO10043597_A_Pter
  gRNA
gacccgcuuaccugucaagg

SEQ ID NO: 43598 - RNA, 20 nt, Artificial Sequence
  MKO10043598_A_Pter
  gRNA
aguugucguauucuccacca

SEQ ID NO: 43599 - RNA, 20 nt, Artificial Sequence
  MKO10043599_A_Pter
  gRNA
auccguauacugcaagaagc

SEQ ID NO: 43600 - RNA, 20 nt, Artificial Sequence
  MKO10043600_A_Ptf1a
  gRNA
gugcgaacgcagccccucga

SEQ ID NO: 43601 - RNA, 20 nt, Artificial Sequence
  MKO10043601_A_Ptf1a
  gRNA
cacgaauacugcuaccgcga

SEQ ID NO: 43602 - RNA, 20 nt, Artificial Sequence
  MKO10043602_A_Ptf1a
  gRNA
gagaccauaauccgggucac

SEQ ID NO: 43603 - RNA, 20 nt, Artificial Sequence
  MKO10043603_A_Pugdr
  gRNA
aaggggcuccucggcgacga

SEQ ID NO: 43604 - RNA, 20 nt, Artificial Sequence
  MKO10043604_A_Pugdr
  gRNA
cacagcgcccaucgucgccg

SEQ ID NO: 43605 - RNA, 20 nt, Artificial Sequence
  MKO10043605_A_Pugdr
  gRNA
ccauucccagcaaaguaacg

SEQ ID NO: 43606 - RNA, 20 nt, Artificial Sequence
  MKO10043606_A_Pugds
  gRNA
cagagcguacucgucauagu

SEQ ID NO: 43607 - RNA, 20 nt, Artificial Sequence
  MKO10043607_A_Pugds
  gRNA
ggucgcaguuccuggggcgc

SEQ ID NO: 43608 - RNA, 20 nt, Artificial Sequence
  MKO10043608_A_Pugds
  gRNA
uacgcucugcuauucagcag

SEQ ID NO: 43609 - RNA, 20 nt, Artificial Sequence
  MKO10043609_A_Puger1
  gRNA
ucccgaugaucgccggcgcu

SEQ ID NO: 43610 - RNA, 20 nt, Artificial Sequence
  MKO10043610_A_Puger1
  gRNA
ccgagcggcgccgccgcauu

SEQ ID NO: 43611 - RNA, 20 nt, Artificial Sequence
  MKO10043611_A_Puger1
  gRNA
uggcuguacgccucgcaucg

SEQ ID NO: 43612 - RNA, 20 nt, Artificial Sequence
  MKO10043612_A_Puger2
  gRNA
aggcgccacuuaucgcgccg

SEQ ID NO: 43613 - RNA, 20 nt, Artificial Sequence
  MKO10043613_A_Puger2
  gRNA
acgcgugacuuucgggagcc

SEQ ID NO: 43614 - RNA, 20 nt, Artificial Sequence
  MKO10043614_A_Puger2
  gRNA
gagcgcauuaaccucaggac

SEQ ID NO: 43615 - RNA, 20 nt, Artificial Sequence
  MKO10043615_A_Puger3
  gRNA
gcccagcaguaccgcgcgcg

SEQ ID NO: 43616 - RNA, 20 nt, Artificial Sequence
  MKO10043616_A_Puger3
  gRNA
gaagacucgcgccacgcgcg

SEQ ID NO: 43617 - RNA, 20 nt, Artificial Sequence
  MKO10043617_A_Puger3
  gRNA
cuuucuaauugcaguucgcc

SEQ ID NO: 43618 - RNA, 20 nt, Artificial Sequence
  MKO10043618_A_Puger4
  gRNA
ugcggcggcgaaagucgcug

SEQ ID NO: 43619 - RNA, 20 nt, Artificial Sequence
  MKO10043619_A_Puger4
  gRNA
ccagccgcuuguccacguag

SEQ ID NO: 43620 - RNA, 20 nt, Artificial Sequence
  MKO10043620_A_Puger4
  gRNA
cucugccggaaccgccaaug

SEQ ID NO: 43621 - RNA, 20 nt, Artificial Sequence
  MKO10043621_A_Puges2
  gRNA
cguguaccgaacacccgcug

SEQ ID NO: 43622 - RNA, 20 nt, Artificial Sequence
  MKO10043622_A_Puges2
  gRNA
cuucgacuacauuguccgug

SEQ ID NO: 43623 - RNA, 20 nt, Artificial Sequence
  MKO10043623_A_Puges2
  gRNA
cacuuauuacccacccauga

SEQ ID NO: 43624 - RNA, 20 nt, Artificial Sequence
  MKO10043624_A_Puges3l
  gRNA
acuacuaccugaacacgacg

SEQ ID NO: 43625 - RNA, 20 nt, Artificial Sequence
  MKO10043625_A_Puges3l
  gRNA
agcgaccagaacgcuuaucc

SEQ ID NO: 43626 - RNA, 20 nt, Artificial Sequence
  MKO10043626_A_Puges3l
  gRNA
cgacgucagugugcucauug

SEQ ID NO: 43627 - RNA, 20 nt, Artificial Sequence
  MKO10043627_A_Puges3
  gRNA
cuagcuuaauuggcucagug

SEQ ID NO: 43628 - RNA, 20 nt, Artificial Sequence
  MKO10043628_A_Puges3
  gRNA
aaauuaccugaaaguaaguu

SEQ ID NO: 43629 - RNA, 20 nt, Artificial Sequence
  MKO10043629_A_Puges3
  gRNA
aaaaauccaaacuuacuuuc

SEQ ID NO: 43630 - RNA, 20 nt, Artificial Sequence
  MKO10043630_A_Puges
  gRNA
ggacauaggccccggagcga

SEQ ID NO: 43631 - RNA, 20 nt, Artificial Sequence
  MKO10043631_A_Puges
  gRNA
cugaacccacgccuucgcuc

SEQ ID NO: 43632 - RNA, 20 nt, Artificial Sequence
  MKO10043632_A_Puges
  gRNA
gcuagccgagaugccuuccc

SEQ ID NO: 43633 - RNA, 20 nt, Artificial Sequence
  MKO10043633_A_Pugfrn
  gRNA
cgcgauacaucgcagcucaa

SEQ ID NO: 43634 - RNA, 20 nt, Artificial Sequence
  MKO10043634_A_Pugfrn
  gRNA
gcggcuugaccgugauuccc

SEQ ID NO: 43635 - RNA, 20 nt, Artificial Sequence
  MKO10043635_A_Pugfrn
  gRNA
gacccgucgcaaugacgacg

SEQ ID NO: 43636 - RNA, 20 nt, Artificial Sequence
  MKO10043636_A_Pugfr
  gRNA
gacuccuauacaccucucga

SEQ ID NO: 43637 - RNA, 20 nt, Artificial Sequence
  MKO10043637_A_Pugfr
  gRNA
cagcuaugccuccguugaua

SEQ ID NO: 43638 - RNA, 20 nt, Artificial Sequence
  MKO10043638_A_Pugfr
  gRNA
ccguagcagaauauagaccc

SEQ ID NO: 43639 - RNA, 20 nt, Artificial Sequence
  MKO10043639_A_Pugir
  gRNA
agccacgaacaucagcgugc

SEQ ID NO: 43640 - RNA, 20 nt, Artificial Sequence
  MKO10043640_A_Pugir
  gRNA
cgcaugcguuccgcccagcc

SEQ ID NO: 43641 - RNA, 20 nt, Artificial Sequence
  MKO10043641_A_Pugir
  gRNA
ucagauccgaggcuucacuc

SEQ ID NO: 43642 - RNA, 20 nt, Artificial Sequence
  MKO10043642_A_Pugis
  gRNA
gccggcuaccugacccuaua

SEQ ID NO: 43643 - RNA, 20 nt, Artificial Sequence
  MKO10043643_A_Pugis
  gRNA
uauggaaaacauccgcugag

SEQ ID NO: 43644 - RNA, 20 nt, Artificial Sequence
  MKO10043644_A_Pugis
  gRNA
cacccagcaggaccgugcga

SEQ ID NO: 43645 - RNA, 20 nt, Artificial Sequence
  MKO10043645_A_Pugr1
  gRNA
acgauuguagcggcuuuauu

SEQ ID NO: 43646 - RNA, 20 nt, Artificial Sequence
  MKO10043646_A_Pugr1
  gRNA
gccgcuacaaucguuccuuu

SEQ ID NO: 43647 - RNA, 20 nt, Artificial Sequence
  MKO10043647_A_Pugr1
  gRNA
gcuugacaucuguggcguga

SEQ ID NO: 43648 - RNA, 20 nt, Artificial Sequence
  MKO10043648_A_Pugr2
  gRNA
cagcaacgcggugauaaguc

SEQ ID NO: 43649 - RNA, 20 nt, Artificial Sequence
  MKO10043649_A_Pugr2
  gRNA
aaguagacauccacuccgcc

SEQ ID NO: 43650 - RNA, 20 nt, Artificial Sequence
  MKO10043650_A_Pugr2
  gRNA
guagacccacaacuuguaga

SEQ ID NO: 43651 - RNA, 20 nt, Artificial Sequence
  MKO10043651_A_Pugs1
  gRNA
ccgagaaguacucaugcgcc

SEQ ID NO: 43652 - RNA, 20 nt, Artificial Sequence
  MKO10043652_A_Pugs1
  gRNA
gcgaguauaguagcucacau

SEQ ID NO: 43653 - RNA, 20 nt, Artificial Sequence
  MKO10043653_A_Pugs1
  gRNA
uugcucacggaugguacagu

SEQ ID NO: 43654 - RNA, 20 nt, Artificial Sequence
  MKO10043654_A_Pugs2
  gRNA
uucaagacagaucauaagcg

SEQ ID NO: 43655 - RNA, 20 nt, Artificial Sequence
  MKO10043655_A_Pugs2
  gRNA
ccauagugcacauuguaagu

SEQ ID NO: 43656 - RNA, 20 nt, Artificial Sequence
  MKO10043656_A_Pugs2
  gRNA
accuggguucacccgaggac

SEQ ID NO: 43657 - RNA, 20 nt, Artificial Sequence
  MKO10043657_A_Pth1r
  gRNA
uacagacgcugcgaccgcaa

SEQ ID NO: 43658 - RNA, 20 nt, Artificial Sequence
  MKO10043658_A_Pth1r
  gRNA
cuugaggcacucgcuguagu

SEQ ID NO: 43659 - RNA, 20 nt, Artificial Sequence
  MKO10043659_A_Pth1r
  gRNA
caaacgauguugucccacuc

SEQ ID NO: 43660 - RNA, 20 nt, Artificial Sequence
  MKO10043660_A_Pth2r
  gRNA
aauagaaucccacgucccau

SEQ ID NO: 43661 - RNA, 20 nt, Artificial Sequence
  MKO10043661_A_Pth2r
  gRNA
cugcagccugauaucaacau

SEQ ID NO: 43662 - RNA, 20 nt, Artificial Sequence
  MKO10043662_A_Pth2r
  gRNA
gggaucauuuguuggcccag

SEQ ID NO: 43663 - RNA, 20 nt, Artificial Sequence
  MKO10043663_A_Pth2
  gRNA
ccgcgucgucagcuagcgcc

SEQ ID NO: 43664 - RNA, 20 nt, Artificial Sequence
  MKO10043664_A_Pth2
  gRNA
ccuggcgcuagcugacgacg

SEQ ID NO: 43665 - RNA, 20 nt, Artificial Sequence
  MKO10043665_A_Pth2
  gRNA
ccuaccugaacacaccagcg

SEQ ID NO: 43666 - RNA, 20 nt, Artificial Sequence
  MKO10043666_A_Pthlh
  gRNA
gccccuccaccgaacgcccg

SEQ ID NO: 43667 - RNA, 20 nt, Artificial Sequence
  MKO10043667_A_Pthlh
  gRNA
agaaacggcggcgcaagucu

SEQ ID NO: 43668 - RNA, 20 nt, Artificial Sequence
  MKO10043668_A_Pthlh
  gRNA
cgagcggcacgaugcugcgg

SEQ ID NO: 43669 - RNA, 20 nt, Artificial Sequence
  MKO10043669_A_Pth
  gRNA
ucacggguuucccauccguu

SEQ ID NO: 43670 - RNA, 20 nt, Artificial Sequence
  MKO10043670_A_Pth
  gRNA
gauggcaauccaaaaagucu

SEQ ID NO: 43671 - RNA, 20 nt, Artificial Sequence
  MKO10043671_A_Pth
  gRNA
gaugaugucugcaaacaccg

SEQ ID NO: 43672 - RNA, 20 nt, Artificial Sequence
  MKO10043672_A_Ptk2b
  gRNA
caugcaacgcuacgccagca

SEQ ID NO: 43673 - RNA, 20 nt, Artificial Sequence
  MKO10043673_A_Ptk2b
  gRNA
ugggcccuauucgcccacuc

SEQ ID NO: 43674 - RNA, 20 nt, Artificial Sequence
  MKO10043674_A_Ptk2b
  gRNA
gcccuugagccguguaaaag

SEQ ID NO: 43675 - RNA, 20 nt, Artificial Sequence
  MKO10043675_A_Ptk2
  gRNA
agugcaccuccuccgaucgc

SEQ ID NO: 43676 - RNA, 20 nt, Artificial Sequence
  MKO10043676_A_Ptk2
  gRNA
uucgaguacuaagacucacc

SEQ ID NO: 43677 - RNA, 20 nt, Artificial Sequence
  MKO10043677_A_Ptk2
  gRNA
ugcaauggaacgaguauuaa

SEQ ID NO: 43678 - RNA, 20 nt, Artificial Sequence
  MKO10043678_A_Ptk6
  gRNA
agaaggauaccgccucauuc

SEQ ID NO: 43679 - RNA, 20 nt, Artificial Sequence
  MKO10043679_A_Ptk6
  gRNA
ccgugcgacauuacaggauc

SEQ ID NO: 43680 - RNA, 20 nt, Artificial Sequence
  MKO10043680_A_Ptk6
  gRNA
aaacugagcccuugccccac

SEQ ID NO: 43681 - RNA, 20 nt, Artificial Sequence
  MKO10043681_A_Ptk7
  gRNA
caaaccgucgcuccgugucc

SEQ ID NO: 43682 - RNA, 20 nt, Artificial Sequence
  MKO10043682_A_Ptk7
  gRNA
gaggccacuauguucgggac

SEQ ID NO: 43683 - RNA, 20 nt, Artificial Sequence
  MKO10043683_A_Ptk7
  gRNA
uuaccggcuucgguuaguga

SEQ ID NO: 43684 - RNA, 20 nt, Artificial Sequence
  MKO10043684_A_Ptma
  gRNA
uucucuacaggaugacgaug

SEQ ID NO: 43685 - RNA, 20 nt, Artificial Sequence
  MKO10043685_A_Ptma
  gRNA
gacacucacagcguucccau

SEQ ID NO: 43686 - RNA, 20 nt, Artificial Sequence
  MKO10043686_A_Ptma
  gRNA
ugauucuccaggugaggagg

SEQ ID NO: 43687 - RNA, 20 nt, Artificial Sequence
  MKO10043687_A_Ptms
  gRNA
uucagcaguucucuuccgca

SEQ ID NO: 43688 - RNA, 20 nt, Artificial Sequence
  MKO10043688_A_Ptms
  gRNA
gaagacagaaaacggggcgu

SEQ ID NO: 43689 - RNA, 20 nt, Artificial Sequence
  MKO10043689_A_Ptms
  gRNA
aggaugaagcagaccccaag

SEQ ID NO: 43690 - RNA, 20 nt, Artificial Sequence
  MKO10043690_A_Ptn
  gRNA
gcccaauccacaguccccgc

SEQ ID NO: 43691 - RNA, 20 nt, Artificial Sequence
  MKO10043691_A_Ptn
  gRNA
cgccagugcgagugcccucc

SEQ ID NO: 43692 - RNA, 20 nt, Artificial Sequence
  MKO10043692_A_Ptn
  gRNA
cauugugcagagcucgcuuc

SEQ ID NO: 43693 - RNA, 20 nt, Artificial Sequence
  MKO10043693_A_Ptov1
  gRNA
gccucgcagugaacgagcac

SEQ ID NO: 43694 - RNA, 20 nt, Artificial Sequence
  MKO10043694_A_Ptov1
  gRNA
acacucacagguucucgccc

SEQ ID NO: 43695 - RNA, 20 nt, Artificial Sequence
  MKO10043695_A_Ptov1
  gRNA
ccuaucgggcccucuucacc

SEQ ID NO: 43696 - RNA, 20 nt, Artificial Sequence
  MKO10043696_A_Ptp4a1
  gRNA
cuuccuuccagaaagcggcg

SEQ ID NO: 43697 - RNA, 20 nt, Artificial Sequence
  MKO10043697_A_Ptp4a1
  gRNA
uccuaggaacuuaagaagua

SEQ ID NO: 43698 - RNA, 20 nt, Artificial Sequence
  MKO10043698_A_Ptp4a1
  gRNA
uucacauacucuuacuauug

SEQ ID NO: 43699 - RNA, 20 nt, Artificial Sequence
  MKO10043699_A_Ptp4a2
  gRNA
agaaguaccgaccuaagaug

SEQ ID NO: 43700 - RNA, 20 nt, Artificial Sequence
  MKO10043700_A_Ptp4a2
  gRNA
cugaagcguaaccgcaucuu

SEQ ID NO: 43701 - RNA, 20 nt, Artificial Sequence
  MKO10043701_A_Ptp4a2
  gRNA
aaugcaagcgcaacuagcac

SEQ ID NO: 43702 - RNA, 20 nt, Artificial Sequence
  MKO10043702_A_Ptp4a3
  gRNA
acuucaucccgcucucgaug

SEQ ID NO: 43703 - RNA, 20 nt, Artificial Sequence
  MKO10043703_A_Ptp4a3
  gRNA
cucucgcccucaucgagagc

SEQ ID NO: 43704 - RNA, 20 nt, Artificial Sequence
  MKO10043704_A_Ptp4a3
  gRNA
gaccuaugacaagacccccc

SEQ ID NO: 43705 - RNA, 20 nt, Artificial Sequence
  MKO10043705_A_Ptpdc1
  gRNA
cgcaucaucgagcaguuccu

SEQ ID NO: 43706 - RNA, 20 nt, Artificial Sequence
  MKO10043706_A_Ptpdc1
  gRNA
cguuugcggcaugucauccc

SEQ ID NO: 43707 - RNA, 20 nt, Artificial Sequence
  MKO10043707_A_Ptpdc1
  gRNA
auaaucaaccugcagcgccc

SEQ ID NO: 43708 - RNA, 20 nt, Artificial Sequence
  MKO10043708_A_Ptplad1
  gRNA
cccugacuuugaucgcuggc

SEQ ID NO: 43709 - RNA, 20 nt, Artificial Sequence
  MKO10043709_A_Ptplad1
  gRNA
caaugggcgcuucucuugcu

SEQ ID NO: 43710 - RNA, 20 nt, Artificial Sequence
  MKO10043710_A_Ptplad1
  gRNA
gacaaugugcugcauuucaa

SEQ ID NO: 43711 - RNA, 20 nt, Artificial Sequence
  MKO10043711_A_Ptplad2
  gRNA
cccaauagcguaaaacgugu

SEQ ID NO: 43712 - RNA, 20 nt, Artificial Sequence
  MKO10043712_A_Ptplad2
  gRNA
aaacuuaccugcaaaaaccg

SEQ ID NO: 43713 - RNA, 20 nt, Artificial Sequence
  MKO10043713_A_Ptplad2
  gRNA
ggugaucaccagucaagagg

SEQ ID NO: 43714 - RNA, 20 nt, Artificial Sequence
  MKO10043714_A_Ptpla
  gRNA
gcgcacguacccggccguca

SEQ ID NO: 43715 - RNA, 20 nt, Artificial Sequence
  MKO10043715_A_Ptpla
  gRNA
gcaacucaccgaucagacaa

SEQ ID NO: 43716 - RNA, 20 nt, Artificial Sequence
  MKO10043716_A_Ptpla
  gRNA
cagguaguccauugucugau

SEQ ID NO: 43717 - RNA, 20 nt, Artificial Sequence
  MKO10043717_A_Ptplb
  gRNA
cuggcccauuugaugauaua

SEQ ID NO: 43718 - RNA, 20 nt, Artificial Sequence
  MKO10043718_A_Ptplb
  gRNA
agguggcuggugauagcagu

SEQ ID NO: 43719 - RNA, 20 nt, Artificial Sequence
  MKO10043719_A_Ptplb
  gRNA
aucugccuuauaucaucaaa

SEQ ID NO: 43720 - RNA, 20 nt, Artificial Sequence
  MKO10043720_A_Ptpmt1
  gRNA
uagaagcgaucgccaaaauc

SEQ ID NO: 43721 - RNA, 20 nt, Artificial Sequence
  MKO10043721_A_Ptpmt1
  gRNA
cgcgaccagccaccgcgaga

SEQ ID NO: 43722 - RNA, 20 nt, Artificial Sequence
  MKO10043722_A_Ptpmt1
  gRNA
cgaugcggugguaccagucg

SEQ ID NO: 43723 - RNA, 20 nt, Artificial Sequence
  MKO10043723_A_Ptpn11
  gRNA
uuugucgucaccagugcgca

SEQ ID NO: 43724 - RNA, 20 nt, Artificial Sequence
  MKO10043724_A_Ptpn11
  gRNA
ccacgucaugauccgcuguc

SEQ ID NO: 43725 - RNA, 20 nt, Artificial Sequence
  MKO10043725_A_Ptpn11
  gRNA
aaaacugccaucgacuccuc

SEQ ID NO: 43726 - RNA, 20 nt, Artificial Sequence
  MKO10043726_A_Ptpn12
  gRNA
uccuucuuagaucaucguga

SEQ ID NO: 43727 - RNA, 20 nt, Artificial Sequence
  MKO10043727_A_Ptpn12
  gRNA
ucuaugacuguauucgccaa

SEQ ID NO: 43728 - RNA, 20 nt, Artificial Sequence
  MKO10043728_A_Ptpn12
  gRNA
ucccaucucaaauucucgac

SEQ ID NO: 43729 - RNA, 20 nt, Artificial Sequence
  MKO10043729_A_Ptpn13
  gRNA
ccggugcggugaaugcucua

SEQ ID NO: 43730 - RNA, 20 nt, Artificial Sequence
  MKO10043730_A_Ptpn13
  gRNA
ccuuagagcauucaccgcac

SEQ ID NO: 43731 - RNA, 20 nt, Artificial Sequence
  MKO10043731_A_Ptpn13
  gRNA
gccauucgagaccgacugag

SEQ ID NO: 43732 - RNA, 20 nt, Artificial Sequence
  MKO10043732_A_Ptpn14
  gRNA
uuuaucuagacgcacuacuu

SEQ ID NO: 43733 - RNA, 20 nt, Artificial Sequence
  MKO10043733_A_Ptpn14
  gRNA
gcucuacccaucucgccugc

SEQ ID NO: 43734 - RNA, 20 nt, Artificial Sequence
  MKO10043734_A_Ptpn14
  gRNA
ggaacucuugggaaucaaac

SEQ ID NO: 43735 - RNA, 20 nt, Artificial Sequence
  MKO10043735_A_Ptpn18
  gRNA
ggguccuugcgucgcaaugu

SEQ ID NO: 43736 - RNA, 20 nt, Artificial Sequence
  MKO10043736_A_Ptpn18
  gRNA
cguguucccaagccgacugc

SEQ ID NO: 43737 - RNA, 20 nt, Artificial Sequence
  MKO10043737_A_Ptpn18
  gRNA
ggacauuaaggcccgcucag

SEQ ID NO: 43738 - RNA, 20 nt, Artificial Sequence
  MKO10043738_A_Ptpn1
  gRNA
ggucaugcucaaccgcauca

SEQ ID NO: 43739 - RNA, 20 nt, Artificial Sequence
  MKO10043739_A_Ptpn1
  gRNA
auauuacacaguacgacagu

SEQ ID NO: 43740 - RNA, 20 nt, Artificial Sequence
  MKO10043740_A_Ptpn1
  gRNA
gacuuugcaugggaagucgc

SEQ ID NO: 43741 - RNA, 20 nt, Artificial Sequence
  MKO10043741_A_Ptpn20
  gRNA
gaaaaugacgccuacgaagc

SEQ ID NO: 43742 - RNA, 20 nt, Artificial Sequence
  MKO10043742_A_Ptpn20
  gRNA
gugaccggucucucagaaac

SEQ ID NO: 43743 - RNA, 20 nt, Artificial Sequence
  MKO10043743_A_Ptpn20
  gRNA
aguauggauucagagacugc

SEQ ID NO: 43744 - RNA, 20 nt, Artificial Sequence
  MKO10043744_A_Ptpn21
  gRNA
aauggcguguucuaauguac

SEQ ID NO: 43745 - RNA, 20 nt, Artificial Sequence
  MKO10043745_A_Ptpn21
  gRNA
gaauagcacgccgaaguaga

SEQ ID NO: 43746 - RNA, 20 nt, Artificial Sequence
  MKO10043746_A_Ptpn21
  gRNA
cuggagccuaccgucuacuu

SEQ ID NO: 43747 - RNA, 20 nt, Artificial Sequence
  MKO10043747_A_Ptpn22
  gRNA
gauuugggaguaccgcaucu

SEQ ID NO: 43748 - RNA, 20 nt, Artificial Sequence
  MKO10043748_A_Ptpn22
  gRNA
gucucuguuaacuuccgaug

SEQ ID NO: 43749 - RNA, 20 nt, Artificial Sequence
  MKO10043749_A_Ptpn22
  gRNA
caaaaucuauccuacaacug

SEQ ID NO: 43750 - RNA, 20 nt, Artificial Sequence
  MKO10043750_A_Ptpn23
  gRNA
agaaugcuauucgcguugcc

SEQ ID NO: 43751 - RNA, 20 nt, Artificial Sequence
  MKO10043751_A_Ptpn23
  gRNA
accgagguuguagagaauac

SEQ ID NO: 43752 - RNA, 20 nt, Artificial Sequence
  MKO10043752_A_Ptpn23
  gRNA
ccaugggcacccgacucugu

SEQ ID NO: 43753 - RNA, 20 nt, Artificial Sequence
  MKO10043753_A_Ptpn2
  gRNA
ccaugucggcaaccaucgag

SEQ ID NO: 43754 - RNA, 20 nt, Artificial Sequence
  MKO10043754_A_Ptpn2
  gRNA
ccaugacuauccucauagag

SEQ ID NO: 43755 - RNA, 20 nt, Artificial Sequence
  MKO10043755_A_Ptpn2
  gRNA
uuccucgaacucccgcucga

SEQ ID NO: 43756 - RNA, 20 nt, Artificial Sequence
  MKO10043756_A_Ptpn3
  gRNA
ucgcuucuggauauggccua

SEQ ID NO: 43757 - RNA, 20 nt, Artificial Sequence
  MKO10043757_A_Ptpn3
  gRNA
ccaccugggugugacggaga

SEQ ID NO: 43758 - RNA, 20 nt, Artificial Sequence
  MKO10043758_A_Ptpn3
  gRNA
aauaucuuacucgaaaaugc

SEQ ID NO: 43759 - RNA, 20 nt, Artificial Sequence
  MKO10043759_A_Ptpn4
  gRNA
uugacugagcgagacuauuu

SEQ ID NO: 43760 - RNA, 20 nt, Artificial Sequence
  MKO10043760_A_Ptpn4
  gRNA
acucuaaaguucaaauugua

SEQ ID NO: 43761 - RNA, 20 nt, Artificial Sequence
  MKO10043761_A_Ptpn4
  gRNA
uaaacuuacuggguuaucug

SEQ ID NO: 43762 - RNA, 20 nt, Artificial Sequence
  MKO10043762_A_Ptpn5
  gRNA
acaggcgucaaucagugagc

SEQ ID NO: 43763 - RNA, 20 nt, Artificial Sequence
  MKO10043763_A_Ptpn5
  gRNA
gcucacaguguugaaccauc

SEQ ID NO: 43764 - RNA, 20 nt, Artificial Sequence
  MKO10043764_A_Ptpn5
  gRNA
agagauggaagcaccggacg

SEQ ID NO: 43765 - RNA, 20 nt, Artificial Sequence
  MKO10043765_A_Ptpn6
  gRNA
caaacuucuccccuccguac

SEQ ID NO: 43766 - RNA, 20 nt, Artificial Sequence
  MKO10043766_A_Ptpn6
  gRNA
gacuucuaugaccuguacgg

SEQ ID NO: 43767 - RNA, 20 nt, Artificial Sequence
  MKO10043767_A_Ptpn6
  gRNA
ucaggguggacgcuauacug

SEQ ID NO: 43768 - RNA, 20 nt, Artificial Sequence
  MKO10043768_A_Ptpn7
  gRNA
gcuguagcguccagcgugua

SEQ ID NO: 43769 - RNA, 20 nt, Artificial Sequence
  MKO10043769_A_Ptpn7
  gRNA
accacucacccggauguagu

SEQ ID NO: 43770 - RNA, 20 nt, Artificial Sequence
  MKO10043770_A_Ptpn7
  gRNA
cacccuacacuuccugcgca

SEQ ID NO: 43771 - RNA, 20 nt, Artificial Sequence
  MKO10043771_A_Ptpn9
  gRNA
uagaauguucgagacccaac

SEQ ID NO: 43772 - RNA, 20 nt, Artificial Sequence
  MKO10043772_A_Ptpn9
  gRNA
uucuugaagagaucaacaag

SEQ ID NO: 43773 - RNA, 20 nt, Artificial Sequence
  MKO10043773_A_Ptpn9
  gRNA
gccaacuuugagcuagaucu

SEQ ID NO: 43774 - RNA, 20 nt, Artificial Sequence
  MKO10043774_A_Ptpra
  gRNA
agugccuccagauuccgugc

SEQ ID NO: 43775 - RNA, 20 nt, Artificial Sequence
  MKO10043775_A_Ptpra
  gRNA
ggcacuaccauuuccccgaa

SEQ ID NO: 43776 - RNA, 20 nt, Artificial Sequence
  MKO10043776_A_Ptpra
  gRNA
gccaccaucaccgcaauaau

SEQ ID NO: 43777 - RNA, 20 nt, Artificial Sequence
  MKO10043777_A_Ptprb
  gRNA
cacguuugugucuugaacga

SEQ ID NO: 43778 - RNA, 20 nt, Artificial Sequence
  MKO10043778_A_Ptprb
  gRNA
aaauaauugcaccucauacc

SEQ ID NO: 43779 - RNA, 20 nt, Artificial Sequence
  MKO10043779_A_Ptprb
  gRNA
uaccuacggauguaacccca

SEQ ID NO: 43780 - RNA, 20 nt, Artificial Sequence
  MKO10043780_A_Ptprcap
  gRNA
gcuucgcgcccgcacugagc

SEQ ID NO: 43781 - RNA, 20 nt, Artificial Sequence
  MKO10043781_A_Ptprcap
  gRNA
ugggugguaguaccccccug

SEQ ID NO: 43782 - RNA, 20 nt, Artificial Sequence
  MKO10043782_A_Ptprcap
  gRNA
gcgcgaagccagcggccugc

SEQ ID NO: 43783 - RNA, 20 nt, Artificial Sequence
  MKO10043783_A_Ptprc
  gRNA
accacauguuugcuucguug

SEQ ID NO: 43784 - RNA, 20 nt, Artificial Sequence
  MKO10043784_A_Ptprc
  gRNA
ggccuuuggauuugcccuuc

SEQ ID NO: 43785 - RNA, 20 nt, Artificial Sequence
  MKO10043785_A_Ptprc
  gRNA
uauaaaucuauaguuguagc

SEQ ID NO: 43786 - RNA, 20 nt, Artificial Sequence
  MKO10043786_A_Ptprd
  gRNA
cguauuaagcaguuacgauc

SEQ ID NO: 43787 - RNA, 20 nt, Artificial Sequence
  MKO10043787_A_Ptprd
  gRNA
ccccagguuuacacgaacuc

SEQ ID NO: 43788 - RNA, 20 nt, Artificial Sequence
  MKO10043788_A_Ptprd
  gRNA
gauuucucccacauuauucg

SEQ ID NO: 43789 - RNA, 20 nt, Artificial Sequence
  MKO10043789_A_Ptpre
  gRNA
ugacugcaagcgauuccgag

SEQ ID NO: 43790 - RNA, 20 nt, Artificial Sequence
  MKO10043790_A_Ptpre
  gRNA
ugcucuucuaagaucccguu

SEQ ID NO: 43791 - RNA, 20 nt, Artificial Sequence
  MKO10043791_A_Ptpre
  gRNA
cacucacauugaacuccucu

SEQ ID NO: 43792 - RNA, 20 nt, Artificial Sequence
  MKO10043792_A_Ptprf
  gRNA
aacccaagccucgaauuacg

SEQ ID NO: 43793 - RNA, 20 nt, Artificial Sequence
  MKO10043793_A_Ptprf
  gRNA
auacgaccguugcuugcagc

SEQ ID NO: 43794 - RNA, 20 nt, Artificial Sequence
  MKO10043794_A_Ptprf
  gRNA
uucuucauccacguaauucg

SEQ ID NO: 43795 - RNA, 20 nt, Artificial Sequence
  MKO10043795_A_Ptprg
  gRNA
gacccauacugggcguauuc

SEQ ID NO: 43796 - RNA, 20 nt, Artificial Sequence
  MKO10043796_A_Ptprg
  gRNA
auucaucgccaacgcgagca

SEQ ID NO: 43797 - RNA, 20 nt, Artificial Sequence
  MKO10043797_A_Ptprg
  gRNA
uuagaccaccaugcucgcgu

SEQ ID NO: 43798 - RNA, 20 nt, Artificial Sequence
  MKO10043798_A_Ptprh
  gRNA
cagauuccuguaaccaccgc

SEQ ID NO: 43799 - RNA, 20 nt, Artificial Sequence
  MKO10043799_A_Ptprh
  gRNA
cucucaccugcggugguuac

SEQ ID NO: 43800 - RNA, 20 nt, Artificial Sequence
  MKO10043800_A_Ptprh
  gRNA
ggguuuguaugguuguucug

SEQ ID NO: 43801 - RNA, 20 nt, Artificial Sequence
  MKO10043801_A_Ptprj
  gRNA
ccguuacagguccugugcgc

SEQ ID NO: 43802 - RNA, 20 nt, Artificial Sequence
  MKO10043802_A_Ptprj
  gRNA
gcgaagcuauuauugguccc

SEQ ID NO: 43803 - RNA, 20 nt, Artificial Sequence
  MKO10043803_A_Ptprj
  gRNA
acucacccgcaccugcgcac

SEQ ID NO: 43804 - RNA, 20 nt, Artificial Sequence
  MKO10043804_A_Ptprk
  gRNA
accuaccgcaaggauaacuc

SEQ ID NO: 43805 - RNA, 20 nt, Artificial Sequence
  MKO10043805_A_Ptprk
  gRNA
gaccucuugcuaauccaauu

SEQ ID NO: 43806 - RNA, 20 nt, Artificial Sequence
  MKO10043806_A_Ptprk
  gRNA
ggggauuaccugguauucau

SEQ ID NO: 43807 - RNA, 20 nt, Artificial Sequence
  MKO10043807_A_Ptprm
  gRNA
ccggagaccccacccgcacg

SEQ ID NO: 43808 - RNA, 20 nt, Artificial Sequence
  MKO10043808_A_Ptprm
  gRNA
aguagugaaagucgaugcag

SEQ ID NO: 43809 - RNA, 20 nt, Artificial Sequence
  MKO10043809_A_Ptprm
  gRNA
accuuccagugcagcgccau

SEQ ID NO: 43810 - RNA, 20 nt, Artificial Sequence
  MKO10043810_A_Ptprn2
  gRNA
cagauagcgccgaagggucu

SEQ ID NO: 43811 - RNA, 20 nt, Artificial Sequence
  MKO10043811_A_Ptprn2
  gRNA
uuacagaagcucucccguac

SEQ ID NO: 43812 - RNA, 20 nt, Artificial Sequence
  MKO10043812_A_Ptprn2
  gRNA
ucggcgcuaucugcccuacc

SEQ ID NO: 43813 - RNA, 20 nt, Artificial Sequence
  MKO10043813_A_Ptprn
  gRNA
ccgcagacuuuguucgcauc

SEQ ID NO: 43814 - RNA, 20 nt, Artificial Sequence
  MKO10043814_A_Ptprn
  gRNA
ugaguuagcaauuccccugc

SEQ ID NO: 43815 - RNA, 20 nt, Artificial Sequence
  MKO10043815_A_Ptprn
  gRNA
ggcucuggggggcgaagccu

SEQ ID NO: 43816 - RNA, 20 nt, Artificial Sequence
  MKO10043816_A_Ptpro
  gRNA
accgagaucaccaccacguu

SEQ ID NO: 43817 - RNA, 20 nt, Artificial Sequence
  MKO10043817_A_Ptpro
  gRNA
uacagaggugaacccuaacg

SEQ ID NO: 43818 - RNA, 20 nt, Artificial Sequence
  MKO10043818_A_Ptpro
  gRNA
aagggaaacuccccuacagu

SEQ ID NO: 43819 - RNA, 20 nt, Artificial Sequence
  MKO10043819_A_Ptprq
  gRNA
cuucacuacuauaccgcuuc

SEQ ID NO: 43820 - RNA, 20 nt, Artificial Sequence
  MKO10043820_A_Ptprq
  gRNA
gagagcgaagcccgacaguc

SEQ ID NO: 43821 - RNA, 20 nt, Artificial Sequence
  MKO10043821_A_Ptprq
  gRNA
uuaaucucguauguuguucc

SEQ ID NO: 43822 - RNA, 20 nt, Artificial Sequence
  MKO10043822_A_Ptprr
  gRNA
ccagcccgaucaggcgccaa

SEQ ID NO: 43823 - RNA, 20 nt, Artificial Sequence
  MKO10043823_A_Ptprr
  gRNA
uugugcuugcugccgugcaa

SEQ ID NO: 43824 - RNA, 20 nt, Artificial Sequence
  MKO10043824_A_Ptprr
  gRNA
cuucucccgggggguugaga

SEQ ID NO: 43825 - RNA, 20 nt, Artificial Sequence
  MKO10043825_A_Ptprs
  gRNA
gcaaagcucaccguccuucg

SEQ ID NO: 43826 - RNA, 20 nt, Artificial Sequence
  MKO10043826_A_Ptprs
  gRNA
gauuggagugucgggaggcg

SEQ ID NO: 43827 - RNA, 20 nt, Artificial Sequence
  MKO10043827_A_Ptprs
  gRNA
ccguggcuuaggaucacccg

SEQ ID NO: 43828 - RNA, 20 nt, Artificial Sequence
  MKO10043828_A_Ptprt
  gRNA
cgggcuggagcgaucucgac

SEQ ID NO: 43829 - RNA, 20 nt, Artificial Sequence
  MKO10043829_A_Ptprt
  gRNA
cguaucuggcgucgucacug

SEQ ID NO: 43830 - RNA, 20 nt, Artificial Sequence
  MKO10043830_A_Ptprt
  gRNA
ccugcgacuccaaaacguug

SEQ ID NO: 43831 - RNA, 20 nt, Artificial Sequence
  MKO10043831_A_Ptpru
  gRNA
cgggucacucgccuccucga

SEQ ID NO: 43832 - RNA, 20 nt, Artificial Sequence
  MKO10043832_A_Ptpru
  gRNA
ccggaucccacggccgucag

SEQ ID NO: 43833 - RNA, 20 nt, Artificial Sequence
  MKO10043833_A_Ptpru
  gRNA
gcgcuuaccugcgggagucu

SEQ ID NO: 43834 - RNA, 20 nt, Artificial Sequence
  MKO10043834_A_Ptprv
  gRNA
uugggcaucccccacacuaa

SEQ ID NO: 43835 - RNA, 20 nt, Artificial Sequence
  MKO10043835_A_Ptprv
  gRNA
agccccgcuguacccgcugc

SEQ ID NO: 43836 - RNA, 20 nt, Artificial Sequence
  MKO10043836_A_Ptprv
  gRNA
cuccugugccaacucagccg

SEQ ID NO: 43837 - RNA, 20 nt, Artificial Sequence
  MKO10043837_A_Ptprz1
  gRNA
aacacguucauucacaacac

SEQ ID NO: 43838 - RNA, 20 nt, Artificial Sequence
  MKO10043838_A_Ptprz1
  gRNA
gcaagucuacugcuuugaug

SEQ ID NO: 43839 - RNA, 20 nt, Artificial Sequence
  MKO10043839_A_Ptprz1
  gRNA
uugguucuagacugggcuua

SEQ ID NO: 43840 - RNA, 20 nt, Artificial Sequence
  MKO10043840_A_Ptrf
  gRNA
ucacgcuccauaucguugag

SEQ ID NO: 43841 - RNA, 20 nt, Artificial Sequence
  MKO10043841_A_Ptrf
  gRNA
cgaggagucggacgccgucc

SEQ ID NO: 43842 - RNA, 20 nt, Artificial Sequence
  MKO10043842_A_Ptrf
  gRNA
ugaagucguccacgcgccgc

SEQ ID NO: 43843 - RNA, 20 nt, Artificial Sequence
  MKO10043843_A_Ptrh1
  gRNA
cggcgccucaugaacgucaa

SEQ ID NO: 43844 - RNA, 20 nt, Artificial Sequence
  MKO10043844_A_Ptrh1
  gRNA
ugcgcccguugacguucaug

SEQ ID NO: 43845 - RNA, 20 nt, Artificial Sequence
  MKO10043845_A_Ptrh1
  gRNA
gacugcggaggagaucuauc

SEQ ID NO: 43846 - RNA, 20 nt, Artificial Sequence
  MKO10043846_A_Ptrh2
  gRNA
uucgaacugaccuuaaaaug

SEQ ID NO: 43847 - RNA, 20 nt, Artificial Sequence
  MKO10043847_A_Ptrh2
  gRNA
cccccagaacucaacaagug

SEQ ID NO: 43848 - RNA, 20 nt, Artificial Sequence
  MKO10043848_A_Ptrh2
  gRNA
aguugcuuguggcaugugcc

SEQ ID NO: 43849 - RNA, 20 nt, Artificial Sequence
  MKO10043849_A_Ptrhd1
  gRNA
caccggcgcacugguagcgc

SEQ ID NO: 43850 - RNA, 20 nt, Artificial Sequence
  MKO10043850_A_Ptrhd1
  gRNA
ucaucgagaccauccgcaca

SEQ ID NO: 43851 - RNA, 20 nt, Artificial Sequence
  MKO10043851_A_Ptrhd1
  gRNA
agaacauugaccacacgcug

SEQ ID NO: 43852 - RNA, 20 nt, Artificial Sequence
  MKO10043852_A_Pts
  gRNA
caccuuuauaguugugcccg

SEQ ID NO: 43853 - RNA, 20 nt, Artificial Sequence
  MKO10043853_A_Pts
  gRNA
ugcaacaauccgaauggcca

SEQ ID NO: 43854 - RNA, 20 nt, Artificial Sequence
  MKO10043854_A_Pts
  gRNA
ccuggaugugccguacuuug

SEQ ID NO: 43855 - RNA, 20 nt, Artificial Sequence
  MKO10043855_A_Puug1ip
  gRNA
guaaauugaguuccgcucgc

SEQ ID NO: 43856 - RNA, 20 nt, Artificial Sequence
  MKO10043856_A_Puug1ip
  gRNA
ccagcauacgccccagcgag

SEQ ID NO: 43857 - RNA, 20 nt, Artificial Sequence
  MKO10043857_A_Puug1ip
  gRNA
gaucaucaccaugucggucc

SEQ ID NO: 43858 - RNA, 20 nt, Artificial Sequence
  MKO10043858_A_Puug1
  gRNA
ugaagaacccggccgccguu

SEQ ID NO: 43859 - RNA, 20 nt, Artificial Sequence
  MKO10043859_A_Puug1
  gRNA
ccaaaacagccgaccuugac

SEQ ID NO: 43860 - RNA, 20 nt, Artificial Sequence
  MKO10043860_A_Puug1
  gRNA
caugagaggcacgccauuca

SEQ ID NO: 43861 - RNA, 20 nt, Artificial Sequence
  MKO10043861_A_Ptx3
  gRNA
aaaaucuucuucgaacgcau

SEQ ID NO: 43862 - RNA, 20 nt, Artificial Sequence
  MKO10043862_A_Ptx3
  gRNA
cacgccaugcgacugccgcc

SEQ ID NO: 43863 - RNA, 20 nt, Artificial Sequence
  MKO10043863_A_Ptx3
  gRNA
cccacccgacgacauuuccc

SEQ ID NO: 43864 - RNA, 20 nt, Artificial Sequence
  MKO10043864_A_Ptx4
  gRNA
cguagggagcauaucuggcu

SEQ ID NO: 43865 - RNA, 20 nt, Artificial Sequence
  MKO10043865_A_Ptx4
  gRNA
agcgucagaauagcgccugu

SEQ ID NO: 43866 - RNA, 20 nt, Artificial Sequence
  MKO10043866_A_Ptx4
  gRNA
cuaccugcucuucuagucga

SEQ ID NO: 43867 - RNA, 20 nt, Artificial Sequence
  MKO10043867_A_Puf60
  gRNA
uccccugacgcccgagcagc

SEQ ID NO: 43868 - RNA, 20 nt, Artificial Sequence
  MKO10043868_A_Puf60
  gRNA
gcagagcaucaagagugugc

SEQ ID NO: 43869 - RNA, 20 nt, Artificial Sequence
  MKO10043869_A_Puf60
  gRNA
cagcaggucaauggccaaca

SEQ ID NO: 43870 - RNA, 20 nt, Artificial Sequence
  MKO10043870_A_Pum1
  gRNA
ugaacacuagguacgcucua

SEQ ID NO: 43871 - RNA, 20 nt, Artificial Sequence
  MKO10043871_A_Pum1
  gRNA
aguccaccauagcgucgucc

SEQ ID NO: 43872 - RNA, 20 nt, Artificial Sequence
  MKO10043872_A_Pum1
  gRNA
gcaugaauguuauccccugu

SEQ ID NO: 43873 - RNA, 20 nt, Artificial Sequence
  MKO10043873_A_Pum2
  gRNA
cgagaauccaauuuaucagc

SEQ ID NO: 43874 - RNA, 20 nt, Artificial Sequence
  MKO10043874_A_Pum2
  gRNA
uucaaugucccagccuauua

SEQ ID NO: 43875 - RNA, 20 nt, Artificial Sequence
  MKO10043875_A_Pum2
  gRNA
ccugaugauucaacaaaaga

SEQ ID NO: 43876 - RNA, 20 nt, Artificial Sequence
  MKO10043876_A_Pura
  gRNA
cguggaguuccgcgacuacc

SEQ ID NO: 43877 - RNA, 20 nt, Artificial Sequence
  MKO10043877_A_Pura
  gRNA
gcucaucgacgacuauggag

SEQ ID NO: 43878 - RNA, 20 nt, Artificial Sequence
  MKO10043878_A_Pura
  gRNA
caucgaguuccgugacgcuc

SEQ ID NO: 43879 - RNA, 20 nt, Artificial Sequence
  MKO10043879_A_Purb
  gRNA
cgccgaguuccgcgacucgc

SEQ ID NO: 43880 - RNA, 20 nt, Artificial Sequence
  MKO10043880_A_Purb
  gRNA
ccaccgccaucgacagcgug

SEQ ID NO: 43881 - RNA, 20 nt, Artificial Sequence
  MKO10043881_A_Purb
  gRNA
gcgcgucgcggaacucgaug

SEQ ID NO: 43882 - RNA, 20 nt, Artificial Sequence
  MKO10043882_A_Purg
  gRNA
uuucuggauguccacacguu

SEQ ID NO: 43883 - RNA, 20 nt, Artificial Sequence
  MKO10043883_A_Purg
  gRNA
cgacccacuugaacucccag

SEQ ID NO: 43884 - RNA, 20 nt, Artificial Sequence
  MKO10043884_A_Purg
  gRNA
cuguugucagaccaagcaua

SEQ ID NO: 43885 - RNA, 20 nt, Artificial Sequence
  MKO10043885_A_Pus10
  gRNA
uggguuugaauucaccagcg

SEQ ID NO: 43886 - RNA, 20 nt, Artificial Sequence
  MKO10043886_A_Pus10
  gRNA
gggcguucccacugauggaa

SEQ ID NO: 43887 - RNA, 20 nt, Artificial Sequence
  MKO10043887_A_Pus10
  gRNA
acccagaggcuucaaccuuu

SEQ ID NO: 43888 - RNA, 20 nt, Artificial Sequence
  MKO10043888_A_Pus1
  gRNA
ucggcaaaguauugagccac

SEQ ID NO: 43889 - RNA, 20 nt, Artificial Sequence
  MKO10043889_A_Pus1
  gRNA
cgaagagcccuucguacgug

SEQ ID NO: 43890 - RNA, 20 nt, Artificial Sequence
  MKO10043890_A_Pus1
  gRNA
ugucuguucgagcacaccgc

SEQ ID NO: 43891 - RNA, 20 nt, Artificial Sequence
  MKO10043891_A_Pus3
  gRNA
gcaauaucuaaauccgcacg

SEQ ID NO: 43892 - RNA, 20 nt, Artificial Sequence
  MKO10043892_A_Pus3
  gRNA
ucgaccacaccuaugauagu

SEQ ID NO: 43893 - RNA, 20 nt, Artificial Sequence
  MKO10043893_A_Pus3
  gRNA
gugugcacaaguacaacuag

SEQ ID NO: 43894 - RNA, 20 nt, Artificial Sequence
  MKO10043894_A_Pus7l
  gRNA
cccgcguaacugaaauccga

SEQ ID NO: 43895 - RNA, 20 nt, Artificial Sequence
  MKO10043895_A_Pus7l
  gRNA
aagcaauacuuucuccgaac

SEQ ID NO: 43896 - RNA, 20 nt, Artificial Sequence
  MKO10043896_A_Pus7l
  gRNA
agcaaucaccuaucaaucga

SEQ ID NO: 43897 - RNA, 20 nt, Artificial Sequence
  MKO10043897_A_Pus7
  gRNA
agacacuaaccgcagguacu

SEQ ID NO: 43898 - RNA, 20 nt, Artificial Sequence
  MKO10043898_A_Pus7
  gRNA
aagacagugagagcgucuuc

SEQ ID NO: 43899 - RNA, 20 nt, Artificial Sequence
  MKO10043899_A_Pus7
  gRNA
gcuuaccucgauggcaacac

SEQ ID NO: 43900 - RNA, 20 nt, Artificial Sequence
  MKO10043900_A_Pusl1
  gRNA
ugaacucugucgacccgguc

SEQ ID NO: 43901 - RNA, 20 nt, Artificial Sequence
  MKO10043901_A_Pusl1
  gRNA
caugcaccccggcaucggug

SEQ ID NO: 43902 - RNA, 20 nt, Artificial Sequence
  MKO10043902_A_Pusl1
  gRNA
gcagugggguugcggccgug

SEQ ID NO: 43903 - RNA, 20 nt, Artificial Sequence
  MKO10043903_A_Pvalb
  gRNA
gacagacgugcucagcgcug

SEQ ID NO: 43904 - RNA, 20 nt, Artificial Sequence
  MKO10043904_A_Pvalb
  gRNA
aaggcgauaggagccuuugc

SEQ ID NO: 43905 - RNA, 20 nt, Artificial Sequence
  MKO10043905_A_Pvalb
  gRNA
aacaccuucuucaccucauc

SEQ ID NO: 43906 - RNA, 20 nt, Artificial Sequence
  MKO10043906_A_Pvrl1
  gRNA
uucacgguugcccguaggga

SEQ ID NO: 43907 - RNA, 20 nt, Artificial Sequence
  MKO10043907_A_Pvrl1
  gRNA
ggccaucuacaacccgacua

SEQ ID NO: 43908 - RNA, 20 nt, Artificial Sequence
  MKO10043908_A_Pvrl1
  gRNA
agucaucagccguuaccguu

SEQ ID NO: 43909 - RNA, 20 nt, Artificial Sequence
  MKO10043909_A_Pvrl2
  gRNA
uacgagugcuucccgagguc

SEQ ID NO: 43910 - RNA, 20 nt, Artificial Sequence
  MKO10043910_A_Pvrl2
  gRNA
caccccccugcggguaccgu

SEQ ID NO: 43911 - RNA, 20 nt, Artificial Sequence
  MKO10043911_A_Pvrl2
  gRNA
gggccgagcggauggcguca

SEQ ID NO: 43912 - RNA, 20 nt, Artificial Sequence
  MKO10043912_A_Pvrl3
  gRNA
acacaacggggccgggcccg

SEQ ID NO: 43913 - RNA, 20 nt, Artificial Sequence
  MKO10043913_A_Pvrl3
  gRNA
cuccacccuucaaguccgug

SEQ ID NO: 43914 - RNA, 20 nt, Artificial Sequence
  MKO10043914_A_Pvrl3
  gRNA
agccagucgcacagauugac

SEQ ID NO: 43915 - RNA, 20 nt, Artificial Sequence
  MKO10043915_A_Pvrl4
  gRNA
ccagcucacccgcggaauau

SEQ ID NO: 43916 - RNA, 20 nt, Artificial Sequence
  MKO10043916_A_Pvrl4
  gRNA
cagcuugcacagcguugcgc

SEQ ID NO: 43917 - RNA, 20 nt, Artificial Sequence
  MKO10043917_A_Pvrl4
  gRNA
ugugggugauucuucggucc

SEQ ID NO: 43918 - RNA, 20 nt, Artificial Sequence
  MKO10043918_A_Pvr
  gRNA
cuacaauucgacaggcgucu

SEQ ID NO: 43919 - RNA, 20 nt, Artificial Sequence
  MKO10043919_A_Pvr
  gRNA
caagacgccugucgaauugu

SEQ ID NO: 43920 - RNA, 20 nt, Artificial Sequence
  MKO10043920_A_Pvr
  gRNA
acccuccuggacgaaucucu

SEQ ID NO: 43921 - RNA, 20 nt, Artificial Sequence
  MKO10043921_A_Pwp1
  gRNA
cuuguggauccccauccucc

SEQ ID NO: 43922 - RNA, 20 nt, Artificial Sequence
  MKO10043922_A_Pwp1
  gRNA
uccacaagaugaccgcacac

SEQ ID NO: 43923 - RNA, 20 nt, Artificial Sequence
  MKO10043923_A_Pwp1
  gRNA
acugacaaccucaucguuug

SEQ ID NO: 43924 - RNA, 20 nt, Artificial Sequence
  MKO10043924_A_Pwp2
  gRNA
cucgcaaucaucguugauga

SEQ ID NO: 43925 - RNA, 20 nt, Artificial Sequence
  MKO10043925_A_Pwp2
  gRNA
augagaccacaugcaucgac

SEQ ID NO: 43926 - RNA, 20 nt, Artificial Sequence
  MKO10043926_A_Pwp2
  gRNA
cucaucauagggcccgaaau

SEQ ID NO: 43927 - RNA, 20 nt, Artificial Sequence
  MKO10043927_A_Pwwp2a
  gRNA
cucgucgugucguuccgccu

SEQ ID NO: 43928 - RNA, 20 nt, Artificial Sequence
  MKO10043928_A_Pwwp2a
  gRNA
gcggugucgcaccucauccc

SEQ ID NO: 43929 - RNA, 20 nt, Artificial Sequence
  MKO10043929_A_Pwwp2a
  gRNA
gugcaucgagacugcggcuu

SEQ ID NO: 43930 - RNA, 20 nt, Artificial Sequence
  MKO10043930_A_Pwwp2b
  gRNA
acaggucgucaacggcgcgc

SEQ ID NO: 43931 - RNA, 20 nt, Artificial Sequence
  MKO10043931_A_Pwwp2b
  gRNA
uguggcgagcgcagcuucgc

SEQ ID NO: 43932 - RNA, 20 nt, Artificial Sequence
  MKO10043932_A_Pwwp2b
  gRNA
gguuucuggagagucgccga

SEQ ID NO: 43933 - RNA, 20 nt, Artificial Sequence
  MKO10043933_A_Pxdc1
  gRNA
ucuaggacugcucgccauca

SEQ ID NO: 43934 - RNA, 20 nt, Artificial Sequence
  MKO10043934_A_Pxdc1
  gRNA
ggucaucagcaugccgugua

SEQ ID NO: 43935 - RNA, 20 nt, Artificial Sequence
  MKO10043935_A_Pxdc1
  gRNA
uccaaaauguccgucucaaa

SEQ ID NO: 43936 - RNA, 20 nt, Artificial Sequence
  MKO10043936_A_Pxdn
  gRNA
cuuuaaucagauagaaacgc

SEQ ID NO: 43937 - RNA, 20 nt, Artificial Sequence
  MKO10043937_A_Pxdn
  gRNA
augagauccaaucaauugac

SEQ ID NO: 43938 - RNA, 20 nt, Artificial Sequence
  MKO10043938_A_Pxdn
  gRNA
cauuggggaucuucuugauc

SEQ ID NO: 43939 - RNA, 20 nt, Artificial Sequence
  MKO10043939_A_Pxk
  gRNA
gauuugccaugaugacguua

SEQ ID NO: 43940 - RNA, 20 nt, Artificial Sequence
  MKO10043940_A_Pxk
  gRNA
accgugaguucaucgcugag

SEQ ID NO: 43941 - RNA, 20 nt, Artificial Sequence
  MKO10043941_A_Pxk
  gRNA
cgacacggugccgcugacag

SEQ ID NO: 43942 - RNA, 20 nt, Artificial Sequence
  MKO10043942_A_Pxmp2
  gRNA
caucaacuaugugccccugc

SEQ ID NO: 43943 - RNA, 20 nt, Artificial Sequence
  MKO10043943_A_Pxmp2
  gRNA
ggaccgaguauuccaugaag

SEQ ID NO: 43944 - RNA, 20 nt, Artificial Sequence
  MKO10043944_A_Pxmp2
  gRNA
gcguccagguuguuugucac

SEQ ID NO: 43945 - RNA, 20 nt, Artificial Sequence
  MKO10043945_A_Pxmp4
  gRNA
ggccgccccaccgcagcuac

SEQ ID NO: 43946 - RNA, 20 nt, Artificial Sequence
  MKO10043946_A_Pxmp4
  gRNA
gcgccgcuaccacgcugcgc

SEQ ID NO: 43947 - RNA, 20 nt, Artificial Sequence
  MKO10043947_A_Pxmp4
  gRNA
caaggcguacaggacgcgug

SEQ ID NO: 43948 - RNA, 20 nt, Artificial Sequence
  MKO10043948_A_Pxn
  gRNA
gcacucaccgaggucgucca

SEQ ID NO: 43949 - RNA, 20 nt, Artificial Sequence
  MKO10043949_A_Pxn
  gRNA
ggaccagccauggacgaccu

SEQ ID NO: 43950 - RNA, 20 nt, Artificial Sequence
  MKO10043950_A_Pxn
  gRNA
gagguggcaccgcaaucucc

SEQ ID NO: 43951 - RNA, 20 nt, Artificial Sequence
  MKO10043951_A_Pxt1
  gRNA
accaugcagcuuagacacau

SEQ ID NO: 43952 - RNA, 20 nt, Artificial Sequence
  MKO10043952_A_Pxt1
  gRNA
cccaaugugucuaagcugca

SEQ ID NO: 43953 - RNA, 20 nt, Artificial Sequence
  MKO10043953_A_Pxt1
  gRNA
gcugguguucgugagaggcc

SEQ ID NO: 43954 - RNA, 20 nt, Artificial Sequence
  MKO10043954_A_Pycard
  gRNA
gcgggcacgagaugccaucc

SEQ ID NO: 43955 - RNA, 20 nt, Artificial Sequence
  MKO10043955_A_Pycard
  gRNA
cuaugggcgcaucccacgcg

SEQ ID NO: 43956 - RNA, 20 nt, Artificial Sequence
  MKO10043956_A_Pycard
  gRNA
uccacccucaggacacuuug

SEQ ID NO: 43957 - RNA, 20 nt, Artificial Sequence
  MKO10043957_A_Pycr1
  gRNA
agucauacaucggaugacuu

SEQ ID NO: 43958 - RNA, 20 nt, Artificial Sequence
  MKO10043958_A_Pycr1
  gRNA
acccccucccguaccacgac

SEQ ID NO: 43959 - RNA, 20 nt, Artificial Sequence
  MKO10043959_A_Pycr1
  gRNA
agacgccuggcaguccgccu

SEQ ID NO: 43960 - RNA, 20 nt, Artificial Sequence
  MKO10043960_A_Pycr2
  gRNA
ugagauuggagccgacgugc

SEQ ID NO: 43961 - RNA, 20 nt, Artificial Sequence
  MKO10043961_A_Pycr2
  gRNA
cagguccauauccggggagc

SEQ ID NO: 43962 - RNA, 20 nt, Artificial Sequence
  MKO10043962_A_Pycr2
  gRNA
cgggcguguuggucaugcag

SEQ ID NO: 43963 - RNA, 20 nt, Artificial Sequence
  MKO10043963_A_Pycrl
  gRNA
acucgcaauacucguguguu

SEQ ID NO: 43964 - RNA, 20 nt, Artificial Sequence
  MKO10043964_A_Pycrl
  gRNA
cuaugggggccacuuccgcc

SEQ ID NO: 43965 - RNA, 20 nt, Artificial Sequence
  MKO10043965_A_Pycrl
  gRNA
guggauaucuacguaggacu

SEQ ID NO: 43966 - RNA, 20 nt, Artificial Sequence
  MKO10043966_A_Pydc3
  gRNA
aaguguugagguugccugac

SEQ ID NO: 43967 - RNA, 20 nt, Artificial Sequence
  MKO10043967_A_Pydc3
  gRNA
cuuuguguucgggacaggcg

SEQ ID NO: 43968 - RNA, 20 nt, Artificial Sequence
  MKO10043968_A_Pydc3
  gRNA
uuguagucaccacacuucuc

SEQ ID NO: 43969 - RNA, 20 nt, Artificial Sequence
  MKO10043969_A_Pydc4
  gRNA
aagcaaauuguucuucucuc

SEQ ID NO: 43970 - RNA, 20 nt, Artificial Sequence
  MKO10043970_A_Pydc4
  gRNA
aauuaacauugcugacuuaa

SEQ ID NO: 43971 - RNA, 20 nt, Artificial Sequence
  MKO10043971_A_Pydc4
  gRNA
uccacuuaccuccagccuga

SEQ ID NO: 43972 - RNA, 20 nt, Artificial Sequence
  MKO10043972_A_Pygb
  gRNA
augcgacgaagccacuuauc

SEQ ID NO: 43973 - RNA, 20 nt, Artificial Sequence
  MKO10043973_A_Pygb
  gRNA
acggccggaguacaugcugc

SEQ ID NO: 43974 - RNA, 20 nt, Artificial Sequence
  MKO10043974_A_Pygb
  gRNA
ccgcacgcugcagaauacca

SEQ ID NO: 43975 - RNA, 20 nt, Artificial Sequence
  MKO10043975_A_Pygl
  gRNA
cgacccacuuuguccccguc

SEQ ID NO: 43976 - RNA, 20 nt, Artificial Sequence
  MKO10043976_A_Pygl
  gRNA
uacggcauucguuaugaaua

SEQ ID NO: 43977 - RNA, 20 nt, Artificial Sequence
  MKO10043977_A_Pygl
  gRNA
auaacgaaugccguagccau

SEQ ID NO: 43978 - RNA, 20 nt, Artificial Sequence
  MKO10043978_A_Pygm
  gRNA
uaugggauccgcuaugaguu

SEQ ID NO: 43979 - RNA, 20 nt, Artificial Sequence
  MKO10043979_A_Pygm
  gRNA
gaggaucuacuaccugucuu

SEQ ID NO: 43980 - RNA, 20 nt, Artificial Sequence
  MKO10043980_A_Pygm
  gRNA
ugccaaguggguggacacac

SEQ ID NO: 43981 - RNA, 20 nt, Artificial Sequence
  MKO10043981_A_Pygo1
  gRNA
ucgacguuacucugauugac

SEQ ID NO: 43982 - RNA, 20 nt, Artificial Sequence
  MKO10043982_A_Pygo1
  gRNA
uacuuaggcaucgccgccca

SEQ ID NO: 43983 - RNA, 20 nt, Artificial Sequence
  MKO10043983_A_Pygo1
  gRNA
aucgcgcugaagagaguuag

SEQ ID NO: 43984 - RNA, 20 nt, Artificial Sequence
  MKO10043984_A_Pygo2
  gRNA
augggaccaaauccgccuac

SEQ ID NO: 43985 - RNA, 20 nt, Artificial Sequence
  MKO10043985_A_Pygo2
  gRNA
acucgcggugaaaccacuuc

SEQ ID NO: 43986 - RNA, 20 nt, Artificial Sequence
  MKO10043986_A_Pygo2
  gRNA
gcgaagaaaguccaauacuc

SEQ ID NO: 43987 - RNA, 20 nt, Artificial Sequence
  MKO10043987_A_Pyhin1
  gRNA
aagaccguccagcaguauuc

SEQ ID NO: 43988 - RNA, 20 nt, Artificial Sequence
  MKO10043988_A_Pyhin1
  gRNA
accuuggcuauuguugcuag

SEQ ID NO: 43989 - RNA, 20 nt, Artificial Sequence
  MKO10043989_A_Pyhin1
  gRNA
ucugucacgucauaugaaaa

SEQ ID NO: 43990 - RNA, 20 nt, Artificial Sequence
  MKO10043990_A_Pyroxd1
  gRNA
uaagccaaaguuaaucuacg

SEQ ID NO: 43991 - RNA, 20 nt, Artificial Sequence
  MKO10043991_A_Pyroxd1
  gRNA
cgacuuuccagcauaguacc

SEQ ID NO: 43992 - RNA, 20 nt, Artificial Sequence
  MKO10043992_A_Pyroxd1
  gRNA
uuucccucguagauuaacuu

SEQ ID NO: 43993 - RNA, 20 nt, Artificial Sequence
  MKO10043993_A_Pyroxd2
  gRNA
ugaacaccgcggucuucgag

SEQ ID NO: 43994 - RNA, 20 nt, Artificial Sequence
  MKO10043994_A_Pyroxd2
  gRNA
cagcugcgcccccaaucaca

SEQ ID NO: 43995 - RNA, 20 nt, Artificial Sequence
  MKO10043995_A_Pyroxd2
  gRNA
cguugcaggacacaaugggc

SEQ ID NO: 43996 - RNA, 20 nt, Artificial Sequence
  MKO10043996_A_Pyurf
  gRNA
cgcgcacugucugcagucgc

SEQ ID NO: 43997 - RNA, 20 nt, Artificial Sequence
  MKO10043997_A_Pyurf
  gRNA
cggcgacugcagacagugcg

SEQ ID NO: 43998 - RNA, 20 nt, Artificial Sequence
  MKO10043998_A_Pyurf
  gRNA
ugaagcaucgacaaaugaau

SEQ ID NO: 43999 - RNA, 20 nt, Artificial Sequence
  MKO10043999_A_Pyy
  gRNA
uagcagcauugcgaccguga

SEQ ID NO: 44000 - RNA, 20 nt, Artificial Sequence
  MKO10044000_A_Pyy
  gRNA
ggcgcagggaggcguaguag

SEQ ID NO: 44001 - RNA, 20 nt, Artificial Sequence
  MKO10044001_A_Pyy
  gRNA
acagcgagaaccuccccuuc

SEQ ID NO: 44002 - RNA, 20 nt, Artificial Sequence
  MKO10044002_A_Pzp
  gRNA
uucuuuaugaagcgcugcgu

SEQ ID NO: 44003 - RNA, 20 nt, Artificial Sequence
  MKO10044003_A_Pzp
  gRNA
ccgcagacaauauguggugc

SEQ ID NO: 44004 - RNA, 20 nt, Artificial Sequence
  MKO10044004_A_Pzp
  gRNA
cuuaccucaauauaaacgac

SEQ ID NO: 44005 - RNA, 20 nt, Artificial Sequence
  MKO10044005_A_Qars
  gRNA
ggugagaacuacaagacgcc

SEQ ID NO: 44006 - RNA, 20 nt, Artificial Sequence
  MKO10044006_A_Qars
  gRNA
uucagcagauccaugguaua

SEQ ID NO: 44007 - RNA, 20 nt, Artificial Sequence
  MKO10044007_A_Qars
  gRNA
ugcucaggugcuucaccuuu

SEQ ID NO: 44008 - RNA, 20 nt, Artificial Sequence
  MKO10044008_A_Qdpr
  gRNA
uucccagggaugaucggcua

SEQ ID NO: 44009 - RNA, 20 nt, Artificial Sequence
  MKO10044009_A_Qdpr
  gRNA
guucuccaccacaucgaugc

SEQ ID NO: 44010 - RNA, 20 nt, Artificial Sequence
  MKO10044010_A_Qdpr
  gRNA
gagcugauggacggcucccu

SEQ ID NO: 44011 - RNA, 20 nt, Artificial Sequence
  MKO10044011_A_Qk
  gRNA
caaccaccucgagcggcugc

SEQ ID NO: 44012 - RNA, 20 nt, Artificial Sequence
  MKO10044012_A_Qk
  gRNA
cuucguccagcagccgcucg

SEQ ID NO: 44013 - RNA, 20 nt, Artificial Sequence
  MKO10044013_A_Qk
  gRNA
auguacaaugacacguuaaa

SEQ ID NO: 44014 - RNA, 20 nt, Artificial Sequence
  MKO10044014_A_Qpcul
  gRNA
gcacaaucaauaagggacgc

SEQ ID NO: 44015 - RNA, 20 nt, Artificial Sequence
  MKO10044015_A_Qpcul
  gRNA
uaccaaugcuccucagucgc

SEQ ID NO: 44016 - RNA, 20 nt, Artificial Sequence
  MKO10044016_A_Qpcul
  gRNA
ccaaccaaggucccgcugau

SEQ ID NO: 44017 - RNA, 20 nt, Artificial Sequence
  MKO10044017_A_Qpcu
  gRNA
agccauagggaguccuacuc

SEQ ID NO: 44018 - RNA, 20 nt, Artificial Sequence
  MKO10044018_A_Qpcu
  gRNA
auauuuggagucguaguggc

SEQ ID NO: 44019 - RNA, 20 nt, Artificial Sequence
  MKO10044019_A_Qpcu
  gRNA
uugcugauagaacgauaucc

SEQ ID NO: 44020 - RNA, 20 nt, Artificial Sequence
  MKO10044020_A_Qprt
  gRNA
acacauugacgucaucucgu

SEQ ID NO: 44021 - RNA, 20 nt, Artificial Sequence
  MKO10044021_A_Qprt
  gRNA
cuuuagaaccggcgagcgug

SEQ ID NO: 44022 - RNA, 20 nt, Artificial Sequence
  MKO10044022_A_Qprt
  gRNA
uaccgggucggcacccucgc

SEQ ID NO: 44023 - RNA, 20 nt, Artificial Sequence
  MKO10044023_A_Qrfpr
  gRNA
ugacuugcaucgcuguugag

SEQ ID NO: 44024 - RNA, 20 nt, Artificial Sequence
  MKO10044024_A_Qrfpr
  gRNA
gaggcguuguacgugccaca

SEQ ID NO: 44025 - RNA, 20 nt, Artificial Sequence
  MKO10044025_A_Qrfpr
  gRNA
ccgaagggcuuucacaaucu

SEQ ID NO: 44026 - RNA, 20 nt, Artificial Sequence
  MKO10044026_A_Qrfp
  gRNA
uccgaugucaccgaugucug

SEQ ID NO: 44027 - RNA, 20 nt, Artificial Sequence
  MKO10044027_A_Qrfp
  gRNA
gccgcuggccuucuccgagu

SEQ ID NO: 44028 - RNA, 20 nt, Artificial Sequence
  MKO10044028_A_Qrfp
  gRNA
ugagggacauccccccaacu

SEQ ID NO: 44029 - RNA, 20 nt, Artificial Sequence
  MKO10044029_A_Qrich1
  gRNA
gcgacaguugcuacgauuuc

SEQ ID NO: 44030 - RNA, 20 nt, Artificial Sequence
  MKO10044030_A_Qrich1
  gRNA
guacagucugagccguauuc

SEQ ID NO: 44031 - RNA, 20 nt, Artificial Sequence
  MKO10044031_A_Qrich1
  gRNA
acugacaugaaccgcauugu

SEQ ID NO: 44032 - RNA, 20 nt, Artificial Sequence
  MKO10044032_A_Qrich2
  gRNA
agguggccucggggucgauc

SEQ ID NO: 44033 - RNA, 20 nt, Artificial Sequence
  MKO10044033_A_Qrich2
  gRNA
gaaagccgacaagagcgcuc

SEQ ID NO: 44034 - RNA, 20 nt, Artificial Sequence
  MKO10044034_A_Qrich2
  gRNA
ccuguagcugcucguagcgc

SEQ ID NO: 44035 - RNA, 20 nt, Artificial Sequence
  MKO10044035_A_Qrsl1
  gRNA
uuacgcaaagcaggugaacg

SEQ ID NO: 44036 - RNA, 20 nt, Artificial Sequence
  MKO10044036_A_Qrsl1
  gRNA
uugggccaguuagaaacccc

SEQ ID NO: 44037 - RNA, 20 nt, Artificial Sequence
  MKO10044037_A_Qrsl1
  gRNA
aucagggugcccuacucaug

SEQ ID NO: 44038 - RNA, 20 nt, Artificial Sequence
  MKO10044038_A_Qser1
  gRNA
cuuugcccaucucgaauuuc

SEQ ID NO: 44039 - RNA, 20 nt, Artificial Sequence
  MKO10044039_A_Qser1
  gRNA
aggaagacuaucaaguucga

SEQ ID NO: 44040 - RNA, 20 nt, Artificial Sequence
  MKO10044040_A_Qser1
  gRNA
gaaaagagcccccagcuauu

SEQ ID NO: 44041 - RNA, 20 nt, Artificial Sequence
  MKO10044041_A_Qsox1
  gRNA
ugucgcuccagaaccguucu

SEQ ID NO: 44042 - RNA, 20 nt, Artificial Sequence
  MKO10044042_A_Qsox1
  gRNA
ugcagagaguucaacaucgc

SEQ ID NO: 44043 - RNA, 20 nt, Artificial Sequence
  MKO10044043_A_Qsox1
  gRNA
uggagucccaccgugacaca

SEQ ID NO: 44044 - RNA, 20 nt, Artificial Sequence
  MKO10044044_A_Qsox2
  gRNA
cuacucacugaauagggucc

SEQ ID NO: 44045 - RNA, 20 nt, Artificial Sequence
  MKO10044045_A_Qsox2
  gRNA
uucuuguguaggaccugaca

SEQ ID NO: 44046 - RNA, 20 nt, Artificial Sequence
  MKO10044046_A_Qsox2
  gRNA
gccacuguggcuauccauga

SEQ ID NO: 44047 - RNA, 20 nt, Artificial Sequence
  MKO10044047_A_Qtrt1
  gRNA
cacuuccgcucgcccuacga

SEQ ID NO: 44048 - RNA, 20 nt, Artificial Sequence
  MKO10044048_A_Qtrt1
  gRNA
gacgcccuccuccgucaccu

SEQ ID NO: 44049 - RNA, 20 nt, Artificial Sequence
  MKO10044049_A_Qtrt1
  gRNA
cgaugcaucuguccagccag

SEQ ID NO: 44050 - RNA, 20 nt, Artificial Sequence
  MKO10044050_A_Qtrtd1
  gRNA
augcacucuagcacuucguc

SEQ ID NO: 44051 - RNA, 20 nt, Artificial Sequence
  MKO10044051_A_Qtrtd1
  gRNA
ucccauaucaagugaccgag

SEQ ID NO: 44052 - RNA, 20 nt, Artificial Sequence
  MKO10044052_A_Qtrtd1
  gRNA
gagacagccaagcgacccgu

SEQ ID NO: 44053 - RNA, 20 nt, Artificial Sequence
  MKO10044053_A_R3hcc1l
  gRNA
uccugcagcucgcgaugccc

SEQ ID NO: 44054 - RNA, 20 nt, Artificial Sequence
  MKO10044054_A_R3hcc1l
  gRNA
aacugcagaaaauccgcaaa

SEQ ID NO: 44055 - RNA, 20 nt, Artificial Sequence
  MKO10044055_A_R3hcc1l
  gRNA
accagcacacgcucuagcuu

SEQ ID NO: 44056 - RNA, 20 nt, Artificial Sequence
  MKO10044056_A_R3hcc1
  gRNA
agaguuccugcgacuaucga

SEQ ID NO: 44057 - RNA, 20 nt, Artificial Sequence
  MKO10044057_A_R3hcc1
  gRNA
caagauccgcccgcucacac

SEQ ID NO: 44058 - RNA, 20 nt, Artificial Sequence
  MKO10044058_A_R3hcc1
  gRNA
ggagagggacuugacccacc

SEQ ID NO: 44059 - RNA, 20 nt, Artificial Sequence
  MKO10044059_A_R3hdm1
  gRNA
cagcggcccccgcagucauu

SEQ ID NO: 44060 - RNA, 20 nt, Artificial Sequence
  MKO10044060_A_R3hdm1
  gRNA
gcucaaaguuaaagcuaguu

SEQ ID NO: 44061 - RNA, 20 nt, Artificial Sequence
  MKO10044061_A_R3hdm1
  gRNA
cccugcagcagagauaucac

SEQ ID NO: 44062 - RNA, 20 nt, Artificial Sequence
  MKO10044062_A_R3hdm2
  gRNA
acugcgcaccaacuugaguu

SEQ ID NO: 44063 - RNA, 20 nt, Artificial Sequence
  MKO10044063_A_R3hdm2
  gRNA
ggaccuaccugggugucuag

SEQ ID NO: 44064 - RNA, 20 nt, Artificial Sequence
  MKO10044064_A_R3hdm2
  gRNA
ccaaggaagaugcuauccag

SEQ ID NO: 44065 - RNA, 20 nt, Artificial Sequence
  MKO10044065_A_R3hdm4
  gRNA
ugcgcuugagcacggaccgc

SEQ ID NO: 44066 - RNA, 20 nt, Artificial Sequence
  MKO10044066_A_R3hdm4
  gRNA
caagcgcagccgcaucccaa

SEQ ID NO: 44067 - RNA, 20 nt, Artificial Sequence
  MKO10044067_A_R3hdm4
  gRNA
agagcgagugcuccguuacu

SEQ ID NO: 44068 - RNA, 20 nt, Artificial Sequence
  MKO10044068_A_R3hdml
  gRNA
uaauggcguaguugcagacc

SEQ ID NO: 44069 - RNA, 20 nt, Artificial Sequence
  MKO10044069_A_R3hdml
  gRNA
gguucacucaccggccggaa

SEQ ID NO: 44070 - RNA, 20 nt, Artificial Sequence
  MKO10044070_A_R3hdml
  gRNA
gaagcgccauuacucauucc

SEQ ID NO: 44071 - RNA, 20 nt, Artificial Sequence
  MKO10044071_A_Rab10
  gRNA
ugauggugugaaaucgcucc

SEQ ID NO: 44072 - RNA, 20 nt, Artificial Sequence
  MKO10044072_A_Rab10
  gRNA
gacaagagaguuguaccgaa

SEQ ID NO: 44073 - RNA, 20 nt, Artificial Sequence
  MKO10044073_A_Rab10
  gRNA
agcugaagacauccuccgaa

SEQ ID NO: 44074 - RNA, 20 nt, Artificial Sequence
  MKO10044074_A_Rab11a
  gRNA
cauuucgaguaaaucgagac

SEQ ID NO: 44075 - RNA, 20 nt, Artificial Sequence
  MKO10044075_A_Rab11a
  gRNA
uucuguugcagauacuaucg

SEQ ID NO: 44076 - RNA, 20 nt, Artificial Sequence
  MKO10044076_A_Rab11a
  gRNA
uacucgaaaugaguuuaauc

SEQ ID NO: 44077 - RNA, 20 nt, Artificial Sequence
  MKO10044077_A_Rab11b
  gRNA
uuacucugcagguacuaccg

SEQ ID NO: 44078 - RNA, 20 nt, Artificial Sequence
  MKO10044078_A_Rab11b
  gRNA
ugcccgcaaguggugcuuau

SEQ ID NO: 44079 - RNA, 20 nt, Artificial Sequence
  MKO10044079_A_Rab11b
  gRNA
gaugaggcccgugccuuugc

SEQ ID NO: 44080 - RNA, 20 nt, Artificial Sequence
  MKO10044080_A_Rab11fip1
  gRNA
uaucgagaccgagcaacgcg

SEQ ID NO: 44081 - RNA, 20 nt, Artificial Sequence
  MKO10044081_A_Rab11fip1
  gRNA
cgguuccgaccuggacuccg

SEQ ID NO: 44082 - RNA, 20 nt, Artificial Sequence
  MKO10044082_A_Rab11fip1
  gRNA
cgcucuaccgucuguaucaa

SEQ ID NO: 44083 - RNA, 20 nt, Artificial Sequence
  MKO10044083_A_Rab11fip2
  gRNA
auggcucguagggcacucgc

SEQ ID NO: 44084 - RNA, 20 nt, Artificial Sequence
  MKO10044084_A_Rab11fip2
  gRNA
ccggagucugaccuacgaag

SEQ ID NO: 44085 - RNA, 20 nt, Artificial Sequence
  MKO10044085_A_Rab11fip2
  gRNA
aagcuuaguguucgucugug

SEQ ID NO: 44086 - RNA, 20 nt, Artificial Sequence
  MKO10044086_A_Rab11fip3
  gRNA
guauagguaucugcaccagu

SEQ ID NO: 44087 - RNA, 20 nt, Artificial Sequence
  MKO10044087_A_Rab11fip3
  gRNA
ccucugcgauggggacggcg

SEQ ID NO: 44088 - RNA, 20 nt, Artificial Sequence
  MKO10044088_A_Rab11fip3
  gRNA
caaugaggcagaacuauccc

SEQ ID NO: 44089 - RNA, 20 nt, Artificial Sequence
  MKO10044089_A_Rab11fip4
  gRNA
cgcggaguauucgccaugaa

SEQ ID NO: 44090 - RNA, 20 nt, Artificial Sequence
  MKO10044090_A_Rab11fip4
  gRNA
cuuucauggcgaauacuccg

SEQ ID NO: 44091 - RNA, 20 nt, Artificial Sequence
  MKO10044091_A_Rab11fip4
  gRNA
cuggucucaucgucggggca

SEQ ID NO: 44092 - RNA, 20 nt, Artificial Sequence
  MKO10044092_A_Rab11fip5
  gRNA
acuugcguagcuuguuucgg

SEQ ID NO: 44093 - RNA, 20 nt, Artificial Sequence
  MKO10044093_A_Rab11fip5
  gRNA
gaucaaacaugcuggcgcuc

SEQ ID NO: 44094 - RNA, 20 nt, Artificial Sequence
  MKO10044094_A_Rab11fip5
  gRNA
ggagggggcccgguuacccg

SEQ ID NO: 44095 - RNA, 20 nt, Artificial Sequence
  MKO10044095_A_Rab12
  gRNA
gucaucgaacgucuccuucu

SEQ ID NO: 44096 - RNA, 20 nt, Artificial Sequence
  MKO10044096_A_Rab12
  gRNA
cguucgaugacuugccaaag

SEQ ID NO: 44097 - RNA, 20 nt, Artificial Sequence
  MKO10044097_A_Rab12
  gRNA
ggcuucgcagaagcgcaucc

SEQ ID NO: 44098 - RNA, 20 nt, Artificial Sequence
  MKO10044098_A_Rab13
  gRNA
ugauuucaagauccgaaccg

SEQ ID NO: 44099 - RNA, 20 nt, Artificial Sequence
  MKO10044099_A_Rab13
  gRNA
auaacuaccgccuauuaccg

SEQ ID NO: 44100 - RNA, 20 nt, Artificial Sequence
  MKO10044100_A_Rab13
  gRNA
uuauugucuugaaucguucu

SEQ ID NO: 44101 - RNA, 20 nt, Artificial Sequence
  MKO10044101_A_Rab14
  gRNA
cauauaaccacuuaagcagc

SEQ ID NO: 44102 - RNA, 20 nt, Artificial Sequence
  MKO10044102_A_Rab14
  gRNA
cugucaaccagcugcuuaag

SEQ ID NO: 44103 - RNA, 20 nt, Artificial Sequence
  MKO10044103_A_Rab14
  gRNA
gcugauuguccucacacaau

SEQ ID NO: 44104 - RNA, 20 nt, Artificial Sequence
  MKO10044104_A_Rab15
  gRNA
ugucccuaguacgcuccaga

SEQ ID NO: 44105 - RNA, 20 nt, Artificial Sequence
  MKO10044105_A_Rab15
  gRNA
ccacuucaugauaugcugau

SEQ ID NO: 44106 - RNA, 20 nt, Artificial Sequence
  MKO10044106_A_Rab15
  gRNA
cuaucacaaagcaguacuau

SEQ ID NO: 44107 - RNA, 20 nt, Artificial Sequence
  MKO10044107_A_Rab17
  gRNA
gaugcuggucggcaacaaaa

SEQ ID NO: 44108 - RNA, 20 nt, Artificial Sequence
  MKO10044108_A_Rab17
  gRNA
agacgcuuugguacuucucc

SEQ ID NO: 44109 - RNA, 20 nt, Artificial Sequence
  MKO10044109_A_Rab17
  gRNA
gcggcuaucgugcacagcac

SEQ ID NO: 44110 - RNA, 20 nt, Artificial Sequence
  MKO10044110_A_Rab18
  gRNA
ccuauuguugcugcaaguuc

SEQ ID NO: 44111 - RNA, 20 nt, Artificial Sequence
  MKO10044111_A_Rab18
  gRNA
cugugcaccucuauaauagc

SEQ ID NO: 44112 - RNA, 20 nt, Artificial Sequence
  MKO10044112_A_Rab18
  gRNA
ccagaacuugcagcaacaau

SEQ ID NO: 44113 - RNA, 20 nt, Artificial Sequence
  MKO10044113_A_Rab19
  gRNA
cauaagcgaugauagcugcg

SEQ ID NO: 44114 - RNA, 20 nt, Artificial Sequence
  MKO10044114_A_Rab19
  gRNA
gugcgcucccucgagauaga

SEQ ID NO: 44115 - RNA, 20 nt, Artificial Sequence
  MKO10044115_A_Rab19
  gRNA
cuuucuugccgucuaucucg

SEQ ID NO: 44116 - RNA, 20 nt, Artificial Sequence
  MKO10044116_A_Rab1b
  gRNA
ccuacgccaacgugaaacag

SEQ ID NO: 44117 - RNA, 20 nt, Artificial Sequence
  MKO10044117_A_Rab1b
  gRNA
augagccccgcgauaguagc

SEQ ID NO: 44118 - RNA, 20 nt, Artificial Sequence
  MKO10044118_A_Rab1b
  gRNA
cguggacaacaccacggcca

SEQ ID NO: 44119 - RNA, 20 nt, Artificial Sequence
  MKO10044119_A_Rab1
  gRNA
ccacuguuuaacguuauuga

SEQ ID NO: 44120 - RNA, 20 nt, Artificial Sequence
  MKO10044120_A_Rab1
  gRNA
cccucaggaugauacguaua

SEQ ID NO: 44121 - RNA, 20 nt, Artificial Sequence
  MKO10044121_A_Rab1
  gRNA
ccuucaauaacguuaaacag

SEQ ID NO: 44122 - RNA, 20 nt, Artificial Sequence
  MKO10044122_A_Rab20
  gRNA
uaccuaugaucaugcggcag

SEQ ID NO: 44123 - RNA, 20 nt, Artificial Sequence
  MKO10044123_A_Rab20
  gRNA
cuccgcggcuaugcggaagc

SEQ ID NO: 44124 - RNA, 20 nt, Artificial Sequence
  MKO10044124_A_Rab20
  gRNA
cccacggugcugaccguguc

SEQ ID NO: 44125 - RNA, 20 nt, Artificial Sequence
  MKO10044125_A_Rab21
  gRNA
aguaaauugggcccagugcg

SEQ ID NO: 44126 - RNA, 20 nt, Artificial Sequence
  MKO10044126_A_Rab21
  gRNA
auuuacuaccgagauucgaa

SEQ ID NO: 44127 - RNA, 20 nt, Artificial Sequence
  MKO10044127_A_Rab21
  gRNA
aaagaguaaaccuugccaua

SEQ ID NO: 44128 - RNA, 20 nt, Artificial Sequence
  MKO10044128_A_Rab22a
  gRNA
agcauugucguugccaucgc

SEQ ID NO: 44129 - RNA, 20 nt, Artificial Sequence
  MKO10044129_A_Rab22a
  gRNA
ugugaugucguaaacgauga

SEQ ID NO: 44130 - RNA, 20 nt, Artificial Sequence
  MKO10044130_A_Rab22a
  gRNA
ccgaauaucaauccaaccau

SEQ ID NO: 44131 - RNA, 20 nt, Artificial Sequence
  MKO10044131_A_Rab23
  gRNA
cuaccggacguccgugaagg

SEQ ID NO: 44132 - RNA, 20 nt, Artificial Sequence
  MKO10044132_A_Rab23
  gRNA
aaacauuucaccucgauagu

SEQ ID NO: 44133 - RNA, 20 nt, Artificial Sequence
  MKO10044133_A_Rab23
  gRNA
ggaguuugaugcaaucacga

SEQ ID NO: 44134 - RNA, 20 nt, Artificial Sequence
  MKO10044134_A_Rab24
  gRNA
gaccaucggggcugcuuucg

SEQ ID NO: 44135 - RNA, 20 nt, Artificial Sequence
  MKO10044135_A_Rab24
  gRNA
gcucauggcuucguagcgcu

SEQ ID NO: 44136 - RNA, 20 nt, Artificial Sequence
  MKO10044136_A_Rab24
  gRNA
ggccacgaaagcagccccga

SEQ ID NO: 44137 - RNA, 20 nt, Artificial Sequence
  MKO10044137_A_Rab25
  gRNA
cgaugguggugcgacugucg

SEQ ID NO: 44138 - RNA, 20 nt, Artificial Sequence
  MKO10044138_A_Rab25
  gRNA
accccauacagguacuaucg

SEQ ID NO: 44139 - RNA, 20 nt, Artificial Sequence
  MKO10044139_A_Rab25
  gRNA
cacgagcaugacaacaaucg

SEQ ID NO: 44140 - RNA, 20 nt, Artificial Sequence
  MKO10044140_A_Rab26
  gRNA
acugaccugaauguugucga

SEQ ID NO: 44141 - RNA, 20 nt, Artificial Sequence
  MKO10044141_A_Rab26
  gRNA
cauccuugaagcgcacaagc

SEQ ID NO: 44142 - RNA, 20 nt, Artificial Sequence
  MKO10044142_A_Rab26
  gRNA
cugccugcuugugcgcuuca

SEQ ID NO: 44143 - RNA, 20 nt, Artificial Sequence
  MKO10044143_A_Rab27a
  gRNA
ccaggagcaucucaaucgcg

SEQ ID NO: 44144 - RNA, 20 nt, Artificial Sequence
  MKO10044144_A_Rab27a
  gRNA
aguacgcgugcaucuguagc

SEQ ID NO: 44145 - RNA, 20 nt, Artificial Sequence
  MKO10044145_A_Rab27a
  gRNA
uuggaccguaccacucccuc

SEQ ID NO: 44146 - RNA, 20 nt, Artificial Sequence
  MKO10044146_A_Rab27b
  gRNA
gcugcgcuuguuucgaagua

SEQ ID NO: 44147 - RNA, 20 nt, Artificial Sequence
  MKO10044147_A_Rab27b
  gRNA
uucgaaacaagcgcagcuac

SEQ ID NO: 44148 - RNA, 20 nt, Artificial Sequence
  MKO10044148_A_Rab27b
  gRNA
agcgucaggaaaagcguuua

SEQ ID NO: 44149 - RNA, 20 nt, Artificial Sequence
  MKO10044149_A_Rab28
  gRNA
uugagcaaaacacguagcua

SEQ ID NO: 44150 - RNA, 20 nt, Artificial Sequence
  MKO10044150_A_Rab28
  gRNA
uauugcccacuaaagcaacc

SEQ ID NO: 44151 - RNA, 20 nt, Artificial Sequence
  MKO10044151_A_Rab28
  gRNA
aagcaguacaagcagacgau

SEQ ID NO: 44152 - RNA, 20 nt, Artificial Sequence
  MKO10044152_A_Rab2a
  gRNA
gcucggaugauaacgauuga

SEQ ID NO: 44153 - RNA, 20 nt, Artificial Sequence
  MKO10044153_A_Rab2a
  gRNA
ugaccgugugauagaacgaa

SEQ ID NO: 44154 - RNA, 20 nt, Artificial Sequence
  MKO10044154_A_Rab2a
  gRNA
cacuuacuguaucccagauc

SEQ ID NO: 44155 - RNA, 20 nt, Artificial Sequence
  MKO10044155_A_Rab2b
  gRNA
accgcuugucgguaaacuga

SEQ ID NO: 44156 - RNA, 20 nt, Artificial Sequence
  MKO10044156_A_Rab2b
  gRNA
gcgggcguccucuaaccaug

SEQ ID NO: 44157 - RNA, 20 nt, Artificial Sequence
  MKO10044157_A_Rab2b
  gRNA
uaaugcugaucgggaauaag

SEQ ID NO: 44158 - RNA, 20 nt, Artificial Sequence
  MKO10044158_A_Rab30
  gRNA
ccuaguccgaagauucacuc

SEQ ID NO: 44159 - RNA, 20 nt, Artificial Sequence
  MKO10044159_A_Rab30
  gRNA
ucgauaguaacuuugaguga

SEQ ID NO: 44160 - RNA, 20 nt, Artificial Sequence
  MKO10044160_A_Rab30
  gRNA
gcagcggaaggauuccucac

SEQ ID NO: 44161 - RNA, 20 nt, Artificial Sequence
  MKO10044161_A_Rab31
  gRNA
gcuguacuuacccaauagug

SEQ ID NO: 44162 - RNA, 20 nt, Artificial Sequence
  MKO10044162_A_Rab31
  gRNA
aacauugugauggcgauugc

SEQ ID NO: 44163 - RNA, 20 nt, Artificial Sequence
  MKO10044163_A_Rab31
  gRNA
gcagauccucgguaguacau

SEQ ID NO: 44164 - RNA, 20 nt, Artificial Sequence
  MKO10044164_A_Rab32
  gRNA
ggauaauauaaacaucgacg

SEQ ID NO: 44165 - RNA, 20 nt, Artificial Sequence
  MKO10044165_A_Rab32
  gRNA
cucucgggucuccggcgccg

SEQ ID NO: 44166 - RNA, 20 nt, Artificial Sequence
  MKO10044166_A_Rab32
  gRNA
ucgcccucaaaguucucaac

SEQ ID NO: 44167 - RNA, 20 nt, Artificial Sequence
  MKO10044167_A_Rab33a
  gRNA
cuaccgcaacgugcaugccg

SEQ ID NO: 44168 - RNA, 20 nt, Artificial Sequence
  MKO10044168_A_Rab33a
  gRNA
ccugaaguccacaccgauag

SEQ ID NO: 44169 - RNA, 20 nt, Artificial Sequence
  MKO10044169_A_Rab33a
  gRNA
gugccuggcuugccgacuua

SEQ ID NO: 44170 - RNA, 20 nt, Artificial Sequence
  MKO10044170_A_Rab33b
  gRNA
ccgcuuccccgaccgcaccg

SEQ ID NO: 44171 - RNA, 20 nt, Artificial Sequence
  MKO10044171_A_Rab33b
  gRNA
cgggaggaugacuucggaga

SEQ ID NO: 44172 - RNA, 20 nt, Artificial Sequence
  MKO10044172_A_Rab33b
  gRNA
ugacuugagaagcgccauuc

SEQ ID NO: 44173 - RNA, 20 nt, Artificial Sequence
  MKO10044173_A_Rab34
  gRNA
ccgcgucacuugcgccugcc

SEQ ID NO: 44174 - RNA, 20 nt, Artificial Sequence
  MKO10044174_A_Rab34
  gRNA
auugcuuccaccuacuaccg

SEQ ID NO: 44175 - RNA, 20 nt, Artificial Sequence
  MKO10044175_A_Rab34
  gRNA
gucuuugcgcacgugcaaag

SEQ ID NO: 44176 - RNA, 20 nt, Artificial Sequence
  MKO10044176_A_Rab35
  gRNA
ccaucgcuugacguugacaa

SEQ ID NO: 44177 - RNA, 20 nt, Artificial Sequence
  MKO10044177_A_Rab35
  gRNA
gacgaugugugccgaauauu

SEQ ID NO: 44178 - RNA, 20 nt, Artificial Sequence
  MKO10044178_A_Rab35
  gRNA
cuugaaauccacuccgauug

SEQ ID NO: 44179 - RNA, 20 nt, Artificial Sequence
  MKO10044179_A_Rab36
  gRNA
ggucguuggcgaucucuacg

SEQ ID NO: 44180 - RNA, 20 nt, Artificial Sequence
  MKO10044180_A_Rab36
  gRNA
uucaaaguccacgccgaucg

SEQ ID NO: 44181 - RNA, 20 nt, Artificial Sequence
  MKO10044181_A_Rab36
  gRNA
aucgccaacgaccaccaccu

SEQ ID NO: 44182 - RNA, 20 nt, Artificial Sequence
  MKO10044182_A_Rab37
  gRNA
ugcuuauuaccgagaugcuc

SEQ ID NO: 44183 - RNA, 20 nt, Artificial Sequence
  MKO10044183_A_Rab37
  gRNA
gcauaaucaccacgucucuc

SEQ ID NO: 44184 - RNA, 20 nt, Artificial Sequence
  MKO10044184_A_Rab37
  gRNA
ugaguaugcccagagagacg

SEQ ID NO: 44185 - RNA, 20 nt, Artificial Sequence
  MKO10044185_A_Rab38
  gRNA
aaaacuucuccucgcacuac

SEQ ID NO: 44186 - RNA, 20 nt, Artificial Sequence
  MKO10044186_A_Rab38
  gRNA
ugcaagcgcaccaccgucuc

SEQ ID NO: 44187 - RNA, 20 nt, Artificial Sequence
  MKO10044187_A_Rab38
  gRNA
gccccaucucacaucgccca

SEQ ID NO: 44188 - RNA, 20 nt, Artificial Sequence
  MKO10044188_A_Rab39b
  gRNA
gaaaaaaucuacccccacgg

SEQ ID NO: 44189 - RNA, 20 nt, Artificial Sequence
  MKO10044189_A_Rab39b
  gRNA
ccaucacucgcgccuacuac

SEQ ID NO: 44190 - RNA, 20 nt, Artificial Sequence
  MKO10044190_A_Rab39b
  gRNA
ccucggugaagcggcggauc

SEQ ID NO: 44191 - RNA, 20 nt, Artificial Sequence
  MKO10044191_A_Rab39
  gRNA
uucaacguuugucgcguccu

SEQ ID NO: 44192 - RNA, 20 nt, Artificial Sequence
  MKO10044192_A_Rab39
  gRNA
ggacuucuucucgcgccugc

SEQ ID NO: 44193 - RNA, 20 nt, Artificial Sequence
  MKO10044193_A_Rab39
  gRNA
gaagaaguccacgccgacug

SEQ ID NO: 44194 - RNA, 20 nt, Artificial Sequence
  MKO10044194_A_Rab3a
  gRNA
ccaucuaccgcaacgacaag

SEQ ID NO: 44195 - RNA, 20 nt, Artificial Sequence
  MKO10044195_A_Rab3a
  gRNA
ugcuuggcaccggugaccgc

SEQ ID NO: 44196 - RNA, 20 nt, Artificial Sequence
  MKO10044196_A_Rab3a
  gRNA
caagcagacguuugaacguc

SEQ ID NO: 44197 - RNA, 20 nt, Artificial Sequence
  MKO10044197_A_Rab3b
  gRNA
uaggcgccuccaagacgacg

SEQ ID NO: 44198 - RNA, 20 nt, Artificial Sequence
  MKO10044198_A_Rab3b
  gRNA
gucugagagccgcgucgucu

SEQ ID NO: 44199 - RNA, 20 nt, Artificial Sequence
  MKO10044199_A_Rab3b
  gRNA
gcagcuucacacgcuucuca

SEQ ID NO: 44200 - RNA, 20 nt, Artificial Sequence
  MKO10044200_A_Rab3c
  gRNA
aaucgucggcauaacggaac

SEQ ID NO: 44201 - RNA, 20 nt, Artificial Sequence
  MKO10044201_A_Rab3c
  gRNA
ccaaucuuguacagcguuga

SEQ ID NO: 44202 - RNA, 20 nt, Artificial Sequence
  MKO10044202_A_Rab3c
  gRNA
cgagcuguucuccuaagcgc

SEQ ID NO: 44203 - RNA, 20 nt, Artificial Sequence
  MKO10044203_A_Rab3d
  gRNA
acccauagcuccgcgauagu

SEQ ID NO: 44204 - RNA, 20 nt, Artificial Sequence
  MKO10044204_A_Rab3d
  gRNA
caaugcccagguaauccucg

SEQ ID NO: 44205 - RNA, 20 nt, Artificial Sequence
  MKO10044205_A_Rab3d
  gRNA
ugauuguccgguagcgcucc

SEQ ID NO: 44206 - RNA, 20 nt, Artificial Sequence
  MKO10044206_A_Rab3gap1
  gRNA
aggauacguaccaucuuacc

SEQ ID NO: 44207 - RNA, 20 nt, Artificial Sequence
  MKO10044207_A_Rab3gap1
  gRNA
aaacugauuggacccucucu

SEQ ID NO: 44208 - RNA, 20 nt, Artificial Sequence
  MKO10044208_A_Rab3gap1
  gRNA
uacucaccucucccacuccg

SEQ ID NO: 44209 - RNA, 20 nt, Artificial Sequence
  MKO10044209_A_Rab3gap2
  gRNA
gcucccgagcuauaaccaua

SEQ ID NO: 44210 - RNA, 20 nt, Artificial Sequence
  MKO10044210_A_Rab3gap2
  gRNA
uaaacacucacagguucucg

SEQ ID NO: 44211 - RNA, 20 nt, Artificial Sequence
  MKO10044211_A_Rab3gap2
  gRNA
uaccucuucugacucgccag

SEQ ID NO: 44212 - RNA, 20 nt, Artificial Sequence
  MKO10044212_A_Rab3il1
  gRNA
gggacagaucgacaugcuac

SEQ ID NO: 44213 - RNA, 20 nt, Artificial Sequence
  MKO10044213_A_Rab3il1
  gRNA
uuugacgugaguggcccuuu

SEQ ID NO: 44214 - RNA, 20 nt, Artificial Sequence
  MKO10044214_A_Rab3il1
  gRNA
acgccugcgcaguuccucca

SEQ ID NO: 44215 - RNA, 20 nt, Artificial Sequence
  MKO10044215_A_Rab3ip
  gRNA
uucuccaacaucgccuacgc

SEQ ID NO: 44216 - RNA, 20 nt, Artificial Sequence
  MKO10044216_A_Rab3ip
  gRNA
gcagggcgccaccaucaccg

SEQ ID NO: 44217 - RNA, 20 nt, Artificial Sequence
  MKO10044217_A_Rab3ip
  gRNA
uuagagagaagggcuacgaa

SEQ ID NO: 44218 - RNA, 20 nt, Artificial Sequence
  MKO10044218_A_Rab40b
  gRNA
aggaucgugcugcugcggca

SEQ ID NO: 44219 - RNA, 20 nt, Artificial Sequence
  MKO10044219_A_Rab40b
  gRNA
ucuaugacauugccaaccga

SEQ ID NO: 44220 - RNA, 20 nt, Artificial Sequence
  MKO10044220_A_Rab40b
  gRNA
auauuccgcucauacuccag

SEQ ID NO: 44221 - RNA, 20 nt, Artificial Sequence
  MKO10044221_A_Rab40c
  gRNA
caugccgcaugagcacgaua

SEQ ID NO: 44222 - RNA, 20 nt, Artificial Sequence
  MKO10044222_A_Rab40c
  gRNA
gcuugacacgccguccaucc

SEQ ID NO: 44223 - RNA, 20 nt, Artificial Sequence
  MKO10044223_A_Rab40c
  gRNA
aagaucuggagacccaaucg

SEQ ID NO: 44224 - RNA, 20 nt, Artificial Sequence
  MKO10044224_A_Rab42
  gRNA
cgagcagcgcgauccgaaau

SEQ ID NO: 44225 - RNA, 20 nt, Artificial Sequence
  MKO10044225_A_Rab42
  gRNA
caauuucggaucgcgcugcu

SEQ ID NO: 44226 - RNA, 20 nt, Artificial Sequence
  MKO10044226_A_Rab42
  gRNA
aagcaacugcaaugucgacc

SEQ ID NO: 44227 - RNA, 20 nt, Artificial Sequence
  MKO10044227_A_Rab43
  gRNA
guuagugggcgacgcgagcg

SEQ ID NO: 44228 - RNA, 20 nt, Artificial Sequence
  MKO10044228_A_Rab43
  gRNA
ucuugcugaugucguacgca

SEQ ID NO: 44229 - RNA, 20 nt, Artificial Sequence
  MKO10044229_A_Rab43
  gRNA
cauggugaagucgacaccga

SEQ ID NO: 44230 - RNA, 20 nt, Artificial Sequence
  MKO10044230_A_Rab44
  gRNA
agucgagccaguaacgcacg

SEQ ID NO: 44231 - RNA, 20 nt, Artificial Sequence
  MKO10044231_A_Rab44
  gRNA
gcuucacccacgugcguuac

SEQ ID NO: 44232 - RNA, 20 nt, Artificial Sequence
  MKO10044232_A_Rab44
  gRNA
gagccucuuggacccggguc

SEQ ID NO: 44233 - RNA, 20 nt, Artificial Sequence
  MKO10044233_A_Rab4a
  gRNA
gccauucucuugugcgaacc

SEQ ID NO: 44234 - RNA, 20 nt, Artificial Sequence
  MKO10044234_A_Rab4a
  gRNA
ccuacaaugcgcuuacuaau

SEQ ID NO: 44235 - RNA, 20 nt, Artificial Sequence
  MKO10044235_A_Rab4a
  gRNA
aaagcuaccugaaccgcucc

SEQ ID NO: 44236 - RNA, 20 nt, Artificial Sequence
  MKO10044236_A_Rab4b
  gRNA
caaacuccacgccgauagug

SEQ ID NO: 44237 - RNA, 20 nt, Artificial Sequence
  MKO10044237_A_Rab4b
  gRNA
cuaccuaccgaaaccgcucc

SEQ ID NO: 44238 - RNA, 20 nt, Artificial Sequence
  MKO10044238_A_Rab4b
  gRNA
ggccucacaggucggugacg

SEQ ID NO: 44239 - RNA, 20 nt, Artificial Sequence
  MKO10044239_A_Rab5a
  gRNA
uuagcaccaauguacuaccg

SEQ ID NO: 44240 - RNA, 20 nt, Artificial Sequence
  MKO10044240_A_Rab5a
  gRNA
ugugcuccucgguaguacau

SEQ ID NO: 44241 - RNA, 20 nt, Artificial Sequence
  MKO10044241_A_Rab5a
  gRNA
aauauugugauagcuuuguc

SEQ ID NO: 44242 - RNA, 20 nt, Artificial Sequence
  MKO10044242_A_Rab5b
  gRNA
uuucccaggaaacguuugcu

SEQ ID NO: 44243 - RNA, 20 nt, Artificial Sequence
  MKO10044243_A_Rab5b
  gRNA
gaagauccacaccccgacuu

SEQ ID NO: 44244 - RNA, 20 nt, Artificial Sequence
  MKO10044244_A_Rab5b
  gRNA
aaagagcgaaccccagaauc

SEQ ID NO: 44245 - RNA, 20 nt, Artificial Sequence
  MKO10044245_A_Rab5c
  gRNA
cgcuagugcaaugacgaugu

SEQ ID NO: 44246 - RNA, 20 nt, Artificial Sequence
  MKO10044246_A_Rab5c
  gRNA
ugggccccccgauaguacau

SEQ ID NO: 44247 - RNA, 20 nt, Artificial Sequence
  MKO10044247_A_Rab5c
  gRNA
caacaucgucauugcacuag

SEQ ID NO: 44248 - RNA, 20 nt, Artificial Sequence
  MKO10044248_A_Rab6a
  gRNA
auucccgaagucuccgcccg

SEQ ID NO: 44249 - RNA, 20 nt, Artificial Sequence
  MKO10044249_A_Rab6a
  gRNA
ggcuccaucauguccgcggg

SEQ ID NO: 44250 - RNA, 20 nt, Artificial Sequence
  MKO10044250_A_Rab6a
  gRNA
caaaacugucauacaugaau

SEQ ID NO: 44251 - RNA, 20 nt, Artificial Sequence
  MKO10044251_A_Rab6b
  gRNA
uguagguucgacugcagcuc

SEQ ID NO: 44252 - RNA, 20 nt, Artificial Sequence
  MKO10044252_A_Rab6b
  gRNA
cagcuucgacaacaccuacc

SEQ ID NO: 44253 - RNA, 20 nt, Artificial Sequence
  MKO10044253_A_Rab6b
  gRNA
ggaagacgucucugaucacg

SEQ ID NO: 44254 - RNA, 20 nt, Artificial Sequence
  MKO10044254_A_Rab7l1
  gRNA
ucuauaguagagucguguca

SEQ ID NO: 44255 - RNA, 20 nt, Artificial Sequence
  MKO10044255_A_Rab7l1
  gRNA
acaccuuguuggccaagagc

SEQ ID NO: 44256 - RNA, 20 nt, Artificial Sequence
  MKO10044256_A_Rab7l1
  gRNA
uggucccggcucacugccca

SEQ ID NO: 44257 - RNA, 20 nt, Artificial Sequence
  MKO10044257_A_Rab7
  gRNA
ucccauagguggccacaaag

SEQ ID NO: 44258 - RNA, 20 nt, Artificial Sequence
  MKO10044258_A_Rab7
  gRNA
cgacagacuuguuaccaugc

SEQ ID NO: 44259 - RNA, 20 nt, Artificial Sequence
  MKO10044259_A_Rab7
  gRNA
agacuggaaccguucuugac

SEQ ID NO: 44260 - RNA, 20 nt, Artificial Sequence
  MKO10044260_A_Rab8a
  gRNA
ccccaaccaggguaucaugc

SEQ ID NO: 44261 - RNA, 20 nt, Artificial Sequence
  MKO10044261_A_Rab8a
  gRNA
caaucacgacagccuacuac

SEQ ID NO: 44262 - RNA, 20 nt, Artificial Sequence
  MKO10044262_A_Rab8a
  gRNA
ugauuguucgaaaccgcucc

SEQ ID NO: 44263 - RNA, 20 nt, Artificial Sequence
  MKO10044263_A_Rab8b
  gRNA
ccucccacagggaauuaugc

SEQ ID NO: 44264 - RNA, 20 nt, Artificial Sequence
  MKO10044264_A_Rab8b
  gRNA
agacaagugucgaaagagag

SEQ ID NO: 44265 - RNA, 20 nt, Artificial Sequence
  MKO10044265_A_Rab8b
  gRNA
aucagaacgauagaacucga

SEQ ID NO: 44266 - RNA, 20 nt, Artificial Sequence
  MKO10044266_A_Rab9b
  gRNA
uaggcaaguaacgacugagg

SEQ ID NO: 44267 - RNA, 20 nt, Artificial Sequence
  MKO10044267_A_Rab9b
  gRNA
ccccuaucgugugaaaagcc

SEQ ID NO: 44268 - RNA, 20 nt, Artificial Sequence
  MKO10044268_A_Rab9b
  gRNA
agaguucuuaaaucgagauc

SEQ ID NO: 44269 - RNA, 20 nt, Artificial Sequence
  MKO10044269_A_Rab9
  gRNA
ucaggcuucggaagcguucu

SEQ ID NO: 44270 - RNA, 20 nt, Artificial Sequence
  MKO10044270_A_Rab9
  gRNA
aagaacgcuuccgaagccug

SEQ ID NO: 44271 - RNA, 20 nt, Artificial Sequence
  MKO10044271_A_Rab9
  gRNA
aguucgaagaauucuggcca

SEQ ID NO: 44272 - RNA, 20 nt, Artificial Sequence
  MKO10044272_A_Rabac1
  gRNA
ccagcgccugguacgcaacg

SEQ ID NO: 44273 - RNA, 20 nt, Artificial Sequence
  MKO10044273_A_Rabac1
  gRNA
gccgggcgaccauccggccc

SEQ ID NO: 44274 - RNA, 20 nt, Artificial Sequence
  MKO10044274_A_Rabac1
  gRNA
ucccccuacaggagccacgc

SEQ ID NO: 44275 - RNA, 20 nt, Artificial Sequence
  MKO10044275_A_Rabep1
  gRNA
ucguucugucgugaugccca

SEQ ID NO: 44276 - RNA, 20 nt, Artificial Sequence
  MKO10044276_A_Rabep1
  gRNA
ccucccacagcuguguccga

SEQ ID NO: 44277 - RNA, 20 nt, Artificial Sequence
  MKO10044277_A_Rabep1
  gRNA
gucaccuucggacacagcug

SEQ ID NO: 44278 - RNA, 20 nt, Artificial Sequence
  MKO10044278_A_Rabep2
  gRNA
ugccgaacuggccggugccc

SEQ ID NO: 44279 - RNA, 20 nt, Artificial Sequence
  MKO10044279_A_Rabep2
  gRNA
aggcacugucaucgcaguug

SEQ ID NO: 44280 - RNA, 20 nt, Artificial Sequence
  MKO10044280_A_Rabep2
  gRNA
gagcgagagcaccaaggcgg

SEQ ID NO: 44281 - RNA, 20 nt, Artificial Sequence
  MKO10044281_A_Rabepk
  gRNA
cgauagcugcggacgaugug

SEQ ID NO: 44282 - RNA, 20 nt, Artificial Sequence
  MKO10044282_A_Rabepk
  gRNA
cacacaucguccgcagcuau

SEQ ID NO: 44283 - RNA, 20 nt, Artificial Sequence
  MKO10044283_A_Rabepk
  gRNA
aaugaagaucuucccgcucu

SEQ ID NO: 44284 - RNA, 20 nt, Artificial Sequence
  MKO10044284_A_Rabgap1l
  gRNA
aaagccuccacuucacugcg

SEQ ID NO: 44285 - RNA, 20 nt, Artificial Sequence
  MKO10044285_A_Rabgap1l
  gRNA
uagaccgcuuuguccuuucu

SEQ ID NO: 44286 - RNA, 20 nt, Artificial Sequence
  MKO10044286_A_Rabgap1l
  gRNA
uucuuccccacgcagugaag

SEQ ID NO: 44287 - RNA, 20 nt, Artificial Sequence
  MKO10044287_A_Rabgap1
  gRNA
ucagugccgaauguaucuga

SEQ ID NO: 44288 - RNA, 20 nt, Artificial Sequence
  MKO10044288_A_Rabgap1
  gRNA
acuacaacgcagagcucuuc

SEQ ID NO: 44289 - RNA, 20 nt, Artificial Sequence
  MKO10044289_A_Rabgap1
  gRNA
ggaagcccuaccagaggcac

SEQ ID NO: 44290 - RNA, 20 nt, Artificial Sequence
  MKO10044290_A_Rabgef1
  gRNA
ugagacggaccgagugacua

SEQ ID NO: 44291 - RNA, 20 nt, Artificial Sequence
  MKO10044291_A_Rabgef1
  gRNA
ccgucucaaugcugguuugc

SEQ ID NO: 44292 - RNA, 20 nt, Artificial Sequence
  MKO10044292_A_Rabgef1
  gRNA
auuccaggauuuaagcaucg

SEQ ID NO: 44293 - RNA, 20 nt, Artificial Sequence
  MKO10044293_A_Rabggua
  gRNA
acacguacaguuccgcucau

SEQ ID NO: 44294 - RNA, 20 nt, Artificial Sequence
  MKO10044294_A_Rabggua
  gRNA
ucggcgauuuguagcugcac

SEQ ID NO: 44295 - RNA, 20 nt, Artificial Sequence
  MKO10044295_A_Rabggua
  gRNA
gucgccugccugagcccaac

SEQ ID NO: 44296 - RNA, 20 nt, Artificial Sequence
  MKO10044296_A_Rabggub
  gRNA
aauagacgccgcucauucuc

SEQ ID NO: 44297 - RNA, 20 nt, Artificial Sequence
  MKO10044297_A_Rabggub
  gRNA
aagucgugccagcaugagug

SEQ ID NO: 44298 - RNA, 20 nt, Artificial Sequence
  MKO10044298_A_Rabggub
  gRNA
ucauguuaucaacguagaua

SEQ ID NO: 44299 - RNA, 20 nt, Artificial Sequence
  MKO10044299_A_Rabif
  gRNA
gaacgagcucgugucagccg

SEQ ID NO: 44300 - RNA, 20 nt, Artificial Sequence
  MKO10044300_A_Rabif
  gRNA
gcacccgagagccacaacgc

SEQ ID NO: 44301 - RNA, 20 nt, Artificial Sequence
  MKO10044301_A_Rabif
  gRNA
uccugauggugaucuccucc

SEQ ID NO: 44302 - RNA, 20 nt, Artificial Sequence
  MKO10044302_A_Rabl2
  gRNA
gaucgucuugccgucuacug

SEQ ID NO: 44303 - RNA, 20 nt, Artificial Sequence
  MKO10044303_A_Rabl2
  gRNA
cucccgaaguucugcauacc

SEQ ID NO: 44304 - RNA, 20 nt, Artificial Sequence
  MKO10044304_A_Rabl2
  gRNA
uaccugguaugcagaacuuc

SEQ ID NO: 44305 - RNA, 20 nt, Artificial Sequence
  MKO10044305_A_Rabl3
  gRNA
uuagucccuauuaccaacag

SEQ ID NO: 44306 - RNA, 20 nt, Artificial Sequence
  MKO10044306_A_Rabl3
  gRNA
caucucaaaacuuauaucgc

SEQ ID NO: 44307 - RNA, 20 nt, Artificial Sequence
  MKO10044307_A_Rabl3
  gRNA
cugugccacaaucaaguguu

SEQ ID NO: 44308 - RNA, 20 nt, Artificial Sequence
  MKO10044308_A_Rabl5
  gRNA
cgggcugcgaauucgagcuc

SEQ ID NO: 44309 - RNA, 20 nt, Artificial Sequence
  MKO10044309_A_Rabl5
  gRNA
aauacuugaugaacuccacc

SEQ ID NO: 44310 - RNA, 20 nt, Artificial Sequence
  MKO10044310_A_Rabl5
  gRNA
caccacaaaccgggcuccgg

SEQ ID NO: 44311 - RNA, 20 nt, Artificial Sequence
  MKO10044311_A_Rabl6
  gRNA
uuucuaggcagagucugaau

SEQ ID NO: 44312 - RNA, 20 nt, Artificial Sequence
  MKO10044312_A_Rabl6
  gRNA
ugcccguguuccugucaccc

SEQ ID NO: 44313 - RNA, 20 nt, Artificial Sequence
  MKO10044313_A_Rabl6
  gRNA
uguuugacaucacuaagcag

SEQ ID NO: 44314 - RNA, 20 nt, Artificial Sequence
  MKO10044314_A_Rac1
  gRNA
cauaccgaucucuuucgcca

SEQ ID NO: 44315 - RNA, 20 nt, Artificial Sequence
  MKO10044315_A_Rac1
  gRNA
gagucuuacugucugcgggu

SEQ ID NO: 44316 - RNA, 20 nt, Artificial Sequence
  MKO10044316_A_Rac1
  gRNA
caauacuccuaucauccucg

SEQ ID NO: 44317 - RNA, 20 nt, Artificial Sequence
  MKO10044317_A_Rac2
  gRNA
ggcaguggugccguaccuca

SEQ ID NO: 44318 - RNA, 20 nt, Artificial Sequence
  MKO10044318_A_Rac2
  gRNA
aagccccauaccaauauccu

SEQ ID NO: 44319 - RNA, 20 nt, Artificial Sequence
  MKO10044319_A_Rac2
  gRNA
ggacaguaagccggugaacc

SEQ ID NO: 44320 - RNA, 20 nt, Artificial Sequence
  MKO10044320_A_Rac3
  gRNA
gaagccuaucguagucuucc

SEQ ID NO: 44321 - RNA, 20 nt, Artificial Sequence
  MKO10044321_A_Rac3
  gRNA
acggcugcgggacaagaagc

SEQ ID NO: 44322 - RNA, 20 nt, Artificial Sequence
  MKO10044322_A_Rac3
  gRNA
gccgccuacuguuugaggau

SEQ ID NO: 44323 - RNA, 20 nt, Artificial Sequence
  MKO10044323_A_Racgap1
  gRNA
ccucgaaguccuucacaacc

SEQ ID NO: 44324 - RNA, 20 nt, Artificial Sequence
  MKO10044324_A_Racgap1
  gRNA
guccucaguugaauucaucc

SEQ ID NO: 44325 - RNA, 20 nt, Artificial Sequence
  MKO10044325_A_Racgap1
  gRNA
gcucucgcuuuccucaaccg

SEQ ID NO: 44326 - RNA, 20 nt, Artificial Sequence
  MKO10044326_A_Rad17
  gRNA
gucuguccgacaaugagccg

SEQ ID NO: 44327 - RNA, 20 nt, Artificial Sequence
  MKO10044327_A_Rad17
  gRNA
auccacccacggcucauugu

SEQ ID NO: 44328 - RNA, 20 nt, Artificial Sequence
  MKO10044328_A_Rad17
  gRNA
gauuaacccauucuuguacu

SEQ ID NO: 44329 - RNA, 20 nt, Artificial Sequence
  MKO10044329_A_Rad18
  gRNA
uaaucgccucuuagaugaac

SEQ ID NO: 44330 - RNA, 20 nt, Artificial Sequence
  MKO10044330_A_Rad18
  gRNA
aaacuuaccacgcaacaagu

SEQ ID NO: 44331 - RNA, 20 nt, Artificial Sequence
  MKO10044331_A_Rad18
  gRNA
ccgagccgcgauggccuccg

SEQ ID NO: 44332 - RNA, 20 nt, Artificial Sequence
  MKO10044332_A_Rad1
  gRNA
cuaucccaaagauuccgacu

SEQ ID NO: 44333 - RNA, 20 nt, Artificial Sequence
  MKO10044333_A_Rad1
  gRNA
ggaagccucgguuaucuguc

SEQ ID NO: 44334 - RNA, 20 nt, Artificial Sequence
  MKO10044334_A_Rad1
  gRNA
cagggacuuugacugcgcuu

SEQ ID NO: 44335 - RNA, 20 nt, Artificial Sequence
  MKO10044335_A_Rad21l
  gRNA
cuuguagucgaacauaguuc

SEQ ID NO: 44336 - RNA, 20 nt, Artificial Sequence
  MKO10044336_A_Rad21l
  gRNA
ggguuguucgaaucuacaac

SEQ ID NO: 44337 - RNA, 20 nt, Artificial Sequence
  MKO10044337_A_Rad21l
  gRNA
auguucgacuacaagaccac

SEQ ID NO: 44338 - RNA, 20 nt, Artificial Sequence
  MKO10044338_A_Rad21
  gRNA
ggaaaugauggcgguauauu

SEQ ID NO: 44339 - RNA, 20 nt, Artificial Sequence
  MKO10044339_A_Rad21
  gRNA
agguguugucgaucuaccug

SEQ ID NO: 44340 - RNA, 20 nt, Artificial Sequence
  MKO10044340_A_Rad21
  gRNA
augcuucauuacagucugcg

SEQ ID NO: 44341 - RNA, 20 nt, Artificial Sequence
  MKO10044341_A_Rad23a
  gRNA
ccgcucccgcucguagccca

SEQ ID NO: 44342 - RNA, 20 nt, Artificial Sequence
  MKO10044342_A_Rad23a
  gRNA
cuacgagcgggagcggguug

SEQ ID NO: 44343 - RNA, 20 nt, Artificial Sequence
  MKO10044343_A_Rad23a
  gRNA
cugggggugccgggauaccc

SEQ ID NO: 44344 - RNA, 20 nt, Artificial Sequence
  MKO10044344_A_Rad23b
  gRNA
auuaacuucugaccugcuac

SEQ ID NO: 44345 - RNA, 20 nt, Artificial Sequence
  MKO10044345_A_Rad23b
  gRNA
aaagaugccuuuccgguagc

SEQ ID NO: 44346 - RNA, 20 nt, Artificial Sequence
  MKO10044346_A_Rad23b
  gRNA
ccuuaccugucagcuggugc

SEQ ID NO: 44347 - RNA, 20 nt, Artificial Sequence
  MKO10044347_A_Rad50
  gRNA
ccgagaucagauuacgagua

SEQ ID NO: 44348 - RNA, 20 nt, Artificial Sequence
  MKO10044348_A_Rad50
  gRNA
agcccaguuagcgucuucgc

SEQ ID NO: 44349 - RNA, 20 nt, Artificial Sequence
  MKO10044349_A_Rad50
  gRNA
cauucacaucucgaaacugc

SEQ ID NO: 44350 - RNA, 20 nt, Artificial Sequence
  MKO10044350_A_Rad51ap1
  gRNA
aagaggucuagaaguugccc

SEQ ID NO: 44351 - RNA, 20 nt, Artificial Sequence
  MKO10044351_A_Rad51ap1
  gRNA
caagucaaaaacugugccaa

SEQ ID NO: 44352 - RNA, 20 nt, Artificial Sequence
  MKO10044352_A_Rad51ap1
  gRNA
uaggguggcuuuagaugaca

SEQ ID NO: 44353 - RNA, 20 nt, Artificial Sequence
  MKO10044353_A_Rad51ap2
  gRNA
ugucucugucgcgccccgcg

SEQ ID NO: 44354 - RNA, 20 nt, Artificial Sequence
  MKO10044354_A_Rad51ap2
  gRNA
ucucagugucaauagcguua

SEQ ID NO: 44355 - RNA, 20 nt, Artificial Sequence
  MKO10044355_A_Rad51ap2
  gRNA
agacaugcagucguccaauu

SEQ ID NO: 44356 - RNA, 20 nt, Artificial Sequence
  MKO10044356_A_Rad51b
  gRNA
acacgaaccguuugcaucug

SEQ ID NO: 44357 - RNA, 20 nt, Artificial Sequence
  MKO10044357_A_Rad51b
  gRNA
gucuacuacccugugcgccu

SEQ ID NO: 44358 - RNA, 20 nt, Artificial Sequence
  MKO10044358_A_Rad51b
  gRNA
accgugcaaugcuucaucca

SEQ ID NO: 44359 - RNA, 20 nt, Artificial Sequence
  MKO10044359_A_Rad51c
  gRNA
cuucguacucgauuacuaaa

SEQ ID NO: 44360 - RNA, 20 nt, Artificial Sequence
  MKO10044360_A_Rad51c
  gRNA
cauuuaguaaucgaguacga

SEQ ID NO: 44361 - RNA, 20 nt, Artificial Sequence
  MKO10044361_A_Rad51c
  gRNA
ucucgagcaagagcauaccc

SEQ ID NO: 44362 - RNA, 20 nt, Artificial Sequence
  MKO10044362_A_Rad51d
  gRNA
gcauacaaaccuuccgaugc

SEQ ID NO: 44363 - RNA, 20 nt, Artificial Sequence
  MKO10044363_A_Rad51d
  gRNA
cccagguagcggcaaaaccc

SEQ ID NO: 44364 - RNA, 20 nt, Artificial Sequence
  MKO10044364_A_Rad51d
  gRNA
auagagaucugcgccauuua

SEQ ID NO: 44365 - RNA, 20 nt, Artificial Sequence
  MKO10044365_A_Rad51
  gRNA
gcuacugcuagcagccgcuc

SEQ ID NO: 44366 - RNA, 20 nt, Artificial Sequence
  MKO10044366_A_Rad51
  gRNA
ggccauguacauugacaccg

SEQ ID NO: 44367 - RNA, 20 nt, Artificial Sequence
  MKO10044367_A_Rad51
  gRNA
gacacagaucugucauacgu

SEQ ID NO: 44368 - RNA, 20 nt, Artificial Sequence
  MKO10044368_A_Rad52
  gRNA
gguauucauccgcuguauac

SEQ ID NO: 44369 - RNA, 20 nt, Artificial Sequence
  MKO10044369_A_Rad52
  gRNA
auuauagagccaguauacag

SEQ ID NO: 44370 - RNA, 20 nt, Artificial Sequence
  MKO10044370_A_Rad52
  gRNA
cguagaacuugccauuguug

SEQ ID NO: 44371 - RNA, 20 nt, Artificial Sequence
  MKO10044371_A_Rad54b
  gRNA
gaugcuauucuuauuguaag

SEQ ID NO: 44372 - RNA, 20 nt, Artificial Sequence
  MKO10044372_A_Rad54b
  gRNA
ggauuugaacugcauacacc

SEQ ID NO: 44373 - RNA, 20 nt, Artificial Sequence
  MKO10044373_A_Rad54b
  gRNA
guccuucacauugaaagauu

SEQ ID NO: 44374 - RNA, 20 nt, Artificial Sequence
  MKO10044374_A_Rad54l2
  gRNA
gaugaaaagaguagucgaga

SEQ ID NO: 44375 - RNA, 20 nt, Artificial Sequence
  MKO10044375_A_Rad54l2
  gRNA
cggaugcuaggaucuugccu

SEQ ID NO: 44376 - RNA, 20 nt, Artificial Sequence
  MKO10044376_A_Rad54l2
  gRNA
guuucacagcccgugccaac

SEQ ID NO: 44377 - RNA, 20 nt, Artificial Sequence
  MKO10044377_A_Rad54l
  gRNA
uccccugggcucucgugcau

SEQ ID NO: 44378 - RNA, 20 nt, Artificial Sequence
  MKO10044378_A_Rad54l
  gRNA
ucgugcccuucaugacccuc

SEQ ID NO: 44379 - RNA, 20 nt, Artificial Sequence
  MKO10044379_A_Rad54l
  gRNA
uaaacacucacuacuguccc

SEQ ID NO: 44380 - RNA, 20 nt, Artificial Sequence
  MKO10044380_A_Rad9a
  gRNA
guccauucgcuaucccgaau

SEQ ID NO: 44381 - RNA, 20 nt, Artificial Sequence
  MKO10044381_A_Rad9a
  gRNA
gauagagcucguccccgauu

SEQ ID NO: 44382 - RNA, 20 nt, Artificial Sequence
  MKO10044382_A_Rad9a
  gRNA
gcuggggugcgcaauaagug

SEQ ID NO: 44383 - RNA, 20 nt, Artificial Sequence
  MKO10044383_A_Rad9b
  gRNA
gacucugcauuuauccgcuc

SEQ ID NO: 44384 - RNA, 20 nt, Artificial Sequence
  MKO10044384_A_Rad9b
  gRNA
aauucuugucauuccacgua

SEQ ID NO: 44385 - RNA, 20 nt, Artificial Sequence
  MKO10044385_A_Rad9b
  gRNA
gugcacaguagucgccagag

SEQ ID NO: 44386 - RNA, 20 nt, Artificial Sequence
  MKO10044386_A_Radil
  gRNA
guuugcuagacggugugcgc

SEQ ID NO: 44387 - RNA, 20 nt, Artificial Sequence
  MKO10044387_A_Radil
  gRNA
cugguacagcgaguaacgca

SEQ ID NO: 44388 - RNA, 20 nt, Artificial Sequence
  MKO10044388_A_Radil
  gRNA
ugccgccccaagacgggcga

SEQ ID NO: 44389 - RNA, 20 nt, Artificial Sequence
  MKO10044389_A_Rae1
  gRNA
uauucuuacagguucgcugc

SEQ ID NO: 44390 - RNA, 20 nt, Artificial Sequence
  MKO10044390_A_Rae1
  gRNA
ggccagugcuugacgucugc

SEQ ID NO: 44391 - RNA, 20 nt, Artificial Sequence
  MKO10044391_A_Rae1
  gRNA
ucucaccugugcuaucugaa

SEQ ID NO: 44392 - RNA, 20 nt, Artificial Sequence
  MKO10044392_A_Raet1a
  gRNA
gaacucaccauccagcccgu

SEQ ID NO: 44393 - RNA, 20 nt, Artificial Sequence
  MKO10044393_A_Raet1a
  gRNA
guaguugcuuaugugccauu

SEQ ID NO: 44394 - RNA, 20 nt, Artificial Sequence
  MKO10044394_A_Raet1a
  gRNA
uuauaggugcagcucacagc

SEQ ID NO: 44395 - RNA, 20 nt, Artificial Sequence
  MKO10044395_A_Raet1b
  gRNA
agaugaagugaagugcuucg

SEQ ID NO: 44396 - RNA, 20 nt, Artificial Sequence
  MKO10044396_A_Raet1b
  gRNA
uaaacauucccccacuucag

SEQ ID NO: 44397 - RNA, 20 nt, Artificial Sequence
  MKO10044397_A_Raet1b
  gRNA
gaacucaccauccagcccgu

SEQ ID NO: 44398 - RNA, 20 nt, Artificial Sequence
  MKO10044398_A_Raet1c
  gRNA
ugagcacuucacgucacacc

SEQ ID NO: 44399 - RNA, 20 nt, Artificial Sequence
  MKO10044399_A_Raet1c
  gRNA
gaacucaccauccagcccgu

SEQ ID NO: 44400 - RNA, 20 nt, Artificial Sequence
  MKO10044400_A_Raet1c
  gRNA
accucugaacgauuugugcc

SEQ ID NO: 44401 - RNA, 20 nt, Artificial Sequence
  MKO10044401_A_Raet1d
  gRNA
agaugaagugaagugcuucg

SEQ ID NO: 44402 - RNA, 20 nt, Artificial Sequence
  MKO10044402_A_Raet1d
  gRNA
uaaacauucccccacuucag

SEQ ID NO: 44403 - RNA, 20 nt, Artificial Sequence
  MKO10044403_A_Raet1d
  gRNA
gaacucaccaucuagcccgu

SEQ ID NO: 44404 - RNA, 20 nt, Artificial Sequence
  MKO10044404_A_Raet1e
  gRNA
ugagcacuucacgucacacc

SEQ ID NO: 44405 - RNA, 20 nt, Artificial Sequence
  MKO10044405_A_Raet1e
  gRNA
gaacucaccauccagcccgu

SEQ ID NO: 44406 - RNA, 20 nt, Artificial Sequence
  MKO10044406_A_Raet1e
  gRNA
accucugaacgauuugugcc

SEQ ID NO: 44407 - RNA, 20 nt, Artificial Sequence
  MKO10044407_A_Raf1
  gRNA
gauucucgcauccgacgcau

SEQ ID NO: 44408 - RNA, 20 nt, Artificial Sequence
  MKO10044408_A_Raf1
  gRNA
accgaugccgccucucugau

SEQ ID NO: 44409 - RNA, 20 nt, Artificial Sequence
  MKO10044409_A_Raf1
  gRNA
gacaucgaaauccauuuagc

SEQ ID NO: 44410 - RNA, 20 nt, Artificial Sequence
  MKO10044410_A_Rag1
  gRNA
uaagcccccucauugccgag

SEQ ID NO: 44411 - RNA, 20 nt, Artificial Sequence
  MKO10044411_A_Rag1
  gRNA
ccggagauguuuguccagcg

SEQ ID NO: 44412 - RNA, 20 nt, Artificial Sequence
  MKO10044412_A_Rag1
  gRNA
acucugugacaccacccguu

SEQ ID NO: 44413 - RNA, 20 nt, Artificial Sequence
  MKO10044413_A_Rag2
  gRNA
auugacgugguguauagucg

SEQ ID NO: 44414 - RNA, 20 nt, Artificial Sequence
  MKO10044414_A_Rag2
  gRNA
ucgacuauacaccacgucaa

SEQ ID NO: 44415 - RNA, 20 nt, Artificial Sequence
  MKO10044415_A_Rag2
  gRNA
uugagcuccguugaauagaa

SEQ ID NO: 44416 - RNA, 20 nt, Artificial Sequence
  MKO10044416_A_Rai14
  gRNA
gaguugucaauguucuccgc

SEQ ID NO: 44417 - RNA, 20 nt, Artificial Sequence
  MKO10044417_A_Rai14
  gRNA
gacacauaccggaagaaucu

SEQ ID NO: 44418 - RNA, 20 nt, Artificial Sequence
  MKO10044418_A_Rai14
  gRNA
uugccccacagacaaacgag

SEQ ID NO: 44419 - RNA, 20 nt, Artificial Sequence
  MKO10044419_A_Rai1
  gRNA
uugaggccgcggcccuuucg

SEQ ID NO: 44420 - RNA, 20 nt, Artificial Sequence
  MKO10044420_A_Rai1
  gRNA
uccucgccagaguagcgccc

SEQ ID NO: 44421 - RNA, 20 nt, Artificial Sequence
  MKO10044421_A_Rai1
  gRNA
uguaccagcugucacgagcc

SEQ ID NO: 44422 - RNA, 20 nt, Artificial Sequence
  MKO10044422_A_Rai2
  gRNA
accuacguuaugacgacaca

SEQ ID NO: 44423 - RNA, 20 nt, Artificial Sequence
  MKO10044423_A_Rai2
  gRNA
agucccgccagcuacccucu

SEQ ID NO: 44424 - RNA, 20 nt, Artificial Sequence
  MKO10044424_A_Rai2
  gRNA
gccuugugucgucauaacgu

SEQ ID NO: 44425 - RNA, 20 nt, Artificial Sequence
  MKO10044425_A_Rala
  gRNA
ucgcagcuaccgcggacuuc

SEQ ID NO: 44426 - RNA, 20 nt, Artificial Sequence
  MKO10044426_A_Rala
  gRNA
aacgcgcgccaacguugaca

SEQ ID NO: 44427 - RNA, 20 nt, Artificial Sequence
  MKO10044427_A_Rala
  gRNA
ucugcaguucauguacgacg

SEQ ID NO: 44428 - RNA, 20 nt, Artificial Sequence
  MKO10044428_A_Ralbp1
  gRNA
ccuggaccacgucauugcga

SEQ ID NO: 44429 - RNA, 20 nt, Artificial Sequence
  MKO10044429_A_Ralbp1
  gRNA
ccucucuacugcgucaacca

SEQ ID NO: 44430 - RNA, 20 nt, Artificial Sequence
  MKO10044430_A_Ralbp1
  gRNA
ccaugauguacgacggcguc

SEQ ID NO: 44431 - RNA, 20 nt, Artificial Sequence
  MKO10044431_A_Ralb
  gRNA
ugcaaagacccgcgccaaug

SEQ ID NO: 44432 - RNA, 20 nt, Artificial Sequence
  MKO10044432_A_Ralb
  gRNA
ggauggccgcauaguccucc

SEQ ID NO: 44433 - RNA, 20 nt, Artificial Sequence
  MKO10044433_A_Ralb
  gRNA
gugccuguggacgaggcccg

SEQ ID NO: 44434 - RNA, 20 nt, Artificial Sequence
  MKO10044434_A_Ralgapa1
  gRNA
caucgcugaugaauucuuuc

SEQ ID NO: 44435 - RNA, 20 nt, Artificial Sequence
  MKO10044435_A_Ralgapa1
  gRNA
aggucacaagucucaaagag

SEQ ID NO: 44436 - RNA, 20 nt, Artificial Sequence
  MKO10044436_A_Ralgapa1
  gRNA
cagaaagaauucaucagcga

SEQ ID NO: 44437 - RNA, 20 nt, Artificial Sequence
  MKO10044437_A_Ralgapa2
  gRNA
caucgaaagaaaauucguuc

SEQ ID NO: 44438 - RNA, 20 nt, Artificial Sequence
  MKO10044438_A_Ralgapa2
  gRNA
cagggaauaauaagucacaa

SEQ ID NO: 44439 - RNA, 20 nt, Artificial Sequence
  MKO10044439_A_Ralgapb
  gRNA
ccaucauggcucgagaaacc

SEQ ID NO: 44440 - RNA, 20 nt, Artificial Sequence
  MKO10044440_A_Ralgapb
  gRNA
gcuucccaacaccuccuuau

SEQ ID NO: 44441 - RNA, 20 nt, Artificial Sequence
  MKO10044441_A_Ralgapb
  gRNA
agauugcuccgcuuuacaua

SEQ ID NO: 44442 - RNA, 20 nt, Artificial Sequence
  MKO10044442_A_Ralgds
  gRNA
cccgcagugugagaacgagu

SEQ ID NO: 44443 - RNA, 20 nt, Artificial Sequence
  MKO10044443_A_Ralgds
  gRNA
cugcgguccgccguccucac

SEQ ID NO: 44444 - RNA, 20 nt, Artificial Sequence
  MKO10044444_A_Ralgds
  gRNA
cacuuaccccuagccagcgc

SEQ ID NO: 44445 - RNA, 20 nt, Artificial Sequence
  MKO10044445_A_Ralgps1
  gRNA
cagucuugcccccaacgucg

SEQ ID NO: 44446 - RNA, 20 nt, Artificial Sequence
  MKO10044446_A_Ralgps1
  gRNA
cuuuacccggagguucaacc

SEQ ID NO: 44447 - RNA, 20 nt, Artificial Sequence
  MKO10044447_A_Ralgps1
  gRNA
gucacuuacggcaaacuccu

SEQ ID NO: 44448 - RNA, 20 nt, Artificial Sequence
  MKO10044448_A_Ralgps2
  gRNA
uaucgcagccacuguuuccg

SEQ ID NO: 44449 - RNA, 20 nt, Artificial Sequence
  MKO10044449_A_Ralgps2
  gRNA
ugcuugccugcccguucauu

SEQ ID NO: 44450 - RNA, 20 nt, Artificial Sequence
  MKO10044450_A_Ralgps2
  gRNA
ccuuagcagucuuaauauag

SEQ ID NO: 44451 - RNA, 20 nt, Artificial Sequence
  MKO10044451_A_Ralyl
  gRNA
ccugcguuugcuccuguaca

SEQ ID NO: 44452 - RNA, 20 nt, Artificial Sequence
  MKO10044452_A_Ralyl
  gRNA
gaccccugucagcccuguac

SEQ ID NO: 44453 - RNA, 20 nt, Artificial Sequence
  MKO10044453_A_Ralyl
  gRNA
uguagacuuacccaacagac

SEQ ID NO: 44454 - RNA, 20 nt, Artificial Sequence
  MKO10044454_A_Raly
  gRNA
guccaacaucgaugcccugu

SEQ ID NO: 44455 - RNA, 20 nt, Artificial Sequence
  MKO10044455_A_Raly
  gRNA
ucgcuucaccggaacugccc

SEQ ID NO: 44456 - RNA, 20 nt, Artificial Sequence
  MKO10044456_A_Raly
  gRNA
ucgcuuggaacagauugcug

SEQ ID NO: 44457 - RNA, 20 nt, Artificial Sequence
  MKO10044457_A_Ramp1
  gRNA
cgcaccgcgggaggccccgc

SEQ ID NO: 44458 - RNA, 20 nt, Artificial Sequence
  MKO10044458_A_Ramp1
  gRNA
ugcgcacucccgcucuguuc

SEQ ID NO: 44459 - RNA, 20 nt, Artificial Sequence
  MKO10044459_A_Ramp1
  gRNA
gccucccgcggugcggccuc

SEQ ID NO: 44460 - RNA, 20 nt, Artificial Sequence
  MKO10044460_A_Ramp2
  gRNA
ggcacaacgcugucggccgc

SEQ ID NO: 44461 - RNA, 20 nt, Artificial Sequence
  MKO10044461_A_Ramp2
  gRNA
agcaguucgcaaaguguauc

SEQ ID NO: 44462 - RNA, 20 nt, Artificial Sequence
  MKO10044462_A_Ramp2
  gRNA
ggcgcgcucuacccggagcg

SEQ ID NO: 44463 - RNA, 20 nt, Artificial Sequence
  MKO10044463_A_Ramp3
  gRNA
ucucguugcagccgcauacc

SEQ ID NO: 44464 - RNA, 20 nt, Artificial Sequence
  MKO10044464_A_Ramp3
  gRNA
cucacacgaugaacuccgac

SEQ ID NO: 44465 - RNA, 20 nt, Artificial Sequence
  MKO10044465_A_Ramp3
  gRNA
aguacucaucccacugaucg

SEQ ID NO: 44466 - RNA, 20 nt, Artificial Sequence
  MKO10044466_A_Ranbp10
  gRNA
uaucgccuucacagaucucc

SEQ ID NO: 44467 - RNA, 20 nt, Artificial Sequence
  MKO10044467_A_Ranbp10
  gRNA
ugaaugugggaccauaaggc

SEQ ID NO: 44468 - RNA, 20 nt, Artificial Sequence
  MKO10044468_A_Ranbp10
  gRNA
gggguggguggcacguacag

SEQ ID NO: 44469 - RNA, 20 nt, Artificial Sequence
  MKO10044469_A_Ranbp17
  gRNA
cgaugacuugaaucagagcu

SEQ ID NO: 44470 - RNA, 20 nt, Artificial Sequence
  MKO10044470_A_Ranbp17
  gRNA
acgguggaacacugcauaau

SEQ ID NO: 44471 - RNA, 20 nt, Artificial Sequence
  MKO10044471_A_Ranbp17
  gRNA
augacaaagggcgccagcuu

SEQ ID NO: 44472 - RNA, 20 nt, Artificial Sequence
  MKO10044472_A_Ranbp1
  gRNA
aggccaccuacuauaguggu

SEQ ID NO: 44473 - RNA, 20 nt, Artificial Sequence
  MKO10044473_A_Ranbp1
  gRNA
ggaccauccgccuucuuaug

SEQ ID NO: 44474 - RNA, 20 nt, Artificial Sequence
  MKO10044474_A_Ranbp1
  gRNA
uacccuaguuacaccaauga

SEQ ID NO: 44475 - RNA, 20 nt, Artificial Sequence
  MKO10044475_A_Ranbp2
  gRNA
cuuuacguucaaguuuagaa

SEQ ID NO: 44476 - RNA, 20 nt, Artificial Sequence
  MKO10044476_A_Ranbp2
  gRNA
ccguucaaauaaaagauuga

SEQ ID NO: 44477 - RNA, 20 nt, Artificial Sequence
  MKO10044477_A_Ranbp2
  gRNA
uccugccauuuauaaguuaa

SEQ ID NO: 44478 - RNA, 20 nt, Artificial Sequence
  MKO10044478_A_Ranbp3l
  gRNA
cuuugucucaaacgcgucug

SEQ ID NO: 44479 - RNA, 20 nt, Artificial Sequence
  MKO10044479_A_Ranbp3l
  gRNA
cgggacaucagugaaugacg

SEQ ID NO: 44480 - RNA, 20 nt, Artificial Sequence
  MKO10044480_A_Ranbp3l
  gRNA
guuucuugagaaagcgugua

SEQ ID NO: 44481 - RNA, 20 nt, Artificial Sequence
  MKO10044481_A_Ranbp3
  gRNA
auguccgcucacgcuugaca

SEQ ID NO: 44482 - RNA, 20 nt, Artificial Sequence
  MKO10044482_A_Ranbp3
  gRNA
gccccccugucaagcgugag

SEQ ID NO: 44483 - RNA, 20 nt, Artificial Sequence
  MKO10044483_A_Ranbp3
  gRNA
uuccuuaccuucuccggcuu

SEQ ID NO: 44484 - RNA, 20 nt, Artificial Sequence
  MKO10044484_A_Ranbp6
  gRNA
augucgacacgccggauuaa

SEQ ID NO: 44485 - RNA, 20 nt, Artificial Sequence
  MKO10044485_A_Ranbp6
  gRNA
caaaagccgucguagcagug

SEQ ID NO: 44486 - RNA, 20 nt, Artificial Sequence
  MKO10044486_A_Ranbp6
  gRNA
uacagcuuuguugcgaacca

SEQ ID NO: 44487 - RNA, 20 nt, Artificial Sequence
  MKO10044487_A_Ranbp9
  gRNA
uauugcuuucaccgacuuac

SEQ ID NO: 44488 - RNA, 20 nt, Artificial Sequence
  MKO10044488_A_Ranbp9
  gRNA
gugaacaugaauagacuacc

SEQ ID NO: 44489 - RNA, 20 nt, Artificial Sequence
  MKO10044489_A_Ranbp9
  gRNA
agccacgcauccaauaccag

SEQ ID NO: 44490 - RNA, 20 nt, Artificial Sequence
  MKO10044490_A_Rangap1
  gRNA
guccaaaugcguugucacug

SEQ ID NO: 44491 - RNA, 20 nt, Artificial Sequence
  MKO10044491_A_Rangap1
  gRNA
gaccucagugacaacgcauu

SEQ ID NO: 44492 - RNA, 20 nt, Artificial Sequence
  MKO10044492_A_Rangap1
  gRNA
caacacggugggcguggaag

SEQ ID NO: 44493 - RNA, 20 nt, Artificial Sequence
  MKO10044493_A_Rangrf
  gRNA
uccuuacgggggcugauuga

SEQ ID NO: 44494 - RNA, 20 nt, Artificial Sequence
  MKO10044494_A_Rangrf
  gRNA
ccucuccagugaccuccgac

SEQ ID NO: 44495 - RNA, 20 nt, Artificial Sequence
  MKO10044495_A_Rangrf
  gRNA
uuacccuaaggugucacagc

SEQ ID NO: 44496 - RNA, 20 nt, Artificial Sequence
  MKO10044496_A_Ran
  gRNA
cgcgauggcuacuacaucca

SEQ ID NO: 44497 - RNA, 20 nt, Artificial Sequence
  MKO10044497_A_Ran
  gRNA
uugaaucuagcucguccugg

SEQ ID NO: 44498 - RNA, 20 nt, Artificial Sequence
  MKO10044498_A_Ran
  gRNA
ccccgcagccacccugggcg

SEQ ID NO: 44499 - RNA, 20 nt, Artificial Sequence
  MKO10044499_A_Rap1a
  gRNA
ccugcagguuccaaugauuu

SEQ ID NO: 44500 - RNA, 20 nt, Artificial Sequence
  MKO10044500_A_Rap1a
  gRNA
uuacgguuccugcagugucc

SEQ ID NO: 44501 - RNA, 20 nt, Artificial Sequence
  MKO10044501_A_Rap1a
  gRNA
gucaaagaucaacguuaaug

SEQ ID NO: 44502 - RNA, 20 nt, Artificial Sequence
  MKO10044502_A_Rap1b
  gRNA
cuuguccguucuucauguac

SEQ ID NO: 44503 - RNA, 20 nt, Artificial Sequence
  MKO10044503_A_Rap1b
  gRNA
uucgcagguuccaaugauuc

SEQ ID NO: 44504 - RNA, 20 nt, Artificial Sequence
  MKO10044504_A_Rap1b
  gRNA
cuauaagaaucuucuaucgu

SEQ ID NO: 44505 - RNA, 20 nt, Artificial Sequence
  MKO10044505_A_Rap1gap2
  gRNA
ugcggaguucuucgagaugc

SEQ ID NO: 44506 - RNA, 20 nt, Artificial Sequence
  MKO10044506_A_Rap1gap2
  gRNA
cccguaccccagcauugaug

SEQ ID NO: 44507 - RNA, 20 nt, Artificial Sequence
  MKO10044507_A_Rap1gap2
  gRNA
gagggucacauccgagcugu

SEQ ID NO: 44508 - RNA, 20 nt, Artificial Sequence
  MKO10044508_A_Rap1gap
  gRNA
gcgacgauaccaugagcggc

SEQ ID NO: 44509 - RNA, 20 nt, Artificial Sequence
  MKO10044509_A_Rap1gap
  gRNA
gcugcgcuuccggccgcuca

SEQ ID NO: 44510 - RNA, 20 nt, Artificial Sequence
  MKO10044510_A_Rap1gap
  gRNA
cucaccacacacucugucga

SEQ ID NO: 44511 - RNA, 20 nt, Artificial Sequence
  MKO10044511_A_Rap1gds1
  gRNA
aagugcugcuucaaacgggc

SEQ ID NO: 44512 - RNA, 20 nt, Artificial Sequence
  MKO10044512_A_Rap1gds1
  gRNA
ugcaaaucuguugacgccac

SEQ ID NO: 44513 - RNA, 20 nt, Artificial Sequence
  MKO10044513_A_Rap1gds1
  gRNA
ccguuugaagcagcacuucc

SEQ ID NO: 44514 - RNA, 20 nt, Artificial Sequence
  MKO10044514_A_Rap2a
  gRNA
ccgcauggacgcgaacugcu

SEQ ID NO: 44515 - RNA, 20 nt, Artificial Sequence
  MKO10044515_A_Rap2a
  gRNA
ccgagcaguucgcguccaug

SEQ ID NO: 44516 - RNA, 20 nt, Artificial Sequence
  MKO10044516_A_Rap2a
  gRNA
cggaugcuauuguauguuac

SEQ ID NO: 44517 - RNA, 20 nt, Artificial Sequence
  MKO10044517_A_Rap2b
  gRNA
ggcgccucacaggaucacgc

SEQ ID NO: 44518 - RNA, 20 nt, Artificial Sequence
  MKO10044518_A_Rap2b
  gRNA
gcagcagcccucgucgccgu

SEQ ID NO: 44519 - RNA, 20 nt, Artificial Sequence
  MKO10044519_A_Rap2b
  gRNA
cgggucguacuucucgauga

SEQ ID NO: 44520 - RNA, 20 nt, Artificial Sequence
  MKO10044520_A_Rap2c
  gRNA
ggcaaacugcucgguuccug

SEQ ID NO: 44521 - RNA, 20 nt, Artificial Sequence
  MKO10044521_A_Rap2c
  gRNA
gauuaaccaaacuauacacc

SEQ ID NO: 44522 - RNA, 20 nt, Artificial Sequence
  MKO10044522_A_Rap2c
  gRNA
gaaagucccacucauccuag

SEQ ID NO: 44523 - RNA, 20 nt, Artificial Sequence
  MKO10044523_A_Rapgef1
  gRNA
cggcgcagcccggaaauguc

SEQ ID NO: 44524 - RNA, 20 nt, Artificial Sequence
  MKO10044524_A_Rapgef1
  gRNA
accaucggauaagguuggcg

SEQ ID NO: 44525 - RNA, 20 nt, Artificial Sequence
  MKO10044525_A_Rapgef1
  gRNA
cugguauacucggcuauaac

SEQ ID NO: 44526 - RNA, 20 nt, Artificial Sequence
  MKO10044526_A_Rapgef2
  gRNA
ucagagucaaccgccgucuc

SEQ ID NO: 44527 - RNA, 20 nt, Artificial Sequence
  MKO10044527_A_Rapgef2
  gRNA
ucuuacugacaucgucauau

SEQ ID NO: 44528 - RNA, 20 nt, Artificial Sequence
  MKO10044528_A_Rapgef2
  gRNA
uguagcaucaccagcgacuc

SEQ ID NO: 44529 - RNA, 20 nt, Artificial Sequence
  MKO10044529_A_Rapgef3
  gRNA
aggucucccggacgugguuc

SEQ ID NO: 44530 - RNA, 20 nt, Artificial Sequence
  MKO10044530_A_Rapgef3
  gRNA
cucaccgauauagucgcaga

SEQ ID NO: 44531 - RNA, 20 nt, Artificial Sequence
  MKO10044531_A_Rapgef3
  gRNA
accagcuaguguucgagcac

SEQ ID NO: 44532 - RNA, 20 nt, Artificial Sequence
  MKO10044532_A_Rapgef4
  gRNA
uugaguccgcgagugaacac

SEQ ID NO: 44533 - RNA, 20 nt, Artificial Sequence
  MKO10044533_A_Rapgef4
  gRNA
gaaguccggccauauacugu

SEQ ID NO: 44534 - RNA, 20 nt, Artificial Sequence
  MKO10044534_A_Rapgef4
  gRNA
gcagaaauaccgacaguaua

SEQ ID NO: 44535 - RNA, 20 nt, Artificial Sequence
  MKO10044535_A_Rapgef5
  gRNA
guacugcgaauuugaaagag

SEQ ID NO: 44536 - RNA, 20 nt, Artificial Sequence
  MKO10044536_A_Rapgef5
  gRNA
caauggccauagaucuacac

SEQ ID NO: 44537 - RNA, 20 nt, Artificial Sequence
  MKO10044537_A_Rapgef5
  gRNA
ugcacucauccgaagaaaac

SEQ ID NO: 44538 - RNA, 20 nt, Artificial Sequence
  MKO10044538_A_Rapgef6
  gRNA
gcacgcuaugagagauacag

SEQ ID NO: 44539 - RNA, 20 nt, Artificial Sequence
  MKO10044539_A_Rapgef6
  gRNA
uggaaauacuaucaaaccuc

SEQ ID NO: 44540 - RNA, 20 nt, Artificial Sequence
  MKO10044540_A_Rapgef6
  gRNA
aaacuuaccugcaaggagga

SEQ ID NO: 44541 - RNA, 20 nt, Artificial Sequence
  MKO10044541_A_Rapgefl1
  gRNA
aggggccggccacauuauca

SEQ ID NO: 44542 - RNA, 20 nt, Artificial Sequence
  MKO10044542_A_Rapgefl1
  gRNA
cgcucuuccgacacuuccgc

SEQ ID NO: 44543 - RNA, 20 nt, Artificial Sequence
  MKO10044543_A_Rapgefl1
  gRNA
ugcuuccgacccagccccuc

SEQ ID NO: 44544 - RNA, 20 nt, Artificial Sequence
  MKO10044544_A_Raph1
  gRNA
agguuuaguuguucuauuag

SEQ ID NO: 44545 - RNA, 20 nt, Artificial Sequence
  MKO10044545_A_Raph1
  gRNA
guggucaaaucaagcucuug

SEQ ID NO: 44546 - RNA, 20 nt, Artificial Sequence
  MKO10044546_A_Raph1
  gRNA
aaaaagaucuccucuucgcc

SEQ ID NO: 44547 - RNA, 20 nt, Artificial Sequence
  MKO10044547_A_Rapsn
  gRNA
cguuguugugggcauagcgc

SEQ ID NO: 44548 - RNA, 20 nt, Artificial Sequence
  MKO10044548_A_Rapsn
  gRNA
gcuucucauugcugcgcgcc

SEQ ID NO: 44549 - RNA, 20 nt, Artificial Sequence
  MKO10044549_A_Rapsn
  gRNA
gcagagcuugucaacgacua

SEQ ID NO: 44550 - RNA, 20 nt, Artificial Sequence
  MKO10044550_A_Rara
  gRNA
gaagguucgcaaagcgcacc

SEQ ID NO: 44551 - RNA, 20 nt, Artificial Sequence
  MKO10044551_A_Rara
  gRNA
cugcagaaauguuucgacgu

SEQ ID NO: 44552 - RNA, 20 nt, Artificial Sequence
  MKO10044552_A_Rara
  gRNA
gagcuacacgcugacgccug

SEQ ID NO: 44553 - RNA, 20 nt, Artificial Sequence
  MKO10044553_A_Rarb
  gRNA
gguagcccgaugacuugucc

SEQ ID NO: 44554 - RNA, 20 nt, Artificial Sequence
  MKO10044554_A_Rarb
  gRNA
ccaaguccaaucggacccgg

SEQ ID NO: 44555 - RNA, 20 nt, Artificial Sequence
  MKO10044555_A_Rarb
  gRNA
ugacgcaguucuuaucucga

SEQ ID NO: 44556 - RNA, 20 nt, Artificial Sequence
  MKO10044556_A_Rarg
  gRNA
cuacaaaaguguuucgaagu

SEQ ID NO: 44557 - RNA, 20 nt, Artificial Sequence
  MKO10044557_A_Rarg
  gRNA
cgaccagaucacgcugcuca

SEQ ID NO: 44558 - RNA, 20 nt, Artificial Sequence
  MKO10044558_A_Rarg
  gRNA
ggguaccaucuccuccgagc

SEQ ID NO: 44559 - RNA, 20 nt, Artificial Sequence
  MKO10044559_A_Rarres1
  gRNA
ccguuaauguaacgugcgca

SEQ ID NO: 44560 - RNA, 20 nt, Artificial Sequence
  MKO10044560_A_Rarres1
  gRNA
ccgugcgcacguuacauuaa

SEQ ID NO: 44561 - RNA, 20 nt, Artificial Sequence
  MKO10044561_A_Rarres1
  gRNA
ucggcagcucauacgugaug

SEQ ID NO: 44562 - RNA, 20 nt, Artificial Sequence
  MKO10044562_A_Rarres2
  gRNA
gcgcugggucucgcugaguu

SEQ ID NO: 44563 - RNA, 20 nt, Artificial Sequence
  MKO10044563_A_Rarres2
  gRNA
cucuguccacaccgaucucu

SEQ ID NO: 44564 - RNA, 20 nt, Artificial Sequence
  MKO10044564_A_Rarres2
  gRNA
ccccacggcuacuuccuacc

SEQ ID NO: 44565 - RNA, 20 nt, Artificial Sequence
  MKO10044565_A_Rars2
  gRNA
gugauuguugucuucuagua

SEQ ID NO: 44566 - RNA, 20 nt, Artificial Sequence
  MKO10044566_A_Rars2
  gRNA
ucagcuuaagugugauacag

SEQ ID NO: 44567 - RNA, 20 nt, Artificial Sequence
  MKO10044567_A_Rars2
  gRNA
ucucagaucuucccaagaag

SEQ ID NO: 44568 - RNA, 20 nt, Artificial Sequence
  MKO10044568_A_Rars
  gRNA
gcugacuuggugucacgauc

SEQ ID NO: 44569 - RNA, 20 nt, Artificial Sequence
  MKO10044569_A_Rars
  gRNA
cucugacugcugagaucgac

SEQ ID NO: 44570 - RNA, 20 nt, Artificial Sequence
  MKO10044570_A_Rars
  gRNA
uaacaucaacagccgccugc

SEQ ID NO: 44571 - RNA, 20 nt, Artificial Sequence
  MKO10044571_A_Rasa1
  gRNA
acacgccuucuaucuucuac

SEQ ID NO: 44572 - RNA, 20 nt, Artificial Sequence
  MKO10044572_A_Rasa1
  gRNA
cuauagcagaagaacgccuc

SEQ ID NO: 44573 - RNA, 20 nt, Artificial Sequence
  MKO10044573_A_Rasa1
  gRNA
cgugacuguaauaaccuauu

SEQ ID NO: 44574 - RNA, 20 nt, Artificial Sequence
  MKO10044574_A_Rasa2
  gRNA
ggaagaaguuuaucgcaccc

SEQ ID NO: 44575 - RNA, 20 nt, Artificial Sequence
  MKO10044575_A_Rasa2
  gRNA
uuacaaagagaucuucguau

SEQ ID NO: 44576 - RNA, 20 nt, Artificial Sequence
  MKO10044576_A_Rasa2
  gRNA
gcucauucagucuuaacuca

SEQ ID NO: 44577 - RNA, 20 nt, Artificial Sequence
  MKO10044577_A_Rasa3
  gRNA
acagguggcggaaacuccga

SEQ ID NO: 44578 - RNA, 20 nt, Artificial Sequence
  MKO10044578_A_Rasa3
  gRNA
cuuaccgugcagcgaguuug

SEQ ID NO: 44579 - RNA, 20 nt, Artificial Sequence
  MKO10044579_A_Rasa3
  gRNA
gagugacuucucgacaauuu

SEQ ID NO: 44580 - RNA, 20 nt, Artificial Sequence
  MKO10044580_A_Rasa4
  gRNA
ccuucccgaucacaucgucc

SEQ ID NO: 44581 - RNA, 20 nt, Artificial Sequence
  MKO10044581_A_Rasa4
  gRNA
cuguccauccgaaucguaga

SEQ ID NO: 44582 - RNA, 20 nt, Artificial Sequence
  MKO10044582_A_Rasa4
  gRNA
cgcgcuagccucucacccaa

SEQ ID NO: 44583 - RNA, 20 nt, Artificial Sequence
  MKO10044583_A_Rasal1
  gRNA
guccuccagggaucgacagc

SEQ ID NO: 44584 - RNA, 20 nt, Artificial Sequence
  MKO10044584_A_Rasal1
  gRNA
guacaccguucaccuuccau

SEQ ID NO: 44585 - RNA, 20 nt, Artificial Sequence
  MKO10044585_A_Rasal1
  gRNA
aagcagugaccccuauuguc

SEQ ID NO: 44586 - RNA, 20 nt, Artificial Sequence
  MKO10044586_A_Rasal2
  gRNA
ccccgcagacggagcaucuc

SEQ ID NO: 44587 - RNA, 20 nt, Artificial Sequence
  MKO10044587_A_Rasal2
  gRNA
uguuucugucaagcuucgac

SEQ ID NO: 44588 - RNA, 20 nt, Artificial Sequence
  MKO10044588_A_Rasal2
  gRNA
ucuccucagacagcgcccuu

SEQ ID NO: 44589 - RNA, 20 nt, Artificial Sequence
  MKO10044589_A_Rasal3
  gRNA
ggguccucgccaaauccgag

SEQ ID NO: 44590 - RNA, 20 nt, Artificial Sequence
  MKO10044590_A_Rasal3
  gRNA
cuucccacucggauuuggcg

SEQ ID NO: 44591 - RNA, 20 nt, Artificial Sequence
  MKO10044591_A_Rasal3
  gRNA
gagccuacaccccucgagau

SEQ ID NO: 44592 - RNA, 20 nt, Artificial Sequence
  MKO10044592_A_Rasd1
  gRNA
cgcggaucgaguaaaacuuu

SEQ ID NO: 44593 - RNA, 20 nt, Artificial Sequence
  MKO10044593_A_Rasd1
  gRNA
caaccgcgacucauucgaag

SEQ ID NO: 44594 - RNA, 20 nt, Artificial Sequence
  MKO10044594_A_Rasd1
  gRNA
aagucggggcucaucucgcu

SEQ ID NO: 44595 - RNA, 20 nt, Artificial Sequence
  MKO10044595_A_Rasd2
  gRNA
gcgaugaaaguccucgauag

SEQ ID NO: 44596 - RNA, 20 nt, Artificial Sequence
  MKO10044596_A_Rasd2
  gRNA
ugaaaacugcgccuacuucg

SEQ ID NO: 44597 - RNA, 20 nt, Artificial Sequence
  MKO10044597_A_Rasd2
  gRNA
cuuagugcgacgcaugcaga

SEQ ID NO: 44598 - RNA, 20 nt, Artificial Sequence
  MKO10044598_A_Rasef
  gRNA
aaccguaugaacgugugaua

SEQ ID NO: 44599 - RNA, 20 nt, Artificial Sequence
  MKO10044599_A_Rasef
  gRNA
cuguuucauacugacgccug

SEQ ID NO: 44600 - RNA, 20 nt, Artificial Sequence
  MKO10044600_A_Rasef
  gRNA
uuccuuaucacacguucaua

SEQ ID NO: 44601 - RNA, 20 nt, Artificial Sequence
  MKO10044601_A_Rasgef1a
  gRNA
gaagcuccggucacccguug

SEQ ID NO: 44602 - RNA, 20 nt, Artificial Sequence
  MKO10044602_A_Rasgef1a
  gRNA
ucaggauaauaguccaccgu

SEQ ID NO: 44603 - RNA, 20 nt, Artificial Sequence
  MKO10044603_A_Rasgef1a
  gRNA
caagauggacgccucacuuc

SEQ ID NO: 44604 - RNA, 20 nt, Artificial Sequence
  MKO10044604_A_Rasgef1b
  gRNA
caugcauccguacgagcuca

SEQ ID NO: 44605 - RNA, 20 nt, Artificial Sequence
  MKO10044605_A_Rasgef1b
  gRNA
agcgccucaccagcucgaug

SEQ ID NO: 44606 - RNA, 20 nt, Artificial Sequence
  MKO10044606_A_Rasgef1b
  gRNA
ggucaugaugucccgcugua

SEQ ID NO: 44607 - RNA, 20 nt, Artificial Sequence
  MKO10044607_A_Rasgef1c
  gRNA
ugcggcccaccacgucuguc

SEQ ID NO: 44608 - RNA, 20 nt, Artificial Sequence
  MKO10044608_A_Rasgef1c
  gRNA
uccccaugcaggagcgacua

SEQ ID NO: 44609 - RNA, 20 nt, Artificial Sequence
  MKO10044609_A_Rasgef1c
  gRNA
ugcuccaguuguuagccgag

SEQ ID NO: 44610 - RNA, 20 nt, Artificial Sequence
  MKO10044610_A_Rasgrf1
  gRNA
cgacguggccaucguuaagc

SEQ ID NO: 44611 - RNA, 20 nt, Artificial Sequence
  MKO10044611_A_Rasgrf1
  gRNA
uggcugcgaucgcucgcgcc

SEQ ID NO: 44612 - RNA, 20 nt, Artificial Sequence
  MKO10044612_A_Rasgrf1
  gRNA
gacaacgcugcgugacagag

SEQ ID NO: 44613 - RNA, 20 nt, Artificial Sequence
  MKO10044613_A_Rasgrf2
  gRNA
ccacgcuggcguagcggauc

SEQ ID NO: 44614 - RNA, 20 nt, Artificial Sequence
  MKO10044614_A_Rasgrf2
  gRNA
gcgccucuuggagcgguuga

SEQ ID NO: 44615 - RNA, 20 nt, Artificial Sequence
  MKO10044615_A_Rasgrf2
  gRNA
gucugcaccagccgacaaag

SEQ ID NO: 44616 - RNA, 20 nt, Artificial Sequence
  MKO10044616_A_Rasgrp1
  gRNA
ggagaugaugauccggugca

SEQ ID NO: 44617 - RNA, 20 nt, Artificial Sequence
  MKO10044617_A_Rasgrp1
  gRNA
aagucaugcuaaccaugcac

SEQ ID NO: 44618 - RNA, 20 nt, Artificial Sequence
  MKO10044618_A_Rasgrp1
  gRNA
agcugucaauaagaucaucc

SEQ ID NO: 44619 - RNA, 20 nt, Artificial Sequence
  MKO10044619_A_Rasgrp2
  gRNA
acacacucucgaugucgaug

SEQ ID NO: 44620 - RNA, 20 nt, Artificial Sequence
  MKO10044620_A_Rasgrp2
  gRNA
uagaccaagaagggaaccgc

SEQ ID NO: 44621 - RNA, 20 nt, Artificial Sequence
  MKO10044621_A_Rasgrp2
  gRNA
ggugacccagcggaacccug

SEQ ID NO: 44622 - RNA, 20 nt, Artificial Sequence
  MKO10044622_A_Rasgrp3
  gRNA
cgggaaguagcuagucaacu

SEQ ID NO: 44623 - RNA, 20 nt, Artificial Sequence
  MKO10044623_A_Rasgrp3
  gRNA
gugcaucaguaacacgauuc

SEQ ID NO: 44624 - RNA, 20 nt, Artificial Sequence
  MKO10044624_A_Rasgrp3
  gRNA
ucguguuacugaugcaccga

SEQ ID NO: 44625 - RNA, 20 nt, Artificial Sequence
  MKO10044625_A_Rasgrp4
  gRNA
cuggagcguccaccgaguuu

SEQ ID NO: 44626 - RNA, 20 nt, Artificial Sequence
  MKO10044626_A_Rasgrp4
  gRNA
ucggcuggcagccugcgccg

SEQ ID NO: 44627 - RNA, 20 nt, Artificial Sequence
  MKO10044627_A_Rasgrp4
  gRNA
cugcagcgaagaugagcuau

SEQ ID NO: 44628 - RNA, 20 nt, Artificial Sequence
  MKO10044628_A_Rasip1
  gRNA
cgccaacuacaagagcgugc

SEQ ID NO: 44629 - RNA, 20 nt, Artificial Sequence
  MKO10044629_A_Rasip1
  gRNA
cuacgcgcuuugcgacgcuc

SEQ ID NO: 44630 - RNA, 20 nt, Artificial Sequence
  MKO10044630_A_Rasip1
  gRNA
gcgcgcaccgugcaaugucg

SEQ ID NO: 44631 - RNA, 20 nt, Artificial Sequence
  MKO10044631_A_Rasl10a
  gRNA
uacgaccugaguauccgcga

SEQ ID NO: 44632 - RNA, 20 nt, Artificial Sequence
  MKO10044632_A_Rasl10a
  gRNA
guccagcgacgucaccaucg

SEQ ID NO: 44633 - RNA, 20 nt, Artificial Sequence
  MKO10044633_A_Rasl10a
  gRNA
ucgauuauguuaaagcccug

SEQ ID NO: 44634 - RNA, 20 nt, Artificial Sequence
  MKO10044634_A_Rasl10b
  gRNA
acgcuggaacgugucgcacu

SEQ ID NO: 44635 - RNA, 20 nt, Artificial Sequence
  MKO10044635_A_Rasl10b
  gRNA
aacaagcgcgaccugcaacg

SEQ ID NO: 44636 - RNA, 20 nt, Artificial Sequence
  MKO10044636_A_Rasl10b
  gRNA
cuuauacaacgaguucagcg

SEQ ID NO: 44637 - RNA, 20 nt, Artificial Sequence
  MKO10044637_A_Rasl11a
  gRNA
guauucgagacucgucuaug

SEQ ID NO: 44638 - RNA, 20 nt, Artificial Sequence
  MKO10044638_A_Rasl11a
  gRNA
guagucgccgaugaaucucu

SEQ ID NO: 44639 - RNA, 20 nt, Artificial Sequence
  MKO10044639_A_Rasl11a
  gRNA
agcgaaagcguccuccgccc

SEQ ID NO: 44640 - RNA, 20 nt, Artificial Sequence
  MKO10044640_A_Rasl11b
  gRNA
ccggcucguuaagaucgccg

SEQ ID NO: 44641 - RNA, 20 nt, Artificial Sequence
  MKO10044641_A_Rasl11b
  gRNA
ccccgaugaaucguuuagug

SEQ ID NO: 44642 - RNA, 20 nt, Artificial Sequence
  MKO10044642_A_Rasl11b
  gRNA
aguugaaucgcugcauucgc

SEQ ID NO: 44643 - RNA, 20 nt, Artificial Sequence
  MKO10044643_A_Rasl12
  gRNA
cuugccgaacaccgacgaca

SEQ ID NO: 44644 - RNA, 20 nt, Artificial Sequence
  MKO10044644_A_Rasl12
  gRNA
cgauagucgugcgaguuucg

SEQ ID NO: 44645 - RNA, 20 nt, Artificial Sequence
  MKO10044645_A_Rasl12
  gRNA
uucgccaugucgucgguguu

SEQ ID NO: 44646 - RNA, 20 nt, Artificial Sequence
  MKO10044646_A_Rasl2-9
  gRNA
gaucgccgcgauggccgccc

SEQ ID NO: 44647 - RNA, 20 nt, Artificial Sequence
  MKO10044647_A_Rasl2-9
  gRNA
acuagaucuuuaugccagcu

SEQ ID NO: 44648 - RNA, 20 nt, Artificial Sequence
  MKO10044648_A_Rasl2-9
  gRNA
ccaccaggacgaccuugaac

SEQ ID NO: 44649 - RNA, 20 nt, Artificial Sequence
  MKO10044649_A_Rassf10
  gRNA
gagcgcgucgguagaacgua

SEQ ID NO: 44650 - RNA, 20 nt, Artificial Sequence
  MKO10044650_A_Rassf10
  gRNA
cgucgccccaagcaguccag

SEQ ID NO: 44651 - RNA, 20 nt, Artificial Sequence
  MKO10044651_A_Rassf10
  gRNA
cgcaagauccgcgucuuguu

SEQ ID NO: 44652 - RNA, 20 nt, Artificial Sequence
  MKO10044652_A_Rassf1
  gRNA
acgcccggagagguacgggg

SEQ ID NO: 44653 - RNA, 20 nt, Artificial Sequence
  MKO10044653_A_Rassf1
  gRNA
gcucgucauccgacagcuuc

SEQ ID NO: 44654 - RNA, 20 nt, Artificial Sequence
  MKO10044654_A_Rassf1
  gRNA
aaaagaggugcggcgcuuca

SEQ ID NO: 44655 - RNA, 20 nt, Artificial Sequence
  MKO10044655_A_Rassf2
  gRNA
ugcgucgccguggcaacgug

SEQ ID NO: 44656 - RNA, 20 nt, Artificial Sequence
  MKO10044656_A_Rassf2
  gRNA
gauggcgucugauccgucgc

SEQ ID NO: 44657 - RNA, 20 nt, Artificial Sequence
  MKO10044657_A_Rassf2
  gRNA
aaugccuuaccucucggugu

SEQ ID NO: 44658 - RNA, 20 nt, Artificial Sequence
  MKO10044658_A_Rassf3
  gRNA
cgcuuuauaagcguugucac

SEQ ID NO: 44659 - RNA, 20 nt, Artificial Sequence
  MKO10044659_A_Rassf3
  gRNA
gcacccgcuguaccuacguu

SEQ ID NO: 44660 - RNA, 20 nt, Artificial Sequence
  MKO10044660_A_Rassf3
  gRNA
acgcuuauaaagcgcaaacu

SEQ ID NO: 44661 - RNA, 20 nt, Artificial Sequence
  MKO10044661_A_Rassf4
  gRNA
accggugccgucguaucuuc

SEQ ID NO: 44662 - RNA, 20 nt, Artificial Sequence
  MKO10044662_A_Rassf4
  gRNA
uucgcuuggugcccgggauu

SEQ ID NO: 44663 - RNA, 20 nt, Artificial Sequence
  MKO10044663_A_Rassf4
  gRNA
gaagggacucugaucaucga

SEQ ID NO: 44664 - RNA, 20 nt, Artificial Sequence
  MKO10044664_A_Rassf5
  gRNA
acagcacccgcccacgauac

SEQ ID NO: 44665 - RNA, 20 nt, Artificial Sequence
  MKO10044665_A_Rassf5
  gRNA
uuucuggagagcgucuaucc

SEQ ID NO: 44666 - RNA, 20 nt, Artificial Sequence
  MKO10044666_A_Rassf5
  gRNA
ugacggugcccgcugggauc

SEQ ID NO: 44667 - RNA, 20 nt, Artificial Sequence
  MKO10044667_A_Rassf6
  gRNA
auagacguguccguugauag

SEQ ID NO: 44668 - RNA, 20 nt, Artificial Sequence
  MKO10044668_A_Rassf6
  gRNA
uccuguccagcucgcugaua

SEQ ID NO: 44669 - RNA, 20 nt, Artificial Sequence
  MKO10044669_A_Rassf6
  gRNA
cgguguguucaacagaucaa

SEQ ID NO: 44670 - RNA, 20 nt, Artificial Sequence
  MKO10044670_A_Rassf7
  gRNA
ucacggccugguaucgccga

SEQ ID NO: 44671 - RNA, 20 nt, Artificial Sequence
  MKO10044671_A_Rassf7
  gRNA
ggcuaggcccuguccgccuc

SEQ ID NO: 44672 - RNA, 20 nt, Artificial Sequence
  MKO10044672_A_Rassf7
  gRNA
gaaacauacccucgggacuc

SEQ ID NO: 44673 - RNA, 20 nt, Artificial Sequence
  MKO10044673_A_Rassf8
  gRNA
cacggagaucgaggccucgc

SEQ ID NO: 44674 - RNA, 20 nt, Artificial Sequence
  MKO10044674_A_Rassf8
  gRNA
uuagaggcgccauuccaguc

SEQ ID NO: 44675 - RNA, 20 nt, Artificial Sequence
  MKO10044675_A_Rassf8
  gRNA
acgugcagcucaucuugcgu

SEQ ID NO: 44676 - RNA, 20 nt, Artificial Sequence
  MKO10044676_A_Rassf9
  gRNA
cgcagacaaucuucucgucc

SEQ ID NO: 44677 - RNA, 20 nt, Artificial Sequence
  MKO10044677_A_Rassf9
  gRNA
uggggcuaauuacguucacg

SEQ ID NO: 44678 - RNA, 20 nt, Artificial Sequence
  MKO10044678_A_Rassf9
  gRNA
ugaagacacgacauaaaaac

SEQ ID NO: 44679 - RNA, 20 nt, Artificial Sequence
  MKO10044679_A_Raver1
  gRNA
acuugaguucguagucgcuc

SEQ ID NO: 44680 - RNA, 20 nt, Artificial Sequence
  MKO10044680_A_Raver1
  gRNA
cugacagcucccgcucucga

SEQ ID NO: 44681 - RNA, 20 nt, Artificial Sequence
  MKO10044681_A_Raver1
  gRNA
caucgagagugcaacaaugc

SEQ ID NO: 44682 - RNA, 20 nt, Artificial Sequence
  MKO10044682_A_Raver2
  gRNA
ccucauagcagcucagcgcg

SEQ ID NO: 44683 - RNA, 20 nt, Artificial Sequence
  MKO10044683_A_Raver2
  gRNA
acugcuagagugcuucgccc

SEQ ID NO: 44684 - RNA, 20 nt, Artificial Sequence
  MKO10044684_A_Raver2
  gRNA
gaagaacucguccgugccua

SEQ ID NO: 44685 - RNA, 20 nt, Artificial Sequence
  MKO10044685_A_Rax
  gRNA
aaacgcgacgugcucccgcc

SEQ ID NO: 44686 - RNA, 20 nt, Artificial Sequence
  MKO10044686_A_Rax
  gRNA
auucggggacaaguucucgc

SEQ ID NO: 44687 - RNA, 20 nt, Artificial Sequence
  MKO10044687_A_Rax
  gRNA
cgagaagcucccguccgcca

SEQ ID NO: 44688 - RNA, 20 nt, Artificial Sequence
  MKO10044688_A_Rb1cc1
  gRNA
agaguguguacuuacagcgc

SEQ ID NO: 44689 - RNA, 20 nt, Artificial Sequence
  MKO10044689_A_Rb1cc1
  gRNA
cugaacguggcaaagaacuu

SEQ ID NO: 44690 - RNA, 20 nt, Artificial Sequence
  MKO10044690_A_Rb1cc1
  gRNA
ucaagauagacccaaugaug

SEQ ID NO: 44691 - RNA, 20 nt, Artificial Sequence
  MKO10044691_A_Rb1
  gRNA
agaaaucgauaccaguacca

SEQ ID NO: 44692 - RNA, 20 nt, Artificial Sequence
  MKO10044692_A_Rb1
  gRNA
ugacauagcauuaucaaccu

SEQ ID NO: 44693 - RNA, 20 nt, Artificial Sequence
  MKO10044693_A_Rb1
  gRNA
uugggagaaaguuucauccg

SEQ ID NO: 44694 - RNA, 20 nt, Artificial Sequence
  MKO10044694_A_Rbak
  gRNA
auguacugaaguccgacauc

SEQ ID NO: 44695 - RNA, 20 nt, Artificial Sequence
  MKO10044695_A_Rbak
  gRNA
ccguacgcuuguagugugug

SEQ ID NO: 44696 - RNA, 20 nt, Artificial Sequence
  MKO10044696_A_Rbak
  gRNA
aaggugaccgccaugcucag

SEQ ID NO: 44697 - RNA, 20 nt, Artificial Sequence
  MKO10044697_A_Rbbp4
  gRNA
aaccccgauuugcgucuccg

SEQ ID NO: 44698 - RNA, 20 nt, Artificial Sequence
  MKO10044698_A_Rbbp4
  gRNA
uucuuccacugcgucgucaa

SEQ ID NO: 44699 - RNA, 20 nt, Artificial Sequence
  MKO10044699_A_Rbbp4
  gRNA
ucgcgucaccuggucacauc

SEQ ID NO: 44700 - RNA, 20 nt, Artificial Sequence
  MKO10044700_A_Rbbp5
  gRNA
uccccuaguuggagccgaga

SEQ ID NO: 44701 - RNA, 20 nt, Artificial Sequence
  MKO10044701_A_Rbbp5
  gRNA
acgauggccggauuguuauu

SEQ ID NO: 44702 - RNA, 20 nt, Artificial Sequence
  MKO10044702_A_Rbbp5
  gRNA
acugaucucgaggaugauau

SEQ ID NO: 44703 - RNA, 20 nt, Artificial Sequence
  MKO10044703_A_Rbbp6
  gRNA
accuucuuucgucugugcgu

SEQ ID NO: 44704 - RNA, 20 nt, Artificial Sequence
  MKO10044704_A_Rbbp6
  gRNA
accaacgcacagacgaaaga

SEQ ID NO: 44705 - RNA, 20 nt, Artificial Sequence
  MKO10044705_A_Rbbp6
  gRNA
aagucgaacugaaccaguga

SEQ ID NO: 44706 - RNA, 20 nt, Artificial Sequence
  MKO10044706_A_Rbbp7
  gRNA
uacaccguuucuguaugacc

SEQ ID NO: 44707 - RNA, 20 nt, Artificial Sequence
  MKO10044707_A_Rbbp7
  gRNA
ugcccagcacuagccaauga

SEQ ID NO: 44708 - RNA, 20 nt, Artificial Sequence
  MKO10044708_A_Rbbp7
  gRNA
ugcccuucauuggcuagugc

SEQ ID NO: 44709 - RNA, 20 nt, Artificial Sequence
  MKO10044709_A_Rbbp8nl
  gRNA
agugaagcggcuucggaguc

SEQ ID NO: 44710 - RNA, 20 nt, Artificial Sequence
  MKO10044710_A_Rbbp8nl
  gRNA
cgaucgaugcauggucaccc

SEQ ID NO: 44711 - RNA, 20 nt, Artificial Sequence
  MKO10044711_A_Rbbp8nl
  gRNA
gaaggagaaccugcgagugc

SEQ ID NO: 44712 - RNA, 20 nt, Artificial Sequence
  MKO10044712_A_Rbbp8
  gRNA
agaccagcagaaaguccuuc

SEQ ID NO: 44713 - RNA, 20 nt, Artificial Sequence
  MKO10044713_A_Rbbp8
  gRNA
ucagcucuguaauaagcuua

SEQ ID NO: 44714 - RNA, 20 nt, Artificial Sequence
  MKO10044714_A_Rbbp8
  gRNA
gcauaugcacaaaaagcagc

SEQ ID NO: 44715 - RNA, 20 nt, Artificial Sequence
  MKO10044715_A_Rbbp9
  gRNA
uuguacaaauucacugaccg

SEQ ID NO: 44716 - RNA, 20 nt, Artificial Sequence
  MKO10044716_A_Rbbp9
  gRNA
accauaccucauggcugcga

SEQ ID NO: 44717 - RNA, 20 nt, Artificial Sequence
  MKO10044717_A_Rbbp9
  gRNA
gacgagaagaccaucaucau

SEQ ID NO: 44718 - RNA, 20 nt, Artificial Sequence
  MKO10044718_A_Rbck1
  gRNA
aguacgcccggauaugacag

SEQ ID NO: 44719 - RNA, 20 nt, Artificial Sequence
  MKO10044719_A_Rbck1
  gRNA
acguguugcgggcugacagc

SEQ ID NO: 44720 - RNA, 20 nt, Artificial Sequence
  MKO10044720_A_Rbck1
  gRNA
cagcuuaccgguggugacuc

SEQ ID NO: 44721 - RNA, 20 nt, Artificial Sequence
  MKO10044721_A_Rbfa
  gRNA
cuuucagguagaucgguugc

SEQ ID NO: 44722 - RNA, 20 nt, Artificial Sequence
  MKO10044722_A_Rbfa
  gRNA
uccaagucgucccuuucauc

SEQ ID NO: 44723 - RNA, 20 nt, Artificial Sequence
  MKO10044723_A_Rbfa
  gRNA
agaggagcgcugccuacaug

SEQ ID NO: 44724 - RNA, 20 nt, Artificial Sequence
  MKO10044724_A_Rbfox1
  gRNA
gaugaugcagccccgaccga

SEQ ID NO: 44725 - RNA, 20 nt, Artificial Sequence
  MKO10044725_A_Rbfox1
  gRNA
accagugcgcagaccgucuc

SEQ ID NO: 44726 - RNA, 20 nt, Artificial Sequence
  MKO10044726_A_Rbfox1
  gRNA
caucccgcgccagaguacac

SEQ ID NO: 44727 - RNA, 20 nt, Artificial Sequence
  MKO10044727_A_Rbfox2
  gRNA
gcguacucccguagaggguc

SEQ ID NO: 44728 - RNA, 20 nt, Artificial Sequence
  MKO10044728_A_Rbfox2
  gRNA
ggugccgugcaauuucuccc

SEQ ID NO: 44729 - RNA, 20 nt, Artificial Sequence
  MKO10044729_A_Rbfox2
  gRNA
aacaacaacuccugacgcaa

SEQ ID NO: 44730 - RNA, 20 nt, Artificial Sequence
  MKO10044730_A_Rbfox3
  gRNA
ucaccccgaacauuugccgc

SEQ ID NO: 44731 - RNA, 20 nt, Artificial Sequence
  MKO10044731_A_Rbfox3
  gRNA
ggucucuuaccggcaccguc

SEQ ID NO: 44732 - RNA, 20 nt, Artificial Sequence
  MKO10044732_A_Rbfox3
  gRNA
guagagggucaugccgugcu

SEQ ID NO: 44733 - RNA, 20 nt, Artificial Sequence
  MKO10044733_A_Rbks
  gRNA
guguguccaagcugcgcgac

SEQ ID NO: 44734 - RNA, 20 nt, Artificial Sequence
  MKO10044734_A_Rbks
  gRNA
uugcucccagucgcgcagcu

SEQ ID NO: 44735 - RNA, 20 nt, Artificial Sequence
  MKO10044735_A_Rbks
  gRNA
ccagaauaucaucgucauag

SEQ ID NO: 44736 - RNA, 20 nt, Artificial Sequence
  MKO10044736_A_Rbl1
  gRNA
auccgcucacgaaacucuug

SEQ ID NO: 44737 - RNA, 20 nt, Artificial Sequence
  MKO10044737_A_Rbl1
  gRNA
cuuagcugagcgcaguauuc

SEQ ID NO: 44738 - RNA, 20 nt, Artificial Sequence
  MKO10044738_A_Rbl1
  gRNA
uuuaacaagucucgucuauu

SEQ ID NO: 44739 - RNA, 20 nt, Artificial Sequence
  MKO10044739_A_Rbl2
  gRNA
ccccaugauuagcgaugauc

SEQ ID NO: 44740 - RNA, 20 nt, Artificial Sequence
  MKO10044740_A_Rbl2
  gRNA
cuaaucuuucaguacguucu

SEQ ID NO: 44741 - RNA, 20 nt, Artificial Sequence
  MKO10044741_A_Rbl2
  gRNA
accucugcuccgaacagcga

SEQ ID NO: 44742 - RNA, 20 nt, Artificial Sequence
  MKO10044742_A_Rbm10
  gRNA
ccuucuucuagagguggucg

SEQ ID NO: 44743 - RNA, 20 nt, Artificial Sequence
  MKO10044743_A_Rbm10
  gRNA
acgauggauggaagccaauc

SEQ ID NO: 44744 - RNA, 20 nt, Artificial Sequence
  MKO10044744_A_Rbm10
  gRNA
gcugucuccaggucagagcc

SEQ ID NO: 44745 - RNA, 20 nt, Artificial Sequence
  MKO10044745_A_Rbm11
  gRNA
uacaggucagggucgcuugg

SEQ ID NO: 44746 - RNA, 20 nt, Artificial Sequence
  MKO10044746_A_Rbm11
  gRNA
gaccaauuaaugugcaguau

SEQ ID NO: 44747 - RNA, 20 nt, Artificial Sequence
  MKO10044747_A_Rbm11
  gRNA
cuacugucgcugucgcuguc

SEQ ID NO: 44748 - RNA, 20 nt, Artificial Sequence
  MKO10044748_A_Rbm12b1
  gRNA
gaccauuuccaauccuccag

SEQ ID NO: 44749 - RNA, 20 nt, Artificial Sequence
  MKO10044749_A_Rbm12b1
  gRNA
agccacccgaagaacauuuc

SEQ ID NO: 44750 - RNA, 20 nt, Artificial Sequence
  MKO10044750_A_Rbm12b1
  gRNA
agugucaugagaaagaucgu

SEQ ID NO: 44751 - RNA, 20 nt, Artificial Sequence
  MKO10044751_A_Rbm12b2
  gRNA
gaaacgauagcuucuccuaa

SEQ ID NO: 44752 - RNA, 20 nt, Artificial Sequence
  MKO10044752_A_Rbm12b2
  gRNA
cguuucaauacaguauaaug

SEQ ID NO: 44753 - RNA, 20 nt, Artificial Sequence
  MKO10044753_A_Rbm12b2
  gRNA
gucuagaauuucauuagcau

SEQ ID NO: 44754 - RNA, 20 nt, Artificial Sequence
  MKO10044754_A_Rbm12
  gRNA
gcugaugauucaacgcuaug

SEQ ID NO: 44755 - RNA, 20 nt, Artificial Sequence
  MKO10044755_A_Rbm12
  gRNA
cccccaauauggauugggcc

SEQ ID NO: 44756 - RNA, 20 nt, Artificial Sequence
  MKO10044756_A_Rbm12
  gRNA
acaaaugcacugcaucgacu

SEQ ID NO: 44757 - RNA, 20 nt, Artificial Sequence
  MKO10044757_A_Rbm14
  gRNA
cgauggggcggauacgacac

SEQ ID NO: 44758 - RNA, 20 nt, Artificial Sequence
  MKO10044758_A_Rbm14
  gRNA
gcguccaggucgcgcgcucg

SEQ ID NO: 44759 - RNA, 20 nt, Artificial Sequence
  MKO10044759_A_Rbm14
  gRNA
cugcggucgcgaccaaagaa

SEQ ID NO: 44760 - RNA, 20 nt, Artificial Sequence
  MKO10044760_A_Rbm15b
  gRNA
gcucuacgaucgcccgcuca

SEQ ID NO: 44761 - RNA, 20 nt, Artificial Sequence
  MKO10044761_A_Rbm15b
  gRNA
uacgggcuguacgacgaccg

SEQ ID NO: 44762 - RNA, 20 nt, Artificial Sequence
  MKO10044762_A_Rbm15b
  gRNA
cggaccaucgaucacgucaa

SEQ ID NO: 44763 - RNA, 20 nt, Artificial Sequence
  MKO10044763_A_Rbm15
  gRNA
uuacgccccgucauccagcg

SEQ ID NO: 44764 - RNA, 20 nt, Artificial Sequence
  MKO10044764_A_Rbm15
  gRNA
gucaagcccaagcgcucccg

SEQ ID NO: 44765 - RNA, 20 nt, Artificial Sequence
  MKO10044765_A_Rbm15
  gRNA
caagcaaaacuggugaacag

SEQ ID NO: 44766 - RNA, 20 nt, Artificial Sequence
  MKO10044766_A_Rbm17
  gRNA
ccucgcuuuaggucgaugac

SEQ ID NO: 44767 - RNA, 20 nt, Artificial Sequence
  MKO10044767_A_Rbm17
  gRNA
ucuuucucuacaagagacgu

SEQ ID NO: 44768 - RNA, 20 nt, Artificial Sequence
  MKO10044768_A_Rbm17
  gRNA
uggucgucuugaaaacccac

SEQ ID NO: 44769 - RNA, 20 nt, Artificial Sequence
  MKO10044769_A_Rbm18
  gRNA
gacuuccucuuccauaaguc

SEQ ID NO: 44770 - RNA, 20 nt, Artificial Sequence
  MKO10044770_A_Rbm18
  gRNA
gacuuaccuugacuugagcg

SEQ ID NO: 44771 - RNA, 20 nt, Artificial Sequence
  MKO10044771_A_Rbm18
  gRNA
ccaucaucuucgagacuucc

SEQ ID NO: 44772 - RNA, 20 nt, Artificial Sequence
  MKO10044772_A_Rbm19
  gRNA
ggagucuugcgacggcugcu

SEQ ID NO: 44773 - RNA, 20 nt, Artificial Sequence
  MKO10044773_A_Rbm19
  gRNA
acccaucgaagccccgagcu

SEQ ID NO: 44774 - RNA, 20 nt, Artificial Sequence
  MKO10044774_A_Rbm19
  gRNA
cacgugggcaaacgacgcuu

SEQ ID NO: 44775 - RNA, 20 nt, Artificial Sequence
  MKO10044775_A_Rbm20
  gRNA
cgaaaaggcgauugcgguug

SEQ ID NO: 44776 - RNA, 20 nt, Artificial Sequence
  MKO10044776_A_Rbm20
  gRNA
gggccuacaccggcuacuac

SEQ ID NO: 44777 - RNA, 20 nt, Artificial Sequence
  MKO10044777_A_Rbm20
  gRNA
cuccugaagcacguauacuc

SEQ ID NO: 44778 - RNA, 20 nt, Artificial Sequence
  MKO10044778_A_Rbm22
  gRNA
auaauccugcaucacgaacc

SEQ ID NO: 44779 - RNA, 20 nt, Artificial Sequence
  MKO10044779_A_Rbm22
  gRNA
gcacucaccauucguauaua

SEQ ID NO: 44780 - RNA, 20 nt, Artificial Sequence
  MKO10044780_A_Rbm22
  gRNA
agaaaacccuuauauacgaa

SEQ ID NO: 44781 - RNA, 20 nt, Artificial Sequence
  MKO10044781_A_Rbm24
  gRNA
cgcccacuacgucuacccgc

SEQ ID NO: 44782 - RNA, 20 nt, Artificial Sequence
  MKO10044782_A_Rbm24
  gRNA
aacuuacaaauccguagccc

SEQ ID NO: 44783 - RNA, 20 nt, Artificial Sequence
  MKO10044783_A_Rbm24
  gRNA
agcggaguacugagcguagg

SEQ ID NO: 44784 - RNA, 20 nt, Artificial Sequence
  MKO10044784_A_Rbm25
  gRNA
auuauacuuacaguuggagc

SEQ ID NO: 44785 - RNA, 20 nt, Artificial Sequence
  MKO10044785_A_Rbm25
  gRNA
gccauaauacucauugguac

SEQ ID NO: 44786 - RNA, 20 nt, Artificial Sequence
  MKO10044786_A_Rbm25
  gRNA
caugcaauaaucugagagca

SEQ ID NO: 44787 - RNA, 20 nt, Artificial Sequence
  MKO10044787_A_Rbm26
  gRNA
ggagaagucgcaguuacagc

SEQ ID NO: 44788 - RNA, 20 nt, Artificial Sequence
  MKO10044788_A_Rbm26
  gRNA
ucccucgccuucuguuauac

SEQ ID NO: 44789 - RNA, 20 nt, Artificial Sequence
  MKO10044789_A_Rbm26
  gRNA
ccuccagagcagccaucguc

SEQ ID NO: 44790 - RNA, 20 nt, Artificial Sequence
  MKO10044790_A_Rbm27
  gRNA
acuaugagcgguacuacgag

SEQ ID NO: 44791 - RNA, 20 nt, Artificial Sequence
  MKO10044791_A_Rbm27
  gRNA
uguaucgggagaaguaugac

SEQ ID NO: 44792 - RNA, 20 nt, Artificial Sequence
  MKO10044792_A_Rbm27
  gRNA
agccaacuauguuguagcac

SEQ ID NO: 44793 - RNA, 20 nt, Artificial Sequence
  MKO10044793_A_Rbm28
  gRNA
ucucaaaggcgcgaauauga

SEQ ID NO: 44794 - RNA, 20 nt, Artificial Sequence
  MKO10044794_A_Rbm28
  gRNA
aucgaucuuacaaccuucaa

SEQ ID NO: 44795 - RNA, 20 nt, Artificial Sequence
  MKO10044795_A_Rbm28
  gRNA
cuagggaguaaggcaugccg

SEQ ID NO: 44796 - RNA, 20 nt, Artificial Sequence
  MKO10044796_A_Rbm31y
  gRNA
aaaacgcggaauaaauucgc

SEQ ID NO: 44797 - RNA, 20 nt, Artificial Sequence
  MKO10044797_A_Rbm31y
  gRNA
gaauacugccagccucgcug

SEQ ID NO: 44798 - RNA, 20 nt, Artificial Sequence
  MKO10044798_A_Rbm31y
  gRNA
agcaaagcaguuuguucuga

SEQ ID NO: 44799 - RNA, 20 nt, Artificial Sequence
  MKO10044799_A_Rbm33
  gRNA
guuacagagugauaacgaag

SEQ ID NO: 44800 - RNA, 20 nt, Artificial Sequence
  MKO10044800_A_Rbm33
  gRNA
cuucaucugacaaauccgac

SEQ ID NO: 44801 - RNA, 20 nt, Artificial Sequence
  MKO10044801_A_Rbm33
  gRNA
aucagucugaauaccaccuc

SEQ ID NO: 44802 - RNA, 20 nt, Artificial Sequence
  MKO10044802_A_Rbm34
  gRNA
auccguacgauuucguucug

SEQ ID NO: 44803 - RNA, 20 nt, Artificial Sequence
  MKO10044803_A_Rbm34
  gRNA
gacaggucgccgacagcuug

SEQ ID NO: 44804 - RNA, 20 nt, Artificial Sequence
  MKO10044804_A_Rbm34
  gRNA
cugucccaccagguagucgc

SEQ ID NO: 44805 - RNA, 20 nt, Artificial Sequence
  MKO10044805_A_Rbm38
  gRNA
guacuuucugagcgaugcgu

SEQ ID NO: 44806 - RNA, 20 nt, Artificial Sequence
  MKO10044806_A_Rbm38
  gRNA
cacucacgaagccguagccg

SEQ ID NO: 44807 - RNA, 20 nt, Artificial Sequence
  MKO10044807_A_Rbm38
  gRNA
uguauacucaagguagggcg

SEQ ID NO: 44808 - RNA, 20 nt, Artificial Sequence
  MKO10044808_A_Rbm39
  gRNA
gacgaagccgcucacgcagu

SEQ ID NO: 44809 - RNA, 20 nt, Artificial Sequence
  MKO10044809_A_Rbm39
  gRNA
uucuaucccgacugcgugag

SEQ ID NO: 44810 - RNA, 20 nt, Artificial Sequence
  MKO10044810_A_Rbm39
  gRNA
cccgaagcaaaaguccauuu

SEQ ID NO: 44811 - RNA, 20 nt, Artificial Sequence
  MKO10044811_A_Rbm3
  gRNA
cccauaccuagucccuggau

SEQ ID NO: 44812 - RNA, 20 nt, Artificial Sequence
  MKO10044812_A_Rbm3
  gRNA
cauggcucacccucagagau

SEQ ID NO: 44813 - RNA, 20 nt, Artificial Sequence
  MKO10044813_A_Rbm3
  gRNA
ucccccagugguuguuguca

SEQ ID NO: 44814 - RNA, 20 nt, Artificial Sequence
  MKO10044814_A_Rbm41
  gRNA
gcugcauccgugagugguag

SEQ ID NO: 44815 - RNA, 20 nt, Artificial Sequence
  MKO10044815_A_Rbm41
  gRNA
ugaucgucacuccuuccuua

SEQ ID NO: 44816 - RNA, 20 nt, Artificial Sequence
  MKO10044816_A_Rbm41
  gRNA
aagccauguuuccggugaaa

SEQ ID NO: 44817 - RNA, 20 nt, Artificial Sequence
  MKO10044817_A_Rbm42
  gRNA
gcgauaauugggcggaucac

SEQ ID NO: 44818 - RNA, 20 nt, Artificial Sequence
  MKO10044818_A_Rbm42
  gRNA
ggcuuuggcccugccgaucg

SEQ ID NO: 44819 - RNA, 20 nt, Artificial Sequence
  MKO10044819_A_Rbm42
  gRNA
gcccacgguagaagcgaugc

SEQ ID NO: 44820 - RNA, 20 nt, Artificial Sequence
  MKO10044820_A_Rbm43
  gRNA
gagaacucggcgucgauacu

SEQ ID NO: 44821 - RNA, 20 nt, Artificial Sequence
  MKO10044821_A_Rbm43
  gRNA
ccacauguccacccucgucu

SEQ ID NO: 44822 - RNA, 20 nt, Artificial Sequence
  MKO10044822_A_Rbm43
  gRNA
gaagugcuacuuccaagacg

SEQ ID NO: 44823 - RNA, 20 nt, Artificial Sequence
  MKO10044823_A_Rbm44
  gRNA
aauaacuccguugcaaccau

SEQ ID NO: 44824 - RNA, 20 nt, Artificial Sequence
  MKO10044824_A_Rbm44
  gRNA
gcguggccuguaacaccgcc

SEQ ID NO: 44825 - RNA, 20 nt, Artificial Sequence
  MKO10044825_A_Rbm44
  gRNA
aguccauaagggcauaccuc

SEQ ID NO: 44826 - RNA, 20 nt, Artificial Sequence
  MKO10044826_A_Rbm45
  gRNA
ggacucucgacaccaccgac

SEQ ID NO: 44827 - RNA, 20 nt, Artificial Sequence
  MKO10044827_A_Rbm45
  gRNA
auugcccagucccgaucauc

SEQ ID NO: 44828 - RNA, 20 nt, Artificial Sequence
  MKO10044828_A_Rbm45
  gRNA
guaccuugaacuucucccgc

SEQ ID NO: 44829 - RNA, 20 nt, Artificial Sequence
  MKO10044829_A_Rbm46
  gRNA
acucuccccacucgucucaa

SEQ ID NO: 44830 - RNA, 20 nt, Artificial Sequence
  MKO10044830_A_Rbm46
  gRNA
ugagauccauuugcgauugc

SEQ ID NO: 44831 - RNA, 20 nt, Artificial Sequence
  MKO10044831_A_Rbm46
  gRNA
ucagaaugaagccgcauugc

SEQ ID NO: 44832 - RNA, 20 nt, Artificial Sequence
  MKO10044832_A_Rbm47
  gRNA
aacaacuacgagauccgccc

SEQ ID NO: 44833 - RNA, 20 nt, Artificial Sequence
  MKO10044833_A_Rbm47
  gRNA
gccguguaugggggcuacgc

SEQ ID NO: 44834 - RNA, 20 nt, Artificial Sequence
  MKO10044834_A_Rbm47
  gRNA
aaguacgguggacccccgcc

SEQ ID NO: 44835 - RNA, 20 nt, Artificial Sequence
  MKO10044835_A_Rbm48
  gRNA
gcgagacugugaucgagaac

SEQ ID NO: 44836 - RNA, 20 nt, Artificial Sequence
  MKO10044836_A_Rbm48
  gRNA
cgcucuagaugaauacccag

SEQ ID NO: 44837 - RNA, 20 nt, Artificial Sequence
  MKO10044837_A_Rbm48
  gRNA
auacaacggcaaccuuaauu

SEQ ID NO: 44838 - RNA, 20 nt, Artificial Sequence
  MKO10044838_A_Rbm4b
  gRNA
acagccgcauuccgacguag

SEQ ID NO: 44839 - RNA, 20 nt, Artificial Sequence
  MKO10044839_A_Rbm4b
  gRNA
cguccgaucuuacgaagcug

SEQ ID NO: 44840 - RNA, 20 nt, Artificial Sequence
  MKO10044840_A_Rbm4b
  gRNA
aggauggugaagcuguucau

SEQ ID NO: 44841 - RNA, 20 nt, Artificial Sequence
  MKO10044841_A_Rbm4
  gRNA
agcccccugcgucgcgcuac

SEQ ID NO: 44842 - RNA, 20 nt, Artificial Sequence
  MKO10044842_A_Rbm4
  gRNA
acgcggcccgaacgaucuau

SEQ ID NO: 44843 - RNA, 20 nt, Artificial Sequence
  MKO10044843_A_Rbm4
  gRNA
gagauggugaagcuguucau

SEQ ID NO: 44844 - RNA, 20 nt, Artificial Sequence
  MKO10044844_A_Rbm5
  gRNA
ucuuacaucgcucucgguga

SEQ ID NO: 44845 - RNA, 20 nt, Artificial Sequence
  MKO10044845_A_Rbm5
  gRNA
cugucucuagguguaagccg

SEQ ID NO: 44846 - RNA, 20 nt, Artificial Sequence
  MKO10044846_A_Rbm5
  gRNA
agcaagaccaucaugcuccg

SEQ ID NO: 44847 - RNA, 20 nt, Artificial Sequence
  MKO10044847_A_Rbm6
  gRNA
cuguccccagguuacgacua

SEQ ID NO: 44848 - RNA, 20 nt, Artificial Sequence
  MKO10044848_A_Rbm6
  gRNA
aaggaccaccuauggacuac

SEQ ID NO: 44849 - RNA, 20 nt, Artificial Sequence
  MKO10044849_A_Rbm6
  gRNA
aacauaccugaaggucuugu

SEQ ID NO: 44850 - RNA, 20 nt, Artificial Sequence
  MKO10044850_A_Rbm7
  gRNA
aaucccaacugauccgcaug

SEQ ID NO: 44851 - RNA, 20 nt, Artificial Sequence
  MKO10044851_A_Rbm7
  gRNA
gcuugccgcugauaaucuuc

SEQ ID NO: 44852 - RNA, 20 nt, Artificial Sequence
  MKO10044852_A_Rbm7
  gRNA
caaccuccacaucuccuaac

SEQ ID NO: 44853 - RNA, 20 nt, Artificial Sequence
  MKO10044853_A_Rbm8a
  gRNA
uagaagaggggucccgagcg

SEQ ID NO: 44854 - RNA, 20 nt, Artificial Sequence
  MKO10044854_A_Rbm8a
  gRNA
aauccucccgcauccgcgcu

SEQ ID NO: 44855 - RNA, 20 nt, Artificial Sequence
  MKO10044855_A_Rbm8a
  gRNA
aagggccgcggcuuuggcuc

SEQ ID NO: 44856 - RNA, 20 nt, Artificial Sequence
  MKO10044856_A_Rbms1
  gRNA
cuuauccaaaaucgccuuug

SEQ ID NO: 44857 - RNA, 20 nt, Artificial Sequence
  MKO10044857_A_Rbms1
  gRNA
gcggcagguuagaaauguac

SEQ ID NO: 44858 - RNA, 20 nt, Artificial Sequence
  MKO10044858_A_Rbms1
  gRNA
uggcaccacuggaaucacgu

SEQ ID NO: 44859 - RNA, 20 nt, Artificial Sequence
  MKO10044859_A_Rbms2
  gRNA
aaaaccaaccuguauauccg

SEQ ID NO: 44860 - RNA, 20 nt, Artificial Sequence
  MKO10044860_A_Rbms2
  gRNA
ugcaaagccgaccccucugc

SEQ ID NO: 44861 - RNA, 20 nt, Artificial Sequence
  MKO10044861_A_Rbms2
  gRNA
cuuguccaggauggccuuag

SEQ ID NO: 44862 - RNA, 20 nt, Artificial Sequence
  MKO10044862_A_Rbms3
  gRNA
gaggacaguaguacguguac

SEQ ID NO: 44863 - RNA, 20 nt, Artificial Sequence
  MKO10044863_A_Rbms3
  gRNA
acgguugacauagcuugaug

SEQ ID NO: 44864 - RNA, 20 nt, Artificial Sequence
  MKO10044864_A_Rbms3
  gRNA
uugcacgccauuugccuuca

SEQ ID NO: 44865 - RNA, 20 nt, Artificial Sequence
  MKO10044865_A_Rbmx2
  gRNA
cccgcgcagcccucugacua

SEQ ID NO: 44866 - RNA, 20 nt, Artificial Sequence
  MKO10044866_A_Rbmx2
  gRNA
gucaaacuaccgggcuccuc

SEQ ID NO: 44867 - RNA, 20 nt, Artificial Sequence
  MKO10044867_A_Rbmx2
  gRNA
ucaacuuggaguggcggaaa

SEQ ID NO: 44868 - RNA, 20 nt, Artificial Sequence
  MKO10044868_A_Rbmxl1
  gRNA
augguugaagcagaucgccc

SEQ ID NO: 44869 - RNA, 20 nt, Artificial Sequence
  MKO10044869_A_Rbmxl1
  gRNA
ugccucccccucuaucagau

SEQ ID NO: 44870 - RNA, 20 nt, Artificial Sequence
  MKO10044870_A_Rbmxl1
  gRNA
acuuuaacaugaguucuucc

SEQ ID NO: 44871 - RNA, 20 nt, Artificial Sequence
  MKO10044871_A_Rbmxl2
  gRNA
auucgucucgcgcgcucgag

SEQ ID NO: 44872 - RNA, 20 nt, Artificial Sequence
  MKO10044872_A_Rbmxl2
  gRNA
uacugugagcgcgacggcua

SEQ ID NO: 44873 - RNA, 20 nt, Artificial Sequence
  MKO10044873_A_Rbmxl2
  gRNA
cgcagcgagcgcuacucgag

SEQ ID NO: 44874 - RNA, 20 nt, Artificial Sequence
  MKO10044874_A_Rbmx
  gRNA
ccuuaagccccugugucccg

SEQ ID NO: 44875 - RNA, 20 nt, Artificial Sequence
  MKO10044875_A_Rbmx
  gRNA
cucuugacuuauucguuucu

SEQ ID NO: 44876 - RNA, 20 nt, Artificial Sequence
  MKO10044876_A_Rbmx
  gRNA
cgagaaacgaauaagucaag

SEQ ID NO: 44877 - RNA, 20 nt, Artificial Sequence
  MKO10044877_A_Rbmy
  gRNA
cagcauucuuagcaucugca

SEQ ID NO: 44878 - RNA, 20 nt, Artificial Sequence
  MKO10044878_A_Rbmy
  gRNA
cgugaaacuaagaagucuag

SEQ ID NO: 44879 - RNA, 20 nt, Artificial Sequence
  MKO10044879_A_Rbmy
  gRNA
cccaaguucccuucacauga

SEQ ID NO: 44880 - RNA, 20 nt, Artificial Sequence
  MKO10044880_A_Rbp1
  gRNA
cgcgcuuaccgagcgcgcgc

SEQ ID NO: 44881 - RNA, 20 nt, Artificial Sequence
  MKO10044881_A_Rbp1
  gRNA
accccuuguagacgucaacg

SEQ ID NO: 44882 - RNA, 20 nt, Artificial Sequence
  MKO10044882_A_Rbp1
  gRNA
cauagacgaccgcaagugca

SEQ ID NO: 44883 - RNA, 20 nt, Artificial Sequence
  MKO10044883_A_Rbp2
  gRNA
cacguuccgcaacuacgacc

SEQ ID NO: 44884 - RNA, 20 nt, Artificial Sequence
  MKO10044884_A_Rbp2
  gRNA
ccuggacggccgacauguca

SEQ ID NO: 44885 - RNA, 20 nt, Artificial Sequence
  MKO10044885_A_Rbp2
  gRNA
aucaugacgaaggaccaaaa

SEQ ID NO: 44886 - RNA, 20 nt, Artificial Sequence
  MKO10044886_A_Rbp3
  gRNA
ggugauuucgccgaccagug

SEQ ID NO: 44887 - RNA, 20 nt, Artificial Sequence
  MKO10044887_A_Rbp3
  gRNA
acguggacaccgucuacgau

SEQ ID NO: 44888 - RNA, 20 nt, Artificial Sequence
  MKO10044888_A_Rbp3
  gRNA
augacucggucagcgaacuu

SEQ ID NO: 44889 - RNA, 20 nt, Artificial Sequence
  MKO10044889_A_Rbp4
  gRNA
gcagcgccgagcgcgacugc

SEQ ID NO: 44890 - RNA, 20 nt, Artificial Sequence
  MKO10044890_A_Rbp4
  gRNA
gcucacccugcagucgcgcu

SEQ ID NO: 44891 - RNA, 20 nt, Artificial Sequence
  MKO10044891_A_Rbp4
  gRNA
aguccgugucgaugauccag

SEQ ID NO: 44892 - RNA, 20 nt, Artificial Sequence
  MKO10044892_A_Rbp7
  gRNA
aaacucacuugcguacagag

SEQ ID NO: 44893 - RNA, 20 nt, Artificial Sequence
  MKO10044893_A_Rbp7
  gRNA
ucucagcagcgacaacuucg

SEQ ID NO: 44894 - RNA, 20 nt, Artificial Sequence
  MKO10044894_A_Rbp7
  gRNA
cgaaggggaccagcuccacc

SEQ ID NO: 44895 - RNA, 20 nt, Artificial Sequence
  MKO10044895_A_Rbpjl
  gRNA
ugggcccggucuccgcagau

SEQ ID NO: 44896 - RNA, 20 nt, Artificial Sequence
  MKO10044896_A_Rbpjl
  gRNA
gcccaccgucugcgguuaca

SEQ ID NO: 44897 - RNA, 20 nt, Artificial Sequence
  MKO10044897_A_Rbpjl
  gRNA
cccuccagccaggacccgcg

SEQ ID NO: 44898 - RNA, 20 nt, Artificial Sequence
  MKO10044898_A_Rbpj
  gRNA
ugcuuaccuagugagucguu

SEQ ID NO: 44899 - RNA, 20 nt, Artificial Sequence
  MKO10044899_A_Rbpj
  gRNA
uuuccaggaaguuuggugag

SEQ ID NO: 44900 - RNA, 20 nt, Artificial Sequence
  MKO10044900_A_Rbpj
  gRNA
cgaaauuauuuaaaagaacg

SEQ ID NO: 44901 - RNA, 20 nt, Artificial Sequence
  MKO10044901_A_Rbpms2
  gRNA
guccgcacacuguuugucag

SEQ ID NO: 44902 - RNA, 20 nt, Artificial Sequence
  MKO10044902_A_Rbpms2
  gRNA
gucuugaggugagcuugauc

SEQ ID NO: 44903 - RNA, 20 nt, Artificial Sequence
  MKO10044903_A_Rbpms2
  gRNA
gaucaagcucaccucaagac

SEQ ID NO: 44904 - RNA, 20 nt, Artificial Sequence
  MKO10044904_A_Rbpms
  gRNA
accgggaagaugaacggcgg

SEQ ID NO: 44905 - RNA, 20 nt, Artificial Sequence
  MKO10044905_A_Rbpms
  gRNA
guccggacccuauuugucag

SEQ ID NO: 44906 - RNA, 20 nt, Artificial Sequence
  MKO10044906_A_Rbpms
  gRNA
gaaggagaacaccccgagcg

SEQ ID NO: 44907 - RNA, 20 nt, Artificial Sequence
  MKO10044907_A_Rbx1
  gRNA
ucccacagguaucgaauguc

SEQ ID NO: 44908 - RNA, 20 nt, Artificial Sequence
  MKO10044908_A_Rbx1
  gRNA
gucuuucagguaugggcauu

SEQ ID NO: 44909 - RNA, 20 nt, Artificial Sequence
  MKO10044909_A_Rbx1
  gRNA
cuccuugcaguggaaugcag

SEQ ID NO: 44910 - RNA, 20 nt, Artificial Sequence
  MKO10044910_A_Rc3h1
  gRNA
uucugagucgcccaaugcag

SEQ ID NO: 44911 - RNA, 20 nt, Artificial Sequence
  MKO10044911_A_Rc3h1
  gRNA
agaagagucuucaucacguu

SEQ ID NO: 44912 - RNA, 20 nt, Artificial Sequence
  MKO10044912_A_Rc3h1
  gRNA
aucgagcagcccucauagca

SEQ ID NO: 44913 - RNA, 20 nt, Artificial Sequence
  MKO10044913_A_Rc3h2
  gRNA
aauacggaguccugcuucca

SEQ ID NO: 44914 - RNA, 20 nt, Artificial Sequence
  MKO10044914_A_Rc3h2
  gRNA
ucgugucagagcuaugcgag

SEQ ID NO: 44915 - RNA, 20 nt, Artificial Sequence
  MKO10044915_A_Rc3h2
  gRNA
cccugagccguccaaugcaa

SEQ ID NO: 44916 - RNA, 20 nt, Artificial Sequence
  MKO10044916_A_Rcan1
  gRNA
gcgcgccgguucagcugagg

SEQ ID NO: 44917 - RNA, 20 nt, Artificial Sequence
  MKO10044917_A_Rcan1
  gRNA
uuaagagcuucaaacguguc

SEQ ID NO: 44918 - RNA, 20 nt, Artificial Sequence
  MKO10044918_A_Rcan1
  gRNA
agggguugcugaaguuuauc

SEQ ID NO: 44919 - RNA, 20 nt, Artificial Sequence
  MKO10044919_A_Rcan2
  gRNA
ugagucuacaccgagcgucg

SEQ ID NO: 44920 - RNA, 20 nt, Artificial Sequence
  MKO10044920_A_Rcan2
  gRNA
ugaaauuuauucgaacccgu

SEQ ID NO: 44921 - RNA, 20 nt, Artificial Sequence
  MKO10044921_A_Rcan2
  gRNA
gcgcuuaccugguccuaguu

SEQ ID NO: 44922 - RNA, 20 nt, Artificial Sequence
  MKO10044922_A_Rcan3
  gRNA
aaagcuucagcuuccguccg

SEQ ID NO: 44923 - RNA, 20 nt, Artificial Sequence
  MKO10044923_A_Rcan3
  gRNA
gcugaagcuuuacuucgcac

SEQ ID NO: 44924 - RNA, 20 nt, Artificial Sequence
  MKO10044924_A_Rcan3
  gRNA
aaccgaguccacccccagug

SEQ ID NO: 44925 - RNA, 20 nt, Artificial Sequence
  MKO10044925_A_Rcbtb1
  gRNA
uacuaaucucuugaucaagc

SEQ ID NO: 44926 - RNA, 20 nt, Artificial Sequence
  MKO10044926_A_Rcbtb1
  gRNA
cuauaacaacuguggucagg

SEQ ID NO: 44927 - RNA, 20 nt, Artificial Sequence
  MKO10044927_A_Rcbtb1
  gRNA
uagauggagucgucuaugcc

SEQ ID NO: 44928 - RNA, 20 nt, Artificial Sequence
  MKO10044928_A_Rcbtb2
  gRNA
cauaucguccuugcgacaac

SEQ ID NO: 44929 - RNA, 20 nt, Artificial Sequence
  MKO10044929_A_Rcbtb2
  gRNA
cuaacaucuucaacgaugac

SEQ ID NO: 44930 - RNA, 20 nt, Artificial Sequence
  MKO10044930_A_Rcbtb2
  gRNA
uucuguuaccuguugucgca

SEQ ID NO: 44931 - RNA, 20 nt, Artificial Sequence
  MKO10044931_A_Rcc1
  gRNA
agacacggccgucuucggug

SEQ ID NO: 44932 - RNA, 20 nt, Artificial Sequence
  MKO10044932_A_Rcc1
  gRNA
agugcagcuggaugcgcccg

SEQ ID NO: 44933 - RNA, 20 nt, Artificial Sequence
  MKO10044933_A_Rcc1
  gRNA
ccuucucuuagcuaugcgcu

SEQ ID NO: 44934 - RNA, 20 nt, Artificial Sequence
  MKO10044934_A_Rcc2
  gRNA
gcagcugcguaccgcaaccu

SEQ ID NO: 44935 - RNA, 20 nt, Artificial Sequence
  MKO10044935_A_Rcc2
  gRNA
ccguccaaucaagucccagu

SEQ ID NO: 44936 - RNA, 20 nt, Artificial Sequence
  MKO10044936_A_Rcc2
  gRNA
cugccagcacgauugccuca

SEQ ID NO: 44937 - RNA, 20 nt, Artificial Sequence
  MKO10044937_A_Rccd1
  gRNA
cggcuccagcacggaagugc

SEQ ID NO: 44938 - RNA, 20 nt, Artificial Sequence
  MKO10044938_A_Rccd1
  gRNA
gguaccagguucugcguuac

SEQ ID NO: 44939 - RNA, 20 nt, Artificial Sequence
  MKO10044939_A_Rccd1
  gRNA
cggaucccgacacacagcug

SEQ ID NO: 44940 - RNA, 20 nt, Artificial Sequence
  MKO10044940_A_Rce1
  gRNA
ggaacgccgcuugauaacag

SEQ ID NO: 44941 - RNA, 20 nt, Artificial Sequence
  MKO10044941_A_Rce1
  gRNA
gcccaugcuagcgccgugca

SEQ ID NO: 44942 - RNA, 20 nt, Artificial Sequence
  MKO10044942_A_Rce1
  gRNA
accaccccgcuguuaucaag

SEQ ID NO: 44943 - RNA, 20 nt, Artificial Sequence
  MKO10044943_A_Rchy1
  gRNA
ugccuaaccacgaaucuucg

SEQ ID NO: 44944 - RNA, 20 nt, Artificial Sequence
  MKO10044944_A_Rchy1
  gRNA
gcuagaucguuucaaaguca

SEQ ID NO: 44945 - RNA, 20 nt, Artificial Sequence
  MKO10044945_A_Rchy1
  gRNA
gugacaagcuuuauaccugc

SEQ ID NO: 44946 - RNA, 20 nt, Artificial Sequence
  MKO10044946_A_Rcl1
  gRNA
gcuccacagacccgccauac

SEQ ID NO: 44947 - RNA, 20 nt, Artificial Sequence
  MKO10044947_A_Rcl1
  gRNA
uacucaccgaagggucaacc

SEQ ID NO: 44948 - RNA, 20 nt, Artificial Sequence
  MKO10044948_A_Rcl1
  gRNA
agcacuucgcccccuccucc

SEQ ID NO: 44949 - RNA, 20 nt, Artificial Sequence
  MKO10044949_A_Rcn1
  gRNA
ugcgcauggucguaguccug

SEQ ID NO: 44950 - RNA, 20 nt, Artificial Sequence
  MKO10044950_A_Rcn1
  gRNA
ucaggacuacgaccaugcgc

SEQ ID NO: 44951 - RNA, 20 nt, Artificial Sequence
  MKO10044951_A_Rcn1
  gRNA
acucaccgauguacucaucc

SEQ ID NO: 44952 - RNA, 20 nt, Artificial Sequence
  MKO10044952_A_Rcn2
  gRNA
gucgaugaguauguuaaacu

SEQ ID NO: 44953 - RNA, 20 nt, Artificial Sequence
  MKO10044953_A_Rcn2
  gRNA
acaacauccagauguacgac

SEQ ID NO: 44954 - RNA, 20 nt, Artificial Sequence
  MKO10044954_A_Rcn2
  gRNA
acagcgacggcgcugugacg

SEQ ID NO: 44955 - RNA, 20 nt, Artificial Sequence
  MKO10044955_A_Rcn3
  gRNA
caggcggaucguagaccgca

SEQ ID NO: 44956 - RNA, 20 nt, Artificial Sequence
  MKO10044956_A_Rcn3
  gRNA
cgccaucuuggucggcuacc

SEQ ID NO: 44957 - RNA, 20 nt, Artificial Sequence
  MKO10044957_A_Rcn3
  gRNA
cccucacaugcgggacaucg

SEQ ID NO: 44958 - RNA, 20 nt, Artificial Sequence
  MKO10044958_A_Rcor1
  gRNA
uugacugcgccuugccaguu

SEQ ID NO: 44959 - RNA, 20 nt, Artificial Sequence
  MKO10044959_A_Rcor1
  gRNA
cccgcuucuguuuccgagca

SEQ ID NO: 44960 - RNA, 20 nt, Artificial Sequence
  MKO10044960_A_Rcor1
  gRNA
agucaagaacgagacaaucu

SEQ ID NO: 44961 - RNA, 20 nt, Artificial Sequence
  MKO10044961_A_Rcor2
  gRNA
ccgaagucgaacuaguguga

SEQ ID NO: 44962 - RNA, 20 nt, Artificial Sequence
  MKO10044962_A_Rcor2
  gRNA
ccaucacacuaguucgacuu

SEQ ID NO: 44963 - RNA, 20 nt, Artificial Sequence
  MKO10044963_A_Rcor2
  gRNA
guaccaucugcuggauccgc

SEQ ID NO: 44964 - RNA, 20 nt, Artificial Sequence
  MKO10044964_A_Rcor3
  gRNA
cggaucccugaauucgaucc

SEQ ID NO: 44965 - RNA, 20 nt, Artificial Sequence
  MKO10044965_A_Rcor3
  gRNA
uaucuaccuggaucgaauuc

SEQ ID NO: 44966 - RNA, 20 nt, Artificial Sequence
  MKO10044966_A_Rcor3
  gRNA
ugaaguuagggagguccgca

SEQ ID NO: 44967 - RNA, 20 nt, Artificial Sequence
  MKO10044967_A_Rcsd1
  gRNA
cauccgaucccacccaagug

SEQ ID NO: 44968 - RNA, 20 nt, Artificial Sequence
  MKO10044968_A_Rcsd1
  gRNA
auaccugaagcuucucgauc

SEQ ID NO: 44969 - RNA, 20 nt, Artificial Sequence
  MKO10044969_A_Rcsd1
  gRNA
ugauacgauggccuugaguc

SEQ ID NO: 44970 - RNA, 20 nt, Artificial Sequence
  MKO10044970_A_Rcvrn
  gRNA
gcggaacacgugcugcgcgu

SEQ ID NO: 44971 - RNA, 20 nt, Artificial Sequence
  MKO10044971_A_Rcvrn
  gRNA
cgaacuccugccgcgugaug

SEQ ID NO: 44972 - RNA, 20 nt, Artificial Sequence
  MKO10044972_A_Rcvrn
  gRNA
ggaauucaucgaggggaccc

SEQ ID NO: 44973 - RNA, 20 nt, Artificial Sequence
  MKO10044973_A_Rd3
  gRNA
gugucguuccaccggagcca

SEQ ID NO: 44974 - RNA, 20 nt, Artificial Sequence
  MKO10044974_A_Rd3
  gRNA
ggcccggaccccggccgaga

SEQ ID NO: 44975 - RNA, 20 nt, Artificial Sequence
  MKO10044975_A_Rd3
  gRNA
gcuguuccgcuccguguugc

SEQ ID NO: 44976 - RNA, 20 nt, Artificial Sequence
  MKO10044976_A_Rdh10
  gRNA
agcucgcgaccgucacaaug

SEQ ID NO: 44977 - RNA, 20 nt, Artificial Sequence
  MKO10044977_A_Rdh10
  gRNA
ugugacggucgcgagcuccc

SEQ ID NO: 44978 - RNA, 20 nt, Artificial Sequence
  MKO10044978_A_Rdh10
  gRNA
ccugcccccguguaacuuac

SEQ ID NO: 44979 - RNA, 20 nt, Artificial Sequence
  MKO10044979_A_Rdh11
  gRNA
ucaggucuucguacggaaac

SEQ ID NO: 44980 - RNA, 20 nt, Artificial Sequence
  MKO10044980_A_Rdh11
  gRNA
gccgucugcagucuucgagu

SEQ ID NO: 44981 - RNA, 20 nt, Artificial Sequence
  MKO10044981_A_Rdh11
  gRNA
cgugagauccaagccgucac

SEQ ID NO: 44982 - RNA, 20 nt, Artificial Sequence
  MKO10044982_A_Rdh12
  gRNA
ccaauuuccgcacuagcacc

SEQ ID NO: 44983 - RNA, 20 nt, Artificial Sequence
  MKO10044983_A_Rdh12
  gRNA
ggaaacggaucuugccaauc

SEQ ID NO: 44984 - RNA, 20 nt, Artificial Sequence
  MKO10044984_A_Rdh12
  gRNA
ucugcucuucacucgagaac

SEQ ID NO: 44985 - RNA, 20 nt, Artificial Sequence
  MKO10044985_A_Rdh13
  gRNA
accuucagggacuaugucgc

SEQ ID NO: 44986 - RNA, 20 nt, Artificial Sequence
  MKO10044986_A_Rdh13
  gRNA
agcacguacgcggggauuca

SEQ ID NO: 44987 - RNA, 20 nt, Artificial Sequence
  MKO10044987_A_Rdh13
  gRNA
uccaggaggcaacgucauuc

SEQ ID NO: 44988 - RNA, 20 nt, Artificial Sequence
  MKO10044988_A_Rdh14
  gRNA
gaauuagcccgucgcuuaga

SEQ ID NO: 44989 - RNA, 20 nt, Artificial Sequence
  MKO10044989_A_Rdh14
  gRNA
ucgggaccgcgcucgagcag

SEQ ID NO: 44990 - RNA, 20 nt, Artificial Sequence
  MKO10044990_A_Rdh14
  gRNA
gccuguucaccugacguaga

SEQ ID NO: 44991 - RNA, 20 nt, Artificial Sequence
  MKO10044991_A_Rdh16
  gRNA
aggugcaacaaggaccuguc

SEQ ID NO: 44992 - RNA, 20 nt, Artificial Sequence
  MKO10044992_A_Rdh16
  gRNA
ggucaacgucuccaguguca

SEQ ID NO: 44993 - RNA, 20 nt, Artificial Sequence
  MKO10044993_A_Rdh16
  gRNA
agacacucgacccaugacac

SEQ ID NO: 44994 - RNA, 20 nt, Artificial Sequence
  MKO10044994_A_Rdh19
  gRNA
ugacacucgacccaugaugc

SEQ ID NO: 44995 - RNA, 20 nt, Artificial Sequence
  MKO10044995_A_Rdh19
  gRNA
guggcucuaccuaguaucac

SEQ ID NO: 44996 - RNA, 20 nt, Artificial Sequence
  MKO10044996_A_Rdh19
  gRNA
cgagugucacuucaugguaa

SEQ ID NO: 44997 - RNA, 20 nt, Artificial Sequence
  MKO10044997_A_Rdh1
  gRNA
cuugugugacaaguagugac

SEQ ID NO: 44998 - RNA, 20 nt, Artificial Sequence
  MKO10044998_A_Rdh1
  gRNA
ccugcugaguaucgagugcg

SEQ ID NO: 44999 - RNA, 20 nt, Artificial Sequence
  MKO10044999_A_Rdh1
  gRNA
acacaagucuugaagccucc

SEQ ID NO: 45000 - RNA, 20 nt, Artificial Sequence
  MKO10045000_A_Rdh5
  gRNA
ccguagugggccuguauagc

SEQ ID NO: 45001 - RNA, 20 nt, Artificial Sequence
  MKO10045001_A_Rdh5
  gRNA
ccggcuaccuccagcuauac

SEQ ID NO: 45002 - RNA, 20 nt, Artificial Sequence
  MKO10045002_A_Rdh5
  gRNA
gauguugaccacccgacccc

SEQ ID NO: 45003 - RNA, 20 nt, Artificial Sequence
  MKO10045003_A_Rdh7
  gRNA
acauuaguccugaacccgcc

SEQ ID NO: 45004 - RNA, 20 nt, Artificial Sequence
  MKO10045004_A_Rdh7
  gRNA
gugugauagccucucguagu

SEQ ID NO: 45005 - RNA, 20 nt, Artificial Sequence
  MKO10045005_A_Rdh7
  gRNA
acacaaagacacucgaccca

SEQ ID NO: 45006 - RNA, 20 nt, Artificial Sequence
  MKO10045006_A_Rdh8
  gRNA
agauauugaauugucgcagc

SEQ ID NO: 45007 - RNA, 20 nt, Artificial Sequence
  MKO10045007_A_Rdh8
  gRNA
cacugcugaccaccacgaug

SEQ ID NO: 45008 - RNA, 20 nt, Artificial Sequence
  MKO10045008_A_Rdh8
  gRNA
caucauugcacacguccagc

SEQ ID NO: 45009 - RNA, 20 nt, Artificial Sequence
  MKO10045009_A_Rdh9
  gRNA
gaucaacgucgccagugucu

SEQ ID NO: 45010 - RNA, 20 nt, Artificial Sequence
  MKO10045010_A_Rdh9
  gRNA
aacuauguggcucuuucuag

SEQ ID NO: 45011 - RNA, 20 nt, Artificial Sequence
  MKO10045011_A_Rdh9
  gRNA
ucugaaaaggcuaaacgaau

SEQ ID NO: 45012 - RNA, 20 nt, Artificial Sequence
  MKO10045012_A_Rdm1
  gRNA
ggacgagccacugcagcguu

SEQ ID NO: 45013 - RNA, 20 nt, Artificial Sequence
  MKO10045013_A_Rdm1
  gRNA
ugcugccccccuacggaugc

SEQ ID NO: 45014 - RNA, 20 nt, Artificial Sequence
  MKO10045014_A_Rdm1
  gRNA
auggucgaaaaggaucauca

SEQ ID NO: 45015 - RNA, 20 nt, Artificial Sequence
  MKO10045015_A_Rdx
  gRNA
gccauccagcccaauacaac

SEQ ID NO: 45016 - RNA, 20 nt, Artificial Sequence
  MKO10045016_A_Rdx
  gRNA
gcucuaaacuugaacuguaa

SEQ ID NO: 45017 - RNA, 20 nt, Artificial Sequence
  MKO10045017_A_Rdx
  gRNA
uaugcuguccaagccaagua

SEQ ID NO: 45018 - RNA, 20 nt, Artificial Sequence
  MKO10045018_A_Rec8
  gRNA
uaucaaugcgaauccgcagc

SEQ ID NO: 45019 - RNA, 20 nt, Artificial Sequence
  MKO10045019_A_Rec8
  gRNA
agagugcaaccuccgguggc

SEQ ID NO: 45020 - RNA, 20 nt, Artificial Sequence
  MKO10045020_A_Rec8
  gRNA
gggcggggcagcccggccac

SEQ ID NO: 45021 - RNA, 20 nt, Artificial Sequence
  MKO10045021_A_Reck
  gRNA
ugcaugaauucgucuuugcc

SEQ ID NO: 45022 - RNA, 20 nt, Artificial Sequence
  MKO10045022_A_Reck
  gRNA
gggguauuuaagaaguccga

SEQ ID NO: 45023 - RNA, 20 nt, Artificial Sequence
  MKO10045023_A_Reck
  gRNA
uauuggcuuggagugccgac

SEQ ID NO: 45024 - RNA, 20 nt, Artificial Sequence
  MKO10045024_A_Recql4
  gRNA
ucugcguugcagcucgacuc

SEQ ID NO: 45025 - RNA, 20 nt, Artificial Sequence
  MKO10045025_A_Recql4
  gRNA
aacaaacgcuuuguacgagu

SEQ ID NO: 45026 - RNA, 20 nt, Artificial Sequence
  MKO10045026_A_Recql4
  gRNA
acggagaagccugccccgau

SEQ ID NO: 45027 - RNA, 20 nt, Artificial Sequence
  MKO10045027_A_Recql5
  gRNA
caugugccaagcgggaacgu

SEQ ID NO: 45028 - RNA, 20 nt, Artificial Sequence
  MKO10045028_A_Recql5
  gRNA
ccgacgucuauggcaaucug

SEQ ID NO: 45029 - RNA, 20 nt, Artificial Sequence
  MKO10045029_A_Recql5
  gRNA
cuuaccugcgugguaagccu

SEQ ID NO: 45030 - RNA, 20 nt, Artificial Sequence
  MKO10045030_A_Recql
  gRNA
uuuagaauggcauccgucuc

SEQ ID NO: 45031 - RNA, 20 nt, Artificial Sequence
  MKO10045031_A_Recql
  gRNA
auaccgucugagcacagcgc

SEQ ID NO: 45032 - RNA, 20 nt, Artificial Sequence
  MKO10045032_A_Recql
  gRNA
ggcugaggcgagcagcgacu

SEQ ID NO: 45033 - RNA, 20 nt, Artificial Sequence
  MKO10045033_A_Reep1
  gRNA
cgucucugcaggcuuauauu

SEQ ID NO: 45034 - RNA, 20 nt, Artificial Sequence
  MKO10045034_A_Reep1
  gRNA
uaugacgcccuugugcacuu

SEQ ID NO: 45035 - RNA, 20 nt, Artificial Sequence
  MKO10045035_A_Reep1
  gRNA
gccuuguaugaauaauaugc

SEQ ID NO: 45036 - RNA, 20 nt, Artificial Sequence
  MKO10045036_A_Reep2
  gRNA
agagcuaugagacgaugaug

SEQ ID NO: 45037 - RNA, 20 nt, Artificial Sequence
  MKO10045037_A_Reep2
  gRNA
guguugggugcacgaacuug

SEQ ID NO: 45038 - RNA, 20 nt, Artificial Sequence
  MKO10045038_A_Reep2
  gRNA
cgugaagaccaaaaacguga

SEQ ID NO: 45039 - RNA, 20 nt, Artificial Sequence
  MKO10045039_A_Reep3
  gRNA
ccguuucaaugacaguguag

SEQ ID NO: 45040 - RNA, 20 nt, Artificial Sequence
  MKO10045040_A_Reep3
  gRNA
cgacagcagccaaaugacga

SEQ ID NO: 45041 - RNA, 20 nt, Artificial Sequence
  MKO10045041_A_Reep3
  gRNA
uaaacucgccccucuagugu

SEQ ID NO: 45042 - RNA, 20 nt, Artificial Sequence
  MKO10045042_A_Reep4
  gRNA
gaucgacgcguguaucgugc

SEQ ID NO: 45043 - RNA, 20 nt, Artificial Sequence
  MKO10045043_A_Reep4
  gRNA
aucccuaucccgccaugaga

SEQ ID NO: 45044 - RNA, 20 nt, Artificial Sequence
  MKO10045044_A_Reep4
  gRNA
gggauggguggacaaacuuu

SEQ ID NO: 45045 - RNA, 20 nt, Artificial Sequence
  MKO10045045_A_Reep5
  gRNA
cugacguacugggugguaua

SEQ ID NO: 45046 - RNA, 20 nt, Artificial Sequence
  MKO10045046_A_Reep5
  gRNA
gucuccaggugucaucggac

SEQ ID NO: 45047 - RNA, 20 nt, Artificial Sequence
  MKO10045047_A_Reep5
  gRNA
cuuccucaagcacgaguccc

SEQ ID NO: 45048 - RNA, 20 nt, Artificial Sequence
  MKO10045048_A_Reep6
  gRNA
ccagaaaacguucgaagcgc

SEQ ID NO: 45049 - RNA, 20 nt, Artificial Sequence
  MKO10045049_A_Reep6
  gRNA
uucgagcgccccgagcgcuu

SEQ ID NO: 45050 - RNA, 20 nt, Artificial Sequence
  MKO10045050_A_Reep6
  gRNA
accuugcccgcguaguagaa

SEQ ID NO: 45051 - RNA, 20 nt, Artificial Sequence
  MKO10045051_A_Reg1
  gRNA
ucuccuaacaguuccaaucg

SEQ ID NO: 45052 - RNA, 20 nt, Artificial Sequence
  MKO10045052_A_Reg1
  gRNA
gcacuacagacgccaauguc

SEQ ID NO: 45053 - RNA, 20 nt, Artificial Sequence
  MKO10045053_A_Reg1
  gRNA
agauacacaguagccacgau

SEQ ID NO: 45054 - RNA, 20 nt, Artificial Sequence
  MKO10045054_A_Reg2
  gRNA
cuucacuauagaaccgucgu

SEQ ID NO: 45055 - RNA, 20 nt, Artificial Sequence
  MKO10045055_A_Reg2
  gRNA
gcuccaagcacugccaaccg

SEQ ID NO: 45056 - RNA, 20 nt, Artificial Sequence
  MKO10045056_A_Reg2
  gRNA
gagcaacuuuguggccucgc

SEQ ID NO: 45057 - RNA, 20 nt, Artificial Sequence
  MKO10045057_A_Reg3a
  gRNA
gcgauaagccuuguaaccca

SEQ ID NO: 45058 - RNA, 20 nt, Artificial Sequence
  MKO10045058_A_Reg3a
  gRNA
uaguuaugacaccuaaaucc

SEQ ID NO: 45059 - RNA, 20 nt, Artificial Sequence
  MKO10045059_A_Reg3a
  gRNA
ccuuccucuacugucaaccg

SEQ ID NO: 45060 - RNA, 20 nt, Artificial Sequence
  MKO10045060_A_Reg3b
  gRNA
cgcacgcauuaguugcccca

SEQ ID NO: 45061 - RNA, 20 nt, Artificial Sequence
  MKO10045061_A_Reg3b
  gRNA
agcuaccaauacacuuggau

SEQ ID NO: 45062 - RNA, 20 nt, Artificial Sequence
  MKO10045062_A_Reg3b
  gRNA
cgcuauugagcacagauacg

SEQ ID NO: 45063 - RNA, 20 nt, Artificial Sequence
  MKO10045063_A_Reg3d
  gRNA
acccucugaccuucuauaac

SEQ ID NO: 45064 - RNA, 20 nt, Artificial Sequence
  MKO10045064_A_Reg3d
  gRNA
ugguaucucccaguuauaga

SEQ ID NO: 45065 - RNA, 20 nt, Artificial Sequence
  MKO10045065_A_Reg3d
  gRNA
agacccuucauagcaugucc

SEQ ID NO: 45066 - RNA, 20 nt, Artificial Sequence
  MKO10045066_A_Reg3g
  gRNA
aucucaccagugucggguca

SEQ ID NO: 45067 - RNA, 20 nt, Artificial Sequence
  MKO10045067_A_Reg3g
  gRNA
gguacccugucaagagccuc

SEQ ID NO: 45068 - RNA, 20 nt, Artificial Sequence
  MKO10045068_A_Reg3g
  gRNA
ccuagauggccugccaaaag

SEQ ID NO: 45069 - RNA, 20 nt, Artificial Sequence
  MKO10045069_A_Reg4
  gRNA
ugggauuccagcgucuguac

SEQ ID NO: 45070 - RNA, 20 nt, Artificial Sequence
  MKO10045070_A_Reg4
  gRNA
gaccuauaguaaaaccaucc

SEQ ID NO: 45071 - RNA, 20 nt, Artificial Sequence
  MKO10045071_A_Reg4
  gRNA
ggcaucugucuugaaucaaa

SEQ ID NO: 45072 - RNA, 20 nt, Artificial Sequence
  MKO10045072_A_Rela
  gRNA
gcgauuccgcuauaaaugcg

SEQ ID NO: 45073 - RNA, 20 nt, Artificial Sequence
  MKO10045073_A_Rela
  gRNA
ucaucgaacagccgaagcaa

SEQ ID NO: 45074 - RNA, 20 nt, Artificial Sequence
  MKO10045074_A_Rela
  gRNA
gcccagaccgcaguauccau

SEQ ID NO: 45075 - RNA, 20 nt, Artificial Sequence
  MKO10045075_A_Relb
  gRNA
agcggcccucgcacucguag

SEQ ID NO: 45076 - RNA, 20 nt, Artificial Sequence
  MKO10045076_A_Relb
  gRNA
gcgcuuccgcuacgagugcg

SEQ ID NO: 45077 - RNA, 20 nt, Artificial Sequence
  MKO10045077_A_Relb
  gRNA
acugcacggacggcgucugc

SEQ ID NO: 45078 - RNA, 20 nt, Artificial Sequence
  MKO10045078_A_Rell1
  gRNA
acggccacggcgacaaggcg

SEQ ID NO: 45079 - RNA, 20 nt, Artificial Sequence
  MKO10045079_A_Rell1
  gRNA
acagcgugggcgauauugaa

SEQ ID NO: 45080 - RNA, 20 nt, Artificial Sequence
  MKO10045080_A_Rell1
  gRNA
guuccgccucuguuguacac

SEQ ID NO: 45081 - RNA, 20 nt, Artificial Sequence
  MKO10045081_A_Rell2
  gRNA
uguccgucagggucgcucua

SEQ ID NO: 45082 - RNA, 20 nt, Artificial Sequence
  MKO10045082_A_Rell2
  gRNA
gggguccccucaaguguaca

SEQ ID NO: 45083 - RNA, 20 nt, Artificial Sequence
  MKO10045083_A_Rell2
  gRNA
ccagccgccugacuaccccc

SEQ ID NO: 45084 - RNA, 20 nt, Artificial Sequence
  MKO10045084_A_Reln
  gRNA
aucauguccgaccaccaguu

SEQ ID NO: 45085 - RNA, 20 nt, Artificial Sequence
  MKO10045085_A_Reln
  gRNA
ggacggcuuaccgaauccaa

SEQ ID NO: 45086 - RNA, 20 nt, Artificial Sequence
  MKO10045086_A_Reln
  gRNA
ccagggcuacugcaacacau

SEQ ID NO: 45087 - RNA, 20 nt, Artificial Sequence
  MKO10045087_A_Relt
  gRNA
cugccacuucgacgccacgc

SEQ ID NO: 45088 - RNA, 20 nt, Artificial Sequence
  MKO10045088_A_Relt
  gRNA
ccgagguucaccguugcuac

SEQ ID NO: 45089 - RNA, 20 nt, Artificial Sequence
  MKO10045089_A_Relt
  gRNA
gcauggauaggaguuccaug

SEQ ID NO: 45090 - RNA, 20 nt, Artificial Sequence
  MKO10045090_A_Rel
  gRNA
gugaaguuaccauguucauc

SEQ ID NO: 45091 - RNA, 20 nt, Artificial Sequence
  MKO10045091_A_Rel
  gRNA
cacuuacgguugucauaaau

SEQ ID NO: 45092 - RNA, 20 nt, Artificial Sequence
  MKO10045092_A_Rel
  gRNA
uugucugugcugcgcucccc

SEQ ID NO: 45093 - RNA, 20 nt, Artificial Sequence
  MKO10045093_A_Rem1
  gRNA
gcuugcucgacgucgcagag

SEQ ID NO: 45094 - RNA, 20 nt, Artificial Sequence
  MKO10045094_A_Rem1
  gRNA
ccagcgcgcccgccgauucc

SEQ ID NO: 45095 - RNA, 20 nt, Artificial Sequence
  MKO10045095_A_Rem1
  gRNA
ccagcugaggcgcacgcauc

SEQ ID NO: 45096 - RNA, 20 nt, Artificial Sequence
  MKO10045096_A_Rem2
  gRNA
aggcucucacggcgcguagg

SEQ ID NO: 45097 - RNA, 20 nt, Artificial Sequence
  MKO10045097_A_Rem2
  gRNA
uugaagaacuuagcguugcg

SEQ ID NO: 45098 - RNA, 20 nt, Artificial Sequence
  MKO10045098_A_Rem2
  gRNA
caccaugauccgucucucau

SEQ ID NO: 45099 - RNA, 20 nt, Artificial Sequence
  MKO10045099_A_Ren1
  gRNA
uuucccgcucaggccguugg

SEQ ID NO: 45100 - RNA, 20 nt, Artificial Sequence
  MKO10045100_A_Ren1
  gRNA
aaccccgccaacggccugag

SEQ ID NO: 45101 - RNA, 20 nt, Artificial Sequence
  MKO10045101_A_Ren1
  gRNA
uacuuacagucaccgagucc

SEQ ID NO: 45102 - RNA, 20 nt, Artificial Sequence
  MKO10045102_A_Ren2
  gRNA
uuucccgcucaggccguugg

SEQ ID NO: 45103 - RNA, 20 nt, Artificial Sequence
  MKO10045103_A_Ren2
  gRNA
aaccccgccaacggccugag

SEQ ID NO: 45104 - RNA, 20 nt, Artificial Sequence
  MKO10045104_A_Ren2
  gRNA
uacuuacagucaccgagucc

SEQ ID NO: 45105 - RNA, 20 nt, Artificial Sequence
  MKO10045105_A_Renbp
  gRNA
uugaucgugugaucgcuuuc

SEQ ID NO: 45106 - RNA, 20 nt, Artificial Sequence
  MKO10045106_A_Renbp
  gRNA
ggauagcuaacccguguucc

SEQ ID NO: 45107 - RNA, 20 nt, Artificial Sequence
  MKO10045107_A_Renbp
  gRNA
cuuccgccguguugagcuuc

SEQ ID NO: 45108 - RNA, 20 nt, Artificial Sequence
  MKO10045108_A_Rep15
  gRNA
ugaagccguauuugcuuauc

SEQ ID NO: 45109 - RNA, 20 nt, Artificial Sequence
  MKO10045109_A_Rep15
  gRNA
cagucagugaacucgcugca

SEQ ID NO: 45110 - RNA, 20 nt, Artificial Sequence
  MKO10045110_A_Rep15
  gRNA
ucagcggauacucaaacccg

SEQ ID NO: 45111 - RNA, 20 nt, Artificial Sequence
  MKO10045111_A_Repin1
  gRNA
acggcgaccacacuccucgc

SEQ ID NO: 45112 - RNA, 20 nt, Artificial Sequence
  MKO10045112_A_Repin1
  gRNA
guaugcgccggugcgagguc

SEQ ID NO: 45113 - RNA, 20 nt, Artificial Sequence
  MKO10045113_A_Repin1
  gRNA
cugaaugcgacagacgcuuc

SEQ ID NO: 45114 - RNA, 20 nt, Artificial Sequence
  MKO10045114_A_Reps1
  gRNA
cgccgagcagaaauacuacu

SEQ ID NO: 45115 - RNA, 20 nt, Artificial Sequence
  MKO10045115_A_Reps1
  gRNA
uaccuggaggaccacgucgu

SEQ ID NO: 45116 - RNA, 20 nt, Artificial Sequence
  MKO10045116_A_Reps1
  gRNA
ugaaccgcgucauggcuucc

SEQ ID NO: 45117 - RNA, 20 nt, Artificial Sequence
  MKO10045117_A_Reps2
  gRNA
aagagaugccugccgacgaa

SEQ ID NO: 45118 - RNA, 20 nt, Artificial Sequence
  MKO10045118_A_Reps2
  gRNA
caggagccaaacccuuucgu

SEQ ID NO: 45119 - RNA, 20 nt, Artificial Sequence
  MKO10045119_A_Reps2
  gRNA
cuuccccgccucauuaccag

SEQ ID NO: 45120 - RNA, 20 nt, Artificial Sequence
  MKO10045120_A_Rer1
  gRNA
guacauugugaccuacgccu

SEQ ID NO: 45121 - RNA, 20 nt, Artificial Sequence
  MKO10045121_A_Rer1
  gRNA
gacguuaaaagccucgaaga

SEQ ID NO: 45122 - RNA, 20 nt, Artificial Sequence
  MKO10045122_A_Rer1
  gRNA
aauuucgucccuucauucga

SEQ ID NO: 45123 - RNA, 20 nt, Artificial Sequence
  MKO10045123_A_Rere
  gRNA
acuguguguauaucgagagu

SEQ ID NO: 45124 - RNA, 20 nt, Artificial Sequence
  MKO10045124_A_Rere
  gRNA
aguucccgauucuugaugac

SEQ ID NO: 45125 - RNA, 20 nt, Artificial Sequence
  MKO10045125_A_Rere
  gRNA
aucuacucaugaacgucaaa

SEQ ID NO: 45126 - RNA, 20 nt, Artificial Sequence
  MKO10045126_A_Rergl
  gRNA
gcucccgaauucuguagaua

SEQ ID NO: 45127 - RNA, 20 nt, Artificial Sequence
  MKO10045127_A_Rergl
  gRNA
uuccuuaccaagcgauucau

SEQ ID NO: 45128 - RNA, 20 nt, Artificial Sequence
  MKO10045128_A_Rergl
  gRNA
caccgacgacucauuguaaa

SEQ ID NO: 45129 - RNA, 20 nt, Artificial Sequence
  MKO10045129_A_Rerg
  gRNA
guuuacgacaucaccgaucg

SEQ ID NO: 45130 - RNA, 20 nt, Artificial Sequence
  MKO10045130_A_Rerg
  gRNA
uucuucgaagcucccucgau

SEQ ID NO: 45131 - RNA, 20 nt, Artificial Sequence
  MKO10045131_A_Rerg
  gRNA
guacucccagaugaaccguu

SEQ ID NO: 45132 - RNA, 20 nt, Artificial Sequence
  MKO10045132_A_Resp18
  gRNA
uuccaccagauuguacccga

SEQ ID NO: 45133 - RNA, 20 nt, Artificial Sequence
  MKO10045133_A_Resp18
  gRNA
gcuuaccuucggguacaauc

SEQ ID NO: 45134 - RNA, 20 nt, Artificial Sequence
  MKO10045134_A_Resp18
  gRNA
ccucaccccagcguuugccg

SEQ ID NO: 45135 - RNA, 20 nt, Artificial Sequence
  MKO10045135_A_Rest
  gRNA
caucaucugcacguacacga

SEQ ID NO: 45136 - RNA, 20 nt, Artificial Sequence
  MKO10045136_A_Rest
  gRNA
aucgccugcgaaaccucccc

SEQ ID NO: 45137 - RNA, 20 nt, Artificial Sequence
  MKO10045137_A_Rest
  gRNA
accaacgugccaaagggcgg

SEQ ID NO: 45138 - RNA, 20 nt, Artificial Sequence
  MKO10045138_A_Retnla
  gRNA
auucuccacgauaaucucua

SEQ ID NO: 45139 - RNA, 20 nt, Artificial Sequence
  MKO10045139_A_Retnla
  gRNA
gccugugcuuacucguugac

SEQ ID NO: 45140 - RNA, 20 nt, Artificial Sequence
  MKO10045140_A_Retnla
  gRNA
uccagucaacgaguaagcac

SEQ ID NO: 45141 - RNA, 20 nt, Artificial Sequence
  MKO10045141_A_Retnlb
  gRNA
gcguucccugggacuaucag

SEQ ID NO: 45142 - RNA, 20 nt, Artificial Sequence
  MKO10045142_A_Retnlb
  gRNA
agaagacgugacacuagugc

SEQ ID NO: 45143 - RNA, 20 nt, Artificial Sequence
  MKO10045143_A_Retnlb
  gRNA
ugcacuagugucacgucuuc

SEQ ID NO: 45144 - RNA, 20 nt, Artificial Sequence
  MKO10045144_A_Retnlg
  gRNA
ggggaccuuagaaucuauug

SEQ ID NO: 45145 - RNA, 20 nt, Artificial Sequence
  MKO10045145_A_Retnlg
  gRNA
ugaagccgugauacuaguac

SEQ ID NO: 45146 - RNA, 20 nt, Artificial Sequence
  MKO10045146_A_Retnlg
  gRNA
caccgcccguugcugccaac

SEQ ID NO: 45147 - RNA, 20 nt, Artificial Sequence
  MKO10045147_A_Retn
  gRNA
acgaaugucccacgagccac

SEQ ID NO: 45148 - RNA, 20 nt, Artificial Sequence
  MKO10045148_A_Retn
  gRNA
cgaccugcagcuuacagcag

SEQ ID NO: 45149 - RNA, 20 nt, Artificial Sequence
  MKO10045149_A_Retn
  gRNA
aaguuggccuccugcccaga

SEQ ID NO: 45150 - RNA, 20 nt, Artificial Sequence
  MKO10045150_A_Retsau
  gRNA
augacaacagccgcccgccu

SEQ ID NO: 45151 - RNA, 20 nt, Artificial Sequence
  MKO10045151_A_Retsau
  gRNA
guggugaucggcagcggcau

SEQ ID NO: 45152 - RNA, 20 nt, Artificial Sequence
  MKO10045152_A_Retsau
  gRNA
aucucacuggaacccccucg

SEQ ID NO: 45153 - RNA, 20 nt, Artificial Sequence
  MKO10045153_A_Ret
  gRNA
gcgauggcgaaagcgacguc

SEQ ID NO: 45154 - RNA, 20 nt, Artificial Sequence
  MKO10045154_A_Ret
  gRNA
ucuauggcgucuaccguaca

SEQ ID NO: 45155 - RNA, 20 nt, Artificial Sequence
  MKO10045155_A_Ret
  gRNA
agaagugccgagcuuccgcc

SEQ ID NO: 45156 - RNA, 20 nt, Artificial Sequence
  MKO10045156_A_Rev1
  gRNA
acggcgucugcaauauuuag

SEQ ID NO: 45157 - RNA, 20 nt, Artificial Sequence
  MKO10045157_A_Rev1
  gRNA
ugaaaugaaguugcaguccg

SEQ ID NO: 45158 - RNA, 20 nt, Artificial Sequence
  MKO10045158_A_Rev1
  gRNA
uuggucguagggcggguaca

SEQ ID NO: 45159 - RNA, 20 nt, Artificial Sequence
  MKO10045159_A_Rev3l
  gRNA
uagggaauaugcgcuucaug

SEQ ID NO: 45160 - RNA, 20 nt, Artificial Sequence
  MKO10045160_A_Rev3l
  gRNA
uaccucuaugugccauacga

SEQ ID NO: 45161 - RNA, 20 nt, Artificial Sequence
  MKO10045161_A_Rev3l
  gRNA
ugcuguccauaaccaucgua

SEQ ID NO: 45162 - RNA, 20 nt, Artificial Sequence
  MKO10045162_A_Rex2
  gRNA
uuguucuucucccagauucu

SEQ ID NO: 45163 - RNA, 20 nt, Artificial Sequence
  MKO10045163_A_Rex2
  gRNA
uuugcuccucaccaagaauc

SEQ ID NO: 45164 - RNA, 20 nt, Artificial Sequence
  MKO10045164_A_Rex2
  gRNA
guccaaaaacacguccuuga

SEQ ID NO: 45165 - RNA, 20 nt, Artificial Sequence
  MKO10045165_A_Rexo1
  gRNA
ggccacccggcguguaaguu

SEQ ID NO: 45166 - RNA, 20 nt, Artificial Sequence
  MKO10045166_A_Rexo1
  gRNA
agcacgccccccgacugcuc

SEQ ID NO: 45167 - RNA, 20 nt, Artificial Sequence
  MKO10045167_A_Rexo1
  gRNA
ggaacgcaaggcccgcuccc

SEQ ID NO: 45168 - RNA, 20 nt, Artificial Sequence
  MKO10045168_A_Rexo2
  gRNA
augcuguccagcaacucguc

SEQ ID NO: 45169 - RNA, 20 nt, Artificial Sequence
  MKO10045169_A_Rexo2
  gRNA
aggagucugcugucguacaa

SEQ ID NO: 45170 - RNA, 20 nt, Artificial Sequence
  MKO10045170_A_Rexo2
  gRNA
uaagaucagagucaguuauc

SEQ ID NO: 45171 - RNA, 20 nt, Artificial Sequence
  MKO10045171_A_Rexo4
  gRNA
ugauacuuacucagugggcg

SEQ ID NO: 45172 - RNA, 20 nt, Artificial Sequence
  MKO10045172_A_Rexo4
  gRNA
cccuagcuugacaaaagccu

SEQ ID NO: 45173 - RNA, 20 nt, Artificial Sequence
  MKO10045173_A_Rexo4
  gRNA
gugucgaucgugaaccagua

SEQ ID NO: 45174 - RNA, 20 nt, Artificial Sequence
  MKO10045174_A_Rfc1
  gRNA
cuuaccugucucagagacgu

SEQ ID NO: 45175 - RNA, 20 nt, Artificial Sequence
  MKO10045175_A_Rfc1
  gRNA
acgucagugcucgacuauuu

SEQ ID NO: 45176 - RNA, 20 nt, Artificial Sequence
  MKO10045176_A_Rfc1
  gRNA
uuuggaggcguccucuuuac

SEQ ID NO: 45177 - RNA, 20 nt, Artificial Sequence
  MKO10045177_A_Rfc2
  gRNA
auugaagcucaacgaaauag

SEQ ID NO: 45178 - RNA, 20 nt, Artificial Sequence
  MKO10045178_A_Rfc2
  gRNA
guuccaggacugcguccuuc

SEQ ID NO: 45179 - RNA, 20 nt, Artificial Sequence
  MKO10045179_A_Rfc2
  gRNA
cuugcugggccccgcccuga

SEQ ID NO: 45180 - RNA, 20 nt, Artificial Sequence
  MKO10045180_A_Rfc3
  gRNA
cagcgaccgaguuguaauuc

SEQ ID NO: 45181 - RNA, 20 nt, Artificial Sequence
  MKO10045181_A_Rfc3
  gRNA
ucggaucggggguaucaccu

SEQ ID NO: 45182 - RNA, 20 nt, Artificial Sequence
  MKO10045182_A_Rfc3
  gRNA
ugauacccccgauccgaagc

SEQ ID NO: 45183 - RNA, 20 nt, Artificial Sequence
  MKO10045183_A_Rfc4
  gRNA
uuaaaugcaucugaugaacg

SEQ ID NO: 45184 - RNA, 20 nt, Artificial Sequence
  MKO10045184_A_Rfc4
  gRNA
acucuuaaucgaaagaguuc

SEQ ID NO: 45185 - RNA, 20 nt, Artificial Sequence
  MKO10045185_A_Rfc4
  gRNA
cuccagccguccaaagugug

SEQ ID NO: 45186 - RNA, 20 nt, Artificial Sequence
  MKO10045186_A_Rfc5
  gRNA
gcccagaacgccuugagacg

SEQ ID NO: 45187 - RNA, 20 nt, Artificial Sequence
  MKO10045187_A_Rfc5
  gRNA
cccgaacaauaucgaucccu

SEQ ID NO: 45188 - RNA, 20 nt, Artificial Sequence
  MKO10045188_A_Rfc5
  gRNA
gcaaaccucaccucgucuca

SEQ ID NO: 45189 - RNA, 20 nt, Artificial Sequence
  MKO10045189_A_Rfesd
  gRNA
gacucugacuauuaugccac

SEQ ID NO: 45190 - RNA, 20 nt, Artificial Sequence
  MKO10045190_A_Rfesd
  gRNA
uucuggagggcccuuacacu

SEQ ID NO: 45191 - RNA, 20 nt, Artificial Sequence
  MKO10045191_A_Rfesd
  gRNA
auugccguuauccaccuuca

SEQ ID NO: 45192 - RNA, 20 nt, Artificial Sequence
  MKO10045192_A_Rffl
  gRNA
ccuucagcugccguacgguc

SEQ ID NO: 45193 - RNA, 20 nt, Artificial Sequence
  MKO10045193_A_Rffl
  gRNA
uccggguugugcuugcgaaa

SEQ ID NO: 45194 - RNA, 20 nt, Artificial Sequence
  MKO10045194_A_Rffl
  gRNA
acauugaaggccugaccgua

SEQ ID NO: 45195 - RNA, 20 nt, Artificial Sequence
  MKO10045195_A_Rfk
  gRNA
guggugcguggcuucggccg

SEQ ID NO: 45196 - RNA, 20 nt, Artificial Sequence
  MKO10045196_A_Rfk
  gRNA
uauuaugguugggccagcgu

SEQ ID NO: 45197 - RNA, 20 nt, Artificial Sequence
  MKO10045197_A_Rfk
  gRNA
ggccgaagccacgcaccacc

SEQ ID NO: 45198 - RNA, 20 nt, Artificial Sequence
  MKO10045198_A_Rfng
  gRNA
uugcccucaaaaugagcccg

SEQ ID NO: 45199 - RNA, 20 nt, Artificial Sequence
  MKO10045199_A_Rfng
  gRNA
gguccaggcuaggucgcccc

SEQ ID NO: 45200 - RNA, 20 nt, Artificial Sequence
  MKO10045200_A_Rfng
  gRNA
ggugcgcacagcagagcaau

SEQ ID NO: 45201 - RNA, 20 nt, Artificial Sequence
  MKO10045201_A_Rfpl3s
  gRNA
uggcaaaucgucacuaguug

SEQ ID NO: 45202 - RNA, 20 nt, Artificial Sequence
  MKO10045202_A_Rfpl3s
  gRNA
cuaauuugcagguccaacca

SEQ ID NO: 45203 - RNA, 20 nt, Artificial Sequence
  MKO10045203_A_Rfpl3s
  gRNA
ugccacuguauucaugaucc

SEQ ID NO: 45204 - RNA, 20 nt, Artificial Sequence
  MKO10045204_A_Rfpl4b
  gRNA
ggaacccucuaaugauuuaa

SEQ ID NO: 45205 - RNA, 20 nt, Artificial Sequence
  MKO10045205_A_Rfpl4b
  gRNA
agugggaguuguccacgaca

SEQ ID NO: 45206 - RNA, 20 nt, Artificial Sequence
  MKO10045206_A_Rfpl4b
  gRNA
auuaccccaucauacuugac

SEQ ID NO: 45207 - RNA, 20 nt, Artificial Sequence
  MKO10045207_A_Rfpl4
  gRNA
augcccacucuacguagccg

SEQ ID NO: 45208 - RNA, 20 nt, Artificial Sequence
  MKO10045208_A_Rfpl4
  gRNA
ucacuucaggccgccauuac

SEQ ID NO: 45209 - RNA, 20 nt, Artificial Sequence
  MKO10045209_A_Rfpl4
  gRNA
cacaguacaccguccccuuc

SEQ ID NO: 45210 - RNA, 20 nt, Artificial Sequence
  MKO10045210_A_Rft1
  gRNA
guacaacucacguuagccac

SEQ ID NO: 45211 - RNA, 20 nt, Artificial Sequence
  MKO10045211_A_Rft1
  gRNA
acaggacaagaagagccguc

SEQ ID NO: 45212 - RNA, 20 nt, Artificial Sequence
  MKO10045212_A_Rft1
  gRNA
uuccgaagagcuugucugag

SEQ ID NO: 45213 - RNA, 20 nt, Artificial Sequence
  MKO10045213_A_Rftn1
  gRNA
ugccgagauccuccgccacg

SEQ ID NO: 45214 - RNA, 20 nt, Artificial Sequence
  MKO10045214_A_Rftn1
  gRNA
aaggcugagcuucacgacga

SEQ ID NO: 45215 - RNA, 20 nt, Artificial Sequence
  MKO10045215_A_Rftn1
  gRNA
ugcaggagugaaccgaagac

SEQ ID NO: 45216 - RNA, 20 nt, Artificial Sequence
  MKO10045216_A_Rftn2
  gRNA
accauguacagcuuaccauc

SEQ ID NO: 45217 - RNA, 20 nt, Artificial Sequence
  MKO10045217_A_Rftn2
  gRNA
ucccuuccgcgucacuuuca

SEQ ID NO: 45218 - RNA, 20 nt, Artificial Sequence
  MKO10045218_A_Rftn2
  gRNA
aaggcgcgcaaggcuuguga

SEQ ID NO: 45219 - RNA, 20 nt, Artificial Sequence
  MKO10045219_A_Rfwd2
  gRNA
auacggugcuacucacugag

SEQ ID NO: 45220 - RNA, 20 nt, Artificial Sequence
  MKO10045220_A_Rfwd2
  gRNA
gauggucuuaccaaaagcug

SEQ ID NO: 45221 - RNA, 20 nt, Artificial Sequence
  MKO10045221_A_Rfwd2
  gRNA
aaagacucacccaagaaauu

SEQ ID NO: 45222 - RNA, 20 nt, Artificial Sequence
  MKO10045222_A_Rfwd3
  gRNA
ucuggugcuaacccaaccgc

SEQ ID NO: 45223 - RNA, 20 nt, Artificial Sequence
  MKO10045223_A_Rfwd3
  gRNA
aucuagcagcuccggcgguu

SEQ ID NO: 45224 - RNA, 20 nt, Artificial Sequence
  MKO10045224_A_Rfwd3
  gRNA
agaugaugcagucccuaaag

SEQ ID NO: 45225 - RNA, 20 nt, Artificial Sequence
  MKO10045225_A_Rfx1
  gRNA
ccugcagcuuaccaacauuc

SEQ ID NO: 45226 - RNA, 20 nt, Artificial Sequence
  MKO10045226_A_Rfx1
  gRNA
cuugggugggaacaccgguc

SEQ ID NO: 45227 - RNA, 20 nt, Artificial Sequence
  MKO10045227_A_Rfx1
  gRNA
ccacucuuagugcccggugc

SEQ ID NO: 45228 - RNA, 20 nt, Artificial Sequence
  MKO10045228_A_Rfx2
  gRNA
ggggacgcugucuacgccaa

SEQ ID NO: 45229 - RNA, 20 nt, Artificial Sequence
  MKO10045229_A_Rfx2
  gRNA
gcacacguacauggcuccgu

SEQ ID NO: 45230 - RNA, 20 nt, Artificial Sequence
  MKO10045230_A_Rfx2
  gRNA
agcagauucgccagcgucag

SEQ ID NO: 45231 - RNA, 20 nt, Artificial Sequence
  MKO10045231_A_Rfx3
  gRNA
cuauuugaucggcaauucaa

SEQ ID NO: 45232 - RNA, 20 nt, Artificial Sequence
  MKO10045232_A_Rfx3
  gRNA
gggauucagaugggcgucac

SEQ ID NO: 45233 - RNA, 20 nt, Artificial Sequence
  MKO10045233_A_Rfx3
  gRNA
ccggucaaugccgccucuuu

SEQ ID NO: 45234 - RNA, 20 nt, Artificial Sequence
  MKO10045234_A_Rfx4
  gRNA
cuccacgguggugaacaucg

SEQ ID NO: 45235 - RNA, 20 nt, Artificial Sequence
  MKO10045235_A_Rfx4
  gRNA
cggcaacgccugcagcaccg

SEQ ID NO: 45236 - RNA, 20 nt, Artificial Sequence
  MKO10045236_A_Rfx4
  gRNA
uauucuccccgguccaagcu

SEQ ID NO: 45237 - RNA, 20 nt, Artificial Sequence
  MKO10045237_A_Rfx5
  gRNA
guaccucuucucgccaacgc

SEQ ID NO: 45238 - RNA, 20 nt, Artificial Sequence
  MKO10045238_A_Rfx5
  gRNA
ugugcugagcgggcggcaac

SEQ ID NO: 45239 - RNA, 20 nt, Artificial Sequence
  MKO10045239_A_Rfx5
  gRNA
agucuucgggccuugauguc

SEQ ID NO: 45240 - RNA, 20 nt, Artificial Sequence
  MKO10045240_A_Rfx6
  gRNA
agaaagaugucugucgcuuc

SEQ ID NO: 45241 - RNA, 20 nt, Artificial Sequence
  MKO10045241_A_Rfx6
  gRNA
auacucgacaaugccaucaa

SEQ ID NO: 45242 - RNA, 20 nt, Artificial Sequence
  MKO10045242_A_Rfx6
  gRNA
agauacaaaucuucgcaaaa

SEQ ID NO: 45243 - RNA, 20 nt, Artificial Sequence
  MKO10045243_A_Rfx7
  gRNA
cugugcccgacuagaugaca

SEQ ID NO: 45244 - RNA, 20 nt, Artificial Sequence
  MKO10045244_A_Rfx7
  gRNA
ugagacgucacuccccaaac

SEQ ID NO: 45245 - RNA, 20 nt, Artificial Sequence
  MKO10045245_A_Rfx7
  gRNA
aggagcuacugcgacaaucu

SEQ ID NO: 45246 - RNA, 20 nt, Artificial Sequence
  MKO10045246_A_Rfx8
  gRNA
caagucaacccagcgacauu

SEQ ID NO: 45247 - RNA, 20 nt, Artificial Sequence
  MKO10045247_A_Rfx8
  gRNA
cuauagcaacguucuccagc

SEQ ID NO: 45248 - RNA, 20 nt, Artificial Sequence
  MKO10045248_A_Rfx8
  gRNA
gagauuuaugucgagaccug

SEQ ID NO: 45249 - RNA, 20 nt, Artificial Sequence
  MKO10045249_A_Rfxank
  gRNA
guggcuacacggacaucgug

SEQ ID NO: 45250 - RNA, 20 nt, Artificial Sequence
  MKO10045250_A_Rfxank
  gRNA
auagacguacccagucuagc

SEQ ID NO: 45251 - RNA, 20 nt, Artificial Sequence
  MKO10045251_A_Rfxank
  gRNA
ggggugaagccacgcucauc

SEQ ID NO: 45252 - RNA, 20 nt, Artificial Sequence
  MKO10045252_A_Rfxap
  gRNA
cuccaagaccugcacguacg

SEQ ID NO: 45253 - RNA, 20 nt, Artificial Sequence
  MKO10045253_A_Rfxap
  gRNA
ggacgacgacgccgaccugc

SEQ ID NO: 45254 - RNA, 20 nt, Artificial Sequence
  MKO10045254_A_Rfxap
  gRNA
ucuugcagggcgaucaccaa

SEQ ID NO: 45255 - RNA, 20 nt, Artificial Sequence
  MKO10045255_A_Rgag1
  gRNA
acgcuucaacaauaugauga

SEQ ID NO: 45256 - RNA, 20 nt, Artificial Sequence
  MKO10045256_A_Rgag1
  gRNA
uagagccgucauuagcacuu

SEQ ID NO: 45257 - RNA, 20 nt, Artificial Sequence
  MKO10045257_A_Rgag1
  gRNA
uuucaaguaguaacagcguu

SEQ ID NO: 45258 - RNA, 20 nt, Artificial Sequence
  MKO10045258_A_Rgag4
  gRNA
augucucgagcuacauccgc

SEQ ID NO: 45259 - RNA, 20 nt, Artificial Sequence
  MKO10045259_A_Rgag4
  gRNA
ccagaaucgagucccacuuc

SEQ ID NO: 45260 - RNA, 20 nt, Artificial Sequence
  MKO10045260_A_Rgag4
  gRNA
cuauggcggagcuaaugguc

SEQ ID NO: 45261 - RNA, 20 nt, Artificial Sequence
  MKO10045261_A_Rgcc
  gRNA
gucgaacucgcacagcacgu

SEQ ID NO: 45262 - RNA, 20 nt, Artificial Sequence
  MKO10045262_A_Rgcc
  gRNA
cgugcugugcgaguucgacg

SEQ ID NO: 45263 - RNA, 20 nt, Artificial Sequence
  MKO10045263_A_Rgcc
  gRNA
cgaagacuucauugccgauc

SEQ ID NO: 45264 - RNA, 20 nt, Artificial Sequence
  MKO10045264_A_Rgl1
  gRNA
ucccuggcagagcucgauuc

SEQ ID NO: 45265 - RNA, 20 nt, Artificial Sequence
  MKO10045265_A_Rgl1
  gRNA
aguacgagaccugcaagauc

SEQ ID NO: 45266 - RNA, 20 nt, Artificial Sequence
  MKO10045266_A_Rgl1
  gRNA
uguccccaaaagccgucagc

SEQ ID NO: 45267 - RNA, 20 nt, Artificial Sequence
  MKO10045267_A_Rgl2
  gRNA
guucggccaaguggucagcg

SEQ ID NO: 45268 - RNA, 20 nt, Artificial Sequence
  MKO10045268_A_Rgl2
  gRNA
cugucacaagccgccaguac

SEQ ID NO: 45269 - RNA, 20 nt, Artificial Sequence
  MKO10045269_A_Rgl2
  gRNA
ccacccgggcccggagguuu

SEQ ID NO: 45270 - RNA, 20 nt, Artificial Sequence
  MKO10045270_A_Rgl3
  gRNA
uguacccacagcccgcguuu

SEQ ID NO: 45271 - RNA, 20 nt, Artificial Sequence
  MKO10045271_A_Rgl3
  gRNA
ccucagcgcccgcaccuugc

SEQ ID NO: 45272 - RNA, 20 nt, Artificial Sequence
  MKO10045272_A_Rgl3
  gRNA
ccguguacagcgucucccug

SEQ ID NO: 45273 - RNA, 20 nt, Artificial Sequence
  MKO10045273_A_Rgma
  gRNA
cgaggagguagucaacgccg

SEQ ID NO: 45274 - RNA, 20 nt, Artificial Sequence
  MKO10045274_A_Rgma
  gRNA
cggggcuauccgagcgcucc

SEQ ID NO: 45275 - RNA, 20 nt, Artificial Sequence
  MKO10045275_A_Rgma
  gRNA
cgagggucggccacaauccc

SEQ ID NO: 45276 - RNA, 20 nt, Artificial Sequence
  MKO10045276_A_Rgmb
  gRNA
ucaagugacgaacgugccug

SEQ ID NO: 45277 - RNA, 20 nt, Artificial Sequence
  MKO10045277_A_Rgmb
  gRNA
gggcaugcaucucuacguag

SEQ ID NO: 45278 - RNA, 20 nt, Artificial Sequence
  MKO10045278_A_Rgmb
  gRNA
gcaggucgaagacacacgau

SEQ ID NO: 45279 - RNA, 20 nt, Artificial Sequence
  MKO10045279_A_Rgn
  gRNA
uggaggaagaguaauucgcc

SEQ ID NO: 45280 - RNA, 20 nt, Artificial Sequence
  MKO10045280_A_Rgn
  gRNA
ccgcagaauuguuuacaaga

SEQ ID NO: 45281 - RNA, 20 nt, Artificial Sequence
  MKO10045281_A_Rgn
  gRNA
uuugacuaugaccuacaaac

SEQ ID NO: 45282 - RNA, 20 nt, Artificial Sequence
  MKO10045282_A_Rgp1
  gRNA
cagugcuacucgacucucgc

SEQ ID NO: 45283 - RNA, 20 nt, Artificial Sequence
  MKO10045283_A_Rgp1
  gRNA
ugaugggugaguucacgcgc

SEQ ID NO: 45284 - RNA, 20 nt, Artificial Sequence
  MKO10045284_A_Rgp1
  gRNA
acguccggcugacuagaguc

SEQ ID NO: 45285 - RNA, 20 nt, Artificial Sequence
  MKO10045285_A_Rgr
  gRNA
ccgcugcaacaagggcauuc

SEQ ID NO: 45286 - RNA, 20 nt, Artificial Sequence
  MKO10045286_A_Rgr
  gRNA
guggcagugcagccguugcc

SEQ ID NO: 45287 - RNA, 20 nt, Artificial Sequence
  MKO10045287_A_Rgr
  gRNA
gcuguacacuggacuauucg

SEQ ID NO: 45288 - RNA, 20 nt, Artificial Sequence
  MKO10045288_A_Rgs10
  gRNA
ucugaaacccaagcgaacug

SEQ ID NO: 45289 - RNA, 20 nt, Artificial Sequence
  MKO10045289_A_Rgs10
  gRNA
cuccacguugacuugugaag

SEQ ID NO: 45290 - RNA, 20 nt, Artificial Sequence
  MKO10045290_A_Rgs10
  gRNA
uuagcugcggucugagcauc

SEQ ID NO: 45291 - RNA, 20 nt, Artificial Sequence
  MKO10045291_A_Rgs11
  gRNA
gcggguagucgugaguaugc

SEQ ID NO: 45292 - RNA, 20 nt, Artificial Sequence
  MKO10045292_A_Rgs11
  gRNA
gagccucacccgcuaccgcg

SEQ ID NO: 45293 - RNA, 20 nt, Artificial Sequence
  MKO10045293_A_Rgs11
  gRNA
agauguagccgugcugcgcc

SEQ ID NO: 45294 - RNA, 20 nt, Artificial Sequence
  MKO10045294_A_Rgs12
  gRNA
uugcaacucuccucucucgu

SEQ ID NO: 45295 - RNA, 20 nt, Artificial Sequence
  MKO10045295_A_Rgs12
  gRNA
gagaaguagcgaacaccaac

SEQ ID NO: 45296 - RNA, 20 nt, Artificial Sequence
  MKO10045296_A_Rgs12
  gRNA
cuaccugucagcucucuuac

SEQ ID NO: 45297 - RNA, 20 nt, Artificial Sequence
  MKO10045297_A_Rgs13
  gRNA
uuaacaucgacaguacaaca

SEQ ID NO: 45298 - RNA, 20 nt, Artificial Sequence
  MKO10045298_A_Rgs13
  gRNA
acaagaaaauugcuucacga

SEQ ID NO: 45299 - RNA, 20 nt, Artificial Sequence
  MKO10045299_A_Rgs13
  gRNA
uucuucaaagcauguuugag

SEQ ID NO: 45300 - RNA, 20 nt, Artificial Sequence
  MKO10045300_A_Rgs14
  gRNA
gaucugcuggaaacguucgc

SEQ ID NO: 45301 - RNA, 20 nt, Artificial Sequence
  MKO10045301_A_Rgs14
  gRNA
cccagugaacaucgaccgac

SEQ ID NO: 45302 - RNA, 20 nt, Artificial Sequence
  MKO10045302_A_Rgs14
  gRNA
gcgcagagaacguaacuuuc

SEQ ID NO: 45303 - RNA, 20 nt, Artificial Sequence
  MKO10045303_A_Rgs16
  gRNA
gucaccagcuuaucgcgacc

SEQ ID NO: 45304 - RNA, 20 nt, Artificial Sequence
  MKO10045304_A_Rgs16
  gRNA
ggguauuagcaaauucgagu

SEQ ID NO: 45305 - RNA, 20 nt, Artificial Sequence
  MKO10045305_A_Rgs16
  gRNA
cacuaccaguugcuucgaug

SEQ ID NO: 45306 - RNA, 20 nt, Artificial Sequence
  MKO10045306_A_Rgs17
  gRNA
guaauccucguauaucaucc

SEQ ID NO: 45307 - RNA, 20 nt, Artificial Sequence
  MKO10045307_A_Rgs17
  gRNA
uuuccgagaguuccuccgaa

SEQ ID NO: 45308 - RNA, 20 nt, Artificial Sequence
  MKO10045308_A_Rgs17
  gRNA
ccuggauucucgaguuagag

SEQ ID NO: 45309 - RNA, 20 nt, Artificial Sequence
  MKO10045309_A_Rgs18
  gRNA
augaucgugaucgucuccua

SEQ ID NO: 45310 - RNA, 20 nt, Artificial Sequence
  MKO10045310_A_Rgs18
  gRNA
uuugugccguaucaaaacug

SEQ ID NO: 45311 - RNA, 20 nt, Artificial Sequence
  MKO10045311_A_Rgs18
  gRNA
gacaaauugcucucucauag

SEQ ID NO: 45312 - RNA, 20 nt, Artificial Sequence
  MKO10045312_A_Rgs19
  gRNA
ccggaauacacugcggcccg

SEQ ID NO: 45313 - RNA, 20 nt, Artificial Sequence
  MKO10045313_A_Rgs19
  gRNA
gccaagcucguugccguucu

SEQ ID NO: 45314 - RNA, 20 nt, Artificial Sequence
  MKO10045314_A_Rgs19
  gRNA
ugcgucauggcuggacaucg

SEQ ID NO: 45315 - RNA, 20 nt, Artificial Sequence
  MKO10045315_A_Rgs1
  gRNA
gagaucgaugaucccacauc

SEQ ID NO: 45316 - RNA, 20 nt, Artificial Sequence
  MKO10045316_A_Rgs1
  gRNA
uuagcaggucaaaaugucuu

SEQ ID NO: 45317 - RNA, 20 nt, Artificial Sequence
  MKO10045317_A_Rgs1
  gRNA
cugcugaagaaguaaugcag

SEQ ID NO: 45318 - RNA, 20 nt, Artificial Sequence
  MKO10045318_A_Rgs20
  gRNA
cuuggacucccgaguacgag

SEQ ID NO: 45319 - RNA, 20 nt, Artificial Sequence
  MKO10045319_A_Rgs20
  gRNA
gagcgucaucgaauaugugc

SEQ ID NO: 45320 - RNA, 20 nt, Artificial Sequence
  MKO10045320_A_Rgs20
  gRNA
uuccggcuggagugaccauc

SEQ ID NO: 45321 - RNA, 20 nt, Artificial Sequence
  MKO10045321_A_Rgs22
  gRNA
auuagauuuaacguagacua

SEQ ID NO: 45322 - RNA, 20 nt, Artificial Sequence
  MKO10045322_A_Rgs22
  gRNA
aaguguccccugcgaagaug

SEQ ID NO: 45323 - RNA, 20 nt, Artificial Sequence
  MKO10045323_A_Rgs22
  gRNA
cagugucucaagcgugaaca

SEQ ID NO: 45324 - RNA, 20 nt, Artificial Sequence
  MKO10045324_A_Rgs2
  gRNA
aauucggacuccaagaaccg

SEQ ID NO: 45325 - RNA, 20 nt, Artificial Sequence
  MKO10045325_A_Rgs2
  gRNA
gggcaaucagagauuucguu

SEQ ID NO: 45326 - RNA, 20 nt, Artificial Sequence
  MKO10045326_A_Rgs2
  gRNA
cuauaccgacuucauagaga

SEQ ID NO: 45327 - RNA, 20 nt, Artificial Sequence
  MKO10045327_A_Rgs3
  gRNA
cgccgcaagacuccgccauc

SEQ ID NO: 45328 - RNA, 20 nt, Artificial Sequence
  MKO10045328_A_Rgs3
  gRNA
ggaccacacgccacacgagc

SEQ ID NO: 45329 - RNA, 20 nt, Artificial Sequence
  MKO10045329_A_Rgs3
  gRNA
caaagccgucuuugccccuc

SEQ ID NO: 45330 - RNA, 20 nt, Artificial Sequence
  MKO10045330_A_Rgs4
  gRNA
ccucgcuguauuccgacuuc

SEQ ID NO: 45331 - RNA, 20 nt, Artificial Sequence
  MKO10045331_A_Rgs4
  gRNA
caagauagaaucgagacuug

SEQ ID NO: 45332 - RNA, 20 nt, Artificial Sequence
  MKO10045332_A_Rgs4
  gRNA
gugugaagaacuguguucgc

SEQ ID NO: 45333 - RNA, 20 nt, Artificial Sequence
  MKO10045333_A_Rgs5
  gRNA
gaucuucuuguaauucucac

SEQ ID NO: 45334 - RNA, 20 nt, Artificial Sequence
  MKO10045334_A_Rgs5
  gRNA
ccugcaguggcgccaguccc

SEQ ID NO: 45335 - RNA, 20 nt, Artificial Sequence
  MKO10045335_A_Rgs5
  gRNA
gaucaagucccccaucaaaa

SEQ ID NO: 45336 - RNA, 20 nt, Artificial Sequence
  MKO10045336_A_Rgs6
  gRNA
uauguuaccugugacgacac

SEQ ID NO: 45337 - RNA, 20 nt, Artificial Sequence
  MKO10045337_A_Rgs6
  gRNA
gccuaccuggaaacgguaaa

SEQ ID NO: 45338 - RNA, 20 nt, Artificial Sequence
  MKO10045338_A_Rgs6
  gRNA
cagcgauccccacugcucgc

SEQ ID NO: 45339 - RNA, 20 nt, Artificial Sequence
  MKO10045339_A_Rgs7bp
  gRNA
ccaagaguucaacacgcaag

SEQ ID NO: 45340 - RNA, 20 nt, Artificial Sequence
  MKO10045340_A_Rgs7bp
  gRNA
agauccaucccgaaaucugc

SEQ ID NO: 45341 - RNA, 20 nt, Artificial Sequence
  MKO10045341_A_Rgs7bp
  gRNA
ucucuucaguuucaucgaaa

SEQ ID NO: 45342 - RNA, 20 nt, Artificial Sequence
  MKO10045342_A_Rgs7
  gRNA
acuuacuugaaaccgguaga

SEQ ID NO: 45343 - RNA, 20 nt, Artificial Sequence
  MKO10045343_A_Rgs7
  gRNA
aacaguggaggcucuccauu

SEQ ID NO: 45344 - RNA, 20 nt, Artificial Sequence
  MKO10045344_A_Rgs7
  gRNA
uagggucagacauuguucaa

SEQ ID NO: 45345 - RNA, 20 nt, Artificial Sequence
  MKO10045345_A_Rgs8
  gRNA
uaucgauuuccagacccgag

SEQ ID NO: 45346 - RNA, 20 nt, Artificial Sequence
  MKO10045346_A_Rgs8
  gRNA
gacuagcuuugcaguugacc

SEQ ID NO: 45347 - RNA, 20 nt, Artificial Sequence
  MKO10045347_A_Rgs8
  gRNA
cuuccgugccuucuugaaga

SEQ ID NO: 45348 - RNA, 20 nt, Artificial Sequence
  MKO10045348_A_Rgs9bp
  gRNA
cccgguugaccgucgcgcuc

SEQ ID NO: 45349 - RNA, 20 nt, Artificial Sequence
  MKO10045349_A_Rgs9bp
  gRNA
cucaaacuccgcgcgcuccu

SEQ ID NO: 45350 - RNA, 20 nt, Artificial Sequence
  MKO10045350_A_Rgs9bp
  gRNA
ugaaagucaacgugccccgc

SEQ ID NO: 45351 - RNA, 20 nt, Artificial Sequence
  MKO10045351_A_Rgs9
  gRNA
aaucgguagagacugcuguc

SEQ ID NO: 45352 - RNA, 20 nt, Artificial Sequence
  MKO10045352_A_Rgs9
  gRNA
agugucccucacgccaugac

SEQ ID NO: 45353 - RNA, 20 nt, Artificial Sequence
  MKO10045353_A_Rgs9
  gRNA
agaaugacgauccgacacca

SEQ ID NO: 45354 - RNA, 20 nt, Artificial Sequence
  MKO10045354_A_Rgsl1
  gRNA
ucugcgcucaccuccuuccg

SEQ ID NO: 45355 - RNA, 20 nt, Artificial Sequence
  MKO10045355_A_Rgsl1
  gRNA
uaaggaaacugacgagcucc

SEQ ID NO: 45356 - RNA, 20 nt, Artificial Sequence
  MKO10045356_A_Rgsl1
  gRNA
gccagaaguaccuuaugacu

SEQ ID NO: 45357 - RNA, 20 nt, Artificial Sequence
  MKO10045357_A_Rhag
  gRNA
ccaaugggguacgauuaugc

SEQ ID NO: 45358 - RNA, 20 nt, Artificial Sequence
  MKO10045358_A_Rhag
  gRNA
ccugcauaaucguaccccau

SEQ ID NO: 45359 - RNA, 20 nt, Artificial Sequence
  MKO10045359_A_Rhag
  gRNA
uccagccuuguagagcgccg

SEQ ID NO: 45360 - RNA, 20 nt, Artificial Sequence
  MKO10045360_A_Rhbdd1
  gRNA
caccuggccggcauucuggu

SEQ ID NO: 45361 - RNA, 20 nt, Artificial Sequence
  MKO10045361_A_Rhbdd1
  gRNA
ugaccuaugaugcaacuuac

SEQ ID NO: 45362 - RNA, 20 nt, Artificial Sequence
  MKO10045362_A_Rhbdd1
  gRNA
aacuaugaugucuacacagc

SEQ ID NO: 45363 - RNA, 20 nt, Artificial Sequence
  MKO10045363_A_Rhbdd2
  gRNA
ccucaugcgagagcggaccg

SEQ ID NO: 45364 - RNA, 20 nt, Artificial Sequence
  MKO10045364_A_Rhbdd2
  gRNA
ccucgguccgcucucgcaug

SEQ ID NO: 45365 - RNA, 20 nt, Artificial Sequence
  MKO10045365_A_Rhbdd2
  gRNA
cgagcaccagaagcgacucg

SEQ ID NO: 45366 - RNA, 20 nt, Artificial Sequence
  MKO10045366_A_Rhbdd3
  gRNA
uugcuucagcaacgacgaug

SEQ ID NO: 45367 - RNA, 20 nt, Artificial Sequence
  MKO10045367_A_Rhbdd3
  gRNA
ccuagacgagcagaugcuac

SEQ ID NO: 45368 - RNA, 20 nt, Artificial Sequence
  MKO10045368_A_Rhbdd3
  gRNA
ggcagcuacagggcguguag

SEQ ID NO: 45369 - RNA, 20 nt, Artificial Sequence
  MKO10045369_A_Rhbdf1
  gRNA
gauucacguuugcgacgccg

SEQ ID NO: 45370 - RNA, 20 nt, Artificial Sequence
  MKO10045370_A_Rhbdf1
  gRNA
agcuaaagccgcaggucauc

SEQ ID NO: 45371 - RNA, 20 nt, Artificial Sequence
  MKO10045371_A_Rhbdf1
  gRNA
gcaagaaagccugucgccgc

SEQ ID NO: 45372 - RNA, 20 nt, Artificial Sequence
  MKO10045372_A_Rhbdf2
  gRNA
cguuccgugcuagaugcgac

SEQ ID NO: 45373 - RNA, 20 nt, Artificial Sequence
  MKO10045373_A_Rhbdf2
  gRNA
ugaggccgguccaccucauc

SEQ ID NO: 45374 - RNA, 20 nt, Artificial Sequence
  MKO10045374_A_Rhbdf2
  gRNA
cccaucugccccgccgcaag

SEQ ID NO: 45375 - RNA, 20 nt, Artificial Sequence
  MKO10045375_A_Rhbdl1
  gRNA
ugagacgugccccguagcac

SEQ ID NO: 45376 - RNA, 20 nt, Artificial Sequence
  MKO10045376_A_Rhbdl1
  gRNA
aucggugcggacaccuucgc

SEQ ID NO: 45377 - RNA, 20 nt, Artificial Sequence
  MKO10045377_A_Rhbdl1
  gRNA
ugcccgcuguccguuagcaa

SEQ ID NO: 45378 - RNA, 20 nt, Artificial Sequence
  MKO10045378_A_Rhbdl2
  gRNA
cuacucguuaucauucugau

SEQ ID NO: 45379 - RNA, 20 nt, Artificial Sequence
  MKO10045379_A_Rhbdl2
  gRNA
cugcagaguccagcacaucg

SEQ ID NO: 45380 - RNA, 20 nt, Artificial Sequence
  MKO10045380_A_Rhbdl2
  gRNA
ccgaguggggcugguguacc

SEQ ID NO: 45381 - RNA, 20 nt, Artificial Sequence
  MKO10045381_A_Rhbdl3
  gRNA
caugaucacaaucacgcugc

SEQ ID NO: 45382 - RNA, 20 nt, Artificial Sequence
  MKO10045382_A_Rhbdl3
  gRNA
cucccggggcagagucucgu

SEQ ID NO: 45383 - RNA, 20 nt, Artificial Sequence
  MKO10045383_A_Rhbdl3
  gRNA
cauagcgccaagccugcgca

SEQ ID NO: 45384 - RNA, 20 nt, Artificial Sequence
  MKO10045384_A_Rhbg
  gRNA
caacuccgcgccgacagcgc

SEQ ID NO: 45385 - RNA, 20 nt, Artificial Sequence
  MKO10045385_A_Rhbg
  gRNA
gaucaacgcugacuucugcg

SEQ ID NO: 45386 - RNA, 20 nt, Artificial Sequence
  MKO10045386_A_Rhbg
  gRNA
ggaugggcagcaucggaccg

SEQ ID NO: 45387 - RNA, 20 nt, Artificial Sequence
  MKO10045387_A_Rhcg
  gRNA
gggcucacuucucgacgcuc

SEQ ID NO: 45388 - RNA, 20 nt, Artificial Sequence
  MKO10045388_A_Rhcg
  gRNA
cgcugaagccguagcgcugc

SEQ ID NO: 45389 - RNA, 20 nt, Artificial Sequence
  MKO10045389_A_Rhcg
  gRNA
ucucaccaaucauggcgaaa

SEQ ID NO: 45390 - RNA, 20 nt, Artificial Sequence
  MKO10045390_A_Rhd
  gRNA
guucaacaccuacuacgccc

SEQ ID NO: 45391 - RNA, 20 nt, Artificial Sequence
  MKO10045391_A_Rhd
  gRNA
caucagauuugccgacgaga

SEQ ID NO: 45392 - RNA, 20 nt, Artificial Sequence
  MKO10045392_A_Rhd
  gRNA
gcgcccgcugagaucagcac

SEQ ID NO: 45393 - RNA, 20 nt, Artificial Sequence
  MKO10045393_A_Rhebl1
  gRNA
auuuguggaaggcgaguucc

SEQ ID NO: 45394 - RNA, 20 nt, Artificial Sequence
  MKO10045394_A_Rhebl1
  gRNA
aguauacaagaacguaacca

SEQ ID NO: 45395 - RNA, 20 nt, Artificial Sequence
  MKO10045395_A_Rhebl1
  gRNA
cuguaccaaaagcuacacga

SEQ ID NO: 45396 - RNA, 20 nt, Artificial Sequence
  MKO10045396_A_Rheb
  gRNA
agcguucaccaaguugauca

SEQ ID NO: 45397 - RNA, 20 nt, Artificial Sequence
  MKO10045397_A_Rheb
  gRNA
gaucguaggaaucaacaaau

SEQ ID NO: 45398 - RNA, 20 nt, Artificial Sequence
  MKO10045398_A_Rheb
  gRNA
uugacaauucaguuuguuga

SEQ ID NO: 45399 - RNA, 20 nt, Artificial Sequence
  MKO10045399_A_Rhoa
  gRNA
ucgugugcucgucauuccga

SEQ ID NO: 45400 - RNA, 20 nt, Artificial Sequence
  MKO10045400_A_Rhoa
  gRNA
cgagcacacgagacgggagu

SEQ ID NO: 45401 - RNA, 20 nt, Artificial Sequence
  MKO10045401_A_Rhoa
  gRNA
ggcuacucaccuaaacuauc

SEQ ID NO: 45402 - RNA, 20 nt, Artificial Sequence
  MKO10045402_A_Rhobtb1
  gRNA
cggcguagcggaggucuagc

SEQ ID NO: 45403 - RNA, 20 nt, Artificial Sequence
  MKO10045403_A_Rhobtb1
  gRNA
accaggacgacgggcguucg

SEQ ID NO: 45404 - RNA, 20 nt, Artificial Sequence
  MKO10045404_A_Rhobtb1
  gRNA
cgaagaggacgucggcgcac

SEQ ID NO: 45405 - RNA, 20 nt, Artificial Sequence
  MKO10045405_A_Rhobtb2
  gRNA
gcgacuucccgacccuucuc

SEQ ID NO: 45406 - RNA, 20 nt, Artificial Sequence
  MKO10045406_A_Rhobtb2
  gRNA
accccguaagaucccgucac

SEQ ID NO: 45407 - RNA, 20 nt, Artificial Sequence
  MKO10045407_A_Rhobtb2
  gRNA
cccccacagauccgacgugg

SEQ ID NO: 45408 - RNA, 20 nt, Artificial Sequence
  MKO10045408_A_Rhobtb3
  gRNA
cuugacguucccgaacgcac

SEQ ID NO: 45409 - RNA, 20 nt, Artificial Sequence
  MKO10045409_A_Rhobtb3
  gRNA
ugcguucgggaacgucaagc

SEQ ID NO: 45410 - RNA, 20 nt, Artificial Sequence
  MKO10045410_A_Rhobtb3
  gRNA
ccaacagccgcaaugauuac

SEQ ID NO: 45411 - RNA, 20 nt, Artificial Sequence
  MKO10045411_A_Rhob
  gRNA
aggaggacuacgaucguuua

SEQ ID NO: 45412 - RNA, 20 nt, Artificial Sequence
  MKO10045412_A_Rhob
  gRNA
aaccucgcgcacgcccuccu

SEQ ID NO: 45413 - RNA, 20 nt, Artificial Sequence
  MKO10045413_A_Rhob
  gRNA
ggacaugcucgucgcugcgc

SEQ ID NO: 45414 - RNA, 20 nt, Artificial Sequence
  MKO10045414_A_Rhoc
  gRNA
ucaggagccgguucgaucug

SEQ ID NO: 45415 - RNA, 20 nt, Artificial Sequence
  MKO10045415_A_Rhoc
  gRNA
cuauauagccgacaucgaag

SEQ ID NO: 45416 - RNA, 20 nt, Artificial Sequence
  MKO10045416_A_Rhoc
  gRNA
agguccggaagaauaagcgc

SEQ ID NO: 45417 - RNA, 20 nt, Artificial Sequence
  MKO10045417_A_Rhod
  gRNA
cugcaagauagaccugcgua

SEQ ID NO: 45418 - RNA, 20 nt, Artificial Sequence
  MKO10045418_A_Rhod
  gRNA
ccagcaccuuguccuuacgc

SEQ ID NO: 45419 - RNA, 20 nt, Artificial Sequence
  MKO10045419_A_Rhod
  gRNA
uaccggcugugucccagauu

SEQ ID NO: 45420 - RNA, 20 nt, Artificial Sequence
  MKO10045420_A_Rhof
  gRNA
cucgcagcacuacgccccgu

SEQ ID NO: 45421 - RNA, 20 nt, Artificial Sequence
  MKO10045421_A_Rhof
  gRNA
gaugaggacguugucguaac

SEQ ID NO: 45422 - RNA, 20 nt, Artificial Sequence
  MKO10045422_A_Rhof
  gRNA
uuacgacaacguccucauca

SEQ ID NO: 45423 - RNA, 20 nt, Artificial Sequence
  MKO10045423_A_Rhog
  gRNA
aacccaacaccgauaaagcg

SEQ ID NO: 45424 - RNA, 20 nt, Artificial Sequence
  MKO10045424_A_Rhog
  gRNA
cgcccacgcuuuaucggugu

SEQ ID NO: 45425 - RNA, 20 nt, Artificial Sequence
  MKO10045425_A_Rhog
  gRNA
ugcgcccaucaaccgcacuc

SEQ ID NO: 45426 - RNA, 20 nt, Artificial Sequence
  MKO10045426_A_Rhoh
  gRNA
acccguauucucguacaccg

SEQ ID NO: 45427 - RNA, 20 nt, Artificial Sequence
  MKO10045427_A_Rhoh
  gRNA
acccacgguguacgagaaua

SEQ ID NO: 45428 - RNA, 20 nt, Artificial Sequence
  MKO10045428_A_Rhoh
  gRNA
cccuucuauggcauugaugc

SEQ ID NO: 45429 - RNA, 20 nt, Artificial Sequence
  MKO10045429_A_Rhoj
  gRNA
cauguacagcagacgcgcca

SEQ ID NO: 45430 - RNA, 20 nt, Artificial Sequence
  MKO10045430_A_Rhoj
  gRNA
agccucuuaccacaacguuc

SEQ ID NO: 45431 - RNA, 20 nt, Artificial Sequence
  MKO10045431_A_Rhoj
  gRNA
uucuccccuaguuaccguga

SEQ ID NO: 45432 - RNA, 20 nt, Artificial Sequence
  MKO10045432_A_Rhoq
  gRNA
aacguccccuucuuguuaau

SEQ ID NO: 45433 - RNA, 20 nt, Artificial Sequence
  MKO10045433_A_Rhoq
  gRNA
aggaagacuaugaucgucug

SEQ ID NO: 45434 - RNA, 20 nt, Artificial Sequence
  MKO10045434_A_Rhoq
  gRNA
ccuugcagucagcgucaccg

SEQ ID NO: 45435 - RNA, 20 nt, Artificial Sequence
  MKO10045435_A_Rhot1
  gRNA
gacaucacugauuaugucgc

SEQ ID NO: 45436 - RNA, 20 nt, Artificial Sequence
  MKO10045436_A_Rhot1
  gRNA
acacacauugucgauuauuc

SEQ ID NO: 45437 - RNA, 20 nt, Artificial Sequence
  MKO10045437_A_Rhot1
  gRNA
ccaugcgugcgggccgagug

SEQ ID NO: 45438 - RNA, 20 nt, Artificial Sequence
  MKO10045438_A_Rhot2
  gRNA
cggcgaggaguuucccgagg

SEQ ID NO: 45439 - RNA, 20 nt, Artificial Sequence
  MKO10045439_A_Rhot2
  gRNA
acuccucgccgaccagcgac

SEQ ID NO: 45440 - RNA, 20 nt, Artificial Sequence
  MKO10045440_A_Rhot2
  gRNA
caccuucuccggggugacgu

SEQ ID NO: 45441 - RNA, 20 nt, Artificial Sequence
  MKO10045441_A_Rhou
  gRNA
cccgcgauggccccgcagca

SEQ ID NO: 45442 - RNA, 20 nt, Artificial Sequence
  MKO10045442_A_Rhou
  gRNA
guaccgccucgccgagagcg

SEQ ID NO: 45443 - RNA, 20 nt, Artificial Sequence
  MKO10045443_A_Rhou
  gRNA
gggcagugacgucgaaucuc

SEQ ID NO: 45444 - RNA, 20 nt, Artificial Sequence
  MKO10045444_A_Rhov
  gRNA
gcgcgcgggguacccauugc

SEQ ID NO: 45445 - RNA, 20 nt, Artificial Sequence
  MKO10045445_A_Rhov
  gRNA
ucccaaagcucgauucgcac

SEQ ID NO: 45446 - RNA, 20 nt, Artificial Sequence
  MKO10045446_A_Rhov
  gRNA
ccccugugcgaaucgagcuu

SEQ ID NO: 45447 - RNA, 20 nt, Artificial Sequence
  MKO10045447_A_Rhox10
  gRNA
uacuucgaccucgauuauua

SEQ ID NO: 45448 - RNA, 20 nt, Artificial Sequence
  MKO10045448_A_Rhox10
  gRNA
agggcagcccaaugucgcuu

SEQ ID NO: 45449 - RNA, 20 nt, Artificial Sequence
  MKO10045449_A_Rhox10
  gRNA
cuacucagcaaugcuacauc

SEQ ID NO: 45450 - RNA, 20 nt, Artificial Sequence
  MKO10045450_A_Rhox11
  gRNA
ccagugagcagucguuauuc

SEQ ID NO: 45451 - RNA, 20 nt, Artificial Sequence
  MKO10045451_A_Rhox11
  gRNA
ggcuucgccgaugaaguaac

SEQ ID NO: 45452 - RNA, 20 nt, Artificial Sequence
  MKO10045452_A_Rhox11
  gRNA
agaacuucgcaugaagacuu

SEQ ID NO: 45453 - RNA, 20 nt, Artificial Sequence
  MKO10045453_A_Rhox12
  gRNA
aaggaugaugugaucuacgu

SEQ ID NO: 45454 - RNA, 20 nt, Artificial Sequence
  MKO10045454_A_Rhox12
  gRNA
cacaaggccacggauccagu

SEQ ID NO: 45455 - RNA, 20 nt, Artificial Sequence
  MKO10045455_A_Rhox12
  gRNA
agcgucacugcauggcaucc

SEQ ID NO: 45456 - RNA, 20 nt, Artificial Sequence
  MKO10045456_A_Rhox13
  gRNA
cgagucgucaucacucucgu

SEQ ID NO: 45457 - RNA, 20 nt, Artificial Sequence
  MKO10045457_A_Rhox13
  gRNA
cgacucgagcaccagcgacg

SEQ ID NO: 45458 - RNA, 20 nt, Artificial Sequence
  MKO10045458_A_Rhox13
  gRNA
augcugagaaauauuccgcc

SEQ ID NO: 45459 - RNA, 20 nt, Artificial Sequence
  MKO10045459_A_Rhox1
  gRNA
cuccauguuccgaaagccgu

SEQ ID NO: 45460 - RNA, 20 nt, Artificial Sequence
  MKO10045460_A_Rhox1
  gRNA
ccugcuucguauaauaccug

SEQ ID NO: 45461 - RNA, 20 nt, Artificial Sequence
  MKO10045461_A_Rhox1
  gRNA
guacccgagaaggccaugac

SEQ ID NO: 45462 - RNA, 20 nt, Artificial Sequence
  MKO10045462_A_Rhox2a
  gRNA
cgucaauuacaagcuugaug

SEQ ID NO: 45463 - RNA, 20 nt, Artificial Sequence
  MKO10045463_A_Rhox2a
  gRNA
gaggaugaggaaaaugcgaa

SEQ ID NO: 45464 - RNA, 20 nt, Artificial Sequence
  MKO10045464_A_Rhox2a
  gRNA
ugcugauguagugauugcac

SEQ ID NO: 45465 - RNA, 20 nt, Artificial Sequence
  MKO10045465_A_Rhox2b
  gRNA
gaaaauguaaagcauguguc

SEQ ID NO: 45466 - RNA, 20 nt, Artificial Sequence
  MKO10045466_A_Rhox2b
  gRNA
cgucaauuacaagcuugaug

SEQ ID NO: 45467 - RNA, 20 nt, Artificial Sequence
  MKO10045467_A_Rhox2b
  gRNA
gaggaugaggaaaaugcgaa

SEQ ID NO: 45468 - RNA, 20 nt, Artificial Sequence
  MKO10045468_A_Rhox2c
  gRNA
cgucaauuacaagcuugaug

SEQ ID NO: 45469 - RNA, 20 nt, Artificial Sequence
  MKO10045469_A_Rhox2c
  gRNA
gaggaugaggaaaaugcgaa

SEQ ID NO: 45470 - RNA, 20 nt, Artificial Sequence
  MKO10045470_A_Rhox2c
  gRNA
ugcugauguagugauugcac

SEQ ID NO: 45471 - RNA, 20 nt, Artificial Sequence
  MKO10045471_A_Rhox2d
  gRNA
ugcccgaauuccgcuacagu

SEQ ID NO: 45472 - RNA, 20 nt, Artificial Sequence
  MKO10045472_A_Rhox2d
  gRNA
agcucuguugccaacuguag

SEQ ID NO: 45473 - RNA, 20 nt, Artificial Sequence
  MKO10045473_A_Rhox2d
  gRNA
aaaacgucuggcaaaaucca

SEQ ID NO: 45474 - RNA, 20 nt, Artificial Sequence
  MKO10045474_A_Rhox2e
  gRNA
cgucaauuacaagcuugaug

SEQ ID NO: 45475 - RNA, 20 nt, Artificial Sequence
  MKO10045475_A_Rhox2e
  gRNA
gaggaugaggaaaaugcgaa

SEQ ID NO: 45476 - RNA, 20 nt, Artificial Sequence
  MKO10045476_A_Rhox2e
  gRNA
ugcugauguagugauugcac

SEQ ID NO: 45477 - RNA, 20 nt, Artificial Sequence
  MKO10045477_A_Rhox2f
  gRNA
cauugaagcugugucgccaa

SEQ ID NO: 45478 - RNA, 20 nt, Artificial Sequence
  MKO10045478_A_Rhox2f
  gRNA
aggucggcuacuugcgcagc

SEQ ID NO: 45479 - RNA, 20 nt, Artificial Sequence
  MKO10045479_A_Rhox2f
  gRNA
caucaauuaccugcuugaug

SEQ ID NO: 45480 - RNA, 20 nt, Artificial Sequence
  MKO10045480_A_Rhox2g
  gRNA
ugccugaauuccuucacggu

SEQ ID NO: 45481 - RNA, 20 nt, Artificial Sequence
  MKO10045481_A_Rhox2g
  gRNA
aaagugucuggcaagaucca

SEQ ID NO: 45482 - RNA, 20 nt, Artificial Sequence
  MKO10045482_A_Rhox2g
  gRNA
agcucuguugccaaccguga

SEQ ID NO: 45483 - RNA, 20 nt, Artificial Sequence
  MKO10045483_A_Rhox2h
  gRNA
gggccggcugcgccuguagc

SEQ ID NO: 45484 - RNA, 20 nt, Artificial Sequence
  MKO10045484_A_Rhox2h
  gRNA
cauugaaguugugucgccaa

SEQ ID NO: 45485 - RNA, 20 nt, Artificial Sequence
  MKO10045485_A_Rhox2h
  gRNA
caucaauuaccugcuugaug

SEQ ID NO: 45486 - RNA, 20 nt, Artificial Sequence
  MKO10045486_A_Rhox3a
  gRNA
ugacugaccuugaagcucug

SEQ ID NO: 45487 - RNA, 20 nt, Artificial Sequence
  MKO10045487_A_Rhox3a
  gRNA
cagaacguuccaucucuaac

SEQ ID NO: 45488 - RNA, 20 nt, Artificial Sequence
  MKO10045488_A_Rhox3a
  gRNA
gacugagaaaauaauucauc

SEQ ID NO: 45489 - RNA, 20 nt, Artificial Sequence
  MKO10045489_A_Rhox3c
  gRNA
agagcuucaagaucagucua

SEQ ID NO: 45490 - RNA, 20 nt, Artificial Sequence
  MKO10045490_A_Rhox3c
  gRNA
cuagaaaacaacuggcccga

SEQ ID NO: 45491 - RNA, 20 nt, Artificial Sequence
  MKO10045491_A_Rhox3c
  gRNA
gugaccaggcugaagcacca

SEQ ID NO: 45492 - RNA, 20 nt, Artificial Sequence
  MKO10045492_A_Rhox3e
  gRNA
ugacugaccuugaagcucug

SEQ ID NO: 45493 - RNA, 20 nt, Artificial Sequence
  MKO10045493_A_Rhox3e
  gRNA
cagaacguuccaucucuaac

SEQ ID NO: 45494 - RNA, 20 nt, Artificial Sequence
  MKO10045494_A_Rhox3e
  gRNA
gacugagaaaauaauucauc

SEQ ID NO: 45495 - RNA, 20 nt, Artificial Sequence
  MKO10045495_A_Rhox3f
  gRNA
cagaacguuccaugucuaac

SEQ ID NO: 45496 - RNA, 20 nt, Artificial Sequence
  MKO10045496_A_Rhox3f
  gRNA
acuauguauccaguuagaca

SEQ ID NO: 45497 - RNA, 20 nt, Artificial Sequence
  MKO10045497_A_Rhox3f
  gRNA
gugaccaggcugaagcgcua

SEQ ID NO: 45498 - RNA, 20 nt, Artificial Sequence
  MKO10045498_A_Rhox3g
  gRNA
cuuggugauauuugcacugc

SEQ ID NO: 45499 - RNA, 20 nt, Artificial Sequence
  MKO10045499_A_Rhox3g
  gRNA
ucauuucuucccucuucagc

SEQ ID NO: 45500 - RNA, 20 nt, Artificial Sequence
  MKO10045500_A_Rhox3g
  gRNA
aguauuaccacagagcuuca

SEQ ID NO: 45501 - RNA, 20 nt, Artificial Sequence
  MKO10045501_A_Rhox3h
  gRNA
ggagagagucccgccgccgc

SEQ ID NO: 45502 - RNA, 20 nt, Artificial Sequence
  MKO10045502_A_Rhox3h
  gRNA
ucauuucuugacucuucagc

SEQ ID NO: 45503 - RNA, 20 nt, Artificial Sequence
  MKO10045503_A_Rhox3h
  gRNA
cagaacguuccaucucuaac

SEQ ID NO: 45504 - RNA, 20 nt, Artificial Sequence
  MKO10045504_A_Rhox4a
  gRNA
ugccaagucccucaugaagu

SEQ ID NO: 45505 - RNA, 20 nt, Artificial Sequence
  MKO10045505_A_Rhox4a
  gRNA
caccaacuaccuacuucaug

SEQ ID NO: 45506 - RNA, 20 nt, Artificial Sequence
  MKO10045506_A_Rhox4a
  gRNA
cugcuuaccuuuccucugca

SEQ ID NO: 45507 - RNA, 20 nt, Artificial Sequence
  MKO10045507_A_Rhox4b
  gRNA
ugccaagucccucaugaagu

SEQ ID NO: 45508 - RNA, 20 nt, Artificial Sequence
  MKO10045508_A_Rhox4b
  gRNA
caccaacuaccuacuucaug

SEQ ID NO: 45509 - RNA, 20 nt, Artificial Sequence
  MKO10045509_A_Rhox4b
  gRNA
cugcuuaccuuuccucugca

SEQ ID NO: 45510 - RNA, 20 nt, Artificial Sequence
  MKO10045510_A_Rhox4c
  gRNA
aaugaaugacgaugccccug

SEQ ID NO: 45511 - RNA, 20 nt, Artificial Sequence
  MKO10045511_A_Rhox4c
  gRNA
ugccaagucccucaugaagu

SEQ ID NO: 45512 - RNA, 20 nt, Artificial Sequence
  MKO10045512_A_Rhox4c
  gRNA
caccaacuaccuacuucaug

SEQ ID NO: 45513 - RNA, 20 nt, Artificial Sequence
  MKO10045513_A_Rhox4d
  gRNA
ugccaagucccucaugaagu

SEQ ID NO: 45514 - RNA, 20 nt, Artificial Sequence
  MKO10045514_A_Rhox4d
  gRNA
caccaacuaccuacuucaug

SEQ ID NO: 45515 - RNA, 20 nt, Artificial Sequence
  MKO10045515_A_Rhox4d
  gRNA
cugcuuaccuuuccucugca

SEQ ID NO: 45516 - RNA, 20 nt, Artificial Sequence
  MKO10045516_A_Rhox4e
  gRNA
ugccaagucccucaugaagu

SEQ ID NO: 45517 - RNA, 20 nt, Artificial Sequence
  MKO10045517_A_Rhox4e
  gRNA
caccaacuaccuacuucaug

SEQ ID NO: 45518 - RNA, 20 nt, Artificial Sequence
  MKO10045518_A_Rhox4e
  gRNA
cugcuuaccuuuccucugca

SEQ ID NO: 45519 - RNA, 20 nt, Artificial Sequence
  MKO10045519_A_Rhox4f
  gRNA
ccaguccggagccacagcag

SEQ ID NO: 45520 - RNA, 20 nt, Artificial Sequence
  MKO10045520_A_Rhox4f
  gRNA
ugacaagucccucaugaagu

SEQ ID NO: 45521 - RNA, 20 nt, Artificial Sequence
  MKO10045521_A_Rhox4f
  gRNA
caccaacuaccuacuucaug

SEQ ID NO: 45522 - RNA, 20 nt, Artificial Sequence
  MKO10045522_A_Rhox4g
  gRNA
caccaacuaccuacuucaug

SEQ ID NO: 45523 - RNA, 20 nt, Artificial Sequence
  MKO10045523_A_Rhox4g
  gRNA
ugccaagucccucaugaagu

SEQ ID NO: 45524 - RNA, 20 nt, Artificial Sequence
  MKO10045524_A_Rhox4g
  gRNA
acauacaggugggaagacac

SEQ ID NO: 45525 - RNA, 20 nt, Artificial Sequence
  MKO10045525_A_Rhox5
  gRNA
gguucgcccagcaucgacug

SEQ ID NO: 45526 - RNA, 20 nt, Artificial Sequence
  MKO10045526_A_Rhox5
  gRNA
uucgaguguccugcuugucg

SEQ ID NO: 45527 - RNA, 20 nt, Artificial Sequence
  MKO10045527_A_Rhox5
  gRNA
ccaguucccucagucgaugc

SEQ ID NO: 45528 - RNA, 20 nt, Artificial Sequence
  MKO10045528_A_Rhox6
  gRNA
aacugcgguacagacgcacc

SEQ ID NO: 45529 - RNA, 20 nt, Artificial Sequence
  MKO10045529_A_Rhox6
  gRNA
aucuucagggagagucgcuc

SEQ ID NO: 45530 - RNA, 20 nt, Artificial Sequence
  MKO10045530_A_Rhox6
  gRNA
cgcucagggugaguuugauc

SEQ ID NO: 45531 - RNA, 20 nt, Artificial Sequence
  MKO10045531_A_Rhox7
  gRNA
aauagcagugcccccgcaua

SEQ ID NO: 45532 - RNA, 20 nt, Artificial Sequence
  MKO10045532_A_Rhox7
  gRNA
agaaucgggucccugagugu

SEQ ID NO: 45533 - RNA, 20 nt, Artificial Sequence
  MKO10045533_A_Rhox7
  gRNA
uccgccccauucugcugcag

SEQ ID NO: 45534 - RNA, 20 nt, Artificial Sequence
  MKO10045534_A_Rhox8
  gRNA
agcuaccccgcaaccgcuac

SEQ ID NO: 45535 - RNA, 20 nt, Artificial Sequence
  MKO10045535_A_Rhox8
  gRNA
uucuuaccgggccgcagcac

SEQ ID NO: 45536 - RNA, 20 nt, Artificial Sequence
  MKO10045536_A_Rhox8
  gRNA
guugacggugcuccugcuuc

SEQ ID NO: 45537 - RNA, 20 nt, Artificial Sequence
  MKO10045537_A_Rhox9
  gRNA
accuggugcggcggguccgc

SEQ ID NO: 45538 - RNA, 20 nt, Artificial Sequence
  MKO10045538_A_Rhox9
  gRNA
ccacucucagcugcgugauc

SEQ ID NO: 45539 - RNA, 20 nt, Artificial Sequence
  MKO10045539_A_Rhox9
  gRNA
uauaggagugguuuaagaug

SEQ ID NO: 45540 - RNA, 20 nt, Artificial Sequence
  MKO10045540_A_Rho
  gRNA
gaccaccacguagcgcucaa

SEQ ID NO: 45541 - RNA, 20 nt, Artificial Sequence
  MKO10045541_A_Rho
  gRNA
auucuugccgcagcacagcg

SEQ ID NO: 45542 - RNA, 20 nt, Artificial Sequence
  MKO10045542_A_Rho
  gRNA
uuacaggugaaaucgcccug

SEQ ID NO: 45543 - RNA, 20 nt, Artificial Sequence
  MKO10045543_A_Rhpn1
  gRNA
cgaggaaagcucucggccgc

SEQ ID NO: 45544 - RNA, 20 nt, Artificial Sequence
  MKO10045544_A_Rhpn1
  gRNA
cggaugcugccgucguccug

SEQ ID NO: 45545 - RNA, 20 nt, Artificial Sequence
  MKO10045545_A_Rhpn1
  gRNA
ccggugcugaaaaccucuac

SEQ ID NO: 45546 - RNA, 20 nt, Artificial Sequence
  MKO10045546_A_Rhpn2
  gRNA
agaccuuauggaccugcgac

SEQ ID NO: 45547 - RNA, 20 nt, Artificial Sequence
  MKO10045547_A_Rhpn2
  gRNA
uuaccugucgcagguccaua

SEQ ID NO: 45548 - RNA, 20 nt, Artificial Sequence
  MKO10045548_A_Rhpn2
  gRNA
gaaccuguucccgcaccuuc

SEQ ID NO: 45549 - RNA, 20 nt, Artificial Sequence
  MKO10045549_A_Ribc1
  gRNA
gcgccaagccgaaaaguuag

SEQ ID NO: 45550 - RNA, 20 nt, Artificial Sequence
  MKO10045550_A_Ribc1
  gRNA
caagcaugcgcacuaugauc

SEQ ID NO: 45551 - RNA, 20 nt, Artificial Sequence
  MKO10045551_A_Ribc1
  gRNA
ucgggucccuuauuaugaga

SEQ ID NO: 45552 - RNA, 20 nt, Artificial Sequence
  MKO10045552_A_Ribc2
  gRNA
ucaaacucacgucgaguuuc

SEQ ID NO: 45553 - RNA, 20 nt, Artificial Sequence
  MKO10045553_A_Ribc2
  gRNA
ucaugcccuuccagcgguca

SEQ ID NO: 45554 - RNA, 20 nt, Artificial Sequence
  MKO10045554_A_Ribc2
  gRNA
gcuuucugagaacccucgac

SEQ ID NO: 45555 - RNA, 20 nt, Artificial Sequence
  MKO10045555_A_Ric3
  gRNA
gaugcaguaaucguuucucu

SEQ ID NO: 45556 - RNA, 20 nt, Artificial Sequence
  MKO10045556_A_Ric3
  gRNA
gaccaucugagggugccgag

SEQ ID NO: 45557 - RNA, 20 nt, Artificial Sequence
  MKO10045557_A_Ric3
  gRNA
aucagcuccgagaaaucacc

SEQ ID NO: 45558 - RNA, 20 nt, Artificial Sequence
  MKO10045558_A_Ric8b
  gRNA
agcgcgcccucuacaucguc

SEQ ID NO: 45559 - RNA, 20 nt, Artificial Sequence
  MKO10045559_A_Ric8b
  gRNA
ccacgagucagacgauucuu

SEQ ID NO: 45560 - RNA, 20 nt, Artificial Sequence
  MKO10045560_A_Ric8b
  gRNA
cucgauagcccccgccucgc

SEQ ID NO: 45561 - RNA, 20 nt, Artificial Sequence
  MKO10045561_A_Ric8
  gRNA
gauucggauagucugcagcc

SEQ ID NO: 45562 - RNA, 20 nt, Artificial Sequence
  MKO10045562_A_Ric8
  gRNA
ccgugcgaagggcuguuagc

SEQ ID NO: 45563 - RNA, 20 nt, Artificial Sequence
  MKO10045563_A_Ric8
  gRNA
agugccgcagaagagucccc

SEQ ID NO: 45564 - RNA, 20 nt, Artificial Sequence
  MKO10045564_A_Ricuor
  gRNA
auagcgcagcgcucgcaacc

SEQ ID NO: 45565 - RNA, 20 nt, Artificial Sequence
  MKO10045565_A_Ricuor
  gRNA
uuaccucgggucagaucgag

SEQ ID NO: 45566 - RNA, 20 nt, Artificial Sequence
  MKO10045566_A_Ricuor
  gRNA
gucccgcucgaucugacccg

SEQ ID NO: 45567 - RNA, 20 nt, Artificial Sequence
  MKO10045567_A_Rif1
  gRNA
uuccuuuaaagucguaugac

SEQ ID NO: 45568 - RNA, 20 nt, Artificial Sequence
  MKO10045568_A_Rif1
  gRNA
aaaccguguacagccgagaa

SEQ ID NO: 45569 - RNA, 20 nt, Artificial Sequence
  MKO10045569_A_Rif1
  gRNA
acucuuaaugauaccauuca

SEQ ID NO: 45570 - RNA, 20 nt, Artificial Sequence
  MKO10045570_A_Riiad1
  gRNA
uuucauuugcgauccgaguc

SEQ ID NO: 45571 - RNA, 20 nt, Artificial Sequence
  MKO10045571_A_Riiad1
  gRNA
ggaucccggaacgcugaacc

SEQ ID NO: 45572 - RNA, 20 nt, Artificial Sequence
  MKO10045572_A_Riiad1
  gRNA
gauccggccccacuauccca

SEQ ID NO: 45573 - RNA, 20 nt, Artificial Sequence
  MKO10045573_A_Rilpl1
  gRNA
aacucggaaagcuucgcgag

SEQ ID NO: 45574 - RNA, 20 nt, Artificial Sequence
  MKO10045574_A_Rilpl1
  gRNA
ugcgggacguccugcacgag

SEQ ID NO: 45575 - RNA, 20 nt, Artificial Sequence
  MKO10045575_A_Rilpl1
  gRNA
ucaaggaccccaaccgcccg

SEQ ID NO: 45576 - RNA, 20 nt, Artificial Sequence
  MKO10045576_A_Rilpl2
  gRNA
gaugucguacacgucgucgg

SEQ ID NO: 45577 - RNA, 20 nt, Artificial Sequence
  MKO10045577_A_Rilpl2
  gRNA
cagcucgcggcccacuacau

SEQ ID NO: 45578 - RNA, 20 nt, Artificial Sequence
  MKO10045578_A_Rilpl2
  gRNA
ugccaugggcaacggcgaga

SEQ ID NO: 45579 - RNA, 20 nt, Artificial Sequence
  MKO10045579_A_Rilp
  gRNA
cuagcuccuggcggaggcgu

SEQ ID NO: 45580 - RNA, 20 nt, Artificial Sequence
  MKO10045580_A_Rilp
  gRNA
cgcgcugcuccgacagcuca

SEQ ID NO: 45581 - RNA, 20 nt, Artificial Sequence
  MKO10045581_A_Rilp
  gRNA
gucucuuaccgggucaucug

SEQ ID NO: 45582 - RNA, 20 nt, Artificial Sequence
  MKO10045582_A_Rimbp2
  gRNA
ggugacuauauuccgcuguc

SEQ ID NO: 45583 - RNA, 20 nt, Artificial Sequence
  MKO10045583_A_Rimbp2
  gRNA
gcugcuggaucgcaagagga

SEQ ID NO: 45584 - RNA, 20 nt, Artificial Sequence
  MKO10045584_A_Rimbp2
  gRNA
caauacucccaguguguugc

SEQ ID NO: 45585 - RNA, 20 nt, Artificial Sequence
  MKO10045585_A_Rimbp3
  gRNA
gcgcgcggcuuguucgccgu

SEQ ID NO: 45586 - RNA, 20 nt, Artificial Sequence
  MKO10045586_A_Rimbp3
  gRNA
cgaaacgccuccguuccgac

SEQ ID NO: 45587 - RNA, 20 nt, Artificial Sequence
  MKO10045587_A_Rimbp3
  gRNA
gcgcgauguuguauugcgcc

SEQ ID NO: 45588 - RNA, 20 nt, Artificial Sequence
  MKO10045588_A_Rimkla
  gRNA
uacucgaacaaccaccacgu

SEQ ID NO: 45589 - RNA, 20 nt, Artificial Sequence
  MKO10045589_A_Rimkla
  gRNA
uggugaucucacuauccgac

SEQ ID NO: 45590 - RNA, 20 nt, Artificial Sequence
  MKO10045590_A_Rimkla
  gRNA
aagugcccacugaccgagca

SEQ ID NO: 45591 - RNA, 20 nt, Artificial Sequence
  MKO10045591_A_Rimklb
  gRNA
cuugaggucgguucaucaau

SEQ ID NO: 45592 - RNA, 20 nt, Artificial Sequence
  MKO10045592_A_Rimklb
  gRNA
cauguugucgacagcagcgc

SEQ ID NO: 45593 - RNA, 20 nt, Artificial Sequence
  MKO10045593_A_Rimklb
  gRNA
agggucgcuaucaacagagc

SEQ ID NO: 45594 - RNA, 20 nt, Artificial Sequence
  MKO10045594_A_Rims1
  gRNA
aaagaugaugccccgacgug

SEQ ID NO: 45595 - RNA, 20 nt, Artificial Sequence
  MKO10045595_A_Rims1
  gRNA
caucaucuuugugcucgccc

SEQ ID NO: 45596 - RNA, 20 nt, Artificial Sequence
  MKO10045596_A_Rims1
  gRNA
ugcgccccagguguguuguc

SEQ ID NO: 45597 - RNA, 20 nt, Artificial Sequence
  MKO10045597_A_Rims2
  gRNA
uuuccauugaauacgaucgu

SEQ ID NO: 45598 - RNA, 20 nt, Artificial Sequence
  MKO10045598_A_Rims2
  gRNA
uccucgagggcuucgaaaug

SEQ ID NO: 45599 - RNA, 20 nt, Artificial Sequence
  MKO10045599_A_Rims2
  gRNA
aaaccaacgaucguauucaa

SEQ ID NO: 45600 - RNA, 20 nt, Artificial Sequence
  MKO10045600_A_Rims3
  gRNA
gcggagccguguaacccgcc

SEQ ID NO: 45601 - RNA, 20 nt, Artificial Sequence
  MKO10045601_A_Rims3
  gRNA
gcagccgggagucuaccgau

SEQ ID NO: 45602 - RNA, 20 nt, Artificial Sequence
  MKO10045602_A_Rims3
  gRNA
cuuucagcuccaagccgugu

SEQ ID NO: 45603 - RNA, 20 nt, Artificial Sequence
  MKO10045603_A_Rims4
  gRNA
acuggacccguuguacaacc

SEQ ID NO: 45604 - RNA, 20 nt, Artificial Sequence
  MKO10045604_A_Rims4
  gRNA
uggcggcccacaaacugugc

SEQ ID NO: 45605 - RNA, 20 nt, Artificial Sequence
  MKO10045605_A_Rims4
  gRNA
acaacggguccagugacuug

SEQ ID NO: 45606 - RNA, 20 nt, Artificial Sequence
  MKO10045606_A_Rin1
  gRNA
gaguguuagauuuccgcacc

SEQ ID NO: 45607 - RNA, 20 nt, Artificial Sequence
  MKO10045607_A_Rin1
  gRNA
caguacucucuucgauauag

SEQ ID NO: 45608 - RNA, 20 nt, Artificial Sequence
  MKO10045608_A_Rin1
  gRNA
cagccgcgcugcacgugcug

SEQ ID NO: 45609 - RNA, 20 nt, Artificial Sequence
  MKO10045609_A_Rin2
  gRNA
gcuugaagaacuagcccaac

SEQ ID NO: 45610 - RNA, 20 nt, Artificial Sequence
  MKO10045610_A_Rin2
  gRNA
cccacuuacuuagucccagu

SEQ ID NO: 45611 - RNA, 20 nt, Artificial Sequence
  MKO10045611_A_Rin2
  gRNA
cuucgccugcccugugaauu

SEQ ID NO: 45612 - RNA, 20 nt, Artificial Sequence
  MKO10045612_A_Rin3
  gRNA
acuugagaccaucuccaacc

SEQ ID NO: 45613 - RNA, 20 nt, Artificial Sequence
  MKO10045613_A_Rin3
  gRNA
cuggggcagccguagaguga

SEQ ID NO: 45614 - RNA, 20 nt, Artificial Sequence
  MKO10045614_A_Rin3
  gRNA
uugcguucuacugugucagu

SEQ ID NO: 45615 - RNA, 20 nt, Artificial Sequence
  MKO10045615_A_Ring1
  gRNA
cgaaguugggguccggccgu

SEQ ID NO: 45616 - RNA, 20 nt, Artificial Sequence
  MKO10045616_A_Ring1
  gRNA
acccgcuccgcggggucgcu

SEQ ID NO: 45617 - RNA, 20 nt, Artificial Sequence
  MKO10045617_A_Ring1
  gRNA
aauacgaggcccaucaggac

SEQ ID NO: 45618 - RNA, 20 nt, Artificial Sequence
  MKO10045618_A_Rinl
  gRNA
uugucugcuccauccgcuag

SEQ ID NO: 45619 - RNA, 20 nt, Artificial Sequence
  MKO10045619_A_Rinl
  gRNA
caggcucauguccgaugacc

SEQ ID NO: 45620 - RNA, 20 nt, Artificial Sequence
  MKO10045620_A_Rinl
  gRNA
agccacuucuucgacugcag

SEQ ID NO: 45621 - RNA, 20 nt, Artificial Sequence
  MKO10045621_A_Rint1
  gRNA
gccgcucaaucucuuccauc

SEQ ID NO: 45622 - RNA, 20 nt, Artificial Sequence
  MKO10045622_A_Rint1
  gRNA
uaagugggugucgcagacug

SEQ ID NO: 45623 - RNA, 20 nt, Artificial Sequence
  MKO10045623_A_Rint1
  gRNA
gcgcgucgucacugccaccu

SEQ ID NO: 45624 - RNA, 20 nt, Artificial Sequence
  MKO10045624_A_Riok1
  gRNA
gggcgacgcugagaccgaug

SEQ ID NO: 45625 - RNA, 20 nt, Artificial Sequence
  MKO10045625_A_Riok1
  gRNA
auaguuacugccgccauucc

SEQ ID NO: 45626 - RNA, 20 nt, Artificial Sequence
  MKO10045626_A_Riok1
  gRNA
cgacagagcaaccguagaac

SEQ ID NO: 45627 - RNA, 20 nt, Artificial Sequence
  MKO10045627_A_Riok2
  gRNA
ugaagcauaaacuuauagcg

SEQ ID NO: 45628 - RNA, 20 nt, Artificial Sequence
  MKO10045628_A_Riok2
  gRNA
agcgcgauuaccacaagcac

SEQ ID NO: 45629 - RNA, 20 nt, Artificial Sequence
  MKO10045629_A_Riok2
  gRNA
uaaucgccaugcagugauca

SEQ ID NO: 45630 - RNA, 20 nt, Artificial Sequence
  MKO10045630_A_Riok3
  gRNA
cgagacgaucccuacagacc

SEQ ID NO: 45631 - RNA, 20 nt, Artificial Sequence
  MKO10045631_A_Riok3
  gRNA
gugucacguacacaacuuca

SEQ ID NO: 45632 - RNA, 20 nt, Artificial Sequence
  MKO10045632_A_Riok3
  gRNA
cacuuccagugaccuaaugc

SEQ ID NO: 45633 - RNA, 20 nt, Artificial Sequence
  MKO10045633_A_Ripk1
  gRNA
gggucuuuagcacgugcauc

SEQ ID NO: 45634 - RNA, 20 nt, Artificial Sequence
  MKO10045634_A_Ripk1
  gRNA
ugugaaagucacgaucaacg

SEQ ID NO: 45635 - RNA, 20 nt, Artificial Sequence
  MKO10045635_A_Ripk1
  gRNA
guacacguccgacuucuccg

SEQ ID NO: 45636 - RNA, 20 nt, Artificial Sequence
  MKO10045636_A_Ripk2
  gRNA
aguuacaaaucugcacccga

SEQ ID NO: 45637 - RNA, 20 nt, Artificial Sequence
  MKO10045637_A_Ripk2
  gRNA
guauauaucaugcuucacac

SEQ ID NO: 45638 - RNA, 20 nt, Artificial Sequence
  MKO10045638_A_Ripk2
  gRNA
cucaauggccaugcaauauc

SEQ ID NO: 45639 - RNA, 20 nt, Artificial Sequence
  MKO10045639_A_Ripk3
  gRNA
ugggggcacccuagcguacu

SEQ ID NO: 45640 - RNA, 20 nt, Artificial Sequence
  MKO10045640_A_Ripk3
  gRNA
acccucccugaaacguggac

SEQ ID NO: 45641 - RNA, 20 nt, Artificial Sequence
  MKO10045641_A_Ripk3
  gRNA
cuaaccuuggcguggagcuc

SEQ ID NO: 45642 - RNA, 20 nt, Artificial Sequence
  MKO10045642_A_Ripk4
  gRNA
accguugcaugagcccuauc

SEQ ID NO: 45643 - RNA, 20 nt, Artificial Sequence
  MKO10045643_A_Ripk4
  gRNA
cgugcacgaugcgaaagcgc

SEQ ID NO: 45644 - RNA, 20 nt, Artificial Sequence
  MKO10045644_A_Ripk4
  gRNA
gguaagcgauuguaccaaac

SEQ ID NO: 45645 - RNA, 20 nt, Artificial Sequence
  MKO10045645_A_Ripply1
  gRNA
aagcuuaccugaccggguga

SEQ ID NO: 45646 - RNA, 20 nt, Artificial Sequence
  MKO10045646_A_Ripply1
  gRNA
ccucuauaaacgaccagcca

SEQ ID NO: 45647 - RNA, 20 nt, Artificial Sequence
  MKO10045647_A_Ripply1
  gRNA
gggauugcuucaauuuggac

SEQ ID NO: 45648 - RNA, 20 nt, Artificial Sequence
  MKO10045648_A_Ripply2
  gRNA
ugauagguacccgggcugcg

SEQ ID NO: 45649 - RNA, 20 nt, Artificial Sequence
  MKO10045649_A_Ripply2
  gRNA
ugcuggguugugcgcgcucu

SEQ ID NO: 45650 - RNA, 20 nt, Artificial Sequence
  MKO10045650_A_Ripply2
  gRNA
agaccguggguucgaacucc

SEQ ID NO: 45651 - RNA, 20 nt, Artificial Sequence
  MKO10045651_A_Ripply3
  gRNA
gcuuaccggacguucaguuc

SEQ ID NO: 45652 - RNA, 20 nt, Artificial Sequence
  MKO10045652_A_Ripply3
  gRNA
ccucaccuuucgggcccgcg

SEQ ID NO: 45653 - RNA, 20 nt, Artificial Sequence
  MKO10045653_A_Ripply3
  gRNA
gggaggcuaccgcugccacg

SEQ ID NO: 45654 - RNA, 20 nt, Artificial Sequence
  MKO10045654_A_Rit1
  gRNA
uaucaucggugcgucggacc

SEQ ID NO: 45655 - RNA, 20 nt, Artificial Sequence
  MKO10045655_A_Rit1
  gRNA
guuuaaacucccgaacuucg

SEQ ID NO: 45656 - RNA, 20 nt, Artificial Sequence
  MKO10045656_A_Rit1
  gRNA
aaacgucgucgauguaguaa

SEQ ID NO: 45657 - RNA, 20 nt, Artificial Sequence
  MKO10045657_A_Rit2
  gRNA
caucaucgauaccgaaucgc

SEQ ID NO: 45658 - RNA, 20 nt, Artificial Sequence
  MKO10045658_A_Rit2
  gRNA
ugacuuggagcaguuccguc

SEQ ID NO: 45659 - RNA, 20 nt, Artificial Sequence
  MKO10045659_A_Rit2
  gRNA
augcgggagcaguacaugcg

SEQ ID NO: 45660 - RNA, 20 nt, Artificial Sequence
  MKO10045660_A_Rlbp1
  gRNA
ucgaccauacuugucccgac

SEQ ID NO: 45661 - RNA, 20 nt, Artificial Sequence
  MKO10045661_A_Rlbp1
  gRNA
ccgugcccgcaaguucgaug

SEQ ID NO: 45662 - RNA, 20 nt, Artificial Sequence
  MKO10045662_A_Rlbp1
  gRNA
cacgacccacaucgaacuug

SEQ ID NO: 45663 - RNA, 20 nt, Artificial Sequence
  MKO10045663_A_Rlf
  gRNA
cuugcugaaaacacgacacc

SEQ ID NO: 45664 - RNA, 20 nt, Artificial Sequence
  MKO10045664_A_Rlf
  gRNA
cuccugaauagccucuucgc

SEQ ID NO: 45665 - RNA, 20 nt, Artificial Sequence
  MKO10045665_A_Rlf
  gRNA
ggagucacaugaugcauugu

SEQ ID NO: 45666 - RNA, 20 nt, Artificial Sequence
  MKO10045666_A_Rlim
  gRNA
gaauugcgcuccgcucgaga

SEQ ID NO: 45667 - RNA, 20 nt, Artificial Sequence
  MKO10045667_A_Rlim
  gRNA
acguccacugcaucgaccgc

SEQ ID NO: 45668 - RNA, 20 nt, Artificial Sequence
  MKO10045668_A_Rlim
  gRNA
aacucagauucuaacgauaa

SEQ ID NO: 45669 - RNA, 20 nt, Artificial Sequence
  MKO10045669_A_Rln1
  gRNA
uccgagacucgcguccugca

SEQ ID NO: 45670 - RNA, 20 nt, Artificial Sequence
  MKO10045670_A_Rln1
  gRNA
cauuucagcgucguaucgaa

SEQ ID NO: 45671 - RNA, 20 nt, Artificial Sequence
  MKO10045671_A_Rln1
  gRNA
aucuucugcuacaaccgacg

SEQ ID NO: 45672 - RNA, 20 nt, Artificial Sequence
  MKO10045672_A_Rln3
  gRNA
cggucgggaguucauccgcg

SEQ ID NO: 45673 - RNA, 20 nt, Artificial Sequence
  MKO10045673_A_Rln3
  gRNA
ucuacgguggucgagccagc

SEQ ID NO: 45674 - RNA, 20 nt, Artificial Sequence
  MKO10045674_A_Rln3
  gRNA
gcaggggacuucuucgcuga

SEQ ID NO: 45675 - RNA, 20 nt, Artificial Sequence
  MKO10045675_A_Rltpr
  gRNA
ggugggcgagaucugccgcc

SEQ ID NO: 45676 - RNA, 20 nt, Artificial Sequence
  MKO10045676_A_Rltpr
  gRNA
gggugagguugccgugcacc

SEQ ID NO: 45677 - RNA, 20 nt, Artificial Sequence
  MKO10045677_A_Rltpr
  gRNA
gguccgaaguagagucuacu

SEQ ID NO: 45678 - RNA, 20 nt, Artificial Sequence
  MKO10045678_A_Rmdn1
  gRNA
gcaaucugcauuagugaugu

SEQ ID NO: 45679 - RNA, 20 nt, Artificial Sequence
  MKO10045679_A_Rmdn1
  gRNA
uacuaagcugugcaauguca

SEQ ID NO: 45680 - RNA, 20 nt, Artificial Sequence
  MKO10045680_A_Rmdn1
  gRNA
ugcaaaugccuauguuauca

SEQ ID NO: 45681 - RNA, 20 nt, Artificial Sequence
  MKO10045681_A_Rmdn2
  gRNA
gagacucauuuguccgcaaa

SEQ ID NO: 45682 - RNA, 20 nt, Artificial Sequence
  MKO10045682_A_Rmdn2
  gRNA
uagguauauuacagcuaaca

SEQ ID NO: 45683 - RNA, 20 nt, Artificial Sequence
  MKO10045683_A_Rmdn2
  gRNA
auuaccagagcgcccaugaa

SEQ ID NO: 45684 - RNA, 20 nt, Artificial Sequence
  MKO10045684_A_Rmdn3
  gRNA
cucguaaucagacuccgcgu

SEQ ID NO: 45685 - RNA, 20 nt, Artificial Sequence
  MKO10045685_A_Rmdn3
  gRNA
uuacgagcgggacuccgaca

SEQ ID NO: 45686 - RNA, 20 nt, Artificial Sequence
  MKO10045686_A_Rmdn3
  gRNA
acucacagacgccgagagcg

SEQ ID NO: 45687 - RNA, 20 nt, Artificial Sequence
  MKO10045687_A_Rmi1
  gRNA
gacauuucuguaacccuucu

SEQ ID NO: 45688 - RNA, 20 nt, Artificial Sequence
  MKO10045688_A_Rmi1
  gRNA
auuuauucaaccguuucuuu

SEQ ID NO: 45689 - RNA, 20 nt, Artificial Sequence
  MKO10045689_A_Rmi1
  gRNA
cuguauuaagaguugaaacc

SEQ ID NO: 45690 - RNA, 20 nt, Artificial Sequence
  MKO10045690_A_Rmi2
  gRNA
cuccgcucgagucgcgcagc

SEQ ID NO: 45691 - RNA, 20 nt, Artificial Sequence
  MKO10045691_A_Rmi2
  gRNA
uccgagucgcuguccuccgg

SEQ ID NO: 45692 - RNA, 20 nt, Artificial Sequence
  MKO10045692_A_Rmi2
  gRNA
ccaguucccacaugcuuucg

SEQ ID NO: 45693 - RNA, 20 nt, Artificial Sequence
  MKO10045693_A_Rmnd1
  gRNA
gaagugacaagccugccuag

SEQ ID NO: 45694 - RNA, 20 nt, Artificial Sequence
  MKO10045694_A_Rmnd1
  gRNA
cacagaugcagcaaauauuu

SEQ ID NO: 45695 - RNA, 20 nt, Artificial Sequence
  MKO10045695_A_Rmnd1
  gRNA
aaccgcagaugaguaucacc

SEQ ID NO: 45696 - RNA, 20 nt, Artificial Sequence
  MKO10045696_A_Rmnd5a
  gRNA
cauagcaguguuucucgagu

SEQ ID NO: 45697 - RNA, 20 nt, Artificial Sequence
  MKO10045697_A_Rmnd5a
  gRNA
cauagcccaaaacaguuccu

SEQ ID NO: 45698 - RNA, 20 nt, Artificial Sequence
  MKO10045698_A_Rmnd5a
  gRNA
cuacauccagcauuccuugu

SEQ ID NO: 45699 - RNA, 20 nt, Artificial Sequence
  MKO10045699_A_Rmnd5b
  gRNA
gcucuacgauggccaucugc

SEQ ID NO: 45700 - RNA, 20 nt, Artificial Sequence
  MKO10045700_A_Rmnd5b
  gRNA
gauccgauucaacuccaaga

SEQ ID NO: 45701 - RNA, 20 nt, Artificial Sequence
  MKO10045701_A_Rmnd5b
  gRNA
ucacagcagcgucucucgag

SEQ ID NO: 45702 - RNA, 20 nt, Artificial Sequence
  MKO10045702_A_Rnase10
  gRNA
ccucauggaugaacguguac

SEQ ID NO: 45703 - RNA, 20 nt, Artificial Sequence
  MKO10045703_A_Rnase10
  gRNA
ccaguacacguucauccaug

SEQ ID NO: 45704 - RNA, 20 nt, Artificial Sequence
  MKO10045704_A_Rnase10
  gRNA
cuaaagcugcuuacaagugu

SEQ ID NO: 45705 - RNA, 20 nt, Artificial Sequence
  MKO10045705_A_Rnase11
  gRNA
uuucugcuguugcucgcccu

SEQ ID NO: 45706 - RNA, 20 nt, Artificial Sequence
  MKO10045706_A_Rnase11
  gRNA
acuggagcguaccacgugca

SEQ ID NO: 45707 - RNA, 20 nt, Artificial Sequence
  MKO10045707_A_Rnase11
  gRNA
guguaaacagccuaagaguc

SEQ ID NO: 45708 - RNA, 20 nt, Artificial Sequence
  MKO10045708_A_Rnase12
  gRNA
guccacaugcaauuguucua

SEQ ID NO: 45709 - RNA, 20 nt, Artificial Sequence
  MKO10045709_A_Rnase12
  gRNA
guccauagaacaauugcaug

SEQ ID NO: 45710 - RNA, 20 nt, Artificial Sequence
  MKO10045710_A_Rnase12
  gRNA
ugcaugucuucauccacgag

SEQ ID NO: 45711 - RNA, 20 nt, Artificial Sequence
  MKO10045711_A_Rnase13
  gRNA
ggccucauggccuacgugag

SEQ ID NO: 45712 - RNA, 20 nt, Artificial Sequence
  MKO10045712_A_Rnase13
  gRNA
ugaggccauuacaguauccg

SEQ ID NO: 45713 - RNA, 20 nt, Artificial Sequence
  MKO10045713_A_Rnase13
  gRNA
cuuacauguugacuacccca

SEQ ID NO: 45714 - RNA, 20 nt, Artificial Sequence
  MKO10045714_A_Rnase1
  gRNA
uacguagggguucccuucac

SEQ ID NO: 45715 - RNA, 20 nt, Artificial Sequence
  MKO10045715_A_Rnase1
  gRNA
ugccaagggcucaugcacga

SEQ ID NO: 45716 - RNA, 20 nt, Artificial Sequence
  MKO10045716_A_Rnase1
  gRNA
gcaaccaaaugaugaaacgc

SEQ ID NO: 45717 - RNA, 20 nt, Artificial Sequence
  MKO10045717_A_Rnase4
  gRNA
agguguugaagcguuugcac

SEQ ID NO: 45718 - RNA, 20 nt, Artificial Sequence
  MKO10045718_A_Rnase4
  gRNA
aggcccccaacuguagauac

SEQ ID NO: 45719 - RNA, 20 nt, Artificial Sequence
  MKO10045719_A_Rnase4
  gRNA
aaugacaacucgccuagugc

SEQ ID NO: 45720 - RNA, 20 nt, Artificial Sequence
  MKO10045720_A_Rnase6
  gRNA
auaauuguugacaccgcgca

SEQ ID NO: 45721 - RNA, 20 nt, Artificial Sequence
  MKO10045721_A_Rnase6
  gRNA
guucuuccgaccguucuugc

SEQ ID NO: 45722 - RNA, 20 nt, Artificial Sequence
  MKO10045722_A_Rnase6
  gRNA
auugcuuaucacuacuauag

SEQ ID NO: 45723 - RNA, 20 nt, Artificial Sequence
  MKO10045723_A_Rnase9
  gRNA
caggcgaacuugaugaccaa

SEQ ID NO: 45724 - RNA, 20 nt, Artificial Sequence
  MKO10045724_A_Rnase9
  gRNA
acuccugcaauguaguguuc

SEQ ID NO: 45725 - RNA, 20 nt, Artificial Sequence
  MKO10045725_A_Rnase9
  gRNA
cuaauaaagucacguacuuc

SEQ ID NO: 45726 - RNA, 20 nt, Artificial Sequence
  MKO10045726_A_Rnaseh1
  gRNA
ugcccgcuuccguccauuac

SEQ ID NO: 45727 - RNA, 20 nt, Artificial Sequence
  MKO10045727_A_Rnaseh1
  gRNA
agagucagucguugucuaca

SEQ ID NO: 45728 - RNA, 20 nt, Artificial Sequence
  MKO10045728_A_Rnaseh1
  gRNA
ugucaggagcucuucaagcc

SEQ ID NO: 45729 - RNA, 20 nt, Artificial Sequence
  MKO10045729_A_Rnaseh2a
  gRNA
gccucaccgcccaagcaugc

SEQ ID NO: 45730 - RNA, 20 nt, Artificial Sequence
  MKO10045730_A_Rnaseh2a
  gRNA
agugcuguuguaaucgagcc

SEQ ID NO: 45731 - RNA, 20 nt, Artificial Sequence
  MKO10045731_A_Rnaseh2a
  gRNA
caggcucaccugccacuuuc

SEQ ID NO: 45732 - RNA, 20 nt, Artificial Sequence
  MKO10045732_A_Rnaseh2b
  gRNA
acgugucaucgaccacgacu

SEQ ID NO: 45733 - RNA, 20 nt, Artificial Sequence
  MKO10045733_A_Rnaseh2b
  gRNA
agacccaccugagugcgggu

SEQ ID NO: 45734 - RNA, 20 nt, Artificial Sequence
  MKO10045734_A_Rnaseh2b
  gRNA
cagccuccuguucguaaagc

SEQ ID NO: 45735 - RNA, 20 nt, Artificial Sequence
  MKO10045735_A_Rnaseh2c
  gRNA
cggacucaccgucugcaucg

SEQ ID NO: 45736 - RNA, 20 nt, Artificial Sequence
  MKO10045736_A_Rnaseh2c
  gRNA
gggcuacaggcgucguuucg

SEQ ID NO: 45737 - RNA, 20 nt, Artificial Sequence
  MKO10045737_A_Rnaseh2c
  gRNA
ggcgugaagaagcgaucuac

SEQ ID NO: 45738 - RNA, 20 nt, Artificial Sequence
  MKO10045738_A_Rnasek
  gRNA
cuacaacuguuucaucgccg

SEQ ID NO: 45739 - RNA, 20 nt, Artificial Sequence
  MKO10045739_A_Rnasek
  gRNA
aguucgucucaacaagcgca

SEQ ID NO: 45740 - RNA, 20 nt, Artificial Sequence
  MKO10045740_A_Rnasek
  gRNA
guggcaucguccucagcgcc

SEQ ID NO: 45741 - RNA, 20 nt, Artificial Sequence
  MKO10045741_A_Rnasel
  gRNA
uauaggcgaacacaucaaug

SEQ ID NO: 45742 - RNA, 20 nt, Artificial Sequence
  MKO10045742_A_Rnasel
  gRNA
gcagccgcuauagaacacuc

SEQ ID NO: 45743 - RNA, 20 nt, Artificial Sequence
  MKO10045743_A_Rnasel
  gRNA
guucucuacgugguaaugaa

SEQ ID NO: 45744 - RNA, 20 nt, Artificial Sequence
  MKO10045744_A_Rnaset2a
  gRNA
uuaacaguggcagccaugag

SEQ ID NO: 45745 - RNA, 20 nt, Artificial Sequence
  MKO10045745_A_Rnaset2a
  gRNA
gagcucaccuugcauacugu

SEQ ID NO: 45746 - RNA, 20 nt, Artificial Sequence
  MKO10045746_A_Rnaset2a
  gRNA
uaacagcugccaagacucuc

SEQ ID NO: 45747 - RNA, 20 nt, Artificial Sequence
  MKO10045747_A_Rnaset2b
  gRNA
gagcucaccuugcauacugu

SEQ ID NO: 45748 - RNA, 20 nt, Artificial Sequence
  MKO10045748_A_Rnaset2b
  gRNA
uuaacaguggcagccaugag

SEQ ID NO: 45749 - RNA, 20 nt, Artificial Sequence
  MKO10045749_A_Rnaset2b
  gRNA
uccaguaauccagagagucu

SEQ ID NO: 45750 - RNA, 20 nt, Artificial Sequence
  MKO10045750_A_Rnd1
  gRNA
cuucggacggggcucuucgg

SEQ ID NO: 45751 - RNA, 20 nt, Artificial Sequence
  MKO10045751_A_Rnd1
  gRNA
ggcacccaucuccuacgagc

SEQ ID NO: 45752 - RNA, 20 nt, Artificial Sequence
  MKO10045752_A_Rnd1
  gRNA
cugugcgauagccaagcagu

SEQ ID NO: 45753 - RNA, 20 nt, Artificial Sequence
  MKO10045753_A_Rnd2
  gRNA
cuucucucggccguggccau

SEQ ID NO: 45754 - RNA, 20 nt, Artificial Sequence
  MKO10045754_A_Rnd2
  gRNA
uacgucguacugacucucgc

SEQ ID NO: 45755 - RNA, 20 nt, Artificial Sequence
  MKO10045755_A_Rnd2
  gRNA
aguguaguucucaaacaccg

SEQ ID NO: 45756 - RNA, 20 nt, Artificial Sequence
  MKO10045756_A_Rnd3
  gRNA
caugugcgaaauccgcuuug

SEQ ID NO: 45757 - RNA, 20 nt, Artificial Sequence
  MKO10045757_A_Rnd3
  gRNA
cguccagaauuacgucccua

SEQ ID NO: 45758 - RNA, 20 nt, Artificial Sequence
  MKO10045758_A_Rnd3
  gRNA
ggacggacguugucauagua

SEQ ID NO: 45759 - RNA, 20 nt, Artificial Sequence
  MKO10045759_A_Rnf103
  gRNA
guacagugcagcguacccgc

SEQ ID NO: 45760 - RNA, 20 nt, Artificial Sequence
  MKO10045760_A_Rnf103
  gRNA
gagaaccacaaaucgcuuga

SEQ ID NO: 45761 - RNA, 20 nt, Artificial Sequence
  MKO10045761_A_Rnf103
  gRNA
aaaaccuggccaggacgaac

SEQ ID NO: 45762 - RNA, 20 nt, Artificial Sequence
  MKO10045762_A_Rnf10
  gRNA
guguccacagcgcguuaucu

SEQ ID NO: 45763 - RNA, 20 nt, Artificial Sequence
  MKO10045763_A_Rnf10
  gRNA
acgcuugcgauuguaacgcu

SEQ ID NO: 45764 - RNA, 20 nt, Artificial Sequence
  MKO10045764_A_Rnf10
  gRNA
caaagugagcugcguagucu

SEQ ID NO: 45765 - RNA, 20 nt, Artificial Sequence
  MKO10045765_A_Rnf111
  gRNA
ccucaaguacaggcgccuug

SEQ ID NO: 45766 - RNA, 20 nt, Artificial Sequence
  MKO10045766_A_Rnf111
  gRNA
acacaccuggucaugguagc

SEQ ID NO: 45767 - RNA, 20 nt, Artificial Sequence
  MKO10045767_A_Rnf111
  gRNA
cucugauacuacuucaacug

SEQ ID NO: 45768 - RNA, 20 nt, Artificial Sequence
  MKO10045768_A_Rnf112
  gRNA
gcuucgagagcccaucucgc

SEQ ID NO: 45769 - RNA, 20 nt, Artificial Sequence
  MKO10045769_A_Rnf112
  gRNA
caggugggcggcucccgggu

SEQ ID NO: 45770 - RNA, 20 nt, Artificial Sequence
  MKO10045770_A_Rnf112
  gRNA
ggacacacccgucugcuuau

SEQ ID NO: 45771 - RNA, 20 nt, Artificial Sequence
  MKO10045771_A_Rnf113a1
  gRNA
ggcgaccgccgucuacgaac

SEQ ID NO: 45772 - RNA, 20 nt, Artificial Sequence
  MKO10045772_A_Rnf113a1
  gRNA
gaucgaacgugagcuugaug

SEQ ID NO: 45773 - RNA, 20 nt, Artificial Sequence
  MKO10045773_A_Rnf113a1
  gRNA
cgucuacaagucuacccguu

SEQ ID NO: 45774 - RNA, 20 nt, Artificial Sequence
  MKO10045774_A_Rnf113a2
  gRNA
cgcacgccggccgcuuccga

SEQ ID NO: 45775 - RNA, 20 nt, Artificial Sequence
  MKO10045775_A_Rnf113a2
  gRNA
cgucuacaaguccacgcgcu

SEQ ID NO: 45776 - RNA, 20 nt, Artificial Sequence
  MKO10045776_A_Rnf113a2
  gRNA
acaguagcgcguagauguuc

SEQ ID NO: 45777 - RNA, 20 nt, Artificial Sequence
  MKO10045777_A_Rnf114
  gRNA
uaggucgguaccucggcuga

SEQ ID NO: 45778 - RNA, 20 nt, Artificial Sequence
  MKO10045778_A_Rnf114
  gRNA
cagcaccgauaccaagucug

SEQ ID NO: 45779 - RNA, 20 nt, Artificial Sequence
  MKO10045779_A_Rnf114
  gRNA
gccgcucgagcuccacagcu

SEQ ID NO: 45780 - RNA, 20 nt, Artificial Sequence
  MKO10045780_A_Rnf115
  gRNA
gcggaaguacucgucccgac

SEQ ID NO: 45781 - RNA, 20 nt, Artificial Sequence
  MKO10045781_A_Rnf115
  gRNA
acaacucacccuucgauagc

SEQ ID NO: 45782 - RNA, 20 nt, Artificial Sequence
  MKO10045782_A_Rnf115
  gRNA
ucgcugugcuauugucuguc

SEQ ID NO: 45783 - RNA, 20 nt, Artificial Sequence
  MKO10045783_A_Rnf11
  gRNA
uucacgagucucaguccgac

SEQ ID NO: 45784 - RNA, 20 nt, Artificial Sequence
  MKO10045784_A_Rnf11
  gRNA
cauccgaagucggggauuug

SEQ ID NO: 45785 - RNA, 20 nt, Artificial Sequence
  MKO10045785_A_Rnf11
  gRNA
augcacggcagaaaucgaau

SEQ ID NO: 45786 - RNA, 20 nt, Artificial Sequence
  MKO10045786_A_Rnf121
  gRNA
gaggaccauuucagcgugca

SEQ ID NO: 45787 - RNA, 20 nt, Artificial Sequence
  MKO10045787_A_Rnf121
  gRNA
cucuaguacagacaacccca

SEQ ID NO: 45788 - RNA, 20 nt, Artificial Sequence
  MKO10045788_A_Rnf121
  gRNA
cgaaugcaugccaaacaucg

SEQ ID NO: 45789 - RNA, 20 nt, Artificial Sequence
  MKO10045789_A_Rnf122
  gRNA
gagcgagcgauacggcuaca

SEQ ID NO: 45790 - RNA, 20 nt, Artificial Sequence
  MKO10045790_A_Rnf122
  gRNA
ccccacauacuugcggugaa

SEQ ID NO: 45791 - RNA, 20 nt, Artificial Sequence
  MKO10045791_A_Rnf122
  gRNA
gcuccacagguggugcuuaa

SEQ ID NO: 45792 - RNA, 20 nt, Artificial Sequence
  MKO10045792_A_Rnf123
  gRNA
ucgacuuggcccaucuacug

SEQ ID NO: 45793 - RNA, 20 nt, Artificial Sequence
  MKO10045793_A_Rnf123
  gRNA
ccacgugcucaggcagguua

SEQ ID NO: 45794 - RNA, 20 nt, Artificial Sequence
  MKO10045794_A_Rnf123
  gRNA
ccauaaccugccugagcacg

SEQ ID NO: 45795 - RNA, 20 nt, Artificial Sequence
  MKO10045795_A_Rnf125
  gRNA
gugucgccaaguucuagcag

SEQ ID NO: 45796 - RNA, 20 nt, Artificial Sequence
  MKO10045796_A_Rnf125
  gRNA
ggcuuucaucaggucgugaa

SEQ ID NO: 45797 - RNA, 20 nt, Artificial Sequence
  MKO10045797_A_Rnf125
  gRNA
aacuuggcgacaccacagca

SEQ ID NO: 45798 - RNA, 20 nt, Artificial Sequence
  MKO10045798_A_Rnf126
  gRNA
gcuaucgucgaagaugccaa

SEQ ID NO: 45799 - RNA, 20 nt, Artificial Sequence
  MKO10045799_A_Rnf126
  gRNA
augaagccagacucgcaccu

SEQ ID NO: 45800 - RNA, 20 nt, Artificial Sequence
  MKO10045800_A_Rnf126
  gRNA
ccccguaccgaugccgagac

SEQ ID NO: 45801 - RNA, 20 nt, Artificial Sequence
  MKO10045801_A_Rnf128
  gRNA
gucacaauggucaucgaagu

SEQ ID NO: 45802 - RNA, 20 nt, Artificial Sequence
  MKO10045802_A_Rnf128
  gRNA
ugcugccguaauuaugaaaa

SEQ ID NO: 45803 - RNA, 20 nt, Artificial Sequence
  MKO10045803_A_Rnf128
  gRNA
cagcugcgcaccuugaaaca

SEQ ID NO: 45804 - RNA, 20 nt, Artificial Sequence
  MKO10045804_A_Rnf130
  gRNA
ccgccaaagaacuucagccg

SEQ ID NO: 45805 - RNA, 20 nt, Artificial Sequence
  MKO10045805_A_Rnf130
  gRNA
acugcacagugaucgaaguc

SEQ ID NO: 45806 - RNA, 20 nt, Artificial Sequence
  MKO10045806_A_Rnf130
  gRNA
auccacuguuugauauuagg

SEQ ID NO: 45807 - RNA, 20 nt, Artificial Sequence
  MKO10045807_A_Rnf133
  gRNA
ccuacuucuucugcgaacgc

SEQ ID NO: 45808 - RNA, 20 nt, Artificial Sequence
  MKO10045808_A_Rnf133
  gRNA
aaguaaagugacccacgugc

SEQ ID NO: 45809 - RNA, 20 nt, Artificial Sequence
  MKO10045809_A_Rnf133
  gRNA
ccguucaaugagugcgaucc

SEQ ID NO: 45810 - RNA, 20 nt, Artificial Sequence
  MKO10045810_A_Rnf135
  gRNA
gugaucggccacugcguaga

SEQ ID NO: 45811 - RNA, 20 nt, Artificial Sequence
  MKO10045811_A_Rnf135
  gRNA
gccccaagaagcuaccccga

SEQ ID NO: 45812 - RNA, 20 nt, Artificial Sequence
  MKO10045812_A_Rnf135
  gRNA
ucaaacgcaaagacccaacu

SEQ ID NO: 45813 - RNA, 20 nt, Artificial Sequence
  MKO10045813_A_Rnf138rt1
  gRNA
gcuucuaccggucgccacua

SEQ ID NO: 45814 - RNA, 20 nt, Artificial Sequence
  MKO10045814_A_Rnf138rt1
  gRNA
gcguugaacucuaucguaug

SEQ ID NO: 45815 - RNA, 20 nt, Artificial Sequence
  MKO10045815_A_Rnf138rt1
  gRNA
uccgcggcagauccgcagac

SEQ ID NO: 45816 - RNA, 20 nt, Artificial Sequence
  MKO10045816_A_Rnf138
  gRNA
auacauuguccccuaugucg

SEQ ID NO: 45817 - RNA, 20 nt, Artificial Sequence
  MKO10045817_A_Rnf138
  gRNA
cguggccgccgaaaguuccu

SEQ ID NO: 45818 - RNA, 20 nt, Artificial Sequence
  MKO10045818_A_Rnf138
  gRNA
uagucacacuuccacgacau

SEQ ID NO: 45819 - RNA, 20 nt, Artificial Sequence
  MKO10045819_A_Rnf139
  gRNA
aaauucgauaauauugcccg

SEQ ID NO: 45820 - RNA, 20 nt, Artificial Sequence
  MKO10045820_A_Rnf139
  gRNA
aggcauauguaccgaauuua

SEQ ID NO: 45821 - RNA, 20 nt, Artificial Sequence
  MKO10045821_A_Rnf139
  gRNA
aucguaguaggaguugaaga

SEQ ID NO: 45822 - RNA, 20 nt, Artificial Sequence
  MKO10045822_A_Rnf13
  gRNA
cguuggaucccaugcuaauc

SEQ ID NO: 45823 - RNA, 20 nt, Artificial Sequence
  MKO10045823_A_Rnf13
  gRNA
aaucagcacgaugaacgugc

SEQ ID NO: 45824 - RNA, 20 nt, Artificial Sequence
  MKO10045824_A_Rnf13
  gRNA
gguuauagacuaccagcuga

SEQ ID NO: 45825 - RNA, 20 nt, Artificial Sequence
  MKO10045825_A_Rnf141
  gRNA
cugacaggagugaucgacac

SEQ ID NO: 45826 - RNA, 20 nt, Artificial Sequence
  MKO10045826_A_Rnf141
  gRNA
uguacggguggucuguacca

SEQ ID NO: 45827 - RNA, 20 nt, Artificial Sequence
  MKO10045827_A_Rnf141
  gRNA
accgaggauggguucucauc

SEQ ID NO: 45828 - RNA, 20 nt, Artificial Sequence
  MKO10045828_A_Rnf144a
  gRNA
guguacaucgagcgggauga

SEQ ID NO: 45829 - RNA, 20 nt, Artificial Sequence
  MKO10045829_A_Rnf144a
  gRNA
gcucugcuugcaaagcccgc

SEQ ID NO: 45830 - RNA, 20 nt, Artificial Sequence
  MKO10045830_A_Rnf144a
  gRNA
cucgauguacacccugcacu

SEQ ID NO: 45831 - RNA, 20 nt, Artificial Sequence
  MKO10045831_A_Rnf144b
  gRNA
auuuacauugagcgcaacga

SEQ ID NO: 45832 - RNA, 20 nt, Artificial Sequence
  MKO10045832_A_Rnf144b
  gRNA
caaaccgggcacugcuugau

SEQ ID NO: 45833 - RNA, 20 nt, Artificial Sequence
  MKO10045833_A_Rnf144b
  gRNA
accgugugccauauuucagc

SEQ ID NO: 45834 - RNA, 20 nt, Artificial Sequence
  MKO10045834_A_Rnf145
  gRNA
cgcuuaccugaacuaacucc

SEQ ID NO: 45835 - RNA, 20 nt, Artificial Sequence
  MKO10045835_A_Rnf145
  gRNA
gcagacuuagcgagguuaua

SEQ ID NO: 45836 - RNA, 20 nt, Artificial Sequence
  MKO10045836_A_Rnf145
  gRNA
gagagagguucuaaauacau

SEQ ID NO: 45837 - RNA, 20 nt, Artificial Sequence
  MKO10045837_A_Rnf146
  gRNA
gccgaccagucagaccgauc

SEQ ID NO: 45838 - RNA, 20 nt, Artificial Sequence
  MKO10045838_A_Rnf146
  gRNA
ucucauaggauggccggcug

SEQ ID NO: 45839 - RNA, 20 nt, Artificial Sequence
  MKO10045839_A_Rnf146
  gRNA
ggcauccucacuaucacuac

SEQ ID NO: 45840 - RNA, 20 nt, Artificial Sequence
  MKO10045840_A_Rnf148
  gRNA
gcugcaacuucgagugcucc

SEQ ID NO: 45841 - RNA, 20 nt, Artificial Sequence
  MKO10045841_A_Rnf148
  gRNA
aaccggaucauaucagagcu

SEQ ID NO: 45842 - RNA, 20 nt, Artificial Sequence
  MKO10045842_A_Rnf148
  gRNA
acaagacuugcaucgauccc

SEQ ID NO: 45843 - RNA, 20 nt, Artificial Sequence
  MKO10045843_A_Rnf149
  gRNA
guucggugauccaaaagcca

SEQ ID NO: 45844 - RNA, 20 nt, Artificial Sequence
  MKO10045844_A_Rnf149
  gRNA
cguaacaaacccaauauccc

SEQ ID NO: 45845 - RNA, 20 nt, Artificial Sequence
  MKO10045845_A_Rnf149
  gRNA
ucaaaaauuucccguccuuu

SEQ ID NO: 45846 - RNA, 20 nt, Artificial Sequence
  MKO10045846_A_Rnf14
  gRNA
uuaugcagacugaccuauca

SEQ ID NO: 45847 - RNA, 20 nt, Artificial Sequence
  MKO10045847_A_Rnf14
  gRNA
ugaccaggagucgccacuga

SEQ ID NO: 45848 - RNA, 20 nt, Artificial Sequence
  MKO10045848_A_Rnf14
  gRNA
ucuuggacuucaaucaagcu

SEQ ID NO: 45849 - RNA, 20 nt, Artificial Sequence
  MKO10045849_A_Rnf150
  gRNA
aaaauaugugagccgcacgu

SEQ ID NO: 45850 - RNA, 20 nt, Artificial Sequence
  MKO10045850_A_Rnf150
  gRNA
acaagcccaacgaugugguc

SEQ ID NO: 45851 - RNA, 20 nt, Artificial Sequence
  MKO10045851_A_Rnf150
  gRNA
agacaaacacaaccgacgug

SEQ ID NO: 45852 - RNA, 20 nt, Artificial Sequence
  MKO10045852_A_Rnf151
  gRNA
cccaagcaucacguagcucg

SEQ ID NO: 45853 - RNA, 20 nt, Artificial Sequence
  MKO10045853_A_Rnf151
  gRNA
uccgguugcgcucauggcgu

SEQ ID NO: 45854 - RNA, 20 nt, Artificial Sequence
  MKO10045854_A_Rnf151
  gRNA
ucagagcuaccuugacuugu

SEQ ID NO: 45855 - RNA, 20 nt, Artificial Sequence
  MKO10045855_A_Rnf152
  gRNA
auuauuacagcccccgacga

SEQ ID NO: 45856 - RNA, 20 nt, Artificial Sequence
  MKO10045856_A_Rnf152
  gRNA
agugcacacgccagaccaug

SEQ ID NO: 45857 - RNA, 20 nt, Artificial Sequence
  MKO10045857_A_Rnf152
  gRNA
uuuggugaugccacggcacc

SEQ ID NO: 45858 - RNA, 20 nt, Artificial Sequence
  MKO10045858_A_Rnf157
  gRNA
ccccucggagugggccgaag

SEQ ID NO: 45859 - RNA, 20 nt, Artificial Sequence
  MKO10045859_A_Rnf157
  gRNA
ggucgcuguucucgccaaac

SEQ ID NO: 45860 - RNA, 20 nt, Artificial Sequence
  MKO10045860_A_Rnf157
  gRNA
gaaguuugacuccacgcauc

SEQ ID NO: 45861 - RNA, 20 nt, Artificial Sequence
  MKO10045861_A_Rnf165
  gRNA
cuucaccccagcuucgacuu

SEQ ID NO: 45862 - RNA, 20 nt, Artificial Sequence
  MKO10045862_A_Rnf165
  gRNA
ccaccccgugcagucgcagc

SEQ ID NO: 45863 - RNA, 20 nt, Artificial Sequence
  MKO10045863_A_Rnf165
  gRNA
gcaggcucgucucgcauccc

SEQ ID NO: 45864 - RNA, 20 nt, Artificial Sequence
  MKO10045864_A_Rnf166
  gRNA
gccuaccacgaaggugucgu

SEQ ID NO: 45865 - RNA, 20 nt, Artificial Sequence
  MKO10045865_A_Rnf166
  gRNA
cuucuuguugcaaccccgac

SEQ ID NO: 45866 - RNA, 20 nt, Artificial Sequence
  MKO10045866_A_Rnf166
  gRNA
ccgcagugaucccaaccgug

SEQ ID NO: 45867 - RNA, 20 nt, Artificial Sequence
  MKO10045867_A_Rnf167
  gRNA
ucugagcgacgagggacugc

SEQ ID NO: 45868 - RNA, 20 nt, Artificial Sequence
  MKO10045868_A_Rnf167
  gRNA
cagucccucgucgcucagag

SEQ ID NO: 45869 - RNA, 20 nt, Artificial Sequence
  MKO10045869_A_Rnf167
  gRNA
caccauguucagcaguucau

SEQ ID NO: 45870 - RNA, 20 nt, Artificial Sequence
  MKO10045870_A_Rnf168
  gRNA
aacuuacgauacuggugcuc

SEQ ID NO: 45871 - RNA, 20 nt, Artificial Sequence
  MKO10045871_A_Rnf168
  gRNA
cacugagccgacgaacuggc

SEQ ID NO: 45872 - RNA, 20 nt, Artificial Sequence
  MKO10045872_A_Rnf168
  gRNA
augagugccagccaguucgu

SEQ ID NO: 45873 - RNA, 20 nt, Artificial Sequence
  MKO10045873_A_Rnf169
  gRNA
ucugaauccgagagacgcgc

SEQ ID NO: 45874 - RNA, 20 nt, Artificial Sequence
  MKO10045874_A_Rnf169
  gRNA
uuacccugccaggaacgcua

SEQ ID NO: 45875 - RNA, 20 nt, Artificial Sequence
  MKO10045875_A_Rnf169
  gRNA
accucguaccuuggcucugu

SEQ ID NO: 45876 - RNA, 20 nt, Artificial Sequence
  MKO10045876_A_Rnf170
  gRNA
cucaccugagaagugcauac

SEQ ID NO: 45877 - RNA, 20 nt, Artificial Sequence
  MKO10045877_A_Rnf170
  gRNA
acuaccguuugucuacagau

SEQ ID NO: 45878 - RNA, 20 nt, Artificial Sequence
  MKO10045878_A_Rnf170
  gRNA
aucagcauaccuguucuguu

SEQ ID NO: 45879 - RNA, 20 nt, Artificial Sequence
  MKO10045879_A_Rnf17
  gRNA
uccucgaugaagccaucuac

SEQ ID NO: 45880 - RNA, 20 nt, Artificial Sequence
  MKO10045880_A_Rnf17
  gRNA
cauaccgacauuacagcuga

SEQ ID NO: 45881 - RNA, 20 nt, Artificial Sequence
  MKO10045881_A_Rnf17
  gRNA
cccaguagauggcuucaucg

SEQ ID NO: 45882 - RNA, 20 nt, Artificial Sequence
  MKO10045882_A_Rnf180
  gRNA
aauacgucgcucgcaccucc

SEQ ID NO: 45883 - RNA, 20 nt, Artificial Sequence
  MKO10045883_A_Rnf180
  gRNA
cgagcccugccuacgaacuc

SEQ ID NO: 45884 - RNA, 20 nt, Artificial Sequence
  MKO10045884_A_Rnf180
  gRNA
gggccccguuucauuuagcc

SEQ ID NO: 45885 - RNA, 20 nt, Artificial Sequence
  MKO10045885_A_Rnf181
  gRNA
aacagucaucaguagcgcca

SEQ ID NO: 45886 - RNA, 20 nt, Artificial Sequence
  MKO10045886_A_Rnf181
  gRNA
cacggagccauguacacgug

SEQ ID NO: 45887 - RNA, 20 nt, Artificial Sequence
  MKO10045887_A_Rnf181
  gRNA
gcgcuacugaugacuguucu

SEQ ID NO: 45888 - RNA, 20 nt, Artificial Sequence
  MKO10045888_A_Rnf182
  gRNA
ucaccaccgugucccauaac

SEQ ID NO: 45889 - RNA, 20 nt, Artificial Sequence
  MKO10045889_A_Rnf182
  gRNA
aggcugcugacuucgucauc

SEQ ID NO: 45890 - RNA, 20 nt, Artificial Sequence
  MKO10045890_A_Rnf182
  gRNA
ccacacguccucuaauugcu

SEQ ID NO: 45891 - RNA, 20 nt, Artificial Sequence
  MKO10045891_A_Rnf183
  gRNA
ccaucagauaggcgaagauc

SEQ ID NO: 45892 - RNA, 20 nt, Artificial Sequence
  MKO10045892_A_Rnf183
  gRNA
gccccaccaugucauccuag

SEQ ID NO: 45893 - RNA, 20 nt, Artificial Sequence
  MKO10045893_A_Rnf183
  gRNA
ucagaggaugagcgaaccac

SEQ ID NO: 45894 - RNA, 20 nt, Artificial Sequence
  MKO10045894_A_Rnf185
  gRNA
cuuugagugcaacauaugcc

SEQ ID NO: 45895 - RNA, 20 nt, Artificial Sequence
  MKO10045895_A_Rnf185
  gRNA
caggcauauguugcacucaa

SEQ ID NO: 45896 - RNA, 20 nt, Artificial Sequence
  MKO10045896_A_Rnf185
  gRNA
uaguuggccguguuuacauc

SEQ ID NO: 45897 - RNA, 20 nt, Artificial Sequence
  MKO10045897_A_Rnf186
  gRNA
gcuccgguggaugucgcaug

SEQ ID NO: 45898 - RNA, 20 nt, Artificial Sequence
  MKO10045898_A_Rnf186
  gRNA
ggacaaggcugauccgcgca

SEQ ID NO: 45899 - RNA, 20 nt, Artificial Sequence
  MKO10045899_A_Rnf186
  gRNA
accugcugacaaccgauguc

SEQ ID NO: 45900 - RNA, 20 nt, Artificial Sequence
  MKO10045900_A_Rnf187
  gRNA
agaagcgcaccacgcacgcc

SEQ ID NO: 45901 - RNA, 20 nt, Artificial Sequence
  MKO10045901_A_Rnf187
  gRNA
cagcugcucugucgcgccga

SEQ ID NO: 45902 - RNA, 20 nt, Artificial Sequence
  MKO10045902_A_Rnf187
  gRNA
ccgacccggcagaucgcuuc

SEQ ID NO: 45903 - RNA, 20 nt, Artificial Sequence
  MKO10045903_A_Rnf19a
  gRNA
gaccugugaugcugcucgac

SEQ ID NO: 45904 - RNA, 20 nt, Artificial Sequence
  MKO10045904_A_Rnf19a
  gRNA
uccuguguacgugggccgca

SEQ ID NO: 45905 - RNA, 20 nt, Artificial Sequence
  MKO10045905_A_Rnf19a
  gRNA
cagggugacaccgccugcua

SEQ ID NO: 45906 - RNA, 20 nt, Artificial Sequence
  MKO10045906_A_Rnf19b
  gRNA
uggcauugcaauucccgcca

SEQ ID NO: 45907 - RNA, 20 nt, Artificial Sequence
  MKO10045907_A_Rnf19b
  gRNA
accuuucuccccacguauac

SEQ ID NO: 45908 - RNA, 20 nt, Artificial Sequence
  MKO10045908_A_Rnf19b
  gRNA
gggcucagacuuuacgaguu

SEQ ID NO: 45909 - RNA, 20 nt, Artificial Sequence
  MKO10045909_A_Rnf207
  gRNA
gcgccaugacauuguagccc

SEQ ID NO: 45910 - RNA, 20 nt, Artificial Sequence
  MKO10045910_A_Rnf207
  gRNA
uacacuucuggaucacgucg

SEQ ID NO: 45911 - RNA, 20 nt, Artificial Sequence
  MKO10045911_A_Rnf207
  gRNA
aacugcagcagccgguccac

SEQ ID NO: 45912 - RNA, 20 nt, Artificial Sequence
  MKO10045912_A_Rnf208
  gRNA
aaucaguaugugauucgacc

SEQ ID NO: 45913 - RNA, 20 nt, Artificial Sequence
  MKO10045913_A_Rnf208
  gRNA
gacguuguauguaugcccac

SEQ ID NO: 45914 - RNA, 20 nt, Artificial Sequence
  MKO10045914_A_Rnf208
  gRNA
auacauacaacgucacucaa

SEQ ID NO: 45915 - RNA, 20 nt, Artificial Sequence
  MKO10045915_A_Rnf20
  gRNA
ugaaaagcuggagcgacgcc

SEQ ID NO: 45916 - RNA, 20 nt, Artificial Sequence
  MKO10045916_A_Rnf20
  gRNA
cauccuuaaacguuaugauc

SEQ ID NO: 45917 - RNA, 20 nt, Artificial Sequence
  MKO10045917_A_Rnf20
  gRNA
cauaacguuuaaggaugaug

SEQ ID NO: 45918 - RNA, 20 nt, Artificial Sequence
  MKO10045918_A_Rnf214
  gRNA
cccagcagccuccguccuaa

SEQ ID NO: 45919 - RNA, 20 nt, Artificial Sequence
  MKO10045919_A_Rnf214
  gRNA
gccuuaagagaccgagugac

SEQ ID NO: 45920 - RNA, 20 nt, Artificial Sequence
  MKO10045920_A_Rnf214
  gRNA
gaagcugcuuuaacugcacc

SEQ ID NO: 45921 - RNA, 20 nt, Artificial Sequence
  MKO10045921_A_Rnf215
  gRNA
cccuuucagccaacaucgag

SEQ ID NO: 45922 - RNA, 20 nt, Artificial Sequence
  MKO10045922_A_Rnf215
  gRNA
gagcaagagauacccguaga

SEQ ID NO: 45923 - RNA, 20 nt, Artificial Sequence
  MKO10045923_A_Rnf215
  gRNA
cucuccaaggauggcuacgg

SEQ ID NO: 45924 - RNA, 20 nt, Artificial Sequence
  MKO10045924_A_Rnf216
  gRNA
uacuugccuucgcgucaucc

SEQ ID NO: 45925 - RNA, 20 nt, Artificial Sequence
  MKO10045925_A_Rnf216
  gRNA
ucaguagaugaccagcuaau

SEQ ID NO: 45926 - RNA, 20 nt, Artificial Sequence
  MKO10045926_A_Rnf216
  gRNA
cgauauugucaaccccagau

SEQ ID NO: 45927 - RNA, 20 nt, Artificial Sequence
  MKO10045927_A_Rnf217
  gRNA
cuuaccgauuacaacugcua

SEQ ID NO: 45928 - RNA, 20 nt, Artificial Sequence
  MKO10045928_A_Rnf217
  gRNA
agacaaguuacugcgucacu

SEQ ID NO: 45929 - RNA, 20 nt, Artificial Sequence
  MKO10045929_A_Rnf217
  gRNA
gucccacuugccaauugauc

SEQ ID NO: 45930 - RNA, 20 nt, Artificial Sequence
  MKO10045930_A_Rnf219
  gRNA
cugcccugcaucaacgcuaa

SEQ ID NO: 45931 - RNA, 20 nt, Artificial Sequence
  MKO10045931_A_Rnf219
  gRNA
guuccauuugcaucgacuug

SEQ ID NO: 45932 - RNA, 20 nt, Artificial Sequence
  MKO10045932_A_Rnf219
  gRNA
gccguaaauucucccucagc

SEQ ID NO: 45933 - RNA, 20 nt, Artificial Sequence
  MKO10045933_A_Rnf220
  gRNA
gccgguuggcucgcacucgc

SEQ ID NO: 45934 - RNA, 20 nt, Artificial Sequence
  MKO10045934_A_Rnf220
  gRNA
uccugcgagugcgagccaac

SEQ ID NO: 45935 - RNA, 20 nt, Artificial Sequence
  MKO10045935_A_Rnf220
  gRNA
cauauguuccugcaacucgc

SEQ ID NO: 45936 - RNA, 20 nt, Artificial Sequence
  MKO10045936_A_Rnf222
  gRNA
aaggugacauagcggcagau

SEQ ID NO: 45937 - RNA, 20 nt, Artificial Sequence
  MKO10045937_A_Rnf222
  gRNA
cgugcugccccgacgcagcc

SEQ ID NO: 45938 - RNA, 20 nt, Artificial Sequence
  MKO10045938_A_Rnf222
  gRNA
ucagcaagaagagcucccgc

SEQ ID NO: 45939 - RNA, 20 nt, Artificial Sequence
  MKO10045939_A_Rnf223
  gRNA
gcgcaccagccgucagcuac

SEQ ID NO: 45940 - RNA, 20 nt, Artificial Sequence
  MKO10045940_A_Rnf223
  gRNA
ucccggcgacgucuuaagga

SEQ ID NO: 45941 - RNA, 20 nt, Artificial Sequence
  MKO10045941_A_Rnf223
  gRNA
uuccuuccuuaagacgucgc

SEQ ID NO: 45942 - RNA, 20 nt, Artificial Sequence
  MKO10045942_A_Rnf24
  gRNA
guguccccugugcaacaugc

SEQ ID NO: 45943 - RNA, 20 nt, Artificial Sequence
  MKO10045943_A_Rnf24
  gRNA
ggcccaauugcacaguaaac

SEQ ID NO: 45944 - RNA, 20 nt, Artificial Sequence
  MKO10045944_A_Rnf24
  gRNA
cuucaagccuagagaugaac

SEQ ID NO: 45945 - RNA, 20 nt, Artificial Sequence
  MKO10045945_A_Rnf25
  gRNA
aucuccauccguaacccucg

SEQ ID NO: 45946 - RNA, 20 nt, Artificial Sequence
  MKO10045946_A_Rnf25
  gRNA
ugcucaucugaaaguccucg

SEQ ID NO: 45947 - RNA, 20 nt, Artificial Sequence
  MKO10045947_A_Rnf25
  gRNA
agcagacaaacugcgaaucu

SEQ ID NO: 45948 - RNA, 20 nt, Artificial Sequence
  MKO10045948_A_Rnf26
  gRNA
ccaaaucggggaggagcacc

SEQ ID NO: 45949 - RNA, 20 nt, Artificial Sequence
  MKO10045949_A_Rnf26
  gRNA
ccuggugcuccuccccgauu

SEQ ID NO: 45950 - RNA, 20 nt, Artificial Sequence
  MKO10045950_A_Rnf26
  gRNA
cggcugacucgccuuccacu

SEQ ID NO: 45951 - RNA, 20 nt, Artificial Sequence
  MKO10045951_A_Rnf2
  gRNA
aagcgggcccgaguaacaaa

SEQ ID NO: 45952 - RNA, 20 nt, Artificial Sequence
  MKO10045952_A_Rnf2
  gRNA
cccuuaauuagauuacagcg

SEQ ID NO: 45953 - RNA, 20 nt, Artificial Sequence
  MKO10045953_A_Rnf2
  gRNA
cgcuucauacucaucacgac

SEQ ID NO: 45954 - RNA, 20 nt, Artificial Sequence
  MKO10045954_A_Rnf31
  gRNA
cauacaaccguaguacaucc

SEQ ID NO: 45955 - RNA, 20 nt, Artificial Sequence
  MKO10045955_A_Rnf31
  gRNA
aggguggccgggauguacua

SEQ ID NO: 45956 - RNA, 20 nt, Artificial Sequence
  MKO10045956_A_Rnf31
  gRNA
uaaccccgucuuucgcagca

SEQ ID NO: 45957 - RNA, 20 nt, Artificial Sequence
  MKO10045957_A_Rnf32
  gRNA
uaggaucguucaucuaacaa

SEQ ID NO: 45958 - RNA, 20 nt, Artificial Sequence
  MKO10045958_A_Rnf32
  gRNA
guuagcuuaccuaaaguuaa

SEQ ID NO: 45959 - RNA, 20 nt, Artificial Sequence
  MKO10045959_A_Rnf32
  gRNA
gaauggaguccccuuguaga

SEQ ID NO: 45960 - RNA, 20 nt, Artificial Sequence
  MKO10045960_A_Rnf34
  gRNA
aaccgacacuugucgugaga

SEQ ID NO: 45961 - RNA, 20 nt, Artificial Sequence
  MKO10045961_A_Rnf34
  gRNA
ugaggaggagauacugccgc

SEQ ID NO: 45962 - RNA, 20 nt, Artificial Sequence
  MKO10045962_A_Rnf34
  gRNA
aguugacaaaauuccgagcc

SEQ ID NO: 45963 - RNA, 20 nt, Artificial Sequence
  MKO10045963_A_Rnf38
  gRNA
uaacuacgguggcaccccau

SEQ ID NO: 45964 - RNA, 20 nt, Artificial Sequence
  MKO10045964_A_Rnf38
  gRNA
cuuccucgcugacgccuaac

SEQ ID NO: 45965 - RNA, 20 nt, Artificial Sequence
  MKO10045965_A_Rnf38
  gRNA
ugccaccguaguuaccgugu

SEQ ID NO: 45966 - RNA, 20 nt, Artificial Sequence
  MKO10045966_A_Rnf39
  gRNA
cugugcgagggucgagcguc

SEQ ID NO: 45967 - RNA, 20 nt, Artificial Sequence
  MKO10045967_A_Rnf39
  gRNA
cuccacugccagucgcacgu

SEQ ID NO: 45968 - RNA, 20 nt, Artificial Sequence
  MKO10045968_A_Rnf39
  gRNA
aagauacgcagcgggguacg

SEQ ID NO: 45969 - RNA, 20 nt, Artificial Sequence
  MKO10045969_A_Rnf40
  gRNA
agguggcacgggugcgcacc

SEQ ID NO: 45970 - RNA, 20 nt, Artificial Sequence
  MKO10045970_A_Rnf40
  gRNA
cuccuaccuccaacgagaug

SEQ ID NO: 45971 - RNA, 20 nt, Artificial Sequence
  MKO10045971_A_Rnf40
  gRNA
aggccucggaccgccugcaa

SEQ ID NO: 45972 - RNA, 20 nt, Artificial Sequence
  MKO10045972_A_Rnf41
  gRNA
uacguggccaagcgcauccc

SEQ ID NO: 45973 - RNA, 20 nt, Artificial Sequence
  MKO10045973_A_Rnf41
  gRNA
gcagucgcgcauugcagagc

SEQ ID NO: 45974 - RNA, 20 nt, Artificial Sequence
  MKO10045974_A_Rnf41
  gRNA
ugucaucaagcgcucccucg

SEQ ID NO: 45975 - RNA, 20 nt, Artificial Sequence
  MKO10045975_A_Rnf43
  gRNA
gagacgcuuaccccggcggg

SEQ ID NO: 45976 - RNA, 20 nt, Artificial Sequence
  MKO10045976_A_Rnf43
  gRNA
caggggcgaggagcucgucg

SEQ ID NO: 45977 - RNA, 20 nt, Artificial Sequence
  MKO10045977_A_Rnf43
  gRNA
uuuccacaggcccgaauggc

SEQ ID NO: 45978 - RNA, 20 nt, Artificial Sequence
  MKO10045978_A_Rnf44
  gRNA
gauaacgagauggaccuucg

SEQ ID NO: 45979 - RNA, 20 nt, Artificial Sequence
  MKO10045979_A_Rnf44
  gRNA
ggcacugagggcgacaaggc

SEQ ID NO: 45980 - RNA, 20 nt, Artificial Sequence
  MKO10045980_A_Rnf44
  gRNA
cacuuaccauacgugggugc

SEQ ID NO: 45981 - RNA, 20 nt, Artificial Sequence
  MKO10045981_A_Rnf4
  gRNA
gacucacaaugacucuguug

SEQ ID NO: 45982 - RNA, 20 nt, Artificial Sequence
  MKO10045982_A_Rnf4
  gRNA
cacgggcucuaaagauucac

SEQ ID NO: 45983 - RNA, 20 nt, Artificial Sequence
  MKO10045983_A_Rnf4
  gRNA
ccauacuccucgaagcacca

SEQ ID NO: 45984 - RNA, 20 nt, Artificial Sequence
  MKO10045984_A_Rnf5
  gRNA
gagaaggucgucccucuuua

SEQ ID NO: 45985 - RNA, 20 nt, Artificial Sequence
  MKO10045985_A_Rnf5
  gRNA
uggcucccucgcccauaaag

SEQ ID NO: 45986 - RNA, 20 nt, Artificial Sequence
  MKO10045986_A_Rnf5
  gRNA
cccuagggguuccagccauu

SEQ ID NO: 45987 - RNA, 20 nt, Artificial Sequence
  MKO10045987_A_Rnf6
  gRNA
cacauucccagugcgccgaa

SEQ ID NO: 45988 - RNA, 20 nt, Artificial Sequence
  MKO10045988_A_Rnf6
  gRNA
cguggucgagccauccuccg

SEQ ID NO: 45989 - RNA, 20 nt, Artificial Sequence
  MKO10045989_A_Rnf6
  gRNA
gauccgucuagaucuagauc

SEQ ID NO: 45990 - RNA, 20 nt, Artificial Sequence
  MKO10045990_A_Rnf7
  gRNA
agauguucucucucaagaag

SEQ ID NO: 45991 - RNA, 20 nt, Artificial Sequence
  MKO10045991_A_Rnf7
  gRNA
cgccgccgccauggccgacg

SEQ ID NO: 45992 - RNA, 20 nt, Artificial Sequence
  MKO10045992_A_Rnf7
  gRNA
ucaagcugaaaacaagcaag

SEQ ID NO: 45993 - RNA, 20 nt, Artificial Sequence
  MKO10045993_A_Rnf8
  gRNA
ugacgcaucgagucaguccu

SEQ ID NO: 45994 - RNA, 20 nt, Artificial Sequence
  MKO10045994_A_Rnf8
  gRNA
uuacuggcgacauuagccag

SEQ ID NO: 45995 - RNA, 20 nt, Artificial Sequence
  MKO10045995_A_Rnf8
  gRNA
ggcaaaccuuugauaucagc

SEQ ID NO: 45996 - RNA, 20 nt, Artificial Sequence
  MKO10045996_A_Rnft1
  gRNA
aagcucaacuguucgagugu

SEQ ID NO: 45997 - RNA, 20 nt, Artificial Sequence
  MKO10045997_A_Rnft1
  gRNA
caaacuccccguagcuuaua

SEQ ID NO: 45998 - RNA, 20 nt, Artificial Sequence
  MKO10045998_A_Rnft1
  gRNA
uaccgaaaccaaacugguau

SEQ ID NO: 45999 - RNA, 20 nt, Artificial Sequence
  MKO10045999_A_Rnft2
  gRNA
aggugcuuccuucggcgcug

SEQ ID NO: 46000 - RNA, 20 nt, Artificial Sequence
  MKO10046000_A_Rnft2
  gRNA
acgucaccuggugcgcagca

SEQ ID NO: 46001 - RNA, 20 nt, Artificial Sequence
  MKO10046001_A_Rnft2
  gRNA
ucgcagcagaagucgcagcc

SEQ ID NO: 46002 - RNA, 20 nt, Artificial Sequence
  MKO10046002_A_Rnguu
  gRNA
accaacauaccuauaaguuc

SEQ ID NO: 46003 - RNA, 20 nt, Artificial Sequence
  MKO10046003_A_Rnguu
  gRNA
uagauaauuugagagcauac

SEQ ID NO: 46004 - RNA, 20 nt, Artificial Sequence
  MKO10046004_A_Rnguu
  gRNA
cuuaccucugaagacgaugc

SEQ ID NO: 46005 - RNA, 20 nt, Artificial Sequence
  MKO10046005_A_Rnh1
  gRNA
ggccuccaaagcuucgcuac

SEQ ID NO: 46006 - RNA, 20 nt, Artificial Sequence
  MKO10046006_A_Rnh1
  gRNA
caguuccuguagcgaagcuu

SEQ ID NO: 46007 - RNA, 20 nt, Artificial Sequence
  MKO10046007_A_Rnh1
  gRNA
ucuuacaagugggauucugc

SEQ ID NO: 46008 - RNA, 20 nt, Artificial Sequence
  MKO10046008_A_Rnls
  gRNA
caguaauuagugaacgccag

SEQ ID NO: 46009 - RNA, 20 nt, Artificial Sequence
  MKO10046009_A_Rnls
  gRNA
cuacuccucucgcuaugcuc

SEQ ID NO: 46010 - RNA, 20 nt, Artificial Sequence
  MKO10046010_A_Rnls
  gRNA
cuucugcacauccgccucac

SEQ ID NO: 46011 - RNA, 20 nt, Artificial Sequence
  MKO10046011_A_Rnmtl1
  gRNA
ucaacgcucggcgcuggguc

SEQ ID NO: 46012 - RNA, 20 nt, Artificial Sequence
  MKO10046012_A_Rnmtl1
  gRNA
ggcagggcuucgcuacgaua

SEQ ID NO: 46013 - RNA, 20 nt, Artificial Sequence
  MKO10046013_A_Rnmtl1
  gRNA
auaaaaccggugaccgugac

SEQ ID NO: 46014 - RNA, 20 nt, Artificial Sequence
  MKO10046014_A_Rnmt
  gRNA
gacuuugacuacgcuucgcc

SEQ ID NO: 46015 - RNA, 20 nt, Artificial Sequence
  MKO10046015_A_Rnmt
  gRNA
ugcgguaccucaucguccug

SEQ ID NO: 46016 - RNA, 20 nt, Artificial Sequence
  MKO10046016_A_Rnmt
  gRNA
agaagcgacugacgcuuucg

SEQ ID NO: 46017 - RNA, 20 nt, Artificial Sequence
  MKO10046017_A_Rnpc3
  gRNA
cgcaaauauaguaaaugcuc

SEQ ID NO: 46018 - RNA, 20 nt, Artificial Sequence
  MKO10046018_A_Rnpc3
  gRNA
ugucccaaaauucuauguac

SEQ ID NO: 46019 - RNA, 20 nt, Artificial Sequence
  MKO10046019_A_Rnpc3
  gRNA
gaccuagaaguuucagcuga

SEQ ID NO: 46020 - RNA, 20 nt, Artificial Sequence
  MKO10046020_A_Rnpepl1
  gRNA
cuucccgugcuucgauacgc

SEQ ID NO: 46021 - RNA, 20 nt, Artificial Sequence
  MKO10046021_A_Rnpepl1
  gRNA
cuacgagguaggcggguacu

SEQ ID NO: 46022 - RNA, 20 nt, Artificial Sequence
  MKO10046022_A_Rnpepl1
  gRNA
accgccggcguaucgaagca

SEQ ID NO: 46023 - RNA, 20 nt, Artificial Sequence
  MKO10046023_A_Rnpep
  gRNA
gcucaccuaccgcgucgggg

SEQ ID NO: 46024 - RNA, 20 nt, Artificial Sequence
  MKO10046024_A_Rnpep
  gRNA
ugccgccgaucgcuucgagc

SEQ ID NO: 46025 - RNA, 20 nt, Artificial Sequence
  MKO10046025_A_Rnpep
  gRNA
gguuuaagaccgccugaccc

SEQ ID NO: 46026 - RNA, 20 nt, Artificial Sequence
  MKO10046026_A_Rnps1
  gRNA
cucucucuaggaucauauca

SEQ ID NO: 46027 - RNA, 20 nt, Artificial Sequence
  MKO10046027_A_Rnps1
  gRNA
ugaggaugcauccucucaac

SEQ ID NO: 46028 - RNA, 20 nt, Artificial Sequence
  MKO10046028_A_Rnps1
  gRNA
uguuaccuuggucacauucc

SEQ ID NO: 46029 - RNA, 20 nt, Artificial Sequence
  MKO10046029_A_Robo1
  gRNA
uauacgcguaaaagcgaugc

SEQ ID NO: 46030 - RNA, 20 nt, Artificial Sequence
  MKO10046030_A_Robo1
  gRNA
cuaccuccagcgaugcguug

SEQ ID NO: 46031 - RNA, 20 nt, Artificial Sequence
  MKO10046031_A_Robo1
  gRNA
gccccaccccgacgauagaa

SEQ ID NO: 46032 - RNA, 20 nt, Artificial Sequence
  MKO10046032_A_Robo2
  gRNA
cgcagaaguaaaccggacga

SEQ ID NO: 46033 - RNA, 20 nt, Artificial Sequence
  MKO10046033_A_Robo2
  gRNA
caaacguaacucccuucguc

SEQ ID NO: 46034 - RNA, 20 nt, Artificial Sequence
  MKO10046034_A_Robo2
  gRNA
acagaugugguagucgcagc

SEQ ID NO: 46035 - RNA, 20 nt, Artificial Sequence
  MKO10046035_A_Robo3
  gRNA
ggcggcugcuccacgaugcg

SEQ ID NO: 46036 - RNA, 20 nt, Artificial Sequence
  MKO10046036_A_Robo3
  gRNA
agcgacgcccgugcacaaug

SEQ ID NO: 46037 - RNA, 20 nt, Artificial Sequence
  MKO10046037_A_Robo3
  gRNA
auugccggaaaucaucacgg

SEQ ID NO: 46038 - RNA, 20 nt, Artificial Sequence
  MKO10046038_A_Robo4
  gRNA
cauccggcaaaagguaaugu

SEQ ID NO: 46039 - RNA, 20 nt, Artificial Sequence
  MKO10046039_A_Robo4
  gRNA
ggacagagggccgauguaac

SEQ ID NO: 46040 - RNA, 20 nt, Artificial Sequence
  MKO10046040_A_Robo4
  gRNA
cuaaaccccgaaccuguaaa

SEQ ID NO: 46041 - RNA, 20 nt, Artificial Sequence
  MKO10046041_A_Rock1
  gRNA
guaaucggcagaggugcauu

SEQ ID NO: 46042 - RNA, 20 nt, Artificial Sequence
  MKO10046042_A_Rock1
  gRNA
cauagcauaaaccuuccuag

SEQ ID NO: 46043 - RNA, 20 nt, Artificial Sequence
  MKO10046043_A_Rock1
  gRNA
uggcguuugccaauaguccu

SEQ ID NO: 46044 - RNA, 20 nt, Artificial Sequence
  MKO10046044_A_Rock2
  gRNA
aaauccucagguucgucaua

SEQ ID NO: 46045 - RNA, 20 nt, Artificial Sequence
  MKO10046045_A_Rock2
  gRNA
guacaucauaauuacucaua

SEQ ID NO: 46046 - RNA, 20 nt, Artificial Sequence
  MKO10046046_A_Rock2
  gRNA
uaugcuuaccugaacuaccc

SEQ ID NO: 46047 - RNA, 20 nt, Artificial Sequence
  MKO10046047_A_Rogdi
  gRNA
cgccgugcugagacagcugc

SEQ ID NO: 46048 - RNA, 20 nt, Artificial Sequence
  MKO10046048_A_Rogdi
  gRNA
ugcaacaacugguuguuccg

SEQ ID NO: 46049 - RNA, 20 nt, Artificial Sequence
  MKO10046049_A_Rogdi
  gRNA
ggggacucaccgcuuggcug

SEQ ID NO: 46050 - RNA, 20 nt, Artificial Sequence
  MKO10046050_A_Rom1
  gRNA
ccuccaaccccguauccguu

SEQ ID NO: 46051 - RNA, 20 nt, Artificial Sequence
  MKO10046051_A_Rom1
  gRNA
cugucaggccaaacgucuga

SEQ ID NO: 46052 - RNA, 20 nt, Artificial Sequence
  MKO10046052_A_Rom1
  gRNA
agguuuagguugggcugccg

SEQ ID NO: 46053 - RNA, 20 nt, Artificial Sequence
  MKO10046053_A_Romo1
  gRNA
cgggagcuaaugggcggcau

SEQ ID NO: 46054 - RNA, 20 nt, Artificial Sequence
  MKO10046054_A_Romo1
  gRNA
gccgcagaugccgguggccg

SEQ ID NO: 46055 - RNA, 20 nt, Artificial Sequence
  MKO10046055_A_Romo1
  gRNA
uccuccucaggaucggaaug

SEQ ID NO: 46056 - RNA, 20 nt, Artificial Sequence
  MKO10046056_A_Ropn1l
  gRNA
ggacuuucggacuucuucgu

SEQ ID NO: 46057 - RNA, 20 nt, Artificial Sequence
  MKO10046057_A_Ropn1l
  gRNA
augcgagcaggcccgcccuc

SEQ ID NO: 46058 - RNA, 20 nt, Artificial Sequence
  MKO10046058_A_Ropn1l
  gRNA
ggacccagaacucccggccg

SEQ ID NO: 46059 - RNA, 20 nt, Artificial Sequence
  MKO10046059_A_Ropn1
  gRNA
guacacguauaucgcugaag

SEQ ID NO: 46060 - RNA, 20 nt, Artificial Sequence
  MKO10046060_A_Ropn1
  gRNA
uauuucggagccaugucccg

SEQ ID NO: 46061 - RNA, 20 nt, Artificial Sequence
  MKO10046061_A_Ropn1
  gRNA
ucucuucaucccacguuagc

SEQ ID NO: 46062 - RNA, 20 nt, Artificial Sequence
  MKO10046062_A_Ror1
  gRNA
ggaguacuuacgaggauccu

SEQ ID NO: 46063 - RNA, 20 nt, Artificial Sequence
  MKO10046063_A_Ror1
  gRNA
uccuuccgggcaaccaacua

SEQ ID NO: 46064 - RNA, 20 nt, Artificial Sequence
  MKO10046064_A_Ror1
  gRNA
auugcaugugcacgauuuau

SEQ ID NO: 46065 - RNA, 20 nt, Artificial Sequence
  MKO10046065_A_Ror2
  gRNA
agcgcgcacaagcgaucccu

SEQ ID NO: 46066 - RNA, 20 nt, Artificial Sequence
  MKO10046066_A_Ror2
  gRNA
aucgcuugugcgcgcuucau

SEQ ID NO: 46067 - RNA, 20 nt, Artificial Sequence
  MKO10046067_A_Ror2
  gRNA
agugauggucuucagcccgu

SEQ ID NO: 46068 - RNA, 20 nt, Artificial Sequence
  MKO10046068_A_Rora
  gRNA
gagagacagcuuguacgccg

SEQ ID NO: 46069 - RNA, 20 nt, Artificial Sequence
  MKO10046069_A_Rora
  gRNA
gacuuccccaaccgugucca

SEQ ID NO: 46070 - RNA, 20 nt, Artificial Sequence
  MKO10046070_A_Rora
  gRNA
cacacguaaugacaccauaa

SEQ ID NO: 46071 - RNA, 20 nt, Artificial Sequence
  MKO10046071_A_Rorb
  gRNA
ugccgccggucucgguguuc

SEQ ID NO: 46072 - RNA, 20 nt, Artificial Sequence
  MKO10046072_A_Rorb
  gRNA
cagccgucucccgaucaguc

SEQ ID NO: 46073 - RNA, 20 nt, Artificial Sequence
  MKO10046073_A_Rorb
  gRNA
cacacgugaugacuccguag

SEQ ID NO: 46074 - RNA, 20 nt, Artificial Sequence
  MKO10046074_A_Rorc
  gRNA
guugcggcugguucggucaa

SEQ ID NO: 46075 - RNA, 20 nt, Artificial Sequence
  MKO10046075_A_Rorc
  gRNA
cuugaguauaguccagaacg

SEQ ID NO: 46076 - RNA, 20 nt, Artificial Sequence
  MKO10046076_A_Rorc
  gRNA
gcaguucugcugacgcgugc

SEQ ID NO: 46077 - RNA, 20 nt, Artificial Sequence
  MKO10046077_A_Ros1
  gRNA
ugcggaggguagcuacgaag

SEQ ID NO: 46078 - RNA, 20 nt, Artificial Sequence
  MKO10046078_A_Ros1
  gRNA
caccuacgccaccauuugug

SEQ ID NO: 46079 - RNA, 20 nt, Artificial Sequence
  MKO10046079_A_Ros1
  gRNA
cacacgguacaaucugagug

SEQ ID NO: 46080 - RNA, 20 nt, Artificial Sequence
  MKO10046080_A_Rp1l1
  gRNA
ucacugccuguaucgccguc

SEQ ID NO: 46081 - RNA, 20 nt, Artificial Sequence
  MKO10046081_A_Rp1l1
  gRNA
ucugcgcuuucccgucaagc

SEQ ID NO: 46082 - RNA, 20 nt, Artificial Sequence
  MKO10046082_A_Rp1l1
  gRNA
ggugacggaacgcaccccaa

SEQ ID NO: 46083 - RNA, 20 nt, Artificial Sequence
  MKO10046083_A_Rp1
  gRNA
acccacaguuuggcggcguu

SEQ ID NO: 46084 - RNA, 20 nt, Artificial Sequence
  MKO10046084_A_Rp1
  gRNA
cgggugucaucggacaaucc

SEQ ID NO: 46085 - RNA, 20 nt, Artificial Sequence
  MKO10046085_A_Rp1
  gRNA
ucugcauugccguacaugcc

SEQ ID NO: 46086 - RNA, 20 nt, Artificial Sequence
  MKO10046086_A_Rp2h
  gRNA
gaaacaguaggucgcuuacc

SEQ ID NO: 46087 - RNA, 20 nt, Artificial Sequence
  MKO10046087_A_Rp2h
  gRNA
auccgcuucauauccccauc

SEQ ID NO: 46088 - RNA, 20 nt, Artificial Sequence
  MKO10046088_A_Rp2h
  gRNA
agucucucacacgaaauugc

SEQ ID NO: 46089 - RNA, 20 nt, Artificial Sequence
  MKO10046089_A_Rp9
  gRNA
ucgcgaaugaugucguacau

SEQ ID NO: 46090 - RNA, 20 nt, Artificial Sequence
  MKO10046090_A_Rp9
  gRNA
auucuuugucgccuguucga

SEQ ID NO: 46091 - RNA, 20 nt, Artificial Sequence
  MKO10046091_A_Rp9
  gRNA
acgcuccgacuaaaggacug

SEQ ID NO: 46092 - RNA, 20 nt, Artificial Sequence
  MKO10046092_A_Rpa1
  gRNA
ugacgaugaacuuguggacc

SEQ ID NO: 46093 - RNA, 20 nt, Artificial Sequence
  MKO10046093_A_Rpa1
  gRNA
ccucgauggcccccucgcuc

SEQ ID NO: 46094 - RNA, 20 nt, Artificial Sequence
  MKO10046094_A_Rpa1
  gRNA
aacauccgucccauuucuac

SEQ ID NO: 46095 - RNA, 20 nt, Artificial Sequence
  MKO10046095_A_Rpa2
  gRNA
cgauaugacagcuccgccca

SEQ ID NO: 46096 - RNA, 20 nt, Artificial Sequence
  MKO10046096_A_Rpa2
  gRNA
guagccgccugcuccgccau

SEQ ID NO: 46097 - RNA, 20 nt, Artificial Sequence
  MKO10046097_A_Rpa2
  gRNA
ggcggcuacacgcagucccc

SEQ ID NO: 46098 - RNA, 20 nt, Artificial Sequence
  MKO10046098_A_Rpa3
  gRNA
uagcuugacgaggaaaucuc

SEQ ID NO: 46099 - RNA, 20 nt, Artificial Sequence
  MKO10046099_A_Rpa3
  gRNA
ugcaucuuauacccuguuua

SEQ ID NO: 46100 - RNA, 20 nt, Artificial Sequence
  MKO10046100_A_Rpa3
  gRNA
uacuggcuccaucaauucaa

SEQ ID NO: 46101 - RNA, 20 nt, Artificial Sequence
  MKO10046101_A_Rpain
  gRNA
gcuccugaacaaauaucgcc

SEQ ID NO: 46102 - RNA, 20 nt, Artificial Sequence
  MKO10046102_A_Rpain
  gRNA
cucuucauacucgcuuauga

SEQ ID NO: 46103 - RNA, 20 nt, Artificial Sequence
  MKO10046103_A_Rpain
  gRNA
caucauaagcgaguaugaag

SEQ ID NO: 46104 - RNA, 20 nt, Artificial Sequence
  MKO10046104_A_Rpap1
  gRNA
gccuguguuccaucgcucuc

SEQ ID NO: 46105 - RNA, 20 nt, Artificial Sequence
  MKO10046105_A_Rpap1
  gRNA
aggcgggaaagcaacaccac

SEQ ID NO: 46106 - RNA, 20 nt, Artificial Sequence
  MKO10046106_A_Rpap1
  gRNA
ucgugaggcagcgggugacc

SEQ ID NO: 46107 - RNA, 20 nt, Artificial Sequence
  MKO10046107_A_Rpap2
  gRNA
agcucacuacagcgacguug

SEQ ID NO: 46108 - RNA, 20 nt, Artificial Sequence
  MKO10046108_A_Rpap2
  gRNA
ucuuccucucgaacccauac

SEQ ID NO: 46109 - RNA, 20 nt, Artificial Sequence
  MKO10046109_A_Rpap2
  gRNA
uucuucagcagcugaaaguc

SEQ ID NO: 46110 - RNA, 20 nt, Artificial Sequence
  MKO10046110_A_Rpap3
  gRNA
uaagccgacgcucuguuugu

SEQ ID NO: 46111 - RNA, 20 nt, Artificial Sequence
  MKO10046111_A_Rpap3
  gRNA
aaaccgagcugcaccucgcc

SEQ ID NO: 46112 - RNA, 20 nt, Artificial Sequence
  MKO10046112_A_Rpap3
  gRNA
gcugccaacaaacagagcgu

SEQ ID NO: 46113 - RNA, 20 nt, Artificial Sequence
  MKO10046113_A_Rpe65
  gRNA
acuggcagucuccuccgaug

SEQ ID NO: 46114 - RNA, 20 nt, Artificial Sequence
  MKO10046114_A_Rpe65
  gRNA
gcauaguaaucuucucccac

SEQ ID NO: 46115 - RNA, 20 nt, Artificial Sequence
  MKO10046115_A_Rpe65
  gRNA
uucagaauugaacacccugc

SEQ ID NO: 46116 - RNA, 20 nt, Artificial Sequence
  MKO10046116_A_Rpe
  gRNA
uuucggaggcuuucaaccac

SEQ ID NO: 46117 - RNA, 20 nt, Artificial Sequence
  MKO10046117_A_Rpe
  gRNA
augaccguagaaccuggguu

SEQ ID NO: 46118 - RNA, 20 nt, Artificial Sequence
  MKO10046118_A_Rpe
  gRNA
ucgucuagguucacugguug

SEQ ID NO: 46119 - RNA, 20 nt, Artificial Sequence
  MKO10046119_A_Rpf1
  gRNA
gagagaggcucuuggcgaua

SEQ ID NO: 46120 - RNA, 20 nt, Artificial Sequence
  MKO10046120_A_Rpf1
  gRNA
gguggcuuacgaugaagcga

SEQ ID NO: 46121 - RNA, 20 nt, Artificial Sequence
  MKO10046121_A_Rpf1
  gRNA
uggucucgucguaaacgcgc

SEQ ID NO: 46122 - RNA, 20 nt, Artificial Sequence
  MKO10046122_A_Rpf2
  gRNA
uaugcacugaagaaaccaua

SEQ ID NO: 46123 - RNA, 20 nt, Artificial Sequence
  MKO10046123_A_Rpf2
  gRNA
agugacgucugauccucaaa

SEQ ID NO: 46124 - RNA, 20 nt, Artificial Sequence
  MKO10046124_A_Rpf2
  gRNA
ucaccuauuacuagguuauu

SEQ ID NO: 46125 - RNA, 20 nt, Artificial Sequence
  MKO10046125_A_Rpgrip1l
  gRNA
cucgaguuaacaccggccgc

SEQ ID NO: 46126 - RNA, 20 nt, Artificial Sequence
  MKO10046126_A_Rpgrip1l
  gRNA
auuaacuagccguauuaacu

SEQ ID NO: 46127 - RNA, 20 nt, Artificial Sequence
  MKO10046127_A_Rpgrip1l
  gRNA
cuucacugugcgugcaguug

SEQ ID NO: 46128 - RNA, 20 nt, Artificial Sequence
  MKO10046128_A_Rpgrip1
  gRNA
ugcacugccuaccgcggucg

SEQ ID NO: 46129 - RNA, 20 nt, Artificial Sequence
  MKO10046129_A_Rpgrip1
  gRNA
cugcgucccgcguggacucg

SEQ ID NO: 46130 - RNA, 20 nt, Artificial Sequence
  MKO10046130_A_Rpgrip1
  gRNA
agaagguuccuucaccaacg

SEQ ID NO: 46131 - RNA, 20 nt, Artificial Sequence
  MKO10046131_A_Rpgr
  gRNA
uacuguaccuguugaaacua

SEQ ID NO: 46132 - RNA, 20 nt, Artificial Sequence
  MKO10046132_A_Rpgr
  gRNA
aucccucaugaagugacugu

SEQ ID NO: 46133 - RNA, 20 nt, Artificial Sequence
  MKO10046133_A_Rpgr
  gRNA
acauguucggcaguaacaac

SEQ ID NO: 46134 - RNA, 20 nt, Artificial Sequence
  MKO10046134_A_Rph3al
  gRNA
ccguauucugcaaagacugc

SEQ ID NO: 46135 - RNA, 20 nt, Artificial Sequence
  MKO10046135_A_Rph3al
  gRNA
ucaggggccugguucuacaa

SEQ ID NO: 46136 - RNA, 20 nt, Artificial Sequence
  MKO10046136_A_Rph3al
  gRNA
aucuugccccugaaaacccc

SEQ ID NO: 46137 - RNA, 20 nt, Artificial Sequence
  MKO10046137_A_Rph3a
  gRNA
cuccaacaaccguccgcauc

SEQ ID NO: 46138 - RNA, 20 nt, Artificial Sequence
  MKO10046138_A_Rph3a
  gRNA
caggcgccugguggaccguc

SEQ ID NO: 46139 - RNA, 20 nt, Artificial Sequence
  MKO10046139_A_Rph3a
  gRNA
acagucuucacacacgacac

SEQ ID NO: 46140 - RNA, 20 nt, Artificial Sequence
  MKO10046140_A_Rpia
  gRNA
uaccuauucgcugcacagcg

SEQ ID NO: 46141 - RNA, 20 nt, Artificial Sequence
  MKO10046141_A_Rpia
  gRNA
cagauugaccuugccaucga

SEQ ID NO: 46142 - RNA, 20 nt, Artificial Sequence
  MKO10046142_A_Rpia
  gRNA
guccacgcugugcagcgaau

SEQ ID NO: 46143 - RNA, 20 nt, Artificial Sequence
  MKO10046143_A_Rpl10a
  gRNA
cucacuugcggcgcuugcgc

SEQ ID NO: 46144 - RNA, 20 nt, Artificial Sequence
  MKO10046144_A_Rpl10a
  gRNA
cucgcucagguuucuggaga

SEQ ID NO: 46145 - RNA, 20 nt, Artificial Sequence
  MKO10046145_A_Rpl10a
  gRNA
ccagacugaccuucuucauc

SEQ ID NO: 46146 - RNA, 20 nt, Artificial Sequence
  MKO10046146_A_Rpl10l
  gRNA
gcgagccggacgacgaccca

SEQ ID NO: 46147 - RNA, 20 nt, Artificial Sequence
  MKO10046147_A_Rpl10l
  gRNA
ugucgccaugggucgucguc

SEQ ID NO: 46148 - RNA, 20 nt, Artificial Sequence
  MKO10046148_A_Rpl10l
  gRNA
acucucgccaccguaccuug

SEQ ID NO: 46149 - RNA, 20 nt, Artificial Sequence
  MKO10046149_A_Rpl10
  gRNA
cuaccuaccuucuggcggcc

SEQ ID NO: 46150 - RNA, 20 nt, Artificial Sequence
  MKO10046150_A_Rpl10
  gRNA
acuacuuaccagggacacca

SEQ ID NO: 46151 - RNA, 20 nt, Artificial Sequence
  MKO10046151_A_Rpl10
  gRNA
uaugagcaacucucuucuga

SEQ ID NO: 46152 - RNA, 20 nt, Artificial Sequence
  MKO10046152_A_Rpl11
  gRNA
caugcgcugguuccagcaga

SEQ ID NO: 46153 - RNA, 20 nt, Artificial Sequence
  MKO10046153_A_Rpl11
  gRNA
cagaccccgguguucuccaa

SEQ ID NO: 46154 - RNA, 20 nt, Artificial Sequence
  MKO10046154_A_Rpl11
  gRNA
ccucuucgcagcaagaucaa

SEQ ID NO: 46155 - RNA, 20 nt, Artificial Sequence
  MKO10046155_A_Rpl12
  gRNA
cgacgacuuaccagacccag

SEQ ID NO: 46156 - RNA, 20 nt, Artificial Sequence
  MKO10046156_A_Rpl12
  gRNA
gaagaucgguccucuggguc

SEQ ID NO: 46157 - RNA, 20 nt, Artificial Sequence
  MKO10046157_A_Rpl12
  gRNA
cuacagucuccgaagaaagu

SEQ ID NO: 46158 - RNA, 20 nt, Artificial Sequence
  MKO10046158_A_Rpl13a
  gRNA
guuaacucuaggccggaagg

SEQ ID NO: 46159 - RNA, 20 nt, Artificial Sequence
  MKO10046159_A_Rpl13a
  gRNA
gaucccuccacccuaugaca

SEQ ID NO: 46160 - RNA, 20 nt, Artificial Sequence
  MKO10046160_A_Rpl13a
  gRNA
guuuccacagguucugguau

SEQ ID NO: 46161 - RNA, 20 nt, Artificial Sequence
  MKO10046161_A_Rpl13
  gRNA
uuuccugcaggcgcaaggcc

SEQ ID NO: 46162 - RNA, 20 nt, Artificial Sequence
  MKO10046162_A_Rpl13
  gRNA
acaggcugaagaacuuaagc

SEQ ID NO: 46163 - RNA, 20 nt, Artificial Sequence
  MKO10046163_A_Rpl13
  gRNA
cucuuuccagguguacaaaa

SEQ ID NO: 46164 - RNA, 20 nt, Artificial Sequence
  MKO10046164_A_Rpl14
  gRNA
uuagguguucaggcguuacg

SEQ ID NO: 46165 - RNA, 20 nt, Artificial Sequence
  MKO10046165_A_Rpl14
  gRNA
guauccuaggcuuuagugga

SEQ ID NO: 46166 - RNA, 20 nt, Artificial Sequence
  MKO10046166_A_Rpl14
  gRNA
ucauccucaaguucccacac

SEQ ID NO: 46167 - RNA, 20 nt, Artificial Sequence
  MKO10046167_A_Rpl15
  gRNA
guguaggcuaugucauuuac

SEQ ID NO: 46168 - RNA, 20 nt, Artificial Sequence
  MKO10046168_A_Rpl15
  gRNA
ucaccucagcaacagacuga

SEQ ID NO: 46169 - RNA, 20 nt, Artificial Sequence
  MKO10046169_A_Rpl15
  gRNA
gggugcauacaaguacaucc

SEQ ID NO: 46170 - RNA, 20 nt, Artificial Sequence
  MKO10046170_A_Rpl17
  gRNA
aaaccuucguguucacuuua

SEQ ID NO: 46171 - RNA, 20 nt, Artificial Sequence
  MKO10046171_A_Rpl17
  gRNA
uuugcagcaugcaaaucaag

SEQ ID NO: 46172 - RNA, 20 nt, Artificial Sequence
  MKO10046172_A_Rpl17
  gRNA
uucucuuucaggccaaacag

SEQ ID NO: 46173 - RNA, 20 nt, Artificial Sequence
  MKO10046173_A_Rpl18a
  gRNA
ucuuuccacagaccgagaca

SEQ ID NO: 46174 - RNA, 20 nt, Artificial Sequence
  MKO10046174_A_Rpl18a
  gRNA
cuuucagcuucgggaguaca

SEQ ID NO: 46175 - RNA, 20 nt, Artificial Sequence
  MKO10046175_A_Rpl18a
  gRNA
uccgcaguacacaauuuccc

SEQ ID NO: 46176 - RNA, 20 nt, Artificial Sequence
  MKO10046176_A_Rpl18
  gRNA
gacuacuaaccaugcgggac

SEQ ID NO: 46177 - RNA, 20 nt, Artificial Sequence
  MKO10046177_A_Rpl18
  gRNA
accucugucccugucccgca

SEQ ID NO: 46178 - RNA, 20 nt, Artificial Sequence
  MKO10046178_A_Rpl18
  gRNA
uggucacuuaccuucagcuu

SEQ ID NO: 46179 - RNA, 20 nt, Artificial Sequence
  MKO10046179_A_Rpl19
  gRNA
cuuacgccaggagcuucuug

SEQ ID NO: 46180 - RNA, 20 nt, Artificial Sequence
  MKO10046180_A_Rpl19
  gRNA
auacucacgggaguuggcau

SEQ ID NO: 46181 - RNA, 20 nt, Artificial Sequence
  MKO10046181_A_Rpl19
  gRNA
ccuucccaggucagcagauc

SEQ ID NO: 46182 - RNA, 20 nt, Artificial Sequence
  MKO10046182_A_Rpl21
  gRNA
ucauuccaggggcaaaauuc

SEQ ID NO: 46183 - RNA, 20 nt, Artificial Sequence
  MKO10046183_A_Rpl21
  gRNA
cuuguagauucgcauguaug

SEQ ID NO: 46184 - RNA, 20 nt, Artificial Sequence
  MKO10046184_A_Rpl21
  gRNA
auacaugcgaaucuacaaga

SEQ ID NO: 46185 - RNA, 20 nt, Artificial Sequence
  MKO10046185_A_Rpl22l1
  gRNA
gaaaauaggaacaguuucua

SEQ ID NO: 46186 - RNA, 20 nt, Artificial Sequence
  MKO10046186_A_Rpl22l1
  gRNA
ucaaaaauuccaucuucuac

SEQ ID NO: 46187 - RNA, 20 nt, Artificial Sequence
  MKO10046187_A_Rpl22l1
  gRNA
agaagccuaagaaguccacc

SEQ ID NO: 46188 - RNA, 20 nt, Artificial Sequence
  MKO10046188_A_Rpl22
  gRNA
cuugcucuugcugcguucga

SEQ ID NO: 46189 - RNA, 20 nt, Artificial Sequence
  MKO10046189_A_Rpl22
  gRNA
cauacuaaccacaggcgcca

SEQ ID NO: 46190 - RNA, 20 nt, Artificial Sequence
  MKO10046190_A_Rpl22
  gRNA
cucugccgccauggcgccug

SEQ ID NO: 46191 - RNA, 20 nt, Artificial Sequence
  MKO10046191_A_Rpl23a
  gRNA
ugcccuagauguugccaaca

SEQ ID NO: 46192 - RNA, 20 nt, Artificial Sequence
  MKO10046192_A_Rpl23a
  gRNA
uuaccuuguuggcaacaucu

SEQ ID NO: 46193 - RNA, 20 nt, Artificial Sequence
  MKO10046193_A_Rpl23a
  gRNA
cccuacugacuuguuucucc

SEQ ID NO: 46194 - RNA, 20 nt, Artificial Sequence
  MKO10046194_A_Rpl23
  gRNA
caaacaggcucugcuaucac

SEQ ID NO: 46195 - RNA, 20 nt, Artificial Sequence
  MKO10046195_A_Rpl23
  gRNA
guccuuaguacauccagcag

SEQ ID NO: 46196 - RNA, 20 nt, Artificial Sequence
  MKO10046196_A_Rpl23
  gRNA
gcaggacgcgguggguccuc

SEQ ID NO: 46197 - RNA, 20 nt, Artificial Sequence
  MKO10046197_A_Rpl24
  gRNA
cuuuaccuucccgucggucc

SEQ ID NO: 46198 - RNA, 20 nt, Artificial Sequence
  MKO10046198_A_Rpl24
  gRNA
accugauagccugcucucgc

SEQ ID NO: 46199 - RNA, 20 nt, Artificial Sequence
  MKO10046199_A_Rpl24
  gRNA
gucgagcugugcaguuucag

SEQ ID NO: 46200 - RNA, 20 nt, Artificial Sequence
  MKO10046200_A_Rpl26
  gRNA
uugugcaggucguuaucacc

SEQ ID NO: 46201 - RNA, 20 nt, Artificial Sequence
  MKO10046201_A_Rpl26
  gRNA
aaacacccaccuugcugggg

SEQ ID NO: 46202 - RNA, 20 nt, Artificial Sequence
  MKO10046202_A_Rpl26
  gRNA
aacuucgucauccuuccgaa

SEQ ID NO: 46203 - RNA, 20 nt, Artificial Sequence
  MKO10046203_A_Rpl27a
  gRNA
cacacuuaccgaugcggccg

SEQ ID NO: 46204 - RNA, 20 nt, Artificial Sequence
  MKO10046204_A_Rpl27a
  gRNA
cccagucacccagguuacuu

SEQ ID NO: 46205 - RNA, 20 nt, Artificial Sequence
  MKO10046205_A_Rpl27a
  gRNA
ccacgcagccauccagacug

SEQ ID NO: 46206 - RNA, 20 nt, Artificial Sequence
  MKO10046206_A_Rpl27
  gRNA
acgcaaagccgucaucguga

SEQ ID NO: 46207 - RNA, 20 nt, Artificial Sequence
  MKO10046207_A_Rpl27
  gRNA
gucugguaccuucacgauga

SEQ ID NO: 46208 - RNA, 20 nt, Artificial Sequence
  MKO10046208_A_Rpl27
  gRNA
cucgucuagaacauugacga

SEQ ID NO: 46209 - RNA, 20 nt, Artificial Sequence
  MKO10046209_A_Rpl28
  gRNA
uuacucaccauacgcagauc

SEQ ID NO: 46210 - RNA, 20 nt, Artificial Sequence
  MKO10046210_A_Rpl28
  gRNA
guccucaggcggccauccgc

SEQ ID NO: 46211 - RNA, 20 nt, Artificial Sequence
  MKO10046211_A_Rpl28
  gRNA
auuccucuugaucaagaaac

SEQ ID NO: 46212 - RNA, 20 nt, Artificial Sequence
  MKO10046212_A_Rpl29
  gRNA
gaacuuacacugguugugug

SEQ ID NO: 46213 - RNA, 20 nt, Artificial Sequence
  MKO10046213_A_Rpl29
  gRNA
gcccgcaaauggcacagaaa

SEQ ID NO: 46214 - RNA, 20 nt, Artificial Sequence
  MKO10046214_A_Rpl29
  gRNA
gagauucguaucuuugcgac

SEQ ID NO: 46215 - RNA, 20 nt, Artificial Sequence
  MKO10046215_A_Rpl30
  gRNA
uucacucaccgucuucuuug

SEQ ID NO: 46216 - RNA, 20 nt, Artificial Sequence
  MKO10046216_A_Rpl30
  gRNA
ugcauuguagaaaaagucuc

SEQ ID NO: 46217 - RNA, 20 nt, Artificial Sequence
  MKO10046217_A_Rpl30
  gRNA
gaugguggccgcaaagaaga

SEQ ID NO: 46218 - RNA, 20 nt, Artificial Sequence
  MKO10046218_A_Rpl31-ps12
  gRNA
caacacaaaaaucaacaaca

SEQ ID NO: 46219 - RNA, 20 nt, Artificial Sequence
  MKO10046219_A_Rpl31-ps12
  gRNA
caacuuuauuugacaugagc

SEQ ID NO: 46220 - RNA, 20 nt, Artificial Sequence
  MKO10046220_A_Rpl31-ps12
  gRNA
cuuguccagaaaacguaaug

SEQ ID NO: 46221 - RNA, 20 nt, Artificial Sequence
  MKO10046221_A_Rpl31
  gRNA
acuucaguaccuuauucccu

SEQ ID NO: 46222 - RNA, 20 nt, Artificial Sequence
  MKO10046222_A_Rpl31
  gRNA
ucuccuuccagaucuacaga

SEQ ID NO: 46223 - RNA, 20 nt, Artificial Sequence
  MKO10046223_A_Rpl31
  gRNA
cuagauggcucccgcaaaga

SEQ ID NO: 46224 - RNA, 20 nt, Artificial Sequence
  MKO10046224_A_Rpl32
  gRNA
ugugucuucagcgaaacugg

SEQ ID NO: 46225 - RNA, 20 nt, Artificial Sequence
  MKO10046225_A_Rpl32
  gRNA
agaccgauaugugaaaauua

SEQ ID NO: 46226 - RNA, 20 nt, Artificial Sequence
  MKO10046226_A_Rpl32
  gRNA
aaggcaucauggcugcccuc

SEQ ID NO: 46227 - RNA, 20 nt, Artificial Sequence
  MKO10046227_A_Rpl34-ps1
  gRNA
cuuccuaggucucgaacccc

SEQ ID NO: 46228 - RNA, 20 nt, Artificial Sequence
  MKO10046228_A_Rpl34-ps1
  gRNA
uaaauuguaggcacucagga

SEQ ID NO: 46229 - RNA, 20 nt, Artificial Sequence
  MKO10046229_A_Rpl34-ps1
  gRNA
uucuacagguucgugcugug

SEQ ID NO: 46230 - RNA, 20 nt, Artificial Sequence
  MKO10046230_A_Rpl34
  gRNA
cuuccuaggucucgaacccc

SEQ ID NO: 46231 - RNA, 20 nt, Artificial Sequence
  MKO10046231_A_Rpl34
  gRNA
uucuacagguucgugcugug

SEQ ID NO: 46232 - RNA, 20 nt, Artificial Sequence
  MKO10046232_A_Rpl34
  gRNA
ucaccugucacggacacacu

SEQ ID NO: 46233 - RNA, 20 nt, Artificial Sequence
  MKO10046233_A_Rpl35a
  gRNA
uugucuuaggcuguggugca

SEQ ID NO: 46234 - RNA, 20 nt, Artificial Sequence
  MKO10046234_A_Rpl35a
  gRNA
cccagaugcuguacccaucc

SEQ ID NO: 46235 - RNA, 20 nt, Artificial Sequence
  MKO10046235_A_Rpl35a
  gRNA
cauuggacacagaauccgug

SEQ ID NO: 46236 - RNA, 20 nt, Artificial Sequence
  MKO10046236_A_Rpl35
  gRNA
cucauugcaggccaagauua

SEQ ID NO: 46237 - RNA, 20 nt, Artificial Sequence
  MKO10046237_A_Rpl35
  gRNA
cacuuacaucuuggagagcu

SEQ ID NO: 46238 - RNA, 20 nt, Artificial Sequence
  MKO10046238_A_Rpl35
  gRNA
ucaccuuguagaauuuccug

SEQ ID NO: 46239 - RNA, 20 nt, Artificial Sequence
  MKO10046239_A_Rpl36al
  gRNA
cgcuacgaucgcaagcagag

SEQ ID NO: 46240 - RNA, 20 nt, Artificial Sequence
  MKO10046240_A_Rpl36al
  gRNA
gaucguagcgccgcuuuccu

SEQ ID NO: 46241 - RNA, 20 nt, Artificial Sequence
  MKO10046241_A_Rpl36al
  gRNA
ucaacguaccaaaaacccga

SEQ ID NO: 46242 - RNA, 20 nt, Artificial Sequence
  MKO10046242_A_Rpl36a
  gRNA
caggaaagcggcguuacgac

SEQ ID NO: 46243 - RNA, 20 nt, Artificial Sequence
  MKO10046243_A_Rpl36a
  gRNA
ucuuguacugugucaccuug

SEQ ID NO: 46244 - RNA, 20 nt, Artificial Sequence
  MKO10046244_A_Rpl36a
  gRNA
ugaacgugccuaaaacccgc

SEQ ID NO: 46245 - RNA, 20 nt, Artificial Sequence
  MKO10046245_A_Rpl36
  gRNA
cagcacucaccccgcgucgc

SEQ ID NO: 46246 - RNA, 20 nt, Artificial Sequence
  MKO10046246_A_Rpl36
  gRNA
cauggcucugcgcuacccca

SEQ ID NO: 46247 - RNA, 20 nt, Artificial Sequence
  MKO10046247_A_Rpl36
  gRNA
cuugagugcgcgcuuguccu

SEQ ID NO: 46248 - RNA, 20 nt, Artificial Sequence
  MKO10046248_A_Rpl37a
  gRNA
aaacacucacuuguaggucc

SEQ ID NO: 46249 - RNA, 20 nt, Artificial Sequence
  MKO10046249_A_Rpl37a
  gRNA
ccgacuugccuugccacaga

SEQ ID NO: 46250 - RNA, 20 nt, Artificial Sequence
  MKO10046250_A_Rpl37a
  gRNA
acaggcuaaacgcaccaaga

SEQ ID NO: 46251 - RNA, 20 nt, Artificial Sequence
  MKO10046251_A_Rpl37
  gRNA
agauugucuaccgcagauuc

SEQ ID NO: 46252 - RNA, 20 nt, Artificial Sequence
  MKO10046252_A_Rpl37
  gRNA
gcacagacauggauuccgug

SEQ ID NO: 46253 - RNA, 20 nt, Artificial Sequence
  MKO10046253_A_Rpl37
  gRNA
caaaacuguaccugaaucug

SEQ ID NO: 46254 - RNA, 20 nt, Artificial Sequence
  MKO10046254_A_Rpl38
  gRNA
ggcguacucacccgggggua

SEQ ID NO: 46255 - RNA, 20 nt, Artificial Sequence
  MKO10046255_A_Rpl38
  gRNA
guuacagccucggaaaauug

SEQ ID NO: 46256 - RNA, 20 nt, Artificial Sequence
  MKO10046256_A_Rpl38
  gRNA
uacacuuggcauccuuccgc

SEQ ID NO: 46257 - RNA, 20 nt, Artificial Sequence
  MKO10046257_A_Rpl39l
  gRNA
acauuggagacgaaccaaau

SEQ ID NO: 46258 - RNA, 20 nt, Artificial Sequence
  MKO10046258_A_Rpl39l
  gRNA
gguuccuuauagacccaauu

SEQ ID NO: 46259 - RNA, 20 nt, Artificial Sequence
  MKO10046259_A_Rpl39l
  gRNA
ucgucuccaaugucuccgcu

SEQ ID NO: 46260 - RNA, 20 nt, Artificial Sequence
  MKO10046260_A_Rpl39
  gRNA
uuuccgaaucaagcgauucc

SEQ ID NO: 46261 - RNA, 20 nt, Artificial Sequence
  MKO10046261_A_Rpl39
  gRNA
aaaaucgcccuauuccucag

SEQ ID NO: 46262 - RNA, 20 nt, Artificial Sequence
  MKO10046262_A_Rpl39
  gRNA
acaacucuaagagaagacac

SEQ ID NO: 46263 - RNA, 20 nt, Artificial Sequence
  MKO10046263_A_Rpl3l
  gRNA
cuugucaguuacgucguagc

SEQ ID NO: 46264 - RNA, 20 nt, Artificial Sequence
  MKO10046264_A_Rpl3l
  gRNA
auggagcagccuacucgggc

SEQ ID NO: 46265 - RNA, 20 nt, Artificial Sequence
  MKO10046265_A_Rpl3l
  gRNA
uccugccagaucuaccgcau

SEQ ID NO: 46266 - RNA, 20 nt, Artificial Sequence
  MKO10046266_A_Rpl3
  gRNA
ccgcaucauugcccacacuc

SEQ ID NO: 46267 - RNA, 20 nt, Artificial Sequence
  MKO10046267_A_Rpl3
  gRNA
aaggcacaagucuaagaaga

SEQ ID NO: 46268 - RNA, 20 nt, Artificial Sequence
  MKO10046268_A_Rpl3
  gRNA
acaggaaauucucagcuccc

SEQ ID NO: 46269 - RNA, 20 nt, Artificial Sequence
  MKO10046269_A_Rpl41
  gRNA
cuccugcgccaugagagcga

SEQ ID NO: 46270 - RNA, 20 nt, Artificial Sequence
  MKO10046270_A_Rpl41
  gRNA
gccgcucaccuucgcucuca

SEQ ID NO: 46271 - RNA, 20 nt, Artificial Sequence
  MKO10046271_A_Rpl4
  gRNA
uuuguuaggucaucguauug

SEQ ID NO: 46272 - RNA, 20 nt, Artificial Sequence
  MKO10046272_A_Rpl4
  gRNA
cauaccugccaauucacuga

SEQ ID NO: 46273 - RNA, 20 nt, Artificial Sequence
  MKO10046273_A_Rpl4
  gRNA
uguuugcaccaaccaaaacc

SEQ ID NO: 46274 - RNA, 20 nt, Artificial Sequence
  MKO10046274_A_Rpl5
  gRNA
gaggcuugucuaucccucau

SEQ ID NO: 46275 - RNA, 20 nt, Artificial Sequence
  MKO10046275_A_Rpl5
  gRNA
auacccugcgggccagcagc

SEQ ID NO: 46276 - RNA, 20 nt, Artificial Sequence
  MKO10046276_A_Rpl5
  gRNA
ucuguucauagcuucugaau

SEQ ID NO: 46277 - RNA, 20 nt, Artificial Sequence
  MKO10046277_A_Rpl6
  gRNA
cacuccucaccuugccccug

SEQ ID NO: 46278 - RNA, 20 nt, Artificial Sequence
  MKO10046278_A_Rpl6
  gRNA
ccguggcucagcagcuuccg

SEQ ID NO: 46279 - RNA, 20 nt, Artificial Sequence
  MKO10046279_A_Rpl6
  gRNA
gaagaagaagaaaaaagaga

SEQ ID NO: 46280 - RNA, 20 nt, Artificial Sequence
  MKO10046280_A_Rpl7a
  gRNA
ccaugacguagaccccauug

SEQ ID NO: 46281 - RNA, 20 nt, Artificial Sequence
  MKO10046281_A_Rpl7a
  gRNA
cacugaccugcucggaggac

SEQ ID NO: 46282 - RNA, 20 nt, Artificial Sequence
  MKO10046282_A_Rpl7a
  gRNA
cguacagcccaaagggaaga

SEQ ID NO: 46283 - RNA, 20 nt, Artificial Sequence
  MKO10046283_A_Rpl7l1
  gRNA
acucacccccaggucacaua

SEQ ID NO: 46284 - RNA, 20 nt, Artificial Sequence
  MKO10046284_A_Rpl7l1
  gRNA
cuugucacguugcugucgcc

SEQ ID NO: 46285 - RNA, 20 nt, Artificial Sequence
  MKO10046285_A_Rpl7l1
  gRNA
uggagccuuaugugaccugg

SEQ ID NO: 46286 - RNA, 20 nt, Artificial Sequence
  MKO10046286_A_Rpl7
  gRNA
ccuuugucaucagaauucga

SEQ ID NO: 46287 - RNA, 20 nt, Artificial Sequence
  MKO10046287_A_Rpl7
  gRNA
acucacccccaugcaaugua

SEQ ID NO: 46288 - RNA, 20 nt, Artificial Sequence
  MKO10046288_A_Rpl7
  gRNA
cccucgaauucugaugacaa

SEQ ID NO: 46289 - RNA, 20 nt, Artificial Sequence
  MKO10046289_A_Rpl8
  gRNA
caacacacgaucguacccuc

SEQ ID NO: 46290 - RNA, 20 nt, Artificial Sequence
  MKO10046290_A_Rpl8
  gRNA
uacgaucguguguugucugg

SEQ ID NO: 46291 - RNA, 20 nt, Artificial Sequence
  MKO10046291_A_Rpl8
  gRNA
agagcuguucaucgcagcgg

SEQ ID NO: 46292 - RNA, 20 nt, Artificial Sequence
  MKO10046292_A_Rpl9
  gRNA
uucagcuccggguugacaaa

SEQ ID NO: 46293 - RNA, 20 nt, Artificial Sequence
  MKO10046293_A_Rpl9
  gRNA
uuuagucgaaaucacucuga

SEQ ID NO: 46294 - RNA, 20 nt, Artificial Sequence
  MKO10046294_A_Rpl9
  gRNA
auugaacuuguuucaaauuc

SEQ ID NO: 46295 - RNA, 20 nt, Artificial Sequence
  MKO10046295_A_Rplp0
  gRNA
cauacaggguguccgcaacg

SEQ ID NO: 46296 - RNA, 20 nt, Artificial Sequence
  MKO10046296_A_Rplp0
  gRNA
ccuucccucggagcgacaug

SEQ ID NO: 46297 - RNA, 20 nt, Artificial Sequence
  MKO10046297_A_Rplp0
  gRNA
ucuacucaccagaauuucaa

SEQ ID NO: 46298 - RNA, 20 nt, Artificial Sequence
  MKO10046298_A_Rplp1
  gRNA
cuuaccuuggcaaacaagcc

SEQ ID NO: 46299 - RNA, 20 nt, Artificial Sequence
  MKO10046299_A_Rplp1
  gRNA
ccucauccugcacgacgacg

SEQ ID NO: 46300 - RNA, 20 nt, Artificial Sequence
  MKO10046300_A_Rplp1
  gRNA
ccgucaccucgucgucgugc

SEQ ID NO: 46301 - RNA, 20 nt, Artificial Sequence
  MKO10046301_A_Rplp2
  gRNA
ccuccauuuaccugcagcgg

SEQ ID NO: 46302 - RNA, 20 nt, Artificial Sequence
  MKO10046302_A_Rplp2
  gRNA
uuguguagguguuggcaagc

SEQ ID NO: 46303 - RNA, 20 nt, Artificial Sequence
  MKO10046303_A_Rplp2
  gRNA
caagaaaauacuagacagcg

SEQ ID NO: 46304 - RNA, 20 nt, Artificial Sequence
  MKO10046304_A_Rpn1
  gRNA
uuccacaacgaccgagaucu

SEQ ID NO: 46305 - RNA, 20 nt, Artificial Sequence
  MKO10046305_A_Rpn1
  gRNA
guccaagaucucggucguug

SEQ ID NO: 46306 - RNA, 20 nt, Artificial Sequence
  MKO10046306_A_Rpn1
  gRNA
ucucccgcuacgauuaccag

SEQ ID NO: 46307 - RNA, 20 nt, Artificial Sequence
  MKO10046307_A_Rpn2
  gRNA
ccuuaccgcucgccucggca

SEQ ID NO: 46308 - RNA, 20 nt, Artificial Sequence
  MKO10046308_A_Rpn2
  gRNA
gaagagagaauccacguugc

SEQ ID NO: 46309 - RNA, 20 nt, Artificial Sequence
  MKO10046309_A_Rpn2
  gRNA
gucugccuucuacuccaucg

SEQ ID NO: 46310 - RNA, 20 nt, Artificial Sequence
  MKO10046310_A_Rpp14
  gRNA
ccaucuugagaauaugcagc

SEQ ID NO: 46311 - RNA, 20 nt, Artificial Sequence
  MKO10046311_A_Rpp14
  gRNA
cgacagugucuucucaucgu

SEQ ID NO: 46312 - RNA, 20 nt, Artificial Sequence
  MKO10046312_A_Rpp14
  gRNA
ucagcccugagagaccuguu

SEQ ID NO: 46313 - RNA, 20 nt, Artificial Sequence
  MKO10046313_A_Rpp21
  gRNA
gaggaccagccgcuucgcga

SEQ ID NO: 46314 - RNA, 20 nt, Artificial Sequence
  MKO10046314_A_Rpp21
  gRNA
cagagaaaaccaucgcgaag

SEQ ID NO: 46315 - RNA, 20 nt, Artificial Sequence
  MKO10046315_A_Rpp21
  gRNA
acgucucuggcgcugcgugc

SEQ ID NO: 46316 - RNA, 20 nt, Artificial Sequence
  MKO10046316_A_Rpp25l
  gRNA
cacguggcgucggacuguga

SEQ ID NO: 46317 - RNA, 20 nt, Artificial Sequence
  MKO10046317_A_Rpp25l
  gRNA
aguccgacgccacgugccug

SEQ ID NO: 46318 - RNA, 20 nt, Artificial Sequence
  MKO10046318_A_Rpp25l
  gRNA
acugcuuagucgggaccccu

SEQ ID NO: 46319 - RNA, 20 nt, Artificial Sequence
  MKO10046319_A_Rpp25
  gRNA
cuacggugucgacguccaag

SEQ ID NO: 46320 - RNA, 20 nt, Artificial Sequence
  MKO10046320_A_Rpp25
  gRNA
gagaaucucggcgcacguga

SEQ ID NO: 46321 - RNA, 20 nt, Artificial Sequence
  MKO10046321_A_Rpp25
  gRNA
cgagauucucaagcgccgcc

SEQ ID NO: 46322 - RNA, 20 nt, Artificial Sequence
  MKO10046322_A_Rpp30
  gRNA
acaaugccuaccuguacgau

SEQ ID NO: 46323 - RNA, 20 nt, Artificial Sequence
  MKO10046323_A_Rpp30
  gRNA
uauagagagcaacuucguca

SEQ ID NO: 46324 - RNA, 20 nt, Artificial Sequence
  MKO10046324_A_Rpp30
  gRNA
cacaacuuuacccaucguac

SEQ ID NO: 46325 - RNA, 20 nt, Artificial Sequence
  MKO10046325_A_Rpp38
  gRNA
uuccgaauagauccccucuu

SEQ ID NO: 46326 - RNA, 20 nt, Artificial Sequence
  MKO10046326_A_Rpp38
  gRNA
uguccaaaaucucguugucc

SEQ ID NO: 46327 - RNA, 20 nt, Artificial Sequence
  MKO10046327_A_Rpp38
  gRNA
ugcccagcuuaaacgugcca

SEQ ID NO: 46328 - RNA, 20 nt, Artificial Sequence
  MKO10046328_A_Rpp40
  gRNA
ggucguccaucucgguauuc

SEQ ID NO: 46329 - RNA, 20 nt, Artificial Sequence
  MKO10046329_A_Rpp40
  gRNA
uuucugccagaauaccgaga

SEQ ID NO: 46330 - RNA, 20 nt, Artificial Sequence
  MKO10046330_A_Rpp40
  gRNA
ggauaaauccauuaggucaa

SEQ ID NO: 46331 - RNA, 20 nt, Artificial Sequence
  MKO10046331_A_Rprd1a
  gRNA
gacacuucuugaacuucgac

SEQ ID NO: 46332 - RNA, 20 nt, Artificial Sequence
  MKO10046332_A_Rprd1a
  gRNA
uugaaugccuccacuauuac

SEQ ID NO: 46333 - RNA, 20 nt, Artificial Sequence
  MKO10046333_A_Rprd1a
  gRNA
gaggacuuaugagcaaauaa

SEQ ID NO: 46334 - RNA, 20 nt, Artificial Sequence
  MKO10046334_A_Rprd1b
  gRNA
ucgcugcuagagaaaauuac

SEQ ID NO: 46335 - RNA, 20 nt, Artificial Sequence
  MKO10046335_A_Rprd1b
  gRNA
caagaacgaaguguguacgg

SEQ ID NO: 46336 - RNA, 20 nt, Artificial Sequence
  MKO10046336_A_Rprd1b
  gRNA
aucuggaaaaugcugcguca

SEQ ID NO: 46337 - RNA, 20 nt, Artificial Sequence
  MKO10046337_A_Rprd2
  gRNA
aaugccacaaucaugucuuc

SEQ ID NO: 46338 - RNA, 20 nt, Artificial Sequence
  MKO10046338_A_Rprd2
  gRNA
uagaacgaaucuuuaaaauc

SEQ ID NO: 46339 - RNA, 20 nt, Artificial Sequence
  MKO10046339_A_Rprd2
  gRNA
gauaaaagagauucaaacga

SEQ ID NO: 46340 - RNA, 20 nt, Artificial Sequence
  MKO10046340_A_Rprml
  gRNA
ccggcgcucaguauaguccc

SEQ ID NO: 46341 - RNA, 20 nt, Artificial Sequence
  MKO10046341_A_Rprml
  gRNA
cagccugugggugucgcgcg

SEQ ID NO: 46342 - RNA, 20 nt, Artificial Sequence
  MKO10046342_A_Rprml
  gRNA
gcaccacugaccgccagcga

SEQ ID NO: 46343 - RNA, 20 nt, Artificial Sequence
  MKO10046343_A_Rprm
  gRNA
gaccgacgauggcuucgccg

SEQ ID NO: 46344 - RNA, 20 nt, Artificial Sequence
  MKO10046344_A_Rprm
  gRNA
gcgcucgucggggccucccu

SEQ ID NO: 46345 - RNA, 20 nt, Artificial Sequence
  MKO10046345_A_Rprm
  gRNA
gcgccucgcuacuguugacc

SEQ ID NO: 46346 - RNA, 20 nt, Artificial Sequence
  MKO10046346_A_Rps10
  gRNA
gaaucaguaccuuugggccg

SEQ ID NO: 46347 - RNA, 20 nt, Artificial Sequence
  MKO10046347_A_Rps10
  gRNA
uucuugcagagaggcggcuu

SEQ ID NO: 46348 - RNA, 20 nt, Artificial Sequence
  MKO10046348_A_Rps10
  gRNA
acucacaaacuggaacucag

SEQ ID NO: 46349 - RNA, 20 nt, Artificial Sequence
  MKO10046349_A_Rps11
  gRNA
ccccacagggauguacagau

SEQ ID NO: 46350 - RNA, 20 nt, Artificial Sequence
  MKO10046350_A_Rps11
  gRNA
ccucgguacuacaagaauau

SEQ ID NO: 46351 - RNA, 20 nt, Artificial Sequence
  MKO10046351_A_Rps11
  gRNA
ccgauauucuuguaguaccg

SEQ ID NO: 46352 - RNA, 20 nt, Artificial Sequence
  MKO10046352_A_Rps12
  gRNA
cacguacuugucuaaggcuu

SEQ ID NO: 46353 - RNA, 20 nt, Artificial Sequence
  MKO10046353_A_Rps12
  gRNA
cugcauuccagcauagcugc

SEQ ID NO: 46354 - RNA, 20 nt, Artificial Sequence
  MKO10046354_A_Rps12
  gRNA
uuaccuuuaucagguugauu

SEQ ID NO: 46355 - RNA, 20 nt, Artificial Sequence
  MKO10046355_A_Rps13
  gRNA
cuaccgccguagcgucccca

SEQ ID NO: 46356 - RNA, 20 nt, Artificial Sequence
  MKO10046356_A_Rps13
  gRNA
uacucaccguggggacgcua

SEQ ID NO: 46357 - RNA, 20 nt, Artificial Sequence
  MKO10046357_A_Rps13
  gRNA
ucaacacucaccuaucuggg

SEQ ID NO: 46358 - RNA, 20 nt, Artificial Sequence
  MKO10046358_A_Rps14
  gRNA
ccuagaaauggcgccacgca

SEQ ID NO: 46359 - RNA, 20 nt, Artificial Sequence
  MKO10046359_A_Rps14
  gRNA
uacucacuugccagaaagau

SEQ ID NO: 46360 - RNA, 20 nt, Artificial Sequence
  MKO10046360_A_Rps14
  gRNA
cucagagcucuugcucgcuc

SEQ ID NO: 46361 - RNA, 20 nt, Artificial Sequence
  MKO10046361_A_Rps15a
  gRNA
acucacccaaacugacguga

SEQ ID NO: 46362 - RNA, 20 nt, Artificial Sequence
  MKO10046362_A_Rps15a
  gRNA
cucaccgugcuucaucauca

SEQ ID NO: 46363 - RNA, 20 nt, Artificial Sequence
  MKO10046363_A_Rps15a
  gRNA
acguuuaaaaaaagaauccc

SEQ ID NO: 46364 - RNA, 20 nt, Artificial Sequence
  MKO10046364_A_Rps15
  gRNA
acuaggacaugucgagcagu

SEQ ID NO: 46365 - RNA, 20 nt, Artificial Sequence
  MKO10046365_A_Rps15
  gRNA
aacucacuuugaucuccacc

SEQ ID NO: 46366 - RNA, 20 nt, Artificial Sequence
  MKO10046366_A_Rps15
  gRNA
aaccugcagccagagaugau

SEQ ID NO: 46367 - RNA, 20 nt, Artificial Sequence
  MKO10046367_A_Rps16
  gRNA
gccgcgcacgcugcaguaca

SEQ ID NO: 46368 - RNA, 20 nt, Artificial Sequence
  MKO10046368_A_Rps16
  gRNA
cugagacuuaccauaaauuu

SEQ ID NO: 46369 - RNA, 20 nt, Artificial Sequence
  MKO10046369_A_Rps16
  gRNA
cccuucacagaaaacagcca

SEQ ID NO: 46370 - RNA, 20 nt, Artificial Sequence
  MKO10046370_A_Rps17
  gRNA
ucgcaccaagaccgugaaga

SEQ ID NO: 46371 - RNA, 20 nt, Artificial Sequence
  MKO10046371_A_Rps17
  gRNA
cuuguuccgaagcuucuugc

SEQ ID NO: 46372 - RNA, 20 nt, Artificial Sequence
  MKO10046372_A_Rps17
  gRNA
augucacgcaucugaugaag

SEQ ID NO: 46373 - RNA, 20 nt, Artificial Sequence
  MKO10046373_A_Rps18
  gRNA
uucugcagccuucguguccg

SEQ ID NO: 46374 - RNA, 20 nt, Artificial Sequence
  MKO10046374_A_Rps18
  gRNA
aaaaucuagguucuggccaa

SEQ ID NO: 46375 - RNA, 20 nt, Artificial Sequence
  MKO10046375_A_Rps18
  gRNA
cacccacuuacccccaaaag

SEQ ID NO: 46376 - RNA, 20 nt, Artificial Sequence
  MKO10046376_A_Rps19bp1
  gRNA
aaggcgccuaaguccgcucu

SEQ ID NO: 46377 - RNA, 20 nt, Artificial Sequence
  MKO10046377_A_Rps19bp1
  gRNA
cuccggcgaagcggacccgg

SEQ ID NO: 46378 - RNA, 20 nt, Artificial Sequence
  MKO10046378_A_Rps19bp1
  gRNA
ggucucgacacugccguuuc

SEQ ID NO: 46379 - RNA, 20 nt, Artificial Sequence
  MKO10046379_A_Rps19
  gRNA
gggccgcaagcugacgccuc

SEQ ID NO: 46380 - RNA, 20 nt, Artificial Sequence
  MKO10046380_A_Rps19
  gRNA
gucccugaggcgucagcuug

SEQ ID NO: 46381 - RNA, 20 nt, Artificial Sequence
  MKO10046381_A_Rps19
  gRNA
cacccacagcuuccacagca

SEQ ID NO: 46382 - RNA, 20 nt, Artificial Sequence
  MKO10046382_A_Rps20
  gRNA
accggugcgcaugccuacca

SEQ ID NO: 46383 - RNA, 20 nt, Artificial Sequence
  MKO10046383_A_Rps20
  gRNA
uaacaggcauuuaaagauac

SEQ ID NO: 46384 - RNA, 20 nt, Artificial Sequence
  MKO10046384_A_Rps20
  gRNA
accuugguaggcaugcgcac

SEQ ID NO: 46385 - RNA, 20 nt, Artificial Sequence
  MKO10046385_A_Rps21
  gRNA
agaacucaccauccugcgaa

SEQ ID NO: 46386 - RNA, 20 nt, Artificial Sequence
  MKO10046386_A_Rps21
  gRNA
ucaccucggccacguucauc

SEQ ID NO: 46387 - RNA, 20 nt, Artificial Sequence
  MKO10046387_A_Rps21
  gRNA
cugcggggccauucgcagga

SEQ ID NO: 46388 - RNA, 20 nt, Artificial Sequence
  MKO10046388_A_Rps23
  gRNA
aagucaccucaaugaaguuc

SEQ ID NO: 46389 - RNA, 20 nt, Artificial Sequence
  MKO10046389_A_Rps23
  gRNA
ucaggaaaaugaugaaguuc

SEQ ID NO: 46390 - RNA, 20 nt, Artificial Sequence
  MKO10046390_A_Rps23
  gRNA
cacaauucccuuugcaugag

SEQ ID NO: 46391 - RNA, 20 nt, Artificial Sequence
  MKO10046391_A_Rps24
  gRNA
gaaugagccuaaacacagac

SEQ ID NO: 46392 - RNA, 20 nt, Artificial Sequence
  MKO10046392_A_Rps24
  gRNA
acucuugccagucuguguuu

SEQ ID NO: 46393 - RNA, 20 nt, Artificial Sequence
  MKO10046393_A_Rps24
  gRNA
agaaugacacaguaaccauc

SEQ ID NO: 46394 - RNA, 20 nt, Artificial Sequence
  MKO10046394_A_Rps25
  gRNA
cuccuuaggacuuaucaagc

SEQ ID NO: 46395 - RNA, 20 nt, Artificial Sequence
  MKO10046395_A_Rps25
  gRNA
gaugagcagaagugguccaa

SEQ ID NO: 46396 - RNA, 20 nt, Artificial Sequence
  MKO10046396_A_Rps25
  gRNA
uugccaccagauuuauuuac

SEQ ID NO: 46397 - RNA, 20 nt, Artificial Sequence
  MKO10046397_A_Rps26
  gRNA
ucugaagcaagcgucuucga

SEQ ID NO: 46398 - RNA, 20 nt, Artificial Sequence
  MKO10046398_A_Rps26
  gRNA
cuuacagcaggucugaaucg

SEQ ID NO: 46399 - RNA, 20 nt, Artificial Sequence
  MKO10046399_A_Rps26
  gRNA
accaaaaaaagaagaaacaa

SEQ ID NO: 46400 - RNA, 20 nt, Artificial Sequence
  MKO10046400_A_Rps27a
  gRNA
aacuuggcagguugaacccu

SEQ ID NO: 46401 - RNA, 20 nt, Artificial Sequence
  MKO10046401_A_Rps27a
  gRNA
uuuacuugccuuccuuaucc

SEQ ID NO: 46402 - RNA, 20 nt, Artificial Sequence
  MKO10046402_A_Rps27a
  gRNA
acaggaguccacccuucauc

SEQ ID NO: 46403 - RNA, 20 nt, Artificial Sequence
  MKO10046403_A_Rps27l
  gRNA
agccauaccuucugugagcc

SEQ ID NO: 46404 - RNA, 20 nt, Artificial Sequence
  MKO10046404_A_Rps27l
  gRNA
uuucagccaugcacagacug

SEQ ID NO: 46405 - RNA, 20 nt, Artificial Sequence
  MKO10046405_A_Rps27l
  gRNA
agaucuguuacacccuuccu

SEQ ID NO: 46406 - RNA, 20 nt, Artificial Sequence
  MKO10046406_A_Rps27rt
  gRNA
cgagaacaugccucucgcaa

SEQ ID NO: 46407 - RNA, 20 nt, Artificial Sequence
  MKO10046407_A_Rps27rt
  gRNA
ucagugcugcuuccuccuga

SEQ ID NO: 46408 - RNA, 20 nt, Artificial Sequence
  MKO10046408_A_Rps27rt
  gRNA
ccuucaucccucuccagaag

SEQ ID NO: 46409 - RNA, 20 nt, Artificial Sequence
  MKO10046409_A_Rps27
  gRNA
uucuuccaggaugcuccuuc

SEQ ID NO: 46410 - RNA, 20 nt, Artificial Sequence
  MKO10046410_A_Rps27
  gRNA
ccuucaucccucuccagaag

SEQ ID NO: 46411 - RNA, 20 nt, Artificial Sequence
  MKO10046411_A_Rps27
  gRNA
gcauuucacguccauaaagu

SEQ ID NO: 46412 - RNA, 20 nt, Artificial Sequence
  MKO10046412_A_Rps28
  gRNA
ccuguagguaaccaaagugc

SEQ ID NO: 46413 - RNA, 20 nt, Artificial Sequence
  MKO10046413_A_Rps28
  gRNA
ccucacccuagccagcuuga

SEQ ID NO: 46414 - RNA, 20 nt, Artificial Sequence
  MKO10046414_A_Rps28
  gRNA
guaggugcgaguggaauuca

SEQ ID NO: 46415 - RNA, 20 nt, Artificial Sequence
  MKO10046415_A_Rps29
  gRNA
cucaccaagagcgggaaccc

SEQ ID NO: 46416 - RNA, 20 nt, Artificial Sequence
  MKO10046416_A_Rps29
  gRNA
gaaggacauaggcuucauua

SEQ ID NO: 46417 - RNA, 20 nt, Artificial Sequence
  MKO10046417_A_Rps29
  gRNA
ugggucaccagcagcucuac

SEQ ID NO: 46418 - RNA, 20 nt, Artificial Sequence
  MKO10046418_A_Rps2
  gRNA
gauaccuaccaaaguugccc

SEQ ID NO: 46419 - RNA, 20 nt, Artificial Sequence
  MKO10046419_A_Rps2
  gRNA
ucauaggcuuucgucgcuau

SEQ ID NO: 46420 - RNA, 20 nt, Artificial Sequence
  MKO10046420_A_Rps2
  gRNA
caaccuugaaccugguccgc

SEQ ID NO: 46421 - RNA, 20 nt, Artificial Sequence
  MKO10046421_A_Rps3a1
  gRNA
uucccacuuacauucaaacu

SEQ ID NO: 46422 - RNA, 20 nt, Artificial Sequence
  MKO10046422_A_Rps3a1
  gRNA
ugcaggauuccagacagcau

SEQ ID NO: 46423 - RNA, 20 nt, Artificial Sequence
  MKO10046423_A_Rps3a1
  gRNA
caccugccacuucuugacca

SEQ ID NO: 46424 - RNA, 20 nt, Artificial Sequence
  MKO10046424_A_Rps3
  gRNA
uucgaaccgcaagcccucca

SEQ ID NO: 46425 - RNA, 20 nt, Artificial Sequence
  MKO10046425_A_Rps3
  gRNA
gcaguuguccagaagcgcuu

SEQ ID NO: 46426 - RNA, 20 nt, Artificial Sequence
  MKO10046426_A_Rps3
  gRNA
ggccaagggcugcgagguug

SEQ ID NO: 46427 - RNA, 20 nt, Artificial Sequence
  MKO10046427_A_Rps4x
  gRNA
caggcuccucguccauccac

SEQ ID NO: 46428 - RNA, 20 nt, Artificial Sequence
  MKO10046428_A_Rps4x
  gRNA
uacucacccauaaacccagc

SEQ ID NO: 46429 - RNA, 20 nt, Artificial Sequence
  MKO10046429_A_Rps4x
  gRNA
acaccaaccuuggccuccuc

SEQ ID NO: 46430 - RNA, 20 nt, Artificial Sequence
  MKO10046430_A_Rps5
  gRNA
accugauucacucgacgcag

SEQ ID NO: 46431 - RNA, 20 nt, Artificial Sequence
  MKO10046431_A_Rps5
  gRNA
ggccgguacagugagacgac

SEQ ID NO: 46432 - RNA, 20 nt, Artificial Sequence
  MKO10046432_A_Rps5
  gRNA
guuaguaaggcgcuccacga

SEQ ID NO: 46433 - RNA, 20 nt, Artificial Sequence
  MKO10046433_A_Rps6ka1
  gRNA
ggccagugcgugaccguguu

SEQ ID NO: 46434 - RNA, 20 nt, Artificial Sequence
  MKO10046434_A_Rps6ka1
  gRNA
ugacgugaaccacccguucg

SEQ ID NO: 46435 - RNA, 20 nt, Artificial Sequence
  MKO10046435_A_Rps6ka1
  gRNA
cuccaucacacaccacguca

SEQ ID NO: 46436 - RNA, 20 nt, Artificial Sequence
  MKO10046436_A_Rps6ka2
  gRNA
cucccaguucgagcuacuaa

SEQ ID NO: 46437 - RNA, 20 nt, Artificial Sequence
  MKO10046437_A_Rps6ka2
  gRNA
uuguuguacagugcgagacc

SEQ ID NO: 46438 - RNA, 20 nt, Artificial Sequence
  MKO10046438_A_Rps6ka2
  gRNA
aaaccuuuaguagcucgaac

SEQ ID NO: 46439 - RNA, 20 nt, Artificial Sequence
  MKO10046439_A_Rps6ka3
  gRNA
uuauaguucgagaccguguu

SEQ ID NO: 46440 - RNA, 20 nt, Artificial Sequence
  MKO10046440_A_Rps6ka3
  gRNA
aaaaauggaacgugauaucu

SEQ ID NO: 46441 - RNA, 20 nt, Artificial Sequence
  MKO10046441_A_Rps6ka3
  gRNA
gcagcacuuaccuuucagcg

SEQ ID NO: 46442 - RNA, 20 nt, Artificial Sequence
  MKO10046442_A_Rps6ka4
  gRNA
gcauacccgcaccgaacgcu

SEQ ID NO: 46443 - RNA, 20 nt, Artificial Sequence
  MKO10046443_A_Rps6ka4
  gRNA
cuucgcgcugcucaaggugc

SEQ ID NO: 46444 - RNA, 20 nt, Artificial Sequence
  MKO10046444_A_Rps6ka4
  gRNA
ggugcagcgcgcgaagacac

SEQ ID NO: 46445 - RNA, 20 nt, Artificial Sequence
  MKO10046445_A_Rps6ka5
  gRNA
cucugcguguccuguuaagu

SEQ ID NO: 46446 - RNA, 20 nt, Artificial Sequence
  MKO10046446_A_Rps6ka5
  gRNA
cauguggugcugacagauuu

SEQ ID NO: 46447 - RNA, 20 nt, Artificial Sequence
  MKO10046447_A_Rps6ka5
  gRNA
cacgaagugcagaucuaugu

SEQ ID NO: 46448 - RNA, 20 nt, Artificial Sequence
  MKO10046448_A_Rps6ka6
  gRNA
cagucacccagcgcgagacc

SEQ ID NO: 46449 - RNA, 20 nt, Artificial Sequence
  MKO10046449_A_Rps6ka6
  gRNA
gaugcuaccguucgccccug

SEQ ID NO: 46450 - RNA, 20 nt, Artificial Sequence
  MKO10046450_A_Rps6ka6
  gRNA
guacuuacccggcaagaaac

SEQ ID NO: 46451 - RNA, 20 nt, Artificial Sequence
  MKO10046451_A_Rps6kb1
  gRNA
ccgggcccaugaggcgacga

SEQ ID NO: 46452 - RNA, 20 nt, Artificial Sequence
  MKO10046452_A_Rps6kb1
  gRNA
uagcgccugacuuccgacac

SEQ ID NO: 46453 - RNA, 20 nt, Artificial Sequence
  MKO10046453_A_Rps6kb1
  gRNA
guacuugguaaagggggcua

SEQ ID NO: 46454 - RNA, 20 nt, Artificial Sequence
  MKO10046454_A_Rps6kb2
  gRNA
cgaauuaagggcugcuggcc

SEQ ID NO: 46455 - RNA, 20 nt, Artificial Sequence
  MKO10046455_A_Rps6kb2
  gRNA
cuuggcacugcauacaaucu

SEQ ID NO: 46456 - RNA, 20 nt, Artificial Sequence
  MKO10046456_A_Rps6kb2
  gRNA
gcccgaugcgcucaggaccc

SEQ ID NO: 46457 - RNA, 20 nt, Artificial Sequence
  MKO10046457_A_Rps6kc1
  gRNA
acuaccuccuggacguccuc

SEQ ID NO: 46458 - RNA, 20 nt, Artificial Sequence
  MKO10046458_A_Rps6kc1
  gRNA
uuaccuucaguaccgcacuc

SEQ ID NO: 46459 - RNA, 20 nt, Artificial Sequence
  MKO10046459_A_Rps6kc1
  gRNA
ucuagggcgguucgacaaga

SEQ ID NO: 46460 - RNA, 20 nt, Artificial Sequence
  MKO10046460_A_Rps6kl1
  gRNA
ggaugaucgucagccgcucc

SEQ ID NO: 46461 - RNA, 20 nt, Artificial Sequence
  MKO10046461_A_Rps6kl1
  gRNA
guugcgauacuucgugagcg

SEQ ID NO: 46462 - RNA, 20 nt, Artificial Sequence
  MKO10046462_A_Rps6kl1
  gRNA
ucuccucaccguguugggac

SEQ ID NO: 46463 - RNA, 20 nt, Artificial Sequence
  MKO10046463_A_Rps6
  gRNA
caacgcaggguuaugugguc

SEQ ID NO: 46464 - RNA, 20 nt, Artificial Sequence
  MKO10046464_A_Rps6
  gRNA
uccauuaccuucuuuguuua

SEQ ID NO: 46465 - RNA, 20 nt, Artificial Sequence
  MKO10046465_A_Rps6
  gRNA
uaaggagagaaggauauucc

SEQ ID NO: 46466 - RNA, 20 nt, Artificial Sequence
  MKO10046466_A_Rps7
  gRNA
gcacguggucuucauugcuc

SEQ ID NO: 46467 - RNA, 20 nt, Artificial Sequence
  MKO10046467_A_Rps7
  gRNA
uccucccaggaaaucgaagu

SEQ ID NO: 46468 - RNA, 20 nt, Artificial Sequence
  MKO10046468_A_Rps7
  gRNA
auaagcagaagcgccccaga

SEQ ID NO: 46469 - RNA, 20 nt, Artificial Sequence
  MKO10046469_A_Rps8
  gRNA
acggcccgcugccaacacga

SEQ ID NO: 46470 - RNA, 20 nt, Artificial Sequence
  MKO10046470_A_Rps8
  gRNA
acgcaccuucguguuggcag

SEQ ID NO: 46471 - RNA, 20 nt, Artificial Sequence
  MKO10046471_A_Rps8
  gRNA
ccgcaagaagggggccaagc

SEQ ID NO: 46472 - RNA, 20 nt, Artificial Sequence
  MKO10046472_A_Rps9
  gRNA
caacucaccuaaugugacgu

SEQ ID NO: 46473 - RNA, 20 nt, Artificial Sequence
  MKO10046473_A_Rps9
  gRNA
ccuguccaggguccgcaagc

SEQ ID NO: 46474 - RNA, 20 nt, Artificial Sequence
  MKO10046474_A_Rps9
  gRNA
ccuggacggccgccgccaua

SEQ ID NO: 46475 - RNA, 20 nt, Artificial Sequence
  MKO10046475_A_Rpsa
  gRNA
acgcacccguggggaacugc

SEQ ID NO: 46476 - RNA, 20 nt, Artificial Sequence
  MKO10046476_A_Rpsa
  gRNA
ccaaguaccuuguuguugca

SEQ ID NO: 46477 - RNA, 20 nt, Artificial Sequence
  MKO10046477_A_Rpsa
  gRNA
cuuacagggagcucacucag

SEQ ID NO: 46478 - RNA, 20 nt, Artificial Sequence
  MKO10046478_A_Rptn
  gRNA
ucuuggacauagucguacaa

SEQ ID NO: 46479 - RNA, 20 nt, Artificial Sequence
  MKO10046479_A_Rptn
  gRNA
guacgacuauguccaagaac

SEQ ID NO: 46480 - RNA, 20 nt, Artificial Sequence
  MKO10046480_A_Rptn
  gRNA
caggacuaugcugaauauca

SEQ ID NO: 46481 - RNA, 20 nt, Artificial Sequence
  MKO10046481_A_Rptor
  gRNA
ccacgucugcaggucguaua

SEQ ID NO: 46482 - RNA, 20 nt, Artificial Sequence
  MKO10046482_A_Rptor
  gRNA
cccguuccuccuuggcguuc

SEQ ID NO: 46483 - RNA, 20 nt, Artificial Sequence
  MKO10046483_A_Rptor
  gRNA
gucuacgacuguuccaaugc

SEQ ID NO: 46484 - RNA, 20 nt, Artificial Sequence
  MKO10046484_A_Rpusd1
  gRNA
gugacgaucaacuaugccau

SEQ ID NO: 46485 - RNA, 20 nt, Artificial Sequence
  MKO10046485_A_Rpusd1
  gRNA
gacgcauaccaugugcaucg

SEQ ID NO: 46486 - RNA, 20 nt, Artificial Sequence
  MKO10046486_A_Rpusd1
  gRNA
gugcugcuaaagccacuuac

SEQ ID NO: 46487 - RNA, 20 nt, Artificial Sequence
  MKO10046487_A_Rpusd2
  gRNA
gcggccucguaguaagacag

SEQ ID NO: 46488 - RNA, 20 nt, Artificial Sequence
  MKO10046488_A_Rpusd2
  gRNA
ucgugccgccuccgaagaaa

SEQ ID NO: 46489 - RNA, 20 nt, Artificial Sequence
  MKO10046489_A_Rpusd2
  gRNA
aggcgguccagccgaugcag

SEQ ID NO: 46490 - RNA, 20 nt, Artificial Sequence
  MKO10046490_A_Rpusd3
  gRNA
agucgaggaccagcccuucc

SEQ ID NO: 46491 - RNA, 20 nt, Artificial Sequence
  MKO10046491_A_Rpusd3
  gRNA
cucucaccaguagguggcug

SEQ ID NO: 46492 - RNA, 20 nt, Artificial Sequence
  MKO10046492_A_Rpusd3
  gRNA
ucccaggugcucgcacaacc

SEQ ID NO: 46493 - RNA, 20 nt, Artificial Sequence
  MKO10046493_A_Rpusd4
  gRNA
ugaccacgaggucguugucc

SEQ ID NO: 46494 - RNA, 20 nt, Artificial Sequence
  MKO10046494_A_Rpusd4
  gRNA
uuacagcaacgugcgcaucg

SEQ ID NO: 46495 - RNA, 20 nt, Artificial Sequence
  MKO10046495_A_Rpusd4
  gRNA
caagggaacacgcaccguga

SEQ ID NO: 46496 - RNA, 20 nt, Artificial Sequence
  MKO10046496_A_Rqcd1
  gRNA
uacuauugcagcacuguuac

SEQ ID NO: 46497 - RNA, 20 nt, Artificial Sequence
  MKO10046497_A_Rqcd1
  gRNA
ggugagccgaagauauucaa

SEQ ID NO: 46498 - RNA, 20 nt, Artificial Sequence
  MKO10046498_A_Rqcd1
  gRNA
cucgucccuuugaauaucuu

SEQ ID NO: 46499 - RNA, 20 nt, Artificial Sequence
  MKO10046499_A_Rrad
  gRNA
cucgacggcggucgcgcucc

SEQ ID NO: 46500 - RNA, 20 nt, Artificial Sequence
  MKO10046500_A_Rrad
  gRNA
gguggacgagcgagaccuuc

SEQ ID NO: 46501 - RNA, 20 nt, Artificial Sequence
  MKO10046501_A_Rrad
  gRNA
ugaccuggugcgcucucgug

SEQ ID NO: 46502 - RNA, 20 nt, Artificial Sequence
  MKO10046502_A_Rraga
  gRNA
ugacguagagagccgcgaac

SEQ ID NO: 46503 - RNA, 20 nt, Artificial Sequence
  MKO10046503_A_Rraga
  gRNA
gaggcguuugucucgcccgc

SEQ ID NO: 46504 - RNA, 20 nt, Artificial Sequence
  MKO10046504_A_Rraga
  gRNA
auuauauugcgcgcgacacu

SEQ ID NO: 46505 - RNA, 20 nt, Artificial Sequence
  MKO10046505_A_Rragb
  gRNA
acauucucauguucgauuuc

SEQ ID NO: 46506 - RNA, 20 nt, Artificial Sequence
  MKO10046506_A_Rragb
  gRNA
accaagacgacgugugucuc

SEQ ID NO: 46507 - RNA, 20 nt, Artificial Sequence
  MKO10046507_A_Rragb
  gRNA
gccagagacacacgucgucu

SEQ ID NO: 46508 - RNA, 20 nt, Artificial Sequence
  MKO10046508_A_Rragc
  gRNA
gauauaugucauugaugcac

SEQ ID NO: 46509 - RNA, 20 nt, Artificial Sequence
  MKO10046509_A_Rragc
  gRNA
ugacuuccaggacgacuaca

SEQ ID NO: 46510 - RNA, 20 nt, Artificial Sequence
  MKO10046510_A_Rragc
  gRNA
uuucuguaccaccuuacuga

SEQ ID NO: 46511 - RNA, 20 nt, Artificial Sequence
  MKO10046511_A_Rragd
  gRNA
uauugcaaccgacagcacgc

SEQ ID NO: 46512 - RNA, 20 nt, Artificial Sequence
  MKO10046512_A_Rragd
  gRNA
uccaagaacagcgucucgcu

SEQ ID NO: 46513 - RNA, 20 nt, Artificial Sequence
  MKO10046513_A_Rragd
  gRNA
cccgagcgagacgcuguucu

SEQ ID NO: 46514 - RNA, 20 nt, Artificial Sequence
  MKO10046514_A_Rras2
  gRNA
aagcuuuccacgaacuuguc

SEQ ID NO: 46515 - RNA, 20 nt, Artificial Sequence
  MKO10046515_A_Rras2
  gRNA
guucugcuuaccuuauaacc

SEQ ID NO: 46516 - RNA, 20 nt, Artificial Sequence
  MKO10046516_A_Rras2
  gRNA
aucauaguccgucacaaaau

SEQ ID NO: 46517 - RNA, 20 nt, Artificial Sequence
  MKO10046517_A_Rras
  gRNA
ugguguuugccauuaacgac

SEQ ID NO: 46518 - RNA, 20 nt, Artificial Sequence
  MKO10046518_A_Rras
  gRNA
aucgacauucagacgcaguu

SEQ ID NO: 46519 - RNA, 20 nt, Artificial Sequence
  MKO10046519_A_Rras
  gRNA
uccucacuguccagccgugc

SEQ ID NO: 46520 - RNA, 20 nt, Artificial Sequence
  MKO10046520_A_Rrbp1
  gRNA
aagagagggccgucgcaauc

SEQ ID NO: 46521 - RNA, 20 nt, Artificial Sequence
  MKO10046521_A_Rrbp1
  gRNA
agagaaucucaauaagccgc

SEQ ID NO: 46522 - RNA, 20 nt, Artificial Sequence
  MKO10046522_A_Rrbp1
  gRNA
gccacagcggauacacgcac

SEQ ID NO: 46523 - RNA, 20 nt, Artificial Sequence
  MKO10046523_A_Rreb1
  gRNA
augacgucgaauucgcccau

SEQ ID NO: 46524 - RNA, 20 nt, Artificial Sequence
  MKO10046524_A_Rreb1
  gRNA
gcugaccaugcacauccguc

SEQ ID NO: 46525 - RNA, 20 nt, Artificial Sequence
  MKO10046525_A_Rreb1
  gRNA
gcaccagcaugugacgaucc

SEQ ID NO: 46526 - RNA, 20 nt, Artificial Sequence
  MKO10046526_A_Rrh
  gRNA
aucauuauuccgccaguuua

SEQ ID NO: 46527 - RNA, 20 nt, Artificial Sequence
  MKO10046527_A_Rrh
  gRNA
acuguuacuaccacgucagu

SEQ ID NO: 46528 - RNA, 20 nt, Artificial Sequence
  MKO10046528_A_Rrh
  gRNA
aguuaugccccggauccuac

SEQ ID NO: 46529 - RNA, 20 nt, Artificial Sequence
  MKO10046529_A_Rrm1
  gRNA
gugcuucguggucaaggucg

SEQ ID NO: 46530 - RNA, 20 nt, Artificial Sequence
  MKO10046530_A_Rrm1
  gRNA
aacuacauaaauccgcacaa

SEQ ID NO: 46531 - RNA, 20 nt, Artificial Sequence
  MKO10046531_A_Rrm1
  gRNA
ugucaaacauaacucgcucu

SEQ ID NO: 46532 - RNA, 20 nt, Artificial Sequence
  MKO10046532_A_Rrm2b
  gRNA
ccauagaagcagcgagccuc

SEQ ID NO: 46533 - RNA, 20 nt, Artificial Sequence
  MKO10046533_A_Rrm2b
  gRNA
ccagaggcucgcugcuucua

SEQ ID NO: 46534 - RNA, 20 nt, Artificial Sequence
  MKO10046534_A_Rrm2b
  gRNA
auucuagguugacuugucaa

SEQ ID NO: 46535 - RNA, 20 nt, Artificial Sequence
  MKO10046535_A_Rrm2
  gRNA
ucucagcagcacccgcgucc

SEQ ID NO: 46536 - RNA, 20 nt, Artificial Sequence
  MKO10046536_A_Rrm2
  gRNA
gauucuccucgcagcuuugc

SEQ ID NO: 46537 - RNA, 20 nt, Artificial Sequence
  MKO10046537_A_Rrm2
  gRNA
acuucagguggaccuuucca

SEQ ID NO: 46538 - RNA, 20 nt, Artificial Sequence
  MKO10046538_A_Rrn3
  gRNA
gcucucuaacgcgagcauau

SEQ ID NO: 46539 - RNA, 20 nt, Artificial Sequence
  MKO10046539_A_Rrn3
  gRNA
cuaguagccaguuaaugauc

SEQ ID NO: 46540 - RNA, 20 nt, Artificial Sequence
  MKO10046540_A_Rrn3
  gRNA
cuccuccgaaaaaaacuguu

SEQ ID NO: 46541 - RNA, 20 nt, Artificial Sequence
  MKO10046541_A_Rrnad1
  gRNA
aaagccagguguccggguaa

SEQ ID NO: 46542 - RNA, 20 nt, Artificial Sequence
  MKO10046542_A_Rrnad1
  gRNA
ggcuugacauguuuccgaaa

SEQ ID NO: 46543 - RNA, 20 nt, Artificial Sequence
  MKO10046543_A_Rrnad1
  gRNA
aagaagcuuagcgaucucac

SEQ ID NO: 46544 - RNA, 20 nt, Artificial Sequence
  MKO10046544_A_Rrp12
  gRNA
gccacucagaaacgugcccg

SEQ ID NO: 46545 - RNA, 20 nt, Artificial Sequence
  MKO10046545_A_Rrp12
  gRNA
uacagaggugauucgauccc

SEQ ID NO: 46546 - RNA, 20 nt, Artificial Sequence
  MKO10046546_A_Rrp12
  gRNA
ucuugguccauggucgucuc

SEQ ID NO: 46547 - RNA, 20 nt, Artificial Sequence
  MKO10046547_A_Rrp15
  gRNA
gacgccgcagagucgagugc

SEQ ID NO: 46548 - RNA, 20 nt, Artificial Sequence
  MKO10046548_A_Rrp15
  gRNA
accuucagaggauugcgaca

SEQ ID NO: 46549 - RNA, 20 nt, Artificial Sequence
  MKO10046549_A_Rrp15
  gRNA
acaucagcuuggcucgcuug

SEQ ID NO: 46550 - RNA, 20 nt, Artificial Sequence
  MKO10046550_A_Rrp1b
  gRNA
ccuccaagcuguuuacaacg

SEQ ID NO: 46551 - RNA, 20 nt, Artificial Sequence
  MKO10046551_A_Rrp1b
  gRNA
caaccuuuagcugauccgcc

SEQ ID NO: 46552 - RNA, 20 nt, Artificial Sequence
  MKO10046552_A_Rrp1b
  gRNA
cccuugccacucucgauuca

SEQ ID NO: 46553 - RNA, 20 nt, Artificial Sequence
  MKO10046553_A_Rrp1
  gRNA
ucaccauguagaacuuaucc

SEQ ID NO: 46554 - RNA, 20 nt, Artificial Sequence
  MKO10046554_A_Rrp1
  gRNA
ccuccgucgugugaaaagca

SEQ ID NO: 46555 - RNA, 20 nt, Artificial Sequence
  MKO10046555_A_Rrp1
  gRNA
gggcauugacagacugcgcc

SEQ ID NO: 46556 - RNA, 20 nt, Artificial Sequence
  MKO10046556_A_Rrp36
  gRNA
ugugugucgccgauaagcac

SEQ ID NO: 46557 - RNA, 20 nt, Artificial Sequence
  MKO10046557_A_Rrp36
  gRNA
caguugaagaagcaccgcuc

SEQ ID NO: 46558 - RNA, 20 nt, Artificial Sequence
  MKO10046558_A_Rrp36
  gRNA
ccugacguaagaauggcacc

SEQ ID NO: 46559 - RNA, 20 nt, Artificial Sequence
  MKO10046559_A_Rrp7a
  gRNA
gcagccuaccggcaccggcu

SEQ ID NO: 46560 - RNA, 20 nt, Artificial Sequence
  MKO10046560_A_Rrp7a
  gRNA
aacaggagaggcaccgagac

SEQ ID NO: 46561 - RNA, 20 nt, Artificial Sequence
  MKO10046561_A_Rrp7a
  gRNA
agacagcaccgaguucgcca

SEQ ID NO: 46562 - RNA, 20 nt, Artificial Sequence
  MKO10046562_A_Rrp8
  gRNA
aauuguagcaguacucgucc

SEQ ID NO: 46563 - RNA, 20 nt, Artificial Sequence
  MKO10046563_A_Rrp8
  gRNA
guugugucaugcgugcucgc

SEQ ID NO: 46564 - RNA, 20 nt, Artificial Sequence
  MKO10046564_A_Rrp8
  gRNA
acgcaagcgccgccaucucu

SEQ ID NO: 46565 - RNA, 20 nt, Artificial Sequence
  MKO10046565_A_Rrp9
  gRNA
ucagguggccgggcgcuuga

SEQ ID NO: 46566 - RNA, 20 nt, Artificial Sequence
  MKO10046566_A_Rrp9
  gRNA
ugaagcccgugcauucgagg

SEQ ID NO: 46567 - RNA, 20 nt, Artificial Sequence
  MKO10046567_A_Rrp9
  gRNA
ccucucgcucucagaaucgc

SEQ ID NO: 46568 - RNA, 20 nt, Artificial Sequence
  MKO10046568_A_Rrs1
  gRNA
caagguuuccaccgcuucgg

SEQ ID NO: 46569 - RNA, 20 nt, Artificial Sequence
  MKO10046569_A_Rrs1
  gRNA
cuggaagcgucccaccgaag

SEQ ID NO: 46570 - RNA, 20 nt, Artificial Sequence
  MKO10046570_A_Rrs1
  gRNA
gcugcguguugucccgcgcc

SEQ ID NO: 46571 - RNA, 20 nt, Artificial Sequence
  MKO10046571_A_Rs1
  gRNA
cgucuaugucacagcguccu

SEQ ID NO: 46572 - RNA, 20 nt, Artificial Sequence
  MKO10046572_A_Rs1
  gRNA
acgcugugacauagacgagu

SEQ ID NO: 46573 - RNA, 20 nt, Artificial Sequence
  MKO10046573_A_Rs1
  gRNA
auugggauugucaucgacag

SEQ ID NO: 46574 - RNA, 20 nt, Artificial Sequence
  MKO10046574_A_Rsad1
  gRNA
cagaguccguaaagcgucgc

SEQ ID NO: 46575 - RNA, 20 nt, Artificial Sequence
  MKO10046575_A_Rsad1
  gRNA
ugacuuccgaaucggcaggc

SEQ ID NO: 46576 - RNA, 20 nt, Artificial Sequence
  MKO10046576_A_Rsad1
  gRNA
cugcagcguuucucgcaaua

SEQ ID NO: 46577 - RNA, 20 nt, Artificial Sequence
  MKO10046577_A_Rsad2
  gRNA
ugucauuaaucgcuucaacg

SEQ ID NO: 46578 - RNA, 20 nt, Artificial Sequence
  MKO10046578_A_Rsad2
  gRNA
cugcgacagcuucgaugagc

SEQ ID NO: 46579 - RNA, 20 nt, Artificial Sequence
  MKO10046579_A_Rsad2
  gRNA
ucacaaagagguguccuguu

SEQ ID NO: 46580 - RNA, 20 nt, Artificial Sequence
  MKO10046580_A_Rsbn1l
  gRNA
augacugccgcgccuccguu

SEQ ID NO: 46581 - RNA, 20 nt, Artificial Sequence
  MKO10046581_A_Rsbn1l
  gRNA
accaagcugaucugucgcau

SEQ ID NO: 46582 - RNA, 20 nt, Artificial Sequence
  MKO10046582_A_Rsbn1l
  gRNA
cccgaugcgacagaucagcu

SEQ ID NO: 46583 - RNA, 20 nt, Artificial Sequence
  MKO10046583_A_Rsbn1
  gRNA
ccuaccgagcagguccuaug

SEQ ID NO: 46584 - RNA, 20 nt, Artificial Sequence
  MKO10046584_A_Rsbn1
  gRNA
acaagacuuaucugccgcau

SEQ ID NO: 46585 - RNA, 20 nt, Artificial Sequence
  MKO10046585_A_Rsbn1
  gRNA
gcgaugacgggccuauaaug

SEQ ID NO: 46586 - RNA, 20 nt, Artificial Sequence
  MKO10046586_A_Rsc1a1
  gRNA
accgggcuugauggcgcaga

SEQ ID NO: 46587 - RNA, 20 nt, Artificial Sequence
  MKO10046587_A_Rsc1a1
  gRNA
cucggggcucugcaucgagu

SEQ ID NO: 46588 - RNA, 20 nt, Artificial Sequence
  MKO10046588_A_Rsc1a1
  gRNA
uccgucugcgccaucaagcc

SEQ ID NO: 46589 - RNA, 20 nt, Artificial Sequence
  MKO10046589_A_Rsf1
  gRNA
acuaugcgucuccagccaau

SEQ ID NO: 46590 - RNA, 20 nt, Artificial Sequence
  MKO10046590_A_Rsf1
  gRNA
guuuagaaaucgaaacgagu

SEQ ID NO: 46591 - RNA, 20 nt, Artificial Sequence
  MKO10046591_A_Rsf1
  gRNA
ccaucuuugucucgcccaau

SEQ ID NO: 46592 - RNA, 20 nt, Artificial Sequence
  MKO10046592_A_Rsg1
  gRNA
auaacuaucuugacgagccc

SEQ ID NO: 46593 - RNA, 20 nt, Artificial Sequence
  MKO10046593_A_Rsg1
  gRNA
gucuucgaaggaggcacgau

SEQ ID NO: 46594 - RNA, 20 nt, Artificial Sequence
  MKO10046594_A_Rsg1
  gRNA
cacacucuucacccggaaca

SEQ ID NO: 46595 - RNA, 20 nt, Artificial Sequence
  MKO10046595_A_Rsl1d1
  gRNA
gagauuaaccgauguaucac

SEQ ID NO: 46596 - RNA, 20 nt, Artificial Sequence
  MKO10046596_A_Rsl1d1
  gRNA
uuacugaugcgagaauucga

SEQ ID NO: 46597 - RNA, 20 nt, Artificial Sequence
  MKO10046597_A_Rsl1d1
  gRNA
uugacccgaaguucuuucuc

SEQ ID NO: 46598 - RNA, 20 nt, Artificial Sequence
  MKO10046598_A_Rsl1
  gRNA
uccuacauaccuggguacac

SEQ ID NO: 46599 - RNA, 20 nt, Artificial Sequence
  MKO10046599_A_Rsl1
  gRNA
gacacauuguucaugcuuga

SEQ ID NO: 46600 - RNA, 20 nt, Artificial Sequence
  MKO10046600_A_Rsl1
  gRNA
gucaguuugcugcaauuguu

SEQ ID NO: 46601 - RNA, 20 nt, Artificial Sequence
  MKO10046601_A_Rsl24d1
  gRNA
gcucaccagcgagaggagcc

SEQ ID NO: 46602 - RNA, 20 nt, Artificial Sequence
  MKO10046602_A_Rsl24d1
  gRNA
auaccuguucauuauaaauu

SEQ ID NO: 46603 - RNA, 20 nt, Artificial Sequence
  MKO10046603_A_Rsl24d1
  gRNA
gcuccuugccagcugcuuuc

SEQ ID NO: 46604 - RNA, 20 nt, Artificial Sequence
  MKO10046604_A_Rslcan18
  gRNA
cgaugaaccuacacucgaga

SEQ ID NO: 46605 - RNA, 20 nt, Artificial Sequence
  MKO10046605_A_Rslcan18
  gRNA
gcucaccaacugaugcugau

SEQ ID NO: 46606 - RNA, 20 nt, Artificial Sequence
  MKO10046606_A_Rslcan18
  gRNA
accuugcccuucucgagugu

SEQ ID NO: 46607 - RNA, 20 nt, Artificial Sequence
  MKO10046607_A_Rsph1
  gRNA
caguaaguaugucgguaccu

SEQ ID NO: 46608 - RNA, 20 nt, Artificial Sequence
  MKO10046608_A_Rsph1
  gRNA
uacugccggucucugcguag

SEQ ID NO: 46609 - RNA, 20 nt, Artificial Sequence
  MKO10046609_A_Rsph1
  gRNA
ugacauaguaguacacgccu

SEQ ID NO: 46610 - RNA, 20 nt, Artificial Sequence
  MKO10046610_A_Rsph3a
  gRNA
ugugcuuaccaccuguccug

SEQ ID NO: 46611 - RNA, 20 nt, Artificial Sequence
  MKO10046611_A_Rsph3a
  gRNA
guugaagaaccuaugaguua

SEQ ID NO: 46612 - RNA, 20 nt, Artificial Sequence
  MKO10046612_A_Rsph3a
  gRNA
cacaugcuuucugcccucca

SEQ ID NO: 46613 - RNA, 20 nt, Artificial Sequence
  MKO10046613_A_Rsph3b
  gRNA
guugaagaaccuaugaguua

SEQ ID NO: 46614 - RNA, 20 nt, Artificial Sequence
  MKO10046614_A_Rsph3b
  gRNA
ugugcuuaccaccuguccug

SEQ ID NO: 46615 - RNA, 20 nt, Artificial Sequence
  MKO10046615_A_Rsph3b
  gRNA
agagcuucagcgacagcagc

SEQ ID NO: 46616 - RNA, 20 nt, Artificial Sequence
  MKO10046616_A_Rsph4a
  gRNA
caaauugcccgcauuucagc

SEQ ID NO: 46617 - RNA, 20 nt, Artificial Sequence
  MKO10046617_A_Rsph4a
  gRNA
cugcacgugaugaacccaau

SEQ ID NO: 46618 - RNA, 20 nt, Artificial Sequence
  MKO10046618_A_Rsph4a
  gRNA
auugccagggucgcuguaau

SEQ ID NO: 46619 - RNA, 20 nt, Artificial Sequence
  MKO10046619_A_Rsph6a
  gRNA
auccgcaggggcgcuguaca

SEQ ID NO: 46620 - RNA, 20 nt, Artificial Sequence
  MKO10046620_A_Rsph6a
  gRNA
gaugcagcccaccuacgaga

SEQ ID NO: 46621 - RNA, 20 nt, Artificial Sequence
  MKO10046621_A_Rsph6a
  gRNA
ugaaccgaccaccuccgcag

SEQ ID NO: 46622 - RNA, 20 nt, Artificial Sequence
  MKO10046622_A_Rsph9
  gRNA
gucggacuuggagcccucgc

SEQ ID NO: 46623 - RNA, 20 nt, Artificial Sequence
  MKO10046623_A_Rsph9
  gRNA
gugcguugccccuuuccauc

SEQ ID NO: 46624 - RNA, 20 nt, Artificial Sequence
  MKO10046624_A_Rsph9
  gRNA
gcuccucgcaccaagaacua

SEQ ID NO: 46625 - RNA, 20 nt, Artificial Sequence
  MKO10046625_A_Rspo1
  gRNA
cccgcaaguguaccgugcgc

SEQ ID NO: 46626 - RNA, 20 nt, Artificial Sequence
  MKO10046626_A_Rspo1
  gRNA
gaggaacgacauccgccagg

SEQ ID NO: 46627 - RNA, 20 nt, Artificial Sequence
  MKO10046627_A_Rspo1
  gRNA
uccugcgcacgguacacuug

SEQ ID NO: 46628 - RNA, 20 nt, Artificial Sequence
  MKO10046628_A_Rspo2
  gRNA
agcagaaacaaccgcacgug

SEQ ID NO: 46629 - RNA, 20 nt, Artificial Sequence
  MKO10046629_A_Rspo2
  gRNA
uuuaacaaucugccguguuc

SEQ ID NO: 46630 - RNA, 20 nt, Artificial Sequence
  MKO10046630_A_Rspo2
  gRNA
ugcaccguuagaugagacua

SEQ ID NO: 46631 - RNA, 20 nt, Artificial Sequence
  MKO10046631_A_Rspo3
  gRNA
uauacaaguucuugucucgc

SEQ ID NO: 46632 - RNA, 20 nt, Artificial Sequence
  MKO10046632_A_Rspo3
  gRNA
gcaacguguucagauuacaa

SEQ ID NO: 46633 - RNA, 20 nt, Artificial Sequence
  MKO10046633_A_Rspo3
  gRNA
ugucucucuucguguccaag

SEQ ID NO: 46634 - RNA, 20 nt, Artificial Sequence
  MKO10046634_A_Rspo4
  gRNA
gaaggaucggcgccagcgua

SEQ ID NO: 46635 - RNA, 20 nt, Artificial Sequence
  MKO10046635_A_Rspo4
  gRNA
ccuagaaacccggguccggg

SEQ ID NO: 46636 - RNA, 20 nt, Artificial Sequence
  MKO10046636_A_Rspo4
  gRNA
uuccucuucauccgccguga

SEQ ID NO: 46637 - RNA, 20 nt, Artificial Sequence
  MKO10046637_A_Rspry1
  gRNA
uaggaauacauccgcagucu

SEQ ID NO: 46638 - RNA, 20 nt, Artificial Sequence
  MKO10046638_A_Rspry1
  gRNA
cuaaguaaaccuaugcuugc

SEQ ID NO: 46639 - RNA, 20 nt, Artificial Sequence
  MKO10046639_A_Rspry1
  gRNA
uaacuuacuuuagugggcaa

SEQ ID NO: 46640 - RNA, 20 nt, Artificial Sequence
  MKO10046640_A_Rsrc1
  gRNA
gucacagaagaacccguagc

SEQ ID NO: 46641 - RNA, 20 nt, Artificial Sequence
  MKO10046641_A_Rsrc1
  gRNA
aaagaagucgcagucguucc

SEQ ID NO: 46642 - RNA, 20 nt, Artificial Sequence
  MKO10046642_A_Rsrc1
  gRNA
uuuauuguagguccagguca

SEQ ID NO: 46643 - RNA, 20 nt, Artificial Sequence
  MKO10046643_A_Rsrc2
  gRNA
aaaggaagaagucucgaucg

SEQ ID NO: 46644 - RNA, 20 nt, Artificial Sequence
  MKO10046644_A_Rsrc2
  gRNA
cccgauccagauccagacac

SEQ ID NO: 46645 - RNA, 20 nt, Artificial Sequence
  MKO10046645_A_Rsrc2
  gRNA
gcuauugauacagaacgaga

SEQ ID NO: 46646 - RNA, 20 nt, Artificial Sequence
  MKO10046646_A_Rsu1
  gRNA
agguugaacacgcugccucg

SEQ ID NO: 46647 - RNA, 20 nt, Artificial Sequence
  MKO10046647_A_Rsu1
  gRNA
cgcuuagauagagugcacgc

SEQ ID NO: 46648 - RNA, 20 nt, Artificial Sequence
  MKO10046648_A_Rsu1
  gRNA
gggagggagccgaauccucg

SEQ ID NO: 46649 - RNA, 20 nt, Artificial Sequence
  MKO10046649_A_Rtbdn
  gRNA
cgcgccgccgcccucgugcc

SEQ ID NO: 46650 - RNA, 20 nt, Artificial Sequence
  MKO10046650_A_Rtbdn
  gRNA
aaccuggagcugcuacccgc

SEQ ID NO: 46651 - RNA, 20 nt, Artificial Sequence
  MKO10046651_A_Rtbdn
  gRNA
gggcgugccccgaagagcug

SEQ ID NO: 46652 - RNA, 20 nt, Artificial Sequence
  MKO10046652_A_Ruca
  gRNA
ccgucggagcuccgucugaa

SEQ ID NO: 46653 - RNA, 20 nt, Artificial Sequence
  MKO10046653_A_Ruca
  gRNA
gcggaucuucugcacgcgca

SEQ ID NO: 46654 - RNA, 20 nt, Artificial Sequence
  MKO10046654_A_Ruca
  gRNA
ccgacggggaagccgcaaac

SEQ ID NO: 46655 - RNA, 20 nt, Artificial Sequence
  MKO10046655_A_Rucb
  gRNA
uucucuugcagcggucuauc

SEQ ID NO: 46656 - RNA, 20 nt, Artificial Sequence
  MKO10046656_A_Rucb
  gRNA
guacuuaccaccaccucgac

SEQ ID NO: 46657 - RNA, 20 nt, Artificial Sequence
  MKO10046657_A_Rucb
  gRNA
gagcgauguacagccuguga

SEQ ID NO: 46658 - RNA, 20 nt, Artificial Sequence
  MKO10046658_A_Rtdr1
  gRNA
caugauguauagaaccuccg

SEQ ID NO: 46659 - RNA, 20 nt, Artificial Sequence
  MKO10046659_A_Rtdr1
  gRNA
aucauggccacccauuacgu

SEQ ID NO: 46660 - RNA, 20 nt, Artificial Sequence
  MKO10046660_A_Rtdr1
  gRNA
ccaagccgugcccuguuuaa

SEQ ID NO: 46661 - RNA, 20 nt, Artificial Sequence
  MKO10046661_A_Rtel1
  gRNA
agcuucggaauaccgccuac

SEQ ID NO: 46662 - RNA, 20 nt, Artificial Sequence
  MKO10046662_A_Rtel1
  gRNA
gucaccuauugagucuccgc

SEQ ID NO: 46663 - RNA, 20 nt, Artificial Sequence
  MKO10046663_A_Rtel1
  gRNA
aggcgguauuccgaagcuca

SEQ ID NO: 46664 - RNA, 20 nt, Artificial Sequence
  MKO10046664_A_Rtf1
  gRNA
cacugcgcuuccguuucgcc

SEQ ID NO: 46665 - RNA, 20 nt, Artificial Sequence
  MKO10046665_A_Rtf1
  gRNA
acggaagcgcagugacuccg

SEQ ID NO: 46666 - RNA, 20 nt, Artificial Sequence
  MKO10046666_A_Rtf1
  gRNA
ucuccgucaucugcuccagu

SEQ ID NO: 46667 - RNA, 20 nt, Artificial Sequence
  MKO10046667_A_Rtfdc1
  gRNA
ggcagaugaaccgcgcucuc

SEQ ID NO: 46668 - RNA, 20 nt, Artificial Sequence
  MKO10046668_A_Rtfdc1
  gRNA
gguugacaaagacgcugaac

SEQ ID NO: 46669 - RNA, 20 nt, Artificial Sequence
  MKO10046669_A_Rtfdc1
  gRNA
uagacuguauaacaaagacg

SEQ ID NO: 46670 - RNA, 20 nt, Artificial Sequence
  MKO10046670_A_Rtkn2
  gRNA
ugcucggauccaggcguaca

SEQ ID NO: 46671 - RNA, 20 nt, Artificial Sequence
  MKO10046671_A_Rtkn2
  gRNA
uuagagauccgcaugcgaga

SEQ ID NO: 46672 - RNA, 20 nt, Artificial Sequence
  MKO10046672_A_Rtkn2
  gRNA
auauccgaauaccauuaaug

SEQ ID NO: 46673 - RNA, 20 nt, Artificial Sequence
  MKO10046673_A_Rtkn
  gRNA
accuccggaucccacucaug

SEQ ID NO: 46674 - RNA, 20 nt, Artificial Sequence
  MKO10046674_A_Rtkn
  gRNA
ugagcugcagcggcgaaagg

SEQ ID NO: 46675 - RNA, 20 nt, Artificial Sequence
  MKO10046675_A_Rtkn
  gRNA
uagaucaugagauccggaug

SEQ ID NO: 46676 - RNA, 20 nt, Artificial Sequence
  MKO10046676_A_Rtl1
  gRNA
cgacguguuuaacccgaggg

SEQ ID NO: 46677 - RNA, 20 nt, Artificial Sequence
  MKO10046677_A_Rtl1
  gRNA
cacacugacgguaacguugc

SEQ ID NO: 46678 - RNA, 20 nt, Artificial Sequence
  MKO10046678_A_Rtl1
  gRNA
ccgcuuccuggucgccaaac

SEQ ID NO: 46679 - RNA, 20 nt, Artificial Sequence
  MKO10046679_A_Rtn1
  gRNA
cgacgcucacaacgcugaac

SEQ ID NO: 46680 - RNA, 20 nt, Artificial Sequence
  MKO10046680_A_Rtn1
  gRNA
auugaagagcgcgccaacgu

SEQ ID NO: 46681 - RNA, 20 nt, Artificial Sequence
  MKO10046681_A_Rtn1
  gRNA
uggugcuuaacguacacaac

SEQ ID NO: 46682 - RNA, 20 nt, Artificial Sequence
  MKO10046682_A_Rtn2
  gRNA
gaagaccgcucccgacgucc

SEQ ID NO: 46683 - RNA, 20 nt, Artificial Sequence
  MKO10046683_A_Rtn2
  gRNA
gcacuuuagcaucguguccg

SEQ ID NO: 46684 - RNA, 20 nt, Artificial Sequence
  MKO10046684_A_Rtn2
  gRNA
ccacgugggaggcgaucugc

SEQ ID NO: 46685 - RNA, 20 nt, Artificial Sequence
  MKO10046685_A_Rtn3
  gRNA
gcgcgccucacccgcacacg

SEQ ID NO: 46686 - RNA, 20 nt, Artificial Sequence
  MKO10046686_A_Rtn3
  gRNA
gccgagccgucagcucucgg

SEQ ID NO: 46687 - RNA, 20 nt, Artificial Sequence
  MKO10046687_A_Rtn3
  gRNA
ucaccuuaccgagaaucaga

SEQ ID NO: 46688 - RNA, 20 nt, Artificial Sequence
  MKO10046688_A_Rtn4ip1
  gRNA
uugaguaugaguaagcgauu

SEQ ID NO: 46689 - RNA, 20 nt, Artificial Sequence
  MKO10046689_A_Rtn4ip1
  gRNA
accugacgcacccaagauua

SEQ ID NO: 46690 - RNA, 20 nt, Artificial Sequence
  MKO10046690_A_Rtn4ip1
  gRNA
aaccuuguuuauggcagacc

SEQ ID NO: 46691 - RNA, 20 nt, Artificial Sequence
  MKO10046691_A_Rtn4rl1
  gRNA
caaccgacagcugcgaacgc

SEQ ID NO: 46692 - RNA, 20 nt, Artificial Sequence
  MKO10046692_A_Rtn4rl1
  gRNA
gaaagagcuuaccgaacugc

SEQ ID NO: 46693 - RNA, 20 nt, Artificial Sequence
  MKO10046693_A_Rtn4rl1
  gRNA
gcggccaacaugcuucgcaa

SEQ ID NO: 46694 - RNA, 20 nt, Artificial Sequence
  MKO10046694_A_Rtn4rl2
  gRNA
cgcccaccgaggacgacuac

SEQ ID NO: 46695 - RNA, 20 nt, Artificial Sequence
  MKO10046695_A_Rtn4rl2
  gRNA
gcuacggcggcgaggaucag

SEQ ID NO: 46696 - RNA, 20 nt, Artificial Sequence
  MKO10046696_A_Rtn4rl2
  gRNA
ugcugagcuggcaacgauac

SEQ ID NO: 46697 - RNA, 20 nt, Artificial Sequence
  MKO10046697_A_Rtn4r
  gRNA
ggcugcgggugcgauucuuc

SEQ ID NO: 46698 - RNA, 20 nt, Artificial Sequence
  MKO10046698_A_Rtn4r
  gRNA
cccuaccacguuccacggcc

SEQ ID NO: 46699 - RNA, 20 nt, Artificial Sequence
  MKO10046699_A_Rtn4r
  gRNA
aagaugaagagggcguccuc

SEQ ID NO: 46700 - RNA, 20 nt, Artificial Sequence
  MKO10046700_A_Rtn4
  gRNA
ugaugccguucauauauaac

SEQ ID NO: 46701 - RNA, 20 nt, Artificial Sequence
  MKO10046701_A_Rtn4
  gRNA
uacguuggugccuuguucaa

SEQ ID NO: 46702 - RNA, 20 nt, Artificial Sequence
  MKO10046702_A_Rtn4
  gRNA
guucagcauugucaguguaa

SEQ ID NO: 46703 - RNA, 20 nt, Artificial Sequence
  MKO10046703_A_Rtp1
  gRNA
ucgccgguuguccugccggc

SEQ ID NO: 46704 - RNA, 20 nt, Artificial Sequence
  MKO10046704_A_Rtp1
  gRNA
caggacaaccggcgacaccg

SEQ ID NO: 46705 - RNA, 20 nt, Artificial Sequence
  MKO10046705_A_Rtp1
  gRNA
cuuacacaugucuucgucag

SEQ ID NO: 46706 - RNA, 20 nt, Artificial Sequence
  MKO10046706_A_Rtp2
  gRNA
gcgcgagcaguguuacgaug

SEQ ID NO: 46707 - RNA, 20 nt, Artificial Sequence
  MKO10046707_A_Rtp2
  gRNA
caauccgcugucuggccggc

SEQ ID NO: 46708 - RNA, 20 nt, Artificial Sequence
  MKO10046708_A_Rtp2
  gRNA
cacccucaagcccaaugagc

SEQ ID NO: 46709 - RNA, 20 nt, Artificial Sequence
  MKO10046709_A_Rtp3
  gRNA
ugcugcucugcugccgucga

SEQ ID NO: 46710 - RNA, 20 nt, Artificial Sequence
  MKO10046710_A_Rtp3
  gRNA
gaagugggugggacguauaa

SEQ ID NO: 46711 - RNA, 20 nt, Artificial Sequence
  MKO10046711_A_Rtp3
  gRNA
ccauccuggcuucaaaacgu

SEQ ID NO: 46712 - RNA, 20 nt, Artificial Sequence
  MKO10046712_A_Rtp4
  gRNA
ccacgacacacgcaauugug

SEQ ID NO: 46713 - RNA, 20 nt, Artificial Sequence
  MKO10046713_A_Rtp4
  gRNA
ccucacaauugcgugugucg

SEQ ID NO: 46714 - RNA, 20 nt, Artificial Sequence
  MKO10046714_A_Rtp4
  gRNA
uccccgaugacuucaguacu

SEQ ID NO: 46715 - RNA, 20 nt, Artificial Sequence
  MKO10046715_A_Ruun
  gRNA
ucaaucaaguguuggacggc

SEQ ID NO: 46716 - RNA, 20 nt, Artificial Sequence
  MKO10046716_A_Ruun
  gRNA
aauugaaccauucgagcaaa

SEQ ID NO: 46717 - RNA, 20 nt, Artificial Sequence
  MKO10046717_A_Ruun
  gRNA
aucuaagcuccguccaaaug

SEQ ID NO: 46718 - RNA, 20 nt, Artificial Sequence
  MKO10046718_A_Rufy1
  gRNA
uggcacgcuccuccaucauc

SEQ ID NO: 46719 - RNA, 20 nt, Artificial Sequence
  MKO10046719_A_Rufy1
  gRNA
gcuggugggacucaacguuc

SEQ ID NO: 46720 - RNA, 20 nt, Artificial Sequence
  MKO10046720_A_Rufy1
  gRNA
cagugaguucuaugagcccg

SEQ ID NO: 46721 - RNA, 20 nt, Artificial Sequence
  MKO10046721_A_Rufy2
  gRNA
gcgaguguccgggacuugcc

SEQ ID NO: 46722 - RNA, 20 nt, Artificial Sequence
  MKO10046722_A_Rufy2
  gRNA
ugaguaccaugcacugauga

SEQ ID NO: 46723 - RNA, 20 nt, Artificial Sequence
  MKO10046723_A_Rufy2
  gRNA
uacaaaggaccccacagccg

SEQ ID NO: 46724 - RNA, 20 nt, Artificial Sequence
  MKO10046724_A_Rufy3
  gRNA
cgaugacauucagacccacc

SEQ ID NO: 46725 - RNA, 20 nt, Artificial Sequence
  MKO10046725_A_Rufy3
  gRNA
ccgagacguacuugaguccu

SEQ ID NO: 46726 - RNA, 20 nt, Artificial Sequence
  MKO10046726_A_Rufy3
  gRNA
gaagaaggagcuauuaucgc

SEQ ID NO: 46727 - RNA, 20 nt, Artificial Sequence
  MKO10046727_A_Rufy4
  gRNA
gcgcacaacagagggcuccg

SEQ ID NO: 46728 - RNA, 20 nt, Artificial Sequence
  MKO10046728_A_Rufy4
  gRNA
ggcaaggcagagucggauaa

SEQ ID NO: 46729 - RNA, 20 nt, Artificial Sequence
  MKO10046729_A_Rufy4
  gRNA
auccgacucugccuugcccg

SEQ ID NO: 46730 - RNA, 20 nt, Artificial Sequence
  MKO10046730_A_Rundc1
  gRNA
ccgugcauauguggaauccc

SEQ ID NO: 46731 - RNA, 20 nt, Artificial Sequence
  MKO10046731_A_Rundc1
  gRNA
acaugaccacgucaucacuu

SEQ ID NO: 46732 - RNA, 20 nt, Artificial Sequence
  MKO10046732_A_Rundc1
  gRNA
ucaacguguggacgcagcag

SEQ ID NO: 46733 - RNA, 20 nt, Artificial Sequence
  MKO10046733_A_Rundc3a
  gRNA
aucuucccgcaacgugaucg

SEQ ID NO: 46734 - RNA, 20 nt, Artificial Sequence
  MKO10046734_A_Rundc3a
  gRNA
ugcgcuccacgaucacguug

SEQ ID NO: 46735 - RNA, 20 nt, Artificial Sequence
  MKO10046735_A_Rundc3a
  gRNA
auggccuaccuuuaaaucgg

SEQ ID NO: 46736 - RNA, 20 nt, Artificial Sequence
  MKO10046736_A_Rundc3b
  gRNA
augaaagcccacguagcuuc

SEQ ID NO: 46737 - RNA, 20 nt, Artificial Sequence
  MKO10046737_A_Rundc3b
  gRNA
caugagugcuacucugaucc

SEQ ID NO: 46738 - RNA, 20 nt, Artificial Sequence
  MKO10046738_A_Rundc3b
  gRNA
caaagcaagaccgaucaauc

SEQ ID NO: 46739 - RNA, 20 nt, Artificial Sequence
  MKO10046739_A_Runx1t1
  gRNA
ugucguuggcguaaaugagc

SEQ ID NO: 46740 - RNA, 20 nt, Artificial Sequence
  MKO10046740_A_Runx1t1
  gRNA
cuucucgacgugaacgaaaa

SEQ ID NO: 46741 - RNA, 20 nt, Artificial Sequence
  MKO10046741_A_Runx1t1
  gRNA
aagaguucgcacccuuguac

SEQ ID NO: 46742 - RNA, 20 nt, Artificial Sequence
  MKO10046742_A_Runx1
  gRNA
ccgggugaaaugggugucgc

SEQ ID NO: 46743 - RNA, 20 nt, Artificial Sequence
  MKO10046743_A_Runx1
  gRNA
uagcgagauucaacgaccuc

SEQ ID NO: 46744 - RNA, 20 nt, Artificial Sequence
  MKO10046744_A_Runx1
  gRNA
uuugucgggcggagcgguag

SEQ ID NO: 46745 - RNA, 20 nt, Artificial Sequence
  MKO10046745_A_Runx2
  gRNA
ugucgugcggcggccucaau

SEQ ID NO: 46746 - RNA, 20 nt, Artificial Sequence
  MKO10046746_A_Runx2
  gRNA
gccgcacgacaaccgcacca

SEQ ID NO: 46747 - RNA, 20 nt, Artificial Sequence
  MKO10046747_A_Runx2
  gRNA
gagaccuaccucguccgcuc

SEQ ID NO: 46748 - RNA, 20 nt, Artificial Sequence
  MKO10046748_A_Runx3
  gRNA
guucaacgaccuucgauucg

SEQ ID NO: 46749 - RNA, 20 nt, Artificial Sequence
  MKO10046749_A_Runx3
  gRNA
ggacgugcuggccgaccacg

SEQ ID NO: 46750 - RNA, 20 nt, Artificial Sequence
  MKO10046750_A_Runx3
  gRNA
ccggcccgaagugcgcucga

SEQ ID NO: 46751 - RNA, 20 nt, Artificial Sequence
  MKO10046751_A_Rusc1
  gRNA
cugaagcgcugacagcuauc

SEQ ID NO: 46752 - RNA, 20 nt, Artificial Sequence
  MKO10046752_A_Rusc1
  gRNA
guacagccaggucagccgac

SEQ ID NO: 46753 - RNA, 20 nt, Artificial Sequence
  MKO10046753_A_Rusc1
  gRNA
agguuccugcacacauucga

SEQ ID NO: 46754 - RNA, 20 nt, Artificial Sequence
  MKO10046754_A_Rusc2
  gRNA
cuuccgguggccuucgaucu

SEQ ID NO: 46755 - RNA, 20 nt, Artificial Sequence
  MKO10046755_A_Rusc2
  gRNA
aucccggcucgugccaaaau

SEQ ID NO: 46756 - RNA, 20 nt, Artificial Sequence
  MKO10046756_A_Rusc2
  gRNA
acccguccuucgcuacagca

SEQ ID NO: 46757 - RNA, 20 nt, Artificial Sequence
  MKO10046757_A_Ruvbl1
  gRNA
ucuuucaggguugcggauaa

SEQ ID NO: 46758 - RNA, 20 nt, Artificial Sequence
  MKO10046758_A_Ruvbl1
  gRNA
augaacaccuugccaguucc

SEQ ID NO: 46759 - RNA, 20 nt, Artificial Sequence
  MKO10046759_A_Ruvbl1
  gRNA
cacacucaccaauggcccug

SEQ ID NO: 46760 - RNA, 20 nt, Artificial Sequence
  MKO10046760_A_Ruvbl2
  gRNA
gugacaagaaucgagcgaau

SEQ ID NO: 46761 - RNA, 20 nt, Artificial Sequence
  MKO10046761_A_Ruvbl2
  gRNA
gggcgggccguccucauugc

SEQ ID NO: 46762 - RNA, 20 nt, Artificial Sequence
  MKO10046762_A_Ruvbl2
  gRNA
caagccuuccgccguuccau

SEQ ID NO: 46763 - RNA, 20 nt, Artificial Sequence
  MKO10046763_A_Rwdd1
  gRNA
ccacaggccgaggagaaucu

SEQ ID NO: 46764 - RNA, 20 nt, Artificial Sequence
  MKO10046764_A_Rwdd1
  gRNA
agccuccgaugucacaguaa

SEQ ID NO: 46765 - RNA, 20 nt, Artificial Sequence
  MKO10046765_A_Rwdd1
  gRNA
acuuuaugaaauauucuccc

SEQ ID NO: 46766 - RNA, 20 nt, Artificial Sequence
  MKO10046766_A_Rwdd2a
  gRNA
cgugaugacaaauucgaugu

SEQ ID NO: 46767 - RNA, 20 nt, Artificial Sequence
  MKO10046767_A_Rwdd2a
  gRNA
cuugacuggcuucgccugua

SEQ ID NO: 46768 - RNA, 20 nt, Artificial Sequence
  MKO10046768_A_Rwdd2a
  gRNA
gcgccucuuccauucguuug

SEQ ID NO: 46769 - RNA, 20 nt, Artificial Sequence
  MKO10046769_A_Rwdd2b
  gRNA
cucgugaaagcgagauccuc

SEQ ID NO: 46770 - RNA, 20 nt, Artificial Sequence
  MKO10046770_A_Rwdd2b
  gRNA
cuuuacgaucaaugugagcc

SEQ ID NO: 46771 - RNA, 20 nt, Artificial Sequence
  MKO10046771_A_Rwdd2b
  gRNA
gcucauagugaaugaccagc

SEQ ID NO: 46772 - RNA, 20 nt, Artificial Sequence
  MKO10046772_A_Rwdd3
  gRNA
ucuucugcgggcccaacgag

SEQ ID NO: 46773 - RNA, 20 nt, Artificial Sequence
  MKO10046773_A_Rwdd3
  gRNA
agaaccagcucgugaaccau

SEQ ID NO: 46774 - RNA, 20 nt, Artificial Sequence
  MKO10046774_A_Rwdd3
  gRNA
ucgucccccgucgcacuuuc

SEQ ID NO: 46775 - RNA, 20 nt, Artificial Sequence
  MKO10046775_A_Rwdd4a
  gRNA
cacguuguucgaguacgcua

SEQ ID NO: 46776 - RNA, 20 nt, Artificial Sequence
  MKO10046776_A_Rwdd4a
  gRNA
agcguacucgaacaacgugu

SEQ ID NO: 46777 - RNA, 20 nt, Artificial Sequence
  MKO10046777_A_Rwdd4a
  gRNA
aguuucaaccgagaugauau

SEQ ID NO: 46778 - RNA, 20 nt, Artificial Sequence
  MKO10046778_A_Rxfp1
  gRNA
ugaugggacagcucguaaau

SEQ ID NO: 46779 - RNA, 20 nt, Artificial Sequence
  MKO10046779_A_Rxfp1
  gRNA
agucacucucggaagugcac

SEQ ID NO: 46780 - RNA, 20 nt, Artificial Sequence
  MKO10046780_A_Rxfp1
  gRNA
uacuuccugaagccguuggg

SEQ ID NO: 46781 - RNA, 20 nt, Artificial Sequence
  MKO10046781_A_Rxfp2
  gRNA
uugcgggaauggugccgacg

SEQ ID NO: 46782 - RNA, 20 nt, Artificial Sequence
  MKO10046782_A_Rxfp2
  gRNA
ucacaguaauguuacguugc

SEQ ID NO: 46783 - RNA, 20 nt, Artificial Sequence
  MKO10046783_A_Rxfp2
  gRNA
cucaccacaguuguccucgu

SEQ ID NO: 46784 - RNA, 20 nt, Artificial Sequence
  MKO10046784_A_Rxfp3
  gRNA
aucuccgaccgucgcguagu

SEQ ID NO: 46785 - RNA, 20 nt, Artificial Sequence
  MKO10046785_A_Rxfp3
  gRNA
cgcggcgcacuaagcaguag

SEQ ID NO: 46786 - RNA, 20 nt, Artificial Sequence
  MKO10046786_A_Rxfp3
  gRNA
gacgacgauggucaccgacu

SEQ ID NO: 46787 - RNA, 20 nt, Artificial Sequence
  MKO10046787_A_Rxfp4
  gRNA
cacugaguaucgcgcgauac

SEQ ID NO: 46788 - RNA, 20 nt, Artificial Sequence
  MKO10046788_A_Rxfp4
  gRNA
agcccgcucuguccgugucc

SEQ ID NO: 46789 - RNA, 20 nt, Artificial Sequence
  MKO10046789_A_Rxfp4
  gRNA
ccugcuggggcucccgccgc

SEQ ID NO: 46790 - RNA, 20 nt, Artificial Sequence
  MKO10046790_A_Rxra
  gRNA
gccauggagccucgacccgu

SEQ ID NO: 46791 - RNA, 20 nt, Artificial Sequence
  MKO10046791_A_Rxra
  gRNA
cuucgggacugguagccccc

SEQ ID NO: 46792 - RNA, 20 nt, Artificial Sequence
  MKO10046792_A_Rxra
  gRNA
guccaccagcagugccaacg

SEQ ID NO: 46793 - RNA, 20 nt, Artificial Sequence
  MKO10046793_A_Rxrb
  gRNA
aguacugacagcgauuccgc

SEQ ID NO: 46794 - RNA, 20 nt, Artificial Sequence
  MKO10046794_A_Rxrb
  gRNA
uuuguuaucacgacacgagu

SEQ ID NO: 46795 - RNA, 20 nt, Artificial Sequence
  MKO10046795_A_Rxrb
  gRNA
aacuccacagugucgcuccc

SEQ ID NO: 46796 - RNA, 20 nt, Artificial Sequence
  MKO10046796_A_Rxrg
  gRNA
cuccacguucaugucaccgu

SEQ ID NO: 46797 - RNA, 20 nt, Artificial Sequence
  MKO10046797_A_Rxrg
  gRNA
acaaucuuuguuaucccgac

SEQ ID NO: 46798 - RNA, 20 nt, Artificial Sequence
  MKO10046798_A_Rxrg
  gRNA
uagccacgaagacaugcccg

SEQ ID NO: 46799 - RNA, 20 nt, Artificial Sequence
  MKO10046799_A_Rybp
  gRNA
aaugcagcaucugcgaugug

SEQ ID NO: 46800 - RNA, 20 nt, Artificial Sequence
  MKO10046800_A_Rybp
  gRNA
uuucacuguaccuugaggug

SEQ ID NO: 46801 - RNA, 20 nt, Artificial Sequence
  MKO10046801_A_Rybp
  gRNA
accucgcaucaauucucagc

SEQ ID NO: 46802 - RNA, 20 nt, Artificial Sequence
  MKO10046802_A_Ryk
  gRNA
cgggucgagcuuucuuguac

SEQ ID NO: 46803 - RNA, 20 nt, Artificial Sequence
  MKO10046803_A_Ryk
  gRNA
gacuucagagucgacuuugc

SEQ ID NO: 46804 - RNA, 20 nt, Artificial Sequence
  MKO10046804_A_Ryk
  gRNA
gaggucccacgcacuuuauc

SEQ ID NO: 46805 - RNA, 20 nt, Artificial Sequence
  MKO10046805_A_Ryr1
  gRNA
ccggcacgcacacagucgua

SEQ ID NO: 46806 - RNA, 20 nt, Artificial Sequence
  MKO10046806_A_Ryr1
  gRNA
ucagaauguacccccugauc

SEQ ID NO: 46807 - RNA, 20 nt, Artificial Sequence
  MKO10046807_A_Ryr1
  gRNA
cacaccggccuccacaguau

SEQ ID NO: 46808 - RNA, 20 nt, Artificial Sequence
  MKO10046808_A_Ryr2
  gRNA
ccugcagggcccguacugac

SEQ ID NO: 46809 - RNA, 20 nt, Artificial Sequence
  MKO10046809_A_Ryr2
  gRNA
ccugucaguacgggcccugc

SEQ ID NO: 46810 - RNA, 20 nt, Artificial Sequence
  MKO10046810_A_Ryr2
  gRNA
uccacagaaguucaugauga

SEQ ID NO: 46811 - RNA, 20 nt, Artificial Sequence
  MKO10046811_A_Ryr3
  gRNA
gaauugcaugcccguagagc

SEQ ID NO: 46812 - RNA, 20 nt, Artificial Sequence
  MKO10046812_A_Ryr3
  gRNA
cugugucugcaauuucgugc

SEQ ID NO: 46813 - RNA, 20 nt, Artificial Sequence
  MKO10046813_A_Ryr3
  gRNA
cguucccacaggcggcacaa

SEQ ID NO: 46814 - RNA, 20 nt, Artificial Sequence
  MKO10046814_A_S100a10
  gRNA
ccaugaugcuuacguuucac

SEQ ID NO: 46815 - RNA, 20 nt, Artificial Sequence
  MKO10046815_A_S100a10
  gRNA
ccacuuugccaucucggcac

SEQ ID NO: 46816 - RNA, 20 nt, Artificial Sequence
  MKO10046816_A_S100a10
  gRNA
gcacuuacuuccaaaaaccc

SEQ ID NO: 46817 - RNA, 20 nt, Artificial Sequence
  MKO10046817_A_S100a11
  gRNA
cuauagcuaagccaccaaug

SEQ ID NO: 46818 - RNA, 20 nt, Artificial Sequence
  MKO10046818_A_S100a11
  gRNA
uugcagaaccagaaggaucc

SEQ ID NO: 46819 - RNA, 20 nt, Artificial Sequence
  MKO10046819_A_S100a11
  gRNA
agccagcucuguguucauga

SEQ ID NO: 46820 - RNA, 20 nt, Artificial Sequence
  MKO10046820_A_S100a13
  gRNA
ugggaugcagcuaaccgauc

SEQ ID NO: 46821 - RNA, 20 nt, Artificial Sequence
  MKO10046821_A_S100a13
  gRNA
ggcgguccccucagcggagg

SEQ ID NO: 46822 - RNA, 20 nt, Artificial Sequence
  MKO10046822_A_S100a13
  gRNA
gcguccuucccgcccugcaa

SEQ ID NO: 46823 - RNA, 20 nt, Artificial Sequence
  MKO10046823_A_S100a14
  gRNA
caacuguaaugacucgaaac

SEQ ID NO: 46824 - RNA, 20 nt, Artificial Sequence
  MKO10046824_A_S100a14
  gRNA
aguccucagcuccgaguaac

SEQ ID NO: 46825 - RNA, 20 nt, Artificial Sequence
  MKO10046825_A_S100a14
  gRNA
cucaguaccggcaugaggug

SEQ ID NO: 46826 - RNA, 20 nt, Artificial Sequence
  MKO10046826_A_S100a16
  gRNA
caaagcagaugcgcccgucg

SEQ ID NO: 46827 - RNA, 20 nt, Artificial Sequence
  MKO10046827_A_S100a16
  gRNA
gcaucugcuuugacgaauac

SEQ ID NO: 46828 - RNA, 20 nt, Artificial Sequence
  MKO10046828_A_S100a16
  gRNA
guggggauaccgucagcaug

SEQ ID NO: 46829 - RNA, 20 nt, Artificial Sequence
  MKO10046829_A_S100a1
  gRNA
uguccccuuccuugcccgaa

SEQ ID NO: 46830 - RNA, 20 nt, Artificial Sequence
  MKO10046830_A_S100a1
  gRNA
cacauugaugagggucucca

SEQ ID NO: 46831 - RNA, 20 nt, Artificial Sequence
  MKO10046831_A_S100a1
  gRNA
agauggggaaguggacuuca

SEQ ID NO: 46832 - RNA, 20 nt, Artificial Sequence
  MKO10046832_A_S100a2
  gRNA
ggaaaugaacaaccucgaua

SEQ ID NO: 46833 - RNA, 20 nt, Artificial Sequence
  MKO10046833_A_S100a2
  gRNA
acauccggaaguccaccugc

SEQ ID NO: 46834 - RNA, 20 nt, Artificial Sequence
  MKO10046834_A_S100a2
  gRNA
ccacaaguacgccagucaag

SEQ ID NO: 46835 - RNA, 20 nt, Artificial Sequence
  MKO10046835_A_S100a3
  gRNA
ggugcucaccggcguccagg

SEQ ID NO: 46836 - RNA, 20 nt, Artificial Sequence
  MKO10046836_A_S100a3
  gRNA
uaccaacaaagacugcgaag

SEQ ID NO: 46837 - RNA, 20 nt, Artificial Sequence
  MKO10046837_A_S100a3
  gRNA
guccacuucgcagucuuugu

SEQ ID NO: 46838 - RNA, 20 nt, Artificial Sequence
  MKO10046838_A_S100a4
  gRNA
gguuaccauggcaagacccu

SEQ ID NO: 46839 - RNA, 20 nt, Artificial Sequence
  MKO10046839_A_S100a4
  gRNA
agguggacacaauuacaucc

SEQ ID NO: 46840 - RNA, 20 nt, Artificial Sequence
  MKO10046840_A_S100a4
  gRNA
ccaaguugcucaucaccuuc

SEQ ID NO: 46841 - RNA, 20 nt, Artificial Sequence
  MKO10046841_A_S100a5
  gRNA
auuguaggccaugcacagcg

SEQ ID NO: 46842 - RNA, 20 nt, Artificial Sequence
  MKO10046842_A_S100a5
  gRNA
guuccugaccacgcugugca

SEQ ID NO: 46843 - RNA, 20 nt, Artificial Sequence
  MKO10046843_A_S100a5
  gRNA
guggucagugccuucucaag

SEQ ID NO: 46844 - RNA, 20 nt, Artificial Sequence
  MKO10046844_A_S100a6
  gRNA
ggaugaucuggaccguaaca

SEQ ID NO: 46845 - RNA, 20 nt, Artificial Sequence
  MKO10046845_A_S100a6
  gRNA
aucagucauggcaugcccuc

SEQ ID NO: 46846 - RNA, 20 nt, Artificial Sequence
  MKO10046846_A_S100a6
  gRNA
ccaggaaggcgacauacucc

SEQ ID NO: 46847 - RNA, 20 nt, Artificial Sequence
  MKO10046847_A_S100a7a
  gRNA
ugaugaguuccuguacaucu

SEQ ID NO: 46848 - RNA, 20 nt, Artificial Sequence
  MKO10046848_A_S100a7a
  gRNA
aacagcucugugauguagua

SEQ ID NO: 46849 - RNA, 20 nt, Artificial Sequence
  MKO10046849_A_S100a7a
  gRNA
gccucgcuucauggacaccu

SEQ ID NO: 46850 - RNA, 20 nt, Artificial Sequence
  MKO10046850_A_S100a8
  gRNA
cgugacaaugccgucugaac

SEQ ID NO: 46851 - RNA, 20 nt, Artificial Sequence
  MKO10046851_A_S100a8
  gRNA
agaagcucugcuacuccuug

SEQ ID NO: 46852 - RNA, 20 nt, Artificial Sequence
  MKO10046852_A_S100a8
  gRNA
ugacaaugcaauuaacuucg

SEQ ID NO: 46853 - RNA, 20 nt, Artificial Sequence
  MKO10046853_A_S100a9
  gRNA
cugcaugagaacaacccacg

SEQ ID NO: 46854 - RNA, 20 nt, Artificial Sequence
  MKO10046854_A_S100a9
  gRNA
augcugcgcuccaucugaga

SEQ ID NO: 46855 - RNA, 20 nt, Artificial Sequence
  MKO10046855_A_S100a9
  gRNA
cucaugcagcuucucaugac

SEQ ID NO: 46856 - RNA, 20 nt, Artificial Sequence
  MKO10046856_A_S100b
  gRNA
guucauggccuucgucgcca

SEQ ID NO: 46857 - RNA, 20 nt, Artificial Sequence
  MKO10046857_A_S100b
  gRNA
cguggucaccauggcgacga

SEQ ID NO: 46858 - RNA, 20 nt, Artificial Sequence
  MKO10046858_A_S100b
  gRNA
agcucccgggauguccgagc

SEQ ID NO: 46859 - RNA, 20 nt, Artificial Sequence
  MKO10046859_A_S100g
  gRNA
cugguccggaucgccuuccu

SEQ ID NO: 46860 - RNA, 20 nt, Artificial Sequence
  MKO10046860_A_S100g
  gRNA
cgauccggaccagcucucca

SEQ ID NO: 46861 - RNA, 20 nt, Artificial Sequence
  MKO10046861_A_S100g
  gRNA
aaagcaggcuucaaguacuc

SEQ ID NO: 46862 - RNA, 20 nt, Artificial Sequence
  MKO10046862_A_S100pbp
  gRNA
cucucaauagaaacuacgcc

SEQ ID NO: 46863 - RNA, 20 nt, Artificial Sequence
  MKO10046863_A_S100pbp
  gRNA
gcauaugaacuugauccauc

SEQ ID NO: 46864 - RNA, 20 nt, Artificial Sequence
  MKO10046864_A_S100pbp
  gRNA
uaccgugugguaagaucuga

SEQ ID NO: 46865 - RNA, 20 nt, Artificial Sequence
  MKO10046865_A_S100z
  gRNA
acucuugcaaggagggcgac

SEQ ID NO: 46866 - RNA, 20 nt, Artificial Sequence
  MKO10046866_A_S100z
  gRNA
cgucagcaugcccacccagc

SEQ ID NO: 46867 - RNA, 20 nt, Artificial Sequence
  MKO10046867_A_S100z
  gRNA
gcauuaucuuauccaccaac

SEQ ID NO: 46868 - RNA, 20 nt, Artificial Sequence
  MKO10046868_A_S1pr1
  gRNA
gcccucucggaccuauuagc

SEQ ID NO: 46869 - RNA, 20 nt, Artificial Sequence
  MKO10046869_A_S1pr1
  gRNA
agaugcgccgggccuucauc

SEQ ID NO: 46870 - RNA, 20 nt, Artificial Sequence
  MKO10046870_A_S1pr1
  gRNA
guccggcauuacaacuacac

SEQ ID NO: 46871 - RNA, 20 nt, Artificial Sequence
  MKO10046871_A_S1pr2
  gRNA
accagcaacauccgcguggc

SEQ ID NO: 46872 - RNA, 20 nt, Artificial Sequence
  MKO10046872_A_S1pr2
  gRNA
caucuugugcugcgccaucg

SEQ ID NO: 46873 - RNA, 20 nt, Artificial Sequence
  MKO10046873_A_S1pr2
  gRNA
uagccgggaccuucggaggg

SEQ ID NO: 46874 - RNA, 20 nt, Artificial Sequence
  MKO10046874_A_S1pr3
  gRNA
gcgcgcauacaagaugacga

SEQ ID NO: 46875 - RNA, 20 nt, Artificial Sequence
  MKO10046875_A_S1pr3
  gRNA
ggugugcggcugucuaguca

SEQ ID NO: 46876 - RNA, 20 nt, Artificial Sequence
  MKO10046876_A_S1pr3
  gRNA
ggcgcgccucaucucuuugc

SEQ ID NO: 46877 - RNA, 20 nt, Artificial Sequence
  MKO10046877_A_S1pr4
  gRNA
gcggcgggaccgcauguaga

SEQ ID NO: 46878 - RNA, 20 nt, Artificial Sequence
  MKO10046878_A_S1pr4
  gRNA
gucgguggccgcagguugcc

SEQ ID NO: 46879 - RNA, 20 nt, Artificial Sequence
  MKO10046879_A_S1pr4
  gRNA
cugcccgccgcaagucccgc

SEQ ID NO: 46880 - RNA, 20 nt, Artificial Sequence
  MKO10046880_A_S1pr5
  gRNA
gagcaauagcgacgcgcccc

SEQ ID NO: 46881 - RNA, 20 nt, Artificial Sequence
  MKO10046881_A_S1pr5
  gRNA
gggccaacgcgcgucgccug

SEQ ID NO: 46882 - RNA, 20 nt, Artificial Sequence
  MKO10046882_A_S1pr5
  gRNA
ccacgcuaaggguacgaagc

SEQ ID NO: 46883 - RNA, 20 nt, Artificial Sequence
  MKO10046883_A_Saa1
  gRNA
uucuccuagugauggaagag

SEQ ID NO: 46884 - RNA, 20 nt, Artificial Sequence
  MKO10046884_A_Saa1
  gRNA
ucugccgaagaauuccugaa

SEQ ID NO: 46885 - RNA, 20 nt, Artificial Sequence
  MKO10046885_A_Saa1
  gRNA
ggaacuaugaugcugcucaa

SEQ ID NO: 46886 - RNA, 20 nt, Artificial Sequence
  MKO10046886_A_Saa2
  gRNA
gaggacucucaguauuuggc

SEQ ID NO: 46887 - RNA, 20 nt, Artificial Sequence
  MKO10046887_A_Saa2
  gRNA
auucuucggcagaggacacg

SEQ ID NO: 46888 - RNA, 20 nt, Artificial Sequence
  MKO10046888_A_Saa2
  gRNA
uacacugacaugaaggaagc

SEQ ID NO: 46889 - RNA, 20 nt, Artificial Sequence
  MKO10046889_A_Saa3
  gRNA
cccaaccacuuccgaccugc

SEQ ID NO: 46890 - RNA, 20 nt, Artificial Sequence
  MKO10046890_A_Saa3
  gRNA
ggaacuaugaugcugcccgg

SEQ ID NO: 46891 - RNA, 20 nt, Artificial Sequence
  MKO10046891_A_Saa3
  gRNA
guucagaaguucacgggaca

SEQ ID NO: 46892 - RNA, 20 nt, Artificial Sequence
  MKO10046892_A_Saa4
  gRNA
gcccucgggucggaagugau

SEQ ID NO: 46893 - RNA, 20 nt, Artificial Sequence
  MKO10046893_A_Saa4
  gRNA
ucccacgagcauagaaguau

SEQ ID NO: 46894 - RNA, 20 nt, Artificial Sequence
  MKO10046894_A_Saa4
  gRNA
ccccaaucacuuccgacccg

SEQ ID NO: 46895 - RNA, 20 nt, Artificial Sequence
  MKO10046895_A_Saal1
  gRNA
cgaguccaucagcaagaacg

SEQ ID NO: 46896 - RNA, 20 nt, Artificial Sequence
  MKO10046896_A_Saal1
  gRNA
augauccucguucuugcuga

SEQ ID NO: 46897 - RNA, 20 nt, Artificial Sequence
  MKO10046897_A_Saal1
  gRNA
ugacauauucaugggagugc

SEQ ID NO: 46898 - RNA, 20 nt, Artificial Sequence
  MKO10046898_A_Sac3d1
  gRNA
ccgcggcgacgugucgugcg

SEQ ID NO: 46899 - RNA, 20 nt, Artificial Sequence
  MKO10046899_A_Sac3d1
  gRNA
gaucuagccgcacugcgcgc

SEQ ID NO: 46900 - RNA, 20 nt, Artificial Sequence
  MKO10046900_A_Sac3d1
  gRNA
ugcgaagcaggcgaaacagu

SEQ ID NO: 46901 - RNA, 20 nt, Artificial Sequence
  MKO10046901_A_Sacm1l
  gRNA
gcuaaaccaugucuugagua

SEQ ID NO: 46902 - RNA, 20 nt, Artificial Sequence
  MKO10046902_A_Sacm1l
  gRNA
gcuguuacaagaccaauauu

SEQ ID NO: 46903 - RNA, 20 nt, Artificial Sequence
  MKO10046903_A_Sacm1l
  gRNA
gauacugggcacaauccauc

SEQ ID NO: 46904 - RNA, 20 nt, Artificial Sequence
  MKO10046904_A_Sacs
  gRNA
guccgcgugaccgugcuccg

SEQ ID NO: 46905 - RNA, 20 nt, Artificial Sequence
  MKO10046905_A_Sacs
  gRNA
cggugccggcgaccgcuacc

SEQ ID NO: 46906 - RNA, 20 nt, Artificial Sequence
  MKO10046906_A_Sacs
  gRNA
uuaaggaucuguccuccuuc

SEQ ID NO: 46907 - RNA, 20 nt, Artificial Sequence
  MKO10046907_A_Sae1
  gRNA
ugugggccgcaauagggccg

SEQ ID NO: 46908 - RNA, 20 nt, Artificial Sequence
  MKO10046908_A_Sae1
  gRNA
cgcaucaaacuucgugaaga

SEQ ID NO: 46909 - RNA, 20 nt, Artificial Sequence
  MKO10046909_A_Sae1
  gRNA
ggguacaccuuugcgaaucu

SEQ ID NO: 46910 - RNA, 20 nt, Artificial Sequence
  MKO10046910_A_Safb2
  gRNA
ugacggugucggccuucccc

SEQ ID NO: 46911 - RNA, 20 nt, Artificial Sequence
  MKO10046911_A_Safb2
  gRNA
ugaugacaguaaagaguacg

SEQ ID NO: 46912 - RNA, 20 nt, Artificial Sequence
  MKO10046912_A_Safb2
  gRNA
gucagaccuuaaaguaacuc

SEQ ID NO: 46913 - RNA, 20 nt, Artificial Sequence
  MKO10046913_A_Safb
  gRNA
uguggaggacaacgggcucg

SEQ ID NO: 46914 - RNA, 20 nt, Artificial Sequence
  MKO10046914_A_Safb
  gRNA
ugacguaucuacauuguuaa

SEQ ID NO: 46915 - RNA, 20 nt, Artificial Sequence
  MKO10046915_A_Safb
  gRNA
uccuccacacccucgucuuc

SEQ ID NO: 46916 - RNA, 20 nt, Artificial Sequence
  MKO10046916_A_Sag
  gRNA
ccccaacaggaggguauacc

SEQ ID NO: 46917 - RNA, 20 nt, Artificial Sequence
  MKO10046917_A_Sag
  gRNA
cauagcggaaggcgcagguc

SEQ ID NO: 46918 - RNA, 20 nt, Artificial Sequence
  MKO10046918_A_Sag
  gRNA
uggcugcaacaucacugaac

SEQ ID NO: 46919 - RNA, 20 nt, Artificial Sequence
  MKO10046919_A_Sall1
  gRNA
agaccauuggcgaacucgcc

SEQ ID NO: 46920 - RNA, 20 nt, Artificial Sequence
  MKO10046920_A_Sall1
  gRNA
uauucgccgcgucuuucauu

SEQ ID NO: 46921 - RNA, 20 nt, Artificial Sequence
  MKO10046921_A_Sall1
  gRNA
uuuccaauccgaccccgaag

SEQ ID NO: 46922 - RNA, 20 nt, Artificial Sequence
  MKO10046922_A_Sall2
  gRNA
ugcgcgcaaauugccccuug

SEQ ID NO: 46923 - RNA, 20 nt, Artificial Sequence
  MKO10046923_A_Sall2
  gRNA
caauuugcgcgcacauuucg

SEQ ID NO: 46924 - RNA, 20 nt, Artificial Sequence
  MKO10046924_A_Sall2
  gRNA
cccaccguucucagaugcgc

SEQ ID NO: 46925 - RNA, 20 nt, Artificial Sequence
  MKO10046925_A_Sall3
  gRNA
cggaggugccaucccgccuu

SEQ ID NO: 46926 - RNA, 20 nt, Artificial Sequence
  MKO10046926_A_Sall3
  gRNA
ugcuccgaagccccguccug

SEQ ID NO: 46927 - RNA, 20 nt, Artificial Sequence
  MKO10046927_A_Sall3
  gRNA
ggcucggcuuuaguaagcga

SEQ ID NO: 46928 - RNA, 20 nt, Artificial Sequence
  MKO10046928_A_Sall4
  gRNA
ccauaccggugaagcggccc

SEQ ID NO: 46929 - RNA, 20 nt, Artificial Sequence
  MKO10046929_A_Sall4
  gRNA
gccaaggacgaagucguccu

SEQ ID NO: 46930 - RNA, 20 nt, Artificial Sequence
  MKO10046930_A_Sall4
  gRNA
ugcggcugcgaugcuagcaa

SEQ ID NO: 46931 - RNA, 20 nt, Artificial Sequence
  MKO10046931_A_Samd10
  gRNA
ugcgggagucaugccacgug

SEQ ID NO: 46932 - RNA, 20 nt, Artificial Sequence
  MKO10046932_A_Samd10
  gRNA
agaaggccucgacguagacg

SEQ ID NO: 46933 - RNA, 20 nt, Artificial Sequence
  MKO10046933_A_Samd10
  gRNA
gccacuugcaaacgucuugu

SEQ ID NO: 46934 - RNA, 20 nt, Artificial Sequence
  MKO10046934_A_Samd11
  gRNA
cuaggccuugcuuccgucga

SEQ ID NO: 46935 - RNA, 20 nt, Artificial Sequence
  MKO10046935_A_Samd11
  gRNA
cgucuacagcagaccaucga

SEQ ID NO: 46936 - RNA, 20 nt, Artificial Sequence
  MKO10046936_A_Samd11
  gRNA
ccaaggugaaagcccgacuc

SEQ ID NO: 46937 - RNA, 20 nt, Artificial Sequence
  MKO10046937_A_Samd12
  gRNA
gcagagugaucaauaccccg

SEQ ID NO: 46938 - RNA, 20 nt, Artificial Sequence
  MKO10046938_A_Samd12
  gRNA
ugucaaaaccaguagcccug

SEQ ID NO: 46939 - RNA, 20 nt, Artificial Sequence
  MKO10046939_A_Samd12
  gRNA
aaacugcaaauugaaggcga

SEQ ID NO: 46940 - RNA, 20 nt, Artificial Sequence
  MKO10046940_A_Samd14
  gRNA
aggguaacgacgcacgaagc

SEQ ID NO: 46941 - RNA, 20 nt, Artificial Sequence
  MKO10046941_A_Samd14
  gRNA
gcacaacgccgccucgcaug

SEQ ID NO: 46942 - RNA, 20 nt, Artificial Sequence
  MKO10046942_A_Samd14
  gRNA
uccgccgagcauccaccagc

SEQ ID NO: 46943 - RNA, 20 nt, Artificial Sequence
  MKO10046943_A_Samd1
  gRNA
accugcggggcggucacucu

SEQ ID NO: 46944 - RNA, 20 nt, Artificial Sequence
  MKO10046944_A_Samd1
  gRNA
cccgagagugaccgccccgc

SEQ ID NO: 46945 - RNA, 20 nt, Artificial Sequence
  MKO10046945_A_Samd1
  gRNA
cugaugcagucccgggcgca

SEQ ID NO: 46946 - RNA, 20 nt, Artificial Sequence
  MKO10046946_A_Samd3
  gRNA
gcuguaccauccgaucauua

SEQ ID NO: 46947 - RNA, 20 nt, Artificial Sequence
  MKO10046947_A_Samd3
  gRNA
uuacucacagcgagccuucc

SEQ ID NO: 46948 - RNA, 20 nt, Artificial Sequence
  MKO10046948_A_Samd3
  gRNA
gacuaaguccuacaucuuac

SEQ ID NO: 46949 - RNA, 20 nt, Artificial Sequence
  MKO10046949_A_Samd4b
  gRNA
gccagagggcuagcgcauug

SEQ ID NO: 46950 - RNA, 20 nt, Artificial Sequence
  MKO10046950_A_Samd4b
  gRNA
ugagcagcaccuagagucgc

SEQ ID NO: 46951 - RNA, 20 nt, Artificial Sequence
  MKO10046951_A_Samd4b
  gRNA
cacuagcuagccgcucuucc

SEQ ID NO: 46952 - RNA, 20 nt, Artificial Sequence
  MKO10046952_A_Samd4
  gRNA
ggacuuacucgugcuugcgc

SEQ ID NO: 46953 - RNA, 20 nt, Artificial Sequence
  MKO10046953_A_Samd4
  gRNA
ggggcaguucacccgaguca

SEQ ID NO: 46954 - RNA, 20 nt, Artificial Sequence
  MKO10046954_A_Samd4
  gRNA
agagcgcagcguacuugugc

SEQ ID NO: 46955 - RNA, 20 nt, Artificial Sequence
  MKO10046955_A_Samd5
  gRNA
ugaaccgcagcccgugccac

SEQ ID NO: 46956 - RNA, 20 nt, Artificial Sequence
  MKO10046956_A_Samd5
  gRNA
aucguagccauuauccacga

SEQ ID NO: 46957 - RNA, 20 nt, Artificial Sequence
  MKO10046957_A_Samd5
  gRNA
uccuagaguacuuaaugaau

SEQ ID NO: 46958 - RNA, 20 nt, Artificial Sequence
  MKO10046958_A_Samd7
  gRNA
uugaaagacaucacgcugcc

SEQ ID NO: 46959 - RNA, 20 nt, Artificial Sequence
  MKO10046959_A_Samd7
  gRNA
gaaguuauacacaucgucca

SEQ ID NO: 46960 - RNA, 20 nt, Artificial Sequence
  MKO10046960_A_Samd7
  gRNA
cucuuuccauucuacguugc

SEQ ID NO: 46961 - RNA, 20 nt, Artificial Sequence
  MKO10046961_A_Samd8
  gRNA
gucaacucugcauucgccgc

SEQ ID NO: 46962 - RNA, 20 nt, Artificial Sequence
  MKO10046962_A_Samd8
  gRNA
ugcaacaagcaccgccuuga

SEQ ID NO: 46963 - RNA, 20 nt, Artificial Sequence
  MKO10046963_A_Samd8
  gRNA
uacgacgggcauuugccauc

SEQ ID NO: 46964 - RNA, 20 nt, Artificial Sequence
  MKO10046964_A_Samd9l
  gRNA
uauccgggaaccacgguucg

SEQ ID NO: 46965 - RNA, 20 nt, Artificial Sequence
  MKO10046965_A_Samd9l
  gRNA
acaccaacaauuuccccgug

SEQ ID NO: 46966 - RNA, 20 nt, Artificial Sequence
  MKO10046966_A_Samd9l
  gRNA
cuuccacgaaccgugguucc

SEQ ID NO: 46967 - RNA, 20 nt, Artificial Sequence
  MKO10046967_A_Samhd1
  gRNA
ucgcagcggggucgcuuagc

SEQ ID NO: 46968 - RNA, 20 nt, Artificial Sequence
  MKO10046968_A_Samhd1
  gRNA
gguacuuaacuucgcagccc

SEQ ID NO: 46969 - RNA, 20 nt, Artificial Sequence
  MKO10046969_A_Samhd1
  gRNA
gcuugauauagcgaagucgc

SEQ ID NO: 46970 - RNA, 20 nt, Artificial Sequence
  MKO10046970_A_Samm50
  gRNA
cuggagccccucccgucgag

SEQ ID NO: 46971 - RNA, 20 nt, Artificial Sequence
  MKO10046971_A_Samm50
  gRNA
ugcggcgaucucaugaagcc

SEQ ID NO: 46972 - RNA, 20 nt, Artificial Sequence
  MKO10046972_A_Samm50
  gRNA
cgaguuuguggaaguugagc

SEQ ID NO: 46973 - RNA, 20 nt, Artificial Sequence
  MKO10046973_A_Samsn1
  gRNA
uaaucgggacagcuuccgac

SEQ ID NO: 46974 - RNA, 20 nt, Artificial Sequence
  MKO10046974_A_Samsn1
  gRNA
augaugacagccccuacuca

SEQ ID NO: 46975 - RNA, 20 nt, Artificial Sequence
  MKO10046975_A_Samsn1
  gRNA
acucaaagccagcgacucua

SEQ ID NO: 46976 - RNA, 20 nt, Artificial Sequence
  MKO10046976_A_Samt1
  gRNA
aucaacucaucguugauacu

SEQ ID NO: 46977 - RNA, 20 nt, Artificial Sequence
  MKO10046977_A_Samt1
  gRNA
cuacagauuuaucaaugaga

SEQ ID NO: 46978 - RNA, 20 nt, Artificial Sequence
  MKO10046978_A_Samt1
  gRNA
uaucacuucacgcaucuaga

SEQ ID NO: 46979 - RNA, 20 nt, Artificial Sequence
  MKO10046979_A_Samt2
  gRNA
aaaguccgauguaaacaagc

SEQ ID NO: 46980 - RNA, 20 nt, Artificial Sequence
  MKO10046980_A_Samt2
  gRNA
cauuauugucaaauucccag

SEQ ID NO: 46981 - RNA, 20 nt, Artificial Sequence
  MKO10046981_A_Samt2
  gRNA
gcuauacccucaacacuaaa

SEQ ID NO: 46982 - RNA, 20 nt, Artificial Sequence
  MKO10046982_A_Samt3
  gRNA
uccuugcaaacagccgaugc

SEQ ID NO: 46983 - RNA, 20 nt, Artificial Sequence
  MKO10046983_A_Samt3
  gRNA
cacgaaugacucguuuguua

SEQ ID NO: 46984 - RNA, 20 nt, Artificial Sequence
  MKO10046984_A_Samt3
  gRNA
uccucaccugcgauauacaa

SEQ ID NO: 46985 - RNA, 20 nt, Artificial Sequence
  MKO10046985_A_Samt4
  gRNA
cuuuagcagccuaucagcuu

SEQ ID NO: 46986 - RNA, 20 nt, Artificial Sequence
  MKO10046986_A_Samt4
  gRNA
ucuucacccuugauacacaa

SEQ ID NO: 46987 - RNA, 20 nt, Artificial Sequence
  MKO10046987_A_Samt4
  gRNA
aagagcaucuucaaguugac

SEQ ID NO: 46988 - RNA, 20 nt, Artificial Sequence
  MKO10046988_A_Sap130
  gRNA
gggagcguugcugcggauua

SEQ ID NO: 46989 - RNA, 20 nt, Artificial Sequence
  MKO10046989_A_Sap130
  gRNA
auaauccgcagcaacgcucc

SEQ ID NO: 46990 - RNA, 20 nt, Artificial Sequence
  MKO10046990_A_Sap130
  gRNA
gcaggcgcaaugggacggcu

SEQ ID NO: 46991 - RNA, 20 nt, Artificial Sequence
  MKO10046991_A_Sap18
  gRNA
cgcaccuucucgcggucgau

SEQ ID NO: 46992 - RNA, 20 nt, Artificial Sequence
  MKO10046992_A_Sap18
  gRNA
gaagccgaucgaccgcgaga

SEQ ID NO: 46993 - RNA, 20 nt, Artificial Sequence
  MKO10046993_A_Sap18
  gRNA
aucuuaaaagaccuggauau

SEQ ID NO: 46994 - RNA, 20 nt, Artificial Sequence
  MKO10046994_A_Sap25
  gRNA
agagcagacacccaacugcg

SEQ ID NO: 46995 - RNA, 20 nt, Artificial Sequence
  MKO10046995_A_Sap25
  gRNA
cugccccaguuaucauacau

SEQ ID NO: 46996 - RNA, 20 nt, Artificial Sequence
  MKO10046996_A_Sap25
  gRNA
cagggguaucuuugucuaac

SEQ ID NO: 46997 - RNA, 20 nt, Artificial Sequence
  MKO10046997_A_Sap30bp
  gRNA
aagaucccaccagaaccgcc

SEQ ID NO: 46998 - RNA, 20 nt, Artificial Sequence
  MKO10046998_A_Sap30bp
  gRNA
ggacgagaacaguaagcagu

SEQ ID NO: 46999 - RNA, 20 nt, Artificial Sequence
  MKO10046999_A_Sap30bp
  gRNA
gguacucacccacuaauucc

SEQ ID NO: 47000 - RNA, 20 nt, Artificial Sequence
  MKO10047000_A_Sap30l
  gRNA
acacgcuccgacguuacaaa

SEQ ID NO: 47001 - RNA, 20 nt, Artificial Sequence
  MKO10047001_A_Sap30l
  gRNA
uauagugccguuuguaacgu

SEQ ID NO: 47002 - RNA, 20 nt, Artificial Sequence
  MKO10047002_A_Sap30l
  gRNA
agcgcucgccguccgcgaug

SEQ ID NO: 47003 - RNA, 20 nt, Artificial Sequence
  MKO10047003_A_Sap30
  gRNA
ugcguucccauuccccgccg

SEQ ID NO: 47004 - RNA, 20 nt, Artificial Sequence
  MKO10047004_A_Sap30
  gRNA
ccaccuggagcggccggucc

SEQ ID NO: 47005 - RNA, 20 nt, Artificial Sequence
  MKO10047005_A_Sap30
  gRNA
ggagugucgauguccugaac

SEQ ID NO: 47006 - RNA, 20 nt, Artificial Sequence
  MKO10047006_A_Sapcd1
  gRNA
ccucagccggucugcgaacc

SEQ ID NO: 47007 - RNA, 20 nt, Artificial Sequence
  MKO10047007_A_Sapcd1
  gRNA
caguguagggcgcuugcacc

SEQ ID NO: 47008 - RNA, 20 nt, Artificial Sequence
  MKO10047008_A_Sapcd1
  gRNA
ugaccaccucucccguggac

SEQ ID NO: 47009 - RNA, 20 nt, Artificial Sequence
  MKO10047009_A_Sapcd2
  gRNA
uaugccuucgacgcucgccu

SEQ ID NO: 47010 - RNA, 20 nt, Artificial Sequence
  MKO10047010_A_Sapcd2
  gRNA
gggcccgaggcgagcgucga

SEQ ID NO: 47011 - RNA, 20 nt, Artificial Sequence
  MKO10047011_A_Sapcd2
  gRNA
ugauggcacggggccgagac

SEQ ID NO: 47012 - RNA, 20 nt, Artificial Sequence
  MKO10047012_A_Sar1a
  gRNA
aaaacuaugccauuaaucgc

SEQ ID NO: 47013 - RNA, 20 nt, Artificial Sequence
  MKO10047013_A_Sar1a
  gRNA
aauuaucucccagcgauuaa

SEQ ID NO: 47014 - RNA, 20 nt, Artificial Sequence
  MKO10047014_A_Sar1a
  gRNA
caacgugccaauucuuaucu

SEQ ID NO: 47015 - RNA, 20 nt, Artificial Sequence
  MKO10047015_A_Sar1b
  gRNA
cacuuacugggauguagcgu

SEQ ID NO: 47016 - RNA, 20 nt, Artificial Sequence
  MKO10047016_A_Sar1b
  gRNA
aacgugccuauucuaauucu

SEQ ID NO: 47017 - RNA, 20 nt, Artificial Sequence
  MKO10047017_A_Sar1b
  gRNA
aacuaccuuccugcuaucaa

SEQ ID NO: 47018 - RNA, 20 nt, Artificial Sequence
  MKO10047018_A_Sardh
  gRNA
caaagucguccguccgcaca

SEQ ID NO: 47019 - RNA, 20 nt, Artificial Sequence
  MKO10047019_A_Sardh
  gRNA
ucuauauccgcugaugaacg

SEQ ID NO: 47020 - RNA, 20 nt, Artificial Sequence
  MKO10047020_A_Sardh
  gRNA
cgucgucacugagcgcaucg

SEQ ID NO: 47021 - RNA, 20 nt, Artificial Sequence
  MKO10047021_A_Sarm1
  gRNA
agggaccgcguggcgcgcau

SEQ ID NO: 47022 - RNA, 20 nt, Artificial Sequence
  MKO10047022_A_Sarm1
  gRNA
ggcgcuugucgagccgcucg

SEQ ID NO: 47023 - RNA, 20 nt, Artificial Sequence
  MKO10047023_A_Sarm1
  gRNA
caauaggcgcagcgcgcgcu

SEQ ID NO: 47024 - RNA, 20 nt, Artificial Sequence
  MKO10047024_A_Sarnp
  gRNA
ucuuagggcaucggaaaaga

SEQ ID NO: 47025 - RNA, 20 nt, Artificial Sequence
  MKO10047025_A_Sarnp
  gRNA
caggccuaucuugaagacca

SEQ ID NO: 47026 - RNA, 20 nt, Artificial Sequence
  MKO10047026_A_Sarnp
  gRNA
cucaccauggucuucaagau

SEQ ID NO: 47027 - RNA, 20 nt, Artificial Sequence
  MKO10047027_A_Sars2
  gRNA
ucucccggccucgggcccgc

SEQ ID NO: 47028 - RNA, 20 nt, Artificial Sequence
  MKO10047028_A_Sars2
  gRNA
cggccuuuaccgugucuggg

SEQ ID NO: 47029 - RNA, 20 nt, Artificial Sequence
  MKO10047029_A_Sars2
  gRNA
ggcagcuucgagagcagauc

SEQ ID NO: 47030 - RNA, 20 nt, Artificial Sequence
  MKO10047030_A_Sars
  gRNA
uuugagaaccuccgcgagau

SEQ ID NO: 47031 - RNA, 20 nt, Artificial Sequence
  MKO10047031_A_Sars
  gRNA
uauccacccgaaacaaaucc

SEQ ID NO: 47032 - RNA, 20 nt, Artificial Sequence
  MKO10047032_A_Sars
  gRNA
agaagcgcuucaaggacccg

SEQ ID NO: 47033 - RNA, 20 nt, Artificial Sequence
  MKO10047033_A_Sart1
  gRNA
caguucuucccgcugucgca

SEQ ID NO: 47034 - RNA, 20 nt, Artificial Sequence
  MKO10047034_A_Sart1
  gRNA
ggcugcaguaucauccagcc

SEQ ID NO: 47035 - RNA, 20 nt, Artificial Sequence
  MKO10047035_A_Sart1
  gRNA
agccgauguuaucaacccca

SEQ ID NO: 47036 - RNA, 20 nt, Artificial Sequence
  MKO10047036_A_Sart3
  gRNA
agagcucguacacgugcucg

SEQ ID NO: 47037 - RNA, 20 nt, Artificial Sequence
  MKO10047037_A_Sart3
  gRNA
cacccgagcagccuccacga

SEQ ID NO: 47038 - RNA, 20 nt, Artificial Sequence
  MKO10047038_A_Sart3
  gRNA
gugggaucgccagcugucgc

SEQ ID NO: 47039 - RNA, 20 nt, Artificial Sequence
  MKO10047039_A_Sash1
  gRNA
ccggaaacggcgcguuuccc

SEQ ID NO: 47040 - RNA, 20 nt, Artificial Sequence
  MKO10047040_A_Sash1
  gRNA
cgccgugucaacaccagaag

SEQ ID NO: 47041 - RNA, 20 nt, Artificial Sequence
  MKO10047041_A_Sash1
  gRNA
ggaccgcagcugaagugacg

SEQ ID NO: 47042 - RNA, 20 nt, Artificial Sequence
  MKO10047042_A_Sash3
  gRNA
aucgaagcccagcucccccg

SEQ ID NO: 47043 - RNA, 20 nt, Artificial Sequence
  MKO10047043_A_Sash3
  gRNA
guucuuaccccggaggauuc

SEQ ID NO: 47044 - RNA, 20 nt, Artificial Sequence
  MKO10047044_A_Sash3
  gRNA
ccugcaguuucaaugagucg

SEQ ID NO: 47045 - RNA, 20 nt, Artificial Sequence
  MKO10047045_A_Sass6
  gRNA
cccuuucgaauccaguacac

SEQ ID NO: 47046 - RNA, 20 nt, Artificial Sequence
  MKO10047046_A_Sass6
  gRNA
aacacgcgaaagagacucca

SEQ ID NO: 47047 - RNA, 20 nt, Artificial Sequence
  MKO10047047_A_Sass6
  gRNA
auacgaaccuuccuguguac

SEQ ID NO: 47048 - RNA, 20 nt, Artificial Sequence
  MKO10047048_A_Sau1
  gRNA
cugucuuacagaucuccaag

SEQ ID NO: 47049 - RNA, 20 nt, Artificial Sequence
  MKO10047049_A_Sau1
  gRNA
auuacaggacauagcauugu

SEQ ID NO: 47050 - RNA, 20 nt, Artificial Sequence
  MKO10047050_A_Sau1
  gRNA
gucauagguaaaauaguaca

SEQ ID NO: 47051 - RNA, 20 nt, Artificial Sequence
  MKO10047051_A_Sau2
  gRNA
uuccagauaaacguuucguc

SEQ ID NO: 47052 - RNA, 20 nt, Artificial Sequence
  MKO10047052_A_Sau2
  gRNA
cagccaguaccccgauauug

SEQ ID NO: 47053 - RNA, 20 nt, Artificial Sequence
  MKO10047053_A_Sau2
  gRNA
uccacuauaggucaagggau

SEQ ID NO: 47054 - RNA, 20 nt, Artificial Sequence
  MKO10047054_A_Saub1
  gRNA
ggagcacgcggaauuuguau

SEQ ID NO: 47055 - RNA, 20 nt, Artificial Sequence
  MKO10047055_A_Saub1
  gRNA
gcaucugucacauacgacag

SEQ ID NO: 47056 - RNA, 20 nt, Artificial Sequence
  MKO10047056_A_Saub1
  gRNA
aucuggacuagggcucaucc

SEQ ID NO: 47057 - RNA, 20 nt, Artificial Sequence
  MKO10047057_A_Saub2
  gRNA
agagcacgcugaguucgucu

SEQ ID NO: 47058 - RNA, 20 nt, Artificial Sequence
  MKO10047058_A_Saub2
  gRNA
caccguccgcaaugccuuaa

SEQ ID NO: 47059 - RNA, 20 nt, Artificial Sequence
  MKO10047059_A_Saub2
  gRNA
gcgugguuccauugcuccgc

SEQ ID NO: 47060 - RNA, 20 nt, Artificial Sequence
  MKO10047060_A_Saul1
  gRNA
uggcaaacugcuucaccuag

SEQ ID NO: 47061 - RNA, 20 nt, Artificial Sequence
  MKO10047061_A_Saul1
  gRNA
ugaagcaguuugccaauccg

SEQ ID NO: 47062 - RNA, 20 nt, Artificial Sequence
  MKO10047062_A_Saul1
  gRNA
gcaaccaggcaguagaaaag

SEQ ID NO: 47063 - RNA, 20 nt, Artificial Sequence
  MKO10047063_A_Sav1
  gRNA
gguggaggcugaucauaccg

SEQ ID NO: 47064 - RNA, 20 nt, Artificial Sequence
  MKO10047064_A_Sav1
  gRNA
ggaccgugccgaaugaauga

SEQ ID NO: 47065 - RNA, 20 nt, Artificial Sequence
  MKO10047065_A_Sav1
  gRNA
agucauccccuugaacgaga

SEQ ID NO: 47066 - RNA, 20 nt, Artificial Sequence
  MKO10047066_A_Saysd1
  gRNA
gucuuuggggucgccgccgc

SEQ ID NO: 47067 - RNA, 20 nt, Artificial Sequence
  MKO10047067_A_Saysd1
  gRNA
cgaggucuguacgcucugac

SEQ ID NO: 47068 - RNA, 20 nt, Artificial Sequence
  MKO10047068_A_Saysd1
  gRNA
cgccuacucuguguucaacc

SEQ ID NO: 47069 - RNA, 20 nt, Artificial Sequence
  MKO10047069_A_Sbds
  gRNA
ggaugaagcgcaaucgcaug

SEQ ID NO: 47070 - RNA, 20 nt, Artificial Sequence
  MKO10047070_A_Sbds
  gRNA
caggugugccucaucgaccc

SEQ ID NO: 47071 - RNA, 20 nt, Artificial Sequence
  MKO10047071_A_Sbds
  gRNA
uucauccugccagugaacga

SEQ ID NO: 47072 - RNA, 20 nt, Artificial Sequence
  MKO10047072_A_Sbf1
  gRNA
guaguccgcgagccgcgcca

SEQ ID NO: 47073 - RNA, 20 nt, Artificial Sequence
  MKO10047073_A_Sbf1
  gRNA
ugagacucaccgcgcgggug

SEQ ID NO: 47074 - RNA, 20 nt, Artificial Sequence
  MKO10047074_A_Sbf1
  gRNA
cuguggaugacagccgcgcu

SEQ ID NO: 47075 - RNA, 20 nt, Artificial Sequence
  MKO10047075_A_Sbf2
  gRNA
cuaaucuggauaccaacacc

SEQ ID NO: 47076 - RNA, 20 nt, Artificial Sequence
  MKO10047076_A_Sbf2
  gRNA
aguauuugcccccaaaagcc

SEQ ID NO: 47077 - RNA, 20 nt, Artificial Sequence
  MKO10047077_A_Sbf2
  gRNA
auuugcgaugagacuuucca

SEQ ID NO: 47078 - RNA, 20 nt, Artificial Sequence
  MKO10047078_A_Sbk1
  gRNA
ucuucgaggaguucgugcgc

SEQ ID NO: 47079 - RNA, 20 nt, Artificial Sequence
  MKO10047079_A_Sbk1
  gRNA
cuucggcaugacgcggcgcg

SEQ ID NO: 47080 - RNA, 20 nt, Artificial Sequence
  MKO10047080_A_Sbk1
  gRNA
ugacguggucuucgagaccg

SEQ ID NO: 47081 - RNA, 20 nt, Artificial Sequence
  MKO10047081_A_Sbk2
  gRNA
ccgguucggccguguccugc

SEQ ID NO: 47082 - RNA, 20 nt, Artificial Sequence
  MKO10047082_A_Sbk2
  gRNA
agucugucagcuugacgcgc

SEQ ID NO: 47083 - RNA, 20 nt, Artificial Sequence
  MKO10047083_A_Sbk2
  gRNA
guacgaggaagugcgucccc

SEQ ID NO: 47084 - RNA, 20 nt, Artificial Sequence
  MKO10047084_A_Sbk3
  gRNA
aaccuagcuuucggaugaga

SEQ ID NO: 47085 - RNA, 20 nt, Artificial Sequence
  MKO10047085_A_Sbk3
  gRNA
uaccgucucauccgaaagcu

SEQ ID NO: 47086 - RNA, 20 nt, Artificial Sequence
  MKO10047086_A_Sbk3
  gRNA
cuggguuugacucgaccuga

SEQ ID NO: 47087 - RNA, 20 nt, Artificial Sequence
  MKO10047087_A_Sbno1
  gRNA
cucccgcacuguuaaaugug

SEQ ID NO: 47088 - RNA, 20 nt, Artificial Sequence
  MKO10047088_A_Sbno1
  gRNA
uauuggcauauacucugcgu

SEQ ID NO: 47089 - RNA, 20 nt, Artificial Sequence
  MKO10047089_A_Sbno1
  gRNA
ugccuauucguuguugcagg

SEQ ID NO: 47090 - RNA, 20 nt, Artificial Sequence
  MKO10047090_A_Sbno2
  gRNA
ucaacgaggugccuaccauc

SEQ ID NO: 47091 - RNA, 20 nt, Artificial Sequence
  MKO10047091_A_Sbno2
  gRNA
cuacagcuguucauaccuag

SEQ ID NO: 47092 - RNA, 20 nt, Artificial Sequence
  MKO10047092_A_Sbno2
  gRNA
cuaggaccccucaugccucg

SEQ ID NO: 47093 - RNA, 20 nt, Artificial Sequence
  MKO10047093_A_Sbpl
  gRNA
gcaccgggccucugcgucac

SEQ ID NO: 47094 - RNA, 20 nt, Artificial Sequence
  MKO10047094_A_Sbpl
  gRNA
guacucacucugggcucugc

SEQ ID NO: 47095 - RNA, 20 nt, Artificial Sequence
  MKO10047095_A_Sbpl
  gRNA
agcccaucccugugacgcag

SEQ ID NO: 47096 - RNA, 20 nt, Artificial Sequence
  MKO10047096_A_Sbp
  gRNA
agccaaucccucugacgcag

SEQ ID NO: 47097 - RNA, 20 nt, Artificial Sequence
  MKO10047097_A_Sbp
  gRNA
uggggaaauaucaaugcuaa

SEQ ID NO: 47098 - RNA, 20 nt, Artificial Sequence
  MKO10047098_A_Sbp
  gRNA
cucacucugggcucugcaug

SEQ ID NO: 47099 - RNA, 20 nt, Artificial Sequence
  MKO10047099_A_Sbsn
  gRNA
ggucaaccacgccgcuggac

SEQ ID NO: 47100 - RNA, 20 nt, Artificial Sequence
  MKO10047100_A_Sbsn
  gRNA
gcaaccacuacaguaguauc

SEQ ID NO: 47101 - RNA, 20 nt, Artificial Sequence
  MKO10047101_A_Sbsn
  gRNA
gauaaauggcuuguugaccg

SEQ ID NO: 47102 - RNA, 20 nt, Artificial Sequence
  MKO10047102_A_Sbspon
  gRNA
cauuggcaauccucgauguc

SEQ ID NO: 47103 - RNA, 20 nt, Artificial Sequence
  MKO10047103_A_Sbspon
  gRNA
cagggcgccccuccguuuag

SEQ ID NO: 47104 - RNA, 20 nt, Artificial Sequence
  MKO10047104_A_Sbspon
  gRNA
ucaacaguccccugacucga

SEQ ID NO: 47105 - RNA, 20 nt, Artificial Sequence
  MKO10047105_A_Sc4mol
  gRNA
gaguuuaucccaccacguga

SEQ ID NO: 47106 - RNA, 20 nt, Artificial Sequence
  MKO10047106_A_Sc4mol
  gRNA
ggcauucuuucccaaucaua

SEQ ID NO: 47107 - RNA, 20 nt, Artificial Sequence
  MKO10047107_A_Sc4mol
  gRNA
augggugaccauacguuugc

SEQ ID NO: 47108 - RNA, 20 nt, Artificial Sequence
  MKO10047108_A_Sc5d
  gRNA
acacgaucucacgcgagacu

SEQ ID NO: 47109 - RNA, 20 nt, Artificial Sequence
  MKO10047109_A_Sc5d
  gRNA
cucugaaggaagccguccac

SEQ ID NO: 47110 - RNA, 20 nt, Artificial Sequence
  MKO10047110_A_Sc5d
  gRNA
cggagugaagaaguaguaau

SEQ ID NO: 47111 - RNA, 20 nt, Artificial Sequence
  MKO10047111_A_Scaf11
  gRNA
agcaauacugccgaugccuc

SEQ ID NO: 47112 - RNA, 20 nt, Artificial Sequence
  MKO10047112_A_Scaf11
  gRNA
ugaaaagguuuccgaucgau

SEQ ID NO: 47113 - RNA, 20 nt, Artificial Sequence
  MKO10047113_A_Scaf11
  gRNA
uacuaaccucuuguugccuu

SEQ ID NO: 47114 - RNA, 20 nt, Artificial Sequence
  MKO10047114_A_Scaf1
  gRNA
ccagauggcgcucggugucg

SEQ ID NO: 47115 - RNA, 20 nt, Artificial Sequence
  MKO10047115_A_Scaf1
  gRNA
cugagguccgcaucggugac

SEQ ID NO: 47116 - RNA, 20 nt, Artificial Sequence
  MKO10047116_A_Scaf1
  gRNA
uuugcagcgggccauucagc

SEQ ID NO: 47117 - RNA, 20 nt, Artificial Sequence
  MKO10047117_A_Scaf4
  gRNA
uaguucgugugcuaaaucuu

SEQ ID NO: 47118 - RNA, 20 nt, Artificial Sequence
  MKO10047118_A_Scaf4
  gRNA
cgauggagucgaugacauac

SEQ ID NO: 47119 - RNA, 20 nt, Artificial Sequence
  MKO10047119_A_Scaf4
  gRNA
ugcuacuggagcagcauuac

SEQ ID NO: 47120 - RNA, 20 nt, Artificial Sequence
  MKO10047120_A_Scaf8
  gRNA
acuccauugugcgacaaucc

SEQ ID NO: 47121 - RNA, 20 nt, Artificial Sequence
  MKO10047121_A_Scaf8
  gRNA
cagaauuuauaucguugccc

SEQ ID NO: 47122 - RNA, 20 nt, Artificial Sequence
  MKO10047122_A_Scaf8
  gRNA
gccaaaacaggcgugacaac

SEQ ID NO: 47123 - RNA, 20 nt, Artificial Sequence
  MKO10047123_A_Scai
  gRNA
caccccgaaaacggaaaagc

SEQ ID NO: 47124 - RNA, 20 nt, Artificial Sequence
  MKO10047124_A_Scai
  gRNA
aucaaaaguucuuccgaagu

SEQ ID NO: 47125 - RNA, 20 nt, Artificial Sequence
  MKO10047125_A_Scai
  gRNA
guaauacagcugcccgaucu

SEQ ID NO: 47126 - RNA, 20 nt, Artificial Sequence
  MKO10047126_A_Scamp1
  gRNA
ucaugcuaccgugcgagagu

SEQ ID NO: 47127 - RNA, 20 nt, Artificial Sequence
  MKO10047127_A_Scamp1
  gRNA
ugaagcuuauguacuaccua

SEQ ID NO: 47128 - RNA, 20 nt, Artificial Sequence
  MKO10047128_A_Scamp1
  gRNA
cccuuucuccgacucucgca

SEQ ID NO: 47129 - RNA, 20 nt, Artificial Sequence
  MKO10047129_A_Scamp2
  gRNA
aaagcaucuugcaaauccgc

SEQ ID NO: 47130 - RNA, 20 nt, Artificial Sequence
  MKO10047130_A_Scamp2
  gRNA
ggcaggcuugcuucgacagc

SEQ ID NO: 47131 - RNA, 20 nt, Artificial Sequence
  MKO10047131_A_Scamp2
  gRNA
agaucccugcugacuaccag

SEQ ID NO: 47132 - RNA, 20 nt, Artificial Sequence
  MKO10047132_A_Scamp3
  gRNA
ggaacucaaccgcaaggcag

SEQ ID NO: 47133 - RNA, 20 nt, Artificial Sequence
  MKO10047133_A_Scamp3
  gRNA
cagccagcaguaugccacgc

SEQ ID NO: 47134 - RNA, 20 nt, Artificial Sequence
  MKO10047134_A_Scamp3
  gRNA
cguccagcguggcauacugc

SEQ ID NO: 47135 - RNA, 20 nt, Artificial Sequence
  MKO10047135_A_Scamp4
  gRNA
acucaccuucacgauaguga

SEQ ID NO: 47136 - RNA, 20 nt, Artificial Sequence
  MKO10047136_A_Scamp4
  gRNA
uaccggaaggccuuguaugc

SEQ ID NO: 47137 - RNA, 20 nt, Artificial Sequence
  MKO10047137_A_Scamp4
  gRNA
agcuccgcccgcaauccacc

SEQ ID NO: 47138 - RNA, 20 nt, Artificial Sequence
  MKO10047138_A_Scamp5
  gRNA
gccgauguucgucccgaaga

SEQ ID NO: 47139 - RNA, 20 nt, Artificial Sequence
  MKO10047139_A_Scamp5
  gRNA
gacgaacaucggcucagcag

SEQ ID NO: 47140 - RNA, 20 nt, Artificial Sequence
  MKO10047140_A_Scamp5
  gRNA
accuggugggcugucucgcg

SEQ ID NO: 47141 - RNA, 20 nt, Artificial Sequence
  MKO10047141_A_Scand1
  gRNA
cgacggggccgcacagucgc

SEQ ID NO: 47142 - RNA, 20 nt, Artificial Sequence
  MKO10047142_A_Scand1
  gRNA
gcggccccgucgcccgauuc

SEQ ID NO: 47143 - RNA, 20 nt, Artificial Sequence
  MKO10047143_A_Scand1
  gRNA
agcgaaacugccggaagcgc

SEQ ID NO: 47144 - RNA, 20 nt, Artificial Sequence
  MKO10047144_A_Scaper
  gRNA
uugacuuaagagcucgcuac

SEQ ID NO: 47145 - RNA, 20 nt, Artificial Sequence
  MKO10047145_A_Scaper
  gRNA
ccgcaagaaacuugauagcu

SEQ ID NO: 47146 - RNA, 20 nt, Artificial Sequence
  MKO10047146_A_Scaper
  gRNA
auuucaaagcauugauugac

SEQ ID NO: 47147 - RNA, 20 nt, Artificial Sequence
  MKO10047147_A_Scap
  gRNA
aauuccacaggucccguucc

SEQ ID NO: 47148 - RNA, 20 nt, Artificial Sequence
  MKO10047148_A_Scap
  gRNA
cggagccuacuucccgaaca

SEQ ID NO: 47149 - RNA, 20 nt, Artificial Sequence
  MKO10047149_A_Scap
  gRNA
caugccgacccugacaucau

SEQ ID NO: 47150 - RNA, 20 nt, Artificial Sequence
  MKO10047150_A_Scara3
  gRNA
aagacagccgcacgucgucc

SEQ ID NO: 47151 - RNA, 20 nt, Artificial Sequence
  MKO10047151_A_Scara3
  gRNA
cauugcgaaggauuucuccg

SEQ ID NO: 47152 - RNA, 20 nt, Artificial Sequence
  MKO10047152_A_Scara3
  gRNA
auccuucccaugcacccaag

SEQ ID NO: 47153 - RNA, 20 nt, Artificial Sequence
  MKO10047153_A_Scara5
  gRNA
gcgcagacacucgccguaug

SEQ ID NO: 47154 - RNA, 20 nt, Artificial Sequence
  MKO10047154_A_Scara5
  gRNA
gggccaacaacgagucuguc

SEQ ID NO: 47155 - RNA, 20 nt, Artificial Sequence
  MKO10047155_A_Scara5
  gRNA
accgugagugaccgugacaa

SEQ ID NO: 47156 - RNA, 20 nt, Artificial Sequence
  MKO10047156_A_Scarb1
  gRNA
acaggcugcucgggucuaug

SEQ ID NO: 47157 - RNA, 20 nt, Artificial Sequence
  MKO10047157_A_Scarb1
  gRNA
aagccaguaguccgggagcg

SEQ ID NO: 47158 - RNA, 20 nt, Artificial Sequence
  MKO10047158_A_Scarb1
  gRNA
cguguugagaaaaugcacga

SEQ ID NO: 47159 - RNA, 20 nt, Artificial Sequence
  MKO10047159_A_Scarb2
  gRNA
guucuaaucaagucaacguu

SEQ ID NO: 47160 - RNA, 20 nt, Artificial Sequence
  MKO10047160_A_Scarb2
  gRNA
ccgaaauucggggagacguc

SEQ ID NO: 47161 - RNA, 20 nt, Artificial Sequence
  MKO10047161_A_Scarb2
  gRNA
ccugacgucuccccgaauuu

SEQ ID NO: 47162 - RNA, 20 nt, Artificial Sequence
  MKO10047162_A_Scarf1
  gRNA
cuggcaugggcgacgacacg

SEQ ID NO: 47163 - RNA, 20 nt, Artificial Sequence
  MKO10047163_A_Scarf1
  gRNA
gugcccaguuuccgcuugac

SEQ ID NO: 47164 - RNA, 20 nt, Artificial Sequence
  MKO10047164_A_Scarf1
  gRNA
ucuuugggucgcacuguccg

SEQ ID NO: 47165 - RNA, 20 nt, Artificial Sequence
  MKO10047165_A_Scarf2
  gRNA
ugucgcgagccaugccccgc

SEQ ID NO: 47166 - RNA, 20 nt, Artificial Sequence
  MKO10047166_A_Scarf2
  gRNA
guacgugucacgcgcgccgc

SEQ ID NO: 47167 - RNA, 20 nt, Artificial Sequence
  MKO10047167_A_Scarf2
  gRNA
cagccgugcacgguagucga

SEQ ID NO: 47168 - RNA, 20 nt, Artificial Sequence
  MKO10047168_A_Sccpdh
  gRNA
uuaccgguccuacgcaguug

SEQ ID NO: 47169 - RNA, 20 nt, Artificial Sequence
  MKO10047169_A_Sccpdh
  gRNA
auuaccguucaucugguucc

SEQ ID NO: 47170 - RNA, 20 nt, Artificial Sequence
  MKO10047170_A_Sccpdh
  gRNA
uauagcacuccuagaucugc

SEQ ID NO: 47171 - RNA, 20 nt, Artificial Sequence
  MKO10047171_A_Scd1
  gRNA
caccuucuugcgauacacuc

SEQ ID NO: 47172 - RNA, 20 nt, Artificial Sequence
  MKO10047172_A_Scd1
  gRNA
gugacuuacccacggcaccc

SEQ ID NO: 47173 - RNA, 20 nt, Artificial Sequence
  MKO10047173_A_Scd1
  gRNA
uauucacgaccccaccuauc

SEQ ID NO: 47174 - RNA, 20 nt, Artificial Sequence
  MKO10047174_A_Scd2
  gRNA
caccuucuugcgauacgccg

SEQ ID NO: 47175 - RNA, 20 nt, Artificial Sequence
  MKO10047175_A_Scd2
  gRNA
guacuauguaaucagcgccc

SEQ ID NO: 47176 - RNA, 20 nt, Artificial Sequence
  MKO10047176_A_Scd2
  gRNA
agagcuaauguucuugucgu

SEQ ID NO: 47177 - RNA, 20 nt, Artificial Sequence
  MKO10047177_A_Scd3
  gRNA
acgauaagaacaucgauccc

SEQ ID NO: 47178 - RNA, 20 nt, Artificial Sequence
  MKO10047178_A_Scd3
  gRNA
gggaucgauguucuuaucgu

SEQ ID NO: 47179 - RNA, 20 nt, Artificial Sequence
  MKO10047179_A_Scd3
  gRNA
aagguacuuaccgaagaggc

SEQ ID NO: 47180 - RNA, 20 nt, Artificial Sequence
  MKO10047180_A_Scd4
  gRNA
gcuccacaagcgaugcgcuc

SEQ ID NO: 47181 - RNA, 20 nt, Artificial Sequence
  MKO10047181_A_Scd4
  gRNA
uaugcgucucgaauuuccug

SEQ ID NO: 47182 - RNA, 20 nt, Artificial Sequence
  MKO10047182_A_Scd4
  gRNA
ucccguugaagaucuccagc

SEQ ID NO: 47183 - RNA, 20 nt, Artificial Sequence
  MKO10047183_A_Scel
  gRNA
acuuacgucuugguugauug

SEQ ID NO: 47184 - RNA, 20 nt, Artificial Sequence
  MKO10047184_A_Scel
  gRNA
gcacaacucccaugaugccu

SEQ ID NO: 47185 - RNA, 20 nt, Artificial Sequence
  MKO10047185_A_Scel
  gRNA
agccaaaagccacaauuagc

SEQ ID NO: 47186 - RNA, 20 nt, Artificial Sequence
  MKO10047186_A_Scfd1
  gRNA
agacauugcgaaugcagcau

SEQ ID NO: 47187 - RNA, 20 nt, Artificial Sequence
  MKO10047187_A_Scfd1
  gRNA
gaucucggucugagugcaaa

SEQ ID NO: 47188 - RNA, 20 nt, Artificial Sequence
  MKO10047188_A_Scfd1
  gRNA
agaagccuuaccuuccauac

SEQ ID NO: 47189 - RNA, 20 nt, Artificial Sequence
  MKO10047189_A_Scfd2
  gRNA
ccacgacgugauggucaaca

SEQ ID NO: 47190 - RNA, 20 nt, Artificial Sequence
  MKO10047190_A_Scfd2
  gRNA
ccauguugaccaucacgucg

SEQ ID NO: 47191 - RNA, 20 nt, Artificial Sequence
  MKO10047191_A_Scfd2
  gRNA
cuguagcgaugacccgacug

SEQ ID NO: 47192 - RNA, 20 nt, Artificial Sequence
  MKO10047192_A_Scg2
  gRNA
cgucaacccucucacgcuuc

SEQ ID NO: 47193 - RNA, 20 nt, Artificial Sequence
  MKO10047193_A_Scg2
  gRNA
ggauaauacucgaggcucug

SEQ ID NO: 47194 - RNA, 20 nt, Artificial Sequence
  MKO10047194_A_Scg2
  gRNA
cauugccuaugaagaugucg

SEQ ID NO: 47195 - RNA, 20 nt, Artificial Sequence
  MKO10047195_A_Scg3
  gRNA
gaguacgauuccaccaagag

SEQ ID NO: 47196 - RNA, 20 nt, Artificial Sequence
  MKO10047196_A_Scg3
  gRNA
uccaguugaugaaggccguc

SEQ ID NO: 47197 - RNA, 20 nt, Artificial Sequence
  MKO10047197_A_Scg3
  gRNA
gucguucuccucauaaaucc

SEQ ID NO: 47198 - RNA, 20 nt, Artificial Sequence
  MKO10047198_A_Scg5
  gRNA
gauccagaacaugacuaccc

SEQ ID NO: 47199 - RNA, 20 nt, Artificial Sequence
  MKO10047199_A_Scg5
  gRNA
cgcugcagggggagcucacg

SEQ ID NO: 47200 - RNA, 20 nt, Artificial Sequence
  MKO10047200_A_Scg5
  gRNA
agugucaaucccuaucuaca

SEQ ID NO: 47201 - RNA, 20 nt, Artificial Sequence
  MKO10047201_A_Scgb1a1
  gRNA
gaucgccaucacaaucacug

SEQ ID NO: 47202 - RNA, 20 nt, Artificial Sequence
  MKO10047202_A_Scgb1a1
  gRNA
gagcuucaugauguuuaucc

SEQ ID NO: 47203 - RNA, 20 nt, Artificial Sequence
  MKO10047203_A_Scgb1a1
  gRNA
gcuucuucggacaucugccc

SEQ ID NO: 47204 - RNA, 20 nt, Artificial Sequence
  MKO10047204_A_Scgb1b19
  gRNA
caaagaugacccuguaguac

SEQ ID NO: 47205 - RNA, 20 nt, Artificial Sequence
  MKO10047205_A_Scgb1b19
  gRNA
ugucaauagcaccuugacag

SEQ ID NO: 47206 - RNA, 20 nt, Artificial Sequence
  MKO10047206_A_Scgb1b19
  gRNA
accaaccucccccugaaguc

SEQ ID NO: 47207 - RNA, 20 nt, Artificial Sequence
  MKO10047207_A_Scgb1b20
  gRNA
aauuguagccaucaacauau

SEQ ID NO: 47208 - RNA, 20 nt, Artificial Sequence
  MKO10047208_A_Scgb1b20
  gRNA
gccuugcuccuccugacuuc

SEQ ID NO: 47209 - RNA, 20 nt, Artificial Sequence
  MKO10047209_A_Scgb1b20
  gRNA
accaaccucccccugaaguc

SEQ ID NO: 47210 - RNA, 20 nt, Artificial Sequence
  MKO10047210_A_Scgb1b24
  gRNA
agaugcaaacaucaacaugc

SEQ ID NO: 47211 - RNA, 20 nt, Artificial Sequence
  MKO10047211_A_Scgb1b24
  gRNA
acccacauaccccugaaugc

SEQ ID NO: 47212 - RNA, 20 nt, Artificial Sequence
  MKO10047212_A_Scgb1b24
  gRNA
auguucaucuauucuuucac

SEQ ID NO: 47213 - RNA, 20 nt, Artificial Sequence
  MKO10047213_A_Scgb1b27
  gRNA
acacaccucccucugaaauc

SEQ ID NO: 47214 - RNA, 20 nt, Artificial Sequence
  MKO10047214_A_Scgb1b27
  gRNA
caaugaaaacacuaaaguac

SEQ ID NO: 47215 - RNA, 20 nt, Artificial Sequence
  MKO10047215_A_Scgb1b27
  gRNA
agaauaaaauaacagccagc

SEQ ID NO: 47216 - RNA, 20 nt, Artificial Sequence
  MKO10047216_A_Scgb1b29
  gRNA
accaaccuccuccugaaguc

SEQ ID NO: 47217 - RNA, 20 nt, Artificial Sequence
  MKO10047217_A_Scgb1b29
  gRNA
accauuaucaugaagcuugc

SEQ ID NO: 47218 - RNA, 20 nt, Artificial Sequence
  MKO10047218_A_Scgb1b29
  gRNA
uaucuugucuuccucuguca

SEQ ID NO: 47219 - RNA, 20 nt, Artificial Sequence
  MKO10047219_A_Scgb1b2
  gRNA
aacucaagauaugugucgau

SEQ ID NO: 47220 - RNA, 20 nt, Artificial Sequence
  MKO10047220_A_Scgb1b2
  gRNA
agaagaguauguuaauuaug

SEQ ID NO: 47221 - RNA, 20 nt, Artificial Sequence
  MKO10047221_A_Scgb1b2
  gRNA
acccugcuccuccuaacuuc

SEQ ID NO: 47222 - RNA, 20 nt, Artificial Sequence
  MKO10047222_A_Scgb1b30
  gRNA
ggccgaggaagacaagacgc

SEQ ID NO: 47223 - RNA, 20 nt, Artificial Sequence
  MKO10047223_A_Scgb1b30
  gRNA
caauaaugacccucucguac

SEQ ID NO: 47224 - RNA, 20 nt, Artificial Sequence
  MKO10047224_A_Scgb1b30
  gRNA
gauguacccaucaacaugac

SEQ ID NO: 47225 - RNA, 20 nt, Artificial Sequence
  MKO10047225_A_Scgb1b3
  gRNA
cacagcaccagcaagcuuca

SEQ ID NO: 47226 - RNA, 20 nt, Artificial Sequence
  MKO10047226_A_Scgb1b3
  gRNA
acuacuaccaugaagcuugc

SEQ ID NO: 47227 - RNA, 20 nt, Artificial Sequence
  MKO10047227_A_Scgb1b3
  gRNA
cauuugcccagcuauaaaag

SEQ ID NO: 47228 - RNA, 20 nt, Artificial Sequence
  MKO10047228_A_Scgb1b7
  gRNA
accaaccuccuccugaaguc

SEQ ID NO: 47229 - RNA, 20 nt, Artificial Sequence
  MKO10047229_A_Scgb1b7
  gRNA
accauuaucaugaagcuugc

SEQ ID NO: 47230 - RNA, 20 nt, Artificial Sequence
  MKO10047230_A_Scgb1b7
  gRNA
uaucuugucuuccucuguca

SEQ ID NO: 47231 - RNA, 20 nt, Artificial Sequence
  MKO10047231_A_Scgb1c1
  gRNA
accccggaagaacucuacga

SEQ ID NO: 47232 - RNA, 20 nt, Artificial Sequence
  MKO10047232_A_Scgb1c1
  gRNA
gagcucgcucagcgcugacu

SEQ ID NO: 47233 - RNA, 20 nt, Artificial Sequence
  MKO10047233_A_Scgb1c1
  gRNA
agggagcagcgcucuucugc

SEQ ID NO: 47234 - RNA, 20 nt, Artificial Sequence
  MKO10047234_A_Scgb2b12
  gRNA
cuugcauagacuucgaagaa

SEQ ID NO: 47235 - RNA, 20 nt, Artificial Sequence
  MKO10047235_A_Scgb2b12
  gRNA
ugucaagacuauaguaugac

SEQ ID NO: 47236 - RNA, 20 nt, Artificial Sequence
  MKO10047236_A_Scgb2b12
  gRNA
aagauuaagaaauauacuuc

SEQ ID NO: 47237 - RNA, 20 nt, Artificial Sequence
  MKO10047237_A_Scgb2b15
  gRNA
caugaaagggacccuucugc

SEQ ID NO: 47238 - RNA, 20 nt, Artificial Sequence
  MKO10047238_A_Scgb2b15
  gRNA
caguucuccagucaccagca

SEQ ID NO: 47239 - RNA, 20 nt, Artificial Sequence
  MKO10047239_A_Scgb2b15
  gRNA
gucuaugcaaguguucucuc

SEQ ID NO: 47240 - RNA, 20 nt, Artificial Sequence
  MKO10047240_A_Scgb2b17
  gRNA
caugaaagggacccuucugc

SEQ ID NO: 47241 - RNA, 20 nt, Artificial Sequence
  MKO10047241_A_Scgb2b17
  gRNA
caguucuccagucaccagca

SEQ ID NO: 47242 - RNA, 20 nt, Artificial Sequence
  MKO10047242_A_Scgb2b17
  gRNA
gucuaugcaaguguucucuc

SEQ ID NO: 47243 - RNA, 20 nt, Artificial Sequence
  MKO10047243_A_Scgb2b19
  gRNA
gcauguguuccuuucuucga

SEQ ID NO: 47244 - RNA, 20 nt, Artificial Sequence
  MKO10047244_A_Scgb2b19
  gRNA
caaguguugucucaggaagu

SEQ ID NO: 47245 - RNA, 20 nt, Artificial Sequence
  MKO10047245_A_Scgb2b19
  gRNA
uuuagcacucuucaccauga

SEQ ID NO: 47246 - RNA, 20 nt, Artificial Sequence
  MKO10047246_A_Scgb2b20
  gRNA
aauucaggacugcuacagug

SEQ ID NO: 47247 - RNA, 20 nt, Artificial Sequence
  MKO10047247_A_Scgb2b20
  gRNA
gcaugucuuccuuucuucga

SEQ ID NO: 47248 - RNA, 20 nt, Artificial Sequence
  MKO10047248_A_Scgb2b20
  gRNA
gaaggggacacuucuucugc

SEQ ID NO: 47249 - RNA, 20 nt, Artificial Sequence
  MKO10047249_A_Scgb2b24
  gRNA
uuucuucggaauaguacugc

SEQ ID NO: 47250 - RNA, 20 nt, Artificial Sequence
  MKO10047250_A_Scgb2b24
  gRNA
caugaacuuagcgcauucaa

SEQ ID NO: 47251 - RNA, 20 nt, Artificial Sequence
  MKO10047251_A_Scgb2b24
  gRNA
agaaaccuuuacgaaaauua

SEQ ID NO: 47252 - RNA, 20 nt, Artificial Sequence
  MKO10047252_A_Scgb2b26
  gRNA
aaguauugcuccguaaguuc

SEQ ID NO: 47253 - RNA, 20 nt, Artificial Sequence
  MKO10047253_A_Scgb2b26
  gRNA
cuaaggaggaccuuccugca

SEQ ID NO: 47254 - RNA, 20 nt, Artificial Sequence
  MKO10047254_A_Scgb2b26
  gRNA
ccauaguauuucuugcauuc

SEQ ID NO: 47255 - RNA, 20 nt, Artificial Sequence
  MKO10047255_A_Scgb2b27
  gRNA
caguagcuugaaacaucgaa

SEQ ID NO: 47256 - RNA, 20 nt, Artificial Sequence
  MKO10047256_A_Scgb2b27
  gRNA
gaggacguuaccauuauuug

SEQ ID NO: 47257 - RNA, 20 nt, Artificial Sequence
  MKO10047257_A_Scgb2b27
  gRNA
acucuucagcucugaaugca

SEQ ID NO: 47258 - RNA, 20 nt, Artificial Sequence
  MKO10047258_A_Scgb2b2
  gRNA
cccaaauauacgccgaagaa

SEQ ID NO: 47259 - RNA, 20 nt, Artificial Sequence
  MKO10047259_A_Scgb2b2
  gRNA
ugcuccauuugauccuacug

SEQ ID NO: 47260 - RNA, 20 nt, Artificial Sequence
  MKO10047260_A_Scgb2b2
  gRNA
guauaacccauuaacuucua

SEQ ID NO: 47261 - RNA, 20 nt, Artificial Sequence
  MKO10047261_A_Scgb2b3
  gRNA
gucuauuugagcacugucuc

SEQ ID NO: 47262 - RNA, 20 nt, Artificial Sequence
  MKO10047262_A_Scgb2b3
  gRNA
ucuuauuucaacccuacuga

SEQ ID NO: 47263 - RNA, 20 nt, Artificial Sequence
  MKO10047263_A_Scgb2b3
  gRNA
agccaagcucuccaaucacc

SEQ ID NO: 47264 - RNA, 20 nt, Artificial Sequence
  MKO10047264_A_Scgb2b7
  gRNA
uuuccucacuguagcagucc

SEQ ID NO: 47265 - RNA, 20 nt, Artificial Sequence
  MKO10047265_A_Scgb2b7
  gRNA
uccugagagaacacuugcau

SEQ ID NO: 47266 - RNA, 20 nt, Artificial Sequence
  MKO10047266_A_Scgb2b7
  gRNA
gaaggggacacuucuucugc

SEQ ID NO: 47267 - RNA, 20 nt, Artificial Sequence
  MKO10047267_A_Scgb3a1
  gRNA
gcggccacggguucuaccgc

SEQ ID NO: 47268 - RNA, 20 nt, Artificial Sequence
  MKO10047268_A_Scgb3a1
  gRNA
caagccugcgguagaacccg

SEQ ID NO: 47269 - RNA, 20 nt, Artificial Sequence
  MKO10047269_A_Scgb3a1
  gRNA
ccccucaaccgaacauuguc

SEQ ID NO: 47270 - RNA, 20 nt, Artificial Sequence
  MKO10047270_A_Scgb3a2
  gRNA
gagggaauaaugucguccaa

SEQ ID NO: 47271 - RNA, 20 nt, Artificial Sequence
  MKO10047271_A_Scgb3a2
  gRNA
cuaggaggcucuuucacacc

SEQ ID NO: 47272 - RNA, 20 nt, Artificial Sequence
  MKO10047272_A_Scgb3a2
  gRNA
gaagaaguguguggacgagc

SEQ ID NO: 47273 - RNA, 20 nt, Artificial Sequence
  MKO10047273_A_Scgn
  gRNA
gauuuggcgcaaauacgaug

SEQ ID NO: 47274 - RNA, 20 nt, Artificial Sequence
  MKO10047274_A_Scgn
  gRNA
aggccgcauacugaugaaag

SEQ ID NO: 47275 - RNA, 20 nt, Artificial Sequence
  MKO10047275_A_Scgn
  gRNA
gaccagccacaacgucucua

SEQ ID NO: 47276 - RNA, 20 nt, Artificial Sequence
  MKO10047276_A_Schip1
  gRNA
aguugugucucuauccgaau

SEQ ID NO: 47277 - RNA, 20 nt, Artificial Sequence
  MKO10047277_A_Schip1
  gRNA
gcccgauagucaugucucuc

SEQ ID NO: 47278 - RNA, 20 nt, Artificial Sequence
  MKO10047278_A_Schip1
  gRNA
cccccacuuacuuucaaucu

SEQ ID NO: 47279 - RNA, 20 nt, Artificial Sequence
  MKO10047279_A_Scimp
  gRNA
cccacuucagcuugccaaaa

SEQ ID NO: 47280 - RNA, 20 nt, Artificial Sequence
  MKO10047280_A_Scimp
  gRNA
aauugcuaagcccucaaaac

SEQ ID NO: 47281 - RNA, 20 nt, Artificial Sequence
  MKO10047281_A_Scimp
  gRNA
cacugaugaguaccaagcug

SEQ ID NO: 47282 - RNA, 20 nt, Artificial Sequence
  MKO10047282_A_Scin
  gRNA
cacccaaauagucguccauc

SEQ ID NO: 47283 - RNA, 20 nt, Artificial Sequence
  MKO10047283_A_Scin
  gRNA
caccccgaguucgcgcgcgc

SEQ ID NO: 47284 - RNA, 20 nt, Artificial Sequence
  MKO10047284_A_Scin
  gRNA
uccgacguaaaagucaccau

SEQ ID NO: 47285 - RNA, 20 nt, Artificial Sequence
  MKO10047285_A_Sclt1
  gRNA
auuccacauaccugcauagu

SEQ ID NO: 47286 - RNA, 20 nt, Artificial Sequence
  MKO10047286_A_Sclt1
  gRNA
caggcagcugaccuauuacc

SEQ ID NO: 47287 - RNA, 20 nt, Artificial Sequence
  MKO10047287_A_Sclt1
  gRNA
uucucauacucagcaaugag

SEQ ID NO: 47288 - RNA, 20 nt, Artificial Sequence
  MKO10047288_A_Scly
  gRNA
uaaugagaccggcgucauca

SEQ ID NO: 47289 - RNA, 20 nt, Artificial Sequence
  MKO10047289_A_Scly
  gRNA
ugcccauucaccuucgacac

SEQ ID NO: 47290 - RNA, 20 nt, Artificial Sequence
  MKO10047290_A_Scly
  gRNA
aaaugcagcucgagcgagcc

SEQ ID NO: 47291 - RNA, 20 nt, Artificial Sequence
  MKO10047291_A_Scmh1
  gRNA
cgacuucgucugcgccuuga

SEQ ID NO: 47292 - RNA, 20 nt, Artificial Sequence
  MKO10047292_A_Scmh1
  gRNA
accugucaauccaacgaccg

SEQ ID NO: 47293 - RNA, 20 nt, Artificial Sequence
  MKO10047293_A_Scmh1
  gRNA
accuagaggugaccccauga

SEQ ID NO: 47294 - RNA, 20 nt, Artificial Sequence
  MKO10047294_A_Scml2
  gRNA
agccagguuacgucuacgac

SEQ ID NO: 47295 - RNA, 20 nt, Artificial Sequence
  MKO10047295_A_Scml2
  gRNA
cacaccgaaucaauauugcg

SEQ ID NO: 47296 - RNA, 20 nt, Artificial Sequence
  MKO10047296_A_Scml2
  gRNA
uucuuacuacguguacuaac

SEQ ID NO: 47297 - RNA, 20 nt, Artificial Sequence
  MKO10047297_A_Scml4
  gRNA
uaccgaggcgagcugguguc

SEQ ID NO: 47298 - RNA, 20 nt, Artificial Sequence
  MKO10047298_A_Scml4
  gRNA
ucgauugugcgcaccagccu

SEQ ID NO: 47299 - RNA, 20 nt, Artificial Sequence
  MKO10047299_A_Scml4
  gRNA
gagcaucggcgccucugaca

SEQ ID NO: 47300 - RNA, 20 nt, Artificial Sequence
  MKO10047300_A_Scn10a
  gRNA
ugagaacucggaauguccgc

SEQ ID NO: 47301 - RNA, 20 nt, Artificial Sequence
  MKO10047301_A_Scn10a
  gRNA
ugcggacauuccgaguucuc

SEQ ID NO: 47302 - RNA, 20 nt, Artificial Sequence
  MKO10047302_A_Scn10a
  gRNA
cgaguggacggacacuuuga

SEQ ID NO: 47303 - RNA, 20 nt, Artificial Sequence
  MKO10047303_A_Scn11a
  gRNA
ucuaucgcuucagcgccaag

SEQ ID NO: 47304 - RNA, 20 nt, Artificial Sequence
  MKO10047304_A_Scn11a
  gRNA
cuuuguagauacgucuucau

SEQ ID NO: 47305 - RNA, 20 nt, Artificial Sequence
  MKO10047305_A_Scn11a
  gRNA
gcgaaucaugaagcuucuga

SEQ ID NO: 47306 - RNA, 20 nt, Artificial Sequence
  MKO10047306_A_Scn1a
  gRNA
uuacuuuccuucgcgaccca

SEQ ID NO: 47307 - RNA, 20 nt, Artificial Sequence
  MKO10047307_A_Scn1a
  gRNA
caaugaguaacccucccgac

SEQ ID NO: 47308 - RNA, 20 nt, Artificial Sequence
  MKO10047308_A_Scn1a
  gRNA
uaacacccuucaauccucuu

SEQ ID NO: 47309 - RNA, 20 nt, Artificial Sequence
  MKO10047309_A_Scn1b
  gRNA
ggagguggauuccgauaccg

SEQ ID NO: 47310 - RNA, 20 nt, Artificial Sequence
  MKO10047310_A_Scn1b
  gRNA
ggucucacuacgacgcuuac

SEQ ID NO: 47311 - RNA, 20 nt, Artificial Sequence
  MKO10047311_A_Scn1b
  gRNA
cgucgucaagaagauccacc

SEQ ID NO: 47312 - RNA, 20 nt, Artificial Sequence
  MKO10047312_A_Scn2a1
  gRNA
cauggucauaaauacacagu

SEQ ID NO: 47313 - RNA, 20 nt, Artificial Sequence
  MKO10047313_A_Scn2a1
  gRNA
ccaugagcaacccuccagac

SEQ ID NO: 47314 - RNA, 20 nt, Artificial Sequence
  MKO10047314_A_Scn2a1
  gRNA
uagaagauuucacauuucua

SEQ ID NO: 47315 - RNA, 20 nt, Artificial Sequence
  MKO10047315_A_Scn2b
  gRNA
ggcggguaucggacccauug

SEQ ID NO: 47316 - RNA, 20 nt, Artificial Sequence
  MKO10047316_A_Scn2b
  gRNA
cacugacacgucguacuuac

SEQ ID NO: 47317 - RNA, 20 nt, Artificial Sequence
  MKO10047317_A_Scn2b
  gRNA
acccacgaugaccgccaccg

SEQ ID NO: 47318 - RNA, 20 nt, Artificial Sequence
  MKO10047318_A_Scn3a
  gRNA
uaacuccacuaaaccccguu

SEQ ID NO: 47319 - RNA, 20 nt, Artificial Sequence
  MKO10047319_A_Scn3a
  gRNA
cauugagcaauccuccugac

SEQ ID NO: 47320 - RNA, 20 nt, Artificial Sequence
  MKO10047320_A_Scn3a
  gRNA
ugagucacuuauaaagaucu

SEQ ID NO: 47321 - RNA, 20 nt, Artificial Sequence
  MKO10047321_A_Scn3b
  gRNA
aggaaaucuuuaccgcccuc

SEQ ID NO: 47322 - RNA, 20 nt, Artificial Sequence
  MKO10047322_A_Scn3b
  gRNA
cagauauaugaguaucgaaa

SEQ ID NO: 47323 - RNA, 20 nt, Artificial Sequence
  MKO10047323_A_Scn3b
  gRNA
gaacucugugguacccgugg

SEQ ID NO: 47324 - RNA, 20 nt, Artificial Sequence
  MKO10047324_A_Scn4a
  gRNA
acacacuuacuccacguccu

SEQ ID NO: 47325 - RNA, 20 nt, Artificial Sequence
  MKO10047325_A_Scn4a
  gRNA
ccaugagcaacccgccuucu

SEQ ID NO: 47326 - RNA, 20 nt, Artificial Sequence
  MKO10047326_A_Scn4a
  gRNA
aauaccugggaugaccguga

SEQ ID NO: 47327 - RNA, 20 nt, Artificial Sequence
  MKO10047327_A_Scn4b
  gRNA
accaccaucuacgcuauuaa

SEQ ID NO: 47328 - RNA, 20 nt, Artificial Sequence
  MKO10047328_A_Scn4b
  gRNA
ugagccguuaauagcguaga

SEQ ID NO: 47329 - RNA, 20 nt, Artificial Sequence
  MKO10047329_A_Scn4b
  gRNA
gcagauacaccugcuucgug

SEQ ID NO: 47330 - RNA, 20 nt, Artificial Sequence
  MKO10047330_A_Scn5a
  gRNA
cacaacacgacccuccgccu

SEQ ID NO: 47331 - RNA, 20 nt, Artificial Sequence
  MKO10047331_A_Scn5a
  gRNA
uucagccaugcgcuucucga

SEQ ID NO: 47332 - RNA, 20 nt, Artificial Sequence
  MKO10047332_A_Scn5a
  gRNA
gcccuuauucagcacgauga

SEQ ID NO: 47333 - RNA, 20 nt, Artificial Sequence
  MKO10047333_A_Scn7a
  gRNA
ucuauugccaauauccauuc

SEQ ID NO: 47334 - RNA, 20 nt, Artificial Sequence
  MKO10047334_A_Scn7a
  gRNA
aagauuaucccuuugaacca

SEQ ID NO: 47335 - RNA, 20 nt, Artificial Sequence
  MKO10047335_A_Scn7a
  gRNA
gcaugaguaaucuaccagaa

SEQ ID NO: 47336 - RNA, 20 nt, Artificial Sequence
  MKO10047336_A_Scn8a
  gRNA
ccuccaggggaaccgcaacc

SEQ ID NO: 47337 - RNA, 20 nt, Artificial Sequence
  MKO10047337_A_Scn8a
  gRNA
gccuuucacccccgagucgc

SEQ ID NO: 47338 - RNA, 20 nt, Artificial Sequence
  MKO10047338_A_Scn8a
  gRNA
ucaccuucuuacgagacccg

SEQ ID NO: 47339 - RNA, 20 nt, Artificial Sequence
  MKO10047339_A_Scn9a
  gRNA
ccacgcaaaagccucuugca

SEQ ID NO: 47340 - RNA, 20 nt, Artificial Sequence
  MKO10047340_A_Scn9a
  gRNA
ucaccuuccuccgugacccu

SEQ ID NO: 47341 - RNA, 20 nt, Artificial Sequence
  MKO10047341_A_Scn9a
  gRNA
ggagacagcauguacaaagc

SEQ ID NO: 47342 - RNA, 20 nt, Artificial Sequence
  MKO10047342_A_Scnm1
  gRNA
ucgaccaguacuagacacgc

SEQ ID NO: 47343 - RNA, 20 nt, Artificial Sequence
  MKO10047343_A_Scnm1
  gRNA
auggccagcgugucuaguac

SEQ ID NO: 47344 - RNA, 20 nt, Artificial Sequence
  MKO10047344_A_Scnm1
  gRNA
gaggcacugaugcugcggga

SEQ ID NO: 47345 - RNA, 20 nt, Artificial Sequence
  MKO10047345_A_Scnn1a
  gRNA
auuguugucgcguacacugg

SEQ ID NO: 47346 - RNA, 20 nt, Artificial Sequence
  MKO10047346_A_Scnn1a
  gRNA
gccuacucacgccugauugc

SEQ ID NO: 47347 - RNA, 20 nt, Artificial Sequence
  MKO10047347_A_Scnn1a
  gRNA
aaagcgucuguuccgugaug

SEQ ID NO: 47348 - RNA, 20 nt, Artificial Sequence
  MKO10047348_A_Scnn1b
  gRNA
ggcacuggugaaguuccgca

SEQ ID NO: 47349 - RNA, 20 nt, Artificial Sequence
  MKO10047349_A_Scnn1b
  gRNA
aguccuccugaccgaugucc

SEQ ID NO: 47350 - RNA, 20 nt, Artificial Sequence
  MKO10047350_A_Scnn1b
  gRNA
caggguuccgcucaucaaua

SEQ ID NO: 47351 - RNA, 20 nt, Artificial Sequence
  MKO10047351_A_Scnn1g
  gRNA
auacccuuucaucgaagacg

SEQ ID NO: 47352 - RNA, 20 nt, Artificial Sequence
  MKO10047352_A_Scnn1g
  gRNA
cguucaugagucgaagaaac

SEQ ID NO: 47353 - RNA, 20 nt, Artificial Sequence
  MKO10047353_A_Scnn1g
  gRNA
gccuucccacguggaccgca

SEQ ID NO: 47354 - RNA, 20 nt, Artificial Sequence
  MKO10047354_A_Sco1
  gRNA
accuuucacauaagucgcaa

SEQ ID NO: 47355 - RNA, 20 nt, Artificial Sequence
  MKO10047355_A_Sco1
  gRNA
gccauugcgacuuaugugaa

SEQ ID NO: 47356 - RNA, 20 nt, Artificial Sequence
  MKO10047356_A_Sco1
  gRNA
guaauacacccuguaugcuc

SEQ ID NO: 47357 - RNA, 20 nt, Artificial Sequence
  MKO10047357_A_Sco2
  gRNA
uaccgcguauacuacagcgc

SEQ ID NO: 47358 - RNA, 20 nt, Artificial Sequence
  MKO10047358_A_Sco2
  gRNA
uucuugcacauagcgggcca

SEQ ID NO: 47359 - RNA, 20 nt, Artificial Sequence
  MKO10047359_A_Sco2
  gRNA
ugauauuugccccgaugagc

SEQ ID NO: 47360 - RNA, 20 nt, Artificial Sequence
  MKO10047360_A_Scoc
  gRNA
gaacuccaacacacacuuga

SEQ ID NO: 47361 - RNA, 20 nt, Artificial Sequence
  MKO10047361_A_Scoc
  gRNA
ggcauugcucaugagcaaga

SEQ ID NO: 47362 - RNA, 20 nt, Artificial Sequence
  MKO10047362_A_Scoc
  gRNA
cggauugagcacaggggagg

SEQ ID NO: 47363 - RNA, 20 nt, Artificial Sequence
  MKO10047363_A_Scp2d1
  gRNA
ccugcuuugaucuucgcuug

SEQ ID NO: 47364 - RNA, 20 nt, Artificial Sequence
  MKO10047364_A_Scp2d1
  gRNA
ccucaagcgaagaucaaagc

SEQ ID NO: 47365 - RNA, 20 nt, Artificial Sequence
  MKO10047365_A_Scp2d1
  gRNA
augaugaagacgguaucugc

SEQ ID NO: 47366 - RNA, 20 nt, Artificial Sequence
  MKO10047366_A_Scp2
  gRNA
acagaucccuuacuccgcag

SEQ ID NO: 47367 - RNA, 20 nt, Artificial Sequence
  MKO10047367_A_Scp2
  gRNA
gcaugcguuggcuaugugua

SEQ ID NO: 47368 - RNA, 20 nt, Artificial Sequence
  MKO10047368_A_Scp2
  gRNA
auggcccaucaacugauuca

SEQ ID NO: 47369 - RNA, 20 nt, Artificial Sequence
  MKO10047369_A_Scpep1
  gRNA
cguguccagguccuuugcgu

SEQ ID NO: 47370 - RNA, 20 nt, Artificial Sequence
  MKO10047370_A_Scpep1
  gRNA
uguacccagguaguauuucg

SEQ ID NO: 47371 - RNA, 20 nt, Artificial Sequence
  MKO10047371_A_Scpep1
  gRNA
ucaagccucgaaauacuacc

SEQ ID NO: 47372 - RNA, 20 nt, Artificial Sequence
  MKO10047372_A_Scrg1
  gRNA
ucgcaauugucacaaccuuc

SEQ ID NO: 47373 - RNA, 20 nt, Artificial Sequence
  MKO10047373_A_Scrg1
  gRNA
agauccucagugguuguugc

SEQ ID NO: 47374 - RNA, 20 nt, Artificial Sequence
  MKO10047374_A_Scrg1
  gRNA
cuaacagcaaaguuagccca

SEQ ID NO: 47375 - RNA, 20 nt, Artificial Sequence
  MKO10047375_A_Scrib
  gRNA
ccugcagggacacgucauuc

SEQ ID NO: 47376 - RNA, 20 nt, Artificial Sequence
  MKO10047376_A_Scrib
  gRNA
cuucacacagcuacgcagcc

SEQ ID NO: 47377 - RNA, 20 nt, Artificial Sequence
  MKO10047377_A_Scrib
  gRNA
gagcuagaugugucccggaa

SEQ ID NO: 47378 - RNA, 20 nt, Artificial Sequence
  MKO10047378_A_Scrn1
  gRNA
cuucauccagcuuagucgcg

SEQ ID NO: 47379 - RNA, 20 nt, Artificial Sequence
  MKO10047379_A_Scrn1
  gRNA
gucugcuuaucacgauggcg

SEQ ID NO: 47380 - RNA, 20 nt, Artificial Sequence
  MKO10047380_A_Scrn1
  gRNA
uucuccagccgaugaccguu

SEQ ID NO: 47381 - RNA, 20 nt, Artificial Sequence
  MKO10047381_A_Scrn2
  gRNA
cuugcuggaccgcuaugggc

SEQ ID NO: 47382 - RNA, 20 nt, Artificial Sequence
  MKO10047382_A_Scrn2
  gRNA
caccuguuccaccucgauau

SEQ ID NO: 47383 - RNA, 20 nt, Artificial Sequence
  MKO10047383_A_Scrn2
  gRNA
uugugauagcagaacggcuc

SEQ ID NO: 47384 - RNA, 20 nt, Artificial Sequence
  MKO10047384_A_Scrn3
  gRNA
ugaggaacuacgcuaagcag

SEQ ID NO: 47385 - RNA, 20 nt, Artificial Sequence
  MKO10047385_A_Scrn3
  gRNA
ccggucaaucuugguuguua

SEQ ID NO: 47386 - RNA, 20 nt, Artificial Sequence
  MKO10047386_A_Scrn3
  gRNA
aguacuuccccgacgucucc

SEQ ID NO: 47387 - RNA, 20 nt, Artificial Sequence
  MKO10047387_A_Scrt1
  gRNA
ggucuacgauggcgacgcug

SEQ ID NO: 47388 - RNA, 20 nt, Artificial Sequence
  MKO10047388_A_Scrt1
  gRNA
ucgccaucguagaccgacgc

SEQ ID NO: 47389 - RNA, 20 nt, Artificial Sequence
  MKO10047389_A_Scrt1
  gRNA
gucgcacuccgagaucgcug

SEQ ID NO: 47390 - RNA, 20 nt, Artificial Sequence
  MKO10047390_A_Scrt2
  gRNA
gcgcgcaagugcccgacgug

SEQ ID NO: 47391 - RNA, 20 nt, Artificial Sequence
  MKO10047391_A_Scrt2
  gRNA
cgcggaaguagcgcgccgac

SEQ ID NO: 47392 - RNA, 20 nt, Artificial Sequence
  MKO10047392_A_Scrt2
  gRNA
gcccacucaccguugucccc

SEQ ID NO: 47393 - RNA, 20 nt, Artificial Sequence
  MKO10047393_A_Scur
  gRNA
ccuugaugaaccguguacga

SEQ ID NO: 47394 - RNA, 20 nt, Artificial Sequence
  MKO10047394_A_Scur
  gRNA
acgccgcacaucacacaauc

SEQ ID NO: 47395 - RNA, 20 nt, Artificial Sequence
  MKO10047395_A_Scur
  gRNA
accgucugcuccuucguaca

SEQ ID NO: 47396 - RNA, 20 nt, Artificial Sequence
  MKO10047396_A_Scu
  gRNA
cuaagggcuuggaccgggcc

SEQ ID NO: 47397 - RNA, 20 nt, Artificial Sequence
  MKO10047397_A_Scu
  gRNA
cagcgagcucagccgcuugc

SEQ ID NO: 47398 - RNA, 20 nt, Artificial Sequence
  MKO10047398_A_Scu
  gRNA
cugcuguugaucguucagag

SEQ ID NO: 47399 - RNA, 20 nt, Artificial Sequence
  MKO10047399_A_Scube1
  gRNA
accauuggagcgguguaugc

SEQ ID NO: 47400 - RNA, 20 nt, Artificial Sequence
  MKO10047400_A_Scube1
  gRNA
accugcauacaccgcuccaa

SEQ ID NO: 47401 - RNA, 20 nt, Artificial Sequence
  MKO10047401_A_Scube1
  gRNA
ugagcauucauccacgucca

SEQ ID NO: 47402 - RNA, 20 nt, Artificial Sequence
  MKO10047402_A_Scube2
  gRNA
uaucgcugcaccuguuucga

SEQ ID NO: 47403 - RNA, 20 nt, Artificial Sequence
  MKO10047403_A_Scube2
  gRNA
cacaucugcaccaacguuau

SEQ ID NO: 47404 - RNA, 20 nt, Artificial Sequence
  MKO10047404_A_Scube2
  gRNA
caacaugaagccaucgaaac

SEQ ID NO: 47405 - RNA, 20 nt, Artificial Sequence
  MKO10047405_A_Scube3
  gRNA
uaccgguguaccugcuacga

SEQ ID NO: 47406 - RNA, 20 nt, Artificial Sequence
  MKO10047406_A_Scube3
  gRNA
auccgucguagcagguacac

SEQ ID NO: 47407 - RNA, 20 nt, Artificial Sequence
  MKO10047407_A_Scube3
  gRNA
cuucccgucccccguguagc

SEQ ID NO: 47408 - RNA, 20 nt, Artificial Sequence
  MKO10047408_A_Scx
  gRNA
acacagcgaaugcgcgcgag

SEQ ID NO: 47409 - RNA, 20 nt, Artificial Sequence
  MKO10047409_A_Scx
  gRNA
uacagguagcgacccggcgg

SEQ ID NO: 47410 - RNA, 20 nt, Artificial Sequence
  MKO10047410_A_Scx
  gRNA
gaaucgccgucuuucuguca

SEQ ID NO: 47411 - RNA, 20 nt, Artificial Sequence
  MKO10047411_A_Scyl1
  gRNA
ggaucauacugcucgagcuc

SEQ ID NO: 47412 - RNA, 20 nt, Artificial Sequence
  MKO10047412_A_Scyl1
  gRNA
gcucgagcaguaugaucccc

SEQ ID NO: 47413 - RNA, 20 nt, Artificial Sequence
  MKO10047413_A_Scyl1
  gRNA
uaccuccaacccaucgauau

SEQ ID NO: 47414 - RNA, 20 nt, Artificial Sequence
  MKO10047414_A_Scyl2
  gRNA
gucguagucggguuagcugu

SEQ ID NO: 47415 - RNA, 20 nt, Artificial Sequence
  MKO10047415_A_Scyl2
  gRNA
gccagugacauguacucguu

SEQ ID NO: 47416 - RNA, 20 nt, Artificial Sequence
  MKO10047416_A_Scyl2
  gRNA
auguacgccguguuuaauca

SEQ ID NO: 47417 - RNA, 20 nt, Artificial Sequence
  MKO10047417_A_Scyl3
  gRNA
aggcaucccgggcguggccg

SEQ ID NO: 47418 - RNA, 20 nt, Artificial Sequence
  MKO10047418_A_Scyl3
  gRNA
ccgagucccacggccacgcc

SEQ ID NO: 47419 - RNA, 20 nt, Artificial Sequence
  MKO10047419_A_Scyl3
  gRNA
cacucacaaaaacagacgac

SEQ ID NO: 47420 - RNA, 20 nt, Artificial Sequence
  MKO10047420_A_Sdad1
  gRNA
gcaucucaguaacuucccgc

SEQ ID NO: 47421 - RNA, 20 nt, Artificial Sequence
  MKO10047421_A_Sdad1
  gRNA
cuuccuaccaugcggagauc

SEQ ID NO: 47422 - RNA, 20 nt, Artificial Sequence
  MKO10047422_A_Sdad1
  gRNA
gcuggugauguucauggcgc

SEQ ID NO: 47423 - RNA, 20 nt, Artificial Sequence
  MKO10047423_A_Sdc1
  gRNA
auuccgcaggccgggcucua

SEQ ID NO: 47424 - RNA, 20 nt, Artificial Sequence
  MKO10047424_A_Sdc1
  gRNA
acugccaaucagcuucccgc

SEQ ID NO: 47425 - RNA, 20 nt, Artificial Sequence
  MKO10047425_A_Sdc1
  gRNA
ccugcggaaucagcccccgg

SEQ ID NO: 47426 - RNA, 20 nt, Artificial Sequence
  MKO10047426_A_Sdc2
  gRNA
cuuaucucagccgucauugc

SEQ ID NO: 47427 - RNA, 20 nt, Artificial Sequence
  MKO10047427_A_Sdc2
  gRNA
ugccuucugguaagcugcgc

SEQ ID NO: 47428 - RNA, 20 nt, Artificial Sequence
  MKO10047428_A_Sdc2
  gRNA
aacagagcugacauccgaua

SEQ ID NO: 47429 - RNA, 20 nt, Artificial Sequence
  MKO10047429_A_Sdc3
  gRNA
ugaaccgcauggccgucuca

SEQ ID NO: 47430 - RNA, 20 nt, Artificial Sequence
  MKO10047430_A_Sdc3
  gRNA
ccacgacaaugccaucgauu

SEQ ID NO: 47431 - RNA, 20 nt, Artificial Sequence
  MKO10047431_A_Sdc3
  gRNA
uacgucagccacgguagccg

SEQ ID NO: 47432 - RNA, 20 nt, Artificial Sequence
  MKO10047432_A_Sdc4
  gRNA
gccgccagcaucuucgucgu

SEQ ID NO: 47433 - RNA, 20 nt, Artificial Sequence
  MKO10047433_A_Sdc4
  gRNA
caugucaucccccacgucgg

SEQ ID NO: 47434 - RNA, 20 nt, Artificial Sequence
  MKO10047434_A_Sdc4
  gRNA
uaccuuugcagaugacacgg

SEQ ID NO: 47435 - RNA, 20 nt, Artificial Sequence
  MKO10047435_A_Sdcbp2
  gRNA
caagacuggacuucgccugc

SEQ ID NO: 47436 - RNA, 20 nt, Artificial Sequence
  MKO10047436_A_Sdcbp2
  gRNA
ucucugcacgcaguauaccc

SEQ ID NO: 47437 - RNA, 20 nt, Artificial Sequence
  MKO10047437_A_Sdcbp2
  gRNA
agucacagccaucaauuugc

SEQ ID NO: 47438 - RNA, 20 nt, Artificial Sequence
  MKO10047438_A_Sdcbp
  gRNA
ccugugacagguaacgaugc

SEQ ID NO: 47439 - RNA, 20 nt, Artificial Sequence
  MKO10047439_A_Sdcbp
  gRNA
ccagcaucguuaccugucac

SEQ ID NO: 47440 - RNA, 20 nt, Artificial Sequence
  MKO10047440_A_Sdcbp
  gRNA
cgccagccaagcauuuguuc

SEQ ID NO: 47441 - RNA, 20 nt, Artificial Sequence
  MKO10047441_A_Sdccag3
  gRNA
agggcgcgcccccucuaucg

SEQ ID NO: 47442 - RNA, 20 nt, Artificial Sequence
  MKO10047442_A_Sdccag3
  gRNA
cuccgcguccgcgauagagg

SEQ ID NO: 47443 - RNA, 20 nt, Artificial Sequence
  MKO10047443_A_Sdccag3
  gRNA
aaccuacuugccaucugccg

SEQ ID NO: 47444 - RNA, 20 nt, Artificial Sequence
  MKO10047444_A_Sdccag8
  gRNA
cggccgucagaaugugacga

SEQ ID NO: 47445 - RNA, 20 nt, Artificial Sequence
  MKO10047445_A_Sdccag8
  gRNA
ggggacaacuuucgucuucg

SEQ ID NO: 47446 - RNA, 20 nt, Artificial Sequence
  MKO10047446_A_Sdccag8
  gRNA
ugagacuggucguuaaugau

SEQ ID NO: 47447 - RNA, 20 nt, Artificial Sequence
  MKO10047447_A_Sde2
  gRNA
gcauggagccguguacaguu

SEQ ID NO: 47448 - RNA, 20 nt, Artificial Sequence
  MKO10047448_A_Sde2
  gRNA
ccucguuaaugccggugaua

SEQ ID NO: 47449 - RNA, 20 nt, Artificial Sequence
  MKO10047449_A_Sde2
  gRNA
gggucuaugcuucgagcacu

SEQ ID NO: 47450 - RNA, 20 nt, Artificial Sequence
  MKO10047450_A_Sdf2l1
  gRNA
gcgaauccgccaguaacuau

SEQ ID NO: 47451 - RNA, 20 nt, Artificial Sequence
  MKO10047451_A_Sdf2l1
  gRNA
gucgccgcuauccaacaacc

SEQ ID NO: 47452 - RNA, 20 nt, Artificial Sequence
  MKO10047452_A_Sdf2l1
  gRNA
gguagcggggccaacgcugc

SEQ ID NO: 47453 - RNA, 20 nt, Artificial Sequence
  MKO10047453_A_Sdf2
  gRNA
ugucguuacuugcggcuccg

SEQ ID NO: 47454 - RNA, 20 nt, Artificial Sequence
  MKO10047454_A_Sdf2
  gRNA
cgcugugggagcguccaaca

SEQ ID NO: 47455 - RNA, 20 nt, Artificial Sequence
  MKO10047455_A_Sdf2
  gRNA
caguacggacgacccauaag

SEQ ID NO: 47456 - RNA, 20 nt, Artificial Sequence
  MKO10047456_A_Sdf4
  gRNA
cccacuguaccgucaccguc

SEQ ID NO: 47457 - RNA, 20 nt, Artificial Sequence
  MKO10047457_A_Sdf4
  gRNA
ccucagagaccgaugguauc

SEQ ID NO: 47458 - RNA, 20 nt, Artificial Sequence
  MKO10047458_A_Sdf4
  gRNA
ggguagacgugaacacugac

SEQ ID NO: 47459 - RNA, 20 nt, Artificial Sequence
  MKO10047459_A_Sdhaf1
  gRNA
guaucgaguaucuguaucgc

SEQ ID NO: 47460 - RNA, 20 nt, Artificial Sequence
  MKO10047460_A_Sdhaf1
  gRNA
gcgcgggagacgcgauccga

SEQ ID NO: 47461 - RNA, 20 nt, Artificial Sequence
  MKO10047461_A_Sdhaf1
  gRNA
uaccgcgagcugcugcgcgc

SEQ ID NO: 47462 - RNA, 20 nt, Artificial Sequence
  MKO10047462_A_Sdhaf2
  gRNA
cguuaaucaggcgaucauag

SEQ ID NO: 47463 - RNA, 20 nt, Artificial Sequence
  MKO10047463_A_Sdhaf2
  gRNA
ggucaccuugaucccgacgc

SEQ ID NO: 47464 - RNA, 20 nt, Artificial Sequence
  MKO10047464_A_Sdhaf2
  gRNA
ucucucacccgcgccagcgu

SEQ ID NO: 47465 - RNA, 20 nt, Artificial Sequence
  MKO10047465_A_Sdha
  gRNA
cuccgacuggcugggggauc

SEQ ID NO: 47466 - RNA, 20 nt, Artificial Sequence
  MKO10047466_A_Sdha
  gRNA
aagauuuaucagcgugcauu

SEQ ID NO: 47467 - RNA, 20 nt, Artificial Sequence
  MKO10047467_A_Sdha
  gRNA
ucacucuuacacacguugua

SEQ ID NO: 47468 - RNA, 20 nt, Artificial Sequence
  MKO10047468_A_Sdhb
  gRNA
accucguacgucugcauucg

SEQ ID NO: 47469 - RNA, 20 nt, Artificial Sequence
  MKO10047469_A_Sdhb
  gRNA
accucgaaugcagacguacg

SEQ ID NO: 47470 - RNA, 20 nt, Artificial Sequence
  MKO10047470_A_Sdhb
  gRNA
cuccaucaggugcggaccua

SEQ ID NO: 47471 - RNA, 20 nt, Artificial Sequence
  MKO10047471_A_Sdhc
  gRNA
uccguuugccaccgaggcuc

SEQ ID NO: 47472 - RNA, 20 nt, Artificial Sequence
  MKO10047472_A_Sdhc
  gRNA
gucggaucccauucagugag

SEQ ID NO: 47473 - RNA, 20 nt, Artificial Sequence
  MKO10047473_A_Sdhc
  gRNA
uuagccgaguagaucagugu

SEQ ID NO: 47474 - RNA, 20 nt, Artificial Sequence
  MKO10047474_A_Sdhd
  gRNA
cucugcagaugccgacaucg

SEQ ID NO: 47475 - RNA, 20 nt, Artificial Sequence
  MKO10047475_A_Sdhd
  gRNA
gcuggguaccacaccguccu

SEQ ID NO: 47476 - RNA, 20 nt, Artificial Sequence
  MKO10047476_A_Sdhd
  gRNA
agucgguaaccacuugucca

SEQ ID NO: 47477 - RNA, 20 nt, Artificial Sequence
  MKO10047477_A_Sdk1
  gRNA
agaacucacgugcuacgcuc

SEQ ID NO: 47478 - RNA, 20 nt, Artificial Sequence
  MKO10047478_A_Sdk1
  gRNA
uccuguuccgcaccacgcag

SEQ ID NO: 47479 - RNA, 20 nt, Artificial Sequence
  MKO10047479_A_Sdk1
  gRNA
caucacucgcuguuguagca

SEQ ID NO: 47480 - RNA, 20 nt, Artificial Sequence
  MKO10047480_A_Sdk2
  gRNA
uucgguuacgcacgaugcag

SEQ ID NO: 47481 - RNA, 20 nt, Artificial Sequence
  MKO10047481_A_Sdk2
  gRNA
caucgggagccaccgucgac

SEQ ID NO: 47482 - RNA, 20 nt, Artificial Sequence
  MKO10047482_A_Sdk2
  gRNA
cugcaucgugcguaaccgaa

SEQ ID NO: 47483 - RNA, 20 nt, Artificial Sequence
  MKO10047483_A_Sdpr
  gRNA
ucaacaugcuggacgccgug

SEQ ID NO: 47484 - RNA, 20 nt, Artificial Sequence
  MKO10047484_A_Sdpr
  gRNA
ugacgaauugccccgugaug

SEQ ID NO: 47485 - RNA, 20 nt, Artificial Sequence
  MKO10047485_A_Sdpr
  gRNA
acggggcaauucgucaucag

SEQ ID NO: 47486 - RNA, 20 nt, Artificial Sequence
  MKO10047486_A_Sdr16c5
  gRNA
gcaaguaaauucgcagcccu

SEQ ID NO: 47487 - RNA, 20 nt, Artificial Sequence
  MKO10047487_A_Sdr16c5
  gRNA
uauacaaguagagcugcucc

SEQ ID NO: 47488 - RNA, 20 nt, Artificial Sequence
  MKO10047488_A_Sdr16c5
  gRNA
ucuauccucaucaacaaugc

SEQ ID NO: 47489 - RNA, 20 nt, Artificial Sequence
  MKO10047489_A_Sdr16c6
  gRNA
ucaagcauagcaggacucgu

SEQ ID NO: 47490 - RNA, 20 nt, Artificial Sequence
  MKO10047490_A_Sdr16c6
  gRNA
cuaugcuugaaauacagacc

SEQ ID NO: 47491 - RNA, 20 nt, Artificial Sequence
  MKO10047491_A_Sdr16c6
  gRNA
aaagucauuccucaauacuc

SEQ ID NO: 47492 - RNA, 20 nt, Artificial Sequence
  MKO10047492_A_Sdr39u1
  gRNA
cuggcccgggucgaaucacg

SEQ ID NO: 47493 - RNA, 20 nt, Artificial Sequence
  MKO10047493_A_Sdr39u1
  gRNA
ccuacccacgugauucgacc

SEQ ID NO: 47494 - RNA, 20 nt, Artificial Sequence
  MKO10047494_A_Sdr39u1
  gRNA
caccugaacguaccacgacc

SEQ ID NO: 47495 - RNA, 20 nt, Artificial Sequence
  MKO10047495_A_Sdr42e1
  gRNA
uauccgcugccucgcugacg

SEQ ID NO: 47496 - RNA, 20 nt, Artificial Sequence
  MKO10047496_A_Sdr42e1
  gRNA
ccacguugaccucuucgauc

SEQ ID NO: 47497 - RNA, 20 nt, Artificial Sequence
  MKO10047497_A_Sdr42e1
  gRNA
ugucucacauggacucccca

SEQ ID NO: 47498 - RNA, 20 nt, Artificial Sequence
  MKO10047498_A_Sdr9c7
  gRNA
ccaggguuguagcggauucg

SEQ ID NO: 47499 - RNA, 20 nt, Artificial Sequence
  MKO10047499_A_Sdr9c7
  gRNA
uuccuugacguucuccgacu

SEQ ID NO: 47500 - RNA, 20 nt, Artificial Sequence
  MKO10047500_A_Sdr9c7
  gRNA
ccccgaauccgcuacaaccc

SEQ ID NO: 47501 - RNA, 20 nt, Artificial Sequence
  MKO10047501_A_Sdsl
  gRNA
cguuugaccauccccuuaua

SEQ ID NO: 47502 - RNA, 20 nt, Artificial Sequence
  MKO10047502_A_Sdsl
  gRNA
aauugaaacugugcgccccg

SEQ ID NO: 47503 - RNA, 20 nt, Artificial Sequence
  MKO10047503_A_Sdsl
  gRNA
ugcauacucggcucguaagc

SEQ ID NO: 47504 - RNA, 20 nt, Artificial Sequence
  MKO10047504_A_Sds
  gRNA
uggcgaccgccuacgcugcc

SEQ ID NO: 47505 - RNA, 20 nt, Artificial Sequence
  MKO10047505_A_Sds
  gRNA
gguguugggcacaacgauag

SEQ ID NO: 47506 - RNA, 20 nt, Artificial Sequence
  MKO10047506_A_Sds
  gRNA
ggaugugcccaucaucgcca

SEQ ID NO: 47507 - RNA, 20 nt, Artificial Sequence
  MKO10047507_A_Sebox
  gRNA
uggagcggguauuugcagcu

SEQ ID NO: 47508 - RNA, 20 nt, Artificial Sequence
  MKO10047508_A_Sebox
  gRNA
cacuuucagugucgggcagu

SEQ ID NO: 47509 - RNA, 20 nt, Artificial Sequence
  MKO10047509_A_Sebox
  gRNA
acccaaaauggggccuaggc

SEQ ID NO: 47510 - RNA, 20 nt, Artificial Sequence
  MKO10047510_A_Sec11a
  gRNA
acgaucucccccacgcguau

SEQ ID NO: 47511 - RNA, 20 nt, Artificial Sequence
  MKO10047511_A_Sec11a
  gRNA
aguugaagauccuauacgcg

SEQ ID NO: 47512 - RNA, 20 nt, Artificial Sequence
  MKO10047512_A_Sec11a
  gRNA
aucgucacaauuccaaugua

SEQ ID NO: 47513 - RNA, 20 nt, Artificial Sequence
  MKO10047513_A_Sec11c
  gRNA
gguccucccggaaauucgug

SEQ ID NO: 47514 - RNA, 20 nt, Artificial Sequence
  MKO10047514_A_Sec11c
  gRNA
gagcgcagaagacacgauca

SEQ ID NO: 47515 - RNA, 20 nt, Artificial Sequence
  MKO10047515_A_Sec11c
  gRNA
cagcgagagucccaucgugg

SEQ ID NO: 47516 - RNA, 20 nt, Artificial Sequence
  MKO10047516_A_Sec13
  gRNA
auccucaucgcagaccucag

SEQ ID NO: 47517 - RNA, 20 nt, Artificial Sequence
  MKO10047517_A_Sec13
  gRNA
agucgugucccgagugcuca

SEQ ID NO: 47518 - RNA, 20 nt, Artificial Sequence
  MKO10047518_A_Sec13
  gRNA
gcccaggccacuugccauac

SEQ ID NO: 47519 - RNA, 20 nt, Artificial Sequence
  MKO10047519_A_Sec14l1
  gRNA
gauguuuauacacccgcacu

SEQ ID NO: 47520 - RNA, 20 nt, Artificial Sequence
  MKO10047520_A_Sec14l1
  gRNA
gggcucuucaugucaucgag

SEQ ID NO: 47521 - RNA, 20 nt, Artificial Sequence
  MKO10047521_A_Sec14l1
  gRNA
acuugcagacuguucgaaac

SEQ ID NO: 47522 - RNA, 20 nt, Artificial Sequence
  MKO10047522_A_Sec14l2
  gRNA
ccgaugaugucguaccagac

SEQ ID NO: 47523 - RNA, 20 nt, Artificial Sequence
  MKO10047523_A_Sec14l2
  gRNA
cggcagauguggcuacgacu

SEQ ID NO: 47524 - RNA, 20 nt, Artificial Sequence
  MKO10047524_A_Sec14l2
  gRNA
gaugcucaccuuucggagca

SEQ ID NO: 47525 - RNA, 20 nt, Artificial Sequence
  MKO10047525_A_Sec14l3
  gRNA
gguauuuaccuugcggagca

SEQ ID NO: 47526 - RNA, 20 nt, Artificial Sequence
  MKO10047526_A_Sec14l3
  gRNA
acaucgaucacauccuugac

SEQ ID NO: 47527 - RNA, 20 nt, Artificial Sequence
  MKO10047527_A_Sec14l3
  gRNA
caucacggucauagccacac

SEQ ID NO: 47528 - RNA, 20 nt, Artificial Sequence
  MKO10047528_A_Sec14l4
  gRNA
ccucuggugccugccacguc

SEQ ID NO: 47529 - RNA, 20 nt, Artificial Sequence
  MKO10047529_A_Sec14l4
  gRNA
caccucggagccaucgcaga

SEQ ID NO: 47530 - RNA, 20 nt, Artificial Sequence
  MKO10047530_A_Sec14l4
  gRNA
augacuacuuccuucugcga

SEQ ID NO: 47531 - RNA, 20 nt, Artificial Sequence
  MKO10047531_A_Sec14l5
  gRNA
cacagaccuaccauccgcua

SEQ ID NO: 47532 - RNA, 20 nt, Artificial Sequence
  MKO10047532_A_Sec14l5
  gRNA
cggacguccuccuccuggac

SEQ ID NO: 47533 - RNA, 20 nt, Artificial Sequence
  MKO10047533_A_Sec14l5
  gRNA
ugcgagccgagugacaguga

SEQ ID NO: 47534 - RNA, 20 nt, Artificial Sequence
  MKO10047534_A_Sec16a
  gRNA
acgaugacgcugagauccac

SEQ ID NO: 47535 - RNA, 20 nt, Artificial Sequence
  MKO10047535_A_Sec16a
  gRNA
agguaugacccucgcuucac

SEQ ID NO: 47536 - RNA, 20 nt, Artificial Sequence
  MKO10047536_A_Sec16a
  gRNA
guuacuaugggucucgccuu

SEQ ID NO: 47537 - RNA, 20 nt, Artificial Sequence
  MKO10047537_A_Sec16b
  gRNA
gguaccacacuccgacaccg

SEQ ID NO: 47538 - RNA, 20 nt, Artificial Sequence
  MKO10047538_A_Sec16b
  gRNA
gguacuucggcgagcaucau

SEQ ID NO: 47539 - RNA, 20 nt, Artificial Sequence
  MKO10047539_A_Sec16b
  gRNA
gaugcucgccgaaguaccuc

SEQ ID NO: 47540 - RNA, 20 nt, Artificial Sequence
  MKO10047540_A_Sec1
  gRNA
ggucauaguugucgucgucg

SEQ ID NO: 47541 - RNA, 20 nt, Artificial Sequence
  MKO10047541_A_Sec1
  gRNA
cgccucauccugaaccgcca

SEQ ID NO: 47542 - RNA, 20 nt, Artificial Sequence
  MKO10047542_A_Sec1
  gRNA
aggcaagccguccauucauc

SEQ ID NO: 47543 - RNA, 20 nt, Artificial Sequence
  MKO10047543_A_Sec22a
  gRNA
agcagcgauauaauaauccc

SEQ ID NO: 47544 - RNA, 20 nt, Artificial Sequence
  MKO10047544_A_Sec22a
  gRNA
gaaaccuaccugguaaaggc

SEQ ID NO: 47545 - RNA, 20 nt, Artificial Sequence
  MKO10047545_A_Sec22a
  gRNA
uaccugcaggaggcuuucua

SEQ ID NO: 47546 - RNA, 20 nt, Artificial Sequence
  MKO10047546_A_Sec22b
  gRNA
cuccagcuacauuauugagc

SEQ ID NO: 47547 - RNA, 20 nt, Artificial Sequence
  MKO10047547_A_Sec22b
  gRNA
gcgguauuucuuagauagac

SEQ ID NO: 47548 - RNA, 20 nt, Artificial Sequence
  MKO10047548_A_Sec22b
  gRNA
cccuauuccuucaucgaguu

SEQ ID NO: 47549 - RNA, 20 nt, Artificial Sequence
  MKO10047549_A_Sec22c
  gRNA
uccuacgacaccaccugcgu

SEQ ID NO: 47550 - RNA, 20 nt, Artificial Sequence
  MKO10047550_A_Sec22c
  gRNA
ccgggaggccaggccaacgc

SEQ ID NO: 47551 - RNA, 20 nt, Artificial Sequence
  MKO10047551_A_Sec22c
  gRNA
gaacuccacggaugagguuc

SEQ ID NO: 47552 - RNA, 20 nt, Artificial Sequence
  MKO10047552_A_Sec23a
  gRNA
cuguaccugaggaccgcgug

SEQ ID NO: 47553 - RNA, 20 nt, Artificial Sequence
  MKO10047553_A_Sec23a
  gRNA
agcaaccgccuccuuccaau

SEQ ID NO: 47554 - RNA, 20 nt, Artificial Sequence
  MKO10047554_A_Sec23a
  gRNA
aaggcucaacgacaucugca

SEQ ID NO: 47555 - RNA, 20 nt, Artificial Sequence
  MKO10047555_A_Sec23b
  gRNA
caaaagugaugagaccaacc

SEQ ID NO: 47556 - RNA, 20 nt, Artificial Sequence
  MKO10047556_A_Sec23b
  gRNA
cacaauugaguacaugaucc

SEQ ID NO: 47557 - RNA, 20 nt, Artificial Sequence
  MKO10047557_A_Sec23b
  gRNA
cccucggaagacauagcucu

SEQ ID NO: 47558 - RNA, 20 nt, Artificial Sequence
  MKO10047558_A_Sec23ip
  gRNA
gaaacgcacucagcgcaucu

SEQ ID NO: 47559 - RNA, 20 nt, Artificial Sequence
  MKO10047559_A_Sec23ip
  gRNA
aaaucaguggcaccgcagac

SEQ ID NO: 47560 - RNA, 20 nt, Artificial Sequence
  MKO10047560_A_Sec23ip
  gRNA
cugacaggaguguggcgaua

SEQ ID NO: 47561 - RNA, 20 nt, Artificial Sequence
  MKO10047561_A_Sec24a
  gRNA
agccgccguagauccauuau

SEQ ID NO: 47562 - RNA, 20 nt, Artificial Sequence
  MKO10047562_A_Sec24a
  gRNA
guagcuccaccaacucuacc

SEQ ID NO: 47563 - RNA, 20 nt, Artificial Sequence
  MKO10047563_A_Sec24a
  gRNA
uucucugcacagucgaacua

SEQ ID NO: 47564 - RNA, 20 nt, Artificial Sequence
  MKO10047564_A_Sec24b
  gRNA
aucccauuugguuucggaug

SEQ ID NO: 47565 - RNA, 20 nt, Artificial Sequence
  MKO10047565_A_Sec24b
  gRNA
gcccaacaguuacgaugccu

SEQ ID NO: 47566 - RNA, 20 nt, Artificial Sequence
  MKO10047566_A_Sec24b
  gRNA
cagccucauccgaaaccaaa

SEQ ID NO: 47567 - RNA, 20 nt, Artificial Sequence
  MKO10047567_A_Sec24c
  gRNA
gugaggacacgugguuagcc

SEQ ID NO: 47568 - RNA, 20 nt, Artificial Sequence
  MKO10047568_A_Sec24c
  gRNA
ccuuguggucagacuacaua

SEQ ID NO: 47569 - RNA, 20 nt, Artificial Sequence
  MKO10047569_A_Sec24c
  gRNA
ucaggguccagacgcuuagg

SEQ ID NO: 47570 - RNA, 20 nt, Artificial Sequence
  MKO10047570_A_Sec24d
  gRNA
guggugccggcccagccauc

SEQ ID NO: 47571 - RNA, 20 nt, Artificial Sequence
  MKO10047571_A_Sec24d
  gRNA
cccccacaguuuggccccaa

SEQ ID NO: 47572 - RNA, 20 nt, Artificial Sequence
  MKO10047572_A_Sec24d
  gRNA
gagaggcaccagggccguuc

SEQ ID NO: 47573 - RNA, 20 nt, Artificial Sequence
  MKO10047573_A_Sec31a
  gRNA
gguccagcucgaauaucucg

SEQ ID NO: 47574 - RNA, 20 nt, Artificial Sequence
  MKO10047574_A_Sec31a
  gRNA
uucccucgagauauucgagc

SEQ ID NO: 47575 - RNA, 20 nt, Artificial Sequence
  MKO10047575_A_Sec31a
  gRNA
uaagguaccacaaguugauc

SEQ ID NO: 47576 - RNA, 20 nt, Artificial Sequence
  MKO10047576_A_Sec31b
  gRNA
ccacaccaccgccuugccgc

SEQ ID NO: 47577 - RNA, 20 nt, Artificial Sequence
  MKO10047577_A_Sec31b
  gRNA
uuccgcucaccccagcggca

SEQ ID NO: 47578 - RNA, 20 nt, Artificial Sequence
  MKO10047578_A_Sec31b
  gRNA
guagguuucacaagcuaaua

SEQ ID NO: 47579 - RNA, 20 nt, Artificial Sequence
  MKO10047579_A_Sec61a1
  gRNA
acucagcugacccguucuac

SEQ ID NO: 47580 - RNA, 20 nt, Artificial Sequence
  MKO10047580_A_Sec61a1
  gRNA
ccuuccucaagguaccuuaa

SEQ ID NO: 47581 - RNA, 20 nt, Artificial Sequence
  MKO10047581_A_Sec61a1
  gRNA
uccggcaagaugacacagaa

SEQ ID NO: 47582 - RNA, 20 nt, Artificial Sequence
  MKO10047582_A_Sec61a2
  gRNA
auuuccccaauuguaacguc

SEQ ID NO: 47583 - RNA, 20 nt, Artificial Sequence
  MKO10047583_A_Sec61a2
  gRNA
aucaaaccagacguuacaau

SEQ ID NO: 47584 - RNA, 20 nt, Artificial Sequence
  MKO10047584_A_Sec61a2
  gRNA
auguuucagauuccgcuguu

SEQ ID NO: 47585 - RNA, 20 nt, Artificial Sequence
  MKO10047585_A_Sec61b
  gRNA
cacuuaccucugccgaacag

SEQ ID NO: 47586 - RNA, 20 nt, Artificial Sequence
  MKO10047586_A_Sec61b
  gRNA
acgacuuacacuuugagccc

SEQ ID NO: 47587 - RNA, 20 nt, Artificial Sequence
  MKO10047587_A_Sec61b
  gRNA
caggggcccugucccagugc

SEQ ID NO: 47588 - RNA, 20 nt, Artificial Sequence
  MKO10047588_A_Sec61g
  gRNA
agaaccgagcccaacggaac

SEQ ID NO: 47589 - RNA, 20 nt, Artificial Sequence
  MKO10047589_A_Sec61g
  gRNA
uugccagcuuccgguuccgu

SEQ ID NO: 47590 - RNA, 20 nt, Artificial Sequence
  MKO10047590_A_Sec61g
  gRNA
ugcaccaaacccgacagaaa

SEQ ID NO: 47591 - RNA, 20 nt, Artificial Sequence
  MKO10047591_A_Sec62
  gRNA
guagucgaccacagacuccc

SEQ ID NO: 47592 - RNA, 20 nt, Artificial Sequence
  MKO10047592_A_Sec62
  gRNA
aggacgcuuuauuuacaacc

SEQ ID NO: 47593 - RNA, 20 nt, Artificial Sequence
  MKO10047593_A_Sec62
  gRNA
aacccgaugacccaucaugu

SEQ ID NO: 47594 - RNA, 20 nt, Artificial Sequence
  MKO10047594_A_Sec63
  gRNA
gauguaugugguaucguuua

SEQ ID NO: 47595 - RNA, 20 nt, Artificial Sequence
  MKO10047595_A_Sec63
  gRNA
acuucaucaccuccuuuauc

SEQ ID NO: 47596 - RNA, 20 nt, Artificial Sequence
  MKO10047596_A_Sec63
  gRNA
uugauauucucggucuguuu

SEQ ID NO: 47597 - RNA, 20 nt, Artificial Sequence
  MKO10047597_A_Secisbp2l
  gRNA
ccgaucaaaaauugugcuuc

SEQ ID NO: 47598 - RNA, 20 nt, Artificial Sequence
  MKO10047598_A_Secisbp2l
  gRNA
uauauaacaacgauauacga

SEQ ID NO: 47599 - RNA, 20 nt, Artificial Sequence
  MKO10047599_A_Secisbp2l
  gRNA
gacgaacggcuccacuucag

SEQ ID NO: 47600 - RNA, 20 nt, Artificial Sequence
  MKO10047600_A_Secisbp2
  gRNA
cggcaagcccgucgcagaua

SEQ ID NO: 47601 - RNA, 20 nt, Artificial Sequence
  MKO10047601_A_Secisbp2
  gRNA
uugccgacgucuccuaggag

SEQ ID NO: 47602 - RNA, 20 nt, Artificial Sequence
  MKO10047602_A_Secisbp2
  gRNA
ccauucgucccuaaguuugc

SEQ ID NO: 47603 - RNA, 20 nt, Artificial Sequence
  MKO10047603_A_Secum1a
  gRNA
cgcgaagagcucuccaauag

SEQ ID NO: 47604 - RNA, 20 nt, Artificial Sequence
  MKO10047604_A_Secum1a
  gRNA
aggaugcccuccgugcagau

SEQ ID NO: 47605 - RNA, 20 nt, Artificial Sequence
  MKO10047605_A_Secum1a
  gRNA
aaacuucucuuggcgugggu

SEQ ID NO: 47606 - RNA, 20 nt, Artificial Sequence
  MKO10047606_A_Secum1b
  gRNA
uuaucagggaccuuagugac

SEQ ID NO: 47607 - RNA, 20 nt, Artificial Sequence
  MKO10047607_A_Secum1b
  gRNA
cuccgacuuaccaugguuau

SEQ ID NO: 47608 - RNA, 20 nt, Artificial Sequence
  MKO10047608_A_Secum1b
  gRNA
cagagacgucaccauugagu

SEQ ID NO: 47609 - RNA, 20 nt, Artificial Sequence
  MKO10047609_A_Seh1l
  gRNA
ucauccccccaugaucgcug

SEQ ID NO: 47610 - RNA, 20 nt, Artificial Sequence
  MKO10047610_A_Seh1l
  gRNA
gaaucaaacgauaaacuucg

SEQ ID NO: 47611 - RNA, 20 nt, Artificial Sequence
  MKO10047611_A_Seh1l
  gRNA
uugaccgaacagcagcugua

SEQ ID NO: 47612 - RNA, 20 nt, Artificial Sequence
  MKO10047612_A_Sel1l2
  gRNA
guaugauccuucuuuagcca

SEQ ID NO: 47613 - RNA, 20 nt, Artificial Sequence
  MKO10047613_A_Sel1l2
  gRNA
ugcucuggugaagagugugu

SEQ ID NO: 47614 - RNA, 20 nt, Artificial Sequence
  MKO10047614_A_Sel1l2
  gRNA
aaugggcaacaagauucucc

SEQ ID NO: 47615 - RNA, 20 nt, Artificial Sequence
  MKO10047615_A_Sel1l3
  gRNA
aaggcgggaccgucugcagc

SEQ ID NO: 47616 - RNA, 20 nt, Artificial Sequence
  MKO10047616_A_Sel1l3
  gRNA
gugggauccuauuggcccag

SEQ ID NO: 47617 - RNA, 20 nt, Artificial Sequence
  MKO10047617_A_Sel1l3
  gRNA
acaugggguaguccacgcgc

SEQ ID NO: 47618 - RNA, 20 nt, Artificial Sequence
  MKO10047618_A_Sel1l
  gRNA
ucgauacugacccgaggucg

SEQ ID NO: 47619 - RNA, 20 nt, Artificial Sequence
  MKO10047619_A_Sel1l
  gRNA
accacgggcaaaguaguugc

SEQ ID NO: 47620 - RNA, 20 nt, Artificial Sequence
  MKO10047620_A_Sel1l
  gRNA
gcaggaugcagguccgcguc

SEQ ID NO: 47621 - RNA, 20 nt, Artificial Sequence
  MKO10047621_A_Selenbp1
  gRNA
caaacugcucacguugcacu

SEQ ID NO: 47622 - RNA, 20 nt, Artificial Sequence
  MKO10047622_A_Selenbp1
  gRNA
agaagucauggucagcaccu

SEQ ID NO: 47623 - RNA, 20 nt, Artificial Sequence
  MKO10047623_A_Selenbp1
  gRNA
uccagguuacuccaccccuc

SEQ ID NO: 47624 - RNA, 20 nt, Artificial Sequence
  MKO10047624_A_Selenbp2
  gRNA
cguauugcucacguugcacu

SEQ ID NO: 47625 - RNA, 20 nt, Artificial Sequence
  MKO10047625_A_Selenbp2
  gRNA
uacgcacaccagccacugcc

SEQ ID NO: 47626 - RNA, 20 nt, Artificial Sequence
  MKO10047626_A_Selenbp2
  gRNA
cauguccucccgcaucuacg

SEQ ID NO: 47627 - RNA, 20 nt, Artificial Sequence
  MKO10047627_A_Sele
  gRNA
accgugcgguguacguccuc

SEQ ID NO: 47628 - RNA, 20 nt, Artificial Sequence
  MKO10047628_A_Sele
  gRNA
cgaacgggugggagcaguuc

SEQ ID NO: 47629 - RNA, 20 nt, Artificial Sequence
  MKO10047629_A_Sele
  gRNA
aacgagacgccaucaugcaa

SEQ ID NO: 47630 - RNA, 20 nt, Artificial Sequence
  MKO10047630_A_Selk
  gRNA
uaauucuguaggucaggugu

SEQ ID NO: 47631 - RNA, 20 nt, Artificial Sequence
  MKO10047631_A_Selk
  gRNA
uuccccagaagaagucuguu

SEQ ID NO: 47632 - RNA, 20 nt, Artificial Sequence
  MKO10047632_A_Selk
  gRNA
cccucuuccaucgucguauc

SEQ ID NO: 47633 - RNA, 20 nt, Artificial Sequence
  MKO10047633_A_Sell
  gRNA
ugacgccugucacaaacgaa

SEQ ID NO: 47634 - RNA, 20 nt, Artificial Sequence
  MKO10047634_A_Sell
  gRNA
guguggagaucuauaucaag

SEQ ID NO: 47635 - RNA, 20 nt, Artificial Sequence
  MKO10047635_A_Sell
  gRNA
gucuggacacugcucuguug

SEQ ID NO: 47636 - RNA, 20 nt, Artificial Sequence
  MKO10047636_A_Selm
  gRNA
ggggcuuagcgggcgcccac

SEQ ID NO: 47637 - RNA, 20 nt, Artificial Sequence
  MKO10047637_A_Selm
  gRNA
gcuguuaagccgaaauuacc

SEQ ID NO: 47638 - RNA, 20 nt, Artificial Sequence
  MKO10047638_A_Selm
  gRNA
augacaguugaaucgccuaa

SEQ ID NO: 47639 - RNA, 20 nt, Artificial Sequence
  MKO10047639_A_Selo
  gRNA
acucacggaugcuugaccgc

SEQ ID NO: 47640 - RNA, 20 nt, Artificial Sequence
  MKO10047640_A_Selo
  gRNA
gauaucaucucgucccacgc

SEQ ID NO: 47641 - RNA, 20 nt, Artificial Sequence
  MKO10047641_A_Selo
  gRNA
uguagacucagacgugacgc

SEQ ID NO: 47642 - RNA, 20 nt, Artificial Sequence
  MKO10047642_A_Selplg
  gRNA
cucggagguuccagcgcucg

SEQ ID NO: 47643 - RNA, 20 nt, Artificial Sequence
  MKO10047643_A_Selplg
  gRNA
gagagagauuccacgagcgc

SEQ ID NO: 47644 - RNA, 20 nt, Artificial Sequence
  MKO10047644_A_Selplg
  gRNA
cguccaaccagcauccacag

SEQ ID NO: 47645 - RNA, 20 nt, Artificial Sequence
  MKO10047645_A_Selp
  gRNA
aauaaccccccgaaguguga

SEQ ID NO: 47646 - RNA, 20 nt, Artificial Sequence
  MKO10047646_A_Selp
  gRNA
acccggcgagcugcaauguu

SEQ ID NO: 47647 - RNA, 20 nt, Artificial Sequence
  MKO10047647_A_Selp
  gRNA
acuccggagucuuggcgucc

SEQ ID NO: 47648 - RNA, 20 nt, Artificial Sequence
  MKO10047648_A_Selrc1
  gRNA
agucggaaucauggcgggcu

SEQ ID NO: 47649 - RNA, 20 nt, Artificial Sequence
  MKO10047649_A_Selrc1
  gRNA
gcuuauuacgugacuggcaa

SEQ ID NO: 47650 - RNA, 20 nt, Artificial Sequence
  MKO10047650_A_Selrc1
  gRNA
caguaguccaacguugugac

SEQ ID NO: 47651 - RNA, 20 nt, Artificial Sequence
  MKO10047651_A_Selt
  gRNA
uguacuccucaaacacccgc

SEQ ID NO: 47652 - RNA, 20 nt, Artificial Sequence
  MKO10047652_A_Selt
  gRNA
uagggcuaugaucgaugaug

SEQ ID NO: 47653 - RNA, 20 nt, Artificial Sequence
  MKO10047653_A_Selt
  gRNA
acucaccuauaaauugguug

SEQ ID NO: 47654 - RNA, 20 nt, Artificial Sequence
  MKO10047654_A_Sema3a
  gRNA
cuacauaccuauuagaagag

SEQ ID NO: 47655 - RNA, 20 nt, Artificial Sequence
  MKO10047655_A_Sema3a
  gRNA
gucaguaguuugggaucaua

SEQ ID NO: 47656 - RNA, 20 nt, Artificial Sequence
  MKO10047656_A_Sema3a
  gRNA
uguggccaguaucuuacaca

SEQ ID NO: 47657 - RNA, 20 nt, Artificial Sequence
  MKO10047657_A_Sema3b
  gRNA
gcccgaugccuugggucaua

SEQ ID NO: 47658 - RNA, 20 nt, Artificial Sequence
  MKO10047658_A_Sema3b
  gRNA
ugguguccgaaccuucaggc

SEQ ID NO: 47659 - RNA, 20 nt, Artificial Sequence
  MKO10047659_A_Sema3b
  gRNA
gcauucuucacgccauucca

SEQ ID NO: 47660 - RNA, 20 nt, Artificial Sequence
  MKO10047660_A_Sema3c
  gRNA
uagagucgaucaugaauacc

SEQ ID NO: 47661 - RNA, 20 nt, Artificial Sequence
  MKO10047661_A_Sema3c
  gRNA
auggcuguggaaauuucguc

SEQ ID NO: 47662 - RNA, 20 nt, Artificial Sequence
  MKO10047662_A_Sema3c
  gRNA
agaucaagaccggauauaug

SEQ ID NO: 47663 - RNA, 20 nt, Artificial Sequence
  MKO10047663_A_Sema3d
  gRNA
aagacucacguuuacgugug

SEQ ID NO: 47664 - RNA, 20 nt, Artificial Sequence
  MKO10047664_A_Sema3d
  gRNA
uaaacuagacacgcacaacc

SEQ ID NO: 47665 - RNA, 20 nt, Artificial Sequence
  MKO10047665_A_Sema3d
  gRNA
ggagcguuucauccgcugug

SEQ ID NO: 47666 - RNA, 20 nt, Artificial Sequence
  MKO10047666_A_Sema3e
  gRNA
aagauaauuaccaacuagcg

SEQ ID NO: 47667 - RNA, 20 nt, Artificial Sequence
  MKO10047667_A_Sema3e
  gRNA
cacugacucguuccaaguuc

SEQ ID NO: 47668 - RNA, 20 nt, Artificial Sequence
  MKO10047668_A_Sema3e
  gRNA
ccaggaaccccuguuucacc

SEQ ID NO: 47669 - RNA, 20 nt, Artificial Sequence
  MKO10047669_A_Sema3f
  gRNA
aggagcuuaccugugcgcga

SEQ ID NO: 47670 - RNA, 20 nt, Artificial Sequence
  MKO10047670_A_Sema3f
  gRNA
agccuccccgcagcgcauug

SEQ ID NO: 47671 - RNA, 20 nt, Artificial Sequence
  MKO10047671_A_Sema3f
  gRNA
augcacuccucaaugcgcug

SEQ ID NO: 47672 - RNA, 20 nt, Artificial Sequence
  MKO10047672_A_Sema3g
  gRNA
guaucgagaucgccucuuuc

SEQ ID NO: 47673 - RNA, 20 nt, Artificial Sequence
  MKO10047673_A_Sema3g
  gRNA
ccauaaccggacccaucugc

SEQ ID NO: 47674 - RNA, 20 nt, Artificial Sequence
  MKO10047674_A_Sema3g
  gRNA
cggagugugccaacuucgug

SEQ ID NO: 47675 - RNA, 20 nt, Artificial Sequence
  MKO10047675_A_Sema4a
  gRNA
gcagcgugucaaagucucgg

SEQ ID NO: 47676 - RNA, 20 nt, Artificial Sequence
  MKO10047676_A_Sema4a
  gRNA
acgcugcuccugagugacga

SEQ ID NO: 47677 - RNA, 20 nt, Artificial Sequence
  MKO10047677_A_Sema4a
  gRNA
uuucaacuucauucgagucc

SEQ ID NO: 47678 - RNA, 20 nt, Artificial Sequence
  MKO10047678_A_Sema4b
  gRNA
accucuugguacuccccgcc

SEQ ID NO: 47679 - RNA, 20 nt, Artificial Sequence
  MKO10047679_A_Sema4b
  gRNA
cagcagaagggccguguagu

SEQ ID NO: 47680 - RNA, 20 nt, Artificial Sequence
  MKO10047680_A_Sema4b
  gRNA
cuuaccaaccaccagagccg

SEQ ID NO: 47681 - RNA, 20 nt, Artificial Sequence
  MKO10047681_A_Sema4c
  gRNA
acucacgauguaggugcacu

SEQ ID NO: 47682 - RNA, 20 nt, Artificial Sequence
  MKO10047682_A_Sema4c
  gRNA
gaacaugcucacguucaccu

SEQ ID NO: 47683 - RNA, 20 nt, Artificial Sequence
  MKO10047683_A_Sema4c
  gRNA
cucgggcccccacauauaaa

SEQ ID NO: 47684 - RNA, 20 nt, Artificial Sequence
  MKO10047684_A_Sema4d
  gRNA
guaguacucgaauguaguuu

SEQ ID NO: 47685 - RNA, 20 nt, Artificial Sequence
  MKO10047685_A_Sema4d
  gRNA
uggucuuaccagguggucac

SEQ ID NO: 47686 - RNA, 20 nt, Artificial Sequence
  MKO10047686_A_Sema4d
  gRNA
ucccucacagguauauugga

SEQ ID NO: 47687 - RNA, 20 nt, Artificial Sequence
  MKO10047687_A_Sema4f
  gRNA
aagcgaaggugccacacgug

SEQ ID NO: 47688 - RNA, 20 nt, Artificial Sequence
  MKO10047688_A_Sema4f
  gRNA
gcuucucacacacuuuacgu

SEQ ID NO: 47689 - RNA, 20 nt, Artificial Sequence
  MKO10047689_A_Sema4f
  gRNA
ggccgcaaaccgggugagau

SEQ ID NO: 47690 - RNA, 20 nt, Artificial Sequence
  MKO10047690_A_Sema4g
  gRNA
gccgcuguagaaaucgcacg

SEQ ID NO: 47691 - RNA, 20 nt, Artificial Sequence
  MKO10047691_A_Sema4g
  gRNA
ggcccuugaagugccgaauc

SEQ ID NO: 47692 - RNA, 20 nt, Artificial Sequence
  MKO10047692_A_Sema4g
  gRNA
accacgugcgauuucuacag

SEQ ID NO: 47693 - RNA, 20 nt, Artificial Sequence
  MKO10047693_A_Sema5a
  gRNA
aagaacuugucguaggagcg

SEQ ID NO: 47694 - RNA, 20 nt, Artificial Sequence
  MKO10047694_A_Sema5a
  gRNA
ggggaccggcuauucaccug

SEQ ID NO: 47695 - RNA, 20 nt, Artificial Sequence
  MKO10047695_A_Sema5a
  gRNA
cauguuuagaaauuggcccc

SEQ ID NO: 47696 - RNA, 20 nt, Artificial Sequence
  MKO10047696_A_Sema5b
  gRNA
cacgaugagcugauuccucg

SEQ ID NO: 47697 - RNA, 20 nt, Artificial Sequence
  MKO10047697_A_Sema5b
  gRNA
ggagcggcgcguguccucac

SEQ ID NO: 47698 - RNA, 20 nt, Artificial Sequence
  MKO10047698_A_Sema5b
  gRNA
agcuugcucuugaucccucg

SEQ ID NO: 47699 - RNA, 20 nt, Artificial Sequence
  MKO10047699_A_Sema6a
  gRNA
cuuaccgagcagcaacguag

SEQ ID NO: 47700 - RNA, 20 nt, Artificial Sequence
  MKO10047700_A_Sema6a
  gRNA
acccuuccugcagaaacuac

SEQ ID NO: 47701 - RNA, 20 nt, Artificial Sequence
  MKO10047701_A_Sema6a
  gRNA
gaugauacgcuguuugucug

SEQ ID NO: 47702 - RNA, 20 nt, Artificial Sequence
  MKO10047702_A_Sema6b
  gRNA
gagccacuaucccguguucg

SEQ ID NO: 47703 - RNA, 20 nt, Artificial Sequence
  MKO10047703_A_Sema6b
  gRNA
ggagccgcacacgaacagcg

SEQ ID NO: 47704 - RNA, 20 nt, Artificial Sequence
  MKO10047704_A_Sema6b
  gRNA
uguuaacacguagcacucuc

SEQ ID NO: 47705 - RNA, 20 nt, Artificial Sequence
  MKO10047705_A_Sema6c
  gRNA
agcccuaugugccgcagcua

SEQ ID NO: 47706 - RNA, 20 nt, Artificial Sequence
  MKO10047706_A_Sema6c
  gRNA
acauccguguucuuguuccc

SEQ ID NO: 47707 - RNA, 20 nt, Artificial Sequence
  MKO10047707_A_Sema6c
  gRNA
uuaccgggcagccacaagca

SEQ ID NO: 47708 - RNA, 20 nt, Artificial Sequence
  MKO10047708_A_Sema6d
  gRNA
gaagcugaccgcccguaacc

SEQ ID NO: 47709 - RNA, 20 nt, Artificial Sequence
  MKO10047709_A_Sema6d
  gRNA
caggcaacgaaucgcagcac

SEQ ID NO: 47710 - RNA, 20 nt, Artificial Sequence
  MKO10047710_A_Sema6d
  gRNA
agugauagucaaccguguug

SEQ ID NO: 47711 - RNA, 20 nt, Artificial Sequence
  MKO10047711_A_Sema7a
  gRNA
gaguucucauccgggcugaa

SEQ ID NO: 47712 - RNA, 20 nt, Artificial Sequence
  MKO10047712_A_Sema7a
  gRNA
cagcccggaugagaacuccc

SEQ ID NO: 47713 - RNA, 20 nt, Artificial Sequence
  MKO10047713_A_Sema7a
  gRNA
ggugaacaucggcuccacaa

SEQ ID NO: 47714 - RNA, 20 nt, Artificial Sequence
  MKO10047714_A_Senp1
  gRNA
aguggagccgugguucacua

SEQ ID NO: 47715 - RNA, 20 nt, Artificial Sequence
  MKO10047715_A_Senp1
  gRNA
uucuuacgucaccugagcca

SEQ ID NO: 47716 - RNA, 20 nt, Artificial Sequence
  MKO10047716_A_Senp1
  gRNA
gaagucuuugccucgaaacc

SEQ ID NO: 47717 - RNA, 20 nt, Artificial Sequence
  MKO10047717_A_Senp2
  gRNA
gcccaacugaccucuccaga

SEQ ID NO: 47718 - RNA, 20 nt, Artificial Sequence
  MKO10047718_A_Senp2
  gRNA
cagugacccgcgaucagcca

SEQ ID NO: 47719 - RNA, 20 nt, Artificial Sequence
  MKO10047719_A_Senp2
  gRNA
uaacuuacccaaaggagggc

SEQ ID NO: 47720 - RNA, 20 nt, Artificial Sequence
  MKO10047720_A_Senp3
  gRNA
ggugagcacgugucgcuuau

SEQ ID NO: 47721 - RNA, 20 nt, Artificial Sequence
  MKO10047721_A_Senp3
  gRNA
ccccuuaccauagcguugcc

SEQ ID NO: 47722 - RNA, 20 nt, Artificial Sequence
  MKO10047722_A_Senp3
  gRNA
ccacaggugaugaacaugua

SEQ ID NO: 47723 - RNA, 20 nt, Artificial Sequence
  MKO10047723_A_Senp5
  gRNA
uauggacgaucuggcaacuu

SEQ ID NO: 47724 - RNA, 20 nt, Artificial Sequence
  MKO10047724_A_Senp5
  gRNA
gcuauaauggaguuaaaaga

SEQ ID NO: 47725 - RNA, 20 nt, Artificial Sequence
  MKO10047725_A_Senp5
  gRNA
cugcagguuauuaauaugua

SEQ ID NO: 47726 - RNA, 20 nt, Artificial Sequence
  MKO10047726_A_Senp6
  gRNA
gaaauuguugcuacuaguuc

SEQ ID NO: 47727 - RNA, 20 nt, Artificial Sequence
  MKO10047727_A_Senp6
  gRNA
cugugcagugaaagcaccgc

SEQ ID NO: 47728 - RNA, 20 nt, Artificial Sequence
  MKO10047728_A_Senp6
  gRNA
gacggcuuuaaaacuuugaa

SEQ ID NO: 47729 - RNA, 20 nt, Artificial Sequence
  MKO10047729_A_Senp7
  gRNA
gggcgucggcgagcuucauc

SEQ ID NO: 47730 - RNA, 20 nt, Artificial Sequence
  MKO10047730_A_Senp7
  gRNA
gaugaagcucgccgacgccc

SEQ ID NO: 47731 - RNA, 20 nt, Artificial Sequence
  MKO10047731_A_Senp7
  gRNA
cguaccuuucggauaaauua

SEQ ID NO: 47732 - RNA, 20 nt, Artificial Sequence
  MKO10047732_A_Senp8
  gRNA
cacuauuggacccuccaagc

SEQ ID NO: 47733 - RNA, 20 nt, Artificial Sequence
  MKO10047733_A_Senp8
  gRNA
caacucaauccaugcaaagc

SEQ ID NO: 47734 - RNA, 20 nt, Artificial Sequence
  MKO10047734_A_Senp8
  gRNA
gcagucaugaaacugacuau

SEQ ID NO: 47735 - RNA, 20 nt, Artificial Sequence
  MKO10047735_A_Sephs1
  gRNA
cgucgacgacccguauauga

SEQ ID NO: 47736 - RNA, 20 nt, Artificial Sequence
  MKO10047736_A_Sephs1
  gRNA
agugauaccgcuaauuauac

SEQ ID NO: 47737 - RNA, 20 nt, Artificial Sequence
  MKO10047737_A_Sephs1
  gRNA
cucuguaacaggcggccaaa

SEQ ID NO: 47738 - RNA, 20 nt, Artificial Sequence
  MKO10047738_A_Sephs2
  gRNA
aacccguggauuaucaucgg

SEQ ID NO: 47739 - RNA, 20 nt, Artificial Sequence
  MKO10047739_A_Sephs2
  gRNA
cgggccgcgucagucccucc

SEQ ID NO: 47740 - RNA, 20 nt, Artificial Sequence
  MKO10047740_A_Sephs2
  gRNA
guccaugccaaugcucagcg

SEQ ID NO: 47741 - RNA, 20 nt, Artificial Sequence
  MKO10047741_A_Sepn1
  gRNA
uaugguaagagucuccucgc

SEQ ID NO: 47742 - RNA, 20 nt, Artificial Sequence
  MKO10047742_A_Sepn1
  gRNA
ccuacuacaccgugauguuc

SEQ ID NO: 47743 - RNA, 20 nt, Artificial Sequence
  MKO10047743_A_Sepn1
  gRNA
gaagacccgcuuugccccuc

SEQ ID NO: 47744 - RNA, 20 nt, Artificial Sequence
  MKO10047744_A_Sepp1
  gRNA
ggccgucuuguguaucaccu

SEQ ID NO: 47745 - RNA, 20 nt, Artificial Sequence
  MKO10047745_A_Sepp1
  gRNA
gcuccuguguaaguugucua

SEQ ID NO: 47746 - RNA, 20 nt, Artificial Sequence
  MKO10047746_A_Sepp1
  gRNA
acuccuuagacaacuuacac

SEQ ID NO: 47747 - RNA, 20 nt, Artificial Sequence
  MKO10047747_A_Sepsecs
  gRNA
ugguugcucgacgacauuac

SEQ ID NO: 47748 - RNA, 20 nt, Artificial Sequence
  MKO10047748_A_Sepsecs
  gRNA
aguuaccuaucgggcacccu

SEQ ID NO: 47749 - RNA, 20 nt, Artificial Sequence
  MKO10047749_A_Sepsecs
  gRNA
gcgcacagaccugaaagccg

SEQ ID NO: 47750 - RNA, 20 nt, Artificial Sequence
  MKO10047750_A_Sepw1
  gRNA
ucggauuuaccuucuuggag

SEQ ID NO: 47751 - RNA, 20 nt, Artificial Sequence
  MKO10047751_A_Sepw1
  gRNA
agagagcaaguuccggaaac

SEQ ID NO: 47752 - RNA, 20 nt, Artificial Sequence
  MKO10047752_A_Sepw1
  gRNA
ugauggcggucaccaguuuc

SEQ ID NO: 47753 - RNA, 20 nt, Artificial Sequence
  MKO10047753_A_Serac1
  gRNA
gaucaaaaagucgcacgccc

SEQ ID NO: 47754 - RNA, 20 nt, Artificial Sequence
  MKO10047754_A_Serac1
  gRNA
cgaucuagcugcacggcugc

SEQ ID NO: 47755 - RNA, 20 nt, Artificial Sequence
  MKO10047755_A_Serac1
  gRNA
gugcagcuagaucguccucc

SEQ ID NO: 47756 - RNA, 20 nt, Artificial Sequence
  MKO10047756_A_Serbp1
  gRNA
cggauaggccguucgauaau

SEQ ID NO: 47757 - RNA, 20 nt, Artificial Sequence
  MKO10047757_A_Serbp1
  gRNA
aagacccgaucaacaacuac

SEQ ID NO: 47758 - RNA, 20 nt, Artificial Sequence
  MKO10047758_A_Serbp1
  gRNA
ucauaaggaauaaggcgagu

SEQ ID NO: 47759 - RNA, 20 nt, Artificial Sequence
  MKO10047759_A_Serf1
  gRNA
cugcauagauuucuucucau

SEQ ID NO: 47760 - RNA, 20 nt, Artificial Sequence
  MKO10047760_A_Serf1
  gRNA
gaaaaacaugaaaaagaccc

SEQ ID NO: 47761 - RNA, 20 nt, Artificial Sequence
  MKO10047761_A_Serf1
  gRNA
ucaccucugcuuucucugag

SEQ ID NO: 47762 - RNA, 20 nt, Artificial Sequence
  MKO10047762_A_Serf2
  gRNA
ccuggggcuaccucugcuug

SEQ ID NO: 47763 - RNA, 20 nt, Artificial Sequence
  MKO10047763_A_Serf2
  gRNA
caugaagaagcagagcgacu

SEQ ID NO: 47764 - RNA, 20 nt, Artificial Sequence
  MKO10047764_A_Serf2
  gRNA
caugcagcagaagcagaaaa

SEQ ID NO: 47765 - RNA, 20 nt, Artificial Sequence
  MKO10047765_A_Sergef
  gRNA
acgcauuugcgagggccgug

SEQ ID NO: 47766 - RNA, 20 nt, Artificial Sequence
  MKO10047766_A_Sergef
  gRNA
ucacggcccucgcaaaugcg

SEQ ID NO: 47767 - RNA, 20 nt, Artificial Sequence
  MKO10047767_A_Sergef
  gRNA
ccguagggugcaaacagcua

SEQ ID NO: 47768 - RNA, 20 nt, Artificial Sequence
  MKO10047768_A_Serhl
  gRNA
cucucgucccauuacaaccc

SEQ ID NO: 47769 - RNA, 20 nt, Artificial Sequence
  MKO10047769_A_Serhl
  gRNA
acaacgccaacuccuuugac

SEQ ID NO: 47770 - RNA, 20 nt, Artificial Sequence
  MKO10047770_A_Serhl
  gRNA
cuauggauuucggaggccac

SEQ ID NO: 47771 - RNA, 20 nt, Artificial Sequence
  MKO10047771_A_Serinc1
  gRNA
ccauuguggacugccgcucu

SEQ ID NO: 47772 - RNA, 20 nt, Artificial Sequence
  MKO10047772_A_Serinc1
  gRNA
cccacgauucauuccaagaa

SEQ ID NO: 47773 - RNA, 20 nt, Artificial Sequence
  MKO10047773_A_Serinc1
  gRNA
gcuuguguaauguuaauacc

SEQ ID NO: 47774 - RNA, 20 nt, Artificial Sequence
  MKO10047774_A_Serinc2
  gRNA
gacucuccagccugguacgc

SEQ ID NO: 47775 - RNA, 20 nt, Artificial Sequence
  MKO10047775_A_Serinc2
  gRNA
agggcacugaccugcguacc

SEQ ID NO: 47776 - RNA, 20 nt, Artificial Sequence
  MKO10047776_A_Serinc2
  gRNA
cucgcggaucccggcuacug

SEQ ID NO: 47777 - RNA, 20 nt, Artificial Sequence
  MKO10047777_A_Serinc3
  gRNA
guagaugagccgaguuacag

SEQ ID NO: 47778 - RNA, 20 nt, Artificial Sequence
  MKO10047778_A_Serinc3
  gRNA
uucaaaaucgcugccauuau

SEQ ID NO: 47779 - RNA, 20 nt, Artificial Sequence
  MKO10047779_A_Serinc3
  gRNA
agagaaagauugugacgugc

SEQ ID NO: 47780 - RNA, 20 nt, Artificial Sequence
  MKO10047780_A_Serinc4
  gRNA
cuaccacugucuucgaaagc

SEQ ID NO: 47781 - RNA, 20 nt, Artificial Sequence
  MKO10047781_A_Serinc4
  gRNA
gcgccagagccacugagaac

SEQ ID NO: 47782 - RNA, 20 nt, Artificial Sequence
  MKO10047782_A_Serinc4
  gRNA
cuugcagccuggcauuauau

SEQ ID NO: 47783 - RNA, 20 nt, Artificial Sequence
  MKO10047783_A_Serinc5
  gRNA
acaccgcagaauacccuacc

SEQ ID NO: 47784 - RNA, 20 nt, Artificial Sequence
  MKO10047784_A_Serinc5
  gRNA
gcccuaaguuccgacagucu

SEQ ID NO: 47785 - RNA, 20 nt, Artificial Sequence
  MKO10047785_A_Serinc5
  gRNA
guccgagacugucggaacuu

SEQ ID NO: 47786 - RNA, 20 nt, Artificial Sequence
  MKO10047786_A_Serp1
  gRNA
gucgguaggacccugguuau

SEQ ID NO: 47787 - RNA, 20 nt, Artificial Sequence
  MKO10047787_A_Serp1
  gRNA
gagaaaugcccccgaagaaa

SEQ ID NO: 47788 - RNA, 20 nt, Artificial Sequence
  MKO10047788_A_Serp1
  gRNA
cgaaaauggucgccaagcag

SEQ ID NO: 47789 - RNA, 20 nt, Artificial Sequence
  MKO10047789_A_Serp2
  gRNA
uccagaucauacagagcaua

SEQ ID NO: 47790 - RNA, 20 nt, Artificial Sequence
  MKO10047790_A_Serp2
  gRNA
uccuuaugcucuguaugauc

SEQ ID NO: 47791 - RNA, 20 nt, Artificial Sequence
  MKO10047791_A_Serp2
  gRNA
aagccaugguggccaaacag

SEQ ID NO: 47792 - RNA, 20 nt, Artificial Sequence
  MKO10047792_A_Serpina10
  gRNA
cuacuugaccguggaucucg

SEQ ID NO: 47793 - RNA, 20 nt, Artificial Sequence
  MKO10047793_A_Serpina10
  gRNA
uuaaggugcccaugauguac

SEQ ID NO: 47794 - RNA, 20 nt, Artificial Sequence
  MKO10047794_A_Serpina10
  gRNA
ugcuucgaaagaucuccaug

SEQ ID NO: 47795 - RNA, 20 nt, Artificial Sequence
  MKO10047795_A_Serpina11
  gRNA
ccuuugaucgcuaccagacc

SEQ ID NO: 47796 - RNA, 20 nt, Artificial Sequence
  MKO10047796_A_Serpina11
  gRNA
gaauucggaguggcguccuc

SEQ ID NO: 47797 - RNA, 20 nt, Artificial Sequence
  MKO10047797_A_Serpina11
  gRNA
ccccgguggacgucagcugc

SEQ ID NO: 47798 - RNA, 20 nt, Artificial Sequence
  MKO10047798_A_Serpina12
  gRNA
ccaugucguacaagccccuu

SEQ ID NO: 47799 - RNA, 20 nt, Artificial Sequence
  MKO10047799_A_Serpina12
  gRNA
uguugugucgagcaagcugc

SEQ ID NO: 47800 - RNA, 20 nt, Artificial Sequence
  MKO10047800_A_Serpina12
  gRNA
guuucccugagggcuauugc

SEQ ID NO: 47801 - RNA, 20 nt, Artificial Sequence
  MKO10047801_A_Serpina1a
  gRNA
gcacaugaagcaugcccgag

SEQ ID NO: 47802 - RNA, 20 nt, Artificial Sequence
  MKO10047802_A_Serpina1a
  gRNA
agcaguuacagucuuacaaa

SEQ ID NO: 47803 - RNA, 20 nt, Artificial Sequence
  MKO10047803_A_Serpina1a
  gRNA
aaaugacucccuccaucuca

SEQ ID NO: 47804 - RNA, 20 nt, Artificial Sequence
  MKO10047804_A_Serpina1b
  gRNA
ggugcccaugaugaugcucu

SEQ ID NO: 47805 - RNA, 20 nt, Artificial Sequence
  MKO10047805_A_Serpina1b
  gRNA
auugcagcauacuguccagc

SEQ ID NO: 47806 - RNA, 20 nt, Artificial Sequence
  MKO10047806_A_Serpina1b
  gRNA
uaaaaagaauguaauucgcc

SEQ ID NO: 47807 - RNA, 20 nt, Artificial Sequence
  MKO10047807_A_Serpina1c
  gRNA
gcacaucaagcauucccgag

SEQ ID NO: 47808 - RNA, 20 nt, Artificial Sequence
  MKO10047808_A_Serpina1c
  gRNA
accuucugggccucuuuagc

SEQ ID NO: 47809 - RNA, 20 nt, Artificial Sequence
  MKO10047809_A_Serpina1c
  gRNA
gggugaucgaagcgcacgau

SEQ ID NO: 47810 - RNA, 20 nt, Artificial Sequence
  MKO10047810_A_Serpina1d
  gRNA
acuuugcccucagacuauac

SEQ ID NO: 47811 - RNA, 20 nt, Artificial Sequence
  MKO10047811_A_Serpina1d
  gRNA
ccagcucccuguauagucug

SEQ ID NO: 47812 - RNA, 20 nt, Artificial Sequence
  MKO10047812_A_Serpina1d
  gRNA
ggacgaguccaccacaguga

SEQ ID NO: 47813 - RNA, 20 nt, Artificial Sequence
  MKO10047813_A_Serpina1e
  gRNA
gggcgguugaagugcaagau

SEQ ID NO: 47814 - RNA, 20 nt, Artificial Sequence
  MKO10047814_A_Serpina1e
  gRNA
gcagcagcuacagucuuaca

SEQ ID NO: 47815 - RNA, 20 nt, Artificial Sequence
  MKO10047815_A_Serpina1e
  gRNA
acuuugccaucagucuauac

SEQ ID NO: 47816 - RNA, 20 nt, Artificial Sequence
  MKO10047816_A_Serpina1f
  gRNA
uagcagcguguucauccacc

SEQ ID NO: 47817 - RNA, 20 nt, Artificial Sequence
  MKO10047817_A_Serpina1f
  gRNA
ucaauaauugucgucucauc

SEQ ID NO: 47818 - RNA, 20 nt, Artificial Sequence
  MKO10047818_A_Serpina1f
  gRNA
uaaccuacccacacuuccgc

SEQ ID NO: 47819 - RNA, 20 nt, Artificial Sequence
  MKO10047819_A_Serpina3a
  gRNA
ugacccugaagacacguucc

SEQ ID NO: 47820 - RNA, 20 nt, Artificial Sequence
  MKO10047820_A_Serpina3a
  gRNA
guuuaagaguauuagcguua

SEQ ID NO: 47821 - RNA, 20 nt, Artificial Sequence
  MKO10047821_A_Serpina3a
  gRNA
ugugcccaugaugaaaaccg

SEQ ID NO: 47822 - RNA, 20 nt, Artificial Sequence
  MKO10047822_A_Serpina3b
  gRNA
cucaucuuuagcggaaugga

SEQ ID NO: 47823 - RNA, 20 nt, Artificial Sequence
  MKO10047823_A_Serpina3b
  gRNA
cagagcaguugcgaugccaa

SEQ ID NO: 47824 - RNA, 20 nt, Artificial Sequence
  MKO10047824_A_Serpina3b
  gRNA
cuugaucuaaaacaauguac

SEQ ID NO: 47825 - RNA, 20 nt, Artificial Sequence
  MKO10047825_A_Serpina3c
  gRNA
ccaucaguguauccguaucc

SEQ ID NO: 47826 - RNA, 20 nt, Artificial Sequence
  MKO10047826_A_Serpina3c
  gRNA
uacggauacacugauggugc

SEQ ID NO: 47827 - RNA, 20 nt, Artificial Sequence
  MKO10047827_A_Serpina3c
  gRNA
aaugcgaaaauugaccccug

SEQ ID NO: 47828 - RNA, 20 nt, Artificial Sequence
  MKO10047828_A_Serpina3f
  gRNA
augggagaugcccuuugauc

SEQ ID NO: 47829 - RNA, 20 nt, Artificial Sequence
  MKO10047829_A_Serpina3f
  gRNA
agauuacaccuugacaacau

SEQ ID NO: 47830 - RNA, 20 nt, Artificial Sequence
  MKO10047830_A_Serpina3f
  gRNA
cuaugaaaauauauuucgac

SEQ ID NO: 47831 - RNA, 20 nt, Artificial Sequence
  MKO10047831_A_Serpina3g
  gRNA
aaauguaucauucgggucaa

SEQ ID NO: 47832 - RNA, 20 nt, Artificial Sequence
  MKO10047832_A_Serpina3g
  gRNA
auuguguccaugaugaaaac

SEQ ID NO: 47833 - RNA, 20 nt, Artificial Sequence
  MKO10047833_A_Serpina3g
  gRNA
ccaucaaugugcucucuuuc

SEQ ID NO: 47834 - RNA, 20 nt, Artificial Sequence
  MKO10047834_A_Serpina3i
  gRNA
ugagcacguccuucccgugc

SEQ ID NO: 47835 - RNA, 20 nt, Artificial Sequence
  MKO10047835_A_Serpina3i
  gRNA
gugcucaaggcuguagucau

SEQ ID NO: 47836 - RNA, 20 nt, Artificial Sequence
  MKO10047836_A_Serpina3i
  gRNA
aaauguaucacgggggucaa

SEQ ID NO: 47837 - RNA, 20 nt, Artificial Sequence
  MKO10047837_A_Serpina3j
  gRNA
gauguuucacagcgcugcgc

SEQ ID NO: 47838 - RNA, 20 nt, Artificial Sequence
  MKO10047838_A_Serpina3j
  gRNA
ugacccuuaugaaacguuca

SEQ ID NO: 47839 - RNA, 20 nt, Artificial Sequence
  MKO10047839_A_Serpina3j
  gRNA
guccccaugaacguuucaua

SEQ ID NO: 47840 - RNA, 20 nt, Artificial Sequence
  MKO10047840_A_Serpina3k
  gRNA
gguuauugguggcauucgua

SEQ ID NO: 47841 - RNA, 20 nt, Artificial Sequence
  MKO10047841_A_Serpina3k
  gRNA
ucuccaucgcuagugacuac

SEQ ID NO: 47842 - RNA, 20 nt, Artificial Sequence
  MKO10047842_A_Serpina3k
  gRNA
cagccuguagucacuagcga

SEQ ID NO: 47843 - RNA, 20 nt, Artificial Sequence
  MKO10047843_A_Serpina3m
  gRNA
cuaugacugugcaguucaac

SEQ ID NO: 47844 - RNA, 20 nt, Artificial Sequence
  MKO10047844_A_Serpina3m
  gRNA
gucuuaccugagacacacuc

SEQ ID NO: 47845 - RNA, 20 nt, Artificial Sequence
  MKO10047845_A_Serpina3m
  gRNA
cucuacugacuacaaccuga

SEQ ID NO: 47846 - RNA, 20 nt, Artificial Sequence
  MKO10047846_A_Serpina3n
  gRNA
ucagacuugaacgugucaag

SEQ ID NO: 47847 - RNA, 20 nt, Artificial Sequence
  MKO10047847_A_Serpina3n
  gRNA
guucaagucugaguucuacg

SEQ ID NO: 47848 - RNA, 20 nt, Artificial Sequence
  MKO10047848_A_Serpina3n
  gRNA
uccauucccaacgugccauc

SEQ ID NO: 47849 - RNA, 20 nt, Artificial Sequence
  MKO10047849_A_Serpina5
  gRNA
ucgucccggauauguacugc

SEQ ID NO: 47850 - RNA, 20 nt, Artificial Sequence
  MKO10047850_A_Serpina5
  gRNA
cuugagcgugucuaugaguu

SEQ ID NO: 47851 - RNA, 20 nt, Artificial Sequence
  MKO10047851_A_Serpina5
  gRNA
cccaugaugaaccgugaaga

SEQ ID NO: 47852 - RNA, 20 nt, Artificial Sequence
  MKO10047852_A_Serpina6
  gRNA
caacuuguacaaacgccuag

SEQ ID NO: 47853 - RNA, 20 nt, Artificial Sequence
  MKO10047853_A_Serpina6
  gRNA
cugucgucgcugcacuuaau

SEQ ID NO: 47854 - RNA, 20 nt, Artificial Sequence
  MKO10047854_A_Serpina6
  gRNA
uucaaguucucaccgagacc

SEQ ID NO: 47855 - RNA, 20 nt, Artificial Sequence
  MKO10047855_A_Serpina7
  gRNA
guaagaaugcucuauccaau

SEQ ID NO: 47856 - RNA, 20 nt, Artificial Sequence
  MKO10047856_A_Serpina7
  gRNA
ucuucacccuguuauccgau

SEQ ID NO: 47857 - RNA, 20 nt, Artificial Sequence
  MKO10047857_A_Serpina7
  gRNA
caucaugggcacuuguacug

SEQ ID NO: 47858 - RNA, 20 nt, Artificial Sequence
  MKO10047858_A_Serpina9
  gRNA
ccaaacuuauaguccgcuca

SEQ ID NO: 47859 - RNA, 20 nt, Artificial Sequence
  MKO10047859_A_Serpina9
  gRNA
caucgcggauucccaucuug

SEQ ID NO: 47860 - RNA, 20 nt, Artificial Sequence
  MKO10047860_A_Serpina9
  gRNA
cgcugcccauccgcaauucc

SEQ ID NO: 47861 - RNA, 20 nt, Artificial Sequence
  MKO10047861_A_Serpinb10
  gRNA
ucaacaaaguuaacagauug

SEQ ID NO: 47862 - RNA, 20 nt, Artificial Sequence
  MKO10047862_A_Serpinb10
  gRNA
ugucgacugagucaucuggg

SEQ ID NO: 47863 - RNA, 20 nt, Artificial Sequence
  MKO10047863_A_Serpinb10
  gRNA
cagugaaaagcaccaccgaa

SEQ ID NO: 47864 - RNA, 20 nt, Artificial Sequence
  MKO10047864_A_Serpinb11
  gRNA
aauugacccauccucgguca

SEQ ID NO: 47865 - RNA, 20 nt, Artificial Sequence
  MKO10047865_A_Serpinb11
  gRNA
acucacuaggaccaugaccg

SEQ ID NO: 47866 - RNA, 20 nt, Artificial Sequence
  MKO10047866_A_Serpinb11
  gRNA
agauucuguuagcaacgcug

SEQ ID NO: 47867 - RNA, 20 nt, Artificial Sequence
  MKO10047867_A_Serpinb12
  gRNA
cuacacuuucgacuguugug

SEQ ID NO: 47868 - RNA, 20 nt, Artificial Sequence
  MKO10047868_A_Serpinb12
  gRNA
ggaauacucugaugacguaa

SEQ ID NO: 47869 - RNA, 20 nt, Artificial Sequence
  MKO10047869_A_Serpinb12
  gRNA
uauugauaacucaacugugc

SEQ ID NO: 47870 - RNA, 20 nt, Artificial Sequence
  MKO10047870_A_Serpinb13
  gRNA
acagccuguugcuuaugauc

SEQ ID NO: 47871 - RNA, 20 nt, Artificial Sequence
  MKO10047871_A_Serpinb13
  gRNA
gagcuguucaaagagccuuc

SEQ ID NO: 47872 - RNA, 20 nt, Artificial Sequence
  MKO10047872_A_Serpinb13
  gRNA
uuugaacagcuccaccaagc

SEQ ID NO: 47873 - RNA, 20 nt, Artificial Sequence
  MKO10047873_A_Serpinb1a
  gRNA
aaugcugaagugagcaaacg

SEQ ID NO: 47874 - RNA, 20 nt, Artificial Sequence
  MKO10047874_A_Serpinb1a
  gRNA
caguaugaccaaacuugugc

SEQ ID NO: 47875 - RNA, 20 nt, Artificial Sequence
  MKO10047875_A_Serpinb1a
  gRNA
gcuucaacccagaaaaugua

SEQ ID NO: 47876 - RNA, 20 nt, Artificial Sequence
  MKO10047876_A_Serpinb1b
  gRNA
ugcuccauucagacugaaua

SEQ ID NO: 47877 - RNA, 20 nt, Artificial Sequence
  MKO10047877_A_Serpinb1b
  gRNA
acacccuuagccagcaguuc

SEQ ID NO: 47878 - RNA, 20 nt, Artificial Sequence
  MKO10047878_A_Serpinb1b
  gRNA
ugaguccacgggucuuaaga

SEQ ID NO: 47879 - RNA, 20 nt, Artificial Sequence
  MKO10047879_A_Serpinb1c
  gRNA
cauuccagaccugaagugca

SEQ ID NO: 47880 - RNA, 20 nt, Artificial Sequence
  MKO10047880_A_Serpinb1c
  gRNA
agugaaugccaccuauuuca

SEQ ID NO: 47881 - RNA, 20 nt, Artificial Sequence
  MKO10047881_A_Serpinb1c
  gRNA
cgagaccacaggucuugagg

SEQ ID NO: 47882 - RNA, 20 nt, Artificial Sequence
  MKO10047882_A_Serpinb2
  gRNA
aucccaaaccugcuacccga

SEQ ID NO: 47883 - RNA, 20 nt, Artificial Sequence
  MKO10047883_A_Serpinb2
  gRNA
ugucucauaccgaguucaca

SEQ ID NO: 47884 - RNA, 20 nt, Artificial Sequence
  MKO10047884_A_Serpinb2
  gRNA
gugcugcaguuuaaugaaau

SEQ ID NO: 47885 - RNA, 20 nt, Artificial Sequence
  MKO10047885_A_Serpinb3a
  gRNA
caaugaugcuuaugaucuaa

SEQ ID NO: 47886 - RNA, 20 nt, Artificial Sequence
  MKO10047886_A_Serpinb3a
  gRNA
ccauuauagugcuccuguuc

SEQ ID NO: 47887 - RNA, 20 nt, Artificial Sequence
  MKO10047887_A_Serpinb3a
  gRNA
uuccuaaugggagccugaac

SEQ ID NO: 47888 - RNA, 20 nt, Artificial Sequence
  MKO10047888_A_Serpinb3b
  gRNA
ccuaagcaguagcacuauac

SEQ ID NO: 47889 - RNA, 20 nt, Artificial Sequence
  MKO10047889_A_Serpinb3b
  gRNA
ccaguauagugcuacugcuu

SEQ ID NO: 47890 - RNA, 20 nt, Artificial Sequence
  MKO10047890_A_Serpinb3b
  gRNA
ucaagcuaagguggaaucac

SEQ ID NO: 47891 - RNA, 20 nt, Artificial Sequence
  MKO10047891_A_Serpinb3c
  gRNA
ccaguuuagugcuacugcuc

SEQ ID NO: 47892 - RNA, 20 nt, Artificial Sequence
  MKO10047892_A_Serpinb3c
  gRNA
ccugagcaguagcacuaaac

SEQ ID NO: 47893 - RNA, 20 nt, Artificial Sequence
  MKO10047893_A_Serpinb3c
  gRNA
gaaaaacuuaccuggaguaa

SEQ ID NO: 47894 - RNA, 20 nt, Artificial Sequence
  MKO10047894_A_Serpinb3d
  gRNA
caagugauuccacguuagcu

SEQ ID NO: 47895 - RNA, 20 nt, Artificial Sequence
  MKO10047895_A_Serpinb3d
  gRNA
auuuguuugccuugccaucc

SEQ ID NO: 47896 - RNA, 20 nt, Artificial Sequence
  MKO10047896_A_Serpinb3d
  gRNA
caauaaugcuuaugaccuaa

SEQ ID NO: 47897 - RNA, 20 nt, Artificial Sequence
  MKO10047897_A_Serpinb5
  gRNA
gcauacucagaugcuuauuc

SEQ ID NO: 47898 - RNA, 20 nt, Artificial Sequence
  MKO10047898_A_Serpinb5
  gRNA
ugaccagaccaaaauccuug

SEQ ID NO: 47899 - RNA, 20 nt, Artificial Sequence
  MKO10047899_A_Serpinb5
  gRNA
uaugcucauugugcucccca

SEQ ID NO: 47900 - RNA, 20 nt, Artificial Sequence
  MKO10047900_A_Serpinb6a
  gRNA
aguuuaacaaagagcauacc

SEQ ID NO: 47901 - RNA, 20 nt, Artificial Sequence
  MKO10047901_A_Serpinb6a
  gRNA
ggacuuucagggugcuacag

SEQ ID NO: 47902 - RNA, 20 nt, Artificial Sequence
  MKO10047902_A_Serpinb6a
  gRNA
ggucacuuaccugagccauc

SEQ ID NO: 47903 - RNA, 20 nt, Artificial Sequence
  MKO10047903_A_Serpinb6b
  gRNA
ugaacacauugaacuaagua

SEQ ID NO: 47904 - RNA, 20 nt, Artificial Sequence
  MKO10047904_A_Serpinb6b
  gRNA
ucguuucugugagaagugau

SEQ ID NO: 47905 - RNA, 20 nt, Artificial Sequence
  MKO10047905_A_Serpinb6b
  gRNA
cucacagaaacgaacaagac

SEQ ID NO: 47906 - RNA, 20 nt, Artificial Sequence
  MKO10047906_A_Serpinb6c
  gRNA
ugaaguagacagcauucacg

SEQ ID NO: 47907 - RNA, 20 nt, Artificial Sequence
  MKO10047907_A_Serpinb6c
  gRNA
ucacuucgcugagaaguaac

SEQ ID NO: 47908 - RNA, 20 nt, Artificial Sequence
  MKO10047908_A_Serpinb6c
  gRNA
guguuugaauguauuguacc

SEQ ID NO: 47909 - RNA, 20 nt, Artificial Sequence
  MKO10047909_A_Serpinb6d
  gRNA
gguggauaucucuucuauau

SEQ ID NO: 47910 - RNA, 20 nt, Artificial Sequence
  MKO10047910_A_Serpinb6d
  gRNA
uccaugugaagauauccacc

SEQ ID NO: 47911 - RNA, 20 nt, Artificial Sequence
  MKO10047911_A_Serpinb6d
  gRNA
gaagugaacaagacugaucc

SEQ ID NO: 47912 - RNA, 20 nt, Artificial Sequence
  MKO10047912_A_Serpinb6e
  gRNA
gucgacagcacaucaacgcc

SEQ ID NO: 47913 - RNA, 20 nt, Artificial Sequence
  MKO10047913_A_Serpinb6e
  gRNA
augugcugucgacacugcuc

SEQ ID NO: 47914 - RNA, 20 nt, Artificial Sequence
  MKO10047914_A_Serpinb6e
  gRNA
uggaggugcagauguccagc

SEQ ID NO: 47915 - RNA, 20 nt, Artificial Sequence
  MKO10047915_A_Serpinb7
  gRNA
ccaugacagccgacgagcug

SEQ ID NO: 47916 - RNA, 20 nt, Artificial Sequence
  MKO10047916_A_Serpinb7
  gRNA
cgacagcagccucagcucgu

SEQ ID NO: 47917 - RNA, 20 nt, Artificial Sequence
  MKO10047917_A_Serpinb7
  gRNA
uaugaacucagcauugccac

SEQ ID NO: 47918 - RNA, 20 nt, Artificial Sequence
  MKO10047918_A_Serpinb8
  gRNA
uuugaccgaaaguacacgag

SEQ ID NO: 47919 - RNA, 20 nt, Artificial Sequence
  MKO10047919_A_Serpinb8
  gRNA
ugaaagcacugaucucgccg

SEQ ID NO: 47920 - RNA, 20 nt, Artificial Sequence
  MKO10047920_A_Serpinb8
  gRNA
aaaagugccugccgacucuu

SEQ ID NO: 47921 - RNA, 20 nt, Artificial Sequence
  MKO10047921_A_Serpinb9b
  gRNA
gagucaucugccaacaacuc

SEQ ID NO: 47922 - RNA, 20 nt, Artificial Sequence
  MKO10047922_A_Serpinb9b
  gRNA
ugaaucauagaagcgaaaac

SEQ ID NO: 47923 - RNA, 20 nt, Artificial Sequence
  MKO10047923_A_Serpinb9b
  gRNA
ugacgagaaccagccugguc

SEQ ID NO: 47924 - RNA, 20 nt, Artificial Sequence
  MKO10047924_A_Serpinb9c
  gRNA
caccgaaauccagauaucug

SEQ ID NO: 47925 - RNA, 20 nt, Artificial Sequence
  MKO10047925_A_Serpinb9c
  gRNA
ugguggacuuuaugucaaac

SEQ ID NO: 47926 - RNA, 20 nt, Artificial Sequence
  MKO10047926_A_Serpinb9c
  gRNA
ggcaacuuaccucagauauc

SEQ ID NO: 47927 - RNA, 20 nt, Artificial Sequence
  MKO10047927_A_Serpinb9d
  gRNA
ugugaaucaauggagucuuu

SEQ ID NO: 47928 - RNA, 20 nt, Artificial Sequence
  MKO10047928_A_Serpinb9d
  gRNA
agaguuuauaccauguuccu

SEQ ID NO: 47929 - RNA, 20 nt, Artificial Sequence
  MKO10047929_A_Serpinb9d
  gRNA
cgugguccuacucccagaua

SEQ ID NO: 47930 - RNA, 20 nt, Artificial Sequence
  MKO10047930_A_Serpinb9e
  gRNA
agcauuggcgagaauuagcc

SEQ ID NO: 47931 - RNA, 20 nt, Artificial Sequence
  MKO10047931_A_Serpinb9e
  gRNA
gccaaugcuuuauacuucca

SEQ ID NO: 47932 - RNA, 20 nt, Artificial Sequence
  MKO10047932_A_Serpinb9e
  gRNA
cugauguccacacccugauc

SEQ ID NO: 47933 - RNA, 20 nt, Artificial Sequence
  MKO10047933_A_Serpinb9f
  gRNA
ccauucuaaggcaguacuuu

SEQ ID NO: 47934 - RNA, 20 nt, Artificial Sequence
  MKO10047934_A_Serpinb9f
  gRNA
ccaaaaguacugccuuagaa

SEQ ID NO: 47935 - RNA, 20 nt, Artificial Sequence
  MKO10047935_A_Serpinb9f
  gRNA
cuucuuaccauuagucuguu

SEQ ID NO: 47936 - RNA, 20 nt, Artificial Sequence
  MKO10047936_A_Serpinb9g
  gRNA
cgugguccuacucccagaug

SEQ ID NO: 47937 - RNA, 20 nt, Artificial Sequence
  MKO10047937_A_Serpinb9g
  gRNA
cccagaugaagauguccauc

SEQ ID NO: 47938 - RNA, 20 nt, Artificial Sequence
  MKO10047938_A_Serpinb9g
  gRNA
ccauaguaaggcaguacuuu

SEQ ID NO: 47939 - RNA, 20 nt, Artificial Sequence
  MKO10047939_A_Serpinb9
  gRNA
auauaaccucgccuauguga

SEQ ID NO: 47940 - RNA, 20 nt, Artificial Sequence
  MKO10047940_A_Serpinb9
  gRNA
gcuccgucgauucagaaacc

SEQ ID NO: 47941 - RNA, 20 nt, Artificial Sequence
  MKO10047941_A_Serpinb9
  gRNA
cagccugguuucugaaucga

SEQ ID NO: 47942 - RNA, 20 nt, Artificial Sequence
  MKO10047942_A_Serpinc1
  gRNA
gaaccguucuauaaggucga

SEQ ID NO: 47943 - RNA, 20 nt, Artificial Sequence
  MKO10047943_A_Serpinc1
  gRNA
caaauucaaauaccggcgcg

SEQ ID NO: 47944 - RNA, 20 nt, Artificial Sequence
  MKO10047944_A_Serpinc1
  gRNA
aucuugauagcucucguuga

SEQ ID NO: 47945 - RNA, 20 nt, Artificial Sequence
  MKO10047945_A_Serpind1
  gRNA
agcuuugaaguccucccgua

SEQ ID NO: 47946 - RNA, 20 nt, Artificial Sequence
  MKO10047946_A_Serpind1
  gRNA
agcugacccaucgucuauuc

SEQ ID NO: 47947 - RNA, 20 nt, Artificial Sequence
  MKO10047947_A_Serpind1
  gRNA
ccaggucaauggcgauccuc

SEQ ID NO: 47948 - RNA, 20 nt, Artificial Sequence
  MKO10047948_A_Serpine1
  gRNA
aacgucauacucgagcccau

SEQ ID NO: 47949 - RNA, 20 nt, Artificial Sequence
  MKO10047949_A_Serpine1
  gRNA
cagcucgucuacagcccccu

SEQ ID NO: 47950 - RNA, 20 nt, Artificial Sequence
  MKO10047950_A_Serpine1
  gRNA
uguagacgagcugacacgcc

SEQ ID NO: 47951 - RNA, 20 nt, Artificial Sequence
  MKO10047951_A_Serpine2
  gRNA
agggcaccaucgaucagauu

SEQ ID NO: 47952 - RNA, 20 nt, Artificial Sequence
  MKO10047952_A_Serpine2
  gRNA
gguguucauccagcuaucaa

SEQ ID NO: 47953 - RNA, 20 nt, Artificial Sequence
  MKO10047953_A_Serpine2
  gRNA
ugaaauacacugcauuaacg

SEQ ID NO: 47954 - RNA, 20 nt, Artificial Sequence
  MKO10047954_A_Serpine3
  gRNA
cggccccacaacgggcuauc

SEQ ID NO: 47955 - RNA, 20 nt, Artificial Sequence
  MKO10047955_A_Serpine3
  gRNA
cgagccuaacagcacuacca

SEQ ID NO: 47956 - RNA, 20 nt, Artificial Sequence
  MKO10047956_A_Serpine3
  gRNA
aaggcccagauagcccguug

SEQ ID NO: 47957 - RNA, 20 nt, Artificial Sequence
  MKO10047957_A_Serpinf1
  gRNA
guacagaucguagccgaagu

SEQ ID NO: 47958 - RNA, 20 nt, Artificial Sequence
  MKO10047958_A_Serpinf1
  gRNA
guccaagccguaucguaaga

SEQ ID NO: 47959 - RNA, 20 nt, Artificial Sequence
  MKO10047959_A_Serpinf1
  gRNA
gaagauugcccgguccacga

SEQ ID NO: 47960 - RNA, 20 nt, Artificial Sequence
  MKO10047960_A_Serpinf2
  gRNA
guucucuccggugagcgccg

SEQ ID NO: 47961 - RNA, 20 nt, Artificial Sequence
  MKO10047961_A_Serpinf2
  gRNA
cagccagucggauugucccu

SEQ ID NO: 47962 - RNA, 20 nt, Artificial Sequence
  MKO10047962_A_Serpinf2
  gRNA
ccugguuguccaacuugaag

SEQ ID NO: 47963 - RNA, 20 nt, Artificial Sequence
  MKO10047963_A_Serping1
  gRNA
ccagcagcuugcggaucuua

SEQ ID NO: 47964 - RNA, 20 nt, Artificial Sequence
  MKO10047964_A_Serping1
  gRNA
ccauaagauccgcaagcugc

SEQ ID NO: 47965 - RNA, 20 nt, Artificial Sequence
  MKO10047965_A_Serping1
  gRNA
guacuuuacgcuacucauca

SEQ ID NO: 47966 - RNA, 20 nt, Artificial Sequence
  MKO10047966_A_Serpinh1
  gRNA
aucgcgcaugucuggcaaga

SEQ ID NO: 47967 - RNA, 20 nt, Artificial Sequence
  MKO10047967_A_Serpinh1
  gRNA
ucacggagcugggcccguac

SEQ ID NO: 47968 - RNA, 20 nt, Artificial Sequence
  MKO10047968_A_Serpinh1
  gRNA
guuacgaugaugcaccggac

SEQ ID NO: 47969 - RNA, 20 nt, Artificial Sequence
  MKO10047969_A_Serpini1
  gRNA
acuuucaucaucuuucguga

SEQ ID NO: 47970 - RNA, 20 nt, Artificial Sequence
  MKO10047970_A_Serpini1
  gRNA
aagcacagcugaucgaagaa

SEQ ID NO: 47971 - RNA, 20 nt, Artificial Sequence
  MKO10047971_A_Serpini1
  gRNA
aauucgcucuuuguacaaaa

SEQ ID NO: 47972 - RNA, 20 nt, Artificial Sequence
  MKO10047972_A_Serpini2
  gRNA
auuuggccccuugacucguc

SEQ ID NO: 47973 - RNA, 20 nt, Artificial Sequence
  MKO10047973_A_Serpini2
  gRNA
uucgaugcucgugucuuccg

SEQ ID NO: 47974 - RNA, 20 nt, Artificial Sequence
  MKO10047974_A_Serpini2
  gRNA
caccaggaccagacgaguca

SEQ ID NO: 47975 - RNA, 20 nt, Artificial Sequence
  MKO10047975_A_Seruad1
  gRNA
aguggcgcagaccccgccga

SEQ ID NO: 47976 - RNA, 20 nt, Artificial Sequence
  MKO10047976_A_Seruad1
  gRNA
ccaaaguucacugucguaca

SEQ ID NO: 47977 - RNA, 20 nt, Artificial Sequence
  MKO10047977_A_Seruad1
  gRNA
cgagccggaccuccggcacc

SEQ ID NO: 47978 - RNA, 20 nt, Artificial Sequence
  MKO10047978_A_Seruad2
  gRNA
caucguugucguccucgagc

SEQ ID NO: 47979 - RNA, 20 nt, Artificial Sequence
  MKO10047979_A_Seruad2
  gRNA
gaagauagucuggcgcugua

SEQ ID NO: 47980 - RNA, 20 nt, Artificial Sequence
  MKO10047980_A_Seruad2
  gRNA
aaaaucgugucccccuccga

SEQ ID NO: 47981 - RNA, 20 nt, Artificial Sequence
  MKO10047981_A_Seruad3
  gRNA
ccagaaugagaucguguccc

SEQ ID NO: 47982 - RNA, 20 nt, Artificial Sequence
  MKO10047982_A_Seruad3
  gRNA
uggaaccgauggugguagau

SEQ ID NO: 47983 - RNA, 20 nt, Artificial Sequence
  MKO10047983_A_Seruad3
  gRNA
ugauacaucugcgguggaaa

SEQ ID NO: 47984 - RNA, 20 nt, Artificial Sequence
  MKO10047984_A_Seruad4
  gRNA
aagcaccucggccgccgcug

SEQ ID NO: 47985 - RNA, 20 nt, Artificial Sequence
  MKO10047985_A_Seruad4
  gRNA
uacggaggugcgagcccccc

SEQ ID NO: 47986 - RNA, 20 nt, Artificial Sequence
  MKO10047986_A_Seruad4
  gRNA
gugugcucgcuccucgaaaa

SEQ ID NO: 47987 - RNA, 20 nt, Artificial Sequence
  MKO10047987_A_Sertm1
  gRNA
cgaggacgaguccaccgacg

SEQ ID NO: 47988 - RNA, 20 nt, Artificial Sequence
  MKO10047988_A_Sertm1
  gRNA
auacuccggguacgaggagc

SEQ ID NO: 47989 - RNA, 20 nt, Artificial Sequence
  MKO10047989_A_Sertm1
  gRNA
ucccacaucgcuguccacgu

SEQ ID NO: 47990 - RNA, 20 nt, Artificial Sequence
  MKO10047990_A_Sesn1
  gRNA
uuccaauguagugccgauaa

SEQ ID NO: 47991 - RNA, 20 nt, Artificial Sequence
  MKO10047991_A_Sesn1
  gRNA
cagcuggucucucgccgagc

SEQ ID NO: 47992 - RNA, 20 nt, Artificial Sequence
  MKO10047992_A_Sesn1
  gRNA
gauuaccaaagaacauaucg

SEQ ID NO: 47993 - RNA, 20 nt, Artificial Sequence
  MKO10047993_A_Sesn2
  gRNA
uuucccguaggagcaucggg

SEQ ID NO: 47994 - RNA, 20 nt, Artificial Sequence
  MKO10047994_A_Sesn2
  gRNA
ucaacaaguuacuggcgcau

SEQ ID NO: 47995 - RNA, 20 nt, Artificial Sequence
  MKO10047995_A_Sesn2
  gRNA
cucgagagccucgccgagcc

SEQ ID NO: 47996 - RNA, 20 nt, Artificial Sequence
  MKO10047996_A_Sesn3
  gRNA
guacucuacauccggucgcc

SEQ ID NO: 47997 - RNA, 20 nt, Artificial Sequence
  MKO10047997_A_Sesn3
  gRNA
guucauccgccguauuugcu

SEQ ID NO: 47998 - RNA, 20 nt, Artificial Sequence
  MKO10047998_A_Sesn3
  gRNA
cuuggcucacuaucacgcuu

SEQ ID NO: 47999 - RNA, 20 nt, Artificial Sequence
  MKO10047999_A_Sestd1
  gRNA
gacaguugucuuaaugcugc

SEQ ID NO: 48000 - RNA, 20 nt, Artificial Sequence
  MKO10048000_A_Sestd1
  gRNA
cagaggauucacugugaucg

SEQ ID NO: 48001 - RNA, 20 nt, Artificial Sequence
  MKO10048001_A_Sestd1
  gRNA
cauccauacuugucugcuca

SEQ ID NO: 48002 - RNA, 20 nt, Artificial Sequence
  MKO10048002_A_Setbp1
  gRNA
agucgaaagaguaccuccgc

SEQ ID NO: 48003 - RNA, 20 nt, Artificial Sequence
  MKO10048003_A_Setbp1
  gRNA
agcuaccgccgaaaaacuga

SEQ ID NO: 48004 - RNA, 20 nt, Artificial Sequence
  MKO10048004_A_Setbp1
  gRNA
ggaguccucaucgaacugug

SEQ ID NO: 48005 - RNA, 20 nt, Artificial Sequence
  MKO10048005_A_Setd1a
  gRNA
uuuagacugaagcccgccga

SEQ ID NO: 48006 - RNA, 20 nt, Artificial Sequence
  MKO10048006_A_Setd1a
  gRNA
cauaguacuucauucguugu

SEQ ID NO: 48007 - RNA, 20 nt, Artificial Sequence
  MKO10048007_A_Setd1a
  gRNA
ggccuaggugcuuucgagug

SEQ ID NO: 48008 - RNA, 20 nt, Artificial Sequence
  MKO10048008_A_Setd1b
  gRNA
cccacugucgcggcucccaa

SEQ ID NO: 48009 - RNA, 20 nt, Artificial Sequence
  MKO10048009_A_Setd1b
  gRNA
acguccgugaaaacuuccua

SEQ ID NO: 48010 - RNA, 20 nt, Artificial Sequence
  MKO10048010_A_Setd1b
  gRNA
ucgucagucacccccaauag

SEQ ID NO: 48011 - RNA, 20 nt, Artificial Sequence
  MKO10048011_A_Setd2
  gRNA
gaucucuuucggaccgacau

SEQ ID NO: 48012 - RNA, 20 nt, Artificial Sequence
  MKO10048012_A_Setd2
  gRNA
gucgguccgaaagagaucga

SEQ ID NO: 48013 - RNA, 20 nt, Artificial Sequence
  MKO10048013_A_Setd2
  gRNA
acugcauucgcuuaauaucc

SEQ ID NO: 48014 - RNA, 20 nt, Artificial Sequence
  MKO10048014_A_Setd3
  gRNA
cuauuucuauaaagucaucc

SEQ ID NO: 48015 - RNA, 20 nt, Artificial Sequence
  MKO10048015_A_Setd3
  gRNA
agcaguccugcacccagccc

SEQ ID NO: 48016 - RNA, 20 nt, Artificial Sequence
  MKO10048016_A_Setd3
  gRNA
gggaagaguacacgcagauc

SEQ ID NO: 48017 - RNA, 20 nt, Artificial Sequence
  MKO10048017_A_Setd4
  gRNA
gaugagcaaagcgucguugc

SEQ ID NO: 48018 - RNA, 20 nt, Artificial Sequence
  MKO10048018_A_Setd4
  gRNA
gugugcgcuugcuccguucc

SEQ ID NO: 48019 - RNA, 20 nt, Artificial Sequence
  MKO10048019_A_Setd4
  gRNA
ccugguguucaccgugcacc

SEQ ID NO: 48020 - RNA, 20 nt, Artificial Sequence
  MKO10048020_A_Setd5
  gRNA
ucgcccguagaggaacgcug

SEQ ID NO: 48021 - RNA, 20 nt, Artificial Sequence
  MKO10048021_A_Setd5
  gRNA
acgcucuucucauuaacugc

SEQ ID NO: 48022 - RNA, 20 nt, Artificial Sequence
  MKO10048022_A_Setd5
  gRNA
guguauuccacucauaauua

SEQ ID NO: 48023 - RNA, 20 nt, Artificial Sequence
  MKO10048023_A_Setd6
  gRNA
cugaccuauaagccaucacg

SEQ ID NO: 48024 - RNA, 20 nt, Artificial Sequence
  MKO10048024_A_Setd6
  gRNA
agucgcaaccgcucuuccuc

SEQ ID NO: 48025 - RNA, 20 nt, Artificial Sequence
  MKO10048025_A_Setd6
  gRNA
cacugccgaguacucuagau

SEQ ID NO: 48026 - RNA, 20 nt, Artificial Sequence
  MKO10048026_A_Setd7
  gRNA
uuacguggacgaugcccugc

SEQ ID NO: 48027 - RNA, 20 nt, Artificial Sequence
  MKO10048027_A_Setd7
  gRNA
cguccacguaauaucccucc

SEQ ID NO: 48028 - RNA, 20 nt, Artificial Sequence
  MKO10048028_A_Setd7
  gRNA
cccgacgucacuucaaagug

SEQ ID NO: 48029 - RNA, 20 nt, Artificial Sequence
  MKO10048029_A_Setd8
  gRNA
gccugcuuaccccgucgcug

SEQ ID NO: 48030 - RNA, 20 nt, Artificial Sequence
  MKO10048030_A_Setd8
  gRNA
gaagaugugcaagccccgcg

SEQ ID NO: 48031 - RNA, 20 nt, Artificial Sequence
  MKO10048031_A_Setd8
  gRNA
uucuaggagaacguguuugc

SEQ ID NO: 48032 - RNA, 20 nt, Artificial Sequence
  MKO10048032_A_Setdb1
  gRNA
ccuacagcuucgugaagcua

SEQ ID NO: 48033 - RNA, 20 nt, Artificial Sequence
  MKO10048033_A_Setdb1
  gRNA
caacucaccuucuggucuuu

SEQ ID NO: 48034 - RNA, 20 nt, Artificial Sequence
  MKO10048034_A_Setdb1
  gRNA
aguucucaagaucuacauaa

SEQ ID NO: 48035 - RNA, 20 nt, Artificial Sequence
  MKO10048035_A_Setdb2
  gRNA
uacgggauaguacagcccuu

SEQ ID NO: 48036 - RNA, 20 nt, Artificial Sequence
  MKO10048036_A_Setdb2
  gRNA
uaggugaugcaaagacuuuc

SEQ ID NO: 48037 - RNA, 20 nt, Artificial Sequence
  MKO10048037_A_Setdb2
  gRNA
uucauuacuuauuccaaucc

SEQ ID NO: 48038 - RNA, 20 nt, Artificial Sequence
  MKO10048038_A_Setmar
  gRNA
accauugagucaauucggac

SEQ ID NO: 48039 - RNA, 20 nt, Artificial Sequence
  MKO10048039_A_Setmar
  gRNA
gaacucucuuacgacuauuc

SEQ ID NO: 48040 - RNA, 20 nt, Artificial Sequence
  MKO10048040_A_Setmar
  gRNA
gaacaacaagauguagcgug

SEQ ID NO: 48041 - RNA, 20 nt, Artificial Sequence
  MKO10048041_A_Setx
  gRNA
caauuacuuagguucggcga

SEQ ID NO: 48042 - RNA, 20 nt, Artificial Sequence
  MKO10048042_A_Setx
  gRNA
cgcucaugcagaagcaagua

SEQ ID NO: 48043 - RNA, 20 nt, Artificial Sequence
  MKO10048043_A_Setx
  gRNA
gaacagcuguuugacuguag

SEQ ID NO: 48044 - RNA, 20 nt, Artificial Sequence
  MKO10048044_A_Set
  gRNA
acauuugucaaccauccaca

SEQ ID NO: 48045 - RNA, 20 nt, Artificial Sequence
  MKO10048045_A_Set
  gRNA
ucucuagugucugcacugcu

SEQ ID NO: 48046 - RNA, 20 nt, Artificial Sequence
  MKO10048046_A_Set
  gRNA
aaguacaaaaugaaauagac

SEQ ID NO: 48047 - RNA, 20 nt, Artificial Sequence
  MKO10048047_A_Sez6l2
  gRNA
cccggcaagaagccgaucuc

SEQ ID NO: 48048 - RNA, 20 nt, Artificial Sequence
  MKO10048048_A_Sez6l2
  gRNA
cgaaggguuuguggagucuc

SEQ ID NO: 48049 - RNA, 20 nt, Artificial Sequence
  MKO10048049_A_Sez6l2
  gRNA
ugaaucucaaugccauaacc

SEQ ID NO: 48050 - RNA, 20 nt, Artificial Sequence
  MKO10048050_A_Sez6l
  gRNA
gaucgcgcccuucacugcac

SEQ ID NO: 48051 - RNA, 20 nt, Artificial Sequence
  MKO10048051_A_Sez6l
  gRNA
cacaagccgcgggacccgac

SEQ ID NO: 48052 - RNA, 20 nt, Artificial Sequence
  MKO10048052_A_Sez6l
  gRNA
uagcuacgaugcccguggca

SEQ ID NO: 48053 - RNA, 20 nt, Artificial Sequence
  MKO10048053_A_Sez6
  gRNA
uuuccccgacguccagcgua

SEQ ID NO: 48054 - RNA, 20 nt, Artificial Sequence
  MKO10048054_A_Sez6
  gRNA
uaccaguccgacuccagccg

SEQ ID NO: 48055 - RNA, 20 nt, Artificial Sequence
  MKO10048055_A_Sez6
  gRNA
ccuuaccuugguagcggaaa

SEQ ID NO: 48056 - RNA, 20 nt, Artificial Sequence
  MKO10048056_A_Sf1
  gRNA
cugugcgcaguuuacgaguc

SEQ ID NO: 48057 - RNA, 20 nt, Artificial Sequence
  MKO10048057_A_Sf1
  gRNA
cggagcgaacgccacgccgc

SEQ ID NO: 48058 - RNA, 20 nt, Artificial Sequence
  MKO10048058_A_Sf1
  gRNA
cugacucguaaacugcgcac

SEQ ID NO: 48059 - RNA, 20 nt, Artificial Sequence
  MKO10048059_A_Sf3a1
  gRNA
ccaagagaccauaguaccga

SEQ ID NO: 48060 - RNA, 20 nt, Artificial Sequence
  MKO10048060_A_Sf3a1
  gRNA
ggguaaauaaugccgaccac

SEQ ID NO: 48061 - RNA, 20 nt, Artificial Sequence
  MKO10048061_A_Sf3a1
  gRNA
agggggcuccuucgguacua

SEQ ID NO: 48062 - RNA, 20 nt, Artificial Sequence
  MKO10048062_A_Sf3a2
  gRNA
ugcacucauaggaucccaag

SEQ ID NO: 48063 - RNA, 20 nt, Artificial Sequence
  MKO10048063_A_Sf3a2
  gRNA
cucuuugcaggggagcuacc

SEQ ID NO: 48064 - RNA, 20 nt, Artificial Sequence
  MKO10048064_A_Sf3a2
  gRNA
aggcugggcgggggcuucuu

SEQ ID NO: 48065 - RNA, 20 nt, Artificial Sequence
  MKO10048065_A_Sf3a3
  gRNA
caucuugcauggcccgagug

SEQ ID NO: 48066 - RNA, 20 nt, Artificial Sequence
  MKO10048066_A_Sf3a3
  gRNA
ccaucggaagcacccaaaug

SEQ ID NO: 48067 - RNA, 20 nt, Artificial Sequence
  MKO10048067_A_Sf3a3
  gRNA
ucaauuccgaucaccgcacu

SEQ ID NO: 48068 - RNA, 20 nt, Artificial Sequence
  MKO10048068_A_Sf3b1
  gRNA
guccuccaaagauugccgau

SEQ ID NO: 48069 - RNA, 20 nt, Artificial Sequence
  MKO10048069_A_Sf3b1
  gRNA
gccuggauaucaugcccccg

SEQ ID NO: 48070 - RNA, 20 nt, Artificial Sequence
  MKO10048070_A_Sf3b1
  gRNA
uauaucauuaagcaacgcca

SEQ ID NO: 48071 - RNA, 20 nt, Artificial Sequence
  MKO10048071_A_Sf3b2
  gRNA
ucguccuauagggagucgcg

SEQ ID NO: 48072 - RNA, 20 nt, Artificial Sequence
  MKO10048072_A_Sf3b2
  gRNA
gucuuaccgcgaggccccag

SEQ ID NO: 48073 - RNA, 20 nt, Artificial Sequence
  MKO10048073_A_Sf3b2
  gRNA
gcugcagaccuacacccguc

SEQ ID NO: 48074 - RNA, 20 nt, Artificial Sequence
  MKO10048074_A_Sf3b3
  gRNA
ggaugucgccguauuguucc

SEQ ID NO: 48075 - RNA, 20 nt, Artificial Sequence
  MKO10048075_A_Sf3b3
  gRNA
uccggucacuuauggcguuu

SEQ ID NO: 48076 - RNA, 20 nt, Artificial Sequence
  MKO10048076_A_Sf3b3
  gRNA
ucacgugguuggcguagacg

SEQ ID NO: 48077 - RNA, 20 nt, Artificial Sequence
  MKO10048077_A_Sf3b4
  gRNA
ccaaugggcaugcccccccg

SEQ ID NO: 48078 - RNA, 20 nt, Artificial Sequence
  MKO10048078_A_Sf3b4
  gRNA
uuuagaugccacgguguacg

SEQ ID NO: 48079 - RNA, 20 nt, Artificial Sequence
  MKO10048079_A_Sf3b4
  gRNA
uacacaggcaugccgccucc

SEQ ID NO: 48080 - RNA, 20 nt, Artificial Sequence
  MKO10048080_A_Sf3b5
  gRNA
agagcggcgcgaugacggac

SEQ ID NO: 48081 - RNA, 20 nt, Artificial Sequence
  MKO10048081_A_Sf3b5
  gRNA
guggcccgugccgauguacu

SEQ ID NO: 48082 - RNA, 20 nt, Artificial Sequence
  MKO10048082_A_Sf3b5
  gRNA
acgagagcaaagcccgcgug

SEQ ID NO: 48083 - RNA, 20 nt, Artificial Sequence
  MKO10048083_A_Sfi1
  gRNA
gauuacaagaacuucgaauc

SEQ ID NO: 48084 - RNA, 20 nt, Artificial Sequence
  MKO10048084_A_Sfi1
  gRNA
ucacucgaauccacaaauac

SEQ ID NO: 48085 - RNA, 20 nt, Artificial Sequence
  MKO10048085_A_Sfi1
  gRNA
acuaucaugccucacaaaac

SEQ ID NO: 48086 - RNA, 20 nt, Artificial Sequence
  MKO10048086_A_Sfmbt1
  gRNA
uacauguuuaaacgaugcgu

SEQ ID NO: 48087 - RNA, 20 nt, Artificial Sequence
  MKO10048087_A_Sfmbt1
  gRNA
ccuuaccuaaugggggcuga

SEQ ID NO: 48088 - RNA, 20 nt, Artificial Sequence
  MKO10048088_A_Sfmbt1
  gRNA
cauagccuucauaacgaagc

SEQ ID NO: 48089 - RNA, 20 nt, Artificial Sequence
  MKO10048089_A_Sfmbt2
  gRNA
gaguugcgcuucuucgaaac

SEQ ID NO: 48090 - RNA, 20 nt, Artificial Sequence
  MKO10048090_A_Sfmbt2
  gRNA
cauagcggaucugcacccug

SEQ ID NO: 48091 - RNA, 20 nt, Artificial Sequence
  MKO10048091_A_Sfmbt2
  gRNA
ccccguaaccacaguaacgc

SEQ ID NO: 48092 - RNA, 20 nt, Artificial Sequence
  MKO10048092_A_Sfn
  gRNA
cgaguccagcaggccgagua

SEQ ID NO: 48093 - RNA, 20 nt, Artificial Sequence
  MKO10048093_A_Sfn
  gRNA
caccacguucuuguaagcua

SEQ ID NO: 48094 - RNA, 20 nt, Artificial Sequence
  MKO10048094_A_Sfn
  gRNA
aguuggcugaacaggccgaa

SEQ ID NO: 48095 - RNA, 20 nt, Artificial Sequence
  MKO10048095_A_Sfpq
  gRNA
ggccucuuccaaaaguucgu

SEQ ID NO: 48096 - RNA, 20 nt, Artificial Sequence
  MKO10048096_A_Sfpq
  gRNA
agacaacuuacguugucagu

SEQ ID NO: 48097 - RNA, 20 nt, Artificial Sequence
  MKO10048097_A_Sfpq
  gRNA
cuuggcgcaaaagauuugcu

SEQ ID NO: 48098 - RNA, 20 nt, Artificial Sequence
  MKO10048098_A_Sfr1
  gRNA
accgagcugaucgacuucua

SEQ ID NO: 48099 - RNA, 20 nt, Artificial Sequence
  MKO10048099_A_Sfr1
  gRNA
cuaacuuuaaccuccgaaga

SEQ ID NO: 48100 - RNA, 20 nt, Artificial Sequence
  MKO10048100_A_Sfr1
  gRNA
cccguagaagucgaucagcu

SEQ ID NO: 48101 - RNA, 20 nt, Artificial Sequence
  MKO10048101_A_Sfrp1
  gRNA
ggcccaucuacccgugucgc

SEQ ID NO: 48102 - RNA, 20 nt, Artificial Sequence
  MKO10048102_A_Sfrp1
  gRNA
gcucacguagucguacucgc

SEQ ID NO: 48103 - RNA, 20 nt, Artificial Sequence
  MKO10048103_A_Sfrp1
  gRNA
gacuucaacucguugucgca

SEQ ID NO: 48104 - RNA, 20 nt, Artificial Sequence
  MKO10048104_A_Sfrp2
  gRNA
cgacaucaacgcuccguauc

SEQ ID NO: 48105 - RNA, 20 nt, Artificial Sequence
  MKO10048105_A_Sfrp2
  gRNA
ggagguggucgcuacuagcg

SEQ ID NO: 48106 - RNA, 20 nt, Artificial Sequence
  MKO10048106_A_Sfrp2
  gRNA
gccccggucauguccgccuu

SEQ ID NO: 48107 - RNA, 20 nt, Artificial Sequence
  MKO10048107_A_Sfrp4
  gRNA
agaucggugcaagugcaaaa

SEQ ID NO: 48108 - RNA, 20 nt, Artificial Sequence
  MKO10048108_A_Sfrp4
  gRNA
ccaaaauaaaagccguccag

SEQ ID NO: 48109 - RNA, 20 nt, Artificial Sequence
  MKO10048109_A_Sfrp4
  gRNA
acguuuacagucagcaucaa

SEQ ID NO: 48110 - RNA, 20 nt, Artificial Sequence
  MKO10048110_A_Sfrp5
  gRNA
cugugcgaagccgugcgcgc

SEQ ID NO: 48111 - RNA, 20 nt, Artificial Sequence
  MKO10048111_A_Sfrp5
  gRNA
aaccguaguagucguacucc

SEQ ID NO: 48112 - RNA, 20 nt, Artificial Sequence
  MKO10048112_A_Sfrp5
  gRNA
ugcucacggccgucuaccgc

SEQ ID NO: 48113 - RNA, 20 nt, Artificial Sequence
  MKO10048113_A_Sfrs18
  gRNA
agcaucguagaacaaccucc

SEQ ID NO: 48114 - RNA, 20 nt, Artificial Sequence
  MKO10048114_A_Sfrs18
  gRNA
gggaguuugccccugacaac

SEQ ID NO: 48115 - RNA, 20 nt, Artificial Sequence
  MKO10048115_A_Sfrs18
  gRNA
aaacagaugcaguaaaacgc

SEQ ID NO: 48116 - RNA, 20 nt, Artificial Sequence
  MKO10048116_A_Sfswap
  gRNA
cauuacagauacgacgggcg

SEQ ID NO: 48117 - RNA, 20 nt, Artificial Sequence
  MKO10048117_A_Sfswap
  gRNA
auuaagcgucccgucugaug

SEQ ID NO: 48118 - RNA, 20 nt, Artificial Sequence
  MKO10048118_A_Sfswap
  gRNA
cucaagcaaguccguaugca

SEQ ID NO: 48119 - RNA, 20 nt, Artificial Sequence
  MKO10048119_A_Sft2d1
  gRNA
uuuagggaacgggguugcua

SEQ ID NO: 48120 - RNA, 20 nt, Artificial Sequence
  MKO10048120_A_Sft2d1
  gRNA
cacaccuggccaaugcagca

SEQ ID NO: 48121 - RNA, 20 nt, Artificial Sequence
  MKO10048121_A_Sft2d1
  gRNA
uuacccacagagcagcacac

SEQ ID NO: 48122 - RNA, 20 nt, Artificial Sequence
  MKO10048122_A_Sft2d2
  gRNA
gcgucucaucgccacaauuc

SEQ ID NO: 48123 - RNA, 20 nt, Artificial Sequence
  MKO10048123_A_Sft2d2
  gRNA
uggaggcgucgucgcugagc

SEQ ID NO: 48124 - RNA, 20 nt, Artificial Sequence
  MKO10048124_A_Sft2d2
  gRNA
aaagaggccgagucccuucc

SEQ ID NO: 48125 - RNA, 20 nt, Artificial Sequence
  MKO10048125_A_Sft2d3
  gRNA
gcgugcggccgccugcuacg

SEQ ID NO: 48126 - RNA, 20 nt, Artificial Sequence
  MKO10048126_A_Sft2d3
  gRNA
gcgcugcucuacgcguugau

SEQ ID NO: 48127 - RNA, 20 nt, Artificial Sequence
  MKO10048127_A_Sft2d3
  gRNA
cuaggccagucccgcgauuu

SEQ ID NO: 48128 - RNA, 20 nt, Artificial Sequence
  MKO10048128_A_Sfua2
  gRNA
gaggcgcaucaaagacucca

SEQ ID NO: 48129 - RNA, 20 nt, Artificial Sequence
  MKO10048129_A_Sfua2
  gRNA
cuccucagcagcucacacgc

SEQ ID NO: 48130 - RNA, 20 nt, Artificial Sequence
  MKO10048130_A_Sfua2
  gRNA
agggccaaaggugacuuugc

SEQ ID NO: 48131 - RNA, 20 nt, Artificial Sequence
  MKO10048131_A_Sftpa1
  gRNA
agcaauguggccaccggcuc

SEQ ID NO: 48132 - RNA, 20 nt, Artificial Sequence
  MKO10048132_A_Sftpa1
  gRNA
gaugguaucaaaggagaccc

SEQ ID NO: 48133 - RNA, 20 nt, Artificial Sequence
  MKO10048133_A_Sftpa1
  gRNA
cuucuuuguaaugcuugcga

SEQ ID NO: 48134 - RNA, 20 nt, Artificial Sequence
  MKO10048134_A_Sftpb
  gRNA
caucaagcacuuggcgacac

SEQ ID NO: 48135 - RNA, 20 nt, Artificial Sequence
  MKO10048135_A_Sftpb
  gRNA
ggaacggcauccggcauccc

SEQ ID NO: 48136 - RNA, 20 nt, Artificial Sequence
  MKO10048136_A_Sftpb
  gRNA
ucaauucuggugccaaagcc

SEQ ID NO: 48137 - RNA, 20 nt, Artificial Sequence
  MKO10048137_A_Sftpc
  gRNA
cuacaaucaccacgacaacg

SEQ ID NO: 48138 - RNA, 20 nt, Artificial Sequence
  MKO10048138_A_Sftpc
  gRNA
cucucucaggauuacucggc

SEQ ID NO: 48139 - RNA, 20 nt, Artificial Sequence
  MKO10048139_A_Sftpc
  gRNA
gagcuggcuuauaggccguc

SEQ ID NO: 48140 - RNA, 20 nt, Artificial Sequence
  MKO10048140_A_Sftpd
  gRNA
ccuguagauccuugcaugcc

SEQ ID NO: 48141 - RNA, 20 nt, Artificial Sequence
  MKO10048141_A_Sftpd
  gRNA
cuuaguccacguucucccuu

SEQ ID NO: 48142 - RNA, 20 nt, Artificial Sequence
  MKO10048142_A_Sftpd
  gRNA
ugcuggcgaaccuggaccaa

SEQ ID NO: 48143 - RNA, 20 nt, Artificial Sequence
  MKO10048143_A_Sfxn1
  gRNA
agcgaaguacgcguacgacu

SEQ ID NO: 48144 - RNA, 20 nt, Artificial Sequence
  MKO10048144_A_Sfxn1
  gRNA
gaacaaaacguccuaucagu

SEQ ID NO: 48145 - RNA, 20 nt, Artificial Sequence
  MKO10048145_A_Sfxn1
  gRNA
aaaccaguccuucaaugccg

SEQ ID NO: 48146 - RNA, 20 nt, Artificial Sequence
  MKO10048146_A_Sfxn2
  gRNA
acucacugcugucgcaucau

SEQ ID NO: 48147 - RNA, 20 nt, Artificial Sequence
  MKO10048147_A_Sfxn2
  gRNA
ugcgaagaagcucuacgacu

SEQ ID NO: 48148 - RNA, 20 nt, Artificial Sequence
  MKO10048148_A_Sfxn2
  gRNA
gcucgccuaccugacagacg

SEQ ID NO: 48149 - RNA, 20 nt, Artificial Sequence
  MKO10048149_A_Sfxn3
  gRNA
ggcacgaaucgaccgacuag

SEQ ID NO: 48150 - RNA, 20 nt, Artificial Sequence
  MKO10048150_A_Sfxn3
  gRNA
ugcugagucauacacguauu

SEQ ID NO: 48151 - RNA, 20 nt, Artificial Sequence
  MKO10048151_A_Sfxn3
  gRNA
uagcaccugcccccgcuagu

SEQ ID NO: 48152 - RNA, 20 nt, Artificial Sequence
  MKO10048152_A_Sfxn4
  gRNA
cugacaaaaucuucgaaaaa

SEQ ID NO: 48153 - RNA, 20 nt, Artificial Sequence
  MKO10048153_A_Sfxn4
  gRNA
gacauaccacuugguuaucc

SEQ ID NO: 48154 - RNA, 20 nt, Artificial Sequence
  MKO10048154_A_Sfxn4
  gRNA
agaugcacccaaacacuacc

SEQ ID NO: 48155 - RNA, 20 nt, Artificial Sequence
  MKO10048155_A_Sfxn5
  gRNA
gugccugaagcgaccguaga

SEQ ID NO: 48156 - RNA, 20 nt, Artificial Sequence
  MKO10048156_A_Sfxn5
  gRNA
caaccaggcuauccuacacc

SEQ ID NO: 48157 - RNA, 20 nt, Artificial Sequence
  MKO10048157_A_Sfxn5
  gRNA
aagaucuucucguugguguc

SEQ ID NO: 48158 - RNA, 20 nt, Artificial Sequence
  MKO10048158_A_Sgca
  gRNA
gucaaaacugucucgauugu

SEQ ID NO: 48159 - RNA, 20 nt, Artificial Sequence
  MKO10048159_A_Sgca
  gRNA
caaccgcuuccucaccgccu

SEQ ID NO: 48160 - RNA, 20 nt, Artificial Sequence
  MKO10048160_A_Sgca
  gRNA
guccccguaggucuccuggc

SEQ ID NO: 48161 - RNA, 20 nt, Artificial Sequence
  MKO10048161_A_Sgcb
  gRNA
aaacugcaucccgaugucgc

SEQ ID NO: 48162 - RNA, 20 nt, Artificial Sequence
  MKO10048162_A_Sgcb
  gRNA
gugauccgcauugggccaaa

SEQ ID NO: 48163 - RNA, 20 nt, Artificial Sequence
  MKO10048163_A_Sgcb
  gRNA
ccacccgcuuuauaagagca

SEQ ID NO: 48164 - RNA, 20 nt, Artificial Sequence
  MKO10048164_A_Sgcd
  gRNA
cccuauacuucaaaucugcc

SEQ ID NO: 48165 - RNA, 20 nt, Artificial Sequence
  MKO10048165_A_Sgcd
  gRNA
uggucgggacuugauuucuu

SEQ ID NO: 48166 - RNA, 20 nt, Artificial Sequence
  MKO10048166_A_Sgcd
  gRNA
aauguucacugucacguucc

SEQ ID NO: 48167 - RNA, 20 nt, Artificial Sequence
  MKO10048167_A_Sgce
  gRNA
cugcagauggguacacguuc

SEQ ID NO: 48168 - RNA, 20 nt, Artificial Sequence
  MKO10048168_A_Sgce
  gRNA
cggaacguguacccaucugc

SEQ ID NO: 48169 - RNA, 20 nt, Artificial Sequence
  MKO10048169_A_Sgce
  gRNA
uggauauaucgaagccaucc

SEQ ID NO: 48170 - RNA, 20 nt, Artificial Sequence
  MKO10048170_A_Sgcg
  gRNA
gucagugcucgcaacucaga

SEQ ID NO: 48171 - RNA, 20 nt, Artificial Sequence
  MKO10048171_A_Sgcg
  gRNA
gagcacugacugucacguuc

SEQ ID NO: 48172 - RNA, 20 nt, Artificial Sequence
  MKO10048172_A_Sgcg
  gRNA
cacucuggagcguauuucuu

SEQ ID NO: 48173 - RNA, 20 nt, Artificial Sequence
  MKO10048173_A_Sgcz
  gRNA
cgccauccauaaauccccac

SEQ ID NO: 48174 - RNA, 20 nt, Artificial Sequence
  MKO10048174_A_Sgcz
  gRNA
ggauuuauggauggcgaaag

SEQ ID NO: 48175 - RNA, 20 nt, Artificial Sequence
  MKO10048175_A_Sgcz
  gRNA
uauuucuuaggacaguccau

SEQ ID NO: 48176 - RNA, 20 nt, Artificial Sequence
  MKO10048176_A_Sgip1
  gRNA
agaggcucgccagaccgaga

SEQ ID NO: 48177 - RNA, 20 nt, Artificial Sequence
  MKO10048177_A_Sgip1
  gRNA
auagcaaagcagagugugcg

SEQ ID NO: 48178 - RNA, 20 nt, Artificial Sequence
  MKO10048178_A_Sgip1
  gRNA
caggacugaaaaaacguaca

SEQ ID NO: 48179 - RNA, 20 nt, Artificial Sequence
  MKO10048179_A_Sgk1
  gRNA
gaacgcuaaccccucuccuc

SEQ ID NO: 48180 - RNA, 20 nt, Artificial Sequence
  MKO10048180_A_Sgk1
  gRNA
gauauacuuaccggaggaga

SEQ ID NO: 48181 - RNA, 20 nt, Artificial Sequence
  MKO10048181_A_Sgk1
  gRNA
ucuucugaauaaaaucguuc

SEQ ID NO: 48182 - RNA, 20 nt, Artificial Sequence
  MKO10048182_A_Sgk2
  gRNA
ggcuccguccgacuugcgcu

SEQ ID NO: 48183 - RNA, 20 nt, Artificial Sequence
  MKO10048183_A_Sgk2
  gRNA
cggagccuucuacgccguga

SEQ ID NO: 48184 - RNA, 20 nt, Artificial Sequence
  MKO10048184_A_Sgk2
  gRNA
cguugcgcucugccaugaug

SEQ ID NO: 48185 - RNA, 20 nt, Artificial Sequence
  MKO10048185_A_Sgk3
  gRNA
uguccgagcauuccuucaaa

SEQ ID NO: 48186 - RNA, 20 nt, Artificial Sequence
  MKO10048186_A_Sgk3
  gRNA
cccacagguuuauaaaguuc

SEQ ID NO: 48187 - RNA, 20 nt, Artificial Sequence
  MKO10048187_A_Sgk3
  gRNA
gucuugggcuguccauuuga

SEQ ID NO: 48188 - RNA, 20 nt, Artificial Sequence
  MKO10048188_A_Sgms1
  gRNA
agaagauuccaacgacgcug

SEQ ID NO: 48189 - RNA, 20 nt, Artificial Sequence
  MKO10048189_A_Sgms1
  gRNA
acauuguaauacaccgauac

SEQ ID NO: 48190 - RNA, 20 nt, Artificial Sequence
  MKO10048190_A_Sgms1
  gRNA
ugagcguuagcaugaccgug

SEQ ID NO: 48191 - RNA, 20 nt, Artificial Sequence
  MKO10048191_A_Sgms2
  gRNA
cccgagacaagaaguucguc

SEQ ID NO: 48192 - RNA, 20 nt, Artificial Sequence
  MKO10048192_A_Sgms2
  gRNA
ugauaccaccagaagugacg

SEQ ID NO: 48193 - RNA, 20 nt, Artificial Sequence
  MKO10048193_A_Sgms2
  gRNA
agcgcaugaacacuauaccg

SEQ ID NO: 48194 - RNA, 20 nt, Artificial Sequence
  MKO10048194_A_Sgol1
  gRNA
gacguaccugugguuuggua

SEQ ID NO: 48195 - RNA, 20 nt, Artificial Sequence
  MKO10048195_A_Sgol1
  gRNA
uauaagccacuccacgacuu

SEQ ID NO: 48196 - RNA, 20 nt, Artificial Sequence
  MKO10048196_A_Sgol1
  gRNA
gauuguccuuaccaaaccac

SEQ ID NO: 48197 - RNA, 20 nt, Artificial Sequence
  MKO10048197_A_Sgol2
  gRNA
ucgcuuaaaguuaaauaccu

SEQ ID NO: 48198 - RNA, 20 nt, Artificial Sequence
  MKO10048198_A_Sgol2
  gRNA
uuucaaauugcacugaugua

SEQ ID NO: 48199 - RNA, 20 nt, Artificial Sequence
  MKO10048199_A_Sgol2
  gRNA
cuugcauauggaagaugcgc

SEQ ID NO: 48200 - RNA, 20 nt, Artificial Sequence
  MKO10048200_A_Sgpl1
  gRNA
gaugccauuuauuggacgua

SEQ ID NO: 48201 - RNA, 20 nt, Artificial Sequence
  MKO10048201_A_Sgpl1
  gRNA
auccuuggagaucgaacaac

SEQ ID NO: 48202 - RNA, 20 nt, Artificial Sequence
  MKO10048202_A_Sgpl1
  gRNA
gaaggacuucgagccuuauu

SEQ ID NO: 48203 - RNA, 20 nt, Artificial Sequence
  MKO10048203_A_Sgpp1
  gRNA
agcccguugcgcacgccguu

SEQ ID NO: 48204 - RNA, 20 nt, Artificial Sequence
  MKO10048204_A_Sgpp1
  gRNA
gccauauuacggaucguccu

SEQ ID NO: 48205 - RNA, 20 nt, Artificial Sequence
  MKO10048205_A_Sgpp1
  gRNA
gcagcgccgcaacucguuga

SEQ ID NO: 48206 - RNA, 20 nt, Artificial Sequence
  MKO10048206_A_Sgpp2
  gRNA
cugacuacuacagcccgacc

SEQ ID NO: 48207 - RNA, 20 nt, Artificial Sequence
  MKO10048207_A_Sgpp2
  gRNA
ccuuaccugauaccggucca

SEQ ID NO: 48208 - RNA, 20 nt, Artificial Sequence
  MKO10048208_A_Sgpp2
  gRNA
accaugagaauaauacuugc

SEQ ID NO: 48209 - RNA, 20 nt, Artificial Sequence
  MKO10048209_A_Sgsh
  gRNA
accccagaucuacgacccuc

SEQ ID NO: 48210 - RNA, 20 nt, Artificial Sequence
  MKO10048210_A_Sgsh
  gRNA
caccucaccugugcgcacuc

SEQ ID NO: 48211 - RNA, 20 nt, Artificial Sequence
  MKO10048211_A_Sgsh
  gRNA
ggucauggaaagccacguac

SEQ ID NO: 48212 - RNA, 20 nt, Artificial Sequence
  MKO10048212_A_Sgsm1
  gRNA
ccgcgaucuuguugcuucgc

SEQ ID NO: 48213 - RNA, 20 nt, Artificial Sequence
  MKO10048213_A_Sgsm1
  gRNA
uaccagaaaguucguccacg

SEQ ID NO: 48214 - RNA, 20 nt, Artificial Sequence
  MKO10048214_A_Sgsm1
  gRNA
ccugcgaagcaacaagaucg

SEQ ID NO: 48215 - RNA, 20 nt, Artificial Sequence
  MKO10048215_A_Sgsm2
  gRNA
cagcuaagacgccgugcugc

SEQ ID NO: 48216 - RNA, 20 nt, Artificial Sequence
  MKO10048216_A_Sgsm2
  gRNA
ccaagaagcccuucggaaac

SEQ ID NO: 48217 - RNA, 20 nt, Artificial Sequence
  MKO10048217_A_Sgsm2
  gRNA
uggcagcaaguauuacgaga

SEQ ID NO: 48218 - RNA, 20 nt, Artificial Sequence
  MKO10048218_A_Sgsm3
  gRNA
accccccgcagaggcuacgu

SEQ ID NO: 48219 - RNA, 20 nt, Artificial Sequence
  MKO10048219_A_Sgsm3
  gRNA
gaaacuccguucccuagugc

SEQ ID NO: 48220 - RNA, 20 nt, Artificial Sequence
  MKO10048220_A_Sgsm3
  gRNA
uguuaccuguuuggcagcga

SEQ ID NO: 48221 - RNA, 20 nt, Artificial Sequence
  MKO10048221_A_Sgua
  gRNA
cgcgccauuggcaucgaccc

SEQ ID NO: 48222 - RNA, 20 nt, Artificial Sequence
  MKO10048222_A_Sgua
  gRNA
gaacuacgugggggccgugc

SEQ ID NO: 48223 - RNA, 20 nt, Artificial Sequence
  MKO10048223_A_Sgua
  gRNA
gcucaauggccuugccguag

SEQ ID NO: 48224 - RNA, 20 nt, Artificial Sequence
  MKO10048224_A_Sgub
  gRNA
guucacaaacuccgucugua

SEQ ID NO: 48225 - RNA, 20 nt, Artificial Sequence
  MKO10048225_A_Sgub
  gRNA
guauuucgagucaauugcaa

SEQ ID NO: 48226 - RNA, 20 nt, Artificial Sequence
  MKO10048226_A_Sgub
  gRNA
augccguuuauuauugcaac

SEQ ID NO: 48227 - RNA, 20 nt, Artificial Sequence
  MKO10048227_A_Sh2b1
  gRNA
gaguaacgaccgccugucgc

SEQ ID NO: 48228 - RNA, 20 nt, Artificial Sequence
  MKO10048228_A_Sh2b1
  gRNA
cgaccuuacccugcgacagg

SEQ ID NO: 48229 - RNA, 20 nt, Artificial Sequence
  MKO10048229_A_Sh2b1
  gRNA
gcaguuccaucgaaucaaaa

SEQ ID NO: 48230 - RNA, 20 nt, Artificial Sequence
  MKO10048230_A_Sh2b2
  gRNA
acccaccgcugucgucgucu

SEQ ID NO: 48231 - RNA, 20 nt, Artificial Sequence
  MKO10048231_A_Sh2b2
  gRNA
ccccgagacgacgacagcgg

SEQ ID NO: 48232 - RNA, 20 nt, Artificial Sequence
  MKO10048232_A_Sh2b2
  gRNA
accucaaugauggccgacag

SEQ ID NO: 48233 - RNA, 20 nt, Artificial Sequence
  MKO10048233_A_Sh2b3
  gRNA
gguccgaccauguacacgcc

SEQ ID NO: 48234 - RNA, 20 nt, Artificial Sequence
  MKO10048234_A_Sh2b3
  gRNA
gccgcaccaggaacacgccg

SEQ ID NO: 48235 - RNA, 20 nt, Artificial Sequence
  MKO10048235_A_Sh2b3
  gRNA
guguacauggucggaccucc

SEQ ID NO: 48236 - RNA, 20 nt, Artificial Sequence
  MKO10048236_A_Sh2d1a
  gRNA
ggcgucacgaugccuugauc

SEQ ID NO: 48237 - RNA, 20 nt, Artificial Sequence
  MKO10048237_A_Sh2d1a
  gRNA
agaagcucuuacucgcuacc

SEQ ID NO: 48238 - RNA, 20 nt, Artificial Sequence
  MKO10048238_A_Sh2d1a
  gRNA
cgagacagcgagaguguccc

SEQ ID NO: 48239 - RNA, 20 nt, Artificial Sequence
  MKO10048239_A_Sh2d1b1
  gRNA
agaaacaaccuaugccaaag

SEQ ID NO: 48240 - RNA, 20 nt, Artificial Sequence
  MKO10048240_A_Sh2d1b1
  gRNA
auuuggagaccaauuccugu

SEQ ID NO: 48241 - RNA, 20 nt, Artificial Sequence
  MKO10048241_A_Sh2d1b1
  gRNA
uuccccagagaacacugaua

SEQ ID NO: 48242 - RNA, 20 nt, Artificial Sequence
  MKO10048242_A_Sh2d1b2
  gRNA
aaguucagucuucucgcucc

SEQ ID NO: 48243 - RNA, 20 nt, Artificial Sequence
  MKO10048243_A_Sh2d1b2
  gRNA
cagaagccgcuucucauuau

SEQ ID NO: 48244 - RNA, 20 nt, Artificial Sequence
  MKO10048244_A_Sh2d1b2
  gRNA
uuccccagagaacacugaug

SEQ ID NO: 48245 - RNA, 20 nt, Artificial Sequence
  MKO10048245_A_Sh2d2a
  gRNA
cugcccuaucggcauucccu

SEQ ID NO: 48246 - RNA, 20 nt, Artificial Sequence
  MKO10048246_A_Sh2d2a
  gRNA
caccaccgugugguuaguuc

SEQ ID NO: 48247 - RNA, 20 nt, Artificial Sequence
  MKO10048247_A_Sh2d2a
  gRNA
gcccagcaugcaaguuauga

SEQ ID NO: 48248 - RNA, 20 nt, Artificial Sequence
  MKO10048248_A_Sh2d3c
  gRNA
ccucacgagggaugcguccg

SEQ ID NO: 48249 - RNA, 20 nt, Artificial Sequence
  MKO10048249_A_Sh2d3c
  gRNA
ugcccucgugcgcuaccacg

SEQ ID NO: 48250 - RNA, 20 nt, Artificial Sequence
  MKO10048250_A_Sh2d3c
  gRNA
gacaaggucacccgcagcga

SEQ ID NO: 48251 - RNA, 20 nt, Artificial Sequence
  MKO10048251_A_Sh2d4a
  gRNA
ccaacagacuaaacccguca

SEQ ID NO: 48252 - RNA, 20 nt, Artificial Sequence
  MKO10048252_A_Sh2d4a
  gRNA
ugggcgccgauaagcaggug

SEQ ID NO: 48253 - RNA, 20 nt, Artificial Sequence
  MKO10048253_A_Sh2d4a
  gRNA
cuuucuagugcgaaaaucua

SEQ ID NO: 48254 - RNA, 20 nt, Artificial Sequence
  MKO10048254_A_Sh2d4b
  gRNA
gccgucgugcucagcgagcc

SEQ ID NO: 48255 - RNA, 20 nt, Artificial Sequence
  MKO10048255_A_Sh2d4b
  gRNA
cccgggcucgcugagcacga

SEQ ID NO: 48256 - RNA, 20 nt, Artificial Sequence
  MKO10048256_A_Sh2d4b
  gRNA
acguauacacgaggaauuca

SEQ ID NO: 48257 - RNA, 20 nt, Artificial Sequence
  MKO10048257_A_Sh2d5
  gRNA
cucaggacuguucccgacgc

SEQ ID NO: 48258 - RNA, 20 nt, Artificial Sequence
  MKO10048258_A_Sh2d5
  gRNA
aagggcucucgcacuaaugc

SEQ ID NO: 48259 - RNA, 20 nt, Artificial Sequence
  MKO10048259_A_Sh2d5
  gRNA
agcgcauccucuaugccacc

SEQ ID NO: 48260 - RNA, 20 nt, Artificial Sequence
  MKO10048260_A_Sh2d7
  gRNA
cagguuggaaucugcucgua

SEQ ID NO: 48261 - RNA, 20 nt, Artificial Sequence
  MKO10048261_A_Sh2d7
  gRNA
ucuguguagaugacgucacu

SEQ ID NO: 48262 - RNA, 20 nt, Artificial Sequence
  MKO10048262_A_Sh2d7
  gRNA
cggggacugguggccuuguc

SEQ ID NO: 48263 - RNA, 20 nt, Artificial Sequence
  MKO10048263_A_Sh3bgrl2
  gRNA
gguuaaccuaccguggaugc

SEQ ID NO: 48264 - RNA, 20 nt, Artificial Sequence
  MKO10048264_A_Sh3bgrl2
  gRNA
gucuucgucgccucaugcuc

SEQ ID NO: 48265 - RNA, 20 nt, Artificial Sequence
  MKO10048265_A_Sh3bgrl2
  gRNA
cgauccccauuaaauaucug

SEQ ID NO: 48266 - RNA, 20 nt, Artificial Sequence
  MKO10048266_A_Sh3bgrl3
  gRNA
ccugcgcgucuacagcacgu

SEQ ID NO: 48267 - RNA, 20 nt, Artificial Sequence
  MKO10048267_A_Sh3bgrl3
  gRNA
ccgacgugcuguagacgcgc

SEQ ID NO: 48268 - RNA, 20 nt, Artificial Sequence
  MKO10048268_A_Sh3bgrl3
  gRNA
caucucgaagggcguugucc

SEQ ID NO: 48269 - RNA, 20 nt, Artificial Sequence
  MKO10048269_A_Sh3bgrl
  gRNA
uucaaugaaugccaguaccg

SEQ ID NO: 48270 - RNA, 20 nt, Artificial Sequence
  MKO10048270_A_Sh3bgrl
  gRNA
gaagacagucgaccauccac

SEQ ID NO: 48271 - RNA, 20 nt, Artificial Sequence
  MKO10048271_A_Sh3bgrl
  gRNA
auuccaggaagccgaagccc

SEQ ID NO: 48272 - RNA, 20 nt, Artificial Sequence
  MKO10048272_A_Sh3bgr
  gRNA
ugcaagcuuaccuuugaccc

SEQ ID NO: 48273 - RNA, 20 nt, Artificial Sequence
  MKO10048273_A_Sh3bgr
  gRNA
ggcucccccuccugggucaa

SEQ ID NO: 48274 - RNA, 20 nt, Artificial Sequence
  MKO10048274_A_Sh3bgr
  gRNA
ggcaaagggaucccauucug

SEQ ID NO: 48275 - RNA, 20 nt, Artificial Sequence
  MKO10048275_A_Sh3bp1
  gRNA
ucucaaacucggcuaggauu

SEQ ID NO: 48276 - RNA, 20 nt, Artificial Sequence
  MKO10048276_A_Sh3bp1
  gRNA
auguccugcagccgcucagc

SEQ ID NO: 48277 - RNA, 20 nt, Artificial Sequence
  MKO10048277_A_Sh3bp1
  gRNA
uguccaugucagccccgcuu

SEQ ID NO: 48278 - RNA, 20 nt, Artificial Sequence
  MKO10048278_A_Sh3bp2
  gRNA
gcuggauggccuugcuacgc

SEQ ID NO: 48279 - RNA, 20 nt, Artificial Sequence
  MKO10048279_A_Sh3bp2
  gRNA
aguaguagaugcagcgcuug

SEQ ID NO: 48280 - RNA, 20 nt, Artificial Sequence
  MKO10048280_A_Sh3bp2
  gRNA
uugcagcuucauggcggcug

SEQ ID NO: 48281 - RNA, 20 nt, Artificial Sequence
  MKO10048281_A_Sh3bp4
  gRNA
gagaagacuuccgaaccgcc

SEQ ID NO: 48282 - RNA, 20 nt, Artificial Sequence
  MKO10048282_A_Sh3bp4
  gRNA
ccauggcagcccagcguauc

SEQ ID NO: 48283 - RNA, 20 nt, Artificial Sequence
  MKO10048283_A_Sh3bp4
  gRNA
gugguacaucggcuacuacc

SEQ ID NO: 48284 - RNA, 20 nt, Artificial Sequence
  MKO10048284_A_Sh3bp5l
  gRNA
cacagcccgcucauaccgca

SEQ ID NO: 48285 - RNA, 20 nt, Artificial Sequence
  MKO10048285_A_Sh3bp5l
  gRNA
cuacuaugaggcucgacgac

SEQ ID NO: 48286 - RNA, 20 nt, Artificial Sequence
  MKO10048286_A_Sh3bp5l
  gRNA
cauggcugacaaaaaucgac

SEQ ID NO: 48287 - RNA, 20 nt, Artificial Sequence
  MKO10048287_A_Sh3bp5
  gRNA
ggaguaccucgguggcccuc

SEQ ID NO: 48288 - RNA, 20 nt, Artificial Sequence
  MKO10048288_A_Sh3bp5
  gRNA
acccauggcagcguuguacc

SEQ ID NO: 48289 - RNA, 20 nt, Artificial Sequence
  MKO10048289_A_Sh3bp5
  gRNA
guuucaccguugccucgacc

SEQ ID NO: 48290 - RNA, 20 nt, Artificial Sequence
  MKO10048290_A_Sh3d19
  gRNA
ucguauuacaguaggcuucc

SEQ ID NO: 48291 - RNA, 20 nt, Artificial Sequence
  MKO10048291_A_Sh3d19
  gRNA
gugucccgguuugggacgag

SEQ ID NO: 48292 - RNA, 20 nt, Artificial Sequence
  MKO10048292_A_Sh3d19
  gRNA
gcuacccccucgucccaaac

SEQ ID NO: 48293 - RNA, 20 nt, Artificial Sequence
  MKO10048293_A_Sh3d21
  gRNA
ccuauuugacuaccaacccg

SEQ ID NO: 48294 - RNA, 20 nt, Artificial Sequence
  MKO10048294_A_Sh3d21
  gRNA
ucaccuguccgcagguaguc

SEQ ID NO: 48295 - RNA, 20 nt, Artificial Sequence
  MKO10048295_A_Sh3d21
  gRNA
gacgagcugacgcuucaaac

SEQ ID NO: 48296 - RNA, 20 nt, Artificial Sequence
  MKO10048296_A_Sh3gl1
  gRNA
ggugaugcccugcuagaugc

SEQ ID NO: 48297 - RNA, 20 nt, Artificial Sequence
  MKO10048297_A_Sh3gl1
  gRNA
ggagagugcaugguucgcca

SEQ ID NO: 48298 - RNA, 20 nt, Artificial Sequence
  MKO10048298_A_Sh3gl1
  gRNA
ugaacaccguauccaagauc

SEQ ID NO: 48299 - RNA, 20 nt, Artificial Sequence
  MKO10048299_A_Sh3gl2
  gRNA
aacaccaugucgaaaauccg

SEQ ID NO: 48300 - RNA, 20 nt, Artificial Sequence
  MKO10048300_A_Sh3gl2
  gRNA
uuugaagucaucaucgagcu

SEQ ID NO: 48301 - RNA, 20 nt, Artificial Sequence
  MKO10048301_A_Sh3gl2
  gRNA
gccagcagugcuuccgccug

SEQ ID NO: 48302 - RNA, 20 nt, Artificial Sequence
  MKO10048302_A_Sh3gl3
  gRNA
aacacugugucgaagcuccg

SEQ ID NO: 48303 - RNA, 20 nt, Artificial Sequence
  MKO10048303_A_Sh3gl3
  gRNA
ugacauuaccuggauugggu

SEQ ID NO: 48304 - RNA, 20 nt, Artificial Sequence
  MKO10048304_A_Sh3gl3
  gRNA
uucaucuagcuucguuccuu

SEQ ID NO: 48305 - RNA, 20 nt, Artificial Sequence
  MKO10048305_A_Sh3glb1
  gRNA
accaagucguauaaacaacc

SEQ ID NO: 48306 - RNA, 20 nt, Artificial Sequence
  MKO10048306_A_Sh3glb1
  gRNA
auuuggcugcaacagcacuu

SEQ ID NO: 48307 - RNA, 20 nt, Artificial Sequence
  MKO10048307_A_Sh3glb1
  gRNA
aagcugaauguaccaaaaua

SEQ ID NO: 48308 - RNA, 20 nt, Artificial Sequence
  MKO10048308_A_Sh3glb2
  gRNA
gcagaaccggcgucuugacc

SEQ ID NO: 48309 - RNA, 20 nt, Artificial Sequence
  MKO10048309_A_Sh3glb2
  gRNA
aggcauccaggucaagacgc

SEQ ID NO: 48310 - RNA, 20 nt, Artificial Sequence
  MKO10048310_A_Sh3glb2
  gRNA
cuacucaccguagggagugc

SEQ ID NO: 48311 - RNA, 20 nt, Artificial Sequence
  MKO10048311_A_Sh3kbp1
  gRNA
uucuaggacugcaucgacgu

SEQ ID NO: 48312 - RNA, 20 nt, Artificial Sequence
  MKO10048312_A_Sh3kbp1
  gRNA
cuguccaucuccgucuucga

SEQ ID NO: 48313 - RNA, 20 nt, Artificial Sequence
  MKO10048313_A_Sh3kbp1
  gRNA
ccugccccuuguuugacgac

SEQ ID NO: 48314 - RNA, 20 nt, Artificial Sequence
  MKO10048314_A_Sh3pxd2a
  gRNA
cugcgugcaagaugccaccg

SEQ ID NO: 48315 - RNA, 20 nt, Artificial Sequence
  MKO10048315_A_Sh3pxd2a
  gRNA
uauacauuaucaacgugacc

SEQ ID NO: 48316 - RNA, 20 nt, Artificial Sequence
  MKO10048316_A_Sh3pxd2a
  gRNA
gucucuucacagccacgucg

SEQ ID NO: 48317 - RNA, 20 nt, Artificial Sequence
  MKO10048317_A_Sh3pxd2b
  gRNA
ggcguuugacggcuacgucc

SEQ ID NO: 48318 - RNA, 20 nt, Artificial Sequence
  MKO10048318_A_Sh3pxd2b
  gRNA
gauggccuccguggcgccac

SEQ ID NO: 48319 - RNA, 20 nt, Artificial Sequence
  MKO10048319_A_Sh3pxd2b
  gRNA
gcgccacggaggccaucuac

SEQ ID NO: 48320 - RNA, 20 nt, Artificial Sequence
  MKO10048320_A_Sh3rf1
  gRNA
caucaucauucugcgccgac

SEQ ID NO: 48321 - RNA, 20 nt, Artificial Sequence
  MKO10048321_A_Sh3rf1
  gRNA
gcccggacaguucgcugaug

SEQ ID NO: 48322 - RNA, 20 nt, Artificial Sequence
  MKO10048322_A_Sh3rf1
  gRNA
ggauacuguaccuuugcgaa

SEQ ID NO: 48323 - RNA, 20 nt, Artificial Sequence
  MKO10048323_A_Sh3rf2
  gRNA
ccuguugcucgugcguuugc

SEQ ID NO: 48324 - RNA, 20 nt, Artificial Sequence
  MKO10048324_A_Sh3rf2
  gRNA
aggugucuugccgagacguu

SEQ ID NO: 48325 - RNA, 20 nt, Artificial Sequence
  MKO10048325_A_Sh3rf2
  gRNA
ugcguuccggacagagcucg

SEQ ID NO: 48326 - RNA, 20 nt, Artificial Sequence
  MKO10048326_A_Sh3rf3
  gRNA
cugguaccacggcgagcugc

SEQ ID NO: 48327 - RNA, 20 nt, Artificial Sequence
  MKO10048327_A_Sh3rf3
  gRNA
cucguagcuguagagcgccu

SEQ ID NO: 48328 - RNA, 20 nt, Artificial Sequence
  MKO10048328_A_Sh3rf3
  gRNA
cgucacgcugagcgcaguga

SEQ ID NO: 48329 - RNA, 20 nt, Artificial Sequence
  MKO10048329_A_Sh3uc1
  gRNA
cagccagcccgaccacgaug

SEQ ID NO: 48330 - RNA, 20 nt, Artificial Sequence
  MKO10048330_A_Sh3uc1
  gRNA
uguggcuccuccccgcaucg

SEQ ID NO: 48331 - RNA, 20 nt, Artificial Sequence
  MKO10048331_A_Sh3uc1
  gRNA
cccggcuaucguucuccagc

SEQ ID NO: 48332 - RNA, 20 nt, Artificial Sequence
  MKO10048332_A_Sh3uc2
  gRNA
ggaaguccacgcgcuauuua

SEQ ID NO: 48333 - RNA, 20 nt, Artificial Sequence
  MKO10048333_A_Sh3uc2
  gRNA
agcucaccuuaaauagcgcg

SEQ ID NO: 48334 - RNA, 20 nt, Artificial Sequence
  MKO10048334_A_Sh3uc2
  gRNA
ugcuguugagccaguacgug

SEQ ID NO: 48335 - RNA, 20 nt, Artificial Sequence
  MKO10048335_A_Sh3yl1
  gRNA
uuccauccggaagacgcgcc

SEQ ID NO: 48336 - RNA, 20 nt, Artificial Sequence
  MKO10048336_A_Sh3yl1
  gRNA
acugucgcaguugggccccu

SEQ ID NO: 48337 - RNA, 20 nt, Artificial Sequence
  MKO10048337_A_Sh3yl1
  gRNA
uacauuucagguauccgauu

SEQ ID NO: 48338 - RNA, 20 nt, Artificial Sequence
  MKO10048338_A_Shank1
  gRNA
agucuauaugcgccccgccc

SEQ ID NO: 48339 - RNA, 20 nt, Artificial Sequence
  MKO10048339_A_Shank1
  gRNA
auucggacgcugugccuggg

SEQ ID NO: 48340 - RNA, 20 nt, Artificial Sequence
  MKO10048340_A_Shank1
  gRNA
cguccuguagacucucgcuc

SEQ ID NO: 48341 - RNA, 20 nt, Artificial Sequence
  MKO10048341_A_Shank2
  gRNA
ccuagccgauacccccauug

SEQ ID NO: 48342 - RNA, 20 nt, Artificial Sequence
  MKO10048342_A_Shank2
  gRNA
uggcaagccggacuaaggac

SEQ ID NO: 48343 - RNA, 20 nt, Artificial Sequence
  MKO10048343_A_Shank2
  gRNA
ccgugacgaccuuaaggaug

SEQ ID NO: 48344 - RNA, 20 nt, Artificial Sequence
  MKO10048344_A_Shank3
  gRNA
ccgcaacggcggugcucauc

SEQ ID NO: 48345 - RNA, 20 nt, Artificial Sequence
  MKO10048345_A_Shank3
  gRNA
cguuguccaacugugccgca

SEQ ID NO: 48346 - RNA, 20 nt, Artificial Sequence
  MKO10048346_A_Shank3
  gRNA
cguaguugagcgcgucuuga

SEQ ID NO: 48347 - RNA, 20 nt, Artificial Sequence
  MKO10048347_A_Sharpin
  gRNA
cgugcacuuccucgaccccg

SEQ ID NO: 48348 - RNA, 20 nt, Artificial Sequence
  MKO10048348_A_Sharpin
  gRNA
gcuauuuguuacaccguccg

SEQ ID NO: 48349 - RNA, 20 nt, Artificial Sequence
  MKO10048349_A_Sharpin
  gRNA
gguucccaccaggucccaua

SEQ ID NO: 48350 - RNA, 20 nt, Artificial Sequence
  MKO10048350_A_Shbg
  gRNA
cucgccgaauacagccgucc

SEQ ID NO: 48351 - RNA, 20 nt, Artificial Sequence
  MKO10048351_A_Shbg
  gRNA
ccuccuuugaguuucgaacc

SEQ ID NO: 48352 - RNA, 20 nt, Artificial Sequence
  MKO10048352_A_Shbg
  gRNA
gcuguauucggcgagauauc

SEQ ID NO: 48353 - RNA, 20 nt, Artificial Sequence
  MKO10048353_A_Shb
  gRNA
guacgacaccccguacgagc

SEQ ID NO: 48354 - RNA, 20 nt, Artificial Sequence
  MKO10048354_A_Shb
  gRNA
uggcgccgucggucccgaga

SEQ ID NO: 48355 - RNA, 20 nt, Artificial Sequence
  MKO10048355_A_Shb
  gRNA
cguacggggugucguacaac

SEQ ID NO: 48356 - RNA, 20 nt, Artificial Sequence
  MKO10048356_A_Shc1
  gRNA
uuugucaauaagcccacacg

SEQ ID NO: 48357 - RNA, 20 nt, Artificial Sequence
  MKO10048357_A_Shc1
  gRNA
auugacaaagcucccguguc

SEQ ID NO: 48358 - RNA, 20 nt, Artificial Sequence
  MKO10048358_A_Shc1
  gRNA
ucuccuccuugucgccccuu

SEQ ID NO: 48359 - RNA, 20 nt, Artificial Sequence
  MKO10048359_A_Shc2
  gRNA
ucuuaccgugucaccacccg

SEQ ID NO: 48360 - RNA, 20 nt, Artificial Sequence
  MKO10048360_A_Shc2
  gRNA
gcuucgauccaugcgcuccc

SEQ ID NO: 48361 - RNA, 20 nt, Artificial Sequence
  MKO10048361_A_Shc2
  gRNA
aaaagcaaccugcgcuucgc

SEQ ID NO: 48362 - RNA, 20 nt, Artificial Sequence
  MKO10048362_A_Shc3
  gRNA
acuuaccgggucucccccug

SEQ ID NO: 48363 - RNA, 20 nt, Artificial Sequence
  MKO10048363_A_Shc3
  gRNA
agaugcucaucccugcgaac

SEQ ID NO: 48364 - RNA, 20 nt, Artificial Sequence
  MKO10048364_A_Shc3
  gRNA
agugcgcagauucaggcugg

SEQ ID NO: 48365 - RNA, 20 nt, Artificial Sequence
  MKO10048365_A_Shc4
  gRNA
ucccguuaaguuccugacaa

SEQ ID NO: 48366 - RNA, 20 nt, Artificial Sequence
  MKO10048366_A_Shc4
  gRNA
caaaugaaaucgauugcauu

SEQ ID NO: 48367 - RNA, 20 nt, Artificial Sequence
  MKO10048367_A_Shc4
  gRNA
gaugaaccuugacaaccaac

SEQ ID NO: 48368 - RNA, 20 nt, Artificial Sequence
  MKO10048368_A_Shcbp1l
  gRNA
cggccgaggccgucgagugc

SEQ ID NO: 48369 - RNA, 20 nt, Artificial Sequence
  MKO10048369_A_Shcbp1l
  gRNA
uuucuugaagcgcugcgcga

SEQ ID NO: 48370 - RNA, 20 nt, Artificial Sequence
  MKO10048370_A_Shcbp1l
  gRNA
gguguaucccguggacgggc

SEQ ID NO: 48371 - RNA, 20 nt, Artificial Sequence
  MKO10048371_A_Shcbp1
  gRNA
caucccugaaggcggucgua

SEQ ID NO: 48372 - RNA, 20 nt, Artificial Sequence
  MKO10048372_A_Shcbp1
  gRNA
caagccuuacgaccgccuuc

SEQ ID NO: 48373 - RNA, 20 nt, Artificial Sequence
  MKO10048373_A_Shcbp1
  gRNA
aauacuuacaaucucagucg

SEQ ID NO: 48374 - RNA, 20 nt, Artificial Sequence
  MKO10048374_A_Shd
  gRNA
ucguucggcucagcgagacc

SEQ ID NO: 48375 - RNA, 20 nt, Artificial Sequence
  MKO10048375_A_Shd
  gRNA
uucguagccugcuccucaua

SEQ ID NO: 48376 - RNA, 20 nt, Artificial Sequence
  MKO10048376_A_Shd
  gRNA
gcuuuacgauacuccauaug

SEQ ID NO: 48377 - RNA, 20 nt, Artificial Sequence
  MKO10048377_A_She
  gRNA
cagaucgcgagagcccuguc

SEQ ID NO: 48378 - RNA, 20 nt, Artificial Sequence
  MKO10048378_A_She
  gRNA
ugaucgaccuccgggcagag

SEQ ID NO: 48379 - RNA, 20 nt, Artificial Sequence
  MKO10048379_A_She
  gRNA
ccacccuccgaaggcucgua

SEQ ID NO: 48380 - RNA, 20 nt, Artificial Sequence
  MKO10048380_A_Shfm1
  gRNA
uccaagagacccaagucgac

SEQ ID NO: 48381 - RNA, 20 nt, Artificial Sequence
  MKO10048381_A_Shfm1
  gRNA
cgaguucgaggaguuucccg

SEQ ID NO: 48382 - RNA, 20 nt, Artificial Sequence
  MKO10048382_A_Shfm1
  gRNA
augacuucucuaaccaguua

SEQ ID NO: 48383 - RNA, 20 nt, Artificial Sequence
  MKO10048383_A_Shf
  gRNA
cagggagucgcgccugccag

SEQ ID NO: 48384 - RNA, 20 nt, Artificial Sequence
  MKO10048384_A_Shf
  gRNA
cagccgcaagcugcccauua

SEQ ID NO: 48385 - RNA, 20 nt, Artificial Sequence
  MKO10048385_A_Shf
  gRNA
cauguguuccgcucccuuaa

SEQ ID NO: 48386 - RNA, 20 nt, Artificial Sequence
  MKO10048386_A_Shh
  gRNA
ccgcgacgaaggcgccaaga

SEQ ID NO: 48387 - RNA, 20 nt, Artificial Sequence
  MKO10048387_A_Shh
  gRNA
cuucuacgugaucgagacgc

SEQ ID NO: 48388 - RNA, 20 nt, Artificial Sequence
  MKO10048388_A_Shh
  gRNA
uagggucuucucggcuacgu

SEQ ID NO: 48389 - RNA, 20 nt, Artificial Sequence
  MKO10048389_A_Shisa2
  gRNA
uacgugccguuccucaucgu

SEQ ID NO: 48390 - RNA, 20 nt, Artificial Sequence
  MKO10048390_A_Shisa2
  gRNA
cugcgacaacgaccgccagc

SEQ ID NO: 48391 - RNA, 20 nt, Artificial Sequence
  MKO10048391_A_Shisa2
  gRNA
gcccuuggugggguacgauc

SEQ ID NO: 48392 - RNA, 20 nt, Artificial Sequence
  MKO10048392_A_Shisa3
  gRNA
cacuuacgcgcggugaugcc

SEQ ID NO: 48393 - RNA, 20 nt, Artificial Sequence
  MKO10048393_A_Shisa3
  gRNA
caccaacgaccgcggagagc

SEQ ID NO: 48394 - RNA, 20 nt, Artificial Sequence
  MKO10048394_A_Shisa3
  gRNA
auacaccuaacccaaccguc

SEQ ID NO: 48395 - RNA, 20 nt, Artificial Sequence
  MKO10048395_A_Shisa4
  gRNA
gcguaccuucaaacgugcuc

SEQ ID NO: 48396 - RNA, 20 nt, Artificial Sequence
  MKO10048396_A_Shisa4
  gRNA
gcugcuggcgccuucgguau

SEQ ID NO: 48397 - RNA, 20 nt, Artificial Sequence
  MKO10048397_A_Shisa4
  gRNA
uccgggggguacugguauac

SEQ ID NO: 48398 - RNA, 20 nt, Artificial Sequence
  MKO10048398_A_Shisa5
  gRNA
uucggagcgaccgucgccau

SEQ ID NO: 48399 - RNA, 20 nt, Artificial Sequence
  MKO10048399_A_Shisa5
  gRNA
augaaccacgguaguaguug

SEQ ID NO: 48400 - RNA, 20 nt, Artificial Sequence
  MKO10048400_A_Shisa5
  gRNA
gcacguccgagcagcaguau

SEQ ID NO: 48401 - RNA, 20 nt, Artificial Sequence
  MKO10048401_A_Shisa6
  gRNA
uagggcaugccgaauucauc

SEQ ID NO: 48402 - RNA, 20 nt, Artificial Sequence
  MKO10048402_A_Shisa6
  gRNA
aaagacguccguaugcgaga

SEQ ID NO: 48403 - RNA, 20 nt, Artificial Sequence
  MKO10048403_A_Shisa6
  gRNA
guucugguaagagcgugaga

SEQ ID NO: 48404 - RNA, 20 nt, Artificial Sequence
  MKO10048404_A_Shisa7
  gRNA
accaagaccagccccgcgag

SEQ ID NO: 48405 - RNA, 20 nt, Artificial Sequence
  MKO10048405_A_Shisa7
  gRNA
cgagcaccgccacaugcgcc

SEQ ID NO: 48406 - RNA, 20 nt, Artificial Sequence
  MKO10048406_A_Shisa7
  gRNA
ggcuguugacguuguagugc

SEQ ID NO: 48407 - RNA, 20 nt, Artificial Sequence
  MKO10048407_A_Shisa9
  gRNA
gacaucgaaguagccccgac

SEQ ID NO: 48408 - RNA, 20 nt, Artificial Sequence
  MKO10048408_A_Shisa9
  gRNA
gggcaagcccccagcgcgua

SEQ ID NO: 48409 - RNA, 20 nt, Artificial Sequence
  MKO10048409_A_Shisa9
  gRNA
augacuucuacgccaaaaga

SEQ ID NO: 48410 - RNA, 20 nt, Artificial Sequence
  MKO10048410_A_Shkbp1
  gRNA
guggagugaguccguagaau

SEQ ID NO: 48411 - RNA, 20 nt, Artificial Sequence
  MKO10048411_A_Shkbp1
  gRNA
uccgcaggaaauuaaggaug

SEQ ID NO: 48412 - RNA, 20 nt, Artificial Sequence
  MKO10048412_A_Shkbp1
  gRNA
ccucucgccagacgcuuacc

SEQ ID NO: 48413 - RNA, 20 nt, Artificial Sequence
  MKO10048413_A_Shmt1
  gRNA
cacccgaagcugaucaucgc

SEQ ID NO: 48414 - RNA, 20 nt, Artificial Sequence
  MKO10048414_A_Shmt1
  gRNA
gaccgaguucaucgaugagc

SEQ ID NO: 48415 - RNA, 20 nt, Artificial Sequence
  MKO10048415_A_Shmt1
  gRNA
agagccucaugggcgaauca

SEQ ID NO: 48416 - RNA, 20 nt, Artificial Sequence
  MKO10048416_A_Shmt2
  gRNA
uuccacggcagauacuacgg

SEQ ID NO: 48417 - RNA, 20 nt, Artificial Sequence
  MKO10048417_A_Shmt2
  gRNA
acuacuuacauugagcuuau

SEQ ID NO: 48418 - RNA, 20 nt, Artificial Sequence
  MKO10048418_A_Shmt2
  gRNA
ucgagcugcucugccagcgc

SEQ ID NO: 48419 - RNA, 20 nt, Artificial Sequence
  MKO10048419_A_Shoc2
  gRNA
ccccacauaccuauuguauc

SEQ ID NO: 48420 - RNA, 20 nt, Artificial Sequence
  MKO10048420_A_Shoc2
  gRNA
cuguccaguuuaaaucgccu

SEQ ID NO: 48421 - RNA, 20 nt, Artificial Sequence
  MKO10048421_A_Shoc2
  gRNA
cuugcagcacaaugaccuac

SEQ ID NO: 48422 - RNA, 20 nt, Artificial Sequence
  MKO10048422_A_Shox2
  gRNA
caucauguaaggcgcgugcg

SEQ ID NO: 48423 - RNA, 20 nt, Artificial Sequence
  MKO10048423_A_Shox2
  gRNA
uccucgcgcaugaaagcguc

SEQ ID NO: 48424 - RNA, 20 nt, Artificial Sequence
  MKO10048424_A_Shox2
  gRNA
guugcacccuaugucaacgu

SEQ ID NO: 48425 - RNA, 20 nt, Artificial Sequence
  MKO10048425_A_Shpk
  gRNA
gucccgacacuccgaugccc

SEQ ID NO: 48426 - RNA, 20 nt, Artificial Sequence
  MKO10048426_A_Shpk
  gRNA
cugaccagaaugccgcuagc

SEQ ID NO: 48427 - RNA, 20 nt, Artificial Sequence
  MKO10048427_A_Shpk
  gRNA
guuaaaauagccccagcuag

SEQ ID NO: 48428 - RNA, 20 nt, Artificial Sequence
  MKO10048428_A_Shprh
  gRNA
ccagcacccugcguugauuc

SEQ ID NO: 48429 - RNA, 20 nt, Artificial Sequence
  MKO10048429_A_Shprh
  gRNA
uugauugugugagugccguc

SEQ ID NO: 48430 - RNA, 20 nt, Artificial Sequence
  MKO10048430_A_Shprh
  gRNA
uacaguuucucccuaucgug

SEQ ID NO: 48431 - RNA, 20 nt, Artificial Sequence
  MKO10048431_A_Shq1
  gRNA
aguuuccuugggcaaucgaa

SEQ ID NO: 48432 - RNA, 20 nt, Artificial Sequence
  MKO10048432_A_Shq1
  gRNA
uggaaaccugcgggccggug

SEQ ID NO: 48433 - RNA, 20 nt, Artificial Sequence
  MKO10048433_A_Shq1
  gRNA
aacacauuuaggugcuuccg

SEQ ID NO: 48434 - RNA, 20 nt, Artificial Sequence
  MKO10048434_A_Shroom1
  gRNA
agcgccucaaaaugccgacu

SEQ ID NO: 48435 - RNA, 20 nt, Artificial Sequence
  MKO10048435_A_Shroom1
  gRNA
gcaagcggugaacggcucug

SEQ ID NO: 48436 - RNA, 20 nt, Artificial Sequence
  MKO10048436_A_Shroom1
  gRNA
cagaccaaaccggcuggcug

SEQ ID NO: 48437 - RNA, 20 nt, Artificial Sequence
  MKO10048437_A_Shroom2
  gRNA
ccuccaauucgaagaacgug

SEQ ID NO: 48438 - RNA, 20 nt, Artificial Sequence
  MKO10048438_A_Shroom2
  gRNA
gaccgcucaugaauguacug

SEQ ID NO: 48439 - RNA, 20 nt, Artificial Sequence
  MKO10048439_A_Shroom2
  gRNA
aagugccuguugaaccaaac

SEQ ID NO: 48440 - RNA, 20 nt, Artificial Sequence
  MKO10048440_A_Shroom3
  gRNA
ugccgucgcgcucgaagaug

SEQ ID NO: 48441 - RNA, 20 nt, Artificial Sequence
  MKO10048441_A_Shroom3
  gRNA
gucacgcugugucgcucccg

SEQ ID NO: 48442 - RNA, 20 nt, Artificial Sequence
  MKO10048442_A_Shroom3
  gRNA
gaagggcugacuccgauauu

SEQ ID NO: 48443 - RNA, 20 nt, Artificial Sequence
  MKO10048443_A_Shroom4
  gRNA
gugugacacgaacgaagccg

SEQ ID NO: 48444 - RNA, 20 nt, Artificial Sequence
  MKO10048444_A_Shroom4
  gRNA
ucagugacuuuaaucggccc

SEQ ID NO: 48445 - RNA, 20 nt, Artificial Sequence
  MKO10048445_A_Shroom4
  gRNA
ucuuggcgggagccauacaa

SEQ ID NO: 48446 - RNA, 20 nt, Artificial Sequence
  MKO10048446_A_Siae
  gRNA
ucaugguccaagcccaccgc

SEQ ID NO: 48447 - RNA, 20 nt, Artificial Sequence
  MKO10048447_A_Siae
  gRNA
cuagaucuuuaacgccucaa

SEQ ID NO: 48448 - RNA, 20 nt, Artificial Sequence
  MKO10048448_A_Siae
  gRNA
aauguacgucccaccccaac

SEQ ID NO: 48449 - RNA, 20 nt, Artificial Sequence
  MKO10048449_A_Siah1a
  gRNA
auucccucaugaauagaccg

SEQ ID NO: 48450 - RNA, 20 nt, Artificial Sequence
  MKO10048450_A_Siah1a
  gRNA
ucauaggcggcgauugacuu

SEQ ID NO: 48451 - RNA, 20 nt, Artificial Sequence
  MKO10048451_A_Siah1a
  gRNA
uggguaaugcuguagcaguc

SEQ ID NO: 48452 - RNA, 20 nt, Artificial Sequence
  MKO10048452_A_Siah1b
  gRNA
accauuuagcucaagucgau

SEQ ID NO: 48453 - RNA, 20 nt, Artificial Sequence
  MKO10048453_A_Siah1b
  gRNA
ucauaggcgccgauuaacuu

SEQ ID NO: 48454 - RNA, 20 nt, Artificial Sequence
  MKO10048454_A_Siah1b
  gRNA
cccuguaaauauuccgcuuc

SEQ ID NO: 48455 - RNA, 20 nt, Artificial Sequence
  MKO10048455_A_Siah2
  gRNA
guuagggcgccccugcacgu

SEQ ID NO: 48456 - RNA, 20 nt, Artificial Sequence
  MKO10048456_A_Siah2
  gRNA
cgaagagcgaggucagcucg

SEQ ID NO: 48457 - RNA, 20 nt, Artificial Sequence
  MKO10048457_A_Siah2
  gRNA
ggaaccggaggagacugacc

SEQ ID NO: 48458 - RNA, 20 nt, Artificial Sequence
  MKO10048458_A_Siah3
  gRNA
gccaucacggagacggacgu

SEQ ID NO: 48459 - RNA, 20 nt, Artificial Sequence
  MKO10048459_A_Siah3
  gRNA
uccgacguccgucuccguga

SEQ ID NO: 48460 - RNA, 20 nt, Artificial Sequence
  MKO10048460_A_Siah3
  gRNA
acucaccuuuagguugugcg

SEQ ID NO: 48461 - RNA, 20 nt, Artificial Sequence
  MKO10048461_A_Sidt1
  gRNA
gauuucgaucgcgucuacag

SEQ ID NO: 48462 - RNA, 20 nt, Artificial Sequence
  MKO10048462_A_Sidt1
  gRNA
gcgauccgcgagaccccgcc

SEQ ID NO: 48463 - RNA, 20 nt, Artificial Sequence
  MKO10048463_A_Sidt1
  gRNA
acuguugacaugcacccgca

SEQ ID NO: 48464 - RNA, 20 nt, Artificial Sequence
  MKO10048464_A_Sidt2
  gRNA
caggugccccuaauccuucg

SEQ ID NO: 48465 - RNA, 20 nt, Artificial Sequence
  MKO10048465_A_Sidt2
  gRNA
gcuguuugugguccgccaga

SEQ ID NO: 48466 - RNA, 20 nt, Artificial Sequence
  MKO10048466_A_Sidt2
  gRNA
auuaccgaguccacaccauc

SEQ ID NO: 48467 - RNA, 20 nt, Artificial Sequence
  MKO10048467_A_Sigirr
  gRNA
ccgcgaccucuugccucgcg

SEQ ID NO: 48468 - RNA, 20 nt, Artificial Sequence
  MKO10048468_A_Sigirr
  gRNA
ccccgacgccgcuccaacug

SEQ ID NO: 48469 - RNA, 20 nt, Artificial Sequence
  MKO10048469_A_Sigirr
  gRNA
gccgacacuuaacauagagc

SEQ ID NO: 48470 - RNA, 20 nt, Artificial Sequence
  MKO10048470_A_Siglec15
  gRNA
cgucgccggugaacuccacg

SEQ ID NO: 48471 - RNA, 20 nt, Artificial Sequence
  MKO10048471_A_Siglec15
  gRNA
ugcacguguagcggccgucg

SEQ ID NO: 48472 - RNA, 20 nt, Artificial Sequence
  MKO10048472_A_Siglec15
  gRNA
cgagccguacgcgggcccgc

SEQ ID NO: 48473 - RNA, 20 nt, Artificial Sequence
  MKO10048473_A_Siglec1
  gRNA
ucugcucuguagcacgccga

SEQ ID NO: 48474 - RNA, 20 nt, Artificial Sequence
  MKO10048474_A_Siglec1
  gRNA
agaucagugauagcaaccgc

SEQ ID NO: 48475 - RNA, 20 nt, Artificial Sequence
  MKO10048475_A_Siglec1
  gRNA
gggccauauguagggucguc

SEQ ID NO: 48476 - RNA, 20 nt, Artificial Sequence
  MKO10048476_A_Siglec5
  gRNA
gcgaauaaccguccguagcc

SEQ ID NO: 48477 - RNA, 20 nt, Artificial Sequence
  MKO10048477_A_Siglec5
  gRNA
cccacagcgaucaguacuga

SEQ ID NO: 48478 - RNA, 20 nt, Artificial Sequence
  MKO10048478_A_Siglec5
  gRNA
ugguccuccaacuccgcccg

SEQ ID NO: 48479 - RNA, 20 nt, Artificial Sequence
  MKO10048479_A_Siglece
  gRNA
ccuccgugcuuaagaugcac

SEQ ID NO: 48480 - RNA, 20 nt, Artificial Sequence
  MKO10048480_A_Siglece
  gRNA
aucccccugcgaaccuaagc

SEQ ID NO: 48481 - RNA, 20 nt, Artificial Sequence
  MKO10048481_A_Siglece
  gRNA
ccgauacucacgccaggagg

SEQ ID NO: 48482 - RNA, 20 nt, Artificial Sequence
  MKO10048482_A_Siglecg
  gRNA
cccuguggggucgagaaccc

SEQ ID NO: 48483 - RNA, 20 nt, Artificial Sequence
  MKO10048483_A_Siglecg
  gRNA
gccaggguucucgaccccac

SEQ ID NO: 48484 - RNA, 20 nt, Artificial Sequence
  MKO10048484_A_Siglecg
  gRNA
cuuaaccguuccccacuuua

SEQ ID NO: 48485 - RNA, 20 nt, Artificial Sequence
  MKO10048485_A_Siglech
  gRNA
gagaucccauacgaagagag

SEQ ID NO: 48486 - RNA, 20 nt, Artificial Sequence
  MKO10048486_A_Siglech
  gRNA
accagcaacacacauggauc

SEQ ID NO: 48487 - RNA, 20 nt, Artificial Sequence
  MKO10048487_A_Siglech
  gRNA
gucagcugcccucauauccc

SEQ ID NO: 48488 - RNA, 20 nt, Artificial Sequence
  MKO10048488_A_Sigmar1
  gRNA
ggccccgggcauaggcccga

SEQ ID NO: 48489 - RNA, 20 nt, Artificial Sequence
  MKO10048489_A_Sigmar1
  gRNA
uauuugugaacgcgggcggc

SEQ ID NO: 48490 - RNA, 20 nt, Artificial Sequence
  MKO10048490_A_Sigmar1
  gRNA
cgcuagaaugccgugggccg

SEQ ID NO: 48491 - RNA, 20 nt, Artificial Sequence
  MKO10048491_A_Sik1
  gRNA
cggggggcucccacaccacg

SEQ ID NO: 48492 - RNA, 20 nt, Artificial Sequence
  MKO10048492_A_Sik1
  gRNA
cuccuacccagacguccagc

SEQ ID NO: 48493 - RNA, 20 nt, Artificial Sequence
  MKO10048493_A_Sik1
  gRNA
aacauggauaucaagcuagc

SEQ ID NO: 48494 - RNA, 20 nt, Artificial Sequence
  MKO10048494_A_Sik2
  gRNA
cuuuaaaacuggugaacugc

SEQ ID NO: 48495 - RNA, 20 nt, Artificial Sequence
  MKO10048495_A_Sik2
  gRNA
auccuaauagauuucggcuu

SEQ ID NO: 48496 - RNA, 20 nt, Artificial Sequence
  MKO10048496_A_Sik2
  gRNA
cacaagguacaacauacuuu

SEQ ID NO: 48497 - RNA, 20 nt, Artificial Sequence
  MKO10048497_A_Sik3
  gRNA
ugacagaauacgcuagcgga

SEQ ID NO: 48498 - RNA, 20 nt, Artificial Sequence
  MKO10048498_A_Sik3
  gRNA
gccgccccagagcucuucga

SEQ ID NO: 48499 - RNA, 20 nt, Artificial Sequence
  MKO10048499_A_Sik3
  gRNA
gacagagcgcaugauuuacc

SEQ ID NO: 48500 - RNA, 20 nt, Artificial Sequence
  MKO10048500_A_Sike1
  gRNA
ggacgauaaccaauucugua

SEQ ID NO: 48501 - RNA, 20 nt, Artificial Sequence
  MKO10048501_A_Sike1
  gRNA
ugaucaguuccaacgcaucc

SEQ ID NO: 48502 - RNA, 20 nt, Artificial Sequence
  MKO10048502_A_Sike1
  gRNA
agaggaugcauccgacguga

SEQ ID NO: 48503 - RNA, 20 nt, Artificial Sequence
  MKO10048503_A_Sil1
  gRNA
ccucguuuacuccagucugu

SEQ ID NO: 48504 - RNA, 20 nt, Artificial Sequence
  MKO10048504_A_Sil1
  gRNA
ggagcuagacaccgagaucc

SEQ ID NO: 48505 - RNA, 20 nt, Artificial Sequence
  MKO10048505_A_Sil1
  gRNA
uguuccacccaacucaagag

SEQ ID NO: 48506 - RNA, 20 nt, Artificial Sequence
  MKO10048506_A_Sim1
  gRNA
uucgcgaccaacguugucca

SEQ ID NO: 48507 - RNA, 20 nt, Artificial Sequence
  MKO10048507_A_Sim1
  gRNA
caccagucgaaccagccccu

SEQ ID NO: 48508 - RNA, 20 nt, Artificial Sequence
  MKO10048508_A_Sim1
  gRNA
acacaccuuguagccaccgc

SEQ ID NO: 48509 - RNA, 20 nt, Artificial Sequence
  MKO10048509_A_Sim2
  gRNA
ucuucgaaugaagugcgucu

SEQ ID NO: 48510 - RNA, 20 nt, Artificial Sequence
  MKO10048510_A_Sim2
  gRNA
ucccaggucuaggagacgcg

SEQ ID NO: 48511 - RNA, 20 nt, Artificial Sequence
  MKO10048511_A_Sim2
  gRNA
cggugggugggcuguaagua

SEQ ID NO: 48512 - RNA, 20 nt, Artificial Sequence
  MKO10048512_A_Simc1
  gRNA
accauucuuagucuucgaug

SEQ ID NO: 48513 - RNA, 20 nt, Artificial Sequence
  MKO10048513_A_Simc1
  gRNA
gcagaaucgugauacuccua

SEQ ID NO: 48514 - RNA, 20 nt, Artificial Sequence
  MKO10048514_A_Simc1
  gRNA
cguagaaagagaacucgucc

SEQ ID NO: 48515 - RNA, 20 nt, Artificial Sequence
  MKO10048515_A_Sin3a
  gRNA
gugcagaaugaagcgacguu

SEQ ID NO: 48516 - RNA, 20 nt, Artificial Sequence
  MKO10048516_A_Sin3a
  gRNA
cgcccuguccuaucuugacc

SEQ ID NO: 48517 - RNA, 20 nt, Artificial Sequence
  MKO10048517_A_Sin3a
  gRNA
ccggggcaaggacccggugc

SEQ ID NO: 48518 - RNA, 20 nt, Artificial Sequence
  MKO10048518_A_Sin3b
  gRNA
uggcucccgcuggggucguu

SEQ ID NO: 48519 - RNA, 20 nt, Artificial Sequence
  MKO10048519_A_Sin3b
  gRNA
caagaucaagacccgcuuuc

SEQ ID NO: 48520 - RNA, 20 nt, Artificial Sequence
  MKO10048520_A_Sin3b
  gRNA
cggcagcuucucgugcccuc

SEQ ID NO: 48521 - RNA, 20 nt, Artificial Sequence
  MKO10048521_A_Sipa1l1
  gRNA
gacuuagagcgucgcuugag

SEQ ID NO: 48522 - RNA, 20 nt, Artificial Sequence
  MKO10048522_A_Sipa1l1
  gRNA
ugcgcugccgaauucugcga

SEQ ID NO: 48523 - RNA, 20 nt, Artificial Sequence
  MKO10048523_A_Sipa1l1
  gRNA
caacgugcagugccugcgcu

SEQ ID NO: 48524 - RNA, 20 nt, Artificial Sequence
  MKO10048524_A_Sipa1l2
  gRNA
aacccuucagccgcacucuc

SEQ ID NO: 48525 - RNA, 20 nt, Artificial Sequence
  MKO10048525_A_Sipa1l2
  gRNA
cagcaaguaccgugcgcagc

SEQ ID NO: 48526 - RNA, 20 nt, Artificial Sequence
  MKO10048526_A_Sipa1l2
  gRNA
gucgcaguucaacuacaggg

SEQ ID NO: 48527 - RNA, 20 nt, Artificial Sequence
  MKO10048527_A_Sipa1l3
  gRNA
cucccucuacacgacguacc

SEQ ID NO: 48528 - RNA, 20 nt, Artificial Sequence
  MKO10048528_A_Sipa1l3
  gRNA
aguccugguacgucguguag

SEQ ID NO: 48529 - RNA, 20 nt, Artificial Sequence
  MKO10048529_A_Sipa1l3
  gRNA
caccaaguaugccgcgcagc

SEQ ID NO: 48530 - RNA, 20 nt, Artificial Sequence
  MKO10048530_A_Sipa1
  gRNA
gcgugguccgcacgaugacc

SEQ ID NO: 48531 - RNA, 20 nt, Artificial Sequence
  MKO10048531_A_Sipa1
  gRNA
ggcauccuguacugccgcgc

SEQ ID NO: 48532 - RNA, 20 nt, Artificial Sequence
  MKO10048532_A_Sipa1
  gRNA
ccccgaggggccuaucuccg

SEQ ID NO: 48533 - RNA, 20 nt, Artificial Sequence
  MKO10048533_A_Sirpa
  gRNA
ccgcggcccauggagcccgc

SEQ ID NO: 48534 - RNA, 20 nt, Artificial Sequence
  MKO10048534_A_Sirpa
  gRNA
cuguugaucuacaguuucgc

SEQ ID NO: 48535 - RNA, 20 nt, Artificial Sequence
  MKO10048535_A_Sirpa
  gRNA
uacuccucuguaccaccuaa

SEQ ID NO: 48536 - RNA, 20 nt, Artificial Sequence
  MKO10048536_A_Sirpb1a
  gRNA
ggggaauguucuccugugaa

SEQ ID NO: 48537 - RNA, 20 nt, Artificial Sequence
  MKO10048537_A_Sirpb1a
  gRNA
cucuugauauacccguucac

SEQ ID NO: 48538 - RNA, 20 nt, Artificial Sequence
  MKO10048538_A_Sirpb1a
  gRNA
cauugaaacccauacugugc

SEQ ID NO: 48539 - RNA, 20 nt, Artificial Sequence
  MKO10048539_A_Sirpb1b
  gRNA
cucuugauacagucguucac

SEQ ID NO: 48540 - RNA, 20 nt, Artificial Sequence
  MKO10048540_A_Sirpb1b
  gRNA
ggcacugaguugucaguacu

SEQ ID NO: 48541 - RNA, 20 nt, Artificial Sequence
  MKO10048541_A_Sirpb1b
  gRNA
cucucagaucauuugugaag

SEQ ID NO: 48542 - RNA, 20 nt, Artificial Sequence
  MKO10048542_A_Sirt1
  gRNA
cggacgagccgcuccgcaag

SEQ ID NO: 48543 - RNA, 20 nt, Artificial Sequence
  MKO10048543_A_Sirt1
  gRNA
ucgaagucgucagccgcccu

SEQ ID NO: 48544 - RNA, 20 nt, Artificial Sequence
  MKO10048544_A_Sirt1
  gRNA
uaucuaugcucgccuugcgg

SEQ ID NO: 48545 - RNA, 20 nt, Artificial Sequence
  MKO10048545_A_Sirt2
  gRNA
cccuaacucacgguccggcu

SEQ ID NO: 48546 - RNA, 20 nt, Artificial Sequence
  MKO10048546_A_Sirt2
  gRNA
gcucuaucccgggcaguuca

SEQ ID NO: 48547 - RNA, 20 nt, Artificial Sequence
  MKO10048547_A_Sirt2
  gRNA
ccccguucccauggccgagc

SEQ ID NO: 48548 - RNA, 20 nt, Artificial Sequence
  MKO10048548_A_Sirt3
  gRNA
caugaacuacauccccuagc

SEQ ID NO: 48549 - RNA, 20 nt, Artificial Sequence
  MKO10048549_A_Sirt3
  gRNA
uugcuguagaggccgcuccc

SEQ ID NO: 48550 - RNA, 20 nt, Artificial Sequence
  MKO10048550_A_Sirt3
  gRNA
agcuguacccugggcacuac

SEQ ID NO: 48551 - RNA, 20 nt, Artificial Sequence
  MKO10048551_A_Sirt4
  gRNA
gucccgugcugugaucgaug

SEQ ID NO: 48552 - RNA, 20 nt, Artificial Sequence
  MKO10048552_A_Sirt4
  gRNA
aguuucgggcccaguaccgc

SEQ ID NO: 48553 - RNA, 20 nt, Artificial Sequence
  MKO10048553_A_Sirt4
  gRNA
uccccaaagaaaacgacguc

SEQ ID NO: 48554 - RNA, 20 nt, Artificial Sequence
  MKO10048554_A_Sirt5
  gRNA
uaccggggaaguuugucgac

SEQ ID NO: 48555 - RNA, 20 nt, Artificial Sequence
  MKO10048555_A_Sirt5
  gRNA
cauugacgaguugcaucgca

SEQ ID NO: 48556 - RNA, 20 nt, Artificial Sequence
  MKO10048556_A_Sirt5
  gRNA
gaucggacuccuauaguucu

SEQ ID NO: 48557 - RNA, 20 nt, Artificial Sequence
  MKO10048557_A_Sirt6
  gRNA
cgagggccgagcauucucga

SEQ ID NO: 48558 - RNA, 20 nt, Artificial Sequence
  MKO10048558_A_Sirt6
  gRNA
cgugcagcccgucuacguuc

SEQ ID NO: 48559 - RNA, 20 nt, Artificial Sequence
  MKO10048559_A_Sirt6
  gRNA
uguucaccgaccugaagucg

SEQ ID NO: 48560 - RNA, 20 nt, Artificial Sequence
  MKO10048560_A_Sirt7
  gRNA
gcggaggaagguccgcgaac

SEQ ID NO: 48561 - RNA, 20 nt, Artificial Sequence
  MKO10048561_A_Sirt7
  gRNA
ugcugccgaccuaagcgaag

SEQ ID NO: 48562 - RNA, 20 nt, Artificial Sequence
  MKO10048562_A_Sirt7
  gRNA
cguaggugucacgcauccug

SEQ ID NO: 48563 - RNA, 20 nt, Artificial Sequence
  MKO10048563_A_Sis
  gRNA
ccuugaaccggaaacgauua

SEQ ID NO: 48564 - RNA, 20 nt, Artificial Sequence
  MKO10048564_A_Sis
  gRNA
gucagacccguaaucguuuc

SEQ ID NO: 48565 - RNA, 20 nt, Artificial Sequence
  MKO10048565_A_Sis
  gRNA
cguucagcaucaaagucauc

SEQ ID NO: 48566 - RNA, 20 nt, Artificial Sequence
  MKO10048566_A_Sit1
  gRNA
uccccuccauaagccacgcg

SEQ ID NO: 48567 - RNA, 20 nt, Artificial Sequence
  MKO10048567_A_Sit1
  gRNA
caguccccacgcguggcuua

SEQ ID NO: 48568 - RNA, 20 nt, Artificial Sequence
  MKO10048568_A_Sit1
  gRNA
gucggcugucucaagaacca

SEQ ID NO: 48569 - RNA, 20 nt, Artificial Sequence
  MKO10048569_A_Siva1
  gRNA
cugugcagcuaugccgacga

SEQ ID NO: 48570 - RNA, 20 nt, Artificial Sequence
  MKO10048570_A_Siva1
  gRNA
ugcgaacgggcagcuccgcu

SEQ ID NO: 48571 - RNA, 20 nt, Artificial Sequence
  MKO10048571_A_Siva1
  gRNA
cagugucuucucaccaucgu

SEQ ID NO: 48572 - RNA, 20 nt, Artificial Sequence
  MKO10048572_A_Six1
  gRNA
augucgaugcugccgucguu

SEQ ID NO: 48573 - RNA, 20 nt, Artificial Sequence
  MKO10048573_A_Six1
  gRNA
gggucggccgcgaaguuucu

SEQ ID NO: 48574 - RNA, 20 nt, Artificial Sequence
  MKO10048574_A_Six1
  gRNA
ccgaguucuggucuggacuu

SEQ ID NO: 48575 - RNA, 20 nt, Artificial Sequence
  MKO10048575_A_Six2
  gRNA
agaaccggcggcagcgcgac

SEQ ID NO: 48576 - RNA, 20 nt, Artificial Sequence
  MKO10048576_A_Six2
  gRNA
ccgugggcaaguaccgcgug

SEQ ID NO: 48577 - RNA, 20 nt, Artificial Sequence
  MKO10048577_A_Six2
  gRNA
acugguacggguacugcgcu

SEQ ID NO: 48578 - RNA, 20 nt, Artificial Sequence
  MKO10048578_A_Six3
  gRNA
cgccaguucgcguuucuugc

SEQ ID NO: 48579 - RNA, 20 nt, Artificial Sequence
  MKO10048579_A_Six3
  gRNA
uacaucacauuccgagucgc

SEQ ID NO: 48580 - RNA, 20 nt, Artificial Sequence
  MKO10048580_A_Six3
  gRNA
uacuuguccaccgggccgag

SEQ ID NO: 48581 - RNA, 20 nt, Artificial Sequence
  MKO10048581_A_Six4
  gRNA
ucugaaggcgcgagcgcucg

SEQ ID NO: 48582 - RNA, 20 nt, Artificial Sequence
  MKO10048582_A_Six4
  gRNA
gaagucgcgcaacgcgcuca

SEQ ID NO: 48583 - RNA, 20 nt, Artificial Sequence
  MKO10048583_A_Six4
  gRNA
ggacacauuaaccaacgacg

SEQ ID NO: 48584 - RNA, 20 nt, Artificial Sequence
  MKO10048584_A_Six5
  gRNA
gcaccggaucgcugccacgu

SEQ ID NO: 48585 - RNA, 20 nt, Artificial Sequence
  MKO10048585_A_Six5
  gRNA
auagcgguugccgcgguagc

SEQ ID NO: 48586 - RNA, 20 nt, Artificial Sequence
  MKO10048586_A_Six5
  gRNA
gcuggacucauccuccguag

SEQ ID NO: 48587 - RNA, 20 nt, Artificial Sequence
  MKO10048587_A_Six6
  gRNA
cgcggcaccugcuucgagag

SEQ ID NO: 48588 - RNA, 20 nt, Artificial Sequence
  MKO10048588_A_Six6
  gRNA
gaugucgcacucacugucgc

SEQ ID NO: 48589 - RNA, 20 nt, Artificial Sequence
  MKO10048589_A_Six6
  gRNA
cacauaccccggcuacuugc

SEQ ID NO: 48590 - RNA, 20 nt, Artificial Sequence
  MKO10048590_A_Ska1
  gRNA
cucugggucgccgucacuug

SEQ ID NO: 48591 - RNA, 20 nt, Artificial Sequence
  MKO10048591_A_Ska1
  gRNA
acaaacuaacaguucacuca

SEQ ID NO: 48592 - RNA, 20 nt, Artificial Sequence
  MKO10048592_A_Ska1
  gRNA
uccccaucugccucaaguga

SEQ ID NO: 48593 - RNA, 20 nt, Artificial Sequence
  MKO10048593_A_Ska2
  gRNA
gccauuaaaaucucauaugc

SEQ ID NO: 48594 - RNA, 20 nt, Artificial Sequence
  MKO10048594_A_Ska2
  gRNA
auuaccucuccugcugaaug

SEQ ID NO: 48595 - RNA, 20 nt, Artificial Sequence
  MKO10048595_A_Ska2
  gRNA
ccagaaagcugauucugauu

SEQ ID NO: 48596 - RNA, 20 nt, Artificial Sequence
  MKO10048596_A_Ska3
  gRNA
aauccuccuugucacgcgcu

SEQ ID NO: 48597 - RNA, 20 nt, Artificial Sequence
  MKO10048597_A_Ska3
  gRNA
cuaccaagcgcgugacaagg

SEQ ID NO: 48598 - RNA, 20 nt, Artificial Sequence
  MKO10048598_A_Ska3
  gRNA
uucaagugcugaagaccccg

SEQ ID NO: 48599 - RNA, 20 nt, Artificial Sequence
  MKO10048599_A_Skap1
  gRNA
uuuagauaccgaagacuucc

SEQ ID NO: 48600 - RNA, 20 nt, Artificial Sequence
  MKO10048600_A_Skap1
  gRNA
gauugucaucagagccgucc

SEQ ID NO: 48601 - RNA, 20 nt, Artificial Sequence
  MKO10048601_A_Skap1
  gRNA
aaugcaggcugucgcccucc

SEQ ID NO: 48602 - RNA, 20 nt, Artificial Sequence
  MKO10048602_A_Skap2
  gRNA
gaauaugacgaucccuuugc

SEQ ID NO: 48603 - RNA, 20 nt, Artificial Sequence
  MKO10048603_A_Skap2
  gRNA
uaccuggaaaaacgcagaaa

SEQ ID NO: 48604 - RNA, 20 nt, Artificial Sequence
  MKO10048604_A_Skap2
  gRNA
aucuuuaucguagcgcucug

SEQ ID NO: 48605 - RNA, 20 nt, Artificial Sequence
  MKO10048605_A_Skida1
  gRNA
ccgaccgacucuccuucgcu

SEQ ID NO: 48606 - RNA, 20 nt, Artificial Sequence
  MKO10048606_A_Skida1
  gRNA
ugagcgugcauuuggccgcg

SEQ ID NO: 48607 - RNA, 20 nt, Artificial Sequence
  MKO10048607_A_Skida1
  gRNA
ggaaggcgacguaguuuccc

SEQ ID NO: 48608 - RNA, 20 nt, Artificial Sequence
  MKO10048608_A_Skil
  gRNA
gcgaaugcaugacgaacguc

SEQ ID NO: 48609 - RNA, 20 nt, Artificial Sequence
  MKO10048609_A_Skil
  gRNA
cgcuuggcgugcucgccauc

SEQ ID NO: 48610 - RNA, 20 nt, Artificial Sequence
  MKO10048610_A_Skil
  gRNA
gauggcaauuccauucccga

SEQ ID NO: 48611 - RNA, 20 nt, Artificial Sequence
  MKO10048611_A_Skint10
  gRNA
aaaagaagcguuguccuacc

SEQ ID NO: 48612 - RNA, 20 nt, Artificial Sequence
  MKO10048612_A_Skint10
  gRNA
guacucuuggaguguacuuc

SEQ ID NO: 48613 - RNA, 20 nt, Artificial Sequence
  MKO10048613_A_Skint10
  gRNA
acauauauuccgauuugaau

SEQ ID NO: 48614 - RNA, 20 nt, Artificial Sequence
  MKO10048614_A_Skint11
  gRNA
aggagaaguauuauccuauc

SEQ ID NO: 48615 - RNA, 20 nt, Artificial Sequence
  MKO10048615_A_Skint11
  gRNA
ucccucucuacuugauguuc

SEQ ID NO: 48616 - RNA, 20 nt, Artificial Sequence
  MKO10048616_A_Skint11
  gRNA
agauguuucuacacaugacg

SEQ ID NO: 48617 - RNA, 20 nt, Artificial Sequence
  MKO10048617_A_Skint1
  gRNA
gugcacccuccuaauaccaa

SEQ ID NO: 48618 - RNA, 20 nt, Artificial Sequence
  MKO10048618_A_Skint1
  gRNA
ucccacgaccucucaugcaa

SEQ ID NO: 48619 - RNA, 20 nt, Artificial Sequence
  MKO10048619_A_Skint1
  gRNA
ucuaagccguucacuauaaa

SEQ ID NO: 48620 - RNA, 20 nt, Artificial Sequence
  MKO10048620_A_Skint2
  gRNA
augcagcccccuaauaucaa

SEQ ID NO: 48621 - RNA, 20 nt, Artificial Sequence
  MKO10048621_A_Skint2
  gRNA
aauguacaugacugagcuug

SEQ ID NO: 48622 - RNA, 20 nt, Artificial Sequence
  MKO10048622_A_Skint2
  gRNA
cugaacucuguguuaccauc

SEQ ID NO: 48623 - RNA, 20 nt, Artificial Sequence
  MKO10048623_A_Skint3
  gRNA
cagguucuguauagcgauuc

SEQ ID NO: 48624 - RNA, 20 nt, Artificial Sequence
  MKO10048624_A_Skint3
  gRNA
augcaucccccgaauauuaa

SEQ ID NO: 48625 - RNA, 20 nt, Artificial Sequence
  MKO10048625_A_Skint3
  gRNA
gaauguagcaagugacaauc

SEQ ID NO: 48626 - RNA, 20 nt, Artificial Sequence
  MKO10048626_A_Skint4
  gRNA
ccauuacgguauaggugcac

SEQ ID NO: 48627 - RNA, 20 nt, Artificial Sequence
  MKO10048627_A_Skint4
  gRNA
ccugugcaccuauaccguaa

SEQ ID NO: 48628 - RNA, 20 nt, Artificial Sequence
  MKO10048628_A_Skint4
  gRNA
augcauacgccuaauauuaa

SEQ ID NO: 48629 - RNA, 20 nt, Artificial Sequence
  MKO10048629_A_Skint5
  gRNA
gacuuaggaucaacaaacuc

SEQ ID NO: 48630 - RNA, 20 nt, Artificial Sequence
  MKO10048630_A_Skint5
  gRNA
agagcauaucauagacguca

SEQ ID NO: 48631 - RNA, 20 nt, Artificial Sequence
  MKO10048631_A_Skint5
  gRNA
aaaguaacuaguguugacag

SEQ ID NO: 48632 - RNA, 20 nt, Artificial Sequence
  MKO10048632_A_Skint6
  gRNA
agcauaagcuuuguccuacc

SEQ ID NO: 48633 - RNA, 20 nt, Artificial Sequence
  MKO10048633_A_Skint6
  gRNA
aaaguaacuaguguugauag

SEQ ID NO: 48634 - RNA, 20 nt, Artificial Sequence
  MKO10048634_A_Skint6
  gRNA
uuauuaaauccaacuccuac

SEQ ID NO: 48635 - RNA, 20 nt, Artificial Sequence
  MKO10048635_A_Skint7
  gRNA
gucaugguggaguguaauuc

SEQ ID NO: 48636 - RNA, 20 nt, Artificial Sequence
  MKO10048636_A_Skint7
  gRNA
aaaguuuagcuuccauugua

SEQ ID NO: 48637 - RNA, 20 nt, Artificial Sequence
  MKO10048637_A_Skint7
  gRNA
ccuuaccaauguucauuuaa

SEQ ID NO: 48638 - RNA, 20 nt, Artificial Sequence
  MKO10048638_A_Skint8
  gRNA
cauuuaccucuguaccggug

SEQ ID NO: 48639 - RNA, 20 nt, Artificial Sequence
  MKO10048639_A_Skint8
  gRNA
aucaugaaccucaacgugac

SEQ ID NO: 48640 - RNA, 20 nt, Artificial Sequence
  MKO10048640_A_Skint8
  gRNA
gugcauuucuuagucuguuc

SEQ ID NO: 48641 - RNA, 20 nt, Artificial Sequence
  MKO10048641_A_Skint9
  gRNA
acauauucuccgauuugaac

SEQ ID NO: 48642 - RNA, 20 nt, Artificial Sequence
  MKO10048642_A_Skint9
  gRNA
cuucugaaacucacguagau

SEQ ID NO: 48643 - RNA, 20 nt, Artificial Sequence
  MKO10048643_A_Skint9
  gRNA
uucagaugcccuguucaaau

SEQ ID NO: 48644 - RNA, 20 nt, Artificial Sequence
  MKO10048644_A_Skiv2l2
  gRNA
uuugcugccuucccaacucg

SEQ ID NO: 48645 - RNA, 20 nt, Artificial Sequence
  MKO10048645_A_Skiv2l2
  gRNA
auaccacuuaaaccucgagu

SEQ ID NO: 48646 - RNA, 20 nt, Artificial Sequence
  MKO10048646_A_Skiv2l2
  gRNA
guaucugcucauacgucagc

SEQ ID NO: 48647 - RNA, 20 nt, Artificial Sequence
  MKO10048647_A_Skiv2l
  gRNA
uuggauugccccauagcgac

SEQ ID NO: 48648 - RNA, 20 nt, Artificial Sequence
  MKO10048648_A_Skiv2l
  gRNA
gaacuuaccccuucgagcuc

SEQ ID NO: 48649 - RNA, 20 nt, Artificial Sequence
  MKO10048649_A_Skiv2l
  gRNA
aaguggggugcacuggccgu

SEQ ID NO: 48650 - RNA, 20 nt, Artificial Sequence
  MKO10048650_A_Ski
  gRNA
cuuguauccagccacgaaaa

SEQ ID NO: 48651 - RNA, 20 nt, Artificial Sequence
  MKO10048651_A_Ski
  gRNA
caccugucucgaaucaaagc

SEQ ID NO: 48652 - RNA, 20 nt, Artificial Sequence
  MKO10048652_A_Ski
  gRNA
aggcaugcaugcuccgcccg

SEQ ID NO: 48653 - RNA, 20 nt, Artificial Sequence
  MKO10048653_A_Skor1
  gRNA
uucguccgcgguguccacgu

SEQ ID NO: 48654 - RNA, 20 nt, Artificial Sequence
  MKO10048654_A_Skor1
  gRNA
cguccgcaccguccucgucc

SEQ ID NO: 48655 - RNA, 20 nt, Artificial Sequence
  MKO10048655_A_Skor1
  gRNA
cucgacgacagccgacgacu

SEQ ID NO: 48656 - RNA, 20 nt, Artificial Sequence
  MKO10048656_A_Skor2
  gRNA
uucaccucauucgcucaaaa

SEQ ID NO: 48657 - RNA, 20 nt, Artificial Sequence
  MKO10048657_A_Skor2
  gRNA
ccaaguuauuauaucuacaa

SEQ ID NO: 48658 - RNA, 20 nt, Artificial Sequence
  MKO10048658_A_Skor2
  gRNA
auccuuacugaagacuggga

SEQ ID NO: 48659 - RNA, 20 nt, Artificial Sequence
  MKO10048659_A_Skp1a
  gRNA
agguacgcaaagagaaccaa

SEQ ID NO: 48660 - RNA, 20 nt, Artificial Sequence
  MKO10048660_A_Skp1a
  gRNA
uucacuucucuucacaccau

SEQ ID NO: 48661 - RNA, 20 nt, Artificial Sequence
  MKO10048661_A_Skp1a
  gRNA
gauuaaggggaaaacuccug

SEQ ID NO: 48662 - RNA, 20 nt, Artificial Sequence
  MKO10048662_A_Skp2
  gRNA
aaguucucccgacuaagcuu

SEQ ID NO: 48663 - RNA, 20 nt, Artificial Sequence
  MKO10048663_A_Skp2
  gRNA
cauuuaucacugaguucgac

SEQ ID NO: 48664 - RNA, 20 nt, Artificial Sequence
  MKO10048664_A_Skp2
  gRNA
uccuuuauggagcagccgcu

SEQ ID NO: 48665 - RNA, 20 nt, Artificial Sequence
  MKO10048665_A_Sla2
  gRNA
cccgagucucagagauaguc

SEQ ID NO: 48666 - RNA, 20 nt, Artificial Sequence
  MKO10048666_A_Sla2
  gRNA
ccugagccgggagaaagccg

SEQ ID NO: 48667 - RNA, 20 nt, Artificial Sequence
  MKO10048667_A_Sla2
  gRNA
uuuacccaccucuccugguc

SEQ ID NO: 48668 - RNA, 20 nt, Artificial Sequence
  MKO10048668_A_Slain1
  gRNA
ccggaugccgagcaccgcug

SEQ ID NO: 48669 - RNA, 20 nt, Artificial Sequence
  MKO10048669_A_Slain1
  gRNA
agaguaugaucgcuacagcc

SEQ ID NO: 48670 - RNA, 20 nt, Artificial Sequence
  MKO10048670_A_Slain1
  gRNA
cucggcauccgggccagauu

SEQ ID NO: 48671 - RNA, 20 nt, Artificial Sequence
  MKO10048671_A_Slain2
  gRNA
guggacacgccgacccgagc

SEQ ID NO: 48672 - RNA, 20 nt, Artificial Sequence
  MKO10048672_A_Slain2
  gRNA
ugacaagcgcuccagcucgu

SEQ ID NO: 48673 - RNA, 20 nt, Artificial Sequence
  MKO10048673_A_Slain2
  gRNA
acuugccugcaccaaacuaa

SEQ ID NO: 48674 - RNA, 20 nt, Artificial Sequence
  MKO10048674_A_Slamf1
  gRNA
gcuuccuggggacgucgcca

SEQ ID NO: 48675 - RNA, 20 nt, Artificial Sequence
  MKO10048675_A_Slamf1
  gRNA
uguccgcauccucgucacca

SEQ ID NO: 48676 - RNA, 20 nt, Artificial Sequence
  MKO10048676_A_Slamf1
  gRNA
aucaucgcaagcaugcaagc

SEQ ID NO: 48677 - RNA, 20 nt, Artificial Sequence
  MKO10048677_A_Slamf6
  gRNA
ggguucuaacuaauccaccc

SEQ ID NO: 48678 - RNA, 20 nt, Artificial Sequence
  MKO10048678_A_Slamf6
  gRNA
gauuacuuagguugauaacg

SEQ ID NO: 48679 - RNA, 20 nt, Artificial Sequence
  MKO10048679_A_Slamf6
  gRNA
ccuuugacuagccaacaucc

SEQ ID NO: 48680 - RNA, 20 nt, Artificial Sequence
  MKO10048680_A_Slamf7
  gRNA
acaugucagauugauuacgc

SEQ ID NO: 48681 - RNA, 20 nt, Artificial Sequence
  MKO10048681_A_Slamf7
  gRNA
ccugagugaaguuagauccg

SEQ ID NO: 48682 - RNA, 20 nt, Artificial Sequence
  MKO10048682_A_Slamf7
  gRNA
cuuguugcuuugccgaucua

SEQ ID NO: 48683 - RNA, 20 nt, Artificial Sequence
  MKO10048683_A_Slamf8
  gRNA
ucuguaccacucucguuucc

SEQ ID NO: 48684 - RNA, 20 nt, Artificial Sequence
  MKO10048684_A_Slamf8
  gRNA
cuccuacaaggacgugcuac

SEQ ID NO: 48685 - RNA, 20 nt, Artificial Sequence
  MKO10048685_A_Slamf8
  gRNA
uaccaguagcacguccuugu

SEQ ID NO: 48686 - RNA, 20 nt, Artificial Sequence
  MKO10048686_A_Slamf9
  gRNA
gggacagccagccguuauca

SEQ ID NO: 48687 - RNA, 20 nt, Artificial Sequence
  MKO10048687_A_Slamf9
  gRNA
aguucccgucgcaucucugu

SEQ ID NO: 48688 - RNA, 20 nt, Artificial Sequence
  MKO10048688_A_Slamf9
  gRNA
acucacgguagacacggaga

SEQ ID NO: 48689 - RNA, 20 nt, Artificial Sequence
  MKO10048689_A_Sla
  gRNA
acauuagccccccaauauuc

SEQ ID NO: 48690 - RNA, 20 nt, Artificial Sequence
  MKO10048690_A_Sla
  gRNA
aauauuggggggcuaauguc

SEQ ID NO: 48691 - RNA, 20 nt, Artificial Sequence
  MKO10048691_A_Sla
  gRNA
uacucacccaugguacacuc

SEQ ID NO: 48692 - RNA, 20 nt, Artificial Sequence
  MKO10048692_A_Slbp
  gRNA
aaacugcucauaaacgacuu

SEQ ID NO: 48693 - RNA, 20 nt, Artificial Sequence
  MKO10048693_A_Slbp
  gRNA
ucgggacccaccuuucaggu

SEQ ID NO: 48694 - RNA, 20 nt, Artificial Sequence
  MKO10048694_A_Slbp
  gRNA
ucucggacggaagcgcagag

SEQ ID NO: 48695 - RNA, 20 nt, Artificial Sequence
  MKO10048695_A_Slc10a1
  gRNA
aaucuacgacggagaucuua

SEQ ID NO: 48696 - RNA, 20 nt, Artificial Sequence
  MKO10048696_A_Slc10a1
  gRNA
cuauguacccuacguccuca

SEQ ID NO: 48697 - RNA, 20 nt, Artificial Sequence
  MKO10048697_A_Slc10a1
  gRNA
cgucaugacaccacacuuac

SEQ ID NO: 48698 - RNA, 20 nt, Artificial Sequence
  MKO10048698_A_Slc10a2
  gRNA
uuacuuaccaaugcuaucau

SEQ ID NO: 48699 - RNA, 20 nt, Artificial Sequence
  MKO10048699_A_Slc10a2
  gRNA
ucccgagucaacccacaucu

SEQ ID NO: 48700 - RNA, 20 nt, Artificial Sequence
  MKO10048700_A_Slc10a2
  gRNA
caggugccgaacaguagccu

SEQ ID NO: 48701 - RNA, 20 nt, Artificial Sequence
  MKO10048701_A_Slc10a3
  gRNA
cucuccguucuucgaucagc

SEQ ID NO: 48702 - RNA, 20 nt, Artificial Sequence
  MKO10048702_A_Slc10a3
  gRNA
gugaucucuagccaauacac

SEQ ID NO: 48703 - RNA, 20 nt, Artificial Sequence
  MKO10048703_A_Slc10a3
  gRNA
caccccugcugaucgaagaa

SEQ ID NO: 48704 - RNA, 20 nt, Artificial Sequence
  MKO10048704_A_Slc10a4
  gRNA
ucggggcuaaagccgaugcu

SEQ ID NO: 48705 - RNA, 20 nt, Artificial Sequence
  MKO10048705_A_Slc10a4
  gRNA
ucaugucgccgucuaccagc

SEQ ID NO: 48706 - RNA, 20 nt, Artificial Sequence
  MKO10048706_A_Slc10a4
  gRNA
cugcacugcgauucucaaac

SEQ ID NO: 48707 - RNA, 20 nt, Artificial Sequence
  MKO10048707_A_Slc10a5
  gRNA
cggaagaaaacaucguugua

SEQ ID NO: 48708 - RNA, 20 nt, Artificial Sequence
  MKO10048708_A_Slc10a5
  gRNA
caucuacuuggcuuuccgga

SEQ ID NO: 48709 - RNA, 20 nt, Artificial Sequence
  MKO10048709_A_Slc10a5
  gRNA
augaugacaccagucgacau

SEQ ID NO: 48710 - RNA, 20 nt, Artificial Sequence
  MKO10048710_A_Slc10a6
  gRNA
uacagaccuaugcucugaua

SEQ ID NO: 48711 - RNA, 20 nt, Artificial Sequence
  MKO10048711_A_Slc10a6
  gRNA
ccaaugcaaaguuuagcagc

SEQ ID NO: 48712 - RNA, 20 nt, Artificial Sequence
  MKO10048712_A_Slc10a6
  gRNA
cauucccagggcggccacug

SEQ ID NO: 48713 - RNA, 20 nt, Artificial Sequence
  MKO10048713_A_Slc10a7
  gRNA
guugaagaauaucguugcga

SEQ ID NO: 48714 - RNA, 20 nt, Artificial Sequence
  MKO10048714_A_Slc10a7
  gRNA
ucucaggugcaccagugcgc

SEQ ID NO: 48715 - RNA, 20 nt, Artificial Sequence
  MKO10048715_A_Slc10a7
  gRNA
gcaggagcugaccagcgcac

SEQ ID NO: 48716 - RNA, 20 nt, Artificial Sequence
  MKO10048716_A_Slc11a1
  gRNA
gagcaucgcuuuccuugacc

SEQ ID NO: 48717 - RNA, 20 nt, Artificial Sequence
  MKO10048717_A_Slc11a1
  gRNA
uaggucucccggcaaggcgc

SEQ ID NO: 48718 - RNA, 20 nt, Artificial Sequence
  MKO10048718_A_Slc11a1
  gRNA
caucccuaccuggucugcgc

SEQ ID NO: 48719 - RNA, 20 nt, Artificial Sequence
  MKO10048719_A_Slc11a2
  gRNA
guugacucagauggcgcuuc

SEQ ID NO: 48720 - RNA, 20 nt, Artificial Sequence
  MKO10048720_A_Slc11a2
  gRNA
cagcgccuugcagcgagacu

SEQ ID NO: 48721 - RNA, 20 nt, Artificial Sequence
  MKO10048721_A_Slc11a2
  gRNA
aucgaaucugauuugcaguc

SEQ ID NO: 48722 - RNA, 20 nt, Artificial Sequence
  MKO10048722_A_Slc12a1
  gRNA
caguagugccagucgcuuuc

SEQ ID NO: 48723 - RNA, 20 nt, Artificial Sequence
  MKO10048723_A_Slc12a1
  gRNA
auugaauacuaccgcaacac

SEQ ID NO: 48724 - RNA, 20 nt, Artificial Sequence
  MKO10048724_A_Slc12a1
  gRNA
gacugucguggaucuucuua

SEQ ID NO: 48725 - RNA, 20 nt, Artificial Sequence
  MKO10048725_A_Slc12a2
  gRNA
guaugcgaccacagcaucuc

SEQ ID NO: 48726 - RNA, 20 nt, Artificial Sequence
  MKO10048726_A_Slc12a2
  gRNA
aucgugggucaagcugggau

SEQ ID NO: 48727 - RNA, 20 nt, Artificial Sequence
  MKO10048727_A_Slc12a2
  gRNA
cucugucgucguaauagcaa

SEQ ID NO: 48728 - RNA, 20 nt, Artificial Sequence
  MKO10048728_A_Slc12a3
  gRNA
auuacggcgcaggcgggcau

SEQ ID NO: 48729 - RNA, 20 nt, Artificial Sequence
  MKO10048729_A_Slc12a3
  gRNA
uugacccagccgaagcgaac

SEQ ID NO: 48730 - RNA, 20 nt, Artificial Sequence
  MKO10048730_A_Slc12a3
  gRNA
agaaccuguucgcuucggcu

SEQ ID NO: 48731 - RNA, 20 nt, Artificial Sequence
  MKO10048731_A_Slc12a4
  gRNA
uugucauagucgccgcgucg

SEQ ID NO: 48732 - RNA, 20 nt, Artificial Sequence
  MKO10048732_A_Slc12a4
  gRNA
acuacggcgagcgcgccgag

SEQ ID NO: 48733 - RNA, 20 nt, Artificial Sequence
  MKO10048733_A_Slc12a4
  gRNA
ucaccuuggcagcucuccgu

SEQ ID NO: 48734 - RNA, 20 nt, Artificial Sequence
  MKO10048734_A_Slc12a5
  gRNA
augagugcaaucgcaaccaa

SEQ ID NO: 48735 - RNA, 20 nt, Artificial Sequence
  MKO10048735_A_Slc12a5
  gRNA
ggugggcaucgcgggcauca

SEQ ID NO: 48736 - RNA, 20 nt, Artificial Sequence
  MKO10048736_A_Slc12a5
  gRNA
ccaccacccacgugagccgc

SEQ ID NO: 48737 - RNA, 20 nt, Artificial Sequence
  MKO10048737_A_Slc12a6
  gRNA
ccgagucagaacuccaucac

SEQ ID NO: 48738 - RNA, 20 nt, Artificial Sequence
  MKO10048738_A_Slc12a6
  gRNA
cacccaugaaaguacccauu

SEQ ID NO: 48739 - RNA, 20 nt, Artificial Sequence
  MKO10048739_A_Slc12a6
  gRNA
gucuucucuccucaaccgca

SEQ ID NO: 48740 - RNA, 20 nt, Artificial Sequence
  MKO10048740_A_Slc12a7
  gRNA
cggcagguagacuccgauga

SEQ ID NO: 48741 - RNA, 20 nt, Artificial Sequence
  MKO10048741_A_Slc12a7
  gRNA
augagcgccaucgcuaccaa

SEQ ID NO: 48742 - RNA, 20 nt, Artificial Sequence
  MKO10048742_A_Slc12a7
  gRNA
guaccuugaccucucgccuc

SEQ ID NO: 48743 - RNA, 20 nt, Artificial Sequence
  MKO10048743_A_Slc12a8
  gRNA
aucaccgugcugucgggcau

SEQ ID NO: 48744 - RNA, 20 nt, Artificial Sequence
  MKO10048744_A_Slc12a8
  gRNA
gagggccacgaggacgacga

SEQ ID NO: 48745 - RNA, 20 nt, Artificial Sequence
  MKO10048745_A_Slc12a8
  gRNA
uugcugggcaucaaccuggc

SEQ ID NO: 48746 - RNA, 20 nt, Artificial Sequence
  MKO10048746_A_Slc12a9
  gRNA
ugcccggucgaggagcuaac

SEQ ID NO: 48747 - RNA, 20 nt, Artificial Sequence
  MKO10048747_A_Slc12a9
  gRNA
ccccccagcuggcuacgccg

SEQ ID NO: 48748 - RNA, 20 nt, Artificial Sequence
  MKO10048748_A_Slc12a9
  gRNA
gagucuauacuggacgucuu

SEQ ID NO: 48749 - RNA, 20 nt, Artificial Sequence
  MKO10048749_A_Slc13a1
  gRNA
uaccaucaauguccaguccg

SEQ ID NO: 48750 - RNA, 20 nt, Artificial Sequence
  MKO10048750_A_Slc13a1
  gRNA
uucaaugaaucugccgccca

SEQ ID NO: 48751 - RNA, 20 nt, Artificial Sequence
  MKO10048751_A_Slc13a1
  gRNA
ugggaucaugcguucuucac

SEQ ID NO: 48752 - RNA, 20 nt, Artificial Sequence
  MKO10048752_A_Slc13a2
  gRNA
acccccgacgaacaauaugu

SEQ ID NO: 48753 - RNA, 20 nt, Artificial Sequence
  MKO10048753_A_Slc13a2
  gRNA
cgggccgcacuccuaugaua

SEQ ID NO: 48754 - RNA, 20 nt, Artificial Sequence
  MKO10048754_A_Slc13a2
  gRNA
auacccgaugggcagcauca

SEQ ID NO: 48755 - RNA, 20 nt, Artificial Sequence
  MKO10048755_A_Slc13a3
  gRNA
gguccuuccgagcuucgcgc

SEQ ID NO: 48756 - RNA, 20 nt, Artificial Sequence
  MKO10048756_A_Slc13a3
  gRNA
uggccaugaucaggccgcua

SEQ ID NO: 48757 - RNA, 20 nt, Artificial Sequence
  MKO10048757_A_Slc13a3
  gRNA
cagagcuuacccuuccgaac

SEQ ID NO: 48758 - RNA, 20 nt, Artificial Sequence
  MKO10048758_A_Slc13a4
  gRNA
caagcgcaucgcccugcgca

SEQ ID NO: 48759 - RNA, 20 nt, Artificial Sequence
  MKO10048759_A_Slc13a4
  gRNA
ccgccaucaagaccaugcgc

SEQ ID NO: 48760 - RNA, 20 nt, Artificial Sequence
  MKO10048760_A_Slc13a4
  gRNA
ggggucuaaccucacuggau

SEQ ID NO: 48761 - RNA, 20 nt, Artificial Sequence
  MKO10048761_A_Slc13a5
  gRNA
gauagccgccaauacagcug

SEQ ID NO: 48762 - RNA, 20 nt, Artificial Sequence
  MKO10048762_A_Slc13a5
  gRNA
caccacguugggucccgucc

SEQ ID NO: 48763 - RNA, 20 nt, Artificial Sequence
  MKO10048763_A_Slc13a5
  gRNA
agccaugaugauacccauug

SEQ ID NO: 48764 - RNA, 20 nt, Artificial Sequence
  MKO10048764_A_Slc14a1
  gRNA
aucgacaacgccauguugaa

SEQ ID NO: 48765 - RNA, 20 nt, Artificial Sequence
  MKO10048765_A_Slc14a1
  gRNA
cucaacgcgcucgagaaaac

SEQ ID NO: 48766 - RNA, 20 nt, Artificial Sequence
  MKO10048766_A_Slc14a1
  gRNA
cugcagaucggcgauagcag

SEQ ID NO: 48767 - RNA, 20 nt, Artificial Sequence
  MKO10048767_A_Slc14a2
  gRNA
ugucccagcaaucguccacc

SEQ ID NO: 48768 - RNA, 20 nt, Artificial Sequence
  MKO10048768_A_Slc14a2
  gRNA
gaagacgggcaggucccacu

SEQ ID NO: 48769 - RNA, 20 nt, Artificial Sequence
  MKO10048769_A_Slc14a2
  gRNA
uguaguggcccguagcugcc

SEQ ID NO: 48770 - RNA, 20 nt, Artificial Sequence
  MKO10048770_A_Slc15a1
  gRNA
agcagagggcaacgaacgua

SEQ ID NO: 48771 - RNA, 20 nt, Artificial Sequence
  MKO10048771_A_Slc15a1
  gRNA
uuguccaaucguguagacga

SEQ ID NO: 48772 - RNA, 20 nt, Artificial Sequence
  MKO10048772_A_Slc15a1
  gRNA
agagauugucgucccagccg

SEQ ID NO: 48773 - RNA, 20 nt, Artificial Sequence
  MKO10048773_A_Slc15a2
  gRNA
guuaccuuucaugccauaau

SEQ ID NO: 48774 - RNA, 20 nt, Artificial Sequence
  MKO10048774_A_Slc15a2
  gRNA
gaauucguucaccacaauga

SEQ ID NO: 48775 - RNA, 20 nt, Artificial Sequence
  MKO10048775_A_Slc15a2
  gRNA
cucaccggaguugacuucuu

SEQ ID NO: 48776 - RNA, 20 nt, Artificial Sequence
  MKO10048776_A_Slc15a3
  gRNA
cgaugaugcuguagccccau

SEQ ID NO: 48777 - RNA, 20 nt, Artificial Sequence
  MKO10048777_A_Slc15a3
  gRNA
guuaccuggaagaggaccuc

SEQ ID NO: 48778 - RNA, 20 nt, Artificial Sequence
  MKO10048778_A_Slc15a3
  gRNA
aaucaggaucaccgcaacau

SEQ ID NO: 48779 - RNA, 20 nt, Artificial Sequence
  MKO10048779_A_Slc15a4
  gRNA
gauucauguaagaugucgcg

SEQ ID NO: 48780 - RNA, 20 nt, Artificial Sequence
  MKO10048780_A_Slc15a4
  gRNA
ccaauugaaaaaucuccgag

SEQ ID NO: 48781 - RNA, 20 nt, Artificial Sequence
  MKO10048781_A_Slc15a4
  gRNA
acacgggcacaaucuugacc

SEQ ID NO: 48782 - RNA, 20 nt, Artificial Sequence
  MKO10048782_A_Slc15a5
  gRNA
caaacgcccuggcgaucguc

SEQ ID NO: 48783 - RNA, 20 nt, Artificial Sequence
  MKO10048783_A_Slc15a5
  gRNA
acuuacucaugcacgcugac

SEQ ID NO: 48784 - RNA, 20 nt, Artificial Sequence
  MKO10048784_A_Slc15a5
  gRNA
auggcguucauuagcgcaau

SEQ ID NO: 48785 - RNA, 20 nt, Artificial Sequence
  MKO10048785_A_Slc16a10
  gRNA
acuagucaacggcaucguca

SEQ ID NO: 48786 - RNA, 20 nt, Artificial Sequence
  MKO10048786_A_Slc16a10
  gRNA
cacuacuucaagaagcgccu

SEQ ID NO: 48787 - RNA, 20 nt, Artificial Sequence
  MKO10048787_A_Slc16a10
  gRNA
auuccccugugcagcgccuu

SEQ ID NO: 48788 - RNA, 20 nt, Artificial Sequence
  MKO10048788_A_Slc16a11
  gRNA
gacggcgaugacccccaagc

SEQ ID NO: 48789 - RNA, 20 nt, Artificial Sequence
  MKO10048789_A_Slc16a11
  gRNA
gccgcagcauucgccgugaa

SEQ ID NO: 48790 - RNA, 20 nt, Artificial Sequence
  MKO10048790_A_Slc16a11
  gRNA
gaaguauccgcccccgauca

SEQ ID NO: 48791 - RNA, 20 nt, Artificial Sequence
  MKO10048791_A_Slc16a12
  gRNA
caacaauaucgauuaccccg

SEQ ID NO: 48792 - RNA, 20 nt, Artificial Sequence
  MKO10048792_A_Slc16a12
  gRNA
agccuacguuaccuugaucc

SEQ ID NO: 48793 - RNA, 20 nt, Artificial Sequence
  MKO10048793_A_Slc16a12
  gRNA
gaugucagacuucgucgugu

SEQ ID NO: 48794 - RNA, 20 nt, Artificial Sequence
  MKO10048794_A_Slc16a13
  gRNA
ccccaaacacgagcgccgac

SEQ ID NO: 48795 - RNA, 20 nt, Artificial Sequence
  MKO10048795_A_Slc16a13
  gRNA
cgcguggcaucugguuggcu

SEQ ID NO: 48796 - RNA, 20 nt, Artificial Sequence
  MKO10048796_A_Slc16a13
  gRNA
cagaugccacgcgccccacg

SEQ ID NO: 48797 - RNA, 20 nt, Artificial Sequence
  MKO10048797_A_Slc16a14
  gRNA
gcccacccgccaucgauauc

SEQ ID NO: 48798 - RNA, 20 nt, Artificial Sequence
  MKO10048798_A_Slc16a14
  gRNA
gaugcacaccuacgcgaguc

SEQ ID NO: 48799 - RNA, 20 nt, Artificial Sequence
  MKO10048799_A_Slc16a14
  gRNA
aaugacagccagacucgcgu

SEQ ID NO: 48800 - RNA, 20 nt, Artificial Sequence
  MKO10048800_A_Slc16a1
  gRNA
agccguccaguaaugaucgc

SEQ ID NO: 48801 - RNA, 20 nt, Artificial Sequence
  MKO10048801_A_Slc16a1
  gRNA
cuucucgucgacaucggugc

SEQ ID NO: 48802 - RNA, 20 nt, Artificial Sequence
  MKO10048802_A_Slc16a1
  gRNA
ccuuugucuacaaccuacgu

SEQ ID NO: 48803 - RNA, 20 nt, Artificial Sequence
  MKO10048803_A_Slc16a2
  gRNA
cccagauacgguaagugcgc

SEQ ID NO: 48804 - RNA, 20 nt, Artificial Sequence
  MKO10048804_A_Slc16a2
  gRNA
cuaggcgacguugaaaguag

SEQ ID NO: 48805 - RNA, 20 nt, Artificial Sequence
  MKO10048805_A_Slc16a2
  gRNA
cccccgaagucccggcauag

SEQ ID NO: 48806 - RNA, 20 nt, Artificial Sequence
  MKO10048806_A_Slc16a3
  gRNA
aagcgucgcccuauugccaa

SEQ ID NO: 48807 - RNA, 20 nt, Artificial Sequence
  MKO10048807_A_Slc16a3
  gRNA
gugcucaucggacccccguc

SEQ ID NO: 48808 - RNA, 20 nt, Artificial Sequence
  MKO10048808_A_Slc16a3
  gRNA
uuggcuacagcgacacggcu

SEQ ID NO: 48809 - RNA, 20 nt, Artificial Sequence
  MKO10048809_A_Slc16a4
  gRNA
ucuacagcaauugcccguuc

SEQ ID NO: 48810 - RNA, 20 nt, Artificial Sequence
  MKO10048810_A_Slc16a4
  gRNA
gcuaucaucugugacguacu

SEQ ID NO: 48811 - RNA, 20 nt, Artificial Sequence
  MKO10048811_A_Slc16a4
  gRNA
aaagcgaagaguucagcaau

SEQ ID NO: 48812 - RNA, 20 nt, Artificial Sequence
  MKO10048812_A_Slc16a5
  gRNA
gugccguacgcuaugcauca

SEQ ID NO: 48813 - RNA, 20 nt, Artificial Sequence
  MKO10048813_A_Slc16a5
  gRNA
ccacuaccgugaugcucgac

SEQ ID NO: 48814 - RNA, 20 nt, Artificial Sequence
  MKO10048814_A_Slc16a5
  gRNA
ccuauccucccuggugacgc

SEQ ID NO: 48815 - RNA, 20 nt, Artificial Sequence
  MKO10048815_A_Slc16a6
  gRNA
agucaccgcggucgcuucua

SEQ ID NO: 48816 - RNA, 20 nt, Artificial Sequence
  MKO10048816_A_Slc16a6
  gRNA
ccaccagccgauguccgaag

SEQ ID NO: 48817 - RNA, 20 nt, Artificial Sequence
  MKO10048817_A_Slc16a6
  gRNA
uucgauguagaucuugcgaa

SEQ ID NO: 48818 - RNA, 20 nt, Artificial Sequence
  MKO10048818_A_Slc16a7
  gRNA
cgauauccaagcgaucugac

SEQ ID NO: 48819 - RNA, 20 nt, Artificial Sequence
  MKO10048819_A_Slc16a7
  gRNA
uacuaacacgacuguuccgc

SEQ ID NO: 48820 - RNA, 20 nt, Artificial Sequence
  MKO10048820_A_Slc16a7
  gRNA
ccaccuccagucagaucgcu

SEQ ID NO: 48821 - RNA, 20 nt, Artificial Sequence
  MKO10048821_A_Slc16a8
  gRNA
gacucuacuucgagcggcga

SEQ ID NO: 48822 - RNA, 20 nt, Artificial Sequence
  MKO10048822_A_Slc16a8
  gRNA
agcgcgcacgcgcgcuaauc

SEQ ID NO: 48823 - RNA, 20 nt, Artificial Sequence
  MKO10048823_A_Slc16a8
  gRNA
gacagccaaagcgcgucacg

SEQ ID NO: 48824 - RNA, 20 nt, Artificial Sequence
  MKO10048824_A_Slc16a9
  gRNA
ucgcgagaaguuaccacgug

SEQ ID NO: 48825 - RNA, 20 nt, Artificial Sequence
  MKO10048825_A_Slc16a9
  gRNA
gacaaauuagcccacgccua

SEQ ID NO: 48826 - RNA, 20 nt, Artificial Sequence
  MKO10048826_A_Slc16a9
  gRNA
gcccucggccugauuucaac

SEQ ID NO: 48827 - RNA, 20 nt, Artificial Sequence
  MKO10048827_A_Slc17a1
  gRNA
auuccagauagguacccgac

SEQ ID NO: 48828 - RNA, 20 nt, Artificial Sequence
  MKO10048828_A_Slc17a1
  gRNA
uuuaucuaacgaaucuguag

SEQ ID NO: 48829 - RNA, 20 nt, Artificial Sequence
  MKO10048829_A_Slc17a1
  gRNA
cuacagauucguuagauaaa

SEQ ID NO: 48830 - RNA, 20 nt, Artificial Sequence
  MKO10048830_A_Slc17a2
  gRNA
gcucacacgcugcguuauca

SEQ ID NO: 48831 - RNA, 20 nt, Artificial Sequence
  MKO10048831_A_Slc17a2
  gRNA
gcucacgcuguuuacuccac

SEQ ID NO: 48832 - RNA, 20 nt, Artificial Sequence
  MKO10048832_A_Slc17a2
  gRNA
cugcucauuacgcuacgcgc

SEQ ID NO: 48833 - RNA, 20 nt, Artificial Sequence
  MKO10048833_A_Slc17a3
  gRNA
ugaucaccgcuuaaacccgc

SEQ ID NO: 48834 - RNA, 20 nt, Artificial Sequence
  MKO10048834_A_Slc17a3
  gRNA
cuugaacugcucgaguugcc

SEQ ID NO: 48835 - RNA, 20 nt, Artificial Sequence
  MKO10048835_A_Slc17a3
  gRNA
cacuaaugaugccgcccaca

SEQ ID NO: 48836 - RNA, 20 nt, Artificial Sequence
  MKO10048836_A_Slc17a4
  gRNA
gcccagaccaaccacguacu

SEQ ID NO: 48837 - RNA, 20 nt, Artificial Sequence
  MKO10048837_A_Slc17a4
  gRNA
cucaucaccaucgcugcauc

SEQ ID NO: 48838 - RNA, 20 nt, Artificial Sequence
  MKO10048838_A_Slc17a4
  gRNA
gagcuuugccauaaccgcca

SEQ ID NO: 48839 - RNA, 20 nt, Artificial Sequence
  MKO10048839_A_Slc17a5
  gRNA
gaaccugaguguugcguuag

SEQ ID NO: 48840 - RNA, 20 nt, Artificial Sequence
  MKO10048840_A_Slc17a5
  gRNA
ucucguugugcuuagagcgc

SEQ ID NO: 48841 - RNA, 20 nt, Artificial Sequence
  MKO10048841_A_Slc17a5
  gRNA
gacugauaauagaacgucua

SEQ ID NO: 48842 - RNA, 20 nt, Artificial Sequence
  MKO10048842_A_Slc17a6
  gRNA
cuaugauguagcggcgcggc

SEQ ID NO: 48843 - RNA, 20 nt, Artificial Sequence
  MKO10048843_A_Slc17a6
  gRNA
aggauauaucgcaucgcggc

SEQ ID NO: 48844 - RNA, 20 nt, Artificial Sequence
  MKO10048844_A_Slc17a6
  gRNA
cuaugcgacugcacgugcuu

SEQ ID NO: 48845 - RNA, 20 nt, Artificial Sequence
  MKO10048845_A_Slc17a7
  gRNA
cgaugauguagcgacgaggg

SEQ ID NO: 48846 - RNA, 20 nt, Artificial Sequence
  MKO10048846_A_Slc17a7
  gRNA
gccaaaaauucgcagccaac

SEQ ID NO: 48847 - RNA, 20 nt, Artificial Sequence
  MKO10048847_A_Slc17a7
  gRNA
uguaugaggccgacagucuc

SEQ ID NO: 48848 - RNA, 20 nt, Artificial Sequence
  MKO10048848_A_Slc17a8
  gRNA
uaaugcacccucgccgcaga

SEQ ID NO: 48849 - RNA, 20 nt, Artificial Sequence
  MKO10048849_A_Slc17a8
  gRNA
gacagcaaugauguaccguu

SEQ ID NO: 48850 - RNA, 20 nt, Artificial Sequence
  MKO10048850_A_Slc17a8
  gRNA
gauucggugcaaccuuggag

SEQ ID NO: 48851 - RNA, 20 nt, Artificial Sequence
  MKO10048851_A_Slc17a9
  gRNA
ugacucgggcgcaguacagc

SEQ ID NO: 48852 - RNA, 20 nt, Artificial Sequence
  MKO10048852_A_Slc17a9
  gRNA
ggccgcccaccaccugaguc

SEQ ID NO: 48853 - RNA, 20 nt, Artificial Sequence
  MKO10048853_A_Slc17a9
  gRNA
gggcguaggcuccgugcucc

SEQ ID NO: 48854 - RNA, 20 nt, Artificial Sequence
  MKO10048854_A_Slc18a1
  gRNA
uauacggauaacuacgagag

SEQ ID NO: 48855 - RNA, 20 nt, Artificial Sequence
  MKO10048855_A_Slc18a1
  gRNA
cuuugaacucugucgcauac

SEQ ID NO: 48856 - RNA, 20 nt, Artificial Sequence
  MKO10048856_A_Slc18a1
  gRNA
acugagccagcuucggugac

SEQ ID NO: 48857 - RNA, 20 nt, Artificial Sequence
  MKO10048857_A_Slc18a2
  gRNA
uucaucaucuguguacacgc

SEQ ID NO: 48858 - RNA, 20 nt, Artificial Sequence
  MKO10048858_A_Slc18a2
  gRNA
aaugccacggggggccuccc

SEQ ID NO: 48859 - RNA, 20 nt, Artificial Sequence
  MKO10048859_A_Slc18a2
  gRNA
gccuugggugacuccccucc

SEQ ID NO: 48860 - RNA, 20 nt, Artificial Sequence
  MKO10048860_A_Slc18a3
  gRNA
uacgacgugccgcugcuuau

SEQ ID NO: 48861 - RNA, 20 nt, Artificial Sequence
  MKO10048861_A_Slc18a3
  gRNA
auagcgcgccgcuagacgca

SEQ ID NO: 48862 - RNA, 20 nt, Artificial Sequence
  MKO10048862_A_Slc18a3
  gRNA
gggauacuugucggcgauca

SEQ ID NO: 48863 - RNA, 20 nt, Artificial Sequence
  MKO10048863_A_Slc18b1
  gRNA
uccgaagaucauuccaauca

SEQ ID NO: 48864 - RNA, 20 nt, Artificial Sequence
  MKO10048864_A_Slc18b1
  gRNA
auaguagacgccauaggcuu

SEQ ID NO: 48865 - RNA, 20 nt, Artificial Sequence
  MKO10048865_A_Slc18b1
  gRNA
ucuguucucuugacagucgc

SEQ ID NO: 48866 - RNA, 20 nt, Artificial Sequence
  MKO10048866_A_Slc19a1
  gRNA
cgcaggugugaucgccaucc

SEQ ID NO: 48867 - RNA, 20 nt, Artificial Sequence
  MKO10048867_A_Slc19a1
  gRNA
aaccgcaguacgcuugcgcg

SEQ ID NO: 48868 - RNA, 20 nt, Artificial Sequence
  MKO10048868_A_Slc19a1
  gRNA
ccaagacuggcuuguaucgc

SEQ ID NO: 48869 - RNA, 20 nt, Artificial Sequence
  MKO10048869_A_Slc19a2
  gRNA
ccaaguggugaacuacgcgc

SEQ ID NO: 48870 - RNA, 20 nt, Artificial Sequence
  MKO10048870_A_Slc19a2
  gRNA
ccugcgcguaguucaccacu

SEQ ID NO: 48871 - RNA, 20 nt, Artificial Sequence
  MKO10048871_A_Slc19a2
  gRNA
gaacucaccgguucuuccac

SEQ ID NO: 48872 - RNA, 20 nt, Artificial Sequence
  MKO10048872_A_Slc19a3
  gRNA
uguagcgcagguagucggug

SEQ ID NO: 48873 - RNA, 20 nt, Artificial Sequence
  MKO10048873_A_Slc19a3
  gRNA
gggcauaacguucuaagcuc

SEQ ID NO: 48874 - RNA, 20 nt, Artificial Sequence
  MKO10048874_A_Slc19a3
  gRNA
acacggguggcagcguugcc

SEQ ID NO: 48875 - RNA, 20 nt, Artificial Sequence
  MKO10048875_A_Slc1a1
  gRNA
ccuuucaggugucgcugcac

SEQ ID NO: 48876 - RNA, 20 nt, Artificial Sequence
  MKO10048876_A_Slc1a1
  gRNA
uuaguugugaguaucaagcc

SEQ ID NO: 48877 - RNA, 20 nt, Artificial Sequence
  MKO10048877_A_Slc1a1
  gRNA
accgucauugcuguaauccu

SEQ ID NO: 48878 - RNA, 20 nt, Artificial Sequence
  MKO10048878_A_Slc1a2
  gRNA
caugcgcaugugcgacaagc

SEQ ID NO: 48879 - RNA, 20 nt, Artificial Sequence
  MKO10048879_A_Slc1a2
  gRNA
gcuaaagccagcggccgccu

SEQ ID NO: 48880 - RNA, 20 nt, Artificial Sequence
  MKO10048880_A_Slc1a2
  gRNA
gaccaucauugccgccgugc

SEQ ID NO: 48881 - RNA, 20 nt, Artificial Sequence
  MKO10048881_A_Slc1a3
  gRNA
uccgguaccugugacgagac

SEQ ID NO: 48882 - RNA, 20 nt, Artificial Sequence
  MKO10048882_A_Slc1a3
  gRNA
caccgcgaccaaucgcauga

SEQ ID NO: 48883 - RNA, 20 nt, Artificial Sequence
  MKO10048883_A_Slc1a3
  gRNA
aauggcggcccuagauagua

SEQ ID NO: 48884 - RNA, 20 nt, Artificial Sequence
  MKO10048884_A_Slc1a4
  gRNA
cuacaaucuugcuuccgauc

SEQ ID NO: 48885 - RNA, 20 nt, Artificial Sequence
  MKO10048885_A_Slc1a4
  gRNA
gucgcaaaagcugucgcaaa

SEQ ID NO: 48886 - RNA, 20 nt, Artificial Sequence
  MKO10048886_A_Slc1a4
  gRNA
uuuggucacguuccccgagc

SEQ ID NO: 48887 - RNA, 20 nt, Artificial Sequence
  MKO10048887_A_Slc1a5
  gRNA
gaucaauucaaccauggucc

SEQ ID NO: 48888 - RNA, 20 nt, Artificial Sequence
  MKO10048888_A_Slc1a5
  gRNA
ugguugaauugaucucccgc

SEQ ID NO: 48889 - RNA, 20 nt, Artificial Sequence
  MKO10048889_A_Slc1a5
  gRNA
acgaaugagcagcucacccu

SEQ ID NO: 48890 - RNA, 20 nt, Artificial Sequence
  MKO10048890_A_Slc1a6
  gRNA
augguuaccaucauacaucc

SEQ ID NO: 48891 - RNA, 20 nt, Artificial Sequence
  MKO10048891_A_Slc1a6
  gRNA
ggagagcugguacgggcgca

SEQ ID NO: 48892 - RNA, 20 nt, Artificial Sequence
  MKO10048892_A_Slc1a6
  gRNA
agccaauggcaucaaugccu

SEQ ID NO: 48893 - RNA, 20 nt, Artificial Sequence
  MKO10048893_A_Slc1a7
  gRNA
ccccauagaugacgauccgc

SEQ ID NO: 48894 - RNA, 20 nt, Artificial Sequence
  MKO10048894_A_Slc1a7
  gRNA
gaacuuaccggacaagaucc

SEQ ID NO: 48895 - RNA, 20 nt, Artificial Sequence
  MKO10048895_A_Slc1a7
  gRNA
gaucgucaucuauggggucc

SEQ ID NO: 48896 - RNA, 20 nt, Artificial Sequence
  MKO10048896_A_Slc20a1
  gRNA
ucgugcguucauccuccgua

SEQ ID NO: 48897 - RNA, 20 nt, Artificial Sequence
  MKO10048897_A_Slc20a1
  gRNA
uguauugucggugcaaccau

SEQ ID NO: 48898 - RNA, 20 nt, Artificial Sequence
  MKO10048898_A_Slc20a1
  gRNA
gagguugauuccgauugugc

SEQ ID NO: 48899 - RNA, 20 nt, Artificial Sequence
  MKO10048899_A_Slc20a2
  gRNA
ugcaucgucggcuccaccau

SEQ ID NO: 48900 - RNA, 20 nt, Artificial Sequence
  MKO10048900_A_Slc20a2
  gRNA
gcaauagcgcucauauccuu

SEQ ID NO: 48901 - RNA, 20 nt, Artificial Sequence
  MKO10048901_A_Slc20a2
  gRNA
gauuaguaugaacagcacgc

SEQ ID NO: 48902 - RNA, 20 nt, Artificial Sequence
  MKO10048902_A_Slc22a12
  gRNA
augagccagcgugccgauuc

SEQ ID NO: 48903 - RNA, 20 nt, Artificial Sequence
  MKO10048903_A_Slc22a12
  gRNA
uggccuauggugugcgcagc

SEQ ID NO: 48904 - RNA, 20 nt, Artificial Sequence
  MKO10048904_A_Slc22a12
  gRNA
gcucaucacgguaggcaagc

SEQ ID NO: 48905 - RNA, 20 nt, Artificial Sequence
  MKO10048905_A_Slc22a13
  gRNA
gugcggugccuguuaucuga

SEQ ID NO: 48906 - RNA, 20 nt, Artificial Sequence
  MKO10048906_A_Slc22a13
  gRNA
gaccagccaugaacaccgac

SEQ ID NO: 48907 - RNA, 20 nt, Artificial Sequence
  MKO10048907_A_Slc22a13
  gRNA
gucuuggcuacugccaaugc

SEQ ID NO: 48908 - RNA, 20 nt, Artificial Sequence
  MKO10048908_A_Slc22a14
  gRNA
uucuccgagaguccccacga

SEQ ID NO: 48909 - RNA, 20 nt, Artificial Sequence
  MKO10048909_A_Slc22a14
  gRNA
uuccugucaggcgucuugac

SEQ ID NO: 48910 - RNA, 20 nt, Artificial Sequence
  MKO10048910_A_Slc22a14
  gRNA
ggucauacuccugacggggc

SEQ ID NO: 48911 - RNA, 20 nt, Artificial Sequence
  MKO10048911_A_Slc22a15
  gRNA
aucgcgcaguaugcccuauu

SEQ ID NO: 48912 - RNA, 20 nt, Artificial Sequence
  MKO10048912_A_Slc22a15
  gRNA
agcggaugaaguacccuaau

SEQ ID NO: 48913 - RNA, 20 nt, Artificial Sequence
  MKO10048913_A_Slc22a15
  gRNA
ccgcgcugacuuuguaagau

SEQ ID NO: 48914 - RNA, 20 nt, Artificial Sequence
  MKO10048914_A_Slc22a16
  gRNA
ggauugguucacggcgaauu

SEQ ID NO: 48915 - RNA, 20 nt, Artificial Sequence
  MKO10048915_A_Slc22a16
  gRNA
accaauccagccaaacgaua

SEQ ID NO: 48916 - RNA, 20 nt, Artificial Sequence
  MKO10048916_A_Slc22a16
  gRNA
uagacguagccaucgaagca

SEQ ID NO: 48917 - RNA, 20 nt, Artificial Sequence
  MKO10048917_A_Slc22a17
  gRNA
uccucaacuaccgcaacauc

SEQ ID NO: 48918 - RNA, 20 nt, Artificial Sequence
  MKO10048918_A_Slc22a17
  gRNA
ucagcagcacaaucccacga

SEQ ID NO: 48919 - RNA, 20 nt, Artificial Sequence
  MKO10048919_A_Slc22a17
  gRNA
aagagccauaaugccuguag

SEQ ID NO: 48920 - RNA, 20 nt, Artificial Sequence
  MKO10048920_A_Slc22a18
  gRNA
gggacccuuaacaccgcaua

SEQ ID NO: 48921 - RNA, 20 nt, Artificial Sequence
  MKO10048921_A_Slc22a18
  gRNA
cuuacccguaugcgguguua

SEQ ID NO: 48922 - RNA, 20 nt, Artificial Sequence
  MKO10048922_A_Slc22a18
  gRNA
guaugcgugaggcgaagagc

SEQ ID NO: 48923 - RNA, 20 nt, Artificial Sequence
  MKO10048923_A_Slc22a19
  gRNA
cauagcucaccuccaagguu

SEQ ID NO: 48924 - RNA, 20 nt, Artificial Sequence
  MKO10048924_A_Slc22a19
  gRNA
auacuuacuugucugauaag

SEQ ID NO: 48925 - RNA, 20 nt, Artificial Sequence
  MKO10048925_A_Slc22a19
  gRNA
cagugucuguccaacuccug

SEQ ID NO: 48926 - RNA, 20 nt, Artificial Sequence
  MKO10048926_A_Slc22a1
  gRNA
ccgcuguuaacacgccagac

SEQ ID NO: 48927 - RNA, 20 nt, Artificial Sequence
  MKO10048927_A_Slc22a1
  gRNA
cauuauccuuaccgcuugag

SEQ ID NO: 48928 - RNA, 20 nt, Artificial Sequence
  MKO10048928_A_Slc22a1
  gRNA
uggccuaugccauuccagac

SEQ ID NO: 48929 - RNA, 20 nt, Artificial Sequence
  MKO10048929_A_Slc22a20
  gRNA
cuggcguggcauaccugauc

SEQ ID NO: 48930 - RNA, 20 nt, Artificial Sequence
  MKO10048930_A_Slc22a20
  gRNA
gcuggacguaccaagaauag

SEQ ID NO: 48931 - RNA, 20 nt, Artificial Sequence
  MKO10048931_A_Slc22a20
  gRNA
gguguggucguaccugcagc

SEQ ID NO: 48932 - RNA, 20 nt, Artificial Sequence
  MKO10048932_A_Slc22a21
  gRNA
gggacauauauccaacuacg

SEQ ID NO: 48933 - RNA, 20 nt, Artificial Sequence
  MKO10048933_A_Slc22a21
  gRNA
agagccccacacagcacgcc

SEQ ID NO: 48934 - RNA, 20 nt, Artificial Sequence
  MKO10048934_A_Slc22a21
  gRNA
cugcuggcaauuacuuuacc

SEQ ID NO: 48935 - RNA, 20 nt, Artificial Sequence
  MKO10048935_A_Slc22a22
  gRNA
cuaugcacaagccacgucuu

SEQ ID NO: 48936 - RNA, 20 nt, Artificial Sequence
  MKO10048936_A_Slc22a22
  gRNA
uugguaucuuguccucuauc

SEQ ID NO: 48937 - RNA, 20 nt, Artificial Sequence
  MKO10048937_A_Slc22a22
  gRNA
acuguucaacaguauuggcc

SEQ ID NO: 48938 - RNA, 20 nt, Artificial Sequence
  MKO10048938_A_Slc22a23
  gRNA
ucgcaugcaggguuggccgg

SEQ ID NO: 48939 - RNA, 20 nt, Artificial Sequence
  MKO10048939_A_Slc22a23
  gRNA
cuuagcgauauggacuuucc

SEQ ID NO: 48940 - RNA, 20 nt, Artificial Sequence
  MKO10048940_A_Slc22a23
  gRNA
auuagccaucggagagacuc

SEQ ID NO: 48941 - RNA, 20 nt, Artificial Sequence
  MKO10048941_A_Slc22a26
  gRNA
uauauucuuaauuggcgugu

SEQ ID NO: 48942 - RNA, 20 nt, Artificial Sequence
  MKO10048942_A_Slc22a26
  gRNA
gguggcugacagaaucagcu

SEQ ID NO: 48943 - RNA, 20 nt, Artificial Sequence
  MKO10048943_A_Slc22a26
  gRNA
augagaacucauugacagug

SEQ ID NO: 48944 - RNA, 20 nt, Artificial Sequence
  MKO10048944_A_Slc22a27
  gRNA
auacaugauaucagcaggcc

SEQ ID NO: 48945 - RNA, 20 nt, Artificial Sequence
  MKO10048945_A_Slc22a27
  gRNA
agauaaaagcgcugccauca

SEQ ID NO: 48946 - RNA, 20 nt, Artificial Sequence
  MKO10048946_A_Slc22a27
  gRNA
uagugacagaauucagugcc

SEQ ID NO: 48947 - RNA, 20 nt, Artificial Sequence
  MKO10048947_A_Slc22a28
  gRNA
uggacaaacccuaaauuccu

SEQ ID NO: 48948 - RNA, 20 nt, Artificial Sequence
  MKO10048948_A_Slc22a28
  gRNA
gguggaugucagagucagcu

SEQ ID NO: 48949 - RNA, 20 nt, Artificial Sequence
  MKO10048949_A_Slc22a28
  gRNA
caaguuacuauuuacugaua

SEQ ID NO: 48950 - RNA, 20 nt, Artificial Sequence
  MKO10048950_A_Slc22a29
  gRNA
uaaguuccuuuaaucccuuc

SEQ ID NO: 48951 - RNA, 20 nt, Artificial Sequence
  MKO10048951_A_Slc22a29
  gRNA
auucaugauauuggcaggac

SEQ ID NO: 48952 - RNA, 20 nt, Artificial Sequence
  MKO10048952_A_Slc22a29
  gRNA
uuggcgcagacauugucagc

SEQ ID NO: 48953 - RNA, 20 nt, Artificial Sequence
  MKO10048953_A_Slc22a2
  gRNA
gcccaacaguaaaggcgauu

SEQ ID NO: 48954 - RNA, 20 nt, Artificial Sequence
  MKO10048954_A_Slc22a2
  gRNA
uaccaaaucgccuuuacugu

SEQ ID NO: 48955 - RNA, 20 nt, Artificial Sequence
  MKO10048955_A_Slc22a2
  gRNA
gcauaccggagucuccaaga

SEQ ID NO: 48956 - RNA, 20 nt, Artificial Sequence
  MKO10048956_A_Slc22a30
  gRNA
uggacaagcccuaaauuccu

SEQ ID NO: 48957 - RNA, 20 nt, Artificial Sequence
  MKO10048957_A_Slc22a30
  gRNA
ggaccuggugugugaaucuc

SEQ ID NO: 48958 - RNA, 20 nt, Artificial Sequence
  MKO10048958_A_Slc22a30
  gRNA
acacucaccugucugacaaa

SEQ ID NO: 48959 - RNA, 20 nt, Artificial Sequence
  MKO10048959_A_Slc22a3
  gRNA
ugugaugccaacgccgaaac

SEQ ID NO: 48960 - RNA, 20 nt, Artificial Sequence
  MKO10048960_A_Slc22a3
  gRNA
ugcacuuagccacgcgccuc

SEQ ID NO: 48961 - RNA, 20 nt, Artificial Sequence
  MKO10048961_A_Slc22a3
  gRNA
cguuggcaucacaggagucg

SEQ ID NO: 48962 - RNA, 20 nt, Artificial Sequence
  MKO10048962_A_Slc22a4
  gRNA
agagaacgccuacgaagaac

SEQ ID NO: 48963 - RNA, 20 nt, Artificial Sequence
  MKO10048963_A_Slc22a4
  gRNA
agaggaucgaauaucccugc

SEQ ID NO: 48964 - RNA, 20 nt, Artificial Sequence
  MKO10048964_A_Slc22a4
  gRNA
agggauauucgauccucuag

SEQ ID NO: 48965 - RNA, 20 nt, Artificial Sequence
  MKO10048965_A_Slc22a5
  gRNA
cugaugggcuccuucauuuc

SEQ ID NO: 48966 - RNA, 20 nt, Artificial Sequence
  MKO10048966_A_Slc22a5
  gRNA
gaauauaauucgaauugacu

SEQ ID NO: 48967 - RNA, 20 nt, Artificial Sequence
  MKO10048967_A_Slc22a5
  gRNA
cacuaucuucgauccaagug

SEQ ID NO: 48968 - RNA, 20 nt, Artificial Sequence
  MKO10048968_A_Slc22a6
  gRNA
ucuucauugagucagcccgc

SEQ ID NO: 48969 - RNA, 20 nt, Artificial Sequence
  MKO10048969_A_Slc22a6
  gRNA
ucaagaucagcaccuuccga

SEQ ID NO: 48970 - RNA, 20 nt, Artificial Sequence
  MKO10048970_A_Slc22a6
  gRNA
ccacucucugcagggcucgg

SEQ ID NO: 48971 - RNA, 20 nt, Artificial Sequence
  MKO10048971_A_Slc22a7
  gRNA
uuggguaccugauacggagc

SEQ ID NO: 48972 - RNA, 20 nt, Artificial Sequence
  MKO10048972_A_Slc22a7
  gRNA
gccaccgccagcuccguauc

SEQ ID NO: 48973 - RNA, 20 nt, Artificial Sequence
  MKO10048973_A_Slc22a7
  gRNA
acccaacggaaguacaauga

SEQ ID NO: 48974 - RNA, 20 nt, Artificial Sequence
  MKO10048974_A_Slc22a8
  gRNA
ggguaccagaguccauacgc

SEQ ID NO: 48975 - RNA, 20 nt, Artificial Sequence
  MKO10048975_A_Slc22a8
  gRNA
ucugaagacacuccaacgug

SEQ ID NO: 48976 - RNA, 20 nt, Artificial Sequence
  MKO10048976_A_Slc22a8
  gRNA
augaucuuccgauuccugug

SEQ ID NO: 48977 - RNA, 20 nt, Artificial Sequence
  MKO10048977_A_Slc23a1
  gRNA
ucacccaccucccggauacg

SEQ ID NO: 48978 - RNA, 20 nt, Artificial Sequence
  MKO10048978_A_Slc23a1
  gRNA
gguuccagccaagucaaucc

SEQ ID NO: 48979 - RNA, 20 nt, Artificial Sequence
  MKO10048979_A_Slc23a1
  gRNA
uggugccacugaagcacguc

SEQ ID NO: 48980 - RNA, 20 nt, Artificial Sequence
  MKO10048980_A_Slc23a2
  gRNA
uguagaucauauccgaccuc

SEQ ID NO: 48981 - RNA, 20 nt, Artificial Sequence
  MKO10048981_A_Slc23a2
  gRNA
cucguuguccugcucuccgc

SEQ ID NO: 48982 - RNA, 20 nt, Artificial Sequence
  MKO10048982_A_Slc23a2
  gRNA
ucgugccacugaaacacguc

SEQ ID NO: 48983 - RNA, 20 nt, Artificial Sequence
  MKO10048983_A_Slc23a3
  gRNA
agaguuucuuauccccgcac

SEQ ID NO: 48984 - RNA, 20 nt, Artificial Sequence
  MKO10048984_A_Slc23a3
  gRNA
gaaacucuagggacggagcc

SEQ ID NO: 48985 - RNA, 20 nt, Artificial Sequence
  MKO10048985_A_Slc23a3
  gRNA
cuggaacacuucucuccgag

SEQ ID NO: 48986 - RNA, 20 nt, Artificial Sequence
  MKO10048986_A_Slc24a1
  gRNA
cucccgucugugcugacccg

SEQ ID NO: 48987 - RNA, 20 nt, Artificial Sequence
  MKO10048987_A_Slc24a1
  gRNA
gaugauacuguugugcagcg

SEQ ID NO: 48988 - RNA, 20 nt, Artificial Sequence
  MKO10048988_A_Slc24a1
  gRNA
gcuggagugaccgugaccgc

SEQ ID NO: 48989 - RNA, 20 nt, Artificial Sequence
  MKO10048989_A_Slc24a2
  gRNA
aucccgaaagagcggccacc

SEQ ID NO: 48990 - RNA, 20 nt, Artificial Sequence
  MKO10048990_A_Slc24a2
  gRNA
uggcgauuaccuucagcgag

SEQ ID NO: 48991 - RNA, 20 nt, Artificial Sequence
  MKO10048991_A_Slc24a2
  gRNA
aggcagagcuuccgccucgu

SEQ ID NO: 48992 - RNA, 20 nt, Artificial Sequence
  MKO10048992_A_Slc24a3
  gRNA
cuccaaugaagaccgacgac

SEQ ID NO: 48993 - RNA, 20 nt, Artificial Sequence
  MKO10048993_A_Slc24a3
  gRNA
uagcccugcaugaauucccc

SEQ ID NO: 48994 - RNA, 20 nt, Artificial Sequence
  MKO10048994_A_Slc24a3
  gRNA
cgcagacgccaaugaugcac

SEQ ID NO: 48995 - RNA, 20 nt, Artificial Sequence
  MKO10048995_A_Slc24a4
  gRNA
uuacaccaaggauguguagc

SEQ ID NO: 48996 - RNA, 20 nt, Artificial Sequence
  MKO10048996_A_Slc24a4
  gRNA
gccgugcugucguucuuugu

SEQ ID NO: 48997 - RNA, 20 nt, Artificial Sequence
  MKO10048997_A_Slc24a4
  gRNA
aacauguucugcuggacacg

SEQ ID NO: 48998 - RNA, 20 nt, Artificial Sequence
  MKO10048998_A_Slc24a5
  gRNA
ccuucgggaaacuccgaugc

SEQ ID NO: 48999 - RNA, 20 nt, Artificial Sequence
  MKO10048999_A_Slc24a5
  gRNA
ugaacuaguuaccgccuucu

SEQ ID NO: 49000 - RNA, 20 nt, Artificial Sequence
  MKO10049000_A_Slc24a5
  gRNA
caacauccugcgacagucca

SEQ ID NO: 49001 - RNA, 20 nt, Artificial Sequence
  MKO10049001_A_Slc25a10
  gRNA
cuccuacucacuugcgucgu

SEQ ID NO: 49002 - RNA, 20 nt, Artificial Sequence
  MKO10049002_A_Slc25a10
  gRNA
ucaggccguuguagagcgcc

SEQ ID NO: 49003 - RNA, 20 nt, Artificial Sequence
  MKO10049003_A_Slc25a10
  gRNA
acguaccugccugcacagcg

SEQ ID NO: 49004 - RNA, 20 nt, Artificial Sequence
  MKO10049004_A_Slc25a11
  gRNA
accuacaccacuacucgccu

SEQ ID NO: 49005 - RNA, 20 nt, Artificial Sequence
  MKO10049005_A_Slc25a11
  gRNA
guguuguuugagcgccugac

SEQ ID NO: 49006 - RNA, 20 nt, Artificial Sequence
  MKO10049006_A_Slc25a11
  gRNA
cuuccagcugaccagcgccg

SEQ ID NO: 49007 - RNA, 20 nt, Artificial Sequence
  MKO10049007_A_Slc25a12
  gRNA
gacuucguucaacgcuaucu

SEQ ID NO: 49008 - RNA, 20 nt, Artificial Sequence
  MKO10049008_A_Slc25a12
  gRNA
aacucgcagucccaguuaaa

SEQ ID NO: 49009 - RNA, 20 nt, Artificial Sequence
  MKO10049009_A_Slc25a12
  gRNA
uagcguugaacgaagucuuc

SEQ ID NO: 49010 - RNA, 20 nt, Artificial Sequence
  MKO10049010_A_Slc25a13
  gRNA
gagugaacuccgcauaugua

SEQ ID NO: 49011 - RNA, 20 nt, Artificial Sequence
  MKO10049011_A_Slc25a13
  gRNA
ccagcccaacccgaaaacug

SEQ ID NO: 49012 - RNA, 20 nt, Artificial Sequence
  MKO10049012_A_Slc25a13
  gRNA
gccaccauaaacaaggcauc

SEQ ID NO: 49013 - RNA, 20 nt, Artificial Sequence
  MKO10049013_A_Slc25a14
  gRNA
ugaaacgaacaucgauacuc

SEQ ID NO: 49014 - RNA, 20 nt, Artificial Sequence
  MKO10049014_A_Slc25a14
  gRNA
gaugccugucuuaguaacgc

SEQ ID NO: 49015 - RNA, 20 nt, Artificial Sequence
  MKO10049015_A_Slc25a14
  gRNA
gcgauuauuuguagaacguu

SEQ ID NO: 49016 - RNA, 20 nt, Artificial Sequence
  MKO10049016_A_Slc25a15
  gRNA
gcagcccuucgacacgauga

SEQ ID NO: 49017 - RNA, 20 nt, Artificial Sequence
  MKO10049017_A_Slc25a15
  gRNA
gguccguaaagugguuggau

SEQ ID NO: 49018 - RNA, 20 nt, Artificial Sequence
  MKO10049018_A_Slc25a15
  gRNA
gcagagaaccagcgcggcaa

SEQ ID NO: 49019 - RNA, 20 nt, Artificial Sequence
  MKO10049019_A_Slc25a16
  gRNA
augauucggaucuuucccua

SEQ ID NO: 49020 - RNA, 20 nt, Artificial Sequence
  MKO10049020_A_Slc25a16
  gRNA
caugaacuggauugcaccgu

SEQ ID NO: 49021 - RNA, 20 nt, Artificial Sequence
  MKO10049021_A_Slc25a16
  gRNA
cgcacccugaccacaucgag

SEQ ID NO: 49022 - RNA, 20 nt, Artificial Sequence
  MKO10049022_A_Slc25a17
  gRNA
aacgacgcaugcagugcucc

SEQ ID NO: 49023 - RNA, 20 nt, Artificial Sequence
  MKO10049023_A_Slc25a17
  gRNA
cucgugguuggguuuguagc

SEQ ID NO: 49024 - RNA, 20 nt, Artificial Sequence
  MKO10049024_A_Slc25a17
  gRNA
accauccucgguauggugcc

SEQ ID NO: 49025 - RNA, 20 nt, Artificial Sequence
  MKO10049025_A_Slc25a18
  gRNA
gcucaccucgguacaugccc

SEQ ID NO: 49026 - RNA, 20 nt, Artificial Sequence
  MKO10049026_A_Slc25a18
  gRNA
ucuguagucgggucuuggca

SEQ ID NO: 49027 - RNA, 20 nt, Artificial Sequence
  MKO10049027_A_Slc25a18
  gRNA
cagcacgugcagucuucauc

SEQ ID NO: 49028 - RNA, 20 nt, Artificial Sequence
  MKO10049028_A_Slc25a19
  gRNA
cggguacgcaggacguccac

SEQ ID NO: 49029 - RNA, 20 nt, Artificial Sequence
  MKO10049029_A_Slc25a19
  gRNA
ugggcggguucgaacaugcc

SEQ ID NO: 49030 - RNA, 20 nt, Artificial Sequence
  MKO10049030_A_Slc25a19
  gRNA
uuggacagcuccguagccua

SEQ ID NO: 49031 - RNA, 20 nt, Artificial Sequence
  MKO10049031_A_Slc25a1
  gRNA
cccaagguaggcucgacagc

SEQ ID NO: 49032 - RNA, 20 nt, Artificial Sequence
  MKO10049032_A_Slc25a1
  gRNA
agaggacuauugugcggucu

SEQ ID NO: 49033 - RNA, 20 nt, Artificial Sequence
  MKO10049033_A_Slc25a1
  gRNA
cagcugcgucuucacguauu

SEQ ID NO: 49034 - RNA, 20 nt, Artificial Sequence
  MKO10049034_A_Slc25a20
  gRNA
acggaucaaaugcuuacugc

SEQ ID NO: 49035 - RNA, 20 nt, Artificial Sequence
  MKO10049035_A_Slc25a20
  gRNA
cauaggggugacuccaauga

SEQ ID NO: 49036 - RNA, 20 nt, Artificial Sequence
  MKO10049036_A_Slc25a20
  gRNA
auguucgccgugugcuucuu

SEQ ID NO: 49037 - RNA, 20 nt, Artificial Sequence
  MKO10049037_A_Slc25a21
  gRNA
ccagaugaucuuccgaacag

SEQ ID NO: 49038 - RNA, 20 nt, Artificial Sequence
  MKO10049038_A_Slc25a21
  gRNA
ccugaugcauccucucgaug

SEQ ID NO: 49039 - RNA, 20 nt, Artificial Sequence
  MKO10049039_A_Slc25a21
  gRNA
cuguuacacuucucugcacc

SEQ ID NO: 49040 - RNA, 20 nt, Artificial Sequence
  MKO10049040_A_Slc25a22
  gRNA
auacaugccgaaguagcccu

SEQ ID NO: 49041 - RNA, 20 nt, Artificial Sequence
  MKO10049041_A_Slc25a22
  gRNA
cugcguguuccccaucgacc

SEQ ID NO: 49042 - RNA, 20 nt, Artificial Sequence
  MKO10049042_A_Slc25a22
  gRNA
caucaagaccauccgcuccg

SEQ ID NO: 49043 - RNA, 20 nt, Artificial Sequence
  MKO10049043_A_Slc25a23
  gRNA
ccgacucaagguauucaugc

SEQ ID NO: 49044 - RNA, 20 nt, Artificial Sequence
  MKO10049044_A_Slc25a23
  gRNA
gguagcgaguaaacuccucc

SEQ ID NO: 49045 - RNA, 20 nt, Artificial Sequence
  MKO10049045_A_Slc25a23
  gRNA
accucuagcauggaccgcga

SEQ ID NO: 49046 - RNA, 20 nt, Artificial Sequence
  MKO10049046_A_Slc25a24
  gRNA
aucuuuguugacaucgccag

SEQ ID NO: 49047 - RNA, 20 nt, Artificial Sequence
  MKO10049047_A_Slc25a24
  gRNA
uagaacgagcaccgcuccuu

SEQ ID NO: 49048 - RNA, 20 nt, Artificial Sequence
  MKO10049048_A_Slc25a24
  gRNA
agcggugcucguucuagaga

SEQ ID NO: 49049 - RNA, 20 nt, Artificial Sequence
  MKO10049049_A_Slc25a25
  gRNA
ugaccaucgacuggaacgag

SEQ ID NO: 49050 - RNA, 20 nt, Artificial Sequence
  MKO10049050_A_Slc25a25
  gRNA
cacaggucgaaucgaugcuc

SEQ ID NO: 49051 - RNA, 20 nt, Artificial Sequence
  MKO10049051_A_Slc25a25
  gRNA
ccgucgagugcuuccaguac

SEQ ID NO: 49052 - RNA, 20 nt, Artificial Sequence
  MKO10049052_A_Slc25a26
  gRNA
aacacccuuaccguuaggaa

SEQ ID NO: 49053 - RNA, 20 nt, Artificial Sequence
  MKO10049053_A_Slc25a26
  gRNA
gcucaccacuucuccuguag

SEQ ID NO: 49054 - RNA, 20 nt, Artificial Sequence
  MKO10049054_A_Slc25a26
  gRNA
gauucgaguuccuucugaag

SEQ ID NO: 49055 - RNA, 20 nt, Artificial Sequence
  MKO10049055_A_Slc25a27
  gRNA
gugcgcaccaugccccuaua

SEQ ID NO: 49056 - RNA, 20 nt, Artificial Sequence
  MKO10049056_A_Slc25a27
  gRNA
gcaacuaggaaaucggucau

SEQ ID NO: 49057 - RNA, 20 nt, Artificial Sequence
  MKO10049057_A_Slc25a27
  gRNA
cccgccauuuacagacacgu

SEQ ID NO: 49058 - RNA, 20 nt, Artificial Sequence
  MKO10049058_A_Slc25a28
  gRNA
guacccgaucgacugcguca

SEQ ID NO: 49059 - RNA, 20 nt, Artificial Sequence
  MKO10049059_A_Slc25a28
  gRNA
gccggcagcgcuucguauuc

SEQ ID NO: 49060 - RNA, 20 nt, Artificial Sequence
  MKO10049060_A_Slc25a28
  gRNA
cugacccagccgcccgcuau

SEQ ID NO: 49061 - RNA, 20 nt, Artificial Sequence
  MKO10049061_A_Slc25a29
  gRNA
ggccugcgcggcaucaaucg

SEQ ID NO: 49062 - RNA, 20 nt, Artificial Sequence
  MKO10049062_A_Slc25a29
  gRNA
ugauguaaugacccgcgcca

SEQ ID NO: 49063 - RNA, 20 nt, Artificial Sequence
  MKO10049063_A_Slc25a29
  gRNA
uaccuccggcgcauccagcc

SEQ ID NO: 49064 - RNA, 20 nt, Artificial Sequence
  MKO10049064_A_Slc25a2
  gRNA
agggauggcucgaaucagag

SEQ ID NO: 49065 - RNA, 20 nt, Artificial Sequence
  MKO10049065_A_Slc25a2
  gRNA
ggucccuuaggcuucuaucg

SEQ ID NO: 49066 - RNA, 20 nt, Artificial Sequence
  MKO10049066_A_Slc25a2
  gRNA
cuggauuuaaugcaguccac

SEQ ID NO: 49067 - RNA, 20 nt, Artificial Sequence
  MKO10049067_A_Slc25a30
  gRNA
ugcacccgcaaugcugcgcc

SEQ ID NO: 49068 - RNA, 20 nt, Artificial Sequence
  MKO10049068_A_Slc25a30
  gRNA
cugguacgugccgaucuuga

SEQ ID NO: 49069 - RNA, 20 nt, Artificial Sequence
  MKO10049069_A_Slc25a30
  gRNA
acccugaauacagcgccuuc

SEQ ID NO: 49070 - RNA, 20 nt, Artificial Sequence
  MKO10049070_A_Slc25a31
  gRNA
auuggucuauaccaaggguu

SEQ ID NO: 49071 - RNA, 20 nt, Artificial Sequence
  MKO10049071_A_Slc25a31
  gRNA
cccgugaacugccgcugcuc

SEQ ID NO: 49072 - RNA, 20 nt, Artificial Sequence
  MKO10049072_A_Slc25a31
  gRNA
guccuuaaaagcgaaguuua

SEQ ID NO: 49073 - RNA, 20 nt, Artificial Sequence
  MKO10049073_A_Slc25a32
  gRNA
uggaaaguugauggacuacg

SEQ ID NO: 49074 - RNA, 20 nt, Artificial Sequence
  MKO10049074_A_Slc25a32
  gRNA
acucgccuuauguuacaaua

SEQ ID NO: 49075 - RNA, 20 nt, Artificial Sequence
  MKO10049075_A_Slc25a32
  gRNA
aaggaguaaccccgaaugug

SEQ ID NO: 49076 - RNA, 20 nt, Artificial Sequence
  MKO10049076_A_Slc25a33
  gRNA
cgcgucuuaaugacuucuag

SEQ ID NO: 49077 - RNA, 20 nt, Artificial Sequence
  MKO10049077_A_Slc25a33
  gRNA
agaccaacgucugugacgcc

SEQ ID NO: 49078 - RNA, 20 nt, Artificial Sequence
  MKO10049078_A_Slc25a33
  gRNA
ggugcaacuccaaccaaauu

SEQ ID NO: 49079 - RNA, 20 nt, Artificial Sequence
  MKO10049079_A_Slc25a34
  gRNA
gccgcgugcugacgacgucc

SEQ ID NO: 49080 - RNA, 20 nt, Artificial Sequence
  MKO10049080_A_Slc25a34
  gRNA
cccuggacgucgucagcacg

SEQ ID NO: 49081 - RNA, 20 nt, Artificial Sequence
  MKO10049081_A_Slc25a34
  gRNA
agcuucggaaacugguugcg

SEQ ID NO: 49082 - RNA, 20 nt, Artificial Sequence
  MKO10049082_A_Slc25a35
  gRNA
gggugucauugccacgacua

SEQ ID NO: 49083 - RNA, 20 nt, Artificial Sequence
  MKO10049083_A_Slc25a35
  gRNA
aaccaacccacugauacucg

SEQ ID NO: 49084 - RNA, 20 nt, Artificial Sequence
  MKO10049084_A_Slc25a35
  gRNA
accccacuagaccauguuuc

SEQ ID NO: 49085 - RNA, 20 nt, Artificial Sequence
  MKO10049085_A_Slc25a36
  gRNA
gugaaccgaguagugucccc

SEQ ID NO: 49086 - RNA, 20 nt, Artificial Sequence
  MKO10049086_A_Slc25a36
  gRNA
ugguggggguugcucccucc

SEQ ID NO: 49087 - RNA, 20 nt, Artificial Sequence
  MKO10049087_A_Slc25a36
  gRNA
ucuuacuucagacaaugaag

SEQ ID NO: 49088 - RNA, 20 nt, Artificial Sequence
  MKO10049088_A_Slc25a37
  gRNA
cguugagcugguacaccguc

SEQ ID NO: 49089 - RNA, 20 nt, Artificial Sequence
  MKO10049089_A_Slc25a37
  gRNA
cauuggccaugcccgacagc

SEQ ID NO: 49090 - RNA, 20 nt, Artificial Sequence
  MKO10049090_A_Slc25a37
  gRNA
gggccugaacgugaugauga

SEQ ID NO: 49091 - RNA, 20 nt, Artificial Sequence
  MKO10049091_A_Slc25a38
  gRNA
ucccgcugauggagccgcag

SEQ ID NO: 49092 - RNA, 20 nt, Artificial Sequence
  MKO10049092_A_Slc25a38
  gRNA
agugaucaagacacgcuaug

SEQ ID NO: 49093 - RNA, 20 nt, Artificial Sequence
  MKO10049093_A_Slc25a38
  gRNA
accgcagugcugcacggcac

SEQ ID NO: 49094 - RNA, 20 nt, Artificial Sequence
  MKO10049094_A_Slc25a39
  gRNA
guacucaccgcugguugccg

SEQ ID NO: 49095 - RNA, 20 nt, Artificial Sequence
  MKO10049095_A_Slc25a39
  gRNA
caaggugccagugaaccgug

SEQ ID NO: 49096 - RNA, 20 nt, Artificial Sequence
  MKO10049096_A_Slc25a39
  gRNA
aagugccuccuauacugcaa

SEQ ID NO: 49097 - RNA, 20 nt, Artificial Sequence
  MKO10049097_A_Slc25a3
  gRNA
gccccgaagugaauguacaa

SEQ ID NO: 49098 - RNA, 20 nt, Artificial Sequence
  MKO10049098_A_Slc25a3
  gRNA
gucagcgaagaauucagcac

SEQ ID NO: 49099 - RNA, 20 nt, Artificial Sequence
  MKO10049099_A_Slc25a3
  gRNA
aauacagugaugugcgccac

SEQ ID NO: 49100 - RNA, 20 nt, Artificial Sequence
  MKO10049100_A_Slc25a40
  gRNA
uauauccauagugacucccc

SEQ ID NO: 49101 - RNA, 20 nt, Artificial Sequence
  MKO10049101_A_Slc25a40
  gRNA
uuucaacuuacagaguagga

SEQ ID NO: 49102 - RNA, 20 nt, Artificial Sequence
  MKO10049102_A_Slc25a40
  gRNA
auauacauaccuuuggggaa

SEQ ID NO: 49103 - RNA, 20 nt, Artificial Sequence
  MKO10049103_A_Slc25a41
  gRNA
gguacccgagcccuauaccg

SEQ ID NO: 49104 - RNA, 20 nt, Artificial Sequence
  MKO10049104_A_Slc25a41
  gRNA
agccugcgacgacccguucc

SEQ ID NO: 49105 - RNA, 20 nt, Artificial Sequence
  MKO10049105_A_Slc25a41
  gRNA
acgggucgucgcaggcuccc

SEQ ID NO: 49106 - RNA, 20 nt, Artificial Sequence
  MKO10049106_A_Slc25a42
  gRNA
auaaggaaucacucgcacca

SEQ ID NO: 49107 - RNA, 20 nt, Artificial Sequence
  MKO10049107_A_Slc25a42
  gRNA
uggcugaguucccacgccaa

SEQ ID NO: 49108 - RNA, 20 nt, Artificial Sequence
  MKO10049108_A_Slc25a42
  gRNA
ggcuucccucacguacccuu

SEQ ID NO: 49109 - RNA, 20 nt, Artificial Sequence
  MKO10049109_A_Slc25a43
  gRNA
gcacguucugcaccaucaau

SEQ ID NO: 49110 - RNA, 20 nt, Artificial Sequence
  MKO10049110_A_Slc25a43
  gRNA
guuccuggcccuuuaucgag

SEQ ID NO: 49111 - RNA, 20 nt, Artificial Sequence
  MKO10049111_A_Slc25a43
  gRNA
ggaguagauguccacuucuc

SEQ ID NO: 49112 - RNA, 20 nt, Artificial Sequence
  MKO10049112_A_Slc25a44
  gRNA
cgaucggcaccgugaugcuc

SEQ ID NO: 49113 - RNA, 20 nt, Artificial Sequence
  MKO10049113_A_Slc25a44
  gRNA
cucggagaccgucagcccga

SEQ ID NO: 49114 - RNA, 20 nt, Artificial Sequence
  MKO10049114_A_Slc25a44
  gRNA
acggguucugaugacaucca

SEQ ID NO: 49115 - RNA, 20 nt, Artificial Sequence
  MKO10049115_A_Slc25a45
  gRNA
uguugcuguacacuccgaac

SEQ ID NO: 49116 - RNA, 20 nt, Artificial Sequence
  MKO10049116_A_Slc25a45
  gRNA
gcugggcccgucgcuccuga

SEQ ID NO: 49117 - RNA, 20 nt, Artificial Sequence
  MKO10049117_A_Slc25a45
  gRNA
uugagagacacuccuacguu

SEQ ID NO: 49118 - RNA, 20 nt, Artificial Sequence
  MKO10049118_A_Slc25a46
  gRNA
uuuagggaccaagagcccua

SEQ ID NO: 49119 - RNA, 20 nt, Artificial Sequence
  MKO10049119_A_Slc25a46
  gRNA
gugaauuuacaccuuuaccg

SEQ ID NO: 49120 - RNA, 20 nt, Artificial Sequence
  MKO10049120_A_Slc25a46
  gRNA
ugagaugguaaugccgagca

SEQ ID NO: 49121 - RNA, 20 nt, Artificial Sequence
  MKO10049121_A_Slc25a47
  gRNA
gcucuugacgauacgugucc

SEQ ID NO: 49122 - RNA, 20 nt, Artificial Sequence
  MKO10049122_A_Slc25a47
  gRNA
uggcguccgugcugccguac

SEQ ID NO: 49123 - RNA, 20 nt, Artificial Sequence
  MKO10049123_A_Slc25a47
  gRNA
gggacacguaucgucaagag

SEQ ID NO: 49124 - RNA, 20 nt, Artificial Sequence
  MKO10049124_A_Slc25a48
  gRNA
agaucagacagacuucggcc

SEQ ID NO: 49125 - RNA, 20 nt, Artificial Sequence
  MKO10049125_A_Slc25a48
  gRNA
gaacaccaccgaguuauaga

SEQ ID NO: 49126 - RNA, 20 nt, Artificial Sequence
  MKO10049126_A_Slc25a48
  gRNA
cacauucaacugcauccgca

SEQ ID NO: 49127 - RNA, 20 nt, Artificial Sequence
  MKO10049127_A_Slc25a4
  gRNA
guaaccuggccaacgugauc

SEQ ID NO: 49128 - RNA, 20 nt, Artificial Sequence
  MKO10049128_A_Slc25a4
  gRNA
cguuugacacuguucgucgu

SEQ ID NO: 49129 - RNA, 20 nt, Artificial Sequence
  MKO10049129_A_Slc25a4
  gRNA
aguaccggaucacguuggcc

SEQ ID NO: 49130 - RNA, 20 nt, Artificial Sequence
  MKO10049130_A_Slc25a51
  gRNA
ucuccuuaaugggcccucga

SEQ ID NO: 49131 - RNA, 20 nt, Artificial Sequence
  MKO10049131_A_Slc25a51
  gRNA
ccagcagcgccgccacgcua

SEQ ID NO: 49132 - RNA, 20 nt, Artificial Sequence
  MKO10049132_A_Slc25a51
  gRNA
ggguuccgcaacuuguaccg

SEQ ID NO: 49133 - RNA, 20 nt, Artificial Sequence
  MKO10049133_A_Slc25a53
  gRNA
augccccgguagaaguacug

SEQ ID NO: 49134 - RNA, 20 nt, Artificial Sequence
  MKO10049134_A_Slc25a53
  gRNA
aauucaauucuuacgggcuc

SEQ ID NO: 49135 - RNA, 20 nt, Artificial Sequence
  MKO10049135_A_Slc25a53
  gRNA
cuucuaccugguaacccagc

SEQ ID NO: 49136 - RNA, 20 nt, Artificial Sequence
  MKO10049136_A_Slc25a54
  gRNA
agucgcugccgugagaucau

SEQ ID NO: 49137 - RNA, 20 nt, Artificial Sequence
  MKO10049137_A_Slc25a54
  gRNA
uggaagcgguuaguagcagc

SEQ ID NO: 49138 - RNA, 20 nt, Artificial Sequence
  MKO10049138_A_Slc25a54
  gRNA
acgcuugaaagucacgaugc

SEQ ID NO: 49139 - RNA, 20 nt, Artificial Sequence
  MKO10049139_A_Slc25a5
  gRNA
cgcagccaucuccaagacag

SEQ ID NO: 49140 - RNA, 20 nt, Artificial Sequence
  MKO10049140_A_Slc25a5
  gRNA
gcagcugauaucauguacac

SEQ ID NO: 49141 - RNA, 20 nt, Artificial Sequence
  MKO10049141_A_Slc25a5
  gRNA
ugccgcuguguccuucgcca

SEQ ID NO: 49142 - RNA, 20 nt, Artificial Sequence
  MKO10049142_A_Slc26a10
  gRNA
uaaacgugcgauuccgggac

SEQ ID NO: 49143 - RNA, 20 nt, Artificial Sequence
  MKO10049143_A_Slc26a10
  gRNA
gacguguagaguccgaacac

SEQ ID NO: 49144 - RNA, 20 nt, Artificial Sequence
  MKO10049144_A_Slc26a10
  gRNA
caccaggcugagcgccgaga

SEQ ID NO: 49145 - RNA, 20 nt, Artificial Sequence
  MKO10049145_A_Slc26a11
  gRNA
cuugccgugaaguucagccg

SEQ ID NO: 49146 - RNA, 20 nt, Artificial Sequence
  MKO10049146_A_Slc26a11
  gRNA
uccgcugccagcaucacaau

SEQ ID NO: 49147 - RNA, 20 nt, Artificial Sequence
  MKO10049147_A_Slc26a11
  gRNA
gguaccuggucucuccgaug

SEQ ID NO: 49148 - RNA, 20 nt, Artificial Sequence
  MKO10049148_A_Slc26a1
  gRNA
cccucgagucaaaccgugua

SEQ ID NO: 49149 - RNA, 20 nt, Artificial Sequence
  MKO10049149_A_Slc26a1
  gRNA
cgccuuaaggaauaccuagc

SEQ ID NO: 49150 - RNA, 20 nt, Artificial Sequence
  MKO10049150_A_Slc26a1
  gRNA
ucgcuaccgacaccgucuga

SEQ ID NO: 49151 - RNA, 20 nt, Artificial Sequence
  MKO10049151_A_Slc26a2
  gRNA
uuaugaagccguugggaucc

SEQ ID NO: 49152 - RNA, 20 nt, Artificial Sequence
  MKO10049152_A_Slc26a2
  gRNA
uaaauuucagaagugcgccc

SEQ ID NO: 49153 - RNA, 20 nt, Artificial Sequence
  MKO10049153_A_Slc26a2
  gRNA
agucugagaccggucauggc

SEQ ID NO: 49154 - RNA, 20 nt, Artificial Sequence
  MKO10049154_A_Slc26a3
  gRNA
aaaggcugcguacaacccgu

SEQ ID NO: 49155 - RNA, 20 nt, Artificial Sequence
  MKO10049155_A_Slc26a3
  gRNA
cuauccgagucccuaaucag

SEQ ID NO: 49156 - RNA, 20 nt, Artificial Sequence
  MKO10049156_A_Slc26a3
  gRNA
gggaguugucguuacaagag

SEQ ID NO: 49157 - RNA, 20 nt, Artificial Sequence
  MKO10049157_A_Slc26a4
  gRNA
caaugcacuuccguuaccgc

SEQ ID NO: 49158 - RNA, 20 nt, Artificial Sequence
  MKO10049158_A_Slc26a4
  gRNA
aacucgaccacguuagacac

SEQ ID NO: 49159 - RNA, 20 nt, Artificial Sequence
  MKO10049159_A_Slc26a4
  gRNA
uuccgaacacaaaauacguc

SEQ ID NO: 49160 - RNA, 20 nt, Artificial Sequence
  MKO10049160_A_Slc26a5
  gRNA
ggugcgaggcuuuaccacug

SEQ ID NO: 49161 - RNA, 20 nt, Artificial Sequence
  MKO10049161_A_Slc26a5
  gRNA
uuggucucgggcauaagcac

SEQ ID NO: 49162 - RNA, 20 nt, Artificial Sequence
  MKO10049162_A_Slc26a5
  gRNA
aggcuuagccuucgccaugc

SEQ ID NO: 49163 - RNA, 20 nt, Artificial Sequence
  MKO10049163_A_Slc26a6
  gRNA
accggaaccaaguucgccac

SEQ ID NO: 49164 - RNA, 20 nt, Artificial Sequence
  MKO10049164_A_Slc26a6
  gRNA
agcugaugaugcacgcgugc

SEQ ID NO: 49165 - RNA, 20 nt, Artificial Sequence
  MKO10049165_A_Slc26a6
  gRNA
cccgguauccugugcgugaa

SEQ ID NO: 49166 - RNA, 20 nt, Artificial Sequence
  MKO10049166_A_Slc26a7
  gRNA
ugacuugugaugucacgaca

SEQ ID NO: 49167 - RNA, 20 nt, Artificial Sequence
  MKO10049167_A_Slc26a7
  gRNA
augggacgccauguugccac

SEQ ID NO: 49168 - RNA, 20 nt, Artificial Sequence
  MKO10049168_A_Slc26a7
  gRNA
cuugauaucagccaacgcug

SEQ ID NO: 49169 - RNA, 20 nt, Artificial Sequence
  MKO10049169_A_Slc26a9
  gRNA
ugucaccaaugagaccuacg

SEQ ID NO: 49170 - RNA, 20 nt, Artificial Sequence
  MKO10049170_A_Slc26a9
  gRNA
cugaccauucccuccuauac

SEQ ID NO: 49171 - RNA, 20 nt, Artificial Sequence
  MKO10049171_A_Slc26a9
  gRNA
cuuugccguuaucagcaucc

SEQ ID NO: 49172 - RNA, 20 nt, Artificial Sequence
  MKO10049172_A_Slc27a1
  gRNA
guugucgccgggccacagcc

SEQ ID NO: 49173 - RNA, 20 nt, Artificial Sequence
  MKO10049173_A_Slc27a1
  gRNA
cugcgacgacaccggcgagc

SEQ ID NO: 49174 - RNA, 20 nt, Artificial Sequence
  MKO10049174_A_Slc27a1
  gRNA
uacuaccgcauugcugccuu

SEQ ID NO: 49175 - RNA, 20 nt, Artificial Sequence
  MKO10049175_A_Slc27a2
  gRNA
caaccacgaugcauccguga

SEQ ID NO: 49176 - RNA, 20 nt, Artificial Sequence
  MKO10049176_A_Slc27a2
  gRNA
cuucacggaugcaucguggu

SEQ ID NO: 49177 - RNA, 20 nt, Artificial Sequence
  MKO10049177_A_Slc27a2
  gRNA
uccugcagucgucccaaaac

SEQ ID NO: 49178 - RNA, 20 nt, Artificial Sequence
  MKO10049178_A_Slc27a3
  gRNA
ucaccgggggcugguugacg

SEQ ID NO: 49179 - RNA, 20 nt, Artificial Sequence
  MKO10049179_A_Slc27a3
  gRNA
gcagagagguaccccggcac

SEQ ID NO: 49180 - RNA, 20 nt, Artificial Sequence
  MKO10049180_A_Slc27a3
  gRNA
guccucaccaguagugccag

SEQ ID NO: 49181 - RNA, 20 nt, Artificial Sequence
  MKO10049181_A_Slc27a4
  gRNA
caaggugcgacgguaccuuc

SEQ ID NO: 49182 - RNA, 20 nt, Artificial Sequence
  MKO10049182_A_Slc27a4
  gRNA
ggcgcagggcaucccgccua

SEQ ID NO: 49183 - RNA, 20 nt, Artificial Sequence
  MKO10049183_A_Slc27a4
  gRNA
uguacuauggauuccgcaug

SEQ ID NO: 49184 - RNA, 20 nt, Artificial Sequence
  MKO10049184_A_Slc27a5
  gRNA
gccuucgagcuacgauuaag

SEQ ID NO: 49185 - RNA, 20 nt, Artificial Sequence
  MKO10049185_A_Slc27a5
  gRNA
ggacguuacacaaguaccgc

SEQ ID NO: 49186 - RNA, 20 nt, Artificial Sequence
  MKO10049186_A_Slc27a5
  gRNA
uccacuuaaucguagcucga

SEQ ID NO: 49187 - RNA, 20 nt, Artificial Sequence
  MKO10049187_A_Slc27a6
  gRNA
caacugccaaacguacccga

SEQ ID NO: 49188 - RNA, 20 nt, Artificial Sequence
  MKO10049188_A_Slc27a6
  gRNA
caucggguacguuuggcagu

SEQ ID NO: 49189 - RNA, 20 nt, Artificial Sequence
  MKO10049189_A_Slc27a6
  gRNA
ucuguugggcuaugggcguu

SEQ ID NO: 49190 - RNA, 20 nt, Artificial Sequence
  MKO10049190_A_Slc28a1
  gRNA
acaccagcuguuccggccgc

SEQ ID NO: 49191 - RNA, 20 nt, Artificial Sequence
  MKO10049191_A_Slc28a1
  gRNA
acgaacagcgccagcgcccu

SEQ ID NO: 49192 - RNA, 20 nt, Artificial Sequence
  MKO10049192_A_Slc28a1
  gRNA
uggccuacaaucugcuaaag

SEQ ID NO: 49193 - RNA, 20 nt, Artificial Sequence
  MKO10049193_A_Slc28a2
  gRNA
accgcuuugcccaaagauuc

SEQ ID NO: 49194 - RNA, 20 nt, Artificial Sequence
  MKO10049194_A_Slc28a2
  gRNA
uccuccuccaggguguucgu

SEQ ID NO: 49195 - RNA, 20 nt, Artificial Sequence
  MKO10049195_A_Slc28a2
  gRNA
aaaacacccaccugaaucuu

SEQ ID NO: 49196 - RNA, 20 nt, Artificial Sequence
  MKO10049196_A_Slc28a3
  gRNA
caggcagaucacgauugaac

SEQ ID NO: 49197 - RNA, 20 nt, Artificial Sequence
  MKO10049197_A_Slc28a3
  gRNA
ucuguggaaguuuaucgcac

SEQ ID NO: 49198 - RNA, 20 nt, Artificial Sequence
  MKO10049198_A_Slc28a3
  gRNA
guuguacaaagcggggaaca

SEQ ID NO: 49199 - RNA, 20 nt, Artificial Sequence
  MKO10049199_A_Slc29a1
  gRNA
gcaugauugaucaguguccg

SEQ ID NO: 49200 - RNA, 20 nt, Artificial Sequence
  MKO10049200_A_Slc29a1
  gRNA
acaguauuucacaaaccgcc

SEQ ID NO: 49201 - RNA, 20 nt, Artificial Sequence
  MKO10049201_A_Slc29a1
  gRNA
gaugagcacaaucuugauca

SEQ ID NO: 49202 - RNA, 20 nt, Artificial Sequence
  MKO10049202_A_Slc29a2
  gRNA
gcccagaauccgcaccgacu

SEQ ID NO: 49203 - RNA, 20 nt, Artificial Sequence
  MKO10049203_A_Slc29a2
  gRNA
uggucccugcuaaccgcccc

SEQ ID NO: 49204 - RNA, 20 nt, Artificial Sequence
  MKO10049204_A_Slc29a2
  gRNA
cugucaccauggcguccguc

SEQ ID NO: 49205 - RNA, 20 nt, Artificial Sequence
  MKO10049205_A_Slc29a3
  gRNA
aaugauggccaugcacgcga

SEQ ID NO: 49206 - RNA, 20 nt, Artificial Sequence
  MKO10049206_A_Slc29a3
  gRNA
cagccucaccaucgcgugca

SEQ ID NO: 49207 - RNA, 20 nt, Artificial Sequence
  MKO10049207_A_Slc29a3
  gRNA
guccuccccggacgcugggc

SEQ ID NO: 49208 - RNA, 20 nt, Artificial Sequence
  MKO10049208_A_Slc29a4
  gRNA
ugugcuccuaaacaacguug

SEQ ID NO: 49209 - RNA, 20 nt, Artificial Sequence
  MKO10049209_A_Slc29a4
  gRNA
cgccaucaaccuggccgccg

SEQ ID NO: 49210 - RNA, 20 nt, Artificial Sequence
  MKO10049210_A_Slc29a4
  gRNA
uuaucagcauaugcgaugug

SEQ ID NO: 49211 - RNA, 20 nt, Artificial Sequence
  MKO10049211_A_Slc2a10
  gRNA
uuacggccucaacuacgucc

SEQ ID NO: 49212 - RNA, 20 nt, Artificial Sequence
  MKO10049212_A_Slc2a10
  gRNA
gccuaugccgcugaccgaua

SEQ ID NO: 49213 - RNA, 20 nt, Artificial Sequence
  MKO10049213_A_Slc2a10
  gRNA
gaauaccgaugcgcugccua

SEQ ID NO: 49214 - RNA, 20 nt, Artificial Sequence
  MKO10049214_A_Slc2a12
  gRNA
guccuacacgcuccuuauaa

SEQ ID NO: 49215 - RNA, 20 nt, Artificial Sequence
  MKO10049215_A_Slc2a12
  gRNA
auuggagcccguuagguguc

SEQ ID NO: 49216 - RNA, 20 nt, Artificial Sequence
  MKO10049216_A_Slc2a12
  gRNA
auaccagugucagaccuauc

SEQ ID NO: 49217 - RNA, 20 nt, Artificial Sequence
  MKO10049217_A_Slc2a13
  gRNA
gaccgugcccguguacaucg

SEQ ID NO: 49218 - RNA, 20 nt, Artificial Sequence
  MKO10049218_A_Slc2a13
  gRNA
agucuggcucgucgagaaag

SEQ ID NO: 49219 - RNA, 20 nt, Artificial Sequence
  MKO10049219_A_Slc2a13
  gRNA
aacucgccgagcguuaguug

SEQ ID NO: 49220 - RNA, 20 nt, Artificial Sequence
  MKO10049220_A_Slc2a1
  gRNA
ccugcucaucaaucguaacg

SEQ ID NO: 49221 - RNA, 20 nt, Artificial Sequence
  MKO10049221_A_Slc2a1
  gRNA
ccucguuacgauugaugagc

SEQ ID NO: 49222 - RNA, 20 nt, Artificial Sequence
  MKO10049222_A_Slc2a1
  gRNA
augggaugggcucuccguag

SEQ ID NO: 49223 - RNA, 20 nt, Artificial Sequence
  MKO10049223_A_Slc2a2
  gRNA
caccgaugucauagccgaac

SEQ ID NO: 49224 - RNA, 20 nt, Artificial Sequence
  MKO10049224_A_Slc2a2
  gRNA
cauuccgcccacugcaaagc

SEQ ID NO: 49225 - RNA, 20 nt, Artificial Sequence
  MKO10049225_A_Slc2a2
  gRNA
agaucgcuccaaccacacuc

SEQ ID NO: 49226 - RNA, 20 nt, Artificial Sequence
  MKO10049226_A_Slc2a3
  gRNA
gugugccaaaugcaccccga

SEQ ID NO: 49227 - RNA, 20 nt, Artificial Sequence
  MKO10049227_A_Slc2a3
  gRNA
ggacucuuugucaaccgcuu

SEQ ID NO: 49228 - RNA, 20 nt, Artificial Sequence
  MKO10049228_A_Slc2a3
  gRNA
uucaacagacuccgcuaucu

SEQ ID NO: 49229 - RNA, 20 nt, Artificial Sequence
  MKO10049229_A_Slc2a4
  gRNA
aaaucgcccccacucaucuu

SEQ ID NO: 49230 - RNA, 20 nt, Artificial Sequence
  MKO10049230_A_Slc2a4
  gRNA
aaggcacccucacuacgcuc

SEQ ID NO: 49231 - RNA, 20 nt, Artificial Sequence
  MKO10049231_A_Slc2a4
  gRNA
uaccugaguaggcgccaaug

SEQ ID NO: 49232 - RNA, 20 nt, Artificial Sequence
  MKO10049232_A_Slc2a5
  gRNA
uccagguaucucuuccaacg

SEQ ID NO: 49233 - RNA, 20 nt, Artificial Sequence
  MKO10049233_A_Slc2a5
  gRNA
cccuauguacuuaggggagc

SEQ ID NO: 49234 - RNA, 20 nt, Artificial Sequence
  MKO10049234_A_Slc2a5
  gRNA
ccugcccaguuuauucacca

SEQ ID NO: 49235 - RNA, 20 nt, Artificial Sequence
  MKO10049235_A_Slc2a6
  gRNA
gcaaucauggccggugcccg

SEQ ID NO: 49236 - RNA, 20 nt, Artificial Sequence
  MKO10049236_A_Slc2a6
  gRNA
agucgcgggcaccucgggga

SEQ ID NO: 49237 - RNA, 20 nt, Artificial Sequence
  MKO10049237_A_Slc2a6
  gRNA
cgacuaugauaccuuccccg

SEQ ID NO: 49238 - RNA, 20 nt, Artificial Sequence
  MKO10049238_A_Slc2a7
  gRNA
cggcgauguuguagccauac

SEQ ID NO: 49239 - RNA, 20 nt, Artificial Sequence
  MKO10049239_A_Slc2a7
  gRNA
ugccccacuuauugaccauc

SEQ ID NO: 49240 - RNA, 20 nt, Artificial Sequence
  MKO10049240_A_Slc2a7
  gRNA
gacacgcacuuugagcgaca

SEQ ID NO: 49241 - RNA, 20 nt, Artificial Sequence
  MKO10049241_A_Slc2a8
  gRNA
acucaccggugccacuagug

SEQ ID NO: 49242 - RNA, 20 nt, Artificial Sequence
  MKO10049242_A_Slc2a8
  gRNA
ugcaccgugcccuucgugac

SEQ ID NO: 49243 - RNA, 20 nt, Artificial Sequence
  MKO10049243_A_Slc2a8
  gRNA
uguacccguaggacuccccg

SEQ ID NO: 49244 - RNA, 20 nt, Artificial Sequence
  MKO10049244_A_Slc2a9
  gRNA
cggcgugggcgcguucacca

SEQ ID NO: 49245 - RNA, 20 nt, Artificial Sequence
  MKO10049245_A_Slc2a9
  gRNA
augguccuucucgcucgucg

SEQ ID NO: 49246 - RNA, 20 nt, Artificial Sequence
  MKO10049246_A_Slc2a9
  gRNA
cauuuccgcagcguugcuga

SEQ ID NO: 49247 - RNA, 20 nt, Artificial Sequence
  MKO10049247_A_Slc30a10
  gRNA
accgcgccgcgcgauguagc

SEQ ID NO: 49248 - RNA, 20 nt, Artificial Sequence
  MKO10049248_A_Slc30a10
  gRNA
aggccguguugcgccuugcg

SEQ ID NO: 49249 - RNA, 20 nt, Artificial Sequence
  MKO10049249_A_Slc30a10
  gRNA
gacgugaagacccguguaac

SEQ ID NO: 49250 - RNA, 20 nt, Artificial Sequence
  MKO10049250_A_Slc30a1
  gRNA
cggcucgaugaagcgcucga

SEQ ID NO: 49251 - RNA, 20 nt, Artificial Sequence
  MKO10049251_A_Slc30a1
  gRNA
cagcgucacgcaucggggcc

SEQ ID NO: 49252 - RNA, 20 nt, Artificial Sequence
  MKO10049252_A_Slc30a1
  gRNA
ccucgccaagggcgcgcgca

SEQ ID NO: 49253 - RNA, 20 nt, Artificial Sequence
  MKO10049253_A_Slc30a2
  gRNA
ucgaugccagccgaaguuca

SEQ ID NO: 49254 - RNA, 20 nt, Artificial Sequence
  MKO10049254_A_Slc30a2
  gRNA
cgauguugcagguggguacc

SEQ ID NO: 49255 - RNA, 20 nt, Artificial Sequence
  MKO10049255_A_Slc30a2
  gRNA
ugugcccguguccagacuga

SEQ ID NO: 49256 - RNA, 20 nt, Artificial Sequence
  MKO10049256_A_Slc30a3
  gRNA
auuggcacagacagcgaugc

SEQ ID NO: 49257 - RNA, 20 nt, Artificial Sequence
  MKO10049257_A_Slc30a3
  gRNA
ggugcggguggcuggccgag

SEQ ID NO: 49258 - RNA, 20 nt, Artificial Sequence
  MKO10049258_A_Slc30a3
  gRNA
cccggacacucguguuuccc

SEQ ID NO: 49259 - RNA, 20 nt, Artificial Sequence
  MKO10049259_A_Slc30a4
  gRNA
agcugcauuuguacacgccu

SEQ ID NO: 49260 - RNA, 20 nt, Artificial Sequence
  MKO10049260_A_Slc30a4
  gRNA
accuaggcgaugaaauccaa

SEQ ID NO: 49261 - RNA, 20 nt, Artificial Sequence
  MKO10049261_A_Slc30a4
  gRNA
uaucuaguggacacaaccau

SEQ ID NO: 49262 - RNA, 20 nt, Artificial Sequence
  MKO10049262_A_Slc30a5
  gRNA
uuacucuuuguggaccacua

SEQ ID NO: 49263 - RNA, 20 nt, Artificial Sequence
  MKO10049263_A_Slc30a5
  gRNA
uuagugguccacaaagagua

SEQ ID NO: 49264 - RNA, 20 nt, Artificial Sequence
  MKO10049264_A_Slc30a5
  gRNA
cucaccugaugcuuuguaau

SEQ ID NO: 49265 - RNA, 20 nt, Artificial Sequence
  MKO10049265_A_Slc30a6
  gRNA
cguugauugcaccgaacaga

SEQ ID NO: 49266 - RNA, 20 nt, Artificial Sequence
  MKO10049266_A_Slc30a6
  gRNA
gggcaacauaccgaugcugu

SEQ ID NO: 49267 - RNA, 20 nt, Artificial Sequence
  MKO10049267_A_Slc30a6
  gRNA
uuagacuugucgcagcugac

SEQ ID NO: 49268 - RNA, 20 nt, Artificial Sequence
  MKO10049268_A_Slc30a7
  gRNA
uccgggaugucuuguccgac

SEQ ID NO: 49269 - RNA, 20 nt, Artificial Sequence
  MKO10049269_A_Slc30a7
  gRNA
gauaaugacgcuuucucuua

SEQ ID NO: 49270 - RNA, 20 nt, Artificial Sequence
  MKO10049270_A_Slc30a7
  gRNA
gcccauugacaaagccagcc

SEQ ID NO: 49271 - RNA, 20 nt, Artificial Sequence
  MKO10049271_A_Slc30a8
  gRNA
acauuugggugguaucgagc

SEQ ID NO: 49272 - RNA, 20 nt, Artificial Sequence
  MKO10049272_A_Slc30a8
  gRNA
caucgaggcccccuuccaag

SEQ ID NO: 49273 - RNA, 20 nt, Artificial Sequence
  MKO10049273_A_Slc30a8
  gRNA
gcaagcaagcgcaugccaag

SEQ ID NO: 49274 - RNA, 20 nt, Artificial Sequence
  MKO10049274_A_Slc30a9
  gRNA
uacucuacgaauguccagaa

SEQ ID NO: 49275 - RNA, 20 nt, Artificial Sequence
  MKO10049275_A_Slc30a9
  gRNA
aaacgcuguaccuggacuua

SEQ ID NO: 49276 - RNA, 20 nt, Artificial Sequence
  MKO10049276_A_Slc30a9
  gRNA
caagacccucuccaaguaag

SEQ ID NO: 49277 - RNA, 20 nt, Artificial Sequence
  MKO10049277_A_Slc31a1
  gRNA
ugguaauguugucguccgug

SEQ ID NO: 49278 - RNA, 20 nt, Artificial Sequence
  MKO10049278_A_Slc31a1
  gRNA
uaugguggugcaucuccaua

SEQ ID NO: 49279 - RNA, 20 nt, Artificial Sequence
  MKO10049279_A_Slc31a1
  gRNA
acuuucgaagcagacccucu

SEQ ID NO: 49280 - RNA, 20 nt, Artificial Sequence
  MKO10049280_A_Slc31a2
  gRNA
ccuauugucugaaguugauc

SEQ ID NO: 49281 - RNA, 20 nt, Artificial Sequence
  MKO10049281_A_Slc31a2
  gRNA
ugcccucauacaguacugcc

SEQ ID NO: 49282 - RNA, 20 nt, Artificial Sequence
  MKO10049282_A_Slc31a2
  gRNA
aguagcccacagccgagccc

SEQ ID NO: 49283 - RNA, 20 nt, Artificial Sequence
  MKO10049283_A_Slc32a1
  gRNA
cgcgaagaagggcaacggau

SEQ ID NO: 49284 - RNA, 20 nt, Artificial Sequence
  MKO10049284_A_Slc32a1
  gRNA
gacguguaucuuguacgucg

SEQ ID NO: 49285 - RNA, 20 nt, Artificial Sequence
  MKO10049285_A_Slc32a1
  gRNA
guuucaggcggccaccgaug

SEQ ID NO: 49286 - RNA, 20 nt, Artificial Sequence
  MKO10049286_A_Slc33a1
  gRNA
gcugaguuaugcauuacauc

SEQ ID NO: 49287 - RNA, 20 nt, Artificial Sequence
  MKO10049287_A_Slc33a1
  gRNA
ucacuuacuucgauagcauc

SEQ ID NO: 49288 - RNA, 20 nt, Artificial Sequence
  MKO10049288_A_Slc33a1
  gRNA
ggccuuacuagcugucccaa

SEQ ID NO: 49289 - RNA, 20 nt, Artificial Sequence
  MKO10049289_A_Slc34a1
  gRNA
cuccgccauuccgaucauca

SEQ ID NO: 49290 - RNA, 20 nt, Artificial Sequence
  MKO10049290_A_Slc34a1
  gRNA
aggcggagcugagcacaucc

SEQ ID NO: 49291 - RNA, 20 nt, Artificial Sequence
  MKO10049291_A_Slc34a1
  gRNA
guagugggucaugacauucc

SEQ ID NO: 49292 - RNA, 20 nt, Artificial Sequence
  MKO10049292_A_Slc34a2
  gRNA
cauaagcgccacgaucgugu

SEQ ID NO: 49293 - RNA, 20 nt, Artificial Sequence
  MKO10049293_A_Slc34a2
  gRNA
cuccaucaccaacacgaucg

SEQ ID NO: 49294 - RNA, 20 nt, Artificial Sequence
  MKO10049294_A_Slc34a2
  gRNA
ucucauagaggagcaucccg

SEQ ID NO: 49295 - RNA, 20 nt, Artificial Sequence
  MKO10049295_A_Slc34a3
  gRNA
ccaaugaccaagcccgccac

SEQ ID NO: 49296 - RNA, 20 nt, Artificial Sequence
  MKO10049296_A_Slc34a3
  gRNA
uaucaucaugggcgucaaug

SEQ ID NO: 49297 - RNA, 20 nt, Artificial Sequence
  MKO10049297_A_Slc34a3
  gRNA
guccaacccuguggcgggcu

SEQ ID NO: 49298 - RNA, 20 nt, Artificial Sequence
  MKO10049298_A_Slc35a1
  gRNA
gcguuacuuacuuagcuaac

SEQ ID NO: 49299 - RNA, 20 nt, Artificial Sequence
  MKO10049299_A_Slc35a1
  gRNA
guagcgcagaauccauuguu

SEQ ID NO: 49300 - RNA, 20 nt, Artificial Sequence
  MKO10049300_A_Slc35a1
  gRNA
cuucaagcuguacugcuuga

SEQ ID NO: 49301 - RNA, 20 nt, Artificial Sequence
  MKO10049301_A_Slc35a2
  gRNA
cgcuacgcucgcacacugcc

SEQ ID NO: 49302 - RNA, 20 nt, Artificial Sequence
  MKO10049302_A_Slc35a2
  gRNA
cccagguuccaacgcgcccg

SEQ ID NO: 49303 - RNA, 20 nt, Artificial Sequence
  MKO10049303_A_Slc35a2
  gRNA
caggcagugugcgagcguag

SEQ ID NO: 49304 - RNA, 20 nt, Artificial Sequence
  MKO10049304_A_Slc35a3
  gRNA
cugaagcucgcuaucccguc

SEQ ID NO: 49305 - RNA, 20 nt, Artificial Sequence
  MKO10049305_A_Slc35a3
  gRNA
caaacugugagccuguugaa

SEQ ID NO: 49306 - RNA, 20 nt, Artificial Sequence
  MKO10049306_A_Slc35a3
  gRNA
ucccuaguaauucugauggc

SEQ ID NO: 49307 - RNA, 20 nt, Artificial Sequence
  MKO10049307_A_Slc35a4
  gRNA
gaaggcgcacaacaggagcu

SEQ ID NO: 49308 - RNA, 20 nt, Artificial Sequence
  MKO10049308_A_Slc35a4
  gRNA
gcaucgucucucugcgcguc

SEQ ID NO: 49309 - RNA, 20 nt, Artificial Sequence
  MKO10049309_A_Slc35a4
  gRNA
ccagcugcugacgcgggccc

SEQ ID NO: 49310 - RNA, 20 nt, Artificial Sequence
  MKO10049310_A_Slc35a5
  gRNA
agucuuugggagcguuccag

SEQ ID NO: 49311 - RNA, 20 nt, Artificial Sequence
  MKO10049311_A_Slc35a5
  gRNA
aagagacaauuguacaucga

SEQ ID NO: 49312 - RNA, 20 nt, Artificial Sequence
  MKO10049312_A_Slc35a5
  gRNA
cucugagcacacguucacag

SEQ ID NO: 49313 - RNA, 20 nt, Artificial Sequence
  MKO10049313_A_Slc35b1
  gRNA
cuugaagaagaaguacccgc

SEQ ID NO: 49314 - RNA, 20 nt, Artificial Sequence
  MKO10049314_A_Slc35b1
  gRNA
ucuucaagagcgucacuccc

SEQ ID NO: 49315 - RNA, 20 nt, Artificial Sequence
  MKO10049315_A_Slc35b1
  gRNA
guuugucaacuauccaacuc

SEQ ID NO: 49316 - RNA, 20 nt, Artificial Sequence
  MKO10049316_A_Slc35b2
  gRNA
cagcggaauccaccccgucu

SEQ ID NO: 49317 - RNA, 20 nt, Artificial Sequence
  MKO10049317_A_Slc35b2
  gRNA
uaucaucaugacucuacgcc

SEQ ID NO: 49318 - RNA, 20 nt, Artificial Sequence
  MKO10049318_A_Slc35b2
  gRNA
ugaagcgugcccccuccagu

SEQ ID NO: 49319 - RNA, 20 nt, Artificial Sequence
  MKO10049319_A_Slc35b3
  gRNA
aaggcuuuaagccuuacggc

SEQ ID NO: 49320 - RNA, 20 nt, Artificial Sequence
  MKO10049320_A_Slc35b3
  gRNA
gagugagcuguagcucgauu

SEQ ID NO: 49321 - RNA, 20 nt, Artificial Sequence
  MKO10049321_A_Slc35b3
  gRNA
aaaacuccuccuagcauaac

SEQ ID NO: 49322 - RNA, 20 nt, Artificial Sequence
  MKO10049322_A_Slc35b4
  gRNA
gugacgauguucccgcaucc

SEQ ID NO: 49323 - RNA, 20 nt, Artificial Sequence
  MKO10049323_A_Slc35b4
  gRNA
agccaccagcuaucccaaua

SEQ ID NO: 49324 - RNA, 20 nt, Artificial Sequence
  MKO10049324_A_Slc35b4
  gRNA
cauggcgauguucagguuca

SEQ ID NO: 49325 - RNA, 20 nt, Artificial Sequence
  MKO10049325_A_Slc35c1
  gRNA
cucaccaaugaugacgccgc

SEQ ID NO: 49326 - RNA, 20 nt, Artificial Sequence
  MKO10049326_A_Slc35c1
  gRNA
ugccugacacguuauggguc

SEQ ID NO: 49327 - RNA, 20 nt, Artificial Sequence
  MKO10049327_A_Slc35c1
  gRNA
aaccucugccucaaguacgu

SEQ ID NO: 49328 - RNA, 20 nt, Artificial Sequence
  MKO10049328_A_Slc35c2
  gRNA
cguucaucgguggcauccgc

SEQ ID NO: 49329 - RNA, 20 nt, Artificial Sequence
  MKO10049329_A_Slc35c2
  gRNA
acuggcaacagcacuugacg

SEQ ID NO: 49330 - RNA, 20 nt, Artificial Sequence
  MKO10049330_A_Slc35c2
  gRNA
cuccugcagaaagccgaucu

SEQ ID NO: 49331 - RNA, 20 nt, Artificial Sequence
  MKO10049331_A_Slc35d1
  gRNA
ugcugaacagucccgugauu

SEQ ID NO: 49332 - RNA, 20 nt, Artificial Sequence
  MKO10049332_A_Slc35d1
  gRNA
cgacagaaauguaccucgaa

SEQ ID NO: 49333 - RNA, 20 nt, Artificial Sequence
  MKO10049333_A_Slc35d1
  gRNA
gccaaguccaacacauagcg

SEQ ID NO: 49334 - RNA, 20 nt, Artificial Sequence
  MKO10049334_A_Slc35d2
  gRNA
aaucguaaacuuccugagca

SEQ ID NO: 49335 - RNA, 20 nt, Artificial Sequence
  MKO10049335_A_Slc35d2
  gRNA
ugccgauguucaccgugcuc

SEQ ID NO: 49336 - RNA, 20 nt, Artificial Sequence
  MKO10049336_A_Slc35d2
  gRNA
uuucccucaccaauuguacu

SEQ ID NO: 49337 - RNA, 20 nt, Artificial Sequence
  MKO10049337_A_Slc35d3
  gRNA
cgaccccauuggguacguaa

SEQ ID NO: 49338 - RNA, 20 nt, Artificial Sequence
  MKO10049338_A_Slc35d3
  gRNA
cacgcccguuacguacccaa

SEQ ID NO: 49339 - RNA, 20 nt, Artificial Sequence
  MKO10049339_A_Slc35d3
  gRNA
gcgcgaugcggcagcugugc

SEQ ID NO: 49340 - RNA, 20 nt, Artificial Sequence
  MKO10049340_A_Slc35e1
  gRNA
cagagcuguccuucgacgug

SEQ ID NO: 49341 - RNA, 20 nt, Artificial Sequence
  MKO10049341_A_Slc35e1
  gRNA
uguucuucaugauccccacg

SEQ ID NO: 49342 - RNA, 20 nt, Artificial Sequence
  MKO10049342_A_Slc35e1
  gRNA
gaccagcccccacacgucga

SEQ ID NO: 49343 - RNA, 20 nt, Artificial Sequence
  MKO10049343_A_Slc35e2
  gRNA
ugcguuauccaccaacauua

SEQ ID NO: 49344 - RNA, 20 nt, Artificial Sequence
  MKO10049344_A_Slc35e2
  gRNA
augcugucaacaacguuaau

SEQ ID NO: 49345 - RNA, 20 nt, Artificial Sequence
  MKO10049345_A_Slc35e2
  gRNA
acuagcguugugcacugcca

SEQ ID NO: 49346 - RNA, 20 nt, Artificial Sequence
  MKO10049346_A_Slc35e3
  gRNA
uaccucagcuacaacauguu

SEQ ID NO: 49347 - RNA, 20 nt, Artificial Sequence
  MKO10049347_A_Slc35e3
  gRNA
agucacgucccuuuaucaag

SEQ ID NO: 49348 - RNA, 20 nt, Artificial Sequence
  MKO10049348_A_Slc35e3
  gRNA
uugcagauuccuauuacugu

SEQ ID NO: 49349 - RNA, 20 nt, Artificial Sequence
  MKO10049349_A_Slc35e4
  gRNA
gcccacguugccgcacgcca

SEQ ID NO: 49350 - RNA, 20 nt, Artificial Sequence
  MKO10049350_A_Slc35e4
  gRNA
cuccauggcgugcggcaacg

SEQ ID NO: 49351 - RNA, 20 nt, Artificial Sequence
  MKO10049351_A_Slc35e4
  gRNA
ugccgaacaggagccgggac

SEQ ID NO: 49352 - RNA, 20 nt, Artificial Sequence
  MKO10049352_A_Slc35f1
  gRNA
agacauuugagaucccguac

SEQ ID NO: 49353 - RNA, 20 nt, Artificial Sequence
  MKO10049353_A_Slc35f1
  gRNA
accacccuagcuguccgaca

SEQ ID NO: 49354 - RNA, 20 nt, Artificial Sequence
  MKO10049354_A_Slc35f1
  gRNA
agcuaauuaccuggugguca

SEQ ID NO: 49355 - RNA, 20 nt, Artificial Sequence
  MKO10049355_A_Slc35f2
  gRNA
ggccgugccgcaaauacaca

SEQ ID NO: 49356 - RNA, 20 nt, Artificial Sequence
  MKO10049356_A_Slc35f2
  gRNA
ccagcaucaacguguaaacc

SEQ ID NO: 49357 - RNA, 20 nt, Artificial Sequence
  MKO10049357_A_Slc35f2
  gRNA
ucuugcccggagaauaaacc

SEQ ID NO: 49358 - RNA, 20 nt, Artificial Sequence
  MKO10049358_A_Slc35f3
  gRNA
uucuucccauuguacuacgc

SEQ ID NO: 49359 - RNA, 20 nt, Artificial Sequence
  MKO10049359_A_Slc35f3
  gRNA
gccgccauccuugccaucgc

SEQ ID NO: 49360 - RNA, 20 nt, Artificial Sequence
  MKO10049360_A_Slc35f3
  gRNA
acgcaccguucacccugacg

SEQ ID NO: 49361 - RNA, 20 nt, Artificial Sequence
  MKO10049361_A_Slc35f4
  gRNA
ggcaaaugccacaccgauga

SEQ ID NO: 49362 - RNA, 20 nt, Artificial Sequence
  MKO10049362_A_Slc35f4
  gRNA
acuguccccucugucgguca

SEQ ID NO: 49363 - RNA, 20 nt, Artificial Sequence
  MKO10049363_A_Slc35f4
  gRNA
agauggccggaauaauagac

SEQ ID NO: 49364 - RNA, 20 nt, Artificial Sequence
  MKO10049364_A_Slc35f5
  gRNA
uuucagucagcgcaggcgaa

SEQ ID NO: 49365 - RNA, 20 nt, Artificial Sequence
  MKO10049365_A_Slc35f5
  gRNA
uacaagcaugaguaguucuu

SEQ ID NO: 49366 - RNA, 20 nt, Artificial Sequence
  MKO10049366_A_Slc35f5
  gRNA
ggggauagugauucuccugc

SEQ ID NO: 49367 - RNA, 20 nt, Artificial Sequence
  MKO10049367_A_Slc35f6
  gRNA
ccagucccgcaauagugauc

SEQ ID NO: 49368 - RNA, 20 nt, Artificial Sequence
  MKO10049368_A_Slc35f6
  gRNA
aaugcugguaccuggacgaa

SEQ ID NO: 49369 - RNA, 20 nt, Artificial Sequence
  MKO10049369_A_Slc35f6
  gRNA
cuuacccacguacaugaugc

SEQ ID NO: 49370 - RNA, 20 nt, Artificial Sequence
  MKO10049370_A_Slc35g1
  gRNA
cuggagcaaccauucgucga

SEQ ID NO: 49371 - RNA, 20 nt, Artificial Sequence
  MKO10049371_A_Slc35g1
  gRNA
gaucagugcguuucgaugcg

SEQ ID NO: 49372 - RNA, 20 nt, Artificial Sequence
  MKO10049372_A_Slc35g1
  gRNA
cgucugcgagggacguuguc

SEQ ID NO: 49373 - RNA, 20 nt, Artificial Sequence
  MKO10049373_A_Slc35g2
  gRNA
uacuaucauagaaagcgccg

SEQ ID NO: 49374 - RNA, 20 nt, Artificial Sequence
  MKO10049374_A_Slc35g2
  gRNA
aagucguaaucuguauccgc

SEQ ID NO: 49375 - RNA, 20 nt, Artificial Sequence
  MKO10049375_A_Slc35g2
  gRNA
cuccauguugcuccgucuaa

SEQ ID NO: 49376 - RNA, 20 nt, Artificial Sequence
  MKO10049376_A_Slc35g3
  gRNA
gcggacagugacugcguugc

SEQ ID NO: 49377 - RNA, 20 nt, Artificial Sequence
  MKO10049377_A_Slc35g3
  gRNA
cgugggcccauucucccgua

SEQ ID NO: 49378 - RNA, 20 nt, Artificial Sequence
  MKO10049378_A_Slc35g3
  gRNA
accaggcaaccugacccagg

SEQ ID NO: 49379 - RNA, 20 nt, Artificial Sequence
  MKO10049379_A_Slc36a1
  gRNA
gugcucaucacuuaugucgu

SEQ ID NO: 49380 - RNA, 20 nt, Artificial Sequence
  MKO10049380_A_Slc36a1
  gRNA
uaucguggccgugcacugca

SEQ ID NO: 49381 - RNA, 20 nt, Artificial Sequence
  MKO10049381_A_Slc36a1
  gRNA
gugguuccggacccaggugc

SEQ ID NO: 49382 - RNA, 20 nt, Artificial Sequence
  MKO10049382_A_Slc36a2
  gRNA
cucaccugugacagaagcgc

SEQ ID NO: 49383 - RNA, 20 nt, Artificial Sequence
  MKO10049383_A_Slc36a2
  gRNA
cuguagcggguuccagacau

SEQ ID NO: 49384 - RNA, 20 nt, Artificial Sequence
  MKO10049384_A_Slc36a2
  gRNA
ugcccgcauucuucacagcc

SEQ ID NO: 49385 - RNA, 20 nt, Artificial Sequence
  MKO10049385_A_Slc36a3
  gRNA
gugcacugugagcgccccga

SEQ ID NO: 49386 - RNA, 20 nt, Artificial Sequence
  MKO10049386_A_Slc36a3
  gRNA
ccagcugagugacgaucagc

SEQ ID NO: 49387 - RNA, 20 nt, Artificial Sequence
  MKO10049387_A_Slc36a3
  gRNA
cguuuccaggcuguacauug

SEQ ID NO: 49388 - RNA, 20 nt, Artificial Sequence
  MKO10049388_A_Slc36a4
  gRNA
auaaacgagcagaauuucga

SEQ ID NO: 49389 - RNA, 20 nt, Artificial Sequence
  MKO10049389_A_Slc36a4
  gRNA
uauaaagaacgcgggcaucg

SEQ ID NO: 49390 - RNA, 20 nt, Artificial Sequence
  MKO10049390_A_Slc36a4
  gRNA
acuccacggacuagccucca

SEQ ID NO: 49391 - RNA, 20 nt, Artificial Sequence
  MKO10049391_A_Slc37a1
  gRNA
uggccagcaucccgaaaguc

SEQ ID NO: 49392 - RNA, 20 nt, Artificial Sequence
  MKO10049392_A_Slc37a1
  gRNA
cugaacaaugagaccgacug

SEQ ID NO: 49393 - RNA, 20 nt, Artificial Sequence
  MKO10049393_A_Slc37a1
  gRNA
cgcacaggaaggcguagucc

SEQ ID NO: 49394 - RNA, 20 nt, Artificial Sequence
  MKO10049394_A_Slc37a2
  gRNA
agaucgugggugucauuaac

SEQ ID NO: 49395 - RNA, 20 nt, Artificial Sequence
  MKO10049395_A_Slc37a2
  gRNA
acgaucucaaugauaccacc

SEQ ID NO: 49396 - RNA, 20 nt, Artificial Sequence
  MKO10049396_A_Slc37a2
  gRNA
ccucaagaugcgguccuccc

SEQ ID NO: 49397 - RNA, 20 nt, Artificial Sequence
  MKO10049397_A_Slc37a3
  gRNA
gcgaucggcugaauuugcga

SEQ ID NO: 49398 - RNA, 20 nt, Artificial Sequence
  MKO10049398_A_Slc37a3
  gRNA
ggcugcacuucuacaacaag

SEQ ID NO: 49399 - RNA, 20 nt, Artificial Sequence
  MKO10049399_A_Slc37a3
  gRNA
caugugcucuucugcauucg

SEQ ID NO: 49400 - RNA, 20 nt, Artificial Sequence
  MKO10049400_A_Slc37a4
  gRNA
gcgaggaucguugccaagau

SEQ ID NO: 49401 - RNA, 20 nt, Artificial Sequence
  MKO10049401_A_Slc37a4
  gRNA
ucuuuacuccgaagaccacg

SEQ ID NO: 49402 - RNA, 20 nt, Artificial Sequence
  MKO10049402_A_Slc37a4
  gRNA
cagaucagaugagcgcccgc

SEQ ID NO: 49403 - RNA, 20 nt, Artificial Sequence
  MKO10049403_A_Slc38a10
  gRNA
ucucuagcguuccacgccua

SEQ ID NO: 49404 - RNA, 20 nt, Artificial Sequence
  MKO10049404_A_Slc38a10
  gRNA
gucaccgaucacgacauaga

SEQ ID NO: 49405 - RNA, 20 nt, Artificial Sequence
  MKO10049405_A_Slc38a10
  gRNA
auuaccuucuaugucgugau

SEQ ID NO: 49406 - RNA, 20 nt, Artificial Sequence
  MKO10049406_A_Slc38a11
  gRNA
uuucccuccguguucauguc

SEQ ID NO: 49407 - RNA, 20 nt, Artificial Sequence
  MKO10049407_A_Slc38a11
  gRNA
ugaaaggguacauaaacugu

SEQ ID NO: 49408 - RNA, 20 nt, Artificial Sequence
  MKO10049408_A_Slc38a11
  gRNA
aauguagucaauucuguuau

SEQ ID NO: 49409 - RNA, 20 nt, Artificial Sequence
  MKO10049409_A_Slc38a1
  gRNA
cccgguguuggccaaggcga

SEQ ID NO: 49410 - RNA, 20 nt, Artificial Sequence
  MKO10049410_A_Slc38a1
  gRNA
agagcaagucuucggcacca

SEQ ID NO: 49411 - RNA, 20 nt, Artificial Sequence
  MKO10049411_A_Slc38a1
  gRNA
cuugggccuugccuucgccu

SEQ ID NO: 49412 - RNA, 20 nt, Artificial Sequence
  MKO10049412_A_Slc38a2
  gRNA
cgggauccacgucggcauaa

SEQ ID NO: 49413 - RNA, 20 nt, Artificial Sequence
  MKO10049413_A_Slc38a2
  gRNA
uugcagccauuaugccgacg

SEQ ID NO: 49414 - RNA, 20 nt, Artificial Sequence
  MKO10049414_A_Slc38a2
  gRNA
cuccucaagacugccaacga

SEQ ID NO: 49415 - RNA, 20 nt, Artificial Sequence
  MKO10049415_A_Slc38a3
  gRNA
acgguagcccaacugcucgu

SEQ ID NO: 49416 - RNA, 20 nt, Artificial Sequence
  MKO10049416_A_Slc38a3
  gRNA
cauccgugccuacgagcagu

SEQ ID NO: 49417 - RNA, 20 nt, Artificial Sequence
  MKO10049417_A_Slc38a3
  gRNA
ucuggggcucgccuacgcca

SEQ ID NO: 49418 - RNA, 20 nt, Artificial Sequence
  MKO10049418_A_Slc38a4
  gRNA
gaagaagcuagccgauuacg

SEQ ID NO: 49419 - RNA, 20 nt, Artificial Sequence
  MKO10049419_A_Slc38a4
  gRNA
uacaugcucauccgcguaau

SEQ ID NO: 49420 - RNA, 20 nt, Artificial Sequence
  MKO10049420_A_Slc38a4
  gRNA
ggguagcauaccuccuuccu

SEQ ID NO: 49421 - RNA, 20 nt, Artificial Sequence
  MKO10049421_A_Slc38a5
  gRNA
agcuacaggcaggaacgcga

SEQ ID NO: 49422 - RNA, 20 nt, Artificial Sequence
  MKO10049422_A_Slc38a5
  gRNA
uccccaugauagcguugcug

SEQ ID NO: 49423 - RNA, 20 nt, Artificial Sequence
  MKO10049423_A_Slc38a5
  gRNA
gggaaucucaccuacaacac

SEQ ID NO: 49424 - RNA, 20 nt, Artificial Sequence
  MKO10049424_A_Slc38a6
  gRNA
cgugacgucuuacgaagauc

SEQ ID NO: 49425 - RNA, 20 nt, Artificial Sequence
  MKO10049425_A_Slc38a6
  gRNA
ccuugguuuggcguauguga

SEQ ID NO: 49426 - RNA, 20 nt, Artificial Sequence
  MKO10049426_A_Slc38a6
  gRNA
cagaucuucguaagacguca

SEQ ID NO: 49427 - RNA, 20 nt, Artificial Sequence
  MKO10049427_A_Slc38a7
  gRNA
uccgaagguauagaccgcaa

SEQ ID NO: 49428 - RNA, 20 nt, Artificial Sequence
  MKO10049428_A_Slc38a7
  gRNA
accaggugcccacgacgcuc

SEQ ID NO: 49429 - RNA, 20 nt, Artificial Sequence
  MKO10049429_A_Slc38a7
  gRNA
ccagauaaagagaugcgccc

SEQ ID NO: 49430 - RNA, 20 nt, Artificial Sequence
  MKO10049430_A_Slc38a8
  gRNA
ggagcuauguggccccgcca

SEQ ID NO: 49431 - RNA, 20 nt, Artificial Sequence
  MKO10049431_A_Slc38a8
  gRNA
auagcucccggaccacaccc

SEQ ID NO: 49432 - RNA, 20 nt, Artificial Sequence
  MKO10049432_A_Slc38a8
  gRNA
ccccauaccugguguacuuc

SEQ ID NO: 49433 - RNA, 20 nt, Artificial Sequence
  MKO10049433_A_Slc38a9
  gRNA
uacucacauaguaacuaagc

SEQ ID NO: 49434 - RNA, 20 nt, Artificial Sequence
  MKO10049434_A_Slc38a9
  gRNA
aaaaaggcuggauuuaccac

SEQ ID NO: 49435 - RNA, 20 nt, Artificial Sequence
  MKO10049435_A_Slc38a9
  gRNA
aaacucaagaguuacacuga

SEQ ID NO: 49436 - RNA, 20 nt, Artificial Sequence
  MKO10049436_A_Slc39a10
  gRNA
ucgaucugauacagcaaugc

SEQ ID NO: 49437 - RNA, 20 nt, Artificial Sequence
  MKO10049437_A_Slc39a10
  gRNA
uuccuacugcuagugcaaca

SEQ ID NO: 49438 - RNA, 20 nt, Artificial Sequence
  MKO10049438_A_Slc39a10
  gRNA
cacagucaucagcauacgca

SEQ ID NO: 49439 - RNA, 20 nt, Artificial Sequence
  MKO10049439_A_Slc39a11
  gRNA
agugaacuuuccauccggau

SEQ ID NO: 49440 - RNA, 20 nt, Artificial Sequence
  MKO10049440_A_Slc39a11
  gRNA
cccagugcuaccuauccgga

SEQ ID NO: 49441 - RNA, 20 nt, Artificial Sequence
  MKO10049441_A_Slc39a11
  gRNA
uggugcaagcagcgaccagu

SEQ ID NO: 49442 - RNA, 20 nt, Artificial Sequence
  MKO10049442_A_Slc39a12
  gRNA
caaucuuaccagauaggugg

SEQ ID NO: 49443 - RNA, 20 nt, Artificial Sequence
  MKO10049443_A_Slc39a12
  gRNA
accaauacccuccaccuauc

SEQ ID NO: 49444 - RNA, 20 nt, Artificial Sequence
  MKO10049444_A_Slc39a12
  gRNA
gaugcacuguuacucacagc

SEQ ID NO: 49445 - RNA, 20 nt, Artificial Sequence
  MKO10049445_A_Slc39a13
  gRNA
cccacugcugccgcgcucaa

SEQ ID NO: 49446 - RNA, 20 nt, Artificial Sequence
  MKO10049446_A_Slc39a13
  gRNA
cucaccgggggugauguuac

SEQ ID NO: 49447 - RNA, 20 nt, Artificial Sequence
  MKO10049447_A_Slc39a13
  gRNA
gagcagcugccucagucgcc

SEQ ID NO: 49448 - RNA, 20 nt, Artificial Sequence
  MKO10049448_A_Slc39a14
  gRNA
ucaaguugugcgccgcaaag

SEQ ID NO: 49449 - RNA, 20 nt, Artificial Sequence
  MKO10049449_A_Slc39a14
  gRNA
augaccuucucguccgugcc

SEQ ID NO: 49450 - RNA, 20 nt, Artificial Sequence
  MKO10049450_A_Slc39a14
  gRNA
uugagcgagcgaucucagau

SEQ ID NO: 49451 - RNA, 20 nt, Artificial Sequence
  MKO10049451_A_Slc39a1
  gRNA
caaugcuuaccgucacaugc

SEQ ID NO: 49452 - RNA, 20 nt, Artificial Sequence
  MKO10049452_A_Slc39a1
  gRNA
gggccucagcacuggcacga

SEQ ID NO: 49453 - RNA, 20 nt, Artificial Sequence
  MKO10049453_A_Slc39a1
  gRNA
ggugcuaaccaugaagcuuc

SEQ ID NO: 49454 - RNA, 20 nt, Artificial Sequence
  MKO10049454_A_Slc39a2
  gRNA
uuacucccaucuacgugaaa

SEQ ID NO: 49455 - RNA, 20 nt, Artificial Sequence
  MKO10049455_A_Slc39a2
  gRNA
cagaaggaccagggcgcgca

SEQ ID NO: 49456 - RNA, 20 nt, Artificial Sequence
  MKO10049456_A_Slc39a2
  gRNA
cgugagggugaggguaccgc

SEQ ID NO: 49457 - RNA, 20 nt, Artificial Sequence
  MKO10049457_A_Slc39a3
  gRNA
ggccaccagaagcuucguca

SEQ ID NO: 49458 - RNA, 20 nt, Artificial Sequence
  MKO10049458_A_Slc39a3
  gRNA
ggaguacgagagcccguucg

SEQ ID NO: 49459 - RNA, 20 nt, Artificial Sequence
  MKO10049459_A_Slc39a3
  gRNA
aucaugagcgucuccgccag

SEQ ID NO: 49460 - RNA, 20 nt, Artificial Sequence
  MKO10049460_A_Slc39a4
  gRNA
cucaccaugcagcgugauau

SEQ ID NO: 49461 - RNA, 20 nt, Artificial Sequence
  MKO10049461_A_Slc39a4
  gRNA
cuaccccacuauccguauuc

SEQ ID NO: 49462 - RNA, 20 nt, Artificial Sequence
  MKO10049462_A_Slc39a4
  gRNA
ccucccaauaucacgcugca

SEQ ID NO: 49463 - RNA, 20 nt, Artificial Sequence
  MKO10049463_A_Slc39a5
  gRNA
ccaccaagcaccgacagucc

SEQ ID NO: 49464 - RNA, 20 nt, Artificial Sequence
  MKO10049464_A_Slc39a5
  gRNA
ucugcuguuggaccauucgu

SEQ ID NO: 49465 - RNA, 20 nt, Artificial Sequence
  MKO10049465_A_Slc39a5
  gRNA
cacagcagagcgaacugacg

SEQ ID NO: 49466 - RNA, 20 nt, Artificial Sequence
  MKO10049466_A_Slc39a6
  gRNA
aucgccacucagcguuccga

SEQ ID NO: 49467 - RNA, 20 nt, Artificial Sequence
  MKO10049467_A_Slc39a6
  gRNA
cuggccgucggaacgcugag

SEQ ID NO: 49468 - RNA, 20 nt, Artificial Sequence
  MKO10049468_A_Slc39a6
  gRNA
cuucuauauucugagccgac

SEQ ID NO: 49469 - RNA, 20 nt, Artificial Sequence
  MKO10049469_A_Slc39a7
  gRNA
ucacaaauuucuccaccacg

SEQ ID NO: 49470 - RNA, 20 nt, Artificial Sequence
  MKO10049470_A_Slc39a7
  gRNA
agguuucaccgggccaucuc

SEQ ID NO: 49471 - RNA, 20 nt, Artificial Sequence
  MKO10049471_A_Slc39a7
  gRNA
aaauuugugagacacgugaa

SEQ ID NO: 49472 - RNA, 20 nt, Artificial Sequence
  MKO10049472_A_Slc39a8
  gRNA
caacgcugacagugucgaag

SEQ ID NO: 49473 - RNA, 20 nt, Artificial Sequence
  MKO10049473_A_Slc39a8
  gRNA
uccgguaccuucggaaagac

SEQ ID NO: 49474 - RNA, 20 nt, Artificial Sequence
  MKO10049474_A_Slc39a8
  gRNA
gucagugacaauuaucaauc

SEQ ID NO: 49475 - RNA, 20 nt, Artificial Sequence
  MKO10049475_A_Slc39a9
  gRNA
ugcacuggcggucaucgucc

SEQ ID NO: 49476 - RNA, 20 nt, Artificial Sequence
  MKO10049476_A_Slc39a9
  gRNA
uugccacgaacacaauuaac

SEQ ID NO: 49477 - RNA, 20 nt, Artificial Sequence
  MKO10049477_A_Slc39a9
  gRNA
uguccaguuaauuguguucg

SEQ ID NO: 49478 - RNA, 20 nt, Artificial Sequence
  MKO10049478_A_Slc3a1
  gRNA
cgcuccguguccuacucgau

SEQ ID NO: 49479 - RNA, 20 nt, Artificial Sequence
  MKO10049479_A_Slc3a1
  gRNA
gggugguuacaccguugaca

SEQ ID NO: 49480 - RNA, 20 nt, Artificial Sequence
  MKO10049480_A_Slc3a1
  gRNA
agacuucagauacgcuguug

SEQ ID NO: 49481 - RNA, 20 nt, Artificial Sequence
  MKO10049481_A_Slc3a2
  gRNA
cgcccgaacgaugauaacca

SEQ ID NO: 49482 - RNA, 20 nt, Artificial Sequence
  MKO10049482_A_Slc3a2
  gRNA
aagggcgcccucuaccgcau

SEQ ID NO: 49483 - RNA, 20 nt, Artificial Sequence
  MKO10049483_A_Slc3a2
  gRNA
ugugaauugggccuaacacc

SEQ ID NO: 49484 - RNA, 20 nt, Artificial Sequence
  MKO10049484_A_Slc40a1
  gRNA
ccacugcgaucacaauccaa

SEQ ID NO: 49485 - RNA, 20 nt, Artificial Sequence
  MKO10049485_A_Slc40a1
  gRNA
ucugaaccaccagugacguc

SEQ ID NO: 49486 - RNA, 20 nt, Artificial Sequence
  MKO10049486_A_Slc40a1
  gRNA
uguuuaagggggaucggaug

SEQ ID NO: 49487 - RNA, 20 nt, Artificial Sequence
  MKO10049487_A_Slc41a1
  gRNA
uccaucgcagccgucgucuu

SEQ ID NO: 49488 - RNA, 20 nt, Artificial Sequence
  MKO10049488_A_Slc41a1
  gRNA
caguggacagccucgacgcc

SEQ ID NO: 49489 - RNA, 20 nt, Artificial Sequence
  MKO10049489_A_Slc41a1
  gRNA
cacgcccaucgccgcuagcc

SEQ ID NO: 49490 - RNA, 20 nt, Artificial Sequence
  MKO10049490_A_Slc41a2
  gRNA
cccgcgcuucuuggucuuaa

SEQ ID NO: 49491 - RNA, 20 nt, Artificial Sequence
  MKO10049491_A_Slc41a2
  gRNA
uaacucucgccauauuagcu

SEQ ID NO: 49492 - RNA, 20 nt, Artificial Sequence
  MKO10049492_A_Slc41a2
  gRNA
uccuuuaagaccaagaagcg

SEQ ID NO: 49493 - RNA, 20 nt, Artificial Sequence
  MKO10049493_A_Slc41a3
  gRNA
gccaccccucgucggucuga

SEQ ID NO: 49494 - RNA, 20 nt, Artificial Sequence
  MKO10049494_A_Slc41a3
  gRNA
aaaucgaugaccgccaggag

SEQ ID NO: 49495 - RNA, 20 nt, Artificial Sequence
  MKO10049495_A_Slc41a3
  gRNA
ugucccacgaggaguucgau

SEQ ID NO: 49496 - RNA, 20 nt, Artificial Sequence
  MKO10049496_A_Slc43a1
  gRNA
cccaggccucuucgacuggu

SEQ ID NO: 49497 - RNA, 20 nt, Artificial Sequence
  MKO10049497_A_Slc43a1
  gRNA
gaauucucauggaccgcuuu

SEQ ID NO: 49498 - RNA, 20 nt, Artificial Sequence
  MKO10049498_A_Slc43a1
  gRNA
cuuaacguuuaccucacuca

SEQ ID NO: 49499 - RNA, 20 nt, Artificial Sequence
  MKO10049499_A_Slc43a2
  gRNA
ccgaaggucgccgaacauau

SEQ ID NO: 49500 - RNA, 20 nt, Artificial Sequence
  MKO10049500_A_Slc43a2
  gRNA
cagcgcagagccggaacccg

SEQ ID NO: 49501 - RNA, 20 nt, Artificial Sequence
  MKO10049501_A_Slc43a2
  gRNA
ucauggacaaguauggucca

SEQ ID NO: 49502 - RNA, 20 nt, Artificial Sequence
  MKO10049502_A_Slc43a3
  gRNA
guauuccuaccuuaaugacg

SEQ ID NO: 49503 - RNA, 20 nt, Artificial Sequence
  MKO10049503_A_Slc43a3
  gRNA
agcaguguuccucgucauua

SEQ ID NO: 49504 - RNA, 20 nt, Artificial Sequence
  MKO10049504_A_Slc43a3
  gRNA
ucucccagauuuaaaagcgc

SEQ ID NO: 49505 - RNA, 20 nt, Artificial Sequence
  MKO10049505_A_Slc44a1
  gRNA
cguagcagcauguccucgac

SEQ ID NO: 49506 - RNA, 20 nt, Artificial Sequence
  MKO10049506_A_Slc44a1
  gRNA
cuggaagcaauaccgaacag

SEQ ID NO: 49507 - RNA, 20 nt, Artificial Sequence
  MKO10049507_A_Slc44a1
  gRNA
cuacucacuuccggugggug

SEQ ID NO: 49508 - RNA, 20 nt, Artificial Sequence
  MKO10049508_A_Slc44a2
  gRNA
uuugcccacagaauucgccc

SEQ ID NO: 49509 - RNA, 20 nt, Artificial Sequence
  MKO10049509_A_Slc44a2
  gRNA
gugggguagaucaccuuccg

SEQ ID NO: 49510 - RNA, 20 nt, Artificial Sequence
  MKO10049510_A_Slc44a2
  gRNA
cacagccacauagccuacga

SEQ ID NO: 49511 - RNA, 20 nt, Artificial Sequence
  MKO10049511_A_Slc44a3
  gRNA
gaaaaugcaccgauacaccg

SEQ ID NO: 49512 - RNA, 20 nt, Artificial Sequence
  MKO10049512_A_Slc44a3
  gRNA
ucagcaccuaccguugaugu

SEQ ID NO: 49513 - RNA, 20 nt, Artificial Sequence
  MKO10049513_A_Slc44a3
  gRNA
aggagccccccucuccgggc

SEQ ID NO: 49514 - RNA, 20 nt, Artificial Sequence
  MKO10049514_A_Slc44a4
  gRNA
gaugucgaaguauagaacgu

SEQ ID NO: 49515 - RNA, 20 nt, Artificial Sequence
  MKO10049515_A_Slc44a4
  gRNA
guugucgcccacgccgcagu

SEQ ID NO: 49516 - RNA, 20 nt, Artificial Sequence
  MKO10049516_A_Slc44a4
  gRNA
ucgaaaggaggggucauauu

SEQ ID NO: 49517 - RNA, 20 nt, Artificial Sequence
  MKO10049517_A_Slc44a5
  gRNA
cuacguucuguuaggacucu

SEQ ID NO: 49518 - RNA, 20 nt, Artificial Sequence
  MKO10049518_A_Slc44a5
  gRNA
aaaugucccuggcuguccgu

SEQ ID NO: 49519 - RNA, 20 nt, Artificial Sequence
  MKO10049519_A_Slc44a5
  gRNA
caggaaaauggccuauccua

SEQ ID NO: 49520 - RNA, 20 nt, Artificial Sequence
  MKO10049520_A_Slc45a1
  gRNA
acagagauugcgcagcgccu

SEQ ID NO: 49521 - RNA, 20 nt, Artificial Sequence
  MKO10049521_A_Slc45a1
  gRNA
ugugugcggcccgguagacc

SEQ ID NO: 49522 - RNA, 20 nt, Artificial Sequence
  MKO10049522_A_Slc45a1
  gRNA
gucucucggggaugcuaauc

SEQ ID NO: 49523 - RNA, 20 nt, Artificial Sequence
  MKO10049523_A_Slc45a2
  gRNA
cuacggugcacacaacucca

SEQ ID NO: 49524 - RNA, 20 nt, Artificial Sequence
  MKO10049524_A_Slc45a2
  gRNA
ugacgcaaaggcagcgauaa

SEQ ID NO: 49525 - RNA, 20 nt, Artificial Sequence
  MKO10049525_A_Slc45a2
  gRNA
cuuugcgucagccaccugau

SEQ ID NO: 49526 - RNA, 20 nt, Artificial Sequence
  MKO10049526_A_Slc45a3
  gRNA
gccccgucccguaacaaccc

SEQ ID NO: 49527 - RNA, 20 nt, Artificial Sequence
  MKO10049527_A_Slc45a3
  gRNA
ggccauagcgcccacgccac

SEQ ID NO: 49528 - RNA, 20 nt, Artificial Sequence
  MKO10049528_A_Slc45a3
  gRNA
cgaugcugcccaugccacgu

SEQ ID NO: 49529 - RNA, 20 nt, Artificial Sequence
  MKO10049529_A_Slc45a4
  gRNA
cccggcgguaucgguagcag

SEQ ID NO: 49530 - RNA, 20 nt, Artificial Sequence
  MKO10049530_A_Slc45a4
  gRNA
cccacugcuaccgauaccgc

SEQ ID NO: 49531 - RNA, 20 nt, Artificial Sequence
  MKO10049531_A_Slc45a4
  gRNA
gcuguaccuccuugauguca

SEQ ID NO: 49532 - RNA, 20 nt, Artificial Sequence
  MKO10049532_A_Slc46a1
  gRNA
gcaaugggcggcgacccacg

SEQ ID NO: 49533 - RNA, 20 nt, Artificial Sequence
  MKO10049533_A_Slc46a1
  gRNA
caggcgucgugaccaaugac

SEQ ID NO: 49534 - RNA, 20 nt, Artificial Sequence
  MKO10049534_A_Slc46a1
  gRNA
cgugggucgccgcccauugc

SEQ ID NO: 49535 - RNA, 20 nt, Artificial Sequence
  MKO10049535_A_Slc46a2
  gRNA
caucccgauuaugaucaucg

SEQ ID NO: 49536 - RNA, 20 nt, Artificial Sequence
  MKO10049536_A_Slc46a2
  gRNA
ggaguaguccugcgucguag

SEQ ID NO: 49537 - RNA, 20 nt, Artificial Sequence
  MKO10049537_A_Slc46a2
  gRNA
caagaucuaucagcuuacgc

SEQ ID NO: 49538 - RNA, 20 nt, Artificial Sequence
  MKO10049538_A_Slc46a3
  gRNA
uugggaauuacaccacguuc

SEQ ID NO: 49539 - RNA, 20 nt, Artificial Sequence
  MKO10049539_A_Slc46a3
  gRNA
acuucgaccucugcguacag

SEQ ID NO: 49540 - RNA, 20 nt, Artificial Sequence
  MKO10049540_A_Slc46a3
  gRNA
gcugcucgcuaaaagcauga

SEQ ID NO: 49541 - RNA, 20 nt, Artificial Sequence
  MKO10049541_A_Slc47a1
  gRNA
ugaagaucaugacguaaguc

SEQ ID NO: 49542 - RNA, 20 nt, Artificial Sequence
  MKO10049542_A_Slc47a1
  gRNA
uguaaacucacaggaagcgc

SEQ ID NO: 49543 - RNA, 20 nt, Artificial Sequence
  MKO10049543_A_Slc47a1
  gRNA
ggaugagugucccccuuugc

SEQ ID NO: 49544 - RNA, 20 nt, Artificial Sequence
  MKO10049544_A_Slc47a2
  gRNA
cguccaacucgacuuugccc

SEQ ID NO: 49545 - RNA, 20 nt, Artificial Sequence
  MKO10049545_A_Slc47a2
  gRNA
uacggaaacagcgaguguca

SEQ ID NO: 49546 - RNA, 20 nt, Artificial Sequence
  MKO10049546_A_Slc47a2
  gRNA
aggcaagaacuugaagcgcg

SEQ ID NO: 49547 - RNA, 20 nt, Artificial Sequence
  MKO10049547_A_Slc48a1
  gRNA
gcggcgauggggggucucgc

SEQ ID NO: 49548 - RNA, 20 nt, Artificial Sequence
  MKO10049548_A_Slc48a1
  gRNA
gcugcgcggcuucuucuucg

SEQ ID NO: 49549 - RNA, 20 nt, Artificial Sequence
  MKO10049549_A_Slc48a1
  gRNA
gccggcuaccgagcugaagc

SEQ ID NO: 49550 - RNA, 20 nt, Artificial Sequence
  MKO10049550_A_Slc4a10
  gRNA
augagauuugcuggcgugaa

SEQ ID NO: 49551 - RNA, 20 nt, Artificial Sequence
  MKO10049551_A_Slc4a10
  gRNA
gaaaaagccaucgucgucac

SEQ ID NO: 49552 - RNA, 20 nt, Artificial Sequence
  MKO10049552_A_Slc4a10
  gRNA
cacgaugccugugacgacga

SEQ ID NO: 49553 - RNA, 20 nt, Artificial Sequence
  MKO10049553_A_Slc4a11
  gRNA
gguccgugcacaccgggacc

SEQ ID NO: 49554 - RNA, 20 nt, Artificial Sequence
  MKO10049554_A_Slc4a11
  gRNA
caaagcgguuuagcauaguu

SEQ ID NO: 49555 - RNA, 20 nt, Artificial Sequence
  MKO10049555_A_Slc4a11
  gRNA
gcucuuacacaccucucgca

SEQ ID NO: 49556 - RNA, 20 nt, Artificial Sequence
  MKO10049556_A_Slc4a1ap
  gRNA
caaggcuucuuugaccgaga

SEQ ID NO: 49557 - RNA, 20 nt, Artificial Sequence
  MKO10049557_A_Slc4a1ap
  gRNA
agcaaugguacagugcucgc

SEQ ID NO: 49558 - RNA, 20 nt, Artificial Sequence
  MKO10049558_A_Slc4a1ap
  gRNA
cugccggguccuugauacac

SEQ ID NO: 49559 - RNA, 20 nt, Artificial Sequence
  MKO10049559_A_Slc4a1
  gRNA
cccauacaccauccucucga

SEQ ID NO: 49560 - RNA, 20 nt, Artificial Sequence
  MKO10049560_A_Slc4a1
  gRNA
ucuagacugcuucaucuacg

SEQ ID NO: 49561 - RNA, 20 nt, Artificial Sequence
  MKO10049561_A_Slc4a1
  gRNA
guccucaccugaccggagcu

SEQ ID NO: 49562 - RNA, 20 nt, Artificial Sequence
  MKO10049562_A_Slc4a2
  gRNA
ccgccgucgcaagacucccc

SEQ ID NO: 49563 - RNA, 20 nt, Artificial Sequence
  MKO10049563_A_Slc4a2
  gRNA
ccuggggagucuugcgacgg

SEQ ID NO: 49564 - RNA, 20 nt, Artificial Sequence
  MKO10049564_A_Slc4a2
  gRNA
cucgaaccgcuccacaccua

SEQ ID NO: 49565 - RNA, 20 nt, Artificial Sequence
  MKO10049565_A_Slc4a3
  gRNA
cugggcacaaucgcucccgc

SEQ ID NO: 49566 - RNA, 20 nt, Artificial Sequence
  MKO10049566_A_Slc4a3
  gRNA
agucccgcucgcuguagcug

SEQ ID NO: 49567 - RNA, 20 nt, Artificial Sequence
  MKO10049567_A_Slc4a3
  gRNA
acuaguaccugccggagcgc

SEQ ID NO: 49568 - RNA, 20 nt, Artificial Sequence
  MKO10049568_A_Slc4a4
  gRNA
ggucaccacacgaucuacau

SEQ ID NO: 49569 - RNA, 20 nt, Artificial Sequence
  MKO10049569_A_Slc4a4
  gRNA
ggaccccaauguagaucgug

SEQ ID NO: 49570 - RNA, 20 nt, Artificial Sequence
  MKO10049570_A_Slc4a4
  gRNA
gcgauggagcaaaccccaug

SEQ ID NO: 49571 - RNA, 20 nt, Artificial Sequence
  MKO10049571_A_Slc4a5
  gRNA
gggucagcuacgugcuccug

SEQ ID NO: 49572 - RNA, 20 nt, Artificial Sequence
  MKO10049572_A_Slc4a5
  gRNA
auucgacaaagcaccagcua

SEQ ID NO: 49573 - RNA, 20 nt, Artificial Sequence
  MKO10049573_A_Slc4a5
  gRNA
ccgacuucccgaugucugca

SEQ ID NO: 49574 - RNA, 20 nt, Artificial Sequence
  MKO10049574_A_Slc4a7
  gRNA
ggucaucgagcuguauaugu

SEQ ID NO: 49575 - RNA, 20 nt, Artificial Sequence
  MKO10049575_A_Slc4a7
  gRNA
caucgucgucuucagucccg

SEQ ID NO: 49576 - RNA, 20 nt, Artificial Sequence
  MKO10049576_A_Slc4a7
  gRNA
cgggacugaagacgacgaug

SEQ ID NO: 49577 - RNA, 20 nt, Artificial Sequence
  MKO10049577_A_Slc4a8
  gRNA
caugcgugcaaguagcauag

SEQ ID NO: 49578 - RNA, 20 nt, Artificial Sequence
  MKO10049578_A_Slc4a8
  gRNA
ggguucggaugccgcugggg

SEQ ID NO: 49579 - RNA, 20 nt, Artificial Sequence
  MKO10049579_A_Slc4a8
  gRNA
caucggcaccaccgcacuca

SEQ ID NO: 49580 - RNA, 20 nt, Artificial Sequence
  MKO10049580_A_Slc4a9
  gRNA
aggauuccgcagucuuacga

SEQ ID NO: 49581 - RNA, 20 nt, Artificial Sequence
  MKO10049581_A_Slc4a9
  gRNA
acugcggaauccuauagugc

SEQ ID NO: 49582 - RNA, 20 nt, Artificial Sequence
  MKO10049582_A_Slc4a9
  gRNA
agcuagacaugggcgcgggc

SEQ ID NO: 49583 - RNA, 20 nt, Artificial Sequence
  MKO10049583_A_Slc50a1
  gRNA
ccuuaucaucgucaauagcg

SEQ ID NO: 49584 - RNA, 20 nt, Artificial Sequence
  MKO10049584_A_Slc50a1
  gRNA
ccacgcuauugacgaugaua

SEQ ID NO: 49585 - RNA, 20 nt, Artificial Sequence
  MKO10049585_A_Slc50a1
  gRNA
ugauuuagucugaacgaucu

SEQ ID NO: 49586 - RNA, 20 nt, Artificial Sequence
  MKO10049586_A_Slc51a
  gRNA
cccuuugccccaucaagaag

SEQ ID NO: 49587 - RNA, 20 nt, Artificial Sequence
  MKO10049587_A_Slc51a
  gRNA
gcccaccucucauacuuacc

SEQ ID NO: 49588 - RNA, 20 nt, Artificial Sequence
  MKO10049588_A_Slc51a
  gRNA
caccccgaugagggugcaca

SEQ ID NO: 49589 - RNA, 20 nt, Artificial Sequence
  MKO10049589_A_Slc51b
  gRNA
accaggauggaauaauucca

SEQ ID NO: 49590 - RNA, 20 nt, Artificial Sequence
  MKO10049590_A_Slc51b
  gRNA
uccuuggaauuauuccaucc

SEQ ID NO: 49591 - RNA, 20 nt, Artificial Sequence
  MKO10049591_A_Slc51b
  gRNA
ucaucaagaugcaggucuuc

SEQ ID NO: 49592 - RNA, 20 nt, Artificial Sequence
  MKO10049592_A_Slc52a2
  gRNA
aucuaccgaguauuucgcag

SEQ ID NO: 49593 - RNA, 20 nt, Artificial Sequence
  MKO10049593_A_Slc52a2
  gRNA
uucccgaagugccugucuac

SEQ ID NO: 49594 - RNA, 20 nt, Artificial Sequence
  MKO10049594_A_Slc52a2
  gRNA
cuaccacuuggcugucguac

SEQ ID NO: 49595 - RNA, 20 nt, Artificial Sequence
  MKO10049595_A_Slc52a3
  gRNA
cgggucggaagcggugcauc

SEQ ID NO: 49596 - RNA, 20 nt, Artificial Sequence
  MKO10049596_A_Slc52a3
  gRNA
aggcagccgugccuacgcac

SEQ ID NO: 49597 - RNA, 20 nt, Artificial Sequence
  MKO10049597_A_Slc52a3
  gRNA
gggacggcaaggcuccauag

SEQ ID NO: 49598 - RNA, 20 nt, Artificial Sequence
  MKO10049598_A_Slc5a10
  gRNA
agccggccaauccuacgaag

SEQ ID NO: 49599 - RNA, 20 nt, Artificial Sequence
  MKO10049599_A_Slc5a10
  gRNA
gaauacauucagaagcgcuu

SEQ ID NO: 49600 - RNA, 20 nt, Artificial Sequence
  MKO10049600_A_Slc5a10
  gRNA
cuuccuggcgggccgggaca

SEQ ID NO: 49601 - RNA, 20 nt, Artificial Sequence
  MKO10049601_A_Slc5a11
  gRNA
aagcgccgccuuagauauuc

SEQ ID NO: 49602 - RNA, 20 nt, Artificial Sequence
  MKO10049602_A_Slc5a11
  gRNA
accuggccagcaauguagau

SEQ ID NO: 49603 - RNA, 20 nt, Artificial Sequence
  MKO10049603_A_Slc5a11
  gRNA
uccuuguucgccagcaaugu

SEQ ID NO: 49604 - RNA, 20 nt, Artificial Sequence
  MKO10049604_A_Slc5a12
  gRNA
cguggucuacgccccugcuc

SEQ ID NO: 49605 - RNA, 20 nt, Artificial Sequence
  MKO10049605_A_Slc5a12
  gRNA
cgucuguacgauguagauaa

SEQ ID NO: 49606 - RNA, 20 nt, Artificial Sequence
  MKO10049606_A_Slc5a12
  gRNA
uugcacauucuacuguaguu

SEQ ID NO: 49607 - RNA, 20 nt, Artificial Sequence
  MKO10049607_A_Slc5a1
  gRNA
uaucugcggaagcgguuugg

SEQ ID NO: 49608 - RNA, 20 nt, Artificial Sequence
  MKO10049608_A_Slc5a1
  gRNA
cgugcagguggugacgaugc

SEQ ID NO: 49609 - RNA, 20 nt, Artificial Sequence
  MKO10049609_A_Slc5a1
  gRNA
caggccgaaguauggugugg

SEQ ID NO: 49610 - RNA, 20 nt, Artificial Sequence
  MKO10049610_A_Slc5a2
  gRNA
caguaccuccgcaagcgcuu

SEQ ID NO: 49611 - RNA, 20 nt, Artificial Sequence
  MKO10049611_A_Slc5a2
  gRNA
guucccacaggcgcucuucg

SEQ ID NO: 49612 - RNA, 20 nt, Artificial Sequence
  MKO10049612_A_Slc5a2
  gRNA
augaccgcugccgauguugc

SEQ ID NO: 49613 - RNA, 20 nt, Artificial Sequence
  MKO10049613_A_Slc5a3
  gRNA
caauauugcuuacccacgcc

SEQ ID NO: 49614 - RNA, 20 nt, Artificial Sequence
  MKO10049614_A_Slc5a3
  gRNA
cauuggggcgcucacacuua

SEQ ID NO: 49615 - RNA, 20 nt, Artificial Sequence
  MKO10049615_A_Slc5a3
  gRNA
ggauaaguuuguacacaucg

SEQ ID NO: 49616 - RNA, 20 nt, Artificial Sequence
  MKO10049616_A_Slc5a4a
  gRNA
aagacgaaccgaagcacugu

SEQ ID NO: 49617 - RNA, 20 nt, Artificial Sequence
  MKO10049617_A_Slc5a4a
  gRNA
caguggccacuucgugggcc

SEQ ID NO: 49618 - RNA, 20 nt, Artificial Sequence
  MKO10049618_A_Slc5a4a
  gRNA
uggcaggucgaucuaugacu

SEQ ID NO: 49619 - RNA, 20 nt, Artificial Sequence
  MKO10049619_A_Slc5a4b
  gRNA
cagcaaucacuucgugggcu

SEQ ID NO: 49620 - RNA, 20 nt, Artificial Sequence
  MKO10049620_A_Slc5a4b
  gRNA
ugaccaugccagaguaucuc

SEQ ID NO: 49621 - RNA, 20 nt, Artificial Sequence
  MKO10049621_A_Slc5a4b
  gRNA
ucaauggugagaagcaaccg

SEQ ID NO: 49622 - RNA, 20 nt, Artificial Sequence
  MKO10049622_A_Slc5a5
  gRNA
cucggcugaagcgcaguucu

SEQ ID NO: 49623 - RNA, 20 nt, Artificial Sequence
  MKO10049623_A_Slc5a5
  gRNA
acuuaccacggucguguaca

SEQ ID NO: 49624 - RNA, 20 nt, Artificial Sequence
  MKO10049624_A_Slc5a5
  gRNA
ugguaaugcucgucggcuuc

SEQ ID NO: 49625 - RNA, 20 nt, Artificial Sequence
  MKO10049625_A_Slc5a6
  gRNA
ggaauccuuaccugcauuga

SEQ ID NO: 49626 - RNA, 20 nt, Artificial Sequence
  MKO10049626_A_Slc5a6
  gRNA
cauccuauaggugauauaca

SEQ ID NO: 49627 - RNA, 20 nt, Artificial Sequence
  MKO10049627_A_Slc5a6
  gRNA
cuuacuuaaucccagagaug

SEQ ID NO: 49628 - RNA, 20 nt, Artificial Sequence
  MKO10049628_A_Slc5a7
  gRNA
ugcgaaaccuaugcguucca

SEQ ID NO: 49629 - RNA, 20 nt, Artificial Sequence
  MKO10049629_A_Slc5a7
  gRNA
aaucaguugaagucuacacc

SEQ ID NO: 49630 - RNA, 20 nt, Artificial Sequence
  MKO10049630_A_Slc5a7
  gRNA
cacagcugugaauccgaugu

SEQ ID NO: 49631 - RNA, 20 nt, Artificial Sequence
  MKO10049631_A_Slc5a8
  gRNA
gcggucuuaaagcaguuguc

SEQ ID NO: 49632 - RNA, 20 nt, Artificial Sequence
  MKO10049632_A_Slc5a8
  gRNA
aaucgaugcauucgucucug

SEQ ID NO: 49633 - RNA, 20 nt, Artificial Sequence
  MKO10049633_A_Slc5a8
  gRNA
uuacuguuugaacgaugaag

SEQ ID NO: 49634 - RNA, 20 nt, Artificial Sequence
  MKO10049634_A_Slc5a9
  gRNA
ucauccauccgugcaagucg

SEQ ID NO: 49635 - RNA, 20 nt, Artificial Sequence
  MKO10049635_A_Slc5a9
  gRNA
caguggcuuauuuaucggcc

SEQ ID NO: 49636 - RNA, 20 nt, Artificial Sequence
  MKO10049636_A_Slc5a9
  gRNA
caguaccugaagaaacgauu

SEQ ID NO: 49637 - RNA, 20 nt, Artificial Sequence
  MKO10049637_A_Slc6a11
  gRNA
ucuggggcaguucacgagcg

SEQ ID NO: 49638 - RNA, 20 nt, Artificial Sequence
  MKO10049638_A_Slc6a11
  gRNA
ggguacuaagucgacuggaa

SEQ ID NO: 49639 - RNA, 20 nt, Artificial Sequence
  MKO10049639_A_Slc6a11
  gRNA
acugccccagagccguuucc

SEQ ID NO: 49640 - RNA, 20 nt, Artificial Sequence
  MKO10049640_A_Slc6a12
  gRNA
auuggccacgauccuucacc

SEQ ID NO: 49641 - RNA, 20 nt, Artificial Sequence
  MKO10049641_A_Slc6a12
  gRNA
ggacaaccugcaccaacucg

SEQ ID NO: 49642 - RNA, 20 nt, Artificial Sequence
  MKO10049642_A_Slc6a12
  gRNA
gauaccuguguuccacgagu

SEQ ID NO: 49643 - RNA, 20 nt, Artificial Sequence
  MKO10049643_A_Slc6a13
  gRNA
ugucuacuacaucguugucc

SEQ ID NO: 49644 - RNA, 20 nt, Artificial Sequence
  MKO10049644_A_Slc6a13
  gRNA
auucucggaggucacauuca

SEQ ID NO: 49645 - RNA, 20 nt, Artificial Sequence
  MKO10049645_A_Slc6a13
  gRNA
acaggaccaguucccagcgc

SEQ ID NO: 49646 - RNA, 20 nt, Artificial Sequence
  MKO10049646_A_Slc6a14
  gRNA
gaaaggccuaccuccgccau

SEQ ID NO: 49647 - RNA, 20 nt, Artificial Sequence
  MKO10049647_A_Slc6a14
  gRNA
ucauccgagaacuuccaugu

SEQ ID NO: 49648 - RNA, 20 nt, Artificial Sequence
  MKO10049648_A_Slc6a14
  gRNA
uuacucccaauacuguucac

SEQ ID NO: 49649 - RNA, 20 nt, Artificial Sequence
  MKO10049649_A_Slc6a15
  gRNA
gccguauuuaauacuacuuc

SEQ ID NO: 49650 - RNA, 20 nt, Artificial Sequence
  MKO10049650_A_Slc6a15
  gRNA
gugggucaaagaauucgaag

SEQ ID NO: 49651 - RNA, 20 nt, Artificial Sequence
  MKO10049651_A_Slc6a15
  gRNA
caguucucuguuccccuacg

SEQ ID NO: 49652 - RNA, 20 nt, Artificial Sequence
  MKO10049652_A_Slc6a17
  gRNA
gcacuaugugugcccccgcc

SEQ ID NO: 49653 - RNA, 20 nt, Artificial Sequence
  MKO10049653_A_Slc6a17
  gRNA
gugggccagaggauccgccg

SEQ ID NO: 49654 - RNA, 20 nt, Artificial Sequence
  MKO10049654_A_Slc6a17
  gRNA
uguaguacagcccaacgaag

SEQ ID NO: 49655 - RNA, 20 nt, Artificial Sequence
  MKO10049655_A_Slc6a18
  gRNA
ggacccgcuuguggacauug

SEQ ID NO: 49656 - RNA, 20 nt, Artificial Sequence
  MKO10049656_A_Slc6a18
  gRNA
agagcguaccuacgccaccg

SEQ ID NO: 49657 - RNA, 20 nt, Artificial Sequence
  MKO10049657_A_Slc6a18
  gRNA
cuccaaugcuuccccuccgu

SEQ ID NO: 49658 - RNA, 20 nt, Artificial Sequence
  MKO10049658_A_Slc6a19os
  gRNA
cagcuccucucuacgcaugc

SEQ ID NO: 49659 - RNA, 20 nt, Artificial Sequence
  MKO10049659_A_Slc6a19os
  gRNA
uuggaccagcaugcguagag

SEQ ID NO: 49660 - RNA, 20 nt, Artificial Sequence
  MKO10049660_A_Slc6a19os
  gRNA
uguucacgauguugaccacu

SEQ ID NO: 49661 - RNA, 20 nt, Artificial Sequence
  MKO10049661_A_Slc6a19
  gRNA
cuugcguagccucugaccga

SEQ ID NO: 49662 - RNA, 20 nt, Artificial Sequence
  MKO10049662_A_Slc6a19
  gRNA
caucggucagaggcuacgca

SEQ ID NO: 49663 - RNA, 20 nt, Artificial Sequence
  MKO10049663_A_Slc6a19
  gRNA
cgaugaugguguuguaguac

SEQ ID NO: 49664 - RNA, 20 nt, Artificial Sequence
  MKO10049664_A_Slc6a1
  gRNA
caccaacaugaccagcgccg

SEQ ID NO: 49665 - RNA, 20 nt, Artificial Sequence
  MKO10049665_A_Slc6a1
  gRNA
gcgccagcuuccauacgccc

SEQ ID NO: 49666 - RNA, 20 nt, Artificial Sequence
  MKO10049666_A_Slc6a1
  gRNA
cacccgcaaagaugagcguc

SEQ ID NO: 49667 - RNA, 20 nt, Artificial Sequence
  MKO10049667_A_Slc6a20a
  gRNA
acuccucaucguagccugug

SEQ ID NO: 49668 - RNA, 20 nt, Artificial Sequence
  MKO10049668_A_Slc6a20a
  gRNA
acccaccuugccaguagauu

SEQ ID NO: 49669 - RNA, 20 nt, Artificial Sequence
  MKO10049669_A_Slc6a20a
  gRNA
acuacaaugucaucaaugcc

SEQ ID NO: 49670 - RNA, 20 nt, Artificial Sequence
  MKO10049670_A_Slc6a20b
  gRNA
ccuuucaggcauugcuagcu

SEQ ID NO: 49671 - RNA, 20 nt, Artificial Sequence
  MKO10049671_A_Slc6a20b
  gRNA
ccugugugauuacuauucag

SEQ ID NO: 49672 - RNA, 20 nt, Artificial Sequence
  MKO10049672_A_Slc6a20b
  gRNA
ccacugaauaguaaucacac

SEQ ID NO: 49673 - RNA, 20 nt, Artificial Sequence
  MKO10049673_A_Slc6a2
  gRNA
ucuggggcaauacaaccggg

SEQ ID NO: 49674 - RNA, 20 nt, Artificial Sequence
  MKO10049674_A_Slc6a2
  gRNA
cacccagcaccgaggcguug

SEQ ID NO: 49675 - RNA, 20 nt, Artificial Sequence
  MKO10049675_A_Slc6a2
  gRNA
uacucauaaaacuccgcagc

SEQ ID NO: 49676 - RNA, 20 nt, Artificial Sequence
  MKO10049676_A_Slc6a3
  gRNA
cugcaccuccaucagagucg

SEQ ID NO: 49677 - RNA, 20 nt, Artificial Sequence
  MKO10049677_A_Slc6a3
  gRNA
cauagcagcaacucuagcga

SEQ ID NO: 49678 - RNA, 20 nt, Artificial Sequence
  MKO10049678_A_Slc6a3
  gRNA
gccccucuucuacauggagc

SEQ ID NO: 49679 - RNA, 20 nt, Artificial Sequence
  MKO10049679_A_Slc6a4
  gRNA
gaugagguaguagagcgccc

SEQ ID NO: 49680 - RNA, 20 nt, Artificial Sequence
  MKO10049680_A_Slc6a4
  gRNA
aggagucaaaacgucuggca

SEQ ID NO: 49681 - RNA, 20 nt, Artificial Sequence
  MKO10049681_A_Slc6a4
  gRNA
cugggccaguaccaccgaaa

SEQ ID NO: 49682 - RNA, 20 nt, Artificial Sequence
  MKO10049682_A_Slc6a5
  gRNA
ugccuauccgaacuugacaa

SEQ ID NO: 49683 - RNA, 20 nt, Artificial Sequence
  MKO10049683_A_Slc6a5
  gRNA
aagccguaccucccccguuc

SEQ ID NO: 49684 - RNA, 20 nt, Artificial Sequence
  MKO10049684_A_Slc6a5
  gRNA
cccgcugacaaaugucuuau

SEQ ID NO: 49685 - RNA, 20 nt, Artificial Sequence
  MKO10049685_A_Slc6a6
  gRNA
agugacucucguuccuacgc

SEQ ID NO: 49686 - RNA, 20 nt, Artificial Sequence
  MKO10049686_A_Slc6a6
  gRNA
ugacgauguaguacacguuc

SEQ ID NO: 49687 - RNA, 20 nt, Artificial Sequence
  MKO10049687_A_Slc6a6
  gRNA
uacccugacaucagccgccu

SEQ ID NO: 49688 - RNA, 20 nt, Artificial Sequence
  MKO10049688_A_Slc6a7
  gRNA
cagccagggcaucggccgac

SEQ ID NO: 49689 - RNA, 20 nt, Artificial Sequence
  MKO10049689_A_Slc6a7
  gRNA
gcccacgcaguagccgaugc

SEQ ID NO: 49690 - RNA, 20 nt, Artificial Sequence
  MKO10049690_A_Slc6a7
  gRNA
agguuccagcgaaucucccc

SEQ ID NO: 49691 - RNA, 20 nt, Artificial Sequence
  MKO10049691_A_Slc6a8
  gRNA
gacccuagcuuugaccaguc

SEQ ID NO: 49692 - RNA, 20 nt, Artificial Sequence
  MKO10049692_A_Slc6a8
  gRNA
cucguugugcugcuggugcg

SEQ ID NO: 49693 - RNA, 20 nt, Artificial Sequence
  MKO10049693_A_Slc6a8
  gRNA
ggccuggggcuucuauuacc

SEQ ID NO: 49694 - RNA, 20 nt, Artificial Sequence
  MKO10049694_A_Slc6a9
  gRNA
ucgucaguacaaacucgauc

SEQ ID NO: 49695 - RNA, 20 nt, Artificial Sequence
  MKO10049695_A_Slc6a9
  gRNA
cgaguuuguacugacgagcg

SEQ ID NO: 49696 - RNA, 20 nt, Artificial Sequence
  MKO10049696_A_Slc6a9
  gRNA
gggguuguugcaguacgccc

SEQ ID NO: 49697 - RNA, 20 nt, Artificial Sequence
  MKO10049697_A_Slc7a10
  gRNA
gcgcguggcccagcguacgc

SEQ ID NO: 49698 - RNA, 20 nt, Artificial Sequence
  MKO10049698_A_Slc7a10
  gRNA
ugaacagcuccagcguacgc

SEQ ID NO: 49699 - RNA, 20 nt, Artificial Sequence
  MKO10049699_A_Slc7a10
  gRNA
ccaccaaugccuucgccuuc

SEQ ID NO: 49700 - RNA, 20 nt, Artificial Sequence
  MKO10049700_A_Slc7a11
  gRNA
agcugacacucgugcuauuu

SEQ ID NO: 49701 - RNA, 20 nt, Artificial Sequence
  MKO10049701_A_Slc7a11
  gRNA
gcuuguaccuaauucugcau

SEQ ID NO: 49702 - RNA, 20 nt, Artificial Sequence
  MKO10049702_A_Slc7a11
  gRNA
uaaauagcacgagugucagc

SEQ ID NO: 49703 - RNA, 20 nt, Artificial Sequence
  MKO10049703_A_Slc7a12
  gRNA
ugaugauccuagauaugagu

SEQ ID NO: 49704 - RNA, 20 nt, Artificial Sequence
  MKO10049704_A_Slc7a12
  gRNA
auuuaccugcuaugacgaug

SEQ ID NO: 49705 - RNA, 20 nt, Artificial Sequence
  MKO10049705_A_Slc7a12
  gRNA
uggcuucaagcuaaccuuaa

SEQ ID NO: 49706 - RNA, 20 nt, Artificial Sequence
  MKO10049706_A_Slc7a13
  gRNA
gguaacugucguguacuuac

SEQ ID NO: 49707 - RNA, 20 nt, Artificial Sequence
  MKO10049707_A_Slc7a13
  gRNA
acuagcuuguuucucggccc

SEQ ID NO: 49708 - RNA, 20 nt, Artificial Sequence
  MKO10049708_A_Slc7a13
  gRNA
accguucacauucauagcgu

SEQ ID NO: 49709 - RNA, 20 nt, Artificial Sequence
  MKO10049709_A_Slc7a14
  gRNA
ucugugucaauggcguaaua

SEQ ID NO: 49710 - RNA, 20 nt, Artificial Sequence
  MKO10049710_A_Slc7a14
  gRNA
uggguguucaucaugaucgc

SEQ ID NO: 49711 - RNA, 20 nt, Artificial Sequence
  MKO10049711_A_Slc7a14
  gRNA
uugauucuggaguaccugau

SEQ ID NO: 49712 - RNA, 20 nt, Artificial Sequence
  MKO10049712_A_Slc7a15
  gRNA
agugaugacugccguccccc

SEQ ID NO: 49713 - RNA, 20 nt, Artificial Sequence
  MKO10049713_A_Slc7a15
  gRNA
ucgcagcugcauagcacacg

SEQ ID NO: 49714 - RNA, 20 nt, Artificial Sequence
  MKO10049714_A_Slc7a15
  gRNA
ugcuaugcagcugcgagaga

SEQ ID NO: 49715 - RNA, 20 nt, Artificial Sequence
  MKO10049715_A_Slc7a1
  gRNA
cucgucaaaagucgcacucc

SEQ ID NO: 49716 - RNA, 20 nt, Artificial Sequence
  MKO10049716_A_Slc7a1
  gRNA
agcgacacaaacgugaaaua

SEQ ID NO: 49717 - RNA, 20 nt, Artificial Sequence
  MKO10049717_A_Slc7a1
  gRNA
cugacgugagaacucuccga

SEQ ID NO: 49718 - RNA, 20 nt, Artificial Sequence
  MKO10049718_A_Slc7a2
  gRNA
cuuucgcgcgaugucugauc

SEQ ID NO: 49719 - RNA, 20 nt, Artificial Sequence
  MKO10049719_A_Slc7a2
  gRNA
gaagucgccaaagccgauuc

SEQ ID NO: 49720 - RNA, 20 nt, Artificial Sequence
  MKO10049720_A_Slc7a2
  gRNA
uuuauuaagaaguucgucga

SEQ ID NO: 49721 - RNA, 20 nt, Artificial Sequence
  MKO10049721_A_Slc7a3
  gRNA
cucuaaccuacaagugccgu

SEQ ID NO: 49722 - RNA, 20 nt, Artificial Sequence
  MKO10049722_A_Slc7a3
  gRNA
cugggagccugcccgcuacu

SEQ ID NO: 49723 - RNA, 20 nt, Artificial Sequence
  MKO10049723_A_Slc7a3
  gRNA
ccacaucucucggacucuga

SEQ ID NO: 49724 - RNA, 20 nt, Artificial Sequence
  MKO10049724_A_Slc7a4
  gRNA
gccgcgcauugucuacgcca

SEQ ID NO: 49725 - RNA, 20 nt, Artificial Sequence
  MKO10049725_A_Slc7a4
  gRNA
ccauggacacguacgugaau

SEQ ID NO: 49726 - RNA, 20 nt, Artificial Sequence
  MKO10049726_A_Slc7a4
  gRNA
ccgugaaguugcgaaugcug

SEQ ID NO: 49727 - RNA, 20 nt, Artificial Sequence
  MKO10049727_A_Slc7a5
  gRNA
uacagcggccucuucgccua

SEQ ID NO: 49728 - RNA, 20 nt, Artificial Sequence
  MKO10049728_A_Slc7a5
  gRNA
cagaaccuaccauccuccgu

SEQ ID NO: 49729 - RNA, 20 nt, Artificial Sequence
  MKO10049729_A_Slc7a5
  gRNA
ccgugugcaggacgccuuug

SEQ ID NO: 49730 - RNA, 20 nt, Artificial Sequence
  MKO10049730_A_Slc7a6os
  gRNA
uccguaaagagggccgcuac

SEQ ID NO: 49731 - RNA, 20 nt, Artificial Sequence
  MKO10049731_A_Slc7a6os
  gRNA
uuuacggaccucgcgcaccg

SEQ ID NO: 49732 - RNA, 20 nt, Artificial Sequence
  MKO10049732_A_Slc7a6os
  gRNA
cuguagaguugauccgugag

SEQ ID NO: 49733 - RNA, 20 nt, Artificial Sequence
  MKO10049733_A_Slc7a6
  gRNA
aacugaacaugccgaauguc

SEQ ID NO: 49734 - RNA, 20 nt, Artificial Sequence
  MKO10049734_A_Slc7a6
  gRNA
ugcauuuaggcccccgaagc

SEQ ID NO: 49735 - RNA, 20 nt, Artificial Sequence
  MKO10049735_A_Slc7a6
  gRNA
acgccuuuaaagguuccucg

SEQ ID NO: 49736 - RNA, 20 nt, Artificial Sequence
  MKO10049736_A_Slc7a7
  gRNA
uaccacggcaacagcgucac

SEQ ID NO: 49737 - RNA, 20 nt, Artificial Sequence
  MKO10049737_A_Slc7a7
  gRNA
caagagaaugcaaccgcuac

SEQ ID NO: 49738 - RNA, 20 nt, Artificial Sequence
  MKO10049738_A_Slc7a7
  gRNA
cagcgccaacaccuuagcau

SEQ ID NO: 49739 - RNA, 20 nt, Artificial Sequence
  MKO10049739_A_Slc7a8
  gRNA
cucauugucuggaucgugac

SEQ ID NO: 49740 - RNA, 20 nt, Artificial Sequence
  MKO10049740_A_Slc7a8
  gRNA
aggagucgcagaccggacuc

SEQ ID NO: 49741 - RNA, 20 nt, Artificial Sequence
  MKO10049741_A_Slc7a8
  gRNA
gagggcgaugacagcuuggu

SEQ ID NO: 49742 - RNA, 20 nt, Artificial Sequence
  MKO10049742_A_Slc7a9
  gRNA
cagugaaugcgcuaagcgug

SEQ ID NO: 49743 - RNA, 20 nt, Artificial Sequence
  MKO10049743_A_Slc7a9
  gRNA
gagcacuuaccaaccaucgu

SEQ ID NO: 49744 - RNA, 20 nt, Artificial Sequence
  MKO10049744_A_Slc7a9
  gRNA
ugaguaccccuaucugaugg

SEQ ID NO: 49745 - RNA, 20 nt, Artificial Sequence
  MKO10049745_A_Slc8a1
  gRNA
gucgcccccucugcgcauaa

SEQ ID NO: 49746 - RNA, 20 nt, Artificial Sequence
  MKO10049746_A_Slc8a1
  gRNA
ccaucugcguuguguucgcg

SEQ ID NO: 49747 - RNA, 20 nt, Artificial Sequence
  MKO10049747_A_Slc8a1
  gRNA
uuagguggcuucacauuaac

SEQ ID NO: 49748 - RNA, 20 nt, Artificial Sequence
  MKO10049748_A_Slc8a2
  gRNA
cgucgaugaucccgaugcgc

SEQ ID NO: 49749 - RNA, 20 nt, Artificial Sequence
  MKO10049749_A_Slc8a2
  gRNA
ccgaugaugauuccacugcg

SEQ ID NO: 49750 - RNA, 20 nt, Artificial Sequence
  MKO10049750_A_Slc8a2
  gRNA
uaccgcaccgacccucgcag

SEQ ID NO: 49751 - RNA, 20 nt, Artificial Sequence
  MKO10049751_A_Slc8a3
  gRNA
uacccgaauuguaguugugc

SEQ ID NO: 49752 - RNA, 20 nt, Artificial Sequence
  MKO10049752_A_Slc8a3
  gRNA
cggugagcaugccaauaaug

SEQ ID NO: 49753 - RNA, 20 nt, Artificial Sequence
  MKO10049753_A_Slc8a3
  gRNA
caugcucaccgccaucaucg

SEQ ID NO: 49754 - RNA, 20 nt, Artificial Sequence
  MKO10049754_A_Slc8b1
  gRNA
cugauacuggagacggcguc

SEQ ID NO: 49755 - RNA, 20 nt, Artificial Sequence
  MKO10049755_A_Slc8b1
  gRNA
uucucagacccacguacugc

SEQ ID NO: 49756 - RNA, 20 nt, Artificial Sequence
  MKO10049756_A_Slc8b1
  gRNA
gaauccggacugccgcagcg

SEQ ID NO: 49757 - RNA, 20 nt, Artificial Sequence
  MKO10049757_A_Slc9a1
  gRNA
ucucuccgacgcccuugauc

SEQ ID NO: 49758 - RNA, 20 nt, Artificial Sequence
  MKO10049758_A_Slc9a1
  gRNA
uccgacucacgccaugauuc

SEQ ID NO: 49759 - RNA, 20 nt, Artificial Sequence
  MKO10049759_A_Slc9a1
  gRNA
uucuccgugaacugccgcag

SEQ ID NO: 49760 - RNA, 20 nt, Artificial Sequence
  MKO10049760_A_Slc9a2
  gRNA
caucgcuaacuucuucgucg

SEQ ID NO: 49761 - RNA, 20 nt, Artificial Sequence
  MKO10049761_A_Slc9a2
  gRNA
cagcucuccggcacgauugu

SEQ ID NO: 49762 - RNA, 20 nt, Artificial Sequence
  MKO10049762_A_Slc9a2
  gRNA
cugccugaucuggcgagcac

SEQ ID NO: 49763 - RNA, 20 nt, Artificial Sequence
  MKO10049763_A_Slc9a3r1
  gRNA
gcuuagacuugucgcugugc

SEQ ID NO: 49764 - RNA, 20 nt, Artificial Sequence
  MKO10049764_A_Slc9a3r1
  gRNA
gguccacugcucggaugaac

SEQ ID NO: 49765 - RNA, 20 nt, Artificial Sequence
  MKO10049765_A_Slc9a3r1
  gRNA
ugccuccagcgauaccagug

SEQ ID NO: 49766 - RNA, 20 nt, Artificial Sequence
  MKO10049766_A_Slc9a3r2
  gRNA
cgagguugucgccagaauca

SEQ ID NO: 49767 - RNA, 20 nt, Artificial Sequence
  MKO10049767_A_Slc9a3r2
  gRNA
uggccaguacauccgcucug

SEQ ID NO: 49768 - RNA, 20 nt, Artificial Sequence
  MKO10049768_A_Slc9a3r2
  gRNA
ccugggguccccuucgcaag

SEQ ID NO: 49769 - RNA, 20 nt, Artificial Sequence
  MKO10049769_A_Slc9a3
  gRNA
caugugcguaucaucgagcc

SEQ ID NO: 49770 - RNA, 20 nt, Artificial Sequence
  MKO10049770_A_Slc9a3
  gRNA
gagugcucuacucaucguuc

SEQ ID NO: 49771 - RNA, 20 nt, Artificial Sequence
  MKO10049771_A_Slc9a3
  gRNA
cucgaugauacgcacaugcu

SEQ ID NO: 49772 - RNA, 20 nt, Artificial Sequence
  MKO10049772_A_Slc9a4
  gRNA
caucucagcggucgaccccg

SEQ ID NO: 49773 - RNA, 20 nt, Artificial Sequence
  MKO10049773_A_Slc9a4
  gRNA
cacccaccacaaaucgccuc

SEQ ID NO: 49774 - RNA, 20 nt, Artificial Sequence
  MKO10049774_A_Slc9a4
  gRNA
gcaccccacgaugacgaauc

SEQ ID NO: 49775 - RNA, 20 nt, Artificial Sequence
  MKO10049775_A_Slc9a5
  gRNA
ugccauccucaccuacgccg

SEQ ID NO: 49776 - RNA, 20 nt, Artificial Sequence
  MKO10049776_A_Slc9a5
  gRNA
cucgaugaugcggacccgcu

SEQ ID NO: 49777 - RNA, 20 nt, Artificial Sequence
  MKO10049777_A_Slc9a5
  gRNA
aauacugaccgacgcccuuu

SEQ ID NO: 49778 - RNA, 20 nt, Artificial Sequence
  MKO10049778_A_Slc9a6
  gRNA
gaaugccguaccgaagcacg

SEQ ID NO: 49779 - RNA, 20 nt, Artificial Sequence
  MKO10049779_A_Slc9a6
  gRNA
auuguuucagccaccgaccc

SEQ ID NO: 49780 - RNA, 20 nt, Artificial Sequence
  MKO10049780_A_Slc9a6
  gRNA
aaaaucucccgcgagcugcc

SEQ ID NO: 49781 - RNA, 20 nt, Artificial Sequence
  MKO10049781_A_Slc9a7
  gRNA
cccuggcaagaucaacaacg

SEQ ID NO: 49782 - RNA, 20 nt, Artificial Sequence
  MKO10049782_A_Slc9a7
  gRNA
uccacguuguugaucuugcc

SEQ ID NO: 49783 - RNA, 20 nt, Artificial Sequence
  MKO10049783_A_Slc9a7
  gRNA
acagguaacauuugauccag

SEQ ID NO: 49784 - RNA, 20 nt, Artificial Sequence
  MKO10049784_A_Slc9a8
  gRNA
cuuauucaccuaggacgagg

SEQ ID NO: 49785 - RNA, 20 nt, Artificial Sequence
  MKO10049785_A_Slc9a8
  gRNA
cgcucgacugcuccuccugc

SEQ ID NO: 49786 - RNA, 20 nt, Artificial Sequence
  MKO10049786_A_Slc9a8
  gRNA
ccaccuauuaucuuugaguc

SEQ ID NO: 49787 - RNA, 20 nt, Artificial Sequence
  MKO10049787_A_Slc9a9
  gRNA
gcgccgacugauauugauag

SEQ ID NO: 49788 - RNA, 20 nt, Artificial Sequence
  MKO10049788_A_Slc9a9
  gRNA
auguugacuaguagaguuga

SEQ ID NO: 49789 - RNA, 20 nt, Artificial Sequence
  MKO10049789_A_Slc9a9
  gRNA
cacuuacccuaugaccacac

SEQ ID NO: 49790 - RNA, 20 nt, Artificial Sequence
  MKO10049790_A_Slc9b1
  gRNA
acuauuauccuaguacgagc

SEQ ID NO: 49791 - RNA, 20 nt, Artificial Sequence
  MKO10049791_A_Slc9b1
  gRNA
guccaagcccagcucguacu

SEQ ID NO: 49792 - RNA, 20 nt, Artificial Sequence
  MKO10049792_A_Slc9b1
  gRNA
gagaacuucuugaccuauaa

SEQ ID NO: 49793 - RNA, 20 nt, Artificial Sequence
  MKO10049793_A_Slc9b2
  gRNA
cggacgcuaucauugaugac

SEQ ID NO: 49794 - RNA, 20 nt, Artificial Sequence
  MKO10049794_A_Slc9b2
  gRNA
cagucaucaaugauagcguc

SEQ ID NO: 49795 - RNA, 20 nt, Artificial Sequence
  MKO10049795_A_Slc9b2
  gRNA
cguucguuaucacucuugcc

SEQ ID NO: 49796 - RNA, 20 nt, Artificial Sequence
  MKO10049796_A_Slc9c1
  gRNA
guauggcaucugcauauauc

SEQ ID NO: 49797 - RNA, 20 nt, Artificial Sequence
  MKO10049797_A_Slc9c1
  gRNA
cauguauauauccaugucga

SEQ ID NO: 49798 - RNA, 20 nt, Artificial Sequence
  MKO10049798_A_Slc9c1
  gRNA
guacuuaccaaggucucuua

SEQ ID NO: 49799 - RNA, 20 nt, Artificial Sequence
  MKO10049799_A_Slco1a1
  gRNA
cuaauaggaaauacuaugcg

SEQ ID NO: 49800 - RNA, 20 nt, Artificial Sequence
  MKO10049800_A_Slco1a1
  gRNA
uaccuagccaaaucacuauc

SEQ ID NO: 49801 - RNA, 20 nt, Artificial Sequence
  MKO10049801_A_Slco1a1
  gRNA
auaaacuccugauagugauu

SEQ ID NO: 49802 - RNA, 20 nt, Artificial Sequence
  MKO10049802_A_Slco1a4
  gRNA
gauaagcccaacuacagacg

SEQ ID NO: 49803 - RNA, 20 nt, Artificial Sequence
  MKO10049803_A_Slco1a4
  gRNA
ucgauauuaagaaacacccc

SEQ ID NO: 49804 - RNA, 20 nt, Artificial Sequence
  MKO10049804_A_Slco1a4
  gRNA
aggaugugcaguuaugggcc

SEQ ID NO: 49805 - RNA, 20 nt, Artificial Sequence
  MKO10049805_A_Slco1a5
  gRNA
gauauccccacaucuauagu

SEQ ID NO: 49806 - RNA, 20 nt, Artificial Sequence
  MKO10049806_A_Slco1a5
  gRNA
agaauacuuaccggcccaug

SEQ ID NO: 49807 - RNA, 20 nt, Artificial Sequence
  MKO10049807_A_Slco1a5
  gRNA
aagccaacgcaagacccugc

SEQ ID NO: 49808 - RNA, 20 nt, Artificial Sequence
  MKO10049808_A_Slco1a6
  gRNA
cccucuuucagguaaccuuu

SEQ ID NO: 49809 - RNA, 20 nt, Artificial Sequence
  MKO10049809_A_Slco1a6
  gRNA
gugauauuaugaaacacccu

SEQ ID NO: 49810 - RNA, 20 nt, Artificial Sequence
  MKO10049810_A_Slco1a6
  gRNA
guaaacuccugauaguauuu

SEQ ID NO: 49811 - RNA, 20 nt, Artificial Sequence
  MKO10049811_A_Slco1b2
  gRNA
cuacaccgaccaaagcugau

SEQ ID NO: 49812 - RNA, 20 nt, Artificial Sequence
  MKO10049812_A_Slco1b2
  gRNA
ggaacaugcuucgugggaua

SEQ ID NO: 49813 - RNA, 20 nt, Artificial Sequence
  MKO10049813_A_Slco1b2
  gRNA
gaaaccccaauagugccccu

SEQ ID NO: 49814 - RNA, 20 nt, Artificial Sequence
  MKO10049814_A_Slco1c1
  gRNA
uaguuccgaagcccaugacc

SEQ ID NO: 49815 - RNA, 20 nt, Artificial Sequence
  MKO10049815_A_Slco1c1
  gRNA
cauccagauaggcgaugccc

SEQ ID NO: 49816 - RNA, 20 nt, Artificial Sequence
  MKO10049816_A_Slco1c1
  gRNA
agcuaacaaacguuaugacc

SEQ ID NO: 49817 - RNA, 20 nt, Artificial Sequence
  MKO10049817_A_Slco2a1
  gRNA
aguugucgacgcguacugau

SEQ ID NO: 49818 - RNA, 20 nt, Artificial Sequence
  MKO10049818_A_Slco2a1
  gRNA
gugaaccgcccacggaugau

SEQ ID NO: 49819 - RNA, 20 nt, Artificial Sequence
  MKO10049819_A_Slco2a1
  gRNA
accacuaucgagaagcgcuu

SEQ ID NO: 49820 - RNA, 20 nt, Artificial Sequence
  MKO10049820_A_Slco2b1
  gRNA
gugcacagaccccggaugau

SEQ ID NO: 49821 - RNA, 20 nt, Artificial Sequence
  MKO10049821_A_Slco2b1
  gRNA
gugggcaaagucgucaaugu

SEQ ID NO: 49822 - RNA, 20 nt, Artificial Sequence
  MKO10049822_A_Slco2b1
  gRNA
ccgugcauaccuugauguug

SEQ ID NO: 49823 - RNA, 20 nt, Artificial Sequence
  MKO10049823_A_Slco3a1
  gRNA
ccuauauugacgaccacgug

SEQ ID NO: 49824 - RNA, 20 nt, Artificial Sequence
  MKO10049824_A_Slco3a1
  gRNA
gggcaccgaccgcgccucau

SEQ ID NO: 49825 - RNA, 20 nt, Artificial Sequence
  MKO10049825_A_Slco3a1
  gRNA
ggguacggugggcgccuacc

SEQ ID NO: 49826 - RNA, 20 nt, Artificial Sequence
  MKO10049826_A_Slco4a1
  gRNA
cucucauaacaacguagcgc

SEQ ID NO: 49827 - RNA, 20 nt, Artificial Sequence
  MKO10049827_A_Slco4a1
  gRNA
ggucuccuuaccgaacaggg

SEQ ID NO: 49828 - RNA, 20 nt, Artificial Sequence
  MKO10049828_A_Slco4a1
  gRNA
cggaggcacucaagcugaac

SEQ ID NO: 49829 - RNA, 20 nt, Artificial Sequence
  MKO10049829_A_Slco4c1
  gRNA
ugucguagcucgaugauauc

SEQ ID NO: 49830 - RNA, 20 nt, Artificial Sequence
  MKO10049830_A_Slco4c1
  gRNA
agagaggacacaaaccucgc

SEQ ID NO: 49831 - RNA, 20 nt, Artificial Sequence
  MKO10049831_A_Slco4c1
  gRNA
ggcuauucuaugucaauccu

SEQ ID NO: 49832 - RNA, 20 nt, Artificial Sequence
  MKO10049832_A_Slco5a1
  gRNA
gucaucgucgauaacgacau

SEQ ID NO: 49833 - RNA, 20 nt, Artificial Sequence
  MKO10049833_A_Slco5a1
  gRNA
ggcacuuaccccguugugua

SEQ ID NO: 49834 - RNA, 20 nt, Artificial Sequence
  MKO10049834_A_Slco5a1
  gRNA
uaucgacgaugacaucauca

SEQ ID NO: 49835 - RNA, 20 nt, Artificial Sequence
  MKO10049835_A_Slco6b1
  gRNA
uugaugcgagcccuacuaga

SEQ ID NO: 49836 - RNA, 20 nt, Artificial Sequence
  MKO10049836_A_Slco6b1
  gRNA
gcaauacuuguagcgcacua

SEQ ID NO: 49837 - RNA, 20 nt, Artificial Sequence
  MKO10049837_A_Slco6b1
  gRNA
uacucaccagguaaacgaug

SEQ ID NO: 49838 - RNA, 20 nt, Artificial Sequence
  MKO10049838_A_Slco6c1
  gRNA
cuauucaagugaaccagcga

SEQ ID NO: 49839 - RNA, 20 nt, Artificial Sequence
  MKO10049839_A_Slco6c1
  gRNA
ggacauucugcauaucugau

SEQ ID NO: 49840 - RNA, 20 nt, Artificial Sequence
  MKO10049840_A_Slco6c1
  gRNA
uguaucuauuuccacaucgc

SEQ ID NO: 49841 - RNA, 20 nt, Artificial Sequence
  MKO10049841_A_Slco6d1
  gRNA
acuaucuccaucacggauag

SEQ ID NO: 49842 - RNA, 20 nt, Artificial Sequence
  MKO10049842_A_Slco6d1
  gRNA
aaguauuccucuauccguga

SEQ ID NO: 49843 - RNA, 20 nt, Artificial Sequence
  MKO10049843_A_Slco6d1
  gRNA
ccgcuaaaaacgacagaguc

SEQ ID NO: 49844 - RNA, 20 nt, Artificial Sequence
  MKO10049844_A_Slfn14
  gRNA
cuaacagaccccaguucgac

SEQ ID NO: 49845 - RNA, 20 nt, Artificial Sequence
  MKO10049845_A_Slfn14
  gRNA
gcuucugugaccccgauggg

SEQ ID NO: 49846 - RNA, 20 nt, Artificial Sequence
  MKO10049846_A_Slfn14
  gRNA
gccaucaacuugugcgccaa

SEQ ID NO: 49847 - RNA, 20 nt, Artificial Sequence
  MKO10049847_A_Slfn1
  gRNA
gccaggcgaugauacgcaag

SEQ ID NO: 49848 - RNA, 20 nt, Artificial Sequence
  MKO10049848_A_Slfn1
  gRNA
uccucuugcguaucaucgcc

SEQ ID NO: 49849 - RNA, 20 nt, Artificial Sequence
  MKO10049849_A_Slfn1
  gRNA
caaauaucccccgucagugu

SEQ ID NO: 49850 - RNA, 20 nt, Artificial Sequence
  MKO10049850_A_Slfn2
  gRNA
uuuauaucuacgugaaaucg

SEQ ID NO: 49851 - RNA, 20 nt, Artificial Sequence
  MKO10049851_A_Slfn2
  gRNA
aaucucggagcaaucacuuu

SEQ ID NO: 49852 - RNA, 20 nt, Artificial Sequence
  MKO10049852_A_Slfn2
  gRNA
ugacauggguacuagacuug

SEQ ID NO: 49853 - RNA, 20 nt, Artificial Sequence
  MKO10049853_A_Slfn3
  gRNA
uucaucgaagugcgcaaauc

SEQ ID NO: 49854 - RNA, 20 nt, Artificial Sequence
  MKO10049854_A_Slfn3
  gRNA
gaauccagaccaaguucacc

SEQ ID NO: 49855 - RNA, 20 nt, Artificial Sequence
  MKO10049855_A_Slfn3
  gRNA
cagauguuguuaaaccauug

SEQ ID NO: 49856 - RNA, 20 nt, Artificial Sequence
  MKO10049856_A_Slfn4
  gRNA
ccuaacauuaaagcagacgu

SEQ ID NO: 49857 - RNA, 20 nt, Artificial Sequence
  MKO10049857_A_Slfn4
  gRNA
aaugaacaucacugucgauc

SEQ ID NO: 49858 - RNA, 20 nt, Artificial Sequence
  MKO10049858_A_Slfn4
  gRNA
ggaggacggcaugccaagcg

SEQ ID NO: 49859 - RNA, 20 nt, Artificial Sequence
  MKO10049859_A_Slfn5
  gRNA
ucuggguagucacgucgugu

SEQ ID NO: 49860 - RNA, 20 nt, Artificial Sequence
  MKO10049860_A_Slfn5
  gRNA
accaguucccguccuccguu

SEQ ID NO: 49861 - RNA, 20 nt, Artificial Sequence
  MKO10049861_A_Slfn5
  gRNA
uugccaaagcgcccgauucc

SEQ ID NO: 49862 - RNA, 20 nt, Artificial Sequence
  MKO10049862_A_Slfn8
  gRNA
gcacgaccauuucacugcua

SEQ ID NO: 49863 - RNA, 20 nt, Artificial Sequence
  MKO10049863_A_Slfn8
  gRNA
agucacuucuccugcguaga

SEQ ID NO: 49864 - RNA, 20 nt, Artificial Sequence
  MKO10049864_A_Slfn8
  gRNA
aacccuuuagucucuuaugc

SEQ ID NO: 49865 - RNA, 20 nt, Artificial Sequence
  MKO10049865_A_Slfn9
  gRNA
guaagaccguuucaccacua

SEQ ID NO: 49866 - RNA, 20 nt, Artificial Sequence
  MKO10049866_A_Slfn9
  gRNA
aauccucuagucucucaugc

SEQ ID NO: 49867 - RNA, 20 nt, Artificial Sequence
  MKO10049867_A_Slfn9
  gRNA
ccugcauagaugaucaaauc

SEQ ID NO: 49868 - RNA, 20 nt, Artificial Sequence
  MKO10049868_A_Slfnl1
  gRNA
cacauacguagcgccgcaca

SEQ ID NO: 49869 - RNA, 20 nt, Artificial Sequence
  MKO10049869_A_Slfnl1
  gRNA
gagguauuucuaaggcgcga

SEQ ID NO: 49870 - RNA, 20 nt, Artificial Sequence
  MKO10049870_A_Slfnl1
  gRNA
cggaacauggaguuuaagcg

SEQ ID NO: 49871 - RNA, 20 nt, Artificial Sequence
  MKO10049871_A_Slirp
  gRNA
cagugcgcuuagccccuuua

SEQ ID NO: 49872 - RNA, 20 nt, Artificial Sequence
  MKO10049872_A_Slirp
  gRNA
agcgcacugcguuccaguac

SEQ ID NO: 49873 - RNA, 20 nt, Artificial Sequence
  MKO10049873_A_Slirp
  gRNA
uugcucuuugagcuugaacg

SEQ ID NO: 49874 - RNA, 20 nt, Artificial Sequence
  MKO10049874_A_Slit1
  gRNA
cgcguuccacagcuccgauc

SEQ ID NO: 49875 - RNA, 20 nt, Artificial Sequence
  MKO10049875_A_Slit1
  gRNA
acaacacucgaagcugcuug

SEQ ID NO: 49876 - RNA, 20 nt, Artificial Sequence
  MKO10049876_A_Slit1
  gRNA
auccacaagaaugacuuugc

SEQ ID NO: 49877 - RNA, 20 nt, Artificial Sequence
  MKO10049877_A_Slit2
  gRNA
acagaaucagcaccaucgag

SEQ ID NO: 49878 - RNA, 20 nt, Artificial Sequence
  MKO10049878_A_Slit2
  gRNA
gucccgagaaacagcagcuc

SEQ ID NO: 49879 - RNA, 20 nt, Artificial Sequence
  MKO10049879_A_Slit2
  gRNA
gugucucuuagggauuugaa

SEQ ID NO: 49880 - RNA, 20 nt, Artificial Sequence
  MKO10049880_A_Slit3
  gRNA
aucccgaggaaggcguucag

SEQ ID NO: 49881 - RNA, 20 nt, Artificial Sequence
  MKO10049881_A_Slit3
  gRNA
caagucagcaucaucgagag

SEQ ID NO: 49882 - RNA, 20 nt, Artificial Sequence
  MKO10049882_A_Slit3
  gRNA
acgccucugaacgccuuccu

SEQ ID NO: 49883 - RNA, 20 nt, Artificial Sequence
  MKO10049883_A_Slitrk1
  gRNA
cgcagaccacucgaccgauu

SEQ ID NO: 49884 - RNA, 20 nt, Artificial Sequence
  MKO10049884_A_Slitrk1
  gRNA
cuugcaugagaucguuccgg

SEQ ID NO: 49885 - RNA, 20 nt, Artificial Sequence
  MKO10049885_A_Slitrk1
  gRNA
cccacgccaccgauagcaac

SEQ ID NO: 49886 - RNA, 20 nt, Artificial Sequence
  MKO10049886_A_Slitrk2
  gRNA
ggccuauuaccgaaaucugc

SEQ ID NO: 49887 - RNA, 20 nt, Artificial Sequence
  MKO10049887_A_Slitrk2
  gRNA
uaaagaugcugagcggcguu

SEQ ID NO: 49888 - RNA, 20 nt, Artificial Sequence
  MKO10049888_A_Slitrk2
  gRNA
cagauaaagucuucguaaac

SEQ ID NO: 49889 - RNA, 20 nt, Artificial Sequence
  MKO10049889_A_Slitrk3
  gRNA
gcaacuucuuccuacgccga

SEQ ID NO: 49890 - RNA, 20 nt, Artificial Sequence
  MKO10049890_A_Slitrk3
  gRNA
gugaugguucaccgucacua

SEQ ID NO: 49891 - RNA, 20 nt, Artificial Sequence
  MKO10049891_A_Slitrk3
  gRNA
auacucguacacgugaccca

SEQ ID NO: 49892 - RNA, 20 nt, Artificial Sequence
  MKO10049892_A_Slitrk4
  gRNA
cuuuaaugcuaccaagucgc

SEQ ID NO: 49893 - RNA, 20 nt, Artificial Sequence
  MKO10049893_A_Slitrk4
  gRNA
gaguucccccgacuaccuac

SEQ ID NO: 49894 - RNA, 20 nt, Artificial Sequence
  MKO10049894_A_Slitrk4
  gRNA
guccuauucgaaguccuccu

SEQ ID NO: 49895 - RNA, 20 nt, Artificial Sequence
  MKO10049895_A_Slitrk5
  gRNA
ugcucucgaucuugcgcucu

SEQ ID NO: 49896 - RNA, 20 nt, Artificial Sequence
  MKO10049896_A_Slitrk5
  gRNA
uagguccucucggggcucga

SEQ ID NO: 49897 - RNA, 20 nt, Artificial Sequence
  MKO10049897_A_Slitrk5
  gRNA
gauuguaccugcgacguggu

SEQ ID NO: 49898 - RNA, 20 nt, Artificial Sequence
  MKO10049898_A_Slitrk6
  gRNA
cguugauguacucacgacca

SEQ ID NO: 49899 - RNA, 20 nt, Artificial Sequence
  MKO10049899_A_Slitrk6
  gRNA
aagagggucuuuccguugua

SEQ ID NO: 49900 - RNA, 20 nt, Artificial Sequence
  MKO10049900_A_Slitrk6
  gRNA
gacaaaaaccacgauccccg

SEQ ID NO: 49901 - RNA, 20 nt, Artificial Sequence
  MKO10049901_A_Slk
  gRNA
accugaaccccgaagaguuu

SEQ ID NO: 49902 - RNA, 20 nt, Artificial Sequence
  MKO10049902_A_Slk
  gRNA
aagguuguucucguaauaga

SEQ ID NO: 49903 - RNA, 20 nt, Artificial Sequence
  MKO10049903_A_Slk
  gRNA
uuuccguaagaucuucaagu

SEQ ID NO: 49904 - RNA, 20 nt, Artificial Sequence
  MKO10049904_A_Slmap
  gRNA
gugacggagaauacccggaa

SEQ ID NO: 49905 - RNA, 20 nt, Artificial Sequence
  MKO10049905_A_Slmap
  gRNA
ccgccaugcgaaauucuuuc

SEQ ID NO: 49906 - RNA, 20 nt, Artificial Sequence
  MKO10049906_A_Slmap
  gRNA
auacucacucugaacgaagu

SEQ ID NO: 49907 - RNA, 20 nt, Artificial Sequence
  MKO10049907_A_Slmo1
  gRNA
cccgaugaaccccugcgucg

SEQ ID NO: 49908 - RNA, 20 nt, Artificial Sequence
  MKO10049908_A_Slmo1
  gRNA
cggguuaggguacuuccgca

SEQ ID NO: 49909 - RNA, 20 nt, Artificial Sequence
  MKO10049909_A_Slmo1
  gRNA
caucaaagagcgcuccgucg

SEQ ID NO: 49910 - RNA, 20 nt, Artificial Sequence
  MKO10049910_A_Slmo2
  gRNA
acgucgacgccaaccacacu

SEQ ID NO: 49911 - RNA, 20 nt, Artificial Sequence
  MKO10049911_A_Slmo2
  gRNA
aaaccccaugaacccgagug

SEQ ID NO: 49912 - RNA, 20 nt, Artificial Sequence
  MKO10049912_A_Slmo2
  gRNA
agcuccauuguccucguuac

SEQ ID NO: 49913 - RNA, 20 nt, Artificial Sequence
  MKO10049913_A_Sln
  gRNA
gugagguccuaccaauacug

SEQ ID NO: 49914 - RNA, 20 nt, Artificial Sequence
  MKO10049914_A_Sln
  gRNA
ucaucaccguucuccuuaug

SEQ ID NO: 49915 - RNA, 20 nt, Artificial Sequence
  MKO10049915_A_Sln
  gRNA
gaagauggagaggucuacuc

SEQ ID NO: 49916 - RNA, 20 nt, Artificial Sequence
  MKO10049916_A_Slpi
  gRNA
cgucacacugcccgucccuc

SEQ ID NO: 49917 - RNA, 20 nt, Artificial Sequence
  MKO10049917_A_Slpi
  gRNA
agccacaaugccguacugac

SEQ ID NO: 49918 - RNA, 20 nt, Artificial Sequence
  MKO10049918_A_Slpi
  gRNA
uggcucaccugguuugcgaa

SEQ ID NO: 49919 - RNA, 20 nt, Artificial Sequence
  MKO10049919_A_Sltm
  gRNA
ucuaauguaggcuauugaag

SEQ ID NO: 49920 - RNA, 20 nt, Artificial Sequence
  MKO10049920_A_Sltm
  gRNA
acuuacuugagcuguuagaa

SEQ ID NO: 49921 - RNA, 20 nt, Artificial Sequence
  MKO10049921_A_Sltm
  gRNA
cucguaacaaccuuugccuu

SEQ ID NO: 49922 - RNA, 20 nt, Artificial Sequence
  MKO10049922_A_Slu7
  gRNA
gugguacaagcgaggcguaa

SEQ ID NO: 49923 - RNA, 20 nt, Artificial Sequence
  MKO10049923_A_Slu7
  gRNA
aauuuagcuccaacccgccu

SEQ ID NO: 49924 - RNA, 20 nt, Artificial Sequence
  MKO10049924_A_Slu7
  gRNA
auaacuaccaaguaccgcaa

SEQ ID NO: 49925 - RNA, 20 nt, Artificial Sequence
  MKO10049925_A_Slurp1
  gRNA
gucgguggccagacacgagc

SEQ ID NO: 49926 - RNA, 20 nt, Artificial Sequence
  MKO10049926_A_Slurp1
  gRNA
ugggcaacgccaaugccauc

SEQ ID NO: 49927 - RNA, 20 nt, Artificial Sequence
  MKO10049927_A_Slurp1
  gRNA
gcugcucacagguauagcau

SEQ ID NO: 49928 - RNA, 20 nt, Artificial Sequence
  MKO10049928_A_Slx1b
  gRNA
gcggccccacgugcgucagg

SEQ ID NO: 49929 - RNA, 20 nt, Artificial Sequence
  MKO10049929_A_Slx1b
  gRNA
uucacgccgccugacgcacg

SEQ ID NO: 49930 - RNA, 20 nt, Artificial Sequence
  MKO10049930_A_Slx1b
  gRNA
ccugguugggcagugccacg

SEQ ID NO: 49931 - RNA, 20 nt, Artificial Sequence
  MKO10049931_A_Slx4ip
  gRNA
gcagagaguucaccgucucc

SEQ ID NO: 49932 - RNA, 20 nt, Artificial Sequence
  MKO10049932_A_Slx4ip
  gRNA
ggugaacucucugcacacuc

SEQ ID NO: 49933 - RNA, 20 nt, Artificial Sequence
  MKO10049933_A_Slx4ip
  gRNA
agauaccuuaccaguauucu

SEQ ID NO: 49934 - RNA, 20 nt, Artificial Sequence
  MKO10049934_A_Slx4
  gRNA
aggaacgguuucccacauau

SEQ ID NO: 49935 - RNA, 20 nt, Artificial Sequence
  MKO10049935_A_Slx4
  gRNA
uacaccaguugucgugaaac

SEQ ID NO: 49936 - RNA, 20 nt, Artificial Sequence
  MKO10049936_A_Slx4
  gRNA
ccuuccuguuucacgacaac

SEQ ID NO: 49937 - RNA, 20 nt, Artificial Sequence
  MKO10049937_A_Slxl1
  gRNA
agaaaacguaaguuucucag

SEQ ID NO: 49938 - RNA, 20 nt, Artificial Sequence
  MKO10049938_A_Slxl1
  gRNA
uagagacaccaauagaaaac

SEQ ID NO: 49939 - RNA, 20 nt, Artificial Sequence
  MKO10049939_A_Slxl1
  gRNA
guaucuccaacgauuucuuc

SEQ ID NO: 49940 - RNA, 20 nt, Artificial Sequence
  MKO10049940_A_Slx
  gRNA
guaucuccaacuacuacuuc

SEQ ID NO: 49941 - RNA, 20 nt, Artificial Sequence
  MKO10049941_A_Slx
  gRNA
gcaaauccugaaguaguagu

SEQ ID NO: 49942 - RNA, 20 nt, Artificial Sequence
  MKO10049942_A_Slx
  gRNA
auaguaaagaggccagcauu

SEQ ID NO: 49943 - RNA, 20 nt, Artificial Sequence
  MKO10049943_A_Sly
  gRNA
aguaauaaguaaccuuccuu

SEQ ID NO: 49944 - RNA, 20 nt, Artificial Sequence
  MKO10049944_A_Sly
  gRNA
cugaguucuuaugagaagaa

SEQ ID NO: 49945 - RNA, 20 nt, Artificial Sequence
  MKO10049945_A_Sly
  gRNA
ucuucaucugcuucugcuug

SEQ ID NO: 49946 - RNA, 20 nt, Artificial Sequence
  MKO10049946_A_Smad1
  gRNA
cauacacggucucgaacccg

SEQ ID NO: 49947 - RNA, 20 nt, Artificial Sequence
  MKO10049947_A_Smad1
  gRNA
ccucuccuccaacguaauaa

SEQ ID NO: 49948 - RNA, 20 nt, Artificial Sequence
  MKO10049948_A_Smad1
  gRNA
cuaugagcucaacaaccgug

SEQ ID NO: 49949 - RNA, 20 nt, Artificial Sequence
  MKO10049949_A_Smad2
  gRNA
guuagaaucuccgugugccg

SEQ ID NO: 49950 - RNA, 20 nt, Artificial Sequence
  MKO10049950_A_Smad2
  gRNA
ucuaacagaacugccgcccc

SEQ ID NO: 49951 - RNA, 20 nt, Artificial Sequence
  MKO10049951_A_Smad2
  gRNA
cuucagguuucacaccggaa

SEQ ID NO: 49952 - RNA, 20 nt, Artificial Sequence
  MKO10049952_A_Smad3
  gRNA
gcuccauggcccguaauuca

SEQ ID NO: 49953 - RNA, 20 nt, Artificial Sequence
  MKO10049953_A_Smad3
  gRNA
accuaccuggaauauugcuc

SEQ ID NO: 49954 - RNA, 20 nt, Artificial Sequence
  MKO10049954_A_Smad3
  gRNA
gcaggucgggccaucgccac

SEQ ID NO: 49955 - RNA, 20 nt, Artificial Sequence
  MKO10049955_A_Smad4
  gRNA
gccaaguaaucgcgcaucaa

SEQ ID NO: 49956 - RNA, 20 nt, Artificial Sequence
  MKO10049956_A_Smad4
  gRNA
uccguugaugcgcgauuacu

SEQ ID NO: 49957 - RNA, 20 nt, Artificial Sequence
  MKO10049957_A_Smad4
  gRNA
acaacccgcucauagugaua

SEQ ID NO: 49958 - RNA, 20 nt, Artificial Sequence
  MKO10049958_A_Smad5
  gRNA
cuugacaaagcucauucgaa

SEQ ID NO: 49959 - RNA, 20 nt, Artificial Sequence
  MKO10049959_A_Smad5
  gRNA
gguguucaucuauacuacgu

SEQ ID NO: 49960 - RNA, 20 nt, Artificial Sequence
  MKO10049960_A_Smad5
  gRNA
ggauugaauucauugugacg

SEQ ID NO: 49961 - RNA, 20 nt, Artificial Sequence
  MKO10049961_A_Smad6
  gRNA
cuaccgagcggacuucggag

SEQ ID NO: 49962 - RNA, 20 nt, Artificial Sequence
  MKO10049962_A_Smad6
  gRNA
gcgacuuuggcgaagucgug

SEQ ID NO: 49963 - RNA, 20 nt, Artificial Sequence
  MKO10049963_A_Smad6
  gRNA
cuucgucaacuccccgacgc

SEQ ID NO: 49964 - RNA, 20 nt, Artificial Sequence
  MKO10049964_A_Smad7
  gRNA
ccaaacgaucugcgcucguc

SEQ ID NO: 49965 - RNA, 20 nt, Artificial Sequence
  MKO10049965_A_Smad7
  gRNA
uguccgaauugagcuguccg

SEQ ID NO: 49966 - RNA, 20 nt, Artificial Sequence
  MKO10049966_A_Smad7
  gRNA
gagcgccuucagauccgccu

SEQ ID NO: 49967 - RNA, 20 nt, Artificial Sequence
  MKO10049967_A_Smad9
  gRNA
gucuaugagcacgcuccgcg

SEQ ID NO: 49968 - RNA, 20 nt, Artificial Sequence
  MKO10049968_A_Smad9
  gRNA
ucaccgacccuuccaauaac

SEQ ID NO: 49969 - RNA, 20 nt, Artificial Sequence
  MKO10049969_A_Smad9
  gRNA
ugacgaagaugugcacgauu

SEQ ID NO: 49970 - RNA, 20 nt, Artificial Sequence
  MKO10049970_A_Smagp
  gRNA
accugcaaugagcgcugugc

SEQ ID NO: 49971 - RNA, 20 nt, Artificial Sequence
  MKO10049971_A_Smagp
  gRNA
cuuccaaguuguuaucaccg

SEQ ID NO: 49972 - RNA, 20 nt, Artificial Sequence
  MKO10049972_A_Smagp
  gRNA
cccagaauugaugaccacgc

SEQ ID NO: 49973 - RNA, 20 nt, Artificial Sequence
  MKO10049973_A_Smap1
  gRNA
uccuuaauuagguccccgau

SEQ ID NO: 49974 - RNA, 20 nt, Artificial Sequence
  MKO10049974_A_Smap1
  gRNA
auguuuaccuguaucuguuc

SEQ ID NO: 49975 - RNA, 20 nt, Artificial Sequence
  MKO10049975_A_Smap1
  gRNA
ucgaaaguucucuggaagau

SEQ ID NO: 49976 - RNA, 20 nt, Artificial Sequence
  MKO10049976_A_Smap2
  gRNA
gaugaacaccccgauguucc

SEQ ID NO: 49977 - RNA, 20 nt, Artificial Sequence
  MKO10049977_A_Smap2
  gRNA
acgagggaaugaacccgcuc

SEQ ID NO: 49978 - RNA, 20 nt, Artificial Sequence
  MKO10049978_A_Smap2
  gRNA
ucgggguguucaucugcauu

SEQ ID NO: 49979 - RNA, 20 nt, Artificial Sequence
  MKO10049979_A_Smarca1
  gRNA
uuucaccuagcuaucgccac

SEQ ID NO: 49980 - RNA, 20 nt, Artificial Sequence
  MKO10049980_A_Smarca1
  gRNA
aagcagagcuugauuuccgu

SEQ ID NO: 49981 - RNA, 20 nt, Artificial Sequence
  MKO10049981_A_Smarca1
  gRNA
cgagccaguuucauguugag

SEQ ID NO: 49982 - RNA, 20 nt, Artificial Sequence
  MKO10049982_A_Smarca2
  gRNA
ggcuccgauacuuaugauua

SEQ ID NO: 49983 - RNA, 20 nt, Artificial Sequence
  MKO10049983_A_Smarca2
  gRNA
gaagcaugacgucuuucucc

SEQ ID NO: 49984 - RNA, 20 nt, Artificial Sequence
  MKO10049984_A_Smarca2
  gRNA
gaaaagaagaggccgcccuc

SEQ ID NO: 49985 - RNA, 20 nt, Artificial Sequence
  MKO10049985_A_Smarca4
  gRNA
ccacccucaguguccgccac

SEQ ID NO: 49986 - RNA, 20 nt, Artificial Sequence
  MKO10049986_A_Smarca4
  gRNA
aggcauguucagagccgccg

SEQ ID NO: 49987 - RNA, 20 nt, Artificial Sequence
  MKO10049987_A_Smarca4
  gRNA
uauggaguccaugcacgaga

SEQ ID NO: 49988 - RNA, 20 nt, Artificial Sequence
  MKO10049988_A_Smarca5
  gRNA
caguuaccgacaccguagaa

SEQ ID NO: 49989 - RNA, 20 nt, Artificial Sequence
  MKO10049989_A_Smarca5
  gRNA
uaccaggaaguauuugauca

SEQ ID NO: 49990 - RNA, 20 nt, Artificial Sequence
  MKO10049990_A_Smarca5
  gRNA
uacauaccauuucaucugca

SEQ ID NO: 49991 - RNA, 20 nt, Artificial Sequence
  MKO10049991_A_Smarcad1
  gRNA
ucacuuacacgguccccucg

SEQ ID NO: 49992 - RNA, 20 nt, Artificial Sequence
  MKO10049992_A_Smarcad1
  gRNA
cagucuguaaaacagccgcg

SEQ ID NO: 49993 - RNA, 20 nt, Artificial Sequence
  MKO10049993_A_Smarcad1
  gRNA
ucauuucuucguguaacaga

SEQ ID NO: 49994 - RNA, 20 nt, Artificial Sequence
  MKO10049994_A_Smarcal1
  gRNA
caucucucgaguccgcuucg

SEQ ID NO: 49995 - RNA, 20 nt, Artificial Sequence
  MKO10049995_A_Smarcal1
  gRNA
ugacaucggcuauucggagg

SEQ ID NO: 49996 - RNA, 20 nt, Artificial Sequence
  MKO10049996_A_Smarcal1
  gRNA
acuccggaaagguccgcuuc

SEQ ID NO: 49997 - RNA, 20 nt, Artificial Sequence
  MKO10049997_A_Smarcb1
  gRNA
aacuaccugcguauguuccg

SEQ ID NO: 49998 - RNA, 20 nt, Artificial Sequence
  MKO10049998_A_Smarcb1
  gRNA
cuagucgccgccagagugag

SEQ ID NO: 49999 - RNA, 20 nt, Artificial Sequence
  MKO10049999_A_Smarcb1
  gRNA
gacggggaguucuacaugau

SEQ ID NO: 50000 - RNA, 20 nt, Artificial Sequence
  MKO10050000_A_Smarcc1
  gRNA
uuucaacguuacgauccauu

SEQ ID NO: 50001 - RNA, 20 nt, Artificial Sequence
  MKO10050001_A_Smarcc1
  gRNA
ucuucagaacccaucccgaa

SEQ ID NO: 50002 - RNA, 20 nt, Artificial Sequence
  MKO10050002_A_Smarcc1
  gRNA
ccuaccaauaaaacacuagc

SEQ ID NO: 50003 - RNA, 20 nt, Artificial Sequence
  MKO10050003_A_Smarcc2
  gRNA
agagccgcacguugucgaac

SEQ ID NO: 50004 - RNA, 20 nt, Artificial Sequence
  MKO10050004_A_Smarcc2
  gRNA
cgcaccgcuuacuaaacugc

SEQ ID NO: 50005 - RNA, 20 nt, Artificial Sequence
  MKO10050005_A_Smarcc2
  gRNA
ggccucguaguacuucacgu

SEQ ID NO: 50006 - RNA, 20 nt, Artificial Sequence
  MKO10050006_A_Smarcd1
  gRNA
cuaagucggacgcggaggau

SEQ ID NO: 50007 - RNA, 20 nt, Artificial Sequence
  MKO10050007_A_Smarcd1
  gRNA
uccuccgcguccgacuuagc

SEQ ID NO: 50008 - RNA, 20 nt, Artificial Sequence
  MKO10050008_A_Smarcd1
  gRNA
gccgcuuccucauaauaguc

SEQ ID NO: 50009 - RNA, 20 nt, Artificial Sequence
  MKO10050009_A_Smarcd2
  gRNA
cuccauccgcuugcgagcga

SEQ ID NO: 50010 - RNA, 20 nt, Artificial Sequence
  MKO10050010_A_Smarcd2
  gRNA
aauaggcuuacccucggcgc

SEQ ID NO: 50011 - RNA, 20 nt, Artificial Sequence
  MKO10050011_A_Smarcd2
  gRNA
accagaccaucgcucgcaag

SEQ ID NO: 50012 - RNA, 20 nt, Artificial Sequence
  MKO10050012_A_Smarcd3
  gRNA
acucaccugcggcuccgcgc

SEQ ID NO: 50013 - RNA, 20 nt, Artificial Sequence
  MKO10050013_A_Smarcd3
  gRNA
cagcgccccgggaugccguc

SEQ ID NO: 50014 - RNA, 20 nt, Artificial Sequence
  MKO10050014_A_Smarcd3
  gRNA
guccacccgcuuccgcauga

SEQ ID NO: 50015 - RNA, 20 nt, Artificial Sequence
  MKO10050015_A_Smarce1
  gRNA
uccuaccgugacccggcugu

SEQ ID NO: 50016 - RNA, 20 nt, Artificial Sequence
  MKO10050016_A_Smarce1
  gRNA
aaacuuacuguugcaggagc

SEQ ID NO: 50017 - RNA, 20 nt, Artificial Sequence
  MKO10050017_A_Smarce1
  gRNA
cagcaaaugcccagcacacc

SEQ ID NO: 50018 - RNA, 20 nt, Artificial Sequence
  MKO10050018_A_Smc1a
  gRNA
ggaccgcuaucagcgccuga

SEQ ID NO: 50019 - RNA, 20 nt, Artificial Sequence
  MKO10050019_A_Smc1a
  gRNA
uuugaagaaauuagucgcuc

SEQ ID NO: 50020 - RNA, 20 nt, Artificial Sequence
  MKO10050020_A_Smc1a
  gRNA
ucguaacuuccucgucuucc

SEQ ID NO: 50021 - RNA, 20 nt, Artificial Sequence
  MKO10050021_A_Smc1b
  gRNA
uacauacacagaacgacuca

SEQ ID NO: 50022 - RNA, 20 nt, Artificial Sequence
  MKO10050022_A_Smc1b
  gRNA
gggugcucagaauaucauuu

SEQ ID NO: 50023 - RNA, 20 nt, Artificial Sequence
  MKO10050023_A_Smc1b
  gRNA
uccaggaaaaucuaauguaa

SEQ ID NO: 50024 - RNA, 20 nt, Artificial Sequence
  MKO10050024_A_Smc2
  gRNA
ugacaaaaagcagaguccgu

SEQ ID NO: 50025 - RNA, 20 nt, Artificial Sequence
  MKO10050025_A_Smc2
  gRNA
ucaugagcuucaaaucccaa

SEQ ID NO: 50026 - RNA, 20 nt, Artificial Sequence
  MKO10050026_A_Smc2
  gRNA
cccucacuuucucaucaugc

SEQ ID NO: 50027 - RNA, 20 nt, Artificial Sequence
  MKO10050027_A_Smc3
  gRNA
ucuucguccagagcagcgau

SEQ ID NO: 50028 - RNA, 20 nt, Artificial Sequence
  MKO10050028_A_Smc3
  gRNA
cuuaccgaugacauuauguu

SEQ ID NO: 50029 - RNA, 20 nt, Artificial Sequence
  MKO10050029_A_Smc3
  gRNA
aacaaagccaaucgcugcuc

SEQ ID NO: 50030 - RNA, 20 nt, Artificial Sequence
  MKO10050030_A_Smc4
  gRNA
gcaggcaguaccuuauggaa

SEQ ID NO: 50031 - RNA, 20 nt, Artificial Sequence
  MKO10050031_A_Smc4
  gRNA
auaugaguuaucaugagacg

SEQ ID NO: 50032 - RNA, 20 nt, Artificial Sequence
  MKO10050032_A_Smc4
  gRNA
cuccgacacaagacuuuaau

SEQ ID NO: 50033 - RNA, 20 nt, Artificial Sequence
  MKO10050033_A_Smc5
  gRNA
gccugcgaguccgaggcaaa

SEQ ID NO: 50034 - RNA, 20 nt, Artificial Sequence
  MKO10050034_A_Smc5
  gRNA
aucgugugugccauuugccu

SEQ ID NO: 50035 - RNA, 20 nt, Artificial Sequence
  MKO10050035_A_Smc5
  gRNA
auugcccacuuggauguuua

SEQ ID NO: 50036 - RNA, 20 nt, Artificial Sequence
  MKO10050036_A_Smc6
  gRNA
ugugcagcaacacauuagcg

SEQ ID NO: 50037 - RNA, 20 nt, Artificial Sequence
  MKO10050037_A_Smc6
  gRNA
caggcaccgugguuucuacu

SEQ ID NO: 50038 - RNA, 20 nt, Artificial Sequence
  MKO10050038_A_Smc6
  gRNA
accaagaccaacuaugagug

SEQ ID NO: 50039 - RNA, 20 nt, Artificial Sequence
  MKO10050039_A_Smchd1
  gRNA
uuaucuaccacugcgacagc

SEQ ID NO: 50040 - RNA, 20 nt, Artificial Sequence
  MKO10050040_A_Smchd1
  gRNA
gcugucgcagugguagauaa

SEQ ID NO: 50041 - RNA, 20 nt, Artificial Sequence
  MKO10050041_A_Smchd1
  gRNA
ucgucgccgucaguagugac

SEQ ID NO: 50042 - RNA, 20 nt, Artificial Sequence
  MKO10050042_A_Smco1
  gRNA
gauguacauccgucuuacgu

SEQ ID NO: 50043 - RNA, 20 nt, Artificial Sequence
  MKO10050043_A_Smco1
  gRNA
acuaugcugccaacguaaga

SEQ ID NO: 50044 - RNA, 20 nt, Artificial Sequence
  MKO10050044_A_Smco1
  gRNA
ucgaagcgucagauuauccu

SEQ ID NO: 50045 - RNA, 20 nt, Artificial Sequence
  MKO10050045_A_Smco2
  gRNA
uguuuguagcuugcuaaccg

SEQ ID NO: 50046 - RNA, 20 nt, Artificial Sequence
  MKO10050046_A_Smco2
  gRNA
agccgaccacggugacuggu

SEQ ID NO: 50047 - RNA, 20 nt, Artificial Sequence
  MKO10050047_A_Smco2
  gRNA
cggcuccgaguucuuucauu

SEQ ID NO: 50048 - RNA, 20 nt, Artificial Sequence
  MKO10050048_A_Smco3
  gRNA
gaagauugccaucgugcaga

SEQ ID NO: 50049 - RNA, 20 nt, Artificial Sequence
  MKO10050049_A_Smco3
  gRNA
guaccaucaugcuaucacug

SEQ ID NO: 50050 - RNA, 20 nt, Artificial Sequence
  MKO10050050_A_Smco3
  gRNA
agaaaugaccuucugcacga

SEQ ID NO: 50051 - RNA, 20 nt, Artificial Sequence
  MKO10050051_A_Smco4
  gRNA
acaaagaugcgucaacucaa

SEQ ID NO: 50052 - RNA, 20 nt, Artificial Sequence
  MKO10050052_A_Smco4
  gRNA
uggacgugcucacucgguga

SEQ ID NO: 50053 - RNA, 20 nt, Artificial Sequence
  MKO10050053_A_Smco4
  gRNA
gcggcagcagaucaccacug

SEQ ID NO: 50054 - RNA, 20 nt, Artificial Sequence
  MKO10050054_A_Smcp
  gRNA
uaccauuucgaccuaacugu

SEQ ID NO: 50055 - RNA, 20 nt, Artificial Sequence
  MKO10050055_A_Smcp
  gRNA
aaugguagcuuaugguugag

SEQ ID NO: 50056 - RNA, 20 nt, Artificial Sequence
  MKO10050056_A_Smcp
  gRNA
uuaacaccgagaaucaagua

SEQ ID NO: 50057 - RNA, 20 nt, Artificial Sequence
  MKO10050057_A_Smcr8
  gRNA
ccaccucaccuuguacgacc

SEQ ID NO: 50058 - RNA, 20 nt, Artificial Sequence
  MKO10050058_A_Smcr8
  gRNA
ccuaaaguguuaauuagcgu

SEQ ID NO: 50059 - RNA, 20 nt, Artificial Sequence
  MKO10050059_A_Smcr8
  gRNA
cccuacgcuguccccuauac

SEQ ID NO: 50060 - RNA, 20 nt, Artificial Sequence
  MKO10050060_A_Smdt1
  gRNA
gucucagccagguaccgucg

SEQ ID NO: 50061 - RNA, 20 nt, Artificial Sequence
  MKO10050061_A_Smdt1
  gRNA
uggcgaugucuacaccguac

SEQ ID NO: 50062 - RNA, 20 nt, Artificial Sequence
  MKO10050062_A_Smdt1
  gRNA
gagugucccgacauagagaa

SEQ ID NO: 50063 - RNA, 20 nt, Artificial Sequence
  MKO10050063_A_Smek1
  gRNA
gcacgaugaccgacacccga

SEQ ID NO: 50064 - RNA, 20 nt, Artificial Sequence
  MKO10050064_A_Smek1
  gRNA
cgcucuccgcccugacgagc

SEQ ID NO: 50065 - RNA, 20 nt, Artificial Sequence
  MKO10050065_A_Smek1
  gRNA
cuagugcgaguuucucacgu

SEQ ID NO: 50066 - RNA, 20 nt, Artificial Sequence
  MKO10050066_A_Smek2
  gRNA
cuuaguuccgaaucuguuau

SEQ ID NO: 50067 - RNA, 20 nt, Artificial Sequence
  MKO10050067_A_Smek2
  gRNA
uucucuccucaccuauccgu

SEQ ID NO: 50068 - RNA, 20 nt, Artificial Sequence
  MKO10050068_A_Smek2
  gRNA
agaagcugaaaacuaugauc

SEQ ID NO: 50069 - RNA, 20 nt, Artificial Sequence
  MKO10050069_A_Smg1
  gRNA
cucgacugucgaaucuucuu

SEQ ID NO: 50070 - RNA, 20 nt, Artificial Sequence
  MKO10050070_A_Smg1
  gRNA
acgacugccaugcugaacac

SEQ ID NO: 50071 - RNA, 20 nt, Artificial Sequence
  MKO10050071_A_Smg1
  gRNA
caaaggcacgaugauaccag

SEQ ID NO: 50072 - RNA, 20 nt, Artificial Sequence
  MKO10050072_A_Smg5
  gRNA
aaccagagaacguuagccug

SEQ ID NO: 50073 - RNA, 20 nt, Artificial Sequence
  MKO10050073_A_Smg5
  gRNA
gcaccuuggaaugugccuac

SEQ ID NO: 50074 - RNA, 20 nt, Artificial Sequence
  MKO10050074_A_Smg5
  gRNA
acucaucuggucgcuggcau

SEQ ID NO: 50075 - RNA, 20 nt, Artificial Sequence
  MKO10050075_A_Smg6
  gRNA
gaggcacuacccgccgacua

SEQ ID NO: 50076 - RNA, 20 nt, Artificial Sequence
  MKO10050076_A_Smg6
  gRNA
uggcccgauccuggcgccgc

SEQ ID NO: 50077 - RNA, 20 nt, Artificial Sequence
  MKO10050077_A_Smg6
  gRNA
cccauaguuugcuguaucgu

SEQ ID NO: 50078 - RNA, 20 nt, Artificial Sequence
  MKO10050078_A_Smg7
  gRNA
agcuagcggcuucuauacuc

SEQ ID NO: 50079 - RNA, 20 nt, Artificial Sequence
  MKO10050079_A_Smg7
  gRNA
gaaaaugcuaguuacugauc

SEQ ID NO: 50080 - RNA, 20 nt, Artificial Sequence
  MKO10050080_A_Smg7
  gRNA
gccuggacuucacuucgauu

SEQ ID NO: 50081 - RNA, 20 nt, Artificial Sequence
  MKO10050081_A_Smg8
  gRNA
gcgggcaccaacaacgauuc

SEQ ID NO: 50082 - RNA, 20 nt, Artificial Sequence
  MKO10050082_A_Smg8
  gRNA
agacgaccccuucgauauca

SEQ ID NO: 50083 - RNA, 20 nt, Artificial Sequence
  MKO10050083_A_Smg8
  gRNA
cgcguuucccccgccuucag

SEQ ID NO: 50084 - RNA, 20 nt, Artificial Sequence
  MKO10050084_A_Smg9
  gRNA
uuucugcaugacguuagugc

SEQ ID NO: 50085 - RNA, 20 nt, Artificial Sequence
  MKO10050085_A_Smg9
  gRNA
augcugugcuucaugcgcuc

SEQ ID NO: 50086 - RNA, 20 nt, Artificial Sequence
  MKO10050086_A_Smg9
  gRNA
uccacacucacccgcucagc

SEQ ID NO: 50087 - RNA, 20 nt, Artificial Sequence
  MKO10050087_A_Smgc
  gRNA
cgguagaauaccuccuacuc

SEQ ID NO: 50088 - RNA, 20 nt, Artificial Sequence
  MKO10050088_A_Smgc
  gRNA
agacucucauuugaccgccu

SEQ ID NO: 50089 - RNA, 20 nt, Artificial Sequence
  MKO10050089_A_Smgc
  gRNA
cugaaugugaauccguuaag

SEQ ID NO: 50090 - RNA, 20 nt, Artificial Sequence
  MKO10050090_A_Smim11
  gRNA
cgggcgugaaaauguaccaa

SEQ ID NO: 50091 - RNA, 20 nt, Artificial Sequence
  MKO10050091_A_Smim11
  gRNA
gccccugcugcuguauaucc

SEQ ID NO: 50092 - RNA, 20 nt, Artificial Sequence
  MKO10050092_A_Smim11
  gRNA
uauucucaccuuccaguuca

SEQ ID NO: 50093 - RNA, 20 nt, Artificial Sequence
  MKO10050093_A_Smim12
  gRNA
gagcauccuggagcgccgag

SEQ ID NO: 50094 - RNA, 20 nt, Artificial Sequence
  MKO10050094_A_Smim12
  gRNA
gcccacagccccgaccacaa

SEQ ID NO: 50095 - RNA, 20 nt, Artificial Sequence
  MKO10050095_A_Smim12
  gRNA
cggggcugugggcuaccacc

SEQ ID NO: 50096 - RNA, 20 nt, Artificial Sequence
  MKO10050096_A_Smim13
  gRNA
gcucaguggccggcgucaac

SEQ ID NO: 50097 - RNA, 20 nt, Artificial Sequence
  MKO10050097_A_Smim13
  gRNA
ucucaaaauguggcacaacg

SEQ ID NO: 50098 - RNA, 20 nt, Artificial Sequence
  MKO10050098_A_Smim13
  gRNA
gcguggccacgaacaccagc

SEQ ID NO: 50099 - RNA, 20 nt, Artificial Sequence
  MKO10050099_A_Smim14
  gRNA
gcaccgacacagagugccuu

SEQ ID NO: 50100 - RNA, 20 nt, Artificial Sequence
  MKO10050100_A_Smim14
  gRNA
acaccaggacguuaguccac

SEQ ID NO: 50101 - RNA, 20 nt, Artificial Sequence
  MKO10050101_A_Smim14
  gRNA
gcucucacgaacaugcuaug

SEQ ID NO: 50102 - RNA, 20 nt, Artificial Sequence
  MKO10050102_A_Smim15
  gRNA
ugugagcgccaagauaacug

SEQ ID NO: 50103 - RNA, 20 nt, Artificial Sequence
  MKO10050103_A_Smim15
  gRNA
uagcuagugcuguacugucc

SEQ ID NO: 50104 - RNA, 20 nt, Artificial Sequence
  MKO10050104_A_Smim15
  gRNA
ugcaaagaugcuugacauaa

SEQ ID NO: 50105 - RNA, 20 nt, Artificial Sequence
  MKO10050105_A_Smim18
  gRNA
agguggugguuucguuccag

SEQ ID NO: 50106 - RNA, 20 nt, Artificial Sequence
  MKO10050106_A_Smim18
  gRNA
ccaggauggcuucuggccgc

SEQ ID NO: 50107 - RNA, 20 nt, Artificial Sequence
  MKO10050107_A_Smim18
  gRNA
caucagaaaacgugacagug

SEQ ID NO: 50108 - RNA, 20 nt, Artificial Sequence
  MKO10050108_A_Smim19
  gRNA
guucccauggccggaaguua

SEQ ID NO: 50109 - RNA, 20 nt, Artificial Sequence
  MKO10050109_A_Smim19
  gRNA
agccaucacaccauaacuuc

SEQ ID NO: 50110 - RNA, 20 nt, Artificial Sequence
  MKO10050110_A_Smim19
  gRNA
aauucgcuuaagacaacaag

SEQ ID NO: 50111 - RNA, 20 nt, Artificial Sequence
  MKO10050111_A_Smim1
  gRNA
uguagugaacaccacucucc

SEQ ID NO: 50112 - RNA, 20 nt, Artificial Sequence
  MKO10050112_A_Smim1
  gRNA
aagaagccucaugcuauagg

SEQ ID NO: 50113 - RNA, 20 nt, Artificial Sequence
  MKO10050113_A_Smim1
  gRNA
caagcuggggauagccauga

SEQ ID NO: 50114 - RNA, 20 nt, Artificial Sequence
  MKO10050114_A_Smim20
  gRNA
cugcgcaccgcgcucauauu

SEQ ID NO: 50115 - RNA, 20 nt, Artificial Sequence
  MKO10050115_A_Smim20
  gRNA
gaagccuccgaauaugagcg

SEQ ID NO: 50116 - RNA, 20 nt, Artificial Sequence
  MKO10050116_A_Smim20
  gRNA
cuggcgguugcacaucuucc

SEQ ID NO: 50117 - RNA, 20 nt, Artificial Sequence
  MKO10050117_A_Smim22
  gRNA
cagcgacgucccauuccgac

SEQ ID NO: 50118 - RNA, 20 nt, Artificial Sequence
  MKO10050118_A_Smim22
  gRNA
augggacgucgcugccuuug

SEQ ID NO: 50119 - RNA, 20 nt, Artificial Sequence
  MKO10050119_A_Smim22
  gRNA
ccggaaggugagccccggga

SEQ ID NO: 50120 - RNA, 20 nt, Artificial Sequence
  MKO10050120_A_Smim3
  gRNA
cggucaucaucuaucgaaug

SEQ ID NO: 50121 - RNA, 20 nt, Artificial Sequence
  MKO10050121_A_Smim3
  gRNA
ucgauagaugaugaccgcag

SEQ ID NO: 50122 - RNA, 20 nt, Artificial Sequence
  MKO10050122_A_Smim3
  gRNA
caggcagccccguugagaac

SEQ ID NO: 50123 - RNA, 20 nt, Artificial Sequence
  MKO10050123_A_Smim5
  gRNA
uguacugggacaccucuucg

SEQ ID NO: 50124 - RNA, 20 nt, Artificial Sequence
  MKO10050124_A_Smim5
  gRNA
ugaagugcgggacccuuaaa

SEQ ID NO: 50125 - RNA, 20 nt, Artificial Sequence
  MKO10050125_A_Smim5
  gRNA
cgagcuccacgggcuccgcc

SEQ ID NO: 50126 - RNA, 20 nt, Artificial Sequence
  MKO10050126_A_Smim6
  gRNA
cagcaaauaagacgaagagc

SEQ ID NO: 50127 - RNA, 20 nt, Artificial Sequence
  MKO10050127_A_Smim6
  gRNA
ccagauuuccaugggccaaa

SEQ ID NO: 50128 - RNA, 20 nt, Artificial Sequence
  MKO10050128_A_Smim6
  gRNA
ugaacaagccaaucacuguc

SEQ ID NO: 50129 - RNA, 20 nt, Artificial Sequence
  MKO10050129_A_Smim7
  gRNA
uccggaucuucaucgcacug

SEQ ID NO: 50130 - RNA, 20 nt, Artificial Sequence
  MKO10050130_A_Smim7
  gRNA
aggacgcuacugaugaacgc

SEQ ID NO: 50131 - RNA, 20 nt, Artificial Sequence
  MKO10050131_A_Smim7
  gRNA
uccacagugcgaugaagauc

SEQ ID NO: 50132 - RNA, 20 nt, Artificial Sequence
  MKO10050132_A_Smim8
  gRNA
auucacagcucgaaauaagg

SEQ ID NO: 50133 - RNA, 20 nt, Artificial Sequence
  MKO10050133_A_Smim8
  gRNA
gugugcgccccucggaggcc

SEQ ID NO: 50134 - RNA, 20 nt, Artificial Sequence
  MKO10050134_A_Smim8
  gRNA
gguaacccuuucacuuugug

SEQ ID NO: 50135 - RNA, 20 nt, Artificial Sequence
  MKO10050135_A_Smim9
  gRNA
gacaucaacagacaagucuc

SEQ ID NO: 50136 - RNA, 20 nt, Artificial Sequence
  MKO10050136_A_Smim9
  gRNA
ucaauuguccauugucuaug

SEQ ID NO: 50137 - RNA, 20 nt, Artificial Sequence
  MKO10050137_A_Smim9
  gRNA
gcagaauaugaaucuaauca

SEQ ID NO: 50138 - RNA, 20 nt, Artificial Sequence
  MKO10050138_A_Smlr1
  gRNA
ggggaccaugagcuccgugc

SEQ ID NO: 50139 - RNA, 20 nt, Artificial Sequence
  MKO10050139_A_Smlr1
  gRNA
cuucccugcgcaagagaaug

SEQ ID NO: 50140 - RNA, 20 nt, Artificial Sequence
  MKO10050140_A_Smlr1
  gRNA
uucaccucauucucuugcgc

SEQ ID NO: 50141 - RNA, 20 nt, Artificial Sequence
  MKO10050141_A_Smn1
  gRNA
ucaauggacguaauaguagc

SEQ ID NO: 50142 - RNA, 20 nt, Artificial Sequence
  MKO10050142_A_Smn1
  gRNA
uccaguauaaaccacgacac

SEQ ID NO: 50143 - RNA, 20 nt, Artificial Sequence
  MKO10050143_A_Smn1
  gRNA
gcaaguccaaagcugcuccg

SEQ ID NO: 50144 - RNA, 20 nt, Artificial Sequence
  MKO10050144_A_Smndc1
  gRNA
gagcuugcgagcgucuccga

SEQ ID NO: 50145 - RNA, 20 nt, Artificial Sequence
  MKO10050145_A_Smndc1
  gRNA
ucuuuacagguguuacgaag

SEQ ID NO: 50146 - RNA, 20 nt, Artificial Sequence
  MKO10050146_A_Smndc1
  gRNA
gggacaagugcauggccgug

SEQ ID NO: 50147 - RNA, 20 nt, Artificial Sequence
  MKO10050147_A_Smoc1
  gRNA
guccaucgaggucgaugcaa

SEQ ID NO: 50148 - RNA, 20 nt, Artificial Sequence
  MKO10050148_A_Smoc1
  gRNA
cgugagcagacggacgcgcg

SEQ ID NO: 50149 - RNA, 20 nt, Artificial Sequence
  MKO10050149_A_Smoc1
  gRNA
caccuuugcaucgaccucga

SEQ ID NO: 50150 - RNA, 20 nt, Artificial Sequence
  MKO10050150_A_Smoc2
  gRNA
gugccgucaucauugcauuc

SEQ ID NO: 50151 - RNA, 20 nt, Artificial Sequence
  MKO10050151_A_Smoc2
  gRNA
gcucaccgugggaauugcaa

SEQ ID NO: 50152 - RNA, 20 nt, Artificial Sequence
  MKO10050152_A_Smoc2
  gRNA
gucagaccuaccggggcacc

SEQ ID NO: 50153 - RNA, 20 nt, Artificial Sequence
  MKO10050153_A_Smok2a
  gRNA
uugcaccaauacucccucuu

SEQ ID NO: 50154 - RNA, 20 nt, Artificial Sequence
  MKO10050154_A_Smok2a
  gRNA
caugcucaauaugagaugcu

SEQ ID NO: 50155 - RNA, 20 nt, Artificial Sequence
  MKO10050155_A_Smok2a
  gRNA
gugcaaaccucucaugucug

SEQ ID NO: 50156 - RNA, 20 nt, Artificial Sequence
  MKO10050156_A_Smok2b
  gRNA
ucgccucacaggcucccaug

SEQ ID NO: 50157 - RNA, 20 nt, Artificial Sequence
  MKO10050157_A_Smok2b
  gRNA
aggcugcuccaaggugaugc

SEQ ID NO: 50158 - RNA, 20 nt, Artificial Sequence
  MKO10050158_A_Smok2b
  gRNA
uauuugcgugugaguaccuu

SEQ ID NO: 50159 - RNA, 20 nt, Artificial Sequence
  MKO10050159_A_Smok3a
  gRNA
gguuaccucaaaugggcccu

SEQ ID NO: 50160 - RNA, 20 nt, Artificial Sequence
  MKO10050160_A_Smok3a
  gRNA
cucuccugcgaaguccgaga

SEQ ID NO: 50161 - RNA, 20 nt, Artificial Sequence
  MKO10050161_A_Smok3a
  gRNA
uaugaacuacugccacaacc

SEQ ID NO: 50162 - RNA, 20 nt, Artificial Sequence
  MKO10050162_A_Smok3b
  gRNA
gguuaccucaaaugggcccu

SEQ ID NO: 50163 - RNA, 20 nt, Artificial Sequence
  MKO10050163_A_Smok3b
  gRNA
cucuccugcgaaguccgaga

SEQ ID NO: 50164 - RNA, 20 nt, Artificial Sequence
  MKO10050164_A_Smok3b
  gRNA
uaugaacuacugccacaacc

SEQ ID NO: 50165 - RNA, 20 nt, Artificial Sequence
  MKO10050165_A_Smox
  gRNA
cucgguacaucucgaugagc

SEQ ID NO: 50166 - RNA, 20 nt, Artificial Sequence
  MKO10050166_A_Smox
  gRNA
ugcggcagccacgguuggua

SEQ ID NO: 50167 - RNA, 20 nt, Artificial Sequence
  MKO10050167_A_Smox
  gRNA
gucauccgcacugucgccac
